United States Patent 11,254,933 (CRISPR/CAS TRANSCRIPTIONAL MODULATION) - sequence listing, part 14

SEQ ID NO: 602732 - DNA, 20 bp, mouse
ggcgggctgcgctcctggcg

SEQ ID NO: 602733 - DNA, 20 bp, mouse
gaggctaaagcccgcgggtg

SEQ ID NO: 602734 - DNA, 20 bp, mouse
ggggtgcggcacccggaagt

SEQ ID NO: 602735 - DNA, 20 bp, mouse
gggaagggtctcggcagcag

SEQ ID NO: 602736 - DNA, 20 bp, mouse
ggaggccgccatgattggag

SEQ ID NO: 602737 - DNA, 20 bp, mouse
gatcatggcggcctccggac

SEQ ID NO: 602738 - DNA, 20 bp, mouse
gcggccgcgctggcccactt

SEQ ID NO: 602739 - DNA, 20 bp, mouse
gcgtgctcaaacacccaagt

SEQ ID NO: 602740 - DNA, 20 bp, mouse
ggcctccgccacattcaaaa

SEQ ID NO: 602741 - DNA, 20 bp, mouse
gggtcgctccactccaatca

SEQ ID NO: 602742 - DNA, 20 bp, mouse
ggcagccgccgccggtccgg

SEQ ID NO: 602743 - DNA, 20 bp, mouse
gcgctccactccaatcatgg

SEQ ID NO: 602744 - DNA, 20 bp, mouse
gaaacatgcggtagcagcca

SEQ ID NO: 602745 - DNA, 20 bp, mouse
gacacccaagtgggccagcg

SEQ ID NO: 602746 - DNA, 20 bp, mouse
gaagcggagacagggagtct

SEQ ID NO: 602747 - DNA, 20 bp, mouse
ggccgggcaccggcgacctg

SEQ ID NO: 602748 - DNA, 20 bp, mouse
gcgctcacgccacaggtcgc

SEQ ID NO: 602749 - DNA, 20 bp, mouse
gtggcgtgagcgagcacagc

SEQ ID NO: 602750 - DNA, 20 bp, mouse
gcggttgcagtcattctgcc

SEQ ID NO: 602751 - DNA, 20 bp, mouse
gcagtcattctgccgggcac

SEQ ID NO: 602752 - DNA, 20 bp, mouse
gtctccgcttttactcacag

SEQ ID NO: 602753 - DNA, 20 bp, mouse
gcctccactgtgagtaaaag

SEQ ID NO: 602754 - DNA, 20 bp, mouse
ggccacaggtcgccggtgcc

SEQ ID NO: 602755 - DNA, 20 bp, mouse
ggctgccctctgaactggaa

SEQ ID NO: 602756 - DNA, 20 bp, mouse
gtgcaaacggcttccagaat

SEQ ID NO: 602757 - DNA, 20 bp, mouse
gggctgtccctggcacgagt

SEQ ID NO: 602758 - DNA, 20 bp, mouse
gtatgtctctttaaagacat

SEQ ID NO: 602759 - DNA, 20 bp, mouse
gtcaacacaagggagagctc

SEQ ID NO: 602760 - DNA, 20 bp, mouse
gagtccccagttcaacacaa

SEQ ID NO: 602761 - DNA, 20 bp, mouse
gtctgtagagcctgtgcaaa

SEQ ID NO: 602762 - DNA, 20 bp, mouse
gaccctgatgcggatgccaa

SEQ ID NO: 602763 - DNA, 20 bp, mouse
gtactctggtatagctgact

SEQ ID NO: 602764 - DNA, 20 bp, mouse
gggttgggatgccttaagtg

SEQ ID NO: 602765 - DNA, 20 bp, mouse
ggatccttctaaccctgatg

SEQ ID NO: 602766 - DNA, 20 bp, mouse
gtgtggcttcagggcttgga

SEQ ID NO: 602767 - DNA, 20 bp, mouse
gctcaagcgggcggcggcac

SEQ ID NO: 602768 - DNA, 20 bp, mouse
gccgcggcgggggaccgaca

SEQ ID NO: 602769 - DNA, 20 bp, mouse
gcgaagggcgcaaggcgagt

SEQ ID NO: 602770 - DNA, 20 bp, mouse
gtcctctctcctcaagcggg

SEQ ID NO: 602771 - DNA, 20 bp, mouse
gcctcggctgggaggaccgg

SEQ ID NO: 602772 - DNA, 20 bp, mouse
ggccctgaagccacagagct

SEQ ID NO: 602773 - DNA, 20 bp, mouse
gtgtgagcgcccccttccca

SEQ ID NO: 602774 - DNA, 20 bp, mouse
gccactaccacccctgggaa

SEQ ID NO: 602775 - DNA, 20 bp, mouse
gcctgccggcgaaggggtaa

SEQ ID NO: 602776 - DNA, 20 bp, mouse
gtctccatcttggaattggg

SEQ ID NO: 602777 - DNA, 20 bp, mouse
gcggctgcacggcccctcta

SEQ ID NO: 602778 - DNA, 20 bp, mouse
gttccaagatggagaccggg

SEQ ID NO: 602779 - DNA, 20 bp, mouse
gcggtctccatcttggaatt

SEQ ID NO: 602780 - DNA, 20 bp, mouse
gtcagctgttccggagagag

SEQ ID NO: 602781 - DNA, 20 bp, mouse
gtgtcgtggccgaagacctg

SEQ ID NO: 602782 - DNA, 20 bp, mouse
gtcggaccccagccttagag

SEQ ID NO: 602783 - DNA, 20 bp, mouse
gagctgagacgaaaaggaaa

SEQ ID NO: 602784 - DNA, 20 bp, mouse
ggggaggccgggacgagagc

SEQ ID NO: 602785 - DNA, 20 bp, mouse
ggtgcagccgggcgtcctcg

SEQ ID NO: 602786 - DNA, 20 bp, mouse
gagggtcctgcgtggagagt

SEQ ID NO: 602787 - DNA, 20 bp, mouse
gccgaggtgcggctccgcca

SEQ ID NO: 602788 - DNA, 20 bp, mouse
gcggcagctagggtcctgcg

SEQ ID NO: 602789 - DNA, 20 bp, mouse
ggggcgcgacggggactcgc

SEQ ID NO: 602790 - DNA, 20 bp, mouse
gtgcgattggtcacccctgg

SEQ ID NO: 602791 - DNA, 20 bp, mouse
gggactgggaaggaccggga

SEQ ID NO: 602792 - DNA, 20 bp, mouse
ggccgctgcgccgaggactc

SEQ ID NO: 602793 - DNA, 20 bp, mouse
ggccgcgggtgacagcgctg

SEQ ID NO: 602794 - DNA, 20 bp, mouse
gcgcgccccactctccacgc

SEQ ID NO: 602795 - DNA, 20 bp, mouse
gtggagagtggggcgcgacg

SEQ ID NO: 602796 - DNA, 20 bp, mouse
ggggccccgatagcaccgtg

SEQ ID NO: 602797 - DNA, 20 bp, mouse
gctccagctgaagacgtgtg

SEQ ID NO: 602798 - DNA, 20 bp, mouse
ggtgtgaggagcgtgcccca

SEQ ID NO: 602799 - DNA, 20 bp, mouse
ggccccatgaagtccttatg

SEQ ID NO: 602800 - DNA, 20 bp, mouse
gctgtttgaagcccatggat

SEQ ID NO: 602801 - DNA, 20 bp, mouse
gttcctcataaggacttcat

SEQ ID NO: 602802 - DNA, 20 bp, mouse
gttgcagacctcccatccat

SEQ ID NO: 602803 - DNA, 20 bp, mouse
gtcagctggagttcctcata

SEQ ID NO: 602804 - DNA, 20 bp, mouse
gagggacatgccctataagg

SEQ ID NO: 602805 - DNA, 20 bp, mouse
gccagaacaggaagtagcgc

SEQ ID NO: 602806 - DNA, 20 bp, mouse
gcgcggacgtcgagagtccc

SEQ ID NO: 602807 - DNA, 20 bp, mouse
ggcgtgagctgtccagagtc

SEQ ID NO: 602808 - DNA, 20 bp, mouse
ggctgcacaggagtctccgt

SEQ ID NO: 602809 - DNA, 20 bp, mouse
gtgagtcgctgggccatcct

SEQ ID NO: 602810 - DNA, 20 bp, mouse
gctcggaacaaggcaagtcc

SEQ ID NO: 602811 - DNA, 20 bp, mouse
gaactcagtgcggccaccag

SEQ ID NO: 602812 - DNA, 20 bp, mouse
gggcacctcgggaaccaaca

SEQ ID NO: 602813 - DNA, 20 bp, mouse
gggaagaagggcgggtccga

SEQ ID NO: 602814 - DNA, 20 bp, mouse
gccacccagacccggagcag

SEQ ID NO: 602815 - DNA, 20 bp, mouse
gctggacagctcacgctcga

SEQ ID NO: 602816 - DNA, 20 bp, mouse
gctcacctgcggctgcggag

SEQ ID NO: 602817 - DNA, 20 bp, mouse
gccaggcgcgctccccgcga

SEQ ID NO: 602818 - DNA, 20 bp, mouse
gttctcaaactggatctcct

SEQ ID NO: 602819 - DNA, 20 bp, mouse
gacacggggcagggagtaag

SEQ ID NO: 602820 - DNA, 20 bp, mouse
gcggcagaagacccaagaca

SEQ ID NO: 602821 - DNA, 20 bp, mouse
gagggcgtcgctgcgcaccc

SEQ ID NO: 602822 - DNA, 20 bp, mouse
ggcgcagcgacgccctcgcg

SEQ ID NO: 602823 - DNA, 20 bp, mouse
gggcgcccgacggaagaccg

SEQ ID NO: 602824 - DNA, 20 bp, mouse
ggggtggggcagaggacctt

SEQ ID NO: 602825 - DNA, 20 bp, mouse
ggggcaggggcacggagcag

SEQ ID NO: 602826 - DNA, 20 bp, mouse
gagcaggagcagaggcttca

SEQ ID NO: 602827 - DNA, 20 bp, mouse
gccctgcgtgagctaagagg

SEQ ID NO: 602828 - DNA, 20 bp, mouse
gctgctcctgctcgtcgctg

SEQ ID NO: 602829 - DNA, 20 bp, mouse
gtgctcgtcgctgtggcact

SEQ ID NO: 602830 - DNA, 20 bp, mouse
gtcgctaggcctggggagag

SEQ ID NO: 602831 - DNA, 20 bp, mouse
gggggaagaaaagacttggt

SEQ ID NO: 602832 - DNA, 20 bp, mouse
gcacactgggaaggagaggg

SEQ ID NO: 602833 - DNA, 20 bp, mouse
gtctggtccagccgagacga

SEQ ID NO: 602834 - DNA, 20 bp, mouse
gtactgcgccatggacccag

SEQ ID NO: 602835 - DNA, 20 bp, mouse
gcctatggccctctggtcac

SEQ ID NO: 602836 - DNA, 20 bp, mouse
ggaccacaggtgctaagtga

SEQ ID NO: 602837 - DNA, 20 bp, mouse
gtgatctctggctgaagagg

SEQ ID NO: 602838 - DNA, 20 bp, mouse
gataagagaacggagaccac

SEQ ID NO: 602839 - DNA, 20 bp, mouse
gagccagagatcactagcag

SEQ ID NO: 602840 - DNA, 20 bp, mouse
ggcccatggaggctactctc

SEQ ID NO: 602841 - DNA, 20 bp, mouse
gttcccctgctagtgatctc

SEQ ID NO: 602842 - DNA, 20 bp, mouse
gatcactagcaggggaactg

SEQ ID NO: 602843 - DNA, 20 bp, mouse
gaagagaaacgataagagaa

SEQ ID NO: 602844 - DNA, 20 bp, mouse
gtagtgatctctggctgaag

SEQ ID NO: 602845 - DNA, 20 bp, mouse
gcaccctcacttagcacctg

SEQ ID NO: 602846 - DNA, 20 bp, mouse
gacgcggccgccccgggaga

SEQ ID NO: 602847 - DNA, 20 bp, mouse
gtgtggctctcggaacatgg

SEQ ID NO: 602848 - DNA, 20 bp, mouse
gccgccgccttctcccgggg

SEQ ID NO: 602849 - DNA, 20 bp, mouse
ggtgtgtggctctcggaaca

SEQ ID NO: 602850 - DNA, 20 bp, mouse
gcttctacgagagcgaccgg

SEQ ID NO: 602851 - DNA, 20 bp, mouse
ggccgcggcgggctaccgag

SEQ ID NO: 602852 - DNA, 20 bp, mouse
gggtgcgcccgggagatcgt

SEQ ID NO: 602853 - DNA, 20 bp, mouse
gcggctggagggaggtggcg

SEQ ID NO: 602854 - DNA, 20 bp, mouse
gcgctccgcgcgcagaggga

SEQ ID NO: 602855 - DNA, 20 bp, mouse
ggccgcggccggtccgctcg

SEQ ID NO: 602856 - DNA, 20 bp, mouse
ggtacaccgccgaggagcta

SEQ ID NO: 602857 - DNA, 20 bp, mouse
gcccggccctagctcctcgg

SEQ ID NO: 602858 - DNA, 20 bp, mouse
gcagcaagcactggggtagt

SEQ ID NO: 602859 - DNA, 20 bp, mouse
ggtggaggctgtagtcacgg

SEQ ID NO: 602860 - DNA, 20 bp, mouse
gaccgccgaggagctagggc

SEQ ID NO: 602861 - DNA, 20 bp, mouse
gggccccggccctagctcct

SEQ ID NO: 602862 - DNA, 20 bp, mouse
gagggctccggcactactac

SEQ ID NO: 602863 - DNA, 20 bp, mouse
gggtagtgggcagaggttcc

SEQ ID NO: 602864 - DNA, 20 bp, mouse
gcccggagtcgcggccggta

SEQ ID NO: 602865 - DNA, 20 bp, mouse
ggccaggtgggtgccgaaag

SEQ ID NO: 602866 - DNA, 20 bp, mouse
gtagcagtggcctagcgggt

SEQ ID NO: 602867 - DNA, 20 bp, mouse
gccattttgtgggcacggag

SEQ ID NO: 602868 - DNA, 20 bp, mouse
gtaggacgcctggaaacccg

SEQ ID NO: 602869 - DNA, 20 bp, mouse
gtgggcacggagcggtagcg

SEQ ID NO: 602870 - DNA, 20 bp, mouse
gggccctagcgccattttgt

SEQ ID NO: 602871 - DNA, 20 bp, mouse
gagtggcctagcgggtaggt

SEQ ID NO: 602872 - DNA, 20 bp, mouse
gcgcttaggccttaacgacg

SEQ ID NO: 602873 - DNA, 20 bp, mouse
gctctccgaagcaacactcg

SEQ ID NO: 602874 - DNA, 20 bp, mouse
gggcgaccaacctacccgct

SEQ ID NO: 602875 - DNA, 20 bp, mouse
gtcacagccaagcagaggcc

SEQ ID NO: 602876 - DNA, 20 bp, mouse
gctcagggagtaggcaggat

SEQ ID NO: 602877 - DNA, 20 bp, mouse
gaggagcctagagatcatgg

SEQ ID NO: 602878 - DNA, 20 bp, mouse
gccaagctcagggagtaggc

SEQ ID NO: 602879 - DNA, 20 bp, mouse
gaacttacggaggcagagaa

SEQ ID NO: 602880 - DNA, 20 bp, mouse
gatcagcatccccaagctca

SEQ ID NO: 602881 - DNA, 20 bp, mouse
gcaccctgaataacttacgg

SEQ ID NO: 602882 - DNA, 20 bp, mouse
gctggtgagatacttgggtg

SEQ ID NO: 602883 - DNA, 20 bp, mouse
gcttggggatgctgatgtcc

SEQ ID NO: 602884 - DNA, 20 bp, mouse
gtaaagctggtgagatactt

SEQ ID NO: 602885 - DNA, 20 bp, mouse
gtagacctgctgaagacctt

SEQ ID NO: 602886 - DNA, 20 bp, mouse
gagagaagaccccaagccgg

SEQ ID NO: 602887 - DNA, 20 bp, mouse
gacgcgcagtgcggaattgt

SEQ ID NO: 602888 - DNA, 20 bp, mouse
ggcccttcggggaagatgga

SEQ ID NO: 602889 - DNA, 20 bp, mouse
gaggtctacaccgccggctt

SEQ ID NO: 602890 - DNA, 20 bp, mouse
gaattgtaggtctacaccgc

SEQ ID NO: 602891 - DNA, 20 bp, mouse
ggggccctgggtaataagtt

SEQ ID NO: 602892 - DNA, 20 bp, mouse
gatccgctctctgcacccca

SEQ ID NO: 602893 - DNA, 20 bp, mouse
gcgccgtggggtgcagagag

SEQ ID NO: 602894 - DNA, 20 bp, mouse
ggccgtccatcttccccgaa

SEQ ID NO: 602895 - DNA, 20 bp, mouse
gtgcgccacgtggccacagg

SEQ ID NO: 602896 - DNA, 20 bp, mouse
gcacggtgtggagctcgcag

SEQ ID NO: 602897 - DNA, 20 bp, mouse
gagcggtgatcggagcatgg

SEQ ID NO: 602898 - DNA, 20 bp, mouse
gctcgcagcggcggaactct

SEQ ID NO: 602899 - DNA, 20 bp, mouse
ggcggcggaactctgggagt

SEQ ID NO: 602900 - DNA, 20 bp, mouse
gagcccagcggagtccaagg

SEQ ID NO: 602901 - DNA, 20 bp, mouse
gtaccgatttgagacagcat

SEQ ID NO: 602902 - DNA, 20 bp, mouse
gcagcatgggtctctgtctg

SEQ ID NO: 602903 - DNA, 20 bp, mouse
ggacccatgctgtctcaaat

SEQ ID NO: 602904 - DNA, 20 bp, mouse
gggtgtggagctcgcagcgg

SEQ ID NO: 602905 - DNA, 20 bp, mouse
ggcgtacctcacgcacggtg

SEQ ID NO: 602906 - DNA, 20 bp, mouse
ggccagggcctgggccgcca

SEQ ID NO: 602907 - DNA, 20 bp, mouse
gaccatggcggcccaggccc

SEQ ID NO: 602908 - DNA, 20 bp, mouse
gggcgggctcaggtggcaca

SEQ ID NO: 602909 - DNA, 20 bp, mouse
gctgggctggcgggctcagg

SEQ ID NO: 602910 - DNA, 20 bp, mouse
ggccaccgcctgagccgcca

SEQ ID NO: 602911 - DNA, 20 bp, mouse
ggccctggcggctcaggcgg

SEQ ID NO: 602912 - DNA, 20 bp, mouse
gcaggccctggcggctcagg

SEQ ID NO: 602913 - DNA, 20 bp, mouse
ggcccaggccctggcggctc

SEQ ID NO: 602914 - DNA, 20 bp, mouse
gcaggcgctggtgcaggtcg

SEQ ID NO: 602915 - DNA, 20 bp, mouse
gccgcgcctgacacgcgagg

SEQ ID NO: 602916 - DNA, 20 bp, mouse
ggcacacccctgacagggaa

SEQ ID NO: 602917 - DNA, 20 bp, mouse
gtgctggacagagggacgtc

SEQ ID NO: 602918 - DNA, 20 bp, mouse
gccagtcccacccctttcag

SEQ ID NO: 602919 - DNA, 20 bp, mouse
gtgccaggaggaagtcccca

SEQ ID NO: 602920 - DNA, 20 bp, mouse
gcaggaggaagtccccaggg

SEQ ID NO: 602921 - DNA, 20 bp, mouse
gagctgccattccctgtcag

SEQ ID NO: 602922 - DNA, 20 bp, mouse
gatgcagttatgaagcgtct

SEQ ID NO: 602923 - DNA, 20 bp, mouse
ggtaagcaacggccagctgc

SEQ ID NO: 602924 - DNA, 20 bp, mouse
gaaagcccagcagtaagcaa

SEQ ID NO: 602925 - DNA, 20 bp, mouse
ggtcagcatggagggagaac

SEQ ID NO: 602926 - DNA, 20 bp, mouse
gtgaggctgggcatcgtcta

SEQ ID NO: 602927 - DNA, 20 bp, mouse
gtggcatgggaccccaggcg

SEQ ID NO: 602928 - DNA, 20 bp, mouse
gttggctggcatgggacccc

SEQ ID NO: 602929 - DNA, 20 bp, mouse
gccggctccacaatgaggct

SEQ ID NO: 602930 - DNA, 20 bp, mouse
gatcgtctaaggctgttact

SEQ ID NO: 602931 - DNA, 20 bp, mouse
gtccccagccaggtgaaagt

SEQ ID NO: 602932 - DNA, 20 bp, mouse
gaaatggagtgtcctcgcct

SEQ ID NO: 602933 - DNA, 20 bp, mouse
gagttccctaccagcatgac

SEQ ID NO: 602934 - DNA, 20 bp, mouse
gcaagtggtggtgcaggggt

SEQ ID NO: 602935 - DNA, 20 bp, mouse
gtggctggggactacctcct

SEQ ID NO: 602936 - DNA, 20 bp, mouse
gtagccaaagctggcatggt

SEQ ID NO: 602937 - DNA, 20 bp, mouse
gtgccagctttggctatcat

SEQ ID NO: 602938 - DNA, 20 bp, mouse
gtcccgtgcaacaggtatgg

SEQ ID NO: 602939 - DNA, 20 bp, mouse
ggcatcccgtgcaacaggta

SEQ ID NO: 602940 - DNA, 20 bp, mouse
ggctatcatgggtctcagcc

SEQ ID NO: 602941 - DNA, 20 bp, mouse
gtccagcactaacaatgggt

SEQ ID NO: 602942 - DNA, 20 bp, mouse
ggtatggaggctagtagctg

SEQ ID NO: 602943 - DNA, 20 bp, mouse
gaagtctccagcactaacaa

SEQ ID NO: 602944 - DNA, 20 bp, mouse
gtccgtggtactaccaatct

SEQ ID NO: 602945 - DNA, 20 bp, mouse
ggtgggagtgaaccgaagct

SEQ ID NO: 602946 - DNA, 20 bp, mouse
gcacttggtcacccagggac

SEQ ID NO: 602947 - DNA, 20 bp, mouse
gtgggccacttggtcaccca

SEQ ID NO: 602948 - DNA, 20 bp, mouse
gaacagcgtcgcctgtccct

SEQ ID NO: 602949 - DNA, 20 bp, mouse
gagcacagtgaaaaactcat

SEQ ID NO: 602950 - DNA, 20 bp, mouse
gtccacgtatattagtacag

SEQ ID NO: 602951 - DNA, 20 bp, mouse
ggagagttgtggcaagccag

SEQ ID NO: 602952 - DNA, 20 bp, mouse
ggccactgtactaatatacg

SEQ ID NO: 602953 - DNA, 20 bp, mouse
gtccatgttcatagaaagct

SEQ ID NO: 602954 - DNA, 20 bp, mouse
ggataaaattcttcttacat

SEQ ID NO: 602955 - DNA, 20 bp, mouse
gtaaaagacgctgagagttg

SEQ ID NO: 602956 - DNA, 20 bp, mouse
gtaagtctggagtttatcat

SEQ ID NO: 602957 - DNA, 20 bp, mouse
gatcatggtgttgacaataa

SEQ ID NO: 602958 - DNA, 20 bp, mouse
ggagatggccagggccatat

SEQ ID NO: 602959 - DNA, 20 bp, mouse
gacaataagggctattttat

SEQ ID NO: 602960 - DNA, 20 bp, mouse
gcaccatccaggaaatagta

SEQ ID NO: 602961 - DNA, 20 bp, mouse
gttgataactattataagtc

SEQ ID NO: 602962 - DNA, 20 bp, mouse
ggggaatgagaacgatggta

SEQ ID NO: 602963 - DNA, 20 bp, mouse
gttattgggaatgagaacga

SEQ ID NO: 602964 - DNA, 20 bp, mouse
gagaggaaagatctctgcag

SEQ ID NO: 602965 - DNA, 20 bp, mouse
gagtttatcataggaatttt

SEQ ID NO: 602966 - DNA, 20 bp, mouse
gcccagcatggcttcactag

SEQ ID NO: 602967 - DNA, 20 bp, mouse
gactagtggcaacagaaaga

SEQ ID NO: 602968 - DNA, 20 bp, mouse
gttccctaaaactcccagca

SEQ ID NO: 602969 - DNA, 20 bp, mouse
gcggcataagcatagtcaga

SEQ ID NO: 602970 - DNA, 20 bp, mouse
ggaatgcatgagttacatat

SEQ ID NO: 602971 - DNA, 20 bp, mouse
gacttgtaaactacacagac

SEQ ID NO: 602972 - DNA, 20 bp, mouse
gaccttcacagctagcggaa

SEQ ID NO: 602973 - DNA, 20 bp, mouse
gtgtattcttaattataacg

SEQ ID NO: 602974 - DNA, 20 bp, mouse
gtttggtttagcaccagcct

SEQ ID NO: 602975 - DNA, 20 bp, mouse
gatatcagagcaacacatcc

SEQ ID NO: 602976 - DNA, 20 bp, mouse
gttcaacagttgcaatggaa

SEQ ID NO: 602977 - DNA, 20 bp, mouse
gaacagttgcaatggaaagg

SEQ ID NO: 602978 - DNA, 20 bp, mouse
gatatgctgagtgcggcaga

SEQ ID NO: 602979 - DNA, 20 bp, mouse
gatgcaacagatacaacttt

SEQ ID NO: 602980 - DNA, 20 bp, mouse
gccagcttcaacagttgcaa

SEQ ID NO: 602981 - DNA, 20 bp, mouse
gtgactggcttccttctcat

SEQ ID NO: 602982 - DNA, 20 bp, mouse
gcaactgttgaagctgggct

SEQ ID NO: 602983 - DNA, 20 bp, mouse
gagatacaactttagggacc

SEQ ID NO: 602984 - DNA, 20 bp, mouse
gggtggcaaaccagacagtc

SEQ ID NO: 602985 - DNA, 20 bp, mouse
gtgtatttctctggttgaag

SEQ ID NO: 602986 - DNA, 20 bp, mouse
gtaactagtggttcagtcct

SEQ ID NO: 602987 - DNA, 20 bp, mouse
gtccatttcctagaactccc

SEQ ID NO: 602988 - DNA, 20 bp, mouse
gcatcagaggcaaccatatg

SEQ ID NO: 602989 - DNA, 20 bp, mouse
gtatcttcaggagatagaag

SEQ ID NO: 602990 - DNA, 20 bp, mouse
gagatgctgactgtagcaga

SEQ ID NO: 602991 - DNA, 20 bp, mouse
gtcctttgttttgtaactag

SEQ ID NO: 602992 - DNA, 20 bp, mouse
gcagctggctttattctcac

SEQ ID NO: 602993 - DNA, 20 bp, mouse
gatagtgatttcttacatat

SEQ ID NO: 602994 - DNA, 20 bp, mouse
ggggatgcttatttatatca

SEQ ID NO: 602995 - DNA, 20 bp, mouse
gaaatatcttcactgtttgt

SEQ ID NO: 602996 - DNA, 20 bp, mouse
ggcatctttacagatctcta

SEQ ID NO: 602997 - DNA, 20 bp, mouse
gctcactagtgacaacacaa

SEQ ID NO: 602998 - DNA, 20 bp, mouse
gtggagaatgtcccatatac

SEQ ID NO: 602999 - DNA, 20 bp, mouse
gccatcaagaagccagtata

SEQ ID NO: 603000 - DNA, 20 bp, mouse
gagatcggtttcattctcat

SEQ ID NO: 603001 - DNA, 20 bp, mouse
gtctattgtaaattatctgc

SEQ ID NO: 603002 - DNA, 20 bp, mouse
gtagaaagtagaggatgttg

SEQ ID NO: 603003 - DNA, 20 bp, mouse
gttccagaattggtgttgta

SEQ ID NO: 603004 - DNA, 20 bp, mouse
ggaatatattacttacatat

SEQ ID NO: 603005 - DNA, 20 bp, mouse
ggcttggcgatttccagaat

SEQ ID NO: 603006 - DNA, 20 bp, mouse
gaaacgaggaaagatgctct

SEQ ID NO: 603007 - DNA, 20 bp, mouse
gagctgaacaggatcctatc

SEQ ID NO: 603008 - DNA, 20 bp, mouse
gaacaggatcctatccggag

SEQ ID NO: 603009 - DNA, 20 bp, mouse
ggtgataattattaagactt

SEQ ID NO: 603010 - DNA, 20 bp, mouse
gcagaagacaggccaacagc

SEQ ID NO: 603011 - DNA, 20 bp, mouse
gcagaattgcctctccggat

SEQ ID NO: 603012 - DNA, 20 bp, mouse
gcattgctacaaatactgga

SEQ ID NO: 603013 - DNA, 20 bp, mouse
gcaggccaacagcaggctgg

SEQ ID NO: 603014 - DNA, 20 bp, mouse
gagacaggccaacagcaggc

SEQ ID NO: 603015 - DNA, 20 bp, mouse
ggtatttgtgtttgctgcct

SEQ ID NO: 603016 - DNA, 20 bp, mouse
gtctagtagtaactaaatat

SEQ ID NO: 603017 - DNA, 20 bp, mouse
gttacaactaatacataaaa

SEQ ID NO: 603018 - DNA, 20 bp, mouse
gtgctctggttcatgctagt

SEQ ID NO: 603019 - DNA, 20 bp, mouse
gataattagaagtatgttct

SEQ ID NO: 603020 - DNA, 20 bp, mouse
gagcaaaccagacactaata

SEQ ID NO: 603021 - DNA, 20 bp, mouse
gacagttcactagtactcta

SEQ ID NO: 603022 - DNA, 20 bp, mouse
gcttggtgcactgcatggac

SEQ ID NO: 603023 - DNA, 20 bp, mouse
gtcctctttagatagagaaa

SEQ ID NO: 603024 - DNA, 20 bp, mouse
gagctaaccatattagtgtc

SEQ ID NO: 603025 - DNA, 20 bp, mouse
gaataaaatcctcaccgctt

SEQ ID NO: 603026 - DNA, 20 bp, mouse
gatagcactagtgaatatca

SEQ ID NO: 603027 - DNA, 20 bp, mouse
gaacatcaattggtattatt

SEQ ID NO: 603028 - DNA, 20 bp, mouse
gatacatgcttagagataac

SEQ ID NO: 603029 - DNA, 20 bp, mouse
ggtagttttaatgataatac

SEQ ID NO: 603030 - DNA, 20 bp, mouse
gtttggcttgccacatgcct

SEQ ID NO: 603031 - DNA, 20 bp, mouse
gcagaaatagtaacatcaat

SEQ ID NO: 603032 - DNA, 20 bp, mouse
ggaataaccatttcagcgtt

SEQ ID NO: 603033 - DNA, 20 bp, mouse
gtctcaattgatgtttatga

SEQ ID NO: 603034 - DNA, 20 bp, mouse
gtgatcttgtaagcaaatgt

SEQ ID NO: 603035 - DNA, 20 bp, mouse
gtttacaataatattatttg

SEQ ID NO: 603036 - DNA, 20 bp, mouse
gtcagtatggaattcataat

SEQ ID NO: 603037 - DNA, 20 bp, mouse
gaattcataatgggaacctt

SEQ ID NO: 603038 - DNA, 20 bp, mouse
gattccatactgaaaattat

SEQ ID NO: 603039 - DNA, 20 bp, mouse
gaaaatgaatccatttccta

SEQ ID NO: 603040 - DNA, 20 bp, mouse
gctgatagtctgcatagact

SEQ ID NO: 603041 - DNA, 20 bp, mouse
gaacagacacccaccaatct

SEQ ID NO: 603042 - DNA, 20 bp, mouse
gggtattgttttacagaaaa

SEQ ID NO: 603043 - DNA, 20 bp, mouse
gcttccaataattttcagta

SEQ ID NO: 603044 - DNA, 20 bp, mouse
gaaaaatagagacactaaca

SEQ ID NO: 603045 - DNA, 20 bp, mouse
gtagcagaatcgctctaatt

SEQ ID NO: 603046 - DNA, 20 bp, mouse
gactagttgaaactgaaagg

SEQ ID NO: 603047 - DNA, 20 bp, mouse
gctcactagttgaaactgaa

SEQ ID NO: 603048 - DNA, 20 bp, mouse
ggataagcaagcaccctatc

SEQ ID NO: 603049 - DNA, 20 bp, mouse
ggtgttgatcttaatcacag

SEQ ID NO: 603050 - DNA, 20 bp, mouse
gtaaaaaatactgagactag

SEQ ID NO: 603051 - DNA, 20 bp, mouse
gattgcacttgtaaactgta

SEQ ID NO: 603052 - DNA, 20 bp, mouse
gagggtgcttgcttatctca

SEQ ID NO: 603053 - DNA, 20 bp, mouse
gtaaccagacaaatatgtag

SEQ ID NO: 603054 - DNA, 20 bp, mouse
gtgagctcatcagttatcta

SEQ ID NO: 603055 - DNA, 20 bp, mouse
gtgagctcaattatgttgac

SEQ ID NO: 603056 - DNA, 20 bp, mouse
ggcttggctgaaattcttcc

SEQ ID NO: 603057 - DNA, 20 bp, mouse
ggtgtttccttaatcagtta

SEQ ID NO: 603058 - DNA, 20 bp, mouse
gtggatttttacctccagct

SEQ ID NO: 603059 - DNA, 20 bp, mouse
ggaggaaatgatctgctgaa

SEQ ID NO: 603060 - DNA, 20 bp, mouse
gtccaggcttgctctgatat

SEQ ID NO: 603061 - DNA, 20 bp, mouse
ggttcttcattggaaatctg

SEQ ID NO: 603062 - DNA, 20 bp, mouse
gactttaaagtctattccat

SEQ ID NO: 603063 - DNA, 20 bp, mouse
gattggtgaatatttcttag

SEQ ID NO: 603064 - DNA, 20 bp, mouse
gatagctctggtacaatgca

SEQ ID NO: 603065 - DNA, 20 bp, mouse
gtttacctgtgatttacttt

SEQ ID NO: 603066 - DNA, 20 bp, mouse
gtgagtgtggaatttataat

SEQ ID NO: 603067 - DNA, 20 bp, mouse
gaagatgaatggtgtcctac

SEQ ID NO: 603068 - DNA, 20 bp, mouse
gatagcggtggtgaacataa

SEQ ID NO: 603069 - DNA, 20 bp, mouse
gtttggcaatggattcatag

SEQ ID NO: 603070 - DNA, 20 bp, mouse
ggactataaatgtaacctgt

SEQ ID NO: 603071 - DNA, 20 bp, mouse
gaatttataattggcatctt

SEQ ID NO: 603072 - DNA, 20 bp, mouse
gggcaatggattcatagcgg

SEQ ID NO: 603073 - DNA, 20 bp, mouse
gacataaaggacttggtcaa

SEQ ID NO: 603074 - DNA, 20 bp, mouse
ggtggtgaacataaaggact

SEQ ID NO: 603075 - DNA, 20 bp, mouse
gtgtgctttacccaggacaa

SEQ ID NO: 603076 - DNA, 20 bp, mouse
gtttatgagaatcaactcag

SEQ ID NO: 603077 - DNA, 20 bp, mouse
gcttaacccagtccatacag

SEQ ID NO: 603078 - DNA, 20 bp, mouse
gatggtcctggtccactgta

SEQ ID NO: 603079 - DNA, 20 bp, mouse
ggtaagaatttgattaacta

SEQ ID NO: 603080 - DNA, 20 bp, mouse
gtaaaaatttacatctcaac

SEQ ID NO: 603081 - DNA, 20 bp, mouse
gccagtccatacagtggacc

SEQ ID NO: 603082 - DNA, 20 bp, mouse
gatccagatgctgaaatggt

SEQ ID NO: 603083 - DNA, 20 bp, mouse
gaatgactgaaagtgtgctc

SEQ ID NO: 603084 - DNA, 20 bp, mouse
gggaaatgggttcatggtcc

SEQ ID NO: 603085 - DNA, 20 bp, mouse
gaaacagagctgaaaaattc

SEQ ID NO: 603086 - DNA, 20 bp, mouse
gagaagatggtgacttgcgt

SEQ ID NO: 603087 - DNA, 20 bp, mouse
gtcctcagccagaggaagat

SEQ ID NO: 603088 - DNA, 20 bp, mouse
gtcaagcacatacatgatga

SEQ ID NO: 603089 - DNA, 20 bp, mouse
gtggaaggtatcagtcgtct

SEQ ID NO: 603090 - DNA, 20 bp, mouse
gattgtgcaaagttgcacaa

SEQ ID NO: 603091 - DNA, 20 bp, mouse
gagagaccttgacacagtag

SEQ ID NO: 603092 - DNA, 20 bp, mouse
gtggttctctggttgatact

SEQ ID NO: 603093 - DNA, 20 bp, mouse
gcactcaccccatcttcctc

SEQ ID NO: 603094 - DNA, 20 bp, mouse
gtttcaaagactgtcaccgg

SEQ ID NO: 603095 - DNA, 20 bp, mouse
gtgatgagaatcgtctccac

SEQ ID NO: 603096 - DNA, 20 bp, mouse
gctgcactaccacaaccagg

SEQ ID NO: 603097 - DNA, 20 bp, mouse
gaaactgcactaccacaacc

SEQ ID NO: 603098 - DNA, 20 bp, mouse
gcagctgggtctatcctgtt

SEQ ID NO: 603099 - DNA, 20 bp, mouse
gcagatgccaggatcagcca

SEQ ID NO: 603100 - DNA, 20 bp, mouse
gttccacatgatcaagtcga

SEQ ID NO: 603101 - DNA, 20 bp, mouse
gggcattgacaaccacaatg

SEQ ID NO: 603102 - DNA, 20 bp, mouse
gttggcaaatggcctcattg

SEQ ID NO: 603103 - DNA, 20 bp, mouse
gtgagggatggtagcaatct

SEQ ID NO: 603104 - DNA, 20 bp, mouse
gaagatgaggatatccaggt

SEQ ID NO: 603105 - DNA, 20 bp, mouse
gtcatttataatgtagacaa

SEQ ID NO: 603106 - DNA, 20 bp, mouse
gactatggttatgaagacat

SEQ ID NO: 603107 - DNA, 20 bp, mouse
gcagtcgatgaagttcacta

SEQ ID NO: 603108 - DNA, 20 bp, mouse
ggtgggcaatgttaacgaac

SEQ ID NO: 603109 - DNA, 20 bp, mouse
gagtatggtccccagccaag

SEQ ID NO: 603110 - DNA, 20 bp, mouse
ggttataattcgatcagctg

SEQ ID NO: 603111 - DNA, 20 bp, mouse
gtacaaatgagagttttcgg

SEQ ID NO: 603112 - DNA, 20 bp, mouse
gagccaagtggtaaaatggt

SEQ ID NO: 603113 - DNA, 20 bp, mouse
gcacaatgaatttggtagaa

SEQ ID NO: 603114 - DNA, 20 bp, mouse
gttggttgcatatcttggga

SEQ ID NO: 603115 - DNA, 20 bp, mouse
gattcattgtgtctgtctaa

SEQ ID NO: 603116 - DNA, 20 bp, mouse
gacatgggaagcaatgtgta

SEQ ID NO: 603117 - DNA, 20 bp, mouse
gtgactggaacagaattacg

SEQ ID NO: 603118 - DNA, 20 bp, mouse
gtaaaagatgctgagaatag

SEQ ID NO: 603119 - DNA, 20 bp, mouse
gtgattgcagagtttgtatt

SEQ ID NO: 603120 - DNA, 20 bp, mouse
gctgataaactgcattgatt

SEQ ID NO: 603121 - DNA, 20 bp, mouse
gaagtgattggaaattaccc

SEQ ID NO: 603122 - DNA, 20 bp, mouse
gtcaagaatggtgttgatat

SEQ ID NO: 603123 - DNA, 20 bp, mouse
gaaatagagaaaaaccggtt

SEQ ID NO: 603124 - DNA, 20 bp, mouse
gatgggaaatgttaataaca

SEQ ID NO: 603125 - DNA, 20 bp, mouse
gaactctttcttccattggt

SEQ ID NO: 603126 - DNA, 20 bp, mouse
gcggttgtagaattcataat

SEQ ID NO: 603127 - DNA, 20 bp, mouse
gaattcataataggaacttt

SEQ ID NO: 603128 - DNA, 20 bp, mouse
ggctcgacatgtcgtttaat

SEQ ID NO: 603129 - DNA, 20 bp, mouse
gattttctttgtgatcattt

SEQ ID NO: 603130 - DNA, 20 bp, mouse
gaacgacatgtcgagcctac

SEQ ID NO: 603131 - DNA, 20 bp, mouse
gtaataggaactttgggaaa

SEQ ID NO: 603132 - DNA, 20 bp, mouse
gccaagaagtactgtttatc

SEQ ID NO: 603133 - DNA, 20 bp, mouse
gaattgctggtgcctctctc

SEQ ID NO: 603134 - DNA, 20 bp, mouse
gctccagaatgtgtgttcta

SEQ ID NO: 603135 - DNA, 20 bp, mouse
gcaggctatgcataaatagt

SEQ ID NO: 603136 - DNA, 20 bp, mouse
gtgatctcctaggcaaatgt

SEQ ID NO: 603137 - DNA, 20 bp, mouse
gaaatagtaacgggaatctt

SEQ ID NO: 603138 - DNA, 20 bp, mouse
gttgtatgtggaaatagtaa

SEQ ID NO: 603139 - DNA, 20 bp, mouse
gtaacgggaatcttaggaca

SEQ ID NO: 603140 - DNA, 20 bp, mouse
gagaagaaggatctcttcag

SEQ ID NO: 603141 - DNA, 20 bp, mouse
gatagcattagtgaacatca

SEQ ID NO: 603142 - DNA, 20 bp, mouse
ggctgtgcccacatttgcct

SEQ ID NO: 603143 - DNA, 20 bp, mouse
gaaagcatttctgatctcct

SEQ ID NO: 603144 - DNA, 20 bp, mouse
gacataaatgaatctggtaa

SEQ ID NO: 603145 - DNA, 20 bp, mouse
gttttcaatcaccttgtatg

SEQ ID NO: 603146 - DNA, 20 bp, mouse
gtctgcaattagtatgatgg

SEQ ID NO: 603147 - DNA, 20 bp, mouse
gaactctgcaattagtatga

SEQ ID NO: 603148 - DNA, 20 bp, mouse
gagcaagccagagactgaag

SEQ ID NO: 603149 - DNA, 20 bp, mouse
gtgggaaacactaattatat

SEQ ID NO: 603150 - DNA, 20 bp, mouse
gtaattgcagagtttgtttg

SEQ ID NO: 603151 - DNA, 20 bp, mouse
ggttgaagaactgcattgac

SEQ ID NO: 603152 - DNA, 20 bp, mouse
gtttggggaaatttgagcaa

SEQ ID NO: 603153 - DNA, 20 bp, mouse
gagatctgccagtagcaatt

SEQ ID NO: 603154 - DNA, 20 bp, mouse
gatgagtatttgatcaactg

SEQ ID NO: 603155 - DNA, 20 bp, mouse
gtcaagaattagtctcatct

SEQ ID NO: 603156 - DNA, 20 bp, mouse
ggctgcccataagatatcta

SEQ ID NO: 603157 - DNA, 20 bp, mouse
gattgccatagatatcttat

SEQ ID NO: 603158 - DNA, 20 bp, mouse
gctattatcttatggatgat

SEQ ID NO: 603159 - DNA, 20 bp, mouse
gctggatccagatattaaaa

SEQ ID NO: 603160 - DNA, 20 bp, mouse
gattacactaacatcttcac

SEQ ID NO: 603161 - DNA, 20 bp, mouse
gttaaggtggagatttaaga

SEQ ID NO: 603162 - DNA, 20 bp, mouse
ggcaaatggattcatagcat

SEQ ID NO: 603163 - DNA, 20 bp, mouse
gtcattgtgcaattcataat

SEQ ID NO: 603164 - DNA, 20 bp, mouse
gaggtggagatttaagaagg

SEQ ID NO: 603165 - DNA, 20 bp, mouse
gctctaggatttatctgctg

SEQ ID NO: 603166 - DNA, 20 bp, mouse
gtcctggggatcctggccaa

SEQ ID NO: 603167 - DNA, 20 bp, mouse
ggccgttggccaggatcccc

SEQ ID NO: 603168 - DNA, 20 bp, mouse
gggagtactcaaccagatgg

SEQ ID NO: 603169 - DNA, 20 bp, mouse
gatcagcacaatgaagccgt

SEQ ID NO: 603170 - DNA, 20 bp, mouse
gcccggagtactcaaccaga

SEQ ID NO: 603171 - DNA, 20 bp, mouse
gcactgctggaagaatcggg

SEQ ID NO: 603172 - DNA, 20 bp, mouse
gggaatggctactgcgtggt

SEQ ID NO: 603173 - DNA, 20 bp, mouse
ggattcttccagcagtgtgt

SEQ ID NO: 603174 - DNA, 20 bp, mouse
ggaagaggatcatgtccgag

SEQ ID NO: 603175 - DNA, 20 bp, mouse
ggcagggaatggctactgcg

SEQ ID NO: 603176 - DNA, 20 bp, mouse
gtctggtgaactgcatacac

SEQ ID NO: 603177 - DNA, 20 bp, mouse
gtgtggaaataataatagga

SEQ ID NO: 603178 - DNA, 20 bp, mouse
ggtgttggtaactagaagag

SEQ ID NO: 603179 - DNA, 20 bp, mouse
gtagattctggagaaagcca

SEQ ID NO: 603180 - DNA, 20 bp, mouse
gttgccttacagacaatgga

SEQ ID NO: 603181 - DNA, 20 bp, mouse
gacgctatacacacacgtgt

SEQ ID NO: 603182 - DNA, 20 bp, mouse
gaagatgagaattaaccagg

SEQ ID NO: 603183 - DNA, 20 bp, mouse
ggttaaaagaaggtagattc

SEQ ID NO: 603184 - DNA, 20 bp, mouse
gagtgaatactgttaaaaga

SEQ ID NO: 603185 - DNA, 20 bp, mouse
gcagagtgtttagaaacaag

SEQ ID NO: 603186 - DNA, 20 bp, mouse
gacttaaggaggtaaagaca

SEQ ID NO: 603187 - DNA, 20 bp, mouse
gcatgggctggatgaagaat

SEQ ID NO: 603188 - DNA, 20 bp, mouse
gggacatggccacacttgag

SEQ ID NO: 603189 - DNA, 20 bp, mouse
ggaagtatccaattagtttc

SEQ ID NO: 603190 - DNA, 20 bp, mouse
gagtgtccagaagaagtcaa

SEQ ID NO: 603191 - DNA, 20 bp, mouse
gtggctgatttgatgcagtt

SEQ ID NO: 603192 - DNA, 20 bp, mouse
gttgcactggtaaacttcat

SEQ ID NO: 603193 - DNA, 20 bp, mouse
gatccagacacctacaacag

SEQ ID NO: 603194 - DNA, 20 bp, mouse
gtgttggtgaggccttagta

SEQ ID NO: 603195 - DNA, 20 bp, mouse
ggagaggattaaatcaatag

SEQ ID NO: 603196 - DNA, 20 bp, mouse
gagacaaattgctagaagtg

SEQ ID NO: 603197 - DNA, 20 bp, mouse
gtgaggcgctagttcttgta

SEQ ID NO: 603198 - DNA, 20 bp, mouse
gattcaactgcttataggac

SEQ ID NO: 603199 - DNA, 20 bp, mouse
ggaataagtagaatatgctc

SEQ ID NO: 603200 - DNA, 20 bp, mouse
gaacttcatcatggtctgtt

SEQ ID NO: 603201 - DNA, 20 bp, mouse
gggtttaagtggagattgag

SEQ ID NO: 603202 - DNA, 20 bp, mouse
ggatcaaatgtatatgatac

SEQ ID NO: 603203 - DNA, 20 bp, mouse
gcttctagcaatttgtctcg

SEQ ID NO: 603204 - DNA, 20 bp, mouse
gaccatgatgaagttgatga

SEQ ID NO: 603205 - DNA, 20 bp, mouse
gactggcaaactgctctgac

SEQ ID NO: 603206 - DNA, 20 bp, mouse
gagtgttggtgaagtcccag

SEQ ID NO: 603207 - DNA, 20 bp, mouse
gatggtccaaaacatagcag

SEQ ID NO: 603208 - DNA, 20 bp, mouse
gcattccctgcccagcacgg

SEQ ID NO: 603209 - DNA, 20 bp, mouse
gtcacaggccgccatctgaa

SEQ ID NO: 603210 - DNA, 20 bp, mouse
ggacagtccaccaatgatca

SEQ ID NO: 603211 - DNA, 20 bp, mouse
ggtgagaaagacatcttctt

SEQ ID NO: 603212 - DNA, 20 bp, mouse
ggctttatggccaccgtgct

SEQ ID NO: 603213 - DNA, 20 bp, mouse
gagggcaattgtgtttccag

SEQ ID NO: 603214 - DNA, 20 bp, mouse
gtagaagatagcaagccagg

SEQ ID NO: 603215 - DNA, 20 bp, mouse
ggggaatgggtacgaagcca

SEQ ID NO: 603216 - DNA, 20 bp, mouse
ggagcctgcatcctcaactc

SEQ ID NO: 603217 - DNA, 20 bp, mouse
gtgtgcctggtggcagtggt

SEQ ID NO: 603218 - DNA, 20 bp, mouse
gcattggagacagaatcgag

SEQ ID NO: 603219 - DNA, 20 bp, mouse
gcttctctacttagagcttg

SEQ ID NO: 603220 - DNA, 20 bp, mouse
gtatagcactgggcatgaaa

SEQ ID NO: 603221 - DNA, 20 bp, mouse
gtggtggcagtggtaggcaa

SEQ ID NO: 603222 - DNA, 20 bp, mouse
ggcaacaaactacccttcat

SEQ ID NO: 603223 - DNA, 20 bp, mouse
gctgtattacagggttgtat

SEQ ID NO: 603224 - DNA, 20 bp, mouse
gtgggacccatcatgtccac

SEQ ID NO: 603225 - DNA, 20 bp, mouse
gtttctcctgtggacatgat

SEQ ID NO: 603226 - DNA, 20 bp, mouse
gaaggtagctgttgtgtcac

SEQ ID NO: 603227 - DNA, 20 bp, mouse
gaccagaacaatgaagacat

SEQ ID NO: 603228 - DNA, 20 bp, mouse
ggctcaagtgtgtttcatgt

SEQ ID NO: 603229 - DNA, 20 bp, mouse
gatgaacacactgattcatg

SEQ ID NO: 603230 - DNA, 20 bp, mouse
gttggataatattaatgaat

SEQ ID NO: 603231 - DNA, 20 bp, mouse
gcttcaggtttgacttgctt

SEQ ID NO: 603232 - DNA, 20 bp, mouse
gtgcaagccatgtattaaaa

SEQ ID NO: 603233 - DNA, 20 bp, mouse
gagccatgtattaaaatggt

SEQ ID NO: 603234 - DNA, 20 bp, mouse
gacaaatacaaaatcttact

SEQ ID NO: 603235 - DNA, 20 bp, mouse
gttatttcctaatcttataa

SEQ ID NO: 603236 - DNA, 20 bp, mouse
gctcagtgatagtcagaacc

SEQ ID NO: 603237 - DNA, 20 bp, mouse
gtttgagccagaggaatgag

SEQ ID NO: 603238 - DNA, 20 bp, mouse
gagccagaggaatgaggggt

SEQ ID NO: 603239 - DNA, 20 bp, mouse
gatgtttggattcattgaag

SEQ ID NO: 603240 - DNA, 20 bp, mouse
gttcattgaaggggtgttcc

SEQ ID NO: 603241 - DNA, 20 bp, mouse
gtttatgaacagaacaagca

SEQ ID NO: 603242 - DNA, 20 bp, mouse
ggataagccaaatactgaag

SEQ ID NO: 603243 - DNA, 20 bp, mouse
gtaccagcttggccctcttc

SEQ ID NO: 603244 - DNA, 20 bp, mouse
gtatccctgagtcatgagtc

SEQ ID NO: 603245 - DNA, 20 bp, mouse
gatcctgaagagggccaagc

SEQ ID NO: 603246 - DNA, 20 bp, mouse
gggagcagtagaggagactg

SEQ ID NO: 603247 - DNA, 20 bp, mouse
gcataggacacagttaagac

SEQ ID NO: 603248 - DNA, 20 bp, mouse
gtgcaaactccatggctgaa

SEQ ID NO: 603249 - DNA, 20 bp, mouse
gattcccactgcaaactcca

SEQ ID NO: 603250 - DNA, 20 bp, mouse
gaccaagacaatgaaggcgt

SEQ ID NO: 603251 - DNA, 20 bp, mouse
gcgatgtcacagttgttcaa

SEQ ID NO: 603252 - DNA, 20 bp, mouse
ggacaatcttggagcagtag

SEQ ID NO: 603253 - DNA, 20 bp, mouse
gcccagcttgctacatggag

SEQ ID NO: 603254 - DNA, 20 bp, mouse
gcagccatggagtttgcagt

SEQ ID NO: 603255 - DNA, 20 bp, mouse
gacatttaccaagacaatga

SEQ ID NO: 603256 - DNA, 20 bp, mouse
gggctcaacccagcaactac

SEQ ID NO: 603257 - DNA, 20 bp, mouse
gatacctatggtgcactcag

SEQ ID NO: 603258 - DNA, 20 bp, mouse
gttaacatcaaaatagacaa

SEQ ID NO: 603259 - DNA, 20 bp, mouse
gtggccactgagtgcaccat

SEQ ID NO: 603260 - DNA, 20 bp, mouse
gtgctgggttgagccatcct

SEQ ID NO: 603261 - DNA, 20 bp, mouse
gctccaaagaggaaccaccc

SEQ ID NO: 603262 - DNA, 20 bp, mouse
gaaagcaacgttgaatatgg

SEQ ID NO: 603263 - DNA, 20 bp, mouse
ggctgtgaatgcagtctcat

SEQ ID NO: 603264 - DNA, 20 bp, mouse
gattgcaagtgggattgtca

SEQ ID NO: 603265 - DNA, 20 bp, mouse
gcataggtatcattgcaagt

SEQ ID NO: 603266 - DNA, 20 bp, mouse
gaaggacttggagcatctcc

SEQ ID NO: 603267 - DNA, 20 bp, mouse
gaggtgtagaaatcattata

SEQ ID NO: 603268 - DNA, 20 bp, mouse
gaggtggagggtaaaaactg

SEQ ID NO: 603269 - DNA, 20 bp, mouse
gagtagcattcattatcacc

SEQ ID NO: 603270 - DNA, 20 bp, mouse
gcttttagaagattacatta

SEQ ID NO: 603271 - DNA, 20 bp, mouse
gaaatcattatagggtgttt

SEQ ID NO: 603272 - DNA, 20 bp, mouse
ggtgaatatctgatccacta

SEQ ID NO: 603273 - DNA, 20 bp, mouse
ggtggtgaacattatggact

SEQ ID NO: 603274 - DNA, 20 bp, mouse
gctccagacttgcttttgtg

SEQ ID NO: 603275 - DNA, 20 bp, mouse
gttatagggtgtttaggaaa

SEQ ID NO: 603276 - DNA, 20 bp, mouse
gtgataatgaagatcaatgt

SEQ ID NO: 603277 - DNA, 20 bp, mouse
gatgaggaaccggacactac

SEQ ID NO: 603278 - DNA, 20 bp, mouse
ggcttggtaacaaaaatcaa

SEQ ID NO: 603279 - DNA, 20 bp, mouse
gaagccattctgcaacatag

SEQ ID NO: 603280 - DNA, 20 bp, mouse
ggtcagctgccggtagtgtc

SEQ ID NO: 603281 - DNA, 20 bp, mouse
gccatgcaagcagaaccggg

SEQ ID NO: 603282 - DNA, 20 bp, mouse
ggctgggcagagagtggatg

SEQ ID NO: 603283 - DNA, 20 bp, mouse
gagtgttagtgaaatcccag

SEQ ID NO: 603284 - DNA, 20 bp, mouse
gatcccagaggatgccaata

SEQ ID NO: 603285 - DNA, 20 bp, mouse
gttggccatgaagttcccgg

SEQ ID NO: 603286 - DNA, 20 bp, mouse
gaagtcagagtcagacagaa

SEQ ID NO: 603287 - DNA, 20 bp, mouse
gatattgtagagaccacgaa

SEQ ID NO: 603288 - DNA, 20 bp, mouse
ggagccaagcagcaaaccag

SEQ ID NO: 603289 - DNA, 20 bp, mouse
gcaggctgttgctacagata

SEQ ID NO: 603290 - DNA, 20 bp, mouse
gcataaggttctcaccagtg

SEQ ID NO: 603291 - DNA, 20 bp, mouse
ggaagtcataatccctttcg

SEQ ID NO: 603292 - DNA, 20 bp, mouse
ggatgaagcagaaaatcata

SEQ ID NO: 603293 - DNA, 20 bp, mouse
ggtcatctatgggactgaat

SEQ ID NO: 603294 - DNA, 20 bp, mouse
gctgacagactcaggagccg

SEQ ID NO: 603295 - DNA, 20 bp, mouse
ggcttcatcacagtcatcta

SEQ ID NO: 603296 - DNA, 20 bp, mouse
gggagaccgaggctaggcag

SEQ ID NO: 603297 - DNA, 20 bp, mouse
gccatacggagaccgaggct

SEQ ID NO: 603298 - DNA, 20 bp, mouse
gccggaccatacggagaccg

SEQ ID NO: 603299 - DNA, 20 bp, mouse
gtgagagccgtcccgagcgg

SEQ ID NO: 603300 - DNA, 20 bp, mouse
ggcgggcctgccggaccata

SEQ ID NO: 603301 - DNA, 20 bp, mouse
ggcggacagcgtcagaacga

SEQ ID NO: 603302 - DNA, 20 bp, mouse
gctcacgccaccgctcggga

SEQ ID NO: 603303 - DNA, 20 bp, mouse
gaggctaggcagcggcgacg

SEQ ID NO: 603304 - DNA, 20 bp, mouse
gccgggctctaacagactca

SEQ ID NO: 603305 - DNA, 20 bp, mouse
gccgcagccaagggaactgg

SEQ ID NO: 603306 - DNA, 20 bp, mouse
ggctcttgctacagatgcag

SEQ ID NO: 603307 - DNA, 20 bp, mouse
ggctgctctggtggaacttg

SEQ ID NO: 603308 - DNA, 20 bp, mouse
gtcctgagtagtaaaatagt

SEQ ID NO: 603309 - DNA, 20 bp, mouse
gtgaatcctacaaaaacaag

SEQ ID NO: 603310 - DNA, 20 bp, mouse
gtcccactttagacacttct

SEQ ID NO: 603311 - DNA, 20 bp, mouse
gaattgcctgtgaaaccaag

SEQ ID NO: 603312 - DNA, 20 bp, mouse
gggtgaatactgtctcctct

SEQ ID NO: 603313 - DNA, 20 bp, mouse
gtcacagatgtaacagatgg

SEQ ID NO: 603314 - DNA, 20 bp, mouse
gtagtattagtgagaaacac

SEQ ID NO: 603315 - DNA, 20 bp, mouse
gttatcacagatgtaacaga

SEQ ID NO: 603316 - DNA, 20 bp, mouse
gtcatcagaggacttggtgg

SEQ ID NO: 603317 - DNA, 20 bp, mouse
ggagcgctcgtgggccttat

SEQ ID NO: 603318 - DNA, 20 bp, mouse
gctcgtgggccttataggtt

SEQ ID NO: 603319 - DNA, 20 bp, mouse
gttggtggaggagcgctcgt

SEQ ID NO: 603320 - DNA, 20 bp, mouse
gcacctgaactcatcatcag

SEQ ID NO: 603321 - DNA, 20 bp, mouse
gagactgctttgcctggacg

SEQ ID NO: 603322 - DNA, 20 bp, mouse
gacgaggaaggtaatcccgg

SEQ ID NO: 603323 - DNA, 20 bp, mouse
gccaagcagccaaacctata

SEQ ID NO: 603324 - DNA, 20 bp, mouse
gtggacgaggaaggtaatcc

SEQ ID NO: 603325 - DNA, 20 bp, mouse
gtcacagtgcagagaacctc

SEQ ID NO: 603326 - DNA, 20 bp, mouse
gtcttcaagttcgtgggtaa

SEQ ID NO: 603327 - DNA, 20 bp, mouse
gtgagtctcttcaagttcgt

SEQ ID NO: 603328 - DNA, 20 bp, mouse
gaacttgaagagactcatga

SEQ ID NO: 603329 - DNA, 20 bp, mouse
gggctcctcccagggaaaag

SEQ ID NO: 603330 - DNA, 20 bp, mouse
gcaagttcgtgggtaagggc

SEQ ID NO: 603331 - DNA, 20 bp, mouse
gggacccgggactgtcagcg

SEQ ID NO: 603332 - DNA, 20 bp, mouse
ggaagagactcatgacggcg

SEQ ID NO: 603333 - DNA, 20 bp, mouse
gggtaagggcaggtttgtct

SEQ ID NO: 603334 - DNA, 20 bp, mouse
gatgctaggcgatcagtcta

SEQ ID NO: 603335 - DNA, 20 bp, mouse
ggagcctcgctgacagtccc

SEQ ID NO: 603336 - DNA, 20 bp, mouse
ggccgaggttgcgaagtagg

SEQ ID NO: 603337 - DNA, 20 bp, mouse
ggacgccgaggttgcgaagt

SEQ ID NO: 603338 - DNA, 20 bp, mouse
gcgcaccgcgccctcatcca

SEQ ID NO: 603339 - DNA, 20 bp, mouse
ggaggttgcgaagtaggcgg

SEQ ID NO: 603340 - DNA, 20 bp, mouse
ggcgcgtgcggcccaaaagg

SEQ ID NO: 603341 - DNA, 20 bp, mouse
gttccgcggagctgacgccg

SEQ ID NO: 603342 - DNA, 20 bp, mouse
gaacctcggcgtcagctccg

SEQ ID NO: 603343 - DNA, 20 bp, mouse
gcgcaggccccggacgccaa

SEQ ID NO: 603344 - DNA, 20 bp, mouse
gccccgcgcagggcttcgga

SEQ ID NO: 603345 - DNA, 20 bp, mouse
ggcgccctcatccaaggcct

SEQ ID NO: 603346 - DNA, 20 bp, mouse
ggccaggcggcggaactctg

SEQ ID NO: 603347 - DNA, 20 bp, mouse
gaaagtccgaggcggagaga

SEQ ID NO: 603348 - DNA, 20 bp, mouse
gacgttgtcaaagtccgagg

SEQ ID NO: 603349 - DNA, 20 bp, mouse
gttctcgactgcaagccagg

SEQ ID NO: 603350 - DNA, 20 bp, mouse
gggtcgccatagactaggta

SEQ ID NO: 603351 - DNA, 20 bp, mouse
gttgcagtcgagaagcctgc

SEQ ID NO: 603352 - DNA, 20 bp, mouse
gtcagaccgtacctagtcta

SEQ ID NO: 603353 - DNA, 20 bp, mouse
ggctatgggtttggggttag

SEQ ID NO: 603354 - DNA, 20 bp, mouse
ggatcagcacacctcaagag

SEQ ID NO: 603355 - DNA, 20 bp, mouse
gaacccatagctactcctgc

SEQ ID NO: 603356 - DNA, 20 bp, mouse
gctacgctgagaggcagtgg

SEQ ID NO: 603357 - DNA, 20 bp, mouse
gggtctacgctgagaggcag

SEQ ID NO: 603358 - DNA, 20 bp, mouse
ggccgcgccccgaacctccg

SEQ ID NO: 603359 - DNA, 20 bp, mouse
gcgctgagaggcagtggtgg

SEQ ID NO: 603360 - DNA, 20 bp, mouse
gtggtggccgcggaggttcg

SEQ ID NO: 603361 - DNA, 20 bp, mouse
ggcggaggccctgaccggta

SEQ ID NO: 603362 - DNA, 20 bp, mouse
ggcggaagcgagcctccctg

SEQ ID NO: 603363 - DNA, 20 bp, mouse
ggtagccggtctacgctgag

SEQ ID NO: 603364 - DNA, 20 bp, mouse
gcgccacgcttcccactcta

SEQ ID NO: 603365 - DNA, 20 bp, mouse
gccggctctccgcttagaga

SEQ ID NO: 603366 - DNA, 20 bp, mouse
gcccccagcgagaatgcccg

SEQ ID NO: 603367 - DNA, 20 bp, mouse
ggcgcagaccgggaggacgt

SEQ ID NO: 603368 - DNA, 20 bp, mouse
ggccctccctggttaacaaa

SEQ ID NO: 603369 - DNA, 20 bp, mouse
ggccgcgggcattctcgctg

SEQ ID NO: 603370 - DNA, 20 bp, mouse
gagcgcactcaccactacgg

SEQ ID NO: 603371 - DNA, 20 bp, mouse
ggcaagcgcactcaccacta

SEQ ID NO: 603372 - DNA, 20 bp, mouse
gggctgccctttgttaacca

SEQ ID NO: 603373 - DNA, 20 bp, mouse
gagacaggctgagaaagtat

SEQ ID NO: 603374 - DNA, 20 bp, mouse
gtgagaaagtataggacccg

SEQ ID NO: 603375 - DNA, 20 bp, mouse
gggcaaactgacatctagac

SEQ ID NO: 603376 - DNA, 20 bp, mouse
ggagtgaggccgtcaagact

SEQ ID NO: 603377 - DNA, 20 bp, mouse
ggctgctcaggcgacgagac

SEQ ID NO: 603378 - DNA, 20 bp, mouse
gtagagaagagccgctgctc

SEQ ID NO: 603379 - DNA, 20 bp, mouse
gctagagtccaggtgagccg

SEQ ID NO: 603380 - DNA, 20 bp, mouse
gtcagccggaaagcaactcg

SEQ ID NO: 603381 - DNA, 20 bp, mouse
gatggccacttcacatggag

SEQ ID NO: 603382 - DNA, 20 bp, mouse
ggaggaactctgggctccgg

SEQ ID NO: 603383 - DNA, 20 bp, mouse
gagaaggatctccaacagac

SEQ ID NO: 603384 - DNA, 20 bp, mouse
gcctgagtggtagaggacat

SEQ ID NO: 603385 - DNA, 20 bp, mouse
gctagactaaggtcacctgg

SEQ ID NO: 603386 - DNA, 20 bp, mouse
gaaggagccacggggatgtt

SEQ ID NO: 603387 - DNA, 20 bp, mouse
ggaagccggagaaccttcca

SEQ ID NO: 603388 - DNA, 20 bp, mouse
gctggagcccaacatccccg

SEQ ID NO: 603389 - DNA, 20 bp, mouse
gccccagccagagacgaagc

SEQ ID NO: 603390 - DNA, 20 bp, mouse
gtatccctgcttcagtccaa

SEQ ID NO: 603391 - DNA, 20 bp, mouse
gcctcgagaagaaggaatgg

SEQ ID NO: 603392 - DNA, 20 bp, mouse
ggtgcctcgagaagaaggaa

SEQ ID NO: 603393 - DNA, 20 bp, mouse
gaaccttccaaggagccacg

SEQ ID NO: 603394 - DNA, 20 bp, mouse
gctgcctttggactgaagca

SEQ ID NO: 603395 - DNA, 20 bp, mouse
gcttaggcgtccaaagcggt

SEQ ID NO: 603396 - DNA, 20 bp, mouse
gagagacggtcggtccgagg

SEQ ID NO: 603397 - DNA, 20 bp, mouse
ggccgccgccggccacaccg

SEQ ID NO: 603398 - DNA, 20 bp, mouse
gcttgcagcaacaggcaccg

SEQ ID NO: 603399 - DNA, 20 bp, mouse
gtgcgggttgaagagacggt

SEQ ID NO: 603400 - DNA, 20 bp, mouse
gagcaacaggcaccgcggtg

SEQ ID NO: 603401 - DNA, 20 bp, mouse
gtgaagagacggtcggtccg

SEQ ID NO: 603402 - DNA, 20 bp, mouse
gcgaggtggcttgcagcaac

SEQ ID NO: 603403 - DNA, 20 bp, mouse
gggcaccgcggtgtggccgg

SEQ ID NO: 603404 - DNA, 20 bp, mouse
gccccaagcagaggacaaca

SEQ ID NO: 603405 - DNA, 20 bp, mouse
gaccgcggtgtggccggcgg

SEQ ID NO: 603406 - DNA, 20 bp, mouse
ggtggccgctggcgctctgg

SEQ ID NO: 603407 - DNA, 20 bp, mouse
gcccgccaccagagcgccag

SEQ ID NO: 603408 - DNA, 20 bp, mouse
ggccgctggcgctctggtgg

SEQ ID NO: 603409 - DNA, 20 bp, mouse
gccgggcgcgggaccagcac

SEQ ID NO: 603410 - DNA, 20 bp, mouse
gaagccgttggcctccgagt

SEQ ID NO: 603411 - DNA, 20 bp, mouse
ggctttcccgggtcccagac

SEQ ID NO: 603412 - DNA, 20 bp, mouse
gagcgtcggcggaggccggg

SEQ ID NO: 603413 - DNA, 20 bp, mouse
ggcgggaccagcacaggcgt

SEQ ID NO: 603414 - DNA, 20 bp, mouse
gagctcgctcggctccgact

SEQ ID NO: 603415 - DNA, 20 bp, mouse
ggtggcgggcgcggccgata

SEQ ID NO: 603416 - DNA, 20 bp, mouse
gctgctccgggcggcctgag

SEQ ID NO: 603417 - DNA, 20 bp, mouse
ggggctgcagagagggcgaa

SEQ ID NO: 603418 - DNA, 20 bp, mouse
gccctcacatccccccgccg

SEQ ID NO: 603419 - DNA, 20 bp, mouse
gccgccggggaggccgcaga

SEQ ID NO: 603420 - DNA, 20 bp, mouse
gccgaagtggctgtagtcac

SEQ ID NO: 603421 - DNA, 20 bp, mouse
gcccggcgggctgctccggg

SEQ ID NO: 603422 - DNA, 20 bp, mouse
ggcagaaggcgccgcccctc

SEQ ID NO: 603423 - DNA, 20 bp, mouse
ggccggatcgcacttagtgg

SEQ ID NO: 603424 - DNA, 20 bp, mouse
gacaggagccgagacgtcgg

SEQ ID NO: 603425 - DNA, 20 bp, mouse
gtcacatccccccgccgggg

SEQ ID NO: 603426 - DNA, 20 bp, mouse
ggaggtgaggtgcagcaagg

SEQ ID NO: 603427 - DNA, 20 bp, mouse
ggagccgggctgctggggta

SEQ ID NO: 603428 - DNA, 20 bp, mouse
gtgcagcaaggaggtgagcc

SEQ ID NO: 603429 - DNA, 20 bp, mouse
gcctgtgacactggggtcca

SEQ ID NO: 603430 - DNA, 20 bp, mouse
ggactccccagcaaaagagg

SEQ ID NO: 603431 - DNA, 20 bp, mouse
gagctctgagtcagacccta

SEQ ID NO: 603432 - DNA, 20 bp, mouse
gggaggtgagccgggctgct

SEQ ID NO: 603433 - DNA, 20 bp, mouse
gagagccccagccccaagcc

SEQ ID NO: 603434 - DNA, 20 bp, mouse
ggtgagtgaggcatgggtag

SEQ ID NO: 603435 - DNA, 20 bp, mouse
ggataacaagtcctctccca

SEQ ID NO: 603436 - DNA, 20 bp, mouse
gcccggccgccgggtgggag

SEQ ID NO: 603437 - DNA, 20 bp, mouse
gacccacccctcccacccgg

SEQ ID NO: 603438 - DNA, 20 bp, mouse
gagaccgtcccggccaccag

SEQ ID NO: 603439 - DNA, 20 bp, mouse
gggtgggtccggggacgtcg

SEQ ID NO: 603440 - DNA, 20 bp, mouse
gcctcgggacccatcatctg

SEQ ID NO: 603441 - DNA, 20 bp, mouse
gaagccgctggtggccggga

SEQ ID NO: 603442 - DNA, 20 bp, mouse
gcgggacccatcatctgagg

SEQ ID NO: 603443 - DNA, 20 bp, mouse
ggaccgtcgcggcccagagg

SEQ ID NO: 603444 - DNA, 20 bp, mouse
gcggcctccggcaactgccc

SEQ ID NO: 603445 - DNA, 20 bp, mouse
gggggcccatgggtcaggac

SEQ ID NO: 603446 - DNA, 20 bp, mouse
gagcgccccgtgtccccgga

SEQ ID NO: 603447 - DNA, 20 bp, mouse
gccccgtgtccccggaggga

SEQ ID NO: 603448 - DNA, 20 bp, mouse
gggcgctgggcaaaagcctc

SEQ ID NO: 603449 - DNA, 20 bp, mouse
gaagcggggagggtaatagg

SEQ ID NO: 603450 - DNA, 20 bp, mouse
ggagccggtaaggagacctg

SEQ ID NO: 603451 - DNA, 20 bp, mouse
ggtctgcacaagagccggta

SEQ ID NO: 603452 - DNA, 20 bp, mouse
ggaacagccccctcccccgg

SEQ ID NO: 603453 - DNA, 20 bp, mouse
gcccctccctccggggacac

SEQ ID NO: 603454 - DNA, 20 bp, mouse
ggcccagcgccccgtgtccc

SEQ ID NO: 603455 - DNA, 20 bp, mouse
gaggcaatgagaccgtaagg

SEQ ID NO: 603456 - DNA, 20 bp, mouse
gcggcaccgcagacgcctgg

SEQ ID NO: 603457 - DNA, 20 bp, mouse
ggcggagccgaccaggtaag

SEQ ID NO: 603458 - DNA, 20 bp, mouse
gagagtcacagtgtccatac

SEQ ID NO: 603459 - DNA, 20 bp, mouse
gtggcaggccggaggagcag

SEQ ID NO: 603460 - DNA, 20 bp, mouse
ggccgcgggcggagccgacc

SEQ ID NO: 603461 - DNA, 20 bp, mouse
gcggaggccccttacctggt

SEQ ID NO: 603462 - DNA, 20 bp, mouse
gtaccggcaccgcagacgcc

SEQ ID NO: 603463 - DNA, 20 bp, mouse
gctggcggaggccccttacc

SEQ ID NO: 603464 - DNA, 20 bp, mouse
gcaccgcagacgcctggcgg

SEQ ID NO: 603465 - DNA, 20 bp, mouse
gcttccaagatggccgcggg

SEQ ID NO: 603466 - DNA, 20 bp, mouse
gttgggctaaagaggctcag

SEQ ID NO: 603467 - DNA, 20 bp, mouse
ggcggtacgcctgaggccct

SEQ ID NO: 603468 - DNA, 20 bp, mouse
gcccgcagcccaggccccgt

SEQ ID NO: 603469 - DNA, 20 bp, mouse
gtgctgaggctgggcatctg

SEQ ID NO: 603470 - DNA, 20 bp, mouse
gacgcagccacgcccccaca

SEQ ID NO: 603471 - DNA, 20 bp, mouse
gggtagctcgggtactgagg

SEQ ID NO: 603472 - DNA, 20 bp, mouse
ggcaagcacctgctgaggct

SEQ ID NO: 603473 - DNA, 20 bp, mouse
gggcgtggctctggagtgcg

SEQ ID NO: 603474 - DNA, 20 bp, mouse
gggccggcaagcacctgctg

SEQ ID NO: 603475 - DNA, 20 bp, mouse
gggagcgagcgatttgcgtt

SEQ ID NO: 603476 - DNA, 20 bp, mouse
gactggcacaaggcctcagg

SEQ ID NO: 603477 - DNA, 20 bp, mouse
gagaaaggttaagcacctct

SEQ ID NO: 603478 - DNA, 20 bp, mouse
gacaaggcctcaggcggaag

SEQ ID NO: 603479 - DNA, 20 bp, mouse
gacaggcccagctgaaattc

SEQ ID NO: 603480 - DNA, 20 bp, mouse
gggactcctggcggacatca

SEQ ID NO: 603481 - DNA, 20 bp, mouse
ggaaactggcacaaggcctc

SEQ ID NO: 603482 - DNA, 20 bp, mouse
ggcagagccagaatttcagc

SEQ ID NO: 603483 - DNA, 20 bp, mouse
gaagagctaatctttgacaa

SEQ ID NO: 603484 - DNA, 20 bp, mouse
gtaatctttgacaaaggcaa

SEQ ID NO: 603485 - DNA, 20 bp, mouse
gaatatgctaacaccttctg

SEQ ID NO: 603486 - DNA, 20 bp, mouse
gtgagcgggaaggtgagtaa

SEQ ID NO: 603487 - DNA, 20 bp, mouse
gcacgcgcgggggaacatgg

SEQ ID NO: 603488 - DNA, 20 bp, mouse
gcccagccagcaccccggag

SEQ ID NO: 603489 - DNA, 20 bp, mouse
gaggcacgcgcgggggaaca

SEQ ID NO: 603490 - DNA, 20 bp, mouse
gggaaggtgagtaacggcac

SEQ ID NO: 603491 - DNA, 20 bp, mouse
gcatcaccaggcacgcgcgg

SEQ ID NO: 603492 - DNA, 20 bp, mouse
gcggcggcgggtgttgtgag

SEQ ID NO: 603493 - DNA, 20 bp, mouse
gtgagtccgagagccacgtg

SEQ ID NO: 603494 - DNA, 20 bp, mouse
gcaggagcacccgcaccagc

SEQ ID NO: 603495 - DNA, 20 bp, mouse
gtggtgcgggtgctcctgac

SEQ ID NO: 603496 - DNA, 20 bp, mouse
gcgccgcgcctcgctttcgg

SEQ ID NO: 603497 - DNA, 20 bp, mouse
ggcgagggctggacacgcgc

SEQ ID NO: 603498 - DNA, 20 bp, mouse
ggcgcggcggggagggaata

SEQ ID NO: 603499 - DNA, 20 bp, mouse
gcacccgggtcccgccgcga

SEQ ID NO: 603500 - DNA, 20 bp, mouse
gccggtgcgtgcagattcca

SEQ ID NO: 603501 - DNA, 20 bp, mouse
ggcgtgtccagccctcgcgg

SEQ ID NO: 603502 - DNA, 20 bp, mouse
ggaccgcacacgccccagga

SEQ ID NO: 603503 - DNA, 20 bp, mouse
ggcggggagggaatatggag

SEQ ID NO: 603504 - DNA, 20 bp, mouse
gctggacacgcgccggctcc

SEQ ID NO: 603505 - DNA, 20 bp, mouse
gagccctcgcggcgggaccc

SEQ ID NO: 603506 - DNA, 20 bp, mouse
gggcagtggaacctccgcgg

SEQ ID NO: 603507 - DNA, 20 bp, mouse
gccggaaaaggaggagatag

SEQ ID NO: 603508 - DNA, 20 bp, mouse
gatggaaggatccagctaca

SEQ ID NO: 603509 - DNA, 20 bp, mouse
gcctccgcggcggcaatgga

SEQ ID NO: 603510 - DNA, 20 bp, mouse
gaggggcagtggaacctccg

SEQ ID NO: 603511 - DNA, 20 bp, mouse
ggtctcctgtagatgagcga

SEQ ID NO: 603512 - DNA, 20 bp, mouse
gcagctacagggtaagactt

SEQ ID NO: 603513 - DNA, 20 bp, mouse
ggaagcggaccatcagtggg

SEQ ID NO: 603514 - DNA, 20 bp, mouse
gaggctctccctaaggactg

SEQ ID NO: 603515 - DNA, 20 bp, mouse
gcccgcctcgcaccccagat

SEQ ID NO: 603516 - DNA, 20 bp, mouse
gggtccgggagaagtgtcag

SEQ ID NO: 603517 - DNA, 20 bp, mouse
gaagtgtcagcggccaggag

SEQ ID NO: 603518 - DNA, 20 bp, mouse
gcgctgcagggtcccactcc

SEQ ID NO: 603519 - DNA, 20 bp, mouse
ggtcccgccgaaaaaaggtc

SEQ ID NO: 603520 - DNA, 20 bp, mouse
gtggccgctgacacttctcc

SEQ ID NO: 603521 - DNA, 20 bp, mouse
gtagcaggcaggtcatcctg

SEQ ID NO: 603522 - DNA, 20 bp, mouse
ggaggagtcccgccgaaaaa

SEQ ID NO: 603523 - DNA, 20 bp, mouse
gttcggcgggactcctccag

SEQ ID NO: 603524 - DNA, 20 bp, mouse
ggcctggcaacgcccgctgg

SEQ ID NO: 603525 - DNA, 20 bp, mouse
gcagccgcggggacggccgc

SEQ ID NO: 603526 - DNA, 20 bp, mouse
gcggtccagcccctagaaga

SEQ ID NO: 603527 - DNA, 20 bp, mouse
ggtgtctaaggcgctctctc

SEQ ID NO: 603528 - DNA, 20 bp, mouse
gaggcggagagcacccctgc

SEQ ID NO: 603529 - DNA, 20 bp, mouse
ggctctccgccttcttctag

SEQ ID NO: 603530 - DNA, 20 bp, mouse
gctctctccggcgccggcag

SEQ ID NO: 603531 - DNA, 20 bp, mouse
gggaggctgtgtggactccg

SEQ ID NO: 603532 - DNA, 20 bp, mouse
gggaatgcgggaggtccgac

SEQ ID NO: 603533 - DNA, 20 bp, mouse
ggcggcaaaggacccatcaa

SEQ ID NO: 603534 - DNA, 20 bp, mouse
gaaccggcgatacctggctg

SEQ ID NO: 603535 - DNA, 20 bp, mouse
gctcatcgtagaagaaccag

SEQ ID NO: 603536 - DNA, 20 bp, mouse
gtgaggagcggctcccacca

SEQ ID NO: 603537 - DNA, 20 bp, mouse
gtcctgccccggccgaactg

SEQ ID NO: 603538 - DNA, 20 bp, mouse
gactggggttaggtccgtgg

SEQ ID NO: 603539 - DNA, 20 bp, mouse
gcccgagccccggctggcgg

SEQ ID NO: 603540 - DNA, 20 bp, mouse
gcctaaccccagttcggccg

SEQ ID NO: 603541 - DNA, 20 bp, mouse
gcgaactggggttaggtccg

SEQ ID NO: 603542 - DNA, 20 bp, mouse
gggtcacgagtgcagagtgg

SEQ ID NO: 603543 - DNA, 20 bp, mouse
gcgaaacgtaggtcacgtgg

SEQ ID NO: 603544 - DNA, 20 bp, mouse
gggggcaggatagactccgt

SEQ ID NO: 603545 - DNA, 20 bp, mouse
gtagggtcacgagtgcagag

SEQ ID NO: 603546 - DNA, 20 bp, mouse
gcctagtgatcagggaacca

SEQ ID NO: 603547 - DNA, 20 bp, mouse
gctagggaagagctggacac

SEQ ID NO: 603548 - DNA, 20 bp, mouse
ggtccagttcatctcttaaa

SEQ ID NO: 603549 - DNA, 20 bp, mouse
gactcccaaggcaacaagag

SEQ ID NO: 603550 - DNA, 20 bp, mouse
gctgatcactagggaagagc

SEQ ID NO: 603551 - DNA, 20 bp, mouse
gctatgggaggcaggcactt

SEQ ID NO: 603552 - DNA, 20 bp, mouse
gctataaaccggactatggg

SEQ ID NO: 603553 - DNA, 20 bp, mouse
ggatgtagatgtctaacctg

SEQ ID NO: 603554 - DNA, 20 bp, mouse
ggaacataccagaatgaagg

SEQ ID NO: 603555 - DNA, 20 bp, mouse
gcattgtgatggcagttcca

SEQ ID NO: 603556 - DNA, 20 bp, mouse
gcacaggagagggccgctgg

SEQ ID NO: 603557 - DNA, 20 bp, mouse
gcggccccctcagagacacc

SEQ ID NO: 603558 - DNA, 20 bp, mouse
ggcctctcggctctacgctt

SEQ ID NO: 603559 - DNA, 20 bp, mouse
ggagagggccgctggaggtg

SEQ ID NO: 603560 - DNA, 20 bp, mouse
gtccgaagcgtagagccgag

SEQ ID NO: 603561 - DNA, 20 bp, mouse
ggcggccctctcctgtgccc

SEQ ID NO: 603562 - DNA, 20 bp, mouse
gcaaccctgacacccgagag

SEQ ID NO: 603563 - DNA, 20 bp, mouse
ggccctctcctgtgccccgg

SEQ ID NO: 603564 - DNA, 20 bp, mouse
ggctctacgcttcggagtcc

SEQ ID NO: 603565 - DNA, 20 bp, mouse
gcgggtggcgtaggagtctg

SEQ ID NO: 603566 - DNA, 20 bp, mouse
ggctgggagcgggtgaccgg

SEQ ID NO: 603567 - DNA, 20 bp, mouse
gggagtgcccacatccaaga

SEQ ID NO: 603568 - DNA, 20 bp, mouse
gccgggaccccgcaatctga

SEQ ID NO: 603569 - DNA, 20 bp, mouse
ggagcgccaagctaccgggg

SEQ ID NO: 603570 - DNA, 20 bp, mouse
gagatggcgcccccaggagc

SEQ ID NO: 603571 - DNA, 20 bp, mouse
gcccaagacggagggattca

SEQ ID NO: 603572 - DNA, 20 bp, mouse
ggaggagcgccaagctaccg

SEQ ID NO: 603573 - DNA, 20 bp, mouse
ggagcgggtgaccggcggcg

SEQ ID NO: 603574 - DNA, 20 bp, mouse
gggattcagggaccaggatc

SEQ ID NO: 603575 - DNA, 20 bp, mouse
gggggcgccatcttggatgt

SEQ ID NO: 603576 - DNA, 20 bp, mouse
gccccgcccgacgttgacag

SEQ ID NO: 603577 - DNA, 20 bp, mouse
gacgtggacgtcaacagcaa

SEQ ID NO: 603578 - DNA, 20 bp, mouse
gtggacgtcaacagcaatgg

SEQ ID NO: 603579 - DNA, 20 bp, mouse
gcagaagcccgcgggcagag

SEQ ID NO: 603580 - DNA, 20 bp, mouse
gcccagccgcagaagcccgc

SEQ ID NO: 603581 - DNA, 20 bp, mouse
gcggctggggcagaatcccg

SEQ ID NO: 603582 - DNA, 20 bp, mouse
gggactcggcgaactcagtg

SEQ ID NO: 603583 - DNA, 20 bp, mouse
gcttctgccactgtcaacgt

SEQ ID NO: 603584 - DNA, 20 bp, mouse
gaggaagagaaggggccagt

SEQ ID NO: 603585 - DNA, 20 bp, mouse
gcttggcccagcgaagagag

SEQ ID NO: 603586 - DNA, 20 bp, mouse
gggtccagcggagagccgaa

SEQ ID NO: 603587 - DNA, 20 bp, mouse
gagcggagagccgaagggag

SEQ ID NO: 603588 - DNA, 20 bp, mouse
gcgaagggagaggtgcggtg

SEQ ID NO: 603589 - DNA, 20 bp, mouse
gaaagtccagtgcggtccag

SEQ ID NO: 603590 - DNA, 20 bp, mouse
ggacgcggggcactcggggt

SEQ ID NO: 603591 - DNA, 20 bp, mouse
gacccgcagcgaccaagaca

SEQ ID NO: 603592 - DNA, 20 bp, mouse
gaagtccctaagcttcaggt

SEQ ID NO: 603593 - DNA, 20 bp, mouse
gcggtgcggcgcgccgaggt

SEQ ID NO: 603594 - DNA, 20 bp, mouse
ggccacggtgcgctgaccgg

SEQ ID NO: 603595 - DNA, 20 bp, mouse
ggaaagccgggcctgcccaa

SEQ ID NO: 603596 - DNA, 20 bp, mouse
gcactgttgggtgtacgtta

SEQ ID NO: 603597 - DNA, 20 bp, mouse
gtgcgctctggtgcaaggtg

SEQ ID NO: 603598 - DNA, 20 bp, mouse
gacctggacagagacgacag

SEQ ID NO: 603599 - DNA, 20 bp, mouse
gcgcgggcgcccgcactgtt

SEQ ID NO: 603600 - DNA, 20 bp, mouse
gttgggtgtacgttagggta

SEQ ID NO: 603601 - DNA, 20 bp, mouse
gacgggtccgagtcaaggtg

SEQ ID NO: 603602 - DNA, 20 bp, mouse
gttagggtacgggtaactat

SEQ ID NO: 603603 - DNA, 20 bp, mouse
ggtggtacgggtccgagtca

SEQ ID NO: 603604 - DNA, 20 bp, mouse
gagcctgcttgggcgcccag

SEQ ID NO: 603605 - DNA, 20 bp, mouse
gggcgtgacttggagactgg

SEQ ID NO: 603606 - DNA, 20 bp, mouse
gcgagcggcagagcgtcctg

SEQ ID NO: 603607 - DNA, 20 bp, mouse
ggcgtggaggagagctgcag

SEQ ID NO: 603608 - DNA, 20 bp, mouse
ggaagtagtagaggtagcag

SEQ ID NO: 603609 - DNA, 20 bp, mouse
gctgctgacgggacacgagt

SEQ ID NO: 603610 - DNA, 20 bp, mouse
gccgtccccggcccccggca

SEQ ID NO: 603611 - DNA, 20 bp, mouse
ggggactcttgaagtagtag

SEQ ID NO: 603612 - DNA, 20 bp, mouse
gccggcggcaggccatgccg

SEQ ID NO: 603613 - DNA, 20 bp, mouse
ggctacctgcagaagctgtc

SEQ ID NO: 603614 - DNA, 20 bp, mouse
gcgatgtccaggtggccgag

SEQ ID NO: 603615 - DNA, 20 bp, mouse
gcgagtcaaacacgaaccag

SEQ ID NO: 603616 - DNA, 20 bp, mouse
gcggagctccgggagtcaag

SEQ ID NO: 603617 - DNA, 20 bp, mouse
gtcaagaggatcagagaaag

SEQ ID NO: 603618 - DNA, 20 bp, mouse
ggcgcgctcgcgactctcca

SEQ ID NO: 603619 - DNA, 20 bp, mouse
gtgagctccgggagaccggc

SEQ ID NO: 603620 - DNA, 20 bp, mouse
gcagatgccagccggtctcc

SEQ ID NO: 603621 - DNA, 20 bp, mouse
ggagcccgaacggctgagaa

SEQ ID NO: 603622 - DNA, 20 bp, mouse
ggcagcagtgagcagccggg

SEQ ID NO: 603623 - DNA, 20 bp, mouse
gcggacggcgctgtcggatg

SEQ ID NO: 603624 - DNA, 20 bp, mouse
gccggctggcatctgcagtg

SEQ ID NO: 603625 - DNA, 20 bp, mouse
ggagcaccgctggcctggga

SEQ ID NO: 603626 - DNA, 20 bp, mouse
gcagccgcggatcggagtcg

SEQ ID NO: 603627 - DNA, 20 bp, mouse
gtccgcggctgacccggtga

SEQ ID NO: 603628 - DNA, 20 bp, mouse
gctaccccgactccgatccg

SEQ ID NO: 603629 - DNA, 20 bp, mouse
gtgctgggtagctctcggga

SEQ ID NO: 603630 - DNA, 20 bp, mouse
gacctgggcaacaaggagag

SEQ ID NO: 603631 - DNA, 20 bp, mouse
ggtctgcgggagactgaagt

SEQ ID NO: 603632 - DNA, 20 bp, mouse
gcaaggagagcggcaagata

SEQ ID NO: 603633 - DNA, 20 bp, mouse
gacatgcagagcactgacct

SEQ ID NO: 603634 - DNA, 20 bp, mouse
gggactgctgggtagctctc

SEQ ID NO: 603635 - DNA, 20 bp, mouse
gtcgggacggttaccctcac

SEQ ID NO: 603636 - DNA, 20 bp, mouse
gtcatcctcgctggagaaat

SEQ ID NO: 603637 - DNA, 20 bp, mouse
gcggagatttgactgctgca

SEQ ID NO: 603638 - DNA, 20 bp, mouse
ggatgctgcaggcgatgctc

SEQ ID NO: 603639 - DNA, 20 bp, mouse
gagcatcacctcatcctcgc

SEQ ID NO: 603640 - DNA, 20 bp, mouse
gcactccaaggagggagctc

SEQ ID NO: 603641 - DNA, 20 bp, mouse
gatttgactgctgcaaggca

SEQ ID NO: 603642 - DNA, 20 bp, mouse
gatggcccatttctccagcg

SEQ ID NO: 603643 - DNA, 20 bp, mouse
gcctctgcgcactccaagga

SEQ ID NO: 603644 - DNA, 20 bp, mouse
gcgcagaggagatcctcttg

SEQ ID NO: 603645 - DNA, 20 bp, mouse
gaatctccgcaaccaccgcg

SEQ ID NO: 603646 - DNA, 20 bp, mouse
ggagcaggatcgagagaccg

SEQ ID NO: 603647 - DNA, 20 bp, mouse
gtccttggggtccgggacca

SEQ ID NO: 603648 - DNA, 20 bp, mouse
ggcgctggcacgggaaggct

SEQ ID NO: 603649 - DNA, 20 bp, mouse
gacccagcgctggcacggga

SEQ ID NO: 603650 - DNA, 20 bp, mouse
gtgagcgcgccggccgcagc

SEQ ID NO: 603651 - DNA, 20 bp, mouse
gcactcggctcaggctccag

SEQ ID NO: 603652 - DNA, 20 bp, mouse
ggaccccaaggacggaccgg

SEQ ID NO: 603653 - DNA, 20 bp, mouse
gagctgggctgcagaatcgg

SEQ ID NO: 603654 - DNA, 20 bp, mouse
gcccggggaagtgtcgcatg

SEQ ID NO: 603655 - DNA, 20 bp, mouse
ggagggagggacgggaaccc

SEQ ID NO: 603656 - DNA, 20 bp, mouse
gagagcccggcagactgacg

SEQ ID NO: 603657 - DNA, 20 bp, mouse
ggcccgaccagcaagagaat

SEQ ID NO: 603658 - DNA, 20 bp, mouse
gtcagtctgccgggctctcg

SEQ ID NO: 603659 - DNA, 20 bp, mouse
gtgcccggggaggctgacgg

SEQ ID NO: 603660 - DNA, 20 bp, mouse
gggcgtgttccacgagagcc

SEQ ID NO: 603661 - DNA, 20 bp, mouse
ggaccacgctccctccgtaa

SEQ ID NO: 603662 - DNA, 20 bp, mouse
gtagaggtggagcgccggga

SEQ ID NO: 603663 - DNA, 20 bp, mouse
gaccagcaagagaatggggc

SEQ ID NO: 603664 - DNA, 20 bp, mouse
ggctgtgcagctgcccgggg

SEQ ID NO: 603665 - DNA, 20 bp, mouse
gaggcggacgccgttacgga

SEQ ID NO: 603666 - DNA, 20 bp, mouse
gtcagactcagagatccggg

SEQ ID NO: 603667 - DNA, 20 bp, mouse
ggactcagagatccgggagg

SEQ ID NO: 603668 - DNA, 20 bp, mouse
gaggcggcggagaaccggcc

SEQ ID NO: 603669 - DNA, 20 bp, mouse
gccgggaggcggcggagaac

SEQ ID NO: 603670 - DNA, 20 bp, mouse
ggcaacgctgtgctaccggc

SEQ ID NO: 603671 - DNA, 20 bp, mouse
ggacggaaccataagcgtca

SEQ ID NO: 603672 - DNA, 20 bp, mouse
gtgctgtcgatagacgacag

SEQ ID NO: 603673 - DNA, 20 bp, mouse
gcccgcaggtggagtcacct

SEQ ID NO: 603674 - DNA, 20 bp, mouse
ggtcagggccgagcgagcga

SEQ ID NO: 603675 - DNA, 20 bp, mouse
ggtctatcgacagcattcct

SEQ ID NO: 603676 - DNA, 20 bp, mouse
gctgcgcgcggagacagaag

SEQ ID NO: 603677 - DNA, 20 bp, mouse
ggagcccgcttggaaggagg

SEQ ID NO: 603678 - DNA, 20 bp, mouse
gaggcggcgggaactgcgcg

SEQ ID NO: 603679 - DNA, 20 bp, mouse
ggggtgagcccggcgagctg

SEQ ID NO: 603680 - DNA, 20 bp, mouse
gtctcacgcgagctccggtc

SEQ ID NO: 603681 - DNA, 20 bp, mouse
gcccgcttggaaggaggcgg

SEQ ID NO: 603682 - DNA, 20 bp, mouse
gatgtggctcaagcccgagg

SEQ ID NO: 603683 - DNA, 20 bp, mouse
gggccacggcaggcagcgcg

SEQ ID NO: 603684 - DNA, 20 bp, mouse
ggggacccacgggccgagag

SEQ ID NO: 603685 - DNA, 20 bp, mouse
ggtcgcaggtggtgtctcgg

SEQ ID NO: 603686 - DNA, 20 bp, mouse
gcgccaacggaagacttggt

SEQ ID NO: 603687 - DNA, 20 bp, mouse
gccgccgccaacggaagact

SEQ ID NO: 603688 - DNA, 20 bp, mouse
gtgggagagaaggcacggtt

SEQ ID NO: 603689 - DNA, 20 bp, mouse
gctcccaccaagtcttccgt

SEQ ID NO: 603690 - DNA, 20 bp, mouse
gagtctggcagtagctccgt

SEQ ID NO: 603691 - DNA, 20 bp, mouse
gttggcggcggcgcctccgg

SEQ ID NO: 603692 - DNA, 20 bp, mouse
gcgcggtggtagcagaggaa

SEQ ID NO: 603693 - DNA, 20 bp, mouse
gtgcaggacaaagtactcgt

SEQ ID NO: 603694 - DNA, 20 bp, mouse
gtgtgccgcctcgggaacgg

SEQ ID NO: 603695 - DNA, 20 bp, mouse
gtggcagtagctccgtggga

SEQ ID NO: 603696 - DNA, 20 bp, mouse
gcacgcccatcccagcaggg

SEQ ID NO: 603697 - DNA, 20 bp, mouse
gccccacgcccatcccagca

SEQ ID NO: 603698 - DNA, 20 bp, mouse
ggcttctcgcgagcccggta

SEQ ID NO: 603699 - DNA, 20 bp, mouse
gcgctcccagagcctgcgtg

SEQ ID NO: 603700 - DNA, 20 bp, mouse
gcacgccacacgcaggctct

SEQ ID NO: 603701 - DNA, 20 bp, mouse
ggaatacacacgccacacgc

SEQ ID NO: 603702 - DNA, 20 bp, mouse
gtggcgagcgaggagccgta

SEQ ID NO: 603703 - DNA, 20 bp, mouse
ggcccggtagggactgtgtg

SEQ ID NO: 603704 - DNA, 20 bp, mouse
gcgagcgaggagccgtaggg

SEQ ID NO: 603705 - DNA, 20 bp, mouse
ggtccacgagcggtgatctc

SEQ ID NO: 603706 - DNA, 20 bp, mouse
ggcgcgcgcttccgcctcac

SEQ ID NO: 603707 - DNA, 20 bp, mouse
gatgtggctcgggcccgagg

SEQ ID NO: 603708 - DNA, 20 bp, mouse
gcaccgggccagagcccgtg

SEQ ID NO: 603709 - DNA, 20 bp, mouse
gggctctggcccggtgcgag

SEQ ID NO: 603710 - DNA, 20 bp, mouse
gggctcgggcgcggcgacgg

SEQ ID NO: 603711 - DNA, 20 bp, mouse
gatcccgcggccgctcgcac

SEQ ID NO: 603712 - DNA, 20 bp, mouse
ggcaagggcggaggcctcac

SEQ ID NO: 603713 - DNA, 20 bp, mouse
gctgcctctgagggaccaag

SEQ ID NO: 603714 - DNA, 20 bp, mouse
gctcggctcgggcgcggcga

SEQ ID NO: 603715 - DNA, 20 bp, mouse
gctcgggcccgaggaggtgc

SEQ ID NO: 603716 - DNA, 20 bp, mouse
ggtagtgaggcggtaaggaa

SEQ ID NO: 603717 - DNA, 20 bp, mouse
gcggcgcgccggcgcagaag

SEQ ID NO: 603718 - DNA, 20 bp, mouse
gccttaccgcctcactactc

SEQ ID NO: 603719 - DNA, 20 bp, mouse
ggcagggccagcgccgaggg

SEQ ID NO: 603720 - DNA, 20 bp, mouse
ggaggggcccgcacacgcct

SEQ ID NO: 603721 - DNA, 20 bp, mouse
ggcggcagggccagcgccga

SEQ ID NO: 603722 - DNA, 20 bp, mouse
gtccctgccagcgccagcct

SEQ ID NO: 603723 - DNA, 20 bp, mouse
ggcacaggccgaggccctcc

SEQ ID NO: 603724 - DNA, 20 bp, mouse
gggtcgcgccgagccctgca

SEQ ID NO: 603725 - DNA, 20 bp, mouse
ggcgccgagccctgcacgga

SEQ ID NO: 603726 - DNA, 20 bp, mouse
gctgcggagccggtgtgaga

SEQ ID NO: 603727 - DNA, 20 bp, mouse
gcgcaccgcgggccactccg

SEQ ID NO: 603728 - DNA, 20 bp, mouse
gcggttcagccgtctcacac

SEQ ID NO: 603729 - DNA, 20 bp, mouse
gatctcgctgcgccccggag

SEQ ID NO: 603730 - DNA, 20 bp, mouse
ggaagcagcggcggccactg

SEQ ID NO: 603731 - DNA, 20 bp, mouse
gagacggctgaaccgcaccg

SEQ ID NO: 603732 - DNA, 20 bp, mouse
gtatatcccagaagcagcgg

SEQ ID NO: 603733 - DNA, 20 bp, mouse
gactagtgggcgaacctgga

SEQ ID NO: 603734 - DNA, 20 bp, mouse
gcagcgagatggaggtgacg

SEQ ID NO: 603735 - DNA, 20 bp, mouse
gacactccagagagccgagg

SEQ ID NO: 603736 - DNA, 20 bp, mouse
ggcagcgtcggccagagcca

SEQ ID NO: 603737 - DNA, 20 bp, mouse
gcgagcgctcggaggcaagg

SEQ ID NO: 603738 - DNA, 20 bp, mouse
gtcagaggcgcgaacaggag

SEQ ID NO: 603739 - DNA, 20 bp, mouse
ggcgctcggaggcaaggcgg

SEQ ID NO: 603740 - DNA, 20 bp, mouse
gctcggaggcaaggcggcgg

SEQ ID NO: 603741 - DNA, 20 bp, mouse
gcgctcccgggcgaaggcgg

SEQ ID NO: 603742 - DNA, 20 bp, mouse
gaccaggctcaggtcccgcg

SEQ ID NO: 603743 - DNA, 20 bp, mouse
gggggagccagcggcagcgt

SEQ ID NO: 603744 - DNA, 20 bp, mouse
gggtgcccgagcgacttcag

SEQ ID NO: 603745 - DNA, 20 bp, mouse
ggagcgagcgctcggaggca

SEQ ID NO: 603746 - DNA, 20 bp, mouse
gactgggagagcctatcccc

SEQ ID NO: 603747 - DNA, 20 bp, mouse
gaccgaagtgcaaccccagg

SEQ ID NO: 603748 - DNA, 20 bp, mouse
gacctcctggggttgcactt

SEQ ID NO: 603749 - DNA, 20 bp, mouse
gggaggtgtcaaagtacgtg

SEQ ID NO: 603750 - DNA, 20 bp, mouse
gctcaccgaagtgcaacccc

SEQ ID NO: 603751 - DNA, 20 bp, mouse
gggcttccagcactccgtag

SEQ ID NO: 603752 - DNA, 20 bp, mouse
gcgtactttgacacctcctg

SEQ ID NO: 603753 - DNA, 20 bp, mouse
gactgtaataagttagtact

SEQ ID NO: 603754 - DNA, 20 bp, mouse
gccagcactccgtagcggtg

SEQ ID NO: 603755 - DNA, 20 bp, mouse
gacgtggggcgtcttgcctg

SEQ ID NO: 603756 - DNA, 20 bp, mouse
ggcttccgtaagaaccctac

SEQ ID NO: 603757 - DNA, 20 bp, mouse
ggttgccggtagggttctta

SEQ ID NO: 603758 - DNA, 20 bp, mouse
gttcttcccggttgccggta

SEQ ID NO: 603759 - DNA, 20 bp, mouse
gagagagcgcgcgtcccggg

SEQ ID NO: 603760 - DNA, 20 bp, mouse
gtctgggaggaagggacctg

SEQ ID NO: 603761 - DNA, 20 bp, mouse
ggggttcttacggaagctgc

SEQ ID NO: 603762 - DNA, 20 bp, mouse
gctggcacggcgctcctatg

SEQ ID NO: 603763 - DNA, 20 bp, mouse
gccatgagcgctctcgtagg

SEQ ID NO: 603764 - DNA, 20 bp, mouse
gacctctctgtggataggga

SEQ ID NO: 603765 - DNA, 20 bp, mouse
gcctcggcggcgctcgcagc

SEQ ID NO: 603766 - DNA, 20 bp, mouse
gtctctgggtgctgacagac

SEQ ID NO: 603767 - DNA, 20 bp, mouse
gggctctaggcggaagtatc

SEQ ID NO: 603768 - DNA, 20 bp, mouse
gtgacagaccggcagaggga

SEQ ID NO: 603769 - DNA, 20 bp, mouse
gtgattgcgtgagggtctct

SEQ ID NO: 603770 - DNA, 20 bp, mouse
gttcgtcgctgattgcgtga

SEQ ID NO: 603771 - DNA, 20 bp, mouse
gggtgctgacagaccggcag

SEQ ID NO: 603772 - DNA, 20 bp, mouse
gtaaggtcgtggagctgagg

SEQ ID NO: 603773 - DNA, 20 bp, mouse
gggaagtcccacctccgcag

SEQ ID NO: 603774 - DNA, 20 bp, mouse
gccattgtgggctgacccag

SEQ ID NO: 603775 - DNA, 20 bp, mouse
ggtcggctgggccccattgt

SEQ ID NO: 603776 - DNA, 20 bp, mouse
gcgggtcaatgcaggacact

SEQ ID NO: 603777 - DNA, 20 bp, mouse
gctccaggccggccccggac

SEQ ID NO: 603778 - DNA, 20 bp, mouse
gttcacctcgaccccttctc

SEQ ID NO: 603779 - DNA, 20 bp, mouse
gggctctggcggccggagaa

SEQ ID NO: 603780 - DNA, 20 bp, mouse
gaggacggcgcactgatgga

SEQ ID NO: 603781 - DNA, 20 bp, mouse
gaggcatgctccacctgtgg

SEQ ID NO: 603782 - DNA, 20 bp, mouse
ggcggccggagaaggggtcg

SEQ ID NO: 603783 - DNA, 20 bp, mouse
gaggtgaagtggagccggtc

SEQ ID NO: 603784 - DNA, 20 bp, mouse
gcataccccaggcctcaagg

SEQ ID NO: 603785 - DNA, 20 bp, mouse
gacccggaagcagctttccg

SEQ ID NO: 603786 - DNA, 20 bp, mouse
gagtggctgtgtgaagttct

SEQ ID NO: 603787 - DNA, 20 bp, mouse
gaatctcggcgtggagacat

SEQ ID NO: 603788 - DNA, 20 bp, mouse
gcagtgtgtttttcagagag

SEQ ID NO: 603789 - DNA, 20 bp, mouse
gggcgtggagacataggtgt

SEQ ID NO: 603790 - DNA, 20 bp, mouse
gaggtcaaatagaaagctca

SEQ ID NO: 603791 - DNA, 20 bp, mouse
gcccacccggaaaaatctca

SEQ ID NO: 603792 - DNA, 20 bp, mouse
ggggcttcaggggatctctt

SEQ ID NO: 603793 - DNA, 20 bp, mouse
gtgtgaggagttggttatgg

SEQ ID NO: 603794 - DNA, 20 bp, mouse
gaaatccccctcagtttccc

SEQ ID NO: 603795 - DNA, 20 bp, mouse
gtaatctgtatttacagcct

SEQ ID NO: 603796 - DNA, 20 bp, mouse
gtccccggctcagaacccga

SEQ ID NO: 603797 - DNA, 20 bp, mouse
ggaggtgcgcgctcaccctc

SEQ ID NO: 603798 - DNA, 20 bp, mouse
gagcagtggccgacccgagg

SEQ ID NO: 603799 - DNA, 20 bp, mouse
gccgtccgcgcgggcctccc

SEQ ID NO: 603800 - DNA, 20 bp, mouse
gtctgagccggggacccggg

SEQ ID NO: 603801 - DNA, 20 bp, mouse
gaccctcgggttctgagccg

SEQ ID NO: 603802 - DNA, 20 bp, mouse
ggatgtgacgtcatgagcag

SEQ ID NO: 603803 - DNA, 20 bp, mouse
gacaagaggccgcctaggga

SEQ ID NO: 603804 - DNA, 20 bp, mouse
gatgagcagtggccgacccg

SEQ ID NO: 603805 - DNA, 20 bp, mouse
ggtctacaagaggccgccta

SEQ ID NO: 603806 - DNA, 20 bp, mouse
ggcgaagccggaagtagcct

SEQ ID NO: 603807 - DNA, 20 bp, mouse
gcggcagctggaccaagggt

SEQ ID NO: 603808 - DNA, 20 bp, mouse
gctggggcgcgagaaggccc

SEQ ID NO: 603809 - DNA, 20 bp, mouse
ggagaaggcccgggagccgc

SEQ ID NO: 603810 - DNA, 20 bp, mouse
ggctggaccaagggtgggag

SEQ ID NO: 603811 - DNA, 20 bp, mouse
gtcgcgccccaggctacttc

SEQ ID NO: 603812 - DNA, 20 bp, mouse
ggacactcgcggggtaagag

SEQ ID NO: 603813 - DNA, 20 bp, mouse
ggtccgccgcgtacagcccg

SEQ ID NO: 603814 - DNA, 20 bp, mouse
gagtagcctggggcgcgaga

SEQ ID NO: 603815 - DNA, 20 bp, mouse
ggggagccgcgggctgtacg

SEQ ID NO: 603816 - DNA, 20 bp, mouse
gaggcctgggatgggaatct

SEQ ID NO: 603817 - DNA, 20 bp, mouse
gccttaggagcaggcgacag

SEQ ID NO: 603818 - DNA, 20 bp, mouse
ggagcaggcgacagaggcct

SEQ ID NO: 603819 - DNA, 20 bp, mouse
gagcgggactagccttcctt

SEQ ID NO: 603820 - DNA, 20 bp, mouse
ggcagtcacagcaggggata

SEQ ID NO: 603821 - DNA, 20 bp, mouse
gccgccaagattcccatccc

SEQ ID NO: 603822 - DNA, 20 bp, mouse
ggcggctgtcgaggtacttg

SEQ ID NO: 603823 - DNA, 20 bp, mouse
ggacgtcatgagtggagtgg

SEQ ID NO: 603824 - DNA, 20 bp, mouse
ggatcctgcgggaggaagtt

SEQ ID NO: 603825 - DNA, 20 bp, mouse
gagaccaagccgagtagtct

SEQ ID NO: 603826 - DNA, 20 bp, mouse
ggggcgctggggcccgtcag

SEQ ID NO: 603827 - DNA, 20 bp, mouse
gtgcgcccgggagcagagtg

SEQ ID NO: 603828 - DNA, 20 bp, mouse
gctccgggcgggctactgag

SEQ ID NO: 603829 - DNA, 20 bp, mouse
gggggtggggagagacccgg

SEQ ID NO: 603830 - DNA, 20 bp, mouse
ggagcggcgcgcggtgccag

SEQ ID NO: 603831 - DNA, 20 bp, mouse
gcgctggggcccgtcagggg

SEQ ID NO: 603832 - DNA, 20 bp, mouse
gcggtctcggccccacagag

SEQ ID NO: 603833 - DNA, 20 bp, mouse
ggtggggagagacccggcgg

SEQ ID NO: 603834 - DNA, 20 bp, mouse
gtcggccccacagaggggag

SEQ ID NO: 603835 - DNA, 20 bp, mouse
ggactgcgagcaggagcccg

SEQ ID NO: 603836 - DNA, 20 bp, mouse
gtagcgctggaaagtttcgg

SEQ ID NO: 603837 - DNA, 20 bp, mouse
gagctagcgctggaaagttt

SEQ ID NO: 603838 - DNA, 20 bp, mouse
gcggccggagggcgctgcag

SEQ ID NO: 603839 - DNA, 20 bp, mouse
ggtgagtacacgccgggcag

SEQ ID NO: 603840 - DNA, 20 bp, mouse
gccggagggcgctgcagcgg

SEQ ID NO: 603841 - DNA, 20 bp, mouse
ggccgcgcggaggccgacga

SEQ ID NO: 603842 - DNA, 20 bp, mouse
gccacgagaagagctagcgc

SEQ ID NO: 603843 - DNA, 20 bp, mouse
gcttctcgtggactaggtgg

SEQ ID NO: 603844 - DNA, 20 bp, mouse
gaagtttcggtggcgaatgg

SEQ ID NO: 603845 - DNA, 20 bp, mouse
gagggagcgcgcccaacctg

SEQ ID NO: 603846 - DNA, 20 bp, mouse
ggcgcagcaccgaggcagga

SEQ ID NO: 603847 - DNA, 20 bp, mouse
gggaggggagctgttactaa

SEQ ID NO: 603848 - DNA, 20 bp, mouse
gggggcagggcgcagcaccg

SEQ ID NO: 603849 - DNA, 20 bp, mouse
gcagggcgcagcaccgaggc

SEQ ID NO: 603850 - DNA, 20 bp, mouse
gccgctatgtgagcacaggg

SEQ ID NO: 603851 - DNA, 20 bp, mouse
gcaagcgcgcgagcggccaa

SEQ ID NO: 603852 - DNA, 20 bp, mouse
gcagccaccccgacccgggg

SEQ ID NO: 603853 - DNA, 20 bp, mouse
gagcggccagggctcaggat

SEQ ID NO: 603854 - DNA, 20 bp, mouse
gagcgccgcgcgtcctggag

SEQ ID NO: 603855 - DNA, 20 bp, mouse
ggacagccgggcagcgggtc

SEQ ID NO: 603856 - DNA, 20 bp, mouse
gccatcagctccggcatctg

SEQ ID NO: 603857 - DNA, 20 bp, mouse
gccggcgtcgtaggctgagg

SEQ ID NO: 603858 - DNA, 20 bp, mouse
ggtgaggacgccggcgtcgt

SEQ ID NO: 603859 - DNA, 20 bp, mouse
gacgccggcgtcgtaggctg

SEQ ID NO: 603860 - DNA, 20 bp, mouse
ggccagcagacccaccagga

SEQ ID NO: 603861 - DNA, 20 bp, mouse
gggcagctgtcccgcagtca

SEQ ID NO: 603862 - DNA, 20 bp, mouse
ggggacaaccccatcagctc

SEQ ID NO: 603863 - DNA, 20 bp, mouse
gcgaggagcgtggagagtca

SEQ ID NO: 603864 - DNA, 20 bp, mouse
gcaaggccagcagacccacc

SEQ ID NO: 603865 - DNA, 20 bp, mouse
gcctcgtgcgccgagacgtg

SEQ ID NO: 603866 - DNA, 20 bp, mouse
gccggttcacgcggggagaa

SEQ ID NO: 603867 - DNA, 20 bp, mouse
ggaggcgctgccctgggaca

SEQ ID NO: 603868 - DNA, 20 bp, mouse
ggaagtacagagtagcacac

SEQ ID NO: 603869 - DNA, 20 bp, mouse
gggagaaaggctgctgaact

SEQ ID NO: 603870 - DNA, 20 bp, mouse
gacactggccggttcacgcg

SEQ ID NO: 603871 - DNA, 20 bp, mouse
gggagccaggagtttaggag

SEQ ID NO: 603872 - DNA, 20 bp, mouse
ggcagtctcggccatgtccc

SEQ ID NO: 603873 - DNA, 20 bp, mouse
gttagtgctaagataggaag

SEQ ID NO: 603874 - DNA, 20 bp, mouse
gaaacagcagctgttcacag

SEQ ID NO: 603875 - DNA, 20 bp, mouse
gaactgcacactatgaataa

SEQ ID NO: 603876 - DNA, 20 bp, mouse
gggtggatcgagtccggtag

SEQ ID NO: 603877 - DNA, 20 bp, mouse
gggatcgagtccggtagcgg

SEQ ID NO: 603878 - DNA, 20 bp, mouse
gcggtttggctaggtttctg

SEQ ID NO: 603879 - DNA, 20 bp, mouse
ggcgttcggtggatcgagtc

SEQ ID NO: 603880 - DNA, 20 bp, mouse
gctccgcagtgcccaggtaa

SEQ ID NO: 603881 - DNA, 20 bp, mouse
ggaccgttacctgggcactg

SEQ ID NO: 603882 - DNA, 20 bp, mouse
gagcggtggcgggtatctgc

SEQ ID NO: 603883 - DNA, 20 bp, mouse
gtcgagtccggtagcggtgg

SEQ ID NO: 603884 - DNA, 20 bp, mouse
ggcgcaactggcggaagtga

SEQ ID NO: 603885 - DNA, 20 bp, mouse
gggtggcgggtatctgctgg

SEQ ID NO: 603886 - DNA, 20 bp, mouse
gaccgagctcgagccttggg

SEQ ID NO: 603887 - DNA, 20 bp, mouse
gtgttgttccgggtacaggg

SEQ ID NO: 603888 - DNA, 20 bp, mouse
ggccccccaaggctcgagct

SEQ ID NO: 603889 - DNA, 20 bp, mouse
ggcggcggccgccctgtacc

SEQ ID NO: 603890 - DNA, 20 bp, mouse
gtcctagcaacgggcctggg

SEQ ID NO: 603891 - DNA, 20 bp, mouse
ggggttaccgtgggaagacg

SEQ ID NO: 603892 - DNA, 20 bp, mouse
ggcggtcgtaaaggacacgg

SEQ ID NO: 603893 - DNA, 20 bp, mouse
gacgcacgggggcatagagg

SEQ ID NO: 603894 - DNA, 20 bp, mouse
gccgccgacggggttaccgt

SEQ ID NO: 603895 - DNA, 20 bp, mouse
gattgtcgcgggggaagcgg

SEQ ID NO: 603896 - DNA, 20 bp, mouse
gtagagctgaggacaagcaa

SEQ ID NO: 603897 - DNA, 20 bp, mouse
gagcccaccatgtagagctg

SEQ ID NO: 603898 - DNA, 20 bp, mouse
ggtgggctctctcatcatgg

SEQ ID NO: 603899 - DNA, 20 bp, mouse
ggtcctcagctctacatggt

SEQ ID NO: 603900 - DNA, 20 bp, mouse
gagcaaaggaatcagcgtcc

SEQ ID NO: 603901 - DNA, 20 bp, mouse
ggaatcagcgtccaggcaag

SEQ ID NO: 603902 - DNA, 20 bp, mouse
gggtataaggatccaggaag

SEQ ID NO: 603903 - DNA, 20 bp, mouse
gaactagagcgaggtgacca

SEQ ID NO: 603904 - DNA, 20 bp, mouse
ggccacattgctgagaacca

SEQ ID NO: 603905 - DNA, 20 bp, mouse
ggcaagagcactggaacccg

SEQ ID NO: 603906 - DNA, 20 bp, mouse
gctgtctagtgaggggtctg

SEQ ID NO: 603907 - DNA, 20 bp, mouse
ggtgctttctgtctagtgag

SEQ ID NO: 603908 - DNA, 20 bp, mouse
gctggctggactgagagagt

SEQ ID NO: 603909 - DNA, 20 bp, mouse
ggtcctgtttatcatacact

SEQ ID NO: 603910 - DNA, 20 bp, mouse
gcttctctccaggttgtcag

SEQ ID NO: 603911 - DNA, 20 bp, mouse
ggactccaaggactcaccag

SEQ ID NO: 603912 - DNA, 20 bp, mouse
ggagcggtggccgcagactg

SEQ ID NO: 603913 - DNA, 20 bp, mouse
gctcagatccgcccgaatgt

SEQ ID NO: 603914 - DNA, 20 bp, mouse
gttaaaacccagggacggga

SEQ ID NO: 603915 - DNA, 20 bp, mouse
ggcagctacccacattcggg

SEQ ID NO: 603916 - DNA, 20 bp, mouse
ggagcgcaggcagaaacaga

SEQ ID NO: 603917 - DNA, 20 bp, mouse
gagaaacagatggcgatcct

SEQ ID NO: 603918 - DNA, 20 bp, mouse
ggagccagaacgagaagtac

SEQ ID NO: 603919 - DNA, 20 bp, mouse
gcttccttgggaaatcgact

SEQ ID NO: 603920 - DNA, 20 bp, mouse
gaatcgactgggaagtgccg

SEQ ID NO: 603921 - DNA, 20 bp, mouse
ggtaccggctgaagtacctg

SEQ ID NO: 603922 - DNA, 20 bp, mouse
gggagctccggggcgcggag

SEQ ID NO: 603923 - DNA, 20 bp, mouse
gcttccggcgggtcttcctt

SEQ ID NO: 603924 - DNA, 20 bp, mouse
gcaagcgaggcaactaacac

SEQ ID NO: 603925 - DNA, 20 bp, mouse
gacccggaagttacacgtgg

SEQ ID NO: 603926 - DNA, 20 bp, mouse
gtctccaggacgccagactg

SEQ ID NO: 603927 - DNA, 20 bp, mouse
gggctgatggaggtcagtga

SEQ ID NO: 603928 - DNA, 20 bp, mouse
gccaggacgccagactgcgg

SEQ ID NO: 603929 - DNA, 20 bp, mouse
gggaggccgtaggctgatgg

SEQ ID NO: 603930 - DNA, 20 bp, mouse
gcaggccgcgtggaggccgt

SEQ ID NO: 603931 - DNA, 20 bp, mouse
gctggcgtcctggagagacc

SEQ ID NO: 603932 - DNA, 20 bp, mouse
gagcgcgccaggccgcgtgg

SEQ ID NO: 603933 - DNA, 20 bp, mouse
gtcagaaacccggtctctcc

SEQ ID NO: 603934 - DNA, 20 bp, mouse
gcgtggaggccgtaggctga

SEQ ID NO: 603935 - DNA, 20 bp, mouse
gtagacacgaggcctatccc

SEQ ID NO: 603936 - DNA, 20 bp, mouse
ggggacggcgctctgatcag

SEQ ID NO: 603937 - DNA, 20 bp, mouse
gagccacggactagacacgg

SEQ ID NO: 603938 - DNA, 20 bp, mouse
ggtgagccacggactagaca

SEQ ID NO: 603939 - DNA, 20 bp, mouse
gacggcgctctgatcagcgg

SEQ ID NO: 603940 - DNA, 20 bp, mouse
gggcggagatcatgacccga

SEQ ID NO: 603941 - DNA, 20 bp, mouse
ggcgagagctgcgtgagcca

SEQ ID NO: 603942 - DNA, 20 bp, mouse
gcgctctgatcagcggcggg

SEQ ID NO: 603943 - DNA, 20 bp, mouse
gatcagagcgccgtcccgcg

SEQ ID NO: 603944 - DNA, 20 bp, mouse
gtcccgcgcggcgggccgag

SEQ ID NO: 603945 - DNA, 20 bp, mouse
ggagctgccagccgccccgg

SEQ ID NO: 603946 - DNA, 20 bp, mouse
ggcctcggctgcaacaagag

SEQ ID NO: 603947 - DNA, 20 bp, mouse
ggctgggcgtacgcagtcgg

SEQ ID NO: 603948 - DNA, 20 bp, mouse
ggggcgtacgcagtcggagg

SEQ ID NO: 603949 - DNA, 20 bp, mouse
gataggcgcccgggcctgac

SEQ ID NO: 603950 - DNA, 20 bp, mouse
gagtatagacgcggacagaa

SEQ ID NO: 603951 - DNA, 20 bp, mouse
gatgctgaacgcgctggccc

SEQ ID NO: 603952 - DNA, 20 bp, mouse
gttgcagccgaggcctcgga

SEQ ID NO: 603953 - DNA, 20 bp, mouse
gaggcggcgccggtcaggcc

SEQ ID NO: 603954 - DNA, 20 bp, mouse
ggcgggctccgcgcgtccat

SEQ ID NO: 603955 - DNA, 20 bp, mouse
gcggagcccgctgtctgccc

SEQ ID NO: 603956 - DNA, 20 bp, mouse
gctccagacactacaatcag

SEQ ID NO: 603957 - DNA, 20 bp, mouse
gagcttggggctgttctggt

SEQ ID NO: 603958 - DNA, 20 bp, mouse
gcctgagcaggacacttggt

SEQ ID NO: 603959 - DNA, 20 bp, mouse
gtcactggcgtcccctccct

SEQ ID NO: 603960 - DNA, 20 bp, mouse
ggtcagggctgcagaagaca

SEQ ID NO: 603961 - DNA, 20 bp, mouse
ggacgccagtgagtgacact

SEQ ID NO: 603962 - DNA, 20 bp, mouse
gtaggctacagccttaccca

SEQ ID NO: 603963 - DNA, 20 bp, mouse
gcctagcctgagctgagatc

SEQ ID NO: 603964 - DNA, 20 bp, mouse
gctacagccttacccaggga

SEQ ID NO: 603965 - DNA, 20 bp, mouse
gagggaagtactgagaactg

SEQ ID NO: 603966 - DNA, 20 bp, mouse
gcgggaagggaggaattcag

SEQ ID NO: 603967 - DNA, 20 bp, mouse
gttcccgaggaacagggggt

SEQ ID NO: 603968 - DNA, 20 bp, mouse
gctcccttcccgaggaacag

SEQ ID NO: 603969 - DNA, 20 bp, mouse
ggcagtgagctcctgtccga

SEQ ID NO: 603970 - DNA, 20 bp, mouse
gggcgccgcggccgaaactg

SEQ ID NO: 603971 - DNA, 20 bp, mouse
gtgcctaccccctgttcctc

SEQ ID NO: 603972 - DNA, 20 bp, mouse
gaaggacgggaagaacgagt

SEQ ID NO: 603973 - DNA, 20 bp, mouse
gcgcgggctagaggagaccc

SEQ ID NO: 603974 - DNA, 20 bp, mouse
gtttccctcacccctcggac

SEQ ID NO: 603975 - DNA, 20 bp, mouse
gggagggcgcagatcacccg

SEQ ID NO: 603976 - DNA, 20 bp, mouse
gagcccgagaggactaacac

SEQ ID NO: 603977 - DNA, 20 bp, mouse
gcactctgcggacacaaatt

SEQ ID NO: 603978 - DNA, 20 bp, mouse
gttcaaggcaggagagcggt

SEQ ID NO: 603979 - DNA, 20 bp, mouse
gctctcgggctcatcagtcg

SEQ ID NO: 603980 - DNA, 20 bp, mouse
gagacagagggaaggaaact

SEQ ID NO: 603981 - DNA, 20 bp, mouse
gttgaagtgctgacagatca

SEQ ID NO: 603982 - DNA, 20 bp, mouse
gtctctggcgttgggatccg

SEQ ID NO: 603983 - DNA, 20 bp, mouse
ggcacttcaaggcaggagag

SEQ ID NO: 603984 - DNA, 20 bp, mouse
gatccgaggaagcaggaacg

SEQ ID NO: 603985 - DNA, 20 bp, mouse
gtccccgtgttagtcctctc

SEQ ID NO: 603986 - DNA, 20 bp, mouse
gcccagacactgaccagctg

SEQ ID NO: 603987 - DNA, 20 bp, mouse
gtcgaaaagccagcaagtga

SEQ ID NO: 603988 - DNA, 20 bp, mouse
gcctggaggatgctcccctc

SEQ ID NO: 603989 - DNA, 20 bp, mouse
ggaagctttagcaagagcca

SEQ ID NO: 603990 - DNA, 20 bp, mouse
gataatttggagactttcag

SEQ ID NO: 603991 - DNA, 20 bp, mouse
gaagtgagctccaggcaggg

SEQ ID NO: 603992 - DNA, 20 bp, mouse
gagcaaaggctagcacaagt

SEQ ID NO: 603993 - DNA, 20 bp, mouse
ggctgcctctgaacgaagag

SEQ ID NO: 603994 - DNA, 20 bp, mouse
gactttcaggggtgtcacac

SEQ ID NO: 603995 - DNA, 20 bp, mouse
ggtgtctcgcctgcttaacg

SEQ ID NO: 603996 - DNA, 20 bp, mouse
gagcgcaggggatccgaaca

SEQ ID NO: 603997 - DNA, 20 bp, mouse
gctagcgccgggaagaagga

SEQ ID NO: 603998 - DNA, 20 bp, mouse
ggccggggaccacgcgcgac

SEQ ID NO: 603999 - DNA, 20 bp, mouse
gaccagtcgcgcgtggtccc

SEQ ID NO: 604000 - DNA, 20 bp, mouse
gcgcagggctctggacgcgg

SEQ ID NO: 604001 - DNA, 20 bp, mouse
gcccatgtccgccttcctgg

SEQ ID NO: 604002 - DNA, 20 bp, mouse
gggcgcgcgcggaggacgga

SEQ ID NO: 604003 - DNA, 20 bp, mouse
gcccccgccaggcccgggtc

SEQ ID NO: 604004 - DNA, 20 bp, mouse
gacatccggcccaggctcct

SEQ ID NO: 604005 - DNA, 20 bp, mouse
gtagatcttgtcctgatctc

SEQ ID NO: 604006 - DNA, 20 bp, mouse
gatcggcgtgggactctaga

SEQ ID NO: 604007 - DNA, 20 bp, mouse
gctagagggtgcggaaacca

SEQ ID NO: 604008 - DNA, 20 bp, mouse
gagtccgaggaggtgacgat

SEQ ID NO: 604009 - DNA, 20 bp, mouse
ggagtggcccaagtccgagg

SEQ ID NO: 604010 - DNA, 20 bp, mouse
gcgtgggactctagagggtg

SEQ ID NO: 604011 - DNA, 20 bp, mouse
gaggaggtgacgatcggcgt

SEQ ID NO: 604012 - DNA, 20 bp, mouse
gggtgcggaaaccagggagt

SEQ ID NO: 604013 - DNA, 20 bp, mouse
ggagaggagatccgactccc

SEQ ID NO: 604014 - DNA, 20 bp, mouse
gagcggacccaaggagggaa

SEQ ID NO: 604015 - DNA, 20 bp, mouse
gcttgctgcgctctgcagag

SEQ ID NO: 604016 - DNA, 20 bp, mouse
gtaggcgcgcagctgctcct

SEQ ID NO: 604017 - DNA, 20 bp, mouse
gtcctgagcgcgcgttggat

SEQ ID NO: 604018 - DNA, 20 bp, mouse
ggcgccgctagtgacagcgc

SEQ ID NO: 604019 - DNA, 20 bp, mouse
gccagggcgcccccagagta

SEQ ID NO: 604020 - DNA, 20 bp, mouse
gcagcccgcgctgtcactag

SEQ ID NO: 604021 - DNA, 20 bp, mouse
gcttagggctggggcgacgg

SEQ ID NO: 604022 - DNA, 20 bp, mouse
ggaccctcgggtctcttcga

SEQ ID NO: 604023 - DNA, 20 bp, mouse
gcgggtaggcgaaggatcca

SEQ ID NO: 604024 - DNA, 20 bp, mouse
gagagacccgagggtcctta

SEQ ID NO: 604025 - DNA, 20 bp, mouse
gcccggcgcggcaggcacca

SEQ ID NO: 604026 - DNA, 20 bp, mouse
ggctcccagaagagctagtg

SEQ ID NO: 604027 - DNA, 20 bp, mouse
gagctcttctgggagcccag

SEQ ID NO: 604028 - DNA, 20 bp, mouse
ggctgaggtcttccacgtca

SEQ ID NO: 604029 - DNA, 20 bp, mouse
gcccagaggtcactcagcct

SEQ ID NO: 604030 - DNA, 20 bp, mouse
gagtgtggtcttccttgacg

SEQ ID NO: 604031 - DNA, 20 bp, mouse
gtcacttgtgcttcaaccct

SEQ ID NO: 604032 - DNA, 20 bp, mouse
ggcagatgagtgtcaagctg

SEQ ID NO: 604033 - DNA, 20 bp, mouse
gctggtgctctaaagagtag

SEQ ID NO: 604034 - DNA, 20 bp, mouse
gtagtcacatctgtcggaat

SEQ ID NO: 604035 - DNA, 20 bp, mouse
gtatcactagtcacatctgt

SEQ ID NO: 604036 - DNA, 20 bp, mouse
gggagtaggcaagtagaggg

SEQ ID NO: 604037 - DNA, 20 bp, mouse
ggctggagtaggcaagtaga

SEQ ID NO: 604038 - DNA, 20 bp, mouse
ggcccggggaattctagagg

SEQ ID NO: 604039 - DNA, 20 bp, mouse
ggaattctagaggcggagga

SEQ ID NO: 604040 - DNA, 20 bp, mouse
gcggggaattctagaggcgg

SEQ ID NO: 604041 - DNA, 20 bp, mouse
ggaagacagccggctccccg

SEQ ID NO: 604042 - DNA, 20 bp, mouse
gaggcagcgagatcaagggg

SEQ ID NO: 604043 - DNA, 20 bp, mouse
ggagccgccgagcagacgcc

SEQ ID NO: 604044 - DNA, 20 bp, mouse
gcgggctgcgcgcagagtct

SEQ ID NO: 604045 - DNA, 20 bp, mouse
gtcacaggcagcgagatcaa

SEQ ID NO: 604046 - DNA, 20 bp, mouse
gcagccggacggtgacccag

SEQ ID NO: 604047 - DNA, 20 bp, mouse
gaagggcccgctctacaccc

SEQ ID NO: 604048 - DNA, 20 bp, mouse
gctcggggcccagcacatcc

SEQ ID NO: 604049 - DNA, 20 bp, mouse
ggcacatcccgggtgtagag

SEQ ID NO: 604050 - DNA, 20 bp, mouse
gagcgggcccttgatctccg

SEQ ID NO: 604051 - DNA, 20 bp, mouse
ggggcctctgggtcaccgtc

SEQ ID NO: 604052 - DNA, 20 bp, mouse
gagtgcagcctcggagatca

SEQ ID NO: 604053 - DNA, 20 bp, mouse
ggaccgcagggagtctgcct

SEQ ID NO: 604054 - DNA, 20 bp, mouse
ggctgcctgctgcgccctcg

SEQ ID NO: 604055 - DNA, 20 bp, mouse
gctagaggaacgggaccgca

SEQ ID NO: 604056 - DNA, 20 bp, mouse
gtactcggccagatccacac

SEQ ID NO: 604057 - DNA, 20 bp, mouse
gtggatctggccgagtaact

SEQ ID NO: 604058 - DNA, 20 bp, mouse
gacagggcctctagccagtg

SEQ ID NO: 604059 - DNA, 20 bp, mouse
gcagcacacgccgagttact

SEQ ID NO: 604060 - DNA, 20 bp, mouse
gatcctgcagcatctcctgc

SEQ ID NO: 604061 - DNA, 20 bp, mouse
ggtgcccactcaaagcctgg

SEQ ID NO: 604062 - DNA, 20 bp, mouse
gaggagatgctgcaggataa

SEQ ID NO: 604063 - DNA, 20 bp, mouse
gggcctgtccgagagcgagg

SEQ ID NO: 604064 - DNA, 20 bp, mouse
ggcctgggggactcttcaca

SEQ ID NO: 604065 - DNA, 20 bp, mouse
gagctctgaggaccccgaga

SEQ ID NO: 604066 - DNA, 20 bp, mouse
gggaaagccggaggccaggt

SEQ ID NO: 604067 - DNA, 20 bp, mouse
gcaacagtagcagctagctt

SEQ ID NO: 604068 - DNA, 20 bp, mouse
gggtgcaggcatggtgtctc

SEQ ID NO: 604069 - DNA, 20 bp, mouse
gttcctgctaagaggaagag

SEQ ID NO: 604070 - DNA, 20 bp, mouse
gctctgcagaatgcaagaca

SEQ ID NO: 604071 - DNA, 20 bp, mouse
gctggggaaacagagaatgg

SEQ ID NO: 604072 - DNA, 20 bp, mouse
ggaacccttgccaggatcca

SEQ ID NO: 604073 - DNA, 20 bp, mouse
gggcggagacgagcaagatg

SEQ ID NO: 604074 - DNA, 20 bp, mouse
ggccatagggagaaaccctc

SEQ ID NO: 604075 - DNA, 20 bp, mouse
gcatatggccggggaggctt

SEQ ID NO: 604076 - DNA, 20 bp, mouse
gcggtagccagtccccaggg

SEQ ID NO: 604077 - DNA, 20 bp, mouse
ggggaggggtacaactctcg

SEQ ID NO: 604078 - DNA, 20 bp, mouse
gaggctgggggtgtcccaga

SEQ ID NO: 604079 - DNA, 20 bp, mouse
gtagcggtaaccctctgtca

SEQ ID NO: 604080 - DNA, 20 bp, mouse
ggcggctgcagccagagtgt

SEQ ID NO: 604081 - DNA, 20 bp, mouse
gggggtacaactctcgtgga

SEQ ID NO: 604082 - DNA, 20 bp, mouse
gcagacggtagccagtcccc

SEQ ID NO: 604083 - DNA, 20 bp, mouse
gagaccccggattctagcaa

SEQ ID NO: 604084 - DNA, 20 bp, mouse
gattctagcaacgggacaca

SEQ ID NO: 604085 - DNA, 20 bp, mouse
gagctgcctcgatcccagag

SEQ ID NO: 604086 - DNA, 20 bp, mouse
gcctggggccgtgggtacag

SEQ ID NO: 604087 - DNA, 20 bp, mouse
gggagaccctcaggcgtcca

SEQ ID NO: 604088 - DNA, 20 bp, mouse
ggggagcactggagaccctc

SEQ ID NO: 604089 - DNA, 20 bp, mouse
gacagaagccctggggccgt

SEQ ID NO: 604090 - DNA, 20 bp, mouse
gtcaggcgtccagggctgga

SEQ ID NO: 604091 - DNA, 20 bp, mouse
gtggtatagtcacagtaggg

SEQ ID NO: 604092 - DNA, 20 bp, mouse
gttccccaggatctatgcag

SEQ ID NO: 604093 - DNA, 20 bp, mouse
gagtcacgttggttgagggg

SEQ ID NO: 604094 - DNA, 20 bp, mouse
gctggcctggaacaccacag

SEQ ID NO: 604095 - DNA, 20 bp, mouse
ggggtggggctgacgagagt

SEQ ID NO: 604096 - DNA, 20 bp, mouse
gcagatcaggactcctataa

SEQ ID NO: 604097 - DNA, 20 bp, mouse
gctgatctgtatataggtgg

SEQ ID NO: 604098 - DNA, 20 bp, mouse
ggtcctgatctgtatatagg

SEQ ID NO: 604099 - DNA, 20 bp, mouse
ggctgctctcctgcccttat

SEQ ID NO: 604100 - DNA, 20 bp, mouse
gttcctcggagaccccggag

SEQ ID NO: 604101 - DNA, 20 bp, mouse
ggtaagtgtggccaaccaca

SEQ ID NO: 604102 - DNA, 20 bp, mouse
gtcaggactcctataagggc

SEQ ID NO: 604103 - DNA, 20 bp, mouse
gagggagttgagtattaaca

SEQ ID NO: 604104 - DNA, 20 bp, mouse
gtgtagtgtcgcagtccctg

SEQ ID NO: 604105 - DNA, 20 bp, mouse
ggtgtcgcagtccctgtggt

SEQ ID NO: 604106 - DNA, 20 bp, mouse
ggagcggtgggactcctcct

SEQ ID NO: 604107 - DNA, 20 bp, mouse
gtacaggtaggcagccggag

SEQ ID NO: 604108 - DNA, 20 bp, mouse
gttcactcagggctctcgag

SEQ ID NO: 604109 - DNA, 20 bp, mouse
gctcccggcgccttcactca

SEQ ID NO: 604110 - DNA, 20 bp, mouse
gctcgcggcacccaccgcca

SEQ ID NO: 604111 - DNA, 20 bp, mouse
gtgctgtgtcagttacaggt

SEQ ID NO: 604112 - DNA, 20 bp, mouse
gggtaggcagccggagcggt

SEQ ID NO: 604113 - DNA, 20 bp, mouse
gcgggaggagcgccagaccg

SEQ ID NO: 604114 - DNA, 20 bp, mouse
gacctcggccagaagcccgc

SEQ ID NO: 604115 - DNA, 20 bp, mouse
gcgcgaacccgagcggacag

SEQ ID NO: 604116 - DNA, 20 bp, mouse
ggtgggaggacgataagcaa

SEQ ID NO: 604117 - DNA, 20 bp, mouse
gtccggccgactaggtctga

SEQ ID NO: 604118 - DNA, 20 bp, mouse
gcctagtcggccggaagaac

SEQ ID NO: 604119 - DNA, 20 bp, mouse
gaaggagtagcgggaggcag

SEQ ID NO: 604120 - DNA, 20 bp, mouse
gggacgataagcaaaggtaa

SEQ ID NO: 604121 - DNA, 20 bp, mouse
gccaggacgtcggctctcag

SEQ ID NO: 604122 - DNA, 20 bp, mouse
gtccctcagacctagtcggc

SEQ ID NO: 604123 - DNA, 20 bp, mouse
gcggctcccagccaggacgt

SEQ ID NO: 604124 - DNA, 20 bp, mouse
gcttgcgcaggcgttctagg

SEQ ID NO: 604125 - DNA, 20 bp, mouse
gtggcaagtgtggagtccct

SEQ ID NO: 604126 - DNA, 20 bp, mouse
gtacaggagcacggactcaa

SEQ ID NO: 604127 - DNA, 20 bp, mouse
gggtccccaagcatcgagga

SEQ ID NO: 604128 - DNA, 20 bp, mouse
gcaacggttgccgcacgtgg

SEQ ID NO: 604129 - DNA, 20 bp, mouse
ggtctgtaggaacccatcag

SEQ ID NO: 604130 - DNA, 20 bp, mouse
gcgctcgaaaccaccacgtg

SEQ ID NO: 604131 - DNA, 20 bp, mouse
gaggatcagctagcaggtgg

SEQ ID NO: 604132 - DNA, 20 bp, mouse
ggagtccgtgctcctgtaag

SEQ ID NO: 604133 - DNA, 20 bp, mouse
gcgaggaaggttcggcagtg

SEQ ID NO: 604134 - DNA, 20 bp, mouse
ggtggtggtttcgagcgcgt

SEQ ID NO: 604135 - DNA, 20 bp, mouse
gtacttgtgaaatccaggag

SEQ ID NO: 604136 - DNA, 20 bp, mouse
ggaggagcaggacatagcag

SEQ ID NO: 604137 - DNA, 20 bp, mouse
gctggttctcctcagacact

SEQ ID NO: 604138 - DNA, 20 bp, mouse
ggaggagaaccaggaacgca

SEQ ID NO: 604139 - DNA, 20 bp, mouse
ggcacgaggaggatacacag

SEQ ID NO: 604140 - DNA, 20 bp, mouse
gggggccccagaaacttcag

SEQ ID NO: 604141 - DNA, 20 bp, mouse
gcagggaactagctatgcca

SEQ ID NO: 604142 - DNA, 20 bp, mouse
gagctagttccctggagcag

SEQ ID NO: 604143 - DNA, 20 bp, mouse
gcccacggccgaggataccc

SEQ ID NO: 604144 - DNA, 20 bp, mouse
ggtctacccggccggaagag

SEQ ID NO: 604145 - DNA, 20 bp, mouse
gggtggtacagcgctcacca

SEQ ID NO: 604146 - DNA, 20 bp, mouse
gactggcacggcctaggggg

SEQ ID NO: 604147 - DNA, 20 bp, mouse
ggcccacgcggagtcagtca

SEQ ID NO: 604148 - DNA, 20 bp, mouse
ggctgggctgagagaatgta

SEQ ID NO: 604149 - DNA, 20 bp, mouse
gttgactggcacggcctagg

SEQ ID NO: 604150 - DNA, 20 bp, mouse
ggccctgactgactccgcgt

SEQ ID NO: 604151 - DNA, 20 bp, mouse
ggacccggcccgcggcggca

SEQ ID NO: 604152 - DNA, 20 bp, mouse
ggccgctctggggtaaccgg

SEQ ID NO: 604153 - DNA, 20 bp, mouse
ggataagcgctccgccccct

SEQ ID NO: 604154 - DNA, 20 bp, mouse
ggccgccggttaccccagag

SEQ ID NO: 604155 - DNA, 20 bp, mouse
gggcgcgcgcggtgcttgac

SEQ ID NO: 604156 - DNA, 20 bp, mouse
gaccgtctgagcctaccctc

SEQ ID NO: 604157 - DNA, 20 bp, mouse
gggaccgcggatctaggcgg

SEQ ID NO: 604158 - DNA, 20 bp, mouse
gccgccaccgaggtagtgat

SEQ ID NO: 604159 - DNA, 20 bp, mouse
gtttggaccgcggatctagg

SEQ ID NO: 604160 - DNA, 20 bp, mouse
gtatcactctgcccgagggt

SEQ ID NO: 604161 - DNA, 20 bp, mouse
ggcgccgcccggcctgacct

SEQ ID NO: 604162 - DNA, 20 bp, mouse
gccgccgccgcctagatccg

SEQ ID NO: 604163 - DNA, 20 bp, mouse
gcggccgccaggcggaggtt

SEQ ID NO: 604164 - DNA, 20 bp, mouse
gtaggtatcactctgcccga

SEQ ID NO: 604165 - DNA, 20 bp, mouse
gaggtttggaccgcggatct

SEQ ID NO: 604166 - DNA, 20 bp, mouse
ggccaaggcgcgagccgcaa

SEQ ID NO: 604167 - DNA, 20 bp, mouse
gcaacgcacggcggggttag

SEQ ID NO: 604168 - DNA, 20 bp, mouse
ggcaagggccgcaaacacac

SEQ ID NO: 604169 - DNA, 20 bp, mouse
gagggcagcagcgggcgcca

SEQ ID NO: 604170 - DNA, 20 bp, mouse
gtggtccacaacgcacggcg

SEQ ID NO: 604171 - DNA, 20 bp, mouse
ggtgcgttgtggaccaacat

SEQ ID NO: 604172 - DNA, 20 bp, mouse
gaggggcgcagggcagcagc

SEQ ID NO: 604173 - DNA, 20 bp, mouse
gcgcagcccccgggccacgg

SEQ ID NO: 604174 - DNA, 20 bp, mouse
gtcctcttccaggcccatgt

SEQ ID NO: 604175 - DNA, 20 bp, mouse
gggcgcagcgagaactggag

SEQ ID NO: 604176 - DNA, 20 bp, mouse
gaaggggtaatagaaagacg

SEQ ID NO: 604177 - DNA, 20 bp, mouse
gagaaagacggggtctggac

SEQ ID NO: 604178 - DNA, 20 bp, mouse
ggagggacttgggcagacat

SEQ ID NO: 604179 - DNA, 20 bp, mouse
gaaaggaccgggatgagaga

SEQ ID NO: 604180 - DNA, 20 bp, mouse
gaccaaatctagaggatcca

SEQ ID NO: 604181 - DNA, 20 bp, mouse
gtgaggaaggtgaaccacaa

SEQ ID NO: 604182 - DNA, 20 bp, mouse
ggtaatagaaagacggggtc

SEQ ID NO: 604183 - DNA, 20 bp, mouse
gaccacaaggtccagagggt

SEQ ID NO: 604184 - DNA, 20 bp, mouse
gtattaccccttgatcgaga

SEQ ID NO: 604185 - DNA, 20 bp, mouse
gtgctttccttctcgatcaa

SEQ ID NO: 604186 - DNA, 20 bp, mouse
gagcaggacgagctgtgagt

SEQ ID NO: 604187 - DNA, 20 bp, mouse
ggtgccaagaccagaccgta

SEQ ID NO: 604188 - DNA, 20 bp, mouse
gaccggccaggcgcagacgt

SEQ ID NO: 604189 - DNA, 20 bp, mouse
ggcttgcccgccctacggtc

SEQ ID NO: 604190 - DNA, 20 bp, mouse
gcgtccgcttgcccgcccta

SEQ ID NO: 604191 - DNA, 20 bp, mouse
gggaaggaggacccccgcag

SEQ ID NO: 604192 - DNA, 20 bp, mouse
gtcagggagctggttctgcg

SEQ ID NO: 604193 - DNA, 20 bp, mouse
gcaagaccagaccgtagggc

SEQ ID NO: 604194 - DNA, 20 bp, mouse
ggaaccagcagcagcgggag

SEQ ID NO: 604195 - DNA, 20 bp, mouse
gtgcaagccggagaaggcaa

SEQ ID NO: 604196 - DNA, 20 bp, mouse
gaccaacctgccgggctata

SEQ ID NO: 604197 - DNA, 20 bp, mouse
gcagctccttatctccgtgg

SEQ ID NO: 604198 - DNA, 20 bp, mouse
gcagaggctaccgagcagag

SEQ ID NO: 604199 - DNA, 20 bp, mouse
gaaactgaacgacagagggg

SEQ ID NO: 604200 - DNA, 20 bp, mouse
ggccttcctccacggagata

SEQ ID NO: 604201 - DNA, 20 bp, mouse
gcctgagggaggggtggtaa

SEQ ID NO: 604202 - DNA, 20 bp, mouse
gcccctccctcaggaatccc

SEQ ID NO: 604203 - DNA, 20 bp, mouse
gtcttcgccaaaatgaatgg

SEQ ID NO: 604204 - DNA, 20 bp, mouse
gtacaagccagggattcctg

SEQ ID NO: 604205 - DNA, 20 bp, mouse
gtgcctgcagagcgctgggt

SEQ ID NO: 604206 - DNA, 20 bp, mouse
gccaggacagctcaaggaaa

SEQ ID NO: 604207 - DNA, 20 bp, mouse
gctgcgcaaatgcgggtgtt

SEQ ID NO: 604208 - DNA, 20 bp, mouse
gcagctggaaccagcatcag

SEQ ID NO: 604209 - DNA, 20 bp, mouse
gctctgggctcacagtaacc

SEQ ID NO: 604210 - DNA, 20 bp, mouse
gcagtaaccaggacagctca

SEQ ID NO: 604211 - DNA, 20 bp, mouse
gaacggtgctgcgcaaatgc

SEQ ID NO: 604212 - DNA, 20 bp, mouse
gggaaggagaaccccctgtg

SEQ ID NO: 604213 - DNA, 20 bp, mouse
ggcaggactagctggcgcgg

SEQ ID NO: 604214 - DNA, 20 bp, mouse
gaaatgcgggtgttgggcac

SEQ ID NO: 604215 - DNA, 20 bp, mouse
gcagcagcagcaggactagc

SEQ ID NO: 604216 - DNA, 20 bp, mouse
gccttggccacaagtattca

SEQ ID NO: 604217 - DNA, 20 bp, mouse
ggtaaagacctcgtacccag

SEQ ID NO: 604218 - DNA, 20 bp, mouse
gtcaatccaagggttcctgg

SEQ ID NO: 604219 - DNA, 20 bp, mouse
gaagctggctgaatgcgtaa

SEQ ID NO: 604220 - DNA, 20 bp, mouse
gtcagccactatcaatccaa

SEQ ID NO: 604221 - DNA, 20 bp, mouse
gggaacccttggattgatag

SEQ ID NO: 604222 - DNA, 20 bp, mouse
gttactgccctgaatacttg

SEQ ID NO: 604223 - DNA, 20 bp, mouse
gatttaccttctcttctcct

SEQ ID NO: 604224 - DNA, 20 bp, mouse
gtcactacatatgtatggag

SEQ ID NO: 604225 - DNA, 20 bp, mouse
gagaaaccaccaggaaccct

SEQ ID NO: 604226 - DNA, 20 bp, mouse
gaggatgggagagatgaacc

SEQ ID NO: 604227 - DNA, 20 bp, mouse
ggatgaacccggtaaagggg

SEQ ID NO: 604228 - DNA, 20 bp, mouse
gagagatgaacccggtaaag

SEQ ID NO: 604229 - DNA, 20 bp, mouse
gtgcttgccacccctttacc

SEQ ID NO: 604230 - DNA, 20 bp, mouse
gtcaaaatggaagaatagga

SEQ ID NO: 604231 - DNA, 20 bp, mouse
gtgcatctgcgtcatcaaaa

SEQ ID NO: 604232 - DNA, 20 bp, mouse
gagacccagggtcggcgtgg

SEQ ID NO: 604233 - DNA, 20 bp, mouse
gatccctccacgccgaccct

SEQ ID NO: 604234 - DNA, 20 bp, mouse
gggtctcccccccccatgca

SEQ ID NO: 604235 - DNA, 20 bp, mouse
gggcatccctgcatgggggg

SEQ ID NO: 604236 - DNA, 20 bp, mouse
gcaggacagagctgctactg

SEQ ID NO: 604237 - DNA, 20 bp, mouse
gttccaggtactttaatagt

SEQ ID NO: 604238 - DNA, 20 bp, mouse
gggaggtagctaaccgagtc

SEQ ID NO: 604239 - DNA, 20 bp, mouse
gcgctggcttaagagatcat

SEQ ID NO: 604240 - DNA, 20 bp, mouse
ggaactgggcctagactata

SEQ ID NO: 604241 - DNA, 20 bp, mouse
gaaagtacctggaagtagct

SEQ ID NO: 604242 - DNA, 20 bp, mouse
gggcttaagagatcataggg

SEQ ID NO: 604243 - DNA, 20 bp, mouse
gcgcccactattaaagtacc

SEQ ID NO: 604244 - DNA, 20 bp, mouse
gaaaggagaactgcgagaga

SEQ ID NO: 604245 - DNA, 20 bp, mouse
ggcagaagtccttatagtct

SEQ ID NO: 604246 - DNA, 20 bp, mouse
gggagttagcccttccgcgg

SEQ ID NO: 604247 - DNA, 20 bp, mouse
ggaccgagcatctccgatgg

SEQ ID NO: 604248 - DNA, 20 bp, mouse
ggccgaggtaacggaaatgg

SEQ ID NO: 604249 - DNA, 20 bp, mouse
gtccgcgggggccgaggtaa

SEQ ID NO: 604250 - DNA, 20 bp, mouse
gggggccgaggtaacggaaa

SEQ ID NO: 604251 - DNA, 20 bp, mouse
gtgctcggtcactgccctag

SEQ ID NO: 604252 - DNA, 20 bp, mouse
gtgaggccgtacagccatgg

SEQ ID NO: 604253 - DNA, 20 bp, mouse
gcggcgcctgcgcttctggg

SEQ ID NO: 604254 - DNA, 20 bp, mouse
gcgccgccatcggagatgct

SEQ ID NO: 604255 - DNA, 20 bp, mouse
gccgggagttagcccttccg

SEQ ID NO: 604256 - DNA, 20 bp, mouse
gtcaagagaccaaacagcgt

SEQ ID NO: 604257 - DNA, 20 bp, mouse
gggcccgggtggaggtcccg

SEQ ID NO: 604258 - DNA, 20 bp, mouse
gcaacgcgcggcccgggtgg

SEQ ID NO: 604259 - DNA, 20 bp, mouse
gttacaacgcgcggcccggg

SEQ ID NO: 604260 - DNA, 20 bp, mouse
gccagcgaggaactgggccc

SEQ ID NO: 604261 - DNA, 20 bp, mouse
gtagttacaacgcgcggccc

SEQ ID NO: 604262 - DNA, 20 bp, mouse
ggggtcaccagcgaggaact

SEQ ID NO: 604263 - DNA, 20 bp, mouse
ggatccagaggggcatgcta

SEQ ID NO: 604264 - DNA, 20 bp, mouse
gagctcgacgtgagacccac

SEQ ID NO: 604265 - DNA, 20 bp, mouse
gcagaggggcatgctaggga

SEQ ID NO: 604266 - DNA, 20 bp, mouse
ggtgagtgtcgggctatggt

SEQ ID NO: 604267 - DNA, 20 bp, mouse
gaggggctgtggcggtacgt

SEQ ID NO: 604268 - DNA, 20 bp, mouse
gggggggcggccctgaatag

SEQ ID NO: 604269 - DNA, 20 bp, mouse
ggctgcggtagctgcgggac

SEQ ID NO: 604270 - DNA, 20 bp, mouse
ggtacgtggggttacggctg

SEQ ID NO: 604271 - DNA, 20 bp, mouse
ggtggcggtacgtggggtta

SEQ ID NO: 604272 - DNA, 20 bp, mouse
ggggactggctagtgagtgt

SEQ ID NO: 604273 - DNA, 20 bp, mouse
ggctagtgagtgtcgggcta

SEQ ID NO: 604274 - DNA, 20 bp, mouse
gttacggctgcggtagctgc

SEQ ID NO: 604275 - DNA, 20 bp, mouse
ggcggcgagggctctctcct

SEQ ID NO: 604276 - DNA, 20 bp, mouse
gcgcccgctcaccatcccgg

SEQ ID NO: 604277 - DNA, 20 bp, mouse
gccagaagcagccgccggga

SEQ ID NO: 604278 - DNA, 20 bp, mouse
gccgcgcccgctcaccatcc

SEQ ID NO: 604279 - DNA, 20 bp, mouse
gcagccgccgggatggtgag

SEQ ID NO: 604280 - DNA, 20 bp, mouse
gatggtgagcgggcgcgggg

SEQ ID NO: 604281 - DNA, 20 bp, mouse
gccagacaggacacttaaca

SEQ ID NO: 604282 - DNA, 20 bp, mouse
ggccaggccgtcttgctcag

SEQ ID NO: 604283 - DNA, 20 bp, mouse
gggctccggggccacgccgg

SEQ ID NO: 604284 - DNA, 20 bp, mouse
gcttacgcagccgaaggtcg

SEQ ID NO: 604285 - DNA, 20 bp, mouse
gcggctgcgtaagattatcg

SEQ ID NO: 604286 - DNA, 20 bp, mouse
ggccgcgccagtgacagcga

SEQ ID NO: 604287 - DNA, 20 bp, mouse
gggagccaggccccacggag

SEQ ID NO: 604288 - DNA, 20 bp, mouse
ggagtcggcgctccaagttg

SEQ ID NO: 604289 - DNA, 20 bp, mouse
gccagtgacagcgatggcgg

SEQ ID NO: 604290 - DNA, 20 bp, mouse
gctggagcttctccacaact

SEQ ID NO: 604291 - DNA, 20 bp, mouse
ggcgaacccggaccccaaga

SEQ ID NO: 604292 - DNA, 20 bp, mouse
ggagcccagttccggcgagg

SEQ ID NO: 604293 - DNA, 20 bp, mouse
gcgcgacgcgagcccagttc

SEQ ID NO: 604294 - DNA, 20 bp, mouse
gccccagcggaggcccggaa

SEQ ID NO: 604295 - DNA, 20 bp, mouse
gtccgccgggccctcacgga

SEQ ID NO: 604296 - DNA, 20 bp, mouse
gtgaactcggctgtctgtaa

SEQ ID NO: 604297 - DNA, 20 bp, mouse
gaggcgagcggttcaacccg

SEQ ID NO: 604298 - DNA, 20 bp, mouse
ggtcggcgggtggatgaact

SEQ ID NO: 604299 - DNA, 20 bp, mouse
gctgtaatggcggagcgtgg

SEQ ID NO: 604300 - DNA, 20 bp, mouse
gtggcggagcgtggcgggga

SEQ ID NO: 604301 - DNA, 20 bp, mouse
ggcttcgatgtgaaggaagg

SEQ ID NO: 604302 - DNA, 20 bp, mouse
gcggagggaacgggagtcgg

SEQ ID NO: 604303 - DNA, 20 bp, mouse
gcacgcttcgatgtgaagga

SEQ ID NO: 604304 - DNA, 20 bp, mouse
gccaattgggaacgccgggt

SEQ ID NO: 604305 - DNA, 20 bp, mouse
gccgggggagctgaggtaaa

SEQ ID NO: 604306 - DNA, 20 bp, mouse
ggccccagcagccccggtgg

SEQ ID NO: 604307 - DNA, 20 bp, mouse
gccaagccggagcagcccgg

SEQ ID NO: 604308 - DNA, 20 bp, mouse
gggcagccgcgggagcaacg

SEQ ID NO: 604309 - DNA, 20 bp, mouse
ggcgccgaggccaacagcac

SEQ ID NO: 604310 - DNA, 20 bp, mouse
gggcagccccaggataggaa

SEQ ID NO: 604311 - DNA, 20 bp, mouse
gccgccgccggcccgcacct

SEQ ID NO: 604312 - DNA, 20 bp, mouse
gggaccatccaaacccaggg

SEQ ID NO: 604313 - DNA, 20 bp, mouse
ggcttcggagcgaactcact

SEQ ID NO: 604314 - DNA, 20 bp, mouse
gaggccaacagcaccggcgg

SEQ ID NO: 604315 - DNA, 20 bp, mouse
gcattcatcggccacgggag

SEQ ID NO: 604316 - DNA, 20 bp, mouse
ggaggcgcggagggatccgg

SEQ ID NO: 604317 - DNA, 20 bp, mouse
gcttgaggcgcggagggatc

SEQ ID NO: 604318 - DNA, 20 bp, mouse
gcgagggagcgagaaagcgg

SEQ ID NO: 604319 - DNA, 20 bp, mouse
gggtgctgaggccgcctcag

SEQ ID NO: 604320 - DNA, 20 bp, mouse
gggagggatccggaggcgag

SEQ ID NO: 604321 - DNA, 20 bp, mouse
gcagcgagggagcgagaaag

SEQ ID NO: 604322 - DNA, 20 bp, mouse
gcccccgcgagtgcttgagt

SEQ ID NO: 604323 - DNA, 20 bp, mouse
gagccgacgcgcttgaggcg

SEQ ID NO: 604324 - DNA, 20 bp, mouse
gccgggcggcaggtaaccgc

SEQ ID NO: 604325 - DNA, 20 bp, mouse
gagcccgcccggggagccac

SEQ ID NO: 604326 - DNA, 20 bp, mouse
gtccccgtcgcggcacttcg

SEQ ID NO: 604327 - DNA, 20 bp, mouse
ggaggcgcggagggatccgg

SEQ ID NO: 604328 - DNA, 20 bp, mouse
gggacaaagcccacggcggg

SEQ ID NO: 604329 - DNA, 20 bp, mouse
gcccagctgcgtccccgtcg

SEQ ID NO: 604330 - DNA, 20 bp, mouse
ggccccgaagtgccgcgacg

SEQ ID NO: 604331 - DNA, 20 bp, mouse
gagcccgcccggggagccac

SEQ ID NO: 604332 - DNA, 20 bp, mouse
gcccccgcgagtgcttgagt

SEQ ID NO: 604333 - DNA, 20 bp, mouse
gggtgctgaggccgcctcag

SEQ ID NO: 604334 - DNA, 20 bp, mouse
gcttgaggcgcggagggatc

SEQ ID NO: 604335 - DNA, 20 bp, mouse
gccggactcgcggaacaatg

SEQ ID NO: 604336 - DNA, 20 bp, mouse
gtcggggacgaggcgagtag

SEQ ID NO: 604337 - DNA, 20 bp, mouse
ggcagcagcgcgaacgccat

SEQ ID NO: 604338 - DNA, 20 bp, mouse
gcgaggcgagtagaggcccg

SEQ ID NO: 604339 - DNA, 20 bp, mouse
gcgaagggctggaggcggca

SEQ ID NO: 604340 - DNA, 20 bp, mouse
gaacggcgcgggccccgtgg

SEQ ID NO: 604341 - DNA, 20 bp, mouse
ggtcgttcggctgctgcgaa

SEQ ID NO: 604342 - DNA, 20 bp, mouse
gcagcacgtgcgcgccgacc

SEQ ID NO: 604343 - DNA, 20 bp, mouse
ggcgagtagaggcccgcggc

SEQ ID NO: 604344 - DNA, 20 bp, mouse
gcgacgaccagcggggccgt

SEQ ID NO: 604345 - DNA, 20 bp, mouse
gcgccatgggcgcccggccg

SEQ ID NO: 604346 - DNA, 20 bp, mouse
ggagcgcgggacgcagggta

SEQ ID NO: 604347 - DNA, 20 bp, mouse
gtcgctcgcggggtaaactg

SEQ ID NO: 604348 - DNA, 20 bp, mouse
ggccttcggggcggcttcct

SEQ ID NO: 604349 - DNA, 20 bp, mouse
ggccaaggaagccgccccga

SEQ ID NO: 604350 - DNA, 20 bp, mouse
gccaagccccgccttcgggg

SEQ ID NO: 604351 - DNA, 20 bp, mouse
gcttggctgtcaaacctcgg

SEQ ID NO: 604352 - DNA, 20 bp, mouse
gttccttggctgtcaaacct

SEQ ID NO: 604353 - DNA, 20 bp, mouse
ggaactgatccgaagagcgg

SEQ ID NO: 604354 - DNA, 20 bp, mouse
gcaaacctcggcgggagcgc

SEQ ID NO: 604355 - DNA, 20 bp, mouse
gtaagtgtaacctggagtca

SEQ ID NO: 604356 - DNA, 20 bp, mouse
gggaaaacaaccccccgcgg

SEQ ID NO: 604357 - DNA, 20 bp, mouse
gaccccccgcggaggcaggg

SEQ ID NO: 604358 - DNA, 20 bp, mouse
ggcaggaaaacaaccccccg

SEQ ID NO: 604359 - DNA, 20 bp, mouse
gcgagaaaccgggaagaaaa

SEQ ID NO: 604360 - DNA, 20 bp, mouse
gacaaccccccgcggaggca

SEQ ID NO: 604361 - DNA, 20 bp, mouse
gctcagagcagtgcccagga

SEQ ID NO: 604362 - DNA, 20 bp, mouse
gctctcgcggccgccctcct

SEQ ID NO: 604363 - DNA, 20 bp, mouse
gtcctccctgcctccgcggg

SEQ ID NO: 604364 - DNA, 20 bp, mouse
gctgccggcctgcatgctgt

SEQ ID NO: 604365 - DNA, 20 bp, mouse
ggggctgtcaaggggtttgg

SEQ ID NO: 604366 - DNA, 20 bp, mouse
gtggtggggagatagagcac

SEQ ID NO: 604367 - DNA, 20 bp, mouse
gcacaagggatcccgcgaca

SEQ ID NO: 604368 - DNA, 20 bp, mouse
gacatcgctgagggagccag

SEQ ID NO: 604369 - DNA, 20 bp, mouse
gactggagtcctggccttaa

SEQ ID NO: 604370 - DNA, 20 bp, mouse
gtcgtggaaaacgatcacaa

SEQ ID NO: 604371 - DNA, 20 bp, mouse
gagaacgggtctccacagaa

SEQ ID NO: 604372 - DNA, 20 bp, mouse
ggctctttcactctccgtta

SEQ ID NO: 604373 - DNA, 20 bp, mouse
gggagagtgaaagagcgccg

SEQ ID NO: 604374 - DNA, 20 bp, mouse
gctccccaccactggagtcc

SEQ ID NO: 604375 - DNA, 20 bp, mouse
gagagcgccgaggaatttgg

SEQ ID NO: 604376 - DNA, 20 bp, mouse
gggctgtaggccctagagca

SEQ ID NO: 604377 - DNA, 20 bp, mouse
gctcgagggaccagagctag

SEQ ID NO: 604378 - DNA, 20 bp, mouse
gtgtcagtgtctgaaggagc

SEQ ID NO: 604379 - DNA, 20 bp, mouse
ggccgctatcatgaagtatg

SEQ ID NO: 604380 - DNA, 20 bp, mouse
ggtgccacctctgaaggaag

SEQ ID NO: 604381 - DNA, 20 bp, mouse
ggagctaggggaacagctca

SEQ ID NO: 604382 - DNA, 20 bp, mouse
gcagcaatgtcagtgtctga

SEQ ID NO: 604383 - DNA, 20 bp, mouse
gtcatgaagtatgaggctgt

SEQ ID NO: 604384 - DNA, 20 bp, mouse
gaacagctcatggcagggta

SEQ ID NO: 604385 - DNA, 20 bp, mouse
gagccacctctgcccctcga

SEQ ID NO: 604386 - DNA, 20 bp, mouse
gcagctgggacgggacccgg

SEQ ID NO: 604387 - DNA, 20 bp, mouse
ggacggggacgcacacgcga

SEQ ID NO: 604388 - DNA, 20 bp, mouse
gctaacccaagggctcgggt

SEQ ID NO: 604389 - DNA, 20 bp, mouse
gtcagcacctggggactcga

SEQ ID NO: 604390 - DNA, 20 bp, mouse
gccaagggcgtcgagcgggt

SEQ ID NO: 604391 - DNA, 20 bp, mouse
gaagccacgtcgggccgaga

SEQ ID NO: 604392 - DNA, 20 bp, mouse
gacggtggtccagctgggac

SEQ ID NO: 604393 - DNA, 20 bp, mouse
gacccgggggtttagtacag

SEQ ID NO: 604394 - DNA, 20 bp, mouse
gccgcccgcccggggaaacg

SEQ ID NO: 604395 - DNA, 20 bp, mouse
gctcgggtgggagaccctct

SEQ ID NO: 604396 - DNA, 20 bp, mouse
gggacccgacagcctgatgt

SEQ ID NO: 604397 - DNA, 20 bp, mouse
gggagggcccggcgcgacat

SEQ ID NO: 604398 - DNA, 20 bp, mouse
gaggaagagcagcagtgtgg

SEQ ID NO: 604399 - DNA, 20 bp, mouse
ggggccctccggagactgag

SEQ ID NO: 604400 - DNA, 20 bp, mouse
gtcgtccctctgcccacatc

SEQ ID NO: 604401 - DNA, 20 bp, mouse
ggcgcggccaggaaccccta

SEQ ID NO: 604402 - DNA, 20 bp, mouse
ggtctggactgcagtcgagt

SEQ ID NO: 604403 - DNA, 20 bp, mouse
gctgcccacatcaggctgtc

SEQ ID NO: 604404 - DNA, 20 bp, mouse
gggaagagggaccaaaaccg

SEQ ID NO: 604405 - DNA, 20 bp, mouse
gaggagctgggcaacctgag

SEQ ID NO: 604406 - DNA, 20 bp, mouse
gctcccgccgcaggaagatg

SEQ ID NO: 604407 - DNA, 20 bp, mouse
ggaagggactgtagcagagg

SEQ ID NO: 604408 - DNA, 20 bp, mouse
ggggactgtagcagaggcgg

SEQ ID NO: 604409 - DNA, 20 bp, mouse
ggaccccggggacaaaaggg

SEQ ID NO: 604410 - DNA, 20 bp, mouse
gccggcggctgcgggcgtag

SEQ ID NO: 604411 - DNA, 20 bp, mouse
gcgggcgtagcgggccaccg

SEQ ID NO: 604412 - DNA, 20 bp, mouse
gagagcaggccccgcgggaa

SEQ ID NO: 604413 - DNA, 20 bp, mouse
ggagaagctcgagagagacc

SEQ ID NO: 604414 - DNA, 20 bp, mouse
gggggaccccggggacaaaa

SEQ ID NO: 604415 - DNA, 20 bp, mouse
ggtccccgagggtcgcgcgt

SEQ ID NO: 604416 - DNA, 20 bp, mouse
gacgcttggcccggccatat

SEQ ID NO: 604417 - DNA, 20 bp, mouse
gtatgggaaaatgcaactga

SEQ ID NO: 604418 - DNA, 20 bp, mouse
gcatggtaccgagaaaggtg

SEQ ID NO: 604419 - DNA, 20 bp, mouse
gacaccatcccgggcatggg

SEQ ID NO: 604420 - DNA, 20 bp, mouse
gagttgttagagtggtactg

SEQ ID NO: 604421 - DNA, 20 bp, mouse
gtcacagggatgagccttct

SEQ ID NO: 604422 - DNA, 20 bp, mouse
gcgggctgcgaggggcattg

SEQ ID NO: 604423 - DNA, 20 bp, mouse
gagcgaactcgggctgcgag

SEQ ID NO: 604424 - DNA, 20 bp, mouse
gctctgggatctactttcag

SEQ ID NO: 604425 - DNA, 20 bp, mouse
ggaaagcggtaagcgaactc

SEQ ID NO: 604426 - DNA, 20 bp, mouse
gctgtgtgtctgcggatcgg

SEQ ID NO: 604427 - DNA, 20 bp, mouse
gtggctgtgtgtctgcggat

SEQ ID NO: 604428 - DNA, 20 bp, mouse
gcctcccgggagaagagagt

SEQ ID NO: 604429 - DNA, 20 bp, mouse
gtgtgtctgcggatcggcgg

SEQ ID NO: 604430 - DNA, 20 bp, mouse
ggcgcgcgggcggtaggtag

SEQ ID NO: 604431 - DNA, 20 bp, mouse
ggcggtggggaagccgaagc

SEQ ID NO: 604432 - DNA, 20 bp, mouse
gaccgcccgcgcgcgacgag

SEQ ID NO: 604433 - DNA, 20 bp, mouse
gccggcgcccgcgcccgctt

SEQ ID NO: 604434 - DNA, 20 bp, mouse
gtgcagcgccggcgcccagg

SEQ ID NO: 604435 - DNA, 20 bp, mouse
ggcggggacagcggggacca

SEQ ID NO: 604436 - DNA, 20 bp, mouse
gcggcgggtcggaacatcaa

SEQ ID NO: 604437 - DNA, 20 bp, mouse
gctccgcctgagcggccagt

SEQ ID NO: 604438 - DNA, 20 bp, mouse
gccgcgcccactggccgctc

SEQ ID NO: 604439 - DNA, 20 bp, mouse
gctcgggacgaggtcctccg

SEQ ID NO: 604440 - DNA, 20 bp, mouse
ggccctcgccccgcgcccac

SEQ ID NO: 604441 - DNA, 20 bp, mouse
gtggaaggccagcagctcgt

SEQ ID NO: 604442 - DNA, 20 bp, mouse
gcgcccactggccgctcagg

SEQ ID NO: 604443 - DNA, 20 bp, mouse
gggttcccaagcaggagggt

SEQ ID NO: 604444 - DNA, 20 bp, mouse
gccccgcccgagtccagctg

SEQ ID NO: 604445 - DNA, 20 bp, mouse
gcagcagctttgggagccgg

SEQ ID NO: 604446 - DNA, 20 bp, mouse
ggcccgggccgagaaggcag

SEQ ID NO: 604447 - DNA, 20 bp, mouse
gtgggacgcccgggccgaga

SEQ ID NO: 604448 - DNA, 20 bp, mouse
ggcggctagttgggagtcct

SEQ ID NO: 604449 - DNA, 20 bp, mouse
ggtcccgcagcacggaacct

SEQ ID NO: 604450 - DNA, 20 bp, mouse
ggccgggccagcgagaggga

SEQ ID NO: 604451 - DNA, 20 bp, mouse
ggccaggcgctgggacgccc

SEQ ID NO: 604452 - DNA, 20 bp, mouse
gagccggggcaagagacact

SEQ ID NO: 604453 - DNA, 20 bp, mouse
gtccgtgctgcgggacgatt

SEQ ID NO: 604454 - DNA, 20 bp, mouse
ggcccagcaccgcccagccg

SEQ ID NO: 604455 - DNA, 20 bp, mouse
ggcggtggcggcggctagtt

SEQ ID NO: 604456 - DNA, 20 bp, mouse
gggatcgaaatccggaggaa

SEQ ID NO: 604457 - DNA, 20 bp, mouse
gaagggggatcgaaatccgg

SEQ ID NO: 604458 - DNA, 20 bp, mouse
gcggaggaacggagtagtct

SEQ ID NO: 604459 - DNA, 20 bp, mouse
ggaacggagtagtctgggag

SEQ ID NO: 604460 - DNA, 20 bp, mouse
gaaatgccgcagctgaacgg

SEQ ID NO: 604461 - DNA, 20 bp, mouse
ggggaagccgaagacaccga

SEQ ID NO: 604462 - DNA, 20 bp, mouse
ggggagcggagattattgac

SEQ ID NO: 604463 - DNA, 20 bp, mouse
gaaaaagggggatcgaaatc

SEQ ID NO: 604464 - DNA, 20 bp, mouse
gaactcggaaaactcctcgg

SEQ ID NO: 604465 - DNA, 20 bp, mouse
gggagggtcggcggagaaag

SEQ ID NO: 604466 - DNA, 20 bp, mouse
gcgcggcgctgggagagccg

SEQ ID NO: 604467 - DNA, 20 bp, mouse
gcccaacggcgcgcccgcgg

SEQ ID NO: 604468 - DNA, 20 bp, mouse
ggggacggcgacgcagacgc

SEQ ID NO: 604469 - DNA, 20 bp, mouse
ggacgacgcgccggccaccg

SEQ ID NO: 604470 - DNA, 20 bp, mouse
ggtggccggcgcgtcgtctg

SEQ ID NO: 604471 - DNA, 20 bp, mouse
ggccggcgcgtcgtctgcgg

SEQ ID NO: 604472 - DNA, 20 bp, mouse
gagcggtttccctcccccaa

SEQ ID NO: 604473 - DNA, 20 bp, mouse
ggcgcggcgcggcccaacgg

SEQ ID NO: 604474 - DNA, 20 bp, mouse
gacagcactgggtacacggg

SEQ ID NO: 604475 - DNA, 20 bp, mouse
gccgtcgcgcccgcctcagg

SEQ ID NO: 604476 - DNA, 20 bp, mouse
gcgacaatgcttcttataag

SEQ ID NO: 604477 - DNA, 20 bp, mouse
gcttgatcaggcatcatcag

SEQ ID NO: 604478 - DNA, 20 bp, mouse
gtccaagttctctctcaagg

SEQ ID NO: 604479 - DNA, 20 bp, mouse
gacctccttgagagagaact

SEQ ID NO: 604480 - DNA, 20 bp, mouse
gtcttgatggcattgttagt

SEQ ID NO: 604481 - DNA, 20 bp, mouse
gaagaaatctataggtgtgg

SEQ ID NO: 604482 - DNA, 20 bp, mouse
gaggtccaactaacttgatc

SEQ ID NO: 604483 - DNA, 20 bp, mouse
gatctccaagttctctctca

SEQ ID NO: 604484 - DNA, 20 bp, mouse
gtatgtgaggtcttacctga

SEQ ID NO: 604485 - DNA, 20 bp, mouse
ggatgcctgatcaagttagt

SEQ ID NO: 604486 - DNA, 20 bp, mouse
gcggaatgtggggcaatgtg

SEQ ID NO: 604487 - DNA, 20 bp, mouse
gcagcagagcccagagatac

SEQ ID NO: 604488 - DNA, 20 bp, mouse
gtgaacgaggtaagtctcat

SEQ ID NO: 604489 - DNA, 20 bp, mouse
gcataggctccagtatctct

SEQ ID NO: 604490 - DNA, 20 bp, mouse
gtgagagcaagcggaatgtg

SEQ ID NO: 604491 - DNA, 20 bp, mouse
gttgctctcactcctgaacg

SEQ ID NO: 604492 - DNA, 20 bp, mouse
gagtcctgccatccaagatg

SEQ ID NO: 604493 - DNA, 20 bp, mouse
gtgactaatgaggtagggtc

SEQ ID NO: 604494 - DNA, 20 bp, mouse
gaaaggtcccagtgcctgca

SEQ ID NO: 604495 - DNA, 20 bp, mouse
gagacttgtggagactgtgc

SEQ ID NO: 604496 - DNA, 20 bp, mouse
gccggcaaccggcgaggaaa

SEQ ID NO: 604497 - DNA, 20 bp, mouse
gcaaccggcgaggaaacggc

SEQ ID NO: 604498 - DNA, 20 bp, mouse
ggtgggcgcctggggaccct

SEQ ID NO: 604499 - DNA, 20 bp, mouse
gtctgtgcagtgggcgcctg

SEQ ID NO: 604500 - DNA, 20 bp, mouse
gacggctggcgtctgtgcag

SEQ ID NO: 604501 - DNA, 20 bp, mouse
gggctgcccggcaaccggcg

SEQ ID NO: 604502 - DNA, 20 bp, mouse
gcacggagtgcatgagtcag

SEQ ID NO: 604503 - DNA, 20 bp, mouse
gaaagtacgcgggaccgctg

SEQ ID NO: 604504 - DNA, 20 bp, mouse
gcccgcgggacaacggagca

SEQ ID NO: 604505 - DNA, 20 bp, mouse
gtggggaccctcggagcgag

SEQ ID NO: 604506 - DNA, 20 bp, mouse
gtttagcaggacactcaccc

SEQ ID NO: 604507 - DNA, 20 bp, mouse
gggaggaagaagcagttggt

SEQ ID NO: 604508 - DNA, 20 bp, mouse
gttgagcgaagagtccacct

SEQ ID NO: 604509 - DNA, 20 bp, mouse
gtggactcttcgctcaactt

SEQ ID NO: 604510 - DNA, 20 bp, mouse
ggctgcactggccggagggc

SEQ ID NO: 604511 - DNA, 20 bp, mouse
gaagaagcagttggtaggca

SEQ ID NO: 604512 - DNA, 20 bp, mouse
gcttcggaggatgaggagag

SEQ ID NO: 604513 - DNA, 20 bp, mouse
gtggacccttgtccaggcgg

SEQ ID NO: 604514 - DNA, 20 bp, mouse
gcaggggcctccatgagctc

SEQ ID NO: 604515 - DNA, 20 bp, mouse
gtcagagccagacgcagcag

SEQ ID NO: 604516 - DNA, 20 bp, mouse
ggctacccagcgggcacaca

SEQ ID NO: 604517 - DNA, 20 bp, mouse
gtgtgcccgctgggtagcca

SEQ ID NO: 604518 - DNA, 20 bp, mouse
ggccatggggctagcaggtg

SEQ ID NO: 604519 - DNA, 20 bp, mouse
gaagcagttttatcacggac

SEQ ID NO: 604520 - DNA, 20 bp, mouse
ggataaaactgcttcctaca

SEQ ID NO: 604521 - DNA, 20 bp, mouse
gtttctcatgctcaccgtgt

SEQ ID NO: 604522 - DNA, 20 bp, mouse
gcacacacaccaggcaacgt

SEQ ID NO: 604523 - DNA, 20 bp, mouse
gatgccctgtctgggtctgg

SEQ ID NO: 604524 - DNA, 20 bp, mouse
gaccaggcaacgtgggagag

SEQ ID NO: 604525 - DNA, 20 bp, mouse
gtggctgcccgtagtcatca

SEQ ID NO: 604526 - DNA, 20 bp, mouse
gtaacggagaccaggtagac

SEQ ID NO: 604527 - DNA, 20 bp, mouse
ggcccagtctaacggagacc

SEQ ID NO: 604528 - DNA, 20 bp, mouse
gtagactggaagtggcccca

SEQ ID NO: 604529 - DNA, 20 bp, mouse
gacctggtctccgttagact

SEQ ID NO: 604530 - DNA, 20 bp, mouse
gagaccaggtagactggaag

SEQ ID NO: 604531 - DNA, 20 bp, mouse
ggggcctgtgaggtctccaa

SEQ ID NO: 604532 - DNA, 20 bp, mouse
gtgcagcttttgatcccctg

SEQ ID NO: 604533 - DNA, 20 bp, mouse
gatgctgagagagctttgtt

SEQ ID NO: 604534 - DNA, 20 bp, mouse
gaacggagttctcaatgcta

SEQ ID NO: 604535 - DNA, 20 bp, mouse
ggctcccttggagacctcac

SEQ ID NO: 604536 - DNA, 20 bp, mouse
gtgtggagatcagaacttgt

SEQ ID NO: 604537 - DNA, 20 bp, mouse
gcttgtgggagtagcctcgg

SEQ ID NO: 604538 - DNA, 20 bp, mouse
ggaacttgtgggagtagcct

SEQ ID NO: 604539 - DNA, 20 bp, mouse
gacacaagggtaagagttgg

SEQ ID NO: 604540 - DNA, 20 bp, mouse
gacaggaccgggcttctatg

SEQ ID NO: 604541 - DNA, 20 bp, mouse
gtgcaggtttttatcctccg

SEQ ID NO: 604542 - DNA, 20 bp, mouse
gtttcagtcattcccctgtc

SEQ ID NO: 604543 - DNA, 20 bp, mouse
ggtgtcagaatagatgatac

SEQ ID NO: 604544 - DNA, 20 bp, mouse
ggaaacatgtccctataccc

SEQ ID NO: 604545 - DNA, 20 bp, mouse
gtcattactatggctgctgc

SEQ ID NO: 604546 - DNA, 20 bp, mouse
gaagaaggcacgcaaccgga

SEQ ID NO: 604547 - DNA, 20 bp, mouse
ggaggtgggaatggcatcca

SEQ ID NO: 604548 - DNA, 20 bp, mouse
gcttaaatgaggttcagaga

SEQ ID NO: 604549 - DNA, 20 bp, mouse
gcacaaaggtaagagttagg

SEQ ID NO: 604550 - DNA, 20 bp, mouse
gagttagggggtaacctgac

SEQ ID NO: 604551 - DNA, 20 bp, mouse
gcgttcaccatatggcagca

SEQ ID NO: 604552 - DNA, 20 bp, mouse
gaaacttctcgttcaccata

SEQ ID NO: 604553 - DNA, 20 bp, mouse
gattattctcactcatcata

SEQ ID NO: 604554 - DNA, 20 bp, mouse
gatgaggttcagagaggggc

SEQ ID NO: 604555 - DNA, 20 bp, mouse
gaactcaccctgctgccata

SEQ ID NO: 604556 - DNA, 20 bp, mouse
gaaggtgggaatggcataca

SEQ ID NO: 604557 - DNA, 20 bp, mouse
gcacacaaaggtaacctgac

SEQ ID NO: 604558 - DNA, 20 bp, mouse
gcagtgggtagctgcaaaag

SEQ ID NO: 604559 - DNA, 20 bp, mouse
gtagaaccttgtctttacct

SEQ ID NO: 604560 - DNA, 20 bp, mouse
gcaggttacctttgtgtgct

SEQ ID NO: 604561 - DNA, 20 bp, mouse
gttacctttgtgtgctaggc

SEQ ID NO: 604562 - DNA, 20 bp, mouse
gatgggcctaggtaaagaca

SEQ ID NO: 604563 - DNA, 20 bp, mouse
gtgcagcaaggtgagtttca

SEQ ID NO: 604564 - DNA, 20 bp, mouse
gccatagtaatgaagctgtc

SEQ ID NO: 604565 - DNA, 20 bp, mouse
gtaccctggagctcgcttgg

SEQ ID NO: 604566 - DNA, 20 bp, mouse
ggcccaggctaacagagacc

SEQ ID NO: 604567 - DNA, 20 bp, mouse
gccactaggtataagagttg

SEQ ID NO: 604568 - DNA, 20 bp, mouse
ggtgcagagccctagtagtg

SEQ ID NO: 604569 - DNA, 20 bp, mouse
gtgtgtctgttgatccccag

SEQ ID NO: 604570 - DNA, 20 bp, mouse
gacacacaccctagcccact

SEQ ID NO: 604571 - DNA, 20 bp, mouse
gatgacagagaactcataac

SEQ ID NO: 604572 - DNA, 20 bp, mouse
gtcttatacctagtgggcta

SEQ ID NO: 604573 - DNA, 20 bp, mouse
gttcagaaaatagctgacac

SEQ ID NO: 604574 - DNA, 20 bp, mouse
ggtgtggatagctgtaaacg

SEQ ID NO: 604575 - DNA, 20 bp, mouse
gataaaccttttctatacct

SEQ ID NO: 604576 - DNA, 20 bp, mouse
ggatagacttgggacagatt

SEQ ID NO: 604577 - DNA, 20 bp, mouse
gcaggactagagtacctacc

SEQ ID NO: 604578 - DNA, 20 bp, mouse
gcctgtgaagtgcacccggt

SEQ ID NO: 604579 - DNA, 20 bp, mouse
gggtcagagctgggaaactg

SEQ ID NO: 604580 - DNA, 20 bp, mouse
ggagcactgtcagatagact

SEQ ID NO: 604581 - DNA, 20 bp, mouse
gtcaaagtaagtactttcca

SEQ ID NO: 604582 - DNA, 20 bp, mouse
ggactctcggggtcagagct

SEQ ID NO: 604583 - DNA, 20 bp, mouse
ggactcctgtgaagtgcacc

SEQ ID NO: 604584 - DNA, 20 bp, mouse
gaactgtggtgatcacgtga

SEQ ID NO: 604585 - DNA, 20 bp, mouse
gtgtgcaagccggggcaggg

SEQ ID NO: 604586 - DNA, 20 bp, mouse
gtgaggaacatgaggttcta

SEQ ID NO: 604587 - DNA, 20 bp, mouse
gaatcccctggccagatctc

SEQ ID NO: 604588 - DNA, 20 bp, mouse
gatgaggttctagggcgcga

SEQ ID NO: 604589 - DNA, 20 bp, mouse
gcgcgcggcgcgggaagtaa

SEQ ID NO: 604590 - DNA, 20 bp, mouse
gcgagggaagcggctagcgg

SEQ ID NO: 604591 - DNA, 20 bp, mouse
gggcgtgcacgtgaatcccc

SEQ ID NO: 604592 - DNA, 20 bp, mouse
ggcgcgagggaagcggctag

SEQ ID NO: 604593 - DNA, 20 bp, mouse
ggccacgtggccagatacta

SEQ ID NO: 604594 - DNA, 20 bp, mouse
gccagcgggagtcagagatg

SEQ ID NO: 604595 - DNA, 20 bp, mouse
gctggccaggtctcccggga

SEQ ID NO: 604596 - DNA, 20 bp, mouse
gccgttaaacggtctcagag

SEQ ID NO: 604597 - DNA, 20 bp, mouse
ggccaccacggcggggacca

SEQ ID NO: 604598 - DNA, 20 bp, mouse
gaacgaagcaaagctcacta

SEQ ID NO: 604599 - DNA, 20 bp, mouse
ggaccgtttaacggccacca

SEQ ID NO: 604600 - DNA, 20 bp, mouse
gcgccgtggtggccgttaaa

SEQ ID NO: 604601 - DNA, 20 bp, mouse
gggtctcagagcggagctat

SEQ ID NO: 604602 - DNA, 20 bp, mouse
gcacggcggggaccacggcg

SEQ ID NO: 604603 - DNA, 20 bp, mouse
gtccgctcccagaatggtaa

SEQ ID NO: 604604 - DNA, 20 bp, mouse
gtgttacccagcaggccccg

SEQ ID NO: 604605 - DNA, 20 bp, mouse
gaagcccagccgcagtccgt

SEQ ID NO: 604606 - DNA, 20 bp, mouse
ggtagcctctgaccggcttg

SEQ ID NO: 604607 - DNA, 20 bp, mouse
gcctcccacaagccggtcag

SEQ ID NO: 604608 - DNA, 20 bp, mouse
gcttaagctagctgtgtagc

SEQ ID NO: 604609 - DNA, 20 bp, mouse
gactggctggggggcacaga

SEQ ID NO: 604610 - DNA, 20 bp, mouse
gagagggagagggtactccc

SEQ ID NO: 604611 - DNA, 20 bp, mouse
gtggggggcacagagggaga

SEQ ID NO: 604612 - DNA, 20 bp, mouse
gcagctagcttaagaacgcc

SEQ ID NO: 604613 - DNA, 20 bp, mouse
ggcttgtgggagggggtgtg

SEQ ID NO: 604614 - DNA, 20 bp, mouse
ggcctagatgaggaatgtcc

SEQ ID NO: 604615 - DNA, 20 bp, mouse
ggcgggcacagagagctgtt

SEQ ID NO: 604616 - DNA, 20 bp, mouse
gcctctacacagctagctta

SEQ ID NO: 604617 - DNA, 20 bp, mouse
ggcagagggagggtactccc

SEQ ID NO: 604618 - DNA, 20 bp, mouse
gaacccactgcaccctcatc

SEQ ID NO: 604619 - DNA, 20 bp, mouse
ggagggcacagagagctgtt

SEQ ID NO: 604620 - DNA, 20 bp, mouse
ggcctagatgaggaatgtcc

SEQ ID NO: 604621 - DNA, 20 bp, mouse
gttgggatatggcctagatg

SEQ ID NO: 604622 - DNA, 20 bp, mouse
ggagtcggtttagaatggac

SEQ ID NO: 604623 - DNA, 20 bp, mouse
gacagagagctgttgggata

SEQ ID NO: 604624 - DNA, 20 bp, mouse
gtggggcccgggccagatga

SEQ ID NO: 604625 - DNA, 20 bp, mouse
gtggtagaagtcaccatctt

SEQ ID NO: 604626 - DNA, 20 bp, mouse
gagagggagagggtactccc

SEQ ID NO: 604627 - DNA, 20 bp, mouse
gttagaatggacaggtttcc

SEQ ID NO: 604628 - DNA, 20 bp, mouse
gcagctagcttaagaacgcc

SEQ ID NO: 604629 - DNA, 20 bp, mouse
gtggggggcgcagagggaga

SEQ ID NO: 604630 - DNA, 20 bp, mouse
ggagggcacagagagctgtt

SEQ ID NO: 604631 - DNA, 20 bp, mouse
ggcctagatgaggaatgtcc

SEQ ID NO: 604632 - DNA, 20 bp, mouse
gcttaagctagctgtgtaga

SEQ ID NO: 604633 - DNA, 20 bp, mouse
gttgggatatggcctagatg

SEQ ID NO: 604634 - DNA, 20 bp, mouse
gacagagagctgttgggata

SEQ ID NO: 604635 - DNA, 20 bp, mouse
gtggtagaagtcaccatctt

SEQ ID NO: 604636 - DNA, 20 bp, mouse
ggagaaggaagtgagctgag

SEQ ID NO: 604637 - DNA, 20 bp, mouse
gccagccagccagagcgggc

SEQ ID NO: 604638 - DNA, 20 bp, mouse
ggcgggcgggccggcagaga

SEQ ID NO: 604639 - DNA, 20 bp, mouse
gactgaggccgcagccccga

SEQ ID NO: 604640 - DNA, 20 bp, mouse
gggagggcggaggtgagcca

SEQ ID NO: 604641 - DNA, 20 bp, mouse
gaggggaggggcgtccgtcg

SEQ ID NO: 604642 - DNA, 20 bp, mouse
ggcccggaaggagcccggcg

SEQ ID NO: 604643 - DNA, 20 bp, mouse
ggggaagaggcatactgaga

SEQ ID NO: 604644 - DNA, 20 bp, mouse
gcccccgcgggattcacggg

SEQ ID NO: 604645 - DNA, 20 bp, mouse
gccaggggcaccgatcgtgt

SEQ ID NO: 604646 - DNA, 20 bp, mouse
gcgacgcggggcacagagga

SEQ ID NO: 604647 - DNA, 20 bp, mouse
gagaggacggcccgcagctc

SEQ ID NO: 604648 - DNA, 20 bp, mouse
gccaccgacgcggggcacag

SEQ ID NO: 604649 - DNA, 20 bp, mouse
gggcgctgcccaccgacgcg

SEQ ID NO: 604650 - DNA, 20 bp, mouse
gagagccaggcgccccggcg

SEQ ID NO: 604651 - DNA, 20 bp, mouse
gcctggctctccccgagctg

SEQ ID NO: 604652 - DNA, 20 bp, mouse
gggacccgaccggctgggag

SEQ ID NO: 604653 - DNA, 20 bp, mouse
gtcgctccggccgcacaggg

SEQ ID NO: 604654 - DNA, 20 bp, mouse
ggaggcgccatgttgaggtt

SEQ ID NO: 604655 - DNA, 20 bp, mouse
ggtcgggtcccgaggatgca

SEQ ID NO: 604656 - DNA, 20 bp, mouse
gcaaccagcgtcgcagacaa

SEQ ID NO: 604657 - DNA, 20 bp, mouse
gctgcgacgctggttgaggg

SEQ ID NO: 604658 - DNA, 20 bp, mouse
gaccgcggcgccagaatcca

SEQ ID NO: 604659 - DNA, 20 bp, mouse
ggatcccgcgtagagactcg

SEQ ID NO: 604660 - DNA, 20 bp, mouse
gggcttgaagtggggcacgg

SEQ ID NO: 604661 - DNA, 20 bp, mouse
ggcgcccagggagtacctct

SEQ ID NO: 604662 - DNA, 20 bp, mouse
ggcggggcctggctgtgtaa

SEQ ID NO: 604663 - DNA, 20 bp, mouse
ggagcgcctgggctgctgta

SEQ ID NO: 604664 - DNA, 20 bp, mouse
ggtctctacgcgggatccgg

SEQ ID NO: 604665 - DNA, 20 bp, mouse
gtagagactcgaggaaagct

SEQ ID NO: 604666 - DNA, 20 bp, mouse
gcttcagcatatcaccttcc

SEQ ID NO: 604667 - DNA, 20 bp, mouse
gaagaaaggcaataccatcc

SEQ ID NO: 604668 - DNA, 20 bp, mouse
gtgtgcctgaaaggtcaatg

SEQ ID NO: 604669 - DNA, 20 bp, mouse
ggaacttttcaaggacacaa

SEQ ID NO: 604670 - DNA, 20 bp, mouse
gctagaaagctctatttcaa

SEQ ID NO: 604671 - DNA, 20 bp, mouse
gcaagtttgattctacactg

SEQ ID NO: 604672 - DNA, 20 bp, mouse
gttctttcccgatgtcataa

SEQ ID NO: 604673 - DNA, 20 bp, mouse
gcaatacacccttatgacat

SEQ ID NO: 604674 - DNA, 20 bp, mouse
gaaacttggaatgtacttgt

SEQ ID NO: 604675 - DNA, 20 bp, mouse
gttaataaagataataatga

SEQ ID NO: 604676 - DNA, 20 bp, mouse
gtgaggatggatggttcagg

SEQ ID NO: 604677 - DNA, 20 bp, mouse
gcagtagaagacggaatcac

SEQ ID NO: 604678 - DNA, 20 bp, mouse
ggaagacggaatcacaggca

SEQ ID NO: 604679 - DNA, 20 bp, mouse
gctcagttcctgaggatgga

SEQ ID NO: 604680 - DNA, 20 bp, mouse
gtcctgaggatggatggttc

SEQ ID NO: 604681 - DNA, 20 bp, mouse
gtctctgtctctcctggaaa

SEQ ID NO: 604682 - DNA, 20 bp, mouse
gtattccacaacagctggag

SEQ ID NO: 604683 - DNA, 20 bp, mouse
gctcaggaactgagaacttc

SEQ ID NO: 604684 - DNA, 20 bp, mouse
gctgagaacttctggaatct

SEQ ID NO: 604685 - DNA, 20 bp, mouse
gacttcctctccagctgttg

SEQ ID NO: 604686 - DNA, 20 bp, mouse
ggatggctggattgccaatt

SEQ ID NO: 604687 - DNA, 20 bp, mouse
gccctgagcaagcttagtga

SEQ ID NO: 604688 - DNA, 20 bp, mouse
gcaatctgcggtaggatttc

SEQ ID NO: 604689 - DNA, 20 bp, mouse
gactataagatgcaggatcc

SEQ ID NO: 604690 - DNA, 20 bp, mouse
gaaacaaagtgtctcagaat

SEQ ID NO: 604691 - DNA, 20 bp, mouse
gtcctgcatcttatagtgcc

SEQ ID NO: 604692 - DNA, 20 bp, mouse
ggagcaagcttagtgagggt

SEQ ID NO: 604693 - DNA, 20 bp, mouse
gcttatagtgccaggcacct

SEQ ID NO: 604694 - DNA, 20 bp, mouse
ggcctggcactataagatgc

SEQ ID NO: 604695 - DNA, 20 bp, mouse
gtccttgacaaaactgggaa

SEQ ID NO: 604696 - DNA, 20 bp, mouse
ggtggggcgctggccagtca

SEQ ID NO: 604697 - DNA, 20 bp, mouse
ggggcgctggccagtcatgg

SEQ ID NO: 604698 - DNA, 20 bp, mouse
gggtgacagtactcccggtg

SEQ ID NO: 604699 - DNA, 20 bp, mouse
gagcgctccgagcaccgtgg

SEQ ID NO: 604700 - DNA, 20 bp, mouse
gactacggtgacagtactcc

SEQ ID NO: 604701 - DNA, 20 bp, mouse
gcccagcgctccgagcaccg

SEQ ID NO: 604702 - DNA, 20 bp, mouse
gcatggcggagccttgggcc

SEQ ID NO: 604703 - DNA, 20 bp, mouse
gcccaaggctccgccatgac

SEQ ID NO: 604704 - DNA, 20 bp, mouse
ggcagaaactgcccggccca

SEQ ID NO: 604705 - DNA, 20 bp, mouse
gtggacacaggagaacccaa

SEQ ID NO: 604706 - DNA, 20 bp, mouse
gaggagggcgccaacgccca

SEQ ID NO: 604707 - DNA, 20 bp, mouse
gagggcgccaacgcccaggg

SEQ ID NO: 604708 - DNA, 20 bp, mouse
gcgccaacgcccagggcgga

SEQ ID NO: 604709 - DNA, 20 bp, mouse
gcccaggagactgctctctg

SEQ ID NO: 604710 - DNA, 20 bp, mouse
ggcgttggcgccctcctcct

SEQ ID NO: 604711 - DNA, 20 bp, mouse
gtaggggcaaccgaggagga

SEQ ID NO: 604712 - DNA, 20 bp, mouse
gcgcgcactaggggcaaccg

SEQ ID NO: 604713 - DNA, 20 bp, mouse
ggcactaggggcaaccgagg

SEQ ID NO: 604714 - DNA, 20 bp, mouse
gagggacgcctgagtcgcca

SEQ ID NO: 604715 - DNA, 20 bp, mouse
gcgcctgagtcgccaggggg

SEQ ID NO: 604716 - DNA, 20 bp, mouse
gacgccatcaaagaaaccgg

SEQ ID NO: 604717 - DNA, 20 bp, mouse
gcggtcacgtggcctcggag

SEQ ID NO: 604718 - DNA, 20 bp, mouse
gggccgcgggccttcccctg

SEQ ID NO: 604719 - DNA, 20 bp, mouse
gtggccagcggggtccctag

SEQ ID NO: 604720 - DNA, 20 bp, mouse
gtccgcctggccacccacgt

SEQ ID NO: 604721 - DNA, 20 bp, mouse
gtggcaggtaagggccggga

SEQ ID NO: 604722 - DNA, 20 bp, mouse
ggccgagatccgcgtcccga

SEQ ID NO: 604723 - DNA, 20 bp, mouse
gggatgcgggtgacacaggt

SEQ ID NO: 604724 - DNA, 20 bp, mouse
gcggccaggtgcagtcctgt

SEQ ID NO: 604725 - DNA, 20 bp, mouse
gagcgcaccggtccccgtcg

SEQ ID NO: 604726 - DNA, 20 bp, mouse
ggtataaactcactagaggt

SEQ ID NO: 604727 - DNA, 20 bp, mouse
gtatggtataaactcactag

SEQ ID NO: 604728 - DNA, 20 bp, mouse
gtactaaaattgcatttgta

SEQ ID NO: 604729 - DNA, 20 bp, mouse
gtacaactacttgataattc

SEQ ID NO: 604730 - DNA, 20 bp, mouse
gccgttgggcagttacacgg

SEQ ID NO: 604731 - DNA, 20 bp, mouse
ggggccgttgggcagttaca

SEQ ID NO: 604732 - DNA, 20 bp, mouse
gtgagccgatcaagatggag

SEQ ID NO: 604733 - DNA, 20 bp, mouse
gcccggtgagccgatcaaga

SEQ ID NO: 604734 - DNA, 20 bp, mouse
ggcagttacacggcggaggg

SEQ ID NO: 604735 - DNA, 20 bp, mouse
gttacacggcggagggcgga

SEQ ID NO: 604736 - DNA, 20 bp, mouse
gacgatagacatctcctgca

SEQ ID NO: 604737 - DNA, 20 bp, mouse
gggaacggaactgatggtca

SEQ ID NO: 604738 - DNA, 20 bp, mouse
gtcaaagccacactgcaatc

SEQ ID NO: 604739 - DNA, 20 bp, mouse
ggggctactgttcatctgag

SEQ ID NO: 604740 - DNA, 20 bp, mouse
ggcagggccagctcttgacg

SEQ ID NO: 604741 - DNA, 20 bp, mouse
gggccagctcttgacgtggt

SEQ ID NO: 604742 - DNA, 20 bp, mouse
gcccatgaacagtcaagccc

SEQ ID NO: 604743 - DNA, 20 bp, mouse
gttgactgttcatgggaggt

SEQ ID NO: 604744 - DNA, 20 bp, mouse
gttgaaaccatgcctccttc

SEQ ID NO: 604745 - DNA, 20 bp, mouse
ggagtaagggtgtttttcga

SEQ ID NO: 604746 - DNA, 20 bp, mouse
ggcaaggaggagcccctgat

SEQ ID NO: 604747 - DNA, 20 bp, mouse
gtacacacagagcccatcag

SEQ ID NO: 604748 - DNA, 20 bp, mouse
gacaagaaacccaagcaagg

SEQ ID NO: 604749 - DNA, 20 bp, mouse
gatctgatctgatccaggtg

SEQ ID NO: 604750 - DNA, 20 bp, mouse
gggaacaagaaacccaagca

SEQ ID NO: 604751 - DNA, 20 bp, mouse
gcaggggctcctccttgctt

SEQ ID NO: 604752 - DNA, 20 bp, mouse
gagacactcacctctctacg

SEQ ID NO: 604753 - DNA, 20 bp, mouse
ggggcaatctgatctgatcc

SEQ ID NO: 604754 - DNA, 20 bp, mouse
ggatttggtggaacttacca

SEQ ID NO: 604755 - DNA, 20 bp, mouse
gtagaggactccattgacaa

SEQ ID NO: 604756 - DNA, 20 bp, mouse
gggagtgagccgataaggac

SEQ ID NO: 604757 - DNA, 20 bp, mouse
gccctcggagtgagccgata

SEQ ID NO: 604758 - DNA, 20 bp, mouse
gtggaccagacgcagggata

SEQ ID NO: 604759 - DNA, 20 bp, mouse
gtccctaaggagacacggag

SEQ ID NO: 604760 - DNA, 20 bp, mouse
gcactccgagggcttgagtg

SEQ ID NO: 604761 - DNA, 20 bp, mouse
gagatctctagaaggaagtg

SEQ ID NO: 604762 - DNA, 20 bp, mouse
ggatctgttggaccagacgc

SEQ ID NO: 604763 - DNA, 20 bp, mouse
gagccgataaggacaggccg

SEQ ID NO: 604764 - DNA, 20 bp, mouse
ggagcttccctaaggagaca

SEQ ID NO: 604765 - DNA, 20 bp, mouse
gatcccggcacaggtcgcta

SEQ ID NO: 604766 - DNA, 20 bp, mouse
gatgcctgcgggagtttcag

SEQ ID NO: 604767 - DNA, 20 bp, mouse
gcagctctctgtagcctcag

SEQ ID NO: 604768 - DNA, 20 bp, mouse
gtggggccagcagagcttgg

SEQ ID NO: 604769 - DNA, 20 bp, mouse
gccagctcagtgaagactgt

SEQ ID NO: 604770 - DNA, 20 bp, mouse
gcaggtgagtcagatgcctg

SEQ ID NO: 604771 - DNA, 20 bp, mouse
gcttcccctgaaactcccgc

SEQ ID NO: 604772 - DNA, 20 bp, mouse
ggctggcctgacaggcctgt

SEQ ID NO: 604773 - DNA, 20 bp, mouse
gcttggaggccaaaggctgc

SEQ ID NO: 604774 - DNA, 20 bp, mouse
gtcccaccgtacacagagca

SEQ ID NO: 604775 - DNA, 20 bp, mouse
gccggctctaagcacctagt

SEQ ID NO: 604776 - DNA, 20 bp, mouse
gtgttgcccgggcaacagac

SEQ ID NO: 604777 - DNA, 20 bp, mouse
gagcagagtagcccgcgccg

SEQ ID NO: 604778 - DNA, 20 bp, mouse
gacagacgggcctagctccc

SEQ ID NO: 604779 - DNA, 20 bp, mouse
ggctactctgctaggccatg

SEQ ID NO: 604780 - DNA, 20 bp, mouse
ggggtcctaggcgacaggga

SEQ ID NO: 604781 - DNA, 20 bp, mouse
gaggaccccgggaactccca

SEQ ID NO: 604782 - DNA, 20 bp, mouse
ggcctagcgctaggtatcac

SEQ ID NO: 604783 - DNA, 20 bp, mouse
ggacagggagggctgcagag

SEQ ID NO: 604784 - DNA, 20 bp, mouse
gccccctgagggtaacgaca

SEQ ID NO: 604785 - DNA, 20 bp, mouse
gcccggggtcctaggcgaca

SEQ ID NO: 604786 - DNA, 20 bp, mouse
gtagcttggcaatatggcgt

SEQ ID NO: 604787 - DNA, 20 bp, mouse
gcaatatggcgtcggctggt

SEQ ID NO: 604788 - DNA, 20 bp, mouse
gcagcaggaggagtccccac

SEQ ID NO: 604789 - DNA, 20 bp, mouse
gggcgtcggctggtcggcga

SEQ ID NO: 604790 - DNA, 20 bp, mouse
gttctcttccaggctattct

SEQ ID NO: 604791 - DNA, 20 bp, mouse
ggcggggacccgggtgtgta

SEQ ID NO: 604792 - DNA, 20 bp, mouse
gtgacagagagcccataccc

SEQ ID NO: 604793 - DNA, 20 bp, mouse
gcaggaggagtccccacagg

SEQ ID NO: 604794 - DNA, 20 bp, mouse
gtccgagcgaccctggtcgg

SEQ ID NO: 604795 - DNA, 20 bp, mouse
gggcccaggctgagggaatc

SEQ ID NO: 604796 - DNA, 20 bp, mouse
gagcggtgcgacaggagcct

SEQ ID NO: 604797 - DNA, 20 bp, mouse
gcagctgcagggtgcacata

SEQ ID NO: 604798 - DNA, 20 bp, mouse
gaggcagcctggccgcagag

SEQ ID NO: 604799 - DNA, 20 bp, mouse
ggatacgtcccaggagccct

SEQ ID NO: 604800 - DNA, 20 bp, mouse
gctcctgtcgcaccgctctg

SEQ ID NO: 604801 - DNA, 20 bp, mouse
gcgggcatcgatagagtcca

SEQ ID NO: 604802 - DNA, 20 bp, mouse
ggacgaatccggaggagctg

SEQ ID NO: 604803 - DNA, 20 bp, mouse
gtacgcgactcttcttccca

SEQ ID NO: 604804 - DNA, 20 bp, mouse
gactggctccaggccccagg

SEQ ID NO: 604805 - DNA, 20 bp, mouse
ggggtgcacataaggcagcc

SEQ ID NO: 604806 - DNA, 20 bp, mouse
gtaaagctcgcgggtacggg

SEQ ID NO: 604807 - DNA, 20 bp, mouse
gtcgcgggtacgggaggcag

SEQ ID NO: 604808 - DNA, 20 bp, mouse
gtcgcggctggggtcggtca

SEQ ID NO: 604809 - DNA, 20 bp, mouse
gaggccgcgcgcaggtaacg

SEQ ID NO: 604810 - DNA, 20 bp, mouse
ggtgatgctggccaggccaa

SEQ ID NO: 604811 - DNA, 20 bp, mouse
gtacagtccacggtgacgga

SEQ ID NO: 604812 - DNA, 20 bp, mouse
gaggcgaagcgggtaccctg

SEQ ID NO: 604813 - DNA, 20 bp, mouse
gggagggtgaagaaccgcgc

SEQ ID NO: 604814 - DNA, 20 bp, mouse
ggacgtgcgcggacctggga

SEQ ID NO: 604815 - DNA, 20 bp, mouse
gcaggtaacgcgggcgctcg

SEQ ID NO: 604816 - DNA, 20 bp, mouse
gtctccgtgtagaccggcag

SEQ ID NO: 604817 - DNA, 20 bp, mouse
gccggtctacacggagatct

SEQ ID NO: 604818 - DNA, 20 bp, mouse
gttgtgattgaggacttcgg

SEQ ID NO: 604819 - DNA, 20 bp, mouse
ggtcaaggttagctcatacc

SEQ ID NO: 604820 - DNA, 20 bp, mouse
gggtttgtgattgaggactt

SEQ ID NO: 604821 - DNA, 20 bp, mouse
gccacagactctccaggacg

SEQ ID NO: 604822 - DNA, 20 bp, mouse
gtccagcaaccaaaaagtca

SEQ ID NO: 604823 - DNA, 20 bp, mouse
gtcaatcacaaaccgtttat

SEQ ID NO: 604824 - DNA, 20 bp, mouse
gagtaggaccctcaggtggg

SEQ ID NO: 604825 - DNA, 20 bp, mouse
gctcccttaaaagaaactta

SEQ ID NO: 604826 - DNA, 20 bp, mouse
gggagccggagcagcacgtg

SEQ ID NO: 604827 - DNA, 20 bp, mouse
ggccacccggggctactcag

SEQ ID NO: 604828 - DNA, 20 bp, mouse
gtgcaggtcagtgtaggaga

SEQ ID NO: 604829 - DNA, 20 bp, mouse
ggactccgcacgtgctgctc

SEQ ID NO: 604830 - DNA, 20 bp, mouse
ggcccctgagtagccccggg

SEQ ID NO: 604831 - DNA, 20 bp, mouse
ggggtcgcgaggggagagat

SEQ ID NO: 604832 - DNA, 20 bp, mouse
gacgtgcggagtcaagagtt

SEQ ID NO: 604833 - DNA, 20 bp, mouse
gggaaagaggtccaattccc

SEQ ID NO: 604834 - DNA, 20 bp, mouse
gtgggcccctgagtagcccc

SEQ ID NO: 604835 - DNA, 20 bp, mouse
ggctgaggttgggaaaccac

SEQ ID NO: 604836 - DNA, 20 bp, mouse
gaagtgtctcaggaccacac

SEQ ID NO: 604837 - DNA, 20 bp, mouse
ggtttgcaggaaacagtgta

SEQ ID NO: 604838 - DNA, 20 bp, mouse
ggacacttcagtactatgag

SEQ ID NO: 604839 - DNA, 20 bp, mouse
gcatagtactgaagtgtctc

SEQ ID NO: 604840 - DNA, 20 bp, mouse
gctgacctagcaaacctgtg

SEQ ID NO: 604841 - DNA, 20 bp, mouse
gggcaagcactaaagtatct

SEQ ID NO: 604842 - DNA, 20 bp, mouse
gagcactaaagtatctggga

SEQ ID NO: 604843 - DNA, 20 bp, mouse
ggcaaaggaggacttatcta

SEQ ID NO: 604844 - DNA, 20 bp, mouse
gagcagctaaagccagcgag

SEQ ID NO: 604845 - DNA, 20 bp, mouse
gcaggaatttgactgtttat

SEQ ID NO: 604846 - DNA, 20 bp, mouse
gcccgagccggcgcccgcag

SEQ ID NO: 604847 - DNA, 20 bp, mouse
ggcggcctggcgggtcaggt

SEQ ID NO: 604848 - DNA, 20 bp, mouse
ggccagagcccgccccgagc

SEQ ID NO: 604849 - DNA, 20 bp, mouse
gggcggcggcctggcgggtc

SEQ ID NO: 604850 - DNA, 20 bp, mouse
ggtgaggaccgcgaggagag

SEQ ID NO: 604851 - DNA, 20 bp, mouse
ggctctgcagcgcgtcccaa

SEQ ID NO: 604852 - DNA, 20 bp, mouse
gctcccgggactcagagcgg

SEQ ID NO: 604853 - DNA, 20 bp, mouse
gcggcgaggccggggtcctt

SEQ ID NO: 604854 - DNA, 20 bp, mouse
ggacacctacctgacccgcc

SEQ ID NO: 604855 - DNA, 20 bp, mouse
ggttaggagcgcagggtccg

SEQ ID NO: 604856 - DNA, 20 bp, mouse
gcgggaagcagcgtgaagag

SEQ ID NO: 604857 - DNA, 20 bp, mouse
gcgtcctgcgggagaacgac

SEQ ID NO: 604858 - DNA, 20 bp, mouse
ggccagacgccatcgccgca

SEQ ID NO: 604859 - DNA, 20 bp, mouse
gtgaggggaccctgcggcga

SEQ ID NO: 604860 - DNA, 20 bp, mouse
ggacgctggggaccatcgtg

SEQ ID NO: 604861 - DNA, 20 bp, mouse
gggaggaccgggtgaagagg

SEQ ID NO: 604862 - DNA, 20 bp, mouse
ggctgccagagaacgaccaa

SEQ ID NO: 604863 - DNA, 20 bp, mouse
gtcggcgcccgaagcagcac

SEQ ID NO: 604864 - DNA, 20 bp, mouse
ggcgcccgaagcagcacagg

SEQ ID NO: 604865 - DNA, 20 bp, mouse
gcccgaagcagcacaggcgg

SEQ ID NO: 604866 - DNA, 20 bp, mouse
gcagaaagcattccacagtg

SEQ ID NO: 604867 - DNA, 20 bp, mouse
gaaaataaagagccccactg

SEQ ID NO: 604868 - DNA, 20 bp, mouse
gttctgacaaatgaacagaa

SEQ ID NO: 604869 - DNA, 20 bp, mouse
gtctgctggaggagtttcgg

SEQ ID NO: 604870 - DNA, 20 bp, mouse
gattttattcaacagaagga

SEQ ID NO: 604871 - DNA, 20 bp, mouse
ggagtttcggaggttaaagt

SEQ ID NO: 604872 - DNA, 20 bp, mouse
gggagaggaggagatctcga

SEQ ID NO: 604873 - DNA, 20 bp, mouse
gtcagaggagaataaggaag

SEQ ID NO: 604874 - DNA, 20 bp, mouse
gttgagggtgtacccaaagg

SEQ ID NO: 604875 - DNA, 20 bp, mouse
gttctcatcagaggagaata

SEQ ID NO: 604876 - DNA, 20 bp, mouse
gccaatacccgtgaagaaat

SEQ ID NO: 604877 - DNA, 20 bp, mouse
gtgatgagagcaagcagaca

SEQ ID NO: 604878 - DNA, 20 bp, mouse
ggagcaagcccatttcttca

SEQ ID NO: 604879 - DNA, 20 bp, mouse
gagaattccagcatctactg

SEQ ID NO: 604880 - DNA, 20 bp, mouse
gggtgttcctcagtagatgc

SEQ ID NO: 604881 - DNA, 20 bp, mouse
gtagagtgggtggggtactt

SEQ ID NO: 604882 - DNA, 20 bp, mouse
gactgtggctgataccacag

SEQ ID NO: 604883 - DNA, 20 bp, mouse
ggatccagttaatccaacaa

SEQ ID NO: 604884 - DNA, 20 bp, mouse
gtccacaaggtttgaagtct

SEQ ID NO: 604885 - DNA, 20 bp, mouse
ggaaccaaatatggtagagt

SEQ ID NO: 604886 - DNA, 20 bp, mouse
gttcttcatcaaacccgttt

SEQ ID NO: 604887 - DNA, 20 bp, mouse
gattcaagctctgcgtatat

SEQ ID NO: 604888 - DNA, 20 bp, mouse
gacatggaagccaagatctg

SEQ ID NO: 604889 - DNA, 20 bp, mouse
gtccttaacactgatctgtg

SEQ ID NO: 604890 - DNA, 20 bp, mouse
gtctgctggaggtactttgg

SEQ ID NO: 604891 - DNA, 20 bp, mouse
gttagaggccaatgaggaag

SEQ ID NO: 604892 - DNA, 20 bp, mouse
gtgtccaggcatgtttaaga

SEQ ID NO: 604893 - DNA, 20 bp, mouse
gtgtgtggagccccagatct

SEQ ID NO: 604894 - DNA, 20 bp, mouse
gggagaggagggaatctcga

SEQ ID NO: 604895 - DNA, 20 bp, mouse
gtgcccaaagagacaagtta

SEQ ID NO: 604896 - DNA, 20 bp, mouse
gcaggtgtcctcttctgtac

SEQ ID NO: 604897 - DNA, 20 bp, mouse
gaaaccaattcatatgggaa

SEQ ID NO: 604898 - DNA, 20 bp, mouse
gacatggaattcaagagctg

SEQ ID NO: 604899 - DNA, 20 bp, mouse
gtcgccagcagaaatggcag

SEQ ID NO: 604900 - DNA, 20 bp, mouse
ggctctggagagcccaattc

SEQ ID NO: 604901 - DNA, 20 bp, mouse
gaaactatcgccagcagaaa

SEQ ID NO: 604902 - DNA, 20 bp, mouse
gttagaggccagtaaggaag

SEQ ID NO: 604903 - DNA, 20 bp, mouse
gggaaaggagaagacctcga

SEQ ID NO: 604904 - DNA, 20 bp, mouse
gttctcattagaggccagta

SEQ ID NO: 604905 - DNA, 20 bp, mouse
gttgaggttgtacccaaatg

SEQ ID NO: 604906 - DNA, 20 bp, mouse
gtgtgtgtcacccctgctct

SEQ ID NO: 604907 - DNA, 20 bp, mouse
gtgaacttttcgaatccaaa

SEQ ID NO: 604908 - DNA, 20 bp, mouse
gaactggaagccaagagcag

SEQ ID NO: 604909 - DNA, 20 bp, mouse
ggaagcagaaataatgtcag

SEQ ID NO: 604910 - DNA, 20 bp, mouse
gtacagccacaccagccctt

SEQ ID NO: 604911 - DNA, 20 bp, mouse
gcttttcgaatccaaagggc

SEQ ID NO: 604912 - DNA, 20 bp, mouse
ggagtacgctcaccttgcag

SEQ ID NO: 604913 - DNA, 20 bp, mouse
gttgagagtatacccaaccg

SEQ ID NO: 604914 - DNA, 20 bp, mouse
gacagaaattgtgctacagg

SEQ ID NO: 604915 - DNA, 20 bp, mouse
gtgtgaaaagggctcagttt

SEQ ID NO: 604916 - DNA, 20 bp, mouse
gacatggaagtcacgaactg

SEQ ID NO: 604917 - DNA, 20 bp, mouse
gctgctatgtgtggactatt

SEQ ID NO: 604918 - DNA, 20 bp, mouse
gggcctctaacgagaagact

SEQ ID NO: 604919 - DNA, 20 bp, mouse
gttgagagcacacccaaatg

SEQ ID NO: 604920 - DNA, 20 bp, mouse
gaccttgcatagatggaatt

SEQ ID NO: 604921 - DNA, 20 bp, mouse
gagagatgaggaaatctcca

SEQ ID NO: 604922 - DNA, 20 bp, mouse
gccgacgtggatgagagatg

SEQ ID NO: 604923 - DNA, 20 bp, mouse
gtctgctggaggtagattgg

SEQ ID NO: 604924 - DNA, 20 bp, mouse
gtctggatcacaacttccca

SEQ ID NO: 604925 - DNA, 20 bp, mouse
gatttctgctggaggtagat

SEQ ID NO: 604926 - DNA, 20 bp, mouse
gtccgaggcgaggtgagcac

SEQ ID NO: 604927 - DNA, 20 bp, mouse
gacccgtgctcacctcgcct

SEQ ID NO: 604928 - DNA, 20 bp, mouse
gcgggccccgcaccacgcgg

SEQ ID NO: 604929 - DNA, 20 bp, mouse
gcggcggctttgagcgtccg

SEQ ID NO: 604930 - DNA, 20 bp, mouse
ggccctaccccgcagctccg

SEQ ID NO: 604931 - DNA, 20 bp, mouse
ggcgcgggccccgcaccacg

SEQ ID NO: 604932 - DNA, 20 bp, mouse
gtgagcacgggtggagctcc

SEQ ID NO: 604933 - DNA, 20 bp, mouse
ggctttgagcgtccgaggcg

SEQ ID NO: 604934 - DNA, 20 bp, mouse
gacctcggagctgcggggta

SEQ ID NO: 604935 - DNA, 20 bp, mouse
gccccgcagctccgaggtcc

SEQ ID NO: 604936 - DNA, 20 bp, mouse
gtaggagtgcgtgcatgcta

SEQ ID NO: 604937 - DNA, 20 bp, mouse
ggcatgctaggggcttacga

SEQ ID NO: 604938 - DNA, 20 bp, mouse
gtggtggtgcagaggctccc

SEQ ID NO: 604939 - DNA, 20 bp, mouse
gacgaaggctggtggtgcag

SEQ ID NO: 604940 - DNA, 20 bp, mouse
gtaatcggaacgcaagccta

SEQ ID NO: 604941 - DNA, 20 bp, mouse
gcgacaaaaagacctggcct

SEQ ID NO: 604942 - DNA, 20 bp, mouse
gaggggcttacgaaggctgg

SEQ ID NO: 604943 - DNA, 20 bp, mouse
ggctaggggcttacgaaggc

SEQ ID NO: 604944 - DNA, 20 bp, mouse
ggtggtgagcgccggccgtt

SEQ ID NO: 604945 - DNA, 20 bp, mouse
gcacgtgcggctgccatctt

SEQ ID NO: 604946 - DNA, 20 bp, mouse
gcagtggcacagtcgaacag

SEQ ID NO: 604947 - DNA, 20 bp, mouse
gcaacccgcctgggacaacg

SEQ ID NO: 604948 - DNA, 20 bp, mouse
ggagcctgaacagctaacca

SEQ ID NO: 604949 - DNA, 20 bp, mouse
gagggcccccgagaggacgg

SEQ ID NO: 604950 - DNA, 20 bp, mouse
gccgcagcgacaccctccag

SEQ ID NO: 604951 - DNA, 20 bp, mouse
ggggtctgaactgagggtgg

SEQ ID NO: 604952 - DNA, 20 bp, mouse
gtcaggctcggggacggcgg

SEQ ID NO: 604953 - DNA, 20 bp, mouse
gagctgttcaggctcgggga

SEQ ID NO: 604954 - DNA, 20 bp, mouse
gcagctccgcgtggcgccgg

SEQ ID NO: 604955 - DNA, 20 bp, mouse
gggcgagcggaacccgcacg

SEQ ID NO: 604956 - DNA, 20 bp, mouse
gtgcgggtgaggccgaggac

SEQ ID NO: 604957 - DNA, 20 bp, mouse
gcaggtggagggtggtccag

SEQ ID NO: 604958 - DNA, 20 bp, mouse
gaccggctccccctctggga

SEQ ID NO: 604959 - DNA, 20 bp, mouse
ggaggaccggctccccctct

SEQ ID NO: 604960 - DNA, 20 bp, mouse
gggtccgggacgctccggga

SEQ ID NO: 604961 - DNA, 20 bp, mouse
ggcgagccgcagccaggtag

SEQ ID NO: 604962 - DNA, 20 bp, mouse
ggtcttcccgcggcttcggg

SEQ ID NO: 604963 - DNA, 20 bp, mouse
gcggcacctgcgtcttcccg

SEQ ID NO: 604964 - DNA, 20 bp, mouse
gttgtagcgccgtcccagag

SEQ ID NO: 604965 - DNA, 20 bp, mouse
gcgaagccgcgggaagacgc

SEQ ID NO: 604966 - DNA, 20 bp, mouse
ggagaggcgatccttcgtcc

SEQ ID NO: 604967 - DNA, 20 bp, mouse
gtccggggcaccgaggcaag

SEQ ID NO: 604968 - DNA, 20 bp, mouse
gtcccaccgggccaggtccg

SEQ ID NO: 604969 - DNA, 20 bp, mouse
gtgagcctgcgaggcactgt

SEQ ID NO: 604970 - DNA, 20 bp, mouse
gccagcgaggccccgggagt

SEQ ID NO: 604971 - DNA, 20 bp, mouse
gtgcagctgtggggactggt

SEQ ID NO: 604972 - DNA, 20 bp, mouse
ggagttctcgaagagaaact

SEQ ID NO: 604973 - DNA, 20 bp, mouse
ggctgcactgggatcacctc

SEQ ID NO: 604974 - DNA, 20 bp, mouse
ggcgccgggcgcctggacga

SEQ ID NO: 604975 - DNA, 20 bp, mouse
gggcctcggggactcgcgac

SEQ ID NO: 604976 - DNA, 20 bp, mouse
gcggagggagccgggcccag

SEQ ID NO: 604977 - DNA, 20 bp, mouse
ggccgccctggcggagggag

SEQ ID NO: 604978 - DNA, 20 bp, mouse
ggtgcggggaaaccgaaagt

SEQ ID NO: 604979 - DNA, 20 bp, mouse
gacgctctggaaccccgcca

SEQ ID NO: 604980 - DNA, 20 bp, mouse
gtccgctccctccgccaggg

SEQ ID NO: 604981 - DNA, 20 bp, mouse
gagccccgcgggccacactg

SEQ ID NO: 604982 - DNA, 20 bp, mouse
gcggctgggtggacgtcccg

SEQ ID NO: 604983 - DNA, 20 bp, mouse
gctgcaccggccggtctcga

SEQ ID NO: 604984 - DNA, 20 bp, mouse
ggacgaggtgagctcggtcg

SEQ ID NO: 604985 - DNA, 20 bp, mouse
ggccgcgggtccccgggacg

SEQ ID NO: 604986 - DNA, 20 bp, mouse
gcattggagtcgggcagttg

SEQ ID NO: 604987 - DNA, 20 bp, mouse
gggcagttgaggcagcgctt

SEQ ID NO: 604988 - DNA, 20 bp, mouse
ggagcagggcagcgctcata

SEQ ID NO: 604989 - DNA, 20 bp, mouse
gcataaggctttgccaccat

SEQ ID NO: 604990 - DNA, 20 bp, mouse
gaggcagcgcttaggcaccg

SEQ ID NO: 604991 - DNA, 20 bp, mouse
gaggatgttgcgcaagctca

SEQ ID NO: 604992 - DNA, 20 bp, mouse
gctttgccaccattggagtc

SEQ ID NO: 604993 - DNA, 20 bp, mouse
ggaggaggtacagcgctcgg

SEQ ID NO: 604994 - DNA, 20 bp, mouse
gtgggccgtaggatcctcat

SEQ ID NO: 604995 - DNA, 20 bp, mouse
gtccgggaggtagggagtcc

SEQ ID NO: 604996 - DNA, 20 bp, mouse
gctgcgctgagggagcgaca

SEQ ID NO: 604997 - DNA, 20 bp, mouse
gtgaaaagcgacccgctagg

SEQ ID NO: 604998 - DNA, 20 bp, mouse
gtgagggagcgacagggcgg

SEQ ID NO: 604999 - DNA, 20 bp, mouse
gggaggcgtgggacacttgg

SEQ ID NO: 605000 - DNA, 20 bp, mouse
ggggagcgacagggcggcgg

SEQ ID NO: 605001 - DNA, 20 bp, mouse
ggcagagcgcgcaactctgg

SEQ ID NO: 605002 - DNA, 20 bp, mouse
gcctcagcgcagccgcctag

SEQ ID NO: 605003 - DNA, 20 bp, mouse
gtgctgaaaagcgacccgct

SEQ ID NO: 605004 - DNA, 20 bp, mouse
ggctaggagtgaggccctcg

SEQ ID NO: 605005 - DNA, 20 bp, mouse
gaactctggaggagcggtaa

SEQ ID NO: 605006 - DNA, 20 bp, mouse
gcggtcgagcaccggagatg

SEQ ID NO: 605007 - DNA, 20 bp, mouse
gggagccaagctgcgcggag

SEQ ID NO: 605008 - DNA, 20 bp, mouse
ggtccagaagcactcgactt

SEQ ID NO: 605009 - DNA, 20 bp, mouse
gagcttggctccgggactga

SEQ ID NO: 605010 - DNA, 20 bp, mouse
ggcgcggagcggtcgagcac

SEQ ID NO: 605011 - DNA, 20 bp, mouse
gtcatcagaggggtcctccg

SEQ ID NO: 605012 - DNA, 20 bp, mouse
gcttgtggcagcagagcgaa

SEQ ID NO: 605013 - DNA, 20 bp, mouse
ggggtgtcctccttcagtcc

SEQ ID NO: 605014 - DNA, 20 bp, mouse
gaggccgagcgcaggtgcat

SEQ ID NO: 605015 - DNA, 20 bp, mouse
ggacagtgcggaggactggg

SEQ ID NO: 605016 - DNA, 20 bp, mouse
ggagtgtgcgaagtgctggg

SEQ ID NO: 605017 - DNA, 20 bp, mouse
ggagcgatgcgaagaatgtg

SEQ ID NO: 605018 - DNA, 20 bp, mouse
gggagtaccgcagggagtac

SEQ ID NO: 605019 - DNA, 20 bp, mouse
ggaatgtgcggaatgaggac

SEQ ID NO: 605020 - DNA, 20 bp, mouse
gccccgcgcgcaacttacca

SEQ ID NO: 605021 - DNA, 20 bp, mouse
gaccggctggagtaacgcgg

SEQ ID NO: 605022 - DNA, 20 bp, mouse
gcctcgccggctcccgggac

SEQ ID NO: 605023 - DNA, 20 bp, mouse
gggcgacgctgcgcgctggg

SEQ ID NO: 605024 - DNA, 20 bp, mouse
ggaccgaactcgctccggag

SEQ ID NO: 605025 - DNA, 20 bp, mouse
ggcgccgggcagccccaacc

SEQ ID NO: 605026 - DNA, 20 bp, mouse
gtacctcccggcctgggcag

SEQ ID NO: 605027 - DNA, 20 bp, mouse
gccgggaggtaggaaggcgc

SEQ ID NO: 605028 - DNA, 20 bp, mouse
ggaaggcgccggcgggaatc

SEQ ID NO: 605029 - DNA, 20 bp, mouse
ggaaggtccaaggggcccta

SEQ ID NO: 605030 - DNA, 20 bp, mouse
ggacctggtagagagaggtt

SEQ ID NO: 605031 - DNA, 20 bp, mouse
ggcaggatcccgattcccgc

SEQ ID NO: 605032 - DNA, 20 bp, mouse
gccggccccggggcagaaaa

SEQ ID NO: 605033 - DNA, 20 bp, mouse
gtgcacgaaggatggcccag

SEQ ID NO: 605034 - DNA, 20 bp, mouse
ggctcccggcaactttctct

SEQ ID NO: 605035 - DNA, 20 bp, mouse
gccagccgcagaccatcccc

SEQ ID NO: 605036 - DNA, 20 bp, mouse
gggcccgagggagtagtgag

SEQ ID NO: 605037 - DNA, 20 bp, mouse
gctcggagcaggtaagcccg

SEQ ID NO: 605038 - DNA, 20 bp, mouse
ggggacccgggacactctag

SEQ ID NO: 605039 - DNA, 20 bp, mouse
gcgggaggtgctgggcgcgg

SEQ ID NO: 605040 - DNA, 20 bp, mouse
ggggggatggccggaatgta

SEQ ID NO: 605041 - DNA, 20 bp, mouse
ggaatgagcccggccggagc

SEQ ID NO: 605042 - DNA, 20 bp, mouse
gaagcccggggaatgcaact

SEQ ID NO: 605043 - DNA, 20 bp, mouse
gtgctcgggtggcttctgga

SEQ ID NO: 605044 - DNA, 20 bp, mouse
gcgggcacccgggacactcc

SEQ ID NO: 605045 - DNA, 20 bp, mouse
ggcgccggagcccaggacct

SEQ ID NO: 605046 - DNA, 20 bp, mouse
gccgggactggagtttgcag

SEQ ID NO: 605047 - DNA, 20 bp, mouse
gtgaggccggtccccacccc

SEQ ID NO: 605048 - DNA, 20 bp, mouse
gggagcccggcaggaatgca

SEQ ID NO: 605049 - DNA, 20 bp, mouse
gcggcaggaatgcacggaat

SEQ ID NO: 605050 - DNA, 20 bp, mouse
gccgaaccctgggaccggta

SEQ ID NO: 605051 - DNA, 20 bp, mouse
gtggagaagagagcccataa

SEQ ID NO: 605052 - DNA, 20 bp, mouse
gtgcgggcggtggagtctag

SEQ ID NO: 605053 - DNA, 20 bp, mouse
gcggtccccacccccgggac

SEQ ID NO: 605054 - DNA, 20 bp, mouse
gggccccgagcgcgtagctg

SEQ ID NO: 605055 - DNA, 20 bp, mouse
ggtaaggctgctgagttcgg

SEQ ID NO: 605056 - DNA, 20 bp, mouse
gccgtcaaggtaagaaccaa

SEQ ID NO: 605057 - DNA, 20 bp, mouse
gctcggcacgcgctccgtca

SEQ ID NO: 605058 - DNA, 20 bp, mouse
ggctctgtcttggcttgtct

SEQ ID NO: 605059 - DNA, 20 bp, mouse
ggggaaggcgcggccatcag

SEQ ID NO: 605060 - DNA, 20 bp, mouse
ggtaagaaccaagggactct

SEQ ID NO: 605061 - DNA, 20 bp, mouse
gtgggccaggaagaagggac

SEQ ID NO: 605062 - DNA, 20 bp, mouse
ggtcagtctcccgcaggtgg

SEQ ID NO: 605063 - DNA, 20 bp, mouse
gctcagatctgcagccaccg

SEQ ID NO: 605064 - DNA, 20 bp, mouse
ggacaggtgcgctcccctga

SEQ ID NO: 605065 - DNA, 20 bp, mouse
gtttggacgtcgctctgtct

SEQ ID NO: 605066 - DNA, 20 bp, mouse
gcggtggggcgggttcccag

SEQ ID NO: 605067 - DNA, 20 bp, mouse
gtggggcgggttcccagcgg

SEQ ID NO: 605068 - DNA, 20 bp, mouse
gcggaggcttctgtactcct

SEQ ID NO: 605069 - DNA, 20 bp, mouse
gccctctagcctgaggccgg

SEQ ID NO: 605070 - DNA, 20 bp, mouse
gcggactgtagctaaaaccg

SEQ ID NO: 605071 - DNA, 20 bp, mouse
gctacagtccggccctcccc

SEQ ID NO: 605072 - DNA, 20 bp, mouse
gcctgtgcccacgcccggtg

SEQ ID NO: 605073 - DNA, 20 bp, mouse
gctagcctgaggccggggga

SEQ ID NO: 605074 - DNA, 20 bp, mouse
gcagttaacgcagccaatgg

SEQ ID NO: 605075 - DNA, 20 bp, mouse
gaactgggacgatcgaggga

SEQ ID NO: 605076 - DNA, 20 bp, mouse
gagccccgccaacccggagg

SEQ ID NO: 605077 - DNA, 20 bp, mouse
gtgccgcgggaggtgagttc

SEQ ID NO: 605078 - DNA, 20 bp, mouse
gcctcccgcggcagcccctc

SEQ ID NO: 605079 - DNA, 20 bp, mouse
ggcggcagagccacaagtgt

SEQ ID NO: 605080 - DNA, 20 bp, mouse
gcccagtaggagttgagtaa

SEQ ID NO: 605081 - DNA, 20 bp, mouse
gcacctcagccccgccaacc

SEQ ID NO: 605082 - DNA, 20 bp, mouse
ggcggggctgaggtgtcctg

SEQ ID NO: 605083 - DNA, 20 bp, mouse
ggctctgccagggggaggaa

SEQ ID NO: 605084 - DNA, 20 bp, mouse
ggtgtgggcgggcccaagga

SEQ ID NO: 605085 - DNA, 20 bp, mouse
gcggccgcgagagggatgca

SEQ ID NO: 605086 - DNA, 20 bp, mouse
gctgctctgctgcaactgag

SEQ ID NO: 605087 - DNA, 20 bp, mouse
gccagctccacacacactcg

SEQ ID NO: 605088 - DNA, 20 bp, mouse
gactcggggagcagcactcc

SEQ ID NO: 605089 - DNA, 20 bp, mouse
gcatccccaaacaacctggg

SEQ ID NO: 605090 - DNA, 20 bp, mouse
gggtgtttggtgcggtacgg

SEQ ID NO: 605091 - DNA, 20 bp, mouse
gcctgcaagaccctaagaaa

SEQ ID NO: 605092 - DNA, 20 bp, mouse
ggcatccttgatggcctgag

SEQ ID NO: 605093 - DNA, 20 bp, mouse
gagcgcctcgggctcaggag

SEQ ID NO: 605094 - DNA, 20 bp, mouse
gatggtctgactctccgcca

SEQ ID NO: 605095 - DNA, 20 bp, mouse
gcaggtgttcaggaggagtg

SEQ ID NO: 605096 - DNA, 20 bp, mouse
gaagtccctggaacgcaaga

SEQ ID NO: 605097 - DNA, 20 bp, mouse
gttcaaaaggcacaagtccc

SEQ ID NO: 605098 - DNA, 20 bp, mouse
ggtgaactagcaggggaatc

SEQ ID NO: 605099 - DNA, 20 bp, mouse
gaattccctcttgcgttcca

SEQ ID NO: 605100 - DNA, 20 bp, mouse
ggggaatctggcatgtaaac

SEQ ID NO: 605101 - DNA, 20 bp, mouse
gaatgaagcaaaagtatata

SEQ ID NO: 605102 - DNA, 20 bp, mouse
gaagagggaattgttattcc

SEQ ID NO: 605103 - DNA, 20 bp, mouse
ggaacattgtgtgaactagc

SEQ ID NO: 605104 - DNA, 20 bp, mouse
gctcgcattattcttcattg

SEQ ID NO: 605105 - DNA, 20 bp, mouse
gcagtgtttaacaggcacaa

SEQ ID NO: 605106 - DNA, 20 bp, mouse
gagtcctgcactagagtcgg

SEQ ID NO: 605107 - DNA, 20 bp, mouse
gttcagggatcagaaataat

SEQ ID NO: 605108 - DNA, 20 bp, mouse
gggattcggacgtgatttca

SEQ ID NO: 605109 - DNA, 20 bp, mouse
gtcaggcctttggaggagca

SEQ ID NO: 605110 - DNA, 20 bp, mouse
gtcatacacagctctagggg

SEQ ID NO: 605111 - DNA, 20 bp, mouse
ggttagtcctgcactagagt

SEQ ID NO: 605112 - DNA, 20 bp, mouse
gttggtgagcccggaaaatt

SEQ ID NO: 605113 - DNA, 20 bp, mouse
gcctgttctgtggagactgg

SEQ ID NO: 605114 - DNA, 20 bp, mouse
ggcatcatacacagctctag

SEQ ID NO: 605115 - DNA, 20 bp, mouse
gcaaaggcctgaagctcgca

SEQ ID NO: 605116 - DNA, 20 bp, mouse
ggatttggggagcttccggg

SEQ ID NO: 605117 - DNA, 20 bp, mouse
gatgtgagtgtcacaggcgg

SEQ ID NO: 605118 - DNA, 20 bp, mouse
gaggatgtgagtgtcacagg

SEQ ID NO: 605119 - DNA, 20 bp, mouse
gctgaggatgtgagtgtcac

SEQ ID NO: 605120 - DNA, 20 bp, mouse
gtcctcagtggtacaagctc

SEQ ID NO: 605121 - DNA, 20 bp, mouse
gatataaggaaataggacag

SEQ ID NO: 605122 - DNA, 20 bp, mouse
ggactctagaggagcgatgg

SEQ ID NO: 605123 - DNA, 20 bp, mouse
ggacagagggatccccatct

SEQ ID NO: 605124 - DNA, 20 bp, mouse
gccaggtggccaaaccaaac

SEQ ID NO: 605125 - DNA, 20 bp, mouse
ggacaggggttagagatttg

SEQ ID NO: 605126 - DNA, 20 bp, mouse
gtacacaggctgcaaggtct

SEQ ID NO: 605127 - DNA, 20 bp, mouse
gttgagctatgagtctaaca

SEQ ID NO: 605128 - DNA, 20 bp, mouse
gtctaacaaggtgtaaaact

SEQ ID NO: 605129 - DNA, 20 bp, mouse
gggtgagcaagaacatgcta

SEQ ID NO: 605130 - DNA, 20 bp, mouse
ggtgtaaaactcggatacac

SEQ ID NO: 605131 - DNA, 20 bp, mouse
gttattggccatatatctcc

SEQ ID NO: 605132 - DNA, 20 bp, mouse
gacgtagacacccaggaccg

SEQ ID NO: 605133 - DNA, 20 bp, mouse
gctcggatacacaggctgca

SEQ ID NO: 605134 - DNA, 20 bp, mouse
ggctggttgaaggttgtgat

SEQ ID NO: 605135 - DNA, 20 bp, mouse
gagaagaccagaaacaagcc

SEQ ID NO: 605136 - DNA, 20 bp, mouse
gaccccgagacgggccggag

SEQ ID NO: 605137 - DNA, 20 bp, mouse
gccgccgcagctgctgacac

SEQ ID NO: 605138 - DNA, 20 bp, mouse
ggaggcgaggcgcacgagtg

SEQ ID NO: 605139 - DNA, 20 bp, mouse
gagccgctccggcccgtctc

SEQ ID NO: 605140 - DNA, 20 bp, mouse
gccccgcccgcaccccgaga

SEQ ID NO: 605141 - DNA, 20 bp, mouse
ggagcccccccccctcaccg

SEQ ID NO: 605142 - DNA, 20 bp, mouse
ggcccgtctcggggtgcggg

SEQ ID NO: 605143 - DNA, 20 bp, mouse
ggccccgcctgaggctccac

SEQ ID NO: 605144 - DNA, 20 bp, mouse
gggaagccgccacttagagg

SEQ ID NO: 605145 - DNA, 20 bp, mouse
gcgggcccgggcatgactag

SEQ ID NO: 605146 - DNA, 20 bp, mouse
gggcaggggccactccaatc

SEQ ID NO: 605147 - DNA, 20 bp, mouse
gaggacctcaggcatgtcca

SEQ ID NO: 605148 - DNA, 20 bp, mouse
gagctgcagccagattggag

SEQ ID NO: 605149 - DNA, 20 bp, mouse
gctcgacatggcccagcagg

SEQ ID NO: 605150 - DNA, 20 bp, mouse
gatctggctgcagctcgaca

SEQ ID NO: 605151 - DNA, 20 bp, mouse
gcagcaggaggtgcttgctc

SEQ ID NO: 605152 - DNA, 20 bp, mouse
gggcagcccaagagttggtg

SEQ ID NO: 605153 - DNA, 20 bp, mouse
gtcaggcatgtccatggcag

SEQ ID NO: 605154 - DNA, 20 bp, mouse
gaccggggcagcccaagagt

SEQ ID NO: 605155 - DNA, 20 bp, mouse
gcaaaagccagcaggcaccg

SEQ ID NO: 605156 - DNA, 20 bp, mouse
gcctacctccggccttgatg

SEQ ID NO: 605157 - DNA, 20 bp, mouse
gtgaggaggaacacaggcgt

SEQ ID NO: 605158 - DNA, 20 bp, mouse
gtgctcaggaaccctacctc

SEQ ID NO: 605159 - DNA, 20 bp, mouse
ggtgggaaagagcctggcga

SEQ ID NO: 605160 - DNA, 20 bp, mouse
ggagcctggcgatggcttgg

SEQ ID NO: 605161 - DNA, 20 bp, mouse
gggccttgatgaggcaagca

SEQ ID NO: 605162 - DNA, 20 bp, mouse
gaaagagcctggcgatggct

SEQ ID NO: 605163 - DNA, 20 bp, mouse
gagggttcctgagcacgagg

SEQ ID NO: 605164 - DNA, 20 bp, mouse
gacgaaaccggaagttgagg

SEQ ID NO: 605165 - DNA, 20 bp, mouse
gagctactccggcccgggaa

SEQ ID NO: 605166 - DNA, 20 bp, mouse
gagcgagtggaccatgcgag

SEQ ID NO: 605167 - DNA, 20 bp, mouse
gcagatgagcatgagtccct

SEQ ID NO: 605168 - DNA, 20 bp, mouse
ggctcttgtttacaagttgg

SEQ ID NO: 605169 - DNA, 20 bp, mouse
gagagaccgtgcaacccagg

SEQ ID NO: 605170 - DNA, 20 bp, mouse
gacttgtaaacaagagcgag

SEQ ID NO: 605171 - DNA, 20 bp, mouse
gcgctggatggggagatctg

SEQ ID NO: 605172 - DNA, 20 bp, mouse
gtagccggcttagttctctg

SEQ ID NO: 605173 - DNA, 20 bp, mouse
gctgttaccgcctgcttctg

SEQ ID NO: 605174 - DNA, 20 bp, mouse
gagttgttgaaagcttccca

SEQ ID NO: 605175 - DNA, 20 bp, mouse
gagcatctgtctacaagaga

SEQ ID NO: 605176 - DNA, 20 bp, mouse
gaagaacacaagcttctgta

SEQ ID NO: 605177 - DNA, 20 bp, mouse
ggccacgctgagacagactc

SEQ ID NO: 605178 - DNA, 20 bp, mouse
gcagactcgggagagaccat

SEQ ID NO: 605179 - DNA, 20 bp, mouse
gccgcgtgggtagggagaag

SEQ ID NO: 605180 - DNA, 20 bp, mouse
ggaaccagccgagaaaactg

SEQ ID NO: 605181 - DNA, 20 bp, mouse
gtcgggagagaccataggag

SEQ ID NO: 605182 - DNA, 20 bp, mouse
ggaaccaggagctctggttg

SEQ ID NO: 605183 - DNA, 20 bp, mouse
gtgaccccaaccagagctcc

SEQ ID NO: 605184 - DNA, 20 bp, mouse
gggctggttctctcagaacc

SEQ ID NO: 605185 - DNA, 20 bp, mouse
ggcccctagggtaaatacta

SEQ ID NO: 605186 - DNA, 20 bp, mouse
gtgggccctgagggcgtgag

SEQ ID NO: 605187 - DNA, 20 bp, mouse
gtgggttaggaggtccgccg

SEQ ID NO: 605188 - DNA, 20 bp, mouse
ggctatctgggtagggaggg

SEQ ID NO: 605189 - DNA, 20 bp, mouse
ggaaaccaggtgaggggatg

SEQ ID NO: 605190 - DNA, 20 bp, mouse
gaacaggagttctcagacct

SEQ ID NO: 605191 - DNA, 20 bp, mouse
ggcgagcagagcagccgcgg

SEQ ID NO: 605192 - DNA, 20 bp, mouse
gttctcagacctgggccctg

SEQ ID NO: 605193 - DNA, 20 bp, mouse
gctcgccgcatcccctcacc

SEQ ID NO: 605194 - DNA, 20 bp, mouse
gtggactgggcgccacaccc

SEQ ID NO: 605195 - DNA, 20 bp, mouse
gccccgcctggtatggagga

SEQ ID NO: 605196 - DNA, 20 bp, mouse
gcgcagccagggtccctagt

SEQ ID NO: 605197 - DNA, 20 bp, mouse
gcagggtccctagtaggaag

SEQ ID NO: 605198 - DNA, 20 bp, mouse
gccctagtaggaagcggatt

SEQ ID NO: 605199 - DNA, 20 bp, mouse
ggaccactcaaccgcagcca

SEQ ID NO: 605200 - DNA, 20 bp, mouse
gcgtccatagcaaccgccta

SEQ ID NO: 605201 - DNA, 20 bp, mouse
gatagcaaccgcctagggca

SEQ ID NO: 605202 - DNA, 20 bp, mouse
ggaccctggctgcggttgag

SEQ ID NO: 605203 - DNA, 20 bp, mouse
gcttccgtggaccacaggat

SEQ ID NO: 605204 - DNA, 20 bp, mouse
gacccaatccgcttcctact

SEQ ID NO: 605205 - DNA, 20 bp, mouse
gagacatcccgcagccctgg

SEQ ID NO: 605206 - DNA, 20 bp, mouse
gagaccgggactactctgag

SEQ ID NO: 605207 - DNA, 20 bp, mouse
gggtcactgggcaattgtcc

SEQ ID NO: 605208 - DNA, 20 bp, mouse
ggcaaccaggaaccttgctt

SEQ ID NO: 605209 - DNA, 20 bp, mouse
gattgtccaggcacgatcaa

SEQ ID NO: 605210 - DNA, 20 bp, mouse
ggcggcagcggcatgagagc

SEQ ID NO: 605211 - DNA, 20 bp, mouse
gcagctggtagccgagactg

SEQ ID NO: 605212 - DNA, 20 bp, mouse
gacgatcaatggagcagtac

SEQ ID NO: 605213 - DNA, 20 bp, mouse
gccagcggtggccagacccg

SEQ ID NO: 605214 - DNA, 20 bp, mouse
gggactactctgagcggcag

SEQ ID NO: 605215 - DNA, 20 bp, mouse
gttggctgtgcggaagccag

SEQ ID NO: 605216 - DNA, 20 bp, mouse
ggtttctgtggccccaagaa

SEQ ID NO: 605217 - DNA, 20 bp, mouse
gttccccggtggggctgatg

SEQ ID NO: 605218 - DNA, 20 bp, mouse
gcagaaactcgctgtctgag

SEQ ID NO: 605219 - DNA, 20 bp, mouse
gtgggatgccctggcccctt

SEQ ID NO: 605220 - DNA, 20 bp, mouse
gcaatccccgaggaatgctc

SEQ ID NO: 605221 - DNA, 20 bp, mouse
gctaagtcacagaggccccg

SEQ ID NO: 605222 - DNA, 20 bp, mouse
gttccccatcagccccaccg

SEQ ID NO: 605223 - DNA, 20 bp, mouse
gtcctcggggattgtctggg

SEQ ID NO: 605224 - DNA, 20 bp, mouse
gccttgggtaaagttttccc

SEQ ID NO: 605225 - DNA, 20 bp, mouse
gacctcccagacaatccccg

SEQ ID NO: 605226 - DNA, 20 bp, mouse
gggagtggttggtccagtcg

SEQ ID NO: 605227 - DNA, 20 bp, mouse
gcagaggaaccctgtaggag

SEQ ID NO: 605228 - DNA, 20 bp, mouse
gggaaccctgtaggagtggt

SEQ ID NO: 605229 - DNA, 20 bp, mouse
gaggacactgcagccccgac

SEQ ID NO: 605230 - DNA, 20 bp, mouse
gctggaccaaccactcctac

SEQ ID NO: 605231 - DNA, 20 bp, mouse
ggtggctagggacgaatcag

SEQ ID NO: 605232 - DNA, 20 bp, mouse
gaacctggagctgcagacgg

SEQ ID NO: 605233 - DNA, 20 bp, mouse
ggggaactggccatgctgca

SEQ ID NO: 605234 - DNA, 20 bp, mouse
gggactgcaccggtgcactg

SEQ ID NO: 605235 - DNA, 20 bp, mouse
gggaaacccggaagaaggac

SEQ ID NO: 605236 - DNA, 20 bp, mouse
gccggtcacgtgaggagtgg

SEQ ID NO: 605237 - DNA, 20 bp, mouse
gcagccggtcacgtgaggag

SEQ ID NO: 605238 - DNA, 20 bp, mouse
ggattcgtccgtccggcggg

SEQ ID NO: 605239 - DNA, 20 bp, mouse
gcggcgggcggtaccagcgt

SEQ ID NO: 605240 - DNA, 20 bp, mouse
gagcaggggattcgtccgtc

SEQ ID NO: 605241 - DNA, 20 bp, mouse
ggctggtaccgcccgccgga

SEQ ID NO: 605242 - DNA, 20 bp, mouse
gaccgccctagcctgaaagg

SEQ ID NO: 605243 - DNA, 20 bp, mouse
gaggggattcgtccgtccgg

SEQ ID NO: 605244 - DNA, 20 bp, mouse
gcttggcgaggagccgctcg

SEQ ID NO: 605245 - DNA, 20 bp, mouse
gtccgggaggaaaagagccc

SEQ ID NO: 605246 - DNA, 20 bp, mouse
gtcctggaagcagcctgccg

SEQ ID NO: 605247 - DNA, 20 bp, mouse
gccgcttcccttgggtggag

SEQ ID NO: 605248 - DNA, 20 bp, mouse
gcaccagctgggcaaaggtg

SEQ ID NO: 605249 - DNA, 20 bp, mouse
ggccgggccaccagcagggt

SEQ ID NO: 605250 - DNA, 20 bp, mouse
gcagggcctgaacaatgctg

SEQ ID NO: 605251 - DNA, 20 bp, mouse
gagcagccgggccaccagca

SEQ ID NO: 605252 - DNA, 20 bp, mouse
gccaagggaagcggctgcct

SEQ ID NO: 605253 - DNA, 20 bp, mouse
gccctgaggtggctagggta

SEQ ID NO: 605254 - DNA, 20 bp, mouse
ggcctcggcaggctgcttcc

SEQ ID NO: 605255 - DNA, 20 bp, mouse
gaggtgcggacaaggcggga

SEQ ID NO: 605256 - DNA, 20 bp, mouse
gttagagtaatattagaata

SEQ ID NO: 605257 - DNA, 20 bp, mouse
gggagaaataagataaattg

SEQ ID NO: 605258 - DNA, 20 bp, mouse
gtggtaagaacacaacagtg

SEQ ID NO: 605259 - DNA, 20 bp, mouse
gcacaacagtgaggcgtcat

SEQ ID NO: 605260 - DNA, 20 bp, mouse
gagtttgattgtgtttggag

SEQ ID NO: 605261 - DNA, 20 bp, mouse
gattgcatttttattttgac

SEQ ID NO: 605262 - DNA, 20 bp, mouse
gtaattgctaaatttctttc

SEQ ID NO: 605263 - DNA, 20 bp, mouse
gtccagctatcaaactaaaa

SEQ ID NO: 605264 - DNA, 20 bp, mouse
gatcaaactaaaatggagat

SEQ ID NO: 605265 - DNA, 20 bp, mouse
gcatacttactttgctgaaa

SEQ ID NO: 605266 - DNA, 20 bp, mouse
ggtttcatgaaaaaaggata

SEQ ID NO: 605267 - DNA, 20 bp, mouse
ggtataaccaagagctgagg

SEQ ID NO: 605268 - DNA, 20 bp, mouse
gcagcttgcttaatcagaga

SEQ ID NO: 605269 - DNA, 20 bp, mouse
gctttggacagaggctgata

SEQ ID NO: 605270 - DNA, 20 bp, mouse
gtctttaatgaaaacagtcc

SEQ ID NO: 605271 - DNA, 20 bp, mouse
gcatgcttgactttggacag

SEQ ID NO: 605272 - DNA, 20 bp, mouse
gttctgatgagagtgaagat

SEQ ID NO: 605273 - DNA, 20 bp, mouse
gccacatgtgcacccagctg

SEQ ID NO: 605274 - DNA, 20 bp, mouse
gggagaaatctactcaaggt

SEQ ID NO: 605275 - DNA, 20 bp, mouse
gtccatttcatgcttgactt

SEQ ID NO: 605276 - DNA, 20 bp, mouse
gtccagagcaggttgcacat

SEQ ID NO: 605277 - DNA, 20 bp, mouse
ggttgcacattggtcctggg

SEQ ID NO: 605278 - DNA, 20 bp, mouse
gcaggttgcacattggtcct

SEQ ID NO: 605279 - DNA, 20 bp, mouse
gacacgcaacgcacacccag

SEQ ID NO: 605280 - DNA, 20 bp, mouse
gtgcgcgtgcaggagccact

SEQ ID NO: 605281 - DNA, 20 bp, mouse
gttcagaaacgattaggagg

SEQ ID NO: 605282 - DNA, 20 bp, mouse
gagctgggaccgaagactct

SEQ ID NO: 605283 - DNA, 20 bp, mouse
gaccaatgtgcaacctgctc

SEQ ID NO: 605284 - DNA, 20 bp, mouse
gtacttcagaaacgattagg

SEQ ID NO: 605285 - DNA, 20 bp, mouse
gcaccgtttggggagtcggg

SEQ ID NO: 605286 - DNA, 20 bp, mouse
gtcttggtcaaggagcagta

SEQ ID NO: 605287 - DNA, 20 bp, mouse
gtcccgtctgctcttggtca

SEQ ID NO: 605288 - DNA, 20 bp, mouse
gtctagggcttgaaaccccg

SEQ ID NO: 605289 - DNA, 20 bp, mouse
gttctctgtgcacatcggtc

SEQ ID NO: 605290 - DNA, 20 bp, mouse
ggaaggaagtatggatgtga

SEQ ID NO: 605291 - DNA, 20 bp, mouse
gttgttctactagagcgggt

SEQ ID NO: 605292 - DNA, 20 bp, mouse
gcgagtatactagacaaggt

SEQ ID NO: 605293 - DNA, 20 bp, mouse
gtatggatgtgaaggaacgc

SEQ ID NO: 605294 - DNA, 20 bp, mouse
gcgcggacaatgaggagtgt

SEQ ID NO: 605295 - DNA, 20 bp, mouse
gatactcgtcggcttctctg

SEQ ID NO: 605296 - DNA, 20 bp, mouse
gtacgtcccaggggtgagta

SEQ ID NO: 605297 - DNA, 20 bp, mouse
gtgcaggaattacgtcccag

SEQ ID NO: 605298 - DNA, 20 bp, mouse
gctcaggagacagggcaccg

SEQ ID NO: 605299 - DNA, 20 bp, mouse
ggcccgtgccctctcaccca

SEQ ID NO: 605300 - DNA, 20 bp, mouse
gttagtggcccggtgtcaag

SEQ ID NO: 605301 - DNA, 20 bp, mouse
gtccctgggtgagagggcac

SEQ ID NO: 605302 - DNA, 20 bp, mouse
gcccagggactgaaacacat

SEQ ID NO: 605303 - DNA, 20 bp, mouse
gggactcctccacttgacac

SEQ ID NO: 605304 - DNA, 20 bp, mouse
ggtggaggagtccagattcg

SEQ ID NO: 605305 - DNA, 20 bp, mouse
gcgcgtccctactcacccct

SEQ ID NO: 605306 - DNA, 20 bp, mouse
gtcaccccttggcctcacta

SEQ ID NO: 605307 - DNA, 20 bp, mouse
gctgcttccaaccagtccac

SEQ ID NO: 605308 - DNA, 20 bp, mouse
gcgcaacggggagcagaaac

SEQ ID NO: 605309 - DNA, 20 bp, mouse
gcctgggtcagccagtggac

SEQ ID NO: 605310 - DNA, 20 bp, mouse
ggccgcccggaaggactaag

SEQ ID NO: 605311 - DNA, 20 bp, mouse
gaggtggggtggccttagtg

SEQ ID NO: 605312 - DNA, 20 bp, mouse
ggcgcgttggttctccgcaa

SEQ ID NO: 605313 - DNA, 20 bp, mouse
gcggggagcagaaaccggcc

SEQ ID NO: 605314 - DNA, 20 bp, mouse
ggactcccggaaggacctct

SEQ ID NO: 605315 - DNA, 20 bp, mouse
gtgcgcaatgagaggcgcgt

SEQ ID NO: 605316 - DNA, 20 bp, mouse
gccacagtggagggtttcag

SEQ ID NO: 605317 - DNA, 20 bp, mouse
gtgtggagagagcccacttt

SEQ ID NO: 605318 - DNA, 20 bp, mouse
gagatctaggttcccaaagt

SEQ ID NO: 605319 - DNA, 20 bp, mouse
gaccccagcctggaccgcta

SEQ ID NO: 605320 - DNA, 20 bp, mouse
ggaggtgacccagaactggc

SEQ ID NO: 605321 - DNA, 20 bp, mouse
ggtgcggtacttgaagccgg

SEQ ID NO: 605322 - DNA, 20 bp, mouse
gacagcgagtcgaaaggcag

SEQ ID NO: 605323 - DNA, 20 bp, mouse
ggcggggtttagttgagggt

SEQ ID NO: 605324 - DNA, 20 bp, mouse
gtttcagtggctacgcggtg

SEQ ID NO: 605325 - DNA, 20 bp, mouse
gcaggggcttctgtccgtag

SEQ ID NO: 605326 - DNA, 20 bp, mouse
gcacggcgccagctgaggca

SEQ ID NO: 605327 - DNA, 20 bp, mouse
ggaaggctcggcacagagac

SEQ ID NO: 605328 - DNA, 20 bp, mouse
ggggacgcgccgagccgtga

SEQ ID NO: 605329 - DNA, 20 bp, mouse
ggagcgctttcggtttaaca

SEQ ID NO: 605330 - DNA, 20 bp, mouse
gcagcgcacggcgccagctg

SEQ ID NO: 605331 - DNA, 20 bp, mouse
gcgctttcggtttaacatgg

SEQ ID NO: 605332 - DNA, 20 bp, mouse
gcgtgagggctggacagatt

SEQ ID NO: 605333 - DNA, 20 bp, mouse
gcggtttaacatggcggaga

SEQ ID NO: 605334 - DNA, 20 bp, mouse
gctgtccagccctcacggct

SEQ ID NO: 605335 - DNA, 20 bp, mouse
ggtcctcggagcggccgtca

SEQ ID NO: 605336 - DNA, 20 bp, mouse
gcggaaccccgtcggtatca

SEQ ID NO: 605337 - DNA, 20 bp, mouse
gcggcgggcgggctcgacgg

SEQ ID NO: 605338 - DNA, 20 bp, mouse
gcgggtcacgcacaacgccc

SEQ ID NO: 605339 - DNA, 20 bp, mouse
ggagcggcggtcgaacacga

SEQ ID NO: 605340 - DNA, 20 bp, mouse
ggcgggagcagcgatagcag

SEQ ID NO: 605341 - DNA, 20 bp, mouse
ggaagcagggcccgctgtcc

SEQ ID NO: 605342 - DNA, 20 bp, mouse
gggcgacacgagccagggtt

SEQ ID NO: 605343 - DNA, 20 bp, mouse
gcgcagccatgataccgacg

SEQ ID NO: 605344 - DNA, 20 bp, mouse
gaacgcccgggccggaagca

SEQ ID NO: 605345 - DNA, 20 bp, mouse
ggctgcgggagccgggacag

SEQ ID NO: 605346 - DNA, 20 bp, mouse
gtacagcggggcgacaggta

SEQ ID NO: 605347 - DNA, 20 bp, mouse
gagcggggcgacaggtatgg

SEQ ID NO: 605348 - DNA, 20 bp, mouse
gggcggagagtccgtcttag

SEQ ID NO: 605349 - DNA, 20 bp, mouse
gtggcggaggcgatggatct

SEQ ID NO: 605350 - DNA, 20 bp, mouse
gtctctcacgaacagagtgg

SEQ ID NO: 605351 - DNA, 20 bp, mouse
gggttcctgcacccgacaca

SEQ ID NO: 605352 - DNA, 20 bp, mouse
gacttgtacagcggggcgac

SEQ ID NO: 605353 - DNA, 20 bp, mouse
gaggcgatgcgcccggtcag

SEQ ID NO: 605354 - DNA, 20 bp, mouse
gcggcggcggcaccgtgtgt

SEQ ID NO: 605355 - DNA, 20 bp, mouse
ggcttccaccgagggctcca

SEQ ID NO: 605356 - DNA, 20 bp, mouse
ggtccacgacgaaaaagatg

SEQ ID NO: 605357 - DNA, 20 bp, mouse
gtgcgggaaccaagatgcaa

SEQ ID NO: 605358 - DNA, 20 bp, mouse
gctctcagtggcctgggtcc

SEQ ID NO: 605359 - DNA, 20 bp, mouse
gtttcgtcgtggactctcag

SEQ ID NO: 605360 - DNA, 20 bp, mouse
gaggctgggaacggaggaag

SEQ ID NO: 605361 - DNA, 20 bp, mouse
gggccccaggcgccgcacaa

SEQ ID NO: 605362 - DNA, 20 bp, mouse
gacctggtggaaggaaaggt

SEQ ID NO: 605363 - DNA, 20 bp, mouse
gctgcgcagccgataccggg

SEQ ID NO: 605364 - DNA, 20 bp, mouse
ggcattgggcaaccaaagtg

SEQ ID NO: 605365 - DNA, 20 bp, mouse
gaggcggcttgtgcaacccg

SEQ ID NO: 605366 - DNA, 20 bp, mouse
gtgccgctgctactcagcat

SEQ ID NO: 605367 - DNA, 20 bp, mouse
ggaacttccgcagcccggtt

SEQ ID NO: 605368 - DNA, 20 bp, mouse
gatctccgctgcgggaactc

SEQ ID NO: 605369 - DNA, 20 bp, mouse
gccgctgccgaaccgggctg

SEQ ID NO: 605370 - DNA, 20 bp, mouse
gtccatactgggcgtcggag

SEQ ID NO: 605371 - DNA, 20 bp, mouse
gtcccagccgctgccgaacc

SEQ ID NO: 605372 - DNA, 20 bp, mouse
ggttcccgcagcggagatcg

SEQ ID NO: 605373 - DNA, 20 bp, mouse
ggcgtccgcgatctccgctg

SEQ ID NO: 605374 - DNA, 20 bp, mouse
ggctgggacctggaacaaag

SEQ ID NO: 605375 - DNA, 20 bp, mouse
gcgcagcgacagtcacccaa

SEQ ID NO: 605376 - DNA, 20 bp, mouse
ggcgcagcccaggcagtccc

SEQ ID NO: 605377 - DNA, 20 bp, mouse
gaggccgctcgagccccacg

SEQ ID NO: 605378 - DNA, 20 bp, mouse
gggtggggacgcggggacag

SEQ ID NO: 605379 - DNA, 20 bp, mouse
gcgctgcgttggagccgggt

SEQ ID NO: 605380 - DNA, 20 bp, mouse
gcgtggccgggaaccctcgt

SEQ ID NO: 605381 - DNA, 20 bp, mouse
gggccccgggcgccccacgc

SEQ ID NO: 605382 - DNA, 20 bp, mouse
gacctcctcggacgccgagt

SEQ ID NO: 605383 - DNA, 20 bp, mouse
gctcgagcggcctcttatag

SEQ ID NO: 605384 - DNA, 20 bp, mouse
ggcacggtggcgcgaagcgg

SEQ ID NO: 605385 - DNA, 20 bp, mouse
gtgcctgggctgcgctgcgt

SEQ ID NO: 605386 - DNA, 20 bp, mouse
gcgagcacacggggcaccat

SEQ ID NO: 605387 - DNA, 20 bp, mouse
gtcctccttggacgaaaggg

SEQ ID NO: 605388 - DNA, 20 bp, mouse
gcctcaggcgctcagtggaa

SEQ ID NO: 605389 - DNA, 20 bp, mouse
ggacgaaagggaggcgccca

SEQ ID NO: 605390 - DNA, 20 bp, mouse
gcactcctccttggacgaaa

SEQ ID NO: 605391 - DNA, 20 bp, mouse
gcagcaaggtgagaccgacc

SEQ ID NO: 605392 - DNA, 20 bp, mouse
gaggtcgttccgagcacacg

SEQ ID NO: 605393 - DNA, 20 bp, mouse
gaacgacctcaggcgctcag

SEQ ID NO: 605394 - DNA, 20 bp, mouse
gagcaggaccgacttatggt

SEQ ID NO: 605395 - DNA, 20 bp, mouse
ggcctccctttcgtccaagg

SEQ ID NO: 605396 - DNA, 20 bp, mouse
gggtgcagaggcctctacag

SEQ ID NO: 605397 - DNA, 20 bp, mouse
gctacagcggttgggatcct

SEQ ID NO: 605398 - DNA, 20 bp, mouse
gcccctcagtccagaggagg

SEQ ID NO: 605399 - DNA, 20 bp, mouse
gaccgggcgtgcgcactccg

SEQ ID NO: 605400 - DNA, 20 bp, mouse
gagaggcctctacagcggtt

SEQ ID NO: 605401 - DNA, 20 bp, mouse
ggagtgcgcacgcccggtct

SEQ ID NO: 605402 - DNA, 20 bp, mouse
ggagggggtgcagcactgag

SEQ ID NO: 605403 - DNA, 20 bp, mouse
ggagacctggcagagtgact

SEQ ID NO: 605404 - DNA, 20 bp, mouse
gccttgaggggaggagtccg

SEQ ID NO: 605405 - DNA, 20 bp, mouse
ggaaagccacgtcccgagac

SEQ ID NO: 605406 - DNA, 20 bp, mouse
ggccggccagagggtaaggg

SEQ ID NO: 605407 - DNA, 20 bp, mouse
gcctccgggccccgccgagt

SEQ ID NO: 605408 - DNA, 20 bp, mouse
gagctcagaccgcaaggcca

SEQ ID NO: 605409 - DNA, 20 bp, mouse
ggaggaggtgagggtccctt

SEQ ID NO: 605410 - DNA, 20 bp, mouse
gtgcgccggccagagggtaa

SEQ ID NO: 605411 - DNA, 20 bp, mouse
ggctgccttctcagtcccag

SEQ ID NO: 605412 - DNA, 20 bp, mouse
gccggaggcggatcaccgct

SEQ ID NO: 605413 - DNA, 20 bp, mouse
gagtgtctgaaacgcctggg

SEQ ID NO: 605414 - DNA, 20 bp, mouse
gcgtttcagacactcaccgg

SEQ ID NO: 605415 - DNA, 20 bp, mouse
gctttcccccgcctactcgg

SEQ ID NO: 605416 - DNA, 20 bp, mouse
gggagtggtgctagagatga

SEQ ID NO: 605417 - DNA, 20 bp, mouse
gaggctgtagagttaaggtc

SEQ ID NO: 605418 - DNA, 20 bp, mouse
gtaagaaagttctcgaaaca

SEQ ID NO: 605419 - DNA, 20 bp, mouse
gtgatgaggctgtagagtta

SEQ ID NO: 605420 - DNA, 20 bp, mouse
gccaagttaagagatttatc

SEQ ID NO: 605421 - DNA, 20 bp, mouse
gtcgagaactttcttacctc

SEQ ID NO: 605422 - DNA, 20 bp, mouse
ggggtcaggggggaaaaatc

SEQ ID NO: 605423 - DNA, 20 bp, mouse
gaccccagaacaataacatc

SEQ ID NO: 605424 - DNA, 20 bp, mouse
gagttatagagaaaaggata

SEQ ID NO: 605425 - DNA, 20 bp, mouse
gtggtaagtgtagttttctt

SEQ ID NO: 605426 - DNA, 20 bp, mouse
gtaggctgcgaagatcactt

SEQ ID NO: 605427 - DNA, 20 bp, mouse
gaagagtgcagccaatggca

SEQ ID NO: 605428 - DNA, 20 bp, mouse
gggcaagatggctacctcgt

SEQ ID NO: 605429 - DNA, 20 bp, mouse
gctagcactatcccagacaa

SEQ ID NO: 605430 - DNA, 20 bp, mouse
gcttcacggcgaagcccacg

SEQ ID NO: 605431 - DNA, 20 bp, mouse
gggtgagagcccagcctcac

SEQ ID NO: 605432 - DNA, 20 bp, mouse
gcattggctgcactctttgt

SEQ ID NO: 605433 - DNA, 20 bp, mouse
gtcacaggagatcctttgtc

SEQ ID NO: 605434 - DNA, 20 bp, mouse
gccagcactgtagacgtgct

SEQ ID NO: 605435 - DNA, 20 bp, mouse
gaaggatctcctgtgaggct

SEQ ID NO: 605436 - DNA, 20 bp, mouse
gggagacccggctgcgacgg

SEQ ID NO: 605437 - DNA, 20 bp, mouse
gaaaggagacccggctgcga

SEQ ID NO: 605438 - DNA, 20 bp, mouse
gctttctaacaaatcctaca

SEQ ID NO: 605439 - DNA, 20 bp, mouse
gatttgttagaaaggagacc

SEQ ID NO: 605440 - DNA, 20 bp, mouse
gtgcaggtcgcaggagaagg

SEQ ID NO: 605441 - DNA, 20 bp, mouse
ggcgacggcggtggactgcg

SEQ ID NO: 605442 - DNA, 20 bp, mouse
gcggctggtgggaggtacaa

SEQ ID NO: 605443 - DNA, 20 bp, mouse
ggcggtggactgcgaggctg

SEQ ID NO: 605444 - DNA, 20 bp, mouse
ggcaaggccgagagaaagag

SEQ ID NO: 605445 - DNA, 20 bp, mouse
gggcgaggctgctttcgtag

SEQ ID NO: 605446 - DNA, 20 bp, mouse
gcgagggagcgcaccgaggg

SEQ ID NO: 605447 - DNA, 20 bp, mouse
gaccgagggaggcactgcag

SEQ ID NO: 605448 - DNA, 20 bp, mouse
gctccctcggcggggataat

SEQ ID NO: 605449 - DNA, 20 bp, mouse
ggcggcggccgatgcagtag

SEQ ID NO: 605450 - DNA, 20 bp, mouse
ggcctctgcagtgcctccct

SEQ ID NO: 605451 - DNA, 20 bp, mouse
gcctcggcggggataatggg

SEQ ID NO: 605452 - DNA, 20 bp, mouse
ggcggccgatgcagtagtgg

SEQ ID NO: 605453 - DNA, 20 bp, mouse
gccgccgagggagcgcaccg

SEQ ID NO: 605454 - DNA, 20 bp, mouse
gggaagggcccggagaagaa

SEQ ID NO: 605455 - DNA, 20 bp, mouse
gataatgggaggcccggcgg

SEQ ID NO: 605456 - DNA, 20 bp, mouse
gaaggagacgcgtccgcgtg

SEQ ID NO: 605457 - DNA, 20 bp, mouse
gacgcgtccgcgtgaggacg

SEQ ID NO: 605458 - DNA, 20 bp, mouse
ggagggcccccacttccggg

SEQ ID NO: 605459 - DNA, 20 bp, mouse
gaacacgctctgggagcgag

SEQ ID NO: 605460 - DNA, 20 bp, mouse
ggtcctgcacggctcttctg

SEQ ID NO: 605461 - DNA, 20 bp, mouse
gggagcacgccgtgaaccgc

SEQ ID NO: 605462 - DNA, 20 bp, mouse
gcggacacgcgaggcccagg

SEQ ID NO: 605463 - DNA, 20 bp, mouse
gaaatcgcctcgtcctcacg

SEQ ID NO: 605464 - DNA, 20 bp, mouse
gcacgcgaggcccaggcgga

SEQ ID NO: 605465 - DNA, 20 bp, mouse
gttccgccgcccggaagtgg

SEQ ID NO: 605466 - DNA, 20 bp, mouse
ggctaggggccgggactcca

SEQ ID NO: 605467 - DNA, 20 bp, mouse
gaccggtcgccatcgaagct

SEQ ID NO: 605468 - DNA, 20 bp, mouse
ggccatcgaagctgggtgca

SEQ ID NO: 605469 - DNA, 20 bp, mouse
gtccgtgcacccagcttcga

SEQ ID NO: 605470 - DNA, 20 bp, mouse
gtccagggtcgaaggaagaa

SEQ ID NO: 605471 - DNA, 20 bp, mouse
gggaacactgcacacggtac

SEQ ID NO: 605472 - DNA, 20 bp, mouse
gtcagaccgaggggtccctc

SEQ ID NO: 605473 - DNA, 20 bp, mouse
gcatgggcgggactcctgag

SEQ ID NO: 605474 - DNA, 20 bp, mouse
gcggctccaggaggcacgga

SEQ ID NO: 605475 - DNA, 20 bp, mouse
gacccagcttcgatggcgac

SEQ ID NO: 605476 - DNA, 20 bp, mouse
gggcttcgggccaccagaga

SEQ ID NO: 605477 - DNA, 20 bp, mouse
gagaaagttgttaaacaggg

SEQ ID NO: 605478 - DNA, 20 bp, mouse
gcagcaagcgtttcgggtgt

SEQ ID NO: 605479 - DNA, 20 bp, mouse
gaggagaaagttgttaaaca

SEQ ID NO: 605480 - DNA, 20 bp, mouse
gtgaaggtgcagggacgttg

SEQ ID NO: 605481 - DNA, 20 bp, mouse
ggagacgccagcaagcgttt

SEQ ID NO: 605482 - DNA, 20 bp, mouse
ggtctccgtctctccgtctc

SEQ ID NO: 605483 - DNA, 20 bp, mouse
gtccgtctctccgtctctgg

SEQ ID NO: 605484 - DNA, 20 bp, mouse
ggaagtaaaagtcagtaatg

SEQ ID NO: 605485 - DNA, 20 bp, mouse
gacgaagtactgcagagact

SEQ ID NO: 605486 - DNA, 20 bp, mouse
gtcgtgctgcggctctgagg

SEQ ID NO: 605487 - DNA, 20 bp, mouse
ggctctgaggcggcaggtcg

SEQ ID NO: 605488 - DNA, 20 bp, mouse
gccactcgcaagcggagatt

SEQ ID NO: 605489 - DNA, 20 bp, mouse
gcgcttgcgagtggggccag

SEQ ID NO: 605490 - DNA, 20 bp, mouse
gagccgcagcacgagcgtga

SEQ ID NO: 605491 - DNA, 20 bp, mouse
ggtcacacgcgctcaccctc

SEQ ID NO: 605492 - DNA, 20 bp, mouse
gagcgcgtgtgacgggaacg

SEQ ID NO: 605493 - DNA, 20 bp, mouse
gcgtggagtcgcagatgtga

SEQ ID NO: 605494 - DNA, 20 bp, mouse
gagccctcacgctcgtgctg

SEQ ID NO: 605495 - DNA, 20 bp, mouse
ggagccaactactgccacag

SEQ ID NO: 605496 - DNA, 20 bp, mouse
gagtctcccgaggaacaaag

SEQ ID NO: 605497 - DNA, 20 bp, mouse
gtgagcagtcctgaaaccaa

SEQ ID NO: 605498 - DNA, 20 bp, mouse
gcgcgaaggccaagtctcat

SEQ ID NO: 605499 - DNA, 20 bp, mouse
gtcaggactgctcatctcac

SEQ ID NO: 605500 - DNA, 20 bp, mouse
ggagctaaagaactgatggg

SEQ ID NO: 605501 - DNA, 20 bp, mouse
gctggcatggcggaacccgg

SEQ ID NO: 605502 - DNA, 20 bp, mouse
ggtgggagggacaggtcccg

SEQ ID NO: 605503 - DNA, 20 bp, mouse
gggcgagctaaagaactgat

SEQ ID NO: 605504 - DNA, 20 bp, mouse
ggctagccttcagagaggtg

SEQ ID NO: 605505 - DNA, 20 bp, mouse
gggggggctgggggaatcgt

SEQ ID NO: 605506 - DNA, 20 bp, mouse
gtccagaagaccagagggga

SEQ ID NO: 605507 - DNA, 20 bp, mouse
ggggttccagaagaccagag

SEQ ID NO: 605508 - DNA, 20 bp, mouse
ggagagccgggaagaacaaa

SEQ ID NO: 605509 - DNA, 20 bp, mouse
gacggccagtaagacactga

SEQ ID NO: 605510 - DNA, 20 bp, mouse
gcccaaggccagggtacccc

SEQ ID NO: 605511 - DNA, 20 bp, mouse
gcaggcaaggctgcttacaa

SEQ ID NO: 605512 - DNA, 20 bp, mouse
gaagcgcacacccaaggcca

SEQ ID NO: 605513 - DNA, 20 bp, mouse
gtccctgtcttgggaagagg

SEQ ID NO: 605514 - DNA, 20 bp, mouse
gatcctgaggatcttggtag

SEQ ID NO: 605515 - DNA, 20 bp, mouse
gactggccgtttgttcttcc

SEQ ID NO: 605516 - DNA, 20 bp, mouse
gccggagctccctcagagtg

SEQ ID NO: 605517 - DNA, 20 bp, mouse
ggagtcccggggtcacccac

SEQ ID NO: 605518 - DNA, 20 bp, mouse
gtccagctacttcttactct

SEQ ID NO: 605519 - DNA, 20 bp, mouse
ggcttccggtgggtgacccc

SEQ ID NO: 605520 - DNA, 20 bp, mouse
gcgcacgcacagcttccggt

SEQ ID NO: 605521 - DNA, 20 bp, mouse
gagggagctccggagtcccg

SEQ ID NO: 605522 - DNA, 20 bp, mouse
gagaaaccgccacactctga

SEQ ID NO: 605523 - DNA, 20 bp, mouse
ggctagaccacgagacgaca

SEQ ID NO: 605524 - DNA, 20 bp, mouse
gtcctccctcgggacaccag

SEQ ID NO: 605525 - DNA, 20 bp, mouse
ggcctagagtaagaagtagc

SEQ ID NO: 605526 - DNA, 20 bp, mouse
ggtacaattgctaaaagaat

SEQ ID NO: 605527 - DNA, 20 bp, mouse
gcttatggaaatgtacaaaa

SEQ ID NO: 605528 - DNA, 20 bp, mouse
gcctgaacaaatggatccac

SEQ ID NO: 605529 - DNA, 20 bp, mouse
ggaacacttcaggaaacctg

SEQ ID NO: 605530 - DNA, 20 bp, mouse
gccactggtaacacagcaag

SEQ ID NO: 605531 - DNA, 20 bp, mouse
gaagcactaaattcagagat

SEQ ID NO: 605532 - DNA, 20 bp, mouse
gttctctcttcataagtctt

SEQ ID NO: 605533 - DNA, 20 bp, mouse
gttccctctcacaacaatac

SEQ ID NO: 605534 - DNA, 20 bp, mouse
ggtttttctttcatacccac

SEQ ID NO: 605535 - DNA, 20 bp, mouse
ggagccagtattgttgtgag

SEQ ID NO: 605536 - DNA, 20 bp, mouse
ggattctgagagttattcag

SEQ ID NO: 605537 - DNA, 20 bp, mouse
ggcttctgtacaaagtctga

SEQ ID NO: 605538 - DNA, 20 bp, mouse
gtggactcacacacagaaaa

SEQ ID NO: 605539 - DNA, 20 bp, mouse
gagaatcagaggacatcaca

SEQ ID NO: 605540 - DNA, 20 bp, mouse
ggctagcagccagttcccaa

SEQ ID NO: 605541 - DNA, 20 bp, mouse
gccagttcccaaaggattca

SEQ ID NO: 605542 - DNA, 20 bp, mouse
gtacagaagctgaagccatt

SEQ ID NO: 605543 - DNA, 20 bp, mouse
gaatctgagtctgtattact

SEQ ID NO: 605544 - DNA, 20 bp, mouse
gatacagactcagattcaga

SEQ ID NO: 605545 - DNA, 20 bp, mouse
ggtctgagtctctacaggac

SEQ ID NO: 605546 - DNA, 20 bp, mouse
gggcagagaggagatcctcc

SEQ ID NO: 605547 - DNA, 20 bp, mouse
gggtcgggtgggagcacggt

SEQ ID NO: 605548 - DNA, 20 bp, mouse
gacaccagggaggacgaacg

SEQ ID NO: 605549 - DNA, 20 bp, mouse
gtcagagccagagtgactca

SEQ ID NO: 605550 - DNA, 20 bp, mouse
gcagagtgaacagggaaccc

SEQ ID NO: 605551 - DNA, 20 bp, mouse
gagtgaacagggaaccccgg

SEQ ID NO: 605552 - DNA, 20 bp, mouse
gccctgcagcgggcccagca

SEQ ID NO: 605553 - DNA, 20 bp, mouse
ggcagggctcccctgaggag

SEQ ID NO: 605554 - DNA, 20 bp, mouse
gaggccgcgttcgtcctccc

SEQ ID NO: 605555 - DNA, 20 bp, mouse
gcggtgggcctgggtcgggt

SEQ ID NO: 605556 - DNA, 20 bp, mouse
gcaccgagcgaggaccaaca

SEQ ID NO: 605557 - DNA, 20 bp, mouse
gtgggccgggtgagcacggt

SEQ ID NO: 605558 - DNA, 20 bp, mouse
gagtgagcagggagccccgg

SEQ ID NO: 605559 - DNA, 20 bp, mouse
gggctttggagtcccttagc

SEQ ID NO: 605560 - DNA, 20 bp, mouse
gaatgtctggagagcttgaa

SEQ ID NO: 605561 - DNA, 20 bp, mouse
gcagggccccccttgaggag

SEQ ID NO: 605562 - DNA, 20 bp, mouse
ggaggagatactcctgacgt

SEQ ID NO: 605563 - DNA, 20 bp, mouse
ggagcactgaacaccgagcg

SEQ ID NO: 605564 - DNA, 20 bp, mouse
ggggccctgcagcagcccgg

SEQ ID NO: 605565 - DNA, 20 bp, mouse
gtccaacaccctctcctcaa

SEQ ID NO: 605566 - DNA, 20 bp, mouse
gcgcggcggccgccaagtac

SEQ ID NO: 605567 - DNA, 20 bp, mouse
ggcgccggtgtagtaggatg

SEQ ID NO: 605568 - DNA, 20 bp, mouse
ggctggagcaggagccgcgg

SEQ ID NO: 605569 - DNA, 20 bp, mouse
ggtacgggcgccggtgtagt

SEQ ID NO: 605570 - DNA, 20 bp, mouse
gcaccggcgcccgtacttgg

SEQ ID NO: 605571 - DNA, 20 bp, mouse
gctgcctcatcctactacac

SEQ ID NO: 605572 - DNA, 20 bp, mouse
ggcaagggccccacgcacag

SEQ ID NO: 605573 - DNA, 20 bp, mouse
gggtcccttccacactacca

SEQ ID NO: 605574 - DNA, 20 bp, mouse
gcgggcgggcagcagcacgg

SEQ ID NO: 605575 - DNA, 20 bp, mouse
gagccgtgagggaaactgtc

SEQ ID NO: 605576 - DNA, 20 bp, mouse
gaggagaccccctagtgatg

SEQ ID NO: 605577 - DNA, 20 bp, mouse
ggcaggatgccccatcacta

SEQ ID NO: 605578 - DNA, 20 bp, mouse
ggtctcctgggaattgatct

SEQ ID NO: 605579 - DNA, 20 bp, mouse
gaaatccaagatcaattccc

SEQ ID NO: 605580 - DNA, 20 bp, mouse
gtctctagggctcacctggt

SEQ ID NO: 605581 - DNA, 20 bp, mouse
gttctactggcaaattatgc

SEQ ID NO: 605582 - DNA, 20 bp, mouse
gggtgcgctatggtggtcag

SEQ ID NO: 605583 - DNA, 20 bp, mouse
gcgtaagatacagcttccta

SEQ ID NO: 605584 - DNA, 20 bp, mouse
gtacttaccatggtgcgcta

SEQ ID NO: 605585 - DNA, 20 bp, mouse
gtgttcatgtgtacttacca

SEQ ID NO: 605586 - DNA, 20 bp, mouse
gtctccgtgggtatgaactg

SEQ ID NO: 605587 - DNA, 20 bp, mouse
gtcatacccacggagagggt

SEQ ID NO: 605588 - DNA, 20 bp, mouse
gcatttcccaccctctccgt

SEQ ID NO: 605589 - DNA, 20 bp, mouse
gggcagcagtgaaggtatgt

SEQ ID NO: 605590 - DNA, 20 bp, mouse
gcagttaagggcagcagtga

SEQ ID NO: 605591 - DNA, 20 bp, mouse
gcttccacagttcataccca

SEQ ID NO: 605592 - DNA, 20 bp, mouse
gtaggctccgggacagatga

SEQ ID NO: 605593 - DNA, 20 bp, mouse
ggctccgggacagatgaggg

SEQ ID NO: 605594 - DNA, 20 bp, mouse
ggaactgtggaagtcagtta

SEQ ID NO: 605595 - DNA, 20 bp, mouse
ggcctgggccttgtgtggta

SEQ ID NO: 605596 - DNA, 20 bp, mouse
gaatagatagtaggtagaag

SEQ ID NO: 605597 - DNA, 20 bp, mouse
gcaggctgtgtgctagaggt

SEQ ID NO: 605598 - DNA, 20 bp, mouse
gacctctggagaaacagtac

SEQ ID NO: 605599 - DNA, 20 bp, mouse
ggctgtgtgctagaggttgg

SEQ ID NO: 605600 - DNA, 20 bp, mouse
gtatagttgtattagagaga

SEQ ID NO: 605601 - DNA, 20 bp, mouse
gagtacaggctgtgtgctag

SEQ ID NO: 605602 - DNA, 20 bp, mouse
ggcctgtactgtttctccag

SEQ ID NO: 605603 - DNA, 20 bp, mouse
gctccaaggcaagaggacat

SEQ ID NO: 605604 - DNA, 20 bp, mouse
gttcagggtaggacttagga

SEQ ID NO: 605605 - DNA, 20 bp, mouse
gatacaactataatgcaagc

SEQ ID NO: 605606 - DNA, 20 bp, mouse
gggacaagatggcccggtat

SEQ ID NO: 605607 - DNA, 20 bp, mouse
ggggaggcgcaagtgagtca

SEQ ID NO: 605608 - DNA, 20 bp, mouse
ggagtactactgccttgtca

SEQ ID NO: 605609 - DNA, 20 bp, mouse
gccccgcagacccgcagcgt

SEQ ID NO: 605610 - DNA, 20 bp, mouse
gatggcccggtataggaaca

SEQ ID NO: 605611 - DNA, 20 bp, mouse
gcttggggtcacattgagca

SEQ ID NO: 605612 - DNA, 20 bp, mouse
gtcttacttgactggagctt

SEQ ID NO: 605613 - DNA, 20 bp, mouse
gaaggcacgcgcagagggtg

SEQ ID NO: 605614 - DNA, 20 bp, mouse
gttagagaggggagtataaa

SEQ ID NO: 605615 - DNA, 20 bp, mouse
gtcgccttcccgccctgaca

SEQ ID NO: 605616 - DNA, 20 bp, mouse
gcggctcccgcgacactgag

SEQ ID NO: 605617 - DNA, 20 bp, mouse
gggaccgcgcaggcccgtcc

SEQ ID NO: 605618 - DNA, 20 bp, mouse
gcggcggccgctcagtgtcg

SEQ ID NO: 605619 - DNA, 20 bp, mouse
gggttccgcagaggtccagt

SEQ ID NO: 605620 - DNA, 20 bp, mouse
gccgcgcaggcccgtcccgg

SEQ ID NO: 605621 - DNA, 20 bp, mouse
gcctctcggcgtcctctggg

SEQ ID NO: 605622 - DNA, 20 bp, mouse
ggaggacgccgagaggagca

SEQ ID NO: 605623 - DNA, 20 bp, mouse
ggaaccacatggcgcccccc

SEQ ID NO: 605624 - DNA, 20 bp, mouse
gccaccggaaggttccgcag

SEQ ID NO: 605625 - DNA, 20 bp, mouse
gcagccgggtgagacagaca

SEQ ID NO: 605626 - DNA, 20 bp, mouse
ggggcgccggaggaagatag

SEQ ID NO: 605627 - DNA, 20 bp, mouse
ggaagataggggctcagtcg

SEQ ID NO: 605628 - DNA, 20 bp, mouse
ggcgaggggcaagcgcacac

SEQ ID NO: 605629 - DNA, 20 bp, mouse
gagcggcggccccacggacg

SEQ ID NO: 605630 - DNA, 20 bp, mouse
gcggccccacggacgcggac

SEQ ID NO: 605631 - DNA, 20 bp, mouse
gcacctcagcggcggcccca

SEQ ID NO: 605632 - DNA, 20 bp, mouse
gtcacgtcccgccgcgaaag

SEQ ID NO: 605633 - DNA, 20 bp, mouse
gcccgggcctgaaagcgacg

SEQ ID NO: 605634 - DNA, 20 bp, mouse
ggccagcagtgagtcagacg

SEQ ID NO: 605635 - DNA, 20 bp, mouse
ggggcctgaaagcgacgggg

SEQ ID NO: 605636 - DNA, 20 bp, mouse
gagccgtagacaagaagctg

SEQ ID NO: 605637 - DNA, 20 bp, mouse
gttcttagaggctaccagag

SEQ ID NO: 605638 - DNA, 20 bp, mouse
gaggacacctcagcacaggg

SEQ ID NO: 605639 - DNA, 20 bp, mouse
gtcctggcctcagggtggag

SEQ ID NO: 605640 - DNA, 20 bp, mouse
gtacctcagcttcttgtcta

SEQ ID NO: 605641 - DNA, 20 bp, mouse
gttcaggtgtgaatactcgg

SEQ ID NO: 605642 - DNA, 20 bp, mouse
gacctcagcacagggagtac

SEQ ID NO: 605643 - DNA, 20 bp, mouse
ggcagctggcgggggataca

SEQ ID NO: 605644 - DNA, 20 bp, mouse
gacggctcacaagtagctgg

SEQ ID NO: 605645 - DNA, 20 bp, mouse
gttttggttaagccacgaac

SEQ ID NO: 605646 - DNA, 20 bp, mouse
gcgctccctgaagagagtga

SEQ ID NO: 605647 - DNA, 20 bp, mouse
ggaagagagtgagggcggtt

SEQ ID NO: 605648 - DNA, 20 bp, mouse
gtccctgaagagagtgaggg

SEQ ID NO: 605649 - DNA, 20 bp, mouse
gcgttcgctggtaagcgcgg

SEQ ID NO: 605650 - DNA, 20 bp, mouse
gtgccgaggagggtggacac

SEQ ID NO: 605651 - DNA, 20 bp, mouse
gccggccggcagctcctcgg

SEQ ID NO: 605652 - DNA, 20 bp, mouse
gtaagcgcggcggcgggaag

SEQ ID NO: 605653 - DNA, 20 bp, mouse
gctgctgtggggcgacactg

SEQ ID NO: 605654 - DNA, 20 bp, mouse
gcctcggcaaaacagaccgt

SEQ ID NO: 605655 - DNA, 20 bp, mouse
ggacacgggtttaggacgac

SEQ ID NO: 605656 - DNA, 20 bp, mouse
gtggttcacctggggaggtg

SEQ ID NO: 605657 - DNA, 20 bp, mouse
gccaggtgaaccactctgga

SEQ ID NO: 605658 - DNA, 20 bp, mouse
gctccccaggtgaaccactc

SEQ ID NO: 605659 - DNA, 20 bp, mouse
gtctgtctgaccctccagag

SEQ ID NO: 605660 - DNA, 20 bp, mouse
ggcagagagacctgtgaggt

SEQ ID NO: 605661 - DNA, 20 bp, mouse
ggaggaccagtgggttacta

SEQ ID NO: 605662 - DNA, 20 bp, mouse
gtgctacccaagaggaccag

SEQ ID NO: 605663 - DNA, 20 bp, mouse
ggctgtagctctgcgaagag

SEQ ID NO: 605664 - DNA, 20 bp, mouse
gctcttcaggtcagtgacat

SEQ ID NO: 605665 - DNA, 20 bp, mouse
gatgaaccgccaggtggtga

SEQ ID NO: 605666 - DNA, 20 bp, mouse
gggactgttgtggggaggtt

SEQ ID NO: 605667 - DNA, 20 bp, mouse
gcttggctgacatgatggaa

SEQ ID NO: 605668 - DNA, 20 bp, mouse
gctccccacaacagtccctt

SEQ ID NO: 605669 - DNA, 20 bp, mouse
gagtcggtggcccagtccta

SEQ ID NO: 605670 - DNA, 20 bp, mouse
ggtcctaagggactgttgtg

SEQ ID NO: 605671 - DNA, 20 bp, mouse
gtgtaagttacataagtcgg

SEQ ID NO: 605672 - DNA, 20 bp, mouse
gctgacatgatggaagggct

SEQ ID NO: 605673 - DNA, 20 bp, mouse
ggcattcttggctgacatga

SEQ ID NO: 605674 - DNA, 20 bp, mouse
gttatgtaacttacaggctt

SEQ ID NO: 605675 - DNA, 20 bp, mouse
gaaggcctgtgtctaactgg

SEQ ID NO: 605676 - DNA, 20 bp, mouse
gctgagaagatcagatacag

SEQ ID NO: 605677 - DNA, 20 bp, mouse
ggaagatcagatacagtggg

SEQ ID NO: 605678 - DNA, 20 bp, mouse
ggaaagcccaccactatcat

SEQ ID NO: 605679 - DNA, 20 bp, mouse
ggagaggtctagggcatcct

SEQ ID NO: 605680 - DNA, 20 bp, mouse
gttgcctcacaagctgtctg

SEQ ID NO: 605681 - DNA, 20 bp, mouse
gggagagaatggccaaaggg

SEQ ID NO: 605682 - DNA, 20 bp, mouse
gcagacgtcacaagcttgtg

SEQ ID NO: 605683 - DNA, 20 bp, mouse
gtaatgacggaagatgggta

SEQ ID NO: 605684 - DNA, 20 bp, mouse
gtgagggcacagatctgggc

SEQ ID NO: 605685 - DNA, 20 bp, mouse
gagcttccatcccatgatag

SEQ ID NO: 605686 - DNA, 20 bp, mouse
gcatacagctggggcacctg

SEQ ID NO: 605687 - DNA, 20 bp, mouse
gggggcacctggggttgaaa

SEQ ID NO: 605688 - DNA, 20 bp, mouse
gagggggtgataagtcatca

SEQ ID NO: 605689 - DNA, 20 bp, mouse
ggcatggacagagtagtcct

SEQ ID NO: 605690 - DNA, 20 bp, mouse
gcagcatagcccagacatgg

SEQ ID NO: 605691 - DNA, 20 bp, mouse
gtcatcaaggcagtgccaac

SEQ ID NO: 605692 - DNA, 20 bp, mouse
ggaacatcgtgtcttgccaa

SEQ ID NO: 605693 - DNA, 20 bp, mouse
gcaggactctccatacagct

SEQ ID NO: 605694 - DNA, 20 bp, mouse
gggtgcttgcctagtatatg

SEQ ID NO: 605695 - DNA, 20 bp, mouse
gttcttgccctttcaacccc

SEQ ID NO: 605696 - DNA, 20 bp, mouse
gtgtgaggggcaaggactag

SEQ ID NO: 605697 - DNA, 20 bp, mouse
gcccaagggtacaatgtgag

SEQ ID NO: 605698 - DNA, 20 bp, mouse
gcttactgccagagaggctt

SEQ ID NO: 605699 - DNA, 20 bp, mouse
gaaaaggacccaagcctctc

SEQ ID NO: 605700 - DNA, 20 bp, mouse
gaggccaagactgaccttta

SEQ ID NO: 605701 - DNA, 20 bp, mouse
gtccttttgggaatccgtaa

SEQ ID NO: 605702 - DNA, 20 bp, mouse
gtagtgaggaggtcaaggag

SEQ ID NO: 605703 - DNA, 20 bp, mouse
gccccagagtgataggctgg

SEQ ID NO: 605704 - DNA, 20 bp, mouse
ggaaacgctaggtctaaagg

SEQ ID NO: 605705 - DNA, 20 bp, mouse
gcacaaggagatccacacta

SEQ ID NO: 605706 - DNA, 20 bp, mouse
gcgttggtgcaggacgatgg

SEQ ID NO: 605707 - DNA, 20 bp, mouse
gtgcgggtcacacacaggta

SEQ ID NO: 605708 - DNA, 20 bp, mouse
gggagtactaaggttcgtct

SEQ ID NO: 605709 - DNA, 20 bp, mouse
gcacagggctcaatcgagaa

SEQ ID NO: 605710 - DNA, 20 bp, mouse
gcctgtggatactggtccgt

SEQ ID NO: 605711 - DNA, 20 bp, mouse
gccggctgcgggtcacacac

SEQ ID NO: 605712 - DNA, 20 bp, mouse
ggtccgttggtgcaggacga

SEQ ID NO: 605713 - DNA, 20 bp, mouse
gggctcaatcgagaagggag

SEQ ID NO: 605714 - DNA, 20 bp, mouse
ggattgagccctgtggatac

SEQ ID NO: 605715 - DNA, 20 bp, mouse
ggatactggtccgttggtgc

SEQ ID NO: 605716 - DNA, 20 bp, mouse
ggggcgaagtgttagagtgc

SEQ ID NO: 605717 - DNA, 20 bp, mouse
gccggggttggtaaagatgg

SEQ ID NO: 605718 - DNA, 20 bp, mouse
ggccccggggttggtaaaga

SEQ ID NO: 605719 - DNA, 20 bp, mouse
gaaccactggtcagtagtct

SEQ ID NO: 605720 - DNA, 20 bp, mouse
gaccccagactactgaccag

SEQ ID NO: 605721 - DNA, 20 bp, mouse
gggaagatgtacggtcacca

SEQ ID NO: 605722 - DNA, 20 bp, mouse
gactctcgcgggaagatgta

SEQ ID NO: 605723 - DNA, 20 bp, mouse
gcggcaaccgcatcgccccg

SEQ ID NO: 605724 - DNA, 20 bp, mouse
gaaccgccctggaaatatga

SEQ ID NO: 605725 - DNA, 20 bp, mouse
gtaccaaccccggggcgatg

SEQ ID NO: 605726 - DNA, 20 bp, mouse
gaccagcgtgggaactccgg

SEQ ID NO: 605727 - DNA, 20 bp, mouse
gtggtagtgtggcagtccat

SEQ ID NO: 605728 - DNA, 20 bp, mouse
gagttcccacgctggtagtg

SEQ ID NO: 605729 - DNA, 20 bp, mouse
gactgccacactaccagcgt

SEQ ID NO: 605730 - DNA, 20 bp, mouse
gcaggcggcccggaggacga

SEQ ID NO: 605731 - DNA, 20 bp, mouse
gttgcgtgagacgaaccgga

SEQ ID NO: 605732 - DNA, 20 bp, mouse
gcggcccggaggacgagggt

SEQ ID NO: 605733 - DNA, 20 bp, mouse
gggcctacctgatagacgag

SEQ ID NO: 605734 - DNA, 20 bp, mouse
gcggttcgtctcacgcaata

SEQ ID NO: 605735 - DNA, 20 bp, mouse
ggaggacgagggtgggacga

SEQ ID NO: 605736 - DNA, 20 bp, mouse
gccccagcggagctactctc

SEQ ID NO: 605737 - DNA, 20 bp, mouse
gtctgcgcctcgcaccccag

SEQ ID NO: 605738 - DNA, 20 bp, mouse
gtcgcgtggagagaaggagg

SEQ ID NO: 605739 - DNA, 20 bp, mouse
gctgggttagcgcaaagtgc

SEQ ID NO: 605740 - DNA, 20 bp, mouse
gctattcgggcgacatggag

SEQ ID NO: 605741 - DNA, 20 bp, mouse
gcccagagagtagctccgct

SEQ ID NO: 605742 - DNA, 20 bp, mouse
ggggcggtgagcaaaagagg

SEQ ID NO: 605743 - DNA, 20 bp, mouse
ggccgcaaggatgactgagt

SEQ ID NO: 605744 - DNA, 20 bp, mouse
gtgcgggcggtgagcaaaag

SEQ ID NO: 605745 - DNA, 20 bp, mouse
gatttcgcgtggagagaagg

SEQ ID NO: 605746 - DNA, 20 bp, mouse
gagtctggggtaaccagtca

SEQ ID NO: 605747 - DNA, 20 bp, mouse
gaacatctgcgaagagtctg

SEQ ID NO: 605748 - DNA, 20 bp, mouse
gtaggtctgcgtgcacggag

SEQ ID NO: 605749 - DNA, 20 bp, mouse
gggggtaaccagtcagggtg

SEQ ID NO: 605750 - DNA, 20 bp, mouse
gggagaggtccagcagggac

SEQ ID NO: 605751 - DNA, 20 bp, mouse
gcccccaaccctgtttcctt

SEQ ID NO: 605752 - DNA, 20 bp, mouse
ggttcacagtttttcagcta

SEQ ID NO: 605753 - DNA, 20 bp, mouse
gattcctaaggaaacagggt

SEQ ID NO: 605754 - DNA, 20 bp, mouse
ggggcctggcggctaaacct

SEQ ID NO: 605755 - DNA, 20 bp, mouse
ggagcgggaacctctctccg

SEQ ID NO: 605756 - DNA, 20 bp, mouse
gtcgcagcctggtctctagg

SEQ ID NO: 605757 - DNA, 20 bp, mouse
gatcatgctctggaaactcg

SEQ ID NO: 605758 - DNA, 20 bp, mouse
gccaggctgcgatcatgctc

SEQ ID NO: 605759 - DNA, 20 bp, mouse
gaagtacgaagacatctatg

SEQ ID NO: 605760 - DNA, 20 bp, mouse
gtgatcgcagcctggtctct

SEQ ID NO: 605761 - DNA, 20 bp, mouse
gaggtgagtgcattcatgtg

SEQ ID NO: 605762 - DNA, 20 bp, mouse
gcatgtgaggagcagatgtc

SEQ ID NO: 605763 - DNA, 20 bp, mouse
gatttctgatcgggtttctg

SEQ ID NO: 605764 - DNA, 20 bp, mouse
gaagacatctatgaggtgag

SEQ ID NO: 605765 - DNA, 20 bp, mouse
gacctaccagagtctacaag

SEQ ID NO: 605766 - DNA, 20 bp, mouse
gtgcggcctctacacaccca

SEQ ID NO: 605767 - DNA, 20 bp, mouse
gtcgccgggacacactgtga

SEQ ID NO: 605768 - DNA, 20 bp, mouse
gacagagatgtggtcgccgt

SEQ ID NO: 605769 - DNA, 20 bp, mouse
gagaggccgcagccgtggac

SEQ ID NO: 605770 - DNA, 20 bp, mouse
ggtgaggcttctccggtcca

SEQ ID NO: 605771 - DNA, 20 bp, mouse
ggccttgctgtcccagtcac

SEQ ID NO: 605772 - DNA, 20 bp, mouse
ggtcactggacgcgcatcgg

SEQ ID NO: 605773 - DNA, 20 bp, mouse
gtgtgagggtgaggcttctc

SEQ ID NO: 605774 - DNA, 20 bp, mouse
gaggattgcgaggtgagcgg

SEQ ID NO: 605775 - DNA, 20 bp, mouse
gtgtgtagaggccgcagccg

SEQ ID NO: 605776 - DNA, 20 bp, mouse
ggcaaggagctatctgatcc

SEQ ID NO: 605777 - DNA, 20 bp, mouse
gacccacttaaaaaacctgt

SEQ ID NO: 605778 - DNA, 20 bp, mouse
gtttaagtgggtacgaggca

SEQ ID NO: 605779 - DNA, 20 bp, mouse
gtcgtggactagtccgggaa

SEQ ID NO: 605780 - DNA, 20 bp, mouse
gcccggactagtccacgatg

SEQ ID NO: 605781 - DNA, 20 bp, mouse
gcagtttagatctctatcta

SEQ ID NO: 605782 - DNA, 20 bp, mouse
gggttttttaagtgggtacg

SEQ ID NO: 605783 - DNA, 20 bp, mouse
gttcgggagaagttacggaa

SEQ ID NO: 605784 - DNA, 20 bp, mouse
ggagaagttacggaagggaa

SEQ ID NO: 605785 - DNA, 20 bp, mouse
gacggtccaatatagattag

SEQ ID NO: 605786 - DNA, 20 bp, mouse
gtgggccagacgggagctga

SEQ ID NO: 605787 - DNA, 20 bp, mouse
gcccgtctggcccatttcca

SEQ ID NO: 605788 - DNA, 20 bp, mouse
gggtacggggtactcagcgg

SEQ ID NO: 605789 - DNA, 20 bp, mouse
gtggcacttggaaaaaagtc

SEQ ID NO: 605790 - DNA, 20 bp, mouse
ggacccgagtctactcacca

SEQ ID NO: 605791 - DNA, 20 bp, mouse
gagtctgccgggagtccaga

SEQ ID NO: 605792 - DNA, 20 bp, mouse
gcgggagcgtccatggaaat

SEQ ID NO: 605793 - DNA, 20 bp, mouse
gacgcctgcgggagcgtcca

SEQ ID NO: 605794 - DNA, 20 bp, mouse
gtagtgtggggcgtgaggtg

SEQ ID NO: 605795 - DNA, 20 bp, mouse
gccgggagtccagaaggtac

SEQ ID NO: 605796 - DNA, 20 bp, mouse
gaaagggcagcgccggacgg

SEQ ID NO: 605797 - DNA, 20 bp, mouse
ggatggaaatccgaatcaaa

SEQ ID NO: 605798 - DNA, 20 bp, mouse
gggccggtcccagatgctgg

SEQ ID NO: 605799 - DNA, 20 bp, mouse
gccaagggaagagggtccct

SEQ ID NO: 605800 - DNA, 20 bp, mouse
ggctgctgccgccagcatct

SEQ ID NO: 605801 - DNA, 20 bp, mouse
gccgattctgcacctccgtc

SEQ ID NO: 605802 - DNA, 20 bp, mouse
gatcggccggtcccagatgc

SEQ ID NO: 605803 - DNA, 20 bp, mouse
gtcagccggagaatgcaaga

SEQ ID NO: 605804 - DNA, 20 bp, mouse
gatcaaagggcagcgccgga

SEQ ID NO: 605805 - DNA, 20 bp, mouse
ggaaaggcgagcgagctcgg

SEQ ID NO: 605806 - DNA, 20 bp, mouse
gaaagtgccgagcttccccg

SEQ ID NO: 605807 - DNA, 20 bp, mouse
ggtctctcatggctgcctcg

SEQ ID NO: 605808 - DNA, 20 bp, mouse
gcacccggccgcgcccacca

SEQ ID NO: 605809 - DNA, 20 bp, mouse
gccacgcgcagcggctggaa

SEQ ID NO: 605810 - DNA, 20 bp, mouse
gcctagcccgcgaggaccgg

SEQ ID NO: 605811 - DNA, 20 bp, mouse
ggcgcccaccacggagaccc

SEQ ID NO: 605812 - DNA, 20 bp, mouse
gctgcgcgtggctgtgtatg

SEQ ID NO: 605813 - DNA, 20 bp, mouse
gactgagccgggctaacgag

SEQ ID NO: 605814 - DNA, 20 bp, mouse
gtcccgaatggtgggcaacg

SEQ ID NO: 605815 - DNA, 20 bp, mouse
gtaatgatctcccgaatggt

SEQ ID NO: 605816 - DNA, 20 bp, mouse
gacttccgcccggcctagtg

SEQ ID NO: 605817 - DNA, 20 bp, mouse
gtccgcccggcctagtgtgg

SEQ ID NO: 605818 - DNA, 20 bp, mouse
gcacatttcaccaccacact

SEQ ID NO: 605819 - DNA, 20 bp, mouse
gcggaagtaaacattacgaa

SEQ ID NO: 605820 - DNA, 20 bp, mouse
ggcgagtgagcaaaggactg

SEQ ID NO: 605821 - DNA, 20 bp, mouse
gtttcaccaccacactaggc

SEQ ID NO: 605822 - DNA, 20 bp, mouse
gtacatgctatgtgacgcgt

SEQ ID NO: 605823 - DNA, 20 bp, mouse
gcgtaatgtttacttccgcc

SEQ ID NO: 605824 - DNA, 20 bp, mouse
gaacactaatttaggatatt

SEQ ID NO: 605825 - DNA, 20 bp, mouse
gttgggcacgtaaacgctaa

SEQ ID NO: 605826 - DNA, 20 bp, mouse
gcggtcgtggtggctaagga

SEQ ID NO: 605827 - DNA, 20 bp, mouse
ggacggctcggaggaaccct

SEQ ID NO: 605828 - DNA, 20 bp, mouse
gcggagacgcgcaggacacc

SEQ ID NO: 605829 - DNA, 20 bp, mouse
gcgcttccaggcggtcgtgg

SEQ ID NO: 605830 - DNA, 20 bp, mouse
gcgctgtccacgcttccagg

SEQ ID NO: 605831 - DNA, 20 bp, mouse
gcaggcggtcgtggtggcta

SEQ ID NO: 605832 - DNA, 20 bp, mouse
gtggtggctaaggagggtgt

SEQ ID NO: 605833 - DNA, 20 bp, mouse
gcgctctcagcacaaaccca

SEQ ID NO: 605834 - DNA, 20 bp, mouse
gctctctgaagcccaccggt

SEQ ID NO: 605835 - DNA, 20 bp, mouse
gcgcggagcgtaactctacc

SEQ ID NO: 605836 - DNA, 20 bp, mouse
gcgtggcaccgagctggacg

SEQ ID NO: 605837 - DNA, 20 bp, mouse
gagtgggtgctgcttaaagg

SEQ ID NO: 605838 - DNA, 20 bp, mouse
gagcccactcaggttcgagt

SEQ ID NO: 605839 - DNA, 20 bp, mouse
gctccagagaagggccctcc

SEQ ID NO: 605840 - DNA, 20 bp, mouse
gtaaaggtggacggcggcca

SEQ ID NO: 605841 - DNA, 20 bp, mouse
gccgggaggcccctagggaa

SEQ ID NO: 605842 - DNA, 20 bp, mouse
gccggggcgtggcaccgagc

SEQ ID NO: 605843 - DNA, 20 bp, mouse
ggcgctcggaccccgatcgt

SEQ ID NO: 605844 - DNA, 20 bp, mouse
ggcttccgcagcaccggccg

SEQ ID NO: 605845 - DNA, 20 bp, mouse
ggctgcttaaaggtggacgg

SEQ ID NO: 605846 - DNA, 20 bp, mouse
gcgggacgcgggctcaccct

SEQ ID NO: 605847 - DNA, 20 bp, mouse
gagccagcggcgccgggacg

SEQ ID NO: 605848 - DNA, 20 bp, mouse
gtcgaggccgactccagctg

SEQ ID NO: 605849 - DNA, 20 bp, mouse
gcggcccgacgctcggccca

SEQ ID NO: 605850 - DNA, 20 bp, mouse
gcgcgcggggcggacgacgg

SEQ ID NO: 605851 - DNA, 20 bp, mouse
gctcaccctgggccgagcgt

SEQ ID NO: 605852 - DNA, 20 bp, mouse
ggcgcgcggcgcggtgacgt

SEQ ID NO: 605853 - DNA, 20 bp, mouse
gcgcggcgcggtgacgtggg

SEQ ID NO: 605854 - DNA, 20 bp, mouse
gggctgcccaagaccccgag

SEQ ID NO: 605855 - DNA, 20 bp, mouse
ggctggagtcggcctcgacg

SEQ ID NO: 605856 - DNA, 20 bp, mouse
gcccgcgtgccaggcagcga

SEQ ID NO: 605857 - DNA, 20 bp, mouse
ggaagcctgcagtgcaggaa

SEQ ID NO: 605858 - DNA, 20 bp, mouse
ggccgcggccgtgtcgctga

SEQ ID NO: 605859 - DNA, 20 bp, mouse
gccgtgtcgctgagggcgga

SEQ ID NO: 605860 - DNA, 20 bp, mouse
ggcggccgtgtcgctgaggg

SEQ ID NO: 605861 - DNA, 20 bp, mouse
gcatcacccgggatcaggaa

SEQ ID NO: 605862 - DNA, 20 bp, mouse
gggccgagggctgtgtggac

SEQ ID NO: 605863 - DNA, 20 bp, mouse
gaccgcagcttggtgcagag

SEQ ID NO: 605864 - DNA, 20 bp, mouse
ggcccctctgcaccaagctg

SEQ ID NO: 605865 - DNA, 20 bp, mouse
ggactcccgggacagggcag

SEQ ID NO: 605866 - DNA, 20 bp, mouse
gctgccttcaaaatgcggta

SEQ ID NO: 605867 - DNA, 20 bp, mouse
gagaccttaccgcattttga

SEQ ID NO: 605868 - DNA, 20 bp, mouse
gaatttcccagtaaaagggg

SEQ ID NO: 605869 - DNA, 20 bp, mouse
gcttggagccagcagatagt

SEQ ID NO: 605870 - DNA, 20 bp, mouse
ggtttctcctccccttttac

SEQ ID NO: 605871 - DNA, 20 bp, mouse
gggatgtgcctttctttctt

SEQ ID NO: 605872 - DNA, 20 bp, mouse
gagctttgctgtatggaacc

SEQ ID NO: 605873 - DNA, 20 bp, mouse
gaaagtgatagcttggattt

SEQ ID NO: 605874 - DNA, 20 bp, mouse
ggctttctaactgactgcct

SEQ ID NO: 605875 - DNA, 20 bp, mouse
gaaaacacaggtgctaagaa

SEQ ID NO: 605876 - DNA, 20 bp, mouse
gaggaggcagcggcaaacag

SEQ ID NO: 605877 - DNA, 20 bp, mouse
gtagctccatggcttaacgg

SEQ ID NO: 605878 - DNA, 20 bp, mouse
gctccatggcttaacggagg

SEQ ID NO: 605879 - DNA, 20 bp, mouse
gggcagcggcaaacaggggg

SEQ ID NO: 605880 - DNA, 20 bp, mouse
gagcggcaaacagggggagg

SEQ ID NO: 605881 - DNA, 20 bp, mouse
gtgaggcgcccacccaagat

SEQ ID NO: 605882 - DNA, 20 bp, mouse
gtgctagctccatggcttaa

SEQ ID NO: 605883 - DNA, 20 bp, mouse
ggagccctgccaggccggtc

SEQ ID NO: 605884 - DNA, 20 bp, mouse
gccacgcagtgctagctcca

SEQ ID NO: 605885 - DNA, 20 bp, mouse
gtagtgggagtgcgtgagga

SEQ ID NO: 605886 - DNA, 20 bp, mouse
gggctaggtgacagcggagg

SEQ ID NO: 605887 - DNA, 20 bp, mouse
ggcgggcgggacgcagagaa

SEQ ID NO: 605888 - DNA, 20 bp, mouse
gcggggctaggtgacagcgg

SEQ ID NO: 605889 - DNA, 20 bp, mouse
ggggacgcagagaacggaga

SEQ ID NO: 605890 - DNA, 20 bp, mouse
gacggagacggcgccgacag

SEQ ID NO: 605891 - DNA, 20 bp, mouse
gcgaggtgagcgggactagg

SEQ ID NO: 605892 - DNA, 20 bp, mouse
ggccacgcgccgggtaccca

SEQ ID NO: 605893 - DNA, 20 bp, mouse
gcgaggagcccgacagcggg

SEQ ID NO: 605894 - DNA, 20 bp, mouse
gcagccggagcccaagcgcc

SEQ ID NO: 605895 - DNA, 20 bp, mouse
gacaagttgccggaacctca

SEQ ID NO: 605896 - DNA, 20 bp, mouse
ggcttaggttatgagacgag

SEQ ID NO: 605897 - DNA, 20 bp, mouse
gacctaagcacaaaagtcaa

SEQ ID NO: 605898 - DNA, 20 bp, mouse
ggagacgaggggctgtaatt

SEQ ID NO: 605899 - DNA, 20 bp, mouse
ggattctaggtgtgtcatcg

SEQ ID NO: 605900 - DNA, 20 bp, mouse
ggttacctaccagcactgat

SEQ ID NO: 605901 - DNA, 20 bp, mouse
gtcgtagcttggctgctcta

SEQ ID NO: 605902 - DNA, 20 bp, mouse
ggaatccaatcagtgctggt

SEQ ID NO: 605903 - DNA, 20 bp, mouse
ggctacgattcgctataatg

SEQ ID NO: 605904 - DNA, 20 bp, mouse
ggaatccgcttagttgagga

SEQ ID NO: 605905 - DNA, 20 bp, mouse
gtgctggtaggtaaccaaac

SEQ ID NO: 605906 - DNA, 20 bp, mouse
gtgctccatggcagcttcac

SEQ ID NO: 605907 - DNA, 20 bp, mouse
gacgggaagaccacgagtga

SEQ ID NO: 605908 - DNA, 20 bp, mouse
gccattggctgcatagggaa

SEQ ID NO: 605909 - DNA, 20 bp, mouse
ggctgccgaaggccagcatg

SEQ ID NO: 605910 - DNA, 20 bp, mouse
gcagatcaccttgtgctcca

SEQ ID NO: 605911 - DNA, 20 bp, mouse
ggaagctgccatggagcaca

SEQ ID NO: 605912 - DNA, 20 bp, mouse
gtcttcccgtgaagctgcca

SEQ ID NO: 605913 - DNA, 20 bp, mouse
ggcctgggcaaggctgccga

SEQ ID NO: 605914 - DNA, 20 bp, mouse
ggtgatctgtgtcctcgctg

SEQ ID NO: 605915 - DNA, 20 bp, mouse
gcaagctcatccatcactcg

SEQ ID NO: 605916 - DNA, 20 bp, mouse
ggagcagacatgcgacctcg

SEQ ID NO: 605917 - DNA, 20 bp, mouse
gccaggaccactgccagcag

SEQ ID NO: 605918 - DNA, 20 bp, mouse
gtgtctgctccactggacct

SEQ ID NO: 605919 - DNA, 20 bp, mouse
gccagcaggggggcacctcg

SEQ ID NO: 605920 - DNA, 20 bp, mouse
gccctcaaaggacaaaggca

SEQ ID NO: 605921 - DNA, 20 bp, mouse
gttcatctaggacctggact

SEQ ID NO: 605922 - DNA, 20 bp, mouse
gcagcagcacccagacagca

SEQ ID NO: 605923 - DNA, 20 bp, mouse
gggtcgcatgtctgctccac

SEQ ID NO: 605924 - DNA, 20 bp, mouse
ggactgcatgctctggtaga

SEQ ID NO: 605925 - DNA, 20 bp, mouse
ggacccagcaggtgaaaggt

SEQ ID NO: 605926 - DNA, 20 bp, mouse
gcatggagaccagagccctc

SEQ ID NO: 605927 - DNA, 20 bp, mouse
gagcattagccagagggctc

SEQ ID NO: 605928 - DNA, 20 bp, mouse
gagcttcaggaccactgcac

SEQ ID NO: 605929 - DNA, 20 bp, mouse
gtaatctgcagctatcccag

SEQ ID NO: 605930 - DNA, 20 bp, mouse
ggccctctggctaatgctgt

SEQ ID NO: 605931 - DNA, 20 bp, mouse
gcaccaacagcattagccag

SEQ ID NO: 605932 - DNA, 20 bp, mouse
gctaggctgggacctctgtg

SEQ ID NO: 605933 - DNA, 20 bp, mouse
gtgcagcggggttggaacca

SEQ ID NO: 605934 - DNA, 20 bp, mouse
gggtcccagcctaggacaga

SEQ ID NO: 605935 - DNA, 20 bp, mouse
gagagttgacatactcggga

SEQ ID NO: 605936 - DNA, 20 bp, mouse
ggactcaaggaggaggtcgg

SEQ ID NO: 605937 - DNA, 20 bp, mouse
gacaccgagtgagcccgcag

SEQ ID NO: 605938 - DNA, 20 bp, mouse
ggcagctcggcgaggctcgg

SEQ ID NO: 605939 - DNA, 20 bp, mouse
ggcagcggccgggtcagctg

SEQ ID NO: 605940 - DNA, 20 bp, mouse
gacagccacggtcccgtacg

SEQ ID NO: 605941 - DNA, 20 bp, mouse
ggcgtggcgactcaaggagg

SEQ ID NO: 605942 - DNA, 20 bp, mouse
gtggctgtcgctaggctcgt

SEQ ID NO: 605943 - DNA, 20 bp, mouse
gcgccacgcgcgcctcactc

SEQ ID NO: 605944 - DNA, 20 bp, mouse
gtcactcggtgtcgcagagg

SEQ ID NO: 605945 - DNA, 20 bp, mouse
gggctcactcggtgtcgcag

SEQ ID NO: 605946 - DNA, 20 bp, mouse
gacgctgggcgaaggctgtg

SEQ ID NO: 605947 - DNA, 20 bp, mouse
gagcgtccccgaatctgcga

SEQ ID NO: 605948 - DNA, 20 bp, mouse
gggtcccgccagcccaaacc

SEQ ID NO: 605949 - DNA, 20 bp, mouse
ggccggtaaaggccacatcc

SEQ ID NO: 605950 - DNA, 20 bp, mouse
ggaaggctgtgtggctctcg

SEQ ID NO: 605951 - DNA, 20 bp, mouse
ggccagcccaaacccggatg

SEQ ID NO: 605952 - DNA, 20 bp, mouse
gggcggtgctgtaattgagt

SEQ ID NO: 605953 - DNA, 20 bp, mouse
gccggtgcatagtgaggagg

SEQ ID NO: 605954 - DNA, 20 bp, mouse
gtcgccggtgcatagtgagg

SEQ ID NO: 605955 - DNA, 20 bp, mouse
ggtttcgccggtgcatagtg

SEQ ID NO: 605956 - DNA, 20 bp, mouse
gaggatgaggccccttatag

SEQ ID NO: 605957 - DNA, 20 bp, mouse
gttgtaggcataagagagag

SEQ ID NO: 605958 - DNA, 20 bp, mouse
gtgtttattcacagcgagga

SEQ ID NO: 605959 - DNA, 20 bp, mouse
gatggccaggagacttgaca

SEQ ID NO: 605960 - DNA, 20 bp, mouse
gagaatgaacaaacagccag

SEQ ID NO: 605961 - DNA, 20 bp, mouse
gggagatgagtggaaatagt

SEQ ID NO: 605962 - DNA, 20 bp, mouse
gagtgggagatgaagactca

SEQ ID NO: 605963 - DNA, 20 bp, mouse
gatgaggccccttatagggg

SEQ ID NO: 605964 - DNA, 20 bp, mouse
gctggccatgtcaagtctcc

SEQ ID NO: 605965 - DNA, 20 bp, mouse
gtttcattcttgtgtgcgag

SEQ ID NO: 605966 - DNA, 20 bp, mouse
gtagcagggtccatagtgtt

SEQ ID NO: 605967 - DNA, 20 bp, mouse
gacagcaccacccaacacta

SEQ ID NO: 605968 - DNA, 20 bp, mouse
gggttctctggacgcctgga

SEQ ID NO: 605969 - DNA, 20 bp, mouse
gctagcactctcctccctcc

SEQ ID NO: 605970 - DNA, 20 bp, mouse
gggtccctgccgccaccgag

SEQ ID NO: 605971 - DNA, 20 bp, mouse
ggcaaattccacagttgcag

SEQ ID NO: 605972 - DNA, 20 bp, mouse
ggggtggtgctgtggttctc

SEQ ID NO: 605973 - DNA, 20 bp, mouse
gctagggcacgacttcccct

SEQ ID NO: 605974 - DNA, 20 bp, mouse
gcacgacttcccctcggtgg

SEQ ID NO: 605975 - DNA, 20 bp, mouse
gcggcagggacctaaagaca

SEQ ID NO: 605976 - DNA, 20 bp, mouse
ggacacctcaagcctcagag

SEQ ID NO: 605977 - DNA, 20 bp, mouse
gggcagtactggagcatcgt

SEQ ID NO: 605978 - DNA, 20 bp, mouse
gatctctgtgggagaaccgg

SEQ ID NO: 605979 - DNA, 20 bp, mouse
gggagaaccggaggcagtac

SEQ ID NO: 605980 - DNA, 20 bp, mouse
gctgtgtcgcaaggcctgat

SEQ ID NO: 605981 - DNA, 20 bp, mouse
gagtgctctcagggacgatg

SEQ ID NO: 605982 - DNA, 20 bp, mouse
gagcaaggagattggagtgt

SEQ ID NO: 605983 - DNA, 20 bp, mouse
gacttggagagccagaatat

SEQ ID NO: 605984 - DNA, 20 bp, mouse
gtggagtcgggtgcaaacga

SEQ ID NO: 605985 - DNA, 20 bp, mouse
gtagcagccgcctcgcggga

SEQ ID NO: 605986 - DNA, 20 bp, mouse
ggtcaaagccgagtcctgag

SEQ ID NO: 605987 - DNA, 20 bp, mouse
gacaggcacgaggcagggac

SEQ ID NO: 605988 - DNA, 20 bp, mouse
gggtcctggtgtcttcgtcg

SEQ ID NO: 605989 - DNA, 20 bp, mouse
gaaacctggaccagaagtaa

SEQ ID NO: 605990 - DNA, 20 bp, mouse
gctcggctttgacaggcacg

SEQ ID NO: 605991 - DNA, 20 bp, mouse
gaccagaagtaagggtgagg

SEQ ID NO: 605992 - DNA, 20 bp, mouse
gaggacctgcagctgtgaat

SEQ ID NO: 605993 - DNA, 20 bp, mouse
gcagaaagatctgagaggta

SEQ ID NO: 605994 - DNA, 20 bp, mouse
gtggaccagaagtaagggtg

SEQ ID NO: 605995 - DNA, 20 bp, mouse
ggactccaagacccactcgt

SEQ ID NO: 605996 - DNA, 20 bp, mouse
gcgaggggcgcagggtacag

SEQ ID NO: 605997 - DNA, 20 bp, mouse
gtgggccgtgccgctgacaa

SEQ ID NO: 605998 - DNA, 20 bp, mouse
ggctgcattgcggactgtag

SEQ ID NO: 605999 - DNA, 20 bp, mouse
gcgccacgcgaggaccacga

SEQ ID NO: 606000 - DNA, 20 bp, mouse
gcagaaggcgtgcggagcgc

SEQ ID NO: 606001 - DNA, 20 bp, mouse
ggaaggcccggaggacccga

SEQ ID NO: 606002 - DNA, 20 bp, mouse
gaggcagcgctgccttcaga

SEQ ID NO: 606003 - DNA, 20 bp, mouse
gagcgcgggctgctgcattg

SEQ ID NO: 606004 - DNA, 20 bp, mouse
gttccgccgggagcacgtgg

SEQ ID NO: 606005 - DNA, 20 bp, mouse
gtcagcggcacggcccatcg

SEQ ID NO: 606006 - DNA, 20 bp, mouse
ggtagagacccacaagacca

SEQ ID NO: 606007 - DNA, 20 bp, mouse
gctaccccttcatcccagta

SEQ ID NO: 606008 - DNA, 20 bp, mouse
gcgtcatcctgtcccctact

SEQ ID NO: 606009 - DNA, 20 bp, mouse
gaaagatgttggctgctacc

SEQ ID NO: 606010 - DNA, 20 bp, mouse
gcttcatcccagtaggggac

SEQ ID NO: 606011 - DNA, 20 bp, mouse
gctgatgagtagactcagat

SEQ ID NO: 606012 - DNA, 20 bp, mouse
ggcaaacttaccaaagatgt

SEQ ID NO: 606013 - DNA, 20 bp, mouse
gatgacggccctggtcttgt

SEQ ID NO: 606014 - DNA, 20 bp, mouse
gtaacctcacaaatgcccag

SEQ ID NO: 606015 - DNA, 20 bp, mouse
gggggacaggatgacggccc

SEQ ID NO: 606016 - DNA, 20 bp, mouse
ggcttcgcgaagctgccggg

SEQ ID NO: 606017 - DNA, 20 bp, mouse
gaggaccagaacgctcctcc

SEQ ID NO: 606018 - DNA, 20 bp, mouse
gatgtccgctgcgagccggg

SEQ ID NO: 606019 - DNA, 20 bp, mouse
gcgctcctcccggctcgcag

SEQ ID NO: 606020 - DNA, 20 bp, mouse
ggcggcgtctgaagaaccga

SEQ ID NO: 606021 - DNA, 20 bp, mouse
gagcgggtcctggtgaccgg

SEQ ID NO: 606022 - DNA, 20 bp, mouse
gcgagccgggaggagcgttc

SEQ ID NO: 606023 - DNA, 20 bp, mouse
gttggctggccagaaagtga

SEQ ID NO: 606024 - DNA, 20 bp, mouse
ggagccagcgccgtaaagcg

SEQ ID NO: 606025 - DNA, 20 bp, mouse
ggaagatgtccgctgcgagc

SEQ ID NO: 606026 - DNA, 20 bp, mouse
gccaaccgcagggagcgcgg

SEQ ID NO: 606027 - DNA, 20 bp, mouse
gctgctagcgctgggtatgt

SEQ ID NO: 606028 - DNA, 20 bp, mouse
gctcaggccagggccaccta

SEQ ID NO: 606029 - DNA, 20 bp, mouse
gtcgccaaccgcagggagcg

SEQ ID NO: 606030 - DNA, 20 bp, mouse
ggcccccagggactcgaaag

SEQ ID NO: 606031 - DNA, 20 bp, mouse
ggcttgggagaacagaagag

SEQ ID NO: 606032 - DNA, 20 bp, mouse
gcggctactcgccaaccgca

SEQ ID NO: 606033 - DNA, 20 bp, mouse
gcaggtaggcaggagggcgt

SEQ ID NO: 606034 - DNA, 20 bp, mouse
gagttcttggtgactcccgg

SEQ ID NO: 606035 - DNA, 20 bp, mouse
gagagcgagctgtccggtcg

SEQ ID NO: 606036 - DNA, 20 bp, mouse
gtggctgtctggaggatccg

SEQ ID NO: 606037 - DNA, 20 bp, mouse
gctgtctggaggatccgcgg

SEQ ID NO: 606038 - DNA, 20 bp, mouse
gggacggcctggggcgcgaa

SEQ ID NO: 606039 - DNA, 20 bp, mouse
gcggcctggggcgcgaaggg

SEQ ID NO: 606040 - DNA, 20 bp, mouse
gcgggggcctggctgtctgg

SEQ ID NO: 606041 - DNA, 20 bp, mouse
gtcccccctgccccggccgg

SEQ ID NO: 606042 - DNA, 20 bp, mouse
gaccagccgccgccgcaggg

SEQ ID NO: 606043 - DNA, 20 bp, mouse
gagccgggggtgccccgaag

SEQ ID NO: 606044 - DNA, 20 bp, mouse
ggagggctggtccggaatag

SEQ ID NO: 606045 - DNA, 20 bp, mouse
gagcgatcgagtgtccacga

SEQ ID NO: 606046 - DNA, 20 bp, mouse
ggcaccgccatggaggacct

SEQ ID NO: 606047 - DNA, 20 bp, mouse
gggaaggatgagaggctagg

SEQ ID NO: 606048 - DNA, 20 bp, mouse
gggacagcttggggagagta

SEQ ID NO: 606049 - DNA, 20 bp, mouse
gtcacccaggtcctccatgg

SEQ ID NO: 606050 - DNA, 20 bp, mouse
ggtccgccagcgcaccgcca

SEQ ID NO: 606051 - DNA, 20 bp, mouse
gcagcttggggagagtaggg

SEQ ID NO: 606052 - DNA, 20 bp, mouse
gtgggaaggggatagatgcg

SEQ ID NO: 606053 - DNA, 20 bp, mouse
ggtcgcaagcgaggcaggaa

SEQ ID NO: 606054 - DNA, 20 bp, mouse
ggtgcgctggcggacagctt

SEQ ID NO: 606055 - DNA, 20 bp, mouse
gagaagtgtgagttgggaag

SEQ ID NO: 606056 - DNA, 20 bp, mouse
gtgccggcaggagagcgagt

SEQ ID NO: 606057 - DNA, 20 bp, mouse
gcatctgcggagagaaggat

SEQ ID NO: 606058 - DNA, 20 bp, mouse
ggctaggagaagctagggaa

SEQ ID NO: 606059 - DNA, 20 bp, mouse
gccgccccggagatccacag

SEQ ID NO: 606060 - DNA, 20 bp, mouse
gacgagacgagaaggtccgg

SEQ ID NO: 606061 - DNA, 20 bp, mouse
gagccaacgcgcccaggagg

SEQ ID NO: 606062 - DNA, 20 bp, mouse
gcagatgggttgctccagaa

SEQ ID NO: 606063 - DNA, 20 bp, mouse
ggaatcgtgatgttatctgc

SEQ ID NO: 606064 - DNA, 20 bp, mouse
gaggcagatgcgccccggag

SEQ ID NO: 606065 - DNA, 20 bp, mouse
gcggcctctgtggatctccg

SEQ ID NO: 606066 - DNA, 20 bp, mouse
gagagaggcgagacgcgcac

SEQ ID NO: 606067 - DNA, 20 bp, mouse
ggaagagggccgagtgtagg

SEQ ID NO: 606068 - DNA, 20 bp, mouse
ggattcaccgcagctgactc

SEQ ID NO: 606069 - DNA, 20 bp, mouse
gcacgggaaaagctttgcgg

SEQ ID NO: 606070 - DNA, 20 bp, mouse
ggaagaagagggccgagtgt

SEQ ID NO: 606071 - DNA, 20 bp, mouse
gtacaactggcaagctggga

SEQ ID NO: 606072 - DNA, 20 bp, mouse
gcccagccaatgaagacgag

SEQ ID NO: 606073 - DNA, 20 bp, mouse
gcaggcccagctaaaggtgg

SEQ ID NO: 606074 - DNA, 20 bp, mouse
ggcgcacgggaaaagctttg

SEQ ID NO: 606075 - DNA, 20 bp, mouse
gcgctttccggagtcagctg

SEQ ID NO: 606076 - DNA, 20 bp, mouse
gtggtgaagtgagagcagcg

SEQ ID NO: 606077 - DNA, 20 bp, mouse
gcgatgaaagcaggcgcggg

SEQ ID NO: 606078 - DNA, 20 bp, mouse
ggcggacccacgatgaaagc

SEQ ID NO: 606079 - DNA, 20 bp, mouse
gagtcgcatgaggagcgcca

SEQ ID NO: 606080 - DNA, 20 bp, mouse
ggctgcagcaccagctggta

SEQ ID NO: 606081 - DNA, 20 bp, mouse
gcacgcctcccatcacagag

SEQ ID NO: 606082 - DNA, 20 bp, mouse
gccacgatgaaagcaggcgc

SEQ ID NO: 606083 - DNA, 20 bp, mouse
ggtcccagccgctctgtgat

SEQ ID NO: 606084 - DNA, 20 bp, mouse
gtgatgggaggcgtgagcat

SEQ ID NO: 606085 - DNA, 20 bp, mouse
gcatggagctggagcacgcg

SEQ ID NO: 606086 - DNA, 20 bp, mouse
gcgggccgggccacaaacag

SEQ ID NO: 606087 - DNA, 20 bp, mouse
ggccgggccacaaacagtgg

SEQ ID NO: 606088 - DNA, 20 bp, mouse
gtgcggacgacgtggagcag

SEQ ID NO: 606089 - DNA, 20 bp, mouse
gggaggggcgaggcttcctg

SEQ ID NO: 606090 - DNA, 20 bp, mouse
gtgaggagctgcggacgacg

SEQ ID NO: 606091 - DNA, 20 bp, mouse
gaacagtggcggcgggacca

SEQ ID NO: 606092 - DNA, 20 bp, mouse
gtgaggagaagctgcggccg

SEQ ID NO: 606093 - DNA, 20 bp, mouse
ggccggcctcgcacccctaa

SEQ ID NO: 606094 - DNA, 20 bp, mouse
ggcggcgacgctgctcccgg

SEQ ID NO: 606095 - DNA, 20 bp, mouse
ggcgagcctgccgaggtcgg

SEQ ID NO: 606096 - DNA, 20 bp, mouse
ggcccggaggaggcccccgg

SEQ ID NO: 606097 - DNA, 20 bp, mouse
gcggagcagcccccgaccca

SEQ ID NO: 606098 - DNA, 20 bp, mouse
gctgagagggcgaggagtaa

SEQ ID NO: 606099 - DNA, 20 bp, mouse
gagatgtggccggcgatccc

SEQ ID NO: 606100 - DNA, 20 bp, mouse
gggtctatgacgagcgacgg

SEQ ID NO: 606101 - DNA, 20 bp, mouse
gtccacaggacgatatgcag

SEQ ID NO: 606102 - DNA, 20 bp, mouse
gcgcgcacacgctcgcctgg

SEQ ID NO: 606103 - DNA, 20 bp, mouse
gtcaggatgcgggccagatg

SEQ ID NO: 606104 - DNA, 20 bp, mouse
gtccccggagctcggaggcc

SEQ ID NO: 606105 - DNA, 20 bp, mouse
ggagccccagtgaaccccca

SEQ ID NO: 606106 - DNA, 20 bp, mouse
gcgtgtgcgcggccgagtta

SEQ ID NO: 606107 - DNA, 20 bp, mouse
gcgccgcacgggcctgatgg

SEQ ID NO: 606108 - DNA, 20 bp, mouse
gcacccccatcaggcccgtg

SEQ ID NO: 606109 - DNA, 20 bp, mouse
gggatggcgcagttgaactg

SEQ ID NO: 606110 - DNA, 20 bp, mouse
gggcaggaggtgaaagtccc

SEQ ID NO: 606111 - DNA, 20 bp, mouse
gagcctggatcacccccatc

SEQ ID NO: 606112 - DNA, 20 bp, mouse
gccgagttagggcgccgcac

SEQ ID NO: 606113 - DNA, 20 bp, mouse
ggcgccactttcctcctccc

SEQ ID NO: 606114 - DNA, 20 bp, mouse
gcggtttggcgccctatcag

SEQ ID NO: 606115 - DNA, 20 bp, mouse
gtctctcactgccagggagg

SEQ ID NO: 606116 - DNA, 20 bp, mouse
gtacgcgggtgagaagcgag

SEQ ID NO: 606117 - DNA, 20 bp, mouse
gacgtgacgggaagcggctg

SEQ ID NO: 606118 - DNA, 20 bp, mouse
ggcagcccaggagccgcggc

SEQ ID NO: 606119 - DNA, 20 bp, mouse
gcggcccacgtgacgggaag

SEQ ID NO: 606120 - DNA, 20 bp, mouse
gcagcaccggtgaccacccc

SEQ ID NO: 606121 - DNA, 20 bp, mouse
gcggtgccccaggccgcggg

SEQ ID NO: 606122 - DNA, 20 bp, mouse
ggcgggtgagaagcgagggg

SEQ ID NO: 606123 - DNA, 20 bp, mouse
gggcgggtgcctgcatgact

SEQ ID NO: 606124 - DNA, 20 bp, mouse
gtgacgggaagcggctgcgg

SEQ ID NO: 606125 - DNA, 20 bp, mouse
ggcgggacggctgcgctacg

SEQ ID NO: 606126 - DNA, 20 bp, mouse
gcgagtggagcgggaaacaa

SEQ ID NO: 606127 - DNA, 20 bp, mouse
gcgaggtgcgccgagtggag

SEQ ID NO: 606128 - DNA, 20 bp, mouse
ggagggagggaattgggcca

SEQ ID NO: 606129 - DNA, 20 bp, mouse
gagcgccgaggtgcgccgag

SEQ ID NO: 606130 - DNA, 20 bp, mouse
ggttaccggagcactagtat

SEQ ID NO: 606131 - DNA, 20 bp, mouse
gaccggagcactagtatagg

SEQ ID NO: 606132 - DNA, 20 bp, mouse
ggccagcagccgtggagtgg

SEQ ID NO: 606133 - DNA, 20 bp, mouse
gttgggccagggagaacccc

SEQ ID NO: 606134 - DNA, 20 bp, mouse
gcagccgtggagtggcggga

SEQ ID NO: 606135 - DNA, 20 bp, mouse
gggagccagcagccgtggag

SEQ ID NO: 606136 - DNA, 20 bp, mouse
gaccgcgactgcagttccaa

SEQ ID NO: 606137 - DNA, 20 bp, mouse
gcgtgaggaagcgtgtttgg

SEQ ID NO: 606138 - DNA, 20 bp, mouse
gagcgcggagaaaccccgtg

SEQ ID NO: 606139 - DNA, 20 bp, mouse
gcctgggacagtcagagtgt

SEQ ID NO: 606140 - DNA, 20 bp, mouse
gccccgtgaggaagcgtgtt

SEQ ID NO: 606141 - DNA, 20 bp, mouse
gccacccaactctctaaggt

SEQ ID NO: 606142 - DNA, 20 bp, mouse
gccacgtcaaggggtgacag

SEQ ID NO: 606143 - DNA, 20 bp, mouse
ggtgtgggcgctctgagttg

SEQ ID NO: 606144 - DNA, 20 bp, mouse
ggtctaggtctgaaagaatg

SEQ ID NO: 606145 - DNA, 20 bp, mouse
gctgcagttccaacggaaca

SEQ ID NO: 606146 - DNA, 20 bp, mouse
gccagccgcgagctgtcagg

SEQ ID NO: 606147 - DNA, 20 bp, mouse
gacacccgcctgacagctcg

SEQ ID NO: 606148 - DNA, 20 bp, mouse
ggtgggtgtgtgagccccgg

SEQ ID NO: 606149 - DNA, 20 bp, mouse
gcaccctgcgcggagtacca

SEQ ID NO: 606150 - DNA, 20 bp, mouse
ggaccccgggaccaggcgaa

SEQ ID NO: 606151 - DNA, 20 bp, mouse
gggcgacagagcgggaccgg

SEQ ID NO: 606152 - DNA, 20 bp, mouse
gtcccggcgcgtgcgacagt

SEQ ID NO: 606153 - DNA, 20 bp, mouse
gggagaggggatctgacgtc

SEQ ID NO: 606154 - DNA, 20 bp, mouse
gtgcgcggagtaccagggaa

SEQ ID NO: 606155 - DNA, 20 bp, mouse
gccaaagctcctctgggaga

SEQ ID NO: 606156 - DNA, 20 bp, mouse
ggtgtcttgacctcctcgga

SEQ ID NO: 606157 - DNA, 20 bp, mouse
gagctgcccagagagagtca

SEQ ID NO: 606158 - DNA, 20 bp, mouse
ggtcttccctgactctctct

SEQ ID NO: 606159 - DNA, 20 bp, mouse
gtctggaagactgctttcag

SEQ ID NO: 606160 - DNA, 20 bp, mouse
gttcagtggcttagaaacca

SEQ ID NO: 606161 - DNA, 20 bp, mouse
ggtgctcacagagccagtca

SEQ ID NO: 606162 - DNA, 20 bp, mouse
gacagtcgggagcttccgag

SEQ ID NO: 606163 - DNA, 20 bp, mouse
gctcacagagccagtcacgg

SEQ ID NO: 606164 - DNA, 20 bp, mouse
ggcagtcttccagaacatgg

SEQ ID NO: 606165 - DNA, 20 bp, mouse
ggtcctacttcgttcatccc

SEQ ID NO: 606166 - DNA, 20 bp, mouse
gagctgcccagagagagtca

SEQ ID NO: 606167 - DNA, 20 bp, mouse
ggtcttccctgactctctct

SEQ ID NO: 606168 - DNA, 20 bp, mouse
gtctggaagactgctttcag

SEQ ID NO: 606169 - DNA, 20 bp, mouse
ggtgctcacagagccagtca

SEQ ID NO: 606170 - DNA, 20 bp, mouse
gttcagtggcttagaaacca

SEQ ID NO: 606171 - DNA, 20 bp, mouse
gacagtcgggagcttccgag

SEQ ID NO: 606172 - DNA, 20 bp, mouse
gctcacagagccagtcacgg

SEQ ID NO: 606173 - DNA, 20 bp, mouse
ggcagtcttccagaacatgg

SEQ ID NO: 606174 - DNA, 20 bp, mouse
ggtcctacttcgttcatccc

SEQ ID NO: 606175 - DNA, 20 bp, mouse
gggatcttcacagacttcaa

SEQ ID NO: 606176 - DNA, 20 bp, mouse
ggcccgggtggagcaggtca

SEQ ID NO: 606177 - DNA, 20 bp, mouse
gtgggacgggaccaacaggc

SEQ ID NO: 606178 - DNA, 20 bp, mouse
gcaggtcagggcgtttggga

SEQ ID NO: 606179 - DNA, 20 bp, mouse
gctggcagcggtgttggtga

SEQ ID NO: 606180 - DNA, 20 bp, mouse
gggagcaggtcagggcgttt

SEQ ID NO: 606181 - DNA, 20 bp, mouse
gctggacgtagccacgcgag

SEQ ID NO: 606182 - DNA, 20 bp, mouse
gtaagctggagcctctcacc

SEQ ID NO: 606183 - DNA, 20 bp, mouse
gcacgcgagtggaaggtgta

SEQ ID NO: 606184 - DNA, 20 bp, mouse
gcagcaggtaggaggcatag

SEQ ID NO: 606185 - DNA, 20 bp, mouse
ggcccacagcaggtacgcac

SEQ ID NO: 606186 - DNA, 20 bp, mouse
gggcgacagctcagacgcag

SEQ ID NO: 606187 - DNA, 20 bp, mouse
gtctgccatggccaggctag

SEQ ID NO: 606188 - DNA, 20 bp, mouse
ggtcgccgctagcctggcca

SEQ ID NO: 606189 - DNA, 20 bp, mouse
ggcagcgggacactcaagcg

SEQ ID NO: 606190 - DNA, 20 bp, mouse
gtggcagagggtgagtgcct

SEQ ID NO: 606191 - DNA, 20 bp, mouse
gcctggggtggggaaaactg

SEQ ID NO: 606192 - DNA, 20 bp, mouse
gcaagcgaggatcaccagcg

SEQ ID NO: 606193 - DNA, 20 bp, mouse
gctcaccctctgccatggcc

SEQ ID NO: 606194 - DNA, 20 bp, mouse
gtcccgactctacctccccg

SEQ ID NO: 606195 - DNA, 20 bp, mouse
gagctccagaggagagcgac

SEQ ID NO: 606196 - DNA, 20 bp, mouse
gcccagaggagccccaggaa

SEQ ID NO: 606197 - DNA, 20 bp, mouse
gcagccccagagggtagtat

SEQ ID NO: 606198 - DNA, 20 bp, mouse
ggcttcttctgcctttcctg

SEQ ID NO: 606199 - DNA, 20 bp, mouse
gtcattcccagaggagcccc

SEQ ID NO: 606200 - DNA, 20 bp, mouse
gggaatgacagagatggtgt

SEQ ID NO: 606201 - DNA, 20 bp, mouse
gtgaccatgagtggtgagtg

SEQ ID NO: 606202 - DNA, 20 bp, mouse
ggagcagccagctggaacag

SEQ ID NO: 606203 - DNA, 20 bp, mouse
gcagtgatggaacatgactg

SEQ ID NO: 606204 - DNA, 20 bp, mouse
gtaaatggtaaggcaatcct

SEQ ID NO: 606205 - DNA, 20 bp, mouse
gggttcccacaagaacctgc

SEQ ID NO: 606206 - DNA, 20 bp, mouse
ggactctagtctgatgccaa

SEQ ID NO: 606207 - DNA, 20 bp, mouse
gtcagactagagtcttgaca

SEQ ID NO: 606208 - DNA, 20 bp, mouse
ggagagaggtagcaggacca

SEQ ID NO: 606209 - DNA, 20 bp, mouse
gtagcaggaccatggactcc

SEQ ID NO: 606210 - DNA, 20 bp, mouse
gagcaagccatggattaggt

SEQ ID NO: 606211 - DNA, 20 bp, mouse
gagacagcaagccatggatt

SEQ ID NO: 606212 - DNA, 20 bp, mouse
gcccaggagcatataaaaag

SEQ ID NO: 606213 - DNA, 20 bp, mouse
gtgtcctcctacctaatcca

SEQ ID NO: 606214 - DNA, 20 bp, mouse
gggccgaggtaccactgtga

SEQ ID NO: 606215 - DNA, 20 bp, mouse
gtcattctcagagcaggatg

SEQ ID NO: 606216 - DNA, 20 bp, mouse
gtcggagcctcggcatggaa

SEQ ID NO: 606217 - DNA, 20 bp, mouse
ggtctctcggagcctcggca

SEQ ID NO: 606218 - DNA, 20 bp, mouse
gtcccccacagacagctgga

SEQ ID NO: 606219 - DNA, 20 bp, mouse
gagcttcaggaaactgatcc

SEQ ID NO: 606220 - DNA, 20 bp, mouse
gccgaggctccgagagacac

SEQ ID NO: 606221 - DNA, 20 bp, mouse
ggccaccatggcccaaggta

SEQ ID NO: 606222 - DNA, 20 bp, mouse
gtccctaccttgggccatgg

SEQ ID NO: 606223 - DNA, 20 bp, mouse
gccgagagacactggaggtg

SEQ ID NO: 606224 - DNA, 20 bp, mouse
gcaggaagccaagagccctc

SEQ ID NO: 606225 - DNA, 20 bp, mouse
gacacggtgggtagaaaatg

SEQ ID NO: 606226 - DNA, 20 bp, mouse
gagatggacgcctgctccct

SEQ ID NO: 606227 - DNA, 20 bp, mouse
gctgccatgcaacagccaga

SEQ ID NO: 606228 - DNA, 20 bp, mouse
gcgtccatctggctgttgca

SEQ ID NO: 606229 - DNA, 20 bp, mouse
gcagcagagtgtagttcgtc

SEQ ID NO: 606230 - DNA, 20 bp, mouse
gactatgggagaatatcttg

SEQ ID NO: 606231 - DNA, 20 bp, mouse
ggacaggagaggtgctgtat

SEQ ID NO: 606232 - DNA, 20 bp, mouse
ggccttggccatgattgaca

SEQ ID NO: 606233 - DNA, 20 bp, mouse
gaggagaggtgctgtatggg

SEQ ID NO: 606234 - DNA, 20 bp, mouse
gtgattgacagggttcattg

SEQ ID NO: 606235 - DNA, 20 bp, mouse
gcattaatgaagaacatcac

SEQ ID NO: 606236 - DNA, 20 bp, mouse
gtgtggaactgcagatcccc

SEQ ID NO: 606237 - DNA, 20 bp, mouse
gcaagcccaaatcctcagtg

SEQ ID NO: 606238 - DNA, 20 bp, mouse
gcaaggctgccacttgggga

SEQ ID NO: 606239 - DNA, 20 bp, mouse
ggtgagctcaccctgccctg

SEQ ID NO: 606240 - DNA, 20 bp, mouse
gcaagacagaaagttcctgg

SEQ ID NO: 606241 - DNA, 20 bp, mouse
ggtggtccttgttgttcctg

SEQ ID NO: 606242 - DNA, 20 bp, mouse
gagctccaaggctgccactt

SEQ ID NO: 606243 - DNA, 20 bp, mouse
gtaagatgaagatctggcca

SEQ ID NO: 606244 - DNA, 20 bp, mouse
gttgaaggaacctcagggca

SEQ ID NO: 606245 - DNA, 20 bp, mouse
gtcacctgtctcagccacaa

SEQ ID NO: 606246 - DNA, 20 bp, mouse
gctctcacgtcatcagaggg

SEQ ID NO: 606247 - DNA, 20 bp, mouse
gcagtccgccggaaagggag

SEQ ID NO: 606248 - DNA, 20 bp, mouse
gtgtttctcagcagtctgcg

SEQ ID NO: 606249 - DNA, 20 bp, mouse
gtaccggaacacacagacaa

SEQ ID NO: 606250 - DNA, 20 bp, mouse
gaagcgcagactgcaggatg

SEQ ID NO: 606251 - DNA, 20 bp, mouse
gcaacagcttccgaaaaacg

SEQ ID NO: 606252 - DNA, 20 bp, mouse
gagatggctagagcagggtc

SEQ ID NO: 606253 - DNA, 20 bp, mouse
gctcccgtagcgacccacca

SEQ ID NO: 606254 - DNA, 20 bp, mouse
ggccgctctcacgtcatcag

SEQ ID NO: 606255 - DNA, 20 bp, mouse
gaaggcgacgcagcacctgc

SEQ ID NO: 606256 - DNA, 20 bp, mouse
gactcgcgcgggcagaggag

SEQ ID NO: 606257 - DNA, 20 bp, mouse
gagaaaggcgtaactcgcgc

SEQ ID NO: 606258 - DNA, 20 bp, mouse
ggaggagcggaacgcgcctg

SEQ ID NO: 606259 - DNA, 20 bp, mouse
gtcccggctcgagcgtcccc

SEQ ID NO: 606260 - DNA, 20 bp, mouse
ggcgtaactcgcgcgggcag

SEQ ID NO: 606261 - DNA, 20 bp, mouse
gcgcctggggacgctcgagc

SEQ ID NO: 606262 - DNA, 20 bp, mouse
ggtgtcgcagagttagagag

SEQ ID NO: 606263 - DNA, 20 bp, mouse
gcgacagcagctaccggaag

SEQ ID NO: 606264 - DNA, 20 bp, mouse
gttcattgaagaccgcgagg

SEQ ID NO: 606265 - DNA, 20 bp, mouse
gagccagccagccgcgctac

SEQ ID NO: 606266 - DNA, 20 bp, mouse
gtggcttgcatggctggcta

SEQ ID NO: 606267 - DNA, 20 bp, mouse
gacccttttagcacagttca

SEQ ID NO: 606268 - DNA, 20 bp, mouse
gaaggagaatatatggagtg

SEQ ID NO: 606269 - DNA, 20 bp, mouse
gatactttggcttgcatggc

SEQ ID NO: 606270 - DNA, 20 bp, mouse
gttttatagtgaggaataca

SEQ ID NO: 606271 - DNA, 20 bp, mouse
gagatgggtcaagttgttta

SEQ ID NO: 606272 - DNA, 20 bp, mouse
gcagttcatggtagatactt

SEQ ID NO: 606273 - DNA, 20 bp, mouse
gaggccttattgtatctgag

SEQ ID NO: 606274 - DNA, 20 bp, mouse
gggctattaccaggtaactt

SEQ ID NO: 606275 - DNA, 20 bp, mouse
ggtagatactttggcttgca

SEQ ID NO: 606276 - DNA, 20 bp, mouse
gaaaggaggagaccgtggga

SEQ ID NO: 606277 - DNA, 20 bp, mouse
gcactgctgaggtaagtgaa

SEQ ID NO: 606278 - DNA, 20 bp, mouse
ggctgtcctgacaccaggaa

SEQ ID NO: 606279 - DNA, 20 bp, mouse
gtttatgaagagaggacatg

SEQ ID NO: 606280 - DNA, 20 bp, mouse
gggagtgctgtcctgacacc

SEQ ID NO: 606281 - DNA, 20 bp, mouse
ggataaagacgttccctaag

SEQ ID NO: 606282 - DNA, 20 bp, mouse
gacagaacatcccaaagcag

SEQ ID NO: 606283 - DNA, 20 bp, mouse
gctcatgctatcacacatct

SEQ ID NO: 606284 - DNA, 20 bp, mouse
gctgtgatggctttcctctt

SEQ ID NO: 606285 - DNA, 20 bp, mouse
gctcaggtttgtactcaggg

SEQ ID NO: 606286 - DNA, 20 bp, mouse
gtgtggcgaggaggcgctgg

SEQ ID NO: 606287 - DNA, 20 bp, mouse
gcccttgggctgtggcgagg

SEQ ID NO: 606288 - DNA, 20 bp, mouse
gcggctcttctgaagccctt

SEQ ID NO: 606289 - DNA, 20 bp, mouse
gaagcccttgggctgtggcg

SEQ ID NO: 606290 - DNA, 20 bp, mouse
ggcctcctcgccacagccca

SEQ ID NO: 606291 - DNA, 20 bp, mouse
ggggtgggcatagtgcaagc

SEQ ID NO: 606292 - DNA, 20 bp, mouse
gaagcaggccgaggctgtca

SEQ ID NO: 606293 - DNA, 20 bp, mouse
gttctgaagcccttgggctg

SEQ ID NO: 606294 - DNA, 20 bp, mouse
gagtgtctggtacctagggt

SEQ ID NO: 606295 - DNA, 20 bp, mouse
gtaagacccactccaaccct

SEQ ID NO: 606296 - DNA, 20 bp, mouse
gttctcggccgcaggagcgg

SEQ ID NO: 606297 - DNA, 20 bp, mouse
gtagcatggcggcccggaac

SEQ ID NO: 606298 - DNA, 20 bp, mouse
gtctttctcggccgcaggag

SEQ ID NO: 606299 - DNA, 20 bp, mouse
gaacaggctgcgtagcatgg

SEQ ID NO: 606300 - DNA, 20 bp, mouse
gaggcgcgctatggccgaag

SEQ ID NO: 606301 - DNA, 20 bp, mouse
ggtggacctacgcagcgaca

SEQ ID NO: 606302 - DNA, 20 bp, mouse
gcgggaccgtggcccggaac

SEQ ID NO: 606303 - DNA, 20 bp, mouse
ggggctcaccgtggaccgta

SEQ ID NO: 606304 - DNA, 20 bp, mouse
gcgacacggtgacccggcca

SEQ ID NO: 606305 - DNA, 20 bp, mouse
gctgtggcactcgtctttct

SEQ ID NO: 606306 - DNA, 20 bp, mouse
ggggacgcggtagacttgac

SEQ ID NO: 606307 - DNA, 20 bp, mouse
gtccccggcgaagggaggca

SEQ ID NO: 606308 - DNA, 20 bp, mouse
ggtccctgcggcttgtaacg

SEQ ID NO: 606309 - DNA, 20 bp, mouse
ggccctgcctcccttcgccg

SEQ ID NO: 606310 - DNA, 20 bp, mouse
gcaagtctaccgcgtccctg

SEQ ID NO: 606311 - DNA, 20 bp, mouse
gagcttgcaggccaccccga

SEQ ID NO: 606312 - DNA, 20 bp, mouse
gtggtgcgcgatccaaaaac

SEQ ID NO: 606313 - DNA, 20 bp, mouse
gccgggcgctgaggtctcca

SEQ ID NO: 606314 - DNA, 20 bp, mouse
gcctcagcgcccggaagcca

SEQ ID NO: 606315 - DNA, 20 bp, mouse
ggccacggctggcaccctcg

SEQ ID NO: 606316 - DNA, 20 bp, mouse
ggctaaagcaaaccccacaa

SEQ ID NO: 606317 - DNA, 20 bp, mouse
gcccgggccgaagggaagtg

SEQ ID NO: 606318 - DNA, 20 bp, mouse
gcgagtcctcgcgagaggtg

SEQ ID NO: 606319 - DNA, 20 bp, mouse
ggcaaaccccacaacggaca

SEQ ID NO: 606320 - DNA, 20 bp, mouse
gggccgaagggaagtgtgga

SEQ ID NO: 606321 - DNA, 20 bp, mouse
ggggagacgggcgacagctg

SEQ ID NO: 606322 - DNA, 20 bp, mouse
gcctccgccatcttgaagat

SEQ ID NO: 606323 - DNA, 20 bp, mouse
gccgtctcccatcttcaaga

SEQ ID NO: 606324 - DNA, 20 bp, mouse
ggactaccctgtccgttgtg

SEQ ID NO: 606325 - DNA, 20 bp, mouse
gcccgggaggcaggcgaagg

SEQ ID NO: 606326 - DNA, 20 bp, mouse
gccgtcgaggagctgagaca

SEQ ID NO: 606327 - DNA, 20 bp, mouse
gggcctctcgagctcttcga

SEQ ID NO: 606328 - DNA, 20 bp, mouse
gaagagctcgagaggccggt

SEQ ID NO: 606329 - DNA, 20 bp, mouse
gggccgtcgaagagctcgag

SEQ ID NO: 606330 - DNA, 20 bp, mouse
ggccgactccgaagcgcagg

SEQ ID NO: 606331 - DNA, 20 bp, mouse
gcgcaggcggacggccgggt

SEQ ID NO: 606332 - DNA, 20 bp, mouse
gctgagacaggggccagacc

SEQ ID NO: 606333 - DNA, 20 bp, mouse
gcgcttcggagtcggcccgg

SEQ ID NO: 606334 - DNA, 20 bp, mouse
ggtggacgctgcagagacgg

SEQ ID NO: 606335 - DNA, 20 bp, mouse
gcggtccgcaaccatattct

SEQ ID NO: 606336 - DNA, 20 bp, mouse
ggtcaaacgctagacaaacg

SEQ ID NO: 606337 - DNA, 20 bp, mouse
gtaagactgcagggacacaa

SEQ ID NO: 606338 - DNA, 20 bp, mouse
gtcggtgcagagcgcgggga

SEQ ID NO: 606339 - DNA, 20 bp, mouse
ggcgctctgcaccgagctgg

SEQ ID NO: 606340 - DNA, 20 bp, mouse
gacctcggacgggatgctag

SEQ ID NO: 606341 - DNA, 20 bp, mouse
gaggggcgtgcacagtaccg

SEQ ID NO: 606342 - DNA, 20 bp, mouse
gaacgctagacaaacgaggc

SEQ ID NO: 606343 - DNA, 20 bp, mouse
gccgccgcggcgcaattggt

SEQ ID NO: 606344 - DNA, 20 bp, mouse
gcccctcccaggtttacctg

SEQ ID NO: 606345 - DNA, 20 bp, mouse
gagcttccacaggtaaacct

SEQ ID NO: 606346 - DNA, 20 bp, mouse
ggccgggccgcgcaagactt

SEQ ID NO: 606347 - DNA, 20 bp, mouse
ggagatgccgaagtcttgcg

SEQ ID NO: 606348 - DNA, 20 bp, mouse
ggagccgccatcttttttag

SEQ ID NO: 606349 - DNA, 20 bp, mouse
gcttcctgcggctgctgtag

SEQ ID NO: 606350 - DNA, 20 bp, mouse
ggtggaccgggactgcgtag

SEQ ID NO: 606351 - DNA, 20 bp, mouse
ggaagcagctcaccttccac

SEQ ID NO: 606352 - DNA, 20 bp, mouse
gacttcggcatctcggagat

SEQ ID NO: 606353 - DNA, 20 bp, mouse
gcggcttccccatccctcac

SEQ ID NO: 606354 - DNA, 20 bp, mouse
gccactgcccctaaaaaaga

SEQ ID NO: 606355 - DNA, 20 bp, mouse
gctgcttccaggcgaggagg

SEQ ID NO: 606356 - DNA, 20 bp, mouse
ggtgtcgccgcgctccctcg

SEQ ID NO: 606357 - DNA, 20 bp, mouse
gtcgccgcgctccctcgggg

SEQ ID NO: 606358 - DNA, 20 bp, mouse
gctggcccgacccgccccga

SEQ ID NO: 606359 - DNA, 20 bp, mouse
gggcaaggatcggagcctgg

SEQ ID NO: 606360 - DNA, 20 bp, mouse
ggctaaccgagggtaactgt

SEQ ID NO: 606361 - DNA, 20 bp, mouse
gtcacgaccgaggcccgcaa

SEQ ID NO: 606362 - DNA, 20 bp, mouse
ggcgggcgggcggcaaggat

SEQ ID NO: 606363 - DNA, 20 bp, mouse
ggcgacacagctcgggacgt

SEQ ID NO: 606364 - DNA, 20 bp, mouse
gtccccgcgggccccggcca

SEQ ID NO: 606365 - DNA, 20 bp, mouse
gtgtctgtacggaaagatgg

SEQ ID NO: 606366 - DNA, 20 bp, mouse
gctcccgtcagcggtactca

SEQ ID NO: 606367 - DNA, 20 bp, mouse
ggaccgtgagtaccgctgac

SEQ ID NO: 606368 - DNA, 20 bp, mouse
ggaacgagctaggacaagac

SEQ ID NO: 606369 - DNA, 20 bp, mouse
gttctatagactcccgtcag

SEQ ID NO: 606370 - DNA, 20 bp, mouse
gtcctgcgaggcctaaggtg

SEQ ID NO: 606371 - DNA, 20 bp, mouse
gggagtctatagaacgagct

SEQ ID NO: 606372 - DNA, 20 bp, mouse
gcggcggcggagcagtgtcg

SEQ ID NO: 606373 - DNA, 20 bp, mouse
gctaggacaagactggtacg

SEQ ID NO: 606374 - DNA, 20 bp, mouse
gacgcacgcgcgctgacctg

SEQ ID NO: 606375 - DNA, 20 bp, mouse
ggattttggcggcgcagcaa

SEQ ID NO: 606376 - DNA, 20 bp, mouse
gcgccggaggcagagcggtg

SEQ ID NO: 606377 - DNA, 20 bp, mouse
gtccgccgccggaggcagag

SEQ ID NO: 606378 - DNA, 20 bp, mouse
gcatggcgggagttccggcg

SEQ ID NO: 606379 - DNA, 20 bp, mouse
gcggcggcggacgcgactcg

SEQ ID NO: 606380 - DNA, 20 bp, mouse
gcggcggacgcgactcgcgg

SEQ ID NO: 606381 - DNA, 20 bp, mouse
ggaaaagctgtcctctgtca

SEQ ID NO: 606382 - DNA, 20 bp, mouse
gagcggccggaggttatacg

SEQ ID NO: 606383 - DNA, 20 bp, mouse
gagtgggtgctggctacagg

SEQ ID NO: 606384 - DNA, 20 bp, mouse
gcccaatgggagataagagg

SEQ ID NO: 606385 - DNA, 20 bp, mouse
gtgccccaccgctctgcctc

SEQ ID NO: 606386 - DNA, 20 bp, mouse
gtcgcagggactaggagcct

SEQ ID NO: 606387 - DNA, 20 bp, mouse
ggcctgggctagaaacgtct

SEQ ID NO: 606388 - DNA, 20 bp, mouse
gaggctgcctcgcagggact

SEQ ID NO: 606389 - DNA, 20 bp, mouse
gtggtgcagacacccagtcc

SEQ ID NO: 606390 - DNA, 20 bp, mouse
gaactggagcttcagcggag

SEQ ID NO: 606391 - DNA, 20 bp, mouse
gcagcggagtggcatgttag

SEQ ID NO: 606392 - DNA, 20 bp, mouse
gtgttagaggctgcctcgca

SEQ ID NO: 606393 - DNA, 20 bp, mouse
gaacgtctaggttgtgatag

SEQ ID NO: 606394 - DNA, 20 bp, mouse
gagacacccagtccaggcag

SEQ ID NO: 606395 - DNA, 20 bp, mouse
gccgaacgtgcaaagaggga

SEQ ID NO: 606396 - DNA, 20 bp, mouse
gtgcctgcagaagtccgatg

SEQ ID NO: 606397 - DNA, 20 bp, mouse
ggctggctgactccaggcag

SEQ ID NO: 606398 - DNA, 20 bp, mouse
gggtaacctggagactactg

SEQ ID NO: 606399 - DNA, 20 bp, mouse
ggcagtggctggcttgactg

SEQ ID NO: 606400 - DNA, 20 bp, mouse
gtgcagaagtccgatgaggc

SEQ ID NO: 606401 - DNA, 20 bp, mouse
gctcgggctgaaagtgaagg

SEQ ID NO: 606402 - DNA, 20 bp, mouse
ggctcagtaacccggagagg

SEQ ID NO: 606403 - DNA, 20 bp, mouse
gtgcttggcgcacagctctc

SEQ ID NO: 606404 - DNA, 20 bp, mouse
gtaacccggagaggtggcaa

SEQ ID NO: 606405 - DNA, 20 bp, mouse
gacggtctctcccggcgcac

SEQ ID NO: 606406 - DNA, 20 bp, mouse
ggaggctgcagacatcggac

SEQ ID NO: 606407 - DNA, 20 bp, mouse
gggagccggtcactgccggg

SEQ ID NO: 606408 - DNA, 20 bp, mouse
gctcaggacagacagagtac

SEQ ID NO: 606409 - DNA, 20 bp, mouse
ggccgcagctagtccccctc

SEQ ID NO: 606410 - DNA, 20 bp, mouse
gtcctgagggggactagctg

SEQ ID NO: 606411 - DNA, 20 bp, mouse
gttgcagagcaaggacggtg

SEQ ID NO: 606412 - DNA, 20 bp, mouse
gtctgcctcccggcagtgac

SEQ ID NO: 606413 - DNA, 20 bp, mouse
gacagacagagtactggcgt

SEQ ID NO: 606414 - DNA, 20 bp, mouse
gcctctgacacttagcccag

SEQ ID NO: 606415 - DNA, 20 bp, mouse
gaaaggagccggtcactgcc

SEQ ID NO: 606416 - DNA, 20 bp, mouse
ggggtagtgaaccggctaag

SEQ ID NO: 606417 - DNA, 20 bp, mouse
gacacgtgtaagagcagagg

SEQ ID NO: 606418 - DNA, 20 bp, mouse
gcctgccaggggtagtgaac

SEQ ID NO: 606419 - DNA, 20 bp, mouse
gcctggcaggcaaggcgact

SEQ ID NO: 606420 - DNA, 20 bp, mouse
gccaggacaccccaaagttc

SEQ ID NO: 606421 - DNA, 20 bp, mouse
ggggtgggcaccagagtggt

SEQ ID NO: 606422 - DNA, 20 bp, mouse
ggcaggcaaggcgactggga

SEQ ID NO: 606423 - DNA, 20 bp, mouse
gtcactacccctggcaggca

SEQ ID NO: 606424 - DNA, 20 bp, mouse
gagcatcaacaggatagtct

SEQ ID NO: 606425 - DNA, 20 bp, mouse
ggagggaagagtcctgaaat

SEQ ID NO: 606426 - DNA, 20 bp, mouse
ggcagccagcgcccctccga

SEQ ID NO: 606427 - DNA, 20 bp, mouse
ggcagtgcgcagccgtcgga

SEQ ID NO: 606428 - DNA, 20 bp, mouse
gcagggcagtgcgcagccgt

SEQ ID NO: 606429 - DNA, 20 bp, mouse
gggctgtgcaggcgacaatg

SEQ ID NO: 606430 - DNA, 20 bp, mouse
gcctcgggcagtgagcgcgc

SEQ ID NO: 606431 - DNA, 20 bp, mouse
gtggatgcaaaggggaccaa

SEQ ID NO: 606432 - DNA, 20 bp, mouse
gggccacaccccagggtaag

SEQ ID NO: 606433 - DNA, 20 bp, mouse
gtgttcctccgggaccagaa

SEQ ID NO: 606434 - DNA, 20 bp, mouse
gggtcctgcagccgtggcag

SEQ ID NO: 606435 - DNA, 20 bp, mouse
gaaaggaagccacttaccct

SEQ ID NO: 606436 - DNA, 20 bp, mouse
gggagtgaggttaaagggtt

SEQ ID NO: 606437 - DNA, 20 bp, mouse
gccatttgggtgctgaggga

SEQ ID NO: 606438 - DNA, 20 bp, mouse
gtaggaggggcagtacacat

SEQ ID NO: 606439 - DNA, 20 bp, mouse
ggggctctaaggccactaca

SEQ ID NO: 606440 - DNA, 20 bp, mouse
gtgaggttaaagggttagga

SEQ ID NO: 606441 - DNA, 20 bp, mouse
gcgaacctcagaagaaccag

SEQ ID NO: 606442 - DNA, 20 bp, mouse
ggggcaggtaggtgccaagg

SEQ ID NO: 606443 - DNA, 20 bp, mouse
gcagcacccaaatggaccta

SEQ ID NO: 606444 - DNA, 20 bp, mouse
gcccccagaggagatggctg

SEQ ID NO: 606445 - DNA, 20 bp, mouse
gctcagtaacccaatcccgg

SEQ ID NO: 606446 - DNA, 20 bp, mouse
gagtcggcgtgtggatagtg

SEQ ID NO: 606447 - DNA, 20 bp, mouse
gaggcggccaggagcagcta

SEQ ID NO: 606448 - DNA, 20 bp, mouse
gagagccccgtcacagccag

SEQ ID NO: 606449 - DNA, 20 bp, mouse
gagcagctagggtgagtccc

SEQ ID NO: 606450 - DNA, 20 bp, mouse
ggactctgggctattaactg

SEQ ID NO: 606451 - DNA, 20 bp, mouse
gctatccacacgccgactct

SEQ ID NO: 606452 - DNA, 20 bp, mouse
gggagaggcgccagcactgt

SEQ ID NO: 606453 - DNA, 20 bp, mouse
gtcagcattgctcaagccga

SEQ ID NO: 606454 - DNA, 20 bp, mouse
gtctgggctattaactgtgg

SEQ ID NO: 606455 - DNA, 20 bp, mouse
ggctttcgtggggcgagaag

SEQ ID NO: 606456 - DNA, 20 bp, mouse
gggaccaggcacacctaaca

SEQ ID NO: 606457 - DNA, 20 bp, mouse
gaggcagccttgcttggacc

SEQ ID NO: 606458 - DNA, 20 bp, mouse
gctagaagaaagcccgtgtt

SEQ ID NO: 606459 - DNA, 20 bp, mouse
ggaagaaactgtgcaagact

SEQ ID NO: 606460 - DNA, 20 bp, mouse
gcagaggacaagtgagtgcc

SEQ ID NO: 606461 - DNA, 20 bp, mouse
ggagtccctggtaagttccc

SEQ ID NO: 606462 - DNA, 20 bp, mouse
ggctgcctgggaacttacca

SEQ ID NO: 606463 - DNA, 20 bp, mouse
gaaatagtggctgactccag

SEQ ID NO: 606464 - DNA, 20 bp, mouse
gaactgtgcaagactgggct

SEQ ID NO: 606465 - DNA, 20 bp, mouse
gaggccttaggcccttagag

SEQ ID NO: 606466 - DNA, 20 bp, mouse
gcagcgggcacctggtgtcc

SEQ ID NO: 606467 - DNA, 20 bp, mouse
gcagcgggctcctggacacc

SEQ ID NO: 606468 - DNA, 20 bp, mouse
ggcagcaggtccaggtccga

SEQ ID NO: 606469 - DNA, 20 bp, mouse
gcccaggcttcagggccggc

SEQ ID NO: 606470 - DNA, 20 bp, mouse
gcagcaggcaacctgcgcag

SEQ ID NO: 606471 - DNA, 20 bp, mouse
gagctcccaggcttcagggc

SEQ ID NO: 606472 - DNA, 20 bp, mouse
gcgggtccgcgacttattgg

SEQ ID NO: 606473 - DNA, 20 bp, mouse
ggtgcgcgcagaacagcaca

SEQ ID NO: 606474 - DNA, 20 bp, mouse
gctcggactgctggaagagt

SEQ ID NO: 606475 - DNA, 20 bp, mouse
ggcctgggagctccgaggac

SEQ ID NO: 606476 - DNA, 20 bp, mouse
ggggcaaacagctcaagcag

SEQ ID NO: 606477 - DNA, 20 bp, mouse
ggtaggacagccctaaggtg

SEQ ID NO: 606478 - DNA, 20 bp, mouse
ggtttctacctggtgcaggg

SEQ ID NO: 606479 - DNA, 20 bp, mouse
ggccattgttgtgtcttcgg

SEQ ID NO: 606480 - DNA, 20 bp, mouse
gagaataggcaggagacagt

SEQ ID NO: 606481 - DNA, 20 bp, mouse
gctggtcttcagtttctacc

SEQ ID NO: 606482 - DNA, 20 bp, mouse
ggggtcctagaaatccagtc

SEQ ID NO: 606483 - DNA, 20 bp, mouse
gtcggggtaggacagcccta

SEQ ID NO: 606484 - DNA, 20 bp, mouse
ggagctgtttgccctgggct

SEQ ID NO: 606485 - DNA, 20 bp, mouse
gaatgggagccaatcggggt

SEQ ID NO: 606486 - DNA, 20 bp, mouse
gcacgcgcggaagggaggtg

SEQ ID NO: 606487 - DNA, 20 bp, mouse
gtctagtcggaacgcgacca

SEQ ID NO: 606488 - DNA, 20 bp, mouse
gcgcagcacgcgcggaaggg

SEQ ID NO: 606489 - DNA, 20 bp, mouse
gacccgcagcacgcgcggaa

SEQ ID NO: 606490 - DNA, 20 bp, mouse
gcggaacgcgaccatggagc

SEQ ID NO: 606491 - DNA, 20 bp, mouse
gcgctgcaggactttgtgag

SEQ ID NO: 606492 - DNA, 20 bp, mouse
gcggaagggaggtggggtcc

SEQ ID NO: 606493 - DNA, 20 bp, mouse
gagcagacccgcagcacgcg

SEQ ID NO: 606494 - DNA, 20 bp, mouse
gcagcttgcagaggacagtc

SEQ ID NO: 606495 - DNA, 20 bp, mouse
gactgatcggcagcttgcag

SEQ ID NO: 606496 - DNA, 20 bp, mouse
gccgtgctcagagcagtgga

SEQ ID NO: 606497 - DNA, 20 bp, mouse
ggctcagagcagtggacgga

SEQ ID NO: 606498 - DNA, 20 bp, mouse
gacggcaaaagaggtctctc

SEQ ID NO: 606499 - DNA, 20 bp, mouse
gagtggacggacggcaaaag

SEQ ID NO: 606500 - DNA, 20 bp, mouse
ggagtcccaagtttgctcca

SEQ ID NO: 606501 - DNA, 20 bp, mouse
gcacagccagagtcatgatc

SEQ ID NO: 606502 - DNA, 20 bp, mouse
gccagggaagatattcaggt

SEQ ID NO: 606503 - DNA, 20 bp, mouse
gagtgccatggagcaaactt

SEQ ID NO: 606504 - DNA, 20 bp, mouse
gtgacccagggaagatattc

SEQ ID NO: 606505 - DNA, 20 bp, mouse
gtgctaggctaaggagaatc

SEQ ID NO: 606506 - DNA, 20 bp, mouse
gctttccgcacagcgaggat

SEQ ID NO: 606507 - DNA, 20 bp, mouse
gagacggtgcctgagattgg

SEQ ID NO: 606508 - DNA, 20 bp, mouse
ggcttccttatggcgaatgt

SEQ ID NO: 606509 - DNA, 20 bp, mouse
ggcgaggatcggcagtcttt

SEQ ID NO: 606510 - DNA, 20 bp, mouse
gttccaccggtgagctggag

SEQ ID NO: 606511 - DNA, 20 bp, mouse
ggaagtgtgggcgcaccacg

SEQ ID NO: 606512 - DNA, 20 bp, mouse
gggacggccggaatttccac

SEQ ID NO: 606513 - DNA, 20 bp, mouse
gactgccgatcctcgctgtg

SEQ ID NO: 606514 - DNA, 20 bp, mouse
ggcctgaaggacttgctagg

SEQ ID NO: 606515 - DNA, 20 bp, mouse
gttaccccggtaactacgag

SEQ ID NO: 606516 - DNA, 20 bp, mouse
ggccggctgaggttgccagg

SEQ ID NO: 606517 - DNA, 20 bp, mouse
gggagaaagggaagcgcctt

SEQ ID NO: 606518 - DNA, 20 bp, mouse
gatgtcaaaaagggagtcaa

SEQ ID NO: 606519 - DNA, 20 bp, mouse
gaccgcctggcaacctcagc

SEQ ID NO: 606520 - DNA, 20 bp, mouse
gcctgtcgcaccggaccctg

SEQ ID NO: 606521 - DNA, 20 bp, mouse
gggttgccaggcggtgccga

SEQ ID NO: 606522 - DNA, 20 bp, mouse
gaagcgccttcggcaccgcc

SEQ ID NO: 606523 - DNA, 20 bp, mouse
ggtggagacagagcaccgca

SEQ ID NO: 606524 - DNA, 20 bp, mouse
ggtccggtgcgacaggtgga

SEQ ID NO: 606525 - DNA, 20 bp, mouse
gcttgccggctgaggttgcc

SEQ ID NO: 606526 - DNA, 20 bp, mouse
gctgggcgaggttaccgtag

SEQ ID NO: 606527 - DNA, 20 bp, mouse
gctggagacccgagtccagt

SEQ ID NO: 606528 - DNA, 20 bp, mouse
gcgcgtcgcccactggactc

SEQ ID NO: 606529 - DNA, 20 bp, mouse
gagctgtgcgcgtcgcccac

SEQ ID NO: 606530 - DNA, 20 bp, mouse
ggtaggggcgcggagctgcc

SEQ ID NO: 606531 - DNA, 20 bp, mouse
gcgggctgctagggctattg

SEQ ID NO: 606532 - DNA, 20 bp, mouse
gcgcagcagagaactgggcg

SEQ ID NO: 606533 - DNA, 20 bp, mouse
gactcagaacctccggctca

SEQ ID NO: 606534 - DNA, 20 bp, mouse
gcgaggttaccgtaggggcg

SEQ ID NO: 606535 - DNA, 20 bp, mouse
gagtagtgatctaccactag

SEQ ID NO: 606536 - DNA, 20 bp, mouse
gggcgccgcagtgcagtggt

SEQ ID NO: 606537 - DNA, 20 bp, mouse
ggccggcgtcggagacatct

SEQ ID NO: 606538 - DNA, 20 bp, mouse
gactgggcgccgcagtgcag

SEQ ID NO: 606539 - DNA, 20 bp, mouse
gccggcaaactgaaaagcgc

SEQ ID NO: 606540 - DNA, 20 bp, mouse
ggaggcgcggacgcgattta

SEQ ID NO: 606541 - DNA, 20 bp, mouse
gcgatttacggtgagctgag

SEQ ID NO: 606542 - DNA, 20 bp, mouse
gaactgaaaagcgccggcgt

SEQ ID NO: 606543 - DNA, 20 bp, mouse
gtgcccgcggagggagggtc

SEQ ID NO: 606544 - DNA, 20 bp, mouse
gggacgacggtaacgaccag

SEQ ID NO: 606545 - DNA, 20 bp, mouse
gaccaagatgtctccgacgc

SEQ ID NO: 606546 - DNA, 20 bp, mouse
gactagcgaggggaagatgg

SEQ ID NO: 606547 - DNA, 20 bp, mouse
gggccactgttactagcgag

SEQ ID NO: 606548 - DNA, 20 bp, mouse
ggcgggaaccaccacagccg

SEQ ID NO: 606549 - DNA, 20 bp, mouse
ggctcgggagctacacatcc

SEQ ID NO: 606550 - DNA, 20 bp, mouse
ggttactagcgaggggaaga

SEQ ID NO: 606551 - DNA, 20 bp, mouse
gtgtggtggttcccgcagag

SEQ ID NO: 606552 - DNA, 20 bp, mouse
gcgcagagtggataaagaac

SEQ ID NO: 606553 - DNA, 20 bp, mouse
gcccgggcggcggatgagga

SEQ ID NO: 606554 - DNA, 20 bp, mouse
ggcggcggcggcgatagtgg

SEQ ID NO: 606555 - DNA, 20 bp, mouse
gggacgagacggaagttctg

SEQ ID NO: 606556 - DNA, 20 bp, mouse
ggaggggcccaggaccgcag

SEQ ID NO: 606557 - DNA, 20 bp, mouse
ggcgcggtccgtgaggaggg

SEQ ID NO: 606558 - DNA, 20 bp, mouse
gcggcgcgcggtccgtgagg

SEQ ID NO: 606559 - DNA, 20 bp, mouse
gggaccccgaggccaagcga

SEQ ID NO: 606560 - DNA, 20 bp, mouse
gggcatggcggcgcccgctg

SEQ ID NO: 606561 - DNA, 20 bp, mouse
gaccggctggtgagcttgta

SEQ ID NO: 606562 - DNA, 20 bp, mouse
gcgccatgcctccctcctca

SEQ ID NO: 606563 - DNA, 20 bp, mouse
ggtcttgtcgaaggaccccg

SEQ ID NO: 606564 - DNA, 20 bp, mouse
gttccggcgcgcggtccgtg

SEQ ID NO: 606565 - DNA, 20 bp, mouse
ggagcagagagcgaacttag

SEQ ID NO: 606566 - DNA, 20 bp, mouse
gggagcattctggtgagcga

SEQ ID NO: 606567 - DNA, 20 bp, mouse
gtctggtgagcgagggtaga

SEQ ID NO: 606568 - DNA, 20 bp, mouse
gctctcgggagactacaatg

SEQ ID NO: 606569 - DNA, 20 bp, mouse
gaagtggctacccggctgga

SEQ ID NO: 606570 - DNA, 20 bp, mouse
gtatggtcgcgagccggaag

SEQ ID NO: 606571 - DNA, 20 bp, mouse
gtacccggctggaaggcgtg

SEQ ID NO: 606572 - DNA, 20 bp, mouse
gcaccagcagcagcactctc

SEQ ID NO: 606573 - DNA, 20 bp, mouse
gcgagccggaagtggctacc

SEQ ID NO: 606574 - DNA, 20 bp, mouse
gccaagaggaccatcgacga

SEQ ID NO: 606575 - DNA, 20 bp, mouse
gctcctcacgccttccagcc

SEQ ID NO: 606576 - DNA, 20 bp, mouse
ggttagaaggcgggacaggt

SEQ ID NO: 606577 - DNA, 20 bp, mouse
gcaggttagaggttagaagg

SEQ ID NO: 606578 - DNA, 20 bp, mouse
gaggcacgtccggaatcgag

SEQ ID NO: 606579 - DNA, 20 bp, mouse
gaatcaggttagaggttaga

SEQ ID NO: 606580 - DNA, 20 bp, mouse
gaaggcgggacaggtcggcg

SEQ ID NO: 606581 - DNA, 20 bp, mouse
gttacgcaggcgcggaagac

SEQ ID NO: 606582 - DNA, 20 bp, mouse
ggtatcctggaacactccag

SEQ ID NO: 606583 - DNA, 20 bp, mouse
gctcgactcacctgacccag

SEQ ID NO: 606584 - DNA, 20 bp, mouse
gagaggttagaaggcgggac

SEQ ID NO: 606585 - DNA, 20 bp, mouse
gcgggacaggtcggcgcggt

SEQ ID NO: 606586 - DNA, 20 bp, mouse
ggaggcctcaccgtcagtca

SEQ ID NO: 606587 - DNA, 20 bp, mouse
gccatgggagccgtgactga

SEQ ID NO: 606588 - DNA, 20 bp, mouse
gccgccgccgcgcacgccat

SEQ ID NO: 606589 - DNA, 20 bp, mouse
gggagccgtgactgacggtg

SEQ ID NO: 606590 - DNA, 20 bp, mouse
ggctcccatggcgtgcgcgg

SEQ ID NO: 606591 - DNA, 20 bp, mouse
gcggcggctaagaggaacag

SEQ ID NO: 606592 - DNA, 20 bp, mouse
gcccccaggcggccccctcg

SEQ ID NO: 606593 - DNA, 20 bp, mouse
gactgacggtgaggcctcgg

SEQ ID NO: 606594 - DNA, 20 bp, mouse
gccggcccgggaagcccccc

SEQ ID NO: 606595 - DNA, 20 bp, mouse
gccggtcgggaagtgtatct

SEQ ID NO: 606596 - DNA, 20 bp, mouse
gtagcgtgctcggagctcgc

SEQ ID NO: 606597 - DNA, 20 bp, mouse
gagctccgagcacgctagga

SEQ ID NO: 606598 - DNA, 20 bp, mouse
gtcagggtcgggaatcccaa

SEQ ID NO: 606599 - DNA, 20 bp, mouse
gtgcccgaaggaggagagaa

SEQ ID NO: 606600 - DNA, 20 bp, mouse
gtgtgcggtccggatctcct

SEQ ID NO: 606601 - DNA, 20 bp, mouse
gtgaagccccccgcaggtac

SEQ ID NO: 606602 - DNA, 20 bp, mouse
gggttccatctgcccgaagg

SEQ ID NO: 606603 - DNA, 20 bp, mouse
ggaggggcgaccggtacctg

SEQ ID NO: 606604 - DNA, 20 bp, mouse
gatcaagaggttgaagtcat

SEQ ID NO: 606605 - DNA, 20 bp, mouse
gcggtcggctgcgcgcgagg

SEQ ID NO: 606606 - DNA, 20 bp, mouse
gagcactctggggaacaagt

SEQ ID NO: 606607 - DNA, 20 bp, mouse
gctctggggaacaagtaggt

SEQ ID NO: 606608 - DNA, 20 bp, mouse
gccactcaccgggtggagaa

SEQ ID NO: 606609 - DNA, 20 bp, mouse
gcaggacccaggtgcacagc

SEQ ID NO: 606610 - DNA, 20 bp, mouse
ggtgcttgccactcaccggg

SEQ ID NO: 606611 - DNA, 20 bp, mouse
gtgaccctactacagaggag

SEQ ID NO: 606612 - DNA, 20 bp, mouse
gcaagtaggtaggaagacac

SEQ ID NO: 606613 - DNA, 20 bp, mouse
gatggtgcttgccactcacc

SEQ ID NO: 606614 - DNA, 20 bp, mouse
ggcttgtgaccctactacag

SEQ ID NO: 606615 - DNA, 20 bp, mouse
gagtggagccttcccagaat

SEQ ID NO: 606616 - DNA, 20 bp, mouse
gctcactcgcactcacaccc

SEQ ID NO: 606617 - DNA, 20 bp, mouse
gtcggcggcgggaaccccct

SEQ ID NO: 606618 - DNA, 20 bp, mouse
gcgggcgccggaaaagactg

SEQ ID NO: 606619 - DNA, 20 bp, mouse
gtgccgggggcgtccatggg

SEQ ID NO: 606620 - DNA, 20 bp, mouse
gtctcagcgccccgtgccgg

SEQ ID NO: 606621 - DNA, 20 bp, mouse
gggctgtgacagggtcaccc

SEQ ID NO: 606622 - DNA, 20 bp, mouse
gactcacaccccggcgctgg

SEQ ID NO: 606623 - DNA, 20 bp, mouse
gagcgcgccaagccgaggta

SEQ ID NO: 606624 - DNA, 20 bp, mouse
gccgcccgcctccagcgccg

SEQ ID NO: 606625 - DNA, 20 bp, mouse
gccgtgccgggggcgtccat

SEQ ID NO: 606626 - DNA, 20 bp, mouse
gtacagctgcaatctcgcaa

SEQ ID NO: 606627 - DNA, 20 bp, mouse
gtagtcgctccggccggtca

SEQ ID NO: 606628 - DNA, 20 bp, mouse
gggccggagcccggagaact

SEQ ID NO: 606629 - DNA, 20 bp, mouse
gtccggccggtcaaggtgag

SEQ ID NO: 606630 - DNA, 20 bp, mouse
gcagccggcgcccagaaaag

SEQ ID NO: 606631 - DNA, 20 bp, mouse
gccggagaactaggccggag

SEQ ID NO: 606632 - DNA, 20 bp, mouse
ggtgcactgtgcgggaacga

SEQ ID NO: 606633 - DNA, 20 bp, mouse
gagaactaggccggagcgga

SEQ ID NO: 606634 - DNA, 20 bp, mouse
ggtgagtggacgcagttgat

SEQ ID NO: 606635 - DNA, 20 bp, mouse
ggagggttaggcctagcgtg

SEQ ID NO: 606636 - DNA, 20 bp, mouse
gcagccggtggcctcagctc

SEQ ID NO: 606637 - DNA, 20 bp, mouse
gtggaggtggcgccccaagg

SEQ ID NO: 606638 - DNA, 20 bp, mouse
gaatacgagcaccagagctg

SEQ ID NO: 606639 - DNA, 20 bp, mouse
ggcggcgtgctggcgagctg

SEQ ID NO: 606640 - DNA, 20 bp, mouse
gcgagaggagccggtctcag

SEQ ID NO: 606641 - DNA, 20 bp, mouse
gagcctgcggagcggatgag

SEQ ID NO: 606642 - DNA, 20 bp, mouse
gccatgaggaggaagttgta

SEQ ID NO: 606643 - DNA, 20 bp, mouse
gtgaagccagaacccaacta

SEQ ID NO: 606644 - DNA, 20 bp, mouse
gaaggagcttgtccctagtt

SEQ ID NO: 606645 - DNA, 20 bp, mouse
ggcggccggccggcgtgacg

SEQ ID NO: 606646 - DNA, 20 bp, mouse
gctgtgtagaagtggaccac

SEQ ID NO: 606647 - DNA, 20 bp, mouse
ggtcatggatcggtactccg

SEQ ID NO: 606648 - DNA, 20 bp, mouse
gctcttgagcatggtgaagt

SEQ ID NO: 606649 - DNA, 20 bp, mouse
gtccatgttccgcaccaccg

SEQ ID NO: 606650 - DNA, 20 bp, mouse
gaactgcctgctgacagtca

SEQ ID NO: 606651 - DNA, 20 bp, mouse
gccgatccatgactgtcagc

SEQ ID NO: 606652 - DNA, 20 bp, mouse
gaagcctagaaatagcgctg

SEQ ID NO: 606653 - DNA, 20 bp, mouse
gatggatcggtactccgcgg

SEQ ID NO: 606654 - DNA, 20 bp, mouse
gtagcgctggggcagtctgc

SEQ ID NO: 606655 - DNA, 20 bp, mouse
gtgcagctgagtgggcctgg

SEQ ID NO: 606656 - DNA, 20 bp, mouse
gagtgagaggggagcctcag

SEQ ID NO: 606657 - DNA, 20 bp, mouse
gctggcacggcggaagtgag

SEQ ID NO: 606658 - DNA, 20 bp, mouse
gtgctcggtcagtcaccctg

SEQ ID NO: 606659 - DNA, 20 bp, mouse
gagtcaccctgtggccgctg

SEQ ID NO: 606660 - DNA, 20 bp, mouse
gctgcgggacgggagatgct

SEQ ID NO: 606661 - DNA, 20 bp, mouse
gcgggcgtgcagctgcggga

SEQ ID NO: 606662 - DNA, 20 bp, mouse
gtcgggtctgtctggcacgg

SEQ ID NO: 606663 - DNA, 20 bp, mouse
gcgaatgacgggactctcaa

SEQ ID NO: 606664 - DNA, 20 bp, mouse
gacctcgggtcgggtctgtc

SEQ ID NO: 606665 - DNA, 20 bp, mouse
ggccagacagacccgacccg

SEQ ID NO: 606666 - DNA, 20 bp, mouse
gccagcgagtgcccagcgca

SEQ ID NO: 606667 - DNA, 20 bp, mouse
ggcccgcgcacccgacacac

SEQ ID NO: 606668 - DNA, 20 bp, mouse
gccagcgcacggctcaggcg

SEQ ID NO: 606669 - DNA, 20 bp, mouse
gggctcaggcgcggtgtctg

SEQ ID NO: 606670 - DNA, 20 bp, mouse
gccgctgcgccccggtgtgt

SEQ ID NO: 606671 - DNA, 20 bp, mouse
gcccggtgtgtcgggtgcgc

SEQ ID NO: 606672 - DNA, 20 bp, mouse
gctgcgcgatctgctcacct

SEQ ID NO: 606673 - DNA, 20 bp, mouse
gggcgcgcgtgggtacgtcg

SEQ ID NO: 606674 - DNA, 20 bp, mouse
ggaggccgcgcgggagggca

SEQ ID NO: 606675 - DNA, 20 bp, mouse
gggcgctcgggaagcacgcg

SEQ ID NO: 606676 - DNA, 20 bp, mouse
gagtctgcgcgccatggcag

SEQ ID NO: 606677 - DNA, 20 bp, mouse
gtagggaacaatagcatcag

SEQ ID NO: 606678 - DNA, 20 bp, mouse
ggcagactggcaggtcctag

SEQ ID NO: 606679 - DNA, 20 bp, mouse
gcagcatccccgccagccag

SEQ ID NO: 606680 - DNA, 20 bp, mouse
gctgcgcgccatggcagcgg

SEQ ID NO: 606681 - DNA, 20 bp, mouse
gtcttccacagatagagggt

SEQ ID NO: 606682 - DNA, 20 bp, mouse
gagccgcaccactctcgcag

SEQ ID NO: 606683 - DNA, 20 bp, mouse
ggtcccctgcgagagtggtg

SEQ ID NO: 606684 - DNA, 20 bp, mouse
gcaaagagcaactaacacta

SEQ ID NO: 606685 - DNA, 20 bp, mouse
ggagagtggtgcggctccgg

SEQ ID NO: 606686 - DNA, 20 bp, mouse
gtgccagacgctggaatggg

SEQ ID NO: 606687 - DNA, 20 bp, mouse
gcagccgggttgccagacgc

SEQ ID NO: 606688 - DNA, 20 bp, mouse
gggttgccagacgctggaat

SEQ ID NO: 606689 - DNA, 20 bp, mouse
gggcaacccggctgcgactc

SEQ ID NO: 606690 - DNA, 20 bp, mouse
gtgaagatggtggtatgtgt

SEQ ID NO: 606691 - DNA, 20 bp, mouse
gcgggaggcgcccccattcg

SEQ ID NO: 606692 - DNA, 20 bp, mouse
gagagagctgccccgaatgg

SEQ ID NO: 606693 - DNA, 20 bp, mouse
gtagctggaagaagggacga

SEQ ID NO: 606694 - DNA, 20 bp, mouse
gccgcgactagctggaagaa

SEQ ID NO: 606695 - DNA, 20 bp, mouse
ggaccacccattccagcgtc

SEQ ID NO: 606696 - DNA, 20 bp, mouse
gcccgggagaaggagaccct

SEQ ID NO: 606697 - DNA, 20 bp, mouse
gggtcttgaagagtgtcccg

SEQ ID NO: 606698 - DNA, 20 bp, mouse
ggacactcttcaagacccca

SEQ ID NO: 606699 - DNA, 20 bp, mouse
gttcgcctagcaccaaacag

SEQ ID NO: 606700 - DNA, 20 bp, mouse
gcaccaaacagcggtacctc

SEQ ID NO: 606701 - DNA, 20 bp, mouse
gacgtgcgacccaacccggt

SEQ ID NO: 606702 - DNA, 20 bp, mouse
gaagaatggcagatcatcct

SEQ ID NO: 606703 - DNA, 20 bp, mouse
gtttggtgctaggcgaagaa

SEQ ID NO: 606704 - DNA, 20 bp, mouse
gtctcccgggacccggaagt

SEQ ID NO: 606705 - DNA, 20 bp, mouse
gccccagggtctccttctcc

SEQ ID NO: 606706 - DNA, 20 bp, mouse
ggccaaggaacgtggatagt

SEQ ID NO: 606707 - DNA, 20 bp, mouse
gcgcgcagacgaagacgcca

SEQ ID NO: 606708 - DNA, 20 bp, mouse
gacaggctgaggggactgct

SEQ ID NO: 606709 - DNA, 20 bp, mouse
gtttccggcaacaggctgag

SEQ ID NO: 606710 - DNA, 20 bp, mouse
gacgaagacgccaaggaacg

SEQ ID NO: 606711 - DNA, 20 bp, mouse
gacgtggatagtaggaagca

SEQ ID NO: 606712 - DNA, 20 bp, mouse
gccccagaagagcccacggg

SEQ ID NO: 606713 - DNA, 20 bp, mouse
gctgttgccggaaagcgcaa

SEQ ID NO: 606714 - DNA, 20 bp, mouse
ggtacggcgacgacatgtac

SEQ ID NO: 606715 - DNA, 20 bp, mouse
gcgcttggccggcaggaact

SEQ ID NO: 606716 - DNA, 20 bp, mouse
gcccgcggtgcagaagaacc

SEQ ID NO: 606717 - DNA, 20 bp, mouse
ggccagcggggtcagaaccc

SEQ ID NO: 606718 - DNA, 20 bp, mouse
gtcagaacccgggtctgcct

SEQ ID NO: 606719 - DNA, 20 bp, mouse
gaagaaccgggcgccgccag

SEQ ID NO: 606720 - DNA, 20 bp, mouse
gacccgggttctgaccccgc

SEQ ID NO: 606721 - DNA, 20 bp, mouse
ggcacctcccgcatcaagaa

SEQ ID NO: 606722 - DNA, 20 bp, mouse
gcaggcgcgaccccgagacc

SEQ ID NO: 606723 - DNA, 20 bp, mouse
gctcgccccgggtcccctct

SEQ ID NO: 606724 - DNA, 20 bp, mouse
gctcacgtgaccgggtctcg

SEQ ID NO: 606725 - DNA, 20 bp, mouse
gccctcttggcaccagcgtg

SEQ ID NO: 606726 - DNA, 20 bp, mouse
gcgcggtgcggagaccggaa

SEQ ID NO: 606727 - DNA, 20 bp, mouse
gcccagccgcggccagttac

SEQ ID NO: 606728 - DNA, 20 bp, mouse
ggtgctcgcggtgcggagac

SEQ ID NO: 606729 - DNA, 20 bp, mouse
gcggcggcgtgctcgcggtg

SEQ ID NO: 606730 - DNA, 20 bp, mouse
gccgggtgggtgggacgcag

SEQ ID NO: 606731 - DNA, 20 bp, mouse
gaagggctgttcggaccgaa

SEQ ID NO: 606732 - DNA, 20 bp, mouse
gcggctgggagtggccgggt

SEQ ID NO: 606733 - DNA, 20 bp, mouse
gtgctctccacactgtccgt

SEQ ID NO: 606734 - DNA, 20 bp, mouse
ggggacgcaggggaagacgg

SEQ ID NO: 606735 - DNA, 20 bp, mouse
ggctgggcttcgcagagggt

SEQ ID NO: 606736 - DNA, 20 bp, mouse
ggcgttggcgcaccaggagg

SEQ ID NO: 606737 - DNA, 20 bp, mouse
ggaggcgttggcgcaccagg

SEQ ID NO: 606738 - DNA, 20 bp, mouse
ggctgcagctaggggagtcc

SEQ ID NO: 606739 - DNA, 20 bp, mouse
ggtgcagcaactggaggcgt

SEQ ID NO: 606740 - DNA, 20 bp, mouse
gcaggaggaggctgcagcta

SEQ ID NO: 606741 - DNA, 20 bp, mouse
gggtgctcccaggtcgaggt

SEQ ID NO: 606742 - DNA, 20 bp, mouse
gcaggtgagagcaggccgac

SEQ ID NO: 606743 - DNA, 20 bp, mouse
gtgagagcaggccgacggga

SEQ ID NO: 606744 - DNA, 20 bp, mouse
gcagcgctgggtgcagcaac

SEQ ID NO: 606745 - DNA, 20 bp, mouse
gtcctctcccacctcgacct

SEQ ID NO: 606746 - DNA, 20 bp, mouse
gggctcccagaagattagcc

SEQ ID NO: 606747 - DNA, 20 bp, mouse
ggtgcttcaaggcgtttggg

SEQ ID NO: 606748 - DNA, 20 bp, mouse
gtggtgcgttgaatgaatgg

SEQ ID NO: 606749 - DNA, 20 bp, mouse
gcctgcatggtgcaagatgg

SEQ ID NO: 606750 - DNA, 20 bp, mouse
ggcagtgcttcaaggcgttt

SEQ ID NO: 606751 - DNA, 20 bp, mouse
gactgccaggctaatcttct

SEQ ID NO: 606752 - DNA, 20 bp, mouse
gggtaaagccgaattaggga

SEQ ID NO: 606753 - DNA, 20 bp, mouse
ggggcacgccagtcgcctca

SEQ ID NO: 606754 - DNA, 20 bp, mouse
gtcttctactaagcctgtcc

SEQ ID NO: 606755 - DNA, 20 bp, mouse
gtaatcttctgggagccttg

SEQ ID NO: 606756 - DNA, 20 bp, mouse
ggccagccgaggggtgacag

SEQ ID NO: 606757 - DNA, 20 bp, mouse
ggctacttcgctttcttctt

SEQ ID NO: 606758 - DNA, 20 bp, mouse
gcggtcgcggcggcacctca

SEQ ID NO: 606759 - DNA, 20 bp, mouse
gtcgccgccatcttggatcg

SEQ ID NO: 606760 - DNA, 20 bp, mouse
gggatttgggaggtagcgaa

SEQ ID NO: 606761 - DNA, 20 bp, mouse
gggcctcctcgcttgaccgg

SEQ ID NO: 606762 - DNA, 20 bp, mouse
gagccgggccgagaggacga

SEQ ID NO: 606763 - DNA, 20 bp, mouse
gtccagactcacagagtctt

SEQ ID NO: 606764 - DNA, 20 bp, mouse
gcactcggctgccggctcct

SEQ ID NO: 606765 - DNA, 20 bp, mouse
gcccgcctcaaggatttggg

SEQ ID NO: 606766 - DNA, 20 bp, mouse
gacactgcgctccaaccagg

SEQ ID NO: 606767 - DNA, 20 bp, mouse
gcggacactgcgctccaacc

SEQ ID NO: 606768 - DNA, 20 bp, mouse
gtggagcgcagtgtccggag

SEQ ID NO: 606769 - DNA, 20 bp, mouse
gtgcggtcccgggaaagtgg

SEQ ID NO: 606770 - DNA, 20 bp, mouse
ggtgtccggagcgggctggg

SEQ ID NO: 606771 - DNA, 20 bp, mouse
gcgggtactcacagagtccg

SEQ ID NO: 606772 - DNA, 20 bp, mouse
gcggctggggacagaggaaa

SEQ ID NO: 606773 - DNA, 20 bp, mouse
gaccctgcgactggacacga

SEQ ID NO: 606774 - DNA, 20 bp, mouse
gcgctccaaccaggaggagc

SEQ ID NO: 606775 - DNA, 20 bp, mouse
gcgctccccccagcccgctc

SEQ ID NO: 606776 - DNA, 20 bp, mouse
gccgctgccggcgagggagt

SEQ ID NO: 606777 - DNA, 20 bp, mouse
gggctgtgccgaggatgggt

SEQ ID NO: 606778 - DNA, 20 bp, mouse
ggttacacccactccctcgc

SEQ ID NO: 606779 - DNA, 20 bp, mouse
ggtgaggctgtgccgaggat

SEQ ID NO: 606780 - DNA, 20 bp, mouse
gacttccagtaactgaaatc

SEQ ID NO: 606781 - DNA, 20 bp, mouse
ggaagactgcgggtagaaag

SEQ ID NO: 606782 - DNA, 20 bp, mouse
gtgttggagagggcccaggg

SEQ ID NO: 606783 - DNA, 20 bp, mouse
ggactgaatggccagagtcc

SEQ ID NO: 606784 - DNA, 20 bp, mouse
gggcaggaagcatccctggt

SEQ ID NO: 606785 - DNA, 20 bp, mouse
gaccacagtaaagagttccg

SEQ ID NO: 606786 - DNA, 20 bp, mouse
ggcaaggacagggacggact

SEQ ID NO: 606787 - DNA, 20 bp, mouse
ggggtagcaagcactagtct

SEQ ID NO: 606788 - DNA, 20 bp, mouse
ggtcggaaacagaaacagca

SEQ ID NO: 606789 - DNA, 20 bp, mouse
gagacttgggtgagagactt

SEQ ID NO: 606790 - DNA, 20 bp, mouse
gcctaaataggaaggattcc

SEQ ID NO: 606791 - DNA, 20 bp, mouse
gtgtggttacaggagagact

SEQ ID NO: 606792 - DNA, 20 bp, mouse
gaagcatcacctaaatagga

SEQ ID NO: 606793 - DNA, 20 bp, mouse
gaccgtgagcagaagtgtca

SEQ ID NO: 606794 - DNA, 20 bp, mouse
gatgtggagtggctgtcagg

SEQ ID NO: 606795 - DNA, 20 bp, mouse
gggcaggaacaagtctccac

SEQ ID NO: 606796 - DNA, 20 bp, mouse
ggaggccccgtggggactca

SEQ ID NO: 606797 - DNA, 20 bp, mouse
gccgctgtggaggcaatcag

SEQ ID NO: 606798 - DNA, 20 bp, mouse
gagagaagccttgaccttcc

SEQ ID NO: 606799 - DNA, 20 bp, mouse
ggccgaagggagggacgcga

SEQ ID NO: 606800 - DNA, 20 bp, mouse
gcgccgatctggcctcactt

SEQ ID NO: 606801 - DNA, 20 bp, mouse
gtgccgaagtgaggccagat

SEQ ID NO: 606802 - DNA, 20 bp, mouse
gcaccccactgcaggatccc

SEQ ID NO: 606803 - DNA, 20 bp, mouse
ggaggctggcccactggtgg

SEQ ID NO: 606804 - DNA, 20 bp, mouse
gagtgacggagaaaacttcg

SEQ ID NO: 606805 - DNA, 20 bp, mouse
gcccacggggcctcgctcag

SEQ ID NO: 606806 - DNA, 20 bp, mouse
gtcatcctacctggctgtag

SEQ ID NO: 606807 - DNA, 20 bp, mouse
gaagacccctacagccaggt

SEQ ID NO: 606808 - DNA, 20 bp, mouse
gccaggtaggatgaaggcag

SEQ ID NO: 606809 - DNA, 20 bp, mouse
gggctgtaggggtcttgagc

SEQ ID NO: 606810 - DNA, 20 bp, mouse
gtggtagatctcccggtccc

SEQ ID NO: 606811 - DNA, 20 bp, mouse
gtgcggatctgagtatccat

SEQ ID NO: 606812 - DNA, 20 bp, mouse
gggccggcgggcatagggtc

SEQ ID NO: 606813 - DNA, 20 bp, mouse
gggaactgagcgagcaccca

SEQ ID NO: 606814 - DNA, 20 bp, mouse
gcgacaacgggagggattga

SEQ ID NO: 606815 - DNA, 20 bp, mouse
gcaacgggagggattgaggg

SEQ ID NO: 606816 - DNA, 20 bp, mouse
gcgcagagcacgacttccaa

SEQ ID NO: 606817 - DNA, 20 bp, mouse
ggcccgcggagtggaagtcc

SEQ ID NO: 606818 - DNA, 20 bp, mouse
ggcccactgagcccgcggag

SEQ ID NO: 606819 - DNA, 20 bp, mouse
gcctgggtctctggcagact

SEQ ID NO: 606820 - DNA, 20 bp, mouse
gcggagtggaagtccaggac

SEQ ID NO: 606821 - DNA, 20 bp, mouse
gggccatggagcccgggcaa

SEQ ID NO: 606822 - DNA, 20 bp, mouse
gggccaccaactacagggtg

SEQ ID NO: 606823 - DNA, 20 bp, mouse
gcggcaccgcggacagacct

SEQ ID NO: 606824 - DNA, 20 bp, mouse
gctgcaacttgcctgggaag

SEQ ID NO: 606825 - DNA, 20 bp, mouse
gaaggcaaagaccattgccc

SEQ ID NO: 606826 - DNA, 20 bp, mouse
gccgcgcgtggcccttcctg

SEQ ID NO: 606827 - DNA, 20 bp, mouse
gagcagggcctcagagaagc

SEQ ID NO: 606828 - DNA, 20 bp, mouse
ggccattgcccgcttctctg

SEQ ID NO: 606829 - DNA, 20 bp, mouse
gccgggcagagggagtcccg

SEQ ID NO: 606830 - DNA, 20 bp, mouse
ggcggcagctcaggtaagtg

SEQ ID NO: 606831 - DNA, 20 bp, mouse
gcggcaggtgagctccggga

SEQ ID NO: 606832 - DNA, 20 bp, mouse
gaggtaagtgaggagccgga

SEQ ID NO: 606833 - DNA, 20 bp, mouse
ggaagaacttgaaggtccag

SEQ ID NO: 606834 - DNA, 20 bp, mouse
ggagaagcgggcaatggcgc

SEQ ID NO: 606835 - DNA, 20 bp, mouse
ggaagagagtgctttacctc

SEQ ID NO: 606836 - DNA, 20 bp, mouse
gtccccaccagaccatactc

SEQ ID NO: 606837 - DNA, 20 bp, mouse
ggaggtgcactgagctggac

SEQ ID NO: 606838 - DNA, 20 bp, mouse
gcagggcagcttccagagta

SEQ ID NO: 606839 - DNA, 20 bp, mouse
ggcccggggtcagttgctgt

SEQ ID NO: 606840 - DNA, 20 bp, mouse
gcagcttccagagtatggtc

SEQ ID NO: 606841 - DNA, 20 bp, mouse
gacccacagcaactgacccc

SEQ ID NO: 606842 - DNA, 20 bp, mouse
gccaaggccagctgggcccg

SEQ ID NO: 606843 - DNA, 20 bp, mouse
gaatagacctcacaatatgg

SEQ ID NO: 606844 - DNA, 20 bp, mouse
gtccagagtatggtctggtg

SEQ ID NO: 606845 - DNA, 20 bp, mouse
ggggccagccaaggccagct

SEQ ID NO: 606846 - DNA, 20 bp, mouse
gacgccaccgagcctcccac

SEQ ID NO: 606847 - DNA, 20 bp, mouse
gcccacgggcgcgccaagag

SEQ ID NO: 606848 - DNA, 20 bp, mouse
gggcctcgcgcgagtgacct

SEQ ID NO: 606849 - DNA, 20 bp, mouse
ggcgcccgtgggaggctcgg

SEQ ID NO: 606850 - DNA, 20 bp, mouse
gactcgcgcgaggccgctct

SEQ ID NO: 606851 - DNA, 20 bp, mouse
gctctgcggggctttcctcc

SEQ ID NO: 606852 - DNA, 20 bp, mouse
gcccggcaagggctttgccg

SEQ ID NO: 606853 - DNA, 20 bp, mouse
ggaaggctccgcaagactca

SEQ ID NO: 606854 - DNA, 20 bp, mouse
gggcgcgcccgtgggaggct

SEQ ID NO: 606855 - DNA, 20 bp, mouse
gcaagtccccaggtacctat

SEQ ID NO: 606856 - DNA, 20 bp, mouse
gcaggacacaggggtcagtt

SEQ ID NO: 606857 - DNA, 20 bp, mouse
gagctgggttgtcagtgctg

SEQ ID NO: 606858 - DNA, 20 bp, mouse
gaaaaaagaggggtctgtgt

SEQ ID NO: 606859 - DNA, 20 bp, mouse
gtggccactggaagactctc

SEQ ID NO: 606860 - DNA, 20 bp, mouse
ggacaacccagctgcgcacg

SEQ ID NO: 606861 - DNA, 20 bp, mouse
gaggagtcctgatctagctg

SEQ ID NO: 606862 - DNA, 20 bp, mouse
ggttaagcctggagagttgg

SEQ ID NO: 606863 - DNA, 20 bp, mouse
gtcacctgagagtcttccag

SEQ ID NO: 606864 - DNA, 20 bp, mouse
gttgtcccgcgtgcgcagct

SEQ ID NO: 606865 - DNA, 20 bp, mouse
gtgagccttgtctcctctcc

SEQ ID NO: 606866 - DNA, 20 bp, mouse
gacagtgcacgcccgaacca

SEQ ID NO: 606867 - DNA, 20 bp, mouse
gcctgggctggaggaagacc

SEQ ID NO: 606868 - DNA, 20 bp, mouse
ggtgtgatcaggcaggacct

SEQ ID NO: 606869 - DNA, 20 bp, mouse
gaggctggtgaggctaggag

SEQ ID NO: 606870 - DNA, 20 bp, mouse
ggggcaggcaagcgcgtccg

SEQ ID NO: 606871 - DNA, 20 bp, mouse
gggcaagcgcgtccgtggtt

SEQ ID NO: 606872 - DNA, 20 bp, mouse
gtgtaccccggaggtaaggt

SEQ ID NO: 606873 - DNA, 20 bp, mouse
ggaggctaggagaggaaccc

SEQ ID NO: 606874 - DNA, 20 bp, mouse
ggggaccaggacccccaggg

SEQ ID NO: 606875 - DNA, 20 bp, mouse
gcaggtgtaccccggaggta

SEQ ID NO: 606876 - DNA, 20 bp, mouse
gcagaacgcagagccagcag

SEQ ID NO: 606877 - DNA, 20 bp, mouse
gccgcagagcgagcgcgcaa

SEQ ID NO: 606878 - DNA, 20 bp, mouse
ggctgcgcggccgagccgga

SEQ ID NO: 606879 - DNA, 20 bp, mouse
gagcgcgcaacggagctgcg

SEQ ID NO: 606880 - DNA, 20 bp, mouse
gccggacgctgggtgaaagt

SEQ ID NO: 606881 - DNA, 20 bp, mouse
gcgctctgcggtggctggcg

SEQ ID NO: 606882 - DNA, 20 bp, mouse
gggcggggtcgacttcgctg

SEQ ID NO: 606883 - DNA, 20 bp, mouse
gcggccagcaagctccgagc

SEQ ID NO: 606884 - DNA, 20 bp, mouse
gacgctcgcaggcaccaccc

SEQ ID NO: 606885 - DNA, 20 bp, mouse
gtaggctctcagctcccggg

SEQ ID NO: 606886 - DNA, 20 bp, mouse
gccgagaggctgctctggag

SEQ ID NO: 606887 - DNA, 20 bp, mouse
gccctcacccgggtctctca

SEQ ID NO: 606888 - DNA, 20 bp, mouse
ggccttgagagacccgggtg

SEQ ID NO: 606889 - DNA, 20 bp, mouse
gctcggcgcgctctgtcctc

SEQ ID NO: 606890 - DNA, 20 bp, mouse
gtcccagccttgagagaccc

SEQ ID NO: 606891 - DNA, 20 bp, mouse
ggggtcaactcagcgaacca

SEQ ID NO: 606892 - DNA, 20 bp, mouse
gtgacgggcgccgcgacccg

SEQ ID NO: 606893 - DNA, 20 bp, mouse
gatcactccaggctatcact

SEQ ID NO: 606894 - DNA, 20 bp, mouse
gcgtccagccgactgacgag

SEQ ID NO: 606895 - DNA, 20 bp, mouse
gcgcggcgcccgtcactctc

SEQ ID NO: 606896 - DNA, 20 bp, mouse
gtgagtcccgatatccacag

SEQ ID NO: 606897 - DNA, 20 bp, mouse
ggcacaagccgcatctgaga

SEQ ID NO: 606898 - DNA, 20 bp, mouse
gttctatatgcggttagaag

SEQ ID NO: 606899 - DNA, 20 bp, mouse
ggaagaggcaccaccttctt

SEQ ID NO: 606900 - DNA, 20 bp, mouse
ggccacacaagatcctaaga

SEQ ID NO: 606901 - DNA, 20 bp, mouse
gttggaaaagatgtatctag

SEQ ID NO: 606902 - DNA, 20 bp, mouse
gtcctagagaatgagactgt

SEQ ID NO: 606903 - DNA, 20 bp, mouse
gacacaagatcctaagaagg

SEQ ID NO: 606904 - DNA, 20 bp, mouse
ggtggaaagtggcaagaaaa

SEQ ID NO: 606905 - DNA, 20 bp, mouse
gagaagcctctgtggatatc

SEQ ID NO: 606906 - DNA, 20 bp, mouse
gcagcccctggacccagacc

SEQ ID NO: 606907 - DNA, 20 bp, mouse
ggctcctggtctgggtccag

SEQ ID NO: 606908 - DNA, 20 bp, mouse
ggccttacctgtagcgagga

SEQ ID NO: 606909 - DNA, 20 bp, mouse
gtgggtccaggggctgatac

SEQ ID NO: 606910 - DNA, 20 bp, mouse
gcatgcatgcttctaaccag

SEQ ID NO: 606911 - DNA, 20 bp, mouse
gggcagcctgtatcagcccc

SEQ ID NO: 606912 - DNA, 20 bp, mouse
ggcagtgagccagtttcagt

SEQ ID NO: 606913 - DNA, 20 bp, mouse
ggccacatccactttgctgt

SEQ ID NO: 606914 - DNA, 20 bp, mouse
ggtcagagtccctaacccag

SEQ ID NO: 606915 - DNA, 20 bp, mouse
gccagtttcagttggaggag

SEQ ID NO: 606916 - DNA, 20 bp, mouse
gagtcaggagaggttgaccc

SEQ ID NO: 606917 - DNA, 20 bp, mouse
ggctgactggaagggaaccg

SEQ ID NO: 606918 - DNA, 20 bp, mouse
gtgacccaggctgactggaa

SEQ ID NO: 606919 - DNA, 20 bp, mouse
gggcaggaagtgtgtatcct

SEQ ID NO: 606920 - DNA, 20 bp, mouse
gactcacctctgcctatcgg

SEQ ID NO: 606921 - DNA, 20 bp, mouse
gcctgcctcagaggcttccg

SEQ ID NO: 606922 - DNA, 20 bp, mouse
gtcaaatggacagacctagt

SEQ ID NO: 606923 - DNA, 20 bp, mouse
gttcagcctccgataggcag

SEQ ID NO: 606924 - DNA, 20 bp, mouse
gtaattcttcagcctccgat

SEQ ID NO: 606925 - DNA, 20 bp, mouse
gtacacacttcctgcctcag

SEQ ID NO: 606926 - DNA, 20 bp, mouse
ggagctccgtcaccagccag

SEQ ID NO: 606927 - DNA, 20 bp, mouse
gctccgtcaccagccagagg

SEQ ID NO: 606928 - DNA, 20 bp, mouse
ggctggtgacggagctctgg

SEQ ID NO: 606929 - DNA, 20 bp, mouse
gccctccactgagcctagaa

SEQ ID NO: 606930 - DNA, 20 bp, mouse
gcagaggaggagaagcccct

SEQ ID NO: 606931 - DNA, 20 bp, mouse
gatcctatcaaaatgtccaa

SEQ ID NO: 606932 - DNA, 20 bp, mouse
gtccattctaggctcagtgg

SEQ ID NO: 606933 - DNA, 20 bp, mouse
gatccctgcataataaggtg

SEQ ID NO: 606934 - DNA, 20 bp, mouse
ggtggtacaaagcaagtgat

SEQ ID NO: 606935 - DNA, 20 bp, mouse
gcagtggagggtagatttta

SEQ ID NO: 606936 - DNA, 20 bp, mouse
ggctgcgaccccgcacctca

SEQ ID NO: 606937 - DNA, 20 bp, mouse
gctggtcgctctcagccgag

SEQ ID NO: 606938 - DNA, 20 bp, mouse
gaggctctgcgaggcttcag

SEQ ID NO: 606939 - DNA, 20 bp, mouse
gcctgaggccctgaggtgcg

SEQ ID NO: 606940 - DNA, 20 bp, mouse
ggtcgctctcagccgagtgg

SEQ ID NO: 606941 - DNA, 20 bp, mouse
gcgaggcttcagaggactcg

SEQ ID NO: 606942 - DNA, 20 bp, mouse
gagcgggtgagtgtgtccgg

SEQ ID NO: 606943 - DNA, 20 bp, mouse
gcagaggactcgcggagagc

SEQ ID NO: 606944 - DNA, 20 bp, mouse
gccgagctcgggctagggaa

SEQ ID NO: 606945 - DNA, 20 bp, mouse
gtcgggtctggactgcagaa

SEQ ID NO: 606946 - DNA, 20 bp, mouse
gaaaaagttaccgggtacca

SEQ ID NO: 606947 - DNA, 20 bp, mouse
gagacccaccccgggaacct

SEQ ID NO: 606948 - DNA, 20 bp, mouse
gagttaccgggtaccaaggc

SEQ ID NO: 606949 - DNA, 20 bp, mouse
gcccgcaacgtccccaactt

SEQ ID NO: 606950 - DNA, 20 bp, mouse
gaccccgggaacctaggctg

SEQ ID NO: 606951 - DNA, 20 bp, mouse
gtcaatagtaaaaagttacc

SEQ ID NO: 606952 - DNA, 20 bp, mouse
gcccgaagttggggacgttg

SEQ ID NO: 606953 - DNA, 20 bp, mouse
ggcccactcaccacggcctg

SEQ ID NO: 606954 - DNA, 20 bp, mouse
ggaagcacgtgggtcacttc

SEQ ID NO: 606955 - DNA, 20 bp, mouse
gccctgggtatcagacacca

SEQ ID NO: 606956 - DNA, 20 bp, mouse
gccacgggcggaagtgacta

SEQ ID NO: 606957 - DNA, 20 bp, mouse
gtgctgctccatcacgccaa

SEQ ID NO: 606958 - DNA, 20 bp, mouse
gcctgccaccccgccacggg

SEQ ID NO: 606959 - DNA, 20 bp, mouse
gtacacgcaagaacccgagg

SEQ ID NO: 606960 - DNA, 20 bp, mouse
gctcctggaaggaagacgga

SEQ ID NO: 606961 - DNA, 20 bp, mouse
gtcccggggagccttagcgg

SEQ ID NO: 606962 - DNA, 20 bp, mouse
gctgtgcgcccttggcgtga

SEQ ID NO: 606963 - DNA, 20 bp, mouse
gcagttgcgagacttcctgt

SEQ ID NO: 606964 - DNA, 20 bp, mouse
gcgagctctggacgctgagg

SEQ ID NO: 606965 - DNA, 20 bp, mouse
gacttccgcccgtggcgggg

SEQ ID NO: 606966 - DNA, 20 bp, mouse
ggagccgaagccgctgtcca

SEQ ID NO: 606967 - DNA, 20 bp, mouse
gtgctcagtcaaccgggcca

SEQ ID NO: 606968 - DNA, 20 bp, mouse
ggacacacgcgaggtctcag

SEQ ID NO: 606969 - DNA, 20 bp, mouse
gggcttccggggcgtatggt

SEQ ID NO: 606970 - DNA, 20 bp, mouse
gcagccatggacagcggctt

SEQ ID NO: 606971 - DNA, 20 bp, mouse
gcgccccggaagccaagccg

SEQ ID NO: 606972 - DNA, 20 bp, mouse
ggcttcggctcggattttgg

SEQ ID NO: 606973 - DNA, 20 bp, mouse
gggggcaccacgggaaacag

SEQ ID NO: 606974 - DNA, 20 bp, mouse
gagccaagccggggcaccac

SEQ ID NO: 606975 - DNA, 20 bp, mouse
ggcacaccgaccatacgccc

SEQ ID NO: 606976 - DNA, 20 bp, mouse
gcggcggcggcaactcacca

SEQ ID NO: 606977 - DNA, 20 bp, mouse
gggaatacgcgagagagccg

SEQ ID NO: 606978 - DNA, 20 bp, mouse
gtaagggacaagggcggcgg

SEQ ID NO: 606979 - DNA, 20 bp, mouse
gcaacccgcgcgagagtcta

SEQ ID NO: 606980 - DNA, 20 bp, mouse
gggtaattaagggacaaggg

SEQ ID NO: 606981 - DNA, 20 bp, mouse
gggaggtaattaagggacaa

SEQ ID NO: 606982 - DNA, 20 bp, mouse
gatgcaccacaaggtcacag

SEQ ID NO: 606983 - DNA, 20 bp, mouse
ggtgccgtagactctcgcgc

SEQ ID NO: 606984 - DNA, 20 bp, mouse
gctccgaccacggcggatgg

SEQ ID NO: 606985 - DNA, 20 bp, mouse
gcctcagactccgaccacgg

SEQ ID NO: 606986 - DNA, 20 bp, mouse
gacgctcgcgaaccttggta

SEQ ID NO: 606987 - DNA, 20 bp, mouse
gatactgggacactccacgg

SEQ ID NO: 606988 - DNA, 20 bp, mouse
gcctccatggcgccagagtc

SEQ ID NO: 606989 - DNA, 20 bp, mouse
gtccggcctggcgcagtcgg

SEQ ID NO: 606990 - DNA, 20 bp, mouse
gactgcgccaggccggactc

SEQ ID NO: 606991 - DNA, 20 bp, mouse
gatggcgccagagtccggcc

SEQ ID NO: 606992 - DNA, 20 bp, mouse
gggccatgccggatgcgcag

SEQ ID NO: 606993 - DNA, 20 bp, mouse
gcgaaccttggtacggcgat

SEQ ID NO: 606994 - DNA, 20 bp, mouse
gggcgctgtacgtagaccaa

SEQ ID NO: 606995 - DNA, 20 bp, mouse
ggtcccacaccgcacatact

SEQ ID NO: 606996 - DNA, 20 bp, mouse
gtccgcaagacggttaaata

SEQ ID NO: 606997 - DNA, 20 bp, mouse
gataatctataagagatgtt

SEQ ID NO: 606998 - DNA, 20 bp, mouse
gctcgcagcccccatctcaa

SEQ ID NO: 606999 - DNA, 20 bp, mouse
gagaagctgcacgggtcctt

SEQ ID NO: 607000 - DNA, 20 bp, mouse
gcttgcggacactcacaaag

SEQ ID NO: 607001 - DNA, 20 bp, mouse
gtcaggaccgcaacttctaa

SEQ ID NO: 607002 - DNA, 20 bp, mouse
ggccctatttaaccgtcttg

SEQ ID NO: 607003 - DNA, 20 bp, mouse
gaactcagcctttgagatgg

SEQ ID NO: 607004 - DNA, 20 bp, mouse
ggcatgcggagaagctgcac

SEQ ID NO: 607005 - DNA, 20 bp, mouse
gctacgagttgtacagcatg

SEQ ID NO: 607006 - DNA, 20 bp, mouse
ggtagccgccatgaccgtag

SEQ ID NO: 607007 - DNA, 20 bp, mouse
gagagcccctacggtcatgg

SEQ ID NO: 607008 - DNA, 20 bp, mouse
gactagagcccctacggtca

SEQ ID NO: 607009 - DNA, 20 bp, mouse
gaaaggtactagagccccta

SEQ ID NO: 607010 - DNA, 20 bp, mouse
gctaccgcccccaaggccgg

SEQ ID NO: 607011 - DNA, 20 bp, mouse
ggcctcaggagctgaacccc

SEQ ID NO: 607012 - DNA, 20 bp, mouse
ggagcagaagatgatcgaga

SEQ ID NO: 607013 - DNA, 20 bp, mouse
gctgtactgcaacggagctt

SEQ ID NO: 607014 - DNA, 20 bp, mouse
gggttcagctcctgaggcag

SEQ ID NO: 607015 - DNA, 20 bp, mouse
gtgccaggctccagaagccg

SEQ ID NO: 607016 - DNA, 20 bp, mouse
gcggaagtgcgatacttcac

SEQ ID NO: 607017 - DNA, 20 bp, mouse
ggccgcacacagccgtaaag

SEQ ID NO: 607018 - DNA, 20 bp, mouse
gcccaggaaggagtcagaaa

SEQ ID NO: 607019 - DNA, 20 bp, mouse
gcgaggcccgatactcacgc

SEQ ID NO: 607020 - DNA, 20 bp, mouse
gccggcggtgaatctcgtaa

SEQ ID NO: 607021 - DNA, 20 bp, mouse
gacgggacggggcactaaag

SEQ ID NO: 607022 - DNA, 20 bp, mouse
gggcgtcccgcgtgagtatc

SEQ ID NO: 607023 - DNA, 20 bp, mouse
gtgcgatacttcacgggagc

SEQ ID NO: 607024 - DNA, 20 bp, mouse
ggtaaaggcgagcaggaaaa

SEQ ID NO: 607025 - DNA, 20 bp, mouse
ggcgtgtgacgagaaaagac

SEQ ID NO: 607026 - DNA, 20 bp, mouse
gcgacgcaggaaggtcacac

SEQ ID NO: 607027 - DNA, 20 bp, mouse
gcggcggcagctctgcgggg

SEQ ID NO: 607028 - DNA, 20 bp, mouse
gacgggctcttccaacatgg

SEQ ID NO: 607029 - DNA, 20 bp, mouse
gcagacgtgcggggctggta

SEQ ID NO: 607030 - DNA, 20 bp, mouse
gtggcggcggcagctctgcg

SEQ ID NO: 607031 - DNA, 20 bp, mouse
gtctgctcacccgcggacag

SEQ ID NO: 607032 - DNA, 20 bp, mouse
gccgcacgtctgctcacccg

SEQ ID NO: 607033 - DNA, 20 bp, mouse
gcacacgggctcttccaaca

SEQ ID NO: 607034 - DNA, 20 bp, mouse
gggctggtgccgctgtccgc

SEQ ID NO: 607035 - DNA, 20 bp, mouse
ggctgaattcggggaagagg

SEQ ID NO: 607036 - DNA, 20 bp, mouse
gtgcggagcgggctccgggt

SEQ ID NO: 607037 - DNA, 20 bp, mouse
gtggcgtcagcgcaagatgg

SEQ ID NO: 607038 - DNA, 20 bp, mouse
ggcgtggcgtcagcgcaaga

SEQ ID NO: 607039 - DNA, 20 bp, mouse
gctcagggtgctgaatggga

SEQ ID NO: 607040 - DNA, 20 bp, mouse
gcgcgagaacagagccgccg

SEQ ID NO: 607041 - DNA, 20 bp, mouse
gtctgggagaccgcacctca

SEQ ID NO: 607042 - DNA, 20 bp, mouse
gcagcgcaagatggcggcct

SEQ ID NO: 607043 - DNA, 20 bp, mouse
gtgttctcgcgcttgcggag

SEQ ID NO: 607044 - DNA, 20 bp, mouse
gccagggcgctagggaccca

SEQ ID NO: 607045 - DNA, 20 bp, mouse
gcgtctggtggcaaccccgg

SEQ ID NO: 607046 - DNA, 20 bp, mouse
ggctccccgcagcaacaccg

SEQ ID NO: 607047 - DNA, 20 bp, mouse
ggcggtaacgcccggcccgt

SEQ ID NO: 607048 - DNA, 20 bp, mouse
gcagtccccgcgagcggaat

SEQ ID NO: 607049 - DNA, 20 bp, mouse
gaaagagtagcataaaggaa

SEQ ID NO: 607050 - DNA, 20 bp, mouse
ggagtagcataaaggaaagg

SEQ ID NO: 607051 - DNA, 20 bp, mouse
ggcaagtcctctgggtgcaa

SEQ ID NO: 607052 - DNA, 20 bp, mouse
gcgtgtctgggtgacggaac

SEQ ID NO: 607053 - DNA, 20 bp, mouse
ggcccttcagtggaccacgt

SEQ ID NO: 607054 - DNA, 20 bp, mouse
gtttggagtttcgctcccac

SEQ ID NO: 607055 - DNA, 20 bp, mouse
gacagggcggtccccggcgg

SEQ ID NO: 607056 - DNA, 20 bp, mouse
ggtcccccgggaagaccagg

SEQ ID NO: 607057 - DNA, 20 bp, mouse
gctggtcccccgggaagacc

SEQ ID NO: 607058 - DNA, 20 bp, mouse
gcagctgcagcggttcatgg

SEQ ID NO: 607059 - DNA, 20 bp, mouse
ggtccgcctggtcttcccgg

SEQ ID NO: 607060 - DNA, 20 bp, mouse
ggatcccaggctggtccccc

SEQ ID NO: 607061 - DNA, 20 bp, mouse
gggtccctggctcgctgtca

SEQ ID NO: 607062 - DNA, 20 bp, mouse
gcagcggttcatggaggcag

SEQ ID NO: 607063 - DNA, 20 bp, mouse
gactccatgacagcgagcca

SEQ ID NO: 607064 - DNA, 20 bp, mouse
gcgactggagcagacccaga

SEQ ID NO: 607065 - DNA, 20 bp, mouse
gttcagacccgcagctgcag

SEQ ID NO: 607066 - DNA, 20 bp, mouse
gaagcgcctgactccgacaa

SEQ ID NO: 607067 - DNA, 20 bp, mouse
gcttggtgaagcggacgaag

SEQ ID NO: 607068 - DNA, 20 bp, mouse
gggagtcaggcgcttcgctg

SEQ ID NO: 607069 - DNA, 20 bp, mouse
gagggtgaggcgcagatccc

SEQ ID NO: 607070 - DNA, 20 bp, mouse
gcaccaagctcggccattgt

SEQ ID NO: 607071 - DNA, 20 bp, mouse
gcacggagctctggacactg

SEQ ID NO: 607072 - DNA, 20 bp, mouse
gaggcgcagcccggatcgag

SEQ ID NO: 607073 - DNA, 20 bp, mouse
gcagcggccccactcgatcc

SEQ ID NO: 607074 - DNA, 20 bp, mouse
gacagtgctcagtgcccggg

SEQ ID NO: 607075 - DNA, 20 bp, mouse
gctccgacaatggccgagct

SEQ ID NO: 607076 - DNA, 20 bp, mouse
gaccgggctgaagagctgcg

SEQ ID NO: 607077 - DNA, 20 bp, mouse
gggtagcgtgtgagctcgga

SEQ ID NO: 607078 - DNA, 20 bp, mouse
ggaaagctgagaacacgtgg

SEQ ID NO: 607079 - DNA, 20 bp, mouse
gtgtcagaggcgagatcctg

SEQ ID NO: 607080 - DNA, 20 bp, mouse
gagcccggtcccggtgtcag

SEQ ID NO: 607081 - DNA, 20 bp, mouse
gcgcctctgacaccgggacc

SEQ ID NO: 607082 - DNA, 20 bp, mouse
gggcaggtagcgtgtgagct

SEQ ID NO: 607083 - DNA, 20 bp, mouse
ggagcgggcaggtaccccgg

SEQ ID NO: 607084 - DNA, 20 bp, mouse
gggatctcgcctctgacacc

SEQ ID NO: 607085 - DNA, 20 bp, mouse
gcgcgtgcacgcgggtcgtg

SEQ ID NO: 607086 - DNA, 20 bp, mouse
ggacctgtacagcccactag

SEQ ID NO: 607087 - DNA, 20 bp, mouse
gtacaggtcaccctctccca

SEQ ID NO: 607088 - DNA, 20 bp, mouse
ggagacagacaccccagggt

SEQ ID NO: 607089 - DNA, 20 bp, mouse
gcggcgggcaccgtgggaga

SEQ ID NO: 607090 - DNA, 20 bp, mouse
gacggtgcccgccgaccctg

SEQ ID NO: 607091 - DNA, 20 bp, mouse
gtgccgctagtgggctgtac

SEQ ID NO: 607092 - DNA, 20 bp, mouse
gcagacaccccagggtcggc

SEQ ID NO: 607093 - DNA, 20 bp, mouse
gaccaggtcggacactatcc

SEQ ID NO: 607094 - DNA, 20 bp, mouse
gcccccaacgtgccgctagt

SEQ ID NO: 607095 - DNA, 20 bp, mouse
ggcccactagcggcacgttg

SEQ ID NO: 607096 - DNA, 20 bp, mouse
gagacacaccagaggtaagt

SEQ ID NO: 607097 - DNA, 20 bp, mouse
gaagtgggagccgggtgtcc

SEQ ID NO: 607098 - DNA, 20 bp, mouse
gttacctctggtgtgtctct

SEQ ID NO: 607099 - DNA, 20 bp, mouse
gccagttctgccaggacacc

SEQ ID NO: 607100 - DNA, 20 bp, mouse
gccccgatctgcgatgatgg

SEQ ID NO: 607101 - DNA, 20 bp, mouse
ggcatgagccgcaccaacac

SEQ ID NO: 607102 - DNA, 20 bp, mouse
gggtttggagcacttagcaa

SEQ ID NO: 607103 - DNA, 20 bp, mouse
gggcggcaggggctgcacag

SEQ ID NO: 607104 - DNA, 20 bp, mouse
gagtctggagagtccagctt

SEQ ID NO: 607105 - DNA, 20 bp, mouse
gtaatgcttgaggaatttgt

SEQ ID NO: 607106 - DNA, 20 bp, mouse
gcacccggcggagaagaaag

SEQ ID NO: 607107 - DNA, 20 bp, mouse
gcgcagggcagtgcacccgg

SEQ ID NO: 607108 - DNA, 20 bp, mouse
ggctcctccgctgccttcta

SEQ ID NO: 607109 - DNA, 20 bp, mouse
ggagcgagcgcagcccggct

SEQ ID NO: 607110 - DNA, 20 bp, mouse
gcagcaaacacagccataga

SEQ ID NO: 607111 - DNA, 20 bp, mouse
gtcctcggagcgcaataaaa

SEQ ID NO: 607112 - DNA, 20 bp, mouse
gaggaggagcagaggatcct

SEQ ID NO: 607113 - DNA, 20 bp, mouse
ggccgccagccaccgagagg

SEQ ID NO: 607114 - DNA, 20 bp, mouse
gagagccccaaccggctgta

SEQ ID NO: 607115 - DNA, 20 bp, mouse
gcggcgcagggcagtgcacc

SEQ ID NO: 607116 - DNA, 20 bp, mouse
gggcctcccggagaaggatc

SEQ ID NO: 607117 - DNA, 20 bp, mouse
gggatcgggaagcggagaag

SEQ ID NO: 607118 - DNA, 20 bp, mouse
gagtccgcggagccaacgag

SEQ ID NO: 607119 - DNA, 20 bp, mouse
gtctccgggaggccactcgt

SEQ ID NO: 607120 - DNA, 20 bp, mouse
gctggactctcgctcacagt

SEQ ID NO: 607121 - DNA, 20 bp, mouse
gccggagaaggatcgggaag

SEQ ID NO: 607122 - DNA, 20 bp, mouse
gtcgctggaacacgagtccg

SEQ ID NO: 607123 - DNA, 20 bp, mouse
ggagccaacgagtggcctcc

SEQ ID NO: 607124 - DNA, 20 bp, mouse
gagaagattcttggcgctgg

SEQ ID NO: 607125 - DNA, 20 bp, mouse
gccggcgggacaggactaag

SEQ ID NO: 607126 - DNA, 20 bp, mouse
ggcgcagccaggggactcca

SEQ ID NO: 607127 - DNA, 20 bp, mouse
gctttctggaggagtcctgg

SEQ ID NO: 607128 - DNA, 20 bp, mouse
gaggggctgtttgttacgac

SEQ ID NO: 607129 - DNA, 20 bp, mouse
ggctgcacgaagctttctgg

SEQ ID NO: 607130 - DNA, 20 bp, mouse
gggactcacctagagccgag

SEQ ID NO: 607131 - DNA, 20 bp, mouse
gagccacctcataaagactg

SEQ ID NO: 607132 - DNA, 20 bp, mouse
gcgtaacaaacagcccctcc

SEQ ID NO: 607133 - DNA, 20 bp, mouse
ggggttgccagtaggaaacg

SEQ ID NO: 607134 - DNA, 20 bp, mouse
gcagtaggaaacgtggtgtt

SEQ ID NO: 607135 - DNA, 20 bp, mouse
ggagctgggcgctggtgctg

SEQ ID NO: 607136 - DNA, 20 bp, mouse
ggaaccaacaaacaataatg

SEQ ID NO: 607137 - DNA, 20 bp, mouse
gaatcaggtgcagttgaaag

SEQ ID NO: 607138 - DNA, 20 bp, mouse
gtaatcaggacagcaatcag

SEQ ID NO: 607139 - DNA, 20 bp, mouse
gaacaaacaataatgtggac

SEQ ID NO: 607140 - DNA, 20 bp, mouse
gtttccaaggggaatactgt

SEQ ID NO: 607141 - DNA, 20 bp, mouse
gccccaagactaaaagaatc

SEQ ID NO: 607142 - DNA, 20 bp, mouse
gctgaaggctgttggaaagg

SEQ ID NO: 607143 - DNA, 20 bp, mouse
gggtctgaaggctgttggaa

SEQ ID NO: 607144 - DNA, 20 bp, mouse
ggcgcctacagtattcccct

SEQ ID NO: 607145 - DNA, 20 bp, mouse
ggggaatactgtaggcgctt

SEQ ID NO: 607146 - DNA, 20 bp, mouse
ggcagtctcgagcttggagg

SEQ ID NO: 607147 - DNA, 20 bp, mouse
gagagtccctacctggtgag

SEQ ID NO: 607148 - DNA, 20 bp, mouse
gcctacctggtgaggggtgt

SEQ ID NO: 607149 - DNA, 20 bp, mouse
gagggactctccctgatcag

SEQ ID NO: 607150 - DNA, 20 bp, mouse
gctggcagtctcgagcttgg

SEQ ID NO: 607151 - DNA, 20 bp, mouse
gctcctcacttgactcggtc

SEQ ID NO: 607152 - DNA, 20 bp, mouse
gcacaaggacagaagggcgg

SEQ ID NO: 607153 - DNA, 20 bp, mouse
ggtctcgagcttggaggcgg

SEQ ID NO: 607154 - DNA, 20 bp, mouse
gtcagagggacgcagagcag

SEQ ID NO: 607155 - DNA, 20 bp, mouse
gggtctggcagtctcgagct

SEQ ID NO: 607156 - DNA, 20 bp, mouse
ggccatggccccacctccag

SEQ ID NO: 607157 - DNA, 20 bp, mouse
gcgcctgagaggagactgcg

SEQ ID NO: 607158 - DNA, 20 bp, mouse
gacgcgggacctacccctgg

SEQ ID NO: 607159 - DNA, 20 bp, mouse
gggagactgcggggttcccg

SEQ ID NO: 607160 - DNA, 20 bp, mouse
gacttaagtcaccgcctgag

SEQ ID NO: 607161 - DNA, 20 bp, mouse
ggcttcccggacgctcccgt

SEQ ID NO: 607162 - DNA, 20 bp, mouse
ggagacgcgggacctacccc

SEQ ID NO: 607163 - DNA, 20 bp, mouse
gactcctgcgtttccctcag

SEQ ID NO: 607164 - DNA, 20 bp, mouse
gtaagtttagtgatctggac

SEQ ID NO: 607165 - DNA, 20 bp, mouse
gccgccactgagggaaacgc

SEQ ID NO: 607166 - DNA, 20 bp, mouse
gcggcgcgcgggccattccg

SEQ ID NO: 607167 - DNA, 20 bp, mouse
gggagcctcgagagcagttg

SEQ ID NO: 607168 - DNA, 20 bp, mouse
gctttcagcgctcaggtccg

SEQ ID NO: 607169 - DNA, 20 bp, mouse
ggacgagggccggtgtctag

SEQ ID NO: 607170 - DNA, 20 bp, mouse
gagcgctcaggtccgcggaa

SEQ ID NO: 607171 - DNA, 20 bp, mouse
gtcccgacggggactcgggg

SEQ ID NO: 607172 - DNA, 20 bp, mouse
ggccggtgtctaggggtcgt

SEQ ID NO: 607173 - DNA, 20 bp, mouse
gagctgacaggcgagcgagc

SEQ ID NO: 607174 - DNA, 20 bp, mouse
ggcggcggagggacccccag

SEQ ID NO: 607175 - DNA, 20 bp, mouse
gggcttgcctgaggtaaaag

SEQ ID NO: 607176 - DNA, 20 bp, mouse
gggcggccgctgtctaggtg

SEQ ID NO: 607177 - DNA, 20 bp, mouse
gtctcacctcacctagacag

SEQ ID NO: 607178 - DNA, 20 bp, mouse
ggtctcgcgagaagcggtgt

SEQ ID NO: 607179 - DNA, 20 bp, mouse
ggtgttggcgcgcttggcgg

SEQ ID NO: 607180 - DNA, 20 bp, mouse
ggcggtgttggcgcgcttgg

SEQ ID NO: 607181 - DNA, 20 bp, mouse
ggacggtgggacgagagtga

SEQ ID NO: 607182 - DNA, 20 bp, mouse
gttggcggcggccgctgtct

SEQ ID NO: 607183 - DNA, 20 bp, mouse
gcggactcgaggggaggcga

SEQ ID NO: 607184 - DNA, 20 bp, mouse
gacggacctagctgagaggg

SEQ ID NO: 607185 - DNA, 20 bp, mouse
ggctgggaagcggactcgag

SEQ ID NO: 607186 - DNA, 20 bp, mouse
gggcggggccgagatggtaa

SEQ ID NO: 607187 - DNA, 20 bp, mouse
ggagcaagcgcctgcggcag

SEQ ID NO: 607188 - DNA, 20 bp, mouse
gtactcggagcaagcgcctg

SEQ ID NO: 607189 - DNA, 20 bp, mouse
gtctctgcagcgcggctcct

SEQ ID NO: 607190 - DNA, 20 bp, mouse
ggcggagccgcagggttact

SEQ ID NO: 607191 - DNA, 20 bp, mouse
gcttgctccgagtaaccctg

SEQ ID NO: 607192 - DNA, 20 bp, mouse
gcccgaaggagaagtcctgg

SEQ ID NO: 607193 - DNA, 20 bp, mouse
gtgaaagccgtggatcatca

SEQ ID NO: 607194 - DNA, 20 bp, mouse
ggatggccctctctgcagcg

SEQ ID NO: 607195 - DNA, 20 bp, mouse
gggcggaagagacggcggaa

SEQ ID NO: 607196 - DNA, 20 bp, mouse
ggaggggccaggttatgaca

SEQ ID NO: 607197 - DNA, 20 bp, mouse
gccgcagcgtggagccgcgt

SEQ ID NO: 607198 - DNA, 20 bp, mouse
gcgccgcccgctcacctacg

SEQ ID NO: 607199 - DNA, 20 bp, mouse
gagccgcgtaggtgagcggg

SEQ ID NO: 607200 - DNA, 20 bp, mouse
gtggagccgcgtaggtgagc

SEQ ID NO: 607201 - DNA, 20 bp, mouse
gcagagacttcagggagcta

SEQ ID NO: 607202 - DNA, 20 bp, mouse
ggaggagcttccgggagccg

SEQ ID NO: 607203 - DNA, 20 bp, mouse
ggagtctgcaacccgcagcg

SEQ ID NO: 607204 - DNA, 20 bp, mouse
ggcagtccggccacatcaag

SEQ ID NO: 607205 - DNA, 20 bp, mouse
ggcgggttgcagactcgtcc

SEQ ID NO: 607206 - DNA, 20 bp, mouse
gagatggctgcctgaaggag

SEQ ID NO: 607207 - DNA, 20 bp, mouse
gctgccggggcctctccttc

SEQ ID NO: 607208 - DNA, 20 bp, mouse
gggcctgccccgcggcaaga

SEQ ID NO: 607209 - DNA, 20 bp, mouse
gcgcggtccaggcccctacc

SEQ ID NO: 607210 - DNA, 20 bp, mouse
gctgggtggcgagagttgag

SEQ ID NO: 607211 - DNA, 20 bp, mouse
gaatttggtggcagccctag

SEQ ID NO: 607212 - DNA, 20 bp, mouse
gcgccccatctcctccccta

SEQ ID NO: 607213 - DNA, 20 bp, mouse
gttggtggcagccctagggg

SEQ ID NO: 607214 - DNA, 20 bp, mouse
gaggcagccatcttgccgcg

SEQ ID NO: 607215 - DNA, 20 bp, mouse
gctcgtagtcgggaaggggt

SEQ ID NO: 607216 - DNA, 20 bp, mouse
ggagccgtcgcgggcaactc

SEQ ID NO: 607217 - DNA, 20 bp, mouse
gccgtcgcgggcaactcagg

SEQ ID NO: 607218 - DNA, 20 bp, mouse
gccgacggcacgtctctcgg

SEQ ID NO: 607219 - DNA, 20 bp, mouse
gcatgctcagtggcccggtc

SEQ ID NO: 607220 - DNA, 20 bp, mouse
ggcgagccggagccaggcac

SEQ ID NO: 607221 - DNA, 20 bp, mouse
gacggggaggggattcaagt

SEQ ID NO: 607222 - DNA, 20 bp, mouse
gccgccgacggcacgtctct

SEQ ID NO: 607223 - DNA, 20 bp, mouse
gaggcccgggtactgcggag

SEQ ID NO: 607224 - DNA, 20 bp, mouse
gtacgtgcgggagcaggctt

SEQ ID NO: 607225 - DNA, 20 bp, mouse
gctcccgcacgtaacttccc

SEQ ID NO: 607226 - DNA, 20 bp, mouse
ggtactcgcctggagaaggg

SEQ ID NO: 607227 - DNA, 20 bp, mouse
gcctcaccggcgccacccag

SEQ ID NO: 607228 - DNA, 20 bp, mouse
gcccgcctggaaggacaagg

SEQ ID NO: 607229 - DNA, 20 bp, mouse
ggtcagcgcgcagaaagcga

SEQ ID NO: 607230 - DNA, 20 bp, mouse
ggtgatgcgaggctgcccaa

SEQ ID NO: 607231 - DNA, 20 bp, mouse
ggcggagggggaggcctcac

SEQ ID NO: 607232 - DNA, 20 bp, mouse
gcggcactccgcctccggac

SEQ ID NO: 607233 - DNA, 20 bp, mouse
ggtcgtcctgttggcggagg

SEQ ID NO: 607234 - DNA, 20 bp, mouse
gacccaggaacggccggtgg

SEQ ID NO: 607235 - DNA, 20 bp, mouse
ggacggtcccaggcgtcggg

SEQ ID NO: 607236 - DNA, 20 bp, mouse
ggcggagtggaaggaacggt

SEQ ID NO: 607237 - DNA, 20 bp, mouse
gcagtcctgccggttccacc

SEQ ID NO: 607238 - DNA, 20 bp, mouse
gtccctttgccgggtggaac

SEQ ID NO: 607239 - DNA, 20 bp, mouse
gagcttccggctcccatggg

SEQ ID NO: 607240 - DNA, 20 bp, mouse
ggcagggaggagacccgagc

SEQ ID NO: 607241 - DNA, 20 bp, mouse
gggagacttaccggtctgga

SEQ ID NO: 607242 - DNA, 20 bp, mouse
ggtgggcgagtccctttgcc

SEQ ID NO: 607243 - DNA, 20 bp, mouse
gtgctctggatgccccccat

SEQ ID NO: 607244 - DNA, 20 bp, mouse
gctgcaggccagcctcccat

SEQ ID NO: 607245 - DNA, 20 bp, mouse
gtcagcgaaagcggagtgga

SEQ ID NO: 607246 - DNA, 20 bp, mouse
gggactctcggtgctaacta

SEQ ID NO: 607247 - DNA, 20 bp, mouse
ggccatggccagatccggag

SEQ ID NO: 607248 - DNA, 20 bp, mouse
gtgcgggccagaatccctgg

SEQ ID NO: 607249 - DNA, 20 bp, mouse
gtccccaagagaaaaggctt

SEQ ID NO: 607250 - DNA, 20 bp, mouse
gtggtgcggggtgtacaagg

SEQ ID NO: 607251 - DNA, 20 bp, mouse
gtgcccgcgaactcaaaagg

SEQ ID NO: 607252 - DNA, 20 bp, mouse
ggctgaggcggaccacatgg

SEQ ID NO: 607253 - DNA, 20 bp, mouse
gtctggcccgcagaaaggga

SEQ ID NO: 607254 - DNA, 20 bp, mouse
gttccagtcccggctctggg

SEQ ID NO: 607255 - DNA, 20 bp, mouse
gagccgcccagagccgggac

SEQ ID NO: 607256 - DNA, 20 bp, mouse
gcccacgctacgcagggacc

SEQ ID NO: 607257 - DNA, 20 bp, mouse
ggcccgaatcgaggctcccg

SEQ ID NO: 607258 - DNA, 20 bp, mouse
gcccgggcccacgctacgca

SEQ ID NO: 607259 - DNA, 20 bp, mouse
ggcgtgggcccggggagctc

SEQ ID NO: 607260 - DNA, 20 bp, mouse
gaccgcagcagcatagtccc

SEQ ID NO: 607261 - DNA, 20 bp, mouse
gctgcggtcgctgcgtagtt

SEQ ID NO: 607262 - DNA, 20 bp, mouse
gggacgcaccggaaggaagt

SEQ ID NO: 607263 - DNA, 20 bp, mouse
gcggcccggcgcccgaatcg

SEQ ID NO: 607264 - DNA, 20 bp, mouse
gcagtgtggcccctacgagg

SEQ ID NO: 607265 - DNA, 20 bp, mouse
gtggggactagcaggtgagg

SEQ ID NO: 607266 - DNA, 20 bp, mouse
ggacgaggacgagaacgctg

SEQ ID NO: 607267 - DNA, 20 bp, mouse
gtccatggcgtggtaggacg

SEQ ID NO: 607268 - DNA, 20 bp, mouse
gaccagcagtgaccgaggac

SEQ ID NO: 607269 - DNA, 20 bp, mouse
gaagcgaccagcagtgaccg

SEQ ID NO: 607270 - DNA, 20 bp, mouse
gacagagccagcagcggctc

SEQ ID NO: 607271 - DNA, 20 bp, mouse
gacgcgacacggagccaggg

SEQ ID NO: 607272 - DNA, 20 bp, mouse
gttgcagccgcagagcgagg

SEQ ID NO: 607273 - DNA, 20 bp, mouse
gacccgtcctcggtcactgc

SEQ ID NO: 607274 - DNA, 20 bp, mouse
gagcatggctcagagttccg

SEQ ID NO: 607275 - DNA, 20 bp, mouse
gcgagggcgcggtcagatgg

SEQ ID NO: 607276 - DNA, 20 bp, mouse
ggttctgcggcacaacgtag

SEQ ID NO: 607277 - DNA, 20 bp, mouse
gcggaagctgaggcaagcag

SEQ ID NO: 607278 - DNA, 20 bp, mouse
gggaaggatgtcggaagctg

SEQ ID NO: 607279 - DNA, 20 bp, mouse
ggttgtgccgcagaactaaa

SEQ ID NO: 607280 - DNA, 20 bp, mouse
gaggcagccgtttagttctg

SEQ ID NO: 607281 - DNA, 20 bp, mouse
gtgcggcacaacgtagagga

SEQ ID NO: 607282 - DNA, 20 bp, mouse
gggcatctagaagcagtagg

SEQ ID NO: 607283 - DNA, 20 bp, mouse
ggctgaggcaagcagtggga

SEQ ID NO: 607284 - DNA, 20 bp, mouse
ggaagaggaatgaaactcat

SEQ ID NO: 607285 - DNA, 20 bp, mouse
ggtgggatggcccacaacgc

SEQ ID NO: 607286 - DNA, 20 bp, mouse
gaaggtgtccgactccagct

SEQ ID NO: 607287 - DNA, 20 bp, mouse
ggagcttcttgctcttcgta

SEQ ID NO: 607288 - DNA, 20 bp, mouse
gacgtcctgaagcacctgaa

SEQ ID NO: 607289 - DNA, 20 bp, mouse
gtgtagtgtggcagagatca

SEQ ID NO: 607290 - DNA, 20 bp, mouse
gggcaggttaaaggtcactg

SEQ ID NO: 607291 - DNA, 20 bp, mouse
gttggccagagatgccaagc

SEQ ID NO: 607292 - DNA, 20 bp, mouse
gcataccatgaggtacaaac

SEQ ID NO: 607293 - DNA, 20 bp, mouse
gccggtgtaagccattccac

SEQ ID NO: 607294 - DNA, 20 bp, mouse
ggcccttggagaggacaaag

SEQ ID NO: 607295 - DNA, 20 bp, mouse
gcccaaaccgcatagaggat

SEQ ID NO: 607296 - DNA, 20 bp, mouse
ggcgctggccagagaaggaa

SEQ ID NO: 607297 - DNA, 20 bp, mouse
gcccgcggcagaaacgatcg

SEQ ID NO: 607298 - DNA, 20 bp, mouse
gagggctccgcgaaactgtg

SEQ ID NO: 607299 - DNA, 20 bp, mouse
gaggcggggtggaacagtag

SEQ ID NO: 607300 - DNA, 20 bp, mouse
gaggagcgaaggggccttga

SEQ ID NO: 607301 - DNA, 20 bp, mouse
ggaggagacggcttaagggg

SEQ ID NO: 607302 - DNA, 20 bp, mouse
ggtgggtgaaagagacgagt

SEQ ID NO: 607303 - DNA, 20 bp, mouse
gtcggaggagacggcttaag

SEQ ID NO: 607304 - DNA, 20 bp, mouse
gcgggaccgtcgcacagacc

SEQ ID NO: 607305 - DNA, 20 bp, mouse
gggagcgccgcctcagacca

SEQ ID NO: 607306 - DNA, 20 bp, mouse
gcctcgaaggggcccccctc

SEQ ID NO: 607307 - DNA, 20 bp, mouse
gggtgcccgggacctcgaag

SEQ ID NO: 607308 - DNA, 20 bp, mouse
gggcccccctccggcagaat

SEQ ID NO: 607309 - DNA, 20 bp, mouse
gcacgctggaaagataatac

SEQ ID NO: 607310 - DNA, 20 bp, mouse
gtcccgattctgccggaggg

SEQ ID NO: 607311 - DNA, 20 bp, mouse
gtcgggaccgctggatgtgg

SEQ ID NO: 607312 - DNA, 20 bp, mouse
gcggtcccgaacagatttcg

SEQ ID NO: 607313 - DNA, 20 bp, mouse
gtagatcccgattctgccgg

SEQ ID NO: 607314 - DNA, 20 bp, mouse
gcgcccctactccagagagt

SEQ ID NO: 607315 - DNA, 20 bp, mouse
gtgttcgggaccgctggatg

SEQ ID NO: 607316 - DNA, 20 bp, mouse
ggctcggtccctgtagacca

SEQ ID NO: 607317 - DNA, 20 bp, mouse
gctgcccaggacgtaccgga

SEQ ID NO: 607318 - DNA, 20 bp, mouse
gcttgctgcccaggacgtac

SEQ ID NO: 607319 - DNA, 20 bp, mouse
gccaaggctggtgagccgga

SEQ ID NO: 607320 - DNA, 20 bp, mouse
gacagggaccgagctccttc

SEQ ID NO: 607321 - DNA, 20 bp, mouse
ggctgggcatagctcaagga

SEQ ID NO: 607322 - DNA, 20 bp, mouse
gcgaggctgggcatagctca

SEQ ID NO: 607323 - DNA, 20 bp, mouse
ggctccttccggtacgtcct

SEQ ID NO: 607324 - DNA, 20 bp, mouse
ggggctctgaagggatccgt

SEQ ID NO: 607325 - DNA, 20 bp, mouse
gctcaccagccttggtctac

SEQ ID NO: 607326 - DNA, 20 bp, mouse
gcagaatgaaaggctggcaa

SEQ ID NO: 607327 - DNA, 20 bp, mouse
gagggctgatggaggaccta

SEQ ID NO: 607328 - DNA, 20 bp, mouse
gcaggacagggtagagtcct

SEQ ID NO: 607329 - DNA, 20 bp, mouse
ggcaagctgaggattcactt

SEQ ID NO: 607330 - DNA, 20 bp, mouse
ggcggtacactcagctggta

SEQ ID NO: 607331 - DNA, 20 bp, mouse
gcctctgaaggagggacctt

SEQ ID NO: 607332 - DNA, 20 bp, mouse
gaggacctagggcatcccca

SEQ ID NO: 607333 - DNA, 20 bp, mouse
ggacaacgccagctatgagg

SEQ ID NO: 607334 - DNA, 20 bp, mouse
gcaatggcggtacactcagc

SEQ ID NO: 607335 - DNA, 20 bp, mouse
gtacgcaggctcagacctgg

SEQ ID NO: 607336 - DNA, 20 bp, mouse
gctaagagccgaggagggga

SEQ ID NO: 607337 - DNA, 20 bp, mouse
gggtcgtgagaactttgcgg

SEQ ID NO: 607338 - DNA, 20 bp, mouse
gccacgtcgaaggcgagtcc

SEQ ID NO: 607339 - DNA, 20 bp, mouse
gcgccgcttacattaacacg

SEQ ID NO: 607340 - DNA, 20 bp, mouse
ggcaccccgcccgagccgtg

SEQ ID NO: 607341 - DNA, 20 bp, mouse
gcgcccgagccgtgtggcgg

SEQ ID NO: 607342 - DNA, 20 bp, mouse
gagcccccgccacacggctc

SEQ ID NO: 607343 - DNA, 20 bp, mouse
gcccaggcggccacggacgt

SEQ ID NO: 607344 - DNA, 20 bp, mouse
gttaatgtaagcggcgcaag

SEQ ID NO: 607345 - DNA, 20 bp, mouse
gcctcctcggctcttagcaa

SEQ ID NO: 607346 - DNA, 20 bp, mouse
gccggggttgtacaacccag

SEQ ID NO: 607347 - DNA, 20 bp, mouse
gcaccagcgccgaccccggg

SEQ ID NO: 607348 - DNA, 20 bp, mouse
gggccaccagcgccgacccc

SEQ ID NO: 607349 - DNA, 20 bp, mouse
gtcggcgctggtggcctcag

SEQ ID NO: 607350 - DNA, 20 bp, mouse
gagtcagcgccgcaggtctg

SEQ ID NO: 607351 - DNA, 20 bp, mouse
gtgtggccgccgcccggggt

SEQ ID NO: 607352 - DNA, 20 bp, mouse
gagccagggagagcctgtcg

SEQ ID NO: 607353 - DNA, 20 bp, mouse
gcctccagccagcgcgtccg

SEQ ID NO: 607354 - DNA, 20 bp, mouse
gggaaggcacccggtgagta

SEQ ID NO: 607355 - DNA, 20 bp, mouse
gcaggatgtaccctcaggga

SEQ ID NO: 607356 - DNA, 20 bp, mouse
gcagcctgcgcgctcctagg

SEQ ID NO: 607357 - DNA, 20 bp, mouse
gcagccggcataggaagcct

SEQ ID NO: 607358 - DNA, 20 bp, mouse
gggtttgtcggggcgcggag

SEQ ID NO: 607359 - DNA, 20 bp, mouse
gcaggctggagagcaccgga

SEQ ID NO: 607360 - DNA, 20 bp, mouse
gtgtggtatccgcaggtccg

SEQ ID NO: 607361 - DNA, 20 bp, mouse
gcgcgcaggctggagagcac

SEQ ID NO: 607362 - DNA, 20 bp, mouse
gggagacgtagcccgagccc

SEQ ID NO: 607363 - DNA, 20 bp, mouse
ggctcgcggcgagaagagaa

SEQ ID NO: 607364 - DNA, 20 bp, mouse
gccgccgccagcccttccca

SEQ ID NO: 607365 - DNA, 20 bp, mouse
gggctggagttaggatgcca

SEQ ID NO: 607366 - DNA, 20 bp, mouse
gtacacgagtgtgtaagagg

SEQ ID NO: 607367 - DNA, 20 bp, mouse
gctaacaacgcgctctgtgt

SEQ ID NO: 607368 - DNA, 20 bp, mouse
gttgttagagctgttccgag

SEQ ID NO: 607369 - DNA, 20 bp, mouse
ggctgttccgagcgggcgtt

SEQ ID NO: 607370 - DNA, 20 bp, mouse
gcaacagccgaacgcccgct

SEQ ID NO: 607371 - DNA, 20 bp, mouse
gtaatacacgagtgtgtaag

SEQ ID NO: 607372 - DNA, 20 bp, mouse
gtccccgcgggcgtcactga

SEQ ID NO: 607373 - DNA, 20 bp, mouse
gtgtggtaaaagaagctaaa

SEQ ID NO: 607374 - DNA, 20 bp, mouse
gtggttcggaagaggtctcg

SEQ ID NO: 607375 - DNA, 20 bp, mouse
gccgcgggcgtcactgaggg

SEQ ID NO: 607376 - DNA, 20 bp, mouse
gcatcagccagtggagactg

SEQ ID NO: 607377 - DNA, 20 bp, mouse
gagtggagactggggactga

SEQ ID NO: 607378 - DNA, 20 bp, mouse
gagctcttggctcccaccct

SEQ ID NO: 607379 - DNA, 20 bp, mouse
gaactgccaccatcagccag

SEQ ID NO: 607380 - DNA, 20 bp, mouse
gagctgtgggcacatttgag

SEQ ID NO: 607381 - DNA, 20 bp, mouse
ggcagggatgggcctggagt

SEQ ID NO: 607382 - DNA, 20 bp, mouse
ggcagcagcgagggtgaagt

SEQ ID NO: 607383 - DNA, 20 bp, mouse
ggctcctctgcaaagccctg

SEQ ID NO: 607384 - DNA, 20 bp, mouse
gacatttgaggggcccaggg

SEQ ID NO: 607385 - DNA, 20 bp, mouse
gaaagccctgaggcagggat

SEQ ID NO: 607386 - DNA, 20 bp, mouse
gtgaccctggctgacctcag

SEQ ID NO: 607387 - DNA, 20 bp, mouse
gaagcctctgaggtcagcca

SEQ ID NO: 607388 - DNA, 20 bp, mouse
ggcccggggcccagcaggag

SEQ ID NO: 607389 - DNA, 20 bp, mouse
gtgaggttagggaggcccca

SEQ ID NO: 607390 - DNA, 20 bp, mouse
ggcctccctaacctcagagg

SEQ ID NO: 607391 - DNA, 20 bp, mouse
gcctcagaggtggtgcgtga

SEQ ID NO: 607392 - DNA, 20 bp, mouse
gcttcctcctggcctgaccc

SEQ ID NO: 607393 - DNA, 20 bp, mouse
gacgcaccacctctgaggtt

SEQ ID NO: 607394 - DNA, 20 bp, mouse
gaccacctctgaggttaggg

SEQ ID NO: 607395 - DNA, 20 bp, mouse
gcgacccgcccgcaggaagc

SEQ ID NO: 607396 - DNA, 20 bp, mouse
ggcgcctccggtagcagcgg

SEQ ID NO: 607397 - DNA, 20 bp, mouse
gcctgcgcctccggtagcag

SEQ ID NO: 607398 - DNA, 20 bp, mouse
gcctctgcatcagttacggg

SEQ ID NO: 607399 - DNA, 20 bp, mouse
gcatcagttacgggcggcgg

SEQ ID NO: 607400 - DNA, 20 bp, mouse
gccggcacccgcctccgtca

SEQ ID NO: 607401 - DNA, 20 bp, mouse
gggagggtagcgccgagggg

SEQ ID NO: 607402 - DNA, 20 bp, mouse
ggactccccccctgcgacgg

SEQ ID NO: 607403 - DNA, 20 bp, mouse
gagcgcggcccccgccatga

SEQ ID NO: 607404 - DNA, 20 bp, mouse
gcccgactccccccctgcga

SEQ ID NO: 607405 - DNA, 20 bp, mouse
gcccgagccccgaggccagg

SEQ ID NO: 607406 - DNA, 20 bp, mouse
gggcgccgggctccacgaca

SEQ ID NO: 607407 - DNA, 20 bp, mouse
gaatccggatcggttcggtc

SEQ ID NO: 607408 - DNA, 20 bp, mouse
gaatccggaccgaaccgatc

SEQ ID NO: 607409 - DNA, 20 bp, mouse
gcccttaatccggatcggtt

SEQ ID NO: 607410 - DNA, 20 bp, mouse
gccgcccgggcagccgccgg

SEQ ID NO: 607411 - DNA, 20 bp, mouse
gcccaggcctgggagtgtgg

SEQ ID NO: 607412 - DNA, 20 bp, mouse
gagcgagggacagctctcgg

SEQ ID NO: 607413 - DNA, 20 bp, mouse
gggtccggattagtagtgat

SEQ ID NO: 607414 - DNA, 20 bp, mouse
gcccactccagggcccgagg

SEQ ID NO: 607415 - DNA, 20 bp, mouse
gaatctcgcgaggaaacacg

SEQ ID NO: 607416 - DNA, 20 bp, mouse
gtcgggagcttccctagctt

SEQ ID NO: 607417 - DNA, 20 bp, mouse
ggactgcccggagagcaaag

SEQ ID NO: 607418 - DNA, 20 bp, mouse
gtaaaagcctgccgaagcta

SEQ ID NO: 607419 - DNA, 20 bp, mouse
gcgccgctgtcaggaccccg

SEQ ID NO: 607420 - DNA, 20 bp, mouse
gagggaagctcccgactgcc

SEQ ID NO: 607421 - DNA, 20 bp, mouse
ggaactgaaaggggagaccg

SEQ ID NO: 607422 - DNA, 20 bp, mouse
gcaagttccccagcatccgg

SEQ ID NO: 607423 - DNA, 20 bp, mouse
gagcctagagggggggaaag

SEQ ID NO: 607424 - DNA, 20 bp, mouse
gagggcagccgcagccaacc

SEQ ID NO: 607425 - DNA, 20 bp, mouse
ggacctagaccgagccgggt

SEQ ID NO: 607426 - DNA, 20 bp, mouse
gtcgtccggcctggacaccc

SEQ ID NO: 607427 - DNA, 20 bp, mouse
gtggctgccaggcaccggta

SEQ ID NO: 607428 - DNA, 20 bp, mouse
ggtggtcgcaaggggcatag

SEQ ID NO: 607429 - DNA, 20 bp, mouse
ggtaccaagcaagcccagta

SEQ ID NO: 607430 - DNA, 20 bp, mouse
gctaaacacgacttgcccag

SEQ ID NO: 607431 - DNA, 20 bp, mouse
ggctccgcccctctccacca

SEQ ID NO: 607432 - DNA, 20 bp, mouse
ggcggtggctgtgattgtgc

SEQ ID NO: 607433 - DNA, 20 bp, mouse
ggctgtgattgtgctggcgg

SEQ ID NO: 607434 - DNA, 20 bp, mouse
gtgtttagcagcggcttccc

SEQ ID NO: 607435 - DNA, 20 bp, mouse
gccagtaaggcgttctcgtc

SEQ ID NO: 607436 - DNA, 20 bp, mouse
gcgagagtgtgtcgaaggga

SEQ ID NO: 607437 - DNA, 20 bp, mouse
gaagcgagcgtgcagagctc

SEQ ID NO: 607438 - DNA, 20 bp, mouse
gtggccgagagtgtgtcgaa

SEQ ID NO: 607439 - DNA, 20 bp, mouse
ggcccgagcatcgagaacta

SEQ ID NO: 607440 - DNA, 20 bp, mouse
gcagcgcaggtaggccggac

SEQ ID NO: 607441 - DNA, 20 bp, mouse
gctcgcttcctgctggggag

SEQ ID NO: 607442 - DNA, 20 bp, mouse
gcggagccccaaaagcgacc

SEQ ID NO: 607443 - DNA, 20 bp, mouse
gagggaactccagcttagtt

SEQ ID NO: 607444 - DNA, 20 bp, mouse
gtgggccgagcttctaggtg

SEQ ID NO: 607445 - DNA, 20 bp, mouse
ggagaacgcccgaactaagc

SEQ ID NO: 607446 - DNA, 20 bp, mouse
ggacccaccatcccactcag

SEQ ID NO: 607447 - DNA, 20 bp, mouse
gccttaggatgatctagaag

SEQ ID NO: 607448 - DNA, 20 bp, mouse
gccaccatcccactcagcgg

SEQ ID NO: 607449 - DNA, 20 bp, mouse
gatgatctagaagaggcgac

SEQ ID NO: 607450 - DNA, 20 bp, mouse
gtcctggaaagggttaacct

SEQ ID NO: 607451 - DNA, 20 bp, mouse
ggaagagagtgtgtttgagc

SEQ ID NO: 607452 - DNA, 20 bp, mouse
gaaacacactctcttcggga

SEQ ID NO: 607453 - DNA, 20 bp, mouse
ggctccgccgctgagtggga

SEQ ID NO: 607454 - DNA, 20 bp, mouse
gtgtgctgggaccccctgct

SEQ ID NO: 607455 - DNA, 20 bp, mouse
gactggtaacacaaacacct

SEQ ID NO: 607456 - DNA, 20 bp, mouse
gaacatctggactggaatag

SEQ ID NO: 607457 - DNA, 20 bp, mouse
gtgtagggtaacatctggac

SEQ ID NO: 607458 - DNA, 20 bp, mouse
gcaagccgatccaggaactt

SEQ ID NO: 607459 - DNA, 20 bp, mouse
ggctgctgtagggtaacatc

SEQ ID NO: 607460 - DNA, 20 bp, mouse
gtgtccctaagttcctggat

SEQ ID NO: 607461 - DNA, 20 bp, mouse
gttaccctacagcagcacac

SEQ ID NO: 607462 - DNA, 20 bp, mouse
gttgccagtgtgctgctgta

SEQ ID NO: 607463 - DNA, 20 bp, mouse
ggtcttcaacaagccgatcc

SEQ ID NO: 607464 - DNA, 20 bp, mouse
gtagaggctcctctggtgct

SEQ ID NO: 607465 - DNA, 20 bp, mouse
gatcgggcacacatagccaa

SEQ ID NO: 607466 - DNA, 20 bp, mouse
gctgctctgccggacgggta

SEQ ID NO: 607467 - DNA, 20 bp, mouse
gcaagacaaccttacccgtc

SEQ ID NO: 607468 - DNA, 20 bp, mouse
gtcttactgctctgccggac

SEQ ID NO: 607469 - DNA, 20 bp, mouse
gattaaatgttggaggaagt

SEQ ID NO: 607470 - DNA, 20 bp, mouse
gcacggagaggaggatggtt

SEQ ID NO: 607471 - DNA, 20 bp, mouse
ggttactaattaaatgttgg

SEQ ID NO: 607472 - DNA, 20 bp, mouse
ggaatttcttactgctctgc

SEQ ID NO: 607473 - DNA, 20 bp, mouse
gttgaaaataaatcacatga

SEQ ID NO: 607474 - DNA, 20 bp, mouse
gagatgtttccatttctaca

SEQ ID NO: 607475 - DNA, 20 bp, mouse
ggctagttgccatgtagaaa

SEQ ID NO: 607476 - DNA, 20 bp, mouse
gcttacctttgagcatgggg

SEQ ID NO: 607477 - DNA, 20 bp, mouse
gcaaagatcagggccagtgg

SEQ ID NO: 607478 - DNA, 20 bp, mouse
gggtggccaggaagaatctc

SEQ ID NO: 607479 - DNA, 20 bp, mouse
gctctggacagttggactaa

SEQ ID NO: 607480 - DNA, 20 bp, mouse
gacctttgagcatggggtgg

SEQ ID NO: 607481 - DNA, 20 bp, mouse
gtccaccaccccatgctcaa

SEQ ID NO: 607482 - DNA, 20 bp, mouse
gtgacacaagcagggaaaaa

SEQ ID NO: 607483 - DNA, 20 bp, mouse
gagccaaagatcagggccag

SEQ ID NO: 607484 - DNA, 20 bp, mouse
ggcctggcactatagaagta

SEQ ID NO: 607485 - DNA, 20 bp, mouse
gtttggctttctctcaatag

SEQ ID NO: 607486 - DNA, 20 bp, mouse
gggaccttgcaggtactctg

SEQ ID NO: 607487 - DNA, 20 bp, mouse
gggtccgggagcaccgtcaa

SEQ ID NO: 607488 - DNA, 20 bp, mouse
gccttgcaggtactctgagg

SEQ ID NO: 607489 - DNA, 20 bp, mouse
gctgaggtggatgagagtat

SEQ ID NO: 607490 - DNA, 20 bp, mouse
gctgtggaagccgggaagtg

SEQ ID NO: 607491 - DNA, 20 bp, mouse
gtgaaatagcgggagaccag

SEQ ID NO: 607492 - DNA, 20 bp, mouse
ggagagtattggtaacccgg

SEQ ID NO: 607493 - DNA, 20 bp, mouse
gcaccgtcaaagggccactg

SEQ ID NO: 607494 - DNA, 20 bp, mouse
gggaagtgaggaggccgact

SEQ ID NO: 607495 - DNA, 20 bp, mouse
gtgctccacccagttaccag

SEQ ID NO: 607496 - DNA, 20 bp, mouse
gccttgaagccgaagatcag

SEQ ID NO: 607497 - DNA, 20 bp, mouse
gtactactactgtctatggt

SEQ ID NO: 607498 - DNA, 20 bp, mouse
gttcttgaaccactgatctt

SEQ ID NO: 607499 - DNA, 20 bp, mouse
ggtagtagtattgcaccgaa

SEQ ID NO: 607500 - DNA, 20 bp, mouse
ggcaatactactactgtcta

SEQ ID NO: 607501 - DNA, 20 bp, mouse
ggtataagtaccagggaaca

SEQ ID NO: 607502 - DNA, 20 bp, mouse
gttaaaaagtataagtacca

SEQ ID NO: 607503 - DNA, 20 bp, mouse
gagtttagaacaaccatcac

SEQ ID NO: 607504 - DNA, 20 bp, mouse
gaacaattgtactatgtgct

SEQ ID NO: 607505 - DNA, 20 bp, mouse
gtcttcggcttcaagggtac

SEQ ID NO: 607506 - DNA, 20 bp, mouse
gcggcggctggaggactcct

SEQ ID NO: 607507 - DNA, 20 bp, mouse
gtggtgcccagatggctagt

SEQ ID NO: 607508 - DNA, 20 bp, mouse
gggctggaggactcctaggt

SEQ ID NO: 607509 - DNA, 20 bp, mouse
gaggaccgatccacctacct

SEQ ID NO: 607510 - DNA, 20 bp, mouse
gccagatggctagtgggcac

SEQ ID NO: 607511 - DNA, 20 bp, mouse
gtcctaggctggtgcccaga

SEQ ID NO: 607512 - DNA, 20 bp, mouse
gtggaggactcctaggtagg

SEQ ID NO: 607513 - DNA, 20 bp, mouse
ggactcctaggtaggtggat

SEQ ID NO: 607514 - DNA, 20 bp, mouse
gactgaagacctggaagtga

SEQ ID NO: 607515 - DNA, 20 bp, mouse
gcctaggaagactgaagacc

SEQ ID NO: 607516 - DNA, 20 bp, mouse
gacatctcggacacaggagg

SEQ ID NO: 607517 - DNA, 20 bp, mouse
gaggacatctcggacacagg

SEQ ID NO: 607518 - DNA, 20 bp, mouse
gcagtgcatggtctgaggtt

SEQ ID NO: 607519 - DNA, 20 bp, mouse
ggcccagagacccagagtgc

SEQ ID NO: 607520 - DNA, 20 bp, mouse
gatgcgcagtgcatggtctg

SEQ ID NO: 607521 - DNA, 20 bp, mouse
ggattcccgaccagcactct

SEQ ID NO: 607522 - DNA, 20 bp, mouse
gttgaggacatctcggacac

SEQ ID NO: 607523 - DNA, 20 bp, mouse
gggaaccggccgccgcctgg

SEQ ID NO: 607524 - DNA, 20 bp, mouse
ggtcgggaatcgcgcatagt

SEQ ID NO: 607525 - DNA, 20 bp, mouse
gtttccagcaggaaatgttg

SEQ ID NO: 607526 - DNA, 20 bp, mouse
ggaagactgaagactagaac

SEQ ID NO: 607527 - DNA, 20 bp, mouse
ggagtcctagccaggagcca

SEQ ID NO: 607528 - DNA, 20 bp, mouse
gagccagggaggcatcatcc

SEQ ID NO: 607529 - DNA, 20 bp, mouse
ggatctgccccgtcgcagga

SEQ ID NO: 607530 - DNA, 20 bp, mouse
gtaacttccctcctgcgacg

SEQ ID NO: 607531 - DNA, 20 bp, mouse
gctggctaggactctgatca

SEQ ID NO: 607532 - DNA, 20 bp, mouse
ggcgtttgctgaccgactgg

SEQ ID NO: 607533 - DNA, 20 bp, mouse
gcgactggaggaacagcaag

SEQ ID NO: 607534 - DNA, 20 bp, mouse
gcacagggagctctgagctg

SEQ ID NO: 607535 - DNA, 20 bp, mouse
ggtggcagcgcagagtccct

SEQ ID NO: 607536 - DNA, 20 bp, mouse
gagccgagtgaggtcagtcc

SEQ ID NO: 607537 - DNA, 20 bp, mouse
gtggtgcctggagccgagtg

SEQ ID NO: 607538 - DNA, 20 bp, mouse
gagcgggattcccacaacac

SEQ ID NO: 607539 - DNA, 20 bp, mouse
gctccaggactgacctcact

SEQ ID NO: 607540 - DNA, 20 bp, mouse
gccgagcccagcggcagctt

SEQ ID NO: 607541 - DNA, 20 bp, mouse
gcctgctttcccgagcccag

SEQ ID NO: 607542 - DNA, 20 bp, mouse
gaggcaccaaagctgccgct

SEQ ID NO: 607543 - DNA, 20 bp, mouse
gttcccacaacacaggctcc

SEQ ID NO: 607544 - DNA, 20 bp, mouse
gaaggctctcacctcccaag

SEQ ID NO: 607545 - DNA, 20 bp, mouse
gactgacctcactcggctcc

SEQ ID NO: 607546 - DNA, 20 bp, mouse
gccaggcttaggactagggt

SEQ ID NO: 607547 - DNA, 20 bp, mouse
ggtcctaagcctgggaacca

SEQ ID NO: 607548 - DNA, 20 bp, mouse
gcctaagtaccgtggttccc

SEQ ID NO: 607549 - DNA, 20 bp, mouse
ggaaccacggtacttaggag

SEQ ID NO: 607550 - DNA, 20 bp, mouse
ggaagtcttggtaagtaaga

SEQ ID NO: 607551 - DNA, 20 bp, mouse
gtttcagagaaattcggaga

SEQ ID NO: 607552 - DNA, 20 bp, mouse
ggtggtcgtgacagcacact

SEQ ID NO: 607553 - DNA, 20 bp, mouse
ggaaaacagcccaaaccaac

SEQ ID NO: 607554 - DNA, 20 bp, mouse
gagcggaaacgaattcacat

SEQ ID NO: 607555 - DNA, 20 bp, mouse
gtaccgtcagtgctggaaat

SEQ ID NO: 607556 - DNA, 20 bp, mouse
gcccaaagcacgcagctcaa

SEQ ID NO: 607557 - DNA, 20 bp, mouse
gtcaaaggctctgcgagtct

SEQ ID NO: 607558 - DNA, 20 bp, mouse
gtgctgttacaagggaatgg

SEQ ID NO: 607559 - DNA, 20 bp, mouse
gcatagagtggttctataga

SEQ ID NO: 607560 - DNA, 20 bp, mouse
gattgaggctgggtagtggg

SEQ ID NO: 607561 - DNA, 20 bp, mouse
gggagaagagagtcagagat

SEQ ID NO: 607562 - DNA, 20 bp, mouse
gcaaatacaaaattgaggct

SEQ ID NO: 607563 - DNA, 20 bp, mouse
ggccaggatcatcctgagaa

SEQ ID NO: 607564 - DNA, 20 bp, mouse
ggcctttgagctgcgtgctt

SEQ ID NO: 607565 - DNA, 20 bp, mouse
gacgtgctgttacaagggaa

SEQ ID NO: 607566 - DNA, 20 bp, mouse
ggcacagctactgtacacag

SEQ ID NO: 607567 - DNA, 20 bp, mouse
ggcttgtagtagcagtgcag

SEQ ID NO: 607568 - DNA, 20 bp, mouse
gctgtgcagagagcagactt

SEQ ID NO: 607569 - DNA, 20 bp, mouse
gtctggctgggatcccttca

SEQ ID NO: 607570 - DNA, 20 bp, mouse
gaagggatcccagccagaaa

SEQ ID NO: 607571 - DNA, 20 bp, mouse
gcccatctagagatccgggt

SEQ ID NO: 607572 - DNA, 20 bp, mouse
gtcgcacaaactcatcagac

SEQ ID NO: 607573 - DNA, 20 bp, mouse
gcacatagcttacccctttc

SEQ ID NO: 607574 - DNA, 20 bp, mouse
gagcttacccctttctggct

SEQ ID NO: 607575 - DNA, 20 bp, mouse
gtaccatgttctatagacaa

SEQ ID NO: 607576 - DNA, 20 bp, mouse
gctccctctgacaaactggg

SEQ ID NO: 607577 - DNA, 20 bp, mouse
gaggctccctctgacaaact

SEQ ID NO: 607578 - DNA, 20 bp, mouse
ggagatggaggattctcccg

SEQ ID NO: 607579 - DNA, 20 bp, mouse
gccaggggggctaagaactg

SEQ ID NO: 607580 - DNA, 20 bp, mouse
gctgccgcccagtttgtcag

SEQ ID NO: 607581 - DNA, 20 bp, mouse
gagaatgatgttccacacca

SEQ ID NO: 607582 - DNA, 20 bp, mouse
gggttccatgagtgtcccaa

SEQ ID NO: 607583 - DNA, 20 bp, mouse
gactcggaatgagcagtggg

SEQ ID NO: 607584 - DNA, 20 bp, mouse
gaactggggtcctaccatgt

SEQ ID NO: 607585 - DNA, 20 bp, mouse
ggacactcatggaaccctaa

SEQ ID NO: 607586 - DNA, 20 bp, mouse
gcgagcgagcagccggagaa

SEQ ID NO: 607587 - DNA, 20 bp, mouse
gcgcagaagggccaaagtag

SEQ ID NO: 607588 - DNA, 20 bp, mouse
gtcgctgcgctggactaccc

SEQ ID NO: 607589 - DNA, 20 bp, mouse
ggcctccaggatggagacta

SEQ ID NO: 607590 - DNA, 20 bp, mouse
ggactacccgggcagcgagt

SEQ ID NO: 607591 - DNA, 20 bp, mouse
gactctgggacatcaatcac

SEQ ID NO: 607592 - DNA, 20 bp, mouse
ggaggcgcctacacttacgg

SEQ ID NO: 607593 - DNA, 20 bp, mouse
ggtctcagcgcagcctgggg

SEQ ID NO: 607594 - DNA, 20 bp, mouse
gtcctcaacagccccgacca

SEQ ID NO: 607595 - DNA, 20 bp, mouse
gcccccgccgccgtaagtgt

SEQ ID NO: 607596 - DNA, 20 bp, mouse
gccctctccacaccggactc

SEQ ID NO: 607597 - DNA, 20 bp, mouse
ggcatcccgaaggagcgcgg

SEQ ID NO: 607598 - DNA, 20 bp, mouse
gccgctgcccgagtccggtg

SEQ ID NO: 607599 - DNA, 20 bp, mouse
gcgggatgcgagtcccagag

SEQ ID NO: 607600 - DNA, 20 bp, mouse
gcagagcggactcccgggag

SEQ ID NO: 607601 - DNA, 20 bp, mouse
gggcggcgcgctcagggcag

SEQ ID NO: 607602 - DNA, 20 bp, mouse
gggggtcgcagtagcgcagg

SEQ ID NO: 607603 - DNA, 20 bp, mouse
gcccggcggcggcgcgctca

SEQ ID NO: 607604 - DNA, 20 bp, mouse
ggtcagtcgggccagagcca

SEQ ID NO: 607605 - DNA, 20 bp, mouse
gccaggccgctgcccgagtc

SEQ ID NO: 607606 - DNA, 20 bp, mouse
gggctgctgggtccccgtta

SEQ ID NO: 607607 - DNA, 20 bp, mouse
gtcagtgcgactggaggcgc

SEQ ID NO: 607608 - DNA, 20 bp, mouse
gggaggcgccgggcgctcca

SEQ ID NO: 607609 - DNA, 20 bp, mouse
gaagagtgcgcgggcccgac

SEQ ID NO: 607610 - DNA, 20 bp, mouse
gccatggccgcgccgtaacg

SEQ ID NO: 607611 - DNA, 20 bp, mouse
gaaagtttcagtgcgactgg

SEQ ID NO: 607612 - DNA, 20 bp, mouse
gccatcctgggcgggcggaa

SEQ ID NO: 607613 - DNA, 20 bp, mouse
ggcggcacggccccagggag

SEQ ID NO: 607614 - DNA, 20 bp, mouse
gacctgggagggccccccgg

SEQ ID NO: 607615 - DNA, 20 bp, mouse
gcgggcagcgcgctaggcag

SEQ ID NO: 607616 - DNA, 20 bp, mouse
ggctgaccgcctgagaacgg

SEQ ID NO: 607617 - DNA, 20 bp, mouse
gccagctgaccgcctgagaa

SEQ ID NO: 607618 - DNA, 20 bp, mouse
gcgtcacgagccacagggtg

SEQ ID NO: 607619 - DNA, 20 bp, mouse
gaaccggaagcgcgaggacg

SEQ ID NO: 607620 - DNA, 20 bp, mouse
gccctggaccgatcagtggt

SEQ ID NO: 607621 - DNA, 20 bp, mouse
gcccttccttctctaggagg

SEQ ID NO: 607622 - DNA, 20 bp, mouse
ggcgaccgtcacgagccaca

SEQ ID NO: 607623 - DNA, 20 bp, mouse
gagggtgggacaatatcctc

SEQ ID NO: 607624 - DNA, 20 bp, mouse
gccggaaagccgccgttctc

SEQ ID NO: 607625 - DNA, 20 bp, mouse
ggtcactagagccacagcgg

SEQ ID NO: 607626 - DNA, 20 bp, mouse
ggcgtacccgacgtagagag

SEQ ID NO: 607627 - DNA, 20 bp, mouse
ggacagcgccgggctccggt

SEQ ID NO: 607628 - DNA, 20 bp, mouse
gcccagcaccatcttcccgg

SEQ ID NO: 607629 - DNA, 20 bp, mouse
ggggctccggtgggccgtgg

SEQ ID NO: 607630 - DNA, 20 bp, mouse
gaaacaaagccaggccgcca

SEQ ID NO: 607631 - DNA, 20 bp, mouse
gagagaggcctgacagcgcc

SEQ ID NO: 607632 - DNA, 20 bp, mouse
gccaggccgccacggcccac

SEQ ID NO: 607633 - DNA, 20 bp, mouse
gtaggccaggtctctaggac

SEQ ID NO: 607634 - DNA, 20 bp, mouse
gtgaggccgcgggaccctcg

SEQ ID NO: 607635 - DNA, 20 bp, mouse
gggggccggtcctagagacc

SEQ ID NO: 607636 - DNA, 20 bp, mouse
gcagcacgcgggacaggtgg

SEQ ID NO: 607637 - DNA, 20 bp, mouse
gcgcgcagcgacaaaaatgg

SEQ ID NO: 607638 - DNA, 20 bp, mouse
gaagcagcacgcgggacagg

SEQ ID NO: 607639 - DNA, 20 bp, mouse
gggtggcggacagaccgcag

SEQ ID NO: 607640 - DNA, 20 bp, mouse
ggcacgcgcagcgacaaaaa

SEQ ID NO: 607641 - DNA, 20 bp, mouse
ggaaaagcagcacgcgggac

SEQ ID NO: 607642 - DNA, 20 bp, mouse
gggctgcggccgagccgctg

SEQ ID NO: 607643 - DNA, 20 bp, mouse
ggggctgcactgggcatcta

SEQ ID NO: 607644 - DNA, 20 bp, mouse
gcggacagaccgcagcggct

SEQ ID NO: 607645 - DNA, 20 bp, mouse
gcccgacagaatgtagcact

SEQ ID NO: 607646 - DNA, 20 bp, mouse
gcacgctaacatctgatctg

SEQ ID NO: 607647 - DNA, 20 bp, mouse
ggtggcaccaggagtcctgc

SEQ ID NO: 607648 - DNA, 20 bp, mouse
gggcaaaataccacacgaaa

SEQ ID NO: 607649 - DNA, 20 bp, mouse
gcactttacgtagcacatag

SEQ ID NO: 607650 - DNA, 20 bp, mouse
gccacacgaaacggctgagg

SEQ ID NO: 607651 - DNA, 20 bp, mouse
gatgttagcgtgcccctttg

SEQ ID NO: 607652 - DNA, 20 bp, mouse
gctctgccattcgagaggag

SEQ ID NO: 607653 - DNA, 20 bp, mouse
gggggagacaaagtatgcta

SEQ ID NO: 607654 - DNA, 20 bp, mouse
gcgtagcacatagtggcacc

SEQ ID NO: 607655 - DNA, 20 bp, mouse
gataccacacgaaacggctg

SEQ ID NO: 607656 - DNA, 20 bp, mouse
gctgcaagcctagccggctg

SEQ ID NO: 607657 - DNA, 20 bp, mouse
gtaggcttgcagggtcggga

SEQ ID NO: 607658 - DNA, 20 bp, mouse
gtcgaggactatagagctag

SEQ ID NO: 607659 - DNA, 20 bp, mouse
gagccggctggggctgcccg

SEQ ID NO: 607660 - DNA, 20 bp, mouse
ggcttaaccactgggacttg

SEQ ID NO: 607661 - DNA, 20 bp, mouse
ggtttgtgatggcaagaatc

SEQ ID NO: 607662 - DNA, 20 bp, mouse
gctagaacctagggagaaaa

SEQ ID NO: 607663 - DNA, 20 bp, mouse
gagagctggtatcgcaagac

SEQ ID NO: 607664 - DNA, 20 bp, mouse
ggatatatcctagaccagca

SEQ ID NO: 607665 - DNA, 20 bp, mouse
gacaactgcactagaaccta

SEQ ID NO: 607666 - DNA, 20 bp, mouse
ggagcccagccaccctgagg

SEQ ID NO: 607667 - DNA, 20 bp, mouse
gcacgagcccagccaccctg

SEQ ID NO: 607668 - DNA, 20 bp, mouse
gcatgacgtgctgtgaaggg

SEQ ID NO: 607669 - DNA, 20 bp, mouse
gaagggtggacatcctgcaa

SEQ ID NO: 607670 - DNA, 20 bp, mouse
gtcagttagaaacctcctca

SEQ ID NO: 607671 - DNA, 20 bp, mouse
gaaccatgacgtgctgtgaa

SEQ ID NO: 607672 - DNA, 20 bp, mouse
gtagcaggatcagaatgagc

SEQ ID NO: 607673 - DNA, 20 bp, mouse
gaaacctcctcagggtggct

SEQ ID NO: 607674 - DNA, 20 bp, mouse
gggctgaaagtcatagttaa

SEQ ID NO: 607675 - DNA, 20 bp, mouse
gccactcatagcaggagatg

SEQ ID NO: 607676 - DNA, 20 bp, mouse
gcggggtcaataagaaaagt

SEQ ID NO: 607677 - DNA, 20 bp, mouse
gcgttccagtggctgtaccg

SEQ ID NO: 607678 - DNA, 20 bp, mouse
ggagaagtgaagtgtctcca

SEQ ID NO: 607679 - DNA, 20 bp, mouse
gttgcagcagcacgttccag

SEQ ID NO: 607680 - DNA, 20 bp, mouse
gacacttcacttctcaacta

SEQ ID NO: 607681 - DNA, 20 bp, mouse
gagcttgacggttctcctca

SEQ ID NO: 607682 - DNA, 20 bp, mouse
gatcagagttctttgaacct

SEQ ID NO: 607683 - DNA, 20 bp, mouse
gcccagccgcgaatagaaag

SEQ ID NO: 607684 - DNA, 20 bp, mouse
ggtaccagacctcatccgaa

SEQ ID NO: 607685 - DNA, 20 bp, mouse
gagaaaggggaagtatatta

SEQ ID NO: 607686 - DNA, 20 bp, mouse
ggatgcagaccagggagaga

SEQ ID NO: 607687 - DNA, 20 bp, mouse
gatgtctgaggcttccaaac

SEQ ID NO: 607688 - DNA, 20 bp, mouse
gttggccacgatgcagacca

SEQ ID NO: 607689 - DNA, 20 bp, mouse
gaagcctcagacatgtgtac

SEQ ID NO: 607690 - DNA, 20 bp, mouse
gtttccagtacacatgtctg

SEQ ID NO: 607691 - DNA, 20 bp, mouse
ggacctgggtaccgagctaa

SEQ ID NO: 607692 - DNA, 20 bp, mouse
gagcggagtgaacgtgagca

SEQ ID NO: 607693 - DNA, 20 bp, mouse
gctgaggcttccaaacaggc

SEQ ID NO: 607694 - DNA, 20 bp, mouse
gcactcaactcaggacccta

SEQ ID NO: 607695 - DNA, 20 bp, mouse
gagctcggtacccaggtccc

SEQ ID NO: 607696 - DNA, 20 bp, mouse
gaaggacgcgggtcacagat

SEQ ID NO: 607697 - DNA, 20 bp, mouse
gaagggcccggcgaaggacg

SEQ ID NO: 607698 - DNA, 20 bp, mouse
gaaaaggaagggcccggcga

SEQ ID NO: 607699 - DNA, 20 bp, mouse
ggcccggcgcgcacagagag

SEQ ID NO: 607700 - DNA, 20 bp, mouse
ggggcatcctcgagctggaa

SEQ ID NO: 607701 - DNA, 20 bp, mouse
ggcgaggagacaagcgcccc

SEQ ID NO: 607702 - DNA, 20 bp, mouse
ggagctgggcatcctcgagc

SEQ ID NO: 607703 - DNA, 20 bp, mouse
ggctttaatgggaaaaggaa

SEQ ID NO: 607704 - DNA, 20 bp, mouse
gccaggacgcttgctttaat

SEQ ID NO: 607705 - DNA, 20 bp, mouse
gcggccctagagcacccggg

SEQ ID NO: 607706 - DNA, 20 bp, mouse
ggactccagacgaacaagag

SEQ ID NO: 607707 - DNA, 20 bp, mouse
gttcgtctggagtctctctg

SEQ ID NO: 607708 - DNA, 20 bp, mouse
ggcaggtgcacaggatgggt

SEQ ID NO: 607709 - DNA, 20 bp, mouse
ggctggggtgtccttacggt

SEQ ID NO: 607710 - DNA, 20 bp, mouse
gtagagaaacaggagggcag

SEQ ID NO: 607711 - DNA, 20 bp, mouse
gcgttagcttccagggagat

SEQ ID NO: 607712 - DNA, 20 bp, mouse
ggaggcctctcttgttcgtc

SEQ ID NO: 607713 - DNA, 20 bp, mouse
gtcctcccttacctctaata

SEQ ID NO: 607714 - DNA, 20 bp, mouse
gatgcgccaggtacctttac

SEQ ID NO: 607715 - DNA, 20 bp, mouse
gttagaggtaagggaggatg

SEQ ID NO: 607716 - DNA, 20 bp, mouse
ggctaggggcgggatgtcca

SEQ ID NO: 607717 - DNA, 20 bp, mouse
gggcgggatgtccatggcag

SEQ ID NO: 607718 - DNA, 20 bp, mouse
gggcagcggcaccccgaccc

SEQ ID NO: 607719 - DNA, 20 bp, mouse
gacggagccaagcgtcctgg

SEQ ID NO: 607720 - DNA, 20 bp, mouse
ggtcacggagccaagcgtcc

SEQ ID NO: 607721 - DNA, 20 bp, mouse
gcgaccccggcgaggcctcc

SEQ ID NO: 607722 - DNA, 20 bp, mouse
ggcgaggcctccaggacgct

SEQ ID NO: 607723 - DNA, 20 bp, mouse
gctctgacgcgctgcggtca

SEQ ID NO: 607724 - DNA, 20 bp, mouse
gcggcccagctcccatccta

SEQ ID NO: 607725 - DNA, 20 bp, mouse
gcccctagccggcaggactg

SEQ ID NO: 607726 - DNA, 20 bp, mouse
gggctctgcatcagacacgg

SEQ ID NO: 607727 - DNA, 20 bp, mouse
ggccataacccggcatgggg

SEQ ID NO: 607728 - DNA, 20 bp, mouse
gtatggctctgcatcagaca

SEQ ID NO: 607729 - DNA, 20 bp, mouse
gctgatgcagagccataacc

SEQ ID NO: 607730 - DNA, 20 bp, mouse
gtctgcatcagacacggagg

SEQ ID NO: 607731 - DNA, 20 bp, mouse
gaggagcaggtggaacatgg

SEQ ID NO: 607732 - DNA, 20 bp, mouse
gctgctttgccggggaacaa

SEQ ID NO: 607733 - DNA, 20 bp, mouse
gcagagccataacccggcat

SEQ ID NO: 607734 - DNA, 20 bp, mouse
gggctcggagcagaaggatc

SEQ ID NO: 607735 - DNA, 20 bp, mouse
ggagcagtcacgctacacag

SEQ ID NO: 607736 - DNA, 20 bp, mouse
ggccccggcccgcagcgatg

SEQ ID NO: 607737 - DNA, 20 bp, mouse
gtccggggtagcaagcgacc

SEQ ID NO: 607738 - DNA, 20 bp, mouse
ggccaggtcgcttgctaccc

SEQ ID NO: 607739 - DNA, 20 bp, mouse
gcccaggcgaactccagcga

SEQ ID NO: 607740 - DNA, 20 bp, mouse
gccggcccgcagcgatgtgg

SEQ ID NO: 607741 - DNA, 20 bp, mouse
ggcgcatctgcaaccgggga

SEQ ID NO: 607742 - DNA, 20 bp, mouse
gtgcggccctgctgcaggag

SEQ ID NO: 607743 - DNA, 20 bp, mouse
ggatgcgcgcgggcgctccg

SEQ ID NO: 607744 - DNA, 20 bp, mouse
ggccggggcgcgcgggccag

SEQ ID NO: 607745 - DNA, 20 bp, mouse
gtgtaagcgcagcacccctg

SEQ ID NO: 607746 - DNA, 20 bp, mouse
ggccgctgtctggaagaccg

SEQ ID NO: 607747 - DNA, 20 bp, mouse
ggaccggggcagaagcccaa

SEQ ID NO: 607748 - DNA, 20 bp, mouse
gaagcccaagggcagctacg

SEQ ID NO: 607749 - DNA, 20 bp, mouse
ggccccggtcttccagacag

SEQ ID NO: 607750 - DNA, 20 bp, mouse
gccagacagcggcgccggag

SEQ ID NO: 607751 - DNA, 20 bp, mouse
gacagcggcgccggagcggt

SEQ ID NO: 607752 - DNA, 20 bp, mouse
gggtcctcactgcgaggtac

SEQ ID NO: 607753 - DNA, 20 bp, mouse
ggcctagaggcgtgaaccct

SEQ ID NO: 607754 - DNA, 20 bp, mouse
ggaggcgccagtggcctcac

SEQ ID NO: 607755 - DNA, 20 bp, mouse
gagaggcgtgaaccctaggt

SEQ ID NO: 607756 - DNA, 20 bp, mouse
gagagaaggccggcccgcaa

SEQ ID NO: 607757 - DNA, 20 bp, mouse
ggcgctcggagatcacctca

SEQ ID NO: 607758 - DNA, 20 bp, mouse
gcaaggcccgagcgcagaga

SEQ ID NO: 607759 - DNA, 20 bp, mouse
ggccaggccgggcaggtaga

SEQ ID NO: 607760 - DNA, 20 bp, mouse
ggccggccttctctgcgctc

SEQ ID NO: 607761 - DNA, 20 bp, mouse
gtcgctgctcctgctaggga

SEQ ID NO: 607762 - DNA, 20 bp, mouse
gcggcgaggaaggaggggtc

SEQ ID NO: 607763 - DNA, 20 bp, mouse
gcttcggcgcagaagttgac

SEQ ID NO: 607764 - DNA, 20 bp, mouse
gaggtgatctccgagcgccc

SEQ ID NO: 607765 - DNA, 20 bp, mouse
gtcatgccggcggctgtgag

SEQ ID NO: 607766 - DNA, 20 bp, mouse
gcgggcgcggacagacgcac

SEQ ID NO: 607767 - DNA, 20 bp, mouse
gcccggtggatgtgaatcgg

SEQ ID NO: 607768 - DNA, 20 bp, mouse
ggccgccgattcacatccac

SEQ ID NO: 607769 - DNA, 20 bp, mouse
ggcgcccggtggatgtgaat

SEQ ID NO: 607770 - DNA, 20 bp, mouse
gggacagacgcacggggccc

SEQ ID NO: 607771 - DNA, 20 bp, mouse
gcgagcacgaacacacggtg

SEQ ID NO: 607772 - DNA, 20 bp, mouse
gggcgcggagcgggcggtga

SEQ ID NO: 607773 - DNA, 20 bp, mouse
ggagctgcggagcaaggccc

SEQ ID NO: 607774 - DNA, 20 bp, mouse
gggatgtgaatcggcggcgg

SEQ ID NO: 607775 - DNA, 20 bp, mouse
gcggcggaggaggagtcggt

SEQ ID NO: 607776 - DNA, 20 bp, mouse
gcggcggcgatggtgagtga

SEQ ID NO: 607777 - DNA, 20 bp, mouse
gacacgtggatccaagatgg

SEQ ID NO: 607778 - DNA, 20 bp, mouse
gggtgagtgaaggagactcc

SEQ ID NO: 607779 - DNA, 20 bp, mouse
gaaggtcctgggctatccag

SEQ ID NO: 607780 - DNA, 20 bp, mouse
gtagaggccgacccagtcaa

SEQ ID NO: 607781 - DNA, 20 bp, mouse
ggaggctgggaaccaggcat

SEQ ID NO: 607782 - DNA, 20 bp, mouse
gccgcttggaaggaagactt

SEQ ID NO: 607783 - DNA, 20 bp, mouse
gactaggtgaagagaacgta

SEQ ID NO: 607784 - DNA, 20 bp, mouse
gggtctgccagaagtcaata

SEQ ID NO: 607785 - DNA, 20 bp, mouse
gtgaaggagactccgggaac

SEQ ID NO: 607786 - DNA, 20 bp, mouse
ggaagaagcggacttgagag

SEQ ID NO: 607787 - DNA, 20 bp, mouse
gtaacacacgtgggccccgg

SEQ ID NO: 607788 - DNA, 20 bp, mouse
gccccgggggaaacaaatag

SEQ ID NO: 607789 - DNA, 20 bp, mouse
ggcctcccggagaacctaag

SEQ ID NO: 607790 - DNA, 20 bp, mouse
gctggagcactccgatcctg

SEQ ID NO: 607791 - DNA, 20 bp, mouse
ggactaaagtcagaacagaa

SEQ ID NO: 607792 - DNA, 20 bp, mouse
gcctaaggggccgctcacca

SEQ ID NO: 607793 - DNA, 20 bp, mouse
ggtaggaatgggagttgtag

SEQ ID NO: 607794 - DNA, 20 bp, mouse
gcccggtgctgccccaggat

SEQ ID NO: 607795 - DNA, 20 bp, mouse
ggcgggccgatgcacctcgt

SEQ ID NO: 607796 - DNA, 20 bp, mouse
ggtttccggcatacgatcag

SEQ ID NO: 607797 - DNA, 20 bp, mouse
gatgtcgggccgggaaggta

SEQ ID NO: 607798 - DNA, 20 bp, mouse
gccaatcaggggccacgcat

SEQ ID NO: 607799 - DNA, 20 bp, mouse
gataggtgcggcataagcga

SEQ ID NO: 607800 - DNA, 20 bp, mouse
gaaggctatttggagatcgg

SEQ ID NO: 607801 - DNA, 20 bp, mouse
ggggcgggcgctgagggtat

SEQ ID NO: 607802 - DNA, 20 bp, mouse
ggagatggacgaggtgagga

SEQ ID NO: 607803 - DNA, 20 bp, mouse
gccgccgggaagggccccct

SEQ ID NO: 607804 - DNA, 20 bp, mouse
gtgctcgtgtcgcccacagg

SEQ ID NO: 607805 - DNA, 20 bp, mouse
gcaaggagatggacgaggtg

SEQ ID NO: 607806 - DNA, 20 bp, mouse
gacagcgcaggcaagtgagg

SEQ ID NO: 607807 - DNA, 20 bp, mouse
ggaggcccaggcggatctca

SEQ ID NO: 607808 - DNA, 20 bp, mouse
gctcgggtccccacctccaa

SEQ ID NO: 607809 - DNA, 20 bp, mouse
gccaggcggatctcacggtc

SEQ ID NO: 607810 - DNA, 20 bp, mouse
gtcacggtccggaacagcgc

SEQ ID NO: 607811 - DNA, 20 bp, mouse
ggtgctccggagccaggcta

SEQ ID NO: 607812 - DNA, 20 bp, mouse
gggaacagcgcaggcaagtg

SEQ ID NO: 607813 - DNA, 20 bp, mouse
gggaggtggggacccgagac

SEQ ID NO: 607814 - DNA, 20 bp, mouse
gccgggcgctggcgaggact

SEQ ID NO: 607815 - DNA, 20 bp, mouse
ggctgcggccgttggaggtg

SEQ ID NO: 607816 - DNA, 20 bp, mouse
gaggcggttgtggtcagtgt

SEQ ID NO: 607817 - DNA, 20 bp, mouse
gacttcggccggggcaggtg

SEQ ID NO: 607818 - DNA, 20 bp, mouse
gtcagtgtaggctcccactt

SEQ ID NO: 607819 - DNA, 20 bp, mouse
gtaggctcccacttcggccg

SEQ ID NO: 607820 - DNA, 20 bp, mouse
gggatagcccgggtccgtgt

SEQ ID NO: 607821 - DNA, 20 bp, mouse
ggctggcgacatggccgaca

SEQ ID NO: 607822 - DNA, 20 bp, mouse
gtcccggaagtgggtgaagg

SEQ ID NO: 607823 - DNA, 20 bp, mouse
gggacgagcggggatagccc

SEQ ID NO: 607824 - DNA, 20 bp, mouse
gacatggccgacacggaccc

SEQ ID NO: 607825 - DNA, 20 bp, mouse
gtggcggccatcccggaagt

SEQ ID NO: 607826 - DNA, 20 bp, mouse
ggacttccagcgccaacccc

SEQ ID NO: 607827 - DNA, 20 bp, mouse
gatgtgctctgagtctccgg

SEQ ID NO: 607828 - DNA, 20 bp, mouse
ggtggaagggacgcaagcga

SEQ ID NO: 607829 - DNA, 20 bp, mouse
gtacgtgcgaaactaggatc

SEQ ID NO: 607830 - DNA, 20 bp, mouse
gcacctggcccgccgtgaca

SEQ ID NO: 607831 - DNA, 20 bp, mouse
gcccggagtgagggataggg

SEQ ID NO: 607832 - DNA, 20 bp, mouse
ggagaggcgatcgcagggtg

SEQ ID NO: 607833 - DNA, 20 bp, mouse
gccctgaactcggctgaggg

SEQ ID NO: 607834 - DNA, 20 bp, mouse
gccgagaaggaacagccgag

SEQ ID NO: 607835 - DNA, 20 bp, mouse
ggaggcagaggaacccgaga

SEQ ID NO: 607836 - DNA, 20 bp, mouse
gtggcaccagggagactctg

SEQ ID NO: 607837 - DNA, 20 bp, mouse
gaggaattgcaagttgaagg

SEQ ID NO: 607838 - DNA, 20 bp, mouse
gatcaggaattgcaagttga

SEQ ID NO: 607839 - DNA, 20 bp, mouse
gtatgtttcagactgtgaag

SEQ ID NO: 607840 - DNA, 20 bp, mouse
gatgcacatggagattctgg

SEQ ID NO: 607841 - DNA, 20 bp, mouse
gagactctggacaagcatat

SEQ ID NO: 607842 - DNA, 20 bp, mouse
gcagaagaaacgcccaagac

SEQ ID NO: 607843 - DNA, 20 bp, mouse
gggtggagcaactcataact

SEQ ID NO: 607844 - DNA, 20 bp, mouse
gtatggtcagatcagcatga

SEQ ID NO: 607845 - DNA, 20 bp, mouse
gtgccagaatgtctctaatc

SEQ ID NO: 607846 - DNA, 20 bp, mouse
gcggcaactaggggcctctg

SEQ ID NO: 607847 - DNA, 20 bp, mouse
gggaacctgacggcaactag

SEQ ID NO: 607848 - DNA, 20 bp, mouse
gggcacagtgggtatcggag

SEQ ID NO: 607849 - DNA, 20 bp, mouse
gtttgttggggagagagatg

SEQ ID NO: 607850 - DNA, 20 bp, mouse
ggccgtcaggttccaggaag

SEQ ID NO: 607851 - DNA, 20 bp, mouse
gtcggagaggcagtctcaag

SEQ ID NO: 607852 - DNA, 20 bp, mouse
ggacagcaggaagtcacccc

SEQ ID NO: 607853 - DNA, 20 bp, mouse
gtcccatcggtgggtcgggt

SEQ ID NO: 607854 - DNA, 20 bp, mouse
gacccgagcggaggagtgtc

SEQ ID NO: 607855 - DNA, 20 bp, mouse
gctctttgcagggctcctag

SEQ ID NO: 607856 - DNA, 20 bp, mouse
ggtcctggtagagataacac

SEQ ID NO: 607857 - DNA, 20 bp, mouse
gcccaagaagcagggagtcc

SEQ ID NO: 607858 - DNA, 20 bp, mouse
ggagagcaggtcaactctgc

SEQ ID NO: 607859 - DNA, 20 bp, mouse
gtggtccctagggatagcca

SEQ ID NO: 607860 - DNA, 20 bp, mouse
ggctctcctccttcagaaac

SEQ ID NO: 607861 - DNA, 20 bp, mouse
gggcctcatgaaaacctcaa

SEQ ID NO: 607862 - DNA, 20 bp, mouse
gctgtagccaatggtcccta

SEQ ID NO: 607863 - DNA, 20 bp, mouse
gcagacacctgatttatcag

SEQ ID NO: 607864 - DNA, 20 bp, mouse
gaaccctgcctgcaaaatca

SEQ ID NO: 607865 - DNA, 20 bp, mouse
gagcagatgaagcccatgtg

SEQ ID NO: 607866 - DNA, 20 bp, mouse
gccggaaagccagaacaggt

SEQ ID NO: 607867 - DNA, 20 bp, mouse
gtccgggagctggagcaggc

SEQ ID NO: 607868 - DNA, 20 bp, mouse
gctccagagacagaaagaac

SEQ ID NO: 607869 - DNA, 20 bp, mouse
gagaacgggtgctggaagta

SEQ ID NO: 607870 - DNA, 20 bp, mouse
ggactctctcctacctgttc

SEQ ID NO: 607871 - DNA, 20 bp, mouse
gtcaaacctagactccgtgg

SEQ ID NO: 607872 - DNA, 20 bp, mouse
ggagagagtccagcaaagtc

SEQ ID NO: 607873 - DNA, 20 bp, mouse
ggaaacgggtccctaatatc

SEQ ID NO: 607874 - DNA, 20 bp, mouse
gctccgtgggggagagtcta

SEQ ID NO: 607875 - DNA, 20 bp, mouse
gtcctcacaagcctgatatt

SEQ ID NO: 607876 - DNA, 20 bp, mouse
gctcctaaggagtcccccca

SEQ ID NO: 607877 - DNA, 20 bp, mouse
ggaagaacaagagtcttcgt

SEQ ID NO: 607878 - DNA, 20 bp, mouse
gtccctggtgggcccaacca

SEQ ID NO: 607879 - DNA, 20 bp, mouse
ggtccctggggggactcctt

SEQ ID NO: 607880 - DNA, 20 bp, mouse
gagaaatgtgtctcctccta

SEQ ID NO: 607881 - DNA, 20 bp, mouse
gtctacagagaatattgcct

SEQ ID NO: 607882 - DNA, 20 bp, mouse
gggagagcacgcagaaggcg

SEQ ID NO: 607883 - DNA, 20 bp, mouse
gatgcagtcagacgaccaag

SEQ ID NO: 607884 - DNA, 20 bp, mouse
gatctctcacttagctacca

SEQ ID NO: 607885 - DNA, 20 bp, mouse
gaagtggagaatgttccctc

SEQ ID NO: 607886 - DNA, 20 bp, mouse
gcacccgccgcggggaaccg

SEQ ID NO: 607887 - DNA, 20 bp, mouse
gatcagcacacagtaattaa

SEQ ID NO: 607888 - DNA, 20 bp, mouse
gctgcaccctgagccagatg

SEQ ID NO: 607889 - DNA, 20 bp, mouse
gctgagacctcggttccccg

SEQ ID NO: 607890 - DNA, 20 bp, mouse
gaggtctcagccccaccagc

SEQ ID NO: 607891 - DNA, 20 bp, mouse
ggctgattctcctgctggtg

SEQ ID NO: 607892 - DNA, 20 bp, mouse
ggccaggtagttgacagctt

SEQ ID NO: 607893 - DNA, 20 bp, mouse
gccgcggcgggtgcgcgcac

SEQ ID NO: 607894 - DNA, 20 bp, mouse
gagacctcggttccccgcgg

SEQ ID NO: 607895 - DNA, 20 bp, mouse
gccaggtgtgcgctgttccg

SEQ ID NO: 607896 - DNA, 20 bp, mouse
ggccgagccgtgatgagcga

SEQ ID NO: 607897 - DNA, 20 bp, mouse
ggcgctgccctcgctcatca

SEQ ID NO: 607898 - DNA, 20 bp, mouse
gcgtcatctggaacccgaca

SEQ ID NO: 607899 - DNA, 20 bp, mouse
gccctccagccgcctgccgg

SEQ ID NO: 607900 - DNA, 20 bp, mouse
gtctggaacccgacaaggca

SEQ ID NO: 607901 - DNA, 20 bp, mouse
ggccctcgctcatcacggct

SEQ ID NO: 607902 - DNA, 20 bp, mouse
gcagctcggtaggcaaggca

SEQ ID NO: 607903 - DNA, 20 bp, mouse
gcttgcctaccgagctggag

SEQ ID NO: 607904 - DNA, 20 bp, mouse
gactgcctctccagctcggt

SEQ ID NO: 607905 - DNA, 20 bp, mouse
ggccccgcggaggaccagga

SEQ ID NO: 607906 - DNA, 20 bp, mouse
gcttaggagggggctcttcg

SEQ ID NO: 607907 - DNA, 20 bp, mouse
gtgtgtcaagagctggtctt

SEQ ID NO: 607908 - DNA, 20 bp, mouse
ggtcaagagctggtcttagg

SEQ ID NO: 607909 - DNA, 20 bp, mouse
gtctgctctggtcttctcaa

SEQ ID NO: 607910 - DNA, 20 bp, mouse
gagcagctcacaaagaggca

SEQ ID NO: 607911 - DNA, 20 bp, mouse
gcccagctctggatgtacta

SEQ ID NO: 607912 - DNA, 20 bp, mouse
ggaccagctcttgacacacc

SEQ ID NO: 607913 - DNA, 20 bp, mouse
gcaataaggacggtgagagg

SEQ ID NO: 607914 - DNA, 20 bp, mouse
gtcaagggacccagaataga

SEQ ID NO: 607915 - DNA, 20 bp, mouse
gagaatggggcgggcagtga

SEQ ID NO: 607916 - DNA, 20 bp, mouse
gctgggccagtcctactcac

SEQ ID NO: 607917 - DNA, 20 bp, mouse
ggccggggccgtggcagcgg

SEQ ID NO: 607918 - DNA, 20 bp, mouse
gggccagtcctactcaccgg

SEQ ID NO: 607919 - DNA, 20 bp, mouse
gctcaccggtggagagacga

SEQ ID NO: 607920 - DNA, 20 bp, mouse
gtctgcccaaaggagagcgg

SEQ ID NO: 607921 - DNA, 20 bp, mouse
gggcgctggagaccgagccg

SEQ ID NO: 607922 - DNA, 20 bp, mouse
ggcgccgccagagcgaccag

SEQ ID NO: 607923 - DNA, 20 bp, mouse
gcgagcgcgaaccagcgcga

SEQ ID NO: 607924 - DNA, 20 bp, mouse
gctgtccgtcgtctctccac

SEQ ID NO: 607925 - DNA, 20 bp, mouse
gctccaccggtgagtaggac

SEQ ID NO: 607926 - DNA, 20 bp, mouse
gaaggagcctgtagagtcct

SEQ ID NO: 607927 - DNA, 20 bp, mouse
gagtggacctaggactctac

SEQ ID NO: 607928 - DNA, 20 bp, mouse
gagccagagggccacagtcg

SEQ ID NO: 607929 - DNA, 20 bp, mouse
gggacagcgagtagcgagga

SEQ ID NO: 607930 - DNA, 20 bp, mouse
gtcgaggacagcgagtagcg

SEQ ID NO: 607931 - DNA, 20 bp, mouse
gggactaagtctcagaacag

SEQ ID NO: 607932 - DNA, 20 bp, mouse
gcaccactgtggctccctcc

SEQ ID NO: 607933 - DNA, 20 bp, mouse
gtctctgagcagttttcccc

SEQ ID NO: 607934 - DNA, 20 bp, mouse
gtgaatgggtattctgcctg

SEQ ID NO: 607935 - DNA, 20 bp, mouse
ggtctgtctgggcagtgcta

SEQ ID NO: 607936 - DNA, 20 bp, mouse
ggcgcagggccgcggggtgt

SEQ ID NO: 607937 - DNA, 20 bp, mouse
ggacatgccgggcagcgaca

SEQ ID NO: 607938 - DNA, 20 bp, mouse
gcaccctcgccccggagccg

SEQ ID NO: 607939 - DNA, 20 bp, mouse
ggtcgcccgcctccccaccc

SEQ ID NO: 607940 - DNA, 20 bp, mouse
gcgcgccaccccctcggccg

SEQ ID NO: 607941 - DNA, 20 bp, mouse
ggctccggggcgagggtgag

SEQ ID NO: 607942 - DNA, 20 bp, mouse
gtgccggccggggtctgagt

SEQ ID NO: 607943 - DNA, 20 bp, mouse
gccgctgcaagagccgggtg

SEQ ID NO: 607944 - DNA, 20 bp, mouse
ggggccaccgctggaatcgg

SEQ ID NO: 607945 - DNA, 20 bp, mouse
ggctccgctcaccctcgccc

SEQ ID NO: 607946 - DNA, 20 bp, mouse
ggagagaccgggaagagacg

SEQ ID NO: 607947 - DNA, 20 bp, mouse
gctccagagccagagagacc

SEQ ID NO: 607948 - DNA, 20 bp, mouse
gagaccgggaagagacgtgg

SEQ ID NO: 607949 - DNA, 20 bp, mouse
gaagttgtagcgctcctcga

SEQ ID NO: 607950 - DNA, 20 bp, mouse
gtgtagcgctcctcgagggt

SEQ ID NO: 607951 - DNA, 20 bp, mouse
ggtggcgggaccgaccctcg

SEQ ID NO: 607952 - DNA, 20 bp, mouse
ggtcccgccacgtctcttcc

SEQ ID NO: 607953 - DNA, 20 bp, mouse
ggaagcggaagtgtagactc

SEQ ID NO: 607954 - DNA, 20 bp, mouse
gcgccatagtcgggagagag

SEQ ID NO: 607955 - DNA, 20 bp, mouse
gcgctgctcgccgagggtga

SEQ ID NO: 607956 - DNA, 20 bp, mouse
gggaatctagacacaaatta

SEQ ID NO: 607957 - DNA, 20 bp, mouse
gaggctggccttgtagaagg

SEQ ID NO: 607958 - DNA, 20 bp, mouse
gtctctgcacatgtagttcc

SEQ ID NO: 607959 - DNA, 20 bp, mouse
gcacaaagcacggctcataa

SEQ ID NO: 607960 - DNA, 20 bp, mouse
gcgcctcagccaacaaactt

SEQ ID NO: 607961 - DNA, 20 bp, mouse
gaaattagggaaagcggcca

SEQ ID NO: 607962 - DNA, 20 bp, mouse
gccagaacatctgaactccc

SEQ ID NO: 607963 - DNA, 20 bp, mouse
gctctctcagcccttagtgg

SEQ ID NO: 607964 - DNA, 20 bp, mouse
ggcgagcaagagcatttaag

SEQ ID NO: 607965 - DNA, 20 bp, mouse
gagacacaaattagggaaag

SEQ ID NO: 607966 - DNA, 20 bp, mouse
gcctcgggaccaggacaccg

SEQ ID NO: 607967 - DNA, 20 bp, mouse
gagcgcctgaagtaagaaga

SEQ ID NO: 607968 - DNA, 20 bp, mouse
gcgcagctggaaagtaggtg

SEQ ID NO: 607969 - DNA, 20 bp, mouse
gccaagaaggagccccgggt

SEQ ID NO: 607970 - DNA, 20 bp, mouse
gtgacgcgcagctggaaagt

SEQ ID NO: 607971 - DNA, 20 bp, mouse
gggacgacggagctgtccat

SEQ ID NO: 607972 - DNA, 20 bp, mouse
gtcctggcgactcctacccg

SEQ ID NO: 607973 - DNA, 20 bp, mouse
gccccctggaaagtagacaa

SEQ ID NO: 607974 - DNA, 20 bp, mouse
gacccggatgaggaccccgg

SEQ ID NO: 607975 - DNA, 20 bp, mouse
gcccgacgcagcgaacctca

SEQ ID NO: 607976 - DNA, 20 bp, mouse
gttcgagcagacacttgaag

SEQ ID NO: 607977 - DNA, 20 bp, mouse
gcaagtgtggcggcaaaatt

SEQ ID NO: 607978 - DNA, 20 bp, mouse
gtgctcaccaggggctgggc

SEQ ID NO: 607979 - DNA, 20 bp, mouse
ggcagcgacggatgggacga

SEQ ID NO: 607980 - DNA, 20 bp, mouse
ggggaggcaccttctgggac

SEQ ID NO: 607981 - DNA, 20 bp, mouse
ggacaggctcttttcaagtg

SEQ ID NO: 607982 - DNA, 20 bp, mouse
gggagggggaggcaccttct

SEQ ID NO: 607983 - DNA, 20 bp, mouse
ggagagtgctcaccaggggc

SEQ ID NO: 607984 - DNA, 20 bp, mouse
gtcccgcctgcgcagcccta

SEQ ID NO: 607985 - DNA, 20 bp, mouse
ggaacaggcggggagcgcca

SEQ ID NO: 607986 - DNA, 20 bp, mouse
gaagcacatcggtagaaggg

SEQ ID NO: 607987 - DNA, 20 bp, mouse
gagggaggtagagtttgtag

SEQ ID NO: 607988 - DNA, 20 bp, mouse
ggtttgtagaggaggttata

SEQ ID NO: 607989 - DNA, 20 bp, mouse
gtcagaaagccaaagcacat

SEQ ID NO: 607990 - DNA, 20 bp, mouse
gccaaagcacatcggtagaa

SEQ ID NO: 607991 - DNA, 20 bp, mouse
gagaagctcctgattagggc

SEQ ID NO: 607992 - DNA, 20 bp, mouse
gaagcagcggtcatgaagaa

SEQ ID NO: 607993 - DNA, 20 bp, mouse
gggaggttatagggcagaga

SEQ ID NO: 607994 - DNA, 20 bp, mouse
gaccatcccggggctatgaa

SEQ ID NO: 607995 - DNA, 20 bp, mouse
gtggggactggggaacatcc

SEQ ID NO: 607996 - DNA, 20 bp, mouse
ggctggaaaggaaatctatt

SEQ ID NO: 607997 - DNA, 20 bp, mouse
gcagcactaagtccagtctt

SEQ ID NO: 607998 - DNA, 20 bp, mouse
gactacttagaaagagacag

SEQ ID NO: 607999 - DNA, 20 bp, mouse
gcaaagagggatgtgaaagg

SEQ ID NO: 608000 - DNA, 20 bp, mouse
gactagtccagttatgtgtg

SEQ ID NO: 608001 - DNA, 20 bp, mouse
gactaagtccagtcttagga

SEQ ID NO: 608002 - DNA, 20 bp, mouse
gcttcaaagagggatgtgaa

SEQ ID NO: 608003 - DNA, 20 bp, mouse
ggtggaagatgaacttcaaa

SEQ ID NO: 608004 - DNA, 20 bp, mouse
ggtggaaatggttaaaggaa

SEQ ID NO: 608005 - DNA, 20 bp, mouse
gctaagtccccacacataac

SEQ ID NO: 608006 - DNA, 20 bp, mouse
ggcaggcgctaaacaaaacc

SEQ ID NO: 608007 - DNA, 20 bp, mouse
gggcgctaaacaaaaccggg

SEQ ID NO: 608008 - DNA, 20 bp, mouse
gtcgcgccccgaggaaggtt

SEQ ID NO: 608009 - DNA, 20 bp, mouse
gaggcaggtgtggatagacg

SEQ ID NO: 608010 - DNA, 20 bp, mouse
gagtctactgcccgcaacag

SEQ ID NO: 608011 - DNA, 20 bp, mouse
gctgcaagatgtggaatcgg

SEQ ID NO: 608012 - DNA, 20 bp, mouse
ggcagtcccaaccttcctcg

SEQ ID NO: 608013 - DNA, 20 bp, mouse
gacgccccggaagaagtcgg

SEQ ID NO: 608014 - DNA, 20 bp, mouse
gctacgtcgcgccccgagga

SEQ ID NO: 608015 - DNA, 20 bp, mouse
gggatagacgaggaagccag

SEQ ID NO: 608016 - DNA, 20 bp, mouse
gagccacagggccagtgcta

SEQ ID NO: 608017 - DNA, 20 bp, mouse
gagggtgacccggatgatgg

SEQ ID NO: 608018 - DNA, 20 bp, mouse
gtagagggtgacccggatga

SEQ ID NO: 608019 - DNA, 20 bp, mouse
gccgtgagtagagggtgacc

SEQ ID NO: 608020 - DNA, 20 bp, mouse
ggtccacgccccgtgagtag

SEQ ID NO: 608021 - DNA, 20 bp, mouse
ggcgccggccgccatcatcc

SEQ ID NO: 608022 - DNA, 20 bp, mouse
gagtaggagtgggagaggca

SEQ ID NO: 608023 - DNA, 20 bp, mouse
gctcctgccagcagtaggag

SEQ ID NO: 608024 - DNA, 20 bp, mouse
gtgctggcaggagtagccac

SEQ ID NO: 608025 - DNA, 20 bp, mouse
gggctactcctgccagcagt

SEQ ID NO: 608026 - DNA, 20 bp, mouse
gaggccccgggtggtgaacg

SEQ ID NO: 608027 - DNA, 20 bp, mouse
ggcgcgctagaggccccggg

SEQ ID NO: 608028 - DNA, 20 bp, mouse
ggagcctcgttcaccacccg

SEQ ID NO: 608029 - DNA, 20 bp, mouse
gtccggcgcgctagaggccc

SEQ ID NO: 608030 - DNA, 20 bp, mouse
ggggcagaggcgcgtcacgt

SEQ ID NO: 608031 - DNA, 20 bp, mouse
gaaagtcggggcccttggaa

SEQ ID NO: 608032 - DNA, 20 bp, mouse
gcctctagcgcgccggaacc

SEQ ID NO: 608033 - DNA, 20 bp, mouse
ggcgcacccacctcaaggtg

SEQ ID NO: 608034 - DNA, 20 bp, mouse
gcccaacgcgcggggtgaag

SEQ ID NO: 608035 - DNA, 20 bp, mouse
gtccggggaaggccgaggta

SEQ ID NO: 608036 - DNA, 20 bp, mouse
gcttgaataggagcagttaa

SEQ ID NO: 608037 - DNA, 20 bp, mouse
gaatgctaattaatctccag

SEQ ID NO: 608038 - DNA, 20 bp, mouse
gtattcaaggaagagacctc

SEQ ID NO: 608039 - DNA, 20 bp, mouse
gtacagcattagctaccccg

SEQ ID NO: 608040 - DNA, 20 bp, mouse
gcagtgaagtgcaaacacct

SEQ ID NO: 608041 - DNA, 20 bp, mouse
gattctgaggtgtcaaacat

SEQ ID NO: 608042 - DNA, 20 bp, mouse
gtgatacattgataacaggt

SEQ ID NO: 608043 - DNA, 20 bp, mouse
gttccatgctggagagcgag

SEQ ID NO: 608044 - DNA, 20 bp, mouse
gttaaaggtgactgtttcct

SEQ ID NO: 608045 - DNA, 20 bp, mouse
ggctgaataatgcagacctc

SEQ ID NO: 608046 - DNA, 20 bp, mouse
gtgggaggcgccgccggaag

SEQ ID NO: 608047 - DNA, 20 bp, mouse
gtcagctccgccccttccgg

SEQ ID NO: 608048 - DNA, 20 bp, mouse
gccggcggcgcctcccaagg

SEQ ID NO: 608049 - DNA, 20 bp, mouse
ggcgggacagcgctcgacaa

SEQ ID NO: 608050 - DNA, 20 bp, mouse
gccccgagagggactcgcga

SEQ ID NO: 608051 - DNA, 20 bp, mouse
ggccccgtgcgagccctgga

SEQ ID NO: 608052 - DNA, 20 bp, mouse
gagcccgggagggagcgact

SEQ ID NO: 608053 - DNA, 20 bp, mouse
ggcctcagctccgccccttc

SEQ ID NO: 608054 - DNA, 20 bp, mouse
gccgcatcagcccccttggg

SEQ ID NO: 608055 - DNA, 20 bp, mouse
gacccgccaaccccccgaga

SEQ ID NO: 608056 - DNA, 20 bp, mouse
gtccgggcctagtcctctct

SEQ ID NO: 608057 - DNA, 20 bp, mouse
ggactaggcccggagcatca

SEQ ID NO: 608058 - DNA, 20 bp, mouse
gtctggaaggatgaagcgtg

SEQ ID NO: 608059 - DNA, 20 bp, mouse
gcagtagccccagtgagacg

SEQ ID NO: 608060 - DNA, 20 bp, mouse
gtcgtggaccatgatgctcc

SEQ ID NO: 608061 - DNA, 20 bp, mouse
gtgaagcgtgcggagcctcg

SEQ ID NO: 608062 - DNA, 20 bp, mouse
ggcgcagccgcacaccagag

SEQ ID NO: 608063 - DNA, 20 bp, mouse
gtagctggacacccactggg

SEQ ID NO: 608064 - DNA, 20 bp, mouse
gccaggggcactggggagtt

SEQ ID NO: 608065 - DNA, 20 bp, mouse
gcccctggcccacttcggga

SEQ ID NO: 608066 - DNA, 20 bp, mouse
gcgagctgacagggaaggag

SEQ ID NO: 608067 - DNA, 20 bp, mouse
ggtcggaccgctgcagggga

SEQ ID NO: 608068 - DNA, 20 bp, mouse
gtggggtcggaccgctgcag

SEQ ID NO: 608069 - DNA, 20 bp, mouse
gggcgcaatggcaggtgttg

SEQ ID NO: 608070 - DNA, 20 bp, mouse
ggaaggaggggtgcttccaa

SEQ ID NO: 608071 - DNA, 20 bp, mouse
ggtgcgcatgtgcaaggttg

SEQ ID NO: 608072 - DNA, 20 bp, mouse
gaaggttgaggcgcaatggc

SEQ ID NO: 608073 - DNA, 20 bp, mouse
gatgtggaaatagagcccac

SEQ ID NO: 608074 - DNA, 20 bp, mouse
gcccccaggaggtggcccca

SEQ ID NO: 608075 - DNA, 20 bp, mouse
gggatggggtcgagctgaca

SEQ ID NO: 608076 - DNA, 20 bp, mouse
gctgagggaacttcaggcag

SEQ ID NO: 608077 - DNA, 20 bp, mouse
gcccgatctgagggaacttc

SEQ ID NO: 608078 - DNA, 20 bp, mouse
gcctcgcccggcccagtgga

SEQ ID NO: 608079 - DNA, 20 bp, mouse
ggcggcgagcctcactctct

SEQ ID NO: 608080 - DNA, 20 bp, mouse
gcgagcctcactctcttgga

SEQ ID NO: 608081 - DNA, 20 bp, mouse
gtgcctggacgcgtgtaggg

SEQ ID NO: 608082 - DNA, 20 bp, mouse
ggtagggaggtgcgggatac

SEQ ID NO: 608083 - DNA, 20 bp, mouse
gggcagagatcgacagggat

SEQ ID NO: 608084 - DNA, 20 bp, mouse
gtctccaacgatgccttcag

SEQ ID NO: 608085 - DNA, 20 bp, mouse
ggatttgaaatcccgatctg

SEQ ID NO: 608086 - DNA, 20 bp, mouse
gctgcagaagaacccacaga

SEQ ID NO: 608087 - DNA, 20 bp, mouse
ggctcctggagagaccacga

SEQ ID NO: 608088 - DNA, 20 bp, mouse
ggctcttaacagaagtcacg

SEQ ID NO: 608089 - DNA, 20 bp, mouse
gcacctcgtagctgaagtag

SEQ ID NO: 608090 - DNA, 20 bp, mouse
gaggagacagatcccctaca

SEQ ID NO: 608091 - DNA, 20 bp, mouse
gtcagctacgaggtgcgtgg

SEQ ID NO: 608092 - DNA, 20 bp, mouse
gtgagctgctcacaatcccg

SEQ ID NO: 608093 - DNA, 20 bp, mouse
gggtccttggagccgtgtag

SEQ ID NO: 608094 - DNA, 20 bp, mouse
ggatcagctccacggaagag

SEQ ID NO: 608095 - DNA, 20 bp, mouse
gggtccacttgattcacaag

SEQ ID NO: 608096 - DNA, 20 bp, mouse
gggcagtgggcagggagacc

SEQ ID NO: 608097 - DNA, 20 bp, mouse
gggaagacccgaggggcagt

SEQ ID NO: 608098 - DNA, 20 bp, mouse
ggcagggagacccggcaaag

SEQ ID NO: 608099 - DNA, 20 bp, mouse
ggggagacccggcaaagcgg

SEQ ID NO: 608100 - DNA, 20 bp, mouse
gggcaaagcggcggaggaag

SEQ ID NO: 608101 - DNA, 20 bp, mouse
gagacccggcaaagcggcgg

SEQ ID NO: 608102 - DNA, 20 bp, mouse
gggcagcgcggtggcctcaa

SEQ ID NO: 608103 - DNA, 20 bp, mouse
ggcttccggagagacacgca

SEQ ID NO: 608104 - DNA, 20 bp, mouse
gggagctgccggcgccactc

SEQ ID NO: 608105 - DNA, 20 bp, mouse
ggagcctcggcgaagcggtg

SEQ ID NO: 608106 - DNA, 20 bp, mouse
gcgggctgcagatgtcggac

SEQ ID NO: 608107 - DNA, 20 bp, mouse
gctgcagcccgcgccgggag

SEQ ID NO: 608108 - DNA, 20 bp, mouse
gggagcggctccgcagccag

SEQ ID NO: 608109 - DNA, 20 bp, mouse
gcggcgcgggctgcagatgt

SEQ ID NO: 608110 - DNA, 20 bp, mouse
gcgcggagagccaaagacag

SEQ ID NO: 608111 - DNA, 20 bp, mouse
gtgcgcggccccgagcccag

SEQ ID NO: 608112 - DNA, 20 bp, mouse
gcgagctgcggggctccaga

SEQ ID NO: 608113 - DNA, 20 bp, mouse
ggcagccgcgggccccgtga

SEQ ID NO: 608114 - DNA, 20 bp, mouse
gcggaccggcaggcagctga

SEQ ID NO: 608115 - DNA, 20 bp, mouse
gtgcggagccgctcccggcg

SEQ ID NO: 608116 - DNA, 20 bp, mouse
gctctccccagcaagagacc

SEQ ID NO: 608117 - DNA, 20 bp, mouse
ggcaggcaggtggggcaaga

SEQ ID NO: 608118 - DNA, 20 bp, mouse
gaggtggggcaagatggctg

SEQ ID NO: 608119 - DNA, 20 bp, mouse
gtgcgaggcgtgcgggttgt

SEQ ID NO: 608120 - DNA, 20 bp, mouse
ggggttgtcggaagctcacc

SEQ ID NO: 608121 - DNA, 20 bp, mouse
ggctcaccgggtctcttgct

SEQ ID NO: 608122 - DNA, 20 bp, mouse
ggcgcctgcgcaggcaggtg

SEQ ID NO: 608123 - DNA, 20 bp, mouse
ggcaagatggctgcggtgcg

SEQ ID NO: 608124 - DNA, 20 bp, mouse
gcaagtcagtggtcctgggg

SEQ ID NO: 608125 - DNA, 20 bp, mouse
ggccgagccacgtagcccag

SEQ ID NO: 608126 - DNA, 20 bp, mouse
gacagccgcgcggacacaaa

SEQ ID NO: 608127 - DNA, 20 bp, mouse
gcgtggggaacacggagctg

SEQ ID NO: 608128 - DNA, 20 bp, mouse
ggacgcagcttctagctcgc

SEQ ID NO: 608129 - DNA, 20 bp, mouse
gcggcggggagctcagggag

SEQ ID NO: 608130 - DNA, 20 bp, mouse
gcggggtctttgtgacgcgg

SEQ ID NO: 608131 - DNA, 20 bp, mouse
ggcgcgccgcgtggggaaca

SEQ ID NO: 608132 - DNA, 20 bp, mouse
gagcggcaggccgggcacac

SEQ ID NO: 608133 - DNA, 20 bp, mouse
gagccgcagacggcgagcgg

SEQ ID NO: 608134 - DNA, 20 bp, mouse
gggccggggtctttgtgacg

SEQ ID NO: 608135 - DNA, 20 bp, mouse
gaggctgtcccgagcgcgga

SEQ ID NO: 608136 - DNA, 20 bp, mouse
gagagcgcgaccagactggg

SEQ ID NO: 608137 - DNA, 20 bp, mouse
gagaagagcgcgaccagact

SEQ ID NO: 608138 - DNA, 20 bp, mouse
gggcggcagagcgcgagagg

SEQ ID NO: 608139 - DNA, 20 bp, mouse
ggcgcgaccagactgggtgg

SEQ ID NO: 608140 - DNA, 20 bp, mouse
ggcgggcggcagagcgcgag

SEQ ID NO: 608141 - DNA, 20 bp, mouse
gccaaacgccagagggatgc

SEQ ID NO: 608142 - DNA, 20 bp, mouse
gaaaccagggtgcggagagg

SEQ ID NO: 608143 - DNA, 20 bp, mouse
ggcggtgatactgcgaccaa

SEQ ID NO: 608144 - DNA, 20 bp, mouse
gcagaaaccagggtgcggag

SEQ ID NO: 608145 - DNA, 20 bp, mouse
gtctgccgcccgcatccctc

SEQ ID NO: 608146 - DNA, 20 bp, mouse
gaagagtgatatcgaagact

SEQ ID NO: 608147 - DNA, 20 bp, mouse
gctaatgtagaagaccgaaa

SEQ ID NO: 608148 - DNA, 20 bp, mouse
gattagcggtggaggagtaa

SEQ ID NO: 608149 - DNA, 20 bp, mouse
gtaattacagtggatggtgt

SEQ ID NO: 608150 - DNA, 20 bp, mouse
gccaacagcgaggccgacag

SEQ ID NO: 608151 - DNA, 20 bp, mouse
gtaagggaccggagacaatt

SEQ ID NO: 608152 - DNA, 20 bp, mouse
gcggtcttctacattagcgg

SEQ ID NO: 608153 - DNA, 20 bp, mouse
gggactgagacagcagcaag

SEQ ID NO: 608154 - DNA, 20 bp, mouse
gcaagcggcggccaacagcg

SEQ ID NO: 608155 - DNA, 20 bp, mouse
gctgagacagcagcaagcgg

SEQ ID NO: 608156 - DNA, 20 bp, mouse
ggacccggctgaggccgtag

SEQ ID NO: 608157 - DNA, 20 bp, mouse
gcaatcttcgaagccatctt

SEQ ID NO: 608158 - DNA, 20 bp, mouse
ggggaaagggcagtccgcta

SEQ ID NO: 608159 - DNA, 20 bp, mouse
ggctgctggtctcccggacc

SEQ ID NO: 608160 - DNA, 20 bp, mouse
gcgattgcaggaacttacag

SEQ ID NO: 608161 - DNA, 20 bp, mouse
ggccgccgccacatcagtaa

SEQ ID NO: 608162 - DNA, 20 bp, mouse
gttcgaagccatcttgggaa

SEQ ID NO: 608163 - DNA, 20 bp, mouse
ggggcagcgcgtgagcagca

SEQ ID NO: 608164 - DNA, 20 bp, mouse
gggtctcccggacccggctg

SEQ ID NO: 608165 - DNA, 20 bp, mouse
ggtccgctacggcctcagcc

SEQ ID NO: 608166 - DNA, 20 bp, mouse
ggaaggggtagcttcaaagg

SEQ ID NO: 608167 - DNA, 20 bp, mouse
gccgcggctttccgatgaag

SEQ ID NO: 608168 - DNA, 20 bp, mouse
gtccctctgaggcagatcaa

SEQ ID NO: 608169 - DNA, 20 bp, mouse
gggggtagcttcaaaggtgg

SEQ ID NO: 608170 - DNA, 20 bp, mouse
gagaagggcttattggtccg

SEQ ID NO: 608171 - DNA, 20 bp, mouse
gggtgaaccgatttaccgtg

SEQ ID NO: 608172 - DNA, 20 bp, mouse
gttacagacaggccacaagt

SEQ ID NO: 608173 - DNA, 20 bp, mouse
gggcggtggtccccaccagg

SEQ ID NO: 608174 - DNA, 20 bp, mouse
ggcaacataaaagattctac

SEQ ID NO: 608175 - DNA, 20 bp, mouse
gctcaaaaagaggtaaaggg

SEQ ID NO: 608176 - DNA, 20 bp, mouse
gaggtctgggacgggcagga

SEQ ID NO: 608177 - DNA, 20 bp, mouse
gacgggcaggagggcaggac

SEQ ID NO: 608178 - DNA, 20 bp, mouse
gagctgccacccggcaccag

SEQ ID NO: 608179 - DNA, 20 bp, mouse
gagaggggaggcttaagggt

SEQ ID NO: 608180 - DNA, 20 bp, mouse
gcggggccgctggtgccggg

SEQ ID NO: 608181 - DNA, 20 bp, mouse
gttaagggtgggaaacccta

SEQ ID NO: 608182 - DNA, 20 bp, mouse
gtgcagcacagctagcttcc

SEQ ID NO: 608183 - DNA, 20 bp, mouse
gacaaggagttaggatggag

SEQ ID NO: 608184 - DNA, 20 bp, mouse
gcagctctgcagctgccacc

SEQ ID NO: 608185 - DNA, 20 bp, mouse
ggagaagcagacagctgtgt

SEQ ID NO: 608186 - DNA, 20 bp, mouse
ggtcccagggacgccttacc

SEQ ID NO: 608187 - DNA, 20 bp, mouse
gcacctggtaaggcgtccct

SEQ ID NO: 608188 - DNA, 20 bp, mouse
gtgctgagggcgttgtcacc

SEQ ID NO: 608189 - DNA, 20 bp, mouse
gtaggggattctgctatggt

SEQ ID NO: 608190 - DNA, 20 bp, mouse
gtgaaaagggtaaagagatg

SEQ ID NO: 608191 - DNA, 20 bp, mouse
ggtcaagtcctctctactag

SEQ ID NO: 608192 - DNA, 20 bp, mouse
gggagaagggcctctagggt

SEQ ID NO: 608193 - DNA, 20 bp, mouse
gttggggagaagggcctcta

SEQ ID NO: 608194 - DNA, 20 bp, mouse
gacctaaaccaggtgagtaa

SEQ ID NO: 608195 - DNA, 20 bp, mouse
gggactcttgtctaccggga

SEQ ID NO: 608196 - DNA, 20 bp, mouse
gagtgcagccgggagagctg

SEQ ID NO: 608197 - DNA, 20 bp, mouse
ggcgtgcgggccgcaggaca

SEQ ID NO: 608198 - DNA, 20 bp, mouse
gtctcccggctgcactctac

SEQ ID NO: 608199 - DNA, 20 bp, mouse
gagcgaagccaaggcccccg

SEQ ID NO: 608200 - DNA, 20 bp, mouse
ggcgccggtagagtgcagcc

SEQ ID NO: 608201 - DNA, 20 bp, mouse
gagttcgccccaggaaggag

SEQ ID NO: 608202 - DNA, 20 bp, mouse
gactcggccgctcagatcaa

SEQ ID NO: 608203 - DNA, 20 bp, mouse
ggcagccgggagagctgcgg

SEQ ID NO: 608204 - DNA, 20 bp, mouse
ggagcggccgagtagctctg

SEQ ID NO: 608205 - DNA, 20 bp, mouse
gtcacagcgtcccggtcccg

SEQ ID NO: 608206 - DNA, 20 bp, mouse
gtggagggaggagtggtccc

SEQ ID NO: 608207 - DNA, 20 bp, mouse
ggctggagcgggcaggtgga

SEQ ID NO: 608208 - DNA, 20 bp, mouse
gactgctggcagttactccc

SEQ ID NO: 608209 - DNA, 20 bp, mouse
gcctgtggcgcaccaactgc

SEQ ID NO: 608210 - DNA, 20 bp, mouse
gtggtgcgccacaggtccgg

SEQ ID NO: 608211 - DNA, 20 bp, mouse
gaggcgcgccgaggactcgc

SEQ ID NO: 608212 - DNA, 20 bp, mouse
gaggactcgctggagcgggc

SEQ ID NO: 608213 - DNA, 20 bp, mouse
gactcgctggagcgggcagg

SEQ ID NO: 608214 - DNA, 20 bp, mouse
ggcgggcgcccccggacctg

SEQ ID NO: 608215 - DNA, 20 bp, mouse
gcgccgaggactcgctggag

SEQ ID NO: 608216 - DNA, 20 bp, mouse
gacacttaagtagagaggtc

SEQ ID NO: 608217 - DNA, 20 bp, mouse
gcaagtctccctgagcaagc

SEQ ID NO: 608218 - DNA, 20 bp, mouse
gagagcgtcaggaaccgaga

SEQ ID NO: 608219 - DNA, 20 bp, mouse
gtctggtcccgggtaagacg

SEQ ID NO: 608220 - DNA, 20 bp, mouse
gcggggaacggagcaacgaa

SEQ ID NO: 608221 - DNA, 20 bp, mouse
gttttgaggttggaagtctg

SEQ ID NO: 608222 - DNA, 20 bp, mouse
gcccgggtaagacgcggaca

SEQ ID NO: 608223 - DNA, 20 bp, mouse
gcttgcggacgcagttacca

SEQ ID NO: 608224 - DNA, 20 bp, mouse
ggggcggcgcccgagcgcgc

SEQ ID NO: 608225 - DNA, 20 bp, mouse
gagttaccatggcagccggg

SEQ ID NO: 608226 - DNA, 20 bp, mouse
ggcgctccggctccctccga

SEQ ID NO: 608227 - DNA, 20 bp, mouse
gagccggagcgcttctcccg

SEQ ID NO: 608228 - DNA, 20 bp, mouse
gccctgggacccggcatcag

SEQ ID NO: 608229 - DNA, 20 bp, mouse
gctttctccggagccgtcgg

SEQ ID NO: 608230 - DNA, 20 bp, mouse
gtctcccgaggtgagcggag

SEQ ID NO: 608231 - DNA, 20 bp, mouse
gcggagccgtcggagggagc

SEQ ID NO: 608232 - DNA, 20 bp, mouse
gcctccggggcgggaaacaa

SEQ ID NO: 608233 - DNA, 20 bp, mouse
ggcgagatgtatcagagggt

SEQ ID NO: 608234 - DNA, 20 bp, mouse
gccccgggagccctgcacta

SEQ ID NO: 608235 - DNA, 20 bp, mouse
gcgaggtgagcggagtgggg

SEQ ID NO: 608236 - DNA, 20 bp, mouse
gaccggagcagggtgagtga

SEQ ID NO: 608237 - DNA, 20 bp, mouse
gaccaacaccccgggagttg

SEQ ID NO: 608238 - DNA, 20 bp, mouse
gtcaccgctatccttcacgt

SEQ ID NO: 608239 - DNA, 20 bp, mouse
gaccggcgcctcaactcccg

SEQ ID NO: 608240 - DNA, 20 bp, mouse
gagaaaacgcgccaccaaac

SEQ ID NO: 608241 - DNA, 20 bp, mouse
gagttgaggcgccggtttgg

SEQ ID NO: 608242 - DNA, 20 bp, mouse
gagtcccacgtgaaggatag

SEQ ID NO: 608243 - DNA, 20 bp, mouse
ggttcgacccctccccacta

SEQ ID NO: 608244 - DNA, 20 bp, mouse
gctagcgaagtcccacgtga

SEQ ID NO: 608245 - DNA, 20 bp, mouse
ggactataaaccaacacccc

SEQ ID NO: 608246 - DNA, 20 bp, mouse
ggaaccgagagtctccaaga

SEQ ID NO: 608247 - DNA, 20 bp, mouse
gcgtggggaaggaggcgtct

SEQ ID NO: 608248 - DNA, 20 bp, mouse
gggaggcgtctgggtccggg

SEQ ID NO: 608249 - DNA, 20 bp, mouse
gtctccaagatggccgcgtg

SEQ ID NO: 608250 - DNA, 20 bp, mouse
gaggggagcgcgactcggag

SEQ ID NO: 608251 - DNA, 20 bp, mouse
ggcgcgacggccaggagcga

SEQ ID NO: 608252 - DNA, 20 bp, mouse
ggagactctcggttcgtcgg

SEQ ID NO: 608253 - DNA, 20 bp, mouse
gctcccgagagaggtaagct

SEQ ID NO: 608254 - DNA, 20 bp, mouse
gcggccatcttggagactct

SEQ ID NO: 608255 - DNA, 20 bp, mouse
gtccgcgggggcttaggtgt

SEQ ID NO: 608256 - DNA, 20 bp, mouse
gcggccgcgggctgagatac

SEQ ID NO: 608257 - DNA, 20 bp, mouse
gcggctgggcagcgcgaccc

SEQ ID NO: 608258 - DNA, 20 bp, mouse
ggcacccagctccaggtccg

SEQ ID NO: 608259 - DNA, 20 bp, mouse
gcgaccccggacctggagct

SEQ ID NO: 608260 - DNA, 20 bp, mouse
ggcccaggccggaactctaa

SEQ ID NO: 608261 - DNA, 20 bp, mouse
gcaggtccggggtcgcggct

SEQ ID NO: 608262 - DNA, 20 bp, mouse
ggataccggcacccagctcc

SEQ ID NO: 608263 - DNA, 20 bp, mouse
gtgcatggcggcctgacggg

SEQ ID NO: 608264 - DNA, 20 bp, mouse
gcgccatgcaaggcccggga

SEQ ID NO: 608265 - DNA, 20 bp, mouse
gaccgtctcgcgggagaggg

SEQ ID NO: 608266 - DNA, 20 bp, mouse
gtgtcggccccggagagggg

SEQ ID NO: 608267 - DNA, 20 bp, mouse
gctccggggccgacaaacag

SEQ ID NO: 608268 - DNA, 20 bp, mouse
gagcccagccggagctaaac

SEQ ID NO: 608269 - DNA, 20 bp, mouse
gagcccgtttagctccggct

SEQ ID NO: 608270 - DNA, 20 bp, mouse
ggtttgtcggccccggagag

SEQ ID NO: 608271 - DNA, 20 bp, mouse
gtgttggcgggcaccaggta

SEQ ID NO: 608272 - DNA, 20 bp, mouse
gcttgacttgggccggaacg

SEQ ID NO: 608273 - DNA, 20 bp, mouse
gggcgagcccaagctaccca

SEQ ID NO: 608274 - DNA, 20 bp, mouse
gggtacctcctcccctctcc

SEQ ID NO: 608275 - DNA, 20 bp, mouse
gctacccagggcctaacgac

SEQ ID NO: 608276 - DNA, 20 bp, mouse
gcgagagagagggcaacgag

SEQ ID NO: 608277 - DNA, 20 bp, mouse
ggcctcccgcgagaacgcag

SEQ ID NO: 608278 - DNA, 20 bp, mouse
gtcttccgaggcgagagaga

SEQ ID NO: 608279 - DNA, 20 bp, mouse
gacgaggggaagggtcgaag

SEQ ID NO: 608280 - DNA, 20 bp, mouse
ggcgagaacgcagcggaaca

SEQ ID NO: 608281 - DNA, 20 bp, mouse
ggcctcggaagaagacgtgg

SEQ ID NO: 608282 - DNA, 20 bp, mouse
gcacttggcgacactcggct

SEQ ID NO: 608283 - DNA, 20 bp, mouse
gtgcaaccgggggtctacaa

SEQ ID NO: 608284 - DNA, 20 bp, mouse
gagagagggcaacgagggga

SEQ ID NO: 608285 - DNA, 20 bp, mouse
gctcgcctcggaagaagacg

SEQ ID NO: 608286 - DNA, 20 bp, mouse
gcaggcggctggtctccagt

SEQ ID NO: 608287 - DNA, 20 bp, mouse
ggcccaggcccttctcagtc

SEQ ID NO: 608288 - DNA, 20 bp, mouse
gcaggtgagaacaccaagta

SEQ ID NO: 608289 - DNA, 20 bp, mouse
gcctgggcttggagggtagc

SEQ ID NO: 608290 - DNA, 20 bp, mouse
ggagaagggcctgggcttgg

SEQ ID NO: 608291 - DNA, 20 bp, mouse
gtctcagtcaggctctgaac

SEQ ID NO: 608292 - DNA, 20 bp, mouse
gaagggaaatgatgacgagg

SEQ ID NO: 608293 - DNA, 20 bp, mouse
ggcaggaactgaagtcttta

SEQ ID NO: 608294 - DNA, 20 bp, mouse
gtcaaacggtaagagaaaca

SEQ ID NO: 608295 - DNA, 20 bp, mouse
gagggggagaggtattagta

SEQ ID NO: 608296 - DNA, 20 bp, mouse
gccgccgcgtactcaccgga

SEQ ID NO: 608297 - DNA, 20 bp, mouse
gcgggccgccgcgtactcac

SEQ ID NO: 608298 - DNA, 20 bp, mouse
ggcgccctccggtgagtacg

SEQ ID NO: 608299 - DNA, 20 bp, mouse
ggcaggacgagcggcgacac

SEQ ID NO: 608300 - DNA, 20 bp, mouse
gccctgcgccccggaatcgg

SEQ ID NO: 608301 - DNA, 20 bp, mouse
ggcgcgcggctcggccaccg

SEQ ID NO: 608302 - DNA, 20 bp, mouse
ggccctcggcccgcagtccc

SEQ ID NO: 608303 - DNA, 20 bp, mouse
gcgtcctgcgtccgccgcgg

SEQ ID NO: 608304 - DNA, 20 bp, mouse
gcggtggagcgggaaagttc

SEQ ID NO: 608305 - DNA, 20 bp, mouse
gcctgtgcgcccgggactgc

SEQ ID NO: 608306 - DNA, 20 bp, mouse
ggcaagccaggcccgctaga

SEQ ID NO: 608307 - DNA, 20 bp, mouse
gagacagtcagaccgtctag

SEQ ID NO: 608308 - DNA, 20 bp, mouse
gtcagaccgtctagcgggcc

SEQ ID NO: 608309 - DNA, 20 bp, mouse
gcgggcctggcttgcctacc

SEQ ID NO: 608310 - DNA, 20 bp, mouse
ggcagagacttaccagctct

SEQ ID NO: 608311 - DNA, 20 bp, mouse
gccggtccttcacccagagc

SEQ ID NO: 608312 - DNA, 20 bp, mouse
ggtcctggtccctcaagaag

SEQ ID NO: 608313 - DNA, 20 bp, mouse
gcctacctggcagctgcacc

SEQ ID NO: 608314 - DNA, 20 bp, mouse
gaggcaggccctgagggaat

SEQ ID NO: 608315 - DNA, 20 bp, mouse
gacttaccagctctgggtga

SEQ ID NO: 608316 - DNA, 20 bp, mouse
gcgagcccggaagcggacgg

SEQ ID NO: 608317 - DNA, 20 bp, mouse
ggaggacggagctgcaaccc

SEQ ID NO: 608318 - DNA, 20 bp, mouse
gtgtccccgagacagagacg

SEQ ID NO: 608319 - DNA, 20 bp, mouse
gccgcggagagccgcgagtg

SEQ ID NO: 608320 - DNA, 20 bp, mouse
ggctccgtcctccccactcg

SEQ ID NO: 608321 - DNA, 20 bp, mouse
gtgtctcggggacaagggtc

SEQ ID NO: 608322 - DNA, 20 bp, mouse
ggcggtggcggaggcttctc

SEQ ID NO: 608323 - DNA, 20 bp, mouse
gttcccgttggcagtcacgg

SEQ ID NO: 608324 - DNA, 20 bp, mouse
gaagcggacgggggcggtgg

SEQ ID NO: 608325 - DNA, 20 bp, mouse
gaggcttctccggccggccg

SEQ ID NO: 608326 - DNA, 20 bp, mouse
gcagctggtgcctcgggagg

SEQ ID NO: 608327 - DNA, 20 bp, mouse
ggggctgggatggctagata

SEQ ID NO: 608328 - DNA, 20 bp, mouse
gaggcggctagtgagcgggc

SEQ ID NO: 608329 - DNA, 20 bp, mouse
ggctcactagccgcctcccg

SEQ ID NO: 608330 - DNA, 20 bp, mouse
ggtgcaatggtgcaaggcgg

SEQ ID NO: 608331 - DNA, 20 bp, mouse
ggagagggcgcgagaatgag

SEQ ID NO: 608332 - DNA, 20 bp, mouse
gagcgctgctacataggaag

SEQ ID NO: 608333 - DNA, 20 bp, mouse
gcaatggtgcaaggcggcgg

SEQ ID NO: 608334 - DNA, 20 bp, mouse
ggagagcgtggagcaaagag

SEQ ID NO: 608335 - DNA, 20 bp, mouse
gatggtgcaatggtgcaagg

SEQ ID NO: 608336 - DNA, 20 bp, mouse
gggtaagcgcgggatgcgaa

SEQ ID NO: 608337 - DNA, 20 bp, mouse
gggagcgcctgggcccggcg

SEQ ID NO: 608338 - DNA, 20 bp, mouse
gtggccggccgggtaagcgc

SEQ ID NO: 608339 - DNA, 20 bp, mouse
gaagcgcgggatgcgaacgg

SEQ ID NO: 608340 - DNA, 20 bp, mouse
gcgaacggcgggacagcagg

SEQ ID NO: 608341 - DNA, 20 bp, mouse
gggcaggggcagctgcatgg

SEQ ID NO: 608342 - DNA, 20 bp, mouse
gcccacggcctgcagcctgg

SEQ ID NO: 608343 - DNA, 20 bp, mouse
gccaggcccaagccccactg

SEQ ID NO: 608344 - DNA, 20 bp, mouse
gccggcgcgctgcatctggc

SEQ ID NO: 608345 - DNA, 20 bp, mouse
gccggcgcggaggctcggcg

SEQ ID NO: 608346 - DNA, 20 bp, mouse
ggtctgcaggggagcggtaa

SEQ ID NO: 608347 - DNA, 20 bp, mouse
ggtgctggcgctgctagggg

SEQ ID NO: 608348 - DNA, 20 bp, mouse
ggcggacgccgaacatggag

SEQ ID NO: 608349 - DNA, 20 bp, mouse
gtgcaggggagcggtaaggg

SEQ ID NO: 608350 - DNA, 20 bp, mouse
gggagcggtaagggcggaag

SEQ ID NO: 608351 - DNA, 20 bp, mouse
gaccgacgctcagggtaagt

SEQ ID NO: 608352 - DNA, 20 bp, mouse
gcggctgaagggccatccca

SEQ ID NO: 608353 - DNA, 20 bp, mouse
gggtaagttggcaggcgcag

SEQ ID NO: 608354 - DNA, 20 bp, mouse
ggcgcagaggaagcgcactg

SEQ ID NO: 608355 - DNA, 20 bp, mouse
ggtaagggcggaaggggacg

SEQ ID NO: 608356 - DNA, 20 bp, mouse
ggctcacctgggtgcaggtt

SEQ ID NO: 608357 - DNA, 20 bp, mouse
gcaggcaggacccagcaggt

SEQ ID NO: 608358 - DNA, 20 bp, mouse
gcgctctaggtctgtttccg

SEQ ID NO: 608359 - DNA, 20 bp, mouse
gacctgggtgcaggttaggc

SEQ ID NO: 608360 - DNA, 20 bp, mouse
gcctagagcgcccaacctgc

SEQ ID NO: 608361 - DNA, 20 bp, mouse
gacctgcctaacctgcaccc

SEQ ID NO: 608362 - DNA, 20 bp, mouse
gtggttgggggagggaccgt

SEQ ID NO: 608363 - DNA, 20 bp, mouse
gtggggaacgaccccagcgt

SEQ ID NO: 608364 - DNA, 20 bp, mouse
ggggcgtatggggcactcac

SEQ ID NO: 608365 - DNA, 20 bp, mouse
gctccaacgagacagagtag

SEQ ID NO: 608366 - DNA, 20 bp, mouse
gctcacacaggctgtctcgg

SEQ ID NO: 608367 - DNA, 20 bp, mouse
gcctctcacacaggctgtct

SEQ ID NO: 608368 - DNA, 20 bp, mouse
ggttccatccaggctgtcgg

SEQ ID NO: 608369 - DNA, 20 bp, mouse
gtcggtggcctgttccatcc

SEQ ID NO: 608370 - DNA, 20 bp, mouse
gcttcctccgacagcctgga

SEQ ID NO: 608371 - DNA, 20 bp, mouse
ggaagctggtggtgccacag

SEQ ID NO: 608372 - DNA, 20 bp, mouse
ggtgtgagaggtcaggagct

SEQ ID NO: 608373 - DNA, 20 bp, mouse
ggctatagggccagatgggt

SEQ ID NO: 608374 - DNA, 20 bp, mouse
gtttgtcctgtcatccactg

SEQ ID NO: 608375 - DNA, 20 bp, mouse
ggctctgccagcacatctgg

SEQ ID NO: 608376 - DNA, 20 bp, mouse
ggctcagacgaccctagcga

SEQ ID NO: 608377 - DNA, 20 bp, mouse
gacgaccctagcgaaggttg

SEQ ID NO: 608378 - DNA, 20 bp, mouse
gtctaccgcaaccttcgcta

SEQ ID NO: 608379 - DNA, 20 bp, mouse
gggacccgggcaagcaccgg

SEQ ID NO: 608380 - DNA, 20 bp, mouse
ggcccgtggacaggaaacag

SEQ ID NO: 608381 - DNA, 20 bp, mouse
ggtcgtctgagctccatctt

SEQ ID NO: 608382 - DNA, 20 bp, mouse
ggactcggcgcgggaggacc

SEQ ID NO: 608383 - DNA, 20 bp, mouse
gcaagcaccggcggctgggg

SEQ ID NO: 608384 - DNA, 20 bp, mouse
gggttgcggtagactcggcg

SEQ ID NO: 608385 - DNA, 20 bp, mouse
ggggcaagcaccggcggctg

SEQ ID NO: 608386 - DNA, 20 bp, mouse
gacgtgaggcgctaagatgg

SEQ ID NO: 608387 - DNA, 20 bp, mouse
gccttcgactcggaccaact

SEQ ID NO: 608388 - DNA, 20 bp, mouse
gggcgtcccagcgaccaagt

SEQ ID NO: 608389 - DNA, 20 bp, mouse
ggtcacgtgaggcgctaaga

SEQ ID NO: 608390 - DNA, 20 bp, mouse
gatagggaagcaccccaggt

SEQ ID NO: 608391 - DNA, 20 bp, mouse
gacaccagcaaccttcgact

SEQ ID NO: 608392 - DNA, 20 bp, mouse
gccaggtaggcggaaatcta

SEQ ID NO: 608393 - DNA, 20 bp, mouse
gggtaggcggaaatctaggg

SEQ ID NO: 608394 - DNA, 20 bp, mouse
ggcctcacgtgactgacagg

SEQ ID NO: 608395 - DNA, 20 bp, mouse
gagcgcctcacgtgactgac

SEQ ID NO: 608396 - DNA, 20 bp, mouse
gcatcggccagggtccgtct

SEQ ID NO: 608397 - DNA, 20 bp, mouse
gtaagaagcctgtgaccggg

SEQ ID NO: 608398 - DNA, 20 bp, mouse
ggcccgggccaaacgatccc

SEQ ID NO: 608399 - DNA, 20 bp, mouse
gctactggcaaggggaccgg

SEQ ID NO: 608400 - DNA, 20 bp, mouse
gagcctgtgaccgggcggag

SEQ ID NO: 608401 - DNA, 20 bp, mouse
gaggagcagggactagagta

SEQ ID NO: 608402 - DNA, 20 bp, mouse
gagctaagaagcctgtgacc

SEQ ID NO: 608403 - DNA, 20 bp, mouse
gcgccgctccgcccggtcac

SEQ ID NO: 608404 - DNA, 20 bp, mouse
ggcctgggatcgtttggccc

SEQ ID NO: 608405 - DNA, 20 bp, mouse
gccagggttatcagacagag

SEQ ID NO: 608406 - DNA, 20 bp, mouse
ggtgggctcgggagcagcta

SEQ ID NO: 608407 - DNA, 20 bp, mouse
gggctcgggagcagctacgg

SEQ ID NO: 608408 - DNA, 20 bp, mouse
ggccaagatggacgctccgt

SEQ ID NO: 608409 - DNA, 20 bp, mouse
ggcccacggagcgtccatct

SEQ ID NO: 608410 - DNA, 20 bp, mouse
ggcactggcgggcgccaaga

SEQ ID NO: 608411 - DNA, 20 bp, mouse
gtcgcagtccagctctactt

SEQ ID NO: 608412 - DNA, 20 bp, mouse
ggcattaagtcgactctcca

SEQ ID NO: 608413 - DNA, 20 bp, mouse
gagtccagctctacttcgga

SEQ ID NO: 608414 - DNA, 20 bp, mouse
gttggcgcccgccagtgcga

SEQ ID NO: 608415 - DNA, 20 bp, mouse
gtcacttccgtcgcactggc

SEQ ID NO: 608416 - DNA, 20 bp, mouse
gcgctcactgggccgtgcag

SEQ ID NO: 608417 - DNA, 20 bp, mouse
gcactgggccgtgcagaggc

SEQ ID NO: 608418 - DNA, 20 bp, mouse
gcccgcgggcgatctgacgg

SEQ ID NO: 608419 - DNA, 20 bp, mouse
gcaacgtgaaggtcacctca

SEQ ID NO: 608420 - DNA, 20 bp, mouse
ggcgggcgatctgacggcgg

SEQ ID NO: 608421 - DNA, 20 bp, mouse
gtgccccgcgggcgatctga

SEQ ID NO: 608422 - DNA, 20 bp, mouse
ggatctgacggcggtggctg

SEQ ID NO: 608423 - DNA, 20 bp, mouse
ggggcgcttggagactccaa

SEQ ID NO: 608424 - DNA, 20 bp, mouse
gcacactgcgaagaccaggt

SEQ ID NO: 608425 - DNA, 20 bp, mouse
gccaccggccggcacacagg

SEQ ID NO: 608426 - DNA, 20 bp, mouse
ggcgaagcgtggataccgag

SEQ ID NO: 608427 - DNA, 20 bp, mouse
gggcgcggggaggatgctca

SEQ ID NO: 608428 - DNA, 20 bp, mouse
gctgggttgtagctccgcag

SEQ ID NO: 608429 - DNA, 20 bp, mouse
gccagacggagccgccactg

SEQ ID NO: 608430 - DNA, 20 bp, mouse
gggttgtagctccgcagtgg

SEQ ID NO: 608431 - DNA, 20 bp, mouse
gcagaagacgaggacgtcgg

SEQ ID NO: 608432 - DNA, 20 bp, mouse
gacgtcggtggccttggcca

SEQ ID NO: 608433 - DNA, 20 bp, mouse
ggcaagcgaaccagaagacg

SEQ ID NO: 608434 - DNA, 20 bp, mouse
gcatgcagggaagccccggt

SEQ ID NO: 608435 - DNA, 20 bp, mouse
gcgccggacccaagagcagg

SEQ ID NO: 608436 - DNA, 20 bp, mouse
gacgaagagccggaacggag

SEQ ID NO: 608437 - DNA, 20 bp, mouse
gcgcctacgaagagccggaa

SEQ ID NO: 608438 - DNA, 20 bp, mouse
gagaggccgcgggtcaggca

SEQ ID NO: 608439 - DNA, 20 bp, mouse
gagagtgtcagtcacagtct

SEQ ID NO: 608440 - DNA, 20 bp, mouse
ggcccgccgtgcctgacccg

SEQ ID NO: 608441 - DNA, 20 bp, mouse
gggccgcgggtcaggcacgg

SEQ ID NO: 608442 - DNA, 20 bp, mouse
gggcatcgcctacgaagagc

SEQ ID NO: 608443 - DNA, 20 bp, mouse
gtcagtcacagtctcggcat

SEQ ID NO: 608444 - DNA, 20 bp, mouse
ggggcggccatactggaaac

SEQ ID NO: 608445 - DNA, 20 bp, mouse
ggcggtgcccgaggagagag

SEQ ID NO: 608446 - DNA, 20 bp, mouse
ggggaactagctggccacag

SEQ ID NO: 608447 - DNA, 20 bp, mouse
gggctgcagttcccagacaa

SEQ ID NO: 608448 - DNA, 20 bp, mouse
gggcggcgcagggaactagc

SEQ ID NO: 608449 - DNA, 20 bp, mouse
gaactgcagccgcgggccgg

SEQ ID NO: 608450 - DNA, 20 bp, mouse
ggagcgggcgcgggagatgt

SEQ ID NO: 608451 - DNA, 20 bp, mouse
gtccctgcgccgccggcccg

SEQ ID NO: 608452 - DNA, 20 bp, mouse
gcgctccgcgccagccgctg

SEQ ID NO: 608453 - DNA, 20 bp, mouse
gccaaggttagacctctcca

SEQ ID NO: 608454 - DNA, 20 bp, mouse
ggcaccgtagggcccccgag

SEQ ID NO: 608455 - DNA, 20 bp, mouse
gtgacctctcacgacttcca

SEQ ID NO: 608456 - DNA, 20 bp, mouse
gactctcgcgctggctggag

SEQ ID NO: 608457 - DNA, 20 bp, mouse
gcgggatgggacgcgcgctg

SEQ ID NO: 608458 - DNA, 20 bp, mouse
gggccgagcgcggagctgag

SEQ ID NO: 608459 - DNA, 20 bp, mouse
gagagtgagcgagccgagca

SEQ ID NO: 608460 - DNA, 20 bp, mouse
gagcgagccgagcagggagg

SEQ ID NO: 608461 - DNA, 20 bp, mouse
gagcagcagcccgagcgacg

SEQ ID NO: 608462 - DNA, 20 bp, mouse
ggactggagaggaggcaaag

SEQ ID NO: 608463 - DNA, 20 bp, mouse
gggctcccgggaggaccatg

SEQ ID NO: 608464 - DNA, 20 bp, mouse
gactccggccaagtgcaggg

SEQ ID NO: 608465 - DNA, 20 bp, mouse
gcagacccgccaagagcagg

SEQ ID NO: 608466 - DNA, 20 bp, mouse
gtccggcggctgctcctgaa

SEQ ID NO: 608467 - DNA, 20 bp, mouse
ggccagccccgggaccgcgc

SEQ ID NO: 608468 - DNA, 20 bp, mouse
gctcctggagggaggcagta

SEQ ID NO: 608469 - DNA, 20 bp, mouse
ggacctccaggtcccctagt

SEQ ID NO: 608470 - DNA, 20 bp, mouse
gccatgcccggggccgcccc

SEQ ID NO: 608471 - DNA, 20 bp, mouse
gctactgggccaaggtaagg

SEQ ID NO: 608472 - DNA, 20 bp, mouse
gcccgttcaggagcagccgc

SEQ ID NO: 608473 - DNA, 20 bp, mouse
gagcctactaggggacctgg

SEQ ID NO: 608474 - DNA, 20 bp, mouse
gcggagccggagcgctgccg

SEQ ID NO: 608475 - DNA, 20 bp, mouse
gggctgctcctgaacgggtc

SEQ ID NO: 608476 - DNA, 20 bp, mouse
gagtaggcgcgagctcgggg

SEQ ID NO: 608477 - DNA, 20 bp, mouse
ggagcggcgcgcggacgagt

SEQ ID NO: 608478 - DNA, 20 bp, mouse
gcaacaaccccagcccgcct

SEQ ID NO: 608479 - DNA, 20 bp, mouse
gacgagtaggcgcgagctcg

SEQ ID NO: 608480 - DNA, 20 bp, mouse
gcagagcagcgtgcccaggc

SEQ ID NO: 608481 - DNA, 20 bp, mouse
ggcgccccgcaaactttggg

SEQ ID NO: 608482 - DNA, 20 bp, mouse
gcacccagagcagcgtgccc

SEQ ID NO: 608483 - DNA, 20 bp, mouse
gcggagacgagcagcgctcg

SEQ ID NO: 608484 - DNA, 20 bp, mouse
gccgtggcgcgggatggggg

SEQ ID NO: 608485 - DNA, 20 bp, mouse
ggccccgtggcgcgggatgg

SEQ ID NO: 608486 - DNA, 20 bp, mouse
gtcggtcgcctccaactcac

SEQ ID NO: 608487 - DNA, 20 bp, mouse
gcagctgggcgccagtgagt

SEQ ID NO: 608488 - DNA, 20 bp, mouse
ggtgtctgttgaggcttcgg

SEQ ID NO: 608489 - DNA, 20 bp, mouse
ggcgccgcgacacttaccgt

SEQ ID NO: 608490 - DNA, 20 bp, mouse
gcggcgggcgcccctggagg

SEQ ID NO: 608491 - DNA, 20 bp, mouse
ggtgtcgcggcgcagactcg

SEQ ID NO: 608492 - DNA, 20 bp, mouse
gggcgaattggtctcaggct

SEQ ID NO: 608493 - DNA, 20 bp, mouse
gagcctcaacagacacagct

SEQ ID NO: 608494 - DNA, 20 bp, mouse
ggcgacggcggagagtccag

SEQ ID NO: 608495 - DNA, 20 bp, mouse
gtccacggcgaattggtctc

SEQ ID NO: 608496 - DNA, 20 bp, mouse
gcggggtgcgaaaaggtcac

SEQ ID NO: 608497 - DNA, 20 bp, mouse
gaggggcggcagacacgcaa

SEQ ID NO: 608498 - DNA, 20 bp, mouse
gatcctgagggactcctcca

SEQ ID NO: 608499 - DNA, 20 bp, mouse
gcggcgtgcggggtgcgaaa

SEQ ID NO: 608500 - DNA, 20 bp, mouse
gtactcaaggccggagtcct

SEQ ID NO: 608501 - DNA, 20 bp, mouse
gcgcggacggccaacatccg

SEQ ID NO: 608502 - DNA, 20 bp, mouse
gcccctcgcgctgccatacg

SEQ ID NO: 608503 - DNA, 20 bp, mouse
gggaacgcagggttcggcag

SEQ ID NO: 608504 - DNA, 20 bp, mouse
gtgagggccgccatgacgag

SEQ ID NO: 608505 - DNA, 20 bp, mouse
gaggggtgcgtagatcctga

SEQ ID NO: 608506 - DNA, 20 bp, mouse
gcagcccagggctcggatca

SEQ ID NO: 608507 - DNA, 20 bp, mouse
gcccgggcgcccacagccca

SEQ ID NO: 608508 - DNA, 20 bp, mouse
ggagcgcaccgggaagcctc

SEQ ID NO: 608509 - DNA, 20 bp, mouse
gggcgaacgctgttacctgg

SEQ ID NO: 608510 - DNA, 20 bp, mouse
gtccggcgaacgctgttacc

SEQ ID NO: 608511 - DNA, 20 bp, mouse
gcgtctggatgcctagataa

SEQ ID NO: 608512 - DNA, 20 bp, mouse
gtcgccgtgatccgagccct

SEQ ID NO: 608513 - DNA, 20 bp, mouse
ggagaggccccggcaccccg

SEQ ID NO: 608514 - DNA, 20 bp, mouse
gagaccggtgtccatccctc

SEQ ID NO: 608515 - DNA, 20 bp, mouse
gacaggaagctgtagaggga

SEQ ID NO: 608516 - DNA, 20 bp, mouse
ggatgctggggatcatagag

SEQ ID NO: 608517 - DNA, 20 bp, mouse
gctggggatcatagagtggc

SEQ ID NO: 608518 - DNA, 20 bp, mouse
gctcacagaccgaaaggcct

SEQ ID NO: 608519 - DNA, 20 bp, mouse
gtctaccaagggcatccgtt

SEQ ID NO: 608520 - DNA, 20 bp, mouse
gcacctcaaggaaccgacgt

SEQ ID NO: 608521 - DNA, 20 bp, mouse
gtgaggtgcgtgtagatgct

SEQ ID NO: 608522 - DNA, 20 bp, mouse
gaatccgctcacagaccgaa

SEQ ID NO: 608523 - DNA, 20 bp, mouse
gtcaaacgcaccacttggta

SEQ ID NO: 608524 - DNA, 20 bp, mouse
gtctgtgagcggattgggac

SEQ ID NO: 608525 - DNA, 20 bp, mouse
gaccgcgtagccagagcgag

SEQ ID NO: 608526 - DNA, 20 bp, mouse
gcccgggacgccgaaaacct

SEQ ID NO: 608527 - DNA, 20 bp, mouse
ggaacaccgggaacagaagg

SEQ ID NO: 608528 - DNA, 20 bp, mouse
gcaggtgagcccgagctcct

SEQ ID NO: 608529 - DNA, 20 bp, mouse
gtgcgccccgccccttgtag

SEQ ID NO: 608530 - DNA, 20 bp, mouse
gttcggcgtcccggggagac

SEQ ID NO: 608531 - DNA, 20 bp, mouse
gagctcctgggacctctaca

SEQ ID NO: 608532 - DNA, 20 bp, mouse
gaagagagggtggggcaagt

SEQ ID NO: 608533 - DNA, 20 bp, mouse
gcgccccttgtagaggtccc

SEQ ID NO: 608534 - DNA, 20 bp, mouse
gaagtgtcctgccagcacgg

SEQ ID NO: 608535 - DNA, 20 bp, mouse
gcacaccagcccgactccca

SEQ ID NO: 608536 - DNA, 20 bp, mouse
gcgcgactgcctgcgagtgc

SEQ ID NO: 608537 - DNA, 20 bp, mouse
ggggctctgcctgcactcgc

SEQ ID NO: 608538 - DNA, 20 bp, mouse
gaagtcaggctccagaaacc

SEQ ID NO: 608539 - DNA, 20 bp, mouse
ggagcatgggggcaggacag

SEQ ID NO: 608540 - DNA, 20 bp, mouse
gtaaatggttagaaacacac

SEQ ID NO: 608541 - DNA, 20 bp, mouse
gtctagcaacaaaccaaggg

SEQ ID NO: 608542 - DNA, 20 bp, mouse
gcagcttctctcctctgccc

SEQ ID NO: 608543 - DNA, 20 bp, mouse
gtgggctgctttctaaagtc

SEQ ID NO: 608544 - DNA, 20 bp, mouse
gcattctagcaacaaaccaa

SEQ ID NO: 608545 - DNA, 20 bp, mouse
gtatcccttgtggagttgtg

SEQ ID NO: 608546 - DNA, 20 bp, mouse
ggcctcaggtcagcatcgta

SEQ ID NO: 608547 - DNA, 20 bp, mouse
gctgacctgaggcaaagtag

SEQ ID NO: 608548 - DNA, 20 bp, mouse
ggccacggcgtcatccacac

SEQ ID NO: 608549 - DNA, 20 bp, mouse
gcgccaggcacccggtgaga

SEQ ID NO: 608550 - DNA, 20 bp, mouse
gcccaggctagccttctcac

SEQ ID NO: 608551 - DNA, 20 bp, mouse
gtgaggcaaagtagaggcag

SEQ ID NO: 608552 - DNA, 20 bp, mouse
gaccctacgatgctgacctg

SEQ ID NO: 608553 - DNA, 20 bp, mouse
ggggaagccctgtcagggag

SEQ ID NO: 608554 - DNA, 20 bp, mouse
gaccgggtgcctggcggcca

SEQ ID NO: 608555 - DNA, 20 bp, mouse
ggaccaaccatggtgaatct

SEQ ID NO: 608556 - DNA, 20 bp, mouse
gcgcgcgttggttaaggtga

SEQ ID NO: 608557 - DNA, 20 bp, mouse
gggctccggaatagggtcag

SEQ ID NO: 608558 - DNA, 20 bp, mouse
ggacagtcgcgcgttggtta

SEQ ID NO: 608559 - DNA, 20 bp, mouse
gaggcccagggaccctgaag

SEQ ID NO: 608560 - DNA, 20 bp, mouse
gtccagggacgacagagctc

SEQ ID NO: 608561 - DNA, 20 bp, mouse
gtacaggtaccgcccatcag

SEQ ID NO: 608562 - DNA, 20 bp, mouse
gcgttggttaaggtgagggc

SEQ ID NO: 608563 - DNA, 20 bp, mouse
ggaactgtccccgaagggag

SEQ ID NO: 608564 - DNA, 20 bp, mouse
gggtcctaggcccagaggat

SEQ ID NO: 608565 - DNA, 20 bp, mouse
gtaagaggtcctaggcccag

SEQ ID NO: 608566 - DNA, 20 bp, mouse
gccaggggcaccttagactc

SEQ ID NO: 608567 - DNA, 20 bp, mouse
gtagactcaggtgacctggt

SEQ ID NO: 608568 - DNA, 20 bp, mouse
gggaagtccgcacgcgtcca

SEQ ID NO: 608569 - DNA, 20 bp, mouse
gagggcggctctcagaccca

SEQ ID NO: 608570 - DNA, 20 bp, mouse
gagcgcagtgagaccccacc

SEQ ID NO: 608571 - DNA, 20 bp, mouse
gcttcctgccggaatctgaa

SEQ ID NO: 608572 - DNA, 20 bp, mouse
gggcgaagctgcactcagat

SEQ ID NO: 608573 - DNA, 20 bp, mouse
gcgaggagctgaaggttgca

SEQ ID NO: 608574 - DNA, 20 bp, mouse
gctccgcctgggagggactc

SEQ ID NO: 608575 - DNA, 20 bp, mouse
ggaccggagtccctcccagg

SEQ ID NO: 608576 - DNA, 20 bp, mouse
ggcagcagcaagagcagtag

SEQ ID NO: 608577 - DNA, 20 bp, mouse
gggcccgcgggacccaagag

SEQ ID NO: 608578 - DNA, 20 bp, mouse
gcccgggtgcgggggtacag

SEQ ID NO: 608579 - DNA, 20 bp, mouse
ggccagggaacgctaggaga

SEQ ID NO: 608580 - DNA, 20 bp, mouse
gctccgtcaccgggccggag

SEQ ID NO: 608581 - DNA, 20 bp, mouse
gtcacgccccggcccgggag

SEQ ID NO: 608582 - DNA, 20 bp, mouse
gctgggtggggagggtcggt

SEQ ID NO: 608583 - DNA, 20 bp, mouse
gtcccgctccggcccggtga

SEQ ID NO: 608584 - DNA, 20 bp, mouse
gggcagcaggcggcgcagca

SEQ ID NO: 608585 - DNA, 20 bp, mouse
gaggcagagtcagagttacg

SEQ ID NO: 608586 - DNA, 20 bp, mouse
gtgccggcgaggccgactag

SEQ ID NO: 608587 - DNA, 20 bp, mouse
ggcgcagcgtctcctctagt

SEQ ID NO: 608588 - DNA, 20 bp, mouse
ggggccacggcaaagcaggt

SEQ ID NO: 608589 - DNA, 20 bp, mouse
gtcagacctgaagaagccgg

SEQ ID NO: 608590 - DNA, 20 bp, mouse
gctcctctagtcggcctcgc

SEQ ID NO: 608591 - DNA, 20 bp, mouse
ggcgcccgccctgcactcac

SEQ ID NO: 608592 - DNA, 20 bp, mouse
ggcgcgggccacggcaaagc

SEQ ID NO: 608593 - DNA, 20 bp, mouse
gcatagctgcacaaagaggt

SEQ ID NO: 608594 - DNA, 20 bp, mouse
gtaaggccgcgcgcgggcca

SEQ ID NO: 608595 - DNA, 20 bp, mouse
gtgaagaagccggcggtgag

SEQ ID NO: 608596 - DNA, 20 bp, mouse
gagctgcagcaagtgctcaa

SEQ ID NO: 608597 - DNA, 20 bp, mouse
gagcaagtgctcaagggtgc

SEQ ID NO: 608598 - DNA, 20 bp, mouse
gagaactgcttccggattga

SEQ ID NO: 608599 - DNA, 20 bp, mouse
gcaagagtagtccctcaatc

SEQ ID NO: 608600 - DNA, 20 bp, mouse
gcaggaggacctgagatggt

SEQ ID NO: 608601 - DNA, 20 bp, mouse
ggatcgagggactgaaggag

SEQ ID NO: 608602 - DNA, 20 bp, mouse
gttactctttaccttcccag

SEQ ID NO: 608603 - DNA, 20 bp, mouse
gaccaccacgcctcacctct

SEQ ID NO: 608604 - DNA, 20 bp, mouse
gtatttacagatatcttagt

SEQ ID NO: 608605 - DNA, 20 bp, mouse
gaattacctatgatctaagt

SEQ ID NO: 608606 - DNA, 20 bp, mouse
gggcctgtgctgtaggacga

SEQ ID NO: 608607 - DNA, 20 bp, mouse
ggccgggaggcctgtgctgt

SEQ ID NO: 608608 - DNA, 20 bp, mouse
gacagcgagaagccgaggtc

SEQ ID NO: 608609 - DNA, 20 bp, mouse
gtcctacagcacaggcctcc

SEQ ID NO: 608610 - DNA, 20 bp, mouse
gagcagacagcgagaagccg

SEQ ID NO: 608611 - DNA, 20 bp, mouse
ggaacacacccaaccaacac

SEQ ID NO: 608612 - DNA, 20 bp, mouse
gccaaccctcggctcctatt

SEQ ID NO: 608613 - DNA, 20 bp, mouse
gcgccctcgtcctacagcac

SEQ ID NO: 608614 - DNA, 20 bp, mouse
gccggctccggctccagtgt

SEQ ID NO: 608615 - DNA, 20 bp, mouse
gcgctgcgtcctagcgggag

SEQ ID NO: 608616 - DNA, 20 bp, mouse
gtggagacgcggccacgagg

SEQ ID NO: 608617 - DNA, 20 bp, mouse
gagggccgcagctggagacg

SEQ ID NO: 608618 - DNA, 20 bp, mouse
gtccctgctcggccccctcg

SEQ ID NO: 608619 - DNA, 20 bp, mouse
gcaaaggggcgggttctcga

SEQ ID NO: 608620 - DNA, 20 bp, mouse
gcctttcagggctgctccga

SEQ ID NO: 608621 - DNA, 20 bp, mouse
ggtggccgcgtctccagctg

SEQ ID NO: 608622 - DNA, 20 bp, mouse
gaatccggtacgcacctccc

SEQ ID NO: 608623 - DNA, 20 bp, mouse
gcggccctttaaacctttca

SEQ ID NO: 608624 - DNA, 20 bp, mouse
gccccaaggcgatccctcgg

SEQ ID NO: 608625 - DNA, 20 bp, mouse
ggaccgggtccagttcgcgt

SEQ ID NO: 608626 - DNA, 20 bp, mouse
gtaatacatttagatctgag

SEQ ID NO: 608627 - DNA, 20 bp, mouse
gccaggctccgggttccctt

SEQ ID NO: 608628 - DNA, 20 bp, mouse
gtaccaggtgattccaggtg

SEQ ID NO: 608629 - DNA, 20 bp, mouse
gtccggaagaggcaaagtcc

SEQ ID NO: 608630 - DNA, 20 bp, mouse
gggcagtaccaggtgattcc

SEQ ID NO: 608631 - DNA, 20 bp, mouse
gagggaacttggaaaggtga

SEQ ID NO: 608632 - DNA, 20 bp, mouse
gggccaggcttccagccagt

SEQ ID NO: 608633 - DNA, 20 bp, mouse
gtaagtagcagaggccctaa

SEQ ID NO: 608634 - DNA, 20 bp, mouse
gtggaaaggtgagggcccta

SEQ ID NO: 608635 - DNA, 20 bp, mouse
gactgccagctcccaggctc

SEQ ID NO: 608636 - DNA, 20 bp, mouse
gcgcgcctacctgctccggg

SEQ ID NO: 608637 - DNA, 20 bp, mouse
gcgcgggccgtgacctgcgg

SEQ ID NO: 608638 - DNA, 20 bp, mouse
ggctcgcgggccgtgacctg

SEQ ID NO: 608639 - DNA, 20 bp, mouse
gaggacgagcagggcatcag

SEQ ID NO: 608640 - DNA, 20 bp, mouse
ggcgccgcgcctacctgctc

SEQ ID NO: 608641 - DNA, 20 bp, mouse
gcggcggtggcagtcgcggt

SEQ ID NO: 608642 - DNA, 20 bp, mouse
gcaggaacgcgcgcccagta

SEQ ID NO: 608643 - DNA, 20 bp, mouse
gggggccgcaggcgacactg

SEQ ID NO: 608644 - DNA, 20 bp, mouse
ggtggcagtcgcggtgggga

SEQ ID NO: 608645 - DNA, 20 bp, mouse
gggcgggcggtgcagctccg

SEQ ID NO: 608646 - DNA, 20 bp, mouse
gctcggggcatgataagcag

SEQ ID NO: 608647 - DNA, 20 bp, mouse
gggctccgcgcactcttcag

SEQ ID NO: 608648 - DNA, 20 bp, mouse
gctgcgagaggaggtaccgg

SEQ ID NO: 608649 - DNA, 20 bp, mouse
ggataagcaggggtgcgggg

SEQ ID NO: 608650 - DNA, 20 bp, mouse
ggggcgtccgctcggctcgg

SEQ ID NO: 608651 - DNA, 20 bp, mouse
gccgctgcgagaggaggtac

SEQ ID NO: 608652 - DNA, 20 bp, mouse
gccccggagagggattgagg

SEQ ID NO: 608653 - DNA, 20 bp, mouse
gcatgccccgagccagggcc

SEQ ID NO: 608654 - DNA, 20 bp, mouse
ggaggggcgtccgctcggct

SEQ ID NO: 608655 - DNA, 20 bp, mouse
ggctgccaggccctggctcg

SEQ ID NO: 608656 - DNA, 20 bp, mouse
gcagcttgagagttaatggg

SEQ ID NO: 608657 - DNA, 20 bp, mouse
gcccgcctgcacccagactc

SEQ ID NO: 608658 - DNA, 20 bp, mouse
gctaaacaaacggcctccca

SEQ ID NO: 608659 - DNA, 20 bp, mouse
gactcagctttcggtagagg

SEQ ID NO: 608660 - DNA, 20 bp, mouse
ggagactcagctttcggtag

SEQ ID NO: 608661 - DNA, 20 bp, mouse
gagagtagtcagcaccctga

SEQ ID NO: 608662 - DNA, 20 bp, mouse
gctgcagtccgcgggaggat

SEQ ID NO: 608663 - DNA, 20 bp, mouse
gctcggagaggcagtcgagg

SEQ ID NO: 608664 - DNA, 20 bp, mouse
ggagcctgagactcagcttt

SEQ ID NO: 608665 - DNA, 20 bp, mouse
gactctctgccagaggtcat

SEQ ID NO: 608666 - DNA, 20 bp, mouse
ggctcggctcagacaaaagg

SEQ ID NO: 608667 - DNA, 20 bp, mouse
gtgtcaccttgaggccctcg

SEQ ID NO: 608668 - DNA, 20 bp, mouse
gccagctcggctcagacaaa

SEQ ID NO: 608669 - DNA, 20 bp, mouse
gcggctcagacaaaaggcgg

SEQ ID NO: 608670 - DNA, 20 bp, mouse
gcggcgccgcgagggcctca

SEQ ID NO: 608671 - DNA, 20 bp, mouse
gaggcggagcggcgccgcga

SEQ ID NO: 608672 - DNA, 20 bp, mouse
ggagctcaggacctcccggg

SEQ ID NO: 608673 - DNA, 20 bp, mouse
ggggcctagaaagggcacgg

SEQ ID NO: 608674 - DNA, 20 bp, mouse
ggaggagcccatggcatcgg

SEQ ID NO: 608675 - DNA, 20 bp, mouse
gccgccggcgctctctcccg

SEQ ID NO: 608676 - DNA, 20 bp, mouse
gaccaacgcagcacagggca

SEQ ID NO: 608677 - DNA, 20 bp, mouse
gtgaccaaacgcgagcccca

SEQ ID NO: 608678 - DNA, 20 bp, mouse
gagggcacggtcatgtcagc

SEQ ID NO: 608679 - DNA, 20 bp, mouse
gtatcctccctcccagccag

SEQ ID NO: 608680 - DNA, 20 bp, mouse
gaactgtcttcgggagggca

SEQ ID NO: 608681 - DNA, 20 bp, mouse
gaccgtgccctgtgctgcgt

SEQ ID NO: 608682 - DNA, 20 bp, mouse
gggtagccccgggcacgcac

SEQ ID NO: 608683 - DNA, 20 bp, mouse
gagccagggtaagcaacctc

SEQ ID NO: 608684 - DNA, 20 bp, mouse
gaaatgtgcgcgttggaggg

SEQ ID NO: 608685 - DNA, 20 bp, mouse
gcaagtgagcaccgacccaa

SEQ ID NO: 608686 - DNA, 20 bp, mouse
gatactatcaagctaccgat

SEQ ID NO: 608687 - DNA, 20 bp, mouse
gtgcagcatgagctgaagtt

SEQ ID NO: 608688 - DNA, 20 bp, mouse
gggccactatgctagataac

SEQ ID NO: 608689 - DNA, 20 bp, mouse
gtattgccacaaataattta

SEQ ID NO: 608690 - DNA, 20 bp, mouse
gagagcacattgtcagcgag

SEQ ID NO: 608691 - DNA, 20 bp, mouse
gataacaggcaactaaaaat

SEQ ID NO: 608692 - DNA, 20 bp, mouse
ggctttccttaaattatttg

SEQ ID NO: 608693 - DNA, 20 bp, mouse
gaacgagagctggattgcaa

SEQ ID NO: 608694 - DNA, 20 bp, mouse
ggtaacataactaagtccta

SEQ ID NO: 608695 - DNA, 20 bp, mouse
gtggtatctcgtttcactta

SEQ ID NO: 608696 - DNA, 20 bp, mouse
ggcagcggaacctcgacgag

SEQ ID NO: 608697 - DNA, 20 bp, mouse
ggagcctcctggccgtccaa

SEQ ID NO: 608698 - DNA, 20 bp, mouse
ggcgagccagcagagcctcc

SEQ ID NO: 608699 - DNA, 20 bp, mouse
gccagtagcgcggcgagaag

SEQ ID NO: 608700 - DNA, 20 bp, mouse
ggtccaagggccccagctct

SEQ ID NO: 608701 - DNA, 20 bp, mouse
gcgacgagcggagtctgaag

SEQ ID NO: 608702 - DNA, 20 bp, mouse
gtgggacgacaccggctcac

SEQ ID NO: 608703 - DNA, 20 bp, mouse
gcggtgtcgtcccaatacac

SEQ ID NO: 608704 - DNA, 20 bp, mouse
ggggcccttggacggccagg

SEQ ID NO: 608705 - DNA, 20 bp, mouse
gcaggcggcggccagtagcg

SEQ ID NO: 608706 - DNA, 20 bp, mouse
gcagagggcgcaaagcgaag

SEQ ID NO: 608707 - DNA, 20 bp, mouse
gagggacgcaggcctgatta

SEQ ID NO: 608708 - DNA, 20 bp, mouse
ggggcgcaaagcgaagtgga

SEQ ID NO: 608709 - DNA, 20 bp, mouse
gaagcggaggagttcagggg

SEQ ID NO: 608710 - DNA, 20 bp, mouse
gggaagacaagaagggacgc

SEQ ID NO: 608711 - DNA, 20 bp, mouse
gagaagccgacggcaacaac

SEQ ID NO: 608712 - DNA, 20 bp, mouse
gccaggtgagagcaaagatg

SEQ ID NO: 608713 - DNA, 20 bp, mouse
gtcaccaacccagaagccga

SEQ ID NO: 608714 - DNA, 20 bp, mouse
gcgacggcaacaacaggcga

SEQ ID NO: 608715 - DNA, 20 bp, mouse
gggaagagcgcttgctggtg

SEQ ID NO: 608716 - DNA, 20 bp, mouse
gccccattgcgagccatggg

SEQ ID NO: 608717 - DNA, 20 bp, mouse
gcattgcgagccatgggagg

SEQ ID NO: 608718 - DNA, 20 bp, mouse
gggagtgggtggccagagta

SEQ ID NO: 608719 - DNA, 20 bp, mouse
gagacccccggaagcgcagg

SEQ ID NO: 608720 - DNA, 20 bp, mouse
gatgggaggcggctggtggt

SEQ ID NO: 608721 - DNA, 20 bp, mouse
gcagagacccccggaagcgc

SEQ ID NO: 608722 - DNA, 20 bp, mouse
gcgctgcggggccgctgagg

SEQ ID NO: 608723 - DNA, 20 bp, mouse
gcgccccacgggcctactgt

SEQ ID NO: 608724 - DNA, 20 bp, mouse
gccggaagcgcaggcgggcc

SEQ ID NO: 608725 - DNA, 20 bp, mouse
gcggccccattgcgagccat

SEQ ID NO: 608726 - DNA, 20 bp, mouse
gaggccctctgggatccccg

SEQ ID NO: 608727 - DNA, 20 bp, mouse
gccgctgtgcgcccagggag

SEQ ID NO: 608728 - DNA, 20 bp, mouse
gtccaccccggggatcccag

SEQ ID NO: 608729 - DNA, 20 bp, mouse
gtgcgcccagggagcggaca

SEQ ID NO: 608730 - DNA, 20 bp, mouse
gagaagtccgaggtccccat

SEQ ID NO: 608731 - DNA, 20 bp, mouse
ggaaccctctcagctcagtt

SEQ ID NO: 608732 - DNA, 20 bp, mouse
gacatggtgagcaggccctc

SEQ ID NO: 608733 - DNA, 20 bp, mouse
gagcggtacgaggctggagg

SEQ ID NO: 608734 - DNA, 20 bp, mouse
gtcgtaccgctgtgcgccca

SEQ ID NO: 608735 - DNA, 20 bp, mouse
ggcgttgggaggtgaagcta

SEQ ID NO: 608736 - DNA, 20 bp, mouse
ggagctctcgaaaccgcgaa

SEQ ID NO: 608737 - DNA, 20 bp, mouse
gcgccacaggacacacgcga

SEQ ID NO: 608738 - DNA, 20 bp, mouse
gcccacgccacgcagagagg

SEQ ID NO: 608739 - DNA, 20 bp, mouse
gagcctgcggcgggaaaagg

SEQ ID NO: 608740 - DNA, 20 bp, mouse
gctgaaggggagattctgga

SEQ ID NO: 608741 - DNA, 20 bp, mouse
gcccttcaggttctgcaaaa

SEQ ID NO: 608742 - DNA, 20 bp, mouse
ggtggcagggacaacgtggt

SEQ ID NO: 608743 - DNA, 20 bp, mouse
gacagacagtctagagtccc

SEQ ID NO: 608744 - DNA, 20 bp, mouse
gctcgaaaccgcgaagggaa

SEQ ID NO: 608745 - DNA, 20 bp, mouse
ggagattctggacggtcccg

SEQ ID NO: 608746 - DNA, 20 bp, mouse
gccaaagtgccagagaccga

SEQ ID NO: 608747 - DNA, 20 bp, mouse
ggagagcttcgcccgtaccg

SEQ ID NO: 608748 - DNA, 20 bp, mouse
gtcgcccgtaccgcggtgag

SEQ ID NO: 608749 - DNA, 20 bp, mouse
gccactcggtgtgctagcgg

SEQ ID NO: 608750 - DNA, 20 bp, mouse
ggcggacctgccgctcaccg

SEQ ID NO: 608751 - DNA, 20 bp, mouse
ggaggcgaagccgaccacga

SEQ ID NO: 608752 - DNA, 20 bp, mouse
gcctgccgctcaccgcggta

SEQ ID NO: 608753 - DNA, 20 bp, mouse
gctagcacaccgagtggcgg

SEQ ID NO: 608754 - DNA, 20 bp, mouse
gcgggactccggggccaggg

SEQ ID NO: 608755 - DNA, 20 bp, mouse
gcgcccgcacctgcccccgg

SEQ ID NO: 608756 - DNA, 20 bp, mouse
gccccaggcggcactcggct

SEQ ID NO: 608757 - DNA, 20 bp, mouse
ggcactcggctgggctcccc

SEQ ID NO: 608758 - DNA, 20 bp, mouse
ggggacgcggggccagccag

SEQ ID NO: 608759 - DNA, 20 bp, mouse
gctgctgctgcggccgcctg

SEQ ID NO: 608760 - DNA, 20 bp, mouse
gcggcgaagttgctagctgg

SEQ ID NO: 608761 - DNA, 20 bp, mouse
gggttcgggggtgtacccag

SEQ ID NO: 608762 - DNA, 20 bp, mouse
gagagagaggggacacgcgg

SEQ ID NO: 608763 - DNA, 20 bp, mouse
ggagcgggaagatggagcgg

SEQ ID NO: 608764 - DNA, 20 bp, mouse
gcgcagccccaggcggcact

SEQ ID NO: 608765 - DNA, 20 bp, mouse
gtggccgccgagtccccctg

SEQ ID NO: 608766 - DNA, 20 bp, mouse
gccggaccgggacggaccgg

SEQ ID NO: 608767 - DNA, 20 bp, mouse
gcgggagctccggagcagct

SEQ ID NO: 608768 - DNA, 20 bp, mouse
gcgggacgcggggaccggac

SEQ ID NO: 608769 - DNA, 20 bp, mouse
gcgcggggaccggaccggga

SEQ ID NO: 608770 - DNA, 20 bp, mouse
ggcacgcgggacgcggggac

SEQ ID NO: 608771 - DNA, 20 bp, mouse
gctgcagcacgcgggacgcg

SEQ ID NO: 608772 - DNA, 20 bp, mouse
ggcacgagcagccttcgcgt

SEQ ID NO: 608773 - DNA, 20 bp, mouse
gcggcagccaggcctgacgg

SEQ ID NO: 608774 - DNA, 20 bp, mouse
gcggaggagttgggccgcgg

SEQ ID NO: 608775 - DNA, 20 bp, mouse
gggcctggctgccgctcagg

SEQ ID NO: 608776 - DNA, 20 bp, mouse
gaccagcaccggcctcacta

SEQ ID NO: 608777 - DNA, 20 bp, mouse
ggagcgagcgggaagcacag

SEQ ID NO: 608778 - DNA, 20 bp, mouse
gcttccgccccggcccggaa

SEQ ID NO: 608779 - DNA, 20 bp, mouse
ggcatcaggccaacagtcct

SEQ ID NO: 608780 - DNA, 20 bp, mouse
gctcactatggtaagaacct

SEQ ID NO: 608781 - DNA, 20 bp, mouse
gccgccgagaaactcaaccg

SEQ ID NO: 608782 - DNA, 20 bp, mouse
gacagtcctaggaagaaccc

SEQ ID NO: 608783 - DNA, 20 bp, mouse
gccggggcggaagaggatgc

SEQ ID NO: 608784 - DNA, 20 bp, mouse
gcggggatccgagggtgcac

SEQ ID NO: 608785 - DNA, 20 bp, mouse
gacatcacccttccgggccg

SEQ ID NO: 608786 - DNA, 20 bp, mouse
gggatcgggaagtgtcaagt

SEQ ID NO: 608787 - DNA, 20 bp, mouse
gaggggtccgggttcagctg

SEQ ID NO: 608788 - DNA, 20 bp, mouse
ggtggcggctgcaaatgcgg

SEQ ID NO: 608789 - DNA, 20 bp, mouse
gcgtcaccacggcccggatc

SEQ ID NO: 608790 - DNA, 20 bp, mouse
ggctgtggcggctgcaaatg

SEQ ID NO: 608791 - DNA, 20 bp, mouse
gtggcggtagtgcccggctg

SEQ ID NO: 608792 - DNA, 20 bp, mouse
gctgcaaatgcgggggaacc

SEQ ID NO: 608793 - DNA, 20 bp, mouse
gcagccgccacagctgaacc

SEQ ID NO: 608794 - DNA, 20 bp, mouse
gggctccccaaggtccaggg

SEQ ID NO: 608795 - DNA, 20 bp, mouse
gtagtgcccggctggggtga

SEQ ID NO: 608796 - DNA, 20 bp, mouse
ggtcagcggcggaaacatgg

SEQ ID NO: 608797 - DNA, 20 bp, mouse
gcactagcaccgcaaggcct

SEQ ID NO: 608798 - DNA, 20 bp, mouse
gtagcgctgggagtcagcgg

SEQ ID NO: 608799 - DNA, 20 bp, mouse
gactttcgctaggaccgaca

SEQ ID NO: 608800 - DNA, 20 bp, mouse
ggcatccgggagccgagggg

SEQ ID NO: 608801 - DNA, 20 bp, mouse
ggcctcgtcccagagctaag

SEQ ID NO: 608802 - DNA, 20 bp, mouse
ggagcctccgagccagaacg

SEQ ID NO: 608803 - DNA, 20 bp, mouse
gagaacgcggaggtgatgtg

SEQ ID NO: 608804 - DNA, 20 bp, mouse
gagggtgaggcgggacaccg

SEQ ID NO: 608805 - DNA, 20 bp, mouse
gggaaacatggcggccgtgt

SEQ ID NO: 608806 - DNA, 20 bp, mouse
gtgggtcccagtgaaggtgt

SEQ ID NO: 608807 - DNA, 20 bp, mouse
gagagctggaccgctcctgg

SEQ ID NO: 608808 - DNA, 20 bp, mouse
gaccttcactgggacccagg

SEQ ID NO: 608809 - DNA, 20 bp, mouse
gcccagagctggaccgctcc

SEQ ID NO: 608810 - DNA, 20 bp, mouse
gctgaggatgcagacggctg

SEQ ID NO: 608811 - DNA, 20 bp, mouse
gtctcacccacaccttcact

SEQ ID NO: 608812 - DNA, 20 bp, mouse
ggcggtccagctctgggagg

SEQ ID NO: 608813 - DNA, 20 bp, mouse
ggcatcctcagcttccctcc

SEQ ID NO: 608814 - DNA, 20 bp, mouse
gttcagggagggagtcgaaa

SEQ ID NO: 608815 - DNA, 20 bp, mouse
gggtgggagctatggcccca

SEQ ID NO: 608816 - DNA, 20 bp, mouse
gggcgctggcgaacagggtc

SEQ ID NO: 608817 - DNA, 20 bp, mouse
gggagtcgccgaacacggtg

SEQ ID NO: 608818 - DNA, 20 bp, mouse
gggtgaggctgaggttgctc

SEQ ID NO: 608819 - DNA, 20 bp, mouse
ggctcaggcgctggcgaaca

SEQ ID NO: 608820 - DNA, 20 bp, mouse
gcggctggagtcgccgaaca

SEQ ID NO: 608821 - DNA, 20 bp, mouse
gcgctagtcggcgggcacag

SEQ ID NO: 608822 - DNA, 20 bp, mouse
ggccgtgcccgggtgaaaga

SEQ ID NO: 608823 - DNA, 20 bp, mouse
gcgactagcgggtgtgtgag

SEQ ID NO: 608824 - DNA, 20 bp, mouse
ggccgaacacggtgaggctg

SEQ ID NO: 608825 - DNA, 20 bp, mouse
gcagaggcttccccttggag

SEQ ID NO: 608826 - DNA, 20 bp, mouse
ggcggaggtgcggtactccg

SEQ ID NO: 608827 - DNA, 20 bp, mouse
gcgccgtggctgcggaggtg

SEQ ID NO: 608828 - DNA, 20 bp, mouse
ggcctcggcctcgccctggg

SEQ ID NO: 608829 - DNA, 20 bp, mouse
gccggccaaaggtgacgccg

SEQ ID NO: 608830 - DNA, 20 bp, mouse
gggagaagagggccggccaa

SEQ ID NO: 608831 - DNA, 20 bp, mouse
gtggagcgcgaggggagcgg

SEQ ID NO: 608832 - DNA, 20 bp, mouse
gctagcagcgccgttggagt

SEQ ID NO: 608833 - DNA, 20 bp, mouse
gcgcggggcggggcgtacct

SEQ ID NO: 608834 - DNA, 20 bp, mouse
ggcagcgccgttggagtggg

SEQ ID NO: 608835 - DNA, 20 bp, mouse
gcggcgcggcgggcggtgga

SEQ ID NO: 608836 - DNA, 20 bp, mouse
gtggctacccaaaggccgag

SEQ ID NO: 608837 - DNA, 20 bp, mouse
gtcgagtgttggctacccaa

SEQ ID NO: 608838 - DNA, 20 bp, mouse
ggggacgcgcgacgaggcag

SEQ ID NO: 608839 - DNA, 20 bp, mouse
gcaaaggccgagcggcaggc

SEQ ID NO: 608840 - DNA, 20 bp, mouse
gcgcgagacgaggctcatcg

SEQ ID NO: 608841 - DNA, 20 bp, mouse
gggggcggctcctcgagtgt

SEQ ID NO: 608842 - DNA, 20 bp, mouse
gaggcgggcggcaggtgccg

SEQ ID NO: 608843 - DNA, 20 bp, mouse
gaggggcaggccgcgagacg

SEQ ID NO: 608844 - DNA, 20 bp, mouse
gatcgcggggacgcgcgacg

SEQ ID NO: 608845 - DNA, 20 bp, mouse
ggcgcgacgcgggccctgag

SEQ ID NO: 608846 - DNA, 20 bp, mouse
ggaccagcagcgcaggtaag

SEQ ID NO: 608847 - DNA, 20 bp, mouse
gagaggagaatgtctttgcg

SEQ ID NO: 608848 - DNA, 20 bp, mouse
ggggtgtggcggagagtccc

SEQ ID NO: 608849 - DNA, 20 bp, mouse
gaaagccagacccaaatcaa

SEQ ID NO: 608850 - DNA, 20 bp, mouse
gctcaaaacacggacaccca

SEQ ID NO: 608851 - DNA, 20 bp, mouse
gtgcaaaggagcgtttagta

SEQ ID NO: 608852 - DNA, 20 bp, mouse
ggcgtttagtagggcagatt

SEQ ID NO: 608853 - DNA, 20 bp, mouse
gtcgcttcagcggccccctt

SEQ ID NO: 608854 - DNA, 20 bp, mouse
gcagggacaaccaaatagat

SEQ ID NO: 608855 - DNA, 20 bp, mouse
gaatgtctttgcggggactc

SEQ ID NO: 608856 - DNA, 20 bp, mouse
gcctagcaggactccataca

SEQ ID NO: 608857 - DNA, 20 bp, mouse
gctcccctcccgatttccgg

SEQ ID NO: 608858 - DNA, 20 bp, mouse
gatcccccggaaatcgggag

SEQ ID NO: 608859 - DNA, 20 bp, mouse
ggagtatagcaggggagggt

SEQ ID NO: 608860 - DNA, 20 bp, mouse
ggtctgagtatagcagggga

SEQ ID NO: 608861 - DNA, 20 bp, mouse
ggggaggggaggggttagac

SEQ ID NO: 608862 - DNA, 20 bp, mouse
gagtcctgctaggtgtccac

SEQ ID NO: 608863 - DNA, 20 bp, mouse
gactccagtggacacctagc

SEQ ID NO: 608864 - DNA, 20 bp, mouse
gatgatagtagagagctttg

SEQ ID NO: 608865 - DNA, 20 bp, mouse
gaccaggtctgagtatagca

SEQ ID NO: 608866 - DNA, 20 bp, mouse
gacagtcgtgtgaggagcta

SEQ ID NO: 608867 - DNA, 20 bp, mouse
ggttaagcgggaagtcctct

SEQ ID NO: 608868 - DNA, 20 bp, mouse
ggtgtgagagtggggaacac

SEQ ID NO: 608869 - DNA, 20 bp, mouse
gcacagcagtaatcgcccag

SEQ ID NO: 608870 - DNA, 20 bp, mouse
gcggcggtactgggtgtgta

SEQ ID NO: 608871 - DNA, 20 bp, mouse
gctccgaccgacagaaggat

SEQ ID NO: 608872 - DNA, 20 bp, mouse
gcaggtgtccgacgacgaca

SEQ ID NO: 608873 - DNA, 20 bp, mouse
gactctgtttcctctcatgt

SEQ ID NO: 608874 - DNA, 20 bp, mouse
gcatgttggacagtcgtgtg

SEQ ID NO: 608875 - DNA, 20 bp, mouse
gagctgggtccattcaaagt

SEQ ID NO: 608876 - DNA, 20 bp, mouse
gcctaggaggcacggaggta

SEQ ID NO: 608877 - DNA, 20 bp, mouse
gcgcagagggtgcgatccta

SEQ ID NO: 608878 - DNA, 20 bp, mouse
gcggacctcaagctcctagg

SEQ ID NO: 608879 - DNA, 20 bp, mouse
gaagctcctaggaggcacgg

SEQ ID NO: 608880 - DNA, 20 bp, mouse
gcattagggacacttagggt

SEQ ID NO: 608881 - DNA, 20 bp, mouse
gcgggcattagggacactta

SEQ ID NO: 608882 - DNA, 20 bp, mouse
gctacggacctcaagctcct

SEQ ID NO: 608883 - DNA, 20 bp, mouse
gcagcggaagcaaccagatg

SEQ ID NO: 608884 - DNA, 20 bp, mouse
gctcaagctcctaggaggca

SEQ ID NO: 608885 - DNA, 20 bp, mouse
gcctgacgcagcaggcggaa

SEQ ID NO: 608886 - DNA, 20 bp, mouse
gaccggggaagtgtgcagca

SEQ ID NO: 608887 - DNA, 20 bp, mouse
gcacacttccccggtcccag

SEQ ID NO: 608888 - DNA, 20 bp, mouse
gagagctcacacagaggcgc

SEQ ID NO: 608889 - DNA, 20 bp, mouse
gcctgggtgggagccagaag

SEQ ID NO: 608890 - DNA, 20 bp, mouse
gtagttgagaacttcagccc

SEQ ID NO: 608891 - DNA, 20 bp, mouse
gcgcagggcgtcagactgga

SEQ ID NO: 608892 - DNA, 20 bp, mouse
gagctatgctaaagtgatgg

SEQ ID NO: 608893 - DNA, 20 bp, mouse
gcaggttcttcctcctgcca

SEQ ID NO: 608894 - DNA, 20 bp, mouse
gctgtcttacctgattcctc

SEQ ID NO: 608895 - DNA, 20 bp, mouse
gagctcgcagggcgtcagac

SEQ ID NO: 608896 - DNA, 20 bp, mouse
ggctaccaaggggccgtgaa

SEQ ID NO: 608897 - DNA, 20 bp, mouse
gccagccccacccatcgcag

SEQ ID NO: 608898 - DNA, 20 bp, mouse
gctgtcctctgcgatgggtg

SEQ ID NO: 608899 - DNA, 20 bp, mouse
ggggctggaactgagaggtc

SEQ ID NO: 608900 - DNA, 20 bp, mouse
gcgtgaggcactgataacta

SEQ ID NO: 608901 - DNA, 20 bp, mouse
gctggcaccgctccagatag

SEQ ID NO: 608902 - DNA, 20 bp, mouse
gttcaaaagggggctaccaa

SEQ ID NO: 608903 - DNA, 20 bp, mouse
gggctggggaggtcagagtc

SEQ ID NO: 608904 - DNA, 20 bp, mouse
gtctggagcggtgccagaag

SEQ ID NO: 608905 - DNA, 20 bp, mouse
gcatagggttccttcttctc

SEQ ID NO: 608906 - DNA, 20 bp, mouse
ggcgggagcggcgtgttcta

SEQ ID NO: 608907 - DNA, 20 bp, mouse
gggccaactgcgagactcag

SEQ ID NO: 608908 - DNA, 20 bp, mouse
gaagagaactcacagccaag

SEQ ID NO: 608909 - DNA, 20 bp, mouse
gttggcctagaagcaggtgt

SEQ ID NO: 608910 - DNA, 20 bp, mouse
gcccacaaaggcccccagac

SEQ ID NO: 608911 - DNA, 20 bp, mouse
gtgttctaaggttgctaccg

SEQ ID NO: 608912 - DNA, 20 bp, mouse
gcgagactcagaggccgacc

SEQ ID NO: 608913 - DNA, 20 bp, mouse
ggctttgcgcctgctcagtc

SEQ ID NO: 608914 - DNA, 20 bp, mouse
gaaagacagggtccttggaa

SEQ ID NO: 608915 - DNA, 20 bp, mouse
ggcgcctgctcagtccggcg

SEQ ID NO: 608916 - DNA, 20 bp, mouse
ggcggcggcgagcccaccgg

SEQ ID NO: 608917 - DNA, 20 bp, mouse
ggcggcggcggcgagcccac

SEQ ID NO: 608918 - DNA, 20 bp, mouse
gcgggaagccatggagccac

SEQ ID NO: 608919 - DNA, 20 bp, mouse
ggccagcagccgccgccggt

SEQ ID NO: 608920 - DNA, 20 bp, mouse
ggagcagccccagggagcaa

SEQ ID NO: 608921 - DNA, 20 bp, mouse
ggagccacgggcgctcgtca

SEQ ID NO: 608922 - DNA, 20 bp, mouse
gacgagcgcccgtggctcca

SEQ ID NO: 608923 - DNA, 20 bp, mouse
ggcagcggcaggtgcgacag

SEQ ID NO: 608924 - DNA, 20 bp, mouse
gccaagtgcattgtgtctgg

SEQ ID NO: 608925 - DNA, 20 bp, mouse
ggcagccggcgccccagggg

SEQ ID NO: 608926 - DNA, 20 bp, mouse
ggcttcatgtgcaggaatga

SEQ ID NO: 608927 - DNA, 20 bp, mouse
ggacggtccgagctccttga

SEQ ID NO: 608928 - DNA, 20 bp, mouse
gcctgaaggccataagataa

SEQ ID NO: 608929 - DNA, 20 bp, mouse
ggcatcagcaccaaatacca

SEQ ID NO: 608930 - DNA, 20 bp, mouse
gtgaagcctctctgttcaca

SEQ ID NO: 608931 - DNA, 20 bp, mouse
gcaggggttaaggaaatcct

SEQ ID NO: 608932 - DNA, 20 bp, mouse
gccctaaatcagtgttgggg

SEQ ID NO: 608933 - DNA, 20 bp, mouse
gagcatatgcgtgtatgtac

SEQ ID NO: 608934 - DNA, 20 bp, mouse
gtttggagggtatttgggag

SEQ ID NO: 608935 - DNA, 20 bp, mouse
gagagatttggagggtattt

SEQ ID NO: 608936 - DNA, 20 bp, mouse
gaagccgggccgcgagtctc

SEQ ID NO: 608937 - DNA, 20 bp, mouse
ggcgcggcgccggagactcg

SEQ ID NO: 608938 - DNA, 20 bp, mouse
gctggcgaggccaccggaca

SEQ ID NO: 608939 - DNA, 20 bp, mouse
gatggtggtgccaggatgag

SEQ ID NO: 608940 - DNA, 20 bp, mouse
gggccggtcccgagccgcgt

SEQ ID NO: 608941 - DNA, 20 bp, mouse
gcggtcccgagccgcgtggg

SEQ ID NO: 608942 - DNA, 20 bp, mouse
ggcgcaacgcgagagacccg

SEQ ID NO: 608943 - DNA, 20 bp, mouse
ggagcgatcgcgtccctgtc

SEQ ID NO: 608944 - DNA, 20 bp, mouse
gcataccctcggtaaagagt

SEQ ID NO: 608945 - DNA, 20 bp, mouse
gcgatcgcgtccctgtccgg

SEQ ID NO: 608946 - DNA, 20 bp, mouse
ggctcaactcgctgcaacca

SEQ ID NO: 608947 - DNA, 20 bp, mouse
gaaagccccgcacaggaagg

SEQ ID NO: 608948 - DNA, 20 bp, mouse
ggccaaagccccgcacagga

SEQ ID NO: 608949 - DNA, 20 bp, mouse
gggccgccaaagccccgcac

SEQ ID NO: 608950 - DNA, 20 bp, mouse
gtgcaaccagggcagcgcca

SEQ ID NO: 608951 - DNA, 20 bp, mouse
gaggcgccgcaacctcacag

SEQ ID NO: 608952 - DNA, 20 bp, mouse
ggcggggctgggcccatatg

SEQ ID NO: 608953 - DNA, 20 bp, mouse
gccatggcgcccaggctacc

SEQ ID NO: 608954 - DNA, 20 bp, mouse
gggccggtacggccgatcat

SEQ ID NO: 608955 - DNA, 20 bp, mouse
ggctgacccggacccaggtg

SEQ ID NO: 608956 - DNA, 20 bp, mouse
gggaagctgcggactcgtcc

SEQ ID NO: 608957 - DNA, 20 bp, mouse
gcgggagctgccccatccag

SEQ ID NO: 608958 - DNA, 20 bp, mouse
ggatgctgactgggaaggat

SEQ ID NO: 608959 - DNA, 20 bp, mouse
gcatccagcggagcagggag

SEQ ID NO: 608960 - DNA, 20 bp, mouse
gtcccggctgtcggaagctg

SEQ ID NO: 608961 - DNA, 20 bp, mouse
gcaccgcagggatgctgact

SEQ ID NO: 608962 - DNA, 20 bp, mouse
gtgcggacgacatcgcgcca

SEQ ID NO: 608963 - DNA, 20 bp, mouse
ggcagggatgctgactggga

SEQ ID NO: 608964 - DNA, 20 bp, mouse
gacgccaccggggtgaacac

SEQ ID NO: 608965 - DNA, 20 bp, mouse
ggtgttggggactcagagga

SEQ ID NO: 608966 - DNA, 20 bp, mouse
gcagacgatgcctaattccg

SEQ ID NO: 608967 - DNA, 20 bp, mouse
gcagcagctcaccgcaatcc

SEQ ID NO: 608968 - DNA, 20 bp, mouse
ggcatcgtctgccaggattg

SEQ ID NO: 608969 - DNA, 20 bp, mouse
gcgctcctccgggaccggag

SEQ ID NO: 608970 - DNA, 20 bp, mouse
gccgggaccggagaggtcct

SEQ ID NO: 608971 - DNA, 20 bp, mouse
gcggagaggtcctgggccgt

SEQ ID NO: 608972 - DNA, 20 bp, mouse
gatgcctaattccgcggcag

SEQ ID NO: 608973 - DNA, 20 bp, mouse
gtccttaaggtgccagatta

SEQ ID NO: 608974 - DNA, 20 bp, mouse
gcggcccgctcctccgggac

SEQ ID NO: 608975 - DNA, 20 bp, mouse
gaggaggaattgggaccaag

SEQ ID NO: 608976 - DNA, 20 bp, mouse
gactcgggaccatccggcgg

SEQ ID NO: 608977 - DNA, 20 bp, mouse
gcgatcgcagctggttgggg

SEQ ID NO: 608978 - DNA, 20 bp, mouse
gataaaactcagcacccgag

SEQ ID NO: 608979 - DNA, 20 bp, mouse
ggaccatccggcgggggccg

SEQ ID NO: 608980 - DNA, 20 bp, mouse
gcgaactcgggaccatccgg

SEQ ID NO: 608981 - DNA, 20 bp, mouse
ggggcgaactcgggaccatc

SEQ ID NO: 608982 - DNA, 20 bp, mouse
gcgcggagagggctggtccg

SEQ ID NO: 608983 - DNA, 20 bp, mouse
gtcgggtccccggcccccgc

SEQ ID NO: 608984 - DNA, 20 bp, mouse
gctctctcgtaagacctctc

SEQ ID NO: 608985 - DNA, 20 bp, mouse
gggggacccgcggagagggc

SEQ ID NO: 608986 - DNA, 20 bp, mouse
ggacgatccggcggggaccg

SEQ ID NO: 608987 - DNA, 20 bp, mouse
ggggcgaactcgggacgatc

SEQ ID NO: 608988 - DNA, 20 bp, mouse
gcgaactcgggacgatccgg

SEQ ID NO: 608989 - DNA, 20 bp, mouse
gctctctcgtaagagctctc

SEQ ID NO: 608990 - DNA, 20 bp, mouse
gtcgcagctggttggggggc

SEQ ID NO: 608991 - DNA, 20 bp, mouse
gcgggacgccgggcgaactc

SEQ ID NO: 608992 - DNA, 20 bp, mouse
ggccgccgccggagccacca

SEQ ID NO: 608993 - DNA, 20 bp, mouse
ggcttccctggtggctccgg

SEQ ID NO: 608994 - DNA, 20 bp, mouse
ggggacccgaggctcggaga

SEQ ID NO: 608995 - DNA, 20 bp, mouse
gtccctggtggctccggcgg

SEQ ID NO: 608996 - DNA, 20 bp, mouse
gtcccctggtcagagctcaa

SEQ ID NO: 608997 - DNA, 20 bp, mouse
gctggtcagagctcaagggc

SEQ ID NO: 608998 - DNA, 20 bp, mouse
gtcacacaggccactgcaga

SEQ ID NO: 608999 - DNA, 20 bp, mouse
gtgttttctgaatgtctgaa

SEQ ID NO: 609000 - DNA, 20 bp, mouse
ggccagctcacaatccaagc

SEQ ID NO: 609001 - DNA, 20 bp, mouse
gtggcaggcattgtaaatag

SEQ ID NO: 609002 - DNA, 20 bp, mouse
ggagattctcgggctgcagc

SEQ ID NO: 609003 - DNA, 20 bp, mouse
ggctgctgctctacaatggt

SEQ ID NO: 609004 - DNA, 20 bp, mouse
ggaaagattggagataaaga

SEQ ID NO: 609005 - DNA, 20 bp, mouse
gagttctccatgagggactg

SEQ ID NO: 609006 - DNA, 20 bp, mouse
ggacctagccgagtcgagag

SEQ ID NO: 609007 - DNA, 20 bp, mouse
gctcgactcggctaggtctg

SEQ ID NO: 609008 - DNA, 20 bp, mouse
gaagaaagccactctcgact

SEQ ID NO: 609009 - DNA, 20 bp, mouse
gagccactctcgactcggct

SEQ ID NO: 609010 - DNA, 20 bp, mouse
gggcttctcgcgactgaagt

SEQ ID NO: 609011 - DNA, 20 bp, mouse
ggagctagcggccatcactg

SEQ ID NO: 609012 - DNA, 20 bp, mouse
gctggggagcaggtcctcgc

SEQ ID NO: 609013 - DNA, 20 bp, mouse
gtcttccaggagagtttcat

SEQ ID NO: 609014 - DNA, 20 bp, mouse
gagccaccacagctccagcg

SEQ ID NO: 609015 - DNA, 20 bp, mouse
gatgttcttagtctcaacga

SEQ ID NO: 609016 - DNA, 20 bp, mouse
ggatagccgcggcctcggtg

SEQ ID NO: 609017 - DNA, 20 bp, mouse
ggaagtcctcgcgatagccg

SEQ ID NO: 609018 - DNA, 20 bp, mouse
ggaggggcgtcggcaatcaa

SEQ ID NO: 609019 - DNA, 20 bp, mouse
gcatccccgcaccgaggccg

SEQ ID NO: 609020 - DNA, 20 bp, mouse
gggagccccgggccatgtct

SEQ ID NO: 609021 - DNA, 20 bp, mouse
gatcgcgaggacttcggcga

SEQ ID NO: 609022 - DNA, 20 bp, mouse
gatgtctcggccccgagagc

SEQ ID NO: 609023 - DNA, 20 bp, mouse
gtgcggccatccccgcaccg

SEQ ID NO: 609024 - DNA, 20 bp, mouse
gcgcctgctcgggccgaggt

SEQ ID NO: 609025 - DNA, 20 bp, mouse
ggcgattggctccccgagag

SEQ ID NO: 609026 - DNA, 20 bp, mouse
gcaggtcgctgacacgaggg

SEQ ID NO: 609027 - DNA, 20 bp, mouse
ggcagatgaggaatgcgtca

SEQ ID NO: 609028 - DNA, 20 bp, mouse
ggcttctgtgggagtgtgag

SEQ ID NO: 609029 - DNA, 20 bp, mouse
ggcagaggagtgagaagcca

SEQ ID NO: 609030 - DNA, 20 bp, mouse
gagccaggtcgctgacacga

SEQ ID NO: 609031 - DNA, 20 bp, mouse
ggctgacacgaggggggctc

SEQ ID NO: 609032 - DNA, 20 bp, mouse
gtgtgggcattgccggaggg

SEQ ID NO: 609033 - DNA, 20 bp, mouse
gtgagacatggtaggattct

SEQ ID NO: 609034 - DNA, 20 bp, mouse
gggtgcaagaggtgcttacc

SEQ ID NO: 609035 - DNA, 20 bp, mouse
gtcagagccaggcctaagga

SEQ ID NO: 609036 - DNA, 20 bp, mouse
gcagcggcggccgagatacc

SEQ ID NO: 609037 - DNA, 20 bp, mouse
ggctcgggacgcgccagcgg

SEQ ID NO: 609038 - DNA, 20 bp, mouse
gtggagactgcaggcggagc

SEQ ID NO: 609039 - DNA, 20 bp, mouse
ggcgccgcagcccggtatct

SEQ ID NO: 609040 - DNA, 20 bp, mouse
gggggctcgggacgcgccag

SEQ ID NO: 609041 - DNA, 20 bp, mouse
ggcggcgcggcggtacccgg

SEQ ID NO: 609042 - DNA, 20 bp, mouse
ggcgaagcgggcacacccac

SEQ ID NO: 609043 - DNA, 20 bp, mouse
gcggccgagataccgggctg

SEQ ID NO: 609044 - DNA, 20 bp, mouse
gtccgccgcccgggtacctc

SEQ ID NO: 609045 - DNA, 20 bp, mouse
ggcggtacccggcggggctc

SEQ ID NO: 609046 - DNA, 20 bp, mouse
ggcctgccagagctggacta

SEQ ID NO: 609047 - DNA, 20 bp, mouse
ggactagggagagggctggt

SEQ ID NO: 609048 - DNA, 20 bp, mouse
gccagagctggactagggag

SEQ ID NO: 609049 - DNA, 20 bp, mouse
ggctggactagggagagggc

SEQ ID NO: 609050 - DNA, 20 bp, mouse
gtctgggccgggtcttccgg

SEQ ID NO: 609051 - DNA, 20 bp, mouse
gggactatcagggtaaacta

SEQ ID NO: 609052 - DNA, 20 bp, mouse
ggtgaccccgaggactatca

SEQ ID NO: 609053 - DNA, 20 bp, mouse
gctggtagggtaccagatgc

SEQ ID NO: 609054 - DNA, 20 bp, mouse
gagggtaaactagggattct

SEQ ID NO: 609055 - DNA, 20 bp, mouse
gccgtgagtgaggaagttct

SEQ ID NO: 609056 - DNA, 20 bp, mouse
gcaggcggcgggctcatggt

SEQ ID NO: 609057 - DNA, 20 bp, mouse
ggcgtgcgtcctgtagcagg

SEQ ID NO: 609058 - DNA, 20 bp, mouse
gcgggtgtgtacgtacgaag

SEQ ID NO: 609059 - DNA, 20 bp, mouse
gtgagcccgccgcctgctac

SEQ ID NO: 609060 - DNA, 20 bp, mouse
gccccggtcgggtctaggac

SEQ ID NO: 609061 - DNA, 20 bp, mouse
gcctagacccgaccggggac

SEQ ID NO: 609062 - DNA, 20 bp, mouse
gtgcgtcctgtagcaggcgg

SEQ ID NO: 609063 - DNA, 20 bp, mouse
gttgtcaccggaaagttgaa

SEQ ID NO: 609064 - DNA, 20 bp, mouse
ggccagtcctagacccgacc

SEQ ID NO: 609065 - DNA, 20 bp, mouse
gactggcaggcaggacgcct

SEQ ID NO: 609066 - DNA, 20 bp, mouse
gcaggcagagcgcagcgggc

SEQ ID NO: 609067 - DNA, 20 bp, mouse
gggatccagagggctcagat

SEQ ID NO: 609068 - DNA, 20 bp, mouse
ggcgccggccggtcattggg

SEQ ID NO: 609069 - DNA, 20 bp, mouse
gggcggcggccgcggaaccg

SEQ ID NO: 609070 - DNA, 20 bp, mouse
gtgcgctctgcctgcagcgg

SEQ ID NO: 609071 - DNA, 20 bp, mouse
ggccgggcgacgggccatgg

SEQ ID NO: 609072 - DNA, 20 bp, mouse
gggagggcctgcgatctgat

SEQ ID NO: 609073 - DNA, 20 bp, mouse
ggccccgaccgaaccccagg

SEQ ID NO: 609074 - DNA, 20 bp, mouse
ggccaggtaggacggatgga

SEQ ID NO: 609075 - DNA, 20 bp, mouse
gtgatatcgccgcggttccg

SEQ ID NO: 609076 - DNA, 20 bp, mouse
gaaggtgctggagctgacgg

SEQ ID NO: 609077 - DNA, 20 bp, mouse
ggagcgacgagtacaagatg

SEQ ID NO: 609078 - DNA, 20 bp, mouse
gcgacgccgagcggcagcag

SEQ ID NO: 609079 - DNA, 20 bp, mouse
ggctgacggcggagaacgag

SEQ ID NO: 609080 - DNA, 20 bp, mouse
ggcgcatcttggccttgtcg

SEQ ID NO: 609081 - DNA, 20 bp, mouse
ggccaaggccaagaagacgg

SEQ ID NO: 609082 - DNA, 20 bp, mouse
gaacctggagacgcagcaca

SEQ ID NO: 609083 - DNA, 20 bp, mouse
gaaggccaagatgcgcaacc

SEQ ID NO: 609084 - DNA, 20 bp, mouse
ggctaccaggcgacgccgag

SEQ ID NO: 609085 - DNA, 20 bp, mouse
gcaccttgtgctgcgtctcc

SEQ ID NO: 609086 - DNA, 20 bp, mouse
ggtgcagggaggatgcacag

SEQ ID NO: 609087 - DNA, 20 bp, mouse
gacccgccaggccagcaggg

SEQ ID NO: 609088 - DNA, 20 bp, mouse
gcgccgcccttggaaaaaga

SEQ ID NO: 609089 - DNA, 20 bp, mouse
gccttccgggtccctctagg

SEQ ID NO: 609090 - DNA, 20 bp, mouse
ggatgcacagaggacccgcc

SEQ ID NO: 609091 - DNA, 20 bp, mouse
gagctacgagcacctgaggg

SEQ ID NO: 609092 - DNA, 20 bp, mouse
gcagcgctccggctcgaccc

SEQ ID NO: 609093 - DNA, 20 bp, mouse
gcttggaaaaagaaggtgca

SEQ ID NO: 609094 - DNA, 20 bp, mouse
gccctctaggtgggagctgc

SEQ ID NO: 609095 - DNA, 20 bp, mouse
gtagagctacgagcacctga

SEQ ID NO: 609096 - DNA, 20 bp, mouse
gtctggggaggtaacatggt

SEQ ID NO: 609097 - DNA, 20 bp, mouse
ggaggtctggggaggtaaca

SEQ ID NO: 609098 - DNA, 20 bp, mouse
gtgcagggctcagtaggtga

SEQ ID NO: 609099 - DNA, 20 bp, mouse
gagctggagggtagaccctt

SEQ ID NO: 609100 - DNA, 20 bp, mouse
gtggctcttacttactccat

SEQ ID NO: 609101 - DNA, 20 bp, mouse
gtcagtaggtgagggtactg

SEQ ID NO: 609102 - DNA, 20 bp, mouse
ggaggtaacatggtggggtc

SEQ ID NO: 609103 - DNA, 20 bp, mouse
ggggtctgggatctcagctt

SEQ ID NO: 609104 - DNA, 20 bp, mouse
ggtgatgttgggagattgtg

SEQ ID NO: 609105 - DNA, 20 bp, mouse
gtactgagccctgcatcagc

SEQ ID NO: 609106 - DNA, 20 bp, mouse
gtgcagaaggacaaccgaga

SEQ ID NO: 609107 - DNA, 20 bp, mouse
gcaaccgagatggccgcctg

SEQ ID NO: 609108 - DNA, 20 bp, mouse
gtgctcctgcggctcagtca

SEQ ID NO: 609109 - DNA, 20 bp, mouse
gacccaggcggtggaggtcg

SEQ ID NO: 609110 - DNA, 20 bp, mouse
ggctagaagagctggtgcgt

SEQ ID NO: 609111 - DNA, 20 bp, mouse
gtccgctgcaggctacacgg

SEQ ID NO: 609112 - DNA, 20 bp, mouse
gaggcagtgggaccctagtc

SEQ ID NO: 609113 - DNA, 20 bp, mouse
gcaggcggtggaggtcgggg

SEQ ID NO: 609114 - DNA, 20 bp, mouse
ggcgtgcggagcgggctcgt

SEQ ID NO: 609115 - DNA, 20 bp, mouse
gttctagctcctgcttccgc

SEQ ID NO: 609116 - DNA, 20 bp, mouse
gggggcgcgcaggtcctagt

SEQ ID NO: 609117 - DNA, 20 bp, mouse
gtagtaggtgcgactgtccc

SEQ ID NO: 609118 - DNA, 20 bp, mouse
ggacctctccaccagcgccc

SEQ ID NO: 609119 - DNA, 20 bp, mouse
gccgcgacggcgggtcatgg

SEQ ID NO: 609120 - DNA, 20 bp, mouse
gaccagcgcccgggcgccga

SEQ ID NO: 609121 - DNA, 20 bp, mouse
gtggagaggtcaggctggcg

SEQ ID NO: 609122 - DNA, 20 bp, mouse
gagtgggtgtgtccgaggcg

SEQ ID NO: 609123 - DNA, 20 bp, mouse
gcgcagagtgggtgtgtccg

SEQ ID NO: 609124 - DNA, 20 bp, mouse
gtgcgactgtcccgggccgt

SEQ ID NO: 609125 - DNA, 20 bp, mouse
gcgcagcggctcgaccatcg

SEQ ID NO: 609126 - DNA, 20 bp, mouse
gaggcggtgtgaggcatcca

SEQ ID NO: 609127 - DNA, 20 bp, mouse
ggcgggaggaatcaaagtgt

SEQ ID NO: 609128 - DNA, 20 bp, mouse
gcggtgtgaggcatccatgg

SEQ ID NO: 609129 - DNA, 20 bp, mouse
gggaggggcacgcgaggagg

SEQ ID NO: 609130 - DNA, 20 bp, mouse
ggtgaggcatccatggcggg

SEQ ID NO: 609131 - DNA, 20 bp, mouse
gccccggccccccagcaccg

SEQ ID NO: 609132 - DNA, 20 bp, mouse
gatcaaagtgtcggtgtggt

SEQ ID NO: 609133 - DNA, 20 bp, mouse
gtgaggaggggcacgcgagg

SEQ ID NO: 609134 - DNA, 20 bp, mouse
gcgttcggagacagttgctg

SEQ ID NO: 609135 - DNA, 20 bp, mouse
gagtaacgggccgcaccctc

SEQ ID NO: 609136 - DNA, 20 bp, mouse
ggcaccagccaccacaacct

SEQ ID NO: 609137 - DNA, 20 bp, mouse
gagcatcgcggccagagcgg

SEQ ID NO: 609138 - DNA, 20 bp, mouse
ggcggccagagcggcggaag

SEQ ID NO: 609139 - DNA, 20 bp, mouse
gcgcgatgctgcctaggttg

SEQ ID NO: 609140 - DNA, 20 bp, mouse
gggcgcagcggaccaagagc

SEQ ID NO: 609141 - DNA, 20 bp, mouse
gatccgatgcccgcagacag

SEQ ID NO: 609142 - DNA, 20 bp, mouse
gcagctgtgcggttgtccag

SEQ ID NO: 609143 - DNA, 20 bp, mouse
gtctggccgcgatgctgcct

SEQ ID NO: 609144 - DNA, 20 bp, mouse
gagcggcggaagtggcgcag

SEQ ID NO: 609145 - DNA, 20 bp, mouse
gagcgcggtgcacgacgagg

SEQ ID NO: 609146 - DNA, 20 bp, mouse
gtggagaacggactctggat

SEQ ID NO: 609147 - DNA, 20 bp, mouse
gcagagacacggcagaactc

SEQ ID NO: 609148 - DNA, 20 bp, mouse
gtggactgcgcctccgacac

SEQ ID NO: 609149 - DNA, 20 bp, mouse
gtcggaagccttgccagtgt

SEQ ID NO: 609150 - DNA, 20 bp, mouse
ggaagccttgccagtgtcgg

SEQ ID NO: 609151 - DNA, 20 bp, mouse
gtgcgcctccgacactggca

SEQ ID NO: 609152 - DNA, 20 bp, mouse
gcccgtggcgggttcacaca

SEQ ID NO: 609153 - DNA, 20 bp, mouse
ggtgtccagcgtggccgtgg

SEQ ID NO: 609154 - DNA, 20 bp, mouse
ggttcctccgccaggaagaa

SEQ ID NO: 609155 - DNA, 20 bp, mouse
ggcaccagcggccagatcat

SEQ ID NO: 609156 - DNA, 20 bp, mouse
gtgagtgacgtcaggagcag

SEQ ID NO: 609157 - DNA, 20 bp, mouse
gaaggccgccagcgggctca

SEQ ID NO: 609158 - DNA, 20 bp, mouse
gcatgccctgagcccgctgg

SEQ ID NO: 609159 - DNA, 20 bp, mouse
gtgacgtcaggagcagaggc

SEQ ID NO: 609160 - DNA, 20 bp, mouse
gagctgtccatcagcaccaa

SEQ ID NO: 609161 - DNA, 20 bp, mouse
ggtgcaccctgagtgacgtc

SEQ ID NO: 609162 - DNA, 20 bp, mouse
ggggaaaggagcaggagctc

SEQ ID NO: 609163 - DNA, 20 bp, mouse
gcggggttgtaggacaccag

SEQ ID NO: 609164 - DNA, 20 bp, mouse
gcagaggctctgactgactg

SEQ ID NO: 609165 - DNA, 20 bp, mouse
gccccatgccctgagcccgc

SEQ ID NO: 609166 - DNA, 20 bp, mouse
gtggccgcaggcaccccctt

SEQ ID NO: 609167 - DNA, 20 bp, mouse
gagagcacagtagcccaagg

SEQ ID NO: 609168 - DNA, 20 bp, mouse
ggaggtcctaggcacacggg

SEQ ID NO: 609169 - DNA, 20 bp, mouse
gccagaggtcctaggcacac

SEQ ID NO: 609170 - DNA, 20 bp, mouse
gaaggactggagacctcccg

SEQ ID NO: 609171 - DNA, 20 bp, mouse
ggattgagaagagccccggg

SEQ ID NO: 609172 - DNA, 20 bp, mouse
gcgcaaaacaaggagagacc

SEQ ID NO: 609173 - DNA, 20 bp, mouse
gtaattgcatttagctccct

SEQ ID NO: 609174 - DNA, 20 bp, mouse
gagcctcagtaccctaaaga

SEQ ID NO: 609175 - DNA, 20 bp, mouse
gctccgacttgcctgagttt

SEQ ID NO: 609176 - DNA, 20 bp, mouse
gtcctggcggagaactggaa

SEQ ID NO: 609177 - DNA, 20 bp, mouse
gatcacctgatcagagcgtg

SEQ ID NO: 609178 - DNA, 20 bp, mouse
gttgcttgccggcgaacgac

SEQ ID NO: 609179 - DNA, 20 bp, mouse
gctgggcacgcagcttccgg

SEQ ID NO: 609180 - DNA, 20 bp, mouse
gtacatccggcgcctgtgag

SEQ ID NO: 609181 - DNA, 20 bp, mouse
ggcgcgaaccagtcgttcgc

SEQ ID NO: 609182 - DNA, 20 bp, mouse
gcaggtgctgatgcagatct

SEQ ID NO: 609183 - DNA, 20 bp, mouse
gttcgcgctttgggtcctgg

SEQ ID NO: 609184 - DNA, 20 bp, mouse
gtggttcgcgctttgggtcc

SEQ ID NO: 609185 - DNA, 20 bp, mouse
gtggcgtcttccttgcttgc

SEQ ID NO: 609186 - DNA, 20 bp, mouse
gtggccggaggctgattaga

SEQ ID NO: 609187 - DNA, 20 bp, mouse
ggagggaccctagcgagccg

SEQ ID NO: 609188 - DNA, 20 bp, mouse
gtgcggctccgagacaatag

SEQ ID NO: 609189 - DNA, 20 bp, mouse
ggccgcgcaggtccccggtt

SEQ ID NO: 609190 - DNA, 20 bp, mouse
gagccgagccggcgcttgtg

SEQ ID NO: 609191 - DNA, 20 bp, mouse
ggccggaggagaagcagtcg

SEQ ID NO: 609192 - DNA, 20 bp, mouse
gcgggcgccgcggctcgcta

SEQ ID NO: 609193 - DNA, 20 bp, mouse
gggtccctctaatcagcctc

SEQ ID NO: 609194 - DNA, 20 bp, mouse
gcgcggcgcccgccgaaccg

SEQ ID NO: 609195 - DNA, 20 bp, mouse
ggctgccgctctgaattcag

SEQ ID NO: 609196 - DNA, 20 bp, mouse
gaagaactggggatccccgg

SEQ ID NO: 609197 - DNA, 20 bp, mouse
gtcggacgcgagttccagaa

SEQ ID NO: 609198 - DNA, 20 bp, mouse
gcgaggggcgtggaaccgag

SEQ ID NO: 609199 - DNA, 20 bp, mouse
gccgccaagaggaggatcgg

SEQ ID NO: 609200 - DNA, 20 bp, mouse
ggaaaatacagagtccgccg

SEQ ID NO: 609201 - DNA, 20 bp, mouse
gagttcttattgagacagga

SEQ ID NO: 609202 - DNA, 20 bp, mouse
gttctggaagaaggatccat

SEQ ID NO: 609203 - DNA, 20 bp, mouse
gtcatctgaaggccagcggg

SEQ ID NO: 609204 - DNA, 20 bp, mouse
gcgtggaaccgaggggccta

SEQ ID NO: 609205 - DNA, 20 bp, mouse
gttattgagacaggaggggc

SEQ ID NO: 609206 - DNA, 20 bp, mouse
gcggggctcgggtgcagccg

SEQ ID NO: 609207 - DNA, 20 bp, mouse
gcggagctgggagccagcgt

SEQ ID NO: 609208 - DNA, 20 bp, mouse
ggccgagcccgcacccgcag

SEQ ID NO: 609209 - DNA, 20 bp, mouse
gcggccccgggaaaatccgg

SEQ ID NO: 609210 - DNA, 20 bp, mouse
gaggcagacactgacccgac

SEQ ID NO: 609211 - DNA, 20 bp, mouse
ggcgcgcgcaggagccccga

SEQ ID NO: 609212 - DNA, 20 bp, mouse
gcagagcgcgcgcaggctgc

SEQ ID NO: 609213 - DNA, 20 bp, mouse
gcgcgggcggtgcgcaggga

SEQ ID NO: 609214 - DNA, 20 bp, mouse
ggcgccgcgaacgcccccga

SEQ ID NO: 609215 - DNA, 20 bp, mouse
gcgttggccgggcccgcggg

SEQ ID NO: 609216 - DNA, 20 bp, mouse
gggtggagttgagcccgcgg

SEQ ID NO: 609217 - DNA, 20 bp, mouse
ggagcgcgcggccgcagggt

SEQ ID NO: 609218 - DNA, 20 bp, mouse
gcgggctcaactccacccgg

SEQ ID NO: 609219 - DNA, 20 bp, mouse
gagaccggagccatgacaca

SEQ ID NO: 609220 - DNA, 20 bp, mouse
ggggtcggcagtgtgcgcag

SEQ ID NO: 609221 - DNA, 20 bp, mouse
ggcagtgtgcgcagcgggag

SEQ ID NO: 609222 - DNA, 20 bp, mouse
gggaggggaccgtggcaaca

SEQ ID NO: 609223 - DNA, 20 bp, mouse
gctggagcccttcttccctc

SEQ ID NO: 609224 - DNA, 20 bp, mouse
gggacaggagggctagtgaa

SEQ ID NO: 609225 - DNA, 20 bp, mouse
gcgccgcagccacacaaaag

SEQ ID NO: 609226 - DNA, 20 bp, mouse
ggcttccgggccgagtcggt

SEQ ID NO: 609227 - DNA, 20 bp, mouse
gtcggcccggaagccatgga

SEQ ID NO: 609228 - DNA, 20 bp, mouse
ggctcgcgccggctacaaag

SEQ ID NO: 609229 - DNA, 20 bp, mouse
gtacaaagcggcgaaggtca

SEQ ID NO: 609230 - DNA, 20 bp, mouse
gggccacggcggagtcctag

SEQ ID NO: 609231 - DNA, 20 bp, mouse
ggggccgagtcggtgggcaa

SEQ ID NO: 609232 - DNA, 20 bp, mouse
gcgactcggcccggaagcca

SEQ ID NO: 609233 - DNA, 20 bp, mouse
gcaggagcacgggcctcgaa

SEQ ID NO: 609234 - DNA, 20 bp, mouse
gcacggcggagtcctagggg

SEQ ID NO: 609235 - DNA, 20 bp, mouse
gcgcccccgcgaggccacgg

SEQ ID NO: 609236 - DNA, 20 bp, mouse
gagtgttgagacaaattccg

SEQ ID NO: 609237 - DNA, 20 bp, mouse
gggcagttagaaagttgaac

SEQ ID NO: 609238 - DNA, 20 bp, mouse
gatgacctcaggactgtaaa

SEQ ID NO: 609239 - DNA, 20 bp, mouse
gctgaggtcatcaaaataaa

SEQ ID NO: 609240 - DNA, 20 bp, mouse
ggggggacctgagataccaa

SEQ ID NO: 609241 - DNA, 20 bp, mouse
gtatcggagtagagagagat

SEQ ID NO: 609242 - DNA, 20 bp, mouse
gccttacccgttggtatctc

SEQ ID NO: 609243 - DNA, 20 bp, mouse
gacattgtctccttacccgt

SEQ ID NO: 609244 - DNA, 20 bp, mouse
gtactccgatatccccaggt

SEQ ID NO: 609245 - DNA, 20 bp, mouse
ggagacaatgtagtccatag

SEQ ID NO: 609246 - DNA, 20 bp, mouse
gaccccggacccggaaccgg

SEQ ID NO: 609247 - DNA, 20 bp, mouse
gaccctgaggaccccaaccc

SEQ ID NO: 609248 - DNA, 20 bp, mouse
gccaaccccggacccggaac

SEQ ID NO: 609249 - DNA, 20 bp, mouse
gggaggctagcagaagcccg

SEQ ID NO: 609250 - DNA, 20 bp, mouse
ggatagcatctggacaccac

SEQ ID NO: 609251 - DNA, 20 bp, mouse
gaggaccccaaccccggacc

SEQ ID NO: 609252 - DNA, 20 bp, mouse
gctggggctctgcgaccctg

SEQ ID NO: 609253 - DNA, 20 bp, mouse
gccggcgtccaggccaggtt

SEQ ID NO: 609254 - DNA, 20 bp, mouse
gtgccgccgctgcacacggg

SEQ ID NO: 609255 - DNA, 20 bp, mouse
ggcctccggttccgggtccg

SEQ ID NO: 609256 - DNA, 20 bp, mouse
gcgggaggcaggcacagcgt

SEQ ID NO: 609257 - DNA, 20 bp, mouse
ggcatacacatgcttccttg

SEQ ID NO: 609258 - DNA, 20 bp, mouse
gcaagaggcaggctaagaca

SEQ ID NO: 609259 - DNA, 20 bp, mouse
gaagcagaacgcctgccaca

SEQ ID NO: 609260 - DNA, 20 bp, mouse
gctgtaggcaagaggcactg

SEQ ID NO: 609261 - DNA, 20 bp, mouse
gaaatggacagcaactcggg

SEQ ID NO: 609262 - DNA, 20 bp, mouse
gtatctctgccacaaatggc

SEQ ID NO: 609263 - DNA, 20 bp, mouse
gaggttacgcgcctcagaac

SEQ ID NO: 609264 - DNA, 20 bp, mouse
gtccctgctccaggctcaag

SEQ ID NO: 609265 - DNA, 20 bp, mouse
gttggtatctctgccacaaa

SEQ ID NO: 609266 - DNA, 20 bp, mouse
ggcgtagggaccaagaaccg

SEQ ID NO: 609267 - DNA, 20 bp, mouse
gagcacacgagctcaggcgt

SEQ ID NO: 609268 - DNA, 20 bp, mouse
gaggcaagccggagctgcac

SEQ ID NO: 609269 - DNA, 20 bp, mouse
gccaacggtggggtcagatg

SEQ ID NO: 609270 - DNA, 20 bp, mouse
gcctaagtgggagagtccag

SEQ ID NO: 609271 - DNA, 20 bp, mouse
ggctcgtgtgctccaacggt

SEQ ID NO: 609272 - DNA, 20 bp, mouse
gtggggtgcagtggacattg

SEQ ID NO: 609273 - DNA, 20 bp, mouse
gggcagctccagtgcagctc

SEQ ID NO: 609274 - DNA, 20 bp, mouse
ggactggatgaagtccggag

SEQ ID NO: 609275 - DNA, 20 bp, mouse
gaactgggcaatccctaagt

SEQ ID NO: 609276 - DNA, 20 bp, mouse
gtagtagagcgggcacatct

SEQ ID NO: 609277 - DNA, 20 bp, mouse
ggggaccgcgacgccgcagg

SEQ ID NO: 609278 - DNA, 20 bp, mouse
gggccctctacggctcacca

SEQ ID NO: 609279 - DNA, 20 bp, mouse
gcttgggcggtagactagag

SEQ ID NO: 609280 - DNA, 20 bp, mouse
ggcgtgccgggaccacgcag

SEQ ID NO: 609281 - DNA, 20 bp, mouse
gttggagctcgcgcctcctg

SEQ ID NO: 609282 - DNA, 20 bp, mouse
ggtccctggtgagccgtaga

SEQ ID NO: 609283 - DNA, 20 bp, mouse
gcgggtcttgcttagtagag

SEQ ID NO: 609284 - DNA, 20 bp, mouse
gcgccacgcctggtcttggg

SEQ ID NO: 609285 - DNA, 20 bp, mouse
gcccggtgcaggtggatgat

SEQ ID NO: 609286 - DNA, 20 bp, mouse
gaagatgtacccagatactg

SEQ ID NO: 609287 - DNA, 20 bp, mouse
ggtgagtaagccacagtatc

SEQ ID NO: 609288 - DNA, 20 bp, mouse
gctggaatagtggcaaacac

SEQ ID NO: 609289 - DNA, 20 bp, mouse
gttttggaagcgacacggaa

SEQ ID NO: 609290 - DNA, 20 bp, mouse
gtacgattttggaagcgaca

SEQ ID NO: 609291 - DNA, 20 bp, mouse
gaataactaatataaatcat

SEQ ID NO: 609292 - DNA, 20 bp, mouse
gcaatgattacctggaatag

SEQ ID NO: 609293 - DNA, 20 bp, mouse
gcatcccgcagttacgattt

SEQ ID NO: 609294 - DNA, 20 bp, mouse
gcagtagttaaatcacacaa

SEQ ID NO: 609295 - DNA, 20 bp, mouse
gattgacacaaaaaatacta

SEQ ID NO: 609296 - DNA, 20 bp, mouse
gacacccagccactgaaaca

SEQ ID NO: 609297 - DNA, 20 bp, mouse
gtgtctgctgcgcaccatgg

SEQ ID NO: 609298 - DNA, 20 bp, mouse
gagagaggggcgccacccaa

SEQ ID NO: 609299 - DNA, 20 bp, mouse
gtgaaacaagggcgagtaac

SEQ ID NO: 609300 - DNA, 20 bp, mouse
gaccatggcggtaagggaca

SEQ ID NO: 609301 - DNA, 20 bp, mouse
gtctagcacagtccattggg

SEQ ID NO: 609302 - DNA, 20 bp, mouse
ggccttgtcccttaccgcca

SEQ ID NO: 609303 - DNA, 20 bp, mouse
gggactgtgctagaccgaac

SEQ ID NO: 609304 - DNA, 20 bp, mouse
gagtgcatgtgctgccgatg

SEQ ID NO: 609305 - DNA, 20 bp, mouse
ggacaaggcgtggtctgcac

SEQ ID NO: 609306 - DNA, 20 bp, mouse
gcagggagggaagctctccg

SEQ ID NO: 609307 - DNA, 20 bp, mouse
ggaacatggtgcgtttgggg

SEQ ID NO: 609308 - DNA, 20 bp, mouse
gcgcagaggcaagactaagg

SEQ ID NO: 609309 - DNA, 20 bp, mouse
gcctctgcgcatgtgcagta

SEQ ID NO: 609310 - DNA, 20 bp, mouse
gcgtactgaggtagccaggg

SEQ ID NO: 609311 - DNA, 20 bp, mouse
gcccgcgccaaaactctcct

SEQ ID NO: 609312 - DNA, 20 bp, mouse
gagaggcaagactaaggcgg

SEQ ID NO: 609313 - DNA, 20 bp, mouse
gcatcccctggctgaacctc

SEQ ID NO: 609314 - DNA, 20 bp, mouse
gtttaggtttggaactctga

SEQ ID NO: 609315 - DNA, 20 bp, mouse
gtgaagaacatggtgcgttt

SEQ ID NO: 609316 - DNA, 20 bp, mouse
gcagacatatcaggccaagg

SEQ ID NO: 609317 - DNA, 20 bp, mouse
ggctgggcaggattcaggct

SEQ ID NO: 609318 - DNA, 20 bp, mouse
gacctctagatggaactcat

SEQ ID NO: 609319 - DNA, 20 bp, mouse
gtggctggagggctactggg

SEQ ID NO: 609320 - DNA, 20 bp, mouse
gcatctagaggtgtgtggtg

SEQ ID NO: 609321 - DNA, 20 bp, mouse
ggaagcagggatgagcaaaa

SEQ ID NO: 609322 - DNA, 20 bp, mouse
gggacagacatatcaggcca

SEQ ID NO: 609323 - DNA, 20 bp, mouse
gtccttcaagggccacaggg

SEQ ID NO: 609324 - DNA, 20 bp, mouse
gtggacctgaggtcctccac

SEQ ID NO: 609325 - DNA, 20 bp, mouse
ggcccagctggcagccccct

SEQ ID NO: 609326 - DNA, 20 bp, mouse
gtcactctgggctgacggat

SEQ ID NO: 609327 - DNA, 20 bp, mouse
ggccagagctggatgagggg

SEQ ID NO: 609328 - DNA, 20 bp, mouse
gatcaatagctattcactct

SEQ ID NO: 609329 - DNA, 20 bp, mouse
gcagtctcaaataggatggg

SEQ ID NO: 609330 - DNA, 20 bp, mouse
gtctgggctgacggatgggc

SEQ ID NO: 609331 - DNA, 20 bp, mouse
gctccagtctcaaataggat

SEQ ID NO: 609332 - DNA, 20 bp, mouse
gagatccctggcctacaaca

SEQ ID NO: 609333 - DNA, 20 bp, mouse
gagcagagcagggtcacgtg

SEQ ID NO: 609334 - DNA, 20 bp, mouse
gcaggaaggaaaccttgcac

SEQ ID NO: 609335 - DNA, 20 bp, mouse
ggctattcactctgggctga

SEQ ID NO: 609336 - DNA, 20 bp, mouse
gaggccccccagagtaacca

SEQ ID NO: 609337 - DNA, 20 bp, mouse
ggcaaagagtcaagccgcag

SEQ ID NO: 609338 - DNA, 20 bp, mouse
gggaccctggttactctggg

SEQ ID NO: 609339 - DNA, 20 bp, mouse
gagggcctctaccaggctgc

SEQ ID NO: 609340 - DNA, 20 bp, mouse
gggcaggaccctggttactc

SEQ ID NO: 609341 - DNA, 20 bp, mouse
gtctggaacggggctttggt

SEQ ID NO: 609342 - DNA, 20 bp, mouse
ggcctgtcccatctggaacg

SEQ ID NO: 609343 - DNA, 20 bp, mouse
gttactggaaaactcttaac

SEQ ID NO: 609344 - DNA, 20 bp, mouse
gtacttgttaccaaaacaca

SEQ ID NO: 609345 - DNA, 20 bp, mouse
gatgtttgggaaattctcat

SEQ ID NO: 609346 - DNA, 20 bp, mouse
gttgctgcagaggtgccctg

SEQ ID NO: 609347 - DNA, 20 bp, mouse
ggcagcaacatggcccagtc

SEQ ID NO: 609348 - DNA, 20 bp, mouse
gtcggaggaagacacctgac

SEQ ID NO: 609349 - DNA, 20 bp, mouse
gttgtggcaagggtcaacag

SEQ ID NO: 609350 - DNA, 20 bp, mouse
gaagaggagggcggcctgcg

SEQ ID NO: 609351 - DNA, 20 bp, mouse
gggtcctgcccagaggaaag

SEQ ID NO: 609352 - DNA, 20 bp, mouse
gccgcaggataagtggaagg

SEQ ID NO: 609353 - DNA, 20 bp, mouse
gacctgtaccgcaggataag

SEQ ID NO: 609354 - DNA, 20 bp, mouse
gctgggccatgttgctgcag

SEQ ID NO: 609355 - DNA, 20 bp, mouse
gcagggttggtcctgcccag

SEQ ID NO: 609356 - DNA, 20 bp, mouse
ggtcatggcggccagatcag

SEQ ID NO: 609357 - DNA, 20 bp, mouse
ggccgaaagccgggaggtgg

SEQ ID NO: 609358 - DNA, 20 bp, mouse
gggtggagctgaagtcatgg

SEQ ID NO: 609359 - DNA, 20 bp, mouse
gcggccagatcagcgggtag

SEQ ID NO: 609360 - DNA, 20 bp, mouse
gccagatcagcgggtagcgg

SEQ ID NO: 609361 - DNA, 20 bp, mouse
gctgccccacaggcccaggt

SEQ ID NO: 609362 - DNA, 20 bp, mouse
gaccgcgcggaggttgtccg

SEQ ID NO: 609363 - DNA, 20 bp, mouse
gacctggagcaagcagcggt

SEQ ID NO: 609364 - DNA, 20 bp, mouse
gtggccgggctcccgaggat

SEQ ID NO: 609365 - DNA, 20 bp, mouse
ggagccgggagccgatcctc

SEQ ID NO: 609366 - DNA, 20 bp, mouse
ggctttctggagacactgag

SEQ ID NO: 609367 - DNA, 20 bp, mouse
gagaggtggcaggagccttc

SEQ ID NO: 609368 - DNA, 20 bp, mouse
gatagcaagaaagagttagt

SEQ ID NO: 609369 - DNA, 20 bp, mouse
gaacatgtgtcaaagaagta

SEQ ID NO: 609370 - DNA, 20 bp, mouse
gcaagaaagagttagtgggt

SEQ ID NO: 609371 - DNA, 20 bp, mouse
gctggatggagtgaaagatg

SEQ ID NO: 609372 - DNA, 20 bp, mouse
gatgttggtatgagatagaa

SEQ ID NO: 609373 - DNA, 20 bp, mouse
ggcctgatgacataaatccg

SEQ ID NO: 609374 - DNA, 20 bp, mouse
gtgtgggaggtgaaaccaca

SEQ ID NO: 609375 - DNA, 20 bp, mouse
gaccaggaaaacactgacca

SEQ ID NO: 609376 - DNA, 20 bp, mouse
gcaggtacccgtgggataag

SEQ ID NO: 609377 - DNA, 20 bp, mouse
gccgcgaggtgagactctgg

SEQ ID NO: 609378 - DNA, 20 bp, mouse
ggcgccgcgaggtgagactc

SEQ ID NO: 609379 - DNA, 20 bp, mouse
gtctctgccccttatcccac

SEQ ID NO: 609380 - DNA, 20 bp, mouse
gtttccatggggactgaaca

SEQ ID NO: 609381 - DNA, 20 bp, mouse
ggcagtgtacgcagtttcca

SEQ ID NO: 609382 - DNA, 20 bp, mouse
ggagcggccagaagaccggg

SEQ ID NO: 609383 - DNA, 20 bp, mouse
ggactgaacatggcgccgcg

SEQ ID NO: 609384 - DNA, 20 bp, mouse
gggggctggcaggtacccgt

SEQ ID NO: 609385 - DNA, 20 bp, mouse
gtcaccccgagtgcctgcat

SEQ ID NO: 609386 - DNA, 20 bp, mouse
ggaaagttcctactccccgg

SEQ ID NO: 609387 - DNA, 20 bp, mouse
gcagagaaccaggtactgcg

SEQ ID NO: 609388 - DNA, 20 bp, mouse
gttagatgggcaggaaggcg

SEQ ID NO: 609389 - DNA, 20 bp, mouse
gctgcgaggaagaagtagat

SEQ ID NO: 609390 - DNA, 20 bp, mouse
gggggaggcggggcttagat

SEQ ID NO: 609391 - DNA, 20 bp, mouse
gttctctgcctccggggagt

SEQ ID NO: 609392 - DNA, 20 bp, mouse
gccataagggaacaaggcgg

SEQ ID NO: 609393 - DNA, 20 bp, mouse
gctcacctcaatggcaccca

SEQ ID NO: 609394 - DNA, 20 bp, mouse
ggtcttggtggagaggggta

SEQ ID NO: 609395 - DNA, 20 bp, mouse
gggggcttagatgggcagga

SEQ ID NO: 609396 - DNA, 20 bp, mouse
gagagccgggtgaggaccgg

SEQ ID NO: 609397 - DNA, 20 bp, mouse
ggagagcgaggggtgagtcc

SEQ ID NO: 609398 - DNA, 20 bp, mouse
gtgaaggggacagagagcga

SEQ ID NO: 609399 - DNA, 20 bp, mouse
gcgaggggtgagtcctggtg

SEQ ID NO: 609400 - DNA, 20 bp, mouse
gggtgaggaacctgagagcc

SEQ ID NO: 609401 - DNA, 20 bp, mouse
ggctgcctgcccagtaaaaa

SEQ ID NO: 609402 - DNA, 20 bp, mouse
gcctcaccttccaggcgtct

SEQ ID NO: 609403 - DNA, 20 bp, mouse
ggcgtcctgccctttttact

SEQ ID NO: 609404 - DNA, 20 bp, mouse
ggaggctggccccagacgcc

SEQ ID NO: 609405 - DNA, 20 bp, mouse
gcacctgactgacagaaaga

SEQ ID NO: 609406 - DNA, 20 bp, mouse
gtgcaagcggtgagagctag

SEQ ID NO: 609407 - DNA, 20 bp, mouse
gcggcgccccgtgacgtcat

SEQ ID NO: 609408 - DNA, 20 bp, mouse
gggtgagagctagtggcgaa

SEQ ID NO: 609409 - DNA, 20 bp, mouse
gagagcctgaggggcagtag

SEQ ID NO: 609410 - DNA, 20 bp, mouse
gaagccacccatgacgtcac

SEQ ID NO: 609411 - DNA, 20 bp, mouse
gcgccccgtgacgtcatggg

SEQ ID NO: 609412 - DNA, 20 bp, mouse
ggcatcccttcccgatcaag

SEQ ID NO: 609413 - DNA, 20 bp, mouse
gcagggactcagaagtggta

SEQ ID NO: 609414 - DNA, 20 bp, mouse
ggacgccgcttgatcgggaa

SEQ ID NO: 609415 - DNA, 20 bp, mouse
ggatctgacgccgcttgatc

SEQ ID NO: 609416 - DNA, 20 bp, mouse
gcaggtcatggcgccagcag

SEQ ID NO: 609417 - DNA, 20 bp, mouse
gagcaggacaggccccagag

SEQ ID NO: 609418 - DNA, 20 bp, mouse
gtcctccggcttccaggtca

SEQ ID NO: 609419 - DNA, 20 bp, mouse
gtgcaggcccgccacaagcc

SEQ ID NO: 609420 - DNA, 20 bp, mouse
gctctggccacgcccctctg

SEQ ID NO: 609421 - DNA, 20 bp, mouse
ggagcccaagtagccactgc

SEQ ID NO: 609422 - DNA, 20 bp, mouse
gcgcctgacctgcaccacag

SEQ ID NO: 609423 - DNA, 20 bp, mouse
gtgggctcccggcttgtggc

SEQ ID NO: 609424 - DNA, 20 bp, mouse
gggcgccagcagtggctact

SEQ ID NO: 609425 - DNA, 20 bp, mouse
gctcagggtggagccgaatt

SEQ ID NO: 609426 - DNA, 20 bp, mouse
gccttccccagcacacccgg

SEQ ID NO: 609427 - DNA, 20 bp, mouse
gtcgagtgctggtaccagat

SEQ ID NO: 609428 - DNA, 20 bp, mouse
gtggccgcgatgaccctact

SEQ ID NO: 609429 - DNA, 20 bp, mouse
ggcctcccccgggtgtgctg

SEQ ID NO: 609430 - DNA, 20 bp, mouse
gtccccagcacacccggggg

SEQ ID NO: 609431 - DNA, 20 bp, mouse
ggccagcgcgaccagcaccg

SEQ ID NO: 609432 - DNA, 20 bp, mouse
ggcggccgggatgcccagta

SEQ ID NO: 609433 - DNA, 20 bp, mouse
ggctggtaccagataggtcg

SEQ ID NO: 609434 - DNA, 20 bp, mouse
ggccagtacccgacctccgt

SEQ ID NO: 609435 - DNA, 20 bp, mouse
gaccagcactcgagccccgg

SEQ ID NO: 609436 - DNA, 20 bp, mouse
ggacaacgccaccggacccg

SEQ ID NO: 609437 - DNA, 20 bp, mouse
gtgaagcagtaccacgggtc

SEQ ID NO: 609438 - DNA, 20 bp, mouse
gtgtccacaccacgcagtag

SEQ ID NO: 609439 - DNA, 20 bp, mouse
gaggggaccgcgcacctcat

SEQ ID NO: 609440 - DNA, 20 bp, mouse
ggaagtagaaacgccgacgg

SEQ ID NO: 609441 - DNA, 20 bp, mouse
gggacatgaagcagtaccac

SEQ ID NO: 609442 - DNA, 20 bp, mouse
gtaggtgacgagagctctag

SEQ ID NO: 609443 - DNA, 20 bp, mouse
gctagcctggcccggagtac

SEQ ID NO: 609444 - DNA, 20 bp, mouse
gctcacgtgagcaccgggat

SEQ ID NO: 609445 - DNA, 20 bp, mouse
gcgttgtcatggacgtggag

SEQ ID NO: 609446 - DNA, 20 bp, mouse
gccgcagcacagacaaaagg

SEQ ID NO: 609447 - DNA, 20 bp, mouse
gggtggctgacattccgcag

SEQ ID NO: 609448 - DNA, 20 bp, mouse
gggaccgcagcacagacaaa

SEQ ID NO: 609449 - DNA, 20 bp, mouse
gggcacagacgccaccatgg

SEQ ID NO: 609450 - DNA, 20 bp, mouse
ggaagagcagcacatcccgt

SEQ ID NO: 609451 - DNA, 20 bp, mouse
gcggctcagaggtctggaca

SEQ ID NO: 609452 - DNA, 20 bp, mouse
gggaagtcccgccccggaga

SEQ ID NO: 609453 - DNA, 20 bp, mouse
gcggaagtgcgccgccatgg

SEQ ID NO: 609454 - DNA, 20 bp, mouse
gccgcaggtactcggctcag

SEQ ID NO: 609455 - DNA, 20 bp, mouse
gagacggaagtgcgccgcca

SEQ ID NO: 609456 - DNA, 20 bp, mouse
gtcactgactgcagagatgt

SEQ ID NO: 609457 - DNA, 20 bp, mouse
gatataagaatggtaaaggg

SEQ ID NO: 609458 - DNA, 20 bp, mouse
gactgcagagatgttggcag

SEQ ID NO: 609459 - DNA, 20 bp, mouse
gccagaggagaagaatatgt

SEQ ID NO: 609460 - DNA, 20 bp, mouse
gtttatataagaatggtaaa

SEQ ID NO: 609461 - DNA, 20 bp, mouse
gaacagaagtatggcaccag

SEQ ID NO: 609462 - DNA, 20 bp, mouse
gctatgctatgggaagtggt

SEQ ID NO: 609463 - DNA, 20 bp, mouse
gcagcctggatacttctgtt

SEQ ID NO: 609464 - DNA, 20 bp, mouse
gggactcatcatggaagact

SEQ ID NO: 609465 - DNA, 20 bp, mouse
gtcagagcaacaaactacta

SEQ ID NO: 609466 - DNA, 20 bp, mouse
gggaagagagccgaggctgg

SEQ ID NO: 609467 - DNA, 20 bp, mouse
ggctgtggggaagagagccg

SEQ ID NO: 609468 - DNA, 20 bp, mouse
gcctgagcctgcagcagagg

SEQ ID NO: 609469 - DNA, 20 bp, mouse
gccctgcgcggcctaaggag

SEQ ID NO: 609470 - DNA, 20 bp, mouse
gatggagctgccaccagcct

SEQ ID NO: 609471 - DNA, 20 bp, mouse
ggcaaggggaggcgatgccg

SEQ ID NO: 609472 - DNA, 20 bp, mouse
ggagtggcgcggccgggcaa

SEQ ID NO: 609473 - DNA, 20 bp, mouse
gcgccccgggggacgaggag

SEQ ID NO: 609474 - DNA, 20 bp, mouse
gcaccctggactggagaaga

SEQ ID NO: 609475 - DNA, 20 bp, mouse
ggaggcgatgccggggctgt

SEQ ID NO: 609476 - DNA, 20 bp, mouse
gggaacccagccccaagcgg

SEQ ID NO: 609477 - DNA, 20 bp, mouse
ggggttccgtggggcagcag

SEQ ID NO: 609478 - DNA, 20 bp, mouse
gcacggaacccagccccaag

SEQ ID NO: 609479 - DNA, 20 bp, mouse
gtgcagccgctgctgcccca

SEQ ID NO: 609480 - DNA, 20 bp, mouse
ggccaggagcgcggtctcac

SEQ ID NO: 609481 - DNA, 20 bp, mouse
ggccgcactcacccatagta

SEQ ID NO: 609482 - DNA, 20 bp, mouse
gaggagagcgccccgagtcc

SEQ ID NO: 609483 - DNA, 20 bp, mouse
ggcctctgtgcgggcatcgt

SEQ ID NO: 609484 - DNA, 20 bp, mouse
gtcctccgcgccgggactcg

SEQ ID NO: 609485 - DNA, 20 bp, mouse
gagcagcggctgcagctacc

SEQ ID NO: 609486 - DNA, 20 bp, mouse
gtccaggccatatgtcatgg

SEQ ID NO: 609487 - DNA, 20 bp, mouse
gcaaatggtggacggtgata

SEQ ID NO: 609488 - DNA, 20 bp, mouse
gctttccaggccatatgtca

SEQ ID NO: 609489 - DNA, 20 bp, mouse
gaaaggaagtgcctatgggt

SEQ ID NO: 609490 - DNA, 20 bp, mouse
gcctggatgaaagagtctta

SEQ ID NO: 609491 - DNA, 20 bp, mouse
ggtggacggtgatatggagc

SEQ ID NO: 609492 - DNA, 20 bp, mouse
gtggtggtgcaaatggtgga

SEQ ID NO: 609493 - DNA, 20 bp, mouse
gcagggaaggagccaacatg

SEQ ID NO: 609494 - DNA, 20 bp, mouse
gtatgtgttgtgcctgtgga

SEQ ID NO: 609495 - DNA, 20 bp, mouse
gaaagttcaatcccacccat

SEQ ID NO: 609496 - DNA, 20 bp, mouse
gcttgtgggcccgggagggt

SEQ ID NO: 609497 - DNA, 20 bp, mouse
gggagggtgggcagaaatcg

SEQ ID NO: 609498 - DNA, 20 bp, mouse
ggctcaacagccaagcggaa

SEQ ID NO: 609499 - DNA, 20 bp, mouse
gggctcgctcaacagccaag

SEQ ID NO: 609500 - DNA, 20 bp, mouse
gaacagccaagcggaagggg

SEQ ID NO: 609501 - DNA, 20 bp, mouse
ggggtgggcagaaatcgtgg

SEQ ID NO: 609502 - DNA, 20 bp, mouse
ggtggcagggccaggtctcg

SEQ ID NO: 609503 - DNA, 20 bp, mouse
ggcccacaaggacctaagcg

SEQ ID NO: 609504 - DNA, 20 bp, mouse
gggagacagttagttcacgt

SEQ ID NO: 609505 - DNA, 20 bp, mouse
gggcggcggagggcgacgag

SEQ ID NO: 609506 - DNA, 20 bp, mouse
ggcggtaagcgcgctcgatt

SEQ ID NO: 609507 - DNA, 20 bp, mouse
ggagtctccacggcaaccga

SEQ ID NO: 609508 - DNA, 20 bp, mouse
ggtacagcgccatgagcgca

SEQ ID NO: 609509 - DNA, 20 bp, mouse
gaaccctgcgggagacaagg

SEQ ID NO: 609510 - DNA, 20 bp, mouse
gtctccacggcaaccgacgg

SEQ ID NO: 609511 - DNA, 20 bp, mouse
gtgcgggagacaaggcgggt

SEQ ID NO: 609512 - DNA, 20 bp, mouse
gggagacaaggcgggttggg

SEQ ID NO: 609513 - DNA, 20 bp, mouse
gcaggccggcaatcctaacc

SEQ ID NO: 609514 - DNA, 20 bp, mouse
gcaaaaccctgcgggagaca

SEQ ID NO: 609515 - DNA, 20 bp, mouse
ggtcaacagcaggaagagcg

SEQ ID NO: 609516 - DNA, 20 bp, mouse
ggagcctggcgggagcgctg

SEQ ID NO: 609517 - DNA, 20 bp, mouse
gcccaagtcaccgacaatag

SEQ ID NO: 609518 - DNA, 20 bp, mouse
gaaccagctggagagcctgg

SEQ ID NO: 609519 - DNA, 20 bp, mouse
gcagggcacagactctaatt

SEQ ID NO: 609520 - DNA, 20 bp, mouse
gggagctagcggaagttgca

SEQ ID NO: 609521 - DNA, 20 bp, mouse
gtaattgtagcccctattgt

SEQ ID NO: 609522 - DNA, 20 bp, mouse
gagcatccttagcaaccagc

SEQ ID NO: 609523 - DNA, 20 bp, mouse
gtacgtgtacgaggagaatg

SEQ ID NO: 609524 - DNA, 20 bp, mouse
ggggagagtatagaaggtgg

SEQ ID NO: 609525 - DNA, 20 bp, mouse
gaagaagacggaagacgggg

SEQ ID NO: 609526 - DNA, 20 bp, mouse
ggtcgactcatggcttgcag

SEQ ID NO: 609527 - DNA, 20 bp, mouse
gctttctgctccgggctcaa

SEQ ID NO: 609528 - DNA, 20 bp, mouse
gggctctggctgtcgactca

SEQ ID NO: 609529 - DNA, 20 bp, mouse
ggcagaggactgacctacgc

SEQ ID NO: 609530 - DNA, 20 bp, mouse
gagccatagatagttactgg

SEQ ID NO: 609531 - DNA, 20 bp, mouse
gaagaagcatgggcgatgag

SEQ ID NO: 609532 - DNA, 20 bp, mouse
ggaagtcggtgacaccggga

SEQ ID NO: 609533 - DNA, 20 bp, mouse
gacagaagatgacaagaccg

SEQ ID NO: 609534 - DNA, 20 bp, mouse
ggtctcatctcccttgagcc

SEQ ID NO: 609535 - DNA, 20 bp, mouse
ggaagatgacaagaccgagg

SEQ ID NO: 609536 - DNA, 20 bp, mouse
gctcgctcccggaagtagaa

SEQ ID NO: 609537 - DNA, 20 bp, mouse
gcatggcggcgtcctggggt

SEQ ID NO: 609538 - DNA, 20 bp, mouse
gagcccggcgggaagaggga

SEQ ID NO: 609539 - DNA, 20 bp, mouse
ggggcccggctacccacccc

SEQ ID NO: 609540 - DNA, 20 bp, mouse
gagagctcccgagccagagt

SEQ ID NO: 609541 - DNA, 20 bp, mouse
gagtcggagcccgcggaggt

SEQ ID NO: 609542 - DNA, 20 bp, mouse
gaggaggccggaggaggacc

SEQ ID NO: 609543 - DNA, 20 bp, mouse
gacttccgggagcgagaggg

SEQ ID NO: 609544 - DNA, 20 bp, mouse
gggacgacttccggatgcgg

SEQ ID NO: 609545 - DNA, 20 bp, mouse
ggaagggcctggcgttttca

SEQ ID NO: 609546 - DNA, 20 bp, mouse
gaagctgagtaaggcgccca

SEQ ID NO: 609547 - DNA, 20 bp, mouse
gagcagcgcgaagctgagta

SEQ ID NO: 609548 - DNA, 20 bp, mouse
gagcttcgcgctgctggcag

SEQ ID NO: 609549 - DNA, 20 bp, mouse
gtgctcctgagcgcagccct

SEQ ID NO: 609550 - DNA, 20 bp, mouse
ggcctggctgggaagagtag

SEQ ID NO: 609551 - DNA, 20 bp, mouse
gaggatgtaccagtagtcgc

SEQ ID NO: 609552 - DNA, 20 bp, mouse
gcccagcaatggaactgata

SEQ ID NO: 609553 - DNA, 20 bp, mouse
gggctgtcgccagcgactac

SEQ ID NO: 609554 - DNA, 20 bp, mouse
gggctctggcgcacctgtga

SEQ ID NO: 609555 - DNA, 20 bp, mouse
gtgatagggacggggttagg

SEQ ID NO: 609556 - DNA, 20 bp, mouse
ggccatcctgagaagcagta

SEQ ID NO: 609557 - DNA, 20 bp, mouse
gtccctactgcttctcagga

SEQ ID NO: 609558 - DNA, 20 bp, mouse
gctgtgaacaggggagtgcc

SEQ ID NO: 609559 - DNA, 20 bp, mouse
gcagctccctactgcttctc

SEQ ID NO: 609560 - DNA, 20 bp, mouse
gacaagggtaggaatggaga

SEQ ID NO: 609561 - DNA, 20 bp, mouse
gactacagccacataggcga

SEQ ID NO: 609562 - DNA, 20 bp, mouse
ggtctgaaaggactcactat

SEQ ID NO: 609563 - DNA, 20 bp, mouse
gagttgtcctatacaagaaa

SEQ ID NO: 609564 - DNA, 20 bp, mouse
gattatcacaagggtaggaa

SEQ ID NO: 609565 - DNA, 20 bp, mouse
ggcagcatataaacacacac

SEQ ID NO: 609566 - DNA, 20 bp, mouse
gggtccctggagacgtgatg

SEQ ID NO: 609567 - DNA, 20 bp, mouse
ggccatggcaacgctgacta

SEQ ID NO: 609568 - DNA, 20 bp, mouse
gtgagctctgctgcggtccc

SEQ ID NO: 609569 - DNA, 20 bp, mouse
gaacagctcaaaagtacctg

SEQ ID NO: 609570 - DNA, 20 bp, mouse
gcttccccatcacgtctcca

SEQ ID NO: 609571 - DNA, 20 bp, mouse
gagaggaggatgttccggtg

SEQ ID NO: 609572 - DNA, 20 bp, mouse
gctgcgcgcctgggcaggag

SEQ ID NO: 609573 - DNA, 20 bp, mouse
gccatggcgacgcctccggg

SEQ ID NO: 609574 - DNA, 20 bp, mouse
gagaagaaccgctgaacagg

SEQ ID NO: 609575 - DNA, 20 bp, mouse
gactagggcgcccggatgtt

SEQ ID NO: 609576 - DNA, 20 bp, mouse
ggggccaccgagggccatgg

SEQ ID NO: 609577 - DNA, 20 bp, mouse
gacgcctgcgagccgcacac

SEQ ID NO: 609578 - DNA, 20 bp, mouse
ggccatggcggcagcgtcac

SEQ ID NO: 609579 - DNA, 20 bp, mouse
gggcgggccaccgagggcca

SEQ ID NO: 609580 - DNA, 20 bp, mouse
gctgccgccatggccctcgg

SEQ ID NO: 609581 - DNA, 20 bp, mouse
gacgctgccgccatggccct

SEQ ID NO: 609582 - DNA, 20 bp, mouse
gggcggcggcgggccaccga

SEQ ID NO: 609583 - DNA, 20 bp, mouse
ggcaccccgggacgctgtcg

SEQ ID NO: 609584 - DNA, 20 bp, mouse
gcggcagcgtcaccggtgtg

SEQ ID NO: 609585 - DNA, 20 bp, mouse
gccccgggaagccgcacccc

SEQ ID NO: 609586 - DNA, 20 bp, mouse
gggcagagccacctaagtca

SEQ ID NO: 609587 - DNA, 20 bp, mouse
gaggccagcctagacacaac

SEQ ID NO: 609588 - DNA, 20 bp, mouse
gacaggaagcaccatgactt

SEQ ID NO: 609589 - DNA, 20 bp, mouse
gcttaggtggctctgcccaa

SEQ ID NO: 609590 - DNA, 20 bp, mouse
ggggcctaggacttaccttt

SEQ ID NO: 609591 - DNA, 20 bp, mouse
gctgcccaaaggtaagtcct

SEQ ID NO: 609592 - DNA, 20 bp, mouse
gcgagggagagactgggatc

SEQ ID NO: 609593 - DNA, 20 bp, mouse
ggtcagggggataccagcat

SEQ ID NO: 609594 - DNA, 20 bp, mouse
ggtgatgcagcagccacgag

SEQ ID NO: 609595 - DNA, 20 bp, mouse
gggatgatccaggctgacca

SEQ ID NO: 609596 - DNA, 20 bp, mouse
ggggcgcagggagcaccgga

SEQ ID NO: 609597 - DNA, 20 bp, mouse
gggagcaccggagggcggag

SEQ ID NO: 609598 - DNA, 20 bp, mouse
gcgcagggagcaccggaggg

SEQ ID NO: 609599 - DNA, 20 bp, mouse
gacaggcagccgagatgtgg

SEQ ID NO: 609600 - DNA, 20 bp, mouse
gccctgcgcccggctccctg

SEQ ID NO: 609601 - DNA, 20 bp, mouse
ggcgcagaccgcagggagcc

SEQ ID NO: 609602 - DNA, 20 bp, mouse
ggcgcgagcgctgacctctg

SEQ ID NO: 609603 - DNA, 20 bp, mouse
gagatgtgggggctgacgtg

SEQ ID NO: 609604 - DNA, 20 bp, mouse
gggccgccgcgcagaccgca

SEQ ID NO: 609605 - DNA, 20 bp, mouse
gagggcagcgcaggccgcac

SEQ ID NO: 609606 - DNA, 20 bp, mouse
gagggcggcggagaccgagg

SEQ ID NO: 609607 - DNA, 20 bp, mouse
ggtcagggcggcggagaccg

SEQ ID NO: 609608 - DNA, 20 bp, mouse
ggcagagcgtcgtgtcaggg

SEQ ID NO: 609609 - DNA, 20 bp, mouse
gagcctgtccccgggaagcc

SEQ ID NO: 609610 - DNA, 20 bp, mouse
ggagctgacagatgaacgtg

SEQ ID NO: 609611 - DNA, 20 bp, mouse
ggagcgtcgtgtcagggcgg

SEQ ID NO: 609612 - DNA, 20 bp, mouse
gcggcggagaccgaggtggc

SEQ ID NO: 609613 - DNA, 20 bp, mouse
ggagaccgaggtggctggct

SEQ ID NO: 609614 - DNA, 20 bp, mouse
gtgagcagagcgtcgtgtca

SEQ ID NO: 609615 - DNA, 20 bp, mouse
gcagaaggtgaggccgagca

SEQ ID NO: 609616 - DNA, 20 bp, mouse
gtccccgggcccaggacccg

SEQ ID NO: 609617 - DNA, 20 bp, mouse
gggcccgagtggaagctcaa

SEQ ID NO: 609618 - DNA, 20 bp, mouse
gaccgatcgtccggagaccc

SEQ ID NO: 609619 - DNA, 20 bp, mouse
gtctaattcagaggactccc

SEQ ID NO: 609620 - DNA, 20 bp, mouse
gaatggagacctcgggtcct

SEQ ID NO: 609621 - DNA, 20 bp, mouse
ggcttccactcgggcctctt

SEQ ID NO: 609622 - DNA, 20 bp, mouse
gtgcccaaggagacttcacc

SEQ ID NO: 609623 - DNA, 20 bp, mouse
ggtatggactggagagtaga

SEQ ID NO: 609624 - DNA, 20 bp, mouse
gagtgacatatgggccccac

SEQ ID NO: 609625 - DNA, 20 bp, mouse
ggttaccaaagaggcccgag

SEQ ID NO: 609626 - DNA, 20 bp, mouse
gccgtgcggcgagtcccccc

SEQ ID NO: 609627 - DNA, 20 bp, mouse
gtcccggaccggagagcccg

SEQ ID NO: 609628 - DNA, 20 bp, mouse
gcgacagtggccgcaggtcc

SEQ ID NO: 609629 - DNA, 20 bp, mouse
gctctccggtccgggacctg

SEQ ID NO: 609630 - DNA, 20 bp, mouse
ggcgcggcggatccaggcag

SEQ ID NO: 609631 - DNA, 20 bp, mouse
gctcaggcagccaatcccac

SEQ ID NO: 609632 - DNA, 20 bp, mouse
ggccggacgccggcgccgtg

SEQ ID NO: 609633 - DNA, 20 bp, mouse
gggagctctcagccgagcta

SEQ ID NO: 609634 - DNA, 20 bp, mouse
ggcgcccgcaagccagacct

SEQ ID NO: 609635 - DNA, 20 bp, mouse
gcccgaccggtttgcgacag

SEQ ID NO: 609636 - DNA, 20 bp, mouse
ggaccgcggcggccctgctg

SEQ ID NO: 609637 - DNA, 20 bp, mouse
gcgtagtcggcgaagcagag

SEQ ID NO: 609638 - DNA, 20 bp, mouse
ggaggcgcgatggccgaccg

SEQ ID NO: 609639 - DNA, 20 bp, mouse
gacagcacggcccagagcag

SEQ ID NO: 609640 - DNA, 20 bp, mouse
gcgcctctgcctggaccgag

SEQ ID NO: 609641 - DNA, 20 bp, mouse
ggcgcgatggccgaccgcgg

SEQ ID NO: 609642 - DNA, 20 bp, mouse
gcgcccctcggtccaggcag

SEQ ID NO: 609643 - DNA, 20 bp, mouse
gcgggctgggcgcctcagca

SEQ ID NO: 609644 - DNA, 20 bp, mouse
gtggccggggagagccccgc

SEQ ID NO: 609645 - DNA, 20 bp, mouse
gcgcctcagcagggccgccg

SEQ ID NO: 609646 - DNA, 20 bp, mouse
ggcccgggagccccacacag

SEQ ID NO: 609647 - DNA, 20 bp, mouse
gcggcgacagccaaagagcg

SEQ ID NO: 609648 - DNA, 20 bp, mouse
gcctgccgggcggagagtag

SEQ ID NO: 609649 - DNA, 20 bp, mouse
gctccagcgaaggtgaccgg

SEQ ID NO: 609650 - DNA, 20 bp, mouse
gggtcccgcagggagagcaa

SEQ ID NO: 609651 - DNA, 20 bp, mouse
ggactgcgagtccagcgcag

SEQ ID NO: 609652 - DNA, 20 bp, mouse
ggccgggccgggttgtcacc

SEQ ID NO: 609653 - DNA, 20 bp, mouse
gccggagcgaatgctggagg

SEQ ID NO: 609654 - DNA, 20 bp, mouse
gtgcgtctgtggcaccaggc

SEQ ID NO: 609655 - DNA, 20 bp, mouse
gggagaagcgcgccctcgag

SEQ ID NO: 609656 - DNA, 20 bp, mouse
gtggatggcgatggaggaca

SEQ ID NO: 609657 - DNA, 20 bp, mouse
ggttatctggatggcgatgg

SEQ ID NO: 609658 - DNA, 20 bp, mouse
gaccaccgtgctgcggacca

SEQ ID NO: 609659 - DNA, 20 bp, mouse
ggggccaccttggagagtgt

SEQ ID NO: 609660 - DNA, 20 bp, mouse
gccgcagcacggtggttatc

SEQ ID NO: 609661 - DNA, 20 bp, mouse
ggtggccctggtccgcagca

SEQ ID NO: 609662 - DNA, 20 bp, mouse
gagcacggtggttatctgga

SEQ ID NO: 609663 - DNA, 20 bp, mouse
gctgtcaacaggggccacct

SEQ ID NO: 609664 - DNA, 20 bp, mouse
gaccagttatagggatatag

SEQ ID NO: 609665 - DNA, 20 bp, mouse
gtgtccacagagggaagtaa

SEQ ID NO: 609666 - DNA, 20 bp, mouse
gcaggccagagcgcgccaac

SEQ ID NO: 609667 - DNA, 20 bp, mouse
gcgcggagccggcgtcccgt

SEQ ID NO: 609668 - DNA, 20 bp, mouse
ggacagcgagcggctcctcg

SEQ ID NO: 609669 - DNA, 20 bp, mouse
ggagcgcgccaacgggacgc

SEQ ID NO: 609670 - DNA, 20 bp, mouse
gagtctgcggggcggtgagt

SEQ ID NO: 609671 - DNA, 20 bp, mouse
ggagccgccagtctgcgggg

SEQ ID NO: 609672 - DNA, 20 bp, mouse
gggctcgagccgccagtctg

SEQ ID NO: 609673 - DNA, 20 bp, mouse
ggaagcgacgacccgaagcc

SEQ ID NO: 609674 - DNA, 20 bp, mouse
gccgctcgctgtctccggag

SEQ ID NO: 609675 - DNA, 20 bp, mouse
gggaccgggtcagctaatag

SEQ ID NO: 609676 - DNA, 20 bp, mouse
ggagagcgtcgcggatccga

SEQ ID NO: 609677 - DNA, 20 bp, mouse
ggctggggctcactctggga

SEQ ID NO: 609678 - DNA, 20 bp, mouse
gtgcatggcgagatatggga

SEQ ID NO: 609679 - DNA, 20 bp, mouse
ggcctagcaagagagcgtcg

SEQ ID NO: 609680 - DNA, 20 bp, mouse
ggcccgcagggacttcgaga

SEQ ID NO: 609681 - DNA, 20 bp, mouse
gagtgaaccgggtcaagaga

SEQ ID NO: 609682 - DNA, 20 bp, mouse
gcccacagtggccaagacac

SEQ ID NO: 609683 - DNA, 20 bp, mouse
gagcgcgcggtgacattgag

SEQ ID NO: 609684 - DNA, 20 bp, mouse
gccttcttgagcaattgctg

SEQ ID NO: 609685 - DNA, 20 bp, mouse
gaggatgctccagcgaccct

SEQ ID NO: 609686 - DNA, 20 bp, mouse
ggacaggaaggtgagacccg

SEQ ID NO: 609687 - DNA, 20 bp, mouse
gcgggcgggccactcaggac

SEQ ID NO: 609688 - DNA, 20 bp, mouse
gggtatccgggactgcgagc

SEQ ID NO: 609689 - DNA, 20 bp, mouse
gcagccaagccgagcagccc

SEQ ID NO: 609690 - DNA, 20 bp, mouse
gacggaagctctgaatgcgg

SEQ ID NO: 609691 - DNA, 20 bp, mouse
gactacggctggtcacgcgg

SEQ ID NO: 609692 - DNA, 20 bp, mouse
gggtgagacccggggctgct

SEQ ID NO: 609693 - DNA, 20 bp, mouse
gtccgggactgcgagcgggc

SEQ ID NO: 609694 - DNA, 20 bp, mouse
gctgaagaaggtgagcgcgg

SEQ ID NO: 609695 - DNA, 20 bp, mouse
gtgggtcgcgcagctgaaga

SEQ ID NO: 609696 - DNA, 20 bp, mouse
gaggagtggcaggatcagag

SEQ ID NO: 609697 - DNA, 20 bp, mouse
gcagaggggctccaagaaga

SEQ ID NO: 609698 - DNA, 20 bp, mouse
gctggaagcagaggagtggc

SEQ ID NO: 609699 - DNA, 20 bp, mouse
ggaaggatcacaaaccccat

SEQ ID NO: 609700 - DNA, 20 bp, mouse
ggaggagggagagggcgcac

SEQ ID NO: 609701 - DNA, 20 bp, mouse
gcccatgggcagaagcacgt

SEQ ID NO: 609702 - DNA, 20 bp, mouse
ggcgccctctccctcctcac

SEQ ID NO: 609703 - DNA, 20 bp, mouse
gggtttgtgatccttctgag

SEQ ID NO: 609704 - DNA, 20 bp, mouse
gatcaggaagccggtgagga

SEQ ID NO: 609705 - DNA, 20 bp, mouse
gctccatcttccactcccag

SEQ ID NO: 609706 - DNA, 20 bp, mouse
gtggagtgaccgcttcaggt

SEQ ID NO: 609707 - DNA, 20 bp, mouse
gctgaagcggtcactccaat

SEQ ID NO: 609708 - DNA, 20 bp, mouse
ggggtcacagtactccttag

SEQ ID NO: 609709 - DNA, 20 bp, mouse
gaccttacacctacctgaag

SEQ ID NO: 609710 - DNA, 20 bp, mouse
gcaatgggttgcaactccgc

SEQ ID NO: 609711 - DNA, 20 bp, mouse
gctgtctgctctgagctacc

SEQ ID NO: 609712 - DNA, 20 bp, mouse
gtcaaccctgaattaggagt

SEQ ID NO: 609713 - DNA, 20 bp, mouse
gcctcaccgccagcaccagt

SEQ ID NO: 609714 - DNA, 20 bp, mouse
ggctcgcttgactgtaagag

SEQ ID NO: 609715 - DNA, 20 bp, mouse
gaccgcttcaggtaggtgta

SEQ ID NO: 609716 - DNA, 20 bp, mouse
gcaaatgaggagagcaaatg

SEQ ID NO: 609717 - DNA, 20 bp, mouse
ggaatggctccgcccaaatg

SEQ ID NO: 609718 - DNA, 20 bp, mouse
gatgaggagagcaaatgagg

SEQ ID NO: 609719 - DNA, 20 bp, mouse
gtcagtgagttgagacggtg

SEQ ID NO: 609720 - DNA, 20 bp, mouse
gactaagccagcgctatgaa

SEQ ID NO: 609721 - DNA, 20 bp, mouse
gccgtctcaactcactgaaa

SEQ ID NO: 609722 - DNA, 20 bp, mouse
gcctgtgcaccagacccgga

SEQ ID NO: 609723 - DNA, 20 bp, mouse
gcaagcgcactggctagtca

SEQ ID NO: 609724 - DNA, 20 bp, mouse
gatgcaagtgaccatccggt

SEQ ID NO: 609725 - DNA, 20 bp, mouse
gcagtgcaaggtggcccggg

SEQ ID NO: 609726 - DNA, 20 bp, mouse
gcaaatgaggagagcaaatg

SEQ ID NO: 609727 - DNA, 20 bp, mouse
ggaatggctccgcccaaatg

SEQ ID NO: 609728 - DNA, 20 bp, mouse
gatgaggagagcaaatgagg

SEQ ID NO: 609729 - DNA, 20 bp, mouse
gtcagtgagttgagacggtg

SEQ ID NO: 609730 - DNA, 20 bp, mouse
gactaagccagcgctatgaa

SEQ ID NO: 609731 - DNA, 20 bp, mouse
gccgtctcaactcactgaaa

SEQ ID NO: 609732 - DNA, 20 bp, mouse
gcctgtgcaccagacccgga

SEQ ID NO: 609733 - DNA, 20 bp, mouse
gcaagcgcactggctagtca

SEQ ID NO: 609734 - DNA, 20 bp, mouse
gatgcaagtgaccatccggt

SEQ ID NO: 609735 - DNA, 20 bp, mouse
gcagtgcaaggtggcccggg

SEQ ID NO: 609736 - DNA, 20 bp, mouse
gatgcaagtgaccatccggt

SEQ ID NO: 609737 - DNA, 20 bp, mouse
gtgagaggtgcctcctgcac

SEQ ID NO: 609738 - DNA, 20 bp, mouse
gcaagcgcactggctagtca

SEQ ID NO: 609739 - DNA, 20 bp, mouse
gtgatctggggaccgagtct

SEQ ID NO: 609740 - DNA, 20 bp, mouse
gtcagtgagttgagacggtg

SEQ ID NO: 609741 - DNA, 20 bp, mouse
gccgtctcaactcactgaaa

SEQ ID NO: 609742 - DNA, 20 bp, mouse
gtgggatcgctgcagcgatg

SEQ ID NO: 609743 - DNA, 20 bp, mouse
gaccggaaaagaccgagact

SEQ ID NO: 609744 - DNA, 20 bp, mouse
gtccagcccaggtccacaca

SEQ ID NO: 609745 - DNA, 20 bp, mouse
gaggtctctcgagatggtgg

SEQ ID NO: 609746 - DNA, 20 bp, mouse
gcgctagggaagaccgagag

SEQ ID NO: 609747 - DNA, 20 bp, mouse
gtcagtccctctcagcgcta

SEQ ID NO: 609748 - DNA, 20 bp, mouse
gggcagagtaggatgctctg

SEQ ID NO: 609749 - DNA, 20 bp, mouse
gtgcggggcgccctgagcca

SEQ ID NO: 609750 - DNA, 20 bp, mouse
gactctgccgctgcctctct

SEQ ID NO: 609751 - DNA, 20 bp, mouse
gggtcttccctagcgctgag

SEQ ID NO: 609752 - DNA, 20 bp, mouse
gatgcactccgggctaggta

SEQ ID NO: 609753 - DNA, 20 bp, mouse
gagaggacaggacttaccca

SEQ ID NO: 609754 - DNA, 20 bp, mouse
gcctctgggaggcagcagta

SEQ ID NO: 609755 - DNA, 20 bp, mouse
gagattggagcgccaagcta

SEQ ID NO: 609756 - DNA, 20 bp, mouse
ggtagaggagagcggacaca

SEQ ID NO: 609757 - DNA, 20 bp, mouse
gaagaagcgcggtggagtag

SEQ ID NO: 609758 - DNA, 20 bp, mouse
gagggaaatgaccaaaggag

SEQ ID NO: 609759 - DNA, 20 bp, mouse
ggaggtagaaagaagcgcgg

SEQ ID NO: 609760 - DNA, 20 bp, mouse
ggaagtgccctccactggga

SEQ ID NO: 609761 - DNA, 20 bp, mouse
ggactctgaaacctaatcac

SEQ ID NO: 609762 - DNA, 20 bp, mouse
gctcctcctgcccggtgatt

SEQ ID NO: 609763 - DNA, 20 bp, mouse
gggttagctaagggcatcgt

SEQ ID NO: 609764 - DNA, 20 bp, mouse
ggacaccacaggttagctaa

SEQ ID NO: 609765 - DNA, 20 bp, mouse
gtccccaaattgcctgccag

SEQ ID NO: 609766 - DNA, 20 bp, mouse
gtccggacaaggcacctagg

SEQ ID NO: 609767 - DNA, 20 bp, mouse
gagctccggacaaggcacct

SEQ ID NO: 609768 - DNA, 20 bp, mouse
gggacaaggcacctaggcgg

SEQ ID NO: 609769 - DNA, 20 bp, mouse
gaaggccccagctccggaca

SEQ ID NO: 609770 - DNA, 20 bp, mouse
ggcgtgaccacccacagcta

SEQ ID NO: 609771 - DNA, 20 bp, mouse
gcacagctatggccggggta

SEQ ID NO: 609772 - DNA, 20 bp, mouse
gccgtaggaggccaaaccca

SEQ ID NO: 609773 - DNA, 20 bp, mouse
gctacggggcacacggtcag

SEQ ID NO: 609774 - DNA, 20 bp, mouse
ggcttgttgggtggtcaggg

SEQ ID NO: 609775 - DNA, 20 bp, mouse
gagaccctctcaaaccccag

SEQ ID NO: 609776 - DNA, 20 bp, mouse
gcgccaccggaagaacacgt

SEQ ID NO: 609777 - DNA, 20 bp, mouse
gtatcctgtgcggggcaaaa

SEQ ID NO: 609778 - DNA, 20 bp, mouse
gtcttccggtggcggatcgg

SEQ ID NO: 609779 - DNA, 20 bp, mouse
gggcaaaatggtgagatgat

SEQ ID NO: 609780 - DNA, 20 bp, mouse
gaggcctccgcggaagaacg

SEQ ID NO: 609781 - DNA, 20 bp, mouse
ggtgagatgatgggagttaa

SEQ ID NO: 609782 - DNA, 20 bp, mouse
gtgccgacgtgttcttccgg

SEQ ID NO: 609783 - DNA, 20 bp, mouse
gacacaagagccctaggtcc

SEQ ID NO: 609784 - DNA, 20 bp, mouse
ggagttaacggacagtgctg

SEQ ID NO: 609785 - DNA, 20 bp, mouse
gccgggcacacaagagccct

SEQ ID NO: 609786 - DNA, 20 bp, mouse
gacgcgagcaaaggggcagg

SEQ ID NO: 609787 - DNA, 20 bp, mouse
ggccggacggacgcgagcaa

SEQ ID NO: 609788 - DNA, 20 bp, mouse
gcggacgcgagcaaaggggc

SEQ ID NO: 609789 - DNA, 20 bp, mouse
gcagggcccgggcccaacgg

SEQ ID NO: 609790 - DNA, 20 bp, mouse
ggaggcggcggaaagcaggt

SEQ ID NO: 609791 - DNA, 20 bp, mouse
gtccgtccggcccgcgacgc

SEQ ID NO: 609792 - DNA, 20 bp, mouse
gtctggcccggcgctctcgc

SEQ ID NO: 609793 - DNA, 20 bp, mouse
gggtcgcgcacgttgatgag

SEQ ID NO: 609794 - DNA, 20 bp, mouse
ggccggcgtcgcgggccgga

SEQ ID NO: 609795 - DNA, 20 bp, mouse
gcccagcgtgccccgcgcac

SEQ ID NO: 609796 - DNA, 20 bp, mouse
gccaggagtgggacacccct

SEQ ID NO: 609797 - DNA, 20 bp, mouse
gctggcaatcacagtcccag

SEQ ID NO: 609798 - DNA, 20 bp, mouse
gtgcgccctaccgaccccgt

SEQ ID NO: 609799 - DNA, 20 bp, mouse
gctgggctgaggtggacaca

SEQ ID NO: 609800 - DNA, 20 bp, mouse
gtgtgagcaagaactcgggc

SEQ ID NO: 609801 - DNA, 20 bp, mouse
gccggtctggcagagcgcaa

SEQ ID NO: 609802 - DNA, 20 bp, mouse
gagggtgctgcccacggggt

SEQ ID NO: 609803 - DNA, 20 bp, mouse
gtggagagtgacctgggtga

SEQ ID NO: 609804 - DNA, 20 bp, mouse
gtcccgcgcaagtctccagt

SEQ ID NO: 609805 - DNA, 20 bp, mouse
ggctgcccacggggtcggta

SEQ ID NO: 609806 - DNA, 20 bp, mouse
gggaccgtgacccctcgcag

SEQ ID NO: 609807 - DNA, 20 bp, mouse
gtgtgcgcgcctctcggcca

SEQ ID NO: 609808 - DNA, 20 bp, mouse
gccgaggcggcggcacccgg

SEQ ID NO: 609809 - DNA, 20 bp, mouse
gcgcgcctctcggccaggga

SEQ ID NO: 609810 - DNA, 20 bp, mouse
gcgtcgccatggagacccat

SEQ ID NO: 609811 - DNA, 20 bp, mouse
gcagcggtgcggaccttccc

SEQ ID NO: 609812 - DNA, 20 bp, mouse
ggcggcacccggaggcaggg

SEQ ID NO: 609813 - DNA, 20 bp, mouse
ggcaccgctgcgaggggtca

SEQ ID NO: 609814 - DNA, 20 bp, mouse
ggacctggcgggcgaaggta

SEQ ID NO: 609815 - DNA, 20 bp, mouse
gcgctgcctgggggagactc

SEQ ID NO: 609816 - DNA, 20 bp, mouse
ggctgtggaaacagttgggg

SEQ ID NO: 609817 - DNA, 20 bp, mouse
gctggccaccaaatagacgt

SEQ ID NO: 609818 - DNA, 20 bp, mouse
gtcggtactccccgaaaaag

SEQ ID NO: 609819 - DNA, 20 bp, mouse
gggggcaggagcggaaaact

SEQ ID NO: 609820 - DNA, 20 bp, mouse
ggctgtgcactcttctgaca

SEQ ID NO: 609821 - DNA, 20 bp, mouse
gtacagggccgtgaggggaa

SEQ ID NO: 609822 - DNA, 20 bp, mouse
gaccgctgtggaaacagttg

SEQ ID NO: 609823 - DNA, 20 bp, mouse
gtcgggctctacactcttcg

SEQ ID NO: 609824 - DNA, 20 bp, mouse
gaacggtgcctgggccaggt

SEQ ID NO: 609825 - DNA, 20 bp, mouse
gttacagcatttcaaagtga

SEQ ID NO: 609826 - DNA, 20 bp, mouse
gtcaaggctacgtacctgga

SEQ ID NO: 609827 - DNA, 20 bp, mouse
gcggctctgaaagaatgttg

SEQ ID NO: 609828 - DNA, 20 bp, mouse
gttgtgggcgctctttttcc

SEQ ID NO: 609829 - DNA, 20 bp, mouse
gagcgtgaatagtagtcacc

SEQ ID NO: 609830 - DNA, 20 bp, mouse
ggcaatcggaagggaaaatg

SEQ ID NO: 609831 - DNA, 20 bp, mouse
ggccacatgtccaaagactt

SEQ ID NO: 609832 - DNA, 20 bp, mouse
gaaacagaagacaaactgag

SEQ ID NO: 609833 - DNA, 20 bp, mouse
gtgactcttagcaatcggaa

SEQ ID NO: 609834 - DNA, 20 bp, mouse
gagcttcaaggctacgtacc

SEQ ID NO: 609835 - DNA, 20 bp, mouse
gaaaatgggggtgatttcat

SEQ ID NO: 609836 - DNA, 20 bp, mouse
gccccctgaaatatgttcag

SEQ ID NO: 609837 - DNA, 20 bp, mouse
gcagcagatagtcagcgcgg

SEQ ID NO: 609838 - DNA, 20 bp, mouse
gcagcagcagatagtcagcg

SEQ ID NO: 609839 - DNA, 20 bp, mouse
ggctcgcggccggcccccca

SEQ ID NO: 609840 - DNA, 20 bp, mouse
gaggcaggcgcgaggccgga

SEQ ID NO: 609841 - DNA, 20 bp, mouse
ggcccctgaacatatttcag

SEQ ID NO: 609842 - DNA, 20 bp, mouse
ggcaccgcgcgaggaggtac

SEQ ID NO: 609843 - DNA, 20 bp, mouse
ggttcaggggcgcttggatg

SEQ ID NO: 609844 - DNA, 20 bp, mouse
gaagaagagcagggacgcca

SEQ ID NO: 609845 - DNA, 20 bp, mouse
ggctgctcgctgaccatctg

SEQ ID NO: 609846 - DNA, 20 bp, mouse
ggtacttgcctaagagagta

SEQ ID NO: 609847 - DNA, 20 bp, mouse
gcggatcgccgtactctctt

SEQ ID NO: 609848 - DNA, 20 bp, mouse
gagggtgaggatgggcgttc

SEQ ID NO: 609849 - DNA, 20 bp, mouse
gcggtgagaaggcgggactt

SEQ ID NO: 609850 - DNA, 20 bp, mouse
gttttcgctagggtgaggat

SEQ ID NO: 609851 - DNA, 20 bp, mouse
gggcgttcgggctttcatcg

SEQ ID NO: 609852 - DNA, 20 bp, mouse
gacaaagggcggggtggagt

SEQ ID NO: 609853 - DNA, 20 bp, mouse
gcttcggctgattttcgcta

SEQ ID NO: 609854 - DNA, 20 bp, mouse
gtagatggcaatgttaaccg

SEQ ID NO: 609855 - DNA, 20 bp, mouse
ggctgattttcgctagggtg

SEQ ID NO: 609856 - DNA, 20 bp, mouse
gcgcgggcgggacttaaaag

SEQ ID NO: 609857 - DNA, 20 bp, mouse
gctttgctcaggtttgagtg

SEQ ID NO: 609858 - DNA, 20 bp, mouse
gtggagagccattcaaacaa

SEQ ID NO: 609859 - DNA, 20 bp, mouse
gagcccataagatgaaggct

SEQ ID NO: 609860 - DNA, 20 bp, mouse
gagacaggcacccacatcgg

SEQ ID NO: 609861 - DNA, 20 bp, mouse
gccttcatcttatgggctgt

SEQ ID NO: 609862 - DNA, 20 bp, mouse
gttcccagccttcatcttat

SEQ ID NO: 609863 - DNA, 20 bp, mouse
gaaggctgtgaatatcaaca

SEQ ID NO: 609864 - DNA, 20 bp, mouse
ggtattttttcaaacacata

SEQ ID NO: 609865 - DNA, 20 bp, mouse
ggaggcttcctttgtttgaa

SEQ ID NO: 609866 - DNA, 20 bp, mouse
ggcgtgccgccgaccctgac

SEQ ID NO: 609867 - DNA, 20 bp, mouse
ggactgcgcgtctcctgtca

SEQ ID NO: 609868 - DNA, 20 bp, mouse
ggcgcgtctcctgtcagggt

SEQ ID NO: 609869 - DNA, 20 bp, mouse
gcgtctcctgtcagggtcgg

SEQ ID NO: 609870 - DNA, 20 bp, mouse
gggccgatgatgaagaaggt

SEQ ID NO: 609871 - DNA, 20 bp, mouse
ggtccagctgggccgcccag

SEQ ID NO: 609872 - DNA, 20 bp, mouse
gacccggaggccggataaca

SEQ ID NO: 609873 - DNA, 20 bp, mouse
ggccaccggggaggcggaag

SEQ ID NO: 609874 - DNA, 20 bp, mouse
gccgtgccggccgtgaggat

SEQ ID NO: 609875 - DNA, 20 bp, mouse
gggcggcacgcaagtcccct

SEQ ID NO: 609876 - DNA, 20 bp, mouse
ggaggctcgccgctgatcct

SEQ ID NO: 609877 - DNA, 20 bp, mouse
ggccgtggcgctccaggtca

SEQ ID NO: 609878 - DNA, 20 bp, mouse
gatcctgggttgagagtcgg

SEQ ID NO: 609879 - DNA, 20 bp, mouse
gagtcggcggccgcaggccc

SEQ ID NO: 609880 - DNA, 20 bp, mouse
gggccgccgactctcaaccc

SEQ ID NO: 609881 - DNA, 20 bp, mouse
ggccatgacctggagcgcca

SEQ ID NO: 609882 - DNA, 20 bp, mouse
ggcctcttctactcctccaa

SEQ ID NO: 609883 - DNA, 20 bp, mouse
gagctggagtacgactacac

SEQ ID NO: 609884 - DNA, 20 bp, mouse
gtgagatccccgccatgacc

SEQ ID NO: 609885 - DNA, 20 bp, mouse
ggccgttggaggagtagaag

SEQ ID NO: 609886 - DNA, 20 bp, mouse
gtggtctcacacaagtatag

SEQ ID NO: 609887 - DNA, 20 bp, mouse
gcagaactctactgggacac

SEQ ID NO: 609888 - DNA, 20 bp, mouse
gtggctggactctgcagatt

SEQ ID NO: 609889 - DNA, 20 bp, mouse
gaagagactggtataacctt

SEQ ID NO: 609890 - DNA, 20 bp, mouse
gcaagtccctggtcccatgt

SEQ ID NO: 609891 - DNA, 20 bp, mouse
gccctgacatctcacacagt

SEQ ID NO: 609892 - DNA, 20 bp, mouse
gacaggcagtgtattagtcc

SEQ ID NO: 609893 - DNA, 20 bp, mouse
gttggtcttcagaactctac

SEQ ID NO: 609894 - DNA, 20 bp, mouse
ggccttcttataagacaagg

SEQ ID NO: 609895 - DNA, 20 bp, mouse
ggcaaactacagagtttcac

SEQ ID NO: 609896 - DNA, 20 bp, mouse
gagccgcagaagtcccccta

SEQ ID NO: 609897 - DNA, 20 bp, mouse
gcgcagaagtccccctatgg

SEQ ID NO: 609898 - DNA, 20 bp, mouse
ggagcggggcaggtattacc

SEQ ID NO: 609899 - DNA, 20 bp, mouse
gtctagaaagacccaagcga

SEQ ID NO: 609900 - DNA, 20 bp, mouse
gagcttcggtctggaccgag

SEQ ID NO: 609901 - DNA, 20 bp, mouse
gtattaccgggccgccatag

SEQ ID NO: 609902 - DNA, 20 bp, mouse
ggaccccgaacggcccccaa

SEQ ID NO: 609903 - DNA, 20 bp, mouse
gggctcccgagtgtctccca

SEQ ID NO: 609904 - DNA, 20 bp, mouse
gttagggaggagccgagtgg

SEQ ID NO: 609905 - DNA, 20 bp, mouse
gtccgccatgggagacactc

SEQ ID NO: 609906 - DNA, 20 bp, mouse
gggcgcaggcagttagcaca

SEQ ID NO: 609907 - DNA, 20 bp, mouse
ggagagctagaggcacgctg

SEQ ID NO: 609908 - DNA, 20 bp, mouse
gttagcacagggagagctag

SEQ ID NO: 609909 - DNA, 20 bp, mouse
gagctagaggcacgctgcgg

SEQ ID NO: 609910 - DNA, 20 bp, mouse
gttgcgcagcccggctgtca

SEQ ID NO: 609911 - DNA, 20 bp, mouse
ggccgggctgcgcaaagcag

SEQ ID NO: 609912 - DNA, 20 bp, mouse
gggatgccatggggtcacca

SEQ ID NO: 609913 - DNA, 20 bp, mouse
gggttgtcacaatcccacag

SEQ ID NO: 609914 - DNA, 20 bp, mouse
gtcccccaaccggcatgcag

SEQ ID NO: 609915 - DNA, 20 bp, mouse
gacgaggagcgctccactgt

SEQ ID NO: 609916 - DNA, 20 bp, mouse
gcgtcatgctgcgctctggt

SEQ ID NO: 609917 - DNA, 20 bp, mouse
gcgagtgcgacagctaggcc

SEQ ID NO: 609918 - DNA, 20 bp, mouse
gcggcgcgcaggtaacctga

SEQ ID NO: 609919 - DNA, 20 bp, mouse
gagcgcagcatgacggccat

SEQ ID NO: 609920 - DNA, 20 bp, mouse
ggtgcacgagtgcgacagct

SEQ ID NO: 609921 - DNA, 20 bp, mouse
ggtaacctgagggacccgcg

SEQ ID NO: 609922 - DNA, 20 bp, mouse
gtgcgccccgcgggtccctc

SEQ ID NO: 609923 - DNA, 20 bp, mouse
gggtctctggtgctcatcag

SEQ ID NO: 609924 - DNA, 20 bp, mouse
gggttcctctgagaggtcgg

SEQ ID NO: 609925 - DNA, 20 bp, mouse
ggcacctaggtgcaaagtgg

SEQ ID NO: 609926 - DNA, 20 bp, mouse
gtggcgagggagcattcgtc

SEQ ID NO: 609927 - DNA, 20 bp, mouse
ggggacgcacggggccgggg

SEQ ID NO: 609928 - DNA, 20 bp, mouse
gagcgctgacatcaggtcca

SEQ ID NO: 609929 - DNA, 20 bp, mouse
ggaggcgccctccatcgcca

SEQ ID NO: 609930 - DNA, 20 bp, mouse
gcgcgggacgcacggggccg

SEQ ID NO: 609931 - DNA, 20 bp, mouse
gagatcctggagctggatgg

SEQ ID NO: 609932 - DNA, 20 bp, mouse
gggtcgaaaacagggaagag

SEQ ID NO: 609933 - DNA, 20 bp, mouse
gcaggtgagtcgaggattgt

SEQ ID NO: 609934 - DNA, 20 bp, mouse
gcagcggggcgcgggacgca

SEQ ID NO: 609935 - DNA, 20 bp, mouse
ggcgatggagggcgcctccc

SEQ ID NO: 609936 - DNA, 20 bp, mouse
ggagcacgggactcagacgt

SEQ ID NO: 609937 - DNA, 20 bp, mouse
ggtcgtcatggagtacccgt

SEQ ID NO: 609938 - DNA, 20 bp, mouse
gcagagtcagatcatcccac

SEQ ID NO: 609939 - DNA, 20 bp, mouse
ggcggcagccggttcccctc

SEQ ID NO: 609940 - DNA, 20 bp, mouse
gtcccgtgctcggtactgag

SEQ ID NO: 609941 - DNA, 20 bp, mouse
ggcggcgtcggtagtcgtca

SEQ ID NO: 609942 - DNA, 20 bp, mouse
ggcagccggttcccctccgg

SEQ ID NO: 609943 - DNA, 20 bp, mouse
gcccaccccctccgccggag

SEQ ID NO: 609944 - DNA, 20 bp, mouse
gacccggaccgtgcctccag

SEQ ID NO: 609945 - DNA, 20 bp, mouse
gagcggccaggtgagtgaag

SEQ ID NO: 609946 - DNA, 20 bp, mouse
gcccgggagctgaggagacg

SEQ ID NO: 609947 - DNA, 20 bp, mouse
gtcccgggcgatggaggctg

SEQ ID NO: 609948 - DNA, 20 bp, mouse
gggctgaggatgatgagtct

SEQ ID NO: 609949 - DNA, 20 bp, mouse
ggccacggagagggatccct

SEQ ID NO: 609950 - DNA, 20 bp, mouse
gacggagagggatccctggg

SEQ ID NO: 609951 - DNA, 20 bp, mouse
gatgatgagtcttggtgatg

SEQ ID NO: 609952 - DNA, 20 bp, mouse
gtcctcagcctccatcgccc

SEQ ID NO: 609953 - DNA, 20 bp, mouse
ggccacgtctcctcagctcc

SEQ ID NO: 609954 - DNA, 20 bp, mouse
gctcctcagctcccgggcga

SEQ ID NO: 609955 - DNA, 20 bp, mouse
ggacgcaggcaggatcccac

SEQ ID NO: 609956 - DNA, 20 bp, mouse
ggctcctgcgggcaatatgt

SEQ ID NO: 609957 - DNA, 20 bp, mouse
gaatatgtcggaggcgacgg

SEQ ID NO: 609958 - DNA, 20 bp, mouse
gaggcgacggcggccgagag

SEQ ID NO: 609959 - DNA, 20 bp, mouse
gcctgcgggcaatatgtcgg

SEQ ID NO: 609960 - DNA, 20 bp, mouse
gagcagccggagggagcgtg

SEQ ID NO: 609961 - DNA, 20 bp, mouse
gatattgcccgcaggagctg

SEQ ID NO: 609962 - DNA, 20 bp, mouse
gggcaatatgtcggaggcga

SEQ ID NO: 609963 - DNA, 20 bp, mouse
gggagcgtgcggctgatacc

SEQ ID NO: 609964 - DNA, 20 bp, mouse
gtgatacccggcccgggctg

SEQ ID NO: 609965 - DNA, 20 bp, mouse
gcgccccctcaggaccggag

SEQ ID NO: 609966 - DNA, 20 bp, mouse
gcccattacctggagtccct

SEQ ID NO: 609967 - DNA, 20 bp, mouse
gtgcagctcacatgagccca

SEQ ID NO: 609968 - DNA, 20 bp, mouse
ggcccagggactccaggtaa

SEQ ID NO: 609969 - DNA, 20 bp, mouse
gacatgagcccagggactcc

SEQ ID NO: 609970 - DNA, 20 bp, mouse
gcatgggactggtcaagcag

SEQ ID NO: 609971 - DNA, 20 bp, mouse
gactccaggtaatgggacat

SEQ ID NO: 609972 - DNA, 20 bp, mouse
ggaggggcctcagcaagcca

SEQ ID NO: 609973 - DNA, 20 bp, mouse
ggggcctcagcaagccaggg

SEQ ID NO: 609974 - DNA, 20 bp, mouse
gactggtcaagcaggggtgg

SEQ ID NO: 609975 - DNA, 20 bp, mouse
gtccgttgtggatgacatcg

SEQ ID NO: 609976 - DNA, 20 bp, mouse
gccctcgctgcagagttgat

SEQ ID NO: 609977 - DNA, 20 bp, mouse
gtcgctgcagagttgatagg

SEQ ID NO: 609978 - DNA, 20 bp, mouse
ggcccaccacgagctgacag

SEQ ID NO: 609979 - DNA, 20 bp, mouse
gtctcaccaagagaaaggaa

SEQ ID NO: 609980 - DNA, 20 bp, mouse
gtcctctgtcagctcgtggt

SEQ ID NO: 609981 - DNA, 20 bp, mouse
gtgacatctcaccaagagaa

SEQ ID NO: 609982 - DNA, 20 bp, mouse
gccagcagggttagccgtca

SEQ ID NO: 609983 - DNA, 20 bp, mouse
gagggttagccgtcacggaa

SEQ ID NO: 609984 - DNA, 20 bp, mouse
gcagatcctctgtcagctcg

SEQ ID NO: 609985 - DNA, 20 bp, mouse
gagtggtgggggcttgaaca

SEQ ID NO: 609986 - DNA, 20 bp, mouse
gggagagcgcgctccccccg

SEQ ID NO: 609987 - DNA, 20 bp, mouse
gcccagtcggcgcacgggga

SEQ ID NO: 609988 - DNA, 20 bp, mouse
gggctctgcgttgccacggg

SEQ ID NO: 609989 - DNA, 20 bp, mouse
gagaagtgcaagggcccccg

SEQ ID NO: 609990 - DNA, 20 bp, mouse
gccgccagcctcggccccaa

SEQ ID NO: 609991 - DNA, 20 bp, mouse
ggagcagcgcgcgcatgccg

SEQ ID NO: 609992 - DNA, 20 bp, mouse
ggagggctctgcgttgccac

SEQ ID NO: 609993 - DNA, 20 bp, mouse
ggcctcgtcactccaagtcc

SEQ ID NO: 609994 - DNA, 20 bp, mouse
ggcttgctcctcgtattcgg

SEQ ID NO: 609995 - DNA, 20 bp, mouse
gggtgcagcctccgaatacg

SEQ ID NO: 609996 - DNA, 20 bp, mouse
gggagccttccagagatatc

SEQ ID NO: 609997 - DNA, 20 bp, mouse
gggccctcacctgatatctc

SEQ ID NO: 609998 - DNA, 20 bp, mouse
gtcgaaaacttgacactcgg

SEQ ID NO: 609999 - DNA, 20 bp, mouse
gcgcgaggcacaactacttc

SEQ ID NO: 610000 - DNA, 20 bp, mouse
ggggagcgcgcgaggttcgt

SEQ ID NO: 610001 - DNA, 20 bp, mouse
ggaggtcgtctcaggtgagg

SEQ ID NO: 610002 - DNA, 20 bp, mouse
gagcgcgcgaggttcgtggg

SEQ ID NO: 610003 - DNA, 20 bp, mouse
gttcgaggtcgtctcaggtg

SEQ ID NO: 610004 - DNA, 20 bp, mouse
gttccagagatatcaggtga

SEQ ID NO: 610005 - DNA, 20 bp, mouse
gtcaggtgaggtggtcgtgc

SEQ ID NO: 610006 - DNA, 20 bp, mouse
gtaagcggccgcagacacgg

SEQ ID NO: 610007 - DNA, 20 bp, mouse
gggcgcagcgggcctcatgg

SEQ ID NO: 610008 - DNA, 20 bp, mouse
ggcagacacggcggcacccg

SEQ ID NO: 610009 - DNA, 20 bp, mouse
ggcacccgaggactgcggac

SEQ ID NO: 610010 - DNA, 20 bp, mouse
ggggtaagcggccgcagaca

SEQ ID NO: 610011 - DNA, 20 bp, mouse
gcggccggtccgcagtcctc

SEQ ID NO: 610012 - DNA, 20 bp, mouse
gaggcccgctgcgcccgcca

SEQ ID NO: 610013 - DNA, 20 bp, mouse
gcggcggcacccgaggactg

SEQ ID NO: 610014 - DNA, 20 bp, mouse
gaggcgagcgggtaactcca

SEQ ID NO: 610015 - DNA, 20 bp, mouse
gtaactccacgggtgagtca

SEQ ID NO: 610016 - DNA, 20 bp, mouse
gacgaccggaacgcagaata

SEQ ID NO: 610017 - DNA, 20 bp, mouse
gagagctgcaagacttctcg

SEQ ID NO: 610018 - DNA, 20 bp, mouse
gtccgcgctgggtcttacag

SEQ ID NO: 610019 - DNA, 20 bp, mouse
gagggcagctgcacccactg

SEQ ID NO: 610020 - DNA, 20 bp, mouse
gcgtggaatccaggacctgg

SEQ ID NO: 610021 - DNA, 20 bp, mouse
gacaacttgaggcttaggca

SEQ ID NO: 610022 - DNA, 20 bp, mouse
gcctgcgtcccgccaggtcc

SEQ ID NO: 610023 - DNA, 20 bp, mouse
gtaggaattgggctgacgac

SEQ ID NO: 610024 - DNA, 20 bp, mouse
gcagcgaaccaagcccacca

SEQ ID NO: 610025 - DNA, 20 bp, mouse
gcgcagacaacttgaggctt

SEQ ID NO: 610026 - DNA, 20 bp, mouse
ggcgctagccccctcctcca

SEQ ID NO: 610027 - DNA, 20 bp, mouse
gccccgcagagccccacaat

SEQ ID NO: 610028 - DNA, 20 bp, mouse
gcgggaactttccccggggt

SEQ ID NO: 610029 - DNA, 20 bp, mouse
gcgagcctccgccgaccccg

SEQ ID NO: 610030 - DNA, 20 bp, mouse
gcccacaataggcgaggctg

SEQ ID NO: 610031 - DNA, 20 bp, mouse
gcggtccgggaactttcccc

SEQ ID NO: 610032 - DNA, 20 bp, mouse
gcagagccccacaataggcg

SEQ ID NO: 610033 - DNA, 20 bp, mouse
gagccccctcctccatggca

SEQ ID NO: 610034 - DNA, 20 bp, mouse
gaggctcggccgtgccatgg

SEQ ID NO: 610035 - DNA, 20 bp, mouse
gctggggagccgcgcggtcc

SEQ ID NO: 610036 - DNA, 20 bp, mouse
gctagcaggaggctacgtgg

SEQ ID NO: 610037 - DNA, 20 bp, mouse
gcgggtggcaggcctggaag

SEQ ID NO: 610038 - DNA, 20 bp, mouse
gctgtgctgagaaagtttgt

SEQ ID NO: 610039 - DNA, 20 bp, mouse
gtccaggcctgccacccgca

SEQ ID NO: 610040 - DNA, 20 bp, mouse
gaagtttgtgggcctcttcc

SEQ ID NO: 610041 - DNA, 20 bp, mouse
gtggctagcaggaggctacg

SEQ ID NO: 610042 - DNA, 20 bp, mouse
gtggcctcgcctcacatggg

SEQ ID NO: 610043 - DNA, 20 bp, mouse
gaaaccagatgaagcacatc

SEQ ID NO: 610044 - DNA, 20 bp, mouse
gtccccggcggggcactgac

SEQ ID NO: 610045 - DNA, 20 bp, mouse
gtgactggggttgcagttgg

SEQ ID NO: 610046 - DNA, 20 bp, mouse
gcacctctgaggctcggaag

SEQ ID NO: 610047 - DNA, 20 bp, mouse
gtacctcttccgagcctcag

SEQ ID NO: 610048 - DNA, 20 bp, mouse
gccccgaaggggctaaccaa

SEQ ID NO: 610049 - DNA, 20 bp, mouse
gggctcagggccgggagaaa

SEQ ID NO: 610050 - DNA, 20 bp, mouse
gaggattcccgctgggtcag

SEQ ID NO: 610051 - DNA, 20 bp, mouse
gcagaggagcaactcccggg

SEQ ID NO: 610052 - DNA, 20 bp, mouse
gactactcctagccccgaag

SEQ ID NO: 610053 - DNA, 20 bp, mouse
gcagagggagtctagtacct

SEQ ID NO: 610054 - DNA, 20 bp, mouse
gagaaagggaggcaccacct

SEQ ID NO: 610055 - DNA, 20 bp, mouse
gaagaggtaggattcccgct

SEQ ID NO: 610056 - DNA, 20 bp, mouse
ggggacgcctggccctaagg

SEQ ID NO: 610057 - DNA, 20 bp, mouse
ggcagcggacgacctcctta

SEQ ID NO: 610058 - DNA, 20 bp, mouse
gagggccaggcgtcccagct

SEQ ID NO: 610059 - DNA, 20 bp, mouse
ggccagccgaagccatgccc

SEQ ID NO: 610060 - DNA, 20 bp, mouse
gtcgtttgcgtcgggaaggg

SEQ ID NO: 610061 - DNA, 20 bp, mouse
gagccaggttggccgcgcca

SEQ ID NO: 610062 - DNA, 20 bp, mouse
gttccggcaggactcccaca

SEQ ID NO: 610063 - DNA, 20 bp, mouse
gcaggttggccgcgccaggg

SEQ ID NO: 610064 - DNA, 20 bp, mouse
ggcatggcttcggctggcag

SEQ ID NO: 610065 - DNA, 20 bp, mouse
ggacctcccgaacaggaaag

SEQ ID NO: 610066 - DNA, 20 bp, mouse
ggcagggagggcggcaacct

SEQ ID NO: 610067 - DNA, 20 bp, mouse
gagcgctgaggaccctgtct

SEQ ID NO: 610068 - DNA, 20 bp, mouse
gcgcccgaagaagacgtggt

SEQ ID NO: 610069 - DNA, 20 bp, mouse
ggcggcgcccgaagaagacg

SEQ ID NO: 610070 - DNA, 20 bp, mouse
gacctctcggaactccagga

SEQ ID NO: 610071 - DNA, 20 bp, mouse
ggcgtcctcgcctccgccct

SEQ ID NO: 610072 - DNA, 20 bp, mouse
ggccttcctggagttccgag

SEQ ID NO: 610073 - DNA, 20 bp, mouse
ggaggcagtacagggcgacg

SEQ ID NO: 610074 - DNA, 20 bp, mouse
gcgtcagccgcatcccaccg

SEQ ID NO: 610075 - DNA, 20 bp, mouse
gcggaactccaggaaggcgg

SEQ ID NO: 610076 - DNA, 20 bp, mouse
ggaccggcacatcgacatcc

SEQ ID NO: 610077 - DNA, 20 bp, mouse
ggcgccgcgactcccaactc

SEQ ID NO: 610078 - DNA, 20 bp, mouse
ggacgtgagtgcggacggga

SEQ ID NO: 610079 - DNA, 20 bp, mouse
gcgcatgcgcactgactcgg

SEQ ID NO: 610080 - DNA, 20 bp, mouse
ggacccgccctgcagactgg

SEQ ID NO: 610081 - DNA, 20 bp, mouse
gggtcgcgggatctcagccc

SEQ ID NO: 610082 - DNA, 20 bp, mouse
gcacgtccaagtccggagtt

SEQ ID NO: 610083 - DNA, 20 bp, mouse
ggcggcgcgtttggtagcct

SEQ ID NO: 610084 - DNA, 20 bp, mouse
ggctgggcacgctcatccga

SEQ ID NO: 610085 - DNA, 20 bp, mouse
gccgcactcacgtccaagtc

SEQ ID NO: 610086 - DNA, 20 bp, mouse
ggcaggagcagggacgtcga

SEQ ID NO: 610087 - DNA, 20 bp, mouse
gtcccggactgaggttgatc

SEQ ID NO: 610088 - DNA, 20 bp, mouse
ggcgtctgtccgggaagcag

SEQ ID NO: 610089 - DNA, 20 bp, mouse
gcgagggcgcgcgtctgtcc

SEQ ID NO: 610090 - DNA, 20 bp, mouse
ggcccgatcaacctcagtcc

SEQ ID NO: 610091 - DNA, 20 bp, mouse
gcgaagtctacaccgagccc

SEQ ID NO: 610092 - DNA, 20 bp, mouse
gacctcagtccgggagccgg

SEQ ID NO: 610093 - DNA, 20 bp, mouse
gcgctccttggcaccgacac

SEQ ID NO: 610094 - DNA, 20 bp, mouse
gtgatcgggccgctgcttcc

SEQ ID NO: 610095 - DNA, 20 bp, mouse
gggcgcggcctgaggttctg

SEQ ID NO: 610096 - DNA, 20 bp, mouse
gcgcagcccggggacctctg

SEQ ID NO: 610097 - DNA, 20 bp, mouse
gtgatcgccacagaggtccc

SEQ ID NO: 610098 - DNA, 20 bp, mouse
gcgctggctgatcgccacag

SEQ ID NO: 610099 - DNA, 20 bp, mouse
gggagagggcgcgcagcccg

SEQ ID NO: 610100 - DNA, 20 bp, mouse
ggcacggtagggcccgggtt

SEQ ID NO: 610101 - DNA, 20 bp, mouse
gcgccgaaaagagcacggta

SEQ ID NO: 610102 - DNA, 20 bp, mouse
gacgcacggatacccaaccc

SEQ ID NO: 610103 - DNA, 20 bp, mouse
gggcggagtggagtcccctg

SEQ ID NO: 610104 - DNA, 20 bp, mouse
gccccaccccaggcaatcgc

SEQ ID NO: 610105 - DNA, 20 bp, mouse
gtcgctgctttgggccgcgc

SEQ ID NO: 610106 - DNA, 20 bp, mouse
gcccaacccacctgggacag

SEQ ID NO: 610107 - DNA, 20 bp, mouse
gggggccgtcagccacacag

SEQ ID NO: 610108 - DNA, 20 bp, mouse
gaatgaggcccaacccacct

SEQ ID NO: 610109 - DNA, 20 bp, mouse
gtctaaggaacatggccccg

SEQ ID NO: 610110 - DNA, 20 bp, mouse
gacagcgtcgagggagttgg

SEQ ID NO: 610111 - DNA, 20 bp, mouse
gtcctgcctctgtcccaggt

SEQ ID NO: 610112 - DNA, 20 bp, mouse
ggcgtcacctgtagggacaa

SEQ ID NO: 610113 - DNA, 20 bp, mouse
gtaagtagctgggggccaag

SEQ ID NO: 610114 - DNA, 20 bp, mouse
gcagggcgggaccgaactca

SEQ ID NO: 610115 - DNA, 20 bp, mouse
gtcgctctgtctaaggaaca

SEQ ID NO: 610116 - DNA, 20 bp, mouse
ggaccccgtgaagagaactc

SEQ ID NO: 610117 - DNA, 20 bp, mouse
gtggacctgtaataggtcaa

SEQ ID NO: 610118 - DNA, 20 bp, mouse
gagccagcgggaacaaggag

SEQ ID NO: 610119 - DNA, 20 bp, mouse
gagagacttggacctgtaat

SEQ ID NO: 610120 - DNA, 20 bp, mouse
gcccgtgaagagaactcagg

SEQ ID NO: 610121 - DNA, 20 bp, mouse
ggaaactagttacacactct

SEQ ID NO: 610122 - DNA, 20 bp, mouse
gcagtctataatgagagact

SEQ ID NO: 610123 - DNA, 20 bp, mouse
gcttcacggggtctccacat

SEQ ID NO: 610124 - DNA, 20 bp, mouse
gatgaacacaagaacacatc

SEQ ID NO: 610125 - DNA, 20 bp, mouse
gtccacgtggcacggagcat

SEQ ID NO: 610126 - DNA, 20 bp, mouse
gccctgctggagccagagta

SEQ ID NO: 610127 - DNA, 20 bp, mouse
gaaactgcgggagttccggc

SEQ ID NO: 610128 - DNA, 20 bp, mouse
gccccgccgaggtgaaactg

SEQ ID NO: 610129 - DNA, 20 bp, mouse
gaggtgcgggtcttcagcac

SEQ ID NO: 610130 - DNA, 20 bp, mouse
gaagacccgcaccttcacca

SEQ ID NO: 610131 - DNA, 20 bp, mouse
gggtgaaactgcgggagttc

SEQ ID NO: 610132 - DNA, 20 bp, mouse
gttcagcacaggcctcccgc

SEQ ID NO: 610133 - DNA, 20 bp, mouse
ggccctgcgggacccccgaa

SEQ ID NO: 610134 - DNA, 20 bp, mouse
gggctccagcagggctgatc

SEQ ID NO: 610135 - DNA, 20 bp, mouse
gctggagccagagtatggag

SEQ ID NO: 610136 - DNA, 20 bp, mouse
ggccgggctgggcgactgag

SEQ ID NO: 610137 - DNA, 20 bp, mouse
gtgggcgactgaggggtgca

SEQ ID NO: 610138 - DNA, 20 bp, mouse
ggcgcgcaggacgccgggct

SEQ ID NO: 610139 - DNA, 20 bp, mouse
gcccgcttctaaggaaactt

SEQ ID NO: 610140 - DNA, 20 bp, mouse
gcgccaggagcctgcttggg

SEQ ID NO: 610141 - DNA, 20 bp, mouse
gggccccgcgctggtctcag

SEQ ID NO: 610142 - DNA, 20 bp, mouse
ggcaacgcgcgcaggacgcc

SEQ ID NO: 610143 - DNA, 20 bp, mouse
gtctgcgcataggtgagctg

SEQ ID NO: 610144 - DNA, 20 bp, mouse
gtgggcgggaagaggagcgc

SEQ ID NO: 610145 - DNA, 20 bp, mouse
gctcctcttcccgcccaagc

SEQ ID NO: 610146 - DNA, 20 bp, mouse
ggccctcccggaggccgtag

SEQ ID NO: 610147 - DNA, 20 bp, mouse
gtgcagacaggctttcgggt

SEQ ID NO: 610148 - DNA, 20 bp, mouse
gtgcaggaaagcagccccag

SEQ ID NO: 610149 - DNA, 20 bp, mouse
ggcgggccgcgggttgagct

SEQ ID NO: 610150 - DNA, 20 bp, mouse
gacatcctgggccctcccgg

SEQ ID NO: 610151 - DNA, 20 bp, mouse
gtgcagtcatggctgctgac

SEQ ID NO: 610152 - DNA, 20 bp, mouse
gcctgctgaagtcctctcaa

SEQ ID NO: 610153 - DNA, 20 bp, mouse
ggggcccaggatgtgtcaca

SEQ ID NO: 610154 - DNA, 20 bp, mouse
ggtcacaaggcaggaggcgg

SEQ ID NO: 610155 - DNA, 20 bp, mouse
ggccgctacggcctccggga

SEQ ID NO: 610156 - DNA, 20 bp, mouse
gagggacccggtagcgacgg

SEQ ID NO: 610157 - DNA, 20 bp, mouse
gcttagggacccggtagcga

SEQ ID NO: 610158 - DNA, 20 bp, mouse
gcgagcgggagtcgccatgg

SEQ ID NO: 610159 - DNA, 20 bp, mouse
gcgcaggcgccttagggacc

SEQ ID NO: 610160 - DNA, 20 bp, mouse
ggaccgagcgggagtcgcca

SEQ ID NO: 610161 - DNA, 20 bp, mouse
ggagctggtcgctgaccgag

SEQ ID NO: 610162 - DNA, 20 bp, mouse
gagacctccggcttaccctg

SEQ ID NO: 610163 - DNA, 20 bp, mouse
ggcctgtcacgtgagcgggg

SEQ ID NO: 610164 - DNA, 20 bp, mouse
gcgccctccgcacctccgta

SEQ ID NO: 610165 - DNA, 20 bp, mouse
ggcgcgaccgggcccggtgg

SEQ ID NO: 610166 - DNA, 20 bp, mouse
gggctcgggttaccgcagag

SEQ ID NO: 610167 - DNA, 20 bp, mouse
gcctttaaggagccgctctg

SEQ ID NO: 610168 - DNA, 20 bp, mouse
gagcgccagcccagtccgag

SEQ ID NO: 610169 - DNA, 20 bp, mouse
gtaacccgagcccgcagtcc

SEQ ID NO: 610170 - DNA, 20 bp, mouse
ggccgcgcccgcccggactg

SEQ ID NO: 610171 - DNA, 20 bp, mouse
gggccgcggccgctcggact

SEQ ID NO: 610172 - DNA, 20 bp, mouse
gcccggaggagctgtcgccg

SEQ ID NO: 610173 - DNA, 20 bp, mouse
gccgagcccgcagtccgggc

SEQ ID NO: 610174 - DNA, 20 bp, mouse
gagcggccgcggccccttta

SEQ ID NO: 610175 - DNA, 20 bp, mouse
gagagcgcagcggggctcac

SEQ ID NO: 610176 - DNA, 20 bp, mouse
gcatggagccagcaccgggg

SEQ ID NO: 610177 - DNA, 20 bp, mouse
ggcggccggtcacacagaca

SEQ ID NO: 610178 - DNA, 20 bp, mouse
gggatcaccgagggtatcta

SEQ ID NO: 610179 - DNA, 20 bp, mouse
gagacatggagccagcaccg

SEQ ID NO: 610180 - DNA, 20 bp, mouse
gtctgtgtgaccggccgcag

SEQ ID NO: 610181 - DNA, 20 bp, mouse
gtccgaaggcggaggaggct

SEQ ID NO: 610182 - DNA, 20 bp, mouse
gttgtttccgaaggcggagg

SEQ ID NO: 610183 - DNA, 20 bp, mouse
gtgtgaccggccgcaggggt

SEQ ID NO: 610184 - DNA, 20 bp, mouse
gaggctcggcgcccccctcc

SEQ ID NO: 610185 - DNA, 20 bp, mouse
gagcggaaccggatcaccga

SEQ ID NO: 610186 - DNA, 20 bp, mouse
gcagcggcgggagccccagt

SEQ ID NO: 610187 - DNA, 20 bp, mouse
gggacccaaagcttcccctt

SEQ ID NO: 610188 - DNA, 20 bp, mouse
gtgcacacctacccgaaggt

SEQ ID NO: 610189 - DNA, 20 bp, mouse
gcaagatggcggcgccaaag

SEQ ID NO: 610190 - DNA, 20 bp, mouse
ggccctgcctaccttcgggt

SEQ ID NO: 610191 - DNA, 20 bp, mouse
gggatgaggggaactcggga

SEQ ID NO: 610192 - DNA, 20 bp, mouse
gttgggtccaggcccaactg

SEQ ID NO: 610193 - DNA, 20 bp, mouse
gaggggaactcgggacggat

SEQ ID NO: 610194 - DNA, 20 bp, mouse
gggcgccaaaggggaagctt

SEQ ID NO: 610195 - DNA, 20 bp, mouse
ggtcagcgccggggccctag

SEQ ID NO: 610196 - DNA, 20 bp, mouse
gggcaatgctaccgcagcca

SEQ ID NO: 610197 - DNA, 20 bp, mouse
gcacccggtcccgcatccca

SEQ ID NO: 610198 - DNA, 20 bp, mouse
gcccgagctgcggagcgaag

SEQ ID NO: 610199 - DNA, 20 bp, mouse
ggagtcctctagaaatagtg

SEQ ID NO: 610200 - DNA, 20 bp, mouse
gggccctgggatgcgggacc

SEQ ID NO: 610201 - DNA, 20 bp, mouse
gctcctgcgcaggtaacaga

SEQ ID NO: 610202 - DNA, 20 bp, mouse
gggctgaagatgcgcagcgc

SEQ ID NO: 610203 - DNA, 20 bp, mouse
ggatgcgcagcgcgggccct

SEQ ID NO: 610204 - DNA, 20 bp, mouse
gaggtaacagatggactctc

SEQ ID NO: 610205 - DNA, 20 bp, mouse
gggtgtcgccagcaccaccc

SEQ ID NO: 610206 - DNA, 20 bp, mouse
gcagctgcggctgtttggag

SEQ ID NO: 610207 - DNA, 20 bp, mouse
gggcagcacggacaggacaa

SEQ ID NO: 610208 - DNA, 20 bp, mouse
ggcccgcacgcagcatgaag

SEQ ID NO: 610209 - DNA, 20 bp, mouse
gtgggcggaaccttgaggtg

SEQ ID NO: 610210 - DNA, 20 bp, mouse
gctgcggctgtttggagagg

SEQ ID NO: 610211 - DNA, 20 bp, mouse
gaaggggtgaggtcacccgg

SEQ ID NO: 610212 - DNA, 20 bp, mouse
gggccctcacatgataatta

SEQ ID NO: 610213 - DNA, 20 bp, mouse
ggctggccggagagccgaga

SEQ ID NO: 610214 - DNA, 20 bp, mouse
gacccggaggcagcacggac

SEQ ID NO: 610215 - DNA, 20 bp, mouse
gcgggaacagccccggatgt

SEQ ID NO: 610216 - DNA, 20 bp, mouse
gagaatgctggcggtccggg

SEQ ID NO: 610217 - DNA, 20 bp, mouse
gaggcggcgggaggccacag

SEQ ID NO: 610218 - DNA, 20 bp, mouse
gatgctggcggtccgggtgg

SEQ ID NO: 610219 - DNA, 20 bp, mouse
gtgcgggccggagcgctccg

SEQ ID NO: 610220 - DNA, 20 bp, mouse
ggagatggcgagaatgctgg

SEQ ID NO: 610221 - DNA, 20 bp, mouse
gaacagcagggcggccaccg

SEQ ID NO: 610222 - DNA, 20 bp, mouse
gtagtgctccaacagcaggg

SEQ ID NO: 610223 - DNA, 20 bp, mouse
ggcgagaatgctggcggtcc

SEQ ID NO: 610224 - DNA, 20 bp, mouse
gctccggggctgcgccgaga

SEQ ID NO: 610225 - DNA, 20 bp, mouse
ggccgagatggcgagaatgc

SEQ ID NO: 610226 - DNA, 20 bp, mouse
gcaccccgcctcgccaggta

SEQ ID NO: 610227 - DNA, 20 bp, mouse
gggagtggtcagtccgtacc

SEQ ID NO: 610228 - DNA, 20 bp, mouse
gacggactgaccactccccc

SEQ ID NO: 610229 - DNA, 20 bp, mouse
gccgccgccgcaggtaaagt

SEQ ID NO: 610230 - DNA, 20 bp, mouse
gctggtgacagtagcggggt

SEQ ID NO: 610231 - DNA, 20 bp, mouse
ggtccgtacctggcgaggcg

SEQ ID NO: 610232 - DNA, 20 bp, mouse
gccgcaggtaaagtgggaag

SEQ ID NO: 610233 - DNA, 20 bp, mouse
gggccggcgcgtcctgggag

SEQ ID NO: 610234 - DNA, 20 bp, mouse
gggtcagtccgtacctggcg

SEQ ID NO: 610235 - DNA, 20 bp, mouse
gcagcggcgcggggcttgat

SEQ ID NO: 610236 - DNA, 20 bp, mouse
ggccgggcggctagagctct

SEQ ID NO: 610237 - DNA, 20 bp, mouse
ggccccacgggacccaacgg

SEQ ID NO: 610238 - DNA, 20 bp, mouse
gcgcaggaggtggaagggag

SEQ ID NO: 610239 - DNA, 20 bp, mouse
gacatctggagccccgacag

SEQ ID NO: 610240 - DNA, 20 bp, mouse
ggggacgcgcagctgagtcc

SEQ ID NO: 610241 - DNA, 20 bp, mouse
ggggagggggagtcgccggg

SEQ ID NO: 610242 - DNA, 20 bp, mouse
gagggggagggggagtcgcc

SEQ ID NO: 610243 - DNA, 20 bp, mouse
gggtccgcgtactcacccct

SEQ ID NO: 610244 - DNA, 20 bp, mouse
ggagctctgggctcctgcgg

SEQ ID NO: 610245 - DNA, 20 bp, mouse
gcacctcctgcgggacccag

SEQ ID NO: 610246 - DNA, 20 bp, mouse
gctgagaggagactgcgggt

SEQ ID NO: 610247 - DNA, 20 bp, mouse
gcaggccgctaaaaagaagg

SEQ ID NO: 610248 - DNA, 20 bp, mouse
gtggtaaagccagctccacc

SEQ ID NO: 610249 - DNA, 20 bp, mouse
gctcccgcggtgatgcagag

SEQ ID NO: 610250 - DNA, 20 bp, mouse
gtaccaggccgctaaaaaga

SEQ ID NO: 610251 - DNA, 20 bp, mouse
ggcaaaccgcagccagggag

SEQ ID NO: 610252 - DNA, 20 bp, mouse
ggacgcccgcccactaggaa

SEQ ID NO: 610253 - DNA, 20 bp, mouse
gagaagggatgagagaatcc

SEQ ID NO: 610254 - DNA, 20 bp, mouse
ggccaaggttgactcctact

SEQ ID NO: 610255 - DNA, 20 bp, mouse
gaaggttgactcctactggg

SEQ ID NO: 610256 - DNA, 20 bp, mouse
ggggaacggccggagaaggg

SEQ ID NO: 610257 - DNA, 20 bp, mouse
gtcctctcgcggggagggaa

SEQ ID NO: 610258 - DNA, 20 bp, mouse
gggagggaacggccggagaa

SEQ ID NO: 610259 - DNA, 20 bp, mouse
gggccggagaagggcggcag

SEQ ID NO: 610260 - DNA, 20 bp, mouse
gagactcgaccgactcccgg

SEQ ID NO: 610261 - DNA, 20 bp, mouse
gctcgcggggagggaacggc

SEQ ID NO: 610262 - DNA, 20 bp, mouse
gggctccctgcgtcctctcg

SEQ ID NO: 610263 - DNA, 20 bp, mouse
gggcagcggcggtcgagacg

SEQ ID NO: 610264 - DNA, 20 bp, mouse
gctccccgcgagaggacgca

SEQ ID NO: 610265 - DNA, 20 bp, mouse
gacgcggtcccgccgggagt

SEQ ID NO: 610266 - DNA, 20 bp, mouse
ggcgcctcccggatgaggag

SEQ ID NO: 610267 - DNA, 20 bp, mouse
gcctcccggatgaggagcgg

SEQ ID NO: 610268 - DNA, 20 bp, mouse
ggcgccgccgctcctcatcc

SEQ ID NO: 610269 - DNA, 20 bp, mouse
gacccccgcagcggtcccaa

SEQ ID NO: 610270 - DNA, 20 bp, mouse
gcgcgcgtcaggaggacccg

SEQ ID NO: 610271 - DNA, 20 bp, mouse
gggcgggcgcctcccggatg

SEQ ID NO: 610272 - DNA, 20 bp, mouse
gtcggggcgcagctggacag

SEQ ID NO: 610273 - DNA, 20 bp, mouse
gcggcgtgaggccagagggt

SEQ ID NO: 610274 - DNA, 20 bp, mouse
gacgccggcctcactcggta

SEQ ID NO: 610275 - DNA, 20 bp, mouse
ggcgtcaggaggacccgggg

SEQ ID NO: 610276 - DNA, 20 bp, mouse
ggccgctgcgcagcgaccac

SEQ ID NO: 610277 - DNA, 20 bp, mouse
gtcctgtggtcgctgcgcag

SEQ ID NO: 610278 - DNA, 20 bp, mouse
gcacaggaacccaccataaa

SEQ ID NO: 610279 - DNA, 20 bp, mouse
gaggccgggcacccgcaggg

SEQ ID NO: 610280 - DNA, 20 bp, mouse
gcgagacccgctgcggaagt

SEQ ID NO: 610281 - DNA, 20 bp, mouse
ggtcgcgtcttgctgctgtc

SEQ ID NO: 610282 - DNA, 20 bp, mouse
gaagaggccgggcacccgca

SEQ ID NO: 610283 - DNA, 20 bp, mouse
ggcgtcttgctgctgtcagg

SEQ ID NO: 610284 - DNA, 20 bp, mouse
gaggtggtcccttttatggt

SEQ ID NO: 610285 - DNA, 20 bp, mouse
gagcggcagtgacgtcagat

SEQ ID NO: 610286 - DNA, 20 bp, mouse
gagactgcggacccaggata

SEQ ID NO: 610287 - DNA, 20 bp, mouse
gaccatggtacccatatcct

SEQ ID NO: 610288 - DNA, 20 bp, mouse
gcccctgtggcgccaaccag

SEQ ID NO: 610289 - DNA, 20 bp, mouse
gggccttgtacgcgtcacca

SEQ ID NO: 610290 - DNA, 20 bp, mouse
gacgcgtacaaggcctgtgg

SEQ ID NO: 610291 - DNA, 20 bp, mouse
gaggcctgtggcggccatgg

SEQ ID NO: 610292 - DNA, 20 bp, mouse
gaggtaggcggtgccagtcc

SEQ ID NO: 610293 - DNA, 20 bp, mouse
gcagagaactaagagaaggt

SEQ ID NO: 610294 - DNA, 20 bp, mouse
ggaacgagatctgaccgcca

SEQ ID NO: 610295 - DNA, 20 bp, mouse
gagctggagactgcggaccc

SEQ ID NO: 610296 - DNA, 20 bp, mouse
gccgggagaagcagacacgc

SEQ ID NO: 610297 - DNA, 20 bp, mouse
gggcgacctcggcagctggt

SEQ ID NO: 610298 - DNA, 20 bp, mouse
gcacaggaaatcggcgacct

SEQ ID NO: 610299 - DNA, 20 bp, mouse
ggctggtcggcggcagagcc

SEQ ID NO: 610300 - DNA, 20 bp, mouse
ggcagacacgcgggtagtgc

SEQ ID NO: 610301 - DNA, 20 bp, mouse
gtcaggcagttaaaggaaac

SEQ ID NO: 610302 - DNA, 20 bp, mouse
ggacggtcctacacccaatg

SEQ ID NO: 610303 - DNA, 20 bp, mouse
gcagaggccgggaactagtc

SEQ ID NO: 610304 - DNA, 20 bp, mouse
gtaactgcctgagaggaaga

SEQ ID NO: 610305 - DNA, 20 bp, mouse
gtgccgccgaccagctgccg

SEQ ID NO: 610306 - DNA, 20 bp, mouse
gcgtacttgccaccatcaca

SEQ ID NO: 610307 - DNA, 20 bp, mouse
gtacgtttcagggttgtcaa

SEQ ID NO: 610308 - DNA, 20 bp, mouse
gcttttgcgccgtgtgatgg

SEQ ID NO: 610309 - DNA, 20 bp, mouse
gtggtggcaagtacgtttca

SEQ ID NO: 610310 - DNA, 20 bp, mouse
ggtacactttgggaaggagg

SEQ ID NO: 610311 - DNA, 20 bp, mouse
gggttgtcaagggtacactt

SEQ ID NO: 610312 - DNA, 20 bp, mouse
gggtggtggtggggtcacta

SEQ ID NO: 610313 - DNA, 20 bp, mouse
gtcaagggtacactttggga

SEQ ID NO: 610314 - DNA, 20 bp, mouse
gcaacgcaactaccacaaac

SEQ ID NO: 610315 - DNA, 20 bp, mouse
gggaatgagcgagttggcca

SEQ ID NO: 610316 - DNA, 20 bp, mouse
gagccagagcggctccggag

SEQ ID NO: 610317 - DNA, 20 bp, mouse
gtgctgcgagttggagaagg

SEQ ID NO: 610318 - DNA, 20 bp, mouse
gggccgcagctggaaactga

SEQ ID NO: 610319 - DNA, 20 bp, mouse
gaagcgactccgctcgacag

SEQ ID NO: 610320 - DNA, 20 bp, mouse
ggcatgctgcgagttggaga

SEQ ID NO: 610321 - DNA, 20 bp, mouse
gccgggtggcccgcaagact

SEQ ID NO: 610322 - DNA, 20 bp, mouse
gccaacagcatgctgcgagt

SEQ ID NO: 610323 - DNA, 20 bp, mouse
gctcgctagccgagccagag

SEQ ID NO: 610324 - DNA, 20 bp, mouse
ggagcctcatcgctcttgtg

SEQ ID NO: 610325 - DNA, 20 bp, mouse
gccataggcccgctgcccac

SEQ ID NO: 610326 - DNA, 20 bp, mouse
gagggcaatttggtggtcag

SEQ ID NO: 610327 - DNA, 20 bp, mouse
gagaatagcttgtcattctt

SEQ ID NO: 610328 - DNA, 20 bp, mouse
ggaaatacgaagcttcccag

SEQ ID NO: 610329 - DNA, 20 bp, mouse
gtacgaagcttcccagtggt

SEQ ID NO: 610330 - DNA, 20 bp, mouse
gcagtcggaagaagagcccg

SEQ ID NO: 610331 - DNA, 20 bp, mouse
gtgacaagctattctattct

SEQ ID NO: 610332 - DNA, 20 bp, mouse
gccaaccagaagggaagacg

SEQ ID NO: 610333 - DNA, 20 bp, mouse
gccactttcacagggcaatt

SEQ ID NO: 610334 - DNA, 20 bp, mouse
gccctgcctctagttcggaa

SEQ ID NO: 610335 - DNA, 20 bp, mouse
gttcttgggagttagtctca

SEQ ID NO: 610336 - DNA, 20 bp, mouse
gggccagagctagttcaggg

SEQ ID NO: 610337 - DNA, 20 bp, mouse
gggaggccagagctagttca

SEQ ID NO: 610338 - DNA, 20 bp, mouse
gcacaagcaggaggctgcgg

SEQ ID NO: 610339 - DNA, 20 bp, mouse
gcaaggagttggtagatgag

SEQ ID NO: 610340 - DNA, 20 bp, mouse
ggtctggtgccgatactcag

SEQ ID NO: 610341 - DNA, 20 bp, mouse
ggggcctctgagcaaggagt

SEQ ID NO: 610342 - DNA, 20 bp, mouse
gcgtagcgatgcccaagagc

SEQ ID NO: 610343 - DNA, 20 bp, mouse
ggccctggcctagcctggag

SEQ ID NO: 610344 - DNA, 20 bp, mouse
gtctggctgaggtgtgaata

SEQ ID NO: 610345 - DNA, 20 bp, mouse
gagcctccctgaactagctc

SEQ ID NO: 610346 - DNA, 20 bp, mouse
gacacaggctacaagtgctg

SEQ ID NO: 610347 - DNA, 20 bp, mouse
gcccacccagcataacccag

SEQ ID NO: 610348 - DNA, 20 bp, mouse
gataacccagcggcaaacac

SEQ ID NO: 610349 - DNA, 20 bp, mouse
ggcagactcttggcccatca

SEQ ID NO: 610350 - DNA, 20 bp, mouse
gtgatcccgcagcctattgg

SEQ ID NO: 610351 - DNA, 20 bp, mouse
ggtgaacactcgcgtccgca

SEQ ID NO: 610352 - DNA, 20 bp, mouse
gactttctccgggtgccatg

SEQ ID NO: 610353 - DNA, 20 bp, mouse
gaaggtgagtagcagagagt

SEQ ID NO: 610354 - DNA, 20 bp, mouse
gctcgcgtccgcatggcacc

SEQ ID NO: 610355 - DNA, 20 bp, mouse
gggacaggggtgcccccaat

SEQ ID NO: 610356 - DNA, 20 bp, mouse
ggcgtgcgcgggcgagacag

SEQ ID NO: 610357 - DNA, 20 bp, mouse
gccttctcggagccccccag

SEQ ID NO: 610358 - DNA, 20 bp, mouse
gacagaggtggctctagggg

SEQ ID NO: 610359 - DNA, 20 bp, mouse
gcgctggccggggaaaccct

SEQ ID NO: 610360 - DNA, 20 bp, mouse
gcgagacagaggtggctcta

SEQ ID NO: 610361 - DNA, 20 bp, mouse
gcccgcggcgctgggtacag

SEQ ID NO: 610362 - DNA, 20 bp, mouse
gagactagggaggcccgaca

SEQ ID NO: 610363 - DNA, 20 bp, mouse
gaccctaggcaaggagcccg

SEQ ID NO: 610364 - DNA, 20 bp, mouse
gctccgagaaggaagggata

SEQ ID NO: 610365 - DNA, 20 bp, mouse
gagccccccagcggccgacg

SEQ ID NO: 610366 - DNA, 20 bp, mouse
gaggcggaggatctccggaa

SEQ ID NO: 610367 - DNA, 20 bp, mouse
gcaaagaggcggaggatctc

SEQ ID NO: 610368 - DNA, 20 bp, mouse
gtccatctgcaaagaggcgg

SEQ ID NO: 610369 - DNA, 20 bp, mouse
gctagagctgggagtctgag

SEQ ID NO: 610370 - DNA, 20 bp, mouse
gggtttggagacacaggcaa

SEQ ID NO: 610371 - DNA, 20 bp, mouse
gggctgaggtgtctaggact

SEQ ID NO: 610372 - DNA, 20 bp, mouse
ggaacggccacactagagct

SEQ ID NO: 610373 - DNA, 20 bp, mouse
gagcccagcccagctgaatc

SEQ ID NO: 610374 - DNA, 20 bp, mouse
ggagagtagaaggcaggtgt

SEQ ID NO: 610375 - DNA, 20 bp, mouse
gcagacaggtttggagacac

SEQ ID NO: 610376 - DNA, 20 bp, mouse
gtcggagccatgggagctcc

SEQ ID NO: 610377 - DNA, 20 bp, mouse
ggcgccgctcgcccccgcct

SEQ ID NO: 610378 - DNA, 20 bp, mouse
gccatgggagctccgggcag

SEQ ID NO: 610379 - DNA, 20 bp, mouse
gccagcaacagcaaggagag

SEQ ID NO: 610380 - DNA, 20 bp, mouse
ggcaggtctatcggagccat

SEQ ID NO: 610381 - DNA, 20 bp, mouse
ggcgctggcggcaggtctat

SEQ ID NO: 610382 - DNA, 20 bp, mouse
ggccgccgccagcaacagca

SEQ ID NO: 610383 - DNA, 20 bp, mouse
gtccttgctgttgctggcgg

SEQ ID NO: 610384 - DNA, 20 bp, mouse
gccgcgccaggtgaacgcac

SEQ ID NO: 610385 - DNA, 20 bp, mouse
gtcggaggcggaagtgcccg

SEQ ID NO: 610386 - DNA, 20 bp, mouse
ggcggccgtgcggccaggtg

SEQ ID NO: 610387 - DNA, 20 bp, mouse
ggggattgtggcggacccag

SEQ ID NO: 610388 - DNA, 20 bp, mouse
gggacccagcggcaaaatgg

SEQ ID NO: 610389 - DNA, 20 bp, mouse
gaggagcgaagatggcggga

SEQ ID NO: 610390 - DNA, 20 bp, mouse
gggcggacccagcggcaaaa

SEQ ID NO: 610391 - DNA, 20 bp, mouse
gcgcgatcgcagggacagtg

SEQ ID NO: 610392 - DNA, 20 bp, mouse
ggccggagttggagagcgag

SEQ ID NO: 610393 - DNA, 20 bp, mouse
gcccgcctcacctggccgca

SEQ ID NO: 610394 - DNA, 20 bp, mouse
gacccctcgctctccaactc

SEQ ID NO: 610395 - DNA, 20 bp, mouse
ggcggcgggaggagcgaaga

SEQ ID NO: 610396 - DNA, 20 bp, mouse
gggagcaagtgagtacgcta

SEQ ID NO: 610397 - DNA, 20 bp, mouse
gagtgagtacgctatggcag

SEQ ID NO: 610398 - DNA, 20 bp, mouse
gcaccagtccgcctcacact

SEQ ID NO: 610399 - DNA, 20 bp, mouse
ggtccaacacacccttccaa

SEQ ID NO: 610400 - DNA, 20 bp, mouse
gaatagagcagaccagagtc

SEQ ID NO: 610401 - DNA, 20 bp, mouse
ggtcctgattcacttagaac

SEQ ID NO: 610402 - DNA, 20 bp, mouse
gggacctgcctagtgtgagg

SEQ ID NO: 610403 - DNA, 20 bp, mouse
gggtgacagcagcctcaaag

SEQ ID NO: 610404 - DNA, 20 bp, mouse
gtgcctagtgtgaggcggac

SEQ ID NO: 610405 - DNA, 20 bp, mouse
gttcgtgagtgctgggagaa

SEQ ID NO: 610406 - DNA, 20 bp, mouse
gccagcgcggacccggtcgg

SEQ ID NO: 610407 - DNA, 20 bp, mouse
ggaaccctcagcctccgacc

SEQ ID NO: 610408 - DNA, 20 bp, mouse
gagactggaaccccactcaa

SEQ ID NO: 610409 - DNA, 20 bp, mouse
gggacccggtcggaggctga

SEQ ID NO: 610410 - DNA, 20 bp, mouse
gaccccactcaaaggaaggg

SEQ ID NO: 610411 - DNA, 20 bp, mouse
ggtcccagcgcggacccggt

SEQ ID NO: 610412 - DNA, 20 bp, mouse
ggaggcagggtgagctcagg

SEQ ID NO: 610413 - DNA, 20 bp, mouse
gaggagccgagacccccacg

SEQ ID NO: 610414 - DNA, 20 bp, mouse
gtcaagcctgagccagacaa

SEQ ID NO: 610415 - DNA, 20 bp, mouse
ggggcaggtgtgcatcccag

SEQ ID NO: 610416 - DNA, 20 bp, mouse
gagacgaccgaacaaagctg

SEQ ID NO: 610417 - DNA, 20 bp, mouse
gctggtggtgcaacccggag

SEQ ID NO: 610418 - DNA, 20 bp, mouse
gcaagccgggccgccgaggg

SEQ ID NO: 610419 - DNA, 20 bp, mouse
ggtgaccggagacaccatgg

SEQ ID NO: 610420 - DNA, 20 bp, mouse
gcgtctgctcacctggctct

SEQ ID NO: 610421 - DNA, 20 bp, mouse
gcctggctctgggtgcgtcc

SEQ ID NO: 610422 - DNA, 20 bp, mouse
ggagggacgctacaagagtg

SEQ ID NO: 610423 - DNA, 20 bp, mouse
gggctgctggcacccgctcc

SEQ ID NO: 610424 - DNA, 20 bp, mouse
ggcgtcctggtggtgcaacc

SEQ ID NO: 610425 - DNA, 20 bp, mouse
gcctcccgcgggcagacgag

SEQ ID NO: 610426 - DNA, 20 bp, mouse
gctgaaaagagtgtctccag

SEQ ID NO: 610427 - DNA, 20 bp, mouse
gaggagccagtggcttcaga

SEQ ID NO: 610428 - DNA, 20 bp, mouse
ggcatggatgctagaaaaga

SEQ ID NO: 610429 - DNA, 20 bp, mouse
ggaccaagtgagaacctgta

SEQ ID NO: 610430 - DNA, 20 bp, mouse
gtgggcaggtctgggaacat

SEQ ID NO: 610431 - DNA, 20 bp, mouse
ggcttctctttaggagccag

SEQ ID NO: 610432 - DNA, 20 bp, mouse
gagaaaagaggggctgcccc

SEQ ID NO: 610433 - DNA, 20 bp, mouse
gccaggacccaagcatgtcc

SEQ ID NO: 610434 - DNA, 20 bp, mouse
gagggcagagggaagtcttg

SEQ ID NO: 610435 - DNA, 20 bp, mouse
gtgctgagttgcttctcttt

SEQ ID NO: 610436 - DNA, 20 bp, mouse
gaaggctcaatactttgggt

SEQ ID NO: 610437 - DNA, 20 bp, mouse
gggaagaaggctcaatactt

SEQ ID NO: 610438 - DNA, 20 bp, mouse
gactttgggtaggcgcttca

SEQ ID NO: 610439 - DNA, 20 bp, mouse
gagggcaggtgggatcccgt

SEQ ID NO: 610440 - DNA, 20 bp, mouse
gcaagaaacgataatgggaa

SEQ ID NO: 610441 - DNA, 20 bp, mouse
ggggacgagccggaagaagg

SEQ ID NO: 610442 - DNA, 20 bp, mouse
gctgtaggcgaggagtgtca

SEQ ID NO: 610443 - DNA, 20 bp, mouse
gcgaccccaacactcaccga

SEQ ID NO: 610444 - DNA, 20 bp, mouse
ggcctgaagggggtaagagg

SEQ ID NO: 610445 - DNA, 20 bp, mouse
ggaactacctagccggaaga

SEQ ID NO: 610446 - DNA, 20 bp, mouse
gccagcctcagaccgacagg

SEQ ID NO: 610447 - DNA, 20 bp, mouse
gaggccagcctcagaccgac

SEQ ID NO: 610448 - DNA, 20 bp, mouse
gacccagcacaggagacaca

SEQ ID NO: 610449 - DNA, 20 bp, mouse
gggttccgggagcgcaggtg

SEQ ID NO: 610450 - DNA, 20 bp, mouse
gtgcggcgtccgcgtcaaga

SEQ ID NO: 610451 - DNA, 20 bp, mouse
gggcggcagccatcttgacg

SEQ ID NO: 610452 - DNA, 20 bp, mouse
gcaagatggctgccgcctgt

SEQ ID NO: 610453 - DNA, 20 bp, mouse
ggctgccgcctgtcggtctg

SEQ ID NO: 610454 - DNA, 20 bp, mouse
gagccgccgggacccagcac

SEQ ID NO: 610455 - DNA, 20 bp, mouse
gtagggctctctgggaccag

SEQ ID NO: 610456 - DNA, 20 bp, mouse
gtgggccgccagcgagaacg

SEQ ID NO: 610457 - DNA, 20 bp, mouse
ggcacaggcccagcaatcta

SEQ ID NO: 610458 - DNA, 20 bp, mouse
gagcaatctaggggatcccg

SEQ ID NO: 610459 - DNA, 20 bp, mouse
ggcctgtgcagtgctagtaa

SEQ ID NO: 610460 - DNA, 20 bp, mouse
gaccaaccaggccatggcgg

SEQ ID NO: 610461 - DNA, 20 bp, mouse
gccagggcaaggacaagcaa

SEQ ID NO: 610462 - DNA, 20 bp, mouse
gtaggggatcccgaggctct

SEQ ID NO: 610463 - DNA, 20 bp, mouse
gtaaggactgcagtcgtgtg

SEQ ID NO: 610464 - DNA, 20 bp, mouse
ggctccggggacctccgcca

SEQ ID NO: 610465 - DNA, 20 bp, mouse
gaggccatggcggaggtccc

SEQ ID NO: 610466 - DNA, 20 bp, mouse
gagacctgagccgagcacat

SEQ ID NO: 610467 - DNA, 20 bp, mouse
gagggccccagtgctcagat

SEQ ID NO: 610468 - DNA, 20 bp, mouse
ggggcctctttaccaggcaa

SEQ ID NO: 610469 - DNA, 20 bp, mouse
gaggcccaacaaggtagcag

SEQ ID NO: 610470 - DNA, 20 bp, mouse
gcttgttgggcctctttacc

SEQ ID NO: 610471 - DNA, 20 bp, mouse
gcaggcagcgcctatgtgct

SEQ ID NO: 610472 - DNA, 20 bp, mouse
gtttcccctgctaccttgtt

SEQ ID NO: 610473 - DNA, 20 bp, mouse
ggcccggccagacagcacca

SEQ ID NO: 610474 - DNA, 20 bp, mouse
ggacatgagtgagcaggaaa

SEQ ID NO: 610475 - DNA, 20 bp, mouse
ggcgcctatgtgctcggctc

SEQ ID NO: 610476 - DNA, 20 bp, mouse
gaccagccttggctagggac

SEQ ID NO: 610477 - DNA, 20 bp, mouse
gagggacaggcatcaccaac

SEQ ID NO: 610478 - DNA, 20 bp, mouse
gtcaccaacaggaacagcga

SEQ ID NO: 610479 - DNA, 20 bp, mouse
ggcccctctggtaccaagta

SEQ ID NO: 610480 - DNA, 20 bp, mouse
ggtgccatcgctgttcctgt

SEQ ID NO: 610481 - DNA, 20 bp, mouse
gcaggcccaaccagtagcca

SEQ ID NO: 610482 - DNA, 20 bp, mouse
gcagccctacttggtaccag

SEQ ID NO: 610483 - DNA, 20 bp, mouse
ggcccgttgccaaggtacca

SEQ ID NO: 610484 - DNA, 20 bp, mouse
gccatcggtgcactatcaca

SEQ ID NO: 610485 - DNA, 20 bp, mouse
gctgcaagtccagccctact

SEQ ID NO: 610486 - DNA, 20 bp, mouse
ggttcaggcctgggcgactc

SEQ ID NO: 610487 - DNA, 20 bp, mouse
gcaggcctgaactcctcccc

SEQ ID NO: 610488 - DNA, 20 bp, mouse
gtgaactcctccccaggtcc

SEQ ID NO: 610489 - DNA, 20 bp, mouse
gcggcgttaaccaggccccg

SEQ ID NO: 610490 - DNA, 20 bp, mouse
gcgttaaccaggccccgcgg

SEQ ID NO: 610491 - DNA, 20 bp, mouse
gggaggccaaggctgaaatt

SEQ ID NO: 610492 - DNA, 20 bp, mouse
ggagcccgcgaggacgccag

SEQ ID NO: 610493 - DNA, 20 bp, mouse
gactccgggctgcgctgaac

SEQ ID NO: 610494 - DNA, 20 bp, mouse
gacgccggttcagcgcagcc

SEQ ID NO: 610495 - DNA, 20 bp, mouse
ggaaattgggataggatgag

SEQ ID NO: 610496 - DNA, 20 bp, mouse
ggcagccctgaccgcagctg

SEQ ID NO: 610497 - DNA, 20 bp, mouse
ggctgccacagctgcggtca

SEQ ID NO: 610498 - DNA, 20 bp, mouse
gggagggcttaagtgctctg

SEQ ID NO: 610499 - DNA, 20 bp, mouse
ggcactgactggggagaagg

SEQ ID NO: 610500 - DNA, 20 bp, mouse
gatggtgaagaggtagacca

SEQ ID NO: 610501 - DNA, 20 bp, mouse
gagcacttaagccctccttg

SEQ ID NO: 610502 - DNA, 20 bp, mouse
gggtagcgatgctcactgtc

SEQ ID NO: 610503 - DNA, 20 bp, mouse
gcctgccctggagaccaggg

SEQ ID NO: 610504 - DNA, 20 bp, mouse
gagcgatgctcactgtcggg

SEQ ID NO: 610505 - DNA, 20 bp, mouse
gtccccatggaccaggagga

SEQ ID NO: 610506 - DNA, 20 bp, mouse
gggtggagcctgctgatcag

SEQ ID NO: 610507 - DNA, 20 bp, mouse
gggagcctgctgatcagtgg

SEQ ID NO: 610508 - DNA, 20 bp, mouse
gtgctgatcagtggcggctg

SEQ ID NO: 610509 - DNA, 20 bp, mouse
ggcttgcaggttggtagact

SEQ ID NO: 610510 - DNA, 20 bp, mouse
gtgggaggagaggtgagggt

SEQ ID NO: 610511 - DNA, 20 bp, mouse
gcagccaatagatgctgaag

SEQ ID NO: 610512 - DNA, 20 bp, mouse
ggggatagtggtcacaacag

SEQ ID NO: 610513 - DNA, 20 bp, mouse
gccaatagatgctgaagggg

SEQ ID NO: 610514 - DNA, 20 bp, mouse
gttggtagactcggcattgg

SEQ ID NO: 610515 - DNA, 20 bp, mouse
gaggttggtagactcggcat

SEQ ID NO: 610516 - DNA, 20 bp, mouse
ggtccgggctaccccgtaca

SEQ ID NO: 610517 - DNA, 20 bp, mouse
gacccagagatcgggcgtcc

SEQ ID NO: 610518 - DNA, 20 bp, mouse
gagcattcagaccctgtacg

SEQ ID NO: 610519 - DNA, 20 bp, mouse
ggcccggacgcccgatctct

SEQ ID NO: 610520 - DNA, 20 bp, mouse
gtgccctgccgcccagagat

SEQ ID NO: 610521 - DNA, 20 bp, mouse
ggccagtggggagatgtgtg

SEQ ID NO: 610522 - DNA, 20 bp, mouse
gcagggtcctggtgttgcgg

SEQ ID NO: 610523 - DNA, 20 bp, mouse
gccagccccgcagcgagctg

SEQ ID NO: 610524 - DNA, 20 bp, mouse
gaggtttgcccatctctggg

SEQ ID NO: 610525 - DNA, 20 bp, mouse
ggccccgcagcgagctgggg

SEQ ID NO: 610526 - DNA, 20 bp, mouse
gctcctccatccaacaaaga

SEQ ID NO: 610527 - DNA, 20 bp, mouse
gtgcagccttctttgttgga

SEQ ID NO: 610528 - DNA, 20 bp, mouse
gacttttggaggacccaaag

SEQ ID NO: 610529 - DNA, 20 bp, mouse
ggatttgcagccttctttgt

SEQ ID NO: 610530 - DNA, 20 bp, mouse
ggggtaggtagggacctcaa

SEQ ID NO: 610531 - DNA, 20 bp, mouse
gataactggtgcttaagtta

SEQ ID NO: 610532 - DNA, 20 bp, mouse
gttccccaaacacaactgac

SEQ ID NO: 610533 - DNA, 20 bp, mouse
gagacttctatgacttttgg

SEQ ID NO: 610534 - DNA, 20 bp, mouse
ggtgagtgtgccccagaccc

SEQ ID NO: 610535 - DNA, 20 bp, mouse
gtgctggacacctgggtctg

SEQ ID NO: 610536 - DNA, 20 bp, mouse
gcatgaagcctgctggggta

SEQ ID NO: 610537 - DNA, 20 bp, mouse
gaagcctgctggggtatgga

SEQ ID NO: 610538 - DNA, 20 bp, mouse
ggcaaaggccgagaaatctg

SEQ ID NO: 610539 - DNA, 20 bp, mouse
gaagatacaagccttggcca

SEQ ID NO: 610540 - DNA, 20 bp, mouse
ggttggaccccctcagacca

SEQ ID NO: 610541 - DNA, 20 bp, mouse
ggacaagaaggagctagagt

SEQ ID NO: 610542 - DNA, 20 bp, mouse
gtcaccactggatcctaagg

SEQ ID NO: 610543 - DNA, 20 bp, mouse
gactcttccctggtctgagg

SEQ ID NO: 610544 - DNA, 20 bp, mouse
gtagtcaccactggatccta

SEQ ID NO: 610545 - DNA, 20 bp, mouse
gcgacagaagatacaagcct

SEQ ID NO: 610546 - DNA, 20 bp, mouse
gcgtagcaggcttctatcac

SEQ ID NO: 610547 - DNA, 20 bp, mouse
gactatacccgcaggaggtg

SEQ ID NO: 610548 - DNA, 20 bp, mouse
gagggtgcaacccaatggta

SEQ ID NO: 610549 - DNA, 20 bp, mouse
gctggggccgaagtcaggca

SEQ ID NO: 610550 - DNA, 20 bp, mouse
ggggcttctaaccacgtagc

SEQ ID NO: 610551 - DNA, 20 bp, mouse
gccgcaggaggtgaggctca

SEQ ID NO: 610552 - DNA, 20 bp, mouse
gaactgagggtgcaacccaa

SEQ ID NO: 610553 - DNA, 20 bp, mouse
gatgggagcgaaacacaccc

SEQ ID NO: 610554 - DNA, 20 bp, mouse
gcccgaactatacccgcagg

SEQ ID NO: 610555 - DNA, 20 bp, mouse
gaggctcaggggtccccacg

SEQ ID NO: 610556 - DNA, 20 bp, mouse
gcggcaggcgggccaaagaa

SEQ ID NO: 610557 - DNA, 20 bp, mouse
ggtccgagtgctgcccgcag

SEQ ID NO: 610558 - DNA, 20 bp, mouse
gtccccgcgatcccccccca

SEQ ID NO: 610559 - DNA, 20 bp, mouse
gccggagctgcaattgaggt

SEQ ID NO: 610560 - DNA, 20 bp, mouse
ggcggggagccggcgtaccc

SEQ ID NO: 610561 - DNA, 20 bp, mouse
gttgcagctccggggtacgc

SEQ ID NO: 610562 - DNA, 20 bp, mouse
gaccgagggatcgcagaagg

SEQ ID NO: 610563 - DNA, 20 bp, mouse
gtggcgggaaggctctctgt

SEQ ID NO: 610564 - DNA, 20 bp, mouse
gcgcctgccgcccccaggga

SEQ ID NO: 610565 - DNA, 20 bp, mouse
gggccgctgcgggcagcact

SEQ ID NO: 610566 - DNA, 20 bp, mouse
gggctcggggctcgcaggag

SEQ ID NO: 610567 - DNA, 20 bp, mouse
ggagcggctggctcccgcga

SEQ ID NO: 610568 - DNA, 20 bp, mouse
ggcccaggcggaagtgcggg

SEQ ID NO: 610569 - DNA, 20 bp, mouse
ggcaggcccaggcggaagtg

SEQ ID NO: 610570 - DNA, 20 bp, mouse
gcgatggcgagcctatggtg

SEQ ID NO: 610571 - DNA, 20 bp, mouse
ggattgggagaccggagagt

SEQ ID NO: 610572 - DNA, 20 bp, mouse
gcgggcggaggatcccgagc

SEQ ID NO: 610573 - DNA, 20 bp, mouse
gcagcaggtttccgcaccat

SEQ ID NO: 610574 - DNA, 20 bp, mouse
gccgcgcccggctcgggatc

SEQ ID NO: 610575 - DNA, 20 bp, mouse
gtcccgcgatggcgagccta

SEQ ID NO: 610576 - DNA, 20 bp, mouse
gccggctccggcggcctcag

SEQ ID NO: 610577 - DNA, 20 bp, mouse
ggggccgaggccatcccgta

SEQ ID NO: 610578 - DNA, 20 bp, mouse
gcaggcaggcgcgacacccc

SEQ ID NO: 610579 - DNA, 20 bp, mouse
gcggctccggccggctccgg

SEQ ID NO: 610580 - DNA, 20 bp, mouse
ggagctcgagctgacacctg

SEQ ID NO: 610581 - DNA, 20 bp, mouse
ggtcagcaggacccgcaccg

SEQ ID NO: 610582 - DNA, 20 bp, mouse
ggcgaagctggacaactgcg

SEQ ID NO: 610583 - DNA, 20 bp, mouse
ggcccagaagtccatcgaca

SEQ ID NO: 610584 - DNA, 20 bp, mouse
gcctagcaattggggatctg

SEQ ID NO: 610585 - DNA, 20 bp, mouse
gcctcagcgccggctccggc

SEQ ID NO: 610586 - DNA, 20 bp, mouse
gagctcgcggaccgaccgaa

SEQ ID NO: 610587 - DNA, 20 bp, mouse
gacagccagggtgcgatcct

SEQ ID NO: 610588 - DNA, 20 bp, mouse
ggtctggcgggagaggctct

SEQ ID NO: 610589 - DNA, 20 bp, mouse
ggactgcgaaagctcccctt

SEQ ID NO: 610590 - DNA, 20 bp, mouse
gtgcgatcctggggagctcg

SEQ ID NO: 610591 - DNA, 20 bp, mouse
gccgtcctcggatctggaga

SEQ ID NO: 610592 - DNA, 20 bp, mouse
ggtgcccagtgacccaaagg

SEQ ID NO: 610593 - DNA, 20 bp, mouse
gacacccgcgaaggagccct

SEQ ID NO: 610594 - DNA, 20 bp, mouse
ggggagctttcgcagtctgg

SEQ ID NO: 610595 - DNA, 20 bp, mouse
gtttcgcagtctggcgggag

SEQ ID NO: 610596 - DNA, 20 bp, mouse
ggatggtgtggaagatcacc

SEQ ID NO: 610597 - DNA, 20 bp, mouse
gtgcaggttggaccttctgg

SEQ ID NO: 610598 - DNA, 20 bp, mouse
gacttacttgttctcccctg

SEQ ID NO: 610599 - DNA, 20 bp, mouse
gataaatcagagccataaac

SEQ ID NO: 610600 - DNA, 20 bp, mouse
gcaccatctttaatgaatgc

SEQ ID NO: 610601 - DNA, 20 bp, mouse
gctgaatcatttgttgtact

SEQ ID NO: 610602 - DNA, 20 bp, mouse
ggggggggggaacctgttta

SEQ ID NO: 610603 - DNA, 20 bp, mouse
gacaactttaagttagagtt

SEQ ID NO: 610604 - DNA, 20 bp, mouse
gagattatctcacttgaaat

SEQ ID NO: 610605 - DNA, 20 bp, mouse
gggttttatctttgccacag

SEQ ID NO: 610606 - DNA, 20 bp, mouse
gcgcgggcggcggcaatgag

SEQ ID NO: 610607 - DNA, 20 bp, mouse
ggtcttaccgggatgcgggg

SEQ ID NO: 610608 - DNA, 20 bp, mouse
gccccgaaggccacccgagg

SEQ ID NO: 610609 - DNA, 20 bp, mouse
gggcttggcgagttccctgg

SEQ ID NO: 610610 - DNA, 20 bp, mouse
ggatccccgaaggccacccg

SEQ ID NO: 610611 - DNA, 20 bp, mouse
gcgaggccgagggggaccta

SEQ ID NO: 610612 - DNA, 20 bp, mouse
gcggcaatgagcggaacgcg

SEQ ID NO: 610613 - DNA, 20 bp, mouse
gggggtcttaccgggatgcg

SEQ ID NO: 610614 - DNA, 20 bp, mouse
ggccgcgggtgggaagccgg

SEQ ID NO: 610615 - DNA, 20 bp, mouse
gcgaaggccacccgaggcgg

SEQ ID NO: 610616 - DNA, 20 bp, mouse
gcgggtccgaccagcagggg

SEQ ID NO: 610617 - DNA, 20 bp, mouse
gggtcggacccgctcactcc

SEQ ID NO: 610618 - DNA, 20 bp, mouse
gtgagcgggtccgaccagca

SEQ ID NO: 610619 - DNA, 20 bp, mouse
gtggagctgcgatcaacagg

SEQ ID NO: 610620 - DNA, 20 bp, mouse
gggcagccggggatgagtgt

SEQ ID NO: 610621 - DNA, 20 bp, mouse
gccgctcactcctggctcta

SEQ ID NO: 610622 - DNA, 20 bp, mouse
gtcgggatgggcacaagcaa

SEQ ID NO: 610623 - DNA, 20 bp, mouse
gggctggagctgcgatcaac

SEQ ID NO: 610624 - DNA, 20 bp, mouse
ggcttgtgcccatcccgaag

SEQ ID NO: 610625 - DNA, 20 bp, mouse
gggccaagtgcagcccgcag

SEQ ID NO: 610626 - DNA, 20 bp, mouse
gggcagctggcgggaggatt

SEQ ID NO: 610627 - DNA, 20 bp, mouse
gacagcgcggtcgggtttag

SEQ ID NO: 610628 - DNA, 20 bp, mouse
gccgcggtgcctcaagttca

SEQ ID NO: 610629 - DNA, 20 bp, mouse
gtcccggcgcccacactccg

SEQ ID NO: 610630 - DNA, 20 bp, mouse
gttgaggcaccgcggagtgt

SEQ ID NO: 610631 - DNA, 20 bp, mouse
gcggcctgggcgactaagaa

SEQ ID NO: 610632 - DNA, 20 bp, mouse
gcggcaactccctgaacttg

SEQ ID NO: 610633 - DNA, 20 bp, mouse
gcaatacagacagcgcggtc

SEQ ID NO: 610634 - DNA, 20 bp, mouse
gtgcggactgtgcagtgggt

SEQ ID NO: 610635 - DNA, 20 bp, mouse
gagtgggtcggcggccagac

SEQ ID NO: 610636 - DNA, 20 bp, mouse
gtgagcgtgaggcactgaca

SEQ ID NO: 610637 - DNA, 20 bp, mouse
gcggaccaactgacaagggg

SEQ ID NO: 610638 - DNA, 20 bp, mouse
gagacggaccaactgacaag

SEQ ID NO: 610639 - DNA, 20 bp, mouse
gggaggtgagaggtgaccat

SEQ ID NO: 610640 - DNA, 20 bp, mouse
gttggtccgtctgttctact

SEQ ID NO: 610641 - DNA, 20 bp, mouse
ggtcaagacagaaacatcgg

SEQ ID NO: 610642 - DNA, 20 bp, mouse
ggttcccccacgctctcccc

SEQ ID NO: 610643 - DNA, 20 bp, mouse
gacactgtccggtcagcagg

SEQ ID NO: 610644 - DNA, 20 bp, mouse
gagtgtcccagtagaacaga

SEQ ID NO: 610645 - DNA, 20 bp, mouse
gaggaggagtctggtgccgg

SEQ ID NO: 610646 - DNA, 20 bp, mouse
gagcccctggcgcacgactg

SEQ ID NO: 610647 - DNA, 20 bp, mouse
gtcgctgcgggctccgggtt

SEQ ID NO: 610648 - DNA, 20 bp, mouse
ggagcaagtgcagccgaacc

SEQ ID NO: 610649 - DNA, 20 bp, mouse
gagcgcgccggcgtgagcag

SEQ ID NO: 610650 - DNA, 20 bp, mouse
gcgggcacggcacagaactc

SEQ ID NO: 610651 - DNA, 20 bp, mouse
gaagggtcctctaggaactc

SEQ ID NO: 610652 - DNA, 20 bp, mouse
gccccgccacaaaaagcccc

SEQ ID NO: 610653 - DNA, 20 bp, mouse
gctccccagtcgtgcgccag

SEQ ID NO: 610654 - DNA, 20 bp, mouse
gcgactgtgaggggccgggg

SEQ ID NO: 610655 - DNA, 20 bp, mouse
ggcgccggcgtgagcagcgg

SEQ ID NO: 610656 - DNA, 20 bp, mouse
gcagagcgcccactgcctaa

SEQ ID NO: 610657 - DNA, 20 bp, mouse
gtaacggagagaccccatcg

SEQ ID NO: 610658 - DNA, 20 bp, mouse
ggcatgatcgcgccacgatg

SEQ ID NO: 610659 - DNA, 20 bp, mouse
gacaacccccggaggtgcag

SEQ ID NO: 610660 - DNA, 20 bp, mouse
gggtcctcaacaacccccgg

SEQ ID NO: 610661 - DNA, 20 bp, mouse
ggggtctctccgttaggcag

SEQ ID NO: 610662 - DNA, 20 bp, mouse
gccagccgctgcacctccgg

SEQ ID NO: 610663 - DNA, 20 bp, mouse
ggcgggagcggcgtacacag

SEQ ID NO: 610664 - DNA, 20 bp, mouse
ggcctctgcccgcttcccag

SEQ ID NO: 610665 - DNA, 20 bp, mouse
gcagaggccgaggaaagccg

SEQ ID NO: 610666 - DNA, 20 bp, mouse
ggggatgtcatagagctgat

SEQ ID NO: 610667 - DNA, 20 bp, mouse
gacatcacgaatgggaggaa

SEQ ID NO: 610668 - DNA, 20 bp, mouse
gtgggaggaagggatcctgc

SEQ ID NO: 610669 - DNA, 20 bp, mouse
ggtagatctctaagacatgt

SEQ ID NO: 610670 - DNA, 20 bp, mouse
gcagatacatcacgaatggg

SEQ ID NO: 610671 - DNA, 20 bp, mouse
gatgcagatacatcacgaat

SEQ ID NO: 610672 - DNA, 20 bp, mouse
gcaccagaggatagctggtg

SEQ ID NO: 610673 - DNA, 20 bp, mouse
gggtagactctccacaccag

SEQ ID NO: 610674 - DNA, 20 bp, mouse
gtctactcctggaagaaata

SEQ ID NO: 610675 - DNA, 20 bp, mouse
gagctggtgaggaatcttta

SEQ ID NO: 610676 - DNA, 20 bp, mouse
gtaacgtgctgatacactgg

SEQ ID NO: 610677 - DNA, 20 bp, mouse
gacataacgtgctgatacac

SEQ ID NO: 610678 - DNA, 20 bp, mouse
ggaaccaatatcaacacgta

SEQ ID NO: 610679 - DNA, 20 bp, mouse
ggtatcagcacgttatgtac

SEQ ID NO: 610680 - DNA, 20 bp, mouse
gtccatactgaagttccaaa

SEQ ID NO: 610681 - DNA, 20 bp, mouse
ggtggctgatattaatgcag

SEQ ID NO: 610682 - DNA, 20 bp, mouse
gactgttgtctagtagagag

SEQ ID NO: 610683 - DNA, 20 bp, mouse
ggccctttggaacttcagta

SEQ ID NO: 610684 - DNA, 20 bp, mouse
gtgaagcacccctcaaactg

SEQ ID NO: 610685 - DNA, 20 bp, mouse
gttttgtcagaaggttagac

SEQ ID NO: 610686 - DNA, 20 bp, mouse
gtgtgccacccagcactcaa

SEQ ID NO: 610687 - DNA, 20 bp, mouse
gtcggaggagcgaagagcaa

SEQ ID NO: 610688 - DNA, 20 bp, mouse
gctcaagggcaagatggcaa

SEQ ID NO: 610689 - DNA, 20 bp, mouse
gggcaaggggacagcctcgg

SEQ ID NO: 610690 - DNA, 20 bp, mouse
gttcttgtaagctaaatagg

SEQ ID NO: 610691 - DNA, 20 bp, mouse
gcagcaagggtcctgctcaa

SEQ ID NO: 610692 - DNA, 20 bp, mouse
gttgtaagctaaataggtgg

SEQ ID NO: 610693 - DNA, 20 bp, mouse
gttcacacacctgttctgca

SEQ ID NO: 610694 - DNA, 20 bp, mouse
ggaacaggtgtgtgaaaggg

SEQ ID NO: 610695 - DNA, 20 bp, mouse
gagaggggaaatggttacaa

SEQ ID NO: 610696 - DNA, 20 bp, mouse
gattcaagagtaaaatgtat

SEQ ID NO: 610697 - DNA, 20 bp, mouse
gaagagtgattcagttgaga

SEQ ID NO: 610698 - DNA, 20 bp, mouse
gaagctacagaggcaaaagc

SEQ ID NO: 610699 - DNA, 20 bp, mouse
gaaaacttataaagctacag

SEQ ID NO: 610700 - DNA, 20 bp, mouse
gagccagtgctgatactgtt

SEQ ID NO: 610701 - DNA, 20 bp, mouse
gaccatgctatctaaacacc

SEQ ID NO: 610702 - DNA, 20 bp, mouse
ggcctggtgtttagatagca

SEQ ID NO: 610703 - DNA, 20 bp, mouse
gcaaagatgtctaagaaatt

SEQ ID NO: 610704 - DNA, 20 bp, mouse
gttctctgcctttggggcag

SEQ ID NO: 610705 - DNA, 20 bp, mouse
gaaaacttgagtgaagcttt

SEQ ID NO: 610706 - DNA, 20 bp, mouse
gttgctggtcagcaatgtat

SEQ ID NO: 610707 - DNA, 20 bp, mouse
gcagcaagttacgagtccag

SEQ ID NO: 610708 - DNA, 20 bp, mouse
gcacaagttactaggcagaa

SEQ ID NO: 610709 - DNA, 20 bp, mouse
gctatagaccacaagttact

SEQ ID NO: 610710 - DNA, 20 bp, mouse
gtgatgaacacactcagtca

SEQ ID NO: 610711 - DNA, 20 bp, mouse
gtgtggtctatagtggtcta

SEQ ID NO: 610712 - DNA, 20 bp, mouse
gttacgagtccagtggtgac

SEQ ID NO: 610713 - DNA, 20 bp, mouse
gagctcgaacagacagcaag

SEQ ID NO: 610714 - DNA, 20 bp, mouse
ggatcaataaagcctaaatt

SEQ ID NO: 610715 - DNA, 20 bp, mouse
ggtgttcatcagctcacctg

SEQ ID NO: 610716 - DNA, 20 bp, mouse
gggtaataaaccaaaaggta

SEQ ID NO: 610717 - DNA, 20 bp, mouse
ggagtctcagggctcctcag

SEQ ID NO: 610718 - DNA, 20 bp, mouse
gttcaaggtaataaaccaaa

SEQ ID NO: 610719 - DNA, 20 bp, mouse
ggttaagtctaagaacagaa

SEQ ID NO: 610720 - DNA, 20 bp, mouse
gcagttgttgaaaatgacac

SEQ ID NO: 610721 - DNA, 20 bp, mouse
gtgaggaaggaacaatttca

SEQ ID NO: 610722 - DNA, 20 bp, mouse
gagcacatgctatgtgagga

SEQ ID NO: 610723 - DNA, 20 bp, mouse
ggcttcgtgttagtttctta

SEQ ID NO: 610724 - DNA, 20 bp, mouse
ggggctcctcagaggcatat

SEQ ID NO: 610725 - DNA, 20 bp, mouse
gaggattagtttaaaaatgt

SEQ ID NO: 610726 - DNA, 20 bp, mouse
ggagaagctcgccttcccca

SEQ ID NO: 610727 - DNA, 20 bp, mouse
gacacagagcagcgtggagg

SEQ ID NO: 610728 - DNA, 20 bp, mouse
gggatgctactcatttgaca

SEQ ID NO: 610729 - DNA, 20 bp, mouse
gcacatctgcaagaatatcc

SEQ ID NO: 610730 - DNA, 20 bp, mouse
gtacatcgccgccgtgggga

SEQ ID NO: 610731 - DNA, 20 bp, mouse
gaagctcgccttccccacgg

SEQ ID NO: 610732 - DNA, 20 bp, mouse
gctgatacatcgccgccgtg

SEQ ID NO: 610733 - DNA, 20 bp, mouse
gcagggactagaatggaatg

SEQ ID NO: 610734 - DNA, 20 bp, mouse
gagaagcactggtaagttca

SEQ ID NO: 610735 - DNA, 20 bp, mouse
gttagaaattatgctaagtt

SEQ ID NO: 610736 - DNA, 20 bp, mouse
gtgcagctcagagtacgcaa

SEQ ID NO: 610737 - DNA, 20 bp, mouse
gacagccaccatggcgtcat

SEQ ID NO: 610738 - DNA, 20 bp, mouse
gagcgcagagccctccctaa

SEQ ID NO: 610739 - DNA, 20 bp, mouse
ggtacgcaaaggcgccgccc

SEQ ID NO: 610740 - DNA, 20 bp, mouse
ggtggctgtaggccccaaga

SEQ ID NO: 610741 - DNA, 20 bp, mouse
gctcagtgcccatgacgcca

SEQ ID NO: 610742 - DNA, 20 bp, mouse
gagtgcccatgacgccatgg

SEQ ID NO: 610743 - DNA, 20 bp, mouse
ggcgccgcgctgctgtgcct

SEQ ID NO: 610744 - DNA, 20 bp, mouse
gagtcctgcgtggctgaggt

SEQ ID NO: 610745 - DNA, 20 bp, mouse
gaggagcagccggtcacgaa

SEQ ID NO: 610746 - DNA, 20 bp, mouse
gtcgagggtaagatccatgt

SEQ ID NO: 610747 - DNA, 20 bp, mouse
gccacacgctgggggactgg

SEQ ID NO: 610748 - DNA, 20 bp, mouse
ggtccctagaaggaactccg

SEQ ID NO: 610749 - DNA, 20 bp, mouse
gctacactcggggcaggtct

SEQ ID NO: 610750 - DNA, 20 bp, mouse
ggacaggctggagtcaggca

SEQ ID NO: 610751 - DNA, 20 bp, mouse
gcctagaaggaactccgagg

SEQ ID NO: 610752 - DNA, 20 bp, mouse
gcccaggcatgagaagggac

SEQ ID NO: 610753 - DNA, 20 bp, mouse
gccttggccacacagcccag

SEQ ID NO: 610754 - DNA, 20 bp, mouse
gccgcggcgcactcacccgg

SEQ ID NO: 610755 - DNA, 20 bp, mouse
gtgtggccaaggcctggaca

SEQ ID NO: 610756 - DNA, 20 bp, mouse
gaaccattcaagctaatgtt

SEQ ID NO: 610757 - DNA, 20 bp, mouse
gctcccaacattagcttgaa

SEQ ID NO: 610758 - DNA, 20 bp, mouse
ggaatccttaggaacttgag

SEQ ID NO: 610759 - DNA, 20 bp, mouse
gtgacgacttcagaatcctt

SEQ ID NO: 610760 - DNA, 20 bp, mouse
gaaaacctctcaagttccta

SEQ ID NO: 610761 - DNA, 20 bp, mouse
ggaatacctttcttatctca

SEQ ID NO: 610762 - DNA, 20 bp, mouse
gtgctgcgtgtctctggaaa

SEQ ID NO: 610763 - DNA, 20 bp, mouse
gatgaaatccagcagagacg

SEQ ID NO: 610764 - DNA, 20 bp, mouse
gttgcagtcaaggaatctga

SEQ ID NO: 610765 - DNA, 20 bp, mouse
ggtgtcctggcttgcagtca

SEQ ID NO: 610766 - DNA, 20 bp, mouse
gccaagagctcggacagagg

SEQ ID NO: 610767 - DNA, 20 bp, mouse
gctcggacagaggcggagag

SEQ ID NO: 610768 - DNA, 20 bp, mouse
gaagccaagagctcggacag

SEQ ID NO: 610769 - DNA, 20 bp, mouse
ggtaggtcgtgtacttggag

SEQ ID NO: 610770 - DNA, 20 bp, mouse
ggtccccaggacgtacactc

SEQ ID NO: 610771 - DNA, 20 bp, mouse
ggaggggcgggaagcgcaac

SEQ ID NO: 610772 - DNA, 20 bp, mouse
ggccgggaccggagcttgtc

SEQ ID NO: 610773 - DNA, 20 bp, mouse
ggacgaggaagccaagagct

SEQ ID NO: 610774 - DNA, 20 bp, mouse
gtctagggtacaagtgagtt

SEQ ID NO: 610775 - DNA, 20 bp, mouse
gtagcgcgcctgacaagctc

SEQ ID NO: 610776 - DNA, 20 bp, mouse
gcggagtctgcaaggctgag

SEQ ID NO: 610777 - DNA, 20 bp, mouse
ggggtgagcagctggcaaag

SEQ ID NO: 610778 - DNA, 20 bp, mouse
gttataaaaaacgagcagga

SEQ ID NO: 610779 - DNA, 20 bp, mouse
gactccgtcactgaagccag

SEQ ID NO: 610780 - DNA, 20 bp, mouse
ggagcaggagggtgagcagc

SEQ ID NO: 610781 - DNA, 20 bp, mouse
gtcgaggggatactccccca

SEQ ID NO: 610782 - DNA, 20 bp, mouse
gtggtaagtaagggacccgg

SEQ ID NO: 610783 - DNA, 20 bp, mouse
gtgggcgagccagagatgta

SEQ ID NO: 610784 - DNA, 20 bp, mouse
gggttggcaggtcccatatg

SEQ ID NO: 610785 - DNA, 20 bp, mouse
gggtagaaatagttctctac

SEQ ID NO: 610786 - DNA, 20 bp, mouse
ggctggcttgcggaaggaag

SEQ ID NO: 610787 - DNA, 20 bp, mouse
gaagtcactcctagatacag

SEQ ID NO: 610788 - DNA, 20 bp, mouse
gtcctagatacagtggcagg

SEQ ID NO: 610789 - DNA, 20 bp, mouse
ggtggtagctggcttgcgga

SEQ ID NO: 610790 - DNA, 20 bp, mouse
gtacagtggcaggtggtagc

SEQ ID NO: 610791 - DNA, 20 bp, mouse
gagtgacttgaggactattg

SEQ ID NO: 610792 - DNA, 20 bp, mouse
gcccctcctgctgtcttggg

SEQ ID NO: 610793 - DNA, 20 bp, mouse
ggaggcagaggagccctgat

SEQ ID NO: 610794 - DNA, 20 bp, mouse
gcactcctagatacagtggc

SEQ ID NO: 610795 - DNA, 20 bp, mouse
ggtaagtacaggggccctca

SEQ ID NO: 610796 - DNA, 20 bp, mouse
gtaaggcagtaagttctgct

SEQ ID NO: 610797 - DNA, 20 bp, mouse
gtcaatcctgacatgaggac

SEQ ID NO: 610798 - DNA, 20 bp, mouse
gcagtaagttctgctgggca

SEQ ID NO: 610799 - DNA, 20 bp, mouse
gaggctcctgtcctcatgtc

SEQ ID NO: 610800 - DNA, 20 bp, mouse
ggcaagagaaaggcatcctc

SEQ ID NO: 610801 - DNA, 20 bp, mouse
gtcagtgcagctgactcata

SEQ ID NO: 610802 - DNA, 20 bp, mouse
ggcagctgactcatatggta

SEQ ID NO: 610803 - DNA, 20 bp, mouse
gtgcatgagacaaggtgatt

SEQ ID NO: 610804 - DNA, 20 bp, mouse
gttcaacagcccagccagtg

SEQ ID NO: 610805 - DNA, 20 bp, mouse
gacagcccagccagtgtggt

SEQ ID NO: 610806 - DNA, 20 bp, mouse
ggccctggacctgacaggag

SEQ ID NO: 610807 - DNA, 20 bp, mouse
gttggggccacaggccacaa

SEQ ID NO: 610808 - DNA, 20 bp, mouse
gttgtcgccctggacctgac

SEQ ID NO: 610809 - DNA, 20 bp, mouse
ggcctctcctgtcaggtcca

SEQ ID NO: 610810 - DNA, 20 bp, mouse
gctgtggccccaagttccat

SEQ ID NO: 610811 - DNA, 20 bp, mouse
ggagaggcccatggaacttg

SEQ ID NO: 610812 - DNA, 20 bp, mouse
gcactcttgaaggtaagcag

SEQ ID NO: 610813 - DNA, 20 bp, mouse
gtggcctggagccatggctg

SEQ ID NO: 610814 - DNA, 20 bp, mouse
gtccatgggcctctcctgtc

SEQ ID NO: 610815 - DNA, 20 bp, mouse
ggacagagaaccaggatctc

SEQ ID NO: 610816 - DNA, 20 bp, mouse
gggaggaagcgagtgaacac

SEQ ID NO: 610817 - DNA, 20 bp, mouse
gtcgtgtgtgtgaccacgta

SEQ ID NO: 610818 - DNA, 20 bp, mouse
gtagcttgaaaagaatggag

SEQ ID NO: 610819 - DNA, 20 bp, mouse
ggcctgcagacttccctacg

SEQ ID NO: 610820 - DNA, 20 bp, mouse
gcttttcaagctagcatggg

SEQ ID NO: 610821 - DNA, 20 bp, mouse
gggtctgaggacttgcagga

SEQ ID NO: 610822 - DNA, 20 bp, mouse
gcatgctagcttgaaaagaa

SEQ ID NO: 610823 - DNA, 20 bp, mouse
gacacacacgagacagaaaa

SEQ ID NO: 610824 - DNA, 20 bp, mouse
gctggtgaaatgaatctacg

SEQ ID NO: 610825 - DNA, 20 bp, mouse
ggtgttcaagcggagagtga

SEQ ID NO: 610826 - DNA, 20 bp, mouse
gcggctgtcatcgcagtggt

SEQ ID NO: 610827 - DNA, 20 bp, mouse
ggggctccatggctcggcaa

SEQ ID NO: 610828 - DNA, 20 bp, mouse
gtgcagtgggctccatggct

SEQ ID NO: 610829 - DNA, 20 bp, mouse
ggggtcaggcaggactacag

SEQ ID NO: 610830 - DNA, 20 bp, mouse
gcgaacggctgtcatcgcag

SEQ ID NO: 610831 - DNA, 20 bp, mouse
ggatgacagccgttcgacaa

SEQ ID NO: 610832 - DNA, 20 bp, mouse
gatgacaagaaggagcgggt

SEQ ID NO: 610833 - DNA, 20 bp, mouse
gtctcttgcaggtgtctagc

SEQ ID NO: 610834 - DNA, 20 bp, mouse
gatccagcagtggcaaggac

SEQ ID NO: 610835 - DNA, 20 bp, mouse
gttcgacaagggccagggtc

SEQ ID NO: 610836 - DNA, 20 bp, mouse
ggggcttcggagggagggtg

SEQ ID NO: 610837 - DNA, 20 bp, mouse
ggctagcaggccacgccctg

SEQ ID NO: 610838 - DNA, 20 bp, mouse
gaggcctgcggacagagaag

SEQ ID NO: 610839 - DNA, 20 bp, mouse
gtgcgggaacgcccaggact

SEQ ID NO: 610840 - DNA, 20 bp, mouse
gggaaggagaatccacggta

SEQ ID NO: 610841 - DNA, 20 bp, mouse
gccgcgaacgcctctcaacg

SEQ ID NO: 610842 - DNA, 20 bp, mouse
ggcgctggggtgggaacccg

SEQ ID NO: 610843 - DNA, 20 bp, mouse
gactggcccgaccccaccca

SEQ ID NO: 610844 - DNA, 20 bp, mouse
gacgtggcattcccagtcct

SEQ ID NO: 610845 - DNA, 20 bp, mouse
gccgggctgcgggaacgccc

SEQ ID NO: 610846 - DNA, 20 bp, mouse
ggagctgttggtctgatagg

SEQ ID NO: 610847 - DNA, 20 bp, mouse
gacagagctgttggtctgat

SEQ ID NO: 610848 - DNA, 20 bp, mouse
ggtggagctgttagtctgat

SEQ ID NO: 610849 - DNA, 20 bp, mouse
gtaactgaagacagagctgt

SEQ ID NO: 610850 - DNA, 20 bp, mouse
gaaacttgcaggtactgcaa

SEQ ID NO: 610851 - DNA, 20 bp, mouse
ggcacagagagagaagtcat

SEQ ID NO: 610852 - DNA, 20 bp, mouse
gggtgagtcttgctgtgaag

SEQ ID NO: 610853 - DNA, 20 bp, mouse
gtgcaagggcagcatcagtt

SEQ ID NO: 610854 - DNA, 20 bp, mouse
ggtcatgggggtcccatctt

SEQ ID NO: 610855 - DNA, 20 bp, mouse
gtccccttgaggttttctgg

SEQ ID NO: 610856 - DNA, 20 bp, mouse
gaccacagggcgggacagag

SEQ ID NO: 610857 - DNA, 20 bp, mouse
gccggtgcagagcatagtcc

SEQ ID NO: 610858 - DNA, 20 bp, mouse
gcagggaaatctgtaaactc

SEQ ID NO: 610859 - DNA, 20 bp, mouse
gagcttcgaggagttagtga

SEQ ID NO: 610860 - DNA, 20 bp, mouse
gtttgcgggaccaagcacag

SEQ ID NO: 610861 - DNA, 20 bp, mouse
gatgggcgggatataggggc

SEQ ID NO: 610862 - DNA, 20 bp, mouse
gtactcacctgccggttcca

SEQ ID NO: 610863 - DNA, 20 bp, mouse
gcggttccaaggctcccttc

SEQ ID NO: 610864 - DNA, 20 bp, mouse
gcagagcatagtcctggtag

SEQ ID NO: 610865 - DNA, 20 bp, mouse
gcccaccctgggaggttcag

SEQ ID NO: 610866 - DNA, 20 bp, mouse
gaccacagggcgggacagag

SEQ ID NO: 610867 - DNA, 20 bp, mouse
gccggtgcagagcatagtcc

SEQ ID NO: 610868 - DNA, 20 bp, mouse
gagcttcgaggagttagtga

SEQ ID NO: 610869 - DNA, 20 bp, mouse
gcagggaaatctgtaaactc

SEQ ID NO: 610870 - DNA, 20 bp, mouse
gtactcacctgccggttcca

SEQ ID NO: 610871 - DNA, 20 bp, mouse
gcggttccaaggctcccttc

SEQ ID NO: 610872 - DNA, 20 bp, mouse
gtttgcgggaccaagcacag

SEQ ID NO: 610873 - DNA, 20 bp, mouse
gcagagcatagtcctggtag

SEQ ID NO: 610874 - DNA, 20 bp, mouse
gcccaccctgggaggttcag

SEQ ID NO: 610875 - DNA, 20 bp, mouse
gatgggcgggatataggggc

SEQ ID NO: 610876 - DNA, 20 bp, mouse
gaccacagggcgggacagag

SEQ ID NO: 610877 - DNA, 20 bp, mouse
gccggtgcagagcatagtcc

SEQ ID NO: 610878 - DNA, 20 bp, mouse
gagcttcgaggagttagtga

SEQ ID NO: 610879 - DNA, 20 bp, mouse
gcagggaaatctgtaaactc

SEQ ID NO: 610880 - DNA, 20 bp, mouse
gtactcacctgccggttcca

SEQ ID NO: 610881 - DNA, 20 bp, mouse
gcggttccaaggctcccttc

SEQ ID NO: 610882 - DNA, 20 bp, mouse
gtttgcgggaccaagcacag

SEQ ID NO: 610883 - DNA, 20 bp, mouse
gcagagcatagtcctggtag

SEQ ID NO: 610884 - DNA, 20 bp, mouse
gcccaccctgggaggttcag

SEQ ID NO: 610885 - DNA, 20 bp, mouse
gatgggcgggatataggggc

SEQ ID NO: 610886 - DNA, 20 bp, mouse
gacagaaggaaggggccctg

SEQ ID NO: 610887 - DNA, 20 bp, mouse
gccctcccgacaatccgcag

SEQ ID NO: 610888 - DNA, 20 bp, mouse
gtgcgctggacaggcaggga

SEQ ID NO: 610889 - DNA, 20 bp, mouse
gcgagcgagctgcgcgaacg

SEQ ID NO: 610890 - DNA, 20 bp, mouse
gtgcctgcgctggacaggca

SEQ ID NO: 610891 - DNA, 20 bp, mouse
ggcaagtgcctgcgctggac

SEQ ID NO: 610892 - DNA, 20 bp, mouse
gcagatgccgagtaacggga

SEQ ID NO: 610893 - DNA, 20 bp, mouse
gtcttccagatgccgagtaa

SEQ ID NO: 610894 - DNA, 20 bp, mouse
gtctgttgcgcagcttagag

SEQ ID NO: 610895 - DNA, 20 bp, mouse
gtatttcggagagagggtcg

SEQ ID NO: 610896 - DNA, 20 bp, mouse
ggcgcccgggcggggacagt

SEQ ID NO: 610897 - DNA, 20 bp, mouse
gtgcagctgggccaccgcgg

SEQ ID NO: 610898 - DNA, 20 bp, mouse
gaccgcggcggcagagcacc

SEQ ID NO: 610899 - DNA, 20 bp, mouse
gcagcgagcggccgtagcaa

SEQ ID NO: 610900 - DNA, 20 bp, mouse
ggcagcggcctgcttggctc

SEQ ID NO: 610901 - DNA, 20 bp, mouse
ggcgcagcgcgcatcctccc

SEQ ID NO: 610902 - DNA, 20 bp, mouse
gtcctccccggccgggaccc

SEQ ID NO: 610903 - DNA, 20 bp, mouse
gacgcccactgtccccgccc

SEQ ID NO: 610904 - DNA, 20 bp, mouse
gatttgcagctgggccaccg

SEQ ID NO: 610905 - DNA, 20 bp, mouse
ggggcgcgcagcggcctgct

SEQ ID NO: 610906 - DNA, 20 bp, mouse
gctgggaccagcgggaggaa

SEQ ID NO: 610907 - DNA, 20 bp, mouse
gactggagaggggtccggga

SEQ ID NO: 610908 - DNA, 20 bp, mouse
gagcgaggatctgggaccag

SEQ ID NO: 610909 - DNA, 20 bp, mouse
gtctccagtgaagtgagaag

SEQ ID NO: 610910 - DNA, 20 bp, mouse
gtcgccgcttctcacttcac

SEQ ID NO: 610911 - DNA, 20 bp, mouse
ggccccccggcggagaatcg

SEQ ID NO: 610912 - DNA, 20 bp, mouse
gaggatctgggaccagcggg

SEQ ID NO: 610913 - DNA, 20 bp, mouse
gctggacagagcgaggatct

SEQ ID NO: 610914 - DNA, 20 bp, mouse
gacttcactggagaggggtc

SEQ ID NO: 610915 - DNA, 20 bp, mouse
gagcaactcggccgccaccg

SEQ ID NO: 610916 - DNA, 20 bp, mouse
gaggagcggctgctaaggtg

SEQ ID NO: 610917 - DNA, 20 bp, mouse
gctgccacgctcggactccg

SEQ ID NO: 610918 - DNA, 20 bp, mouse
gagctgggggaaggctcggg

SEQ ID NO: 610919 - DNA, 20 bp, mouse
gcgtgcaatgcgggagtctg

SEQ ID NO: 610920 - DNA, 20 bp, mouse
ggggctggcggatcttgcag

SEQ ID NO: 610921 - DNA, 20 bp, mouse
ggtcctccggctactcaggt

SEQ ID NO: 610922 - DNA, 20 bp, mouse
gctagcttggggctgccgaa

SEQ ID NO: 610923 - DNA, 20 bp, mouse
gaggttccctgagctactcc

SEQ ID NO: 610924 - DNA, 20 bp, mouse
ggcggagccgccctcaggtg

SEQ ID NO: 610925 - DNA, 20 bp, mouse
gccgccctcaggtgaggtcg

SEQ ID NO: 610926 - DNA, 20 bp, mouse
ggggaggggagatgagatcg

SEQ ID NO: 610927 - DNA, 20 bp, mouse
ggagtttaagcacgcgggag

SEQ ID NO: 610928 - DNA, 20 bp, mouse
gtcggagctaactctagtag

SEQ ID NO: 610929 - DNA, 20 bp, mouse
gagctgcgctcggccctcag

SEQ ID NO: 610930 - DNA, 20 bp, mouse
gaggcgcagaccgcccgggg

SEQ ID NO: 610931 - DNA, 20 bp, mouse
gccgcgtgcttaaactccgg

SEQ ID NO: 610932 - DNA, 20 bp, mouse
gcgggaggcagctcgagtgt

SEQ ID NO: 610933 - DNA, 20 bp, mouse
gcccaggcgcagaccgcccg

SEQ ID NO: 610934 - DNA, 20 bp, mouse
gtccttgcaggtaaagcgcg

SEQ ID NO: 610935 - DNA, 20 bp, mouse
gagcccgccgccgccagggg

SEQ ID NO: 610936 - DNA, 20 bp, mouse
gagtgcccgaggagccgaga

SEQ ID NO: 610937 - DNA, 20 bp, mouse
gagctccaccagctccatct

SEQ ID NO: 610938 - DNA, 20 bp, mouse
ggttctccccgagggatcaa

SEQ ID NO: 610939 - DNA, 20 bp, mouse
ggccccccagagctactgga

SEQ ID NO: 610940 - DNA, 20 bp, mouse
gttcggcccggaagtgcccg

SEQ ID NO: 610941 - DNA, 20 bp, mouse
gagctccatctcggctcctc

SEQ ID NO: 610942 - DNA, 20 bp, mouse
gtggcctggggcgacccggt

SEQ ID NO: 610943 - DNA, 20 bp, mouse
gcggctcctcgggcacttcc

SEQ ID NO: 610944 - DNA, 20 bp, mouse
gcgggccgcggcagcaggga

SEQ ID NO: 610945 - DNA, 20 bp, mouse
gaggtctaggttctccccga

SEQ ID NO: 610946 - DNA, 20 bp, mouse
ggcccctcccctgaccccta

SEQ ID NO: 610947 - DNA, 20 bp, mouse
gtccgtaggggtcaggggag

SEQ ID NO: 610948 - DNA, 20 bp, mouse
gaagcgagggtcgggaggta

SEQ ID NO: 610949 - DNA, 20 bp, mouse
ggagaaaagccggaagagat

SEQ ID NO: 610950 - DNA, 20 bp, mouse
gctctttccgtaggggtcag

SEQ ID NO: 610951 - DNA, 20 bp, mouse
ggccggaagagatcggaccc

SEQ ID NO: 610952 - DNA, 20 bp, mouse
gcaggtgaagaagcgagggt

SEQ ID NO: 610953 - DNA, 20 bp, mouse
gtgaggacgcgaggagtcat

SEQ ID NO: 610954 - DNA, 20 bp, mouse
gcaactcaggattctgtcca

SEQ ID NO: 610955 - DNA, 20 bp, mouse
gtgtagttctctttccgtag

SEQ ID NO: 610956 - DNA, 20 bp, mouse
ggcaggaccagagctgccag

SEQ ID NO: 610957 - DNA, 20 bp, mouse
ggcgggaacgcgctgaggct

SEQ ID NO: 610958 - DNA, 20 bp, mouse
gtccagcttgagggacgggg

SEQ ID NO: 610959 - DNA, 20 bp, mouse
ggggcgtcttatggttcccc

SEQ ID NO: 610960 - DNA, 20 bp, mouse
gcggctgacatggcgcactt

SEQ ID NO: 610961 - DNA, 20 bp, mouse
gagacctggccgaggaagat

SEQ ID NO: 610962 - DNA, 20 bp, mouse
gagggaccgcccagagcagc

SEQ ID NO: 610963 - DNA, 20 bp, mouse
ggctctggtcctgctgctct

SEQ ID NO: 610964 - DNA, 20 bp, mouse
ggtgtccagcttgagggacg

SEQ ID NO: 610965 - DNA, 20 bp, mouse
ggcgcacttggggcgtctta

SEQ ID NO: 610966 - DNA, 20 bp, mouse
gtcaaggtcgagagctggta

SEQ ID NO: 610967 - DNA, 20 bp, mouse
gtcgagagctggtaaggcag

SEQ ID NO: 610968 - DNA, 20 bp, mouse
gccaggagcgcagagtgcta

SEQ ID NO: 610969 - DNA, 20 bp, mouse
gtaagttgccggaagatggt

SEQ ID NO: 610970 - DNA, 20 bp, mouse
ggggcggaggacgaagattt

SEQ ID NO: 610971 - DNA, 20 bp, mouse
gagcctgcgagagagtaggc

SEQ ID NO: 610972 - DNA, 20 bp, mouse
ggtcgcctgagagactggtt

SEQ ID NO: 610973 - DNA, 20 bp, mouse
ggctctgcactcagtctgta

SEQ ID NO: 610974 - DNA, 20 bp, mouse
gagggctacgcggggccagt

SEQ ID NO: 610975 - DNA, 20 bp, mouse
gggaggttatgactagataa

SEQ ID NO: 610976 - DNA, 20 bp, mouse
ggccccgccccgttcctggt

SEQ ID NO: 610977 - DNA, 20 bp, mouse
gacgcagcgcccaccaggaa

SEQ ID NO: 610978 - DNA, 20 bp, mouse
gggctcccgcctcccccgaa

SEQ ID NO: 610979 - DNA, 20 bp, mouse
ggcgcccaccaggaacgggg

SEQ ID NO: 610980 - DNA, 20 bp, mouse
ggaagcctgacccaccaagg

SEQ ID NO: 610981 - DNA, 20 bp, mouse
gttcctcactttcctttcgg

SEQ ID NO: 610982 - DNA, 20 bp, mouse
ggctaccgggatcctgaagg

SEQ ID NO: 610983 - DNA, 20 bp, mouse
gtgggctaccgggatcctga

SEQ ID NO: 610984 - DNA, 20 bp, mouse
gctgcgggtgaggagcactc

SEQ ID NO: 610985 - DNA, 20 bp, mouse
gcccgcggcgcggccccaca

SEQ ID NO: 610986 - DNA, 20 bp, mouse
gcaagcaaccgccttcacag

SEQ ID NO: 610987 - DNA, 20 bp, mouse
gccgccttcacagaggtctg

SEQ ID NO: 610988 - DNA, 20 bp, mouse
gtctcctcagacctctgtga

SEQ ID NO: 610989 - DNA, 20 bp, mouse
gactggacgctggtgatgga

SEQ ID NO: 610990 - DNA, 20 bp, mouse
gccaggcggccaggagtacc

SEQ ID NO: 610991 - DNA, 20 bp, mouse
gtcggagcacggcgcagagg

SEQ ID NO: 610992 - DNA, 20 bp, mouse
gtccagttggaggcggtcat

SEQ ID NO: 610993 - DNA, 20 bp, mouse
gggctcggagcacggcgcag

SEQ ID NO: 610994 - DNA, 20 bp, mouse
gtagcccgggttaggacaac

SEQ ID NO: 610995 - DNA, 20 bp, mouse
gcagaagccgcctgtcatgg

SEQ ID NO: 610996 - DNA, 20 bp, mouse
gctgtgcccaccagaggcta

SEQ ID NO: 610997 - DNA, 20 bp, mouse
gcactgtctgtgcccaccag

SEQ ID NO: 610998 - DNA, 20 bp, mouse
ggggagagacgcgtgacagt

SEQ ID NO: 610999 - DNA, 20 bp, mouse
gagtggctgggaagacgcta

SEQ ID NO: 611000 - DNA, 20 bp, mouse
gagacacacaccctagcctc

SEQ ID NO: 611001 - DNA, 20 bp, mouse
gccggtacccagtaagatgt

SEQ ID NO: 611002 - DNA, 20 bp, mouse
ggagacgcgtgacagtaggc

SEQ ID NO: 611003 - DNA, 20 bp, mouse
ggctttggcaggcttatata

SEQ ID NO: 611004 - DNA, 20 bp, mouse
gacagtaggcaggctgtggc

SEQ ID NO: 611005 - DNA, 20 bp, mouse
gtagggtgtgtgtctgcgcg

SEQ ID NO: 611006 - DNA, 20 bp, mouse
gccctcagcgaggacagcaa

SEQ ID NO: 611007 - DNA, 20 bp, mouse
gtgagaagaggctgagacat

SEQ ID NO: 611008 - DNA, 20 bp, mouse
gagcagaagctccctcagcg

SEQ ID NO: 611009 - DNA, 20 bp, mouse
gcactcccccaaaagatggg

SEQ ID NO: 611010 - DNA, 20 bp, mouse
ggagtttctgttctccctcc

SEQ ID NO: 611011 - DNA, 20 bp, mouse
ggggacagaacctgcctggt

SEQ ID NO: 611012 - DNA, 20 bp, mouse
gcttgggccagtgagtgaaa

SEQ ID NO: 611013 - DNA, 20 bp, mouse
gggacagcaagggactagcc

SEQ ID NO: 611014 - DNA, 20 bp, mouse
gagtagacagaagagcgtgg

SEQ ID NO: 611015 - DNA, 20 bp, mouse
gtgcttgtgagcgagaataa

SEQ ID NO: 611016 - DNA, 20 bp, mouse
gggcagccgcaggccagagg

SEQ ID NO: 611017 - DNA, 20 bp, mouse
gacttgactgagactcggag

SEQ ID NO: 611018 - DNA, 20 bp, mouse
ggcaggcagccgcaggccag

SEQ ID NO: 611019 - DNA, 20 bp, mouse
gcgcggacggtgagagccag

SEQ ID NO: 611020 - DNA, 20 bp, mouse
gagctcacagccgagattgc

SEQ ID NO: 611021 - DNA, 20 bp, mouse
gggagaggcgtccccgcgga

SEQ ID NO: 611022 - DNA, 20 bp, mouse
gttgctacttgactgagact

SEQ ID NO: 611023 - DNA, 20 bp, mouse
gactcggagaggcgtccccg

SEQ ID NO: 611024 - DNA, 20 bp, mouse
ggctgtaactccggagtcgg

SEQ ID NO: 611025 - DNA, 20 bp, mouse
gtgggctgtaactccggagt

SEQ ID NO: 611026 - DNA, 20 bp, mouse
ggaagggaagctacgtagag

SEQ ID NO: 611027 - DNA, 20 bp, mouse
ggacagaggcacagcggcag

SEQ ID NO: 611028 - DNA, 20 bp, mouse
ggaagctacgtagagcggca

SEQ ID NO: 611029 - DNA, 20 bp, mouse
gggactaaggcgtcctgtcc

SEQ ID NO: 611030 - DNA, 20 bp, mouse
gggagggcccctccagggtc

SEQ ID NO: 611031 - DNA, 20 bp, mouse
gttccggaccctggtgtgag

SEQ ID NO: 611032 - DNA, 20 bp, mouse
gactctgtgtcaggactgga

SEQ ID NO: 611033 - DNA, 20 bp, mouse
gcagtcctgacacagagtgt

SEQ ID NO: 611034 - DNA, 20 bp, mouse
gcttagtcccgaccctggag

SEQ ID NO: 611035 - DNA, 20 bp, mouse
gggcccgcagaggcacgaag

SEQ ID NO: 611036 - DNA, 20 bp, mouse
ggagagcaaagacctaatgt

SEQ ID NO: 611037 - DNA, 20 bp, mouse
gctgcaccggtccttggact

SEQ ID NO: 611038 - DNA, 20 bp, mouse
gggatgcctagtccaaggac

SEQ ID NO: 611039 - DNA, 20 bp, mouse
gactcagactggatcccgaa

SEQ ID NO: 611040 - DNA, 20 bp, mouse
gagcctgcggtgtcctgcac

SEQ ID NO: 611041 - DNA, 20 bp, mouse
gggactaggcatcctacatt

SEQ ID NO: 611042 - DNA, 20 bp, mouse
gggtgtcctgcaccggtcct

SEQ ID NO: 611043 - DNA, 20 bp, mouse
ggccagagagcacttcaggg

SEQ ID NO: 611044 - DNA, 20 bp, mouse
gagcagggtgtcgaagccat

SEQ ID NO: 611045 - DNA, 20 bp, mouse
gactggatcccgaagggaac

SEQ ID NO: 611046 - DNA, 20 bp, mouse
gtcgggctcgctggctgagg

SEQ ID NO: 611047 - DNA, 20 bp, mouse
gtagtcttcggagccggagg

SEQ ID NO: 611048 - DNA, 20 bp, mouse
ggccccatggacacccgatc

SEQ ID NO: 611049 - DNA, 20 bp, mouse
ggggtgtgcacgtctttcgg

SEQ ID NO: 611050 - DNA, 20 bp, mouse
ggctccgaagactacagact

SEQ ID NO: 611051 - DNA, 20 bp, mouse
gtcagccagcgagcccgatc

SEQ ID NO: 611052 - DNA, 20 bp, mouse
ggcccgatcgggtgtccatg

SEQ ID NO: 611053 - DNA, 20 bp, mouse
ggacacccgatcgggctcgc

SEQ ID NO: 611054 - DNA, 20 bp, mouse
gtggctcaccgctccgcctc

SEQ ID NO: 611055 - DNA, 20 bp, mouse
gggctccgcgcggccccaag

SEQ ID NO: 611056 - DNA, 20 bp, mouse
gagagccggttacaatgtcg

SEQ ID NO: 611057 - DNA, 20 bp, mouse
gtgctctgagaatttcgtgt

SEQ ID NO: 611058 - DNA, 20 bp, mouse
gcaagacgcataagcaaagg

SEQ ID NO: 611059 - DNA, 20 bp, mouse
ggcagccccgacattgtaac

SEQ ID NO: 611060 - DNA, 20 bp, mouse
gcagagcagcggctggaatg

SEQ ID NO: 611061 - DNA, 20 bp, mouse
gcagcaagacgcataagcaa

SEQ ID NO: 611062 - DNA, 20 bp, mouse
gggctctgcaaccgaagaga

SEQ ID NO: 611063 - DNA, 20 bp, mouse
ggacatcatagaggactgaa

SEQ ID NO: 611064 - DNA, 20 bp, mouse
gtcatagaggactgaatgga

SEQ ID NO: 611065 - DNA, 20 bp, mouse
gtgggaagaggctcacggat

SEQ ID NO: 611066 - DNA, 20 bp, mouse
ggctcacaggtagggagctc

SEQ ID NO: 611067 - DNA, 20 bp, mouse
ggtagtgtagctcacaggta

SEQ ID NO: 611068 - DNA, 20 bp, mouse
gtctgtgtagtgtagctcac

SEQ ID NO: 611069 - DNA, 20 bp, mouse
gttcacacagaggatggatg

SEQ ID NO: 611070 - DNA, 20 bp, mouse
gcttactgtgctaggcacat

SEQ ID NO: 611071 - DNA, 20 bp, mouse
ggcataccgtaggtcatcag

SEQ ID NO: 611072 - DNA, 20 bp, mouse
ggcgtctcgtggggtctggt

SEQ ID NO: 611073 - DNA, 20 bp, mouse
gagtgaccactgatgaccta

SEQ ID NO: 611074 - DNA, 20 bp, mouse
gcttaattgtgctgtcacag

SEQ ID NO: 611075 - DNA, 20 bp, mouse
gggggctgtacactaatcaa

SEQ ID NO: 611076 - DNA, 20 bp, mouse
ggcgcacatctcactcgtct

SEQ ID NO: 611077 - DNA, 20 bp, mouse
gggcgccaccgccacggaca

SEQ ID NO: 611078 - DNA, 20 bp, mouse
gacatggacgtgaggctgcg

SEQ ID NO: 611079 - DNA, 20 bp, mouse
gtgtcggggtgcacagccac

SEQ ID NO: 611080 - DNA, 20 bp, mouse
ggagctcgcagaaagcggtg

SEQ ID NO: 611081 - DNA, 20 bp, mouse
gagcctcacgtccatgtccg

SEQ ID NO: 611082 - DNA, 20 bp, mouse
ggatgggagctcgcagaaag

SEQ ID NO: 611083 - DNA, 20 bp, mouse
ggacagcatgctctccgaag

SEQ ID NO: 611084 - DNA, 20 bp, mouse
gtactctctaaagtccagcc

SEQ ID NO: 611085 - DNA, 20 bp, mouse
gcggctggcgtaccttccct

SEQ ID NO: 611086 - DNA, 20 bp, mouse
gaatgcctctggccccacag

SEQ ID NO: 611087 - DNA, 20 bp, mouse
gcggccgggctcagatccag

SEQ ID NO: 611088 - DNA, 20 bp, mouse
gttctgtaggtgcctctgtg

SEQ ID NO: 611089 - DNA, 20 bp, mouse
ggaggagcaggtgagcgatg

SEQ ID NO: 611090 - DNA, 20 bp, mouse
ggaaggcttgacacatcccg

SEQ ID NO: 611091 - DNA, 20 bp, mouse
gactgaggcgggatatacag

SEQ ID NO: 611092 - DNA, 20 bp, mouse
gatccagcggccaatgcctc

SEQ ID NO: 611093 - DNA, 20 bp, mouse
gaggccacgcccccgagaaa

SEQ ID NO: 611094 - DNA, 20 bp, mouse
gtggccgctggatctgagcc

SEQ ID NO: 611095 - DNA, 20 bp, mouse
ggtcagtaataggtatacag

SEQ ID NO: 611096 - DNA, 20 bp, mouse
ggagctctcagaaacatcca

SEQ ID NO: 611097 - DNA, 20 bp, mouse
gagagtctggcaatgacaga

SEQ ID NO: 611098 - DNA, 20 bp, mouse
gctggcacccagcacacggc

SEQ ID NO: 611099 - DNA, 20 bp, mouse
gtgacagagggtgggtttcg

SEQ ID NO: 611100 - DNA, 20 bp, mouse
ggctgtctgagagtgagacc

SEQ ID NO: 611101 - DNA, 20 bp, mouse
ggtctggcaatgacagaggg

SEQ ID NO: 611102 - DNA, 20 bp, mouse
gcgtgtgctgggtgccagtc

SEQ ID NO: 611103 - DNA, 20 bp, mouse
gtaggtccccagtcctccca

SEQ ID NO: 611104 - DNA, 20 bp, mouse
gagtgagacctggcttggga

SEQ ID NO: 611105 - DNA, 20 bp, mouse
gattcatgagggtcacgtag

SEQ ID NO: 611106 - DNA, 20 bp, mouse
ggacgcggcacacacggtat

SEQ ID NO: 611107 - DNA, 20 bp, mouse
gcgggtggacgcggcacaca

SEQ ID NO: 611108 - DNA, 20 bp, mouse
gagcccgggcggtgcagagt

SEQ ID NO: 611109 - DNA, 20 bp, mouse
gctcctggctcgggtggacg

SEQ ID NO: 611110 - DNA, 20 bp, mouse
gaaagagtctggagcccggg

SEQ ID NO: 611111 - DNA, 20 bp, mouse
gagtgtgtggccagacacta

SEQ ID NO: 611112 - DNA, 20 bp, mouse
gactgctgcaggtagcgagg

SEQ ID NO: 611113 - DNA, 20 bp, mouse
gtgcccactctgcaccgccc

SEQ ID NO: 611114 - DNA, 20 bp, mouse
ggtatgggctgcaaagagtc

SEQ ID NO: 611115 - DNA, 20 bp, mouse
gtgcggggcgctcctggctc

SEQ ID NO: 611116 - DNA, 20 bp, mouse
gaagttctggattcttgtcg

SEQ ID NO: 611117 - DNA, 20 bp, mouse
gtgcgcgcgcaagcccgcgg

SEQ ID NO: 611118 - DNA, 20 bp, mouse
ggcaagcccgcggaggttgg

SEQ ID NO: 611119 - DNA, 20 bp, mouse
ggcggcgacttgacgcttag

SEQ ID NO: 611120 - DNA, 20 bp, mouse
gtagtgatctgcccgggcag

SEQ ID NO: 611121 - DNA, 20 bp, mouse
ggtccaggtaggcctcaaca

SEQ ID NO: 611122 - DNA, 20 bp, mouse
gcgcgcaagcccgcggaggt

SEQ ID NO: 611123 - DNA, 20 bp, mouse
ggaagtctgcgcttcgggag

SEQ ID NO: 611124 - DNA, 20 bp, mouse
gcgactgcggtgcccgaagt

SEQ ID NO: 611125 - DNA, 20 bp, mouse
gtgggcgtgctgggtcctgg

SEQ ID NO: 611126 - DNA, 20 bp, mouse
ggcacgcagagcgccagcag

SEQ ID NO: 611127 - DNA, 20 bp, mouse
gggcgaccgccggtccacag

SEQ ID NO: 611128 - DNA, 20 bp, mouse
gggtgcgtggatctaaggga

SEQ ID NO: 611129 - DNA, 20 bp, mouse
ggccatggcgcggtgcgggc

SEQ ID NO: 611130 - DNA, 20 bp, mouse
gcagcggcgcgggcagctgg

SEQ ID NO: 611131 - DNA, 20 bp, mouse
gagctggtgcgtggatctaa

SEQ ID NO: 611132 - DNA, 20 bp, mouse
gcatggccccgcgcgcccgg

SEQ ID NO: 611133 - DNA, 20 bp, mouse
gggcgcgcggggccatggcg

SEQ ID NO: 611134 - DNA, 20 bp, mouse
gagagcgccagcagcggcgc

SEQ ID NO: 611135 - DNA, 20 bp, mouse
ggagcaccaggtgaaactcg

SEQ ID NO: 611136 - DNA, 20 bp, mouse
ggcacctagcactgacccag

SEQ ID NO: 611137 - DNA, 20 bp, mouse
gacccagcggctgcctcctg

SEQ ID NO: 611138 - DNA, 20 bp, mouse
gactcctggtggtaagtcgt

SEQ ID NO: 611139 - DNA, 20 bp, mouse
gggctgccctgaagagtgaa

SEQ ID NO: 611140 - DNA, 20 bp, mouse
ggtggtcctcgggaaacctc

SEQ ID NO: 611141 - DNA, 20 bp, mouse
gtgcctcctgaggtttcccg

SEQ ID NO: 611142 - DNA, 20 bp, mouse
gacctcaggaggcagccgct

SEQ ID NO: 611143 - DNA, 20 bp, mouse
gctgtgctgcgcactcctgg

SEQ ID NO: 611144 - DNA, 20 bp, mouse
gtggtccccatcagcaggag

SEQ ID NO: 611145 - DNA, 20 bp, mouse
ggaggaccacaatgaacaag

SEQ ID NO: 611146 - DNA, 20 bp, mouse
gatcccaacacgaggatctg

SEQ ID NO: 611147 - DNA, 20 bp, mouse
ggcctcgggaccggcaatca

SEQ ID NO: 611148 - DNA, 20 bp, mouse
ggccatgattgccggtcccg

SEQ ID NO: 611149 - DNA, 20 bp, mouse
gcacccgcaagccagactca

SEQ ID NO: 611150 - DNA, 20 bp, mouse
gacagttcttgcctcgggac

SEQ ID NO: 611151 - DNA, 20 bp, mouse
gggaccggcaatcatggctt

SEQ ID NO: 611152 - DNA, 20 bp, mouse
gctgccgcagatcctcgtgt

SEQ ID NO: 611153 - DNA, 20 bp, mouse
gagggaaccgggaagacacg

SEQ ID NO: 611154 - DNA, 20 bp, mouse
gggagaacccggtgaaacca

SEQ ID NO: 611155 - DNA, 20 bp, mouse
gagtctggcttgcgggtggt

SEQ ID NO: 611156 - DNA, 20 bp, mouse
ggaacggcaagatggaagat

SEQ ID NO: 611157 - DNA, 20 bp, mouse
gagaatcggatcacagagaa

SEQ ID NO: 611158 - DNA, 20 bp, mouse
gatttactctgaccttccag

SEQ ID NO: 611159 - DNA, 20 bp, mouse
gtgtgatccgattcttggaa

SEQ ID NO: 611160 - DNA, 20 bp, mouse
gtcttgttagaggcagaatg

SEQ ID NO: 611161 - DNA, 20 bp, mouse
ggattcttggaacggcaaga

SEQ ID NO: 611162 - DNA, 20 bp, mouse
ggaggggagggtcttgttag

SEQ ID NO: 611163 - DNA, 20 bp, mouse
ggtcgtcgccagataggaaa

SEQ ID NO: 611164 - DNA, 20 bp, mouse
gccgggagcccatccagaag

SEQ ID NO: 611165 - DNA, 20 bp, mouse
ggactttctgctgggagcga

SEQ ID NO: 611166 - DNA, 20 bp, mouse
gctgcatgaggcggcgacat

SEQ ID NO: 611167 - DNA, 20 bp, mouse
gctgtcccagctgcatgagg

SEQ ID NO: 611168 - DNA, 20 bp, mouse
gcatgggcgccaggagactc

SEQ ID NO: 611169 - DNA, 20 bp, mouse
gactccgggtccgaagccag

SEQ ID NO: 611170 - DNA, 20 bp, mouse
gcttcggacccggagtctcc

SEQ ID NO: 611171 - DNA, 20 bp, mouse
gcggtctgattgcactgggt

SEQ ID NO: 611172 - DNA, 20 bp, mouse
gctgggacagttccgagtct

SEQ ID NO: 611173 - DNA, 20 bp, mouse
gcactggacatagtaagcaa

SEQ ID NO: 611174 - DNA, 20 bp, mouse
ggggtcagcagaggagcatg

SEQ ID NO: 611175 - DNA, 20 bp, mouse
gggtgggcaccgagctgtcc

SEQ ID NO: 611176 - DNA, 20 bp, mouse
ggcgtataggctgaagaagc

SEQ ID NO: 611177 - DNA, 20 bp, mouse
gaatgtgctcagaagcgtat

SEQ ID NO: 611178 - DNA, 20 bp, mouse
gcttcccagacaccacgtca

SEQ ID NO: 611179 - DNA, 20 bp, mouse
gttcaggccaagagccccat

SEQ ID NO: 611180 - DNA, 20 bp, mouse
gtggaggcccgggagtggag

SEQ ID NO: 611181 - DNA, 20 bp, mouse
gttccagagggtatatatac

SEQ ID NO: 611182 - DNA, 20 bp, mouse
gtaaccctgacgtggtgtct

SEQ ID NO: 611183 - DNA, 20 bp, mouse
gcacattcggcgctaggaac

SEQ ID NO: 611184 - DNA, 20 bp, mouse
gaggaggttcagagcccatg

SEQ ID NO: 611185 - DNA, 20 bp, mouse
ggaggtgtttgtagtgacct

SEQ ID NO: 611186 - DNA, 20 bp, mouse
gtcagtgatccagtccctca

SEQ ID NO: 611187 - DNA, 20 bp, mouse
gctgttgcgccatgagggac

SEQ ID NO: 611188 - DNA, 20 bp, mouse
gactgtcaaaatattcactg

SEQ ID NO: 611189 - DNA, 20 bp, mouse
gagggccacaggtattgtgg

SEQ ID NO: 611190 - DNA, 20 bp, mouse
gtggaacatcgcaagtgaca

SEQ ID NO: 611191 - DNA, 20 bp, mouse
gaaacactgttgcgccatga

SEQ ID NO: 611192 - DNA, 20 bp, mouse
gggtagatggtcagcactat

SEQ ID NO: 611193 - DNA, 20 bp, mouse
gaaaatgtgtagaggagatg

SEQ ID NO: 611194 - DNA, 20 bp, mouse
gaagagggccacaggtattg

SEQ ID NO: 611195 - DNA, 20 bp, mouse
gacttacttggatcacagta

SEQ ID NO: 611196 - DNA, 20 bp, mouse
gctcaggagaagcactatgg

SEQ ID NO: 611197 - DNA, 20 bp, mouse
gatcagccgacagaagactc

SEQ ID NO: 611198 - DNA, 20 bp, mouse
gcttctcctgagtcttctgt

SEQ ID NO: 611199 - DNA, 20 bp, mouse
gagactcaggagaagcacta

SEQ ID NO: 611200 - DNA, 20 bp, mouse
gaggcagagacaaggcaagt

SEQ ID NO: 611201 - DNA, 20 bp, mouse
ggggcatgggccatgctgta

SEQ ID NO: 611202 - DNA, 20 bp, mouse
gctcatatgagtgtcgggaa

SEQ ID NO: 611203 - DNA, 20 bp, mouse
ggcacagggcacatgtgagt

SEQ ID NO: 611204 - DNA, 20 bp, mouse
gacactcatatgaggaggct

SEQ ID NO: 611205 - DNA, 20 bp, mouse
gggtcagccgagtgtagttg

SEQ ID NO: 611206 - DNA, 20 bp, mouse
gctctcgcggtgccccagct

SEQ ID NO: 611207 - DNA, 20 bp, mouse
ggattacccgcgcagatcaa

SEQ ID NO: 611208 - DNA, 20 bp, mouse
ggatctgcagctctctctcg

SEQ ID NO: 611209 - DNA, 20 bp, mouse
gaggcaggcgaactaggaga

SEQ ID NO: 611210 - DNA, 20 bp, mouse
ggcgcagcagcgctggcact

SEQ ID NO: 611211 - DNA, 20 bp, mouse
ggcactggcgagtagcaggt

SEQ ID NO: 611212 - DNA, 20 bp, mouse
ggagctggggcagaacaacg

SEQ ID NO: 611213 - DNA, 20 bp, mouse
gtgatcggcgatcagattac

SEQ ID NO: 611214 - DNA, 20 bp, mouse
gttgatgcgcagcaactgat

SEQ ID NO: 611215 - DNA, 20 bp, mouse
gcagcgagatgaaagggatg

SEQ ID NO: 611216 - DNA, 20 bp, mouse
gagccagagttcggaaaact

SEQ ID NO: 611217 - DNA, 20 bp, mouse
gccaggacctcgcacccagt

SEQ ID NO: 611218 - DNA, 20 bp, mouse
gcgaggcgccgggcaggagt

SEQ ID NO: 611219 - DNA, 20 bp, mouse
ggcagcaggccaggcacggt

SEQ ID NO: 611220 - DNA, 20 bp, mouse
gcccattggggctggggaca

SEQ ID NO: 611221 - DNA, 20 bp, mouse
ggcctctcactcccccattg

SEQ ID NO: 611222 - DNA, 20 bp, mouse
gtcggagaaaatttaagctg

SEQ ID NO: 611223 - DNA, 20 bp, mouse
ggcgggaccggaagagcctg

SEQ ID NO: 611224 - DNA, 20 bp, mouse
gcaggagtgggcttgtacta

SEQ ID NO: 611225 - DNA, 20 bp, mouse
gggtgttgcaagagcgggac

SEQ ID NO: 611226 - DNA, 20 bp, mouse
gactagagctccaggcacaa

SEQ ID NO: 611227 - DNA, 20 bp, mouse
gaccagcgcgacccagaggg

SEQ ID NO: 611228 - DNA, 20 bp, mouse
gagggcggcgggcgccatag

SEQ ID NO: 611229 - DNA, 20 bp, mouse
gaccagctagagcgcagctg

SEQ ID NO: 611230 - DNA, 20 bp, mouse
ggcgggcgccataggggcag

SEQ ID NO: 611231 - DNA, 20 bp, mouse
ggtgtctgctggggacgtga

SEQ ID NO: 611232 - DNA, 20 bp, mouse
gcagtagcagtagctggaat

SEQ ID NO: 611233 - DNA, 20 bp, mouse
gaagaccagcgcgacccaga

SEQ ID NO: 611234 - DNA, 20 bp, mouse
gaattccgggacagcatgag

SEQ ID NO: 611235 - DNA, 20 bp, mouse
gccagacctcgggtccccag

SEQ ID NO: 611236 - DNA, 20 bp, mouse
gggccggcgagggactgagt

SEQ ID NO: 611237 - DNA, 20 bp, mouse
gccggtctaggcagcggagg

SEQ ID NO: 611238 - DNA, 20 bp, mouse
gcgccggccggtctaggcag

SEQ ID NO: 611239 - DNA, 20 bp, mouse
ggtccctcgccggccggtct

SEQ ID NO: 611240 - DNA, 20 bp, mouse
gggaggcgagtgcttgatag

SEQ ID NO: 611241 - DNA, 20 bp, mouse
ggcacccaggcggaagaggg

SEQ ID NO: 611242 - DNA, 20 bp, mouse
gcagcaggggaggctccgaa

SEQ ID NO: 611243 - DNA, 20 bp, mouse
gcggccggtctaggcagcgg

SEQ ID NO: 611244 - DNA, 20 bp, mouse
gggcgagggactgagtcgga

SEQ ID NO: 611245 - DNA, 20 bp, mouse
ggtcgttggagagcaccggg

SEQ ID NO: 611246 - DNA, 20 bp, mouse
gctgcagaagaagccaaaca

SEQ ID NO: 611247 - DNA, 20 bp, mouse
ggcttgcactcggccatgtt

SEQ ID NO: 611248 - DNA, 20 bp, mouse
gtcgctggttcctttggcgg

SEQ ID NO: 611249 - DNA, 20 bp, mouse
gccggcggtgaactgatggc

SEQ ID NO: 611250 - DNA, 20 bp, mouse
gggtgtccagtctgagtcgc

SEQ ID NO: 611251 - DNA, 20 bp, mouse
gactgccggcggtgaactga

SEQ ID NO: 611252 - DNA, 20 bp, mouse
gcagaaagcggtccatcgga

SEQ ID NO: 611253 - DNA, 20 bp, mouse
gcggagctgagactcgctct

SEQ ID NO: 611254 - DNA, 20 bp, mouse
ggaagttctgaagtgttggt

SEQ ID NO: 611255 - DNA, 20 bp, mouse
ggcagcggcgtgcttgcact

SEQ ID NO: 611256 - DNA, 20 bp, mouse
gacgtggctgaaggtaacca

SEQ ID NO: 611257 - DNA, 20 bp, mouse
ggtgactcagactggagacg

SEQ ID NO: 611258 - DNA, 20 bp, mouse
ggaagttctgaggagttggt

SEQ ID NO: 611259 - DNA, 20 bp, mouse
gagactggagacgtggctga

SEQ ID NO: 611260 - DNA, 20 bp, mouse
gaactctggacgaagttctg

SEQ ID NO: 611261 - DNA, 20 bp, mouse
gcatggtgtcactcagctgg

SEQ ID NO: 611262 - DNA, 20 bp, mouse
gcagagttggggaattgtgg

SEQ ID NO: 611263 - DNA, 20 bp, mouse
ggttctgaggagttggttgg

SEQ ID NO: 611264 - DNA, 20 bp, mouse
gcctgagctcccggacaaga

SEQ ID NO: 611265 - DNA, 20 bp, mouse
gcgctgggcaccggatcccc

SEQ ID NO: 611266 - DNA, 20 bp, mouse
gctgctgcggggctgcgtgg

SEQ ID NO: 611267 - DNA, 20 bp, mouse
gcaggcggtacagaccgcaa

SEQ ID NO: 611268 - DNA, 20 bp, mouse
ggcggtacagaccgcaatgg

SEQ ID NO: 611269 - DNA, 20 bp, mouse
gacagaccgcaatggaggca

SEQ ID NO: 611270 - DNA, 20 bp, mouse
ggcactcacaagggcccagg

SEQ ID NO: 611271 - DNA, 20 bp, mouse
gtggaggcacggctgctgcg

SEQ ID NO: 611272 - DNA, 20 bp, mouse
gaccagagccgcactcacaa

SEQ ID NO: 611273 - DNA, 20 bp, mouse
gcccggggaaaggggtctgg

SEQ ID NO: 611274 - DNA, 20 bp, mouse
gtcaccggcgacctagttag

SEQ ID NO: 611275 - DNA, 20 bp, mouse
ggaggaagcacaagctcccg

SEQ ID NO: 611276 - DNA, 20 bp, mouse
gtgcttctgagggtgagtag

SEQ ID NO: 611277 - DNA, 20 bp, mouse
ggcctgctggggctccgcta

SEQ ID NO: 611278 - DNA, 20 bp, mouse
gagtagaggcacaagtgtgt

SEQ ID NO: 611279 - DNA, 20 bp, mouse
gaagtgtgtgggaaccatag

SEQ ID NO: 611280 - DNA, 20 bp, mouse
gatggtggaggtggagaatg

SEQ ID NO: 611281 - DNA, 20 bp, mouse
gtgaccatgatagcctgctg

SEQ ID NO: 611282 - DNA, 20 bp, mouse
ggagccccagcaggctatca

SEQ ID NO: 611283 - DNA, 20 bp, mouse
ggatttaacagagaaggagt

SEQ ID NO: 611284 - DNA, 20 bp, mouse
gacaggaaaggagctgagaa

SEQ ID NO: 611285 - DNA, 20 bp, mouse
gcacctccaccatacaggaa

SEQ ID NO: 611286 - DNA, 20 bp, mouse
gcagacaaggatgtatgtgt

SEQ ID NO: 611287 - DNA, 20 bp, mouse
gaaaccccagactcctgtga

SEQ ID NO: 611288 - DNA, 20 bp, mouse
gacacaggtccagaatacgt

SEQ ID NO: 611289 - DNA, 20 bp, mouse
gtccactacaggccatggta

SEQ ID NO: 611290 - DNA, 20 bp, mouse
gacttggagttacagcaagg

SEQ ID NO: 611291 - DNA, 20 bp, mouse
gacagcacttgtgaccactg

SEQ ID NO: 611292 - DNA, 20 bp, mouse
gcacttgtgaccactggggt

SEQ ID NO: 611293 - DNA, 20 bp, mouse
gaccataccatggcctgtag

SEQ ID NO: 611294 - DNA, 20 bp, mouse
gcacacttggagttacagca

SEQ ID NO: 611295 - DNA, 20 bp, mouse
gacagcggctcaccatacca

SEQ ID NO: 611296 - DNA, 20 bp, mouse
gggccaggcgctggagactc

SEQ ID NO: 611297 - DNA, 20 bp, mouse
gtttcaccgcgggagagtca

SEQ ID NO: 611298 - DNA, 20 bp, mouse
gcggcaccctgactctcccg

SEQ ID NO: 611299 - DNA, 20 bp, mouse
gaaccccgctgcggtgagta

SEQ ID NO: 611300 - DNA, 20 bp, mouse
ggagtcagggtgccggcagg

SEQ ID NO: 611301 - DNA, 20 bp, mouse
gctatccaggaccccctctg

SEQ ID NO: 611302 - DNA, 20 bp, mouse
gggagagtcagggtgccggc

SEQ ID NO: 611303 - DNA, 20 bp, mouse
gggacactgtgcgagagcag

SEQ ID NO: 611304 - DNA, 20 bp, mouse
gagagcagtggctagagtaa

SEQ ID NO: 611305 - DNA, 20 bp, mouse
gaggaacagcaaccccgctg

SEQ ID NO: 611306 - DNA, 20 bp, mouse
ggtctgctggggactagtgg

SEQ ID NO: 611307 - DNA, 20 bp, mouse
gtcgctgccctgagatcgaa

SEQ ID NO: 611308 - DNA, 20 bp, mouse
ggaggagcgttctgcttcct

SEQ ID NO: 611309 - DNA, 20 bp, mouse
ggacaaacctttcgatctca

SEQ ID NO: 611310 - DNA, 20 bp, mouse
ggggactagtgggggactag

SEQ ID NO: 611311 - DNA, 20 bp, mouse
gcttccttggcagctcggtg

SEQ ID NO: 611312 - DNA, 20 bp, mouse
gtttgtctgctggggactag

SEQ ID NO: 611313 - DNA, 20 bp, mouse
gtgccgctccacaagaccac

SEQ ID NO: 611314 - DNA, 20 bp, mouse
gaagaccacaggtcaaacac

SEQ ID NO: 611315 - DNA, 20 bp, mouse
gggaacccaggtactcaatc

SEQ ID NO: 611316 - DNA, 20 bp, mouse
gtaagcggcaaagccaagag

SEQ ID NO: 611317 - DNA, 20 bp, mouse
gggaaggcatactgctgtcc

SEQ ID NO: 611318 - DNA, 20 bp, mouse
gctgggctgcaagtctgcat

SEQ ID NO: 611319 - DNA, 20 bp, mouse
gaggtccttcagggcccctg

SEQ ID NO: 611320 - DNA, 20 bp, mouse
ggaaggtcacagttagaagg

SEQ ID NO: 611321 - DNA, 20 bp, mouse
gctgaagctgaggtccttca

SEQ ID NO: 611322 - DNA, 20 bp, mouse
gcagcagtatgccttcctca

SEQ ID NO: 611323 - DNA, 20 bp, mouse
gccttcctcaggggccctga

SEQ ID NO: 611324 - DNA, 20 bp, mouse
gcaaagaagagcaagctaag

SEQ ID NO: 611325 - DNA, 20 bp, mouse
ggaagtgctgactgaagctg

SEQ ID NO: 611326 - DNA, 20 bp, mouse
gcgccccgaccggttcacag

SEQ ID NO: 611327 - DNA, 20 bp, mouse
ggacctctgtgaaccggtcg

SEQ ID NO: 611328 - DNA, 20 bp, mouse
gtgcgcagctcggaggagat

SEQ ID NO: 611329 - DNA, 20 bp, mouse
ggtgcagcggaccctcgtgt

SEQ ID NO: 611330 - DNA, 20 bp, mouse
gtgccaggacctctgtgaac

SEQ ID NO: 611331 - DNA, 20 bp, mouse
gtggccgggagtctgctcgg

SEQ ID NO: 611332 - DNA, 20 bp, mouse
ggtcccggggagccactgcc

SEQ ID NO: 611333 - DNA, 20 bp, mouse
ggccgggccagccgagacta

SEQ ID NO: 611334 - DNA, 20 bp, mouse
gcagtggctccccgggacgt

SEQ ID NO: 611335 - DNA, 20 bp, mouse
gagagatggcagggtacccc

SEQ ID NO: 611336 - DNA, 20 bp, mouse
gtatgctgagggcctcacct

SEQ ID NO: 611337 - DNA, 20 bp, mouse
gctcgggtcccgggatgggg

SEQ ID NO: 611338 - DNA, 20 bp, mouse
gatcccgggacccgagggat

SEQ ID NO: 611339 - DNA, 20 bp, mouse
gcgggacccgagggatgggg

SEQ ID NO: 611340 - DNA, 20 bp, mouse
gcgcccgtcggagccagagg

SEQ ID NO: 611341 - DNA, 20 bp, mouse
gtcccagcaggagccttctc

SEQ ID NO: 611342 - DNA, 20 bp, mouse
gggagtgaaccagcccacgt

SEQ ID NO: 611343 - DNA, 20 bp, mouse
gaccagcggggccagcaggg

SEQ ID NO: 611344 - DNA, 20 bp, mouse
ggctgaccacgaccagcagg

SEQ ID NO: 611345 - DNA, 20 bp, mouse
gcctcaccgcccccccatcc

SEQ ID NO: 611346 - DNA, 20 bp, mouse
gcccatgtggcctggagatg

SEQ ID NO: 611347 - DNA, 20 bp, mouse
gctgggagcaggtgagtcag

SEQ ID NO: 611348 - DNA, 20 bp, mouse
ggaagcagggagagcgccca

SEQ ID NO: 611349 - DNA, 20 bp, mouse
gcaggggagatgggaatcta

SEQ ID NO: 611350 - DNA, 20 bp, mouse
ggcagggagggtgggaatac

SEQ ID NO: 611351 - DNA, 20 bp, mouse
gtggccaagaggtagcaggg

SEQ ID NO: 611352 - DNA, 20 bp, mouse
gtctgactgagccccccatg

SEQ ID NO: 611353 - DNA, 20 bp, mouse
gtgtggtctcagaagtgagg

SEQ ID NO: 611354 - DNA, 20 bp, mouse
gccagccttcaggagcccag

SEQ ID NO: 611355 - DNA, 20 bp, mouse
gcagaagtgaggtggccaag

SEQ ID NO: 611356 - DNA, 20 bp, mouse
gagccagagaacctacttca

SEQ ID NO: 611357 - DNA, 20 bp, mouse
gggagactgccctcagagca

SEQ ID NO: 611358 - DNA, 20 bp, mouse
gaagtcaggagagcgctcct

SEQ ID NO: 611359 - DNA, 20 bp, mouse
gtaccctgaagtaggttctc

SEQ ID NO: 611360 - DNA, 20 bp, mouse
gtttctcggagcaaaaacag

SEQ ID NO: 611361 - DNA, 20 bp, mouse
gaaaaacagaggcacggtgg

SEQ ID NO: 611362 - DNA, 20 bp, mouse
gagcaaaaacagaggcacgg

SEQ ID NO: 611363 - DNA, 20 bp, mouse
gaactctggagcacccgcgg

SEQ ID NO: 611364 - DNA, 20 bp, mouse
gcccatcactccgcagaagg

SEQ ID NO: 611365 - DNA, 20 bp, mouse
gactgccctcagagcatggc

SEQ ID NO: 611366 - DNA, 20 bp, mouse
gctccggagaggaggaactc

SEQ ID NO: 611367 - DNA, 20 bp, mouse
gattgtggtttcctccggag

SEQ ID NO: 611368 - DNA, 20 bp, mouse
gcgagcgtgttgggcaattg

SEQ ID NO: 611369 - DNA, 20 bp, mouse
ggcttgccaaccctttccct

SEQ ID NO: 611370 - DNA, 20 bp, mouse
gtgcacagcccgagcgtgtt

SEQ ID NO: 611371 - DNA, 20 bp, mouse
ggcggctggaacagaaccac

SEQ ID NO: 611372 - DNA, 20 bp, mouse
gagtgagtcctaggggtgac

SEQ ID NO: 611373 - DNA, 20 bp, mouse
gctccatgccagagcagctg

SEQ ID NO: 611374 - DNA, 20 bp, mouse
gaccaccggagacggcgctg

SEQ ID NO: 611375 - DNA, 20 bp, mouse
ggctttaaagtgagtcctag

SEQ ID NO: 611376 - DNA, 20 bp, mouse
ggacagcagaaggatggcag

SEQ ID NO: 611377 - DNA, 20 bp, mouse
gttcggagaaggagtcccag

SEQ ID NO: 611378 - DNA, 20 bp, mouse
ggagctggccagccattagg

SEQ ID NO: 611379 - DNA, 20 bp, mouse
gcttccggcagcacttccac

SEQ ID NO: 611380 - DNA, 20 bp, mouse
ggtctctccaagacagcaga

SEQ ID NO: 611381 - DNA, 20 bp, mouse
gggacttagcaccctcctaa

SEQ ID NO: 611382 - DNA, 20 bp, mouse
gctcctgcttagacaatcag

SEQ ID NO: 611383 - DNA, 20 bp, mouse
ggagggtgctaagtcctgcg

SEQ ID NO: 611384 - DNA, 20 bp, mouse
gtgctctcttatttaatggg

SEQ ID NO: 611385 - DNA, 20 bp, mouse
gccggagctggccagccatt

SEQ ID NO: 611386 - DNA, 20 bp, mouse
ggaggacttgattctctcaa

SEQ ID NO: 611387 - DNA, 20 bp, mouse
ggctagaactcgttctctga

SEQ ID NO: 611388 - DNA, 20 bp, mouse
gacgagttctagcctcatgg

SEQ ID NO: 611389 - DNA, 20 bp, mouse
gcaaaggcatttcctccatg

SEQ ID NO: 611390 - DNA, 20 bp, mouse
gagagaatcaagtcctcaaa

SEQ ID NO: 611391 - DNA, 20 bp, mouse
gaagtcctcaaagggcagag

SEQ ID NO: 611392 - DNA, 20 bp, mouse
gcagcattgctagaggtagt

SEQ ID NO: 611393 - DNA, 20 bp, mouse
gagaacgagttctagcctca

SEQ ID NO: 611394 - DNA, 20 bp, mouse
gtacctctagcaatgctgaa

SEQ ID NO: 611395 - DNA, 20 bp, mouse
ggaagagccatgtcattaca

SEQ ID NO: 611396 - DNA, 20 bp, mouse
gaccacaaaggagccaataa

SEQ ID NO: 611397 - DNA, 20 bp, mouse
gcctgcgggtcagaagataa

SEQ ID NO: 611398 - DNA, 20 bp, mouse
gaagataaaggtcccagaac

SEQ ID NO: 611399 - DNA, 20 bp, mouse
gtggtggtctctgggatcaa

SEQ ID NO: 611400 - DNA, 20 bp, mouse
gagactgctcttcaccacaa

SEQ ID NO: 611401 - DNA, 20 bp, mouse
gaagggcaaagtcaagcctg

SEQ ID NO: 611402 - DNA, 20 bp, mouse
gcaagtggaagaagacgcta

SEQ ID NO: 611403 - DNA, 20 bp, mouse
gtgcagaggagatacagctg

SEQ ID NO: 611404 - DNA, 20 bp, mouse
gggcttgactttgcccttat

SEQ ID NO: 611405 - DNA, 20 bp, mouse
gccgactgcagagatggaag

SEQ ID NO: 611406 - DNA, 20 bp, mouse
ggaagggtggctgcaagggt

SEQ ID NO: 611407 - DNA, 20 bp, mouse
gctgcactcagattaatccc

SEQ ID NO: 611408 - DNA, 20 bp, mouse
gaggcgaagggtggctgcaa

SEQ ID NO: 611409 - DNA, 20 bp, mouse
gattgtagcgagatagacga

SEQ ID NO: 611410 - DNA, 20 bp, mouse
gatgtcagcgggtggtagga

SEQ ID NO: 611411 - DNA, 20 bp, mouse
gagacgatggttgatgtcag

SEQ ID NO: 611412 - DNA, 20 bp, mouse
gtacagaaccgaatcagatg

SEQ ID NO: 611413 - DNA, 20 bp, mouse
ggatggttgatgtcagcggg

SEQ ID NO: 611414 - DNA, 20 bp, mouse
gaatcagatgaggagagata

SEQ ID NO: 611415 - DNA, 20 bp, mouse
ggagagataaggtgtgatgt

SEQ ID NO: 611416 - DNA, 20 bp, mouse
ggaggagcgccgcatccgag

SEQ ID NO: 611417 - DNA, 20 bp, mouse
gcttgatgtggaggataccg

SEQ ID NO: 611418 - DNA, 20 bp, mouse
ggaagtacctgctggatgtc

SEQ ID NO: 611419 - DNA, 20 bp, mouse
ggtgtgctggtccattacca

SEQ ID NO: 611420 - DNA, 20 bp, mouse
gcactgaccgaccgtggtaa

SEQ ID NO: 611421 - DNA, 20 bp, mouse
gtcggtagcctataaagcac

SEQ ID NO: 611422 - DNA, 20 bp, mouse
gcagcacacacttgatgtgg

SEQ ID NO: 611423 - DNA, 20 bp, mouse
ggacgtgcactgaccgaccg

SEQ ID NO: 611424 - DNA, 20 bp, mouse
gtataaagcacgggcactgg

SEQ ID NO: 611425 - DNA, 20 bp, mouse
gcagggtaggcagcatccgt

SEQ ID NO: 611426 - DNA, 20 bp, mouse
gtgatcggctaagggcgctg

SEQ ID NO: 611427 - DNA, 20 bp, mouse
gaagggcgctggggctgcgt

SEQ ID NO: 611428 - DNA, 20 bp, mouse
gccggagccgcggtgcgtgt

SEQ ID NO: 611429 - DNA, 20 bp, mouse
gctcccgcgaagagtcgaca

SEQ ID NO: 611430 - DNA, 20 bp, mouse
gacgcgagcgaaatagaccg

SEQ ID NO: 611431 - DNA, 20 bp, mouse
gcccccacctcccagctgag

SEQ ID NO: 611432 - DNA, 20 bp, mouse
gtgtccgccagagaggcccg

SEQ ID NO: 611433 - DNA, 20 bp, mouse
gcacgttctgctcaccctca

SEQ ID NO: 611434 - DNA, 20 bp, mouse
ggctctcggaagatcgggat

SEQ ID NO: 611435 - DNA, 20 bp, mouse
ggcgcgccctgatcggctaa

SEQ ID NO: 611436 - DNA, 20 bp, mouse
gccctaggacgagagcttcg

SEQ ID NO: 611437 - DNA, 20 bp, mouse
ggcagaatctaagctccggt

SEQ ID NO: 611438 - DNA, 20 bp, mouse
gactcgcagaatctaagctc

SEQ ID NO: 611439 - DNA, 20 bp, mouse
ggccccgaagctctcgtcct

SEQ ID NO: 611440 - DNA, 20 bp, mouse
gcctcctgcggcgctaggta

SEQ ID NO: 611441 - DNA, 20 bp, mouse
ggattctgcgagtctggccc

SEQ ID NO: 611442 - DNA, 20 bp, mouse
ggtccgcccatcccccgcag

SEQ ID NO: 611443 - DNA, 20 bp, mouse
gggcatttcctggtaccgac

SEQ ID NO: 611444 - DNA, 20 bp, mouse
ggctctcgtcctagggtgag

SEQ ID NO: 611445 - DNA, 20 bp, mouse
gccggccggaggagccagac

SEQ ID NO: 611446 - DNA, 20 bp, mouse
gaggcatggccgcactcact

SEQ ID NO: 611447 - DNA, 20 bp, mouse
gagcttggtgggcccaccta

SEQ ID NO: 611448 - DNA, 20 bp, mouse
gaagcccagcaaccttcaca

SEQ ID NO: 611449 - DNA, 20 bp, mouse
gaccccagctggcagagaag

SEQ ID NO: 611450 - DNA, 20 bp, mouse
gggcccaccaagctaggctg

SEQ ID NO: 611451 - DNA, 20 bp, mouse
gaagatgtgcccagtgagtg

SEQ ID NO: 611452 - DNA, 20 bp, mouse
gattctcggatgagtgacct

SEQ ID NO: 611453 - DNA, 20 bp, mouse
gagaattcaaggccctaggt

SEQ ID NO: 611454 - DNA, 20 bp, mouse
gactcatccgagaatgcacg

SEQ ID NO: 611455 - DNA, 20 bp, mouse
ggctgaaggtaggtgtgaca

SEQ ID NO: 611456 - DNA, 20 bp, mouse
gcttgggtccccagacgaca

SEQ ID NO: 611457 - DNA, 20 bp, mouse
gcgtctggggacccaaggtc

SEQ ID NO: 611458 - DNA, 20 bp, mouse
gtggctgtaggccttccgtg

SEQ ID NO: 611459 - DNA, 20 bp, mouse
gaggccttccgtggggactt

SEQ ID NO: 611460 - DNA, 20 bp, mouse
gtccccctgtgtggagaagt

SEQ ID NO: 611461 - DNA, 20 bp, mouse
gccccagacgacatggctgt

SEQ ID NO: 611462 - DNA, 20 bp, mouse
ggtcctgtctaccagacctt

SEQ ID NO: 611463 - DNA, 20 bp, mouse
ggaagtgcgtccacgagtga

SEQ ID NO: 611464 - DNA, 20 bp, mouse
gccgcctcgcggctctggaa

SEQ ID NO: 611465 - DNA, 20 bp, mouse
ggcctacagccatgtcgtct

SEQ ID NO: 611466 - DNA, 20 bp, mouse
ggcttgcatggagcacacag

SEQ ID NO: 611467 - DNA, 20 bp, mouse
gcgcgagtcaacagagacat

SEQ ID NO: 611468 - DNA, 20 bp, mouse
ggacatgtcctgggaagaca

SEQ ID NO: 611469 - DNA, 20 bp, mouse
ggacatgtctggactgagtg

SEQ ID NO: 611470 - DNA, 20 bp, mouse
gagcatgtgtcaggttaagg

SEQ ID NO: 611471 - DNA, 20 bp, mouse
gtgcctttcacgatgagaac

SEQ ID NO: 611472 - DNA, 20 bp, mouse
gcatgcatccttattctgtg

SEQ ID NO: 611473 - DNA, 20 bp, mouse
gagaggtaagagcatgtgtc

SEQ ID NO: 611474 - DNA, 20 bp, mouse
gagtgcggctggagcttgca

SEQ ID NO: 611475 - DNA, 20 bp, mouse
gaagagcatgtgtcaggtta

SEQ ID NO: 611476 - DNA, 20 bp, mouse
ggagagtccacacctagcag

SEQ ID NO: 611477 - DNA, 20 bp, mouse
gatccagcgacgcaccccaa

SEQ ID NO: 611478 - DNA, 20 bp, mouse
gcacctggcgaaggcggaag

SEQ ID NO: 611479 - DNA, 20 bp, mouse
ggcccgctggtcccaggccc

SEQ ID NO: 611480 - DNA, 20 bp, mouse
gcgggcgcccctgctaggtg

SEQ ID NO: 611481 - DNA, 20 bp, mouse
gaggcccgggcgcccctgct

SEQ ID NO: 611482 - DNA, 20 bp, mouse
gcgaggaagtcctagatcgg

SEQ ID NO: 611483 - DNA, 20 bp, mouse
ggcccgggcctgggaccagc

SEQ ID NO: 611484 - DNA, 20 bp, mouse
ggaccagcgggctccctttg

SEQ ID NO: 611485 - DNA, 20 bp, mouse
gcaccccaaagggagcccgc

SEQ ID NO: 611486 - DNA, 20 bp, mouse
gggtggccgaggtcgagtgt

SEQ ID NO: 611487 - DNA, 20 bp, mouse
gggccgaggtcgagtgtggg

SEQ ID NO: 611488 - DNA, 20 bp, mouse
gcgcgcgggctctgagaacc

SEQ ID NO: 611489 - DNA, 20 bp, mouse
gcgccgcccacactcgacct

SEQ ID NO: 611490 - DNA, 20 bp, mouse
ggtgctgcggccccgcgagc

SEQ ID NO: 611491 - DNA, 20 bp, mouse
gcacctgcggcgcggcgccg

SEQ ID NO: 611492 - DNA, 20 bp, mouse
ggcacgcgcctgccccccag

SEQ ID NO: 611493 - DNA, 20 bp, mouse
gagggcagcaccatctggag

SEQ ID NO: 611494 - DNA, 20 bp, mouse
gagccggcggccctccagcc

SEQ ID NO: 611495 - DNA, 20 bp, mouse
gcagcgggccccacccccta

SEQ ID NO: 611496 - DNA, 20 bp, mouse
gggcggagccgaagcccctg

SEQ ID NO: 611497 - DNA, 20 bp, mouse
ggttgccgcagtgacagtac

SEQ ID NO: 611498 - DNA, 20 bp, mouse
gctggagctgttgctgatga

SEQ ID NO: 611499 - DNA, 20 bp, mouse
gagtgacagtacgggggagt

SEQ ID NO: 611500 - DNA, 20 bp, mouse
gaccgcggccggagcagcca

SEQ ID NO: 611501 - DNA, 20 bp, mouse
ggagccgaagcccctggggc

SEQ ID NO: 611502 - DNA, 20 bp, mouse
gctcgagccaggggaggacg

SEQ ID NO: 611503 - DNA, 20 bp, mouse
gacggcgccgtccaccgggt

SEQ ID NO: 611504 - DNA, 20 bp, mouse
ggagatcgcggcctgtcggg

SEQ ID NO: 611505 - DNA, 20 bp, mouse
gccgtaggcgaggcaggggt

SEQ ID NO: 611506 - DNA, 20 bp, mouse
gggtcccgcggtgacggtgg

SEQ ID NO: 611507 - DNA, 20 bp, mouse
gggaccggctccactcagcg

SEQ ID NO: 611508 - DNA, 20 bp, mouse
gtgagtggagccggtcccgg

SEQ ID NO: 611509 - DNA, 20 bp, mouse
gtcacgcgctcccccgggac

SEQ ID NO: 611510 - DNA, 20 bp, mouse
gctcggtcccgcggtgacgg

SEQ ID NO: 611511 - DNA, 20 bp, mouse
ggcagcggtcactggcgtcg

SEQ ID NO: 611512 - DNA, 20 bp, mouse
ggtcggggtgcctcgctgag

SEQ ID NO: 611513 - DNA, 20 bp, mouse
gccctcgaaggaacagacgg

SEQ ID NO: 611514 - DNA, 20 bp, mouse
gtggctcggtcccgcggtga

SEQ ID NO: 611515 - DNA, 20 bp, mouse
ggggcgtgccgtgggagcta

SEQ ID NO: 611516 - DNA, 20 bp, mouse
ggagccccgaagcgacgcga

SEQ ID NO: 611517 - DNA, 20 bp, mouse
gccccgaagcgacgcgacgg

SEQ ID NO: 611518 - DNA, 20 bp, mouse
gtcccaggacccgaccgagc

SEQ ID NO: 611519 - DNA, 20 bp, mouse
ggagctggcaggagtggtct

SEQ ID NO: 611520 - DNA, 20 bp, mouse
gcccggctgccccaccgcgg

SEQ ID NO: 611521 - DNA, 20 bp, mouse
gaggacccgaccgagctggc

SEQ ID NO: 611522 - DNA, 20 bp, mouse
gcggcggccagacatgatcc

SEQ ID NO: 611523 - DNA, 20 bp, mouse
gctgggagcgcgcgtgacgt

SEQ ID NO: 611524 - DNA, 20 bp, mouse
gtgagcgcgtctcctgcggg

SEQ ID NO: 611525 - DNA, 20 bp, mouse
gaggctggtgacgcccgaga

SEQ ID NO: 611526 - DNA, 20 bp, mouse
gactgagaggactactgctg

SEQ ID NO: 611527 - DNA, 20 bp, mouse
gggtggagttgcaagtgagt

SEQ ID NO: 611528 - DNA, 20 bp, mouse
ggctctttccctgctttgag

SEQ ID NO: 611529 - DNA, 20 bp, mouse
ggagaggactactgctgagg

SEQ ID NO: 611530 - DNA, 20 bp, mouse
gtctcagtcctctcaaagca

SEQ ID NO: 611531 - DNA, 20 bp, mouse
gtgagtcggctaccagatgc

SEQ ID NO: 611532 - DNA, 20 bp, mouse
ggtcggctaccagatgccgg

SEQ ID NO: 611533 - DNA, 20 bp, mouse
ggcctaagcaaagaacagaa

SEQ ID NO: 611534 - DNA, 20 bp, mouse
gagccctcacagttctctgg

SEQ ID NO: 611535 - DNA, 20 bp, mouse
gggaaagagcaccgtgtgct

SEQ ID NO: 611536 - DNA, 20 bp, mouse
gaccaggaccagctcacagg

SEQ ID NO: 611537 - DNA, 20 bp, mouse
gagtaccaggaccagctcac

SEQ ID NO: 611538 - DNA, 20 bp, mouse
gaagatattgagggacggat

SEQ ID NO: 611539 - DNA, 20 bp, mouse
ggaccagctcacaggaggca

SEQ ID NO: 611540 - DNA, 20 bp, mouse
gggagctggcactcttacct

SEQ ID NO: 611541 - DNA, 20 bp, mouse
gcagagggagaagatattga

SEQ ID NO: 611542 - DNA, 20 bp, mouse
gcaacgaagtctccagtacc

SEQ ID NO: 611543 - DNA, 20 bp, mouse
ggctggcactcttacctggg

SEQ ID NO: 611544 - DNA, 20 bp, mouse
ggagattacacggagagaag

SEQ ID NO: 611545 - DNA, 20 bp, mouse
gcagagtctgataccagcta

SEQ ID NO: 611546 - DNA, 20 bp, mouse
gctcacaggacaggctactg

SEQ ID NO: 611547 - DNA, 20 bp, mouse
gcattctggcgacagctcac

SEQ ID NO: 611548 - DNA, 20 bp, mouse
ggatgacatctacaaagctg

SEQ ID NO: 611549 - DNA, 20 bp, mouse
gcccttgagctgacatttgg

SEQ ID NO: 611550 - DNA, 20 bp, mouse
gatctttaaggggttagggt

SEQ ID NO: 611551 - DNA, 20 bp, mouse
gggaggacaggggtacacta

SEQ ID NO: 611552 - DNA, 20 bp, mouse
ggccagccagccctctgctt

SEQ ID NO: 611553 - DNA, 20 bp, mouse
gtgagagatgaatctttaag

SEQ ID NO: 611554 - DNA, 20 bp, mouse
gttgtagatgtcatccattc

SEQ ID NO: 611555 - DNA, 20 bp, mouse
ggtcctccatccttagctaa

SEQ ID NO: 611556 - DNA, 20 bp, mouse
gaggagacaacccacagcgg

SEQ ID NO: 611557 - DNA, 20 bp, mouse
ggatctggggcacctttggg

SEQ ID NO: 611558 - DNA, 20 bp, mouse
gggagagatggagagcacga

SEQ ID NO: 611559 - DNA, 20 bp, mouse
gacctttgggtggtggagtg

SEQ ID NO: 611560 - DNA, 20 bp, mouse
gaccatggtaaggacaagaa

SEQ ID NO: 611561 - DNA, 20 bp, mouse
gactgggactcctccgctgt

SEQ ID NO: 611562 - DNA, 20 bp, mouse
gtcccagtcgccagcaacca

SEQ ID NO: 611563 - DNA, 20 bp, mouse
gagcagggcagacacagagt

SEQ ID NO: 611564 - DNA, 20 bp, mouse
gtccgcactccaccacccaa

SEQ ID NO: 611565 - DNA, 20 bp, mouse
ggtcgccagcaaccatggta

SEQ ID NO: 611566 - DNA, 20 bp, mouse
gtgggcagggctgagtagag

SEQ ID NO: 611567 - DNA, 20 bp, mouse
ggctccacgaggactaaact

SEQ ID NO: 611568 - DNA, 20 bp, mouse
gaggccagcctagctccacg

SEQ ID NO: 611569 - DNA, 20 bp, mouse
gagtgtctgaccatggacct

SEQ ID NO: 611570 - DNA, 20 bp, mouse
ggagcccctgaggaacatgt

SEQ ID NO: 611571 - DNA, 20 bp, mouse
gtcctcaggggctcaaagca

SEQ ID NO: 611572 - DNA, 20 bp, mouse
gctaggtaagtgtctgacca

SEQ ID NO: 611573 - DNA, 20 bp, mouse
gctggggaccaagtgagcca

SEQ ID NO: 611574 - DNA, 20 bp, mouse
gaccttggaccttagttcaa

SEQ ID NO: 611575 - DNA, 20 bp, mouse
ggagccaaggcatcacaatt

SEQ ID NO: 611576 - DNA, 20 bp, mouse
ggcactgctgcacagcatct

SEQ ID NO: 611577 - DNA, 20 bp, mouse
ggctgggagcgaggtcaggc

SEQ ID NO: 611578 - DNA, 20 bp, mouse
gtgctactaggataggacag

SEQ ID NO: 611579 - DNA, 20 bp, mouse
gggagactagagcactactc

SEQ ID NO: 611580 - DNA, 20 bp, mouse
ggtactgcagtccctcacca

SEQ ID NO: 611581 - DNA, 20 bp, mouse
gctcataggaggacttcccc

SEQ ID NO: 611582 - DNA, 20 bp, mouse
gactcaggctggctcatagg

SEQ ID NO: 611583 - DNA, 20 bp, mouse
gcacctcaagaagatgggct

SEQ ID NO: 611584 - DNA, 20 bp, mouse
gcaggccggcagcagtgagt

SEQ ID NO: 611585 - DNA, 20 bp, mouse
gtaggacaggggtctacaat

SEQ ID NO: 611586 - DNA, 20 bp, mouse
gtgaccttggaggtctctag

SEQ ID NO: 611587 - DNA, 20 bp, mouse
gggtcctggaagggtgtccc

SEQ ID NO: 611588 - DNA, 20 bp, mouse
gttcctggagggtcctggaa

SEQ ID NO: 611589 - DNA, 20 bp, mouse
gcaacctctagagacctcca

SEQ ID NO: 611590 - DNA, 20 bp, mouse
gcaggatcggagattcctgg

SEQ ID NO: 611591 - DNA, 20 bp, mouse
gcgagccacacgccaaggtg

SEQ ID NO: 611592 - DNA, 20 bp, mouse
gcttgtcctgagagagtagg

SEQ ID NO: 611593 - DNA, 20 bp, mouse
gtatctcagtgtcctcagtg

SEQ ID NO: 611594 - DNA, 20 bp, mouse
ggaggtgcggtgggtcttga

SEQ ID NO: 611595 - DNA, 20 bp, mouse
ggagctgtgagctaagaagt

SEQ ID NO: 611596 - DNA, 20 bp, mouse
gtggaatcttatatcgtgaa

SEQ ID NO: 611597 - DNA, 20 bp, mouse
gtaccagaacaagtctgtgt

SEQ ID NO: 611598 - DNA, 20 bp, mouse
ggaacaagtctgtgtcggtc

SEQ ID NO: 611599 - DNA, 20 bp, mouse
gagcagacttctttaaaatg

SEQ ID NO: 611600 - DNA, 20 bp, mouse
gctgtttcagcgctagaact

SEQ ID NO: 611601 - DNA, 20 bp, mouse
ggaacatggtggaaatcaga

SEQ ID NO: 611602 - DNA, 20 bp, mouse
ggagaaatgttagcagaaca

SEQ ID NO: 611603 - DNA, 20 bp, mouse
gaaatgttagcagaacatgg

SEQ ID NO: 611604 - DNA, 20 bp, mouse
gtagaactgtttcagggaaa

SEQ ID NO: 611605 - DNA, 20 bp, mouse
gtatattgtacaatatcaaa

SEQ ID NO: 611606 - DNA, 20 bp, mouse
gatgctgtagagggagtctg

SEQ ID NO: 611607 - DNA, 20 bp, mouse
gactcagagacagttaccta

SEQ ID NO: 611608 - DNA, 20 bp, mouse
ggagacagttacctaaggct

SEQ ID NO: 611609 - DNA, 20 bp, mouse
gccactccaagtcttcccaa

SEQ ID NO: 611610 - DNA, 20 bp, mouse
gtgtggaggaagcattctga

SEQ ID NO: 611611 - DNA, 20 bp, mouse
gggggggggtacataatctg

SEQ ID NO: 611612 - DNA, 20 bp, mouse
gtggagtggcaaaagtggag

SEQ ID NO: 611613 - DNA, 20 bp, mouse
gaggacagtgacgcaccccc

SEQ ID NO: 611614 - DNA, 20 bp, mouse
gtgggggccaggtgtgacag

SEQ ID NO: 611615 - DNA, 20 bp, mouse
ggtggaggggtagaatctgg

SEQ ID NO: 611616 - DNA, 20 bp, mouse
ggcaccagcccccttcctta

SEQ ID NO: 611617 - DNA, 20 bp, mouse
ggagatagatccctaaggaa

SEQ ID NO: 611618 - DNA, 20 bp, mouse
gctccctagagacatgaaca

SEQ ID NO: 611619 - DNA, 20 bp, mouse
gagtgagcaacgcagtctgg

SEQ ID NO: 611620 - DNA, 20 bp, mouse
gtagtcctggataggagact

SEQ ID NO: 611621 - DNA, 20 bp, mouse
gtcttcggtgtctgacatcc

SEQ ID NO: 611622 - DNA, 20 bp, mouse
gggcttgggggcttacaatg

SEQ ID NO: 611623 - DNA, 20 bp, mouse
gaccgaagaacaagaatatg

SEQ ID NO: 611624 - DNA, 20 bp, mouse
ggaactcctgagtctgatgg

SEQ ID NO: 611625 - DNA, 20 bp, mouse
gagggcctacccgacccctt

SEQ ID NO: 611626 - DNA, 20 bp, mouse
ggtgtgcagtccctgttcag

SEQ ID NO: 611627 - DNA, 20 bp, mouse
gctgttcagaggtaagacaa

SEQ ID NO: 611628 - DNA, 20 bp, mouse
gggactgcacacaggtcttg

SEQ ID NO: 611629 - DNA, 20 bp, mouse
gcctcagccagtccctgctg

SEQ ID NO: 611630 - DNA, 20 bp, mouse
gcaagggggagctctaggaa

SEQ ID NO: 611631 - DNA, 20 bp, mouse
gctggctgagggcagggcat

SEQ ID NO: 611632 - DNA, 20 bp, mouse
gctacctccacattcagagt

SEQ ID NO: 611633 - DNA, 20 bp, mouse
gtatctgttcagcctcagca

SEQ ID NO: 611634 - DNA, 20 bp, mouse
gggaagggacagaggtcagt

SEQ ID NO: 611635 - DNA, 20 bp, mouse
gggtcagtgggggaacatga

SEQ ID NO: 611636 - DNA, 20 bp, mouse
ggaacagcccgcgtaggagt

SEQ ID NO: 611637 - DNA, 20 bp, mouse
gggatgtgaacagcccgcgt

SEQ ID NO: 611638 - DNA, 20 bp, mouse
gactcaactacaggtgtgta

SEQ ID NO: 611639 - DNA, 20 bp, mouse
gggagtgggcaactgtgtct

SEQ ID NO: 611640 - DNA, 20 bp, mouse
gtgtggacaggaccagcagc

SEQ ID NO: 611641 - DNA, 20 bp, mouse
gaaaggctgggggctccttg

SEQ ID NO: 611642 - DNA, 20 bp, mouse
gcatgaaggggtgaggctgt

SEQ ID NO: 611643 - DNA, 20 bp, mouse
gacagttgcccactcctacg

SEQ ID NO: 611644 - DNA, 20 bp, mouse
gctgggggctccttgtggac

SEQ ID NO: 611645 - DNA, 20 bp, mouse
gacaggaagtgagaaggagt

SEQ ID NO: 611646 - DNA, 20 bp, mouse
ggccgcaagctaaagactca

SEQ ID NO: 611647 - DNA, 20 bp, mouse
gagcttgcggctggtcgaca

SEQ ID NO: 611648 - DNA, 20 bp, mouse
gctcacaagggcgtcaagag

SEQ ID NO: 611649 - DNA, 20 bp, mouse
gagaaccgagctcctcacaa

SEQ ID NO: 611650 - DNA, 20 bp, mouse
gctgaggtctggctccatga

SEQ ID NO: 611651 - DNA, 20 bp, mouse
gacaagggcgtcaagagagg

SEQ ID NO: 611652 - DNA, 20 bp, mouse
gtactttctgccgaaatgag

SEQ ID NO: 611653 - DNA, 20 bp, mouse
ggctaaagactcatggcatg

SEQ ID NO: 611654 - DNA, 20 bp, mouse
ggccatgagtctttagcttg

SEQ ID NO: 611655 - DNA, 20 bp, mouse
gctggctccatgaaggtgtc

SEQ ID NO: 611656 - DNA, 20 bp, mouse
gccatgggaggccacactcg

SEQ ID NO: 611657 - DNA, 20 bp, mouse
gagccgggcctgctgggagg

SEQ ID NO: 611658 - DNA, 20 bp, mouse
ggaagtctctgccccgagtg

SEQ ID NO: 611659 - DNA, 20 bp, mouse
ggtgggaaggctctgcatct

SEQ ID NO: 611660 - DNA, 20 bp, mouse
gccccaaagccgggcctgct

SEQ ID NO: 611661 - DNA, 20 bp, mouse
ggcatcttggtgtccatggg

SEQ ID NO: 611662 - DNA, 20 bp, mouse
gtgaggccgcgaggagctgt

SEQ ID NO: 611663 - DNA, 20 bp, mouse
gtatataactaggggctgtg

SEQ ID NO: 611664 - DNA, 20 bp, mouse
ggcagccaggcaggccacgc

SEQ ID NO: 611665 - DNA, 20 bp, mouse
gaggtaagccatgaccgcct

SEQ ID NO: 611666 - DNA, 20 bp, mouse
gcagctcctggcgctcgagg

SEQ ID NO: 611667 - DNA, 20 bp, mouse
gaattcgcggtgactcagtc

SEQ ID NO: 611668 - DNA, 20 bp, mouse
ggtgtctgtgctgtgctccg

SEQ ID NO: 611669 - DNA, 20 bp, mouse
ggggccagattgcaaattcg

SEQ ID NO: 611670 - DNA, 20 bp, mouse
ggcacagacacggcggacgt

SEQ ID NO: 611671 - DNA, 20 bp, mouse
ggaggctcggacccgaaacc

SEQ ID NO: 611672 - DNA, 20 bp, mouse
ggcgcggcgggcctctgcgt

SEQ ID NO: 611673 - DNA, 20 bp, mouse
ggctcccgtgagcggatctt

SEQ ID NO: 611674 - DNA, 20 bp, mouse
gcccggccggaccgctccaa

SEQ ID NO: 611675 - DNA, 20 bp, mouse
gggtcagctcctggcgctcg

SEQ ID NO: 611676 - DNA, 20 bp, mouse
gaggccccgggaggcagcgg

SEQ ID NO: 611677 - DNA, 20 bp, mouse
gtggagaagctgcagcactt

SEQ ID NO: 611678 - DNA, 20 bp, mouse
gagaggctcgcgcggaagga

SEQ ID NO: 611679 - DNA, 20 bp, mouse
gaggcccacctaccaggccc

SEQ ID NO: 611680 - DNA, 20 bp, mouse
gctcccggggcctggtaggt

SEQ ID NO: 611681 - DNA, 20 bp, mouse
gggagctgatctgatctcaa

SEQ ID NO: 611682 - DNA, 20 bp, mouse
gcgaggcgagctgaagccaa

SEQ ID NO: 611683 - DNA, 20 bp, mouse
gcagaacccagggaggttcg

SEQ ID NO: 611684 - DNA, 20 bp, mouse
gctctcgaggccggcagaac

SEQ ID NO: 611685 - DNA, 20 bp, mouse
ggcttctccagaggctcgcg

SEQ ID NO: 611686 - DNA, 20 bp, mouse
gcacgcagcgagccgaagca

SEQ ID NO: 611687 - DNA, 20 bp, mouse
ggaggagatggcgccagtca

SEQ ID NO: 611688 - DNA, 20 bp, mouse
gtaggcctctgcgagcaagg

SEQ ID NO: 611689 - DNA, 20 bp, mouse
gtccctggtaacggccagaa

SEQ ID NO: 611690 - DNA, 20 bp, mouse
gcctctgcgagcaaggcggg

SEQ ID NO: 611691 - DNA, 20 bp, mouse
gaagcctagggaggagtatc

SEQ ID NO: 611692 - DNA, 20 bp, mouse
ggccacagccgctccctgac

SEQ ID NO: 611693 - DNA, 20 bp, mouse
gcgtggttcgtgtcatgcgg

SEQ ID NO: 611694 - DNA, 20 bp, mouse
gaccacgacccggatcccag

SEQ ID NO: 611695 - DNA, 20 bp, mouse
ggagcccgatactcctccct

SEQ ID NO: 611696 - DNA, 20 bp, mouse
ggtgatgtcgtcctctctga

SEQ ID NO: 611697 - DNA, 20 bp, mouse
ggcatcaactcattgctcag

SEQ ID NO: 611698 - DNA, 20 bp, mouse
gtcaagagaaaccatcagag

SEQ ID NO: 611699 - DNA, 20 bp, mouse
gtcagaggtcagatctcatc

SEQ ID NO: 611700 - DNA, 20 bp, mouse
ggttagagtcacagagcacg

SEQ ID NO: 611701 - DNA, 20 bp, mouse
gccagaggagctgacgctgt

SEQ ID NO: 611702 - DNA, 20 bp, mouse
gtgatgcagacacctgcaac

SEQ ID NO: 611703 - DNA, 20 bp, mouse
gtgagctcagtccctctaaa

SEQ ID NO: 611704 - DNA, 20 bp, mouse
gccagtttaaggctttcagt

SEQ ID NO: 611705 - DNA, 20 bp, mouse
gcaaaaggtctcgggtcccg

SEQ ID NO: 611706 - DNA, 20 bp, mouse
gtacagcccgggattggaaa

SEQ ID NO: 611707 - DNA, 20 bp, mouse
gtccaatcccgggctgtata

SEQ ID NO: 611708 - DNA, 20 bp, mouse
ggggctgtatatggagattt

SEQ ID NO: 611709 - DNA, 20 bp, mouse
gtccccagaagggaagcgga

SEQ ID NO: 611710 - DNA, 20 bp, mouse
gcgagaggaacttgaaaggg

SEQ ID NO: 611711 - DNA, 20 bp, mouse
gtccatatacagcccgggat

SEQ ID NO: 611712 - DNA, 20 bp, mouse
gtaaaaagcggggagctcgg

SEQ ID NO: 611713 - DNA, 20 bp, mouse
ggcgggcaaaaagtgtgagg

SEQ ID NO: 611714 - DNA, 20 bp, mouse
ggcagactgagagctcgggt

SEQ ID NO: 611715 - DNA, 20 bp, mouse
gcgtactgcccgccatccct

SEQ ID NO: 611716 - DNA, 20 bp, mouse
gagcgggacggtgtagaaaa

SEQ ID NO: 611717 - DNA, 20 bp, mouse
gtccggtctggggcctgcgg

SEQ ID NO: 611718 - DNA, 20 bp, mouse
gaccccctcgggctgatggg

SEQ ID NO: 611719 - DNA, 20 bp, mouse
ggaaaatggcgctggtgcag

SEQ ID NO: 611720 - DNA, 20 bp, mouse
ggctgccgcaggaccccctc

SEQ ID NO: 611721 - DNA, 20 bp, mouse
gtgaggtgagcggaccggag

SEQ ID NO: 611722 - DNA, 20 bp, mouse
gtcagcccgagggggtcctg

SEQ ID NO: 611723 - DNA, 20 bp, mouse
ggccgccgcaggccccagac

SEQ ID NO: 611724 - DNA, 20 bp, mouse
ggccgcccatcagcccgagg

SEQ ID NO: 611725 - DNA, 20 bp, mouse
gggtcctgcggcagcgccgg

SEQ ID NO: 611726 - DNA, 20 bp, mouse
gtgagaggcgaggggggtca

SEQ ID NO: 611727 - DNA, 20 bp, mouse
ggagcggggcgacccagggt

SEQ ID NO: 611728 - DNA, 20 bp, mouse
gagctgtggaggcgtcgtcg

SEQ ID NO: 611729 - DNA, 20 bp, mouse
gagcggagcggggcgaccca

SEQ ID NO: 611730 - DNA, 20 bp, mouse
gttctggggtccccgagctt

SEQ ID NO: 611731 - DNA, 20 bp, mouse
gcgggagccgccaggcggag

SEQ ID NO: 611732 - DNA, 20 bp, mouse
ggcctggcggctcccgagaa

SEQ ID NO: 611733 - DNA, 20 bp, mouse
ggctcctccgcaagctgtgg

SEQ ID NO: 611734 - DNA, 20 bp, mouse
gcgactgaggacgccctcgg

SEQ ID NO: 611735 - DNA, 20 bp, mouse
gagcggtgagtgaggatcgt

SEQ ID NO: 611736 - DNA, 20 bp, mouse
ggggccgtcgcgctgaggtg

SEQ ID NO: 611737 - DNA, 20 bp, mouse
gacggcgacgcggacggcga

SEQ ID NO: 611738 - DNA, 20 bp, mouse
gtagagcaacaagatggccg

SEQ ID NO: 611739 - DNA, 20 bp, mouse
gggctgcacggcgacgcgga

SEQ ID NO: 611740 - DNA, 20 bp, mouse
gtcccggggccgtcgcgctg

SEQ ID NO: 611741 - DNA, 20 bp, mouse
ggcgcagaaccggagaacgg

SEQ ID NO: 611742 - DNA, 20 bp, mouse
ggctccgcacctcagcgcga

SEQ ID NO: 611743 - DNA, 20 bp, mouse
gacgcagcccgggtctgagg

SEQ ID NO: 611744 - DNA, 20 bp, mouse
gggtgacccggcggctctca

SEQ ID NO: 611745 - DNA, 20 bp, mouse
gcagaaccggagaacggagg

SEQ ID NO: 611746 - DNA, 20 bp, mouse
gccactgcctggcagagcgg

SEQ ID NO: 611747 - DNA, 20 bp, mouse
gctgcctggcagagcggtgg

SEQ ID NO: 611748 - DNA, 20 bp, mouse
gtctgcgacgtggggaagaa

SEQ ID NO: 611749 - DNA, 20 bp, mouse
gggcccggcggagtcccggg

SEQ ID NO: 611750 - DNA, 20 bp, mouse
ggcggaggcggactccgacg

SEQ ID NO: 611751 - DNA, 20 bp, mouse
ggccccgcactcccactgcc

SEQ ID NO: 611752 - DNA, 20 bp, mouse
gcccaggcgtctgcgacgtg

SEQ ID NO: 611753 - DNA, 20 bp, mouse
ggcgggccgcaggagggcag

SEQ ID NO: 611754 - DNA, 20 bp, mouse
gagtctgggaaggtgtaggt

SEQ ID NO: 611755 - DNA, 20 bp, mouse
gtgcggcgcccgacccgagg

SEQ ID NO: 611756 - DNA, 20 bp, mouse
gcgggttcgcccaggtacca

SEQ ID NO: 611757 - DNA, 20 bp, mouse
gtcgcccaggtaccagggtc

SEQ ID NO: 611758 - DNA, 20 bp, mouse
ggctcccgaccctggtacct

SEQ ID NO: 611759 - DNA, 20 bp, mouse
ggcgaacccgcagcgcggtc

SEQ ID NO: 611760 - DNA, 20 bp, mouse
ggccccgccggaccgcgctg

SEQ ID NO: 611761 - DNA, 20 bp, mouse
gccccaaacaaagagtgtgg

SEQ ID NO: 611762 - DNA, 20 bp, mouse
gtgggcgcggagacagttga

SEQ ID NO: 611763 - DNA, 20 bp, mouse
gcgatggccgaagcgaagct

SEQ ID NO: 611764 - DNA, 20 bp, mouse
ggggccccaaacaaagagtg

SEQ ID NO: 611765 - DNA, 20 bp, mouse
ggtgtagggacaaggcgcgg

SEQ ID NO: 611766 - DNA, 20 bp, mouse
gagagtcttgagtggaacag

SEQ ID NO: 611767 - DNA, 20 bp, mouse
gacagcggccacgagcaggt

SEQ ID NO: 611768 - DNA, 20 bp, mouse
gccaggtaaactgcaagagg

SEQ ID NO: 611769 - DNA, 20 bp, mouse
gaggagacctgggtctatcc

SEQ ID NO: 611770 - DNA, 20 bp, mouse
ggcccaggtagagaaggcag

SEQ ID NO: 611771 - DNA, 20 bp, mouse
gataggagcccaggtagaga

SEQ ID NO: 611772 - DNA, 20 bp, mouse
gagcactaagccagtctagg

SEQ ID NO: 611773 - DNA, 20 bp, mouse
gttagagcctggatagaccc

SEQ ID NO: 611774 - DNA, 20 bp, mouse
gtttaggagttaggagacct

SEQ ID NO: 611775 - DNA, 20 bp, mouse
gcagagcactaagccagtct

SEQ ID NO: 611776 - DNA, 20 bp, mouse
gaggatggtcagaatagacg

SEQ ID NO: 611777 - DNA, 20 bp, mouse
gattagaccgaggagagaat

SEQ ID NO: 611778 - DNA, 20 bp, mouse
gcccccagccttctgaacca

SEQ ID NO: 611779 - DNA, 20 bp, mouse
gagccgcagccggctgacgg

SEQ ID NO: 611780 - DNA, 20 bp, mouse
ggaagtgtcacattagaccg

SEQ ID NO: 611781 - DNA, 20 bp, mouse
gggagagaatgggcctgctc

SEQ ID NO: 611782 - DNA, 20 bp, mouse
gcctctgaagcaggcaccgg

SEQ ID NO: 611783 - DNA, 20 bp, mouse
gatctccaggcggaccctca

SEQ ID NO: 611784 - DNA, 20 bp, mouse
gcagctgtacgagcatactg

SEQ ID NO: 611785 - DNA, 20 bp, mouse
gtgagctgccatggttcaga

SEQ ID NO: 611786 - DNA, 20 bp, mouse
ggcgcagagggcgctgtacg

SEQ ID NO: 611787 - DNA, 20 bp, mouse
gaaggagcgaagctctggcc

SEQ ID NO: 611788 - DNA, 20 bp, mouse
ggcttctctacacagcccgg

SEQ ID NO: 611789 - DNA, 20 bp, mouse
gggcgctgtacggggacgca

SEQ ID NO: 611790 - DNA, 20 bp, mouse
gcggctgggcgggggagaag

SEQ ID NO: 611791 - DNA, 20 bp, mouse
gggcagaaggagcgaagctc

SEQ ID NO: 611792 - DNA, 20 bp, mouse
gcggccgacgggcaaccggg

SEQ ID NO: 611793 - DNA, 20 bp, mouse
ggccaccgccggacacgcga

SEQ ID NO: 611794 - DNA, 20 bp, mouse
gctcgcttctctacacagcc

SEQ ID NO: 611795 - DNA, 20 bp, mouse
gaggccgcccctccacaccc

SEQ ID NO: 611796 - DNA, 20 bp, mouse
ggagtgtcgtgggaaccgag

SEQ ID NO: 611797 - DNA, 20 bp, mouse
gcccaggcgcgggaaggtgc

SEQ ID NO: 611798 - DNA, 20 bp, mouse
gaccgagaggccagaaggac

SEQ ID NO: 611799 - DNA, 20 bp, mouse
gttcgggcccaggcgcggga

SEQ ID NO: 611800 - DNA, 20 bp, mouse
gagccctggatgtactcgtc

SEQ ID NO: 611801 - DNA, 20 bp, mouse
gcgttgagactgagtgtcgt

SEQ ID NO: 611802 - DNA, 20 bp, mouse
gtgccagacgagtacatcca

SEQ ID NO: 611803 - DNA, 20 bp, mouse
gtcacttcgggcccaggcgc

SEQ ID NO: 611804 - DNA, 20 bp, mouse
gaccgcgaggctgagggcca

SEQ ID NO: 611805 - DNA, 20 bp, mouse
ggctcgacctccaaaaacag

SEQ ID NO: 611806 - DNA, 20 bp, mouse
gcagagggcgttggaactgg

SEQ ID NO: 611807 - DNA, 20 bp, mouse
gaggctggcgaggggcgtca

SEQ ID NO: 611808 - DNA, 20 bp, mouse
gcgtcagagggcgttggaac

SEQ ID NO: 611809 - DNA, 20 bp, mouse
ggggagccgctcaccgtcag

SEQ ID NO: 611810 - DNA, 20 bp, mouse
ggctcaccgtcagagggcgt

SEQ ID NO: 611811 - DNA, 20 bp, mouse
ggcgaggggcgtcatggccg

SEQ ID NO: 611812 - DNA, 20 bp, mouse
gtccctccccaggacccctt

SEQ ID NO: 611813 - DNA, 20 bp, mouse
gagaagcctaaggggtcctg

SEQ ID NO: 611814 - DNA, 20 bp, mouse
ggacggtgagcggctcccca

SEQ ID NO: 611815 - DNA, 20 bp, mouse
ggcgacacggatctaggatg

SEQ ID NO: 611816 - DNA, 20 bp, mouse
gacgcagcttgtggtgggag

SEQ ID NO: 611817 - DNA, 20 bp, mouse
gcggcgacgcagcttgtggt

SEQ ID NO: 611818 - DNA, 20 bp, mouse
gtgcctcgcgggacaacggt

SEQ ID NO: 611819 - DNA, 20 bp, mouse
gagcggaagagctctcccgg

SEQ ID NO: 611820 - DNA, 20 bp, mouse
gaactgcacagagacccgcc

SEQ ID NO: 611821 - DNA, 20 bp, mouse
ggagagtcgctgctccgggt

SEQ ID NO: 611822 - DNA, 20 bp, mouse
gcggtcggcgacgcagcttg

SEQ ID NO: 611823 - DNA, 20 bp, mouse
gcgattgcctcgcgggacaa

SEQ ID NO: 611824 - DNA, 20 bp, mouse
gcgggtgggtacccgaaggt

SEQ ID NO: 611825 - DNA, 20 bp, mouse
gtctggcccagagcactcac

SEQ ID NO: 611826 - DNA, 20 bp, mouse
gaacgggtcacgtggcgggt

SEQ ID NO: 611827 - DNA, 20 bp, mouse
gaggccagagcggcacacag

SEQ ID NO: 611828 - DNA, 20 bp, mouse
gtggccaacgggtcacgtgg

SEQ ID NO: 611829 - DNA, 20 bp, mouse
gatcaggtgggtcatagggt

SEQ ID NO: 611830 - DNA, 20 bp, mouse
ggcctgccggcaccaccccg

SEQ ID NO: 611831 - DNA, 20 bp, mouse
ggggtcacgtggcgggtcgg

SEQ ID NO: 611832 - DNA, 20 bp, mouse
gccagagcggcacacagggg

SEQ ID NO: 611833 - DNA, 20 bp, mouse
gccgcagtctggcagacagg

SEQ ID NO: 611834 - DNA, 20 bp, mouse
gcggactccgacaggtccca

SEQ ID NO: 611835 - DNA, 20 bp, mouse
gcctgtcggagtccgcagtc

SEQ ID NO: 611836 - DNA, 20 bp, mouse
gagaggtagcgtaaggatcg

SEQ ID NO: 611837 - DNA, 20 bp, mouse
ggacccacagaggtagcgta

SEQ ID NO: 611838 - DNA, 20 bp, mouse
gcctctgtgggtcacctcat

SEQ ID NO: 611839 - DNA, 20 bp, mouse
gggtcacctcataggtaagg

SEQ ID NO: 611840 - DNA, 20 bp, mouse
ggggctctctggagctacca

SEQ ID NO: 611841 - DNA, 20 bp, mouse
ggtgggtcacctcataggta

SEQ ID NO: 611842 - DNA, 20 bp, mouse
gatttcctgggagggctctc

SEQ ID NO: 611843 - DNA, 20 bp, mouse
gtggagctaccatggcgttt

SEQ ID NO: 611844 - DNA, 20 bp, mouse
gatccttacgctacctctgt

SEQ ID NO: 611845 - DNA, 20 bp, mouse
gcggtggaggcggatttcct

SEQ ID NO: 611846 - DNA, 20 bp, mouse
gtgtcagtcagggcagaacg

SEQ ID NO: 611847 - DNA, 20 bp, mouse
gccgtggcacacaggagtcc

SEQ ID NO: 611848 - DNA, 20 bp, mouse
gcccagcaggaactccatct

SEQ ID NO: 611849 - DNA, 20 bp, mouse
gaggagtccgggctggaacg

SEQ ID NO: 611850 - DNA, 20 bp, mouse
gagcaggaactccatctcgg

SEQ ID NO: 611851 - DNA, 20 bp, mouse
gggcacacaggagtccgggc

SEQ ID NO: 611852 - DNA, 20 bp, mouse
gggcgtcgagtgagccacag

SEQ ID NO: 611853 - DNA, 20 bp, mouse
ggccctacaggggtgctgaa

SEQ ID NO: 611854 - DNA, 20 bp, mouse
gtccgttcagcacccctgta

SEQ ID NO: 611855 - DNA, 20 bp, mouse
ggtcagggcagaacgcggcg

SEQ ID NO: 611856 - DNA, 20 bp, mouse
gcctccagtccagacggaaa

SEQ ID NO: 611857 - DNA, 20 bp, mouse
ggacgccggggagcactcgg

SEQ ID NO: 611858 - DNA, 20 bp, mouse
gggccgagcgcgaggacttc

SEQ ID NO: 611859 - DNA, 20 bp, mouse
gcggccttttccgtctggac

SEQ ID NO: 611860 - DNA, 20 bp, mouse
gtccggcgcgcgaggacccc

SEQ ID NO: 611861 - DNA, 20 bp, mouse
gtgcccgcgggcctccatct

SEQ ID NO: 611862 - DNA, 20 bp, mouse
gagccaggtcgcctccaaga

SEQ ID NO: 611863 - DNA, 20 bp, mouse
gccgcgggcctccatcttgg

SEQ ID NO: 611864 - DNA, 20 bp, mouse
gaggcttcgagaacgtgagt

SEQ ID NO: 611865 - DNA, 20 bp, mouse
ggcgctcggccttttccgtc

SEQ ID NO: 611866 - DNA, 20 bp, mouse
ggtagacgcagtagctgagt

SEQ ID NO: 611867 - DNA, 20 bp, mouse
gcgacgccaagacggacgct

SEQ ID NO: 611868 - DNA, 20 bp, mouse
gctcctggcgggcttggcag

SEQ ID NO: 611869 - DNA, 20 bp, mouse
gcaatgcccagcgtccgtct

SEQ ID NO: 611870 - DNA, 20 bp, mouse
gttggcgtcggtctcctggc

SEQ ID NO: 611871 - DNA, 20 bp, mouse
gtcggtgccgcctccagtcc

SEQ ID NO: 611872 - DNA, 20 bp, mouse
gcgtcttggcgtcggtctcc

SEQ ID NO: 611873 - DNA, 20 bp, mouse
ggcccgctgccaagcccgcc

SEQ ID NO: 611874 - DNA, 20 bp, mouse
gctactgcgtctacctggac

SEQ ID NO: 611875 - DNA, 20 bp, mouse
gcccgtgcccaacgctcgca

SEQ ID NO: 611876 - DNA, 20 bp, mouse
gggctgtaggacaccggaag

SEQ ID NO: 611877 - DNA, 20 bp, mouse
gggccatggctgtaggacac

SEQ ID NO: 611878 - DNA, 20 bp, mouse
gtggacgccgcgagccgaga

SEQ ID NO: 611879 - DNA, 20 bp, mouse
gttctccgcgcggcacggaa

SEQ ID NO: 611880 - DNA, 20 bp, mouse
ggcgtgggtcgtcggtgaag

SEQ ID NO: 611881 - DNA, 20 bp, mouse
gacagggtctcgtctagctg

SEQ ID NO: 611882 - DNA, 20 bp, mouse
gaccgggagcgggcatggac

SEQ ID NO: 611883 - DNA, 20 bp, mouse
gcgtctagctgtggtggagg

SEQ ID NO: 611884 - DNA, 20 bp, mouse
ggcacggaagggccaggccc

SEQ ID NO: 611885 - DNA, 20 bp, mouse
gcggcggcggccatggctgt

SEQ ID NO: 611886 - DNA, 20 bp, mouse
gcgcagccctagcttccggg

SEQ ID NO: 611887 - DNA, 20 bp, mouse
gaggcccggagggaaacgtg

SEQ ID NO: 611888 - DNA, 20 bp, mouse
ggcagcgcggagctgttcca

SEQ ID NO: 611889 - DNA, 20 bp, mouse
gtttgggggccatctcgggt

SEQ ID NO: 611890 - DNA, 20 bp, mouse
gtgttgcgcaccacttagct

SEQ ID NO: 611891 - DNA, 20 bp, mouse
gaacgcacttcccagctaag

SEQ ID NO: 611892 - DNA, 20 bp, mouse
gcgcggggaagggaaaacca

SEQ ID NO: 611893 - DNA, 20 bp, mouse
ggcacgcagccctagcttcc

SEQ ID NO: 611894 - DNA, 20 bp, mouse
gctcgggtgggctgggaaac

SEQ ID NO: 611895 - DNA, 20 bp, mouse
gcctcagggccggtccacag

SEQ ID NO: 611896 - DNA, 20 bp, mouse
gagcctggcggcgaaggagg

SEQ ID NO: 611897 - DNA, 20 bp, mouse
gggcggcgggagccccacga

SEQ ID NO: 611898 - DNA, 20 bp, mouse
gttagcgcacggggtaggag

SEQ ID NO: 611899 - DNA, 20 bp, mouse
ggcgggagccccacgaggga

SEQ ID NO: 611900 - DNA, 20 bp, mouse
ggccccacgagggacggcgt

SEQ ID NO: 611901 - DNA, 20 bp, mouse
ggataccatggggaacgtgt

SEQ ID NO: 611902 - DNA, 20 bp, mouse
gctctcactggcggccgcgg

SEQ ID NO: 611903 - DNA, 20 bp, mouse
ggtaggagcggagcccaggc

SEQ ID NO: 611904 - DNA, 20 bp, mouse
gcggagcccaggccgggaag

SEQ ID NO: 611905 - DNA, 20 bp, mouse
gccacgagggacggcgtagg

SEQ ID NO: 611906 - DNA, 20 bp, mouse
gggtgtgcctagggggaaag

SEQ ID NO: 611907 - DNA, 20 bp, mouse
gctgcagcctctttccccct

SEQ ID NO: 611908 - DNA, 20 bp, mouse
gggatggtctgagatggtaa

SEQ ID NO: 611909 - DNA, 20 bp, mouse
gataatgggagagcagacgg

SEQ ID NO: 611910 - DNA, 20 bp, mouse
gctgcccccatcaagatgac

SEQ ID NO: 611911 - DNA, 20 bp, mouse
ggttctgccattactcaaga

SEQ ID NO: 611912 - DNA, 20 bp, mouse
ggggtgagggatcaacgatg

SEQ ID NO: 611913 - DNA, 20 bp, mouse
gcacacccggtcatcttgat

SEQ ID NO: 611914 - DNA, 20 bp, mouse
ggctgcaggatggtctgaga

SEQ ID NO: 611915 - DNA, 20 bp, mouse
ggatgaccgggtgtgcctag

SEQ ID NO: 611916 - DNA, 20 bp, mouse
gctaagttccgggtgcaggg

SEQ ID NO: 611917 - DNA, 20 bp, mouse
gctgctgctctcgcaagctt

SEQ ID NO: 611918 - DNA, 20 bp, mouse
gtgctccgaggataacacgt

SEQ ID NO: 611919 - DNA, 20 bp, mouse
ggtggagcctggctaagttc

SEQ ID NO: 611920 - DNA, 20 bp, mouse
gtgagcatcctggggagagt

SEQ ID NO: 611921 - DNA, 20 bp, mouse
gccgcgtgcagggttgggtg

SEQ ID NO: 611922 - DNA, 20 bp, mouse
gatgtgcccagtgcacgtgg

SEQ ID NO: 611923 - DNA, 20 bp, mouse
gtggctaagttccgggtgca

SEQ ID NO: 611924 - DNA, 20 bp, mouse
gccacgaccgcgtgcagggt

SEQ ID NO: 611925 - DNA, 20 bp, mouse
gctcacggtcacagcccaga

SEQ ID NO: 611926 - DNA, 20 bp, mouse
gtacgtgcttagtgctggta

SEQ ID NO: 611927 - DNA, 20 bp, mouse
gatggcttccagcggagtga

SEQ ID NO: 611928 - DNA, 20 bp, mouse
gacccggtgcgacgctcggt

SEQ ID NO: 611929 - DNA, 20 bp, mouse
gtcggccagcgaggcctcag

SEQ ID NO: 611930 - DNA, 20 bp, mouse
ggcctcgctggccgacccgg

SEQ ID NO: 611931 - DNA, 20 bp, mouse
ggcgctcaccgtcactccgc

SEQ ID NO: 611932 - DNA, 20 bp, mouse
gcaatcggcttgcgacgacc

SEQ ID NO: 611933 - DNA, 20 bp, mouse
gtaccaaccgagcgtcgcac

SEQ ID NO: 611934 - DNA, 20 bp, mouse
gaggtcagtacaacccgcag

SEQ ID NO: 611935 - DNA, 20 bp, mouse
ggttggtacgtgcttagtgc

SEQ ID NO: 611936 - DNA, 20 bp, mouse
gcatggcgacgacggaccag

SEQ ID NO: 611937 - DNA, 20 bp, mouse
gcccttccgggatccggaca

SEQ ID NO: 611938 - DNA, 20 bp, mouse
gcgggatccggacacggtgg

SEQ ID NO: 611939 - DNA, 20 bp, mouse
gtccggatcccggaagggag

SEQ ID NO: 611940 - DNA, 20 bp, mouse
gttccgggatccggacacgg

SEQ ID NO: 611941 - DNA, 20 bp, mouse
ggaaatcgtggacaacgcgg

SEQ ID NO: 611942 - DNA, 20 bp, mouse
gcgcagggcaggggttggtg

SEQ ID NO: 611943 - DNA, 20 bp, mouse
ggaacttgggaggagccgca

SEQ ID NO: 611944 - DNA, 20 bp, mouse
gacgacggaccagcggaacg

SEQ ID NO: 611945 - DNA, 20 bp, mouse
gatttaagtagggaatataa

SEQ ID NO: 611946 - DNA, 20 bp, mouse
gaggaagccgggagcgtgga

SEQ ID NO: 611947 - DNA, 20 bp, mouse
gacggtcaccgggcagcgtg

SEQ ID NO: 611948 - DNA, 20 bp, mouse
ggtcaccgggcagcgtgggg

SEQ ID NO: 611949 - DNA, 20 bp, mouse
gcgcgggcgccacggtcacc

SEQ ID NO: 611950 - DNA, 20 bp, mouse
gaggagcggacgacagaaaa

SEQ ID NO: 611951 - DNA, 20 bp, mouse
gccggttctggaaatggagt

SEQ ID NO: 611952 - DNA, 20 bp, mouse
ggtgaacggaagacccccga

SEQ ID NO: 611953 - DNA, 20 bp, mouse
gcggcggaggacagtcgtca

SEQ ID NO: 611954 - DNA, 20 bp, mouse
ggtacctgtggagccgaagg

SEQ ID NO: 611955 - DNA, 20 bp, mouse
gggagtccccagaaccgtcg

SEQ ID NO: 611956 - DNA, 20 bp, mouse
gcctaagaaagaccaggtac

SEQ ID NO: 611957 - DNA, 20 bp, mouse
gcggaatgggagtccttcag

SEQ ID NO: 611958 - DNA, 20 bp, mouse
ggaaagaccaggtaccggaa

SEQ ID NO: 611959 - DNA, 20 bp, mouse
ggatctaaggggaggagcag

SEQ ID NO: 611960 - DNA, 20 bp, mouse
gtctccaggaccacctatag

SEQ ID NO: 611961 - DNA, 20 bp, mouse
gcaggctccgatctaagggg

SEQ ID NO: 611962 - DNA, 20 bp, mouse
gcagggccttgtgggttctc

SEQ ID NO: 611963 - DNA, 20 bp, mouse
gtatcaggctccgatctaag

SEQ ID NO: 611964 - DNA, 20 bp, mouse
gagaggactaaccccaagga

SEQ ID NO: 611965 - DNA, 20 bp, mouse
gcttcagaggactaacccca

SEQ ID NO: 611966 - DNA, 20 bp, mouse
gcggcgaagctcctgttcca

SEQ ID NO: 611967 - DNA, 20 bp, mouse
gtagccacggtgagccggag

SEQ ID NO: 611968 - DNA, 20 bp, mouse
ggcactccccaaaatactca

SEQ ID NO: 611969 - DNA, 20 bp, mouse
ggaagtgcagattttcgcgg

SEQ ID NO: 611970 - DNA, 20 bp, mouse
ggcggcggcggtggcttgtc

SEQ ID NO: 611971 - DNA, 20 bp, mouse
gagagcgtccaggacactct

SEQ ID NO: 611972 - DNA, 20 bp, mouse
gcgtgggctcagggaagcgc

SEQ ID NO: 611973 - DNA, 20 bp, mouse
gcgggaagtgcagattttcg

SEQ ID NO: 611974 - DNA, 20 bp, mouse
gggagtgagaaaatgggcgt

SEQ ID NO: 611975 - DNA, 20 bp, mouse
gtcaccgctccggctcaccg

SEQ ID NO: 611976 - DNA, 20 bp, mouse
gcgactgacagactgccggg

SEQ ID NO: 611977 - DNA, 20 bp, mouse
gacgcgactgacagactgcc

SEQ ID NO: 611978 - DNA, 20 bp, mouse
gccaccggcccgagactccc

SEQ ID NO: 611979 - DNA, 20 bp, mouse
ggcgaacgctgcgggctcag

SEQ ID NO: 611980 - DNA, 20 bp, mouse
gtgaggggaaatgcgaactt

SEQ ID NO: 611981 - DNA, 20 bp, mouse
gggcccgagtctgcgatgag

SEQ ID NO: 611982 - DNA, 20 bp, mouse
ggcacgccggccgacatgag

SEQ ID NO: 611983 - DNA, 20 bp, mouse
ggggctcagaggcagcgcgg

SEQ ID NO: 611984 - DNA, 20 bp, mouse
gccggcgccccggaacccag

SEQ ID NO: 611985 - DNA, 20 bp, mouse
ggagaggcggacggcaggga

SEQ ID NO: 611986 - DNA, 20 bp, mouse
gccgggacacctgacaggaa

SEQ ID NO: 611987 - DNA, 20 bp, mouse
gacaggaagggacgcggcag

SEQ ID NO: 611988 - DNA, 20 bp, mouse
ggcgacccgggacacctgac

SEQ ID NO: 611989 - DNA, 20 bp, mouse
gggcccagacccaattacat

SEQ ID NO: 611990 - DNA, 20 bp, mouse
gccggcacaggagcaggatt

SEQ ID NO: 611991 - DNA, 20 bp, mouse
gggggacatgctggaaacgc

SEQ ID NO: 611992 - DNA, 20 bp, mouse
gacccctaggaagtccctcg

SEQ ID NO: 611993 - DNA, 20 bp, mouse
gcacacgcatgctgctgctg

SEQ ID NO: 611994 - DNA, 20 bp, mouse
gacggagctcaggcgagaca

SEQ ID NO: 611995 - DNA, 20 bp, mouse
ggccccgagggacttcctag

SEQ ID NO: 611996 - DNA, 20 bp, mouse
gcggaaagcgacaaaaccag

SEQ ID NO: 611997 - DNA, 20 bp, mouse
gaccgacaagcgtctgtgag

SEQ ID NO: 611998 - DNA, 20 bp, mouse
gcgacgcgcgacgcgggacc

SEQ ID NO: 611999 - DNA, 20 bp, mouse
gggcgagagttgaggttcca

SEQ ID NO: 612000 - DNA, 20 bp, mouse
ggaacgcagaggccacgtaa

SEQ ID NO: 612001 - DNA, 20 bp, mouse
gaaaaccagcgggaaacgct

SEQ ID NO: 612002 - DNA, 20 bp, mouse
ggacccgcgacgcgcgacgc

SEQ ID NO: 612003 - DNA, 20 bp, mouse
gtgcagcggtgacaactcca

SEQ ID NO: 612004 - DNA, 20 bp, mouse
gcatggtgacggtcctgaag

SEQ ID NO: 612005 - DNA, 20 bp, mouse
gaaaggttcaaatgaaacta

SEQ ID NO: 612006 - DNA, 20 bp, mouse
gtaaagggaggccaccacgg

SEQ ID NO: 612007 - DNA, 20 bp, mouse
gtccggagcacagtccaaga

SEQ ID NO: 612008 - DNA, 20 bp, mouse
ggttatgccggactaaaggg

SEQ ID NO: 612009 - DNA, 20 bp, mouse
gggcataacacggcacacac

SEQ ID NO: 612010 - DNA, 20 bp, mouse
gggcgcccgggcctacagag

SEQ ID NO: 612011 - DNA, 20 bp, mouse
gataaacagagccgccgtgg

SEQ ID NO: 612012 - DNA, 20 bp, mouse
gcgtgttatgccggactaaa

SEQ ID NO: 612013 - DNA, 20 bp, mouse
gagtggtcgaggactaggaa

SEQ ID NO: 612014 - DNA, 20 bp, mouse
gacacaggcgcgctccggga

SEQ ID NO: 612015 - DNA, 20 bp, mouse
gggcgtctgaaccggtcctc

SEQ ID NO: 612016 - DNA, 20 bp, mouse
gaagcgagactcggacgtgt

SEQ ID NO: 612017 - DNA, 20 bp, mouse
gtgtgggtttctgatcgagg

SEQ ID NO: 612018 - DNA, 20 bp, mouse
gacccagaggaaaagccacg

SEQ ID NO: 612019 - DNA, 20 bp, mouse
gacgtgtgggtttctgatcg

SEQ ID NO: 612020 - DNA, 20 bp, mouse
gtccatggcagcgcgggaca

SEQ ID NO: 612021 - DNA, 20 bp, mouse
ggctgctggagcaggaccta

SEQ ID NO: 612022 - DNA, 20 bp, mouse
gtggctctcacagttcctcg

SEQ ID NO: 612023 - DNA, 20 bp, mouse
gagcaagtcggcgatcccct

SEQ ID NO: 612024 - DNA, 20 bp, mouse
gcctcggaaggccacttcca

SEQ ID NO: 612025 - DNA, 20 bp, mouse
gtgcttagtggcgcagtggg

SEQ ID NO: 612026 - DNA, 20 bp, mouse
ggccggagcgagaggcgcag

SEQ ID NO: 612027 - DNA, 20 bp, mouse
ggagaggcgcagcggcacgg

SEQ ID NO: 612028 - DNA, 20 bp, mouse
gaaagcacagccggagcgag

SEQ ID NO: 612029 - DNA, 20 bp, mouse
ggccgctgcgcctctcgctc

SEQ ID NO: 612030 - DNA, 20 bp, mouse
gagttcgtgagtggccaccg

SEQ ID NO: 612031 - DNA, 20 bp, mouse
gagacagagcaggctccggg

SEQ ID NO: 612032 - DNA, 20 bp, mouse
gtgctggctgctcgaggaag

SEQ ID NO: 612033 - DNA, 20 bp, mouse
gggcacggcgggtgagcagt

SEQ ID NO: 612034 - DNA, 20 bp, mouse
gcgggtgagcagtgggatgc

SEQ ID NO: 612035 - DNA, 20 bp, mouse
gcccagaggccccacggcga

SEQ ID NO: 612036 - DNA, 20 bp, mouse
ggtagtgtcgggtacagggt

SEQ ID NO: 612037 - DNA, 20 bp, mouse
gcacaggctactgcccaccc

SEQ ID NO: 612038 - DNA, 20 bp, mouse
gcctctctgggaagcctaga

SEQ ID NO: 612039 - DNA, 20 bp, mouse
gtacccgacactacaggaag

SEQ ID NO: 612040 - DNA, 20 bp, mouse
gcgccagagccaggcgaggg

SEQ ID NO: 612041 - DNA, 20 bp, mouse
gcagggtcggaagcgaggcc

SEQ ID NO: 612042 - DNA, 20 bp, mouse
gacaggaagcggaagtcggt

SEQ ID NO: 612043 - DNA, 20 bp, mouse
ggggtacagggtcggaagcg

SEQ ID NO: 612044 - DNA, 20 bp, mouse
gtgacgccagagccaggcga

SEQ ID NO: 612045 - DNA, 20 bp, mouse
gccaaggagccagggtgcaa

SEQ ID NO: 612046 - DNA, 20 bp, mouse
gacccggaagggccaagacc

SEQ ID NO: 612047 - DNA, 20 bp, mouse
gaacgctgcagaacccggaa

SEQ ID NO: 612048 - DNA, 20 bp, mouse
gcgcgcggccggcaggacgg

SEQ ID NO: 612049 - DNA, 20 bp, mouse
gaagctaacgctgcagaacc

SEQ ID NO: 612050 - DNA, 20 bp, mouse
gtgcagcgttagcttcgggt

SEQ ID NO: 612051 - DNA, 20 bp, mouse
gccacgggcaccaagtcggg

SEQ ID NO: 612052 - DNA, 20 bp, mouse
gcccacccgccggttaggag

SEQ ID NO: 612053 - DNA, 20 bp, mouse
gcccagggaaaggagcgtcc

SEQ ID NO: 612054 - DNA, 20 bp, mouse
gtccaggccgcggctcccca

SEQ ID NO: 612055 - DNA, 20 bp, mouse
ggaggcgcgaaggccgcaag

SEQ ID NO: 612056 - DNA, 20 bp, mouse
gcgagccgaaggtagactgt

SEQ ID NO: 612057 - DNA, 20 bp, mouse
gggagctccagagcgcacca

SEQ ID NO: 612058 - DNA, 20 bp, mouse
gtggtaggtaccgagcagag

SEQ ID NO: 612059 - DNA, 20 bp, mouse
gggcagggcccgcgagccga

SEQ ID NO: 612060 - DNA, 20 bp, mouse
gtccagagcgcaccatggca

SEQ ID NO: 612061 - DNA, 20 bp, mouse
ggccctgccatggtgcgctc

SEQ ID NO: 612062 - DNA, 20 bp, mouse
ggcagagtcccgctgaaaaa

SEQ ID NO: 612063 - DNA, 20 bp, mouse
ggagtcgccgaagcctggac

SEQ ID NO: 612064 - DNA, 20 bp, mouse
gcagggagtaagtccagtcc

SEQ ID NO: 612065 - DNA, 20 bp, mouse
gactggacttactccctggt

SEQ ID NO: 612066 - DNA, 20 bp, mouse
ggagcctcagccgggagggt

SEQ ID NO: 612067 - DNA, 20 bp, mouse
gcccggccaagcttcataac

SEQ ID NO: 612068 - DNA, 20 bp, mouse
ggaagaggcagtagagacga

SEQ ID NO: 612069 - DNA, 20 bp, mouse
gccaggcgtccgggatgctg

SEQ ID NO: 612070 - DNA, 20 bp, mouse
ggcgccgtgcgtggttcgtg

SEQ ID NO: 612071 - DNA, 20 bp, mouse
gtggggccaaccccgaggaa

SEQ ID NO: 612072 - DNA, 20 bp, mouse
gcggaggcctgagagatgag

SEQ ID NO: 612073 - DNA, 20 bp, mouse
gagacgagggtaggagatat

SEQ ID NO: 612074 - DNA, 20 bp, mouse
gcgagtgctgcggccagatg

SEQ ID NO: 612075 - DNA, 20 bp, mouse
gcgagggtaggagatatagg

SEQ ID NO: 612076 - DNA, 20 bp, mouse
ggtcctgagggctgtcggag

SEQ ID NO: 612077 - DNA, 20 bp, mouse
gagccctcaggacacaccat

SEQ ID NO: 612078 - DNA, 20 bp, mouse
gcatgggcctggaggctggt

SEQ ID NO: 612079 - DNA, 20 bp, mouse
gacacgagcgaggacgcagg

SEQ ID NO: 612080 - DNA, 20 bp, mouse
gggcccatggtgtgtcctga

SEQ ID NO: 612081 - DNA, 20 bp, mouse
ggttgtcgcagtggtcaggg

SEQ ID NO: 612082 - DNA, 20 bp, mouse
gaggcagttgagagtcgccg

SEQ ID NO: 612083 - DNA, 20 bp, mouse
gtcgtggccggagacagctg

SEQ ID NO: 612084 - DNA, 20 bp, mouse
gtgcctctccgacagccctc

SEQ ID NO: 612085 - DNA, 20 bp, mouse
gccttcgctctcgaccacgg

SEQ ID NO: 612086 - DNA, 20 bp, mouse
gccttcgcggtcctcactgg

SEQ ID NO: 612087 - DNA, 20 bp, mouse
gaccgcgaaggtaacagtct

SEQ ID NO: 612088 - DNA, 20 bp, mouse
gttaccttcgcggtcctcac

SEQ ID NO: 612089 - DNA, 20 bp, mouse
gagctgtctccggccacgag

SEQ ID NO: 612090 - DNA, 20 bp, mouse
gcgcggtcctcactggagga

SEQ ID NO: 612091 - DNA, 20 bp, mouse
gacgagcggccgagggttac

SEQ ID NO: 612092 - DNA, 20 bp, mouse
gcggagagtcccgtaaccct

SEQ ID NO: 612093 - DNA, 20 bp, mouse
ggccgagactgttaccttcg

SEQ ID NO: 612094 - DNA, 20 bp, mouse
gccttcgctctcgaccacgg

SEQ ID NO: 612095 - DNA, 20 bp, mouse
ggccaaagaaaggtctccgg

SEQ ID NO: 612096 - DNA, 20 bp, mouse
gacgggacagtcaggatcag

SEQ ID NO: 612097 - DNA, 20 bp, mouse
gagctggaggaacggcctag

SEQ ID NO: 612098 - DNA, 20 bp, mouse
gcaggatcagcggtaccact

SEQ ID NO: 612099 - DNA, 20 bp, mouse
gctgcaacccccagccgcca

SEQ ID NO: 612100 - DNA, 20 bp, mouse
ggggttgcagaccagcgctg

SEQ ID NO: 612101 - DNA, 20 bp, mouse
gaggcgacattctgccgtgg

SEQ ID NO: 612102 - DNA, 20 bp, mouse
gtacaggcgacattctgccg

SEQ ID NO: 612103 - DNA, 20 bp, mouse
gattctgccgtggcggctgg

SEQ ID NO: 612104 - DNA, 20 bp, mouse
gcacgtcacgtgggcggtac

SEQ ID NO: 612105 - DNA, 20 bp, mouse
gttgtgccgtaggggaggtg

SEQ ID NO: 612106 - DNA, 20 bp, mouse
gcacgcagggaagcaccgtg

SEQ ID NO: 612107 - DNA, 20 bp, mouse
gtgcgtgcgatgagacgaat

SEQ ID NO: 612108 - DNA, 20 bp, mouse
gagcagcgcccacagggccg

SEQ ID NO: 612109 - DNA, 20 bp, mouse
ggcggccagcagcgcccaca

SEQ ID NO: 612110 - DNA, 20 bp, mouse
gcgctcggagcgcagccgca

SEQ ID NO: 612111 - DNA, 20 bp, mouse
ggacgaatcggagcgtttgg

SEQ ID NO: 612112 - DNA, 20 bp, mouse
gagcgcaggattcagtccca

SEQ ID NO: 612113 - DNA, 20 bp, mouse
ggcgccgcgggagacacaca

SEQ ID NO: 612114 - DNA, 20 bp, mouse
gatggcagcactcggtgaag

SEQ ID NO: 612115 - DNA, 20 bp, mouse
gtcgaacgcccccgccacgt

SEQ ID NO: 612116 - DNA, 20 bp, mouse
gggcctcaaccggatggcgg

SEQ ID NO: 612117 - DNA, 20 bp, mouse
gaaatcgggcctcaaccgga

SEQ ID NO: 612118 - DNA, 20 bp, mouse
ggcggcctctgaccgaaatc

SEQ ID NO: 612119 - DNA, 20 bp, mouse
gggcagccggcagttcgcag

SEQ ID NO: 612120 - DNA, 20 bp, mouse
ggtgcctcgccaccgccatc

SEQ ID NO: 612121 - DNA, 20 bp, mouse
gggccagcccgagcagcccg

SEQ ID NO: 612122 - DNA, 20 bp, mouse
gaccgaaatcgggcctcaac

SEQ ID NO: 612123 - DNA, 20 bp, mouse
gaccgggagctgtagttcac

SEQ ID NO: 612124 - DNA, 20 bp, mouse
ggaagccacgtcccaggcgg

SEQ ID NO: 612125 - DNA, 20 bp, mouse
gcgacttgccgggtgagggg

SEQ ID NO: 612126 - DNA, 20 bp, mouse
ggagcgccaagaaacatgac

SEQ ID NO: 612127 - DNA, 20 bp, mouse
ggtcccgggactcttggagg

SEQ ID NO: 612128 - DNA, 20 bp, mouse
gtgggtcccgggactcttgg

SEQ ID NO: 612129 - DNA, 20 bp, mouse
ggaggcggaagcgctcgctc

SEQ ID NO: 612130 - DNA, 20 bp, mouse
gtgacgctcggccaaggggt

SEQ ID NO: 612131 - DNA, 20 bp, mouse
gctagagtcgtgcggaggtg

SEQ ID NO: 612132 - DNA, 20 bp, mouse
gttacccagaggcggcacgg

SEQ ID NO: 612133 - DNA, 20 bp, mouse
gtcgctccggtcatgtttct

SEQ ID NO: 612134 - DNA, 20 bp, mouse
gtgagtgtctagagaaatca

SEQ ID NO: 612135 - DNA, 20 bp, mouse
gggggaccgctcttacccag

SEQ ID NO: 612136 - DNA, 20 bp, mouse
ggcccaactcaggcttgaag

SEQ ID NO: 612137 - DNA, 20 bp, mouse
gggtccccagggacaggaac

SEQ ID NO: 612138 - DNA, 20 bp, mouse
gaggtgggtgggccagggtc

SEQ ID NO: 612139 - DNA, 20 bp, mouse
gggtctggctggcccaactc

SEQ ID NO: 612140 - DNA, 20 bp, mouse
gatgcaaaggaagtgagtca

SEQ ID NO: 612141 - DNA, 20 bp, mouse
gggctttacaggtcccaagt

SEQ ID NO: 612142 - DNA, 20 bp, mouse
gttctctgggaggatggtga

SEQ ID NO: 612143 - DNA, 20 bp, mouse
gcccaatcggtgaggtgggt

SEQ ID NO: 612144 - DNA, 20 bp, mouse
gggagtgggttggaaggcct

SEQ ID NO: 612145 - DNA, 20 bp, mouse
gacaacttctgcaggtcccc

SEQ ID NO: 612146 - DNA, 20 bp, mouse
ggaaggtcccagacaaggag

SEQ ID NO: 612147 - DNA, 20 bp, mouse
gggtcccagacaaggagcgg

SEQ ID NO: 612148 - DNA, 20 bp, mouse
gaatagtaggggtccaggca

SEQ ID NO: 612149 - DNA, 20 bp, mouse
gcgcccgccgctccttgtct

SEQ ID NO: 612150 - DNA, 20 bp, mouse
gggactgggccggctcgcag

SEQ ID NO: 612151 - DNA, 20 bp, mouse
ggcttgatgtgagagtgaaa

SEQ ID NO: 612152 - DNA, 20 bp, mouse
ggctcgcagaggcccgtccc

SEQ ID NO: 612153 - DNA, 20 bp, mouse
gtgcgcgccacggcttgggg

SEQ ID NO: 612154 - DNA, 20 bp, mouse
gcgcccagcgggccccatcg

SEQ ID NO: 612155 - DNA, 20 bp, mouse
gcctaagcagggatccttag

SEQ ID NO: 612156 - DNA, 20 bp, mouse
gtacaggcggacgtccatgg

SEQ ID NO: 612157 - DNA, 20 bp, mouse
ggggcgccgagggatacagg

SEQ ID NO: 612158 - DNA, 20 bp, mouse
gggctcgcatagggctccca

SEQ ID NO: 612159 - DNA, 20 bp, mouse
gcgcgggcgccgagggatac

SEQ ID NO: 612160 - DNA, 20 bp, mouse
gggatacaggcggacgtcca

SEQ ID NO: 612161 - DNA, 20 bp, mouse
ggctcccgcgggcagtgcct

SEQ ID NO: 612162 - DNA, 20 bp, mouse
gtcgcacacgggctcgcata

SEQ ID NO: 612163 - DNA, 20 bp, mouse
gacgtccatggcgggcgcgg

SEQ ID NO: 612164 - DNA, 20 bp, mouse
gtgcctgggcgggcagccgt

SEQ ID NO: 612165 - DNA, 20 bp, mouse
ggacgtccgcctgtatccct

SEQ ID NO: 612166 - DNA, 20 bp, mouse
ggtgcgcggcgaagctggga

SEQ ID NO: 612167 - DNA, 20 bp, mouse
gcggctcagtccgcccgggg

SEQ ID NO: 612168 - DNA, 20 bp, mouse
gcgcggcgaagctgggacgg

SEQ ID NO: 612169 - DNA, 20 bp, mouse
ggcagcgcgtgggcccggga

SEQ ID NO: 612170 - DNA, 20 bp, mouse
gctgcggctgcagcacacaa

SEQ ID NO: 612171 - DNA, 20 bp, mouse
gctcagtccgcccggggagg

SEQ ID NO: 612172 - DNA, 20 bp, mouse
gtcaggtgcgcggcgaagct

SEQ ID NO: 612173 - DNA, 20 bp, mouse
gcgggacggccggcgagctc

SEQ ID NO: 612174 - DNA, 20 bp, mouse
gggactgagccgaggagccg

SEQ ID NO: 612175 - DNA, 20 bp, mouse
gcctcggctcagtccgcccg

SEQ ID NO: 612176 - DNA, 20 bp, mouse
ggacgctgagtcgctggtag

SEQ ID NO: 612177 - DNA, 20 bp, mouse
gcgcgctcggaacctagtgg

SEQ ID NO: 612178 - DNA, 20 bp, mouse
gtcatcagccctcaaagact

SEQ ID NO: 612179 - DNA, 20 bp, mouse
ggtgggtgccgagtctttga

SEQ ID NO: 612180 - DNA, 20 bp, mouse
gagggttcgcggccgactag

SEQ ID NO: 612181 - DNA, 20 bp, mouse
gcgccggagggcctaggcag

SEQ ID NO: 612182 - DNA, 20 bp, mouse
gcgcggagacgctgagtcgc

SEQ ID NO: 612183 - DNA, 20 bp, mouse
ggaggcttcgagctcctcta

SEQ ID NO: 612184 - DNA, 20 bp, mouse
gcactgggtggccctagagg

SEQ ID NO: 612185 - DNA, 20 bp, mouse
gtgacgcgctcggaacctag

SEQ ID NO: 612186 - DNA, 20 bp, mouse
gcccgcagcaggagctggga

SEQ ID NO: 612187 - DNA, 20 bp, mouse
gtgggaaggcgcgtggactc

SEQ ID NO: 612188 - DNA, 20 bp, mouse
ggaaggcgcgtggactcggg

SEQ ID NO: 612189 - DNA, 20 bp, mouse
gctggggttgagaggagagt

SEQ ID NO: 612190 - DNA, 20 bp, mouse
gctcgggtggccctcggagt

SEQ ID NO: 612191 - DNA, 20 bp, mouse
ggcctgcaaagccaactccg

SEQ ID NO: 612192 - DNA, 20 bp, mouse
ggaactggggagtcgagagt

SEQ ID NO: 612193 - DNA, 20 bp, mouse
gagggaacccgccaacaaag

SEQ ID NO: 612194 - DNA, 20 bp, mouse
gaaagcggccgtgggaccgt

SEQ ID NO: 612195 - DNA, 20 bp, mouse
ggctgggtggccaggaactg

SEQ ID NO: 612196 - DNA, 20 bp, mouse
gtctccagggagttcctcca

SEQ ID NO: 612197 - DNA, 20 bp, mouse
gaagtctgagccttgttaca

SEQ ID NO: 612198 - DNA, 20 bp, mouse
gtcaagtcctcaatctgctt

SEQ ID NO: 612199 - DNA, 20 bp, mouse
gacaaagttgtatgcccgag

SEQ ID NO: 612200 - DNA, 20 bp, mouse
gaactgggaagtactgggca

SEQ ID NO: 612201 - DNA, 20 bp, mouse
ggaatggatttaaattgtgt

SEQ ID NO: 612202 - DNA, 20 bp, mouse
ggtataaagtagacactccc

SEQ ID NO: 612203 - DNA, 20 bp, mouse
ggatttaaattgtgttggta

SEQ ID NO: 612204 - DNA, 20 bp, mouse
ggagaaacaaggaggatgaa

SEQ ID NO: 612205 - DNA, 20 bp, mouse
ggacttgaggagtgccctgg

SEQ ID NO: 612206 - DNA, 20 bp, mouse
gatctgctctggcagagtca

SEQ ID NO: 612207 - DNA, 20 bp, mouse
gtctgtgcagaaggaatacc

SEQ ID NO: 612208 - DNA, 20 bp, mouse
gataagttcccaatctgctc

SEQ ID NO: 612209 - DNA, 20 bp, mouse
gactggcactccctgtgacc

SEQ ID NO: 612210 - DNA, 20 bp, mouse
gtggctgctgccattgttca

SEQ ID NO: 612211 - DNA, 20 bp, mouse
gaagtctgagcctggtcaca

SEQ ID NO: 612212 - DNA, 20 bp, mouse
gacaaagttgcatgcttgag

SEQ ID NO: 612213 - DNA, 20 bp, mouse
gggaaaaagtgatcctaagt

SEQ ID NO: 612214 - DNA, 20 bp, mouse
gcacccagtacttcccactt

SEQ ID NO: 612215 - DNA, 20 bp, mouse
ggttgcatgcttgaggggac

SEQ ID NO: 612216 - DNA, 20 bp, mouse
gtccgcgctggggatattgg

SEQ ID NO: 612217 - DNA, 20 bp, mouse
gcgctgtggcagcggtgagg

SEQ ID NO: 612218 - DNA, 20 bp, mouse
gggctccgcgctggggatat

SEQ ID NO: 612219 - DNA, 20 bp, mouse
ggcgctggggatattggcgg

SEQ ID NO: 612220 - DNA, 20 bp, mouse
gtgtggcagcggtgaggcgg

SEQ ID NO: 612221 - DNA, 20 bp, mouse
gatattggcggcggcaactg

SEQ ID NO: 612222 - DNA, 20 bp, mouse
gtgagtgctccagaagcccg

SEQ ID NO: 612223 - DNA, 20 bp, mouse
gacagtgcgggatcccggga

SEQ ID NO: 612224 - DNA, 20 bp, mouse
gtgccgctgtggcagcggtg

SEQ ID NO: 612225 - DNA, 20 bp, mouse
gcaggagtcggcggatgcga

SEQ ID NO: 612226 - DNA, 20 bp, mouse
gctcggtcccggcccagaag

SEQ ID NO: 612227 - DNA, 20 bp, mouse
gtcgcggctgggaccaggtc

SEQ ID NO: 612228 - DNA, 20 bp, mouse
ggcagtggccaggtccactc

SEQ ID NO: 612229 - DNA, 20 bp, mouse
gcagaagagcagccccttct

SEQ ID NO: 612230 - DNA, 20 bp, mouse
gtccggcctgttacattggt

SEQ ID NO: 612231 - DNA, 20 bp, mouse
gtgttacattggtgggatgg

SEQ ID NO: 612232 - DNA, 20 bp, mouse
ggacacctcactcaccggag

SEQ ID NO: 612233 - DNA, 20 bp, mouse
gctcactgcctggggaccat

SEQ ID NO: 612234 - DNA, 20 bp, mouse
ggtggacctggccactgcct

SEQ ID NO: 612235 - DNA, 20 bp, mouse
ggcctgttacattggtggga

SEQ ID NO: 612236 - DNA, 20 bp, mouse
gggcagggaagaggaccccg

SEQ ID NO: 612237 - DNA, 20 bp, mouse
gcgcgcagcgagggccaccc

SEQ ID NO: 612238 - DNA, 20 bp, mouse
gccgcggcgagcaaggtagg

SEQ ID NO: 612239 - DNA, 20 bp, mouse
gcttacgagcgcggagaggg

SEQ ID NO: 612240 - DNA, 20 bp, mouse
ggtcgctagaccagaatcct

SEQ ID NO: 612241 - DNA, 20 bp, mouse
gcgatcgcgcacactcgctc

SEQ ID NO: 612242 - DNA, 20 bp, mouse
gcctcttacgagcgcggaga

SEQ ID NO: 612243 - DNA, 20 bp, mouse
gcggcagatcctggaagtga

SEQ ID NO: 612244 - DNA, 20 bp, mouse
gaggctgcacaagcagctac

SEQ ID NO: 612245 - DNA, 20 bp, mouse
ggccgcccgagccgacgtgg

SEQ ID NO: 612246 - DNA, 20 bp, mouse
ggcgcgccgggagagggcac

SEQ ID NO: 612247 - DNA, 20 bp, mouse
gcgccgggagagggcacggg

SEQ ID NO: 612248 - DNA, 20 bp, mouse
gcgacacgcgcgccgggaga

SEQ ID NO: 612249 - DNA, 20 bp, mouse
gcgccgcccgtgccctctcc

SEQ ID NO: 612250 - DNA, 20 bp, mouse
gggaggcgcaggcacaaggt

SEQ ID NO: 612251 - DNA, 20 bp, mouse
gtggtagcgattcccgagct

SEQ ID NO: 612252 - DNA, 20 bp, mouse
gtctgtcccggagtaaagtt

SEQ ID NO: 612253 - DNA, 20 bp, mouse
gggatcccgaaggcgcgcgt

SEQ ID NO: 612254 - DNA, 20 bp, mouse
ggtgtcgcgagcattcgtgg

SEQ ID NO: 612255 - DNA, 20 bp, mouse
gtccaaaccggccaccatgg

SEQ ID NO: 612256 - DNA, 20 bp, mouse
gagccccgaggactgcaagc

SEQ ID NO: 612257 - DNA, 20 bp, mouse
gctacaggagcccagccccg

SEQ ID NO: 612258 - DNA, 20 bp, mouse
gctgggatcgcaggtcctac

SEQ ID NO: 612259 - DNA, 20 bp, mouse
gtgccagcttgcagtcctcg

SEQ ID NO: 612260 - DNA, 20 bp, mouse
gacgagccagtggaactgta

SEQ ID NO: 612261 - DNA, 20 bp, mouse
gtgcggccctacagttccac

SEQ ID NO: 612262 - DNA, 20 bp, mouse
gagctgggtgtagctggcgt

SEQ ID NO: 612263 - DNA, 20 bp, mouse
gcttcgtacacacgagccag

SEQ ID NO: 612264 - DNA, 20 bp, mouse
gaagggaggccgaggcgcca

SEQ ID NO: 612265 - DNA, 20 bp, mouse
gagcagagtccatgttcagg

SEQ ID NO: 612266 - DNA, 20 bp, mouse
gtaagtgaggccaaaaaccc

SEQ ID NO: 612267 - DNA, 20 bp, mouse
gctcggaaggagactaagtg

SEQ ID NO: 612268 - DNA, 20 bp, mouse
ggagagcccaggccgagtct

SEQ ID NO: 612269 - DNA, 20 bp, mouse
gtctggtgacaactccgctc

SEQ ID NO: 612270 - DNA, 20 bp, mouse
gcaaaaacccgggagagccc

SEQ ID NO: 612271 - DNA, 20 bp, mouse
gcaaaatggtcccccaggaa

SEQ ID NO: 612272 - DNA, 20 bp, mouse
gttgctcccagactcggcct

SEQ ID NO: 612273 - DNA, 20 bp, mouse
ggagcgttaaggtgcctgag

SEQ ID NO: 612274 - DNA, 20 bp, mouse
gaaagctcaccaggaatcta

SEQ ID NO: 612275 - DNA, 20 bp, mouse
ggacttgcccactaccaaga

SEQ ID NO: 612276 - DNA, 20 bp, mouse
ggcaggccggctgtccacgg

SEQ ID NO: 612277 - DNA, 20 bp, mouse
gccggcaggccggctgtcca

SEQ ID NO: 612278 - DNA, 20 bp, mouse
ggtcctcacaccgcgcgcag

SEQ ID NO: 612279 - DNA, 20 bp, mouse
gagcttggtgctgtacccag

SEQ ID NO: 612280 - DNA, 20 bp, mouse
gcccgacggccgcagacctg

SEQ ID NO: 612281 - DNA, 20 bp, mouse
gaggatgcgagtgacgccta

SEQ ID NO: 612282 - DNA, 20 bp, mouse
ggtgaggacgcgtgccatgg

SEQ ID NO: 612283 - DNA, 20 bp, mouse
gggctgccttggatactgag

SEQ ID NO: 612284 - DNA, 20 bp, mouse
gggtgtgaggacgcgtgcca

SEQ ID NO: 612285 - DNA, 20 bp, mouse
gtccgccaggagaggatggg

SEQ ID NO: 612286 - DNA, 20 bp, mouse
ggaagactcccagcaaggac

SEQ ID NO: 612287 - DNA, 20 bp, mouse
gcgaagagcagagccctgag

SEQ ID NO: 612288 - DNA, 20 bp, mouse
gagtgggatagcccctccct

SEQ ID NO: 612289 - DNA, 20 bp, mouse
gccactcacctcagagccac

SEQ ID NO: 612290 - DNA, 20 bp, mouse
gctgatccgatgtcccaggg

SEQ ID NO: 612291 - DNA, 20 bp, mouse
gcttctgatccgatgtccca

SEQ ID NO: 612292 - DNA, 20 bp, mouse
ggtgactctttaaactccag

SEQ ID NO: 612293 - DNA, 20 bp, mouse
gtaaagccgaaatccaacgt

SEQ ID NO: 612294 - DNA, 20 bp, mouse
ggacgggatcaacttctagt

SEQ ID NO: 612295 - DNA, 20 bp, mouse
gggtgaagtcctacccctca

SEQ ID NO: 612296 - DNA, 20 bp, mouse
gtgtgaactgcctgatgtcg

SEQ ID NO: 612297 - DNA, 20 bp, mouse
gaggggagaggaatgcatgg

SEQ ID NO: 612298 - DNA, 20 bp, mouse
gctggtgcatgagttacagc

SEQ ID NO: 612299 - DNA, 20 bp, mouse
gcaagtggcactgatagaca

SEQ ID NO: 612300 - DNA, 20 bp, mouse
gaactgcctgatgtcggggc

SEQ ID NO: 612301 - DNA, 20 bp, mouse
gagagagaaggcgtggagga

SEQ ID NO: 612302 - DNA, 20 bp, mouse
gagcgtgggttagggctgtg

SEQ ID NO: 612303 - DNA, 20 bp, mouse
gcaagaagctgggataaaca

SEQ ID NO: 612304 - DNA, 20 bp, mouse
gggaataagcacggaagcgt

SEQ ID NO: 612305 - DNA, 20 bp, mouse
ggaggcacagagagggaatt

SEQ ID NO: 612306 - DNA, 20 bp, mouse
ggccttggcagagatgaagg

SEQ ID NO: 612307 - DNA, 20 bp, mouse
ggcagcaggggggaccagag

SEQ ID NO: 612308 - DNA, 20 bp, mouse
gtctggacagcgccccgagc

SEQ ID NO: 612309 - DNA, 20 bp, mouse
gagtggcagctgcctgctcg

SEQ ID NO: 612310 - DNA, 20 bp, mouse
gtaaatactgggccaggaga

SEQ ID NO: 612311 - DNA, 20 bp, mouse
gttgatgccctagagaacac

SEQ ID NO: 612312 - DNA, 20 bp, mouse
ggccaggagagggttgtcct

SEQ ID NO: 612313 - DNA, 20 bp, mouse
gagcaggtgtccatatggtg

SEQ ID NO: 612314 - DNA, 20 bp, mouse
gtctggcacagcagaatcca

SEQ ID NO: 612315 - DNA, 20 bp, mouse
gtctacagcaggtgtccata

SEQ ID NO: 612316 - DNA, 20 bp, mouse
gcaacgaagaacttcctggt

SEQ ID NO: 612317 - DNA, 20 bp, mouse
gtggtaggcgccattgtacc

SEQ ID NO: 612318 - DNA, 20 bp, mouse
gagctccggtccactcccaa

SEQ ID NO: 612319 - DNA, 20 bp, mouse
gctgctgccgggacaccaaa

SEQ ID NO: 612320 - DNA, 20 bp, mouse
gaacgcacggctctctccac

SEQ ID NO: 612321 - DNA, 20 bp, mouse
ggtgtctgagtggacctgga

SEQ ID NO: 612322 - DNA, 20 bp, mouse
ggaaggtcagtacaaacgca

SEQ ID NO: 612323 - DNA, 20 bp, mouse
gccggagctgcaccagttag

SEQ ID NO: 612324 - DNA, 20 bp, mouse
gtgtccccaggccaccatcc

SEQ ID NO: 612325 - DNA, 20 bp, mouse
gatcgcccttgggagtggac

SEQ ID NO: 612326 - DNA, 20 bp, mouse
gaccgggagcctgaagagtg

SEQ ID NO: 612327 - DNA, 20 bp, mouse
gggtgcacaaaccacctctg

SEQ ID NO: 612328 - DNA, 20 bp, mouse
gtttctggactgaaaaacga

SEQ ID NO: 612329 - DNA, 20 bp, mouse
gtgggctctgtagtggacaa

SEQ ID NO: 612330 - DNA, 20 bp, mouse
gctgatctcgtcctcagagg

SEQ ID NO: 612331 - DNA, 20 bp, mouse
gtcggcaagaagccctcacg

SEQ ID NO: 612332 - DNA, 20 bp, mouse
gagaaagcccctcactcttc

SEQ ID NO: 612333 - DNA, 20 bp, mouse
gggtcttgcattcactttct

SEQ ID NO: 612334 - DNA, 20 bp, mouse
gcaaagtcgatgtaagcggt

SEQ ID NO: 612335 - DNA, 20 bp, mouse
ggtaaacaggaggggagata

SEQ ID NO: 612336 - DNA, 20 bp, mouse
gcagccgcgcacttacacaa

SEQ ID NO: 612337 - DNA, 20 bp, mouse
gccacgagcgacgcgagcga

SEQ ID NO: 612338 - DNA, 20 bp, mouse
gccgcgcacttacacaatgg

SEQ ID NO: 612339 - DNA, 20 bp, mouse
ggccaggaaggtgcagcggt

SEQ ID NO: 612340 - DNA, 20 bp, mouse
ggcgagggctgcgggagtga

SEQ ID NO: 612341 - DNA, 20 bp, mouse
ggcacttacacaatggcggg

SEQ ID NO: 612342 - DNA, 20 bp, mouse
ggcactacgggaggccagga

SEQ ID NO: 612343 - DNA, 20 bp, mouse
ggtgggcgggggaaagtccc

SEQ ID NO: 612344 - DNA, 20 bp, mouse
gagtccccggatggaagctg

SEQ ID NO: 612345 - DNA, 20 bp, mouse
gggggcgtctgggtgaatag

SEQ ID NO: 612346 - DNA, 20 bp, mouse
ggcgaggggcccttaggcag

SEQ ID NO: 612347 - DNA, 20 bp, mouse
gccttaggcagcggagcgag

SEQ ID NO: 612348 - DNA, 20 bp, mouse
ggcggtggcgaggggccctt

SEQ ID NO: 612349 - DNA, 20 bp, mouse
gaggagacgcgagcgcggtg

SEQ ID NO: 612350 - DNA, 20 bp, mouse
gccccagccagggtgtccag

SEQ ID NO: 612351 - DNA, 20 bp, mouse
gatggcgtccatggtggcgg

SEQ ID NO: 612352 - DNA, 20 bp, mouse
ggcgagaggagacgcgagcg

SEQ ID NO: 612353 - DNA, 20 bp, mouse
ggcggaggctgataagaagg

SEQ ID NO: 612354 - DNA, 20 bp, mouse
gcagctccgcgctcgcactc

SEQ ID NO: 612355 - DNA, 20 bp, mouse
gttgatggcgtccatggtgg

SEQ ID NO: 612356 - DNA, 20 bp, mouse
gtagcagctgcagagcgcgg

SEQ ID NO: 612357 - DNA, 20 bp, mouse
gccggacctgggctcggtag

SEQ ID NO: 612358 - DNA, 20 bp, mouse
ggcgcgagctggaccaggag

SEQ ID NO: 612359 - DNA, 20 bp, mouse
gcatggcgaggcggtggctg

SEQ ID NO: 612360 - DNA, 20 bp, mouse
ggctacccgccatggcgagg

SEQ ID NO: 612361 - DNA, 20 bp, mouse
gcagtagcagctgcagagcg

SEQ ID NO: 612362 - DNA, 20 bp, mouse
gggcgggacgaaccggacct

SEQ ID NO: 612363 - DNA, 20 bp, mouse
gagcgagctgctacccgcca

SEQ ID NO: 612364 - DNA, 20 bp, mouse
gcggcctgggcgggacgaac

SEQ ID NO: 612365 - DNA, 20 bp, mouse
ggctgctacccgccatggcg

SEQ ID NO: 612366 - DNA, 20 bp, mouse
ggcgagctctggatgcacag

SEQ ID NO: 612367 - DNA, 20 bp, mouse
gcaggtcaggaggaccaaga

SEQ ID NO: 612368 - DNA, 20 bp, mouse
gggtgaagagtaggtagact

SEQ ID NO: 612369 - DNA, 20 bp, mouse
ggatgcacaggggacaggtc

SEQ ID NO: 612370 - DNA, 20 bp, mouse
ggcacaggggacaggtcagg

SEQ ID NO: 612371 - DNA, 20 bp, mouse
gctgggctaggcgcgagctc

SEQ ID NO: 612372 - DNA, 20 bp, mouse
gcagaggccacaagaccctt

SEQ ID NO: 612373 - DNA, 20 bp, mouse
gggcgtccatggctgcggtg

SEQ ID NO: 612374 - DNA, 20 bp, mouse
gcaaggcccaaaccttgtag

SEQ ID NO: 612375 - DNA, 20 bp, mouse
gagaccgatgcaagcaggtg

SEQ ID NO: 612376 - DNA, 20 bp, mouse
gggcggagcaggcggaagta

SEQ ID NO: 612377 - DNA, 20 bp, mouse
ggcggaagtagggtgaaaag

SEQ ID NO: 612378 - DNA, 20 bp, mouse
ggccgaggcgcagcagggaa

SEQ ID NO: 612379 - DNA, 20 bp, mouse
gtatttcagggcggagcagg

SEQ ID NO: 612380 - DNA, 20 bp, mouse
gagtgagttccggtatttca

SEQ ID NO: 612381 - DNA, 20 bp, mouse
ggagttccggtatttcaggg

SEQ ID NO: 612382 - DNA, 20 bp, mouse
ggcccgggagcaggtacgca

SEQ ID NO: 612383 - DNA, 20 bp, mouse
gaggtacgcacggagagccg

SEQ ID NO: 612384 - DNA, 20 bp, mouse
gacgcgagcaggctagaccc

SEQ ID NO: 612385 - DNA, 20 bp, mouse
gccggcgtatgagtgagttc

SEQ ID NO: 612386 - DNA, 20 bp, mouse
ggaagaggtggctcgtaagt

SEQ ID NO: 612387 - DNA, 20 bp, mouse
gaagttataaagtcaagaag

SEQ ID NO: 612388 - DNA, 20 bp, mouse
ggataggaagtatgaagagg

SEQ ID NO: 612389 - DNA, 20 bp, mouse
ggagcgcctccagcaggaag

SEQ ID NO: 612390 - DNA, 20 bp, mouse
ggaaaggcgggcccggaagc

SEQ ID NO: 612391 - DNA, 20 bp, mouse
gcagcaagctgatgatgcag

SEQ ID NO: 612392 - DNA, 20 bp, mouse
gaacgccgagcggaggaggt

SEQ ID NO: 612393 - DNA, 20 bp, mouse
gctacaacgccgagcggagg

SEQ ID NO: 612394 - DNA, 20 bp, mouse
gcggctacaacgccgagcgg

SEQ ID NO: 612395 - DNA, 20 bp, mouse
gaagcagcttgtaggcacca

SEQ ID NO: 612396 - DNA, 20 bp, mouse
gcagcagaacgattgagcta

SEQ ID NO: 612397 - DNA, 20 bp, mouse
gcagcaggcagacgacgcag

SEQ ID NO: 612398 - DNA, 20 bp, mouse
gacggggctccaggatccaa

SEQ ID NO: 612399 - DNA, 20 bp, mouse
gcaaggcggaggggagacgg

SEQ ID NO: 612400 - DNA, 20 bp, mouse
gagcgcgcgggacgaaaagt

SEQ ID NO: 612401 - DNA, 20 bp, mouse
gagaacgattgagctatggc

SEQ ID NO: 612402 - DNA, 20 bp, mouse
ggcctgcagcgcgaactgga

SEQ ID NO: 612403 - DNA, 20 bp, mouse
gctgcggctgaccaaggtgg

SEQ ID NO: 612404 - DNA, 20 bp, mouse
gagggtatggatgatcaagg

SEQ ID NO: 612405 - DNA, 20 bp, mouse
gccgggcccgcagtgctccc

SEQ ID NO: 612406 - DNA, 20 bp, mouse
gcacagctcccggcttacaa

SEQ ID NO: 612407 - DNA, 20 bp, mouse
gaggcgggctagtgtctgag

SEQ ID NO: 612408 - DNA, 20 bp, mouse
gagttctcaaccggtagtaa

SEQ ID NO: 612409 - DNA, 20 bp, mouse
gagctcccggcttacaaagg

SEQ ID NO: 612410 - DNA, 20 bp, mouse
ggagctgtgcaaggactcac

SEQ ID NO: 612411 - DNA, 20 bp, mouse
ggttgagaacttacttacct

SEQ ID NO: 612412 - DNA, 20 bp, mouse
gtctcaaccggtagtaaagg

SEQ ID NO: 612413 - DNA, 20 bp, mouse
ggataaccgcagcaaaaact

SEQ ID NO: 612414 - DNA, 20 bp, mouse
gcgggcagggcctataggac

SEQ ID NO: 612415 - DNA, 20 bp, mouse
gaaggggctacttaatacat

SEQ ID NO: 612416 - DNA, 20 bp, mouse
gccgctgggtgtgttctctg

SEQ ID NO: 612417 - DNA, 20 bp, mouse
gaagcaggatgtgcaccgct

SEQ ID NO: 612418 - DNA, 20 bp, mouse
gtctatgggagaccattatt

SEQ ID NO: 612419 - DNA, 20 bp, mouse
gtctcagcagcggaagaagc

SEQ ID NO: 612420 - DNA, 20 bp, mouse
gacacctgaactgaaggaat

SEQ ID NO: 612421 - DNA, 20 bp, mouse
ggtaccaccaggctttgtta

SEQ ID NO: 612422 - DNA, 20 bp, mouse
ggaactgaaggaataggaac

SEQ ID NO: 612423 - DNA, 20 bp, mouse
gaataggaacgggtaccacc

SEQ ID NO: 612424 - DNA, 20 bp, mouse
gtctccctaacaaagcctgg

SEQ ID NO: 612425 - DNA, 20 bp, mouse
gcctagcacacctgaactga

SEQ ID NO: 612426 - DNA, 20 bp, mouse
gccggtgagaaactgaggtg

SEQ ID NO: 612427 - DNA, 20 bp, mouse
gcaagcccggtgagaaactg

SEQ ID NO: 612428 - DNA, 20 bp, mouse
gtgagaaactgaggtgggga

SEQ ID NO: 612429 - DNA, 20 bp, mouse
gcaaccctgagccggaccag

SEQ ID NO: 612430 - DNA, 20 bp, mouse
ggtggggagggtagctaagg

SEQ ID NO: 612431 - DNA, 20 bp, mouse
gcaaaatgggactccaagcc

SEQ ID NO: 612432 - DNA, 20 bp, mouse
gctgtccctgcagcctccta

SEQ ID NO: 612433 - DNA, 20 bp, mouse
gaccaagcgtctgcagagac

SEQ ID NO: 612434 - DNA, 20 bp, mouse
gccctgagccggaccagcgg

SEQ ID NO: 612435 - DNA, 20 bp, mouse
gaagtcacatgagcatggtc

SEQ ID NO: 612436 - DNA, 20 bp, mouse
ggcaagctggaggacagacg

SEQ ID NO: 612437 - DNA, 20 bp, mouse
gggccatggacgcaagctgg

SEQ ID NO: 612438 - DNA, 20 bp, mouse
gcgagcggcgcgaggacacc

SEQ ID NO: 612439 - DNA, 20 bp, mouse
gtagcggcacaggaaggagg

SEQ ID NO: 612440 - DNA, 20 bp, mouse
gggaaagggctcctcggtcg

SEQ ID NO: 612441 - DNA, 20 bp, mouse
gaagggctcctcggtcgcgg

SEQ ID NO: 612442 - DNA, 20 bp, mouse
gatcgccgtcctggacacag

SEQ ID NO: 612443 - DNA, 20 bp, mouse
gggccccgggcatgcaggtg

SEQ ID NO: 612444 - DNA, 20 bp, mouse
gtccgggtagcggcacagga

SEQ ID NO: 612445 - DNA, 20 bp, mouse
gccgctacccggagtatgac

SEQ ID NO: 612446 - DNA, 20 bp, mouse
gggcgcgcgtctagtcgctg

SEQ ID NO: 612447 - DNA, 20 bp, mouse
gagaaccgcgcctcggacca

SEQ ID NO: 612448 - DNA, 20 bp, mouse
gcgactagacgcgcgcccag

SEQ ID NO: 612449 - DNA, 20 bp, mouse
ggagcagtggtgtcaagaat

SEQ ID NO: 612450 - DNA, 20 bp, mouse
gctgagagctcggcgcccct

SEQ ID NO: 612451 - DNA, 20 bp, mouse
gccagcctcacggaccggag

SEQ ID NO: 612452 - DNA, 20 bp, mouse
gattgcgtcggcacttgata

SEQ ID NO: 612453 - DNA, 20 bp, mouse
gtgagccaggcgcattgcgt

SEQ ID NO: 612454 - DNA, 20 bp, mouse
gagcagtggacgcgttttgg

SEQ ID NO: 612455 - DNA, 20 bp, mouse
gcgcagcagtggacgcgttt

SEQ ID NO: 612456 - DNA, 20 bp, mouse
gagacaccggcagggctccc

SEQ ID NO: 612457 - DNA, 20 bp, mouse
gaaaggcacagacaccggca

SEQ ID NO: 612458 - DNA, 20 bp, mouse
gtgtacacacttgtatacaa

SEQ ID NO: 612459 - DNA, 20 bp, mouse
gtggccactttcatatacct

SEQ ID NO: 612460 - DNA, 20 bp, mouse
ggatgggagtcatatgactg

SEQ ID NO: 612461 - DNA, 20 bp, mouse
ggctcccaggtatatgaaag

SEQ ID NO: 612462 - DNA, 20 bp, mouse
gcaagtgtgtacagctagat

SEQ ID NO: 612463 - DNA, 20 bp, mouse
gtatatgaaagtggccagaa

SEQ ID NO: 612464 - DNA, 20 bp, mouse
gatgagatgatggaagggta

SEQ ID NO: 612465 - DNA, 20 bp, mouse
gtcaattgctgggggagtgg

SEQ ID NO: 612466 - DNA, 20 bp, mouse
gcccgggagccggcagggag

SEQ ID NO: 612467 - DNA, 20 bp, mouse
gtcccgcccgggagccggca

SEQ ID NO: 612468 - DNA, 20 bp, mouse
gactgatgctggagaccagg

SEQ ID NO: 612469 - DNA, 20 bp, mouse
gcctgagcgtgccttcggac

SEQ ID NO: 612470 - DNA, 20 bp, mouse
gacgctcaggagcagccaag

SEQ ID NO: 612471 - DNA, 20 bp, mouse
ggcggagctgtggagcctcc

SEQ ID NO: 612472 - DNA, 20 bp, mouse
ggttcctgggtcctgtccga

SEQ ID NO: 612473 - DNA, 20 bp, mouse
ggtgccttcggacaggaccc

SEQ ID NO: 612474 - DNA, 20 bp, mouse
ggtctccagcatcagttcct

SEQ ID NO: 612475 - DNA, 20 bp, mouse
gcccagcaggagctgacgag

SEQ ID NO: 612476 - DNA, 20 bp, mouse
gcgagagaccgcgagcgagg

SEQ ID NO: 612477 - DNA, 20 bp, mouse
gtgcccgcctgagactcccg

SEQ ID NO: 612478 - DNA, 20 bp, mouse
gactcccgcggcgggaccct

SEQ ID NO: 612479 - DNA, 20 bp, mouse
gcagcgtgcctagctcccgg

SEQ ID NO: 612480 - DNA, 20 bp, mouse
ggctctggctgcacctaacg

SEQ ID NO: 612481 - DNA, 20 bp, mouse
ggatcgactgcctgaagggg

SEQ ID NO: 612482 - DNA, 20 bp, mouse
gcttaacggtgccccgagag

SEQ ID NO: 612483 - DNA, 20 bp, mouse
gagcgaggcggcggacgggg

SEQ ID NO: 612484 - DNA, 20 bp, mouse
gcactcgtcacagccatagg

SEQ ID NO: 612485 - DNA, 20 bp, mouse
gggcaccgttaagatcgtgg

SEQ ID NO: 612486 - DNA, 20 bp, mouse
ggagtcgccgctgccagggg

SEQ ID NO: 612487 - DNA, 20 bp, mouse
ggaacccgaagaaggagcag

SEQ ID NO: 612488 - DNA, 20 bp, mouse
gtgagagtcgccgctgccag

SEQ ID NO: 612489 - DNA, 20 bp, mouse
gcgctgccaggggaggaccg

SEQ ID NO: 612490 - DNA, 20 bp, mouse
gcttggcggagcaggagatg

SEQ ID NO: 612491 - DNA, 20 bp, mouse
gggaggaccggggaagtccg

SEQ ID NO: 612492 - DNA, 20 bp, mouse
ggcaggactcacgggacccg

SEQ ID NO: 612493 - DNA, 20 bp, mouse
gcgccagcgcgcaggactca

SEQ ID NO: 612494 - DNA, 20 bp, mouse
gggttctcgctacctcgcag

SEQ ID NO: 612495 - DNA, 20 bp, mouse
gtacgtggatcggtcagagg

SEQ ID NO: 612496 - DNA, 20 bp, mouse
gaagtgcggctgggtatcag

SEQ ID NO: 612497 - DNA, 20 bp, mouse
gcagctacagaagtgcggct

SEQ ID NO: 612498 - DNA, 20 bp, mouse
gtaaccgctccctctcaaag

SEQ ID NO: 612499 - DNA, 20 bp, mouse
gaggcagtagtgggtcctca

SEQ ID NO: 612500 - DNA, 20 bp, mouse
ggctactgtagctgtctcag

SEQ ID NO: 612501 - DNA, 20 bp, mouse
ggctgggcaggagaatagcc

SEQ ID NO: 612502 - DNA, 20 bp, mouse
gcttacctggaaggcagtag

SEQ ID NO: 612503 - DNA, 20 bp, mouse
gttcagcatatggaagaaca

SEQ ID NO: 612504 - DNA, 20 bp, mouse
gatcagtgggtgacagctcc

SEQ ID NO: 612505 - DNA, 20 bp, mouse
gcaattttgcccctttgaga

SEQ ID NO: 612506 - DNA, 20 bp, mouse
gctgcagctgcgggacacgg

SEQ ID NO: 612507 - DNA, 20 bp, mouse
gcgtcggtggaggctgccgg

SEQ ID NO: 612508 - DNA, 20 bp, mouse
gatgctgcagctgcgggaca

SEQ ID NO: 612509 - DNA, 20 bp, mouse
gctgcgggacacggtggact

SEQ ID NO: 612510 - DNA, 20 bp, mouse
ggggcggcggccgtcggtgg

SEQ ID NO: 612511 - DNA, 20 bp, mouse
gtcctccacgggccgtacca

SEQ ID NO: 612512 - DNA, 20 bp, mouse
ggcgggcacgagccccacgg

SEQ ID NO: 612513 - DNA, 20 bp, mouse
ggcggcccctctcctctcca

SEQ ID NO: 612514 - DNA, 20 bp, mouse
gcgcggccgggcggacgccg

SEQ ID NO: 612515 - DNA, 20 bp, mouse
gtagggtcgtggacgttcag

SEQ ID NO: 612516 - DNA, 20 bp, mouse
gccgcagggaaagagcaaca

SEQ ID NO: 612517 - DNA, 20 bp, mouse
ggatgcgggcgtaggatgca

SEQ ID NO: 612518 - DNA, 20 bp, mouse
gagagagctaagtttcctag

SEQ ID NO: 612519 - DNA, 20 bp, mouse
gaggggacgatcttctgatg

SEQ ID NO: 612520 - DNA, 20 bp, mouse
ggatcttctgatgcgggcgt

SEQ ID NO: 612521 - DNA, 20 bp, mouse
gtcaggagcgcggctcggga

SEQ ID NO: 612522 - DNA, 20 bp, mouse
gaccccgtgaccattgggat

SEQ ID NO: 612523 - DNA, 20 bp, mouse
ggaagtgcttaatgtttgat

SEQ ID NO: 612524 - DNA, 20 bp, mouse
gctgggaccagcatgtagtc

SEQ ID NO: 612525 - DNA, 20 bp, mouse
gccctcagggcttcttgcct

SEQ ID NO: 612526 - DNA, 20 bp, mouse
gcgccgtgcagtcctatcgg

SEQ ID NO: 612527 - DNA, 20 bp, mouse
gggccgccgataggactgca

SEQ ID NO: 612528 - DNA, 20 bp, mouse
ggtggcacggcgcggtactg

SEQ ID NO: 612529 - DNA, 20 bp, mouse
gggtcgccgtgcagtcctat

SEQ ID NO: 612530 - DNA, 20 bp, mouse
gccccaggccggccatgctg

SEQ ID NO: 612531 - DNA, 20 bp, mouse
ggccggatgggcctaacgag

SEQ ID NO: 612532 - DNA, 20 bp, mouse
gcacggcgcggtactgaggc

SEQ ID NO: 612533 - DNA, 20 bp, mouse
gtggtgctggccgagagtct

SEQ ID NO: 612534 - DNA, 20 bp, mouse
gcaagcgcgctctgacctaa

SEQ ID NO: 612535 - DNA, 20 bp, mouse
gacgggagatccttgagcgg

SEQ ID NO: 612536 - DNA, 20 bp, mouse
gaacagcccgaggtctctaa

SEQ ID NO: 612537 - DNA, 20 bp, mouse
ggcttggccactctgcttca

SEQ ID NO: 612538 - DNA, 20 bp, mouse
gccaggggagaactcaccgg

SEQ ID NO: 612539 - DNA, 20 bp, mouse
gggagagggaacttgagact

SEQ ID NO: 612540 - DNA, 20 bp, mouse
ggcgcacaagccaggaacct

SEQ ID NO: 612541 - DNA, 20 bp, mouse
gggcccaggggagaactcac

SEQ ID NO: 612542 - DNA, 20 bp, mouse
ggtagtgcgggcccagttgg

SEQ ID NO: 612543 - DNA, 20 bp, mouse
gggttcattccaacagcccg

SEQ ID NO: 612544 - DNA, 20 bp, mouse
ggccaagccattagagacct

SEQ ID NO: 612545 - DNA, 20 bp, mouse
gcctgcgagataagagggtc

SEQ ID NO: 612546 - DNA, 20 bp, mouse
gggcagctaaggtaaagtcc

SEQ ID NO: 612547 - DNA, 20 bp, mouse
gttggtgcaccaggttacaa

SEQ ID NO: 612548 - DNA, 20 bp, mouse
gaggatgacatatagacacc

SEQ ID NO: 612549 - DNA, 20 bp, mouse
gtcagcatctggaagcagtg

SEQ ID NO: 612550 - DNA, 20 bp, mouse
gtgagtccagctaaaagaca

SEQ ID NO: 612551 - DNA, 20 bp, mouse
ggcccagccaatcagcgagt

SEQ ID NO: 612552 - DNA, 20 bp, mouse
ggttagctccaattcaggag

SEQ ID NO: 612553 - DNA, 20 bp, mouse
gaccaagcccgcagactcct

SEQ ID NO: 612554 - DNA, 20 bp, mouse
gtggagggcaggttcatccc

SEQ ID NO: 612555 - DNA, 20 bp, mouse
gtacaccagactagccagga

SEQ ID NO: 612556 - DNA, 20 bp, mouse
ggcctggtccctgtagccca

SEQ ID NO: 612557 - DNA, 20 bp, mouse
gaactcagacccccaaggag

SEQ ID NO: 612558 - DNA, 20 bp, mouse
gactctctcagggtccacat

SEQ ID NO: 612559 - DNA, 20 bp, mouse
ggccatgggctacagggacc

SEQ ID NO: 612560 - DNA, 20 bp, mouse
gtcagcccagcccagccatc

SEQ ID NO: 612561 - DNA, 20 bp, mouse
gggcctctggctgagacagt

SEQ ID NO: 612562 - DNA, 20 bp, mouse
ggctgaactgagcttctcac

SEQ ID NO: 612563 - DNA, 20 bp, mouse
gtatctgtcacctgatggct

SEQ ID NO: 612564 - DNA, 20 bp, mouse
ggacagataaaaacggtcat

SEQ ID NO: 612565 - DNA, 20 bp, mouse
gttcagaaggtcaggacttg

SEQ ID NO: 612566 - DNA, 20 bp, mouse
gtggctctggggccctactg

SEQ ID NO: 612567 - DNA, 20 bp, mouse
ggtggtcctgactctgctgt

SEQ ID NO: 612568 - DNA, 20 bp, mouse
gtactgataggcctggggct

SEQ ID NO: 612569 - DNA, 20 bp, mouse
gaacagtaggatgccacagt

SEQ ID NO: 612570 - DNA, 20 bp, mouse
gccccaggcctatcagtatg

SEQ ID NO: 612571 - DNA, 20 bp, mouse
gtatccaaccccatactgat

SEQ ID NO: 612572 - DNA, 20 bp, mouse
gctgtcattactggagacag

SEQ ID NO: 612573 - DNA, 20 bp, mouse
ggctggagctcagagaaatc

SEQ ID NO: 612574 - DNA, 20 bp, mouse
gcctggaaggacacacctca

SEQ ID NO: 612575 - DNA, 20 bp, mouse
gagccatgtaagaggggtcc

SEQ ID NO: 612576 - DNA, 20 bp, mouse
gccgcgggtgcgcttctcgg

SEQ ID NO: 612577 - DNA, 20 bp, mouse
ggcgctatggccaccaacta

SEQ ID NO: 612578 - DNA, 20 bp, mouse
ggggcagggccgtcgcctgg

SEQ ID NO: 612579 - DNA, 20 bp, mouse
gcgtcctcaccgccaggcga

SEQ ID NO: 612580 - DNA, 20 bp, mouse
gcggccgcgggtgcgcttct

SEQ ID NO: 612581 - DNA, 20 bp, mouse
gcggccgcctcagcagcgac

SEQ ID NO: 612582 - DNA, 20 bp, mouse
gggagcgcgtcctcaccgcc

SEQ ID NO: 612583 - DNA, 20 bp, mouse
gttctcggcggggccgggca

SEQ ID NO: 612584 - DNA, 20 bp, mouse
ggctaggcgaaaggagcggg

SEQ ID NO: 612585 - DNA, 20 bp, mouse
ggggcaggcgggatgaagga

SEQ ID NO: 612586 - DNA, 20 bp, mouse
gagggagccggagtctgcgc

SEQ ID NO: 612587 - DNA, 20 bp, mouse
gtgggcacggtaggtggcag

SEQ ID NO: 612588 - DNA, 20 bp, mouse
gccgatttgggcacggtagg

SEQ ID NO: 612589 - DNA, 20 bp, mouse
gtcggcgcccgcgcagactc

SEQ ID NO: 612590 - DNA, 20 bp, mouse
gcgcagccctgacctggtac

SEQ ID NO: 612591 - DNA, 20 bp, mouse
gcctcgcggcgcctccctgg

SEQ ID NO: 612592 - DNA, 20 bp, mouse
ggcgggcgccgatttgggca

SEQ ID NO: 612593 - DNA, 20 bp, mouse
gtccctgccggccgccaggg

SEQ ID NO: 612594 - DNA, 20 bp, mouse
gtctgcgcgggcgccgattt

SEQ ID NO: 612595 - DNA, 20 bp, mouse
ggcgccgatttgggcacggt

SEQ ID NO: 612596 - DNA, 20 bp, mouse
ggagcccaggtccttgagtg

SEQ ID NO: 612597 - DNA, 20 bp, mouse
gttaccccactcaaggacct

SEQ ID NO: 612598 - DNA, 20 bp, mouse
gcccttccttaccccactca

SEQ ID NO: 612599 - DNA, 20 bp, mouse
gttctagtttgctcccacat

SEQ ID NO: 612600 - DNA, 20 bp, mouse
gtccttgagtggggtaagga

SEQ ID NO: 612601 - DNA, 20 bp, mouse
gtaaggaaggggctgtggat

SEQ ID NO: 612602 - DNA, 20 bp, mouse
gccctcacagagctgactta

SEQ ID NO: 612603 - DNA, 20 bp, mouse
ggtggattggccctaatgga

SEQ ID NO: 612604 - DNA, 20 bp, mouse
gggtggggcgcacagagcgg

SEQ ID NO: 612605 - DNA, 20 bp, mouse
gctgggtttggaagattgag

SEQ ID NO: 612606 - DNA, 20 bp, mouse
gggacacgagcgcagagctt

SEQ ID NO: 612607 - DNA, 20 bp, mouse
gagcccggcgcgggaaatgg

SEQ ID NO: 612608 - DNA, 20 bp, mouse
ggccttcgctcgctcacggg

SEQ ID NO: 612609 - DNA, 20 bp, mouse
gggttggggagcgcccgcgt

SEQ ID NO: 612610 - DNA, 20 bp, mouse
gccgcgggcgccgggactta

SEQ ID NO: 612611 - DNA, 20 bp, mouse
gcgagcgtgccctctatatg

SEQ ID NO: 612612 - DNA, 20 bp, mouse
gcgggcggaaaaggccgacg

SEQ ID NO: 612613 - DNA, 20 bp, mouse
ggtgccctctatatgaggtt

SEQ ID NO: 612614 - DNA, 20 bp, mouse
ggccgcccgtgagcgagcga

SEQ ID NO: 612615 - DNA, 20 bp, mouse
gccgagcccggcgcgggaaa

SEQ ID NO: 612616 - DNA, 20 bp, mouse
gacagtcccagagagcagaa

SEQ ID NO: 612617 - DNA, 20 bp, mouse
ggagcctcgaccctggacat

SEQ ID NO: 612618 - DNA, 20 bp, mouse
gtggggtgagggtctgacca

SEQ ID NO: 612619 - DNA, 20 bp, mouse
ggggcagccggagaaaagac

SEQ ID NO: 612620 - DNA, 20 bp, mouse
gttattacctcattctcact

SEQ ID NO: 612621 - DNA, 20 bp, mouse
ggctcatctggggagaacac

SEQ ID NO: 612622 - DNA, 20 bp, mouse
ggaatggaatggaatatcct

SEQ ID NO: 612623 - DNA, 20 bp, mouse
gagcaacagataaagacctt

SEQ ID NO: 612624 - DNA, 20 bp, mouse
gtctgggtgttcctccagga

SEQ ID NO: 612625 - DNA, 20 bp, mouse
ggataaagaccttggggtga

SEQ ID NO: 612626 - DNA, 20 bp, mouse
ggtgagtcgctggactcgta

SEQ ID NO: 612627 - DNA, 20 bp, mouse
ggtcgctggactcgtagggt

SEQ ID NO: 612628 - DNA, 20 bp, mouse
gcgtcaggactcaactggta

SEQ ID NO: 612629 - DNA, 20 bp, mouse
ggaccgcgtcaggactcaac

SEQ ID NO: 612630 - DNA, 20 bp, mouse
gcaggctgtcagccactaga

SEQ ID NO: 612631 - DNA, 20 bp, mouse
ggttggtgcaagctgaaacc

SEQ ID NO: 612632 - DNA, 20 bp, mouse
gaaccgggaaagtagcgtga

SEQ ID NO: 612633 - DNA, 20 bp, mouse
gtctgggaaccccggagcag

SEQ ID NO: 612634 - DNA, 20 bp, mouse
ggaaggaaggcgaggcccag

SEQ ID NO: 612635 - DNA, 20 bp, mouse
gcgccggtgacaggacttcg

SEQ ID NO: 612636 - DNA, 20 bp, mouse
gaagaaggcgacggctacaa

SEQ ID NO: 612637 - DNA, 20 bp, mouse
gtggtgggagtggaacgcac

SEQ ID NO: 612638 - DNA, 20 bp, mouse
gcctgaacgtgcgagctggt

SEQ ID NO: 612639 - DNA, 20 bp, mouse
gcgctgttcggactgtgggg

SEQ ID NO: 612640 - DNA, 20 bp, mouse
gtagaggagaacaacttcga

SEQ ID NO: 612641 - DNA, 20 bp, mouse
gccgcgctgttcggactgtg

SEQ ID NO: 612642 - DNA, 20 bp, mouse
gccgcgggagccgtcttcgg

SEQ ID NO: 612643 - DNA, 20 bp, mouse
gcgcacctcggagcagagat

SEQ ID NO: 612644 - DNA, 20 bp, mouse
gaagccgcgggagccgtctt

SEQ ID NO: 612645 - DNA, 20 bp, mouse
ggcggcggcccgatgctccg

SEQ ID NO: 612646 - DNA, 20 bp, mouse
gcggcagtgttagaccggtg

SEQ ID NO: 612647 - DNA, 20 bp, mouse
gaagagcgtggcgtcacatc

SEQ ID NO: 612648 - DNA, 20 bp, mouse
gcagtgttagaccggtgcgg

SEQ ID NO: 612649 - DNA, 20 bp, mouse
gacatccggcagtgttagac

SEQ ID NO: 612650 - DNA, 20 bp, mouse
gctagaagaagtagcagggt

SEQ ID NO: 612651 - DNA, 20 bp, mouse
ggtgtcgggagcctgacgtg

SEQ ID NO: 612652 - DNA, 20 bp, mouse
gccccccgccccgtaacggg

SEQ ID NO: 612653 - DNA, 20 bp, mouse
gtgacgtgcggagggagccg

SEQ ID NO: 612654 - DNA, 20 bp, mouse
ggcctccccccgccccgtaa

SEQ ID NO: 612655 - DNA, 20 bp, mouse
gggtaagcgcggagttgcgc

SEQ ID NO: 612656 - DNA, 20 bp, mouse
gggcgtaccgagagaggcgg

SEQ ID NO: 612657 - DNA, 20 bp, mouse
gcacggcgtaccgagagagg

SEQ ID NO: 612658 - DNA, 20 bp, mouse
gggccacggcgtaccgagag

SEQ ID NO: 612659 - DNA, 20 bp, mouse
gcgcccgcccggtcaggcca

SEQ ID NO: 612660 - DNA, 20 bp, mouse
gcgcgcgtcgccgggctgac

SEQ ID NO: 612661 - DNA, 20 bp, mouse
gcccggcgacgcgcgcatgg

SEQ ID NO: 612662 - DNA, 20 bp, mouse
ggcgacgcgcgcatggaggc

SEQ ID NO: 612663 - DNA, 20 bp, mouse
ggtggggactgcgaagacca

SEQ ID NO: 612664 - DNA, 20 bp, mouse
gggagcgccgccgcctctct

SEQ ID NO: 612665 - DNA, 20 bp, mouse
gggacggtgtagatgctcct

SEQ ID NO: 612666 - DNA, 20 bp, mouse
gccccgagcccggctcagag

SEQ ID NO: 612667 - DNA, 20 bp, mouse
gcgagcccggctcagagggg

SEQ ID NO: 612668 - DNA, 20 bp, mouse
gcggccgcggagcagcatgg

SEQ ID NO: 612669 - DNA, 20 bp, mouse
gtcccggccgcggagcagca

SEQ ID NO: 612670 - DNA, 20 bp, mouse
ggagattccagggtgagcgg

SEQ ID NO: 612671 - DNA, 20 bp, mouse
ggcgcgcagtgggacaagtg

SEQ ID NO: 612672 - DNA, 20 bp, mouse
gagatgctgggagcccgctg

SEQ ID NO: 612673 - DNA, 20 bp, mouse
ggagccgcgtcagggtccag

SEQ ID NO: 612674 - DNA, 20 bp, mouse
ggctccgccatgctgctccg

SEQ ID NO: 612675 - DNA, 20 bp, mouse
ggggtcccggagccgcgtca

SEQ ID NO: 612676 - DNA, 20 bp, mouse
ggcagagccaggcgagtgtg

SEQ ID NO: 612677 - DNA, 20 bp, mouse
ggagccaggcgagtgtgcgg

SEQ ID NO: 612678 - DNA, 20 bp, mouse
gagccgcgcgcagcagagcc

SEQ ID NO: 612679 - DNA, 20 bp, mouse
gggtgtgcgcggagacgcag

SEQ ID NO: 612680 - DNA, 20 bp, mouse
ggagggtgggtgggctccct

SEQ ID NO: 612681 - DNA, 20 bp, mouse
ggccaggttagtgcggaggg

SEQ ID NO: 612682 - DNA, 20 bp, mouse
gggcggccaggttagtgcgg

SEQ ID NO: 612683 - DNA, 20 bp, mouse
gcccaccctccgcactaacc

SEQ ID NO: 612684 - DNA, 20 bp, mouse
gtggccgccgcacactcgcc

SEQ ID NO: 612685 - DNA, 20 bp, mouse
ggagagatctggcttcccga

SEQ ID NO: 612686 - DNA, 20 bp, mouse
ggtccttggggcagagaacc

SEQ ID NO: 612687 - DNA, 20 bp, mouse
ggccttctgctcgcaccggg

SEQ ID NO: 612688 - DNA, 20 bp, mouse
gccgggcggtagcgtccttg

SEQ ID NO: 612689 - DNA, 20 bp, mouse
gtggggcagagaaccgggct

SEQ ID NO: 612690 - DNA, 20 bp, mouse
gcaggtaggcaggaattcat

SEQ ID NO: 612691 - DNA, 20 bp, mouse
gctgggctggcggaagccaa

SEQ ID NO: 612692 - DNA, 20 bp, mouse
gcagaaggcggcgcacaggt

SEQ ID NO: 612693 - DNA, 20 bp, mouse
gaccgcccggtgcgagcaga

SEQ ID NO: 612694 - DNA, 20 bp, mouse
gtaggcaggaattcataggt

SEQ ID NO: 612695 - DNA, 20 bp, mouse
ggccgccttctgctcgcacc

SEQ ID NO: 612696 - DNA, 20 bp, mouse
gggtctgttaagtagagcag

SEQ ID NO: 612697 - DNA, 20 bp, mouse
ggagcagaggaccagccttg

SEQ ID NO: 612698 - DNA, 20 bp, mouse
gcagccccgaatcccatcag

SEQ ID NO: 612699 - DNA, 20 bp, mouse
gtgtagagagaggtgggttc

SEQ ID NO: 612700 - DNA, 20 bp, mouse
ggacaaagccaagggccggt

SEQ ID NO: 612701 - DNA, 20 bp, mouse
gctcaggttctcagagagac

SEQ ID NO: 612702 - DNA, 20 bp, mouse
ggaacccctgatgggattcg

SEQ ID NO: 612703 - DNA, 20 bp, mouse
gggggtttcaggtggccaga

SEQ ID NO: 612704 - DNA, 20 bp, mouse
gctctacttaacagaccttc

SEQ ID NO: 612705 - DNA, 20 bp, mouse
ggagaactctgggctccgat

SEQ ID NO: 612706 - DNA, 20 bp, mouse
gcgggcgcgcgaagaccgtt

SEQ ID NO: 612707 - DNA, 20 bp, mouse
gtccgcgccgcctcacccaa

SEQ ID NO: 612708 - DNA, 20 bp, mouse
gcgaagaccgttgggtgagg

SEQ ID NO: 612709 - DNA, 20 bp, mouse
ggcggcgcggatctaagcgg

SEQ ID NO: 612710 - DNA, 20 bp, mouse
ggaggcggcgcggatctaag

SEQ ID NO: 612711 - DNA, 20 bp, mouse
ggcgcgaagaccgttgggtg

SEQ ID NO: 612712 - DNA, 20 bp, mouse
gcccggcgagcgctgagttc

SEQ ID NO: 612713 - DNA, 20 bp, mouse
ggcggggggtctactctcag

SEQ ID NO: 612714 - DNA, 20 bp, mouse
ggcgcagccaagcaccgctg

SEQ ID NO: 612715 - DNA, 20 bp, mouse
gaagttcgcgacgtccgcag

SEQ ID NO: 612716 - DNA, 20 bp, mouse
gtccctgctgggctgcaacc

SEQ ID NO: 612717 - DNA, 20 bp, mouse
gcggctggaaagtccctgct

SEQ ID NO: 612718 - DNA, 20 bp, mouse
gctgcagcgtccagctcccc

SEQ ID NO: 612719 - DNA, 20 bp, mouse
gcgggcagccccatgtcggg

SEQ ID NO: 612720 - DNA, 20 bp, mouse
gagctggacgctgcagaagg

SEQ ID NO: 612721 - DNA, 20 bp, mouse
gactttccagccggcggcgg

SEQ ID NO: 612722 - DNA, 20 bp, mouse
gtccccgggcagccccatgt

SEQ ID NO: 612723 - DNA, 20 bp, mouse
ggggactttccagccggcgg

SEQ ID NO: 612724 - DNA, 20 bp, mouse
ggcgggcggctccatcccgg

SEQ ID NO: 612725 - DNA, 20 bp, mouse
ggtgcggagcggcggagaca

SEQ ID NO: 612726 - DNA, 20 bp, mouse
gggagaccggcgcgccggga

SEQ ID NO: 612727 - DNA, 20 bp, mouse
gaccggcgcgccgggacggc

SEQ ID NO: 612728 - DNA, 20 bp, mouse
gatctcggggcaccgggcag

SEQ ID NO: 612729 - DNA, 20 bp, mouse
gtgcgcgtcaggttgaggtg

SEQ ID NO: 612730 - DNA, 20 bp, mouse
gtgtcgtgcaggtagcggaa

SEQ ID NO: 612731 - DNA, 20 bp, mouse
gccgggacggcgggcatctc

SEQ ID NO: 612732 - DNA, 20 bp, mouse
gctgcggtgcactgtgggat

SEQ ID NO: 612733 - DNA, 20 bp, mouse
gcggagtgagggtccgggta

SEQ ID NO: 612734 - DNA, 20 bp, mouse
gccgggtagggtgagagtcg

SEQ ID NO: 612735 - DNA, 20 bp, mouse
ggtagggtgagagtcgaggt

SEQ ID NO: 612736 - DNA, 20 bp, mouse
gctctccagtcccaggtaag

SEQ ID NO: 612737 - DNA, 20 bp, mouse
gaggtctgagcggcccaagg

SEQ ID NO: 612738 - DNA, 20 bp, mouse
gcctgctccaccacttacct

SEQ ID NO: 612739 - DNA, 20 bp, mouse
ggctcacggggatccacctt

SEQ ID NO: 612740 - DNA, 20 bp, mouse
gcaggctctcgagcaggaag

SEQ ID NO: 612741 - DNA, 20 bp, mouse
gatggacaaggtaaaggtgg

SEQ ID NO: 612742 - DNA, 20 bp, mouse
gcgacagacggcccaggggg

SEQ ID NO: 612743 - DNA, 20 bp, mouse
gccaccgacagacggcccag

SEQ ID NO: 612744 - DNA, 20 bp, mouse
ggggaggtctgagcggccca

SEQ ID NO: 612745 - DNA, 20 bp, mouse
gctccagatggacaaggtaa

SEQ ID NO: 612746 - DNA, 20 bp, mouse
ggatctgctgacttagggtg

SEQ ID NO: 612747 - DNA, 20 bp, mouse
gctggtgaggaagtccaccc

SEQ ID NO: 612748 - DNA, 20 bp, mouse
gggccctctcaaattgctaa

SEQ ID NO: 612749 - DNA, 20 bp, mouse
gctgggacttgaggtaactg

SEQ ID NO: 612750 - DNA, 20 bp, mouse
gggacttgaggtaactgtgg

SEQ ID NO: 612751 - DNA, 20 bp, mouse
gagctgggagccataccctg

SEQ ID NO: 612752 - DNA, 20 bp, mouse
gctcaggcaaccacagggta

SEQ ID NO: 612753 - DNA, 20 bp, mouse
gcgtcagtataagaagaaaa

SEQ ID NO: 612754 - DNA, 20 bp, mouse
gagagggcccctgcactctt

SEQ ID NO: 612755 - DNA, 20 bp, mouse
gtaagaagaaaatggtgagg

SEQ ID NO: 612756 - DNA, 20 bp, mouse
ggcccaccgagccaagccag

SEQ ID NO: 612757 - DNA, 20 bp, mouse
gcggtgggctgagagctatg

SEQ ID NO: 612758 - DNA, 20 bp, mouse
ggccaagtgtgagcgacgtc

SEQ ID NO: 612759 - DNA, 20 bp, mouse
gtcccctggcttggctcggt

SEQ ID NO: 612760 - DNA, 20 bp, mouse
gaggccaagccagggaacaa

SEQ ID NO: 612761 - DNA, 20 bp, mouse
gcctccagcaagacagatgg

SEQ ID NO: 612762 - DNA, 20 bp, mouse
gcagactcgaggtcctcccc

SEQ ID NO: 612763 - DNA, 20 bp, mouse
gcggcggcgacggttttctc

SEQ ID NO: 612764 - DNA, 20 bp, mouse
ggcggcaagtggtctcattg

SEQ ID NO: 612765 - DNA, 20 bp, mouse
ggcaagtggtctcattgcgg

SEQ ID NO: 612766 - DNA, 20 bp, mouse
ggcaggtgtcgcagaagcgg

SEQ ID NO: 612767 - DNA, 20 bp, mouse
gtctcaggtgcgacccgggg

SEQ ID NO: 612768 - DNA, 20 bp, mouse
gcacagcccgcgcctcgctc

SEQ ID NO: 612769 - DNA, 20 bp, mouse
gcaggcaggtgtcgcagaag

SEQ ID NO: 612770 - DNA, 20 bp, mouse
ggccggctacgggtcaggaa

SEQ ID NO: 612771 - DNA, 20 bp, mouse
gtgcgggcggcgccgactgg

SEQ ID NO: 612772 - DNA, 20 bp, mouse
gcagtgacgtcagggccctg

SEQ ID NO: 612773 - DNA, 20 bp, mouse
ggggaaacgcggcccgagcg

SEQ ID NO: 612774 - DNA, 20 bp, mouse
ggacccgagaccctacgctt

SEQ ID NO: 612775 - DNA, 20 bp, mouse
gccaccatgatgtcaagggg

SEQ ID NO: 612776 - DNA, 20 bp, mouse
gctccgctggcgccctacgg

SEQ ID NO: 612777 - DNA, 20 bp, mouse
ggagctccgctggcgcccta

SEQ ID NO: 612778 - DNA, 20 bp, mouse
gcctagtgcccgccgccgta

SEQ ID NO: 612779 - DNA, 20 bp, mouse
gcgggttaggccagctccag

SEQ ID NO: 612780 - DNA, 20 bp, mouse
ggtcagcagacagagtggag

SEQ ID NO: 612781 - DNA, 20 bp, mouse
gcccgcaagtggcgaagtcc

SEQ ID NO: 612782 - DNA, 20 bp, mouse
gcggcgcaggctcgagaccc

SEQ ID NO: 612783 - DNA, 20 bp, mouse
gcagcggcgggctccgggag

SEQ ID NO: 612784 - DNA, 20 bp, mouse
gctggcctaacccgctgctg

SEQ ID NO: 612785 - DNA, 20 bp, mouse
gagcagacccgggcgcctag

SEQ ID NO: 612786 - DNA, 20 bp, mouse
gctgaggctccggccgtcgg

SEQ ID NO: 612787 - DNA, 20 bp, mouse
ggccgcgtcgcctacataca

SEQ ID NO: 612788 - DNA, 20 bp, mouse
gcggctgctgcgtccgccga

SEQ ID NO: 612789 - DNA, 20 bp, mouse
gtgtcaggcgacagggacag

SEQ ID NO: 612790 - DNA, 20 bp, mouse
gctgtcccgtggggaaccgg

SEQ ID NO: 612791 - DNA, 20 bp, mouse
gcgccaaactcccggctcgt

SEQ ID NO: 612792 - DNA, 20 bp, mouse
gggctccgacgccaaactcc

SEQ ID NO: 612793 - DNA, 20 bp, mouse
gacggcactccgagaccaag

SEQ ID NO: 612794 - DNA, 20 bp, mouse
ggggctgaggctccggccgt

SEQ ID NO: 612795 - DNA, 20 bp, mouse
ggcagccgcggcccacgagc

SEQ ID NO: 612796 - DNA, 20 bp, mouse
ggagcagcgacttcacccac

SEQ ID NO: 612797 - DNA, 20 bp, mouse
gcccggccgcgggccgagag

SEQ ID NO: 612798 - DNA, 20 bp, mouse
ggagtcaggaggacttatag

SEQ ID NO: 612799 - DNA, 20 bp, mouse
ggggtgaagtcgctgctcct

SEQ ID NO: 612800 - DNA, 20 bp, mouse
ggagaggggcaagatgatgc

SEQ ID NO: 612801 - DNA, 20 bp, mouse
gggggcaagatgatgccggt

SEQ ID NO: 612802 - DNA, 20 bp, mouse
ggcgcggagcacaagacctg

SEQ ID NO: 612803 - DNA, 20 bp, mouse
gggcgggactgagacggctg

SEQ ID NO: 612804 - DNA, 20 bp, mouse
gtacaggagccggaagtccc

SEQ ID NO: 612805 - DNA, 20 bp, mouse
ggtgtgccaagcagtatcct

SEQ ID NO: 612806 - DNA, 20 bp, mouse
gtgggctcggaggtgaacgg

SEQ ID NO: 612807 - DNA, 20 bp, mouse
gggcggttgttggctccggg

SEQ ID NO: 612808 - DNA, 20 bp, mouse
ggaagactcagcaaaccggg

SEQ ID NO: 612809 - DNA, 20 bp, mouse
gacagacagacctctagcga

SEQ ID NO: 612810 - DNA, 20 bp, mouse
ggccgggccacacgccaccg

SEQ ID NO: 612811 - DNA, 20 bp, mouse
gcagcaaaccgggaggccgg

SEQ ID NO: 612812 - DNA, 20 bp, mouse
ggcagagcggccgctccccg

SEQ ID NO: 612813 - DNA, 20 bp, mouse
gggttgttggctccgggcgg

SEQ ID NO: 612814 - DNA, 20 bp, mouse
gcagacctctagcgacggca

SEQ ID NO: 612815 - DNA, 20 bp, mouse
ggcaccgactgctaacaaag

SEQ ID NO: 612816 - DNA, 20 bp, mouse
ggctcgactcaagcagccca

SEQ ID NO: 612817 - DNA, 20 bp, mouse
gaccggagcggtggccggtt

SEQ ID NO: 612818 - DNA, 20 bp, mouse
gttcactaccggaagtcgtg

SEQ ID NO: 612819 - DNA, 20 bp, mouse
gcgctggcagctggttccct

SEQ ID NO: 612820 - DNA, 20 bp, mouse
gcatctgcaatggtgagtga

SEQ ID NO: 612821 - DNA, 20 bp, mouse
ggccgaaccggccaccgctc

SEQ ID NO: 612822 - DNA, 20 bp, mouse
gctgcaatggtgagtgacgg

SEQ ID NO: 612823 - DNA, 20 bp, mouse
gaaggaaccggagcggtggc

SEQ ID NO: 612824 - DNA, 20 bp, mouse
gtggatggcagccacgtcac

SEQ ID NO: 612825 - DNA, 20 bp, mouse
gggccaggtggaagtgatac

SEQ ID NO: 612826 - DNA, 20 bp, mouse
gccagtgtgtggctgagtcc

SEQ ID NO: 612827 - DNA, 20 bp, mouse
gcacccgccccaccctagag

SEQ ID NO: 612828 - DNA, 20 bp, mouse
gacaacacgacacctctcta

SEQ ID NO: 612829 - DNA, 20 bp, mouse
gacgacacctctctagggtg

SEQ ID NO: 612830 - DNA, 20 bp, mouse
gcagctcaggcagccctcca

SEQ ID NO: 612831 - DNA, 20 bp, mouse
ggcagaggttgggccctgga

SEQ ID NO: 612832 - DNA, 20 bp, mouse
ggtctgtcccagccagtgtg

SEQ ID NO: 612833 - DNA, 20 bp, mouse
gttcataagatgaggtgata

SEQ ID NO: 612834 - DNA, 20 bp, mouse
gcttacagcggacagacgga

SEQ ID NO: 612835 - DNA, 20 bp, mouse
ggcagacacaaactccaaag

SEQ ID NO: 612836 - DNA, 20 bp, mouse
gccccgggcgtggcaggaac

SEQ ID NO: 612837 - DNA, 20 bp, mouse
ggcgctctcacatcatcacc

SEQ ID NO: 612838 - DNA, 20 bp, mouse
ggagctaacccccccgggcg

SEQ ID NO: 612839 - DNA, 20 bp, mouse
gggcagcccccacccagcta

SEQ ID NO: 612840 - DNA, 20 bp, mouse
gccaccgagctaaccccccc

SEQ ID NO: 612841 - DNA, 20 bp, mouse
gtgcagtgacgccggttcaa

SEQ ID NO: 612842 - DNA, 20 bp, mouse
gcacgcgggagcttactcac

SEQ ID NO: 612843 - DNA, 20 bp, mouse
gagagggacgcgggacagga

SEQ ID NO: 612844 - DNA, 20 bp, mouse
gccttgtcaacttctctcaa

SEQ ID NO: 612845 - DNA, 20 bp, mouse
ggaccagagggacgcgggac

SEQ ID NO: 612846 - DNA, 20 bp, mouse
ggaagtgaagccccagcgag

SEQ ID NO: 612847 - DNA, 20 bp, mouse
gacaggcggcggctccacca

SEQ ID NO: 612848 - DNA, 20 bp, mouse
ggctccggccgggtacgcta

SEQ ID NO: 612849 - DNA, 20 bp, mouse
gagcagccgagagctcggag

SEQ ID NO: 612850 - DNA, 20 bp, mouse
gcgccccggcggctgcgtac

SEQ ID NO: 612851 - DNA, 20 bp, mouse
gcggccgggtacgctagggt

SEQ ID NO: 612852 - DNA, 20 bp, mouse
ggggcggaggaagcacctgc

SEQ ID NO: 612853 - DNA, 20 bp, mouse
gagccagtacgcagccgccg

SEQ ID NO: 612854 - DNA, 20 bp, mouse
gcggggccggatgactaaca

SEQ ID NO: 612855 - DNA, 20 bp, mouse
gtgcgtactggctgtgggat

SEQ ID NO: 612856 - DNA, 20 bp, mouse
gaccctgggcgtcagacggg

SEQ ID NO: 612857 - DNA, 20 bp, mouse
gcggcagcggctgcgaccct

SEQ ID NO: 612858 - DNA, 20 bp, mouse
ggcgaccctgggcgtcagac

SEQ ID NO: 612859 - DNA, 20 bp, mouse
gaccgcccgtctgacgccca

SEQ ID NO: 612860 - DNA, 20 bp, mouse
gcgtcagacgggcggtgatg

SEQ ID NO: 612861 - DNA, 20 bp, mouse
gggtggaggccggtgactac

SEQ ID NO: 612862 - DNA, 20 bp, mouse
gtgactactggtgagtaccg

SEQ ID NO: 612863 - DNA, 20 bp, mouse
ggcggctcagtgatcagcgg

SEQ ID NO: 612864 - DNA, 20 bp, mouse
gctgccgaccgatcaatcaa

SEQ ID NO: 612865 - DNA, 20 bp, mouse
gacagggtcctggacccgga

SEQ ID NO: 612866 - DNA, 20 bp, mouse
ggccccagcgaaaacttctc

SEQ ID NO: 612867 - DNA, 20 bp, mouse
ggtcctcctacggaaagcca

SEQ ID NO: 612868 - DNA, 20 bp, mouse
ggccggagaagttttcgctg

SEQ ID NO: 612869 - DNA, 20 bp, mouse
ggcgcgctccagcccagatg

SEQ ID NO: 612870 - DNA, 20 bp, mouse
gctctcaaagccggaggaca

SEQ ID NO: 612871 - DNA, 20 bp, mouse
gccgcacagctaggagttag

SEQ ID NO: 612872 - DNA, 20 bp, mouse
gtgcttgcggcttccaccgg

SEQ ID NO: 612873 - DNA, 20 bp, mouse
gcgctgccatggctttccgt

SEQ ID NO: 612874 - DNA, 20 bp, mouse
ggctggcgtgcggaccgggc

SEQ ID NO: 612875 - DNA, 20 bp, mouse
gctccggctttgagaggaag

SEQ ID NO: 612876 - DNA, 20 bp, mouse
gaagggccgcgaagtcgtga

SEQ ID NO: 612877 - DNA, 20 bp, mouse
gaagtcgtgagggtgaggcg

SEQ ID NO: 612878 - DNA, 20 bp, mouse
gccgcgaagtcgtgagggtg

SEQ ID NO: 612879 - DNA, 20 bp, mouse
gtcccggctcaggagagctt

SEQ ID NO: 612880 - DNA, 20 bp, mouse
gctcagtcgcgaggaccacc

SEQ ID NO: 612881 - DNA, 20 bp, mouse
gagtcgcgaggaccacccgg

SEQ ID NO: 612882 - DNA, 20 bp, mouse
gtggaggtcgggagcagacc

SEQ ID NO: 612883 - DNA, 20 bp, mouse
ggcgaggaccacccggcggg

SEQ ID NO: 612884 - DNA, 20 bp, mouse
gtcgtgagggtgaggcgagg

SEQ ID NO: 612885 - DNA, 20 bp, mouse
ggcctcgcggcgggagacga

SEQ ID NO: 612886 - DNA, 20 bp, mouse
gtaggctgttagccacactt

SEQ ID NO: 612887 - DNA, 20 bp, mouse
gtgttagccacacttgggaa

SEQ ID NO: 612888 - DNA, 20 bp, mouse
ggccccctcatcactctgtt

SEQ ID NO: 612889 - DNA, 20 bp, mouse
ggcgccggagctgctaagtg

SEQ ID NO: 612890 - DNA, 20 bp, mouse
gtcaagccctggggtaacta

SEQ ID NO: 612891 - DNA, 20 bp, mouse
ggactgacgagagcaggctg

SEQ ID NO: 612892 - DNA, 20 bp, mouse
gccggagctgctaagtgggg

SEQ ID NO: 612893 - DNA, 20 bp, mouse
ggcgcggcacgagagcgcag

SEQ ID NO: 612894 - DNA, 20 bp, mouse
gcggcacgagagcgcagagg

SEQ ID NO: 612895 - DNA, 20 bp, mouse
gcgaactccagccagcgcgg

SEQ ID NO: 612896 - DNA, 20 bp, mouse
ggagtagagtcgcaagctag

SEQ ID NO: 612897 - DNA, 20 bp, mouse
gagaccagccaccctagata

SEQ ID NO: 612898 - DNA, 20 bp, mouse
gcaacgccattgcactgagc

SEQ ID NO: 612899 - DNA, 20 bp, mouse
gttcgaccagctcagtgcaa

SEQ ID NO: 612900 - DNA, 20 bp, mouse
ggttatcagacatggcacaa

SEQ ID NO: 612901 - DNA, 20 bp, mouse
gtggcacaaagggtaccagc

SEQ ID NO: 612902 - DNA, 20 bp, mouse
gaattctgccttatctaggg

SEQ ID NO: 612903 - DNA, 20 bp, mouse
gacagtggctcaggtggtga

SEQ ID NO: 612904 - DNA, 20 bp, mouse
gttattgcaccggtactccc

SEQ ID NO: 612905 - DNA, 20 bp, mouse
gacttagctcggcttcctgc

SEQ ID NO: 612906 - DNA, 20 bp, mouse
gaagcaagcagggatcccta

SEQ ID NO: 612907 - DNA, 20 bp, mouse
gagcccagctgggtcgtaag

SEQ ID NO: 612908 - DNA, 20 bp, mouse
ggcaattccggtgagtccgg

SEQ ID NO: 612909 - DNA, 20 bp, mouse
ggtgtctacactacagcgag

SEQ ID NO: 612910 - DNA, 20 bp, mouse
gcaggtgggaaccccacccc

SEQ ID NO: 612911 - DNA, 20 bp, mouse
ggtactcctggagggagagg

SEQ ID NO: 612912 - DNA, 20 bp, mouse
ggagtctagtaagactatcg

SEQ ID NO: 612913 - DNA, 20 bp, mouse
ggagggtgacaagctacttc

SEQ ID NO: 612914 - DNA, 20 bp, mouse
gcccacctggctgaagaatc

SEQ ID NO: 612915 - DNA, 20 bp, mouse
gaccggaattgctctgaaag

SEQ ID NO: 612916 - DNA, 20 bp, mouse
ggccggctaggagctgccgg

SEQ ID NO: 612917 - DNA, 20 bp, mouse
gccggggccggaagtggacg

SEQ ID NO: 612918 - DNA, 20 bp, mouse
gcgcccgccatgggcacccg

SEQ ID NO: 612919 - DNA, 20 bp, mouse
gcccggaagtggtcacgcgg

SEQ ID NO: 612920 - DNA, 20 bp, mouse
ggcggcgccggggccggaag

SEQ ID NO: 612921 - DNA, 20 bp, mouse
ggcgcaggagagccgaccca

SEQ ID NO: 612922 - DNA, 20 bp, mouse
ggcgctgaccgcagtccggt

SEQ ID NO: 612923 - DNA, 20 bp, mouse
gccaccggtggtctacacca

SEQ ID NO: 612924 - DNA, 20 bp, mouse
ggcgggtcggaggtcacccg

SEQ ID NO: 612925 - DNA, 20 bp, mouse
gaggtcacccgcggaaaggt

SEQ ID NO: 612926 - DNA, 20 bp, mouse
ggagccaggcaggggcgtct

SEQ ID NO: 612927 - DNA, 20 bp, mouse
ggcaggggcgtctaggaatg

SEQ ID NO: 612928 - DNA, 20 bp, mouse
gccgcagaccgggcgacaga

SEQ ID NO: 612929 - DNA, 20 bp, mouse
gtggggctgttgcttgtcgg

SEQ ID NO: 612930 - DNA, 20 bp, mouse
gggctggggctgttgcttgt

SEQ ID NO: 612931 - DNA, 20 bp, mouse
gaacagccccagccgcagac

SEQ ID NO: 612932 - DNA, 20 bp, mouse
gggctctcttgcctctttcg

SEQ ID NO: 612933 - DNA, 20 bp, mouse
ggtcgcccggtctgcggctg

SEQ ID NO: 612934 - DNA, 20 bp, mouse
gggctctagtagctgccact

SEQ ID NO: 612935 - DNA, 20 bp, mouse
ggccagcggaggcggggaaa

SEQ ID NO: 612936 - DNA, 20 bp, mouse
ggtgggtgacccgacctcag

SEQ ID NO: 612937 - DNA, 20 bp, mouse
gggtgacccgacctcagggg

SEQ ID NO: 612938 - DNA, 20 bp, mouse
gggtcacccacaggcgaaaa

SEQ ID NO: 612939 - DNA, 20 bp, mouse
gtgccacccgcccctgaggt

SEQ ID NO: 612940 - DNA, 20 bp, mouse
gcacctgccacccgcccctg

SEQ ID NO: 612941 - DNA, 20 bp, mouse
gcggtcttccgtcatctctt

SEQ ID NO: 612942 - DNA, 20 bp, mouse
ggagcgggtcgcagtgagga

SEQ ID NO: 612943 - DNA, 20 bp, mouse
ggaaggagccagcccctcgt

SEQ ID NO: 612944 - DNA, 20 bp, mouse
gcgcagagtagccccacgag

SEQ ID NO: 612945 - DNA, 20 bp, mouse
gtgaggagcgggtcgcagtg

SEQ ID NO: 612946 - DNA, 20 bp, mouse
gacacttgcctcaaccacta

SEQ ID NO: 612947 - DNA, 20 bp, mouse
ggcgaattgtcagcaagaag

SEQ ID NO: 612948 - DNA, 20 bp, mouse
gtcgttgtagtcagccttag

SEQ ID NO: 612949 - DNA, 20 bp, mouse
ggcacaggtcccggaagatc

SEQ ID NO: 612950 - DNA, 20 bp, mouse
ggtgaaacttcagcctgcgt

SEQ ID NO: 612951 - DNA, 20 bp, mouse
gtcacgagcagaaagaagtc

SEQ ID NO: 612952 - DNA, 20 bp, mouse
gagctttcattgcccggtgg

SEQ ID NO: 612953 - DNA, 20 bp, mouse
gaagtgcaaagcacaggtcc

SEQ ID NO: 612954 - DNA, 20 bp, mouse
ggggatccttcgcacaatga

SEQ ID NO: 612955 - DNA, 20 bp, mouse
gaagtttcaccgggtctgga

SEQ ID NO: 612956 - DNA, 20 bp, mouse
gcgctcgggagcctcagcct

SEQ ID NO: 612957 - DNA, 20 bp, mouse
gcctccagagctcacctgta

SEQ ID NO: 612958 - DNA, 20 bp, mouse
ggaggagtccgaccgtggag

SEQ ID NO: 612959 - DNA, 20 bp, mouse
gggcgtgctgtcccgagtca

SEQ ID NO: 612960 - DNA, 20 bp, mouse
gcccctccaaggggacacgg

SEQ ID NO: 612961 - DNA, 20 bp, mouse
gcccacggtatgggaagggt

SEQ ID NO: 612962 - DNA, 20 bp, mouse
ggcagtgtagggatgagcta

SEQ ID NO: 612963 - DNA, 20 bp, mouse
ggggccgaggagtccgaccg

SEQ ID NO: 612964 - DNA, 20 bp, mouse
gaagtctggagggcgaggta

SEQ ID NO: 612965 - DNA, 20 bp, mouse
gacaagcgagggccccgaag

SEQ ID NO: 612966 - DNA, 20 bp, mouse
ggcacagcctgccaatatgg

SEQ ID NO: 612967 - DNA, 20 bp, mouse
gtgcatcgcggtgatcgcca

SEQ ID NO: 612968 - DNA, 20 bp, mouse
gatcgcggtgatcgccaagg

SEQ ID NO: 612969 - DNA, 20 bp, mouse
gggcgcacagcctgccaata

SEQ ID NO: 612970 - DNA, 20 bp, mouse
gagcctctcacgcacctcct

SEQ ID NO: 612971 - DNA, 20 bp, mouse
ggcgatgcacaccgccatat

SEQ ID NO: 612972 - DNA, 20 bp, mouse
gcgccaaggaggtgcgtgag

SEQ ID NO: 612973 - DNA, 20 bp, mouse
gcacatcgggtcacatgatg

SEQ ID NO: 612974 - DNA, 20 bp, mouse
ggaacgcgtagagcgacggg

SEQ ID NO: 612975 - DNA, 20 bp, mouse
ggcggggcctgcctccacat

SEQ ID NO: 612976 - DNA, 20 bp, mouse
gggccgcggctgggttgaat

SEQ ID NO: 612977 - DNA, 20 bp, mouse
ggtcagtcctagacgctgag

SEQ ID NO: 612978 - DNA, 20 bp, mouse
ggaggtgaggcggcactgaa

SEQ ID NO: 612979 - DNA, 20 bp, mouse
ggttgaatcggcgactcccg

SEQ ID NO: 612980 - DNA, 20 bp, mouse
gccgcggcccctcagcgtct

SEQ ID NO: 612981 - DNA, 20 bp, mouse
gacgctgaggggccgcggct

SEQ ID NO: 612982 - DNA, 20 bp, mouse
gaacggtgggcaccatgtcg

SEQ ID NO: 612983 - DNA, 20 bp, mouse
gtgaggcggcactgaacggt

SEQ ID NO: 612984 - DNA, 20 bp, mouse
gtcggcgactcccggggtct

SEQ ID NO: 612985 - DNA, 20 bp, mouse
ggatggggaagtcccagtgt

SEQ ID NO: 612986 - DNA, 20 bp, mouse
gttcagaccaccgccttccc

SEQ ID NO: 612987 - DNA, 20 bp, mouse
gctgaatcctggtggagtag

SEQ ID NO: 612988 - DNA, 20 bp, mouse
gttcagctttgctagagtaa

SEQ ID NO: 612989 - DNA, 20 bp, mouse
gtctgctccactactccacc

SEQ ID NO: 612990 - DNA, 20 bp, mouse
gcccattaagcataaaggag

SEQ ID NO: 612991 - DNA, 20 bp, mouse
gtgtgccagccaaaagaact

SEQ ID NO: 612992 - DNA, 20 bp, mouse
ggctggcacatcaatttctg

SEQ ID NO: 612993 - DNA, 20 bp, mouse
gctaaacccattaagcataa

SEQ ID NO: 612994 - DNA, 20 bp, mouse
gtttgggtttatttttctcc

SEQ ID NO: 612995 - DNA, 20 bp, mouse
gttaagcataaaggagagga

SEQ ID NO: 612996 - DNA, 20 bp, mouse
gcctatccgtagcacagtga

SEQ ID NO: 612997 - DNA, 20 bp, mouse
gacgtggtgaacaaagccgg

SEQ ID NO: 612998 - DNA, 20 bp, mouse
gcggcggcctgatttaccag

SEQ ID NO: 612999 - DNA, 20 bp, mouse
gtgtacgtggtgaacaaagc

SEQ ID NO: 613000 - DNA, 20 bp, mouse
ggctgtcccactggtaaatc

SEQ ID NO: 613001 - DNA, 20 bp, mouse
ggccagcgcgacggcatccg

SEQ ID NO: 613002 - DNA, 20 bp, mouse
gtggcgaatagctgtcccac

SEQ ID NO: 613003 - DNA, 20 bp, mouse
gaatcgccatcactgtgcta

SEQ ID NO: 613004 - DNA, 20 bp, mouse
ggggctggcgctgcggaagt

SEQ ID NO: 613005 - DNA, 20 bp, mouse
gtggcccactacaagaagag

SEQ ID NO: 613006 - DNA, 20 bp, mouse
gcgcgccggagaaggttctc

SEQ ID NO: 613007 - DNA, 20 bp, mouse
gcccgcccgagaaccttctc

SEQ ID NO: 613008 - DNA, 20 bp, mouse
gggcccgagcgcgccggaga

SEQ ID NO: 613009 - DNA, 20 bp, mouse
gacgcacagaaaaaaagacg

SEQ ID NO: 613010 - DNA, 20 bp, mouse
gagacgaggcccgagcgcgc

SEQ ID NO: 613011 - DNA, 20 bp, mouse
ggccggagaaggttctcggg

SEQ ID NO: 613012 - DNA, 20 bp, mouse
gtgacccgggaacgctgctc

SEQ ID NO: 613013 - DNA, 20 bp, mouse
gacccaaagcagactgaccc

SEQ ID NO: 613014 - DNA, 20 bp, mouse
gatggggacactagtggagg

SEQ ID NO: 613015 - DNA, 20 bp, mouse
gaaccttctccggcgcgctc

SEQ ID NO: 613016 - DNA, 20 bp, mouse
ggtcgcgaggcggcgtatgg

SEQ ID NO: 613017 - DNA, 20 bp, mouse
gcacagctccgccaccatct

SEQ ID NO: 613018 - DNA, 20 bp, mouse
gctgcacaccgagatggtgg

SEQ ID NO: 613019 - DNA, 20 bp, mouse
gagggtcgcgaggcggcgta

SEQ ID NO: 613020 - DNA, 20 bp, mouse
gtttctgcacaccgagatgg

SEQ ID NO: 613021 - DNA, 20 bp, mouse
ggagtttctgcacaccgaga

SEQ ID NO: 613022 - DNA, 20 bp, mouse
gaggcggcgtatggcggacg

SEQ ID NO: 613023 - DNA, 20 bp, mouse
gaggcgtgagggtcgcgagg

SEQ ID NO: 613024 - DNA, 20 bp, mouse
ggccaggcgtgagggtcgcg

SEQ ID NO: 613025 - DNA, 20 bp, mouse
ggagctgtgggccccggacc

SEQ ID NO: 613026 - DNA, 20 bp, mouse
gacgcccagcgctatagtct

SEQ ID NO: 613027 - DNA, 20 bp, mouse
gcccagtggcggcggccccg

SEQ ID NO: 613028 - DNA, 20 bp, mouse
gcgtggaccgcgcccctccc

SEQ ID NO: 613029 - DNA, 20 bp, mouse
gcccagcccggaagtggctc

SEQ ID NO: 613030 - DNA, 20 bp, mouse
ggcggccttaggacccgggt

SEQ ID NO: 613031 - DNA, 20 bp, mouse
gaggaccccagggtgcgtgg

SEQ ID NO: 613032 - DNA, 20 bp, mouse
gagagatcccatctcggagg

SEQ ID NO: 613033 - DNA, 20 bp, mouse
gctgccaagactatagcgct

SEQ ID NO: 613034 - DNA, 20 bp, mouse
gtctgtgggatgcctctagg

SEQ ID NO: 613035 - DNA, 20 bp, mouse
gatgagagatcccatctcgg

SEQ ID NO: 613036 - DNA, 20 bp, mouse
gcgccgctcggtcctcccta

SEQ ID NO: 613037 - DNA, 20 bp, mouse
gtcctgtcggacagtgacca

SEQ ID NO: 613038 - DNA, 20 bp, mouse
gcgacaggaaccgccatgtt

SEQ ID NO: 613039 - DNA, 20 bp, mouse
gccgccggcagtactactcc

SEQ ID NO: 613040 - DNA, 20 bp, mouse
ggtcggggttcggcccaaca

SEQ ID NO: 613041 - DNA, 20 bp, mouse
ggccttggtcactgtccgac

SEQ ID NO: 613042 - DNA, 20 bp, mouse
gcctccctacggcaaagcct

SEQ ID NO: 613043 - DNA, 20 bp, mouse
gtagtactgccggcgggtcg

SEQ ID NO: 613044 - DNA, 20 bp, mouse
gtgaccaaggctttgccgta

SEQ ID NO: 613045 - DNA, 20 bp, mouse
gtcggctgcaggctccggag

SEQ ID NO: 613046 - DNA, 20 bp, mouse
gggctcggccggtggttcgg

SEQ ID NO: 613047 - DNA, 20 bp, mouse
gccggtggttcggaggttcc

SEQ ID NO: 613048 - DNA, 20 bp, mouse
gaaggggacctgacagacag

SEQ ID NO: 613049 - DNA, 20 bp, mouse
gccaacgcgcggccctaacc

SEQ ID NO: 613050 - DNA, 20 bp, mouse
gcagaggaccaggcaagcag

SEQ ID NO: 613051 - DNA, 20 bp, mouse
gcggccccaagcaggagccg

SEQ ID NO: 613052 - DNA, 20 bp, mouse
gaggtcttcgggaaaacccg

SEQ ID NO: 613053 - DNA, 20 bp, mouse
gacccgggcaggtgcagacc

SEQ ID NO: 613054 - DNA, 20 bp, mouse
ggataccgcaccccaggtgt

SEQ ID NO: 613055 - DNA, 20 bp, mouse
gtagcaggctgtccccggct

SEQ ID NO: 613056 - DNA, 20 bp, mouse
gttctaacataacagagcaa

SEQ ID NO: 613057 - DNA, 20 bp, mouse
gtactgataaagatatatgt

SEQ ID NO: 613058 - DNA, 20 bp, mouse
gatccatgaaagagatccgt

SEQ ID NO: 613059 - DNA, 20 bp, mouse
ggacatgctagccctttcag

SEQ ID NO: 613060 - DNA, 20 bp, mouse
gaattactaaatgagttgtt

SEQ ID NO: 613061 - DNA, 20 bp, mouse
gatttaaggaaaaaagttgg

SEQ ID NO: 613062 - DNA, 20 bp, mouse
gaacagagcaacggcattta

SEQ ID NO: 613063 - DNA, 20 bp, mouse
ggtggagaattcttagccta

SEQ ID NO: 613064 - DNA, 20 bp, mouse
gagcctacggatctctttca

SEQ ID NO: 613065 - DNA, 20 bp, mouse
gatatctttatcagtactca

SEQ ID NO: 613066 - DNA, 20 bp, mouse
gcagaaccaaggacgcgggg

SEQ ID NO: 613067 - DNA, 20 bp, mouse
ggagctgcgactttcattac

SEQ ID NO: 613068 - DNA, 20 bp, mouse
gcagagcccccccgcgtcct

SEQ ID NO: 613069 - DNA, 20 bp, mouse
gctttcattactggctgcgg

SEQ ID NO: 613070 - DNA, 20 bp, mouse
gcgactttcattactggctg

SEQ ID NO: 613071 - DNA, 20 bp, mouse
gcttgggcagagcagagagg

SEQ ID NO: 613072 - DNA, 20 bp, mouse
gacagcaaacctgggtgcac

SEQ ID NO: 613073 - DNA, 20 bp, mouse
gctgttgtacagtccttctt

SEQ ID NO: 613074 - DNA, 20 bp, mouse
gcttcttgggcagagcagag

SEQ ID NO: 613075 - DNA, 20 bp, mouse
gctgttcaaagttgtggaat

SEQ ID NO: 613076 - DNA, 20 bp, mouse
ggagctgcgactttcgttac

SEQ ID NO: 613077 - DNA, 20 bp, mouse
gcagaaccaaggacgcgggg

SEQ ID NO: 613078 - DNA, 20 bp, mouse
gcagagcccccccgcgtcct

SEQ ID NO: 613079 - DNA, 20 bp, mouse
gctttcgttactggctgcgg

SEQ ID NO: 613080 - DNA, 20 bp, mouse
gcgactttcgttactggctg

SEQ ID NO: 613081 - DNA, 20 bp, mouse
gcttgggcagagcagagagg

SEQ ID NO: 613082 - DNA, 20 bp, mouse
gacagcaaacctgggtgcac

SEQ ID NO: 613083 - DNA, 20 bp, mouse
gctgttgtacagtccttctt

SEQ ID NO: 613084 - DNA, 20 bp, mouse
gcttcttgggcagagcagag

SEQ ID NO: 613085 - DNA, 20 bp, mouse
gctgttcaaagttgtggaat

SEQ ID NO: 613086 - DNA, 20 bp, mouse
ggtgcagttgagggaggaca

SEQ ID NO: 613087 - DNA, 20 bp, mouse
gctctgcaacaaaatcaggt

SEQ ID NO: 613088 - DNA, 20 bp, mouse
gaaatcaggtgggaggcctg

SEQ ID NO: 613089 - DNA, 20 bp, mouse
gtatggatattagtgcttcg

SEQ ID NO: 613090 - DNA, 20 bp, mouse
gtgttcctctggcttcaact

SEQ ID NO: 613091 - DNA, 20 bp, mouse
gaacactagtgaaacatgta

SEQ ID NO: 613092 - DNA, 20 bp, mouse
gttcaagccagcaaaaggag

SEQ ID NO: 613093 - DNA, 20 bp, mouse
gtcctctggcttcaactagg

SEQ ID NO: 613094 - DNA, 20 bp, mouse
gtgtttcactagtgttcctc

SEQ ID NO: 613095 - DNA, 20 bp, mouse
gaaggtcagacggtcaagac

SEQ ID NO: 613096 - DNA, 20 bp, mouse
gtatcccgaggaacgagatg

SEQ ID NO: 613097 - DNA, 20 bp, mouse
ggaggccacggccatgatgt

SEQ ID NO: 613098 - DNA, 20 bp, mouse
gcctggtacatccaacatca

SEQ ID NO: 613099 - DNA, 20 bp, mouse
gaattcgtaattgtgatgca

SEQ ID NO: 613100 - DNA, 20 bp, mouse
ggtgtgcatctacaactatc

SEQ ID NO: 613101 - DNA, 20 bp, mouse
gcaggagcatggctgcgcac

SEQ ID NO: 613102 - DNA, 20 bp, mouse
ggaggaacgagatgaggacc

SEQ ID NO: 613103 - DNA, 20 bp, mouse
gcccagttcttggagacagt

SEQ ID NO: 613104 - DNA, 20 bp, mouse
gcctggctcgtgcaggaaag

SEQ ID NO: 613105 - DNA, 20 bp, mouse
ggccaactgtctccaagaac

SEQ ID NO: 613106 - DNA, 20 bp, mouse
gactgcagagagtacaaggt

SEQ ID NO: 613107 - DNA, 20 bp, mouse
gaaggtaggatacaacctgt

SEQ ID NO: 613108 - DNA, 20 bp, mouse
gtaccctggtaactaagtca

SEQ ID NO: 613109 - DNA, 20 bp, mouse
gctagtaaggactctctagt

SEQ ID NO: 613110 - DNA, 20 bp, mouse
gatgctccaagggtcttgag

SEQ ID NO: 613111 - DNA, 20 bp, mouse
gctaagtcatggattcccac

SEQ ID NO: 613112 - DNA, 20 bp, mouse
gcaagtgtctaggatcactg

SEQ ID NO: 613113 - DNA, 20 bp, mouse
gctaggatcactgtggatga

SEQ ID NO: 613114 - DNA, 20 bp, mouse
ggcacggtcttcttgtgtcc

SEQ ID NO: 613115 - DNA, 20 bp, mouse
gtgtaggtgtccgtatcatg

SEQ ID NO: 613116 - DNA, 20 bp, mouse
gagctgtacagtggcattgg

SEQ ID NO: 613117 - DNA, 20 bp, mouse
gagtaagagacgcagagaac

SEQ ID NO: 613118 - DNA, 20 bp, mouse
gggtcgcggttgcgagagga

SEQ ID NO: 613119 - DNA, 20 bp, mouse
gccgcggtcgcggttgcgag

SEQ ID NO: 613120 - DNA, 20 bp, mouse
gagcctggaggggcggacca

SEQ ID NO: 613121 - DNA, 20 bp, mouse
ggaaccagaagcgaagggaa

SEQ ID NO: 613122 - DNA, 20 bp, mouse
gcgaccgcggcctggaaact

SEQ ID NO: 613123 - DNA, 20 bp, mouse
gctggaggggcggaccaggg

SEQ ID NO: 613124 - DNA, 20 bp, mouse
gaggcctagtttccaggccg

SEQ ID NO: 613125 - DNA, 20 bp, mouse
gtaagcaggccggctcccca

SEQ ID NO: 613126 - DNA, 20 bp, mouse
gcacaagtactgcttggaaa

SEQ ID NO: 613127 - DNA, 20 bp, mouse
gctctgcagagttctccccc

SEQ ID NO: 613128 - DNA, 20 bp, mouse
gtggtagaggggtatgacaa

SEQ ID NO: 613129 - DNA, 20 bp, mouse
gagggcttaggttgtttcca

SEQ ID NO: 613130 - DNA, 20 bp, mouse
gtcagcagtgatctcagtca

SEQ ID NO: 613131 - DNA, 20 bp, mouse
ggaagcctatagcgtccctg

SEQ ID NO: 613132 - DNA, 20 bp, mouse
gacagcctcagggacgctat

SEQ ID NO: 613133 - DNA, 20 bp, mouse
gtatagaggtgaggtgataa

SEQ ID NO: 613134 - DNA, 20 bp, mouse
gaggtaggattagagaactc

SEQ ID NO: 613135 - DNA, 20 bp, mouse
ggcactttgcagaataaggt

SEQ ID NO: 613136 - DNA, 20 bp, mouse
ggcagctcccaggtcatcct

SEQ ID NO: 613137 - DNA, 20 bp, mouse
gctgggcacggtgcctagaa

SEQ ID NO: 613138 - DNA, 20 bp, mouse
ggaagaaaccaggcttgtag

SEQ ID NO: 613139 - DNA, 20 bp, mouse
gcaccaccctgtgagaggta

SEQ ID NO: 613140 - DNA, 20 bp, mouse
ggccgtgttcagcaagccag

SEQ ID NO: 613141 - DNA, 20 bp, mouse
gctgaggaccagcctctcag

SEQ ID NO: 613142 - DNA, 20 bp, mouse
gagcagcaggtgcagctccc

SEQ ID NO: 613143 - DNA, 20 bp, mouse
ggcctctcagaggataaaga

SEQ ID NO: 613144 - DNA, 20 bp, mouse
gctctggtcagcagcacgga

SEQ ID NO: 613145 - DNA, 20 bp, mouse
ggaacggaatgagcaaaccc

SEQ ID NO: 613146 - DNA, 20 bp, mouse
gagcccacagaggcagtcgt

SEQ ID NO: 613147 - DNA, 20 bp, mouse
gctccaacgactgcctctgt

SEQ ID NO: 613148 - DNA, 20 bp, mouse
ggtgttctttgtctcaggta

SEQ ID NO: 613149 - DNA, 20 bp, mouse
gggtaaggcaagcgggagat

SEQ ID NO: 613150 - DNA, 20 bp, mouse
gtgggagcaggtggtctctc

SEQ ID NO: 613151 - DNA, 20 bp, mouse
gatgaggaaggctgggctct

SEQ ID NO: 613152 - DNA, 20 bp, mouse
gtgtctcaggtaaggcaagc

SEQ ID NO: 613153 - DNA, 20 bp, mouse
gctcaagggggaaaaaaata

SEQ ID NO: 613154 - DNA, 20 bp, mouse
gtgtgcgtgttctttgtctc

SEQ ID NO: 613155 - DNA, 20 bp, mouse
gtagcaagttccagccatac

SEQ ID NO: 613156 - DNA, 20 bp, mouse
gtgccagcagccagccggag

SEQ ID NO: 613157 - DNA, 20 bp, mouse
gcctataggaagggtaacag

SEQ ID NO: 613158 - DNA, 20 bp, mouse
ggcacaaggtcccctccggc

SEQ ID NO: 613159 - DNA, 20 bp, mouse
gcacaggtgggaccacagga

SEQ ID NO: 613160 - DNA, 20 bp, mouse
gtgatcacaggtgggaccac

SEQ ID NO: 613161 - DNA, 20 bp, mouse
gggcaaaggaaaggtgccat

SEQ ID NO: 613162 - DNA, 20 bp, mouse
ggtcccctccggctggctgc

SEQ ID NO: 613163 - DNA, 20 bp, mouse
gggagggggaactattatgg

SEQ ID NO: 613164 - DNA, 20 bp, mouse
gagacagtgttgctgaaggt

SEQ ID NO: 613165 - DNA, 20 bp, mouse
gtggcactagttgtgaggta

SEQ ID NO: 613166 - DNA, 20 bp, mouse
gaaggagcttcatacagagg

SEQ ID NO: 613167 - DNA, 20 bp, mouse
gagcagcggtgacatccccc

SEQ ID NO: 613168 - DNA, 20 bp, mouse
gctgtgtctcgggtaaggag

SEQ ID NO: 613169 - DNA, 20 bp, mouse
gggcagttagcacaccagga

SEQ ID NO: 613170 - DNA, 20 bp, mouse
gctaactgccaatggcccca

SEQ ID NO: 613171 - DNA, 20 bp, mouse
gtataccctggtctccaccc

SEQ ID NO: 613172 - DNA, 20 bp, mouse
gaggcaggtgaggaagctag

SEQ ID NO: 613173 - DNA, 20 bp, mouse
gcattggcagttagcacacc

SEQ ID NO: 613174 - DNA, 20 bp, mouse
gtcctgatgcagcagagagt

SEQ ID NO: 613175 - DNA, 20 bp, mouse
gccacttgccttggggccat

SEQ ID NO: 613176 - DNA, 20 bp, mouse
gagcagcaggtagcagtcca

SEQ ID NO: 613177 - DNA, 20 bp, mouse
gtccatggctgggcagtagt

SEQ ID NO: 613178 - DNA, 20 bp, mouse
gctcctgggactagcaggta

SEQ ID NO: 613179 - DNA, 20 bp, mouse
gcaccttacctgctagtccc

SEQ ID NO: 613180 - DNA, 20 bp, mouse
gtgggcagtagtaggttctg

SEQ ID NO: 613181 - DNA, 20 bp, mouse
ggcaggtagcagtccatggc

SEQ ID NO: 613182 - DNA, 20 bp, mouse
gcacatcctggagccggtag

SEQ ID NO: 613183 - DNA, 20 bp, mouse
gcacccactagtgacctcag

SEQ ID NO: 613184 - DNA, 20 bp, mouse
gctgcagaaggaaaagatgt

SEQ ID NO: 613185 - DNA, 20 bp, mouse
gtaaaactgcaggcccctgg

SEQ ID NO: 613186 - DNA, 20 bp, mouse
gggcagtgtggggtagacag

SEQ ID NO: 613187 - DNA, 20 bp, mouse
gcaggacccacactgatccc

SEQ ID NO: 613188 - DNA, 20 bp, mouse
gctgacctcccagggttgga

SEQ ID NO: 613189 - DNA, 20 bp, mouse
gcagtcagcccggggatcga

SEQ ID NO: 613190 - DNA, 20 bp, mouse
ggggctgtgtctcaggtgag

SEQ ID NO: 613191 - DNA, 20 bp, mouse
ggaacaagaagaggcagtgt

SEQ ID NO: 613192 - DNA, 20 bp, mouse
gagagcctgccgtccaaccc

SEQ ID NO: 613193 - DNA, 20 bp, mouse
ggtcctgcccctcgatcccc

SEQ ID NO: 613194 - DNA, 20 bp, mouse
gccccaggcagagcttagac

SEQ ID NO: 613195 - DNA, 20 bp, mouse
gttccccaaacaggcaactg

SEQ ID NO: 613196 - DNA, 20 bp, mouse
gaggaggagacctctgaact

SEQ ID NO: 613197 - DNA, 20 bp, mouse
ggattctgtcagtagaggag

SEQ ID NO: 613198 - DNA, 20 bp, mouse
ggtccagattctgtcagtag

SEQ ID NO: 613199 - DNA, 20 bp, mouse
ggaagacttgcctagttcag

SEQ ID NO: 613200 - DNA, 20 bp, mouse
gcacagatgatgagacttag

SEQ ID NO: 613201 - DNA, 20 bp, mouse
gcaggctgaccctgtgacca

SEQ ID NO: 613202 - DNA, 20 bp, mouse
gctggactggtatggcctgg

SEQ ID NO: 613203 - DNA, 20 bp, mouse
ggagaggtgggatagataaa

SEQ ID NO: 613204 - DNA, 20 bp, mouse
ggacagaatctggactggta

SEQ ID NO: 613205 - DNA, 20 bp, mouse
gtgggatagataaaaggaca

SEQ ID NO: 613206 - DNA, 20 bp, mouse
gctatgcgatggctgagagg

SEQ ID NO: 613207 - DNA, 20 bp, mouse
ggaggcggtgcatgcagatg

SEQ ID NO: 613208 - DNA, 20 bp, mouse
gagtttcctggaggggagga

SEQ ID NO: 613209 - DNA, 20 bp, mouse
gcctctatgcgatggctgag

SEQ ID NO: 613210 - DNA, 20 bp, mouse
ggggagtaagtttcctggag

SEQ ID NO: 613211 - DNA, 20 bp, mouse
gccactctctccctccccgg

SEQ ID NO: 613212 - DNA, 20 bp, mouse
ggtcccgggtgggaagctca

SEQ ID NO: 613213 - DNA, 20 bp, mouse
gccatcgcatagagggaagg

SEQ ID NO: 613214 - DNA, 20 bp, mouse
ggagggcgcgtgaggaggag

SEQ ID NO: 613215 - DNA, 20 bp, mouse
gatctgggagtaagtttcca

SEQ ID NO: 613216 - DNA, 20 bp, mouse
gctcggtaagtgtggagtaa

SEQ ID NO: 613217 - DNA, 20 bp, mouse
gcagcaggaaggtctcaagt

SEQ ID NO: 613218 - DNA, 20 bp, mouse
gggtaaggcagaagagaata

SEQ ID NO: 613219 - DNA, 20 bp, mouse
gtctgctgctggcagcagtg

SEQ ID NO: 613220 - DNA, 20 bp, mouse
gggcagcaaggcactccgct

SEQ ID NO: 613221 - DNA, 20 bp, mouse
gagggccactagaagctgga

SEQ ID NO: 613222 - DNA, 20 bp, mouse
gtaagtgtggagtaagggta

SEQ ID NO: 613223 - DNA, 20 bp, mouse
gcttcagcaggtactatcca

SEQ ID NO: 613224 - DNA, 20 bp, mouse
gactccgctgggtctgctgc

SEQ ID NO: 613225 - DNA, 20 bp, mouse
gctagtgctgactaccttca

SEQ ID NO: 613226 - DNA, 20 bp, mouse
gcatcacactggcttacctg

SEQ ID NO: 613227 - DNA, 20 bp, mouse
gccacctatccccatcacac

SEQ ID NO: 613228 - DNA, 20 bp, mouse
ggataaagccacgagcctag

SEQ ID NO: 613229 - DNA, 20 bp, mouse
ggccagctgaagcccgcccc

SEQ ID NO: 613230 - DNA, 20 bp, mouse
gacactggcttacctggggc

SEQ ID NO: 613231 - DNA, 20 bp, mouse
ggatctagcccatcaaggag

SEQ ID NO: 613232 - DNA, 20 bp, mouse
gtgggcacctgtctctgcac

SEQ ID NO: 613233 - DNA, 20 bp, mouse
gctggcttctacctgcctct

SEQ ID NO: 613234 - DNA, 20 bp, mouse
gtgcctgaggctcctagcca

SEQ ID NO: 613235 - DNA, 20 bp, mouse
ggtcaggcaccggaggaatc

SEQ ID NO: 613236 - DNA, 20 bp, mouse
gcaggccagcagggcaccca

SEQ ID NO: 613237 - DNA, 20 bp, mouse
gaggcggcgcagaagcgggt

SEQ ID NO: 613238 - DNA, 20 bp, mouse
gagggcagcgcaggccagca

SEQ ID NO: 613239 - DNA, 20 bp, mouse
gcacacacaccgagaggatg

SEQ ID NO: 613240 - DNA, 20 bp, mouse
gtcgccacacacacaccgag

SEQ ID NO: 613241 - DNA, 20 bp, mouse
gacggtgagcctcatcctct

SEQ ID NO: 613242 - DNA, 20 bp, mouse
gaggcgagcgggccacgggc

SEQ ID NO: 613243 - DNA, 20 bp, mouse
ggccccttgcttcttctctg

SEQ ID NO: 613244 - DNA, 20 bp, mouse
ggcgctggtggcttagacta

SEQ ID NO: 613245 - DNA, 20 bp, mouse
ggcgtgatgaggatagtgaa

SEQ ID NO: 613246 - DNA, 20 bp, mouse
gccttcctgctgattccgaa

SEQ ID NO: 613247 - DNA, 20 bp, mouse
gcaaccatgagaggacccag

SEQ ID NO: 613248 - DNA, 20 bp, mouse
gaatggcagtgacatagtta

SEQ ID NO: 613249 - DNA, 20 bp, mouse
gtggactacaggctgtacct

SEQ ID NO: 613250 - DNA, 20 bp, mouse
ggctgttaagggtcccccca

SEQ ID NO: 613251 - DNA, 20 bp, mouse
gttaagggtccccccaagga

SEQ ID NO: 613252 - DNA, 20 bp, mouse
gagtgacatagttatggcca

SEQ ID NO: 613253 - DNA, 20 bp, mouse
gtgacctctgggtcctctca

SEQ ID NO: 613254 - DNA, 20 bp, mouse
gcctgtagtccatccttggg

SEQ ID NO: 613255 - DNA, 20 bp, mouse
gaggcgtgtgtaagtattca

SEQ ID NO: 613256 - DNA, 20 bp, mouse
gtggctgggtagagtctgca

SEQ ID NO: 613257 - DNA, 20 bp, mouse
gaggagcgcgcagtcgactc

SEQ ID NO: 613258 - DNA, 20 bp, mouse
ggactgcgcgctcctcggag

SEQ ID NO: 613259 - DNA, 20 bp, mouse
gcgaagagtgcaaactggct

SEQ ID NO: 613260 - DNA, 20 bp, mouse
gtgagccgaagagtgcaaac

SEQ ID NO: 613261 - DNA, 20 bp, mouse
gataagcctcggcccctccg

SEQ ID NO: 613262 - DNA, 20 bp, mouse
gagttctgggtggaagaggt

SEQ ID NO: 613263 - DNA, 20 bp, mouse
ggctagaagaagactctcac

SEQ ID NO: 613264 - DNA, 20 bp, mouse
gccctccccgctgacctcac

SEQ ID NO: 613265 - DNA, 20 bp, mouse
gaggtccacaccaggacggt

SEQ ID NO: 613266 - DNA, 20 bp, mouse
ggtctgagccgcgtccccgg

SEQ ID NO: 613267 - DNA, 20 bp, mouse
ggagagaggtttagcgacag

SEQ ID NO: 613268 - DNA, 20 bp, mouse
gagaggaccgaggaaaggac

SEQ ID NO: 613269 - DNA, 20 bp, mouse
gctagccggaggaagtccca

SEQ ID NO: 613270 - DNA, 20 bp, mouse
gctggagggcagagcatcat

SEQ ID NO: 613271 - DNA, 20 bp, mouse
gagaggagaggatggaccag

SEQ ID NO: 613272 - DNA, 20 bp, mouse
gctgaagtggacaccccgac

SEQ ID NO: 613273 - DNA, 20 bp, mouse
ggaggtttagcgacagaggc

SEQ ID NO: 613274 - DNA, 20 bp, mouse
gctgcttaaagtgtccaggg

SEQ ID NO: 613275 - DNA, 20 bp, mouse
gctgaaactcccggagaaac

SEQ ID NO: 613276 - DNA, 20 bp, mouse
gagcagcaggcgcagcaccg

SEQ ID NO: 613277 - DNA, 20 bp, mouse
gaagggatgtgagggtttag

SEQ ID NO: 613278 - DNA, 20 bp, mouse
ggtctgtcatgagttgaaaa

SEQ ID NO: 613279 - DNA, 20 bp, mouse
gtattaaggttggagacttg

SEQ ID NO: 613280 - DNA, 20 bp, mouse
gttcagttactgcggctgtg

SEQ ID NO: 613281 - DNA, 20 bp, mouse
gaagtacagctaagaaggaa

SEQ ID NO: 613282 - DNA, 20 bp, mouse
gctcattaagggacgatcta

SEQ ID NO: 613283 - DNA, 20 bp, mouse
gatcttcctgccagacagac

SEQ ID NO: 613284 - DNA, 20 bp, mouse
gttcatctacacagagaaac

SEQ ID NO: 613285 - DNA, 20 bp, mouse
gaagaaggaaaggtatcaaa

SEQ ID NO: 613286 - DNA, 20 bp, mouse
gaccaaggtcaaggccggca

SEQ ID NO: 613287 - DNA, 20 bp, mouse
gaggcacaggtcacttacca

SEQ ID NO: 613288 - DNA, 20 bp, mouse
ggaacgagtgagacattgct

SEQ ID NO: 613289 - DNA, 20 bp, mouse
gacagaagacgccagcaaga

SEQ ID NO: 613290 - DNA, 20 bp, mouse
gagagcatgggatagcccgt

SEQ ID NO: 613291 - DNA, 20 bp, mouse
gcgcagccagcagcacaatg

SEQ ID NO: 613292 - DNA, 20 bp, mouse
ggccctgccggccttgacct

SEQ ID NO: 613293 - DNA, 20 bp, mouse
gccaggctgtcagagacatt

SEQ ID NO: 613294 - DNA, 20 bp, mouse
gtgtgcaccgtgggcatcgt

SEQ ID NO: 613295 - DNA, 20 bp, mouse
gggtgcacaccaggaggacc

SEQ ID NO: 613296 - DNA, 20 bp, mouse
gtccccgacgctgttcatgg

SEQ ID NO: 613297 - DNA, 20 bp, mouse
gaccgccatgaacagcgtcg

SEQ ID NO: 613298 - DNA, 20 bp, mouse
ggcctccccgacgctgttca

SEQ ID NO: 613299 - DNA, 20 bp, mouse
gaaaccagcggttgaagcac

SEQ ID NO: 613300 - DNA, 20 bp, mouse
ggacagcctggcggtttcgg

SEQ ID NO: 613301 - DNA, 20 bp, mouse
gtaatgtcctagcgcacggg

SEQ ID NO: 613302 - DNA, 20 bp, mouse
ggtgtcaagtggagacagcc

SEQ ID NO: 613303 - DNA, 20 bp, mouse
gaagtaccgcaaaggcatcc

SEQ ID NO: 613304 - DNA, 20 bp, mouse
gctgtctccacttgacacac

SEQ ID NO: 613305 - DNA, 20 bp, mouse
gcccggagccgtcccctttg

SEQ ID NO: 613306 - DNA, 20 bp, mouse
ggagcgcgcaggattccgag

SEQ ID NO: 613307 - DNA, 20 bp, mouse
gcggcacacacactcatagt

SEQ ID NO: 613308 - DNA, 20 bp, mouse
gtacagcgtgagtcaccggg

SEQ ID NO: 613309 - DNA, 20 bp, mouse
gccgaggctgtggatagtcc

SEQ ID NO: 613310 - DNA, 20 bp, mouse
gccccacaggcaccaggtct

SEQ ID NO: 613311 - DNA, 20 bp, mouse
gcggaatcctgcgcgctcct

SEQ ID NO: 613312 - DNA, 20 bp, mouse
gacagcctcggcaacaatag

SEQ ID NO: 613313 - DNA, 20 bp, mouse
ggcctcggcaacaatagcgg

SEQ ID NO: 613314 - DNA, 20 bp, mouse
gtggccacgcgtccaagggt

SEQ ID NO: 613315 - DNA, 20 bp, mouse
gtcctcgaggctcaacaccc

SEQ ID NO: 613316 - DNA, 20 bp, mouse
gcaagcacgcccgcatcccc

SEQ ID NO: 613317 - DNA, 20 bp, mouse
gcggcgccctaggccaatcc

SEQ ID NO: 613318 - DNA, 20 bp, mouse
ggtcctctcctacttctggg

SEQ ID NO: 613319 - DNA, 20 bp, mouse
ggagtccggggagcatctgc

SEQ ID NO: 613320 - DNA, 20 bp, mouse
gagcagcaggagctttccgg

SEQ ID NO: 613321 - DNA, 20 bp, mouse
gcatacgcgcacacacagcc

SEQ ID NO: 613322 - DNA, 20 bp, mouse
ggggctcgctccgagatccc

SEQ ID NO: 613323 - DNA, 20 bp, mouse
gacggtcctctcctacttct

SEQ ID NO: 613324 - DNA, 20 bp, mouse
gcaggaaaaataaaaatcga

SEQ ID NO: 613325 - DNA, 20 bp, mouse
ggtagggagtgcgcggagta

SEQ ID NO: 613326 - DNA, 20 bp, mouse
ggctgctgccgagtacgtga

SEQ ID NO: 613327 - DNA, 20 bp, mouse
gaccccagccgtcacgtact

SEQ ID NO: 613328 - DNA, 20 bp, mouse
gtgccgcagcactttagcag

SEQ ID NO: 613329 - DNA, 20 bp, mouse
gagagggtcactggaagtcc

SEQ ID NO: 613330 - DNA, 20 bp, mouse
gagcactttagcagcggaag

SEQ ID NO: 613331 - DNA, 20 bp, mouse
ggccgagtacgtgacggctg

SEQ ID NO: 613332 - DNA, 20 bp, mouse
gcaggacaaggtacccagta

SEQ ID NO: 613333 - DNA, 20 bp, mouse
gtaggctggcggcggtccac

SEQ ID NO: 613334 - DNA, 20 bp, mouse
gtgggctgcataataagctg

SEQ ID NO: 613335 - DNA, 20 bp, mouse
gccagtagggagctgcgaag

SEQ ID NO: 613336 - DNA, 20 bp, mouse
ggccggagtgagcagcctgg

SEQ ID NO: 613337 - DNA, 20 bp, mouse
ggtccggaagggacccatgt

SEQ ID NO: 613338 - DNA, 20 bp, mouse
ggcgcaagcagcgtccggaa

SEQ ID NO: 613339 - DNA, 20 bp, mouse
gcgtggagcgagcaaaccgg

SEQ ID NO: 613340 - DNA, 20 bp, mouse
ggctcgctccacgccgacat

SEQ ID NO: 613341 - DNA, 20 bp, mouse
gcggcgtggagcgagcaaac

SEQ ID NO: 613342 - DNA, 20 bp, mouse
ggaagggacccatgtcggcg

SEQ ID NO: 613343 - DNA, 20 bp, mouse
ggggacgcgcaagcagcgtc

SEQ ID NO: 613344 - DNA, 20 bp, mouse
ggggaggagcgagcaagagt

SEQ ID NO: 613345 - DNA, 20 bp, mouse
gtccgcctgcatcccccggg

SEQ ID NO: 613346 - DNA, 20 bp, mouse
ggactgtgagcagcttcggg

SEQ ID NO: 613347 - DNA, 20 bp, mouse
gagagactgtgagcagcttc

SEQ ID NO: 613348 - DNA, 20 bp, mouse
ggcaccataagttaactctc

SEQ ID NO: 613349 - DNA, 20 bp, mouse
gccagtgtgggtgactatgt

SEQ ID NO: 613350 - DNA, 20 bp, mouse
ggggtcccttgtcccagtgt

SEQ ID NO: 613351 - DNA, 20 bp, mouse
gggtccagagagttaactta

SEQ ID NO: 613352 - DNA, 20 bp, mouse
gataggtgaagaaatagagg

SEQ ID NO: 613353 - DNA, 20 bp, mouse
gagcataggtgaagaaatag

SEQ ID NO: 613354 - DNA, 20 bp, mouse
gcatctgccaaggcaccctg

SEQ ID NO: 613355 - DNA, 20 bp, mouse
gctggtgccagagatgtaac

SEQ ID NO: 613356 - DNA, 20 bp, mouse
ggatgtacccactacccagg

SEQ ID NO: 613357 - DNA, 20 bp, mouse
ggtgggaacgggccaggagc

SEQ ID NO: 613358 - DNA, 20 bp, mouse
gtccgccgcgagagcgcagt

SEQ ID NO: 613359 - DNA, 20 bp, mouse
gcgcgagagcgcagtgggaa

SEQ ID NO: 613360 - DNA, 20 bp, mouse
gccggatgtacccactaccc

SEQ ID NO: 613361 - DNA, 20 bp, mouse
gagcgcagtgggaacgggcc

SEQ ID NO: 613362 - DNA, 20 bp, mouse
ggccggaagagaaaccacag

SEQ ID NO: 613363 - DNA, 20 bp, mouse
ggcaacgtcggatgcactcg

SEQ ID NO: 613364 - DNA, 20 bp, mouse
gcagtcggtcatcaccgggt

SEQ ID NO: 613365 - DNA, 20 bp, mouse
gttcgtggtgcaccgggatc

SEQ ID NO: 613366 - DNA, 20 bp, mouse
gcattcaaacgggtctgatc

SEQ ID NO: 613367 - DNA, 20 bp, mouse
gaaaacgcagtaaaaagcag

SEQ ID NO: 613368 - DNA, 20 bp, mouse
ggggggagggaaagggggac

SEQ ID NO: 613369 - DNA, 20 bp, mouse
ggtagaaaaatatagttaag

SEQ ID NO: 613370 - DNA, 20 bp, mouse
ggtttgaatgaccttttcac

SEQ ID NO: 613371 - DNA, 20 bp, mouse
gtccgcatactctagggctg

SEQ ID NO: 613372 - DNA, 20 bp, mouse
gaagtgaaactcccgtgaaa

SEQ ID NO: 613373 - DNA, 20 bp, mouse
gctttctggcgtctgataaa

SEQ ID NO: 613374 - DNA, 20 bp, mouse
gggagaacattgcttttgtt

SEQ ID NO: 613375 - DNA, 20 bp, mouse
gtggtacttccgcatactct

SEQ ID NO: 613376 - DNA, 20 bp, mouse
gcgtttctctagcttcgagt

SEQ ID NO: 613377 - DNA, 20 bp, mouse
ggaaagggaatgtctgtggt

SEQ ID NO: 613378 - DNA, 20 bp, mouse
gtggtaggaaacaacgctct

SEQ ID NO: 613379 - DNA, 20 bp, mouse
gtgaagggggagactaaacc

SEQ ID NO: 613380 - DNA, 20 bp, mouse
gaccaaagccctaaagtatg

SEQ ID NO: 613381 - DNA, 20 bp, mouse
ggaaacgaaagtttgagagc

SEQ ID NO: 613382 - DNA, 20 bp, mouse
ggctctgggtctcgtgcaca

SEQ ID NO: 613383 - DNA, 20 bp, mouse
gttaaagttgtgttttttcc

SEQ ID NO: 613384 - DNA, 20 bp, mouse
gtccgcatactttagggctt

SEQ ID NO: 613385 - DNA, 20 bp, mouse
gcagattgtgaaactgaagg

SEQ ID NO: 613386 - DNA, 20 bp, mouse
gtgctccgagtagggaccgg

SEQ ID NO: 613387 - DNA, 20 bp, mouse
gccggcccccggtccctact

SEQ ID NO: 613388 - DNA, 20 bp, mouse
gcagcccggccccagttggc

SEQ ID NO: 613389 - DNA, 20 bp, mouse
gtcacctccaccagccaact

SEQ ID NO: 613390 - DNA, 20 bp, mouse
gtgagcagtgtgctccgagt

SEQ ID NO: 613391 - DNA, 20 bp, mouse
gaggccccctggctaggagg

SEQ ID NO: 613392 - DNA, 20 bp, mouse
gcgggacagcgggaagcaga

SEQ ID NO: 613393 - DNA, 20 bp, mouse
gcagcgggaagcagagggcg

SEQ ID NO: 613394 - DNA, 20 bp, mouse
ggggctgcgccggtgcaaaa

SEQ ID NO: 613395 - DNA, 20 bp, mouse
gcagcggggccagcgactcc

SEQ ID NO: 613396 - DNA, 20 bp, mouse
gcagcggttgccactgagaa

SEQ ID NO: 613397 - DNA, 20 bp, mouse
gtctcgctcgccattctcag

SEQ ID NO: 613398 - DNA, 20 bp, mouse
gatggcgagcgagactaccg

SEQ ID NO: 613399 - DNA, 20 bp, mouse
gacgccccgtcgggctgaaa

SEQ ID NO: 613400 - DNA, 20 bp, mouse
gcagtgtggtcgggttgggt

SEQ ID NO: 613401 - DNA, 20 bp, mouse
gatcgggaggcagaacccta

SEQ ID NO: 613402 - DNA, 20 bp, mouse
ggccagccatacgccccgtc

SEQ ID NO: 613403 - DNA, 20 bp, mouse
ggagcgagactaccgaggcg

SEQ ID NO: 613404 - DNA, 20 bp, mouse
gagtagacagtaggatcggg

SEQ ID NO: 613405 - DNA, 20 bp, mouse
ggcagagcgcgcacacacag

SEQ ID NO: 613406 - DNA, 20 bp, mouse
ggagtcagaagactgtggac

SEQ ID NO: 613407 - DNA, 20 bp, mouse
gggtcgggtgcagacaggac

SEQ ID NO: 613408 - DNA, 20 bp, mouse
gggaccgagtcagaagactg

SEQ ID NO: 613409 - DNA, 20 bp, mouse
gtgaagtccccgcagggacc

SEQ ID NO: 613410 - DNA, 20 bp, mouse
gcccgcagggaccgggttga

SEQ ID NO: 613411 - DNA, 20 bp, mouse
gcacggtgatgccctcaacc

SEQ ID NO: 613412 - DNA, 20 bp, mouse
gggtgcgcgggaggcagagt

SEQ ID NO: 613413 - DNA, 20 bp, mouse
gacttggtgaagtccccgca

SEQ ID NO: 613414 - DNA, 20 bp, mouse
gagggacaccggggccactg

SEQ ID NO: 613415 - DNA, 20 bp, mouse
gtggtcaccgcatcctgcaa

SEQ ID NO: 613416 - DNA, 20 bp, mouse
gctctgcggactaaggacta

SEQ ID NO: 613417 - DNA, 20 bp, mouse
gccgcagagcctccaccaga

SEQ ID NO: 613418 - DNA, 20 bp, mouse
gatccaattcagccatctgg

SEQ ID NO: 613419 - DNA, 20 bp, mouse
ggtggaggctctgcggacta

SEQ ID NO: 613420 - DNA, 20 bp, mouse
gcctgagccaagggaccgcg

SEQ ID NO: 613421 - DNA, 20 bp, mouse
gagccaagggaccgcgagga

SEQ ID NO: 613422 - DNA, 20 bp, mouse
gcaattcagccatctggtgg

SEQ ID NO: 613423 - DNA, 20 bp, mouse
ggagcagtgaccccggtcag

SEQ ID NO: 613424 - DNA, 20 bp, mouse
gactaaggcgtccttcctcg

SEQ ID NO: 613425 - DNA, 20 bp, mouse
ggcggggagggtgaacacag

SEQ ID NO: 613426 - DNA, 20 bp, mouse
ggttatcagtggaagatgtc

SEQ ID NO: 613427 - DNA, 20 bp, mouse
gagtggaagatgtctggtcg

SEQ ID NO: 613428 - DNA, 20 bp, mouse
ggcgtacttttggttatcag

SEQ ID NO: 613429 - DNA, 20 bp, mouse
gtcgcactaacgaccggtag

SEQ ID NO: 613430 - DNA, 20 bp, mouse
gactgctgagatcctggaat

SEQ ID NO: 613431 - DNA, 20 bp, mouse
ggggcaagtgaggcccctac

SEQ ID NO: 613432 - DNA, 20 bp, mouse
gtaagggtaattattcggag

SEQ ID NO: 613433 - DNA, 20 bp, mouse
gtggaaactgcaggccggca

SEQ ID NO: 613434 - DNA, 20 bp, mouse
gctccgtaagggtaattatt

SEQ ID NO: 613435 - DNA, 20 bp, mouse
gattacccttacggagaagg

SEQ ID NO: 613436 - DNA, 20 bp, mouse
gtgcagcgacagcctcgagg

SEQ ID NO: 613437 - DNA, 20 bp, mouse
gcactgcagcaagggattgt

SEQ ID NO: 613438 - DNA, 20 bp, mouse
ggcaagccacactgcagcaa

SEQ ID NO: 613439 - DNA, 20 bp, mouse
gatggctgcattgcatggta

SEQ ID NO: 613440 - DNA, 20 bp, mouse
ggattggtctgaattcggaa

SEQ ID NO: 613441 - DNA, 20 bp, mouse
ggatgcgccagctcatgaac

SEQ ID NO: 613442 - DNA, 20 bp, mouse
gagcaagggattgtgggata

SEQ ID NO: 613443 - DNA, 20 bp, mouse
gttgatcgggagaaatgggt

SEQ ID NO: 613444 - DNA, 20 bp, mouse
gttagagcagaagatatgct

SEQ ID NO: 613445 - DNA, 20 bp, mouse
gtctgttgatcgggagaaat

SEQ ID NO: 613446 - DNA, 20 bp, mouse
ggcccggttccagaacgatt

SEQ ID NO: 613447 - DNA, 20 bp, mouse
gacgattcggatgactcagg

SEQ ID NO: 613448 - DNA, 20 bp, mouse
ggattggcgcatcccggctg

SEQ ID NO: 613449 - DNA, 20 bp, mouse
gagaacgattcggatgactc

SEQ ID NO: 613450 - DNA, 20 bp, mouse
gaacccagccagccgcggat

SEQ ID NO: 613451 - DNA, 20 bp, mouse
gtccgaatcgttctggaacc

SEQ ID NO: 613452 - DNA, 20 bp, mouse
ggccgcggattggcgcatcc

SEQ ID NO: 613453 - DNA, 20 bp, mouse
gcgcggacaaacacgcaagt

SEQ ID NO: 613454 - DNA, 20 bp, mouse
gtcgcgggacacgatctgag

SEQ ID NO: 613455 - DNA, 20 bp, mouse
gctgaaaacccagccagccg

SEQ ID NO: 613456 - DNA, 20 bp, mouse
gaaagctgaggaccctggtt

SEQ ID NO: 613457 - DNA, 20 bp, mouse
gagtctcactcacctaacca

SEQ ID NO: 613458 - DNA, 20 bp, mouse
gagcttccacaggccagcat

SEQ ID NO: 613459 - DNA, 20 bp, mouse
ggagcacataactaaagctg

SEQ ID NO: 613460 - DNA, 20 bp, mouse
gtaactaaagctgaggaccc

SEQ ID NO: 613461 - DNA, 20 bp, mouse
gtgagtgagactgggacccc

SEQ ID NO: 613462 - DNA, 20 bp, mouse
gggcttgcaaaagcgaagct

SEQ ID NO: 613463 - DNA, 20 bp, mouse
gtgtcgtctcagctagtcca

SEQ ID NO: 613464 - DNA, 20 bp, mouse
gagcccacctaggccggcca

SEQ ID NO: 613465 - DNA, 20 bp, mouse
gacccctggccggcctaggt

SEQ ID NO: 613466 - DNA, 20 bp, mouse
gcgagggcagccatcctgga

SEQ ID NO: 613467 - DNA, 20 bp, mouse
gggcgcggctccatccagga

SEQ ID NO: 613468 - DNA, 20 bp, mouse
gagccggagtagacagtggg

SEQ ID NO: 613469 - DNA, 20 bp, mouse
gccggagccggagtagacag

SEQ ID NO: 613470 - DNA, 20 bp, mouse
gctctcctgcagctgtggcg

SEQ ID NO: 613471 - DNA, 20 bp, mouse
gaaaggctctcctgcagctg

SEQ ID NO: 613472 - DNA, 20 bp, mouse
gccgggcttgtttacagcga

SEQ ID NO: 613473 - DNA, 20 bp, mouse
ggtctccaggacgaaccgaa

SEQ ID NO: 613474 - DNA, 20 bp, mouse
gggcttgtaacgcccaccag

SEQ ID NO: 613475 - DNA, 20 bp, mouse
gggaccgcggaagggcggaa

SEQ ID NO: 613476 - DNA, 20 bp, mouse
gcggctgcggaggtcgtcgg

SEQ ID NO: 613477 - DNA, 20 bp, mouse
gtcgcggagggagcacaggg

SEQ ID NO: 613478 - DNA, 20 bp, mouse
ggcggaatcgagcgtctcgg

SEQ ID NO: 613479 - DNA, 20 bp, mouse
gtccaaggggcccgagagaa

SEQ ID NO: 613480 - DNA, 20 bp, mouse
ggaatcgagcgtctcggtgg

SEQ ID NO: 613481 - DNA, 20 bp, mouse
ggactcgcggagggagcaca

SEQ ID NO: 613482 - DNA, 20 bp, mouse
ggcctcggagaagcgggagg

SEQ ID NO: 613483 - DNA, 20 bp, mouse
gggcggccgcaggacaatgg

SEQ ID NO: 613484 - DNA, 20 bp, mouse
gaaggctgctaggcacgggc

SEQ ID NO: 613485 - DNA, 20 bp, mouse
gggcggcggccgcaggacaa

SEQ ID NO: 613486 - DNA, 20 bp, mouse
ggctccgccatcgcgctcgt

SEQ ID NO: 613487 - DNA, 20 bp, mouse
ggacattgcgggcatcggta

SEQ ID NO: 613488 - DNA, 20 bp, mouse
gtcttaagtaccgcgcggta

SEQ ID NO: 613489 - DNA, 20 bp, mouse
gggtgagcccacgagcgcga

SEQ ID NO: 613490 - DNA, 20 bp, mouse
gctgtccctgcgcgtcacgt

SEQ ID NO: 613491 - DNA, 20 bp, mouse
ggagcccacgagcgcgatgg

SEQ ID NO: 613492 - DNA, 20 bp, mouse
gtcatgcctggatgagacgt

SEQ ID NO: 613493 - DNA, 20 bp, mouse
gagctgcgcaccctaccgcg

SEQ ID NO: 613494 - DNA, 20 bp, mouse
gtggtcgcaggccacctggg

SEQ ID NO: 613495 - DNA, 20 bp, mouse
gtcacccgacgtgacgcgca

SEQ ID NO: 613496 - DNA, 20 bp, mouse
gaccccgcggagcagctcca

SEQ ID NO: 613497 - DNA, 20 bp, mouse
gttgctcaggacctaccccg

SEQ ID NO: 613498 - DNA, 20 bp, mouse
gggagctcccggagactgct

SEQ ID NO: 613499 - DNA, 20 bp, mouse
gtctccctggagctgctccg

SEQ ID NO: 613500 - DNA, 20 bp, mouse
gagtgacccggcccggagag

SEQ ID NO: 613501 - DNA, 20 bp, mouse
gggtcccagagaaatctcgg

SEQ ID NO: 613502 - DNA, 20 bp, mouse
gggcggggagactgtggtgc

SEQ ID NO: 613503 - DNA, 20 bp, mouse
gggagaggagtgacccggcc

SEQ ID NO: 613504 - DNA, 20 bp, mouse
gctcagggcgaaaggcccaa

SEQ ID NO: 613505 - DNA, 20 bp, mouse
gtggtgccggctgcttgctc

SEQ ID NO: 613506 - DNA, 20 bp, mouse
gtgcccggtgagccagcccg

SEQ ID NO: 613507 - DNA, 20 bp, mouse
gccgctccggagccgagaag

SEQ ID NO: 613508 - DNA, 20 bp, mouse
gagccgagccgaggggagtc

SEQ ID NO: 613509 - DNA, 20 bp, mouse
gcctcaccgacagcacgggg

SEQ ID NO: 613510 - DNA, 20 bp, mouse
ggcccggagccgagctctgt

SEQ ID NO: 613511 - DNA, 20 bp, mouse
gcggccgcgcagactcctca

SEQ ID NO: 613512 - DNA, 20 bp, mouse
gcaacgtggccgcgtcggaa

SEQ ID NO: 613513 - DNA, 20 bp, mouse
gcgcgtcggaaggggtcccg

SEQ ID NO: 613514 - DNA, 20 bp, mouse
ggcgctgcgggaaggtctcc

SEQ ID NO: 613515 - DNA, 20 bp, mouse
ggtcgggaaccgggcgccgc

SEQ ID NO: 613516 - DNA, 20 bp, mouse
ggcgagtgtctcagaagcga

SEQ ID NO: 613517 - DNA, 20 bp, mouse
gcgggcctctgtacagacga

SEQ ID NO: 613518 - DNA, 20 bp, mouse
gctgtcccgcctccaggccg

SEQ ID NO: 613519 - DNA, 20 bp, mouse
gctgcgagcggcgcgcggtc

SEQ ID NO: 613520 - DNA, 20 bp, mouse
gcggttgttcgcaagtcttg

SEQ ID NO: 613521 - DNA, 20 bp, mouse
gcggcccaggagacgcgtgg

SEQ ID NO: 613522 - DNA, 20 bp, mouse
gagaaagagccgcggcctgg

SEQ ID NO: 613523 - DNA, 20 bp, mouse
ggaggcgggacagaaatatc

SEQ ID NO: 613524 - DNA, 20 bp, mouse
gctcggcctcgcggcatcgg

SEQ ID NO: 613525 - DNA, 20 bp, mouse
ggtgtgaatggcggcctcgg

SEQ ID NO: 613526 - DNA, 20 bp, mouse
ggaccccaaccagcagacac

SEQ ID NO: 613527 - DNA, 20 bp, mouse
gcaggcatcggcaccttcca

SEQ ID NO: 613528 - DNA, 20 bp, mouse
gtctgctggttggggtctcg

SEQ ID NO: 613529 - DNA, 20 bp, mouse
gtgacagagggcaagaccct

SEQ ID NO: 613530 - DNA, 20 bp, mouse
gcatcggcaccttccatggt

SEQ ID NO: 613531 - DNA, 20 bp, mouse
gccagcggcagcctagagaa

SEQ ID NO: 613532 - DNA, 20 bp, mouse
gggcttcagcggatgtctcg

SEQ ID NO: 613533 - DNA, 20 bp, mouse
gtgtctcggggcacgaagtg

SEQ ID NO: 613534 - DNA, 20 bp, mouse
ggctagcaagtgacctacca

SEQ ID NO: 613535 - DNA, 20 bp, mouse
gagcctgtgtctgctggttg

SEQ ID NO: 613536 - DNA, 20 bp, mouse
ggcctgtgcgacgggtccag

SEQ ID NO: 613537 - DNA, 20 bp, mouse
ggcgccggcgcggggacaga

SEQ ID NO: 613538 - DNA, 20 bp, mouse
ggacggaggcgcgggacgtg

SEQ ID NO: 613539 - DNA, 20 bp, mouse
gggactgcagccactcggag

SEQ ID NO: 613540 - DNA, 20 bp, mouse
gtgcgccgcgcgggccccaa

SEQ ID NO: 613541 - DNA, 20 bp, mouse
gcggggacagacggaggcgc

SEQ ID NO: 613542 - DNA, 20 bp, mouse
gccgccccggcccctccctc

SEQ ID NO: 613543 - DNA, 20 bp, mouse
ggacccgcaccccgatacac

SEQ ID NO: 613544 - DNA, 20 bp, mouse
gcgctgcgggccgctccgag

SEQ ID NO: 613545 - DNA, 20 bp, mouse
gggcccgcgcggcgcactca

SEQ ID NO: 613546 - DNA, 20 bp, mouse
gatcatcaagacttagacta

SEQ ID NO: 613547 - DNA, 20 bp, mouse
gcagaggggtgcagtcagag

SEQ ID NO: 613548 - DNA, 20 bp, mouse
gcttcctgctgagtattata

SEQ ID NO: 613549 - DNA, 20 bp, mouse
gccacagatcctgagtctct

SEQ ID NO: 613550 - DNA, 20 bp, mouse
gaggagagcaatgtctgtat

SEQ ID NO: 613551 - DNA, 20 bp, mouse
gtggaggtaaaaagcaggat

SEQ ID NO: 613552 - DNA, 20 bp, mouse
gagacagcagcatagggaat

SEQ ID NO: 613553 - DNA, 20 bp, mouse
ggaatgggcccttagaatca

SEQ ID NO: 613554 - DNA, 20 bp, mouse
gctctggcttcttctattta

SEQ ID NO: 613555 - DNA, 20 bp, mouse
gtctggtgagtttaagttgg

SEQ ID NO: 613556 - DNA, 20 bp, mouse
gtgcggagaggagcaaatgg

SEQ ID NO: 613557 - DNA, 20 bp, mouse
gagacccaaactctgcggag

SEQ ID NO: 613558 - DNA, 20 bp, mouse
gcagtcactaagttgctctc

SEQ ID NO: 613559 - DNA, 20 bp, mouse
gaggggtagcctgaagagga

SEQ ID NO: 613560 - DNA, 20 bp, mouse
ggcctcctgccgaatgttgt

SEQ ID NO: 613561 - DNA, 20 bp, mouse
gaagttcagactttaaaggt

SEQ ID NO: 613562 - DNA, 20 bp, mouse
ggggttgaagagcaagaggg

SEQ ID NO: 613563 - DNA, 20 bp, mouse
gctggcttaacttctcctaa

SEQ ID NO: 613564 - DNA, 20 bp, mouse
gagttgctctctggtgagcc

SEQ ID NO: 613565 - DNA, 20 bp, mouse
gattctcaggacatagtctt

SEQ ID NO: 613566 - DNA, 20 bp, mouse
gatgatggcctcctcagctc

SEQ ID NO: 613567 - DNA, 20 bp, mouse
ggttcagtatgatacaggtt

SEQ ID NO: 613568 - DNA, 20 bp, mouse
ggtaaccaacccggcacaca

SEQ ID NO: 613569 - DNA, 20 bp, mouse
gaagtctatcccagaggaga

SEQ ID NO: 613570 - DNA, 20 bp, mouse
ggtccaacagaagaatggat

SEQ ID NO: 613571 - DNA, 20 bp, mouse
gtatgtgtccaacagaagaa

SEQ ID NO: 613572 - DNA, 20 bp, mouse
ggctgccctgtgtgccgggt

SEQ ID NO: 613573 - DNA, 20 bp, mouse
gaccccatccattcttctgt

SEQ ID NO: 613574 - DNA, 20 bp, mouse
gtgttgatcatgttttgatt

SEQ ID NO: 613575 - DNA, 20 bp, mouse
gtgttttactgtgcacaaca

SEQ ID NO: 613576 - DNA, 20 bp, mouse
gatcatcaggacttagactc

SEQ ID NO: 613577 - DNA, 20 bp, mouse
gaaagcaggagggtgttgga

SEQ ID NO: 613578 - DNA, 20 bp, mouse
gttaaaaagcaggagggtgt

SEQ ID NO: 613579 - DNA, 20 bp, mouse
ggggagaccaaagtctgtct

SEQ ID NO: 613580 - DNA, 20 bp, mouse
gatagaagaagtacagccaa

SEQ ID NO: 613581 - DNA, 20 bp, mouse
gggcttcctgctgagtattg

SEQ ID NO: 613582 - DNA, 20 bp, mouse
ggctgtacttcttctattta

SEQ ID NO: 613583 - DNA, 20 bp, mouse
ggttggagttaaaaagcagg

SEQ ID NO: 613584 - DNA, 20 bp, mouse
gttgctttcatacactcctt

SEQ ID NO: 613585 - DNA, 20 bp, mouse
gtcatcccacaatactcagc

SEQ ID NO: 613586 - DNA, 20 bp, mouse
gcagttggcaggccagaggt

SEQ ID NO: 613587 - DNA, 20 bp, mouse
ggaggttgaagagtatctca

SEQ ID NO: 613588 - DNA, 20 bp, mouse
gatcatggcaggccaacctc

SEQ ID NO: 613589 - DNA, 20 bp, mouse
gtataggcagcaggcactct

SEQ ID NO: 613590 - DNA, 20 bp, mouse
gtagccctgctgttccatca

SEQ ID NO: 613591 - DNA, 20 bp, mouse
gatctcagggagaggattag

SEQ ID NO: 613592 - DNA, 20 bp, mouse
gctgccatgatggaacagca

SEQ ID NO: 613593 - DNA, 20 bp, mouse
ggtgaaagtacagaaatcca

SEQ ID NO: 613594 - DNA, 20 bp, mouse
gggtcacctcctcctgcagt

SEQ ID NO: 613595 - DNA, 20 bp, mouse
gtcctgtcaccattgactgt

SEQ ID NO: 613596 - DNA, 20 bp, mouse
ggagctgcgggcggtcaggt

SEQ ID NO: 613597 - DNA, 20 bp, mouse
gctgcgggcggtcaggtagg

SEQ ID NO: 613598 - DNA, 20 bp, mouse
gggcagcggtggactcgcgt

SEQ ID NO: 613599 - DNA, 20 bp, mouse
gctcgcgtcggagctgcggg

SEQ ID NO: 613600 - DNA, 20 bp, mouse
ggcgcatgcgcagaaggcag

SEQ ID NO: 613601 - DNA, 20 bp, mouse
ggaaggagggtctgcgacca

SEQ ID NO: 613602 - DNA, 20 bp, mouse
gatgcgcagaaggcagcggg

SEQ ID NO: 613603 - DNA, 20 bp, mouse
gggtctgcgaccagggactg

SEQ ID NO: 613604 - DNA, 20 bp, mouse
ggggctcaggagcgattcgg

SEQ ID NO: 613605 - DNA, 20 bp, mouse
gggagatgagatgcagctgg

SEQ ID NO: 613606 - DNA, 20 bp, mouse
gctacttcgctcgctctcgg

SEQ ID NO: 613607 - DNA, 20 bp, mouse
gtcggcggccgctcttgctg

SEQ ID NO: 613608 - DNA, 20 bp, mouse
gccagcaccgcggcgagagg

SEQ ID NO: 613609 - DNA, 20 bp, mouse
gtcgctacttcgctcgctct

SEQ ID NO: 613610 - DNA, 20 bp, mouse
ggccggggccgagcttgagg

SEQ ID NO: 613611 - DNA, 20 bp, mouse
gctcgccgcggtgctggtgg

SEQ ID NO: 613612 - DNA, 20 bp, mouse
gtgggctccgcggtccccgg

SEQ ID NO: 613613 - DNA, 20 bp, mouse
ggccgggcccacggcgcagg

SEQ ID NO: 613614 - DNA, 20 bp, mouse
gcggtccggcgggttcaaag

SEQ ID NO: 613615 - DNA, 20 bp, mouse
gagcgcgccggtaaccgccg

SEQ ID NO: 613616 - DNA, 20 bp, mouse
gctcacctccgacctggaag

SEQ ID NO: 613617 - DNA, 20 bp, mouse
gcctccagacagaagcggtg

SEQ ID NO: 613618 - DNA, 20 bp, mouse
ggtcggaggtgagggtccaa

SEQ ID NO: 613619 - DNA, 20 bp, mouse
gtttcctcaccgcttctgtc

SEQ ID NO: 613620 - DNA, 20 bp, mouse
gtctgcagtcaaaaagggag

SEQ ID NO: 613621 - DNA, 20 bp, mouse
ggctgcaaggaggggaatag

SEQ ID NO: 613622 - DNA, 20 bp, mouse
gatctccccttccaggtcgg

SEQ ID NO: 613623 - DNA, 20 bp, mouse
gagtatcttagtaggcagag

SEQ ID NO: 613624 - DNA, 20 bp, mouse
gcttcagtgacgcttaggag

SEQ ID NO: 613625 - DNA, 20 bp, mouse
gaactctacagtatcttagt

SEQ ID NO: 613626 - DNA, 20 bp, mouse
gcccccagccagaacagaaa

SEQ ID NO: 613627 - DNA, 20 bp, mouse
gaaggggagatctttcatcc

SEQ ID NO: 613628 - DNA, 20 bp, mouse
gactcaacttcaggtcacag

SEQ ID NO: 613629 - DNA, 20 bp, mouse
gccttcctggccagaggtga

SEQ ID NO: 613630 - DNA, 20 bp, mouse
gtgtgcagaagtcacaggag

SEQ ID NO: 613631 - DNA, 20 bp, mouse
gcttgccctggcgaaagaag

SEQ ID NO: 613632 - DNA, 20 bp, mouse
gaccaagaggaggagttgca

SEQ ID NO: 613633 - DNA, 20 bp, mouse
gaatcagtgacagttaggaa

SEQ ID NO: 613634 - DNA, 20 bp, mouse
gatctttggaccctcacctc

SEQ ID NO: 613635 - DNA, 20 bp, mouse
gggtcttcctccctccgcca

SEQ ID NO: 613636 - DNA, 20 bp, mouse
gacaggcccgacgaatatac

SEQ ID NO: 613637 - DNA, 20 bp, mouse
gacaggcttggcatacaagg

SEQ ID NO: 613638 - DNA, 20 bp, mouse
gatgcagtgatcaaccccag

SEQ ID NO: 613639 - DNA, 20 bp, mouse
gcttctcctgtatattcgtc

SEQ ID NO: 613640 - DNA, 20 bp, mouse
gatattcgtcgggcctgttg

SEQ ID NO: 613641 - DNA, 20 bp, mouse
gacagctgcttttccctctg

SEQ ID NO: 613642 - DNA, 20 bp, mouse
ggagcctcagagactaggac

SEQ ID NO: 613643 - DNA, 20 bp, mouse
gtttcctgtcctagtctctg

SEQ ID NO: 613644 - DNA, 20 bp, mouse
gagacacaggggcaacataa

SEQ ID NO: 613645 - DNA, 20 bp, mouse
gctaggacaggaaaagacac

SEQ ID NO: 613646 - DNA, 20 bp, mouse
gcgcaggctaggcatgaagg

SEQ ID NO: 613647 - DNA, 20 bp, mouse
ggcccgcaggctaggcatga

SEQ ID NO: 613648 - DNA, 20 bp, mouse
gaaggcggcgacaccggtgg

SEQ ID NO: 613649 - DNA, 20 bp, mouse
gggcatgaaggcggcgacac

SEQ ID NO: 613650 - DNA, 20 bp, mouse
gatgaaggcggcgacaccgg

SEQ ID NO: 613651 - DNA, 20 bp, mouse
gaaggagcgcgaaggccccg

SEQ ID NO: 613652 - DNA, 20 bp, mouse
gcagcagggacaacgcccgc

SEQ ID NO: 613653 - DNA, 20 bp, mouse
gccttgcacaccggacacga

SEQ ID NO: 613654 - DNA, 20 bp, mouse
gaagggcccggctccatcgc

SEQ ID NO: 613655 - DNA, 20 bp, mouse
ggggacaacgcccgcaggct

SEQ ID NO: 613656 - DNA, 20 bp, mouse
gccggcgcaggcgaaaccac

SEQ ID NO: 613657 - DNA, 20 bp, mouse
gccacgggcgcgggagagtg

SEQ ID NO: 613658 - DNA, 20 bp, mouse
gtgtgggcgagtccccgagg

SEQ ID NO: 613659 - DNA, 20 bp, mouse
ggggagccgcgaatgacgcc

SEQ ID NO: 613660 - DNA, 20 bp, mouse
ggtgcgtacctgagagtctg

SEQ ID NO: 613661 - DNA, 20 bp, mouse
gggcagccgggcgtcattcg

SEQ ID NO: 613662 - DNA, 20 bp, mouse
gggccctagcagggtcgtgt

SEQ ID NO: 613663 - DNA, 20 bp, mouse
gcgccgggtgacattaacca

SEQ ID NO: 613664 - DNA, 20 bp, mouse
gagcagccaggcggagactg

SEQ ID NO: 613665 - DNA, 20 bp, mouse
gagccaggcggagactgggg

SEQ ID NO: 613666 - DNA, 20 bp, mouse
gccgccgcggggcccgtccg

SEQ ID NO: 613667 - DNA, 20 bp, mouse
gcaaacaccaacggtaacca

SEQ ID NO: 613668 - DNA, 20 bp, mouse
gtagctgccctggttaccgt

SEQ ID NO: 613669 - DNA, 20 bp, mouse
gtagaggcgcggcaacgggg

SEQ ID NO: 613670 - DNA, 20 bp, mouse
gaccagggcagctagaggcg

SEQ ID NO: 613671 - DNA, 20 bp, mouse
gccgcggggcccgtccgggg

SEQ ID NO: 613672 - DNA, 20 bp, mouse
gatcccgtcgggttccccac

SEQ ID NO: 613673 - DNA, 20 bp, mouse
gggtgtttgcgaattctctg

SEQ ID NO: 613674 - DNA, 20 bp, mouse
gtagccggtggggaacccga

SEQ ID NO: 613675 - DNA, 20 bp, mouse
ggagaattcgcaaacaccaa

SEQ ID NO: 613676 - DNA, 20 bp, mouse
gagcacggtgaagataagaa

SEQ ID NO: 613677 - DNA, 20 bp, mouse
gctcactgggtgagacatca

SEQ ID NO: 613678 - DNA, 20 bp, mouse
ggagaacctcaggcccaaca

SEQ ID NO: 613679 - DNA, 20 bp, mouse
gatgggctcagactttagca

SEQ ID NO: 613680 - DNA, 20 bp, mouse
gacccagtgagcatcaactg

SEQ ID NO: 613681 - DNA, 20 bp, mouse
gtccacagttgatgctcact

SEQ ID NO: 613682 - DNA, 20 bp, mouse
ggacatcatggccttgcaga

SEQ ID NO: 613683 - DNA, 20 bp, mouse
gaaacagggtggaagatgtt

SEQ ID NO: 613684 - DNA, 20 bp, mouse
ggcgctgttattgggaagat

SEQ ID NO: 613685 - DNA, 20 bp, mouse
gttagattggacacttgtag

SEQ ID NO: 613686 - DNA, 20 bp, mouse
gcggtctccgggtcaattct

SEQ ID NO: 613687 - DNA, 20 bp, mouse
gaaggcggcggtgtattacg

SEQ ID NO: 613688 - DNA, 20 bp, mouse
gggagggttgctgtttaagg

SEQ ID NO: 613689 - DNA, 20 bp, mouse
gctgggaaccgcagaggcct

SEQ ID NO: 613690 - DNA, 20 bp, mouse
gccctcccccagaattgacc

SEQ ID NO: 613691 - DNA, 20 bp, mouse
gggcgagacgccgaacccca

SEQ ID NO: 613692 - DNA, 20 bp, mouse
ggcggtcccccggagactga

SEQ ID NO: 613693 - DNA, 20 bp, mouse
ggagacgccgaaccccatgg

SEQ ID NO: 613694 - DNA, 20 bp, mouse
gctcaagctggtcctcggtg

SEQ ID NO: 613695 - DNA, 20 bp, mouse
gggcgcccaggtgaccagag

SEQ ID NO: 613696 - DNA, 20 bp, mouse
ggcctgtgaaactagggaga

SEQ ID NO: 613697 - DNA, 20 bp, mouse
gtcacatgcctgtgaaacta

SEQ ID NO: 613698 - DNA, 20 bp, mouse
gttcagtgagtgcagctcat

SEQ ID NO: 613699 - DNA, 20 bp, mouse
gaagtggggtaaagaagagg

SEQ ID NO: 613700 - DNA, 20 bp, mouse
gcttcagcagtgaattatca

SEQ ID NO: 613701 - DNA, 20 bp, mouse
gagggtgctcaaacaagaag

SEQ ID NO: 613702 - DNA, 20 bp, mouse
ggcatgtgagtgtatataat

SEQ ID NO: 613703 - DNA, 20 bp, mouse
gtccaaggatgacctaaaaa

SEQ ID NO: 613704 - DNA, 20 bp, mouse
gaaaggagagatttgaggta

SEQ ID NO: 613705 - DNA, 20 bp, mouse
gatctgctggtcttctccct

SEQ ID NO: 613706 - DNA, 20 bp, mouse
gtagcgccatcctaccgacc

SEQ ID NO: 613707 - DNA, 20 bp, mouse
gccatcctaccgaccaggca

SEQ ID NO: 613708 - DNA, 20 bp, mouse
gctccgtgctccaaccgcag

SEQ ID NO: 613709 - DNA, 20 bp, mouse
gaccagtgccggaagctgag

SEQ ID NO: 613710 - DNA, 20 bp, mouse
gggcacggacgattgcagaa

SEQ ID NO: 613711 - DNA, 20 bp, mouse
gggatggcgctaggccgctg

SEQ ID NO: 613712 - DNA, 20 bp, mouse
gagagcgaccggaaacgaga

SEQ ID NO: 613713 - DNA, 20 bp, mouse
gagcttccggcactggtcct

SEQ ID NO: 613714 - DNA, 20 bp, mouse
ggcaatcgtccgtgcctggt

SEQ ID NO: 613715 - DNA, 20 bp, mouse
ggcaggccaggggagcgttg

SEQ ID NO: 613716 - DNA, 20 bp, mouse
gctgccagcctcacgagagt

SEQ ID NO: 613717 - DNA, 20 bp, mouse
gcaggcaggagaacagccgg

SEQ ID NO: 613718 - DNA, 20 bp, mouse
ggctggcagtttgggaattg

SEQ ID NO: 613719 - DNA, 20 bp, mouse
gctcgtgaggctggcagttt

SEQ ID NO: 613720 - DNA, 20 bp, mouse
gatgaggccttcacaggtgg

SEQ ID NO: 613721 - DNA, 20 bp, mouse
gcagtttatgaggccttcac

SEQ ID NO: 613722 - DNA, 20 bp, mouse
gggaagttggccagtttatg

SEQ ID NO: 613723 - DNA, 20 bp, mouse
ggagtgggcaagggtccctt

SEQ ID NO: 613724 - DNA, 20 bp, mouse
gctgcccctacaaggatgag

SEQ ID NO: 613725 - DNA, 20 bp, mouse
ggggaattgtggcaggaagt

SEQ ID NO: 613726 - DNA, 20 bp, mouse
gccctgtttgtatttaaaat

SEQ ID NO: 613727 - DNA, 20 bp, mouse
ggaaagttccaggaaaacta

SEQ ID NO: 613728 - DNA, 20 bp, mouse
gtatttgcattttttttctt

SEQ ID NO: 613729 - DNA, 20 bp, mouse
gtcctattttaaatacaaac

SEQ ID NO: 613730 - DNA, 20 bp, mouse
gaaacactctacctctggtc

SEQ ID NO: 613731 - DNA, 20 bp, mouse
ggttagaaacactctacctc

SEQ ID NO: 613732 - DNA, 20 bp, mouse
ggggacgaggataattgctt

SEQ ID NO: 613733 - DNA, 20 bp, mouse
gtgtgtagccctagttttcc

SEQ ID NO: 613734 - DNA, 20 bp, mouse
gtcattcttctccagaccag

SEQ ID NO: 613735 - DNA, 20 bp, mouse
gtagcagtgtctggagcaaa

SEQ ID NO: 613736 - DNA, 20 bp, mouse
ggttagaaacactccacttc

SEQ ID NO: 613737 - DNA, 20 bp, mouse
ggggaccggaataattgctt

SEQ ID NO: 613738 - DNA, 20 bp, mouse
gtaacccacattatacccca

SEQ ID NO: 613739 - DNA, 20 bp, mouse
gcttacccaagcaattattc

SEQ ID NO: 613740 - DNA, 20 bp, mouse
gttcttctccagaccagaag

SEQ ID NO: 613741 - DNA, 20 bp, mouse
gtatttgcattttttccttg

SEQ ID NO: 613742 - DNA, 20 bp, mouse
gtttccttggggtataatgt

SEQ ID NO: 613743 - DNA, 20 bp, mouse
gaaacactccacttctggtc

SEQ ID NO: 613744 - DNA, 20 bp, mouse
gcctatttttaaatacaaac

SEQ ID NO: 613745 - DNA, 20 bp, mouse
gtagcagtgtctggagcaaa

SEQ ID NO: 613746 - DNA, 20 bp, mouse
gatagatgagctctcttaag

SEQ ID NO: 613747 - DNA, 20 bp, mouse
gaaaagggaggaaatgggtg

SEQ ID NO: 613748 - DNA, 20 bp, mouse
ggcatttgcatttttttctt

SEQ ID NO: 613749 - DNA, 20 bp, mouse
ggggacgaggataattgctt

SEQ ID NO: 613750 - DNA, 20 bp, mouse
gaaacactctacctctggtc

SEQ ID NO: 613751 - DNA, 20 bp, mouse
ggttagaaacactctacctc

SEQ ID NO: 613752 - DNA, 20 bp, mouse
gcctatttttaaatacaaac

SEQ ID NO: 613753 - DNA, 20 bp, mouse
gtaagtgggattattctaaa

SEQ ID NO: 613754 - DNA, 20 bp, mouse
gtgcttgtggagattggcca

SEQ ID NO: 613755 - DNA, 20 bp, mouse
gttagtaaaagggaggaaat

SEQ ID NO: 613756 - DNA, 20 bp, mouse
ggcgcggcgaagagaccgag

SEQ ID NO: 613757 - DNA, 20 bp, mouse
gaagtggcgcgcgagggacg

SEQ ID NO: 613758 - DNA, 20 bp, mouse
ggcctcagcagctgcagacg

SEQ ID NO: 613759 - DNA, 20 bp, mouse
ggcctgggcgccatggacgt

SEQ ID NO: 613760 - DNA, 20 bp, mouse
gtgcagctgctgaggcctga

SEQ ID NO: 613761 - DNA, 20 bp, mouse
ggcgaggagctgcctcccga

SEQ ID NO: 613762 - DNA, 20 bp, mouse
gggacgaggccgaggcctag

SEQ ID NO: 613763 - DNA, 20 bp, mouse
gcgtcacacgtgccgtcggg

SEQ ID NO: 613764 - DNA, 20 bp, mouse
gtcgcaggccgcgcccactc

SEQ ID NO: 613765 - DNA, 20 bp, mouse
gcgcggcgcaggggccgacg

SEQ ID NO: 613766 - DNA, 20 bp, mouse
gcgggctctcccagagtgag

SEQ ID NO: 613767 - DNA, 20 bp, mouse
gtgcccctggcccctcactc

SEQ ID NO: 613768 - DNA, 20 bp, mouse
gctccgggcgatgaggtagt

SEQ ID NO: 613769 - DNA, 20 bp, mouse
ggcgcgccctccgggcgatg

SEQ ID NO: 613770 - DNA, 20 bp, mouse
gcttgcgaggaggacgatgt

SEQ ID NO: 613771 - DNA, 20 bp, mouse
gcgatgaggtagtgggtcct

SEQ ID NO: 613772 - DNA, 20 bp, mouse
ggacggctctagggcctcct

SEQ ID NO: 613773 - DNA, 20 bp, mouse
gacgatgtgggtgatccagg

SEQ ID NO: 613774 - DNA, 20 bp, mouse
gtgactggtgtgggatgcag

SEQ ID NO: 613775 - DNA, 20 bp, mouse
gaggcggggcgacggctcta

SEQ ID NO: 613776 - DNA, 20 bp, mouse
ggccaggatcgggcacccgg

SEQ ID NO: 613777 - DNA, 20 bp, mouse
gttaatgcaggagccgggtg

SEQ ID NO: 613778 - DNA, 20 bp, mouse
ggcccccgggtgcccgatcc

SEQ ID NO: 613779 - DNA, 20 bp, mouse
gtggctgctgctgcgaaccc

SEQ ID NO: 613780 - DNA, 20 bp, mouse
ggcaccagggctatgagaag

SEQ ID NO: 613781 - DNA, 20 bp, mouse
gtcgcagcagcagccaggat

SEQ ID NO: 613782 - DNA, 20 bp, mouse
gcgaacccggggcttaatgc

SEQ ID NO: 613783 - DNA, 20 bp, mouse
gaggagccgggtggggtgaa

SEQ ID NO: 613784 - DNA, 20 bp, mouse
gtcgcagccatcccggtcag

SEQ ID NO: 613785 - DNA, 20 bp, mouse
gagaagctgcccggacccag

SEQ ID NO: 613786 - DNA, 20 bp, mouse
ggtagcggcggagccatgga

SEQ ID NO: 613787 - DNA, 20 bp, mouse
ggtgtcaccggctcccggag

SEQ ID NO: 613788 - DNA, 20 bp, mouse
gacaggcggtgcccgggtag

SEQ ID NO: 613789 - DNA, 20 bp, mouse
gggagcggttccaggcagat

SEQ ID NO: 613790 - DNA, 20 bp, mouse
gtcccaggcgggagcagcac

SEQ ID NO: 613791 - DNA, 20 bp, mouse
gggccgcagggtagtgtcac

SEQ ID NO: 613792 - DNA, 20 bp, mouse
gaaaggcccgctgccgtcca

SEQ ID NO: 613793 - DNA, 20 bp, mouse
gggcagatggggcagctgaa

SEQ ID NO: 613794 - DNA, 20 bp, mouse
gagcagcacaggcggtgccc

SEQ ID NO: 613795 - DNA, 20 bp, mouse
gagccggtgacactaccctg

SEQ ID NO: 613796 - DNA, 20 bp, mouse
gctccttaccttgtactccc

SEQ ID NO: 613797 - DNA, 20 bp, mouse
gatttccttatcacatttga

SEQ ID NO: 613798 - DNA, 20 bp, mouse
ggaatccatcaaatgtgata

SEQ ID NO: 613799 - DNA, 20 bp, mouse
gaggttcagacagacaggac

SEQ ID NO: 613800 - DNA, 20 bp, mouse
gccatcaggttcagacagac

SEQ ID NO: 613801 - DNA, 20 bp, mouse
gcacaggatcacagcaacta

SEQ ID NO: 613802 - DNA, 20 bp, mouse
ggaccacaatctgcactcac

SEQ ID NO: 613803 - DNA, 20 bp, mouse
gttcatgaagaatttaaagg

SEQ ID NO: 613804 - DNA, 20 bp, mouse
gcaattcatgaagaatttaa

SEQ ID NO: 613805 - DNA, 20 bp, mouse
gtgtggccaacatagtagag

SEQ ID NO: 613806 - DNA, 20 bp, mouse
gtccgcatactctagagctt

SEQ ID NO: 613807 - DNA, 20 bp, mouse
gaaaacgctttaaaaagcag

SEQ ID NO: 613808 - DNA, 20 bp, mouse
gcatttgcattttcaaacag

SEQ ID NO: 613809 - DNA, 20 bp, mouse
gaccaaagctctagagtatg

SEQ ID NO: 613810 - DNA, 20 bp, mouse
ggtcatagacaacaatgttc

SEQ ID NO: 613811 - DNA, 20 bp, mouse
gcagattgtgaatcggaagg

SEQ ID NO: 613812 - DNA, 20 bp, mouse
ggagactaaatctggacaac

SEQ ID NO: 613813 - DNA, 20 bp, mouse
gtcctgtaaaagcgggggag

SEQ ID NO: 613814 - DNA, 20 bp, mouse
gggaagggggagactaaatc

SEQ ID NO: 613815 - DNA, 20 bp, mouse
gcagaacttcaaggtatttc

SEQ ID NO: 613816 - DNA, 20 bp, mouse
gggccgcactgtagcatcag

SEQ ID NO: 613817 - DNA, 20 bp, mouse
gagctgtgcgcatggcgtgg

SEQ ID NO: 613818 - DNA, 20 bp, mouse
gcccgggccagggagacatt

SEQ ID NO: 613819 - DNA, 20 bp, mouse
gggtggtgcacgcagacggt

SEQ ID NO: 613820 - DNA, 20 bp, mouse
ggcagctggtcctggagttc

SEQ ID NO: 613821 - DNA, 20 bp, mouse
gaggctctttgaagacctcc

SEQ ID NO: 613822 - DNA, 20 bp, mouse
ggcgtggcggctgactgtgc

SEQ ID NO: 613823 - DNA, 20 bp, mouse
gctgactgtgccggaactcc

SEQ ID NO: 613824 - DNA, 20 bp, mouse
gagcctctgatgctacagtg

SEQ ID NO: 613825 - DNA, 20 bp, mouse
gccgggtgatagatgctctg

SEQ ID NO: 613826 - DNA, 20 bp, mouse
gcggagctgccgggcatgtg

SEQ ID NO: 613827 - DNA, 20 bp, mouse
ggcagctgactggagcctcg

SEQ ID NO: 613828 - DNA, 20 bp, mouse
gcttgtgcggggcttccccg

SEQ ID NO: 613829 - DNA, 20 bp, mouse
gaggcagcagccagcagcct

SEQ ID NO: 613830 - DNA, 20 bp, mouse
gcacctctgcctcacatgcc

SEQ ID NO: 613831 - DNA, 20 bp, mouse
gacagaagcacgcagctgac

SEQ ID NO: 613832 - DNA, 20 bp, mouse
ggcctacggccccctcagca

SEQ ID NO: 613833 - DNA, 20 bp, mouse
gccctcagcgcccgtcgggt

SEQ ID NO: 613834 - DNA, 20 bp, mouse
gcaacgggcgctgaggacta

SEQ ID NO: 613835 - DNA, 20 bp, mouse
gctccgaagccagaaggcgc

SEQ ID NO: 613836 - DNA, 20 bp, mouse
ggcccaaagagtgaccaaga

SEQ ID NO: 613837 - DNA, 20 bp, mouse
gcaaagagtgaccaagaggg

SEQ ID NO: 613838 - DNA, 20 bp, mouse
ggacaggaggagaatttcac

SEQ ID NO: 613839 - DNA, 20 bp, mouse
gagctacaagcgcctggtga

SEQ ID NO: 613840 - DNA, 20 bp, mouse
ggcctaaactgaccgaggaa

SEQ ID NO: 613841 - DNA, 20 bp, mouse
gcccacctggaagacgtcgt

SEQ ID NO: 613842 - DNA, 20 bp, mouse
gtccaggtgggctcagggag

SEQ ID NO: 613843 - DNA, 20 bp, mouse
gcaacgacagggccacagcg

SEQ ID NO: 613844 - DNA, 20 bp, mouse
gacccttcctcggtcagttt

SEQ ID NO: 613845 - DNA, 20 bp, mouse
gtggcagggcaagatcacca

SEQ ID NO: 613846 - DNA, 20 bp, mouse
gagggaaaggtgctcccgaa

SEQ ID NO: 613847 - DNA, 20 bp, mouse
gcccgaacggcttctgtaag

SEQ ID NO: 613848 - DNA, 20 bp, mouse
gggcaagggagaatgaccac

SEQ ID NO: 613849 - DNA, 20 bp, mouse
ggagtgtgctgccaagggaa

SEQ ID NO: 613850 - DNA, 20 bp, mouse
gttccaggcctggctcagat

SEQ ID NO: 613851 - DNA, 20 bp, mouse
ggcctggctcagatgggtga

SEQ ID NO: 613852 - DNA, 20 bp, mouse
gcctacctggaagatgtcac

SEQ ID NO: 613853 - DNA, 20 bp, mouse
ggtctcagaaaactctctaa

SEQ ID NO: 613854 - DNA, 20 bp, mouse
gtccctgagtgtgctgccaa

SEQ ID NO: 613855 - DNA, 20 bp, mouse
gagtccttggaattatttcc

SEQ ID NO: 613856 - DNA, 20 bp, mouse
ggactctcccagcaggaccg

SEQ ID NO: 613857 - DNA, 20 bp, mouse
ggcaggtagtcaactgctgg

SEQ ID NO: 613858 - DNA, 20 bp, mouse
gtggcggtagcgggatttcg

SEQ ID NO: 613859 - DNA, 20 bp, mouse
gagtcaactgctggcggtag

SEQ ID NO: 613860 - DNA, 20 bp, mouse
gacccagccacagctgatcc

SEQ ID NO: 613861 - DNA, 20 bp, mouse
ggcccgggacaactactctg

SEQ ID NO: 613862 - DNA, 20 bp, mouse
gcttgcaggtagtcaactgc

SEQ ID NO: 613863 - DNA, 20 bp, mouse
gggctgggtaaggagagccc

SEQ ID NO: 613864 - DNA, 20 bp, mouse
ggagcccgggaaggcggatg

SEQ ID NO: 613865 - DNA, 20 bp, mouse
gaaggctagatctctctgta

SEQ ID NO: 613866 - DNA, 20 bp, mouse
ggagctgctgccacaagcta

SEQ ID NO: 613867 - DNA, 20 bp, mouse
gtgcagaccgctagggtaat

SEQ ID NO: 613868 - DNA, 20 bp, mouse
gcaagctaaggccatggcca

SEQ ID NO: 613869 - DNA, 20 bp, mouse
ggccatggccacggcacccg

SEQ ID NO: 613870 - DNA, 20 bp, mouse
ggcagctcctattaccctag

SEQ ID NO: 613871 - DNA, 20 bp, mouse
gccttctatgcagaccgcta

SEQ ID NO: 613872 - DNA, 20 bp, mouse
gtccccgggtgccgtggcca

SEQ ID NO: 613873 - DNA, 20 bp, mouse
gagtcgctccccgggtgccg

SEQ ID NO: 613874 - DNA, 20 bp, mouse
gagaagtcggacagcgctca

SEQ ID NO: 613875 - DNA, 20 bp, mouse
gcctgaagggacccctgcac

SEQ ID NO: 613876 - DNA, 20 bp, mouse
ggcgcacggcgagggctccc

SEQ ID NO: 613877 - DNA, 20 bp, mouse
ggagcgcgcgaagcgaggag

SEQ ID NO: 613878 - DNA, 20 bp, mouse
ggcgacggcgcgcacggcga

SEQ ID NO: 613879 - DNA, 20 bp, mouse
gaggcgggcgaggcgggcga

SEQ ID NO: 613880 - DNA, 20 bp, mouse
ggcgggcgctcgagaaagag

SEQ ID NO: 613881 - DNA, 20 bp, mouse
gaggcgggcgacggcgcgca

SEQ ID NO: 613882 - DNA, 20 bp, mouse
ggcctggtgcggacactgcg

SEQ ID NO: 613883 - DNA, 20 bp, mouse
ggcgctcgcgggtggagcag

SEQ ID NO: 613884 - DNA, 20 bp, mouse
ggcctcgcagtgtccgcacc

SEQ ID NO: 613885 - DNA, 20 bp, mouse
gcgccgccgacttgaggatg

SEQ ID NO: 613886 - DNA, 20 bp, mouse
gaagtcctcggcactgatcc

SEQ ID NO: 613887 - DNA, 20 bp, mouse
gccaggcacggattccagat

SEQ ID NO: 613888 - DNA, 20 bp, mouse
gctggaaggagccgtctcct

SEQ ID NO: 613889 - DNA, 20 bp, mouse
gccagtgggacagcaacgac

SEQ ID NO: 613890 - DNA, 20 bp, mouse
gcgtgcctggatcagtgccg

SEQ ID NO: 613891 - DNA, 20 bp, mouse
ggtccggctttagtactgga

SEQ ID NO: 613892 - DNA, 20 bp, mouse
gtggagtccggctttagtac

SEQ ID NO: 613893 - DNA, 20 bp, mouse
ggccggactccaggaaaaag

SEQ ID NO: 613894 - DNA, 20 bp, mouse
gaactcaaggaaactcaaag

SEQ ID NO: 613895 - DNA, 20 bp, mouse
ggagtcccgagtggattcag

SEQ ID NO: 613896 - DNA, 20 bp, mouse
ggtcctgcctgctcagttgt

SEQ ID NO: 613897 - DNA, 20 bp, mouse
gcagcaggaatggcccacgt

SEQ ID NO: 613898 - DNA, 20 bp, mouse
gagcctcgctcaatttccca

SEQ ID NO: 613899 - DNA, 20 bp, mouse
gtgcccacaactgagcaggc

SEQ ID NO: 613900 - DNA, 20 bp, mouse
gggaatggcccacgtaggca

SEQ ID NO: 613901 - DNA, 20 bp, mouse
gcagttgtgggcagctcctt

SEQ ID NO: 613902 - DNA, 20 bp, mouse
gactgcatccatgcctacgt

SEQ ID NO: 613903 - DNA, 20 bp, mouse
gctccttgggaaattgagcg

SEQ ID NO: 613904 - DNA, 20 bp, mouse
gacctgttagagaaagcggg

SEQ ID NO: 613905 - DNA, 20 bp, mouse
gaactgcctatgtaacaata

SEQ ID NO: 613906 - DNA, 20 bp, mouse
ggtcctgcctgctcagttgt

SEQ ID NO: 613907 - DNA, 20 bp, mouse
gcagcaggaatggcccacgt

SEQ ID NO: 613908 - DNA, 20 bp, mouse
gagcctcgctcaatttccca

SEQ ID NO: 613909 - DNA, 20 bp, mouse
gtgcccacaactgagcaggc

SEQ ID NO: 613910 - DNA, 20 bp, mouse
gggaatggcccacgtaggca

SEQ ID NO: 613911 - DNA, 20 bp, mouse
gcagttgtgggcagctcctt

SEQ ID NO: 613912 - DNA, 20 bp, mouse
gactgcatccatgcctacgt

SEQ ID NO: 613913 - DNA, 20 bp, mouse
gctccttgggaaattgagcg

SEQ ID NO: 613914 - DNA, 20 bp, mouse
gacctgttagagaaagcggg

SEQ ID NO: 613915 - DNA, 20 bp, mouse
gaactgcctatgtaacaata

SEQ ID NO: 613916 - DNA, 20 bp, mouse
gaggctgcgctggaccgaag

SEQ ID NO: 613917 - DNA, 20 bp, mouse
gcggctggttccgggttgag

SEQ ID NO: 613918 - DNA, 20 bp, mouse
gcttacccgcaccagctcag

SEQ ID NO: 613919 - DNA, 20 bp, mouse
gctgcgctggaccgaagcgg

SEQ ID NO: 613920 - DNA, 20 bp, mouse
gccaggcgaggaggatctag

SEQ ID NO: 613921 - DNA, 20 bp, mouse
gaggaggagatcccgaagag

SEQ ID NO: 613922 - DNA, 20 bp, mouse
gccagcgcagcctctcaacc

SEQ ID NO: 613923 - DNA, 20 bp, mouse
gcgggtcctggtagatgctc

SEQ ID NO: 613924 - DNA, 20 bp, mouse
gaccaggacccggtgagcct

SEQ ID NO: 613925 - DNA, 20 bp, mouse
gagggatagatgctgcgagg

SEQ ID NO: 613926 - DNA, 20 bp, mouse
ggacagaagtcgggggtcag

SEQ ID NO: 613927 - DNA, 20 bp, mouse
gagaccaagacagaagtcgg

SEQ ID NO: 613928 - DNA, 20 bp, mouse
gagacaaagaggatccgagt

SEQ ID NO: 613929 - DNA, 20 bp, mouse
gtcaggggacgaagacaaag

SEQ ID NO: 613930 - DNA, 20 bp, mouse
ggacttggtgtgacgcaggt

SEQ ID NO: 613931 - DNA, 20 bp, mouse
gctgacctggaagatgtcgt

SEQ ID NO: 613932 - DNA, 20 bp, mouse
gagacccccgggaagggcta

SEQ ID NO: 613933 - DNA, 20 bp, mouse
gaagaggatccgagtgggtt

SEQ ID NO: 613934 - DNA, 20 bp, mouse
ggccctgcctagcactgacc

SEQ ID NO: 613935 - DNA, 20 bp, mouse
gcagccctagcccttcccgg

SEQ ID NO: 613936 - DNA, 20 bp, mouse
gagcaactgagcggccatgg

SEQ ID NO: 613937 - DNA, 20 bp, mouse
gatggccgctcagttgctgg

SEQ ID NO: 613938 - DNA, 20 bp, mouse
ggccgctcagttgctggagg

SEQ ID NO: 613939 - DNA, 20 bp, mouse
gtcctcctccagcaactgag

SEQ ID NO: 613940 - DNA, 20 bp, mouse
gcggtagcgacctaagcaga

SEQ ID NO: 613941 - DNA, 20 bp, mouse
ggagtcccggcgcggagtca

SEQ ID NO: 613942 - DNA, 20 bp, mouse
gctgggcctcgcttccgcca

SEQ ID NO: 613943 - DNA, 20 bp, mouse
ggtgctcagatctcttaaag

SEQ ID NO: 613944 - DNA, 20 bp, mouse
ggcccgcagggcagcgtcac

SEQ ID NO: 613945 - DNA, 20 bp, mouse
gcagcagcgcccgctcgtgg

SEQ ID NO: 613946 - DNA, 20 bp, mouse
gcaggagcaggtgagtgttt

SEQ ID NO: 613947 - DNA, 20 bp, mouse
gggacttcaggtgaagtagc

SEQ ID NO: 613948 - DNA, 20 bp, mouse
gggggtggggatctgccaac

SEQ ID NO: 613949 - DNA, 20 bp, mouse
ggctggaacctgccccgatc

SEQ ID NO: 613950 - DNA, 20 bp, mouse
gtactgcaggagagtgcagg

SEQ ID NO: 613951 - DNA, 20 bp, mouse
gtaacaggctcccgcagcag

SEQ ID NO: 613952 - DNA, 20 bp, mouse
gactgtgacgtcacaagata

SEQ ID NO: 613953 - DNA, 20 bp, mouse
gtaaatgagctgccggatcg

SEQ ID NO: 613954 - DNA, 20 bp, mouse
gttatggaccgagtcctcaa

SEQ ID NO: 613955 - DNA, 20 bp, mouse
gcagaggcacccagaggatt

SEQ ID NO: 613956 - DNA, 20 bp, mouse
gagagcagcggcccgagcag

SEQ ID NO: 613957 - DNA, 20 bp, mouse
gagcggcccgagcagcggta

SEQ ID NO: 613958 - DNA, 20 bp, mouse
gtcaataccggcctacgagg

SEQ ID NO: 613959 - DNA, 20 bp, mouse
gggctcgggaatccccctcc

SEQ ID NO: 613960 - DNA, 20 bp, mouse
gaactcctgggcgcgcggca

SEQ ID NO: 613961 - DNA, 20 bp, mouse
gctctgagctgcctcctcgt

SEQ ID NO: 613962 - DNA, 20 bp, mouse
gctggccaagagctgggtag

SEQ ID NO: 613963 - DNA, 20 bp, mouse
gcgtggcgcggccaaggtca

SEQ ID NO: 613964 - DNA, 20 bp, mouse
gttccagagcgagagtaacg

SEQ ID NO: 613965 - DNA, 20 bp, mouse
gggcgcgcggcacggcgggc

SEQ ID NO: 613966 - DNA, 20 bp, mouse
gtccgcagcgtaggaagcag

SEQ ID NO: 613967 - DNA, 20 bp, mouse
ggaagccgcgatagcagcgg

SEQ ID NO: 613968 - DNA, 20 bp, mouse
ggcctcgggtctggaagcag

SEQ ID NO: 613969 - DNA, 20 bp, mouse
gctgctatcgcggcttccgg

SEQ ID NO: 613970 - DNA, 20 bp, mouse
ggcggtccaatccgcagcgt

SEQ ID NO: 613971 - DNA, 20 bp, mouse
gtagtgcccgaaggtcagga

SEQ ID NO: 613972 - DNA, 20 bp, mouse
gtcagggccgcgaagggagg

SEQ ID NO: 613973 - DNA, 20 bp, mouse
gcccgctgcttcctacgctg

SEQ ID NO: 613974 - DNA, 20 bp, mouse
gagggggaagagcctggaag

SEQ ID NO: 613975 - DNA, 20 bp, mouse
ggcggccctgaggaccgtgg

SEQ ID NO: 613976 - DNA, 20 bp, mouse
gtggactcagagcccatgag

SEQ ID NO: 613977 - DNA, 20 bp, mouse
gcctgttagtatgctaggaa

SEQ ID NO: 613978 - DNA, 20 bp, mouse
gacacacagggtaggaaaca

SEQ ID NO: 613979 - DNA, 20 bp, mouse
gctgggcctgttagtatgct

SEQ ID NO: 613980 - DNA, 20 bp, mouse
gttgctcagtgagcccagga

SEQ ID NO: 613981 - DNA, 20 bp, mouse
gcttggtctgcagccatcct

SEQ ID NO: 613982 - DNA, 20 bp, mouse
gtggtcattaggccaccagg

SEQ ID NO: 613983 - DNA, 20 bp, mouse
gctaacaggcccagaactct

SEQ ID NO: 613984 - DNA, 20 bp, mouse
ggtgtagaaaacccgctgag

SEQ ID NO: 613985 - DNA, 20 bp, mouse
gcctagagtttagaaggtaa

SEQ ID NO: 613986 - DNA, 20 bp, mouse
gaatgtactaaggacacgga

SEQ ID NO: 613987 - DNA, 20 bp, mouse
gctcgaatgtactaaggaca

SEQ ID NO: 613988 - DNA, 20 bp, mouse
gcggctcccggaaaaactct

SEQ ID NO: 613989 - DNA, 20 bp, mouse
gccctagcggcagagctcca

SEQ ID NO: 613990 - DNA, 20 bp, mouse
gggacacggatggcgactgt

SEQ ID NO: 613991 - DNA, 20 bp, mouse
gacaagactcgaatgtacta

SEQ ID NO: 613992 - DNA, 20 bp, mouse
ggctcgcggcactgaggaca

SEQ ID NO: 613993 - DNA, 20 bp, mouse
ggccgaggcgctggccctag

SEQ ID NO: 613994 - DNA, 20 bp, mouse
ggcactgaggacagggcagt

SEQ ID NO: 613995 - DNA, 20 bp, mouse
ggggccgaacgcaggagccg

SEQ ID NO: 613996 - DNA, 20 bp, mouse
gggcaaagcggagaaagaag

SEQ ID NO: 613997 - DNA, 20 bp, mouse
gtaacccgcgttctgagagg

SEQ ID NO: 613998 - DNA, 20 bp, mouse
ggttctgagaggcggcaaag

SEQ ID NO: 613999 - DNA, 20 bp, mouse
gcacgactcccccgaacgag

SEQ ID NO: 614000 - DNA, 20 bp, mouse
gcaataacccgcgttctgag

SEQ ID NO: 614001 - DNA, 20 bp, mouse
gcacacagcccctcgttcgg

SEQ ID NO: 614002 - DNA, 20 bp, mouse
gcgctcggcgaatcgttcgt

SEQ ID NO: 614003 - DNA, 20 bp, mouse
ggggagagcctgagcccggt

SEQ ID NO: 614004 - DNA, 20 bp, mouse
ggaatcagaggagtacgcga

SEQ ID NO: 614005 - DNA, 20 bp, mouse
gcaagcccgggagggagact

SEQ ID NO: 614006 - DNA, 20 bp, mouse
gactcccaggaggaccagtc

SEQ ID NO: 614007 - DNA, 20 bp, mouse
gggtctaacagcagggtgat

SEQ ID NO: 614008 - DNA, 20 bp, mouse
ggccaaaaaagactcccagg

SEQ ID NO: 614009 - DNA, 20 bp, mouse
gtaggccaaaaaagactccc

SEQ ID NO: 614010 - DNA, 20 bp, mouse
ggaacctgactggtcctcct

SEQ ID NO: 614011 - DNA, 20 bp, mouse
gagagtgaaggtccagacct

SEQ ID NO: 614012 - DNA, 20 bp, mouse
gtgtggtgtcgtcccagagt

SEQ ID NO: 614013 - DNA, 20 bp, mouse
gcaggactcacaagtctggt

SEQ ID NO: 614014 - DNA, 20 bp, mouse
gatgcaagggcagggattca

SEQ ID NO: 614015 - DNA, 20 bp, mouse
gtcagtctgtgacctaggtc

SEQ ID NO: 614016 - DNA, 20 bp, mouse
gctcttaaggggattaaata

SEQ ID NO: 614017 - DNA, 20 bp, mouse
gatcattcatactctaggta

SEQ ID NO: 614018 - DNA, 20 bp, mouse
gtggtgcagcctcaccatct

SEQ ID NO: 614019 - DNA, 20 bp, mouse
ggcagcctcaccatcttgga

SEQ ID NO: 614020 - DNA, 20 bp, mouse
gcccttaagagtgaagatgg

SEQ ID NO: 614021 - DNA, 20 bp, mouse
gagaacagtaccttccaaga

SEQ ID NO: 614022 - DNA, 20 bp, mouse
gagatgatcattcatactct

SEQ ID NO: 614023 - DNA, 20 bp, mouse
gtactgttctcatctggtgt

SEQ ID NO: 614024 - DNA, 20 bp, mouse
gatccccttaagagtgaaga

SEQ ID NO: 614025 - DNA, 20 bp, mouse
gggaaggtactgttctcatc

SEQ ID NO: 614026 - DNA, 20 bp, mouse
gcgcgggcgggccgactccg

SEQ ID NO: 614027 - DNA, 20 bp, mouse
gtcccggccgaggtccgagg

SEQ ID NO: 614028 - DNA, 20 bp, mouse
ggcacgcagcgccccggagt

SEQ ID NO: 614029 - DNA, 20 bp, mouse
gcagccggccggccagctgg

SEQ ID NO: 614030 - DNA, 20 bp, mouse
gaccacagcgctctcctcca

SEQ ID NO: 614031 - DNA, 20 bp, mouse
ggctgcgggtggcagggcgc

SEQ ID NO: 614032 - DNA, 20 bp, mouse
gcccgcggcgcaccgagcgg

SEQ ID NO: 614033 - DNA, 20 bp, mouse
ggccctggaggagagcgctg

SEQ ID NO: 614034 - DNA, 20 bp, mouse
gcgccgccaaaggaagagtg

SEQ ID NO: 614035 - DNA, 20 bp, mouse
gggcgacagtggctaccttc

SEQ ID NO: 614036 - DNA, 20 bp, mouse
ggcgcctaggcgaccgggga

SEQ ID NO: 614037 - DNA, 20 bp, mouse
ggagagcagggcaagatgat

SEQ ID NO: 614038 - DNA, 20 bp, mouse
ggcctaggcgccgactcccc

SEQ ID NO: 614039 - DNA, 20 bp, mouse
ggcggtggtggcgccttccc

SEQ ID NO: 614040 - DNA, 20 bp, mouse
gcacagagagagcgcatcct

SEQ ID NO: 614041 - DNA, 20 bp, mouse
gagtcggcgcctaggcgacc

SEQ ID NO: 614042 - DNA, 20 bp, mouse
gagagcgcatcctggggagt

SEQ ID NO: 614043 - DNA, 20 bp, mouse
gtcctggggagtcggcgcct

SEQ ID NO: 614044 - DNA, 20 bp, mouse
ggaggcccggcggctctggg

SEQ ID NO: 614045 - DNA, 20 bp, mouse
ggccccgccccgccagggag

SEQ ID NO: 614046 - DNA, 20 bp, mouse
gtccagtgaccaccgagtgt

SEQ ID NO: 614047 - DNA, 20 bp, mouse
gttggtgtaatcaggtacag

SEQ ID NO: 614048 - DNA, 20 bp, mouse
gaagctgtgcccacactcgg

SEQ ID NO: 614049 - DNA, 20 bp, mouse
gggatgagcagagcatctgt

SEQ ID NO: 614050 - DNA, 20 bp, mouse
gctcctcccaactcttgagg

SEQ ID NO: 614051 - DNA, 20 bp, mouse
gatggttggacatcaggaca

SEQ ID NO: 614052 - DNA, 20 bp, mouse
gtgcctcctcaagagttggg

SEQ ID NO: 614053 - DNA, 20 bp, mouse
gtggggagactggctaatat

SEQ ID NO: 614054 - DNA, 20 bp, mouse
gagcattcaggacaagataa

SEQ ID NO: 614055 - DNA, 20 bp, mouse
gcaggacaaggctacacttc

SEQ ID NO: 614056 - DNA, 20 bp, mouse
gctctggtctccactggctg

SEQ ID NO: 614057 - DNA, 20 bp, mouse
gatcttaaggatttccttca

SEQ ID NO: 614058 - DNA, 20 bp, mouse
gaccttcgtactgaagtctc

SEQ ID NO: 614059 - DNA, 20 bp, mouse
gtcaggccctccgggttgga

SEQ ID NO: 614060 - DNA, 20 bp, mouse
ggcccgaaggcagaatcctc

SEQ ID NO: 614061 - DNA, 20 bp, mouse
gatcctcaggccctccgggt

SEQ ID NO: 614062 - DNA, 20 bp, mouse
gtcagtacgaaggtcagttc

SEQ ID NO: 614063 - DNA, 20 bp, mouse
gaccagagacttcagtacga

SEQ ID NO: 614064 - DNA, 20 bp, mouse
gtctctccgtccaacccgga

SEQ ID NO: 614065 - DNA, 20 bp, mouse
gccgcttctgccaagcccga

SEQ ID NO: 614066 - DNA, 20 bp, mouse
gtccccgtcggaaagcaaga

SEQ ID NO: 614067 - DNA, 20 bp, mouse
gccgcgatcacgaacgccgg

SEQ ID NO: 614068 - DNA, 20 bp, mouse
ggctccgcgatcacgaacgc

SEQ ID NO: 614069 - DNA, 20 bp, mouse
gcagcggcgcggacacgcga

SEQ ID NO: 614070 - DNA, 20 bp, mouse
gccgccgccgaagccatgag

SEQ ID NO: 614071 - DNA, 20 bp, mouse
gcccctccttccttccccgt

SEQ ID NO: 614072 - DNA, 20 bp, mouse
ggagcgcgcccacatagacg

SEQ ID NO: 614073 - DNA, 20 bp, mouse
ggcggtgtcctcgtctatgt

SEQ ID NO: 614074 - DNA, 20 bp, mouse
gcgcggacacgcgagggcgg

SEQ ID NO: 614075 - DNA, 20 bp, mouse
ggctttccgacggggaagga

SEQ ID NO: 614076 - DNA, 20 bp, mouse
ggacgctgcacgggacactc

SEQ ID NO: 614077 - DNA, 20 bp, mouse
gaggggccggggcagctccg

SEQ ID NO: 614078 - DNA, 20 bp, mouse
gtagctgggagaccgctcta

SEQ ID NO: 614079 - DNA, 20 bp, mouse
gcccagcccaccgcccctct

SEQ ID NO: 614080 - DNA, 20 bp, mouse
gttccaccaggagatctggt

SEQ ID NO: 614081 - DNA, 20 bp, mouse
gctggagctacggcgtccgg

SEQ ID NO: 614082 - DNA, 20 bp, mouse
gcctctggcagaacccacat

SEQ ID NO: 614083 - DNA, 20 bp, mouse
gccgcggggcgaggagggca

SEQ ID NO: 614084 - DNA, 20 bp, mouse
ggggctggagctacggcgtc

SEQ ID NO: 614085 - DNA, 20 bp, mouse
ggcggagcccgtgccgtgga

SEQ ID NO: 614086 - DNA, 20 bp, mouse
gtggagggcggcggagaccc

SEQ ID NO: 614087 - DNA, 20 bp, mouse
gctgagtctccggtggaggg

SEQ ID NO: 614088 - DNA, 20 bp, mouse
ggaggcggtggcgtcctggg

SEQ ID NO: 614089 - DNA, 20 bp, mouse
gcaggaggcggtggcgtcct

SEQ ID NO: 614090 - DNA, 20 bp, mouse
ggggctgagtctccggtgga

SEQ ID NO: 614091 - DNA, 20 bp, mouse
gcctggggctgagtctccgg

SEQ ID NO: 614092 - DNA, 20 bp, mouse
gggttgggcacactgccctg

SEQ ID NO: 614093 - DNA, 20 bp, mouse
ggcagagggcggggacccaa

SEQ ID NO: 614094 - DNA, 20 bp, mouse
gcccagcaagggagaaccgt

SEQ ID NO: 614095 - DNA, 20 bp, mouse
gggcaagagcagcatggatt

SEQ ID NO: 614096 - DNA, 20 bp, mouse
gatggcggccggcgttgagt

SEQ ID NO: 614097 - DNA, 20 bp, mouse
gggcgttgagttggcaggac

SEQ ID NO: 614098 - DNA, 20 bp, mouse
gcatgacactgccgggaaag

SEQ ID NO: 614099 - DNA, 20 bp, mouse
ggggcccacggtgtccacaa

SEQ ID NO: 614100 - DNA, 20 bp, mouse
gctatcgcgaagcttctcta

SEQ ID NO: 614101 - DNA, 20 bp, mouse
gtgactttcctcagtttcgt

SEQ ID NO: 614102 - DNA, 20 bp, mouse
ggctgaggactcgcaggaca

SEQ ID NO: 614103 - DNA, 20 bp, mouse
gcggccgccatgacactgcc

SEQ ID NO: 614104 - DNA, 20 bp, mouse
gcggccggcgttgagttggc

SEQ ID NO: 614105 - DNA, 20 bp, mouse
gagtctctcggtcaagtagg

SEQ ID NO: 614106 - DNA, 20 bp, mouse
ggcgcgacggcaacttccac

SEQ ID NO: 614107 - DNA, 20 bp, mouse
gcgcggacggaggcgcacgg

SEQ ID NO: 614108 - DNA, 20 bp, mouse
gaccggagccaaaaagtctc

SEQ ID NO: 614109 - DNA, 20 bp, mouse
gcgatgagcaaggccctagg

SEQ ID NO: 614110 - DNA, 20 bp, mouse
gagggaggcggcgcggacgg

SEQ ID NO: 614111 - DNA, 20 bp, mouse
gacccccccgccgctcggaa

SEQ ID NO: 614112 - DNA, 20 bp, mouse
gcgcgccacggagtccggac

SEQ ID NO: 614113 - DNA, 20 bp, mouse
ggcacggcggcgcggtgctg

SEQ ID NO: 614114 - DNA, 20 bp, mouse
gcccgcggcctgaggagcca

SEQ ID NO: 614115 - DNA, 20 bp, mouse
gcggcgcggacggaggcgca

SEQ ID NO: 614116 - DNA, 20 bp, mouse
gcggagaaggctgtcgcaca

SEQ ID NO: 614117 - DNA, 20 bp, mouse
gtgtcgcacagggcgcaggg

SEQ ID NO: 614118 - DNA, 20 bp, mouse
ggatgtaggaggatccacct

SEQ ID NO: 614119 - DNA, 20 bp, mouse
ggatcctcctacatcggaga

SEQ ID NO: 614120 - DNA, 20 bp, mouse
gggcgaccgcggcctcactc

SEQ ID NO: 614121 - DNA, 20 bp, mouse
gcgacagccttctccgatgt

SEQ ID NO: 614122 - DNA, 20 bp, mouse
gtgccgccggagtgaggccg

SEQ ID NO: 614123 - DNA, 20 bp, mouse
ggaccgcggcctcactccgg

SEQ ID NO: 614124 - DNA, 20 bp, mouse
gggccggcccttagccaagg

SEQ ID NO: 614125 - DNA, 20 bp, mouse
gtttggccggcccttagcca

SEQ ID NO: 614126 - DNA, 20 bp, mouse
ggtgtgcaccagtgtactag

SEQ ID NO: 614127 - DNA, 20 bp, mouse
gccgggagccgctagtacac

SEQ ID NO: 614128 - DNA, 20 bp, mouse
gcagtccagggcgggacgag

SEQ ID NO: 614129 - DNA, 20 bp, mouse
gtaggagagtgggtggactc

SEQ ID NO: 614130 - DNA, 20 bp, mouse
ggtggctggggcggcgtacc

SEQ ID NO: 614131 - DNA, 20 bp, mouse
ggcccagctggttccggctg

SEQ ID NO: 614132 - DNA, 20 bp, mouse
gatttcctcgctgacatcca

SEQ ID NO: 614133 - DNA, 20 bp, mouse
gatgggtaccgggactgagg

SEQ ID NO: 614134 - DNA, 20 bp, mouse
ggaagggaaccagtccaggg

SEQ ID NO: 614135 - DNA, 20 bp, mouse
gactttcctaggagagtggg

SEQ ID NO: 614136 - DNA, 20 bp, mouse
gggactgttggtaagtgggt

SEQ ID NO: 614137 - DNA, 20 bp, mouse
gtcggggactgttggtaagt

SEQ ID NO: 614138 - DNA, 20 bp, mouse
gcagtccccgaagaaatggg

SEQ ID NO: 614139 - DNA, 20 bp, mouse
ggcctaacattgtaaactaa

SEQ ID NO: 614140 - DNA, 20 bp, mouse
gctgcagcgaagggtttacc

SEQ ID NO: 614141 - DNA, 20 bp, mouse
gcctggagaggagctttggg

SEQ ID NO: 614142 - DNA, 20 bp, mouse
gggtgtcagagaccaactga

SEQ ID NO: 614143 - DNA, 20 bp, mouse
gtactacctgctgcagcgaa

SEQ ID NO: 614144 - DNA, 20 bp, mouse
ggatggcccaggattccagg

SEQ ID NO: 614145 - DNA, 20 bp, mouse
ggagaaagaagctcccgcaa

SEQ ID NO: 614146 - DNA, 20 bp, mouse
gacggggcgtgggacagtaa

SEQ ID NO: 614147 - DNA, 20 bp, mouse
gccactccagacagaggtca

SEQ ID NO: 614148 - DNA, 20 bp, mouse
ggttactccactccagacag

SEQ ID NO: 614149 - DNA, 20 bp, mouse
gtttgcgggagtcccaaacg

SEQ ID NO: 614150 - DNA, 20 bp, mouse
gaggagagccacccttagaa

SEQ ID NO: 614151 - DNA, 20 bp, mouse
gagcctggagctcggagcct

SEQ ID NO: 614152 - DNA, 20 bp, mouse
gggagtcccaaacggggcgt

SEQ ID NO: 614153 - DNA, 20 bp, mouse
gggtagagctgcccttctaa

SEQ ID NO: 614154 - DNA, 20 bp, mouse
gaaccctccagactccctca

SEQ ID NO: 614155 - DNA, 20 bp, mouse
gctccaggctctgagcttgt

SEQ ID NO: 614156 - DNA, 20 bp, mouse
gagcgagggcggcccaactg

SEQ ID NO: 614157 - DNA, 20 bp, mouse
gactgcgggtccggccgggt

SEQ ID NO: 614158 - DNA, 20 bp, mouse
gtgtcactcagaggcagggg

SEQ ID NO: 614159 - DNA, 20 bp, mouse
gcctcagcattgcccagcga

SEQ ID NO: 614160 - DNA, 20 bp, mouse
gcccaactgcgggtccggcc

SEQ ID NO: 614161 - DNA, 20 bp, mouse
ggctcggagcccagatcccc

SEQ ID NO: 614162 - DNA, 20 bp, mouse
gcagcattgcccagcgaggg

SEQ ID NO: 614163 - DNA, 20 bp, mouse
gaggagggccagacgaggag

SEQ ID NO: 614164 - DNA, 20 bp, mouse
ggcgtggacagctgcccacc

SEQ ID NO: 614165 - DNA, 20 bp, mouse
gcctctgagtgacagcagcg

SEQ ID NO: 614166 - DNA, 20 bp, mouse
gctgtgagctctggattccg

SEQ ID NO: 614167 - DNA, 20 bp, mouse
gccccgagaatcactacaag

SEQ ID NO: 614168 - DNA, 20 bp, mouse
ggccgcagccgccatcttga

SEQ ID NO: 614169 - DNA, 20 bp, mouse
gtgctcagatgccttcaaga

SEQ ID NO: 614170 - DNA, 20 bp, mouse
gcagtgttcgccgcaggcct

SEQ ID NO: 614171 - DNA, 20 bp, mouse
gagggtgtcccctagtccag

SEQ ID NO: 614172 - DNA, 20 bp, mouse
gtggcctaactgcagagcca

SEQ ID NO: 614173 - DNA, 20 bp, mouse
gtgctaggtacccattccaa

SEQ ID NO: 614174 - DNA, 20 bp, mouse
gggcccgcacgcgacctcca

SEQ ID NO: 614175 - DNA, 20 bp, mouse
gctctggattccgaggcctg

SEQ ID NO: 614176 - DNA, 20 bp, mouse
gcacaggatccaacgagtca

SEQ ID NO: 614177 - DNA, 20 bp, mouse
gagggcactggacccaacag

SEQ ID NO: 614178 - DNA, 20 bp, mouse
gttggatcctgtgagcggaa

SEQ ID NO: 614179 - DNA, 20 bp, mouse
gactcgttggatcctgtgag

SEQ ID NO: 614180 - DNA, 20 bp, mouse
gagcatgcaccgtgactcgt

SEQ ID NO: 614181 - DNA, 20 bp, mouse
ggcgtctcccttccgctcac

SEQ ID NO: 614182 - DNA, 20 bp, mouse
ggggagacgcttgtccgggt

SEQ ID NO: 614183 - DNA, 20 bp, mouse
ggccgccatgttggcaaaga

SEQ ID NO: 614184 - DNA, 20 bp, mouse
ggcttctcgcattagggcct

SEQ ID NO: 614185 - DNA, 20 bp, mouse
ggacgcttgtccgggtgggt

SEQ ID NO: 614186 - DNA, 20 bp, mouse
ggtggttgcgcgcccggtta

SEQ ID NO: 614187 - DNA, 20 bp, mouse
gttggttgcagcggaggcta

SEQ ID NO: 614188 - DNA, 20 bp, mouse
gccaaggcttccggagtaga

SEQ ID NO: 614189 - DNA, 20 bp, mouse
gaggccctcaccctctactc

SEQ ID NO: 614190 - DNA, 20 bp, mouse
gagagtccctaccggaagtg

SEQ ID NO: 614191 - DNA, 20 bp, mouse
gcatgcgacggcctgaccca

SEQ ID NO: 614192 - DNA, 20 bp, mouse
gtggcttgggagggaatctc

SEQ ID NO: 614193 - DNA, 20 bp, mouse
gcgcatgtaagggcgccgag

SEQ ID NO: 614194 - DNA, 20 bp, mouse
gcttccggagtagagggtga

SEQ ID NO: 614195 - DNA, 20 bp, mouse
gcgcccggttacggcactta

SEQ ID NO: 614196 - DNA, 20 bp, mouse
gcttctgagcaaggtgtgtt

SEQ ID NO: 614197 - DNA, 20 bp, mouse
gtgttaggtaagccaagatc

SEQ ID NO: 614198 - DNA, 20 bp, mouse
gggtgcctaggcgtctcggt

SEQ ID NO: 614199 - DNA, 20 bp, mouse
gaagccaagatctggttctg

SEQ ID NO: 614200 - DNA, 20 bp, mouse
ggcaagacccagactcccca

SEQ ID NO: 614201 - DNA, 20 bp, mouse
ggcgtgctgcgaccgaggaa

SEQ ID NO: 614202 - DNA, 20 bp, mouse
ggggttggctagagactgcg

SEQ ID NO: 614203 - DNA, 20 bp, mouse
ggggtcccaccgagacgcct

SEQ ID NO: 614204 - DNA, 20 bp, mouse
ggtggggtgcctaggcgtct

SEQ ID NO: 614205 - DNA, 20 bp, mouse
gtgaggacgtgtgagactaa

SEQ ID NO: 614206 - DNA, 20 bp, mouse
gcgcggtgcagtgcaggccg

SEQ ID NO: 614207 - DNA, 20 bp, mouse
gggcacggcgctacctgaag

SEQ ID NO: 614208 - DNA, 20 bp, mouse
ggccgcggcggaaaccctcg

SEQ ID NO: 614209 - DNA, 20 bp, mouse
ggcgacacaggagacgatct

SEQ ID NO: 614210 - DNA, 20 bp, mouse
gccgtgctgtaggagtcgtt

SEQ ID NO: 614211 - DNA, 20 bp, mouse
ggccgcagtctgggtacctg

SEQ ID NO: 614212 - DNA, 20 bp, mouse
ggtacccagactgcggccgg

SEQ ID NO: 614213 - DNA, 20 bp, mouse
gcagccgccggccgcagtct

SEQ ID NO: 614214 - DNA, 20 bp, mouse
ggccagccggcgctaaagag

SEQ ID NO: 614215 - DNA, 20 bp, mouse
gcggcagagagaagctccgc

SEQ ID NO: 614216 - DNA, 20 bp, mouse
gcgcacggtagtagctgcaa

SEQ ID NO: 614217 - DNA, 20 bp, mouse
gtagctgcaatggcgctgcc

SEQ ID NO: 614218 - DNA, 20 bp, mouse
gagcaagagatagcgattca

SEQ ID NO: 614219 - DNA, 20 bp, mouse
ggcacgtgcagaggggtgaa

SEQ ID NO: 614220 - DNA, 20 bp, mouse
ggctgggcggaccatgtccc

SEQ ID NO: 614221 - DNA, 20 bp, mouse
gtgcagaggggtgaatggca

SEQ ID NO: 614222 - DNA, 20 bp, mouse
ggaatggcaaggctccgtcc

SEQ ID NO: 614223 - DNA, 20 bp, mouse
gaatcgctatctcttgctca

SEQ ID NO: 614224 - DNA, 20 bp, mouse
gaaggctccgtcctggagaa

SEQ ID NO: 614225 - DNA, 20 bp, mouse
ggcgcctgcgcggcctccac

SEQ ID NO: 614226 - DNA, 20 bp, mouse
gggtccggcgaagagttcaa

SEQ ID NO: 614227 - DNA, 20 bp, mouse
gccacagcgccggcttagag

SEQ ID NO: 614228 - DNA, 20 bp, mouse
ggccgtgacgcactacgacg

SEQ ID NO: 614229 - DNA, 20 bp, mouse
ggcctgagcccgcccccaag

SEQ ID NO: 614230 - DNA, 20 bp, mouse
gacgaacaccgaggccgtcc

SEQ ID NO: 614231 - DNA, 20 bp, mouse
ggagaagtgtggactccttc

SEQ ID NO: 614232 - DNA, 20 bp, mouse
gggaagcgtacgtggtcagt

SEQ ID NO: 614233 - DNA, 20 bp, mouse
gccccccccgcaggccactg

SEQ ID NO: 614234 - DNA, 20 bp, mouse
gcaaagcggaagtggtagaa

SEQ ID NO: 614235 - DNA, 20 bp, mouse
ggagttcaacggcttcaaag

SEQ ID NO: 614236 - DNA, 20 bp, mouse
gggagaatctcgctgatgga

SEQ ID NO: 614237 - DNA, 20 bp, mouse
gttagctcttccggttgtag

SEQ ID NO: 614238 - DNA, 20 bp, mouse
gagccggagaatctcgctga

SEQ ID NO: 614239 - DNA, 20 bp, mouse
gagataccgagactacctgg

SEQ ID NO: 614240 - DNA, 20 bp, mouse
gttggacaggctgcaccggg

SEQ ID NO: 614241 - DNA, 20 bp, mouse
gaaaggctttccgccagcac

SEQ ID NO: 614242 - DNA, 20 bp, mouse
gggtacaaacactagcgaca

SEQ ID NO: 614243 - DNA, 20 bp, mouse
gctggaggagcagaaactct

SEQ ID NO: 614244 - DNA, 20 bp, mouse
gaagctgcgggatggcgcgg

SEQ ID NO: 614245 - DNA, 20 bp, mouse
gcacttccgatgcgccgtag

SEQ ID NO: 614246 - DNA, 20 bp, mouse
gtctgcagtgaggttaaggg

SEQ ID NO: 614247 - DNA, 20 bp, mouse
gatctctgcagtgaggttaa

SEQ ID NO: 614248 - DNA, 20 bp, mouse
gagggtggcacctaaatacg

SEQ ID NO: 614249 - DNA, 20 bp, mouse
ggtccagcagctctatgaag

SEQ ID NO: 614250 - DNA, 20 bp, mouse
gttctgtgcagagcatccaa

SEQ ID NO: 614251 - DNA, 20 bp, mouse
ggtggagttggaatattcac

SEQ ID NO: 614252 - DNA, 20 bp, mouse
gtactcgcttgctccagcca

SEQ ID NO: 614253 - DNA, 20 bp, mouse
gtgtctgtgtctcacagcgt

SEQ ID NO: 614254 - DNA, 20 bp, mouse
gtgaagtggaacgaccagtg

SEQ ID NO: 614255 - DNA, 20 bp, mouse
gagaaatgaaccccgtattt

SEQ ID NO: 614256 - DNA, 20 bp, mouse
ggcgtgccacagacaaacgg

SEQ ID NO: 614257 - DNA, 20 bp, mouse
gggaaggggaagccggcgaa

SEQ ID NO: 614258 - DNA, 20 bp, mouse
ggcttctgcgcagtctgtgg

SEQ ID NO: 614259 - DNA, 20 bp, mouse
ggagctgctaccccaggaga

SEQ ID NO: 614260 - DNA, 20 bp, mouse
gcacacagggctggatccaa

SEQ ID NO: 614261 - DNA, 20 bp, mouse
gacagggctggatccaaggg

SEQ ID NO: 614262 - DNA, 20 bp, mouse
gcagcggttcgacccttcgc

SEQ ID NO: 614263 - DNA, 20 bp, mouse
gtcgtaacgcctcggggaag

SEQ ID NO: 614264 - DNA, 20 bp, mouse
gagggtcgaaccgctgcctc

SEQ ID NO: 614265 - DNA, 20 bp, mouse
gaaggaggaggcccaggtca

SEQ ID NO: 614266 - DNA, 20 bp, mouse
ggcggatgcactgtccccaa

SEQ ID NO: 614267 - DNA, 20 bp, mouse
gctgcgtctcctctctctaa

SEQ ID NO: 614268 - DNA, 20 bp, mouse
gctcgtgagcaccctggtcc

SEQ ID NO: 614269 - DNA, 20 bp, mouse
ggggtgctcacgaggaccac

SEQ ID NO: 614270 - DNA, 20 bp, mouse
ggtagaccgcagctccacac

SEQ ID NO: 614271 - DNA, 20 bp, mouse
gcacacgctgcgcctgcctt

SEQ ID NO: 614272 - DNA, 20 bp, mouse
ggcgctggccagccgaaggc

SEQ ID NO: 614273 - DNA, 20 bp, mouse
ggggagacgtgcaggagatg

SEQ ID NO: 614274 - DNA, 20 bp, mouse
gcctggccgcagtcctccat

SEQ ID NO: 614275 - DNA, 20 bp, mouse
ggctgctggaaggatcagtc

SEQ ID NO: 614276 - DNA, 20 bp, mouse
ggagtcactaaggccttgga

SEQ ID NO: 614277 - DNA, 20 bp, mouse
gctgccctagggaagagagg

SEQ ID NO: 614278 - DNA, 20 bp, mouse
ggccttggacggacgtgcag

SEQ ID NO: 614279 - DNA, 20 bp, mouse
gtggcgcgaaggggttgcag

SEQ ID NO: 614280 - DNA, 20 bp, mouse
gtggcaaactaaaataccag

SEQ ID NO: 614281 - DNA, 20 bp, mouse
gctgcgcaccaggaagtgac

SEQ ID NO: 614282 - DNA, 20 bp, mouse
gaccagcggatggcgcgaag

SEQ ID NO: 614283 - DNA, 20 bp, mouse
ggactccttgggagtcacta

SEQ ID NO: 614284 - DNA, 20 bp, mouse
gtacttacccgggactcctt

SEQ ID NO: 614285 - DNA, 20 bp, mouse
gttgggagtcactaaggcct

SEQ ID NO: 614286 - DNA, 20 bp, mouse
ggccgagcgcgcagccatgg

SEQ ID NO: 614287 - DNA, 20 bp, mouse
gctggagagggaacccggac

SEQ ID NO: 614288 - DNA, 20 bp, mouse
gctctccagccacacggtca

SEQ ID NO: 614289 - DNA, 20 bp, mouse
ggagccagagtcgggaccta

SEQ ID NO: 614290 - DNA, 20 bp, mouse
gctgcaggtagcagggcatc

SEQ ID NO: 614291 - DNA, 20 bp, mouse
gtccagccacacggtcacgg

SEQ ID NO: 614292 - DNA, 20 bp, mouse
gaggctgaggacccaacgag

SEQ ID NO: 614293 - DNA, 20 bp, mouse
gccaggcggagtgtggaccg

SEQ ID NO: 614294 - DNA, 20 bp, mouse
ggtggaccgcggcagggaca

SEQ ID NO: 614295 - DNA, 20 bp, mouse
gcggcggcccagaagcctgc

SEQ ID NO: 614296 - DNA, 20 bp, mouse
gctggtgcagctcggaaata

SEQ ID NO: 614297 - DNA, 20 bp, mouse
gcaccagagcatgaggtgag

SEQ ID NO: 614298 - DNA, 20 bp, mouse
gccagggccagcgtcacccg

SEQ ID NO: 614299 - DNA, 20 bp, mouse
gtgaccagccccctacccaa

SEQ ID NO: 614300 - DNA, 20 bp, mouse
gctcggaaatagggcgtcgg

SEQ ID NO: 614301 - DNA, 20 bp, mouse
gaaaggtgcagctggtgagg

SEQ ID NO: 614302 - DNA, 20 bp, mouse
gaacccctcacctcatgctc

SEQ ID NO: 614303 - DNA, 20 bp, mouse
gcagctcggaaatagggcgt

SEQ ID NO: 614304 - DNA, 20 bp, mouse
gggccagcgtcacccgaggc

SEQ ID NO: 614305 - DNA, 20 bp, mouse
ggaggccggagcccttgggt

SEQ ID NO: 614306 - DNA, 20 bp, mouse
gggtcgtgccgggctcctag

SEQ ID NO: 614307 - DNA, 20 bp, mouse
ggcggctggagcaaaaacgg

SEQ ID NO: 614308 - DNA, 20 bp, mouse
ggagcccggcacgaccagga

SEQ ID NO: 614309 - DNA, 20 bp, mouse
gctagcggctggagcaaaaa

SEQ ID NO: 614310 - DNA, 20 bp, mouse
gagcggcgtgcagcacgtgg

SEQ ID NO: 614311 - DNA, 20 bp, mouse
gtccatggaggcatcagctg

SEQ ID NO: 614312 - DNA, 20 bp, mouse
gtccgcagctgatgcctcca

SEQ ID NO: 614313 - DNA, 20 bp, mouse
gggtccctcctggtcgtgcc

SEQ ID NO: 614314 - DNA, 20 bp, mouse
ggtgggaaggcctcagtgat

SEQ ID NO: 614315 - DNA, 20 bp, mouse
ggatgcggcaggatcccggt

SEQ ID NO: 614316 - DNA, 20 bp, mouse
ggccgccgtggagccacgtg

SEQ ID NO: 614317 - DNA, 20 bp, mouse
gtccacacgtggctccacgg

SEQ ID NO: 614318 - DNA, 20 bp, mouse
gctgctgtgcacgctatcag

SEQ ID NO: 614319 - DNA, 20 bp, mouse
ggcctcccgccgaacagcac

SEQ ID NO: 614320 - DNA, 20 bp, mouse
gtgagtttccgagctgggag

SEQ ID NO: 614321 - DNA, 20 bp, mouse
gaaactcacgcagcataaac

SEQ ID NO: 614322 - DNA, 20 bp, mouse
gctccacggagggctcccga

SEQ ID NO: 614323 - DNA, 20 bp, mouse
gcggctcccggctccacacg

SEQ ID NO: 614324 - DNA, 20 bp, mouse
ggaatcccctagtgtgaagg

SEQ ID NO: 614325 - DNA, 20 bp, mouse
ggtggagccacgtgtggagc

SEQ ID NO: 614326 - DNA, 20 bp, mouse
ggacgcagccagaaagctcg

SEQ ID NO: 614327 - DNA, 20 bp, mouse
gtcgcggtgtagcctgatgt

SEQ ID NO: 614328 - DNA, 20 bp, mouse
ggtgccgcagcgccgacatc

SEQ ID NO: 614329 - DNA, 20 bp, mouse
gtagcctgatgtcggcgctg

SEQ ID NO: 614330 - DNA, 20 bp, mouse
gtcgtgtgcgccctgtctgg

SEQ ID NO: 614331 - DNA, 20 bp, mouse
gatccaacgaaggagaacac

SEQ ID NO: 614332 - DNA, 20 bp, mouse
gccccggaggctgggacttc

SEQ ID NO: 614333 - DNA, 20 bp, mouse
gccccggggaagatgatcca

SEQ ID NO: 614334 - DNA, 20 bp, mouse
gcgtcccccccgtcccccgg

SEQ ID NO: 614335 - DNA, 20 bp, mouse
gctgttgcggcggagaggtg

SEQ ID NO: 614336 - DNA, 20 bp, mouse
gtgcgcacacgctgcctcgg

SEQ ID NO: 614337 - DNA, 20 bp, mouse
ggaggcagcgtgtgcgcagg

SEQ ID NO: 614338 - DNA, 20 bp, mouse
ggacaggtcggaggaaaacc

SEQ ID NO: 614339 - DNA, 20 bp, mouse
gtgcaggcttaggctccggg

SEQ ID NO: 614340 - DNA, 20 bp, mouse
ggagggtctcgagtcgtagg

SEQ ID NO: 614341 - DNA, 20 bp, mouse
gtgtgcgcaggaggtgctgc

SEQ ID NO: 614342 - DNA, 20 bp, mouse
gaggaaaacccggatcgctc

SEQ ID NO: 614343 - DNA, 20 bp, mouse
gcgagtcgtagggggaggaa

SEQ ID NO: 614344 - DNA, 20 bp, mouse
gccggaagcggcggacaggt

SEQ ID NO: 614345 - DNA, 20 bp, mouse
gtcggcggccagagcgatcc

SEQ ID NO: 614346 - DNA, 20 bp, mouse
gtgggcacgagactagtgag

SEQ ID NO: 614347 - DNA, 20 bp, mouse
gccagggttgtcggtgcgtg

SEQ ID NO: 614348 - DNA, 20 bp, mouse
gcggcccaggggcccaggaa

SEQ ID NO: 614349 - DNA, 20 bp, mouse
gcggccgcctcgggtaaggg

SEQ ID NO: 614350 - DNA, 20 bp, mouse
ggaggcggccgagacacccg

SEQ ID NO: 614351 - DNA, 20 bp, mouse
gggcatcccccgccccgcgg

SEQ ID NO: 614352 - DNA, 20 bp, mouse
gggccgagacacccgtggaa

SEQ ID NO: 614353 - DNA, 20 bp, mouse
gtgggccgcaggcgctgatt

SEQ ID NO: 614354 - DNA, 20 bp, mouse
gcgcggcggcccagggttgt

SEQ ID NO: 614355 - DNA, 20 bp, mouse
ggcgcgtgcggcctgggtgt

SEQ ID NO: 614356 - DNA, 20 bp, mouse
gctgcacagccaggtcgcca

SEQ ID NO: 614357 - DNA, 20 bp, mouse
ggtaagcgggtcttcggagt

SEQ ID NO: 614358 - DNA, 20 bp, mouse
gccaaggtgtcttagaaacg

SEQ ID NO: 614359 - DNA, 20 bp, mouse
gcgggcagcaggcgggtaag

SEQ ID NO: 614360 - DNA, 20 bp, mouse
gggaagtgcgcgtgcggccc

SEQ ID NO: 614361 - DNA, 20 bp, mouse
gccgggcgttgcctagagta

SEQ ID NO: 614362 - DNA, 20 bp, mouse
gtgaggccgaccctgggtag

SEQ ID NO: 614363 - DNA, 20 bp, mouse
ggtgcggcccgggcagcagg

SEQ ID NO: 614364 - DNA, 20 bp, mouse
gggctcaatgaagagagacc

SEQ ID NO: 614365 - DNA, 20 bp, mouse
gtgcccgacctctaagaggt

SEQ ID NO: 614366 - DNA, 20 bp, mouse
gacgtcctctcggctcacga

SEQ ID NO: 614367 - DNA, 20 bp, mouse
gacgagggcgaggtgagctg

SEQ ID NO: 614368 - DNA, 20 bp, mouse
ggagagagcagacgtcctct

SEQ ID NO: 614369 - DNA, 20 bp, mouse
gtcagacctgaggagaggct

SEQ ID NO: 614370 - DNA, 20 bp, mouse
gcggctctgaagcccccacg

SEQ ID NO: 614371 - DNA, 20 bp, mouse
gctcgccctcgtgagccgag

SEQ ID NO: 614372 - DNA, 20 bp, mouse
gtttaggaaagaccccgtgg

SEQ ID NO: 614373 - DNA, 20 bp, mouse
gtctcactgcgtaaaggcgg

SEQ ID NO: 614374 - DNA, 20 bp, mouse
gaggcgggggcggaatctcc

SEQ ID NO: 614375 - DNA, 20 bp, mouse
ggccagtcaccccgaagccg

SEQ ID NO: 614376 - DNA, 20 bp, mouse
ggaaaaacccgaggaagtag

SEQ ID NO: 614377 - DNA, 20 bp, mouse
ggggtcacctctacttcctc

SEQ ID NO: 614378 - DNA, 20 bp, mouse
ggaaatcggcgaaaaacccg

SEQ ID NO: 614379 - DNA, 20 bp, mouse
gggtttttcgccgatttctt

SEQ ID NO: 614380 - DNA, 20 bp, mouse
ggaagtagaggtgacccgga

SEQ ID NO: 614381 - DNA, 20 bp, mouse
gagtcctgccgaggttccta

SEQ ID NO: 614382 - DNA, 20 bp, mouse
gtgtgcctagaagcccgcac

SEQ ID NO: 614383 - DNA, 20 bp, mouse
gaccattccaggaggccctc

SEQ ID NO: 614384 - DNA, 20 bp, mouse
gcggcacgaggatcttagag

SEQ ID NO: 614385 - DNA, 20 bp, mouse
gcaagatccgagggtaggag

SEQ ID NO: 614386 - DNA, 20 bp, mouse
ggcgtcgcaccaggaatagg

SEQ ID NO: 614387 - DNA, 20 bp, mouse
gaataggaggcggcccgaaa

SEQ ID NO: 614388 - DNA, 20 bp, mouse
gcctgcgtcgcaccaggaat

SEQ ID NO: 614389 - DNA, 20 bp, mouse
gtcgcaccaggaataggagg

SEQ ID NO: 614390 - DNA, 20 bp, mouse
gtgcgacgcaggctttctgt

SEQ ID NO: 614391 - DNA, 20 bp, mouse
gggcgggtgccggagcacag

SEQ ID NO: 614392 - DNA, 20 bp, mouse
gtcgggccgcctcctattcc

SEQ ID NO: 614393 - DNA, 20 bp, mouse
ggctcgctccgacccgaacc

SEQ ID NO: 614394 - DNA, 20 bp, mouse
ggacagctccaggttcgggt

SEQ ID NO: 614395 - DNA, 20 bp, mouse
ggaggcggcccgaaagggcg

SEQ ID NO: 614396 - DNA, 20 bp, mouse
gggtagcgactacagttagg

SEQ ID NO: 614397 - DNA, 20 bp, mouse
ggtaggtagcgactacagtt

SEQ ID NO: 614398 - DNA, 20 bp, mouse
gcagttcattgggaccatcc

SEQ ID NO: 614399 - DNA, 20 bp, mouse
gtcgctacctacagccagga

SEQ ID NO: 614400 - DNA, 20 bp, mouse
gttgggaccatcctggctgt

SEQ ID NO: 614401 - DNA, 20 bp, mouse
gttagccagggtgagcacgt

SEQ ID NO: 614402 - DNA, 20 bp, mouse
ggtagtcgctacctacagcc

SEQ ID NO: 614403 - DNA, 20 bp, mouse
ggactcagcgcgatggagat

SEQ ID NO: 614404 - DNA, 20 bp, mouse
ggcgatggagatgggcggaa

SEQ ID NO: 614405 - DNA, 20 bp, mouse
ggagagagccagtgaccgag

SEQ ID NO: 614406 - DNA, 20 bp, mouse
gtgcctcgcgctggatctag

SEQ ID NO: 614407 - DNA, 20 bp, mouse
gacgctgcccaggcccctcc

SEQ ID NO: 614408 - DNA, 20 bp, mouse
gtggcgacagtggcgacctg

SEQ ID NO: 614409 - DNA, 20 bp, mouse
gggcgacctggggatcgacc

SEQ ID NO: 614410 - DNA, 20 bp, mouse
gcctggggatcgacctggag

SEQ ID NO: 614411 - DNA, 20 bp, mouse
gagctcgcggccagtggcgg

SEQ ID NO: 614412 - DNA, 20 bp, mouse
gtgcggcctcaggaccaccg

SEQ ID NO: 614413 - DNA, 20 bp, mouse
ggtgacgtgacgggaaaagg

SEQ ID NO: 614414 - DNA, 20 bp, mouse
gtacctggcatcccggcgag

SEQ ID NO: 614415 - DNA, 20 bp, mouse
gaggaagcgtgtctgaggga

SEQ ID NO: 614416 - DNA, 20 bp, mouse
gaaagccgcgtcccggagac

SEQ ID NO: 614417 - DNA, 20 bp, mouse
gccgggacgcggctttgtct

SEQ ID NO: 614418 - DNA, 20 bp, mouse
gggcgctggagtcccctcag

SEQ ID NO: 614419 - DNA, 20 bp, mouse
gaccgtcgcggggacccaga

SEQ ID NO: 614420 - DNA, 20 bp, mouse
gaatcccctcgcccgtctcc

SEQ ID NO: 614421 - DNA, 20 bp, mouse
gccgagcagaagtgacccga

SEQ ID NO: 614422 - DNA, 20 bp, mouse
ggttggtttcggcgagaagg

SEQ ID NO: 614423 - DNA, 20 bp, mouse
ggggcccggccgggattagt

SEQ ID NO: 614424 - DNA, 20 bp, mouse
gtcgcggggacccagaggga

SEQ ID NO: 614425 - DNA, 20 bp, mouse
gctcgcccgtctccgggacg

SEQ ID NO: 614426 - DNA, 20 bp, mouse
ggcgccgcgctaggcaggca

SEQ ID NO: 614427 - DNA, 20 bp, mouse
gagtgcgggccgccagactc

SEQ ID NO: 614428 - DNA, 20 bp, mouse
gcccggggagtctcacatcg

SEQ ID NO: 614429 - DNA, 20 bp, mouse
gtgtgcgcggcactagagga

SEQ ID NO: 614430 - DNA, 20 bp, mouse
gtcgcggcgccgcgctaggc

SEQ ID NO: 614431 - DNA, 20 bp, mouse
gactagaggagggaccagtg

SEQ ID NO: 614432 - DNA, 20 bp, mouse
gctgccctgcctgcctagcg

SEQ ID NO: 614433 - DNA, 20 bp, mouse
gcacatcgcggcgccgcgct

SEQ ID NO: 614434 - DNA, 20 bp, mouse
gtgctgggctcgcccgagtc

SEQ ID NO: 614435 - DNA, 20 bp, mouse
gcccagcgcgtgggagggga

SEQ ID NO: 614436 - DNA, 20 bp, mouse
ggggctaccagaagcaaccg

SEQ ID NO: 614437 - DNA, 20 bp, mouse
gggcgctgcagctagttggt

SEQ ID NO: 614438 - DNA, 20 bp, mouse
ggagtggcgctgcagctagt

SEQ ID NO: 614439 - DNA, 20 bp, mouse
ggaggcgcggacggatggag

SEQ ID NO: 614440 - DNA, 20 bp, mouse
gccagaagcaaccggggcgg

SEQ ID NO: 614441 - DNA, 20 bp, mouse
gcgcgcgcgaggggattcgg

SEQ ID NO: 614442 - DNA, 20 bp, mouse
gtgaagacgctggagactga

SEQ ID NO: 614443 - DNA, 20 bp, mouse
gcgcgagccgcggtctacgt

SEQ ID NO: 614444 - DNA, 20 bp, mouse
ggtagggccgaggacgagaa

SEQ ID NO: 614445 - DNA, 20 bp, mouse
gctttcggttctaggagtag

SEQ ID NO: 614446 - DNA, 20 bp, mouse
gaggccgggctcctgcgctg

SEQ ID NO: 614447 - DNA, 20 bp, mouse
gtgatgcgcgaggtcaggag

SEQ ID NO: 614448 - DNA, 20 bp, mouse
gagcagagctgcgggtgctg

SEQ ID NO: 614449 - DNA, 20 bp, mouse
gggtgtcgccgtgctcgtca

SEQ ID NO: 614450 - DNA, 20 bp, mouse
gacaacaaaaggacccggac

SEQ ID NO: 614451 - DNA, 20 bp, mouse
gtcacggcagggagagagtc

SEQ ID NO: 614452 - DNA, 20 bp, mouse
gcaaaaggacccggacgggc

SEQ ID NO: 614453 - DNA, 20 bp, mouse
gggcgacaccgagaacctgc

SEQ ID NO: 614454 - DNA, 20 bp, mouse
gcgaccgcagcgcaggagcc

SEQ ID NO: 614455 - DNA, 20 bp, mouse
gcgggcgggtctccgggtaa

SEQ ID NO: 614456 - DNA, 20 bp, mouse
gagacggcggggctcccgaa

SEQ ID NO: 614457 - DNA, 20 bp, mouse
gccggggacgggccgagaga

SEQ ID NO: 614458 - DNA, 20 bp, mouse
ggacgggccgagagacggcg

SEQ ID NO: 614459 - DNA, 20 bp, mouse
gcaactggagccgcataccg

SEQ ID NO: 614460 - DNA, 20 bp, mouse
ggccgctgcgcccgggctca

SEQ ID NO: 614461 - DNA, 20 bp, mouse
gcagctccgggcgtccgttc

SEQ ID NO: 614462 - DNA, 20 bp, mouse
gggaggtcgggactcacctg

SEQ ID NO: 614463 - DNA, 20 bp, mouse
gcggcttggagcaaccaata

SEQ ID NO: 614464 - DNA, 20 bp, mouse
gtgtcctctggtgacccggt

SEQ ID NO: 614465 - DNA, 20 bp, mouse
ggcgcccaccgggtcaccag

SEQ ID NO: 614466 - DNA, 20 bp, mouse
gatggctggtgtgtcctcgg

SEQ ID NO: 614467 - DNA, 20 bp, mouse
ggctggtgtgtcctcggagg

SEQ ID NO: 614468 - DNA, 20 bp, mouse
gggcatggctggtgtgtcct

SEQ ID NO: 614469 - DNA, 20 bp, mouse
gggcaaggcaactcacagaa

SEQ ID NO: 614470 - DNA, 20 bp, mouse
gctcctgcaccgtccgccga

SEQ ID NO: 614471 - DNA, 20 bp, mouse
gtgcgggagaccggtgggac

SEQ ID NO: 614472 - DNA, 20 bp, mouse
gaccgggctccgagttccgg

SEQ ID NO: 614473 - DNA, 20 bp, mouse
gcggctcggccgtcggcgga

SEQ ID NO: 614474 - DNA, 20 bp, mouse
gagatgcttaaaactaccca

SEQ ID NO: 614475 - DNA, 20 bp, mouse
gattagaactcgggaaattt

SEQ ID NO: 614476 - DNA, 20 bp, mouse
gaacacatcctgccacacaa

SEQ ID NO: 614477 - DNA, 20 bp, mouse
gatagcaacccgggatccaa

SEQ ID NO: 614478 - DNA, 20 bp, mouse
gctgaggaacagctgtaact

SEQ ID NO: 614479 - DNA, 20 bp, mouse
ggagcactgggggatgtaaa

SEQ ID NO: 614480 - DNA, 20 bp, mouse
gtgtaaacggaacgggttct

SEQ ID NO: 614481 - DNA, 20 bp, mouse
gctgcttccggcttgagcag

SEQ ID NO: 614482 - DNA, 20 bp, mouse
gctgggggatgtaaacggaa

SEQ ID NO: 614483 - DNA, 20 bp, mouse
gtcctggctatcgggagtca

SEQ ID NO: 614484 - DNA, 20 bp, mouse
gtttcgttcatattcatgac

SEQ ID NO: 614485 - DNA, 20 bp, mouse
ggcgaactgagcagcagaca

SEQ ID NO: 614486 - DNA, 20 bp, mouse
gagtgcgaggagcagggtgc

SEQ ID NO: 614487 - DNA, 20 bp, mouse
gcgctgcagtgcgaggagca

SEQ ID NO: 614488 - DNA, 20 bp, mouse
ggcgctcggctgagtaacat

SEQ ID NO: 614489 - DNA, 20 bp, mouse
gggggctgtaggagcaagac

SEQ ID NO: 614490 - DNA, 20 bp, mouse
gagccgagcgctgcagtgcg

SEQ ID NO: 614491 - DNA, 20 bp, mouse
gacagtctctccagtcatgt

SEQ ID NO: 614492 - DNA, 20 bp, mouse
gctgccggggctccaggaca

SEQ ID NO: 614493 - DNA, 20 bp, mouse
gggttggcttccctaagcag

SEQ ID NO: 614494 - DNA, 20 bp, mouse
gctcctcgcactgcagcgct

SEQ ID NO: 614495 - DNA, 20 bp, mouse
ggacaaggtctgaccttaga

SEQ ID NO: 614496 - DNA, 20 bp, mouse
ggcagcgcaaggctctcaga

SEQ ID NO: 614497 - DNA, 20 bp, mouse
gtaagaagataacagaattc

SEQ ID NO: 614498 - DNA, 20 bp, mouse
gaaccctggaagcagaaaag

SEQ ID NO: 614499 - DNA, 20 bp, mouse
gttagcagtgagactggtca

SEQ ID NO: 614500 - DNA, 20 bp, mouse
gcaaggctctcagagggggt

SEQ ID NO: 614501 - DNA, 20 bp, mouse
ggactcaatttagtgaggta

SEQ ID NO: 614502 - DNA, 20 bp, mouse
gttagaagattcgcagcgca

SEQ ID NO: 614503 - DNA, 20 bp, mouse
ggggggggctggcaaaaccc

SEQ ID NO: 614504 - DNA, 20 bp, mouse
ggaaaaggatctctatgcag

SEQ ID NO: 614505 - DNA, 20 bp, mouse
ggcccagactcaatttagtg

SEQ ID NO: 614506 - DNA, 20 bp, mouse
gagctctgggacccgagcta

SEQ ID NO: 614507 - DNA, 20 bp, mouse
gggagcaggtaggcagctct

SEQ ID NO: 614508 - DNA, 20 bp, mouse
gcacctgtagtggacagtgt

SEQ ID NO: 614509 - DNA, 20 bp, mouse
ggtcccgcatccaggcgagg

SEQ ID NO: 614510 - DNA, 20 bp, mouse
ggtcggcgtcggcgagggct

SEQ ID NO: 614511 - DNA, 20 bp, mouse
gccgggccgggcgtcggcgt

SEQ ID NO: 614512 - DNA, 20 bp, mouse
ggccatacccggagattctg

SEQ ID NO: 614513 - DNA, 20 bp, mouse
ggagcctcgtgcgaaatacc

SEQ ID NO: 614514 - DNA, 20 bp, mouse
gaaatacctggccctagctc

SEQ ID NO: 614515 - DNA, 20 bp, mouse
gtatttcgcacgaggctccg

SEQ ID NO: 614516 - DNA, 20 bp, mouse
gaggcgtgcggactgagagt

SEQ ID NO: 614517 - DNA, 20 bp, mouse
gcccggtggggtggactgag

SEQ ID NO: 614518 - DNA, 20 bp, mouse
gaagcatggtaggctcgtgg

SEQ ID NO: 614519 - DNA, 20 bp, mouse
gcccatgagacacctcgcca

SEQ ID NO: 614520 - DNA, 20 bp, mouse
gtgcctgatggcagaggggt

SEQ ID NO: 614521 - DNA, 20 bp, mouse
gaggcacgttacacctaccg

SEQ ID NO: 614522 - DNA, 20 bp, mouse
ggactggtggctgcccggtg

SEQ ID NO: 614523 - DNA, 20 bp, mouse
gcaccgacgtaaagcatggt

SEQ ID NO: 614524 - DNA, 20 bp, mouse
gaccgtggcgaggtgtctca

SEQ ID NO: 614525 - DNA, 20 bp, mouse
gagaaatgagggagatgggc

SEQ ID NO: 614526 - DNA, 20 bp, mouse
gggaagctgcagccggactt

SEQ ID NO: 614527 - DNA, 20 bp, mouse
ggcagcagctctccacaagg

SEQ ID NO: 614528 - DNA, 20 bp, mouse
ggcacctagggacagggcac

SEQ ID NO: 614529 - DNA, 20 bp, mouse
gtccagcagagcttagttgt

SEQ ID NO: 614530 - DNA, 20 bp, mouse
gctccacaaggcggcaccta

SEQ ID NO: 614531 - DNA, 20 bp, mouse
ggaatggggctatagctgca

SEQ ID NO: 614532 - DNA, 20 bp, mouse
gggcgcagcagctctccaca

SEQ ID NO: 614533 - DNA, 20 bp, mouse
gcttccggtgccctgtccct

SEQ ID NO: 614534 - DNA, 20 bp, mouse
gcgcggcgtcggggaagaca

SEQ ID NO: 614535 - DNA, 20 bp, mouse
gcaaggcggcacctagggac

SEQ ID NO: 614536 - DNA, 20 bp, mouse
ggcccagcagcacccacagg

SEQ ID NO: 614537 - DNA, 20 bp, mouse
gcgccggccggagagctcgg

SEQ ID NO: 614538 - DNA, 20 bp, mouse
gcgcagcacgtctggctccg

SEQ ID NO: 614539 - DNA, 20 bp, mouse
gccagcggttcccacagccc

SEQ ID NO: 614540 - DNA, 20 bp, mouse
gcgtctggctccggggctgt

SEQ ID NO: 614541 - DNA, 20 bp, mouse
gagagtggagcgcgccaggg

SEQ ID NO: 614542 - DNA, 20 bp, mouse
gccgtccggggacgacagag

SEQ ID NO: 614543 - DNA, 20 bp, mouse
gccggcctgggagggagtga

SEQ ID NO: 614544 - DNA, 20 bp, mouse
gggagcggcccggcctggga

SEQ ID NO: 614545 - DNA, 20 bp, mouse
gcgcggaggcgacgacaccg

SEQ ID NO: 614546 - DNA, 20 bp, mouse
gaagtcccactcgctaaggg

SEQ ID NO: 614547 - DNA, 20 bp, mouse
gccactcgctaagggcggac

SEQ ID NO: 614548 - DNA, 20 bp, mouse
ggaaggcggaggtcacggaa

SEQ ID NO: 614549 - DNA, 20 bp, mouse
gggccagaaggcggaggtca

SEQ ID NO: 614550 - DNA, 20 bp, mouse
ggtcgtggtagcctcagctc

SEQ ID NO: 614551 - DNA, 20 bp, mouse
ggcttggggccagaaggcgg

SEQ ID NO: 614552 - DNA, 20 bp, mouse
gtttaagtcccactcgctaa

SEQ ID NO: 614553 - DNA, 20 bp, mouse
gggaggtcacggaacggaat

SEQ ID NO: 614554 - DNA, 20 bp, mouse
gttggcgggagaataagatc

SEQ ID NO: 614555 - DNA, 20 bp, mouse
gggtcacggaacggaattgg

SEQ ID NO: 614556 - DNA, 20 bp, mouse
gtgccggcccgacagcatcg

SEQ ID NO: 614557 - DNA, 20 bp, mouse
gaagtgccgggagcccgcga

SEQ ID NO: 614558 - DNA, 20 bp, mouse
ggtctcgccgcgatgctgtc

SEQ ID NO: 614559 - DNA, 20 bp, mouse
gcagcggagcttggggtccg

SEQ ID NO: 614560 - DNA, 20 bp, mouse
gccggcagaccgcgcacagc

SEQ ID NO: 614561 - DNA, 20 bp, mouse
gcgacctgcagcggagcttg

SEQ ID NO: 614562 - DNA, 20 bp, mouse
gcgccgcgatgctgtcgggc

SEQ ID NO: 614563 - DNA, 20 bp, mouse
gaccttgcccgctccggagg

SEQ ID NO: 614564 - DNA, 20 bp, mouse
gagagagaacgaggccacct

SEQ ID NO: 614565 - DNA, 20 bp, mouse
ggggtccgcggccgcgctgc

SEQ ID NO: 614566 - DNA, 20 bp, mouse
gcagctggcacagaactggg

SEQ ID NO: 614567 - DNA, 20 bp, mouse
gaggaggcgggtatccctgg

SEQ ID NO: 614568 - DNA, 20 bp, mouse
gcagctggtcagttccgatg

SEQ ID NO: 614569 - DNA, 20 bp, mouse
gtggttgaagtgaccgaggt

SEQ ID NO: 614570 - DNA, 20 bp, mouse
ggttttttggagcattccaa

SEQ ID NO: 614571 - DNA, 20 bp, mouse
gcaactttgcgggtaagaga

SEQ ID NO: 614572 - DNA, 20 bp, mouse
gagacgcgggcctcacatct

SEQ ID NO: 614573 - DNA, 20 bp, mouse
gccgcaaagttgcaatctgg

SEQ ID NO: 614574 - DNA, 20 bp, mouse
gcacagaactgggcggagtg

SEQ ID NO: 614575 - DNA, 20 bp, mouse
gtgcgggtaagagagggtgc

SEQ ID NO: 614576 - DNA, 20 bp, mouse
gtggagctggggccagccgg

SEQ ID NO: 614577 - DNA, 20 bp, mouse
gtttgtcggacgaggagaca

SEQ ID NO: 614578 - DNA, 20 bp, mouse
ggtacgaggccggcccggag

SEQ ID NO: 614579 - DNA, 20 bp, mouse
gcgccccgtagaaatcgaca

SEQ ID NO: 614580 - DNA, 20 bp, mouse
gggatctggacggtccgcag

SEQ ID NO: 614581 - DNA, 20 bp, mouse
gaggcggttggcagctaccg

SEQ ID NO: 614582 - DNA, 20 bp, mouse
ggacgcgccatcaatacccc

SEQ ID NO: 614583 - DNA, 20 bp, mouse
ggcgccgcggccagccaagg

SEQ ID NO: 614584 - DNA, 20 bp, mouse
gcggctggggaggtcgaccg

SEQ ID NO: 614585 - DNA, 20 bp, mouse
ggccagccgggggaggcggt

SEQ ID NO: 614586 - DNA, 20 bp, mouse
gttgaggatagcagacaccc

SEQ ID NO: 614587 - DNA, 20 bp, mouse
gaggagcacaccgggcagtc

SEQ ID NO: 614588 - DNA, 20 bp, mouse
gaagatgagtgcgtgtggag

SEQ ID NO: 614589 - DNA, 20 bp, mouse
gagccgacaccgggaaattg

SEQ ID NO: 614590 - DNA, 20 bp, mouse
ggagtttcgggcactggcag

SEQ ID NO: 614591 - DNA, 20 bp, mouse
gggcctggaggctgccgagt

SEQ ID NO: 614592 - DNA, 20 bp, mouse
ggtgggtggtggttgagtac

SEQ ID NO: 614593 - DNA, 20 bp, mouse
gaagagagagagaaccgggc

SEQ ID NO: 614594 - DNA, 20 bp, mouse
gacgcactcatcttcctacc

SEQ ID NO: 614595 - DNA, 20 bp, mouse
gtggggaaccgcattcacac

SEQ ID NO: 614596 - DNA, 20 bp, mouse
ggcttccctgcccgccacag

SEQ ID NO: 614597 - DNA, 20 bp, mouse
gagtggaagtcactagttag

SEQ ID NO: 614598 - DNA, 20 bp, mouse
gacttccactgtggcgggca

SEQ ID NO: 614599 - DNA, 20 bp, mouse
gtggcagaacctagccagtc

SEQ ID NO: 614600 - DNA, 20 bp, mouse
gagagatgcagattcctgac

SEQ ID NO: 614601 - DNA, 20 bp, mouse
gtggggtagtagccatacgg

SEQ ID NO: 614602 - DNA, 20 bp, mouse
gcgaggttcgtgacccggag

SEQ ID NO: 614603 - DNA, 20 bp, mouse
gggttcgtgacccggagggg

SEQ ID NO: 614604 - DNA, 20 bp, mouse
gcgccgggtgccggctccag

SEQ ID NO: 614605 - DNA, 20 bp, mouse
gcttgggagacagccgcgaa

SEQ ID NO: 614606 - DNA, 20 bp, mouse
gcccatggggagccagatcc

SEQ ID NO: 614607 - DNA, 20 bp, mouse
gcccagattaggaaaaggac

SEQ ID NO: 614608 - DNA, 20 bp, mouse
gtggcatgcagcgtgatgat

SEQ ID NO: 614609 - DNA, 20 bp, mouse
gagatgacccgaatcctgaa

SEQ ID NO: 614610 - DNA, 20 bp, mouse
gaaggcaagtcggccacaaa

SEQ ID NO: 614611 - DNA, 20 bp, mouse
gtccccatgggtggccgagg

SEQ ID NO: 614612 - DNA, 20 bp, mouse
gctacgtctggaagaggggt

SEQ ID NO: 614613 - DNA, 20 bp, mouse
gcaggattcgggtcatctag

SEQ ID NO: 614614 - DNA, 20 bp, mouse
gcgagatctgctccagagag

SEQ ID NO: 614615 - DNA, 20 bp, mouse
gattcgggtcatctagagga

SEQ ID NO: 614616 - DNA, 20 bp, mouse
ggccagtgggataggactcg

SEQ ID NO: 614617 - DNA, 20 bp, mouse
ggtcctgtcgagaggagtgg

SEQ ID NO: 614618 - DNA, 20 bp, mouse
gtacgtcctgtcgagaggag

SEQ ID NO: 614619 - DNA, 20 bp, mouse
gcgacaggacgtagacacat

SEQ ID NO: 614620 - DNA, 20 bp, mouse
gagacacatcggccaagata

SEQ ID NO: 614621 - DNA, 20 bp, mouse
ggacttctggccagtgggat

SEQ ID NO: 614622 - DNA, 20 bp, mouse
gataggactcgaggtgagac

SEQ ID NO: 614623 - DNA, 20 bp, mouse
ggtgtctacgtcctgtcgag

SEQ ID NO: 614624 - DNA, 20 bp, mouse
gagcctccactcctctcgac

SEQ ID NO: 614625 - DNA, 20 bp, mouse
gacctcgagtcctatcccac

SEQ ID NO: 614626 - DNA, 20 bp, mouse
gtgggtgggagtccagccgg

SEQ ID NO: 614627 - DNA, 20 bp, mouse
gcagcaggctggacctcaca

SEQ ID NO: 614628 - DNA, 20 bp, mouse
gctggaagacgagagcccac

SEQ ID NO: 614629 - DNA, 20 bp, mouse
ggggaggccctggtcagctg

SEQ ID NO: 614630 - DNA, 20 bp, mouse
gagctttgtttgaggcccaa

SEQ ID NO: 614631 - DNA, 20 bp, mouse
gaccttctgggaccctgatg

SEQ ID NO: 614632 - DNA, 20 bp, mouse
ggagtttgagatgatattga

SEQ ID NO: 614633 - DNA, 20 bp, mouse
gggaatgcagaagcacccat

SEQ ID NO: 614634 - DNA, 20 bp, mouse
gtttatgagactggacagca

SEQ ID NO: 614635 - DNA, 20 bp, mouse
gcatcagacatgggacatag

SEQ ID NO: 614636 - DNA, 20 bp, mouse
ggcgccgggtacctgctcag

SEQ ID NO: 614637 - DNA, 20 bp, mouse
gcggcctctgagcaggtacc

SEQ ID NO: 614638 - DNA, 20 bp, mouse
gggtacccggcgctggtcaa

SEQ ID NO: 614639 - DNA, 20 bp, mouse
gggggcgctgacccagtatc

SEQ ID NO: 614640 - DNA, 20 bp, mouse
gagctgcgcgtgtgacgctg

SEQ ID NO: 614641 - DNA, 20 bp, mouse
ggcgtgggcacaggtcacac

SEQ ID NO: 614642 - DNA, 20 bp, mouse
gactggtgttgggaacggag

SEQ ID NO: 614643 - DNA, 20 bp, mouse
ggctgagagctatagcgcgt

SEQ ID NO: 614644 - DNA, 20 bp, mouse
gcaaggggacctaaagactg

SEQ ID NO: 614645 - DNA, 20 bp, mouse
ggtccgctcaggtccaacag

SEQ ID NO: 614646 - DNA, 20 bp, mouse
gggagctcccgactcaggcg

SEQ ID NO: 614647 - DNA, 20 bp, mouse
ggggccaggctgctaagaat

SEQ ID NO: 614648 - DNA, 20 bp, mouse
gtaggctccccgcctgagtc

SEQ ID NO: 614649 - DNA, 20 bp, mouse
gcggggagcctactaggcga

SEQ ID NO: 614650 - DNA, 20 bp, mouse
gctcgcgattggctcaacag

SEQ ID NO: 614651 - DNA, 20 bp, mouse
gctgccggcacagcagacac

SEQ ID NO: 614652 - DNA, 20 bp, mouse
ggcagccgcagcgccagccg

SEQ ID NO: 614653 - DNA, 20 bp, mouse
ggagcgcaagcgcagcctgc

SEQ ID NO: 614654 - DNA, 20 bp, mouse
gtactaggcgaaggcggcgc

SEQ ID NO: 614655 - DNA, 20 bp, mouse
gtttacggagctcccgactc

SEQ ID NO: 614656 - DNA, 20 bp, mouse
gggcggctggaggaaataca

SEQ ID NO: 614657 - DNA, 20 bp, mouse
ggaaatacacggagcctcag

SEQ ID NO: 614658 - DNA, 20 bp, mouse
gagcatggtggggccggaga

SEQ ID NO: 614659 - DNA, 20 bp, mouse
gcactgggaactcctccctc

SEQ ID NO: 614660 - DNA, 20 bp, mouse
gcgcgcccacgggacacact

SEQ ID NO: 614661 - DNA, 20 bp, mouse
gggctgcggcagcagcatgg

SEQ ID NO: 614662 - DNA, 20 bp, mouse
gccggtttggtcgggcgggt

SEQ ID NO: 614663 - DNA, 20 bp, mouse
ggtttggtcgggcgggtcgg

SEQ ID NO: 614664 - DNA, 20 bp, mouse
gggagtcgagtcagacccac

SEQ ID NO: 614665 - DNA, 20 bp, mouse
gctgagaaccggaacaagaa

SEQ ID NO: 614666 - DNA, 20 bp, mouse
ggagacctcaggagcagctt

SEQ ID NO: 614667 - DNA, 20 bp, mouse
gtcctgtgccaaggagagag

SEQ ID NO: 614668 - DNA, 20 bp, mouse
gctctcccagggccccagca

SEQ ID NO: 614669 - DNA, 20 bp, mouse
gtgctgtgcacgccatgctg

SEQ ID NO: 614670 - DNA, 20 bp, mouse
gctgaggggtgggaactctg

SEQ ID NO: 614671 - DNA, 20 bp, mouse
gccttgggagtgggaacgac

SEQ ID NO: 614672 - DNA, 20 bp, mouse
gcctgggagaggcttcagca

SEQ ID NO: 614673 - DNA, 20 bp, mouse
gagcagaggacaggttatgg

SEQ ID NO: 614674 - DNA, 20 bp, mouse
gtccccaagatgctgtagat

SEQ ID NO: 614675 - DNA, 20 bp, mouse
gggagtatcctcctgtgcca

SEQ ID NO: 614676 - DNA, 20 bp, mouse
gccgcgtggacccttccgaa

SEQ ID NO: 614677 - DNA, 20 bp, mouse
gcgggtcctgcccttcggaa

SEQ ID NO: 614678 - DNA, 20 bp, mouse
gatgttcgggtggagactag

SEQ ID NO: 614679 - DNA, 20 bp, mouse
gctcccggaagaaagactgc

SEQ ID NO: 614680 - DNA, 20 bp, mouse
gccaggccggtcccaactcc

SEQ ID NO: 614681 - DNA, 20 bp, mouse
gggaggaatcgagtcctggg

SEQ ID NO: 614682 - DNA, 20 bp, mouse
gcgagtcctgggaggtgtcc

SEQ ID NO: 614683 - DNA, 20 bp, mouse
gctcgtccgggacacctccc

SEQ ID NO: 614684 - DNA, 20 bp, mouse
gcagctacgataatcatgtt

SEQ ID NO: 614685 - DNA, 20 bp, mouse
gtccaggaggaatcgagtcc

SEQ ID NO: 614686 - DNA, 20 bp, mouse
gcctgtggccagtcacccgg

SEQ ID NO: 614687 - DNA, 20 bp, mouse
gcacggggcggactccggaa

SEQ ID NO: 614688 - DNA, 20 bp, mouse
ggtccctgtggccagtcacc

SEQ ID NO: 614689 - DNA, 20 bp, mouse
ggctgccgcggccccgtctc

SEQ ID NO: 614690 - DNA, 20 bp, mouse
gcccgcctccgccggagacg

SEQ ID NO: 614691 - DNA, 20 bp, mouse
gccccgtgaggagaatggta

SEQ ID NO: 614692 - DNA, 20 bp, mouse
ggcggactccggaagggcag

SEQ ID NO: 614693 - DNA, 20 bp, mouse
ggccagtcacccggcggagc

SEQ ID NO: 614694 - DNA, 20 bp, mouse
gttgtgcgaccagctccgcc

SEQ ID NO: 614695 - DNA, 20 bp, mouse
gaccagctccgccgggtgac

SEQ ID NO: 614696 - DNA, 20 bp, mouse
ggcaagggcagcacttacag

SEQ ID NO: 614697 - DNA, 20 bp, mouse
gggctgattgagcagctcca

SEQ ID NO: 614698 - DNA, 20 bp, mouse
gttgaggagagagaagctct

SEQ ID NO: 614699 - DNA, 20 bp, mouse
gactgcacaagccacagcaa

SEQ ID NO: 614700 - DNA, 20 bp, mouse
gaaaagctgagaacataccg

SEQ ID NO: 614701 - DNA, 20 bp, mouse
gttgtctcttagctcactgg

SEQ ID NO: 614702 - DNA, 20 bp, mouse
gctcttagctcactggagga

SEQ ID NO: 614703 - DNA, 20 bp, mouse
gtcagggtctcgatagatag

SEQ ID NO: 614704 - DNA, 20 bp, mouse
gttagctcactggaggaggg

SEQ ID NO: 614705 - DNA, 20 bp, mouse
gtgcttgtctcttagctcac

SEQ ID NO: 614706 - DNA, 20 bp, mouse
gacgtaatgcgcggagagtg

SEQ ID NO: 614707 - DNA, 20 bp, mouse
gccgagcagcagcgaaaaag

SEQ ID NO: 614708 - DNA, 20 bp, mouse
ggatgtgcccggtgccgggt

SEQ ID NO: 614709 - DNA, 20 bp, mouse
gtggagattgcaatgagatc

SEQ ID NO: 614710 - DNA, 20 bp, mouse
gccagcaagagacagcgagg

SEQ ID NO: 614711 - DNA, 20 bp, mouse
gtccgcagcccgaaagatgg

SEQ ID NO: 614712 - DNA, 20 bp, mouse
gagccagggcgcttccgtag

SEQ ID NO: 614713 - DNA, 20 bp, mouse
gcggggagcagactaggcac

SEQ ID NO: 614714 - DNA, 20 bp, mouse
gccggtgccgggtgggaaga

SEQ ID NO: 614715 - DNA, 20 bp, mouse
gcaaaggcgagagagcgatc

SEQ ID NO: 614716 - DNA, 20 bp, mouse
ggggtctgcatagatctgaa

SEQ ID NO: 614717 - DNA, 20 bp, mouse
ggatctgaagggctccactg

SEQ ID NO: 614718 - DNA, 20 bp, mouse
gtatgcgttgacaagtaggt

SEQ ID NO: 614719 - DNA, 20 bp, mouse
ggcgttgacaagtaggtcgg

SEQ ID NO: 614720 - DNA, 20 bp, mouse
gggcgtatgcgttgacaagt

SEQ ID NO: 614721 - DNA, 20 bp, mouse
gcggatcccgccctccgcag

SEQ ID NO: 614722 - DNA, 20 bp, mouse
gcgggatccggacctgaaca

SEQ ID NO: 614723 - DNA, 20 bp, mouse
gctgaagggctccactgcgg

SEQ ID NO: 614724 - DNA, 20 bp, mouse
gcacggctgccccgggcacc

SEQ ID NO: 614725 - DNA, 20 bp, mouse
ggccagtccgtgttcaggtc

SEQ ID NO: 614726 - DNA, 20 bp, mouse
gggacttaccagctaggtgc

SEQ ID NO: 614727 - DNA, 20 bp, mouse
gcccacaaagaacagctcca

SEQ ID NO: 614728 - DNA, 20 bp, mouse
ggctggtaagtccttctcat

SEQ ID NO: 614729 - DNA, 20 bp, mouse
gggtgcaggcacactccaaa

SEQ ID NO: 614730 - DNA, 20 bp, mouse
gacttaacttggctgactgt

SEQ ID NO: 614731 - DNA, 20 bp, mouse
gtcagcctcccagaagtcca

SEQ ID NO: 614732 - DNA, 20 bp, mouse
ggctgccttggacttctggg

SEQ ID NO: 614733 - DNA, 20 bp, mouse
gccacggaaggcctccagat

SEQ ID NO: 614734 - DNA, 20 bp, mouse
gccaaggcacttgctccatt

SEQ ID NO: 614735 - DNA, 20 bp, mouse
gggctgctgtgtggtaagag

SEQ ID NO: 614736 - DNA, 20 bp, mouse
ggtgtgcgacgaacaggtgg

SEQ ID NO: 614737 - DNA, 20 bp, mouse
gagaaagctacggccagcta

SEQ ID NO: 614738 - DNA, 20 bp, mouse
gaagctacggccagctacgg

SEQ ID NO: 614739 - DNA, 20 bp, mouse
ggcgacgaacaggtggaggg

SEQ ID NO: 614740 - DNA, 20 bp, mouse
gccagctacggaggcttccg

SEQ ID NO: 614741 - DNA, 20 bp, mouse
gcagcagcggggattgagag

SEQ ID NO: 614742 - DNA, 20 bp, mouse
gtccactgtgtgcgacgaac

SEQ ID NO: 614743 - DNA, 20 bp, mouse
gacctgttcgtcgcacacag

SEQ ID NO: 614744 - DNA, 20 bp, mouse
gattgagagaggaagtgccg

SEQ ID NO: 614745 - DNA, 20 bp, mouse
gggctgaagtcaaggcgtag

SEQ ID NO: 614746 - DNA, 20 bp, mouse
ggctgtggtagaggctggcc

SEQ ID NO: 614747 - DNA, 20 bp, mouse
gttttatagtgcttgaacat

SEQ ID NO: 614748 - DNA, 20 bp, mouse
gaccagcactgtagagagag

SEQ ID NO: 614749 - DNA, 20 bp, mouse
ggcttgaacatgggcatgcc

SEQ ID NO: 614750 - DNA, 20 bp, mouse
ggtatggcagtcattagcca

SEQ ID NO: 614751 - DNA, 20 bp, mouse
ggaaagatgaccaaccatgg

SEQ ID NO: 614752 - DNA, 20 bp, mouse
gagacctgtaccgtccagta

SEQ ID NO: 614753 - DNA, 20 bp, mouse
gttcagatgagtccactgta

SEQ ID NO: 614754 - DNA, 20 bp, mouse
ggagaaaacaggacatattt

SEQ ID NO: 614755 - DNA, 20 bp, mouse
gcatatttgggaagagtgga

SEQ ID NO: 614756 - DNA, 20 bp, mouse
gggccagaggctctcatcgt

SEQ ID NO: 614757 - DNA, 20 bp, mouse
gaccgtcgggaaggtggctg

SEQ ID NO: 614758 - DNA, 20 bp, mouse
gacctcagccaccttcccga

SEQ ID NO: 614759 - DNA, 20 bp, mouse
ggggcccaaaacccaccgtc

SEQ ID NO: 614760 - DNA, 20 bp, mouse
gagctggaatgaggcatcag

SEQ ID NO: 614761 - DNA, 20 bp, mouse
gaaacccaccgtcgggaagg

SEQ ID NO: 614762 - DNA, 20 bp, mouse
gtgcctacgatgagagcctc

SEQ ID NO: 614763 - DNA, 20 bp, mouse
gccaaaacccaccgtcggga

SEQ ID NO: 614764 - DNA, 20 bp, mouse
gcatgggtcctaggaaggtg

SEQ ID NO: 614765 - DNA, 20 bp, mouse
gggcaggttccagatggtgg

SEQ ID NO: 614766 - DNA, 20 bp, mouse
ggagcagccccactcacctc

SEQ ID NO: 614767 - DNA, 20 bp, mouse
gcggagggatcaggaagcgg

SEQ ID NO: 614768 - DNA, 20 bp, mouse
ggccgaagcgcagcaggagg

SEQ ID NO: 614769 - DNA, 20 bp, mouse
gccgcgtcctgaggtgagtg

SEQ ID NO: 614770 - DNA, 20 bp, mouse
gggacgcggccggagggatc

SEQ ID NO: 614771 - DNA, 20 bp, mouse
ggcgctgcgcccgcgtcctg

SEQ ID NO: 614772 - DNA, 20 bp, mouse
gaactcgcggatcccttccc

SEQ ID NO: 614773 - DNA, 20 bp, mouse
ggcggccgaagcgcagcagg

SEQ ID NO: 614774 - DNA, 20 bp, mouse
gggaggaggacgcggccgga

SEQ ID NO: 614775 - DNA, 20 bp, mouse
ggtggggctgctccggggaa

SEQ ID NO: 614776 - DNA, 20 bp, mouse
gagccagtctaggatgacag

SEQ ID NO: 614777 - DNA, 20 bp, mouse
gtacgtgcaagaagacatgg

SEQ ID NO: 614778 - DNA, 20 bp, mouse
ggaaacaggctaggtaccaa

SEQ ID NO: 614779 - DNA, 20 bp, mouse
gtgagaagtctaggtctgtt

SEQ ID NO: 614780 - DNA, 20 bp, mouse
gatgctacagcaaaaaaggt

SEQ ID NO: 614781 - DNA, 20 bp, mouse
gtgcctctgtcatcctagac

SEQ ID NO: 614782 - DNA, 20 bp, mouse
ggaggtagcaatgggaccca

SEQ ID NO: 614783 - DNA, 20 bp, mouse
gtccagctagcccgtggtat

SEQ ID NO: 614784 - DNA, 20 bp, mouse
gcgtgctgtaggttgttgtg

SEQ ID NO: 614785 - DNA, 20 bp, mouse
gaaaaaaggtaggctcttca

SEQ ID NO: 614786 - DNA, 20 bp, mouse
ggcccctaggagcctgaaga

SEQ ID NO: 614787 - DNA, 20 bp, mouse
ggagtgagcaggagctatgt

SEQ ID NO: 614788 - DNA, 20 bp, mouse
ggctcctgctcactcccaac

SEQ ID NO: 614789 - DNA, 20 bp, mouse
ggagctgctgaggcttcccg

SEQ ID NO: 614790 - DNA, 20 bp, mouse
gctcgaccctggggccacat

SEQ ID NO: 614791 - DNA, 20 bp, mouse
gcagggaccaccccatgggg

SEQ ID NO: 614792 - DNA, 20 bp, mouse
gccagggtcgagcccagttg

SEQ ID NO: 614793 - DNA, 20 bp, mouse
ggcagctccacaggtgaagt

SEQ ID NO: 614794 - DNA, 20 bp, mouse
ggcttcccgtggctgcccct

SEQ ID NO: 614795 - DNA, 20 bp, mouse
ggatttccagcccggccaag

SEQ ID NO: 614796 - DNA, 20 bp, mouse
gtcggcggcgagagttcttg

SEQ ID NO: 614797 - DNA, 20 bp, mouse
gtcccggtaagcgcaaggga

SEQ ID NO: 614798 - DNA, 20 bp, mouse
gctcaggcgtgggagagagt

SEQ ID NO: 614799 - DNA, 20 bp, mouse
gcaggtcccggtaagcgcaa

SEQ ID NO: 614800 - DNA, 20 bp, mouse
ggactcgggcccggatgctg

SEQ ID NO: 614801 - DNA, 20 bp, mouse
gacgccgcggctttaagccg

SEQ ID NO: 614802 - DNA, 20 bp, mouse
gctgcgctggagcggatgga

SEQ ID NO: 614803 - DNA, 20 bp, mouse
gccggatgctgggggctagt

SEQ ID NO: 614804 - DNA, 20 bp, mouse
ggagagtcggtgcagcacga

SEQ ID NO: 614805 - DNA, 20 bp, mouse
gcgacggctccacggagaag

SEQ ID NO: 614806 - DNA, 20 bp, mouse
ggagctgtgtccacaatcag

SEQ ID NO: 614807 - DNA, 20 bp, mouse
gggcccaggccgtgaaagca

SEQ ID NO: 614808 - DNA, 20 bp, mouse
ggcctctgtagcagcatcgg

SEQ ID NO: 614809 - DNA, 20 bp, mouse
gcggctgttcctgaagtgtc

SEQ ID NO: 614810 - DNA, 20 bp, mouse
ggaggcctctgtagcagcat

SEQ ID NO: 614811 - DNA, 20 bp, mouse
gcaggtactgccgcccgggt

SEQ ID NO: 614812 - DNA, 20 bp, mouse
gagcctggtccctacccggg

SEQ ID NO: 614813 - DNA, 20 bp, mouse
gaactctggacgaaaaccca

SEQ ID NO: 614814 - DNA, 20 bp, mouse
gtgccgcccgggtagggacc

SEQ ID NO: 614815 - DNA, 20 bp, mouse
gagaaggccttgcaacacat

SEQ ID NO: 614816 - DNA, 20 bp, mouse
gaccgctgagttccagccat

SEQ ID NO: 614817 - DNA, 20 bp, mouse
gttccagccatgggttcttc

SEQ ID NO: 614818 - DNA, 20 bp, mouse
ggaactccgacgcggaccca

SEQ ID NO: 614819 - DNA, 20 bp, mouse
gtacagtagggaccacattt

SEQ ID NO: 614820 - DNA, 20 bp, mouse
ggcagccacttcagccccgg

SEQ ID NO: 614821 - DNA, 20 bp, mouse
gtaaacctccggggctgaag

SEQ ID NO: 614822 - DNA, 20 bp, mouse
gccgcccgcatccccgcttc

SEQ ID NO: 614823 - DNA, 20 bp, mouse
gcgctgtctataaacctccg

SEQ ID NO: 614824 - DNA, 20 bp, mouse
gtagggaccacatttgggaa

SEQ ID NO: 614825 - DNA, 20 bp, mouse
ggttcaacatcatccagaag

SEQ ID NO: 614826 - DNA, 20 bp, mouse
gctggcattgagggtcacaa

SEQ ID NO: 614827 - DNA, 20 bp, mouse
gagcaggcagtgaacactgt

SEQ ID NO: 614828 - DNA, 20 bp, mouse
gaagttccatgatttaactt

SEQ ID NO: 614829 - DNA, 20 bp, mouse
gagcttctataagaaagaac

SEQ ID NO: 614830 - DNA, 20 bp, mouse
gacagagctactactgctgg

SEQ ID NO: 614831 - DNA, 20 bp, mouse
gcctcttgtacagatgactt

SEQ ID NO: 614832 - DNA, 20 bp, mouse
gtgcatgggtccaacagact

SEQ ID NO: 614833 - DNA, 20 bp, mouse
gtcattgttccagactccta

SEQ ID NO: 614834 - DNA, 20 bp, mouse
gcatattagatgagcaagga

SEQ ID NO: 614835 - DNA, 20 bp, mouse
ggagacagagctactactgc

SEQ ID NO: 614836 - DNA, 20 bp, mouse
gcaagacctgagttaagaca

SEQ ID NO: 614837 - DNA, 20 bp, mouse
gaacaggagtgctctcattt

SEQ ID NO: 614838 - DNA, 20 bp, mouse
gtaaataagtcagagtggaa

SEQ ID NO: 614839 - DNA, 20 bp, mouse
ggaacactggagttgagatg

SEQ ID NO: 614840 - DNA, 20 bp, mouse
ggatcagagaatataaaaaa

SEQ ID NO: 614841 - DNA, 20 bp, mouse
gtaggaaaatgactcatagt

SEQ ID NO: 614842 - DNA, 20 bp, mouse
ggccatgaaccccatcatca

SEQ ID NO: 614843 - DNA, 20 bp, mouse
ggaagacacctggaagatac

SEQ ID NO: 614844 - DNA, 20 bp, mouse
gtgagctattgggcccatat

SEQ ID NO: 614845 - DNA, 20 bp, mouse
ggaatcaggcctgagctatt

SEQ ID NO: 614846 - DNA, 20 bp, mouse
gctagaagaaggaagagcat

SEQ ID NO: 614847 - DNA, 20 bp, mouse
gaagagcatgggttaaggca

SEQ ID NO: 614848 - DNA, 20 bp, mouse
ggtccacggcttctagaaga

SEQ ID NO: 614849 - DNA, 20 bp, mouse
gattatacacgagagaggaa

SEQ ID NO: 614850 - DNA, 20 bp, mouse
gggacattggggtagagata

SEQ ID NO: 614851 - DNA, 20 bp, mouse
ggaggaaaggataataaacc

SEQ ID NO: 614852 - DNA, 20 bp, mouse
gattgggtaacctcaggtgg

SEQ ID NO: 614853 - DNA, 20 bp, mouse
gaccacattatacacgagag

SEQ ID NO: 614854 - DNA, 20 bp, mouse
ggggtagagatagggtgaaa

SEQ ID NO: 614855 - DNA, 20 bp, mouse
gcctgaggttacccaatctt

SEQ ID NO: 614856 - DNA, 20 bp, mouse
gtgagtacccactagagggt

SEQ ID NO: 614857 - DNA, 20 bp, mouse
gcgcatgagtacccactaga

SEQ ID NO: 614858 - DNA, 20 bp, mouse
gccagcacccaccctctagt

SEQ ID NO: 614859 - DNA, 20 bp, mouse
gtagcggtagggaggagtag

SEQ ID NO: 614860 - DNA, 20 bp, mouse
ggtcgtggcccgagagattg

SEQ ID NO: 614861 - DNA, 20 bp, mouse
gtgcgcaagcgccaaagcac

SEQ ID NO: 614862 - DNA, 20 bp, mouse
gctcccagcatgctccgggg

SEQ ID NO: 614863 - DNA, 20 bp, mouse
ggggcggggaggcaacgact

SEQ ID NO: 614864 - DNA, 20 bp, mouse
gcgaccgtgaaggccaagga

SEQ ID NO: 614865 - DNA, 20 bp, mouse
gacggtcggacgagaaccga

SEQ ID NO: 614866 - DNA, 20 bp, mouse
ggtaggctggagggactgtg

SEQ ID NO: 614867 - DNA, 20 bp, mouse
gcggcgccctgtaggctgga

SEQ ID NO: 614868 - DNA, 20 bp, mouse
gctgagggggaggagacggt

SEQ ID NO: 614869 - DNA, 20 bp, mouse
gtgctgcgcgtccaagatgg

SEQ ID NO: 614870 - DNA, 20 bp, mouse
gaggtgctgcgcgtccaaga

SEQ ID NO: 614871 - DNA, 20 bp, mouse
gcaagatggcggcgccctgt

SEQ ID NO: 614872 - DNA, 20 bp, mouse
ggtgaggtaaacagctgagg

SEQ ID NO: 614873 - DNA, 20 bp, mouse
gagacggtgggtgagtacgg

SEQ ID NO: 614874 - DNA, 20 bp, mouse
gatggcggcgccctgtaggc

SEQ ID NO: 614875 - DNA, 20 bp, mouse
ggacgcttcacgccaggggg

SEQ ID NO: 614876 - DNA, 20 bp, mouse
gtcctcctgcacccagggaa

SEQ ID NO: 614877 - DNA, 20 bp, mouse
gagggaagggcgcacacccc

SEQ ID NO: 614878 - DNA, 20 bp, mouse
ggcgcaacccgtacttccgg

SEQ ID NO: 614879 - DNA, 20 bp, mouse
gaagcgctaggacttgtcag

SEQ ID NO: 614880 - DNA, 20 bp, mouse
gggcagctgccctgggccgg

SEQ ID NO: 614881 - DNA, 20 bp, mouse
gagcctcgcccccggaagta

SEQ ID NO: 614882 - DNA, 20 bp, mouse
ggcggggtgagtagccctgg

SEQ ID NO: 614883 - DNA, 20 bp, mouse
gaggaggacctgcgcgcgaa

SEQ ID NO: 614884 - DNA, 20 bp, mouse
gggcccgctcacattcgcaa

SEQ ID NO: 614885 - DNA, 20 bp, mouse
gcgcaggtcctcctgcaccc

SEQ ID NO: 614886 - DNA, 20 bp, mouse
ggctcagggcgtgagaacgg

SEQ ID NO: 614887 - DNA, 20 bp, mouse
ggtggagccggcagccgagt

SEQ ID NO: 614888 - DNA, 20 bp, mouse
ggcagcagctcggtcctact

SEQ ID NO: 614889 - DNA, 20 bp, mouse
ggccgggcggcctcctctag

SEQ ID NO: 614890 - DNA, 20 bp, mouse
ggcagctcagggcgtgagaa

SEQ ID NO: 614891 - DNA, 20 bp, mouse
gggcgtgagaacggtggtgc

SEQ ID NO: 614892 - DNA, 20 bp, mouse
ggccggctccactcctctag

SEQ ID NO: 614893 - DNA, 20 bp, mouse
gggctccactcctctagagg

SEQ ID NO: 614894 - DNA, 20 bp, mouse
gggtgctggctcgagtgacc

SEQ ID NO: 614895 - DNA, 20 bp, mouse
ggagctgctgcagacgcgcc

SEQ ID NO: 614896 - DNA, 20 bp, mouse
gcgggctggactgaccgcgg

SEQ ID NO: 614897 - DNA, 20 bp, mouse
gcgccgggctggactgaccg

SEQ ID NO: 614898 - DNA, 20 bp, mouse
gcggcccgagcgtggtccag

SEQ ID NO: 614899 - DNA, 20 bp, mouse
gccgagcgtggtccaggggc

SEQ ID NO: 614900 - DNA, 20 bp, mouse
ggcccacgccgccaagtcac

SEQ ID NO: 614901 - DNA, 20 bp, mouse
gccccaccggaaaccgagaa

SEQ ID NO: 614902 - DNA, 20 bp, mouse
gaccgagaagggccgagcac

SEQ ID NO: 614903 - DNA, 20 bp, mouse
gcggtcagcaggcccggctg

SEQ ID NO: 614904 - DNA, 20 bp, mouse
gtcgctgaggagttgaattg

SEQ ID NO: 614905 - DNA, 20 bp, mouse
gcggcgtgggccgtagaccc

SEQ ID NO: 614906 - DNA, 20 bp, mouse
gtgaagagaagtgactccaa

SEQ ID NO: 614907 - DNA, 20 bp, mouse
gctctgagtctgggttggac

SEQ ID NO: 614908 - DNA, 20 bp, mouse
ggcgctcgagttagagtcag

SEQ ID NO: 614909 - DNA, 20 bp, mouse
gtggcgcgccgctataggat

SEQ ID NO: 614910 - DNA, 20 bp, mouse
gattatctctgagtctgggt

SEQ ID NO: 614911 - DNA, 20 bp, mouse
gagggccggcgagctaggca

SEQ ID NO: 614912 - DNA, 20 bp, mouse
gaccttaggggcctgcaata

SEQ ID NO: 614913 - DNA, 20 bp, mouse
ggccaaagcctatcctatag

SEQ ID NO: 614914 - DNA, 20 bp, mouse
ggcagggcggagccctcaca

SEQ ID NO: 614915 - DNA, 20 bp, mouse
ggctaggtccggagttcggt

SEQ ID NO: 614916 - DNA, 20 bp, mouse
gccagagacccagaccgaga

SEQ ID NO: 614917 - DNA, 20 bp, mouse
gacatccagtggggccacgt

SEQ ID NO: 614918 - DNA, 20 bp, mouse
gtccagtggggccacgtggg

SEQ ID NO: 614919 - DNA, 20 bp, mouse
gcctcagctccgctccgtct

SEQ ID NO: 614920 - DNA, 20 bp, mouse
gcacggcaggcagcaatcaa

SEQ ID NO: 614921 - DNA, 20 bp, mouse
gagctgagagatacatccag

SEQ ID NO: 614922 - DNA, 20 bp, mouse
gctccgctccgtctcggtct

SEQ ID NO: 614923 - DNA, 20 bp, mouse
gtcctcccacgtggccccac

SEQ ID NO: 614924 - DNA, 20 bp, mouse
gactctgcgaggcatctcgg

SEQ ID NO: 614925 - DNA, 20 bp, mouse
gtgcctcgcagagtgagatg

SEQ ID NO: 614926 - DNA, 20 bp, mouse
gtgggcagagcagggttctt

SEQ ID NO: 614927 - DNA, 20 bp, mouse
gcagagcagggttcttcgga

SEQ ID NO: 614928 - DNA, 20 bp, mouse
gggttcttcggatggatgcc

SEQ ID NO: 614929 - DNA, 20 bp, mouse
ggtcaggcagagtgcctggg

SEQ ID NO: 614930 - DNA, 20 bp, mouse
ggaccagcaatcggtaagtc

SEQ ID NO: 614931 - DNA, 20 bp, mouse
gcagcccagccgagtacctg

SEQ ID NO: 614932 - DNA, 20 bp, mouse
ggtggtggggatggcgccag

SEQ ID NO: 614933 - DNA, 20 bp, mouse
gcaccctgccctccccctca

SEQ ID NO: 614934 - DNA, 20 bp, mouse
gaggaggtcccgatacccct

SEQ ID NO: 614935 - DNA, 20 bp, mouse
gccaggggcaccccgaaaaa

SEQ ID NO: 614936 - DNA, 20 bp, mouse
gccgctcggccagaagcaga

SEQ ID NO: 614937 - DNA, 20 bp, mouse
gaggaggcgcgaggccagca

SEQ ID NO: 614938 - DNA, 20 bp, mouse
ggggcacacaccctaaggtc

SEQ ID NO: 614939 - DNA, 20 bp, mouse
gtggatgggcacacacccta

SEQ ID NO: 614940 - DNA, 20 bp, mouse
gccctctccggcccgcgtct

SEQ ID NO: 614941 - DNA, 20 bp, mouse
ggtgcaccgcaaaccccgct

SEQ ID NO: 614942 - DNA, 20 bp, mouse
gttaatggagggctcatcag

SEQ ID NO: 614943 - DNA, 20 bp, mouse
gcagtgtgcgcggcgggaag

SEQ ID NO: 614944 - DNA, 20 bp, mouse
gtctccggcccgcgtctcgg

SEQ ID NO: 614945 - DNA, 20 bp, mouse
gcacacaccctaaggtcagg

SEQ ID NO: 614946 - DNA, 20 bp, mouse
gtaacggtgggcgcgcgtgg

SEQ ID NO: 614947 - DNA, 20 bp, mouse
ggacacagaacgcgagaaac

SEQ ID NO: 614948 - DNA, 20 bp, mouse
gatgatgaggagcccacgag

SEQ ID NO: 614949 - DNA, 20 bp, mouse
gcggcccaggagctgtgcag

SEQ ID NO: 614950 - DNA, 20 bp, mouse
gccccccggttgccgggtaa

SEQ ID NO: 614951 - DNA, 20 bp, mouse
gcccggttgccgggtaacgg

SEQ ID NO: 614952 - DNA, 20 bp, mouse
gcccatcctcagcccctcgt

SEQ ID NO: 614953 - DNA, 20 bp, mouse
gcatgggcacagcgtcccga

SEQ ID NO: 614954 - DNA, 20 bp, mouse
ggctcctgggccgaggtgca

SEQ ID NO: 614955 - DNA, 20 bp, mouse
gcccccactgcacagctcct

SEQ ID NO: 614956 - DNA, 20 bp, mouse
gcgaggtgcagtgtgcgtcg

SEQ ID NO: 614957 - DNA, 20 bp, mouse
gaatctgtcgtactgtcctc

SEQ ID NO: 614958 - DNA, 20 bp, mouse
gtcgtactgtcctcaggcag

SEQ ID NO: 614959 - DNA, 20 bp, mouse
gacagtacgacagattgaaa

SEQ ID NO: 614960 - DNA, 20 bp, mouse
ggaacgcatgcgggagatct

SEQ ID NO: 614961 - DNA, 20 bp, mouse
gctccgccttagccgagagt

SEQ ID NO: 614962 - DNA, 20 bp, mouse
ggctggcgcaagacaggact

SEQ ID NO: 614963 - DNA, 20 bp, mouse
gccacagctggaagaacgat

SEQ ID NO: 614964 - DNA, 20 bp, mouse
gaggcgggaaaggcgaatct

SEQ ID NO: 614965 - DNA, 20 bp, mouse
gggcgtggaagacttcagtc

SEQ ID NO: 614966 - DNA, 20 bp, mouse
gcccgaacccgaacccgggt

SEQ ID NO: 614967 - DNA, 20 bp, mouse
gggagcccgaacccgaaccc

SEQ ID NO: 614968 - DNA, 20 bp, mouse
ggcgggaacctccaccgacc

SEQ ID NO: 614969 - DNA, 20 bp, mouse
gcgcgcgcagccgcagacag

SEQ ID NO: 614970 - DNA, 20 bp, mouse
gcccgaacccgggtcggtgg

SEQ ID NO: 614971 - DNA, 20 bp, mouse
ggaacccgaacccgggtcgg

SEQ ID NO: 614972 - DNA, 20 bp, mouse
ggacggctcggaggcccagg

SEQ ID NO: 614973 - DNA, 20 bp, mouse
gccgtccgggaggaagtcct

SEQ ID NO: 614974 - DNA, 20 bp, mouse
gacctccaccgacccgggtt

SEQ ID NO: 614975 - DNA, 20 bp, mouse
gcctgtgtcgccaagagctg

SEQ ID NO: 614976 - DNA, 20 bp, mouse
gcggtcgctgcgcttcttcc

SEQ ID NO: 614977 - DNA, 20 bp, mouse
gggcgcgcgcgctcaccgag

SEQ ID NO: 614978 - DNA, 20 bp, mouse
gcatccgcggggccagggtc

SEQ ID NO: 614979 - DNA, 20 bp, mouse
ggcggccggtgcacgcgacc

SEQ ID NO: 614980 - DNA, 20 bp, mouse
gcgcagaagcgacatccctc

SEQ ID NO: 614981 - DNA, 20 bp, mouse
gccgtctgtgcgccgatggg

SEQ ID NO: 614982 - DNA, 20 bp, mouse
gaggcagcagaggacagcga

SEQ ID NO: 614983 - DNA, 20 bp, mouse
gtcttcccggtcgcgtgcac

SEQ ID NO: 614984 - DNA, 20 bp, mouse
gccctcgcctggggagagta

SEQ ID NO: 614985 - DNA, 20 bp, mouse
gaggctctggagacttgtgg

SEQ ID NO: 614986 - DNA, 20 bp, mouse
ggtccccacaggcagagggt

SEQ ID NO: 614987 - DNA, 20 bp, mouse
gaggcagagggtaggcgcca

SEQ ID NO: 614988 - DNA, 20 bp, mouse
gggcggcggcgattgtctgg

SEQ ID NO: 614989 - DNA, 20 bp, mouse
gcctctgcctgtggggacgg

SEQ ID NO: 614990 - DNA, 20 bp, mouse
gtgactctcggacaccgcca

SEQ ID NO: 614991 - DNA, 20 bp, mouse
gccggcttcctgcttcgcag

SEQ ID NO: 614992 - DNA, 20 bp, mouse
gggcggcggcggcgattgtc

SEQ ID NO: 614993 - DNA, 20 bp, mouse
gagttctctggagcggggaa

SEQ ID NO: 614994 - DNA, 20 bp, mouse
gctaggccgccttccctctg

SEQ ID NO: 614995 - DNA, 20 bp, mouse
ggggacggaggagcgcgcca

SEQ ID NO: 614996 - DNA, 20 bp, mouse
gggcgggaaggaggagacta

SEQ ID NO: 614997 - DNA, 20 bp, mouse
gccggacggaagtggagcgt

SEQ ID NO: 614998 - DNA, 20 bp, mouse
ggctcaggtacagagcgtga

SEQ ID NO: 614999 - DNA, 20 bp, mouse
gagggcgcgccggacggaag

SEQ ID NO: 615000 - DNA, 20 bp, mouse
gaagtggagcgtaggcgccg

SEQ ID NO: 615001 - DNA, 20 bp, mouse
gtggagcgtaggcgccgggg

SEQ ID NO: 615002 - DNA, 20 bp, mouse
gggctcttcttccacctccc

SEQ ID NO: 615003 - DNA, 20 bp, mouse
ggctcatcccggccactgag

SEQ ID NO: 615004 - DNA, 20 bp, mouse
gctagagaagagccatcccg

SEQ ID NO: 615005 - DNA, 20 bp, mouse
gtgagctccggggagaacga

SEQ ID NO: 615006 - DNA, 20 bp, mouse
gctgttccctccggatgtgt

SEQ ID NO: 615007 - DNA, 20 bp, mouse
gggcagcctacacatccgga

SEQ ID NO: 615008 - DNA, 20 bp, mouse
ggccgaggtgcgcagagccc

SEQ ID NO: 615009 - DNA, 20 bp, mouse
ggcctggcagcctacacatc

SEQ ID NO: 615010 - DNA, 20 bp, mouse
gagtttgcgctgaggtgcca

SEQ ID NO: 615011 - DNA, 20 bp, mouse
gtggcaggtaacaactgtca

SEQ ID NO: 615012 - DNA, 20 bp, mouse
ggcacctcagcgcaaactag

SEQ ID NO: 615013 - DNA, 20 bp, mouse
ggcgcaaactagaggagcta

SEQ ID NO: 615014 - DNA, 20 bp, mouse
gctaacacattgagccagtg

SEQ ID NO: 615015 - DNA, 20 bp, mouse
gtcccgggctctgcgcacct

SEQ ID NO: 615016 - DNA, 20 bp, mouse
ggaagagacaagtccttaac

SEQ ID NO: 615017 - DNA, 20 bp, mouse
ggatttcctagtatccttaa

SEQ ID NO: 615018 - DNA, 20 bp, mouse
gacggaaagcttccctgtta

SEQ ID NO: 615019 - DNA, 20 bp, mouse
gctggcttgtggtaccttta

SEQ ID NO: 615020 - DNA, 20 bp, mouse
gcagcttctcggaaggctga

SEQ ID NO: 615021 - DNA, 20 bp, mouse
ggagagatcatgacaaagaa

SEQ ID NO: 615022 - DNA, 20 bp, mouse
ggagtgctgtcccagcttct

SEQ ID NO: 615023 - DNA, 20 bp, mouse
gaaaatgtacaacttctcat

SEQ ID NO: 615024 - DNA, 20 bp, mouse
gaggatgctttgcgttcagg

SEQ ID NO: 615025 - DNA, 20 bp, mouse
gctagctcacatcccaagaa

SEQ ID NO: 615026 - DNA, 20 bp, mouse
gaagggagagagctctagta

SEQ ID NO: 615027 - DNA, 20 bp, mouse
gagggttactaagaaatcaa

SEQ ID NO: 615028 - DNA, 20 bp, mouse
gagttgctcccgagctctcg

SEQ ID NO: 615029 - DNA, 20 bp, mouse
ggagagagctctagtagggt

SEQ ID NO: 615030 - DNA, 20 bp, mouse
gaacacttgaaagctgttgg

SEQ ID NO: 615031 - DNA, 20 bp, mouse
gtgaaagctgttggcggcga

SEQ ID NO: 615032 - DNA, 20 bp, mouse
ggttgctacctcgagagctc

SEQ ID NO: 615033 - DNA, 20 bp, mouse
gagcaacacttgaaagctgt

SEQ ID NO: 615034 - DNA, 20 bp, mouse
gggtgtggccttcaatgctc

SEQ ID NO: 615035 - DNA, 20 bp, mouse
gacaagcgtgggaaacgcgg

SEQ ID NO: 615036 - DNA, 20 bp, mouse
gcactcatgcaaagtaaggt

SEQ ID NO: 615037 - DNA, 20 bp, mouse
gcagatcctgcagtagtggg

SEQ ID NO: 615038 - DNA, 20 bp, mouse
gaactcactcatgcaaagta

SEQ ID NO: 615039 - DNA, 20 bp, mouse
gccctcatcaggaaatggac

SEQ ID NO: 615040 - DNA, 20 bp, mouse
gatcttacaggttctgcaca

SEQ ID NO: 615041 - DNA, 20 bp, mouse
gtgagcgcatacgagtggag

SEQ ID NO: 615042 - DNA, 20 bp, mouse
gtaaaggcacttcatcttac

SEQ ID NO: 615043 - DNA, 20 bp, mouse
gaagagtgagcgcatacgag

SEQ ID NO: 615044 - DNA, 20 bp, mouse
gctccagatcctgcagtagt

SEQ ID NO: 615045 - DNA, 20 bp, mouse
gttgttcaaacacagtgaaa

SEQ ID NO: 615046 - DNA, 20 bp, mouse
gctgacgctggaagagaccc

SEQ ID NO: 615047 - DNA, 20 bp, mouse
gcggcaggctggggattcgg

SEQ ID NO: 615048 - DNA, 20 bp, mouse
gattttccaagggaccctct

SEQ ID NO: 615049 - DNA, 20 bp, mouse
gtcttccagcgtcagacgca

SEQ ID NO: 615050 - DNA, 20 bp, mouse
gccccgcaggctcctggaca

SEQ ID NO: 615051 - DNA, 20 bp, mouse
gagagacccgggtgcaggag

SEQ ID NO: 615052 - DNA, 20 bp, mouse
gtccagcgggcactaggagt

SEQ ID NO: 615053 - DNA, 20 bp, mouse
gaacgatgaagtagcccaga

SEQ ID NO: 615054 - DNA, 20 bp, mouse
gcccttggaaaatgaggcca

SEQ ID NO: 615055 - DNA, 20 bp, mouse
gccctgtgagtgtcaccagg

SEQ ID NO: 615056 - DNA, 20 bp, mouse
gcggagagtgggcaccgagg

SEQ ID NO: 615057 - DNA, 20 bp, mouse
gggcagcgcggggcacgaag

SEQ ID NO: 615058 - DNA, 20 bp, mouse
ggttatatttcactgaaaag

SEQ ID NO: 615059 - DNA, 20 bp, mouse
gcaacaacaacccggagagt

SEQ ID NO: 615060 - DNA, 20 bp, mouse
gccggcgcatgtatgtacag

SEQ ID NO: 615061 - DNA, 20 bp, mouse
gacccggagagtgggcaccg

SEQ ID NO: 615062 - DNA, 20 bp, mouse
gtcctccccgcacttagtct

SEQ ID NO: 615063 - DNA, 20 bp, mouse
gggcggccaaggccccccgg

SEQ ID NO: 615064 - DNA, 20 bp, mouse
gtccccgcacttagtctagg

SEQ ID NO: 615065 - DNA, 20 bp, mouse
ggaagaagcggcgatcctgg

SEQ ID NO: 615066 - DNA, 20 bp, mouse
gacacacacaagacagggcg

SEQ ID NO: 615067 - DNA, 20 bp, mouse
ggggagagatcactcactgt

SEQ ID NO: 615068 - DNA, 20 bp, mouse
ggaatccgccatcaagatca

SEQ ID NO: 615069 - DNA, 20 bp, mouse
gatcaagatcagggaagagg

SEQ ID NO: 615070 - DNA, 20 bp, mouse
gtgccagcaaacatcgatcc

SEQ ID NO: 615071 - DNA, 20 bp, mouse
gtatgcgagaggacaggagc

SEQ ID NO: 615072 - DNA, 20 bp, mouse
gtcttccctgatcttgatgg

SEQ ID NO: 615073 - DNA, 20 bp, mouse
ggagtgatatgcgagaggac

SEQ ID NO: 615074 - DNA, 20 bp, mouse
gtcgcgcttaaagataaggg

SEQ ID NO: 615075 - DNA, 20 bp, mouse
gtaaggggggaaacaatccc

SEQ ID NO: 615076 - DNA, 20 bp, mouse
ggcacgttcggggatcgcgg

SEQ ID NO: 615077 - DNA, 20 bp, mouse
gggcgcgcagcaggtacgag

SEQ ID NO: 615078 - DNA, 20 bp, mouse
gtccgcacgttcggggatcg

SEQ ID NO: 615079 - DNA, 20 bp, mouse
ggagaagcatcatgccgagg

SEQ ID NO: 615080 - DNA, 20 bp, mouse
ggaaggagggcgggcaaggg

SEQ ID NO: 615081 - DNA, 20 bp, mouse
gcgcggcggagcgcagcgag

SEQ ID NO: 615082 - DNA, 20 bp, mouse
gcgggagaagcatcatgccg

SEQ ID NO: 615083 - DNA, 20 bp, mouse
gccccgaacgtgcggaggga

SEQ ID NO: 615084 - DNA, 20 bp, mouse
gacatagcggggcaactggg

SEQ ID NO: 615085 - DNA, 20 bp, mouse
ggcaggatgctgctgcgccc

SEQ ID NO: 615086 - DNA, 20 bp, mouse
gcgcaccatggcaagcgtgg

SEQ ID NO: 615087 - DNA, 20 bp, mouse
gagatggtgagtctccccct

SEQ ID NO: 615088 - DNA, 20 bp, mouse
gacgcttgccatggtgcggg

SEQ ID NO: 615089 - DNA, 20 bp, mouse
gggccatgttgtcaccaaca

SEQ ID NO: 615090 - DNA, 20 bp, mouse
gcggggggcctgctcccagg

SEQ ID NO: 615091 - DNA, 20 bp, mouse
gcccgcttcgtggatctctt

SEQ ID NO: 615092 - DNA, 20 bp, mouse
gggtgcaggaaacccaccca

SEQ ID NO: 615093 - DNA, 20 bp, mouse
gcctgagcgccgggggggga

SEQ ID NO: 615094 - DNA, 20 bp, mouse
gttcaccaccacgcttgcca

SEQ ID NO: 615095 - DNA, 20 bp, mouse
gtccaaagagatccacgaag

SEQ ID NO: 615096 - DNA, 20 bp, mouse
gcgcctcggcacgctcacct

SEQ ID NO: 615097 - DNA, 20 bp, mouse
gggccaacgccgggtcgcct

SEQ ID NO: 615098 - DNA, 20 bp, mouse
gaactgcagacctgccaggt

SEQ ID NO: 615099 - DNA, 20 bp, mouse
gtcgggaggcgcagcgagat

SEQ ID NO: 615100 - DNA, 20 bp, mouse
gcatagagtcgggggagcaa

SEQ ID NO: 615101 - DNA, 20 bp, mouse
gaggtctgcagttgtcgcct

SEQ ID NO: 615102 - DNA, 20 bp, mouse
gcgcctaggtgagcgtgccg

SEQ ID NO: 615103 - DNA, 20 bp, mouse
ggcccacgcccacgaccccc

SEQ ID NO: 615104 - DNA, 20 bp, mouse
gcgacaactgcagacctgcc

SEQ ID NO: 615105 - DNA, 20 bp, mouse
gccgacagcacccacctggc

SEQ ID NO: 615106 - DNA, 20 bp, mouse
ggataggagggaaagacacc

SEQ ID NO: 615107 - DNA, 20 bp, mouse
gcctgggcagtggtcattga

SEQ ID NO: 615108 - DNA, 20 bp, mouse
gcaagctggctgctcacaag

SEQ ID NO: 615109 - DNA, 20 bp, mouse
gctgataccagacaccttcc

SEQ ID NO: 615110 - DNA, 20 bp, mouse
gtgttttgtcggggagtgaa

SEQ ID NO: 615111 - DNA, 20 bp, mouse
gccaggctaccctgaaactg

SEQ ID NO: 615112 - DNA, 20 bp, mouse
ggagaacaatctgctaacat

SEQ ID NO: 615113 - DNA, 20 bp, mouse
gccccagtcattcattgcaa

SEQ ID NO: 615114 - DNA, 20 bp, mouse
ggaatcaacccacaggaggg

SEQ ID NO: 615115 - DNA, 20 bp, mouse
gacggaatcaacccacagga

SEQ ID NO: 615116 - DNA, 20 bp, mouse
ggggctagtggacgcggcag

SEQ ID NO: 615117 - DNA, 20 bp, mouse
ggccttggcgcaagggctag

SEQ ID NO: 615118 - DNA, 20 bp, mouse
ggccgagcaggacatccgag

SEQ ID NO: 615119 - DNA, 20 bp, mouse
gcgcgggtgtgggaagaccc

SEQ ID NO: 615120 - DNA, 20 bp, mouse
ggagtccgctacttgtttgt

SEQ ID NO: 615121 - DNA, 20 bp, mouse
gccggtgctgactgattgta

SEQ ID NO: 615122 - DNA, 20 bp, mouse
gcgaatccggaaccaagagg

SEQ ID NO: 615123 - DNA, 20 bp, mouse
ggtgggtcgtacttcttcgg

SEQ ID NO: 615124 - DNA, 20 bp, mouse
gggcgccagccttggcgcaa

SEQ ID NO: 615125 - DNA, 20 bp, mouse
gtccggtgcgccgcgggtgt

SEQ ID NO: 615126 - DNA, 20 bp, mouse
ggtgacagcgcacaccaccc

SEQ ID NO: 615127 - DNA, 20 bp, mouse
gcggtgacagccgagcacag

SEQ ID NO: 615128 - DNA, 20 bp, mouse
gcccggctgaggctgcgtga

SEQ ID NO: 615129 - DNA, 20 bp, mouse
gtgcggccgaggggactccg

SEQ ID NO: 615130 - DNA, 20 bp, mouse
ggtgaaggatccgcttccgg

SEQ ID NO: 615131 - DNA, 20 bp, mouse
gtcagcgcggcgtcccgcga

SEQ ID NO: 615132 - DNA, 20 bp, mouse
gggccgaggggactccgcgg

SEQ ID NO: 615133 - DNA, 20 bp, mouse
gcctgggggcgtgcgatgga

SEQ ID NO: 615134 - DNA, 20 bp, mouse
gtgctagcgcggcatcgcaa

SEQ ID NO: 615135 - DNA, 20 bp, mouse
gacgcccccaggggaccctg

SEQ ID NO: 615136 - DNA, 20 bp, mouse
gggactgtacactaccgcaa

SEQ ID NO: 615137 - DNA, 20 bp, mouse
gtgtaggttggccatgactt

SEQ ID NO: 615138 - DNA, 20 bp, mouse
gggtctggtccctatggcaa

SEQ ID NO: 615139 - DNA, 20 bp, mouse
gtgctggggtctggtcccta

SEQ ID NO: 615140 - DNA, 20 bp, mouse
ggcccggccaggtgctacct

SEQ ID NO: 615141 - DNA, 20 bp, mouse
gatgcaggattgagccgttg

SEQ ID NO: 615142 - DNA, 20 bp, mouse
gtccaagccaaggtagcacc

SEQ ID NO: 615143 - DNA, 20 bp, mouse
ggaaacttttacgctcctgt

SEQ ID NO: 615144 - DNA, 20 bp, mouse
gagtggaagaagggcgagag

SEQ ID NO: 615145 - DNA, 20 bp, mouse
ggccaggtgctaccttggct

SEQ ID NO: 615146 - DNA, 20 bp, mouse
gtggcagaacgctgaaggag

SEQ ID NO: 615147 - DNA, 20 bp, mouse
ggaaggaacagaacagctcc

SEQ ID NO: 615148 - DNA, 20 bp, mouse
gtgtgctggcagaacgctga

SEQ ID NO: 615149 - DNA, 20 bp, mouse
gaaactgccactcagtgtgc

SEQ ID NO: 615150 - DNA, 20 bp, mouse
gcactactcacctacaggtg

SEQ ID NO: 615151 - DNA, 20 bp, mouse
gggatctgttgcactccaga

SEQ ID NO: 615152 - DNA, 20 bp, mouse
gaaacacctgccccacctgt

SEQ ID NO: 615153 - DNA, 20 bp, mouse
gtctgagaactagtacaggt

SEQ ID NO: 615154 - DNA, 20 bp, mouse
gcttggcaataggttctgaa

SEQ ID NO: 615155 - DNA, 20 bp, mouse
ggtcaggcaagggtgttgag

SEQ ID NO: 615156 - DNA, 20 bp, mouse
gcagagaagccaagggacac

SEQ ID NO: 615157 - DNA, 20 bp, mouse
gagaaaaccacggagagcag

SEQ ID NO: 615158 - DNA, 20 bp, mouse
gagcacacagctagactggg

SEQ ID NO: 615159 - DNA, 20 bp, mouse
gccctggccactgctctccg

SEQ ID NO: 615160 - DNA, 20 bp, mouse
gggctcacctgagacagcaa

SEQ ID NO: 615161 - DNA, 20 bp, mouse
gtcctaaaataacggtgtcc

SEQ ID NO: 615162 - DNA, 20 bp, mouse
gaacctgttcagagagaccc

SEQ ID NO: 615163 - DNA, 20 bp, mouse
gaccgggacaccgttatttt

SEQ ID NO: 615164 - DNA, 20 bp, mouse
ggagctaggccattaagtgt

SEQ ID NO: 615165 - DNA, 20 bp, mouse
gagtcaggtagactgcaacc

SEQ ID NO: 615166 - DNA, 20 bp, mouse
ggccaggctggatgcagcga

SEQ ID NO: 615167 - DNA, 20 bp, mouse
gcaaggagcgcagggtggag

SEQ ID NO: 615168 - DNA, 20 bp, mouse
gcacactgagcactcggtcc

SEQ ID NO: 615169 - DNA, 20 bp, mouse
gctggatgcagcgagggatc

SEQ ID NO: 615170 - DNA, 20 bp, mouse
gctggggtcgtgccagggac

SEQ ID NO: 615171 - DNA, 20 bp, mouse
ggccgggtaagtgcaggtgg

SEQ ID NO: 615172 - DNA, 20 bp, mouse
gccctggcacgaccccagag

SEQ ID NO: 615173 - DNA, 20 bp, mouse
ggagcgcagggtggagcggg

SEQ ID NO: 615174 - DNA, 20 bp, mouse
gcagcgagggatcgggaatc

SEQ ID NO: 615175 - DNA, 20 bp, mouse
gcagtgtgctctgctttggg

SEQ ID NO: 615176 - DNA, 20 bp, mouse
ggagagccaaagggatgcat

SEQ ID NO: 615177 - DNA, 20 bp, mouse
gagttagcgacgccgacggt

SEQ ID NO: 615178 - DNA, 20 bp, mouse
gctcctcccggagagccaaa

SEQ ID NO: 615179 - DNA, 20 bp, mouse
ggacgccgacggttggagag

SEQ ID NO: 615180 - DNA, 20 bp, mouse
gcgcggtcaggcaaagtcac

SEQ ID NO: 615181 - DNA, 20 bp, mouse
gtggcgccgatgcatccctt

SEQ ID NO: 615182 - DNA, 20 bp, mouse
gccgcgggcaggagagatgt

SEQ ID NO: 615183 - DNA, 20 bp, mouse
gggtcaggcaaagtcaccgg

SEQ ID NO: 615184 - DNA, 20 bp, mouse
gtcttcctctctccaaccgt

SEQ ID NO: 615185 - DNA, 20 bp, mouse
gcggcaggacgcaccgcgca

SEQ ID NO: 615186 - DNA, 20 bp, mouse
gcgcaggttgcagagcgggt

SEQ ID NO: 615187 - DNA, 20 bp, mouse
gggttcggggttcaggatca

SEQ ID NO: 615188 - DNA, 20 bp, mouse
gtgcagtgccgcgcccgcag

SEQ ID NO: 615189 - DNA, 20 bp, mouse
gaccgggcgcgggctactca

SEQ ID NO: 615190 - DNA, 20 bp, mouse
ggcggccgcaggttgcagag

SEQ ID NO: 615191 - DNA, 20 bp, mouse
gtgagcctgtggcccgggct

SEQ ID NO: 615192 - DNA, 20 bp, mouse
ggagcgccacaatgaaggac

SEQ ID NO: 615193 - DNA, 20 bp, mouse
gcagcaggttgagcgcgcac

SEQ ID NO: 615194 - DNA, 20 bp, mouse
gctgcagagagcagggcgag

SEQ ID NO: 615195 - DNA, 20 bp, mouse
ggggcgtgggaagcccgcaa

SEQ ID NO: 615196 - DNA, 20 bp, mouse
gtacccgggcgcggcagcag

SEQ ID NO: 615197 - DNA, 20 bp, mouse
gccacgcgttctacttaccc

SEQ ID NO: 615198 - DNA, 20 bp, mouse
gggcggcagcacggcccggt

SEQ ID NO: 615199 - DNA, 20 bp, mouse
gcgttctacttacccgggcg

SEQ ID NO: 615200 - DNA, 20 bp, mouse
gtcagcagctccgagcggga

SEQ ID NO: 615201 - DNA, 20 bp, mouse
gcccgagaggacgctcacga

SEQ ID NO: 615202 - DNA, 20 bp, mouse
gagcacggcccggttggccg

SEQ ID NO: 615203 - DNA, 20 bp, mouse
gctaacttcctcggccaacc

SEQ ID NO: 615204 - DNA, 20 bp, mouse
gcgccagccaagggagtcca

SEQ ID NO: 615205 - DNA, 20 bp, mouse
ggtgaggaccgacagagccc

SEQ ID NO: 615206 - DNA, 20 bp, mouse
ggcgcgcctgagtcagtcca

SEQ ID NO: 615207 - DNA, 20 bp, mouse
gcagtccagggagagagcgc

SEQ ID NO: 615208 - DNA, 20 bp, mouse
gcgcgggacagccgcaggtg

SEQ ID NO: 615209 - DNA, 20 bp, mouse
gcaggccgcgggacagccgc

SEQ ID NO: 615210 - DNA, 20 bp, mouse
gctgcggggctgcctcgatc

SEQ ID NO: 615211 - DNA, 20 bp, mouse
ggccacccgcgctctctccc

SEQ ID NO: 615212 - DNA, 20 bp, mouse
gcgaacgctgaggactgact

SEQ ID NO: 615213 - DNA, 20 bp, mouse
gtcactcacccagaacacgg

SEQ ID NO: 615214 - DNA, 20 bp, mouse
gtcgatccggccaccgctcc

SEQ ID NO: 615215 - DNA, 20 bp, mouse
gccatcactcacccagaaca

SEQ ID NO: 615216 - DNA, 20 bp, mouse
ggggcagccggtgagctgtg

SEQ ID NO: 615217 - DNA, 20 bp, mouse
gccatgaagccgcagccacc

SEQ ID NO: 615218 - DNA, 20 bp, mouse
gcgctctgcgctgaggatag

SEQ ID NO: 615219 - DNA, 20 bp, mouse
gagccccgggcctagcccgg

SEQ ID NO: 615220 - DNA, 20 bp, mouse
gcagccaccgggctaggccc

SEQ ID NO: 615221 - DNA, 20 bp, mouse
gagcagccccgggcctagcc

SEQ ID NO: 615222 - DNA, 20 bp, mouse
gggcggtgccacagcgggcg

SEQ ID NO: 615223 - DNA, 20 bp, mouse
ggccgtgggcggtgccacag

SEQ ID NO: 615224 - DNA, 20 bp, mouse
gagctactgggatagctggg

SEQ ID NO: 615225 - DNA, 20 bp, mouse
ggggctgctccaggcctggg

SEQ ID NO: 615226 - DNA, 20 bp, mouse
ggctgccgccggcgtctcag

SEQ ID NO: 615227 - DNA, 20 bp, mouse
ggcagcccctgagacgccgg

SEQ ID NO: 615228 - DNA, 20 bp, mouse
ggcgtcaaagcgacaaggag

SEQ ID NO: 615229 - DNA, 20 bp, mouse
gggggccagtacgcacagag

SEQ ID NO: 615230 - DNA, 20 bp, mouse
gcgggcggcctggcgtggct

SEQ ID NO: 615231 - DNA, 20 bp, mouse
ggagcggcgacgcccgctgg

SEQ ID NO: 615232 - DNA, 20 bp, mouse
gctgcgcccagcgatctcgg

SEQ ID NO: 615233 - DNA, 20 bp, mouse
gggctcaggcgacagtaagg

SEQ ID NO: 615234 - DNA, 20 bp, mouse
ggcccggccctggcccccag

SEQ ID NO: 615235 - DNA, 20 bp, mouse
ggcgctgtccccgcccccag

SEQ ID NO: 615236 - DNA, 20 bp, mouse
gaacgatacccagccaagat

SEQ ID NO: 615237 - DNA, 20 bp, mouse
gaaaccagcactaacatgga

SEQ ID NO: 615238 - DNA, 20 bp, mouse
gttaagtgcccatcttggct

SEQ ID NO: 615239 - DNA, 20 bp, mouse
gctccactggaccaaaccca

SEQ ID NO: 615240 - DNA, 20 bp, mouse
gagtgcaccagcaggcctgg

SEQ ID NO: 615241 - DNA, 20 bp, mouse
gacttaaaccagcactaaca

SEQ ID NO: 615242 - DNA, 20 bp, mouse
gggcatgcccaggcactctg

SEQ ID NO: 615243 - DNA, 20 bp, mouse
gcactagagtccagtgatgg

SEQ ID NO: 615244 - DNA, 20 bp, mouse
ggtgccttccatgttagtgc

SEQ ID NO: 615245 - DNA, 20 bp, mouse
ggggtgaaatgaagccccaa

SEQ ID NO: 615246 - DNA, 20 bp, mouse
ggagagggcaggatgttcag

SEQ ID NO: 615247 - DNA, 20 bp, mouse
gccccatgctgcgaccccgg

SEQ ID NO: 615248 - DNA, 20 bp, mouse
gaatcgggagcccgccgccg

SEQ ID NO: 615249 - DNA, 20 bp, mouse
gcatgctgcgaccccggcgg

SEQ ID NO: 615250 - DNA, 20 bp, mouse
gagggaggggacatatggag

SEQ ID NO: 615251 - DNA, 20 bp, mouse
gggcgcgggcctggggaatc

SEQ ID NO: 615252 - DNA, 20 bp, mouse
ggagaagcttgagctaccag

SEQ ID NO: 615253 - DNA, 20 bp, mouse
gacgccccatgctgcgaccc

SEQ ID NO: 615254 - DNA, 20 bp, mouse
gtagagttgggccataggag

SEQ ID NO: 615255 - DNA, 20 bp, mouse
gagaaggcagcgcgagaagt

SEQ ID NO: 615256 - DNA, 20 bp, mouse
gagctgcgaggtgcttgctg

SEQ ID NO: 615257 - DNA, 20 bp, mouse
gtcaccgagcgagaaggcaa

SEQ ID NO: 615258 - DNA, 20 bp, mouse
ggagaaggcaatggcgccgg

SEQ ID NO: 615259 - DNA, 20 bp, mouse
gtggcggggagaccggacag

SEQ ID NO: 615260 - DNA, 20 bp, mouse
gaccagcacggtcttagagg

SEQ ID NO: 615261 - DNA, 20 bp, mouse
gccagctcacccagaagatg

SEQ ID NO: 615262 - DNA, 20 bp, mouse
gccggcaccatgggccaatg

SEQ ID NO: 615263 - DNA, 20 bp, mouse
ggccccccgggacctccggt

SEQ ID NO: 615264 - DNA, 20 bp, mouse
gcggcgctcaccgagcgaga

SEQ ID NO: 615265 - DNA, 20 bp, mouse
gagcccgccgcaggccccct

SEQ ID NO: 615266 - DNA, 20 bp, mouse
ggtatcgaggaccgtcttgt

SEQ ID NO: 615267 - DNA, 20 bp, mouse
gaatggtcccaagacttgtg

SEQ ID NO: 615268 - DNA, 20 bp, mouse
gtccggggcggaaagaatgg

SEQ ID NO: 615269 - DNA, 20 bp, mouse
ggtcccaagacttgtgggga

SEQ ID NO: 615270 - DNA, 20 bp, mouse
gtaaagcgatagacgcggtt

SEQ ID NO: 615271 - DNA, 20 bp, mouse
gcggcgaagagggaattcct

SEQ ID NO: 615272 - DNA, 20 bp, mouse
gcgcagagaattggtttggg

SEQ ID NO: 615273 - DNA, 20 bp, mouse
gtaccctccccacaagtctt

SEQ ID NO: 615274 - DNA, 20 bp, mouse
gcggtgcaggcgcagagaat

SEQ ID NO: 615275 - DNA, 20 bp, mouse
gggatttaaagcgatagacg

SEQ ID NO: 615276 - DNA, 20 bp, mouse
gggaggcctacatatttctg

SEQ ID NO: 615277 - DNA, 20 bp, mouse
gtccttggtgcacaggaaca

SEQ ID NO: 615278 - DNA, 20 bp, mouse
gacaggaacaaggcagctac

SEQ ID NO: 615279 - DNA, 20 bp, mouse
gcctgcccacagaaatatgt

SEQ ID NO: 615280 - DNA, 20 bp, mouse
gcaccatggtggccatagag

SEQ ID NO: 615281 - DNA, 20 bp, mouse
gccagcagctgagggtgaag

SEQ ID NO: 615282 - DNA, 20 bp, mouse
gtccagggccaaacacatct

SEQ ID NO: 615283 - DNA, 20 bp, mouse
ggtgcaccaaggaagctgga

SEQ ID NO: 615284 - DNA, 20 bp, mouse
gccagccctaggctgcccag

SEQ ID NO: 615285 - DNA, 20 bp, mouse
gggcctctctatggccacca

SEQ ID NO: 615286 - DNA, 20 bp, mouse
ggagccgcgcggccagggaa

SEQ ID NO: 615287 - DNA, 20 bp, mouse
gcggcgggcagcgtgagcag

SEQ ID NO: 615288 - DNA, 20 bp, mouse
gtgggagataggccccccgg

SEQ ID NO: 615289 - DNA, 20 bp, mouse
gaaggagaactcgtccccgt

SEQ ID NO: 615290 - DNA, 20 bp, mouse
ggccgccgctgaagccgcgg

SEQ ID NO: 615291 - DNA, 20 bp, mouse
gccgcccgaaccgtgcgtcg

SEQ ID NO: 615292 - DNA, 20 bp, mouse
gagctggtctgcggccgcgg

SEQ ID NO: 615293 - DNA, 20 bp, mouse
gggcgggccaagctggtctg

SEQ ID NO: 615294 - DNA, 20 bp, mouse
gcacggggacccgaacgccg

SEQ ID NO: 615295 - DNA, 20 bp, mouse
gcgtgcgtcggggagccgcg

SEQ ID NO: 615296 - DNA, 20 bp, mouse
ggatgctgccgcgggctcgg

SEQ ID NO: 615297 - DNA, 20 bp, mouse
ggccgcttcagggtaatcat

SEQ ID NO: 615298 - DNA, 20 bp, mouse
ggcggcgcgcacaggtacgg

SEQ ID NO: 615299 - DNA, 20 bp, mouse
gtcccatgattaccctgaag

SEQ ID NO: 615300 - DNA, 20 bp, mouse
gccaccacagcgggaggggg

SEQ ID NO: 615301 - DNA, 20 bp, mouse
gccgggatctaccaccacag

SEQ ID NO: 615302 - DNA, 20 bp, mouse
gtctaccaccacagcgggag

SEQ ID NO: 615303 - DNA, 20 bp, mouse
gcagtcggcagcccgctctc

SEQ ID NO: 615304 - DNA, 20 bp, mouse
gtgtgcgcgccgccgcacgg

SEQ ID NO: 615305 - DNA, 20 bp, mouse
gtcctggcccggactccaag

SEQ ID NO: 615306 - DNA, 20 bp, mouse
gtgggatcaggctcaagatc

SEQ ID NO: 615307 - DNA, 20 bp, mouse
ggatctggactgaagactgc

SEQ ID NO: 615308 - DNA, 20 bp, mouse
gggataggagatggtctgta

SEQ ID NO: 615309 - DNA, 20 bp, mouse
ggggggcctgtgagtcactg

SEQ ID NO: 615310 - DNA, 20 bp, mouse
gacacacacacgggaattcc

SEQ ID NO: 615311 - DNA, 20 bp, mouse
gagtttccagtggctatcgt

SEQ ID NO: 615312 - DNA, 20 bp, mouse
gcagtggctatcgtgggtgg

SEQ ID NO: 615313 - DNA, 20 bp, mouse
gagggtctgccctaggggat

SEQ ID NO: 615314 - DNA, 20 bp, mouse
ggtttacttagggagagttg

SEQ ID NO: 615315 - DNA, 20 bp, mouse
ggggatggggtggaggccaa

SEQ ID NO: 615316 - DNA, 20 bp, mouse
gaccggcacggagcacaaag

SEQ ID NO: 615317 - DNA, 20 bp, mouse
gccgggaagcctcctcgaac

SEQ ID NO: 615318 - DNA, 20 bp, mouse
gcaaagcgggagctccgcgt

SEQ ID NO: 615319 - DNA, 20 bp, mouse
gagcagcccggcgagcagtg

SEQ ID NO: 615320 - DNA, 20 bp, mouse
ggcggccgcgcagatgccgg

SEQ ID NO: 615321 - DNA, 20 bp, mouse
ggcgtcggtgcgccaggcgg

SEQ ID NO: 615322 - DNA, 20 bp, mouse
ggaggcggccgcgcagatgc

SEQ ID NO: 615323 - DNA, 20 bp, mouse
ggtctccgccggcatctgcg

SEQ ID NO: 615324 - DNA, 20 bp, mouse
gtccgcgtcggtgcgccagg

SEQ ID NO: 615325 - DNA, 20 bp, mouse
gtgtccgggaagcactacaa

SEQ ID NO: 615326 - DNA, 20 bp, mouse
ggtctgcagcctccgagatg

SEQ ID NO: 615327 - DNA, 20 bp, mouse
gcagggtctccgggtagtca

SEQ ID NO: 615328 - DNA, 20 bp, mouse
gcatggcgtccccatctcgg

SEQ ID NO: 615329 - DNA, 20 bp, mouse
gagccgatcgcccggtgcat

SEQ ID NO: 615330 - DNA, 20 bp, mouse
ggcataggcgcagggtctcc

SEQ ID NO: 615331 - DNA, 20 bp, mouse
gagaacctcgggtctggagt

SEQ ID NO: 615332 - DNA, 20 bp, mouse
ggagttggcctaggccacag

SEQ ID NO: 615333 - DNA, 20 bp, mouse
gcaactcgtggccaaggctg

SEQ ID NO: 615334 - DNA, 20 bp, mouse
gagtcatggcgtccccatct

SEQ ID NO: 615335 - DNA, 20 bp, mouse
ggaccctgcgcctatgcacc

SEQ ID NO: 615336 - DNA, 20 bp, mouse
gccgccggagctgagtagta

SEQ ID NO: 615337 - DNA, 20 bp, mouse
gccggccagtagccagaagt

SEQ ID NO: 615338 - DNA, 20 bp, mouse
ggcactcacccagaagacga

SEQ ID NO: 615339 - DNA, 20 bp, mouse
ggaaggagtagatgatgagg

SEQ ID NO: 615340 - DNA, 20 bp, mouse
ggctgagtagtatggcatcg

SEQ ID NO: 615341 - DNA, 20 bp, mouse
gagacaggttatcacaggtt

SEQ ID NO: 615342 - DNA, 20 bp, mouse
gtcggggctgtgagatggta

SEQ ID NO: 615343 - DNA, 20 bp, mouse
gatgccatactactcagctc

SEQ ID NO: 615344 - DNA, 20 bp, mouse
gctgggtcggggctgtgaga

SEQ ID NO: 615345 - DNA, 20 bp, mouse
ggtccgacgaaggctgaagt

SEQ ID NO: 615346 - DNA, 20 bp, mouse
gggcagccaccaagttacag

SEQ ID NO: 615347 - DNA, 20 bp, mouse
gtgtcctgcgtaggctctga

SEQ ID NO: 615348 - DNA, 20 bp, mouse
ggtagaaggctgtcctgcgt

SEQ ID NO: 615349 - DNA, 20 bp, mouse
ggaatgaagaagtccgtaga

SEQ ID NO: 615350 - DNA, 20 bp, mouse
gaatccgtcagagcctacgc

SEQ ID NO: 615351 - DNA, 20 bp, mouse
gcaggcacacggatctctgc

SEQ ID NO: 615352 - DNA, 20 bp, mouse
gccgtgtgcctgcagcttcg

SEQ ID NO: 615353 - DNA, 20 bp, mouse
gacctgccatttcggagaag

SEQ ID NO: 615354 - DNA, 20 bp, mouse
gcatagagctagaggataag

SEQ ID NO: 615355 - DNA, 20 bp, mouse
gtttctacccccgaagctgc

SEQ ID NO: 615356 - DNA, 20 bp, mouse
gaccgcgcttggactcggtg

SEQ ID NO: 615357 - DNA, 20 bp, mouse
ggccacaccgagtccaagcg

SEQ ID NO: 615358 - DNA, 20 bp, mouse
gcactcaccgcgcttggact

SEQ ID NO: 615359 - DNA, 20 bp, mouse
gccgagtcgccagcccgccc

SEQ ID NO: 615360 - DNA, 20 bp, mouse
gcctgggctggggaataagg

SEQ ID NO: 615361 - DNA, 20 bp, mouse
gggcggccagcggaaacggg

SEQ ID NO: 615362 - DNA, 20 bp, mouse
gaggagggtgggtcgaggga

SEQ ID NO: 615363 - DNA, 20 bp, mouse
gtggactcggtgtggcgccc

SEQ ID NO: 615364 - DNA, 20 bp, mouse
ggaaggggccgggacgtgag

SEQ ID NO: 615365 - DNA, 20 bp, mouse
ggaggcggaactccccgggg

SEQ ID NO: 615366 - DNA, 20 bp, mouse
gacaggaagtgcagctgtgt

SEQ ID NO: 615367 - DNA, 20 bp, mouse
gaggagggcggagctaaggt

SEQ ID NO: 615368 - DNA, 20 bp, mouse
gaccgggaggccacagtccg

SEQ ID NO: 615369 - DNA, 20 bp, mouse
gggcctcccggtggacatgt

SEQ ID NO: 615370 - DNA, 20 bp, mouse
gagagggacacgctactgct

SEQ ID NO: 615371 - DNA, 20 bp, mouse
gctccgccagcagggagagc

SEQ ID NO: 615372 - DNA, 20 bp, mouse
ggaatacctgctctccctgc

SEQ ID NO: 615373 - DNA, 20 bp, mouse
gagggtaggggctatagcag

SEQ ID NO: 615374 - DNA, 20 bp, mouse
ggggaaggaccaagaaggac

SEQ ID NO: 615375 - DNA, 20 bp, mouse
ggggctccagaaggacacac

SEQ ID NO: 615376 - DNA, 20 bp, mouse
gtgggtacgtgagaccctga

SEQ ID NO: 615377 - DNA, 20 bp, mouse
ggtacgtgagaccctgacgg

SEQ ID NO: 615378 - DNA, 20 bp, mouse
gactgcgtgagcggggctgt

SEQ ID NO: 615379 - DNA, 20 bp, mouse
gctgtgcgcagtgtccttca

SEQ ID NO: 615380 - DNA, 20 bp, mouse
gtcctgtgcctacctcggtg

SEQ ID NO: 615381 - DNA, 20 bp, mouse
gaccagcgactgcgtgagcg

SEQ ID NO: 615382 - DNA, 20 bp, mouse
gactcctgcctcaccgaggt

SEQ ID NO: 615383 - DNA, 20 bp, mouse
gtgacggcggggagccaaaa

SEQ ID NO: 615384 - DNA, 20 bp, mouse
ggccccgctcacgcagtcgc

SEQ ID NO: 615385 - DNA, 20 bp, mouse
ggtcgctggttgttccgtga

SEQ ID NO: 615386 - DNA, 20 bp, mouse
gggccttcctgacttacctc

SEQ ID NO: 615387 - DNA, 20 bp, mouse
gcctcccagcctgatgatat

SEQ ID NO: 615388 - DNA, 20 bp, mouse
gtgagtcggtagacagtgag

SEQ ID NO: 615389 - DNA, 20 bp, mouse
gatgtgtataaggtagaaga

SEQ ID NO: 615390 - DNA, 20 bp, mouse
gcgtgtgcctgaggtaagtc

SEQ ID NO: 615391 - DNA, 20 bp, mouse
gataaggtagaagatggcga

SEQ ID NO: 615392 - DNA, 20 bp, mouse
ggctgggaggcgtgtgcctg

SEQ ID NO: 615393 - DNA, 20 bp, mouse
gtagagtgactgacaggtca

SEQ ID NO: 615394 - DNA, 20 bp, mouse
gagatggcgagggactggaa

SEQ ID NO: 615395 - DNA, 20 bp, mouse
ggagtgggcacggtcaatga

SEQ ID NO: 615396 - DNA, 20 bp, mouse
gcgctccgggctgctcatgt

SEQ ID NO: 615397 - DNA, 20 bp, mouse
gcgtgagggttgttgtttgt

SEQ ID NO: 615398 - DNA, 20 bp, mouse
ggggttgcgggggaccgtga

SEQ ID NO: 615399 - DNA, 20 bp, mouse
gccgcggctgtcggggacag

SEQ ID NO: 615400 - DNA, 20 bp, mouse
gctgctcggcgaggagaagg

SEQ ID NO: 615401 - DNA, 20 bp, mouse
gactgcgctggagagagcga

SEQ ID NO: 615402 - DNA, 20 bp, mouse
gagggccgcgcagggatcgt

SEQ ID NO: 615403 - DNA, 20 bp, mouse
gcgctggagagagcgagggg

SEQ ID NO: 615404 - DNA, 20 bp, mouse
gtgcggccacccgaatctgg

SEQ ID NO: 615405 - DNA, 20 bp, mouse
gcaaggccctcgacatctcg

SEQ ID NO: 615406 - DNA, 20 bp, mouse
gctggtcgcgtgaggtgtgg

SEQ ID NO: 615407 - DNA, 20 bp, mouse
gaggggacgtcagagcgagg

SEQ ID NO: 615408 - DNA, 20 bp, mouse
ggagctggtcgcgtgaggtg

SEQ ID NO: 615409 - DNA, 20 bp, mouse
ggctctgcggctctcagaca

SEQ ID NO: 615410 - DNA, 20 bp, mouse
gccgcttcaagtgtgactgg

SEQ ID NO: 615411 - DNA, 20 bp, mouse
ggagcagagctggtcgcgtg

SEQ ID NO: 615412 - DNA, 20 bp, mouse
gcaagtgtgactggtggcta

SEQ ID NO: 615413 - DNA, 20 bp, mouse
ggctccgcttcaagtgtgac

SEQ ID NO: 615414 - DNA, 20 bp, mouse
ggcagtcgctggagcggtgg

SEQ ID NO: 615415 - DNA, 20 bp, mouse
ggtgaccgcactcacaacac

SEQ ID NO: 615416 - DNA, 20 bp, mouse
ggcggcagtagagatgcagg

SEQ ID NO: 615417 - DNA, 20 bp, mouse
ggtcgcggcagtagagatgc

SEQ ID NO: 615418 - DNA, 20 bp, mouse
ggcaggattgtggtatgtcg

SEQ ID NO: 615419 - DNA, 20 bp, mouse
gcggccaggagagcacccgc

SEQ ID NO: 615420 - DNA, 20 bp, mouse
ggagagcacccgcaggattg

SEQ ID NO: 615421 - DNA, 20 bp, mouse
gactgagtgtctggctggag

SEQ ID NO: 615422 - DNA, 20 bp, mouse
gggcggagctcgccccagag

SEQ ID NO: 615423 - DNA, 20 bp, mouse
gtccaggttcagaacgcggg

SEQ ID NO: 615424 - DNA, 20 bp, mouse
gcggggttgcagggcctaag

SEQ ID NO: 615425 - DNA, 20 bp, mouse
gatccggcaggggggtgcaa

SEQ ID NO: 615426 - DNA, 20 bp, mouse
gccttccacgccgttcattt

SEQ ID NO: 615427 - DNA, 20 bp, mouse
ggacacagtgcgggagatgg

SEQ ID NO: 615428 - DNA, 20 bp, mouse
ggctgccaaaatgaacggcg

SEQ ID NO: 615429 - DNA, 20 bp, mouse
gcactcggaagcagagctcg

SEQ ID NO: 615430 - DNA, 20 bp, mouse
gatcttcggaggcatgggag

SEQ ID NO: 615431 - DNA, 20 bp, mouse
gttcagatccagatcttcgg

SEQ ID NO: 615432 - DNA, 20 bp, mouse
ggcggcagcgagaggtctgg

SEQ ID NO: 615433 - DNA, 20 bp, mouse
ggctgcggcagcgagaggtc

SEQ ID NO: 615434 - DNA, 20 bp, mouse
gaggacaaggaaagctctgc

SEQ ID NO: 615435 - DNA, 20 bp, mouse
ggtgaggccggtgcggatgg

SEQ ID NO: 615436 - DNA, 20 bp, mouse
gagagaccctgggctggtag

SEQ ID NO: 615437 - DNA, 20 bp, mouse
gtgttctctggcaccatgag

SEQ ID NO: 615438 - DNA, 20 bp, mouse
gcttcgtagagaccctgggc

SEQ ID NO: 615439 - DNA, 20 bp, mouse
gcaaagccgctaccagccca

SEQ ID NO: 615440 - DNA, 20 bp, mouse
gaggccggcgcagctcaagg

SEQ ID NO: 615441 - DNA, 20 bp, mouse
gccagcttcgtagagaccct

SEQ ID NO: 615442 - DNA, 20 bp, mouse
gaccatgagcggacggagta

SEQ ID NO: 615443 - DNA, 20 bp, mouse
gctctggcaccatgagcgga

SEQ ID NO: 615444 - DNA, 20 bp, mouse
gtacgaagctggcctctcca

SEQ ID NO: 615445 - DNA, 20 bp, mouse
gcggctcggggaggactccg

SEQ ID NO: 615446 - DNA, 20 bp, mouse
gctgcttcagcggcccggag

SEQ ID NO: 615447 - DNA, 20 bp, mouse
gaaggcgggcggcatcacgg

SEQ ID NO: 615448 - DNA, 20 bp, mouse
gctggaaggcagatcggaag

SEQ ID NO: 615449 - DNA, 20 bp, mouse
gagtcggtgagtagaagcgg

SEQ ID NO: 615450 - DNA, 20 bp, mouse
gggcgcaggaaggttcttgt

SEQ ID NO: 615451 - DNA, 20 bp, mouse
gataaaggcgggcggcatca

SEQ ID NO: 615452 - DNA, 20 bp, mouse
gccaagtctagtctcggtgt

SEQ ID NO: 615453 - DNA, 20 bp, mouse
gcggtcctacccggcctgga

SEQ ID NO: 615454 - DNA, 20 bp, mouse
ggacttgggacccttgccca

SEQ ID NO: 615455 - DNA, 20 bp, mouse
gtgcgccgcttaagagcctt

SEQ ID NO: 615456 - DNA, 20 bp, mouse
gagcacacgcacatcttcag

SEQ ID NO: 615457 - DNA, 20 bp, mouse
ggggagccacgtgatctaaa

SEQ ID NO: 615458 - DNA, 20 bp, mouse
gaagatgtgcgtgtgctctt

SEQ ID NO: 615459 - DNA, 20 bp, mouse
gtgatctaaacggatgatgg

SEQ ID NO: 615460 - DNA, 20 bp, mouse
ggcagtccgagctgcgctgg

SEQ ID NO: 615461 - DNA, 20 bp, mouse
gcagccaggagaaggccgag

SEQ ID NO: 615462 - DNA, 20 bp, mouse
gctgtggagaatggcttcgg

SEQ ID NO: 615463 - DNA, 20 bp, mouse
gcatggctgggcggtgtaag

SEQ ID NO: 615464 - DNA, 20 bp, mouse
gaggcgaggcgccagagcca

SEQ ID NO: 615465 - DNA, 20 bp, mouse
ggtgtaagcggcagactccc

SEQ ID NO: 615466 - DNA, 20 bp, mouse
gccgaggaggccgaggacca

SEQ ID NO: 615467 - DNA, 20 bp, mouse
gaggaggccgaggaccaggg

SEQ ID NO: 615468 - DNA, 20 bp, mouse
ggggctgcacggatgctaca

SEQ ID NO: 615469 - DNA, 20 bp, mouse
gtgaacaaacgctggagctg

SEQ ID NO: 615470 - DNA, 20 bp, mouse
gggatttcatctaacattat

SEQ ID NO: 615471 - DNA, 20 bp, mouse
ggccgcaagaaagttgctcg

SEQ ID NO: 615472 - DNA, 20 bp, mouse
gagcagtcggagcagcgggt

SEQ ID NO: 615473 - DNA, 20 bp, mouse
gcacgctcttgaacaaacgc

SEQ ID NO: 615474 - DNA, 20 bp, mouse
ggcagcgcaccagacccaga

SEQ ID NO: 615475 - DNA, 20 bp, mouse
gtccgcgagcaactttcttg

SEQ ID NO: 615476 - DNA, 20 bp, mouse
gtggactacgagacccagac

SEQ ID NO: 615477 - DNA, 20 bp, mouse
ggccgtcagggagccggtct

SEQ ID NO: 615478 - DNA, 20 bp, mouse
gacccagaccggctccctga

SEQ ID NO: 615479 - DNA, 20 bp, mouse
gttggaaccagactgagtgt

SEQ ID NO: 615480 - DNA, 20 bp, mouse
gtttcaggcggggaatgaat

SEQ ID NO: 615481 - DNA, 20 bp, mouse
gaacaggaagtgagccgtca

SEQ ID NO: 615482 - DNA, 20 bp, mouse
gggtgagggccaggcacagg

SEQ ID NO: 615483 - DNA, 20 bp, mouse
gctgggtaggcagagtatca

SEQ ID NO: 615484 - DNA, 20 bp, mouse
gtctgagcgatccctggtga

SEQ ID NO: 615485 - DNA, 20 bp, mouse
ggggctggcatagacagcag

SEQ ID NO: 615486 - DNA, 20 bp, mouse
gcgggacgctgcgagaaagg

SEQ ID NO: 615487 - DNA, 20 bp, mouse
gcagggtattgaggcgtgta

SEQ ID NO: 615488 - DNA, 20 bp, mouse
ggaaaggcggcagggtattg

SEQ ID NO: 615489 - DNA, 20 bp, mouse
gacgctggaacggtgagcac

SEQ ID NO: 615490 - DNA, 20 bp, mouse
ggcgtgtacggacgctggaa

SEQ ID NO: 615491 - DNA, 20 bp, mouse
gcccgtccggctgtgagtag

SEQ ID NO: 615492 - DNA, 20 bp, mouse
gtggcgggacgctgcgagaa

SEQ ID NO: 615493 - DNA, 20 bp, mouse
ggtgagcactggcctcccta

SEQ ID NO: 615494 - DNA, 20 bp, mouse
gcgaatcccggggaactggc

SEQ ID NO: 615495 - DNA, 20 bp, mouse
gtggacaggaccgaatcccg

SEQ ID NO: 615496 - DNA, 20 bp, mouse
gtgtctggcagggatgtaga

SEQ ID NO: 615497 - DNA, 20 bp, mouse
ggacactgctggcccatgtc

SEQ ID NO: 615498 - DNA, 20 bp, mouse
gctagagtcttgggcctctt

SEQ ID NO: 615499 - DNA, 20 bp, mouse
gatgtagagggcagcctcgg

SEQ ID NO: 615500 - DNA, 20 bp, mouse
gtagcctcgtcgcttgagga

SEQ ID NO: 615501 - DNA, 20 bp, mouse
gggagtgcccagtgcctccg

SEQ ID NO: 615502 - DNA, 20 bp, mouse
gagtgtcctcatttacactg

SEQ ID NO: 615503 - DNA, 20 bp, mouse
ggaggcccaagactctagca

SEQ ID NO: 615504 - DNA, 20 bp, mouse
gtctgtccacagtgtaaatg

SEQ ID NO: 615505 - DNA, 20 bp, mouse
gacatcatggggataaactt

SEQ ID NO: 615506 - DNA, 20 bp, mouse
gccagacgcctccccacagt

SEQ ID NO: 615507 - DNA, 20 bp, mouse
gatgcctgctggcccgtgtg

SEQ ID NO: 615508 - DNA, 20 bp, mouse
gaacttgaggcgctctgagt

SEQ ID NO: 615509 - DNA, 20 bp, mouse
gtgctggcccgtgtggggag

SEQ ID NO: 615510 - DNA, 20 bp, mouse
gtcgtccatgctgccaggag

SEQ ID NO: 615511 - DNA, 20 bp, mouse
ggagcgcctcaagttcaatg

SEQ ID NO: 615512 - DNA, 20 bp, mouse
gcctcattcccactgtgggg

SEQ ID NO: 615513 - DNA, 20 bp, mouse
gcctggcagcatggacgatg

SEQ ID NO: 615514 - DNA, 20 bp, mouse
ggaggggatgtagagggcgg

SEQ ID NO: 615515 - DNA, 20 bp, mouse
gggaggcgtctggctaggct

SEQ ID NO: 615516 - DNA, 20 bp, mouse
gagcaggccgagggcgatgg

SEQ ID NO: 615517 - DNA, 20 bp, mouse
gtctccctccccaccacctg

SEQ ID NO: 615518 - DNA, 20 bp, mouse
gtgtgaatgaagtccttggg

SEQ ID NO: 615519 - DNA, 20 bp, mouse
ggacacagccacaggtggtg

SEQ ID NO: 615520 - DNA, 20 bp, mouse
gcagctgggcaagaccattg

SEQ ID NO: 615521 - DNA, 20 bp, mouse
ggaggcagcatgagctgaga

SEQ ID NO: 615522 - DNA, 20 bp, mouse
gggaaagggcctacccgtgt

SEQ ID NO: 615523 - DNA, 20 bp, mouse
ggccatcctgactcaaaggg

SEQ ID NO: 615524 - DNA, 20 bp, mouse
gttgcccagctgatacccat

SEQ ID NO: 615525 - DNA, 20 bp, mouse
ggtggtggcgagggaaagta

SEQ ID NO: 615526 - DNA, 20 bp, mouse
ggccaccttgagctcctgaa

SEQ ID NO: 615527 - DNA, 20 bp, mouse
ggggtactgaagtgaagtta

SEQ ID NO: 615528 - DNA, 20 bp, mouse
gacagagcgataggctgggg

SEQ ID NO: 615529 - DNA, 20 bp, mouse
gtaccaagtcacacaaggct

SEQ ID NO: 615530 - DNA, 20 bp, mouse
ggagctgaaagaaggaactt

SEQ ID NO: 615531 - DNA, 20 bp, mouse
gtgtgtgacttggtaaacac

SEQ ID NO: 615532 - DNA, 20 bp, mouse
gcttccaagttcttagtgaa

SEQ ID NO: 615533 - DNA, 20 bp, mouse
ggtggcttctccgtagacag

SEQ ID NO: 615534 - DNA, 20 bp, mouse
gcggcccttcactaagaact

SEQ ID NO: 615535 - DNA, 20 bp, mouse
gccagcctatcgctctgtca

SEQ ID NO: 615536 - DNA, 20 bp, mouse
gataggttgagagcctcagg

SEQ ID NO: 615537 - DNA, 20 bp, mouse
gggttttaggctaagagcat

SEQ ID NO: 615538 - DNA, 20 bp, mouse
gggcagggcgccacagaact

SEQ ID NO: 615539 - DNA, 20 bp, mouse
gtgcccgtcagccaggggaa

SEQ ID NO: 615540 - DNA, 20 bp, mouse
gagctgctgctcctcatgga

SEQ ID NO: 615541 - DNA, 20 bp, mouse
gcaagcgccacactatggtg

SEQ ID NO: 615542 - DNA, 20 bp, mouse
gtggagagtaaagactccaa

SEQ ID NO: 615543 - DNA, 20 bp, mouse
gcttattgcccgtcagccag

SEQ ID NO: 615544 - DNA, 20 bp, mouse
gctggcgcaagtcggatcag

SEQ ID NO: 615545 - DNA, 20 bp, mouse
gctgctcctcatggaaggca

SEQ ID NO: 615546 - DNA, 20 bp, mouse
gcaatctcgggcctaaccca

SEQ ID NO: 615547 - DNA, 20 bp, mouse
gtgcaggtgccaagcaccat

SEQ ID NO: 615548 - DNA, 20 bp, mouse
gtgggccgcacgataggtga

SEQ ID NO: 615549 - DNA, 20 bp, mouse
ggcggccggactccaatctc

SEQ ID NO: 615550 - DNA, 20 bp, mouse
ggctgtagggccttgggagt

SEQ ID NO: 615551 - DNA, 20 bp, mouse
gaggaggcggctgctgtcgg

SEQ ID NO: 615552 - DNA, 20 bp, mouse
gggtgagggcagctactcca

SEQ ID NO: 615553 - DNA, 20 bp, mouse
ggccttgggagtgggcacat

SEQ ID NO: 615554 - DNA, 20 bp, mouse
gtgggcacatgggggcacgg

SEQ ID NO: 615555 - DNA, 20 bp, mouse
gtaggcccgagattggagtc

SEQ ID NO: 615556 - DNA, 20 bp, mouse
gcccaggcggccagaccgaa

SEQ ID NO: 615557 - DNA, 20 bp, mouse
gactcgcagaactgacacta

SEQ ID NO: 615558 - DNA, 20 bp, mouse
gggcgctggtatccaccaag

SEQ ID NO: 615559 - DNA, 20 bp, mouse
ggtacatcaggtgctctacc

SEQ ID NO: 615560 - DNA, 20 bp, mouse
gcgagtcacctggcgcggtt

SEQ ID NO: 615561 - DNA, 20 bp, mouse
gtatacgatggagatgacct

SEQ ID NO: 615562 - DNA, 20 bp, mouse
ggactcacagtgggagaggt

SEQ ID NO: 615563 - DNA, 20 bp, mouse
gtgagagggctgagtgcggt

SEQ ID NO: 615564 - DNA, 20 bp, mouse
gtgggcagcatcatctcata

SEQ ID NO: 615565 - DNA, 20 bp, mouse
ggaggttggcacattcccta

SEQ ID NO: 615566 - DNA, 20 bp, mouse
gggctggtggaacccatcgc

SEQ ID NO: 615567 - DNA, 20 bp, mouse
ggattcggcgcagcaaaccg

SEQ ID NO: 615568 - DNA, 20 bp, mouse
ggaccagcctgcgagatccc

SEQ ID NO: 615569 - DNA, 20 bp, mouse
gtgcaccggaagtagctctt

SEQ ID NO: 615570 - DNA, 20 bp, mouse
gcgcaggtgagatttacagt

SEQ ID NO: 615571 - DNA, 20 bp, mouse
ggtccctgcacagatcatag

SEQ ID NO: 615572 - DNA, 20 bp, mouse
gtagctggagaattgtgcac

SEQ ID NO: 615573 - DNA, 20 bp, mouse
gagcaaaccggggatctcgc

SEQ ID NO: 615574 - DNA, 20 bp, mouse
gcccttgctcatcttggtaa

SEQ ID NO: 615575 - DNA, 20 bp, mouse
ggaagtagctcttgggctgg

SEQ ID NO: 615576 - DNA, 20 bp, mouse
ggagggtgagggagatgctt

SEQ ID NO: 615577 - DNA, 20 bp, mouse
gtcgtcagcctcacatccag

SEQ ID NO: 615578 - DNA, 20 bp, mouse
gttgggctctgggagggtga

SEQ ID NO: 615579 - DNA, 20 bp, mouse
gtcacatccagggggttctc

SEQ ID NO: 615580 - DNA, 20 bp, mouse
gaaggagactgtaggcactg

SEQ ID NO: 615581 - DNA, 20 bp, mouse
ggacgttcgatctccagagg

SEQ ID NO: 615582 - DNA, 20 bp, mouse
ggatgctggtcccctgggaa

SEQ ID NO: 615583 - DNA, 20 bp, mouse
gcgggaccacaagacacttg

SEQ ID NO: 615584 - DNA, 20 bp, mouse
ggcagctggtaccattcctg

SEQ ID NO: 615585 - DNA, 20 bp, mouse
gccagagcccaaccagagac

SEQ ID NO: 615586 - DNA, 20 bp, mouse
ggtgaagggagacccaggaa

SEQ ID NO: 615587 - DNA, 20 bp, mouse
ggcagcgccaagttggtgaa

SEQ ID NO: 615588 - DNA, 20 bp, mouse
gagttggtgaagggagaccc

SEQ ID NO: 615589 - DNA, 20 bp, mouse
gaggcctagggtttgcgggt

SEQ ID NO: 615590 - DNA, 20 bp, mouse
ggcggggagcagcgccaagt

SEQ ID NO: 615591 - DNA, 20 bp, mouse
ggagacccaggaaaggccta

SEQ ID NO: 615592 - DNA, 20 bp, mouse
gtctcccgaggcgtctacag

SEQ ID NO: 615593 - DNA, 20 bp, mouse
gcgaggcgtctacagcggga

SEQ ID NO: 615594 - DNA, 20 bp, mouse
gggacgccccagctactgat

SEQ ID NO: 615595 - DNA, 20 bp, mouse
gacacctacccgcaaaccct

SEQ ID NO: 615596 - DNA, 20 bp, mouse
ggcaggaaggagccgaggaa

SEQ ID NO: 615597 - DNA, 20 bp, mouse
gtgggctctctgggaccccg

SEQ ID NO: 615598 - DNA, 20 bp, mouse
ggcctggccagcatcacaat

SEQ ID NO: 615599 - DNA, 20 bp, mouse
ggagcctggacagcgcctgt

SEQ ID NO: 615600 - DNA, 20 bp, mouse
gagggcggccctaggatcag

SEQ ID NO: 615601 - DNA, 20 bp, mouse
gggaagtggtcagcagcccc

SEQ ID NO: 615602 - DNA, 20 bp, mouse
ggctgaccacttcctttcct

SEQ ID NO: 615603 - DNA, 20 bp, mouse
ggtgcttgggacctcaggca

SEQ ID NO: 615604 - DNA, 20 bp, mouse
gagcatcacaatgggctctc

SEQ ID NO: 615605 - DNA, 20 bp, mouse
ggaggtcccaagcaccagcc

SEQ ID NO: 615606 - DNA, 20 bp, mouse
gggagctgatacccaagtct

SEQ ID NO: 615607 - DNA, 20 bp, mouse
gctgatacccaagtctaggt

SEQ ID NO: 615608 - DNA, 20 bp, mouse
gggtatcagctccaccaaca

SEQ ID NO: 615609 - DNA, 20 bp, mouse
gctccgggattcggcttctg

SEQ ID NO: 615610 - DNA, 20 bp, mouse
gcgggattcggcttctgtgg

SEQ ID NO: 615611 - DNA, 20 bp, mouse
gcacagcacccacctagact

SEQ ID NO: 615612 - DNA, 20 bp, mouse
gaggtgggtgctgtgaataa

SEQ ID NO: 615613 - DNA, 20 bp, mouse
gtcctctgggcacgagtcca

SEQ ID NO: 615614 - DNA, 20 bp, mouse
gtccctggactcgtgcccag

SEQ ID NO: 615615 - DNA, 20 bp, mouse
gcagacatagctccgggatt

SEQ ID NO: 615616 - DNA, 20 bp, mouse
ggatcctcctcgggcgacgg

SEQ ID NO: 615617 - DNA, 20 bp, mouse
ggtcggagtgacaggaggag

SEQ ID NO: 615618 - DNA, 20 bp, mouse
gagactggcggagatcatgg

SEQ ID NO: 615619 - DNA, 20 bp, mouse
ggccgcagcggacaccgagc

SEQ ID NO: 615620 - DNA, 20 bp, mouse
gcacagcccgaggcctggag

SEQ ID NO: 615621 - DNA, 20 bp, mouse
gagcggacaccgagcaggtg

SEQ ID NO: 615622 - DNA, 20 bp, mouse
gacggcggcggctgcgaagt

SEQ ID NO: 615623 - DNA, 20 bp, mouse
gccggcgtcccggctcctag

SEQ ID NO: 615624 - DNA, 20 bp, mouse
gggtaagtcggagtgacagg

SEQ ID NO: 615625 - DNA, 20 bp, mouse
gaggcccgatgtaccccagg

SEQ ID NO: 615626 - DNA, 20 bp, mouse
ggccgcagcggcgatgggag

SEQ ID NO: 615627 - DNA, 20 bp, mouse
gcagcggcgatgggagcggt

SEQ ID NO: 615628 - DNA, 20 bp, mouse
ggctgcagtagtcgccgcag

SEQ ID NO: 615629 - DNA, 20 bp, mouse
ggatgggagcggtagggacg

SEQ ID NO: 615630 - DNA, 20 bp, mouse
gtctagctcagggtccgcac

SEQ ID NO: 615631 - DNA, 20 bp, mouse
gtagtcgccgcagcggcgat

SEQ ID NO: 615632 - DNA, 20 bp, mouse
gtaacgtcgggccgggtcag

SEQ ID NO: 615633 - DNA, 20 bp, mouse
gcctcggttgagctgaacga

SEQ ID NO: 615634 - DNA, 20 bp, mouse
gccggtcccgccgcagtggg

SEQ ID NO: 615635 - DNA, 20 bp, mouse
ggcggacgcaggatctctga

SEQ ID NO: 615636 - DNA, 20 bp, mouse
gaggaagtagaaggactcgg

SEQ ID NO: 615637 - DNA, 20 bp, mouse
gaggttgtgaagcccatcgt

SEQ ID NO: 615638 - DNA, 20 bp, mouse
gacgccgcgagacccacgat

SEQ ID NO: 615639 - DNA, 20 bp, mouse
gccggaagtgcacctgactc

SEQ ID NO: 615640 - DNA, 20 bp, mouse
gggtctcgcggcgttcggtg

SEQ ID NO: 615641 - DNA, 20 bp, mouse
gccctcccggctatgagtca

SEQ ID NO: 615642 - DNA, 20 bp, mouse
ggaggactgtggcctgggac

SEQ ID NO: 615643 - DNA, 20 bp, mouse
gaagcccatcgtgggtctcg

SEQ ID NO: 615644 - DNA, 20 bp, mouse
gtttgctgcgaccagagggg

SEQ ID NO: 615645 - DNA, 20 bp, mouse
gtaacaggctaggacgaatt

SEQ ID NO: 615646 - DNA, 20 bp, mouse
gttagtgcccaggatcggac

SEQ ID NO: 615647 - DNA, 20 bp, mouse
gccacttcccgtccgatcct

SEQ ID NO: 615648 - DNA, 20 bp, mouse
ggtctagccgggtggccgtg

SEQ ID NO: 615649 - DNA, 20 bp, mouse
ggacctttagtgcccaggat

SEQ ID NO: 615650 - DNA, 20 bp, mouse
gggccgtggggaatctatct

SEQ ID NO: 615651 - DNA, 20 bp, mouse
gactaaaggtcagtctagcc

SEQ ID NO: 615652 - DNA, 20 bp, mouse
gtgtgtagtaccgaagggtg

SEQ ID NO: 615653 - DNA, 20 bp, mouse
gactccatggagggagggcg

SEQ ID NO: 615654 - DNA, 20 bp, mouse
gttccaagatagattcccca

SEQ ID NO: 615655 - DNA, 20 bp, mouse
gggagttgtgtagtaccgaa

SEQ ID NO: 615656 - DNA, 20 bp, mouse
gagatggcacctgccggctg

SEQ ID NO: 615657 - DNA, 20 bp, mouse
gcctgcgccgtgcgggaaga

SEQ ID NO: 615658 - DNA, 20 bp, mouse
gtacccggagtgcggtgagt

SEQ ID NO: 615659 - DNA, 20 bp, mouse
gcaggtgccatcttcccgca

SEQ ID NO: 615660 - DNA, 20 bp, mouse
gtcgggcagcttgggtgctg

SEQ ID NO: 615661 - DNA, 20 bp, mouse
gacgccagcaggcaccctcc

SEQ ID NO: 615662 - DNA, 20 bp, mouse
ggcccgcggcgggcagagca

SEQ ID NO: 615663 - DNA, 20 bp, mouse
ggcggctgctcgggcagctt

SEQ ID NO: 615664 - DNA, 20 bp, mouse
gggccgcgcctgcgccgtgc

SEQ ID NO: 615665 - DNA, 20 bp, mouse
gggcggctgtccgcagtcgg

SEQ ID NO: 615666 - DNA, 20 bp, mouse
gcgccgcgagcgcttccggg

SEQ ID NO: 615667 - DNA, 20 bp, mouse
gccgggaggttagcgcgtcc

SEQ ID NO: 615668 - DNA, 20 bp, mouse
ggcgtccgggcagcttccct

SEQ ID NO: 615669 - DNA, 20 bp, mouse
gccgcgctcccgcaagccga

SEQ ID NO: 615670 - DNA, 20 bp, mouse
gaacctcccggaagcgctcg

SEQ ID NO: 615671 - DNA, 20 bp, mouse
gctcggacgccggagcctgg

SEQ ID NO: 615672 - DNA, 20 bp, mouse
ggatacctgccggctcccgg

SEQ ID NO: 615673 - DNA, 20 bp, mouse
gcgactgccgcagcaagtcg

SEQ ID NO: 615674 - DNA, 20 bp, mouse
gtcccaggcttcgcaagggt

SEQ ID NO: 615675 - DNA, 20 bp, mouse
gcgcagcaagtcgcggtcca

SEQ ID NO: 615676 - DNA, 20 bp, mouse
gcagtcctaagggagagaga

SEQ ID NO: 615677 - DNA, 20 bp, mouse
ggaggtcggggccgcaagaa

SEQ ID NO: 615678 - DNA, 20 bp, mouse
gagccagtcaagcccttcag

SEQ ID NO: 615679 - DNA, 20 bp, mouse
gactggcctcccagtcctaa

SEQ ID NO: 615680 - DNA, 20 bp, mouse
gggtttctaggctaacttct

SEQ ID NO: 615681 - DNA, 20 bp, mouse
gcctagcaacaacggagcta

SEQ ID NO: 615682 - DNA, 20 bp, mouse
gaaccccgttctagagctag

SEQ ID NO: 615683 - DNA, 20 bp, mouse
ggtagtgtggtaggggagaa

SEQ ID NO: 615684 - DNA, 20 bp, mouse
gttcccctgaagggcttgac

SEQ ID NO: 615685 - DNA, 20 bp, mouse
ggggaagggtgatcacacag

SEQ ID NO: 615686 - DNA, 20 bp, mouse
ggcgaggtagcagctcgaac

SEQ ID NO: 615687 - DNA, 20 bp, mouse
gcggcggcaataggggtccg

SEQ ID NO: 615688 - DNA, 20 bp, mouse
ggccgcgcggagccacccag

SEQ ID NO: 615689 - DNA, 20 bp, mouse
gaaggctgagaagccaaccc

SEQ ID NO: 615690 - DNA, 20 bp, mouse
gctgagaagccaacccgggc

SEQ ID NO: 615691 - DNA, 20 bp, mouse
gaagatggcggcggcaatag

SEQ ID NO: 615692 - DNA, 20 bp, mouse
gacctcgctccggcccgggt

SEQ ID NO: 615693 - DNA, 20 bp, mouse
gtagcagctcgaaccggccg

SEQ ID NO: 615694 - DNA, 20 bp, mouse
ggtgagcagcccggccgggg

SEQ ID NO: 615695 - DNA, 20 bp, mouse
gaccgtgggaagccaagctg

SEQ ID NO: 615696 - DNA, 20 bp, mouse
gagtggcaggccaccaaaat

SEQ ID NO: 615697 - DNA, 20 bp, mouse
gatcttagaggggaatatat

SEQ ID NO: 615698 - DNA, 20 bp, mouse
gggcagagattcagaagatc

SEQ ID NO: 615699 - DNA, 20 bp, mouse
gtatatgttgaatattacag

SEQ ID NO: 615700 - DNA, 20 bp, mouse
ggatttcttttccggctgag

SEQ ID NO: 615701 - DNA, 20 bp, mouse
gcccgccagttgttacacat

SEQ ID NO: 615702 - DNA, 20 bp, mouse
ggaagggctgttataaaaaa

SEQ ID NO: 615703 - DNA, 20 bp, mouse
gagattcagaagatctggca

SEQ ID NO: 615704 - DNA, 20 bp, mouse
ggaaggttaattaacggaaa

SEQ ID NO: 615705 - DNA, 20 bp, mouse
gttggatctacatcttagag

SEQ ID NO: 615706 - DNA, 20 bp, mouse
ggcccctaaaagggagttac

SEQ ID NO: 615707 - DNA, 20 bp, mouse
gatcctagaaaaaaagatct

SEQ ID NO: 615708 - DNA, 20 bp, mouse
ggccagtaactcccttttag

SEQ ID NO: 615709 - DNA, 20 bp, mouse
gtttctagtcacaggctcag

SEQ ID NO: 615710 - DNA, 20 bp, mouse
gcaacctggtcttagctgta

SEQ ID NO: 615711 - DNA, 20 bp, mouse
ggagggcaagaacaatagtt

SEQ ID NO: 615712 - DNA, 20 bp, mouse
ggcttacctgaggcagacgc

SEQ ID NO: 615713 - DNA, 20 bp, mouse
ggacagctaccaatcgactt

SEQ ID NO: 615714 - DNA, 20 bp, mouse
gttcacctatagcccctaaa

SEQ ID NO: 615715 - DNA, 20 bp, mouse
gactcccttttaggggctat

SEQ ID NO: 615716 - DNA, 20 bp, mouse
gtctctgagggaggacccgt

SEQ ID NO: 615717 - DNA, 20 bp, mouse
gtggcttagtggatctctga

SEQ ID NO: 615718 - DNA, 20 bp, mouse
gagcaaccggaacatgccga

SEQ ID NO: 615719 - DNA, 20 bp, mouse
gaccgctcacctgccaacag

SEQ ID NO: 615720 - DNA, 20 bp, mouse
gaggacccgtcggcatgttc

SEQ ID NO: 615721 - DNA, 20 bp, mouse
gcttagtggatctctgaggg

SEQ ID NO: 615722 - DNA, 20 bp, mouse
gcagacgccagcgaagcaac

SEQ ID NO: 615723 - DNA, 20 bp, mouse
gaggcgagagctgcgagaag

SEQ ID NO: 615724 - DNA, 20 bp, mouse
gcagctgctgaagcaagcca

SEQ ID NO: 615725 - DNA, 20 bp, mouse
ggaggacgcgtcagacgagg

SEQ ID NO: 615726 - DNA, 20 bp, mouse
ggcccggctcaggtgatgac

SEQ ID NO: 615727 - DNA, 20 bp, mouse
ggctcacggccggaagtcta

SEQ ID NO: 615728 - DNA, 20 bp, mouse
ggaattgggcggccagagct

SEQ ID NO: 615729 - DNA, 20 bp, mouse
gtgagcgggattcccagctc

SEQ ID NO: 615730 - DNA, 20 bp, mouse
ggtgagctgggctgcgaatt

SEQ ID NO: 615731 - DNA, 20 bp, mouse
gggcagcagggtggatggtg

SEQ ID NO: 615732 - DNA, 20 bp, mouse
gagagcagagagctagccca

SEQ ID NO: 615733 - DNA, 20 bp, mouse
ggtggcagagggtggcccaa

SEQ ID NO: 615734 - DNA, 20 bp, mouse
ggccagagtagtgaacagag

SEQ ID NO: 615735 - DNA, 20 bp, mouse
gtcgcagcccagctcacggc

SEQ ID NO: 615736 - DNA, 20 bp, mouse
gctgcccgccgcagggttag

SEQ ID NO: 615737 - DNA, 20 bp, mouse
ggtttgagggcccgggaagt

SEQ ID NO: 615738 - DNA, 20 bp, mouse
gtggccgccggctacccgga

SEQ ID NO: 615739 - DNA, 20 bp, mouse
gggcggccatggactcccag

SEQ ID NO: 615740 - DNA, 20 bp, mouse
gcccgccgggatgatcccga

SEQ ID NO: 615741 - DNA, 20 bp, mouse
gacgcggcgtgcagcacgag

SEQ ID NO: 615742 - DNA, 20 bp, mouse
gtggactgcgaggtacaggg

SEQ ID NO: 615743 - DNA, 20 bp, mouse
gtgaacccctaaccctgcgg

SEQ ID NO: 615744 - DNA, 20 bp, mouse
gctgcacgccgcgtccctta

SEQ ID NO: 615745 - DNA, 20 bp, mouse
gtccatggccgccggctacc

SEQ ID NO: 615746 - DNA, 20 bp, mouse
gccccggagggagccccgca

SEQ ID NO: 615747 - DNA, 20 bp, mouse
gccaaggacagtggatgggg

SEQ ID NO: 615748 - DNA, 20 bp, mouse
ggctcccaaggacagtggat

SEQ ID NO: 615749 - DNA, 20 bp, mouse
gagccccgcacggcggtccg

SEQ ID NO: 615750 - DNA, 20 bp, mouse
ggctccagcgagagggtctg

SEQ ID NO: 615751 - DNA, 20 bp, mouse
gccgacctcggcctccgtca

SEQ ID NO: 615752 - DNA, 20 bp, mouse
gccactgtccttgggagcta

SEQ ID NO: 615753 - DNA, 20 bp, mouse
gacagtggatggggcggccc

SEQ ID NO: 615754 - DNA, 20 bp, mouse
gccacttgcaagaggtgccc

SEQ ID NO: 615755 - DNA, 20 bp, mouse
gtcaggggcagccatgacgg

SEQ ID NO: 615756 - DNA, 20 bp, mouse
gctggagttttgttaagtac

SEQ ID NO: 615757 - DNA, 20 bp, mouse
gtgctttatggaaaaatgct

SEQ ID NO: 615758 - DNA, 20 bp, mouse
gtaagtaccgggttgcttta

SEQ ID NO: 615759 - DNA, 20 bp, mouse
ggggaccgctaaactcacaa

SEQ ID NO: 615760 - DNA, 20 bp, mouse
gctccctctgtatcaagtta

SEQ ID NO: 615761 - DNA, 20 bp, mouse
ggaaaaggactctctctcca

SEQ ID NO: 615762 - DNA, 20 bp, mouse
gaatccttaacttgatacag

SEQ ID NO: 615763 - DNA, 20 bp, mouse
gaaaattccactgataacct

SEQ ID NO: 615764 - DNA, 20 bp, mouse
gtctcttctccactccctat

SEQ ID NO: 615765 - DNA, 20 bp, mouse
gctctgtttagacttgtctg

SEQ ID NO: 615766 - DNA, 20 bp, mouse
gcacaggcccgaggtagcag

SEQ ID NO: 615767 - DNA, 20 bp, mouse
ggcttcagcgagactcctca

SEQ ID NO: 615768 - DNA, 20 bp, mouse
gatggcccgggcacccgcac

SEQ ID NO: 615769 - DNA, 20 bp, mouse
ggggcacccgcacaggcccg

SEQ ID NO: 615770 - DNA, 20 bp, mouse
ggcgagactcctcatggccc

SEQ ID NO: 615771 - DNA, 20 bp, mouse
gttcagacctctgctacctc

SEQ ID NO: 615772 - DNA, 20 bp, mouse
gtccaggggcgtccacagtt

SEQ ID NO: 615773 - DNA, 20 bp, mouse
ggatggtagccgagctccag

SEQ ID NO: 615774 - DNA, 20 bp, mouse
gctggcccggtgagcaggct

SEQ ID NO: 615775 - DNA, 20 bp, mouse
gaccttcccagcctgctcac

SEQ ID NO: 615776 - DNA, 20 bp, mouse
ggccattcgtgtgaagagtt

SEQ ID NO: 615777 - DNA, 20 bp, mouse
gctaaatggccacaggatgg

SEQ ID NO: 615778 - DNA, 20 bp, mouse
ggagttgggaggctgctctt

SEQ ID NO: 615779 - DNA, 20 bp, mouse
gaatggccacaggatggggg

SEQ ID NO: 615780 - DNA, 20 bp, mouse
gttgggtgcaattccctaaa

SEQ ID NO: 615781 - DNA, 20 bp, mouse
ggcgctcgaggtacagtcca

SEQ ID NO: 615782 - DNA, 20 bp, mouse
gctaccaaagagacagctcc

SEQ ID NO: 615783 - DNA, 20 bp, mouse
gcaattccctaaatggccac

SEQ ID NO: 615784 - DNA, 20 bp, mouse
ggagggtgtagttcagatgt

SEQ ID NO: 615785 - DNA, 20 bp, mouse
gcagtatggtaactgaacta

SEQ ID NO: 615786 - DNA, 20 bp, mouse
ggaggtaagaggtcctggag

SEQ ID NO: 615787 - DNA, 20 bp, mouse
gaggccactgtggagaaaac

SEQ ID NO: 615788 - DNA, 20 bp, mouse
ggtagaggagacaataggaa

SEQ ID NO: 615789 - DNA, 20 bp, mouse
ggaccaaggcgggaaccgac

SEQ ID NO: 615790 - DNA, 20 bp, mouse
gccttctggaatggttctgc

SEQ ID NO: 615791 - DNA, 20 bp, mouse
ggggacagtccggagcctca

SEQ ID NO: 615792 - DNA, 20 bp, mouse
gactccaggctgtcaccttg

SEQ ID NO: 615793 - DNA, 20 bp, mouse
gaccgactggcagaaagtag

SEQ ID NO: 615794 - DNA, 20 bp, mouse
gcctggagtgcctcaaggtg

SEQ ID NO: 615795 - DNA, 20 bp, mouse
gcataaggctccccaccttg

SEQ ID NO: 615796 - DNA, 20 bp, mouse
gttctgaagcagattcagaa

SEQ ID NO: 615797 - DNA, 20 bp, mouse
ggaagttagactatctctct

SEQ ID NO: 615798 - DNA, 20 bp, mouse
ggtagggtgaccatgtcgga

SEQ ID NO: 615799 - DNA, 20 bp, mouse
gcctccagaggacataagga

SEQ ID NO: 615800 - DNA, 20 bp, mouse
gctgtgcggggagttcacta

SEQ ID NO: 615801 - DNA, 20 bp, mouse
gctctaggttgctaagagac

SEQ ID NO: 615802 - DNA, 20 bp, mouse
gaggaaggcaacacagtaat

SEQ ID NO: 615803 - DNA, 20 bp, mouse
gaagatatcaccgtccgaca

SEQ ID NO: 615804 - DNA, 20 bp, mouse
ggggtagttcgagaccaccc

SEQ ID NO: 615805 - DNA, 20 bp, mouse
gagaggccaactgcaagata

SEQ ID NO: 615806 - DNA, 20 bp, mouse
gaggagggaagagagcatcg

SEQ ID NO: 615807 - DNA, 20 bp, mouse
gtgcagactatctgcagcgg

SEQ ID NO: 615808 - DNA, 20 bp, mouse
gtagtggctctgaatagtaa

SEQ ID NO: 615809 - DNA, 20 bp, mouse
gtcagagccactaaccatct

SEQ ID NO: 615810 - DNA, 20 bp, mouse
gctcagaaggaccagcctcc

SEQ ID NO: 615811 - DNA, 20 bp, mouse
gatctgcagcgggggctcac

SEQ ID NO: 615812 - DNA, 20 bp, mouse
gcatccctccctattcccgg

SEQ ID NO: 615813 - DNA, 20 bp, mouse
gggaaacggagctcgctgtg

SEQ ID NO: 615814 - DNA, 20 bp, mouse
ggtttccaccgggaataggg

SEQ ID NO: 615815 - DNA, 20 bp, mouse
gggcggcgttgccgtggaaa

SEQ ID NO: 615816 - DNA, 20 bp, mouse
gcttctgaggggcttctcca

SEQ ID NO: 615817 - DNA, 20 bp, mouse
gtgcatgtataatctcacat

SEQ ID NO: 615818 - DNA, 20 bp, mouse
gcggagctggcgcttctgag

SEQ ID NO: 615819 - DNA, 20 bp, mouse
gtaaggaggagaaaaacgag

SEQ ID NO: 615820 - DNA, 20 bp, mouse
gagcgatgccgggaatgatg

SEQ ID NO: 615821 - DNA, 20 bp, mouse
gctgaggggcttctccacgg

SEQ ID NO: 615822 - DNA, 20 bp, mouse
gtgagattatacatgcatgg

SEQ ID NO: 615823 - DNA, 20 bp, mouse
gatgccagccctgggtacat

SEQ ID NO: 615824 - DNA, 20 bp, mouse
gccgatacagtgtcccacta

SEQ ID NO: 615825 - DNA, 20 bp, mouse
ggaggagggtccaaagtcgc

SEQ ID NO: 615826 - DNA, 20 bp, mouse
gggcgtctgcctagagctaa

SEQ ID NO: 615827 - DNA, 20 bp, mouse
gtggcgggaccgttagctct

SEQ ID NO: 615828 - DNA, 20 bp, mouse
ggcgcggcacggcaggaaca

SEQ ID NO: 615829 - DNA, 20 bp, mouse
gggtgcgcgcgcctagctgg

SEQ ID NO: 615830 - DNA, 20 bp, mouse
gccatccccgcggggcccgt

SEQ ID NO: 615831 - DNA, 20 bp, mouse
gagcggtgcgcgcgcctagc

SEQ ID NO: 615832 - DNA, 20 bp, mouse
ggctcgggcgccagaggcgg

SEQ ID NO: 615833 - DNA, 20 bp, mouse
ggctaacggtcccgccagct

SEQ ID NO: 615834 - DNA, 20 bp, mouse
ggggctcgaaccctgacgag

SEQ ID NO: 615835 - DNA, 20 bp, mouse
ggccccgtcccgctccgagg

SEQ ID NO: 615836 - DNA, 20 bp, mouse
gcaagccaggccaacaatct

SEQ ID NO: 615837 - DNA, 20 bp, mouse
gactaagcttctgcaggcgg

SEQ ID NO: 615838 - DNA, 20 bp, mouse
ggtcagggacacagaatcac

SEQ ID NO: 615839 - DNA, 20 bp, mouse
gcaagctggggcccaagtaa

SEQ ID NO: 615840 - DNA, 20 bp, mouse
gtctgcaggcggtgggtgct

SEQ ID NO: 615841 - DNA, 20 bp, mouse
ggcccaagtaatggaagaag

SEQ ID NO: 615842 - DNA, 20 bp, mouse
gtactctcatcccagattgt

SEQ ID NO: 615843 - DNA, 20 bp, mouse
gtggcccaccaaggtccaag

SEQ ID NO: 615844 - DNA, 20 bp, mouse
gggctcggcgggccagatgg

SEQ ID NO: 615845 - DNA, 20 bp, mouse
gtccctgactaagcttctgc

SEQ ID NO: 615846 - DNA, 20 bp, mouse
gagcccgcgagcctcagacg

SEQ ID NO: 615847 - DNA, 20 bp, mouse
gcgggtctggttgacgtgga

SEQ ID NO: 615848 - DNA, 20 bp, mouse
gcgtggagggccggaggcgt

SEQ ID NO: 615849 - DNA, 20 bp, mouse
gccgcccgcctcaggagccg

SEQ ID NO: 615850 - DNA, 20 bp, mouse
gccgcagagcgaacgctccg

SEQ ID NO: 615851 - DNA, 20 bp, mouse
gtctggttgacgtggagggc

SEQ ID NO: 615852 - DNA, 20 bp, mouse
gcgtagggaagggagagcgt

SEQ ID NO: 615853 - DNA, 20 bp, mouse
gcgctccgcggctcctgagg

SEQ ID NO: 615854 - DNA, 20 bp, mouse
gtctgcgggtctggttgacg

SEQ ID NO: 615855 - DNA, 20 bp, mouse
ggaacgctccgcggctcctg

SEQ ID NO: 615856 - DNA, 20 bp, mouse
ggcagctctaaagttcccga

SEQ ID NO: 615857 - DNA, 20 bp, mouse
ggcacgcgctacaattttgg

SEQ ID NO: 615858 - DNA, 20 bp, mouse
gtagcgcgtgctagtttcca

SEQ ID NO: 615859 - DNA, 20 bp, mouse
gctagcacgcgctacaattt

SEQ ID NO: 615860 - DNA, 20 bp, mouse
gtccggttacctagtttcct

SEQ ID NO: 615861 - DNA, 20 bp, mouse
gaattttggcggctatggcg

SEQ ID NO: 615862 - DNA, 20 bp, mouse
gttgcatgccgggagaaacc

SEQ ID NO: 615863 - DNA, 20 bp, mouse
ggctacaattttggcggcta

SEQ ID NO: 615864 - DNA, 20 bp, mouse
ggctagtttccaaggaaact

SEQ ID NO: 615865 - DNA, 20 bp, mouse
ggaaactaggtaaccggaaa

SEQ ID NO: 615866 - DNA, 20 bp, mouse
gaatcttgacagttatggca

SEQ ID NO: 615867 - DNA, 20 bp, mouse
gcactcaatcttgacagtta

SEQ ID NO: 615868 - DNA, 20 bp, mouse
ggactcggctatagaaggtg

SEQ ID NO: 615869 - DNA, 20 bp, mouse
ggaactcaccgtcggggatc

SEQ ID NO: 615870 - DNA, 20 bp, mouse
gtccgttggcttgttgccat

SEQ ID NO: 615871 - DNA, 20 bp, mouse
gcgaaggactcggctataga

SEQ ID NO: 615872 - DNA, 20 bp, mouse
gagcttgtaaacgaaggact

SEQ ID NO: 615873 - DNA, 20 bp, mouse
gggcaacaagccaacggaaa

SEQ ID NO: 615874 - DNA, 20 bp, mouse
gtccagacttccgtttccgt

SEQ ID NO: 615875 - DNA, 20 bp, mouse
ggatagcagcttgtaaacga

SEQ ID NO: 615876 - DNA, 20 bp, mouse
gaagctaggtgaatatggca

SEQ ID NO: 615877 - DNA, 20 bp, mouse
gaaaacaagctaggtgaata

SEQ ID NO: 615878 - DNA, 20 bp, mouse
gggtgtagaggacagtggag

SEQ ID NO: 615879 - DNA, 20 bp, mouse
gctgagtggggaaggtgtag

SEQ ID NO: 615880 - DNA, 20 bp, mouse
ggcaataggccaaccggaaa

SEQ ID NO: 615881 - DNA, 20 bp, mouse
gtccaaggcaataggccaac

SEQ ID NO: 615882 - DNA, 20 bp, mouse
gtccggttggcctattgcct

SEQ ID NO: 615883 - DNA, 20 bp, mouse
ggaggggagagtgattatga

SEQ ID NO: 615884 - DNA, 20 bp, mouse
gtttgtagagcagacaacct

SEQ ID NO: 615885 - DNA, 20 bp, mouse
gaacagcttccgtttccggt

SEQ ID NO: 615886 - DNA, 20 bp, mouse
gccttgcggccaggccgaga

SEQ ID NO: 615887 - DNA, 20 bp, mouse
gtgcggccaggccgagaggg

SEQ ID NO: 615888 - DNA, 20 bp, mouse
gggccatgaccgcctcaccc

SEQ ID NO: 615889 - DNA, 20 bp, mouse
gcatgaccgcctcacccggg

SEQ ID NO: 615890 - DNA, 20 bp, mouse
ggccaacgaagtcccgtgag

SEQ ID NO: 615891 - DNA, 20 bp, mouse
gcgaaggacagggctcggag

SEQ ID NO: 615892 - DNA, 20 bp, mouse
gcgcttccacccgggtgagg

SEQ ID NO: 615893 - DNA, 20 bp, mouse
ggtcccgtgagcggtagctg

SEQ ID NO: 615894 - DNA, 20 bp, mouse
gtgtggttccgcttccaccc

SEQ ID NO: 615895 - DNA, 20 bp, mouse
ggcgcaggctcgcttctcca

SEQ ID NO: 615896 - DNA, 20 bp, mouse
gtgcgggtaggcggtagaca

SEQ ID NO: 615897 - DNA, 20 bp, mouse
gcaggtaactggctgcgggt

SEQ ID NO: 615898 - DNA, 20 bp, mouse
gggcacgtggaatgtaaaca

SEQ ID NO: 615899 - DNA, 20 bp, mouse
ggttacctgaaaacactctg

SEQ ID NO: 615900 - DNA, 20 bp, mouse
gtgctacccgaggagaacac

SEQ ID NO: 615901 - DNA, 20 bp, mouse
ggccatagcagctcctcggg

SEQ ID NO: 615902 - DNA, 20 bp, mouse
gtaggcggtagacagggctg

SEQ ID NO: 615903 - DNA, 20 bp, mouse
ggccgcccgaggagctgcta

SEQ ID NO: 615904 - DNA, 20 bp, mouse
ggtaactggctgcgggtagg

SEQ ID NO: 615905 - DNA, 20 bp, mouse
ggcaaggcagattagaatcc

SEQ ID NO: 615906 - DNA, 20 bp, mouse
gtagtccagcgcgcccagga

SEQ ID NO: 615907 - DNA, 20 bp, mouse
gtggcgggtagcgccttcct

SEQ ID NO: 615908 - DNA, 20 bp, mouse
gtgccggctgcgaccagagg

SEQ ID NO: 615909 - DNA, 20 bp, mouse
ggacatagtccagcgcgccc

SEQ ID NO: 615910 - DNA, 20 bp, mouse
gagcgcgcggcgccacacgc

SEQ ID NO: 615911 - DNA, 20 bp, mouse
gcagcacgcgtagcagccct

SEQ ID NO: 615912 - DNA, 20 bp, mouse
gggctgctacgcgtgctggc

SEQ ID NO: 615913 - DNA, 20 bp, mouse
ggcctgccggctgcgaccag

SEQ ID NO: 615914 - DNA, 20 bp, mouse
ggctgcgtgcgcgcgctgtg

SEQ ID NO: 615915 - DNA, 20 bp, mouse
gcgtgccctggaaccagcga

SEQ ID NO: 615916 - DNA, 20 bp, mouse
gggcccaagtggtaactcag

SEQ ID NO: 615917 - DNA, 20 bp, mouse
gacagggtagagcctccagc

SEQ ID NO: 615918 - DNA, 20 bp, mouse
gcacagcatctgccagctgg

SEQ ID NO: 615919 - DNA, 20 bp, mouse
gagctggcagatgctgtgaa

SEQ ID NO: 615920 - DNA, 20 bp, mouse
gaaggaagatggtggggaca

SEQ ID NO: 615921 - DNA, 20 bp, mouse
gtggcagatgctgtgaacgg

SEQ ID NO: 615922 - DNA, 20 bp, mouse
gcagatgctgtgaacggagg

SEQ ID NO: 615923 - DNA, 20 bp, mouse
gatggctcctagggcccaag

SEQ ID NO: 615924 - DNA, 20 bp, mouse
ggtcctgtaggaaatctcag

SEQ ID NO: 615925 - DNA, 20 bp, mouse
gctgccaggcagcctatgga

SEQ ID NO: 615926 - DNA, 20 bp, mouse
gaagcgatcagaacccacct

SEQ ID NO: 615927 - DNA, 20 bp, mouse
gcagtcccacatgcccaggt

SEQ ID NO: 615928 - DNA, 20 bp, mouse
gggcagaagttgaaatctaa

SEQ ID NO: 615929 - DNA, 20 bp, mouse
ggtggcagtcccacatgccc

SEQ ID NO: 615930 - DNA, 20 bp, mouse
ggaacttggcggtgatgagg

SEQ ID NO: 615931 - DNA, 20 bp, mouse
gctagcctaaagtcccatat

SEQ ID NO: 615932 - DNA, 20 bp, mouse
gctcactcaagcgatgtctg

SEQ ID NO: 615933 - DNA, 20 bp, mouse
gtgttcagacttgtactttg

SEQ ID NO: 615934 - DNA, 20 bp, mouse
gagtgaacttggcggtgatg

SEQ ID NO: 615935 - DNA, 20 bp, mouse
gctgtcacttgaattggatt

SEQ ID NO: 615936 - DNA, 20 bp, mouse
ggagtctctgagagggtctg

SEQ ID NO: 615937 - DNA, 20 bp, mouse
gcccagggtggactccaaag

SEQ ID NO: 615938 - DNA, 20 bp, mouse
ggtgcataggcagcccaggg

SEQ ID NO: 615939 - DNA, 20 bp, mouse
gacctgagctcgctgtgcat

SEQ ID NO: 615940 - DNA, 20 bp, mouse
ggcttttggagtctctgaga

SEQ ID NO: 615941 - DNA, 20 bp, mouse
ggctgtgcataggcagccca

SEQ ID NO: 615942 - DNA, 20 bp, mouse
gtcccagtcaagtgcaccgg

SEQ ID NO: 615943 - DNA, 20 bp, mouse
gtccaccggtgcacttgact

SEQ ID NO: 615944 - DNA, 20 bp, mouse
ggtcaactcccggaccgagg

SEQ ID NO: 615945 - DNA, 20 bp, mouse
ggaggaggacccagccgaac

SEQ ID NO: 615946 - DNA, 20 bp, mouse
ggcgcgcgcagcgatgacca

SEQ ID NO: 615947 - DNA, 20 bp, mouse
gggatccggccgcagcacct

SEQ ID NO: 615948 - DNA, 20 bp, mouse
gccccgccggcaggtcgccc

SEQ ID NO: 615949 - DNA, 20 bp, mouse
gcagcgatgaccacggccag

SEQ ID NO: 615950 - DNA, 20 bp, mouse
ggacctgccggcggggtgag

SEQ ID NO: 615951 - DNA, 20 bp, mouse
gcacggcccgcgccccgagg

SEQ ID NO: 615952 - DNA, 20 bp, mouse
gcctccgccactcaccccgc

SEQ ID NO: 615953 - DNA, 20 bp, mouse
ggggtatagactccatgagg

SEQ ID NO: 615954 - DNA, 20 bp, mouse
gagcggcccgggcgacctgc

SEQ ID NO: 615955 - DNA, 20 bp, mouse
gggcccgggcgacctgccgg

SEQ ID NO: 615956 - DNA, 20 bp, mouse
gcggcggccgcacacccaca

SEQ ID NO: 615957 - DNA, 20 bp, mouse
ggccgccgcggaggggaaca

SEQ ID NO: 615958 - DNA, 20 bp, mouse
gaggggaacatggcgctcgt

SEQ ID NO: 615959 - DNA, 20 bp, mouse
gcccagagccagaaaagagt

SEQ ID NO: 615960 - DNA, 20 bp, mouse
ggccatgttcccctccgcgg

SEQ ID NO: 615961 - DNA, 20 bp, mouse
ggtcggttctgagttccctg

SEQ ID NO: 615962 - DNA, 20 bp, mouse
gctgctctgcctggccccgt

SEQ ID NO: 615963 - DNA, 20 bp, mouse
gctccgctggcacggagggt

SEQ ID NO: 615964 - DNA, 20 bp, mouse
gaagcccatagggtccaagg

SEQ ID NO: 615965 - DNA, 20 bp, mouse
ggcgctcgtgggcagccgag

SEQ ID NO: 615966 - DNA, 20 bp, mouse
gggcacacgaggcctcgagt

SEQ ID NO: 615967 - DNA, 20 bp, mouse
gcgaggcgaggtgccggagg

SEQ ID NO: 615968 - DNA, 20 bp, mouse
gtgctctgctccccgcaggt

SEQ ID NO: 615969 - DNA, 20 bp, mouse
gggagcccggctccgacctg

SEQ ID NO: 615970 - DNA, 20 bp, mouse
ggcgcggctggacacccagg

SEQ ID NO: 615971 - DNA, 20 bp, mouse
gaccctggacgcactgggag

SEQ ID NO: 615972 - DNA, 20 bp, mouse
gggccgaggcgaggtgccgg

SEQ ID NO: 615973 - DNA, 20 bp, mouse
gcagggaagagagcagccac

SEQ ID NO: 615974 - DNA, 20 bp, mouse
gcgtactgcggtcataggga

SEQ ID NO: 615975 - DNA, 20 bp, mouse
ggggcaggagagcttaactc

SEQ ID NO: 615976 - DNA, 20 bp, mouse
gggagggagcaggagaccgc

SEQ ID NO: 615977 - DNA, 20 bp, mouse
gagaggttaggaggacccac

SEQ ID NO: 615978 - DNA, 20 bp, mouse
gggagcaggagaccgccgga

SEQ ID NO: 615979 - DNA, 20 bp, mouse
gacccacagggttcaggaaa

SEQ ID NO: 615980 - DNA, 20 bp, mouse
gtaaacctgtggccttccgg

SEQ ID NO: 615981 - DNA, 20 bp, mouse
gactaggccaggtaccccaa

SEQ ID NO: 615982 - DNA, 20 bp, mouse
ggagaccgccggaaggccac

SEQ ID NO: 615983 - DNA, 20 bp, mouse
ggtggcgaccgggacagcag

SEQ ID NO: 615984 - DNA, 20 bp, mouse
gaggtttatgggcaagatcc

SEQ ID NO: 615985 - DNA, 20 bp, mouse
gatgaagaggtaaaagggtt

SEQ ID NO: 615986 - DNA, 20 bp, mouse
gccatggaagcgtcctctgt

SEQ ID NO: 615987 - DNA, 20 bp, mouse
gaagcgtcctctgtaggctc

SEQ ID NO: 615988 - DNA, 20 bp, mouse
gacttcggcgcttcagtccc

SEQ ID NO: 615989 - DNA, 20 bp, mouse
gccatggcagctcgcaactt

SEQ ID NO: 615990 - DNA, 20 bp, mouse
gtatacgcaaaacctcgagg

SEQ ID NO: 615991 - DNA, 20 bp, mouse
ggcccggactgcaaaaggaa

SEQ ID NO: 615992 - DNA, 20 bp, mouse
gaacgcgccgctccttccgg

SEQ ID NO: 615993 - DNA, 20 bp, mouse
gtggtagtagagcctggtgg

SEQ ID NO: 615994 - DNA, 20 bp, mouse
gggtaggagcttggtcctcg

SEQ ID NO: 615995 - DNA, 20 bp, mouse
ggtcctcgaggcttggtcac

SEQ ID NO: 615996 - DNA, 20 bp, mouse
ggttaccgaggaaacccggt

SEQ ID NO: 615997 - DNA, 20 bp, mouse
gtctgtggttgaaaagttgg

SEQ ID NO: 615998 - DNA, 20 bp, mouse
gagtagctttgtacgcggag

SEQ ID NO: 615999 - DNA, 20 bp, mouse
gaggcatggctgagtctctg

SEQ ID NO: 616000 - DNA, 20 bp, mouse
gaccgagcagccctcagcac

SEQ ID NO: 616001 - DNA, 20 bp, mouse
ggcagtggtcagggcccggg

SEQ ID NO: 616002 - DNA, 20 bp, mouse
gccggtgggcagactccctc

SEQ ID NO: 616003 - DNA, 20 bp, mouse
gtgctcggtgggcgcccgga

SEQ ID NO: 616004 - DNA, 20 bp, mouse
gaaacaactcggttaacagt

SEQ ID NO: 616005 - DNA, 20 bp, mouse
gccaggtgactattgtggaa

SEQ ID NO: 616006 - DNA, 20 bp, mouse
gagactgccaacacccaagg

SEQ ID NO: 616007 - DNA, 20 bp, mouse
ggagctgcctgggcctcctt

SEQ ID NO: 616008 - DNA, 20 bp, mouse
gccaacacccaaggaggccc

SEQ ID NO: 616009 - DNA, 20 bp, mouse
gttagctggtagagctgcct

SEQ ID NO: 616010 - DNA, 20 bp, mouse
gccaaagtggataagaaagt

SEQ ID NO: 616011 - DNA, 20 bp, mouse
gttgggtgttggcagtctct

SEQ ID NO: 616012 - DNA, 20 bp, mouse
ggcagctctaccagctaaat

SEQ ID NO: 616013 - DNA, 20 bp, mouse
gtggcagtctctgggttatc

SEQ ID NO: 616014 - DNA, 20 bp, mouse
gaaactggaacccaccaaag

SEQ ID NO: 616015 - DNA, 20 bp, mouse
gttcccctagctgatgatga

SEQ ID NO: 616016 - DNA, 20 bp, mouse
gctgcggctgcgcgacccca

SEQ ID NO: 616017 - DNA, 20 bp, mouse
gggagctgtcatgggaggtg

SEQ ID NO: 616018 - DNA, 20 bp, mouse
ggagcaggagctgtcatggg

SEQ ID NO: 616019 - DNA, 20 bp, mouse
gcacggcacccacctgaagg

SEQ ID NO: 616020 - DNA, 20 bp, mouse
gcggcggaggagtggagacc

SEQ ID NO: 616021 - DNA, 20 bp, mouse
gaccggcgaaacagcccgag

SEQ ID NO: 616022 - DNA, 20 bp, mouse
gacggcatccggggcccggg

SEQ ID NO: 616023 - DNA, 20 bp, mouse
gccagtccagaggctccagg

SEQ ID NO: 616024 - DNA, 20 bp, mouse
ggctgtcatgggaggtgcgg

SEQ ID NO: 616025 - DNA, 20 bp, mouse
gcacctgaaggtggagagcg

SEQ ID NO: 616026 - DNA, 20 bp, mouse
ggctccggctcccggctcgg

SEQ ID NO: 616027 - DNA, 20 bp, mouse
gtcccggctcggcggcgtaa

SEQ ID NO: 616028 - DNA, 20 bp, mouse
gctcccattggcactcggag

SEQ ID NO: 616029 - DNA, 20 bp, mouse
gctcggggatccgctcccat

SEQ ID NO: 616030 - DNA, 20 bp, mouse
gggaacgccggccggggaag

SEQ ID NO: 616031 - DNA, 20 bp, mouse
gcggccaagctcatcgccaa

SEQ ID NO: 616032 - DNA, 20 bp, mouse
gcctgcacgtcaggactcca

SEQ ID NO: 616033 - DNA, 20 bp, mouse
ggcctcaggcctagccccgg

SEQ ID NO: 616034 - DNA, 20 bp, mouse
gggcggcgtaacgggaacgc

SEQ ID NO: 616035 - DNA, 20 bp, mouse
gaggactccaaggctccgac

SEQ ID NO: 616036 - DNA, 20 bp, mouse
gtggtccgggacaaccctca

SEQ ID NO: 616037 - DNA, 20 bp, mouse
gccagagcccggcccgggga

SEQ ID NO: 616038 - DNA, 20 bp, mouse
ggggccgggctctgggtaca

SEQ ID NO: 616039 - DNA, 20 bp, mouse
gctctgggtacagggcctct

SEQ ID NO: 616040 - DNA, 20 bp, mouse
gggttgtcccggaccaccat

SEQ ID NO: 616041 - DNA, 20 bp, mouse
gaggccctgtacccagagcc

SEQ ID NO: 616042 - DNA, 20 bp, mouse
gcctcccgggcctccctcag

SEQ ID NO: 616043 - DNA, 20 bp, mouse
gctctgagcccatggtggtc

SEQ ID NO: 616044 - DNA, 20 bp, mouse
gggttccttgagggttgtcc

SEQ ID NO: 616045 - DNA, 20 bp, mouse
gaaccccgccctccccgggc

SEQ ID NO: 616046 - DNA, 20 bp, mouse
gcgcgcggcgcccagggtaa

SEQ ID NO: 616047 - DNA, 20 bp, mouse
ggcgcccagggtaacggccg

SEQ ID NO: 616048 - DNA, 20 bp, mouse
gctgccgcggccgttaccct

SEQ ID NO: 616049 - DNA, 20 bp, mouse
gggcggctggcgaaaaggat

SEQ ID NO: 616050 - DNA, 20 bp, mouse
gaggagggagctgcctcggg

SEQ ID NO: 616051 - DNA, 20 bp, mouse
gaggaggagggagctgcctc

SEQ ID NO: 616052 - DNA, 20 bp, mouse
gggccgcggcagagtctgcg

SEQ ID NO: 616053 - DNA, 20 bp, mouse
gcgccccgcagactctgccg

SEQ ID NO: 616054 - DNA, 20 bp, mouse
gcgctcgggacgcacggcgg

SEQ ID NO: 616055 - DNA, 20 bp, mouse
gggcaagcgcgcggcgccca

SEQ ID NO: 616056 - DNA, 20 bp, mouse
ggggcgcggtggaggctccg

SEQ ID NO: 616057 - DNA, 20 bp, mouse
gcgcctggtggagaacacag

SEQ ID NO: 616058 - DNA, 20 bp, mouse
gacccgaccgagcagagcca

SEQ ID NO: 616059 - DNA, 20 bp, mouse
gggcccggcggggaaagggc

SEQ ID NO: 616060 - DNA, 20 bp, mouse
gccgcctcagcgaggagcag

SEQ ID NO: 616061 - DNA, 20 bp, mouse
gccctccgccttgaacgcca

SEQ ID NO: 616062 - DNA, 20 bp, mouse
ggacggccccgtaccagtga

SEQ ID NO: 616063 - DNA, 20 bp, mouse
gaggcccccagacggctctg

SEQ ID NO: 616064 - DNA, 20 bp, mouse
ggcattgtgggaaactcctg

SEQ ID NO: 616065 - DNA, 20 bp, mouse
gaccgagcagagccatggcg

SEQ ID NO: 616066 - DNA, 20 bp, mouse
gaattcctggaggagtcttc

SEQ ID NO: 616067 - DNA, 20 bp, mouse
gaacaaccgcaccacagcgg

SEQ ID NO: 616068 - DNA, 20 bp, mouse
gacttaaaccgaattcctgg

SEQ ID NO: 616069 - DNA, 20 bp, mouse
gggcgtgattacagacacta

SEQ ID NO: 616070 - DNA, 20 bp, mouse
gtccacaagtgaggcacaag

SEQ ID NO: 616071 - DNA, 20 bp, mouse
gcaagtgaggcacaagaggc

SEQ ID NO: 616072 - DNA, 20 bp, mouse
gctagcacaggagaatagat

SEQ ID NO: 616073 - DNA, 20 bp, mouse
gtggaggagtcttccggctt

SEQ ID NO: 616074 - DNA, 20 bp, mouse
ggctaaactgctggcaggtc

SEQ ID NO: 616075 - DNA, 20 bp, mouse
ggaggctcaggtatacaagg

SEQ ID NO: 616076 - DNA, 20 bp, mouse
gacattgtcgctgggtaggt

SEQ ID NO: 616077 - DNA, 20 bp, mouse
ggcagccgcccgccacactt

SEQ ID NO: 616078 - DNA, 20 bp, mouse
gcttggggcgcagaaactca

SEQ ID NO: 616079 - DNA, 20 bp, mouse
gcctaacaacacttccgggt

SEQ ID NO: 616080 - DNA, 20 bp, mouse
gtagcgctcgtcttccaacc

SEQ ID NO: 616081 - DNA, 20 bp, mouse
gcgctacattgtcgctgggt

SEQ ID NO: 616082 - DNA, 20 bp, mouse
gtccgcctaacaacacttcc

SEQ ID NO: 616083 - DNA, 20 bp, mouse
gaagctagggtggtgagcgg

SEQ ID NO: 616084 - DNA, 20 bp, mouse
gaggcccccactgcccccgg

SEQ ID NO: 616085 - DNA, 20 bp, mouse
gcgagcgctacattgtcgct

SEQ ID NO: 616086 - DNA, 20 bp, mouse
gaagtgtccggagcacggta

SEQ ID NO: 616087 - DNA, 20 bp, mouse
ggggcttcctggctgcggta

SEQ ID NO: 616088 - DNA, 20 bp, mouse
ggagggaaatcccgagactg

SEQ ID NO: 616089 - DNA, 20 bp, mouse
ggtgctccggacacttaacc

SEQ ID NO: 616090 - DNA, 20 bp, mouse
gcacggtaaggcctcagtct

SEQ ID NO: 616091 - DNA, 20 bp, mouse
ggggctggagactcactcgg

SEQ ID NO: 616092 - DNA, 20 bp, mouse
ggccgggctggagactcact

SEQ ID NO: 616093 - DNA, 20 bp, mouse
gtctagaaggatcggagtgt

SEQ ID NO: 616094 - DNA, 20 bp, mouse
gcctggctgcggtatggacc

SEQ ID NO: 616095 - DNA, 20 bp, mouse
gctgaggccttaccgtgctc

SEQ ID NO: 616096 - DNA, 20 bp, mouse
ggcaggaggcgggagagtga

SEQ ID NO: 616097 - DNA, 20 bp, mouse
gccgcctagggtgcaggagg

SEQ ID NO: 616098 - DNA, 20 bp, mouse
gagggaaagactggaagacg

SEQ ID NO: 616099 - DNA, 20 bp, mouse
gaagagtggcgggagtgtaa

SEQ ID NO: 616100 - DNA, 20 bp, mouse
gctcccgcctcctgcaccct

SEQ ID NO: 616101 - DNA, 20 bp, mouse
gtaagggagcccagccgctt

SEQ ID NO: 616102 - DNA, 20 bp, mouse
ggtttctggacgctcctaag

SEQ ID NO: 616103 - DNA, 20 bp, mouse
gtttccgcctagggtgcagg

SEQ ID NO: 616104 - DNA, 20 bp, mouse
ggtggggccagactcagtag

SEQ ID NO: 616105 - DNA, 20 bp, mouse
gctcagtagaggtcagtaga

SEQ ID NO: 616106 - DNA, 20 bp, mouse
gcggaatacagctaccgtac

SEQ ID NO: 616107 - DNA, 20 bp, mouse
gctgaaccgtgacaccaaaa

SEQ ID NO: 616108 - DNA, 20 bp, mouse
gtggtggcgcacgcttcagg

SEQ ID NO: 616109 - DNA, 20 bp, mouse
gacggctacaatgctctcca

SEQ ID NO: 616110 - DNA, 20 bp, mouse
gagtgccgaagagaagtcgg

SEQ ID NO: 616111 - DNA, 20 bp, mouse
gaccgtactggaagagcgct

SEQ ID NO: 616112 - DNA, 20 bp, mouse
gtcggagggaaggtcgtccg

SEQ ID NO: 616113 - DNA, 20 bp, mouse
gctggaagagcgcttggttt

SEQ ID NO: 616114 - DNA, 20 bp, mouse
gtggtgtctggagtctcgga

SEQ ID NO: 616115 - DNA, 20 bp, mouse
gaagaagagagcctcaagcc

SEQ ID NO: 616116 - DNA, 20 bp, mouse
ggctgcagcttggctttcag

SEQ ID NO: 616117 - DNA, 20 bp, mouse
gagctcacagccacccacgg

SEQ ID NO: 616118 - DNA, 20 bp, mouse
ggaggtgggtgcatcagagc

SEQ ID NO: 616119 - DNA, 20 bp, mouse
gtgtttccggagaggggttg

SEQ ID NO: 616120 - DNA, 20 bp, mouse
gcagcttggctttcagaggt

SEQ ID NO: 616121 - DNA, 20 bp, mouse
ggcgagccgtaaccaatgag

SEQ ID NO: 616122 - DNA, 20 bp, mouse
ggcccaaaggaggggagcaa

SEQ ID NO: 616123 - DNA, 20 bp, mouse
gtctcaagacctgcccccgt

SEQ ID NO: 616124 - DNA, 20 bp, mouse
gggtacggcctgtaggtcct

SEQ ID NO: 616125 - DNA, 20 bp, mouse
gcaatgagaggtagcgggga

SEQ ID NO: 616126 - DNA, 20 bp, mouse
ggcggtggcgcgggcgccca

SEQ ID NO: 616127 - DNA, 20 bp, mouse
gagacactagggtaatccgg

SEQ ID NO: 616128 - DNA, 20 bp, mouse
gagcagcagccgggagacct

SEQ ID NO: 616129 - DNA, 20 bp, mouse
gggcagacactagggtaatc

SEQ ID NO: 616130 - DNA, 20 bp, mouse
gcgctgtcggtctaattcca

SEQ ID NO: 616131 - DNA, 20 bp, mouse
ggctcacctagtctcccgaa

SEQ ID NO: 616132 - DNA, 20 bp, mouse
ggtggcgctcgccactcggg

SEQ ID NO: 616133 - DNA, 20 bp, mouse
gggccaccggctactggaag

SEQ ID NO: 616134 - DNA, 20 bp, mouse
gttaccctagtgtctgccct

SEQ ID NO: 616135 - DNA, 20 bp, mouse
gcgtctacgccgaggtctcc

SEQ ID NO: 616136 - DNA, 20 bp, mouse
gagcagcggagacacggact

SEQ ID NO: 616137 - DNA, 20 bp, mouse
gtgcccgtgaaggatccggg

SEQ ID NO: 616138 - DNA, 20 bp, mouse
gacgttgagcagcggagaca

SEQ ID NO: 616139 - DNA, 20 bp, mouse
gaaccgcccggatccttcac

SEQ ID NO: 616140 - DNA, 20 bp, mouse
gggcttgcccgtgaaggatc

SEQ ID NO: 616141 - DNA, 20 bp, mouse
gagaaaacgacgttgagcag

SEQ ID NO: 616142 - DNA, 20 bp, mouse
gagagggcaacatctcgggt

SEQ ID NO: 616143 - DNA, 20 bp, mouse
gtgagctccccgtacaggtg

SEQ ID NO: 616144 - DNA, 20 bp, mouse
gccccgcccgggctccacag

SEQ ID NO: 616145 - DNA, 20 bp, mouse
gggtcggtgcagtcttgcag

SEQ ID NO: 616146 - DNA, 20 bp, mouse
gctccaccctccttaccagt

SEQ ID NO: 616147 - DNA, 20 bp, mouse
gagtgggctagagtgtgaga

SEQ ID NO: 616148 - DNA, 20 bp, mouse
ggtaggaaaggctccatgca

SEQ ID NO: 616149 - DNA, 20 bp, mouse
gttcctactggtaaggaggg

SEQ ID NO: 616150 - DNA, 20 bp, mouse
gcctttcctactggtaagga

SEQ ID NO: 616151 - DNA, 20 bp, mouse
gggagcctttcctactggta

SEQ ID NO: 616152 - DNA, 20 bp, mouse
ggtagtgtggagattacatt

SEQ ID NO: 616153 - DNA, 20 bp, mouse
gggctgaagaaaggtccagg

SEQ ID NO: 616154 - DNA, 20 bp, mouse
ggggctcaggcagattgaat

SEQ ID NO: 616155 - DNA, 20 bp, mouse
gctggaccaagatgcaggtg

SEQ ID NO: 616156 - DNA, 20 bp, mouse
ggggcctgagaacaccatgt

SEQ ID NO: 616157 - DNA, 20 bp, mouse
gggcccctaggagtctgaca

SEQ ID NO: 616158 - DNA, 20 bp, mouse
gtaggagtctgacatggagt

SEQ ID NO: 616159 - DNA, 20 bp, mouse
gccaccagcctctccctaca

SEQ ID NO: 616160 - DNA, 20 bp, mouse
gcatggagtaggacgaatgg

SEQ ID NO: 616161 - DNA, 20 bp, mouse
gtgacatggagtaggacgaa

SEQ ID NO: 616162 - DNA, 20 bp, mouse
gtaccgtggtggaacagcag

SEQ ID NO: 616163 - DNA, 20 bp, mouse
gtccagctgggatttagatg

SEQ ID NO: 616164 - DNA, 20 bp, mouse
gttagatgtggagccatctt

SEQ ID NO: 616165 - DNA, 20 bp, mouse
gaggctgccgcctcagaggt

SEQ ID NO: 616166 - DNA, 20 bp, mouse
gaccggggcctgagagatca

SEQ ID NO: 616167 - DNA, 20 bp, mouse
ggcctgagagatcatggcaa

SEQ ID NO: 616168 - DNA, 20 bp, mouse
gcgactatccctgtcaaccg

SEQ ID NO: 616169 - DNA, 20 bp, mouse
gagatcatggcaacgggctc

SEQ ID NO: 616170 - DNA, 20 bp, mouse
gtctcaggccccggttgaca

SEQ ID NO: 616171 - DNA, 20 bp, mouse
gcccgttgccatgatctctc

SEQ ID NO: 616172 - DNA, 20 bp, mouse
gatggcaacgggctcgggcg

SEQ ID NO: 616173 - DNA, 20 bp, mouse
ggaagaagccggaggctgag

SEQ ID NO: 616174 - DNA, 20 bp, mouse
ggatagtcgccgcctcggga

SEQ ID NO: 616175 - DNA, 20 bp, mouse
ggcggggccccgtcccgagg

SEQ ID NO: 616176 - DNA, 20 bp, mouse
gcactatggagatccagtcc

SEQ ID NO: 616177 - DNA, 20 bp, mouse
gcatagtgctcggaagagca

SEQ ID NO: 616178 - DNA, 20 bp, mouse
gtggagcacgaggtacgaga

SEQ ID NO: 616179 - DNA, 20 bp, mouse
gcagtcccggccgcgccgag

SEQ ID NO: 616180 - DNA, 20 bp, mouse
ggcccaccgcaggatttaag

SEQ ID NO: 616181 - DNA, 20 bp, mouse
gacgaggtacgagatggcac

SEQ ID NO: 616182 - DNA, 20 bp, mouse
ggccgtccgcttaaatcctg

SEQ ID NO: 616183 - DNA, 20 bp, mouse
gggccgcagcctggcagtcc

SEQ ID NO: 616184 - DNA, 20 bp, mouse
gtccagtccgggccgcagcc

SEQ ID NO: 616185 - DNA, 20 bp, mouse
gactggatctccatagtgct

SEQ ID NO: 616186 - DNA, 20 bp, mouse
gtccagccccgagccgatag

SEQ ID NO: 616187 - DNA, 20 bp, mouse
gggctccgagatcctggcgg

SEQ ID NO: 616188 - DNA, 20 bp, mouse
gccccctcggggttaactcc

SEQ ID NO: 616189 - DNA, 20 bp, mouse
gctgctggagctgcccctat

SEQ ID NO: 616190 - DNA, 20 bp, mouse
gtctcctcgaaacctcgggt

SEQ ID NO: 616191 - DNA, 20 bp, mouse
ggccgccgccgccaggatct

SEQ ID NO: 616192 - DNA, 20 bp, mouse
gtccgagatcctggcggcgg

SEQ ID NO: 616193 - DNA, 20 bp, mouse
ggccaggagttaaccccgag

SEQ ID NO: 616194 - DNA, 20 bp, mouse
gttcgtgtccatagcgacgg

SEQ ID NO: 616195 - DNA, 20 bp, mouse
gaagagccgcagcgaacgag

SEQ ID NO: 616196 - DNA, 20 bp, mouse
ggacagaagatgaaccccaa

SEQ ID NO: 616197 - DNA, 20 bp, mouse
gcaacagagcttccaatgag

SEQ ID NO: 616198 - DNA, 20 bp, mouse
gggaggactggaatctgtac

SEQ ID NO: 616199 - DNA, 20 bp, mouse
ggaggtgggtttgtcggcag

SEQ ID NO: 616200 - DNA, 20 bp, mouse
gggactggaatctgtactgg

SEQ ID NO: 616201 - DNA, 20 bp, mouse
gcgcacagaagccgaagctt

SEQ ID NO: 616202 - DNA, 20 bp, mouse
ggtacagaatgtccctctag

SEQ ID NO: 616203 - DNA, 20 bp, mouse
gcccagaggcaggactacaa

SEQ ID NO: 616204 - DNA, 20 bp, mouse
ggaggcaggactacaatgga

SEQ ID NO: 616205 - DNA, 20 bp, mouse
gtggatggtctgcagagttt

SEQ ID NO: 616206 - DNA, 20 bp, mouse
gcaataaggtacaatcactg

SEQ ID NO: 616207 - DNA, 20 bp, mouse
gcagaccacagcgaccaata

SEQ ID NO: 616208 - DNA, 20 bp, mouse
gcttaggcctagtagagagg

SEQ ID NO: 616209 - DNA, 20 bp, mouse
gcagtcacagccactggagc

SEQ ID NO: 616210 - DNA, 20 bp, mouse
ggcctagtagagaggcggta

SEQ ID NO: 616211 - DNA, 20 bp, mouse
ggactcaggaggctagtaga

SEQ ID NO: 616212 - DNA, 20 bp, mouse
gggagcagaggagcccgagc

SEQ ID NO: 616213 - DNA, 20 bp, mouse
gctccttaggcctagtagag

SEQ ID NO: 616214 - DNA, 20 bp, mouse
gacaggccctgcacccagac

SEQ ID NO: 616215 - DNA, 20 bp, mouse
gtgccgggcaggcctaggag

SEQ ID NO: 616216 - DNA, 20 bp, mouse
gctctgtgtgggacagaaag

SEQ ID NO: 616217 - DNA, 20 bp, mouse
gtggttgctagggacacctg

SEQ ID NO: 616218 - DNA, 20 bp, mouse
gcagagcgtgggtcgcgtgg

SEQ ID NO: 616219 - DNA, 20 bp, mouse
gacagaaagcggcagagcgt

SEQ ID NO: 616220 - DNA, 20 bp, mouse
gagcaggcgcagcgaagaag

SEQ ID NO: 616221 - DNA, 20 bp, mouse
gtgggcgagcgggcgacctc

SEQ ID NO: 616222 - DNA, 20 bp, mouse
gcggcgaagtagggtaccgt

SEQ ID NO: 616223 - DNA, 20 bp, mouse
gcggcagagcgtgggtcgcg

SEQ ID NO: 616224 - DNA, 20 bp, mouse
gctgcgaccacactcaccta

SEQ ID NO: 616225 - DNA, 20 bp, mouse
gactcgagagagggcccggg

SEQ ID NO: 616226 - DNA, 20 bp, mouse
gttggttgttgtagtaacgg

SEQ ID NO: 616227 - DNA, 20 bp, mouse
ggaatcaacgcagccgccga

SEQ ID NO: 616228 - DNA, 20 bp, mouse
gcgggggaagcagccttcgg

SEQ ID NO: 616229 - DNA, 20 bp, mouse
gtggcggctggtccctgtag

SEQ ID NO: 616230 - DNA, 20 bp, mouse
gggaggtgcgctccagggtt

SEQ ID NO: 616231 - DNA, 20 bp, mouse
gagctcggagggaagcgcag

SEQ ID NO: 616232 - DNA, 20 bp, mouse
gagctccgcaggcaaggacg

SEQ ID NO: 616233 - DNA, 20 bp, mouse
gtgagcggcgtagcaggaag

SEQ ID NO: 616234 - DNA, 20 bp, mouse
ggtgctgggcagaagcgctg

SEQ ID NO: 616235 - DNA, 20 bp, mouse
gtaacgggggaagcagcctt

SEQ ID NO: 616236 - DNA, 20 bp, mouse
gagttccacagaagatctgg

SEQ ID NO: 616237 - DNA, 20 bp, mouse
gtgcctgacttcggaaagtg

SEQ ID NO: 616238 - DNA, 20 bp, mouse
ggacttcggaaagtgaggaa

SEQ ID NO: 616239 - DNA, 20 bp, mouse
gttctctctcacaaaagcca

SEQ ID NO: 616240 - DNA, 20 bp, mouse
gatcttcctagccctggagg

SEQ ID NO: 616241 - DNA, 20 bp, mouse
ggaaggtcttggctgatgag

SEQ ID NO: 616242 - DNA, 20 bp, mouse
ggcagcatggtaagaaaaag

SEQ ID NO: 616243 - DNA, 20 bp, mouse
gtgaaaaacgaggagtttcg

SEQ ID NO: 616244 - DNA, 20 bp, mouse
gtccagaacgcacagcagca

SEQ ID NO: 616245 - DNA, 20 bp, mouse
gtgtcggtgttgataagagc

SEQ ID NO: 616246 - DNA, 20 bp, mouse
gcggtagctaccaccccctt

SEQ ID NO: 616247 - DNA, 20 bp, mouse
ggcttctaagctctgaaccg

SEQ ID NO: 616248 - DNA, 20 bp, mouse
gctctctggcaggatgaagt

SEQ ID NO: 616249 - DNA, 20 bp, mouse
gcacccccccggggcagccg

SEQ ID NO: 616250 - DNA, 20 bp, mouse
ggctccagctgctcctggtc

SEQ ID NO: 616251 - DNA, 20 bp, mouse
ggaaccgcggctgccccggg

SEQ ID NO: 616252 - DNA, 20 bp, mouse
gttagaagctcgaccggacc

SEQ ID NO: 616253 - DNA, 20 bp, mouse
gcagagcttagaagctcgac

SEQ ID NO: 616254 - DNA, 20 bp, mouse
gaagcaccaggacctcgaga

SEQ ID NO: 616255 - DNA, 20 bp, mouse
ggaatgggcgcagcgacctg

SEQ ID NO: 616256 - DNA, 20 bp, mouse
gaggttgaacaggcgtggtg

SEQ ID NO: 616257 - DNA, 20 bp, mouse
ggggaggccgttacgaagtt

SEQ ID NO: 616258 - DNA, 20 bp, mouse
gcgaagtttggaggaaagtg

SEQ ID NO: 616259 - DNA, 20 bp, mouse
gcgtggtggggtgaaagtgg

SEQ ID NO: 616260 - DNA, 20 bp, mouse
gaggccgttacgaagtttgg

SEQ ID NO: 616261 - DNA, 20 bp, mouse
ggagggaaagaaggttgaac

SEQ ID NO: 616262 - DNA, 20 bp, mouse
gtagacttgggccagagtta

SEQ ID NO: 616263 - DNA, 20 bp, mouse
gtagggtagagggacaactc

SEQ ID NO: 616264 - DNA, 20 bp, mouse
ggcaggcttagggtcagaaa

SEQ ID NO: 616265 - DNA, 20 bp, mouse
ggtctggagctaagaaggag

SEQ ID NO: 616266 - DNA, 20 bp, mouse
gtcatgtcgcgacagaaggt

SEQ ID NO: 616267 - DNA, 20 bp, mouse
gctttctagggtgcccgcgg

SEQ ID NO: 616268 - DNA, 20 bp, mouse
ggagacgcacatgctttcta

SEQ ID NO: 616269 - DNA, 20 bp, mouse
gtagggtgcccgcggcggtt

SEQ ID NO: 616270 - DNA, 20 bp, mouse
ggcccaaaccaaaccgccgc

SEQ ID NO: 616271 - DNA, 20 bp, mouse
ggattcggaaggggaaggtt

SEQ ID NO: 616272 - DNA, 20 bp, mouse
gctcgcggagcgtgtgtatg

SEQ ID NO: 616273 - DNA, 20 bp, mouse
gttctgtcgcgacatgagtt

SEQ ID NO: 616274 - DNA, 20 bp, mouse
gtgcccgcggcggtttggtt

SEQ ID NO: 616275 - DNA, 20 bp, mouse
gacaatctacatcatcggat

SEQ ID NO: 616276 - DNA, 20 bp, mouse
gcctacacccgaggcgaggt

SEQ ID NO: 616277 - DNA, 20 bp, mouse
gcgcattcccacctcgcctc

SEQ ID NO: 616278 - DNA, 20 bp, mouse
gaatccctacacccgaggcg

SEQ ID NO: 616279 - DNA, 20 bp, mouse
gtatgcaatccctacacccg

SEQ ID NO: 616280 - DNA, 20 bp, mouse
gtctcaggagtgcccaaaaa

SEQ ID NO: 616281 - DNA, 20 bp, mouse
gtgggcactcctgagaaatc

SEQ ID NO: 616282 - DNA, 20 bp, mouse
gccaatcagaaagagctcca

SEQ ID NO: 616283 - DNA, 20 bp, mouse
gccacacagtcttgactgtg

SEQ ID NO: 616284 - DNA, 20 bp, mouse
gaggagtgcccaaaaagggt

SEQ ID NO: 616285 - DNA, 20 bp, mouse
gataagggccggccagcccc

SEQ ID NO: 616286 - DNA, 20 bp, mouse
gggagcagcggcgagtggtc

SEQ ID NO: 616287 - DNA, 20 bp, mouse
gtgcggccggggccattggt

SEQ ID NO: 616288 - DNA, 20 bp, mouse
gtgtcgccgggacagcacgg

SEQ ID NO: 616289 - DNA, 20 bp, mouse
gccctgtcgccgggacagca

SEQ ID NO: 616290 - DNA, 20 bp, mouse
gcatggcagagatgcggccg

SEQ ID NO: 616291 - DNA, 20 bp, mouse
ggcgcgtaagtgtgcaccgg

SEQ ID NO: 616292 - DNA, 20 bp, mouse
gcccgccggtgcaagggtca

SEQ ID NO: 616293 - DNA, 20 bp, mouse
ggataactaggtgtggacag

SEQ ID NO: 616294 - DNA, 20 bp, mouse
ggtttcccaaccaatggccc

SEQ ID NO: 616295 - DNA, 20 bp, mouse
ggacatcccgtggactacta

SEQ ID NO: 616296 - DNA, 20 bp, mouse
ggtcacggcggcaggagcct

SEQ ID NO: 616297 - DNA, 20 bp, mouse
gtgggcactcaccagcccgg

SEQ ID NO: 616298 - DNA, 20 bp, mouse
gggcgcacacccgggctcgt

SEQ ID NO: 616299 - DNA, 20 bp, mouse
gcggcggcaggagcctcggc

SEQ ID NO: 616300 - DNA, 20 bp, mouse
ggcactcaccagcccggcgg

SEQ ID NO: 616301 - DNA, 20 bp, mouse
gagcggctcgcaggtctctg

SEQ ID NO: 616302 - DNA, 20 bp, mouse
gctgcgcgcgctgccagccg

SEQ ID NO: 616303 - DNA, 20 bp, mouse
gtcaccagcccggcggcggg

SEQ ID NO: 616304 - DNA, 20 bp, mouse
gcgccgaggggccagagata

SEQ ID NO: 616305 - DNA, 20 bp, mouse
ggatgccccggagagagaga

SEQ ID NO: 616306 - DNA, 20 bp, mouse
gcagtccagcgaggcaaagg

SEQ ID NO: 616307 - DNA, 20 bp, mouse
gtaccagtccagcgaggcaa

SEQ ID NO: 616308 - DNA, 20 bp, mouse
ggaagggaagccatcctgtc

SEQ ID NO: 616309 - DNA, 20 bp, mouse
gagatccacaagctcctgac

SEQ ID NO: 616310 - DNA, 20 bp, mouse
gagcttgtggatctgtgtga

SEQ ID NO: 616311 - DNA, 20 bp, mouse
ggcaaaggaggaagagtcga

SEQ ID NO: 616312 - DNA, 20 bp, mouse
gcctgtgagcgatccagaca

SEQ ID NO: 616313 - DNA, 20 bp, mouse
gagaagagctggagtgcctc

SEQ ID NO: 616314 - DNA, 20 bp, mouse
gctcacaggatcactcaccg

SEQ ID NO: 616315 - DNA, 20 bp, mouse
ggcactccagctcttctctt

SEQ ID NO: 616316 - DNA, 20 bp, mouse
gcagagggtcggtagcccgg

SEQ ID NO: 616317 - DNA, 20 bp, mouse
gcccccatggccccggggag

SEQ ID NO: 616318 - DNA, 20 bp, mouse
gaggggcagcggggcggacc

SEQ ID NO: 616319 - DNA, 20 bp, mouse
gatgcacccaggcagagggt

SEQ ID NO: 616320 - DNA, 20 bp, mouse
gggagcctcggtgctgtgcg

SEQ ID NO: 616321 - DNA, 20 bp, mouse
gcaggtcccctgggaacagg

SEQ ID NO: 616322 - DNA, 20 bp, mouse
gaacctgggccaggtcccct

SEQ ID NO: 616323 - DNA, 20 bp, mouse
ggcagcggggcggaccgggc

SEQ ID NO: 616324 - DNA, 20 bp, mouse
gccgggagcaggagcccgga

SEQ ID NO: 616325 - DNA, 20 bp, mouse
gaccgggcggagctggaagt

SEQ ID NO: 616326 - DNA, 20 bp, mouse
gcttgtgcaagccatgccgg

SEQ ID NO: 616327 - DNA, 20 bp, mouse
ggtagtggtggtagcggcgt

SEQ ID NO: 616328 - DNA, 20 bp, mouse
ggcagccacacgacccacca

SEQ ID NO: 616329 - DNA, 20 bp, mouse
gtggcttgcacaagctgcag

SEQ ID NO: 616330 - DNA, 20 bp, mouse
gtcgcttccgagccgggtag

SEQ ID NO: 616331 - DNA, 20 bp, mouse
ggccatgccggcggcgcgag

SEQ ID NO: 616332 - DNA, 20 bp, mouse
gcatgagccgagccacggag

SEQ ID NO: 616333 - DNA, 20 bp, mouse
gaagaagaggaaggacgcgg

SEQ ID NO: 616334 - DNA, 20 bp, mouse
gaagcccatgagccgagcca

SEQ ID NO: 616335 - DNA, 20 bp, mouse
gctctaagggtccctctccg

SEQ ID NO: 616336 - DNA, 20 bp, mouse
gagctacgcggcgccctggt

SEQ ID NO: 616337 - DNA, 20 bp, mouse
ggcggtgaacaaagaggcgg

SEQ ID NO: 616338 - DNA, 20 bp, mouse
gcccaccgcaggtcgaagtg

SEQ ID NO: 616339 - DNA, 20 bp, mouse
gaggccctggtgacacagag

SEQ ID NO: 616340 - DNA, 20 bp, mouse
gtcatcgtgcccgcttccag

SEQ ID NO: 616341 - DNA, 20 bp, mouse
gacaaagaggcggcgggcgc

SEQ ID NO: 616342 - DNA, 20 bp, mouse
gtgcaggaggctcacccacc

SEQ ID NO: 616343 - DNA, 20 bp, mouse
gtagctgaccccggccatgg

SEQ ID NO: 616344 - DNA, 20 bp, mouse
ggcgtagctgaccccggcca

SEQ ID NO: 616345 - DNA, 20 bp, mouse
gggcgactcctagaatgaaa

SEQ ID NO: 616346 - DNA, 20 bp, mouse
gcggccgcgggctcccagaa

SEQ ID NO: 616347 - DNA, 20 bp, mouse
ggtgcagcgctcgggagagg

SEQ ID NO: 616348 - DNA, 20 bp, mouse
ggcgcacagacaaccgttct

SEQ ID NO: 616349 - DNA, 20 bp, mouse
gcagcgctcgggagaggcgg

SEQ ID NO: 616350 - DNA, 20 bp, mouse
gaggccctctctgcacgcca

SEQ ID NO: 616351 - DNA, 20 bp, mouse
gcgtgcagagagggcctcgg

SEQ ID NO: 616352 - DNA, 20 bp, mouse
gcacgccagggccccggccg

SEQ ID NO: 616353 - DNA, 20 bp, mouse
ggggccctggcgtgcagaga

SEQ ID NO: 616354 - DNA, 20 bp, mouse
gagcgcgcctgaggcgggag

SEQ ID NO: 616355 - DNA, 20 bp, mouse
gtgtgcgcggtgcagcgctc

SEQ ID NO: 616356 - DNA, 20 bp, mouse
gcccagaccgggaagaacaa

SEQ ID NO: 616357 - DNA, 20 bp, mouse
ggcggctgccgggtggatgg

SEQ ID NO: 616358 - DNA, 20 bp, mouse
ggctgccgggtggatggcgg

SEQ ID NO: 616359 - DNA, 20 bp, mouse
gttcgcggctgccgggtgga

SEQ ID NO: 616360 - DNA, 20 bp, mouse
gacacggaaacgcccagacc

SEQ ID NO: 616361 - DNA, 20 bp, mouse
gatctaccgagagccgggga

SEQ ID NO: 616362 - DNA, 20 bp, mouse
gctctcggtagatagagggt

SEQ ID NO: 616363 - DNA, 20 bp, mouse
gtccgtgtcccgcactgcgg

SEQ ID NO: 616364 - DNA, 20 bp, mouse
gcacctctgcggggaaaggg

SEQ ID NO: 616365 - DNA, 20 bp, mouse
gcccggctctcggtagatag

SEQ ID NO: 616366 - DNA, 20 bp, mouse
gggtaagtaacgcaatgagg

SEQ ID NO: 616367 - DNA, 20 bp, mouse
gctacttaagaggctcggag

SEQ ID NO: 616368 - DNA, 20 bp, mouse
gtccccagctgctacttaag

SEQ ID NO: 616369 - DNA, 20 bp, mouse
gaagtaacgcaatgaggcgg

SEQ ID NO: 616370 - DNA, 20 bp, mouse
gtcggggctgtgatcgaggg

SEQ ID NO: 616371 - DNA, 20 bp, mouse
gggaggaagaagctcgctcg

SEQ ID NO: 616372 - DNA, 20 bp, mouse
ggccgggcgcccagtggacg

SEQ ID NO: 616373 - DNA, 20 bp, mouse
gagctgctacttaagaggct

SEQ ID NO: 616374 - DNA, 20 bp, mouse
gctctcaggcgggaatgtaa

SEQ ID NO: 616375 - DNA, 20 bp, mouse
gggtcaggccgggcgcccag

SEQ ID NO: 616376 - DNA, 20 bp, mouse
ggagccagagaggtgacccg

SEQ ID NO: 616377 - DNA, 20 bp, mouse
gaaggtccgcctccaggaca

SEQ ID NO: 616378 - DNA, 20 bp, mouse
gcagaagccagtctaactgg

SEQ ID NO: 616379 - DNA, 20 bp, mouse
gatcagctgtgagtccccgg

SEQ ID NO: 616380 - DNA, 20 bp, mouse
gcccaggaggatcgagacag

SEQ ID NO: 616381 - DNA, 20 bp, mouse
gcgtagaaggagctggaagt

SEQ ID NO: 616382 - DNA, 20 bp, mouse
gaagtcccaggtagagaggg

SEQ ID NO: 616383 - DNA, 20 bp, mouse
gcggccgcctccagttagac

SEQ ID NO: 616384 - DNA, 20 bp, mouse
gcgagacgggatgctctccc

SEQ ID NO: 616385 - DNA, 20 bp, mouse
gccgccggtcgctcccggaa

SEQ ID NO: 616386 - DNA, 20 bp, mouse
gagaggcggttgaggaccag

SEQ ID NO: 616387 - DNA, 20 bp, mouse
gtgagcgcgcagaccagagg

SEQ ID NO: 616388 - DNA, 20 bp, mouse
ggaggaccagtggtgaggaa

SEQ ID NO: 616389 - DNA, 20 bp, mouse
gtgttgagcgcgcagaccag

SEQ ID NO: 616390 - DNA, 20 bp, mouse
gtggtgaggaacggccgagg

SEQ ID NO: 616391 - DNA, 20 bp, mouse
gtgcatggtgaggagtctag

SEQ ID NO: 616392 - DNA, 20 bp, mouse
ggccgaggcggcgtctgagc

SEQ ID NO: 616393 - DNA, 20 bp, mouse
gcagtggtgaggaacggccg

SEQ ID NO: 616394 - DNA, 20 bp, mouse
ggggtctccggagttcagca

SEQ ID NO: 616395 - DNA, 20 bp, mouse
gagcatggtgagagcggccg

SEQ ID NO: 616396 - DNA, 20 bp, mouse
gcggttgaggagcagctctg

SEQ ID NO: 616397 - DNA, 20 bp, mouse
gcagctctgaggatcggctg

SEQ ID NO: 616398 - DNA, 20 bp, mouse
gctctgctaggagttcagca

SEQ ID NO: 616399 - DNA, 20 bp, mouse
ggtgagaacagcccgaaccg

SEQ ID NO: 616400 - DNA, 20 bp, mouse
gggaccgttgggcgcacgag

SEQ ID NO: 616401 - DNA, 20 bp, mouse
ggcatccagcctggaccgtt

SEQ ID NO: 616402 - DNA, 20 bp, mouse
ggaaccggggtgggacccac

SEQ ID NO: 616403 - DNA, 20 bp, mouse
gcggggtgggacccacggga

SEQ ID NO: 616404 - DNA, 20 bp, mouse
ggaacagcccgaaccggggt

SEQ ID NO: 616405 - DNA, 20 bp, mouse
gccgccgctcgtgcgcccaa

SEQ ID NO: 616406 - DNA, 20 bp, mouse
gtataggaccggagagatcc

SEQ ID NO: 616407 - DNA, 20 bp, mouse
gtacgtctcacgtagagtcg

SEQ ID NO: 616408 - DNA, 20 bp, mouse
ggcaggaggacactacagaa

SEQ ID NO: 616409 - DNA, 20 bp, mouse
gcaggtgagagaatccggag

SEQ ID NO: 616410 - DNA, 20 bp, mouse
gcgggtctcggtgagatctg

SEQ ID NO: 616411 - DNA, 20 bp, mouse
gcggaggagagcactgggta

SEQ ID NO: 616412 - DNA, 20 bp, mouse
gtcacgtagagtcggggtca

SEQ ID NO: 616413 - DNA, 20 bp, mouse
ggaccggagagatcctggcg

SEQ ID NO: 616414 - DNA, 20 bp, mouse
gcctgcctataagagcggtg

SEQ ID NO: 616415 - DNA, 20 bp, mouse
gttcagaagctggggactga

SEQ ID NO: 616416 - DNA, 20 bp, mouse
gggcgagcgggcgaagagag

SEQ ID NO: 616417 - DNA, 20 bp, mouse
gcggggaagtctcaccatcg

SEQ ID NO: 616418 - DNA, 20 bp, mouse
ggcccagctgggaggcgagc

SEQ ID NO: 616419 - DNA, 20 bp, mouse
ggcgcgtccggggccagccc

SEQ ID NO: 616420 - DNA, 20 bp, mouse
gtggtgagacttccccgccc

SEQ ID NO: 616421 - DNA, 20 bp, mouse
gtagagaatgtagagagcag

SEQ ID NO: 616422 - DNA, 20 bp, mouse
gcaagggtcttgtttcccag

SEQ ID NO: 616423 - DNA, 20 bp, mouse
ggccgtatctggagcagttg

SEQ ID NO: 616424 - DNA, 20 bp, mouse
ggtatctggagcagttgggg

SEQ ID NO: 616425 - DNA, 20 bp, mouse
gagagagctgcggggccacg

SEQ ID NO: 616426 - DNA, 20 bp, mouse
gcgtcaccagagggttgtag

SEQ ID NO: 616427 - DNA, 20 bp, mouse
gcatcatggtaagtgaacat

SEQ ID NO: 616428 - DNA, 20 bp, mouse
gaggtgcccctacaaccctc

SEQ ID NO: 616429 - DNA, 20 bp, mouse
gggacgcgattaacagggtt

SEQ ID NO: 616430 - DNA, 20 bp, mouse
gacataggacgcgattaaca

SEQ ID NO: 616431 - DNA, 20 bp, mouse
ggcgattaacagggttggga

SEQ ID NO: 616432 - DNA, 20 bp, mouse
ggctcctcaatcgtcaccag

SEQ ID NO: 616433 - DNA, 20 bp, mouse
gaaccctctggtgacgattg

SEQ ID NO: 616434 - DNA, 20 bp, mouse
gctcaaacagaactaatgaa

SEQ ID NO: 616435 - DNA, 20 bp, mouse
gacttaagcaaacttaatgg

SEQ ID NO: 616436 - DNA, 20 bp, mouse
gccagatcggagccaaggta

SEQ ID NO: 616437 - DNA, 20 bp, mouse
gtgcgacctaactgactctt

SEQ ID NO: 616438 - DNA, 20 bp, mouse
ggactcttgggttcaaggct

SEQ ID NO: 616439 - DNA, 20 bp, mouse
gtcagttaggtcgcagagtc

SEQ ID NO: 616440 - DNA, 20 bp, mouse
gcagctcacactggtgaccc

SEQ ID NO: 616441 - DNA, 20 bp, mouse
gacatccagattggccagtg

SEQ ID NO: 616442 - DNA, 20 bp, mouse
gaactgcacccagctcacac

SEQ ID NO: 616443 - DNA, 20 bp, mouse
gtaactgactcttgggttca

SEQ ID NO: 616444 - DNA, 20 bp, mouse
gcgcagagtctggaagagcc

SEQ ID NO: 616445 - DNA, 20 bp, mouse
ggctctgctctgccttacct

SEQ ID NO: 616446 - DNA, 20 bp, mouse
ggtgcgtggacagagggcta

SEQ ID NO: 616447 - DNA, 20 bp, mouse
gtgtccacgcactgctccga

SEQ ID NO: 616448 - DNA, 20 bp, mouse
gggagcagtgcgtggacaga

SEQ ID NO: 616449 - DNA, 20 bp, mouse
gttgccctcggagcagtgcg

SEQ ID NO: 616450 - DNA, 20 bp, mouse
gggaagcaggccgagcctag

SEQ ID NO: 616451 - DNA, 20 bp, mouse
gaccagatcggcgctaaggt

SEQ ID NO: 616452 - DNA, 20 bp, mouse
gcagggtcccaaggttgcgt

SEQ ID NO: 616453 - DNA, 20 bp, mouse
gtaaggtgggctcaccccta

SEQ ID NO: 616454 - DNA, 20 bp, mouse
gtggaatgcgacaccagccg

SEQ ID NO: 616455 - DNA, 20 bp, mouse
gcaaggttgcgtggggagag

SEQ ID NO: 616456 - DNA, 20 bp, mouse
gggccacctggaacttactc

SEQ ID NO: 616457 - DNA, 20 bp, mouse
gccctcagcccgtagcccgt

SEQ ID NO: 616458 - DNA, 20 bp, mouse
gaacttactccggaaccgac

SEQ ID NO: 616459 - DNA, 20 bp, mouse
gcccgaggggagctccgtta

SEQ ID NO: 616460 - DNA, 20 bp, mouse
gagctcccctcgggataggt

SEQ ID NO: 616461 - DNA, 20 bp, mouse
gttccggagtaagttccagg

SEQ ID NO: 616462 - DNA, 20 bp, mouse
gcggttccggagtaagttcc

SEQ ID NO: 616463 - DNA, 20 bp, mouse
gcggatgggcgtggtctcag

SEQ ID NO: 616464 - DNA, 20 bp, mouse
gtccggaaccgacgggctac

SEQ ID NO: 616465 - DNA, 20 bp, mouse
gggaccccacctatcccgag

SEQ ID NO: 616466 - DNA, 20 bp, mouse
gcacgcggctagagacgaaa

SEQ ID NO: 616467 - DNA, 20 bp, mouse
gcggctagagacgaaaaggc

SEQ ID NO: 616468 - DNA, 20 bp, mouse
gacagcaggctgcggaggat

SEQ ID NO: 616469 - DNA, 20 bp, mouse
gccagataggggccaaggtg

SEQ ID NO: 616470 - DNA, 20 bp, mouse
ggagccgctagcggaacaaa

SEQ ID NO: 616471 - DNA, 20 bp, mouse
ggcagagtggcgtgattgag

SEQ ID NO: 616472 - DNA, 20 bp, mouse
gcgactctgggagccgctag

SEQ ID NO: 616473 - DNA, 20 bp, mouse
ggaccccggggtcccaggag

SEQ ID NO: 616474 - DNA, 20 bp, mouse
gggcggacagcaggctgcgg

SEQ ID NO: 616475 - DNA, 20 bp, mouse
gcccacaagcgccagcccca

SEQ ID NO: 616476 - DNA, 20 bp, mouse
gtccagagctagagccacag

SEQ ID NO: 616477 - DNA, 20 bp, mouse
ggctggtggcgtctgatgga

SEQ ID NO: 616478 - DNA, 20 bp, mouse
gctgatggacgggtgtcgac

SEQ ID NO: 616479 - DNA, 20 bp, mouse
ggctctagctctggacgaga

SEQ ID NO: 616480 - DNA, 20 bp, mouse
ggggtgtcgaccggccgctg

SEQ ID NO: 616481 - DNA, 20 bp, mouse
gatggtggtggcgctgctgg

SEQ ID NO: 616482 - DNA, 20 bp, mouse
gcgctgctggtggcgtctga

SEQ ID NO: 616483 - DNA, 20 bp, mouse
gtgcatcctaggtggaggag

SEQ ID NO: 616484 - DNA, 20 bp, mouse
ggtcggactgagtagagggt

SEQ ID NO: 616485 - DNA, 20 bp, mouse
gacgatttcccgcatggtgg

SEQ ID NO: 616486 - DNA, 20 bp, mouse
ggtatccaggacgcaatgaa

SEQ ID NO: 616487 - DNA, 20 bp, mouse
ggacgagggcgggtcataag

SEQ ID NO: 616488 - DNA, 20 bp, mouse
gctctcggagtgctcccagg

SEQ ID NO: 616489 - DNA, 20 bp, mouse
gccccaccgacaccagccac

SEQ ID NO: 616490 - DNA, 20 bp, mouse
gcagggcgacgaatccctaa

SEQ ID NO: 616491 - DNA, 20 bp, mouse
gagccaccggcgctacgtct

SEQ ID NO: 616492 - DNA, 20 bp, mouse
gtccgagagcctgacactat

SEQ ID NO: 616493 - DNA, 20 bp, mouse
gaccagattggcgccaaggt

SEQ ID NO: 616494 - DNA, 20 bp, mouse
gccactgggacagccagccg

SEQ ID NO: 616495 - DNA, 20 bp, mouse
gagattggcgccaaggtagg

SEQ ID NO: 616496 - DNA, 20 bp, mouse
ggacttggagccctgcacca

SEQ ID NO: 616497 - DNA, 20 bp, mouse
gattacaacgaagccaccgg

SEQ ID NO: 616498 - DNA, 20 bp, mouse
ggaaccgagtccatggtgca

SEQ ID NO: 616499 - DNA, 20 bp, mouse
gggcacatacttgccaccgg

SEQ ID NO: 616500 - DNA, 20 bp, mouse
gcatggactcggttcgttca

SEQ ID NO: 616501 - DNA, 20 bp, mouse
gtaccctcatcagcaagatc

SEQ ID NO: 616502 - DNA, 20 bp, mouse
gcagattggcgccaagttct

SEQ ID NO: 616503 - DNA, 20 bp, mouse
gattggcgccaagttctggg

SEQ ID NO: 616504 - DNA, 20 bp, mouse
gctgattacctcccagaact

SEQ ID NO: 616505 - DNA, 20 bp, mouse
gtccagctgacccactccct

SEQ ID NO: 616506 - DNA, 20 bp, mouse
gaccgcaggaaggttctaag

SEQ ID NO: 616507 - DNA, 20 bp, mouse
gggatggaccggagcccggg

SEQ ID NO: 616508 - DNA, 20 bp, mouse
ggcctcttagaaccttcctg

SEQ ID NO: 616509 - DNA, 20 bp, mouse
gtgcaagcacgaccgcagga

SEQ ID NO: 616510 - DNA, 20 bp, mouse
gccagatcggtgctaaggta

SEQ ID NO: 616511 - DNA, 20 bp, mouse
ggagatgcaagcacgaccgc

SEQ ID NO: 616512 - DNA, 20 bp, mouse
gcggtctcagactgaaagga

SEQ ID NO: 616513 - DNA, 20 bp, mouse
ggcaggagggaaggcgcgca

SEQ ID NO: 616514 - DNA, 20 bp, mouse
gttgaggggccaaatctgac

SEQ ID NO: 616515 - DNA, 20 bp, mouse
gaggggccaaatctgacggg

SEQ ID NO: 616516 - DNA, 20 bp, mouse
ggcgctggctctcccgactg

SEQ ID NO: 616517 - DNA, 20 bp, mouse
gctcctgggagagcaagtcc

SEQ ID NO: 616518 - DNA, 20 bp, mouse
ggcagacgcgcccgccatga

SEQ ID NO: 616519 - DNA, 20 bp, mouse
ggctgaccctgctcactcct

SEQ ID NO: 616520 - DNA, 20 bp, mouse
gtgcccgcggggactcaggg

SEQ ID NO: 616521 - DNA, 20 bp, mouse
gccgcagtcacgccgcagtc

SEQ ID NO: 616522 - DNA, 20 bp, mouse
ggtgatccggtccagagagt

SEQ ID NO: 616523 - DNA, 20 bp, mouse
gtcctgacagctggaaccct

SEQ ID NO: 616524 - DNA, 20 bp, mouse
ggcacaatctccctcatggc

SEQ ID NO: 616525 - DNA, 20 bp, mouse
gcgcgcgcccggacccacct

SEQ ID NO: 616526 - DNA, 20 bp, mouse
ggccttcctaaatagaagaa

SEQ ID NO: 616527 - DNA, 20 bp, mouse
gaaatagaagaagggaaacg

SEQ ID NO: 616528 - DNA, 20 bp, mouse
gggttaccggggagctgata

SEQ ID NO: 616529 - DNA, 20 bp, mouse
gtagccccggaaaggagcag

SEQ ID NO: 616530 - DNA, 20 bp, mouse
gtatgcgaagagctctgctg

SEQ ID NO: 616531 - DNA, 20 bp, mouse
gtcccttcttctatttagga

SEQ ID NO: 616532 - DNA, 20 bp, mouse
gatgcgcgtagtgagagggt

SEQ ID NO: 616533 - DNA, 20 bp, mouse
gcagagctgtcagtgagtgt

SEQ ID NO: 616534 - DNA, 20 bp, mouse
ggagcatgcgcgtagtgaga

SEQ ID NO: 616535 - DNA, 20 bp, mouse
gtcactgacagctctgcgac

SEQ ID NO: 616536 - DNA, 20 bp, mouse
gtcgttgagctcgaaagcta

SEQ ID NO: 616537 - DNA, 20 bp, mouse
gctcaacgacgccctacgag

SEQ ID NO: 616538 - DNA, 20 bp, mouse
gcttaaggccgcccctcgta

SEQ ID NO: 616539 - DNA, 20 bp, mouse
gctcctgctggtcctcccgg

SEQ ID NO: 616540 - DNA, 20 bp, mouse
gctaaggcgggagtttgggc

SEQ ID NO: 616541 - DNA, 20 bp, mouse
ggcggcagcgacgtgactta

SEQ ID NO: 616542 - DNA, 20 bp, mouse
gaaagctaaggcgggagttt

SEQ ID NO: 616543 - DNA, 20 bp, mouse
gaacgacgccctacgagggg

SEQ ID NO: 616544 - DNA, 20 bp, mouse
gtgagctcgaaagctaaggc

SEQ ID NO: 616545 - DNA, 20 bp, mouse
gcctggccgtaaagaaacaa

SEQ ID NO: 616546 - DNA, 20 bp, mouse
gccgcactggcccaactgta

SEQ ID NO: 616547 - DNA, 20 bp, mouse
gcggtcggcggtgttgctgg

SEQ ID NO: 616548 - DNA, 20 bp, mouse
gggcagttgggcacagggtt

SEQ ID NO: 616549 - DNA, 20 bp, mouse
gcggcgagcgcgctagcggt

SEQ ID NO: 616550 - DNA, 20 bp, mouse
gactgcaacgccgatgtctg

SEQ ID NO: 616551 - DNA, 20 bp, mouse
ggtagggtgatgatttctct

SEQ ID NO: 616552 - DNA, 20 bp, mouse
gtgcacctaaggaacctggg

SEQ ID NO: 616553 - DNA, 20 bp, mouse
gttgccggcgagcgcgctag

SEQ ID NO: 616554 - DNA, 20 bp, mouse
ggtcattggcctagacacta

SEQ ID NO: 616555 - DNA, 20 bp, mouse
gcccaactaagagagggagg

SEQ ID NO: 616556 - DNA, 20 bp, mouse
ggccggaggcgcaggacatg

SEQ ID NO: 616557 - DNA, 20 bp, mouse
gaggaactcctgccagccgg

SEQ ID NO: 616558 - DNA, 20 bp, mouse
gccctctggttcaatccctc

SEQ ID NO: 616559 - DNA, 20 bp, mouse
gctcgtccgccccggcctgg

SEQ ID NO: 616560 - DNA, 20 bp, mouse
ggcagggtgatgatctcccg

SEQ ID NO: 616561 - DNA, 20 bp, mouse
ggagaggaactcctgccagc

SEQ ID NO: 616562 - DNA, 20 bp, mouse
gaaccagagggatagaagcg

SEQ ID NO: 616563 - DNA, 20 bp, mouse
ggcctgagggattgaaccag

SEQ ID NO: 616564 - DNA, 20 bp, mouse
gagaactcgaacccaactgg

SEQ ID NO: 616565 - DNA, 20 bp, mouse
gcagagtgagcaagcgacca

SEQ ID NO: 616566 - DNA, 20 bp, mouse
ggacgcgcggaggtgagtca

SEQ ID NO: 616567 - DNA, 20 bp, mouse
gtgttgtggcgggaactggt

SEQ ID NO: 616568 - DNA, 20 bp, mouse
gaactggtcggagaagggcg

SEQ ID NO: 616569 - DNA, 20 bp, mouse
gcgtggagcgagacaagccc

SEQ ID NO: 616570 - DNA, 20 bp, mouse
gggcctgctgcagtagagac

SEQ ID NO: 616571 - DNA, 20 bp, mouse
ggcgggaactggtcggagaa

SEQ ID NO: 616572 - DNA, 20 bp, mouse
ggagcgagacaagcccgggc

SEQ ID NO: 616573 - DNA, 20 bp, mouse
gcgcggaggtgagtcagggc

SEQ ID NO: 616574 - DNA, 20 bp, mouse
ggcagaggcccaagagaatc

SEQ ID NO: 616575 - DNA, 20 bp, mouse
gtccaattggactcctggag

SEQ ID NO: 616576 - DNA, 20 bp, mouse
gggatcccgcgccctaacta

SEQ ID NO: 616577 - DNA, 20 bp, mouse
ggttagggcgcgggatcctg

SEQ ID NO: 616578 - DNA, 20 bp, mouse
ggccgcttccgcgaatatgg

SEQ ID NO: 616579 - DNA, 20 bp, mouse
gtatggcggcgccgtagtta

SEQ ID NO: 616580 - DNA, 20 bp, mouse
gtacggcgccgccatattcg

SEQ ID NO: 616581 - DNA, 20 bp, mouse
ggggatcctggggcgcgggg

SEQ ID NO: 616582 - DNA, 20 bp, mouse
gggttctgcagcagaacgtt

SEQ ID NO: 616583 - DNA, 20 bp, mouse
gccggcccccgggaaggaaa

SEQ ID NO: 616584 - DNA, 20 bp, mouse
gaggctgcagtgcgcagtcc

SEQ ID NO: 616585 - DNA, 20 bp, mouse
gcaggactcatcatcaccag

SEQ ID NO: 616586 - DNA, 20 bp, mouse
gggtggactgcggggattca

SEQ ID NO: 616587 - DNA, 20 bp, mouse
gccccgcagtccaccgggag

SEQ ID NO: 616588 - DNA, 20 bp, mouse
ggatgcggcgcgcggctctg

SEQ ID NO: 616589 - DNA, 20 bp, mouse
gggcgacccctcacacccag

SEQ ID NO: 616590 - DNA, 20 bp, mouse
ggtggcatctcctctcccgg

SEQ ID NO: 616591 - DNA, 20 bp, mouse
gtgtgaggggtcgcccggag

SEQ ID NO: 616592 - DNA, 20 bp, mouse
gccatagccggagctccgta

SEQ ID NO: 616593 - DNA, 20 bp, mouse
gagcgaggcggtgggcgcct

SEQ ID NO: 616594 - DNA, 20 bp, mouse
ggaccctgggtacccactca

SEQ ID NO: 616595 - DNA, 20 bp, mouse
gagattccgctgggtgtgag

SEQ ID NO: 616596 - DNA, 20 bp, mouse
gaagtcgtccgggagccgga

SEQ ID NO: 616597 - DNA, 20 bp, mouse
gggcccggcctaagtcgtcc

SEQ ID NO: 616598 - DNA, 20 bp, mouse
ggatcctgataggtacgccg

SEQ ID NO: 616599 - DNA, 20 bp, mouse
gttaggccgggccattgccg

SEQ ID NO: 616600 - DNA, 20 bp, mouse
ggctcgtccggcaggttacg

SEQ ID NO: 616601 - DNA, 20 bp, mouse
gacttagcagagatcctgat

SEQ ID NO: 616602 - DNA, 20 bp, mouse
gggcacctaaggggaaacca

SEQ ID NO: 616603 - DNA, 20 bp, mouse
ggttacggggctgcaggacg

SEQ ID NO: 616604 - DNA, 20 bp, mouse
gtgtctgtccatccggctcc

SEQ ID NO: 616605 - DNA, 20 bp, mouse
ggataggtacgccgcggcaa

SEQ ID NO: 616606 - DNA, 20 bp, mouse
gagcccgggacgcccgaact

SEQ ID NO: 616607 - DNA, 20 bp, mouse
gcgtgggtgtgacgccagag

SEQ ID NO: 616608 - DNA, 20 bp, mouse
ggcggcgggagtcccagttc

SEQ ID NO: 616609 - DNA, 20 bp, mouse
gtggcgtcacacccacgcga

SEQ ID NO: 616610 - DNA, 20 bp, mouse
ggtcccagttcgggcgtccc

SEQ ID NO: 616611 - DNA, 20 bp, mouse
ggggtgtgacgccagagcgg

SEQ ID NO: 616612 - DNA, 20 bp, mouse
ggggcttgcaggctggtcat

SEQ ID NO: 616613 - DNA, 20 bp, mouse
ggaggacgagcgccaggtgg

SEQ ID NO: 616614 - DNA, 20 bp, mouse
gaaaggccaaagctcaccgt

SEQ ID NO: 616615 - DNA, 20 bp, mouse
gtggggcgtacgcattcggt

SEQ ID NO: 616616 - DNA, 20 bp, mouse
gcagggaaggacgggcactt

SEQ ID NO: 616617 - DNA, 20 bp, mouse
gctccatgcccggatatcag

SEQ ID NO: 616618 - DNA, 20 bp, mouse
ggagtcagaactagagcgta

SEQ ID NO: 616619 - DNA, 20 bp, mouse
ggactgcagatcacttccgg

SEQ ID NO: 616620 - DNA, 20 bp, mouse
gtccggcggaaatgagggtc

SEQ ID NO: 616621 - DNA, 20 bp, mouse
gcgggcatggagcggaagag

SEQ ID NO: 616622 - DNA, 20 bp, mouse
gcagaactagagcgtagggt

SEQ ID NO: 616623 - DNA, 20 bp, mouse
gtcacttccggcggaaatga

SEQ ID NO: 616624 - DNA, 20 bp, mouse
ggccatcacgaaaagtgagt

SEQ ID NO: 616625 - DNA, 20 bp, mouse
ggagttgcgaggggcgcgga

SEQ ID NO: 616626 - DNA, 20 bp, mouse
ggaaaaggcgtaacccacct

SEQ ID NO: 616627 - DNA, 20 bp, mouse
ggacgttgcgccggcccagg

SEQ ID NO: 616628 - DNA, 20 bp, mouse
ggggaaactaggccggcagg

SEQ ID NO: 616629 - DNA, 20 bp, mouse
gccggggaaactaggccggc

SEQ ID NO: 616630 - DNA, 20 bp, mouse
gccgaggtcccggggaaact

SEQ ID NO: 616631 - DNA, 20 bp, mouse
gccccgggacctcggagttg

SEQ ID NO: 616632 - DNA, 20 bp, mouse
gggtcccggggaaactaggc

SEQ ID NO: 616633 - DNA, 20 bp, mouse
gccgacgcgcctatactagg

SEQ ID NO: 616634 - DNA, 20 bp, mouse
gacgcgcctatactaggggg

SEQ ID NO: 616635 - DNA, 20 bp, mouse
ggcccggcgtcaggtgaaat

SEQ ID NO: 616636 - DNA, 20 bp, mouse
ggaggcccacacttcccgaa

SEQ ID NO: 616637 - DNA, 20 bp, mouse
ggagacccttcgggaagtgt

SEQ ID NO: 616638 - DNA, 20 bp, mouse
gctgcaggaggagacccttc

SEQ ID NO: 616639 - DNA, 20 bp, mouse
gaccctcagcggccatgaag

SEQ ID NO: 616640 - DNA, 20 bp, mouse
ggacgcaatgccactgcagg

SEQ ID NO: 616641 - DNA, 20 bp, mouse
gtggcgagaggacctctccc

SEQ ID NO: 616642 - DNA, 20 bp, mouse
gacagacgcaatgccactgc

SEQ ID NO: 616643 - DNA, 20 bp, mouse
gtctgggccgcagtagggag

SEQ ID NO: 616644 - DNA, 20 bp, mouse
gggagagtagacggcaagag

SEQ ID NO: 616645 - DNA, 20 bp, mouse
gtggccgctgagggtacaaa

SEQ ID NO: 616646 - DNA, 20 bp, mouse
gtggaactgcgggaccagag

SEQ ID NO: 616647 - DNA, 20 bp, mouse
ggcgcagagcgcccccacac

SEQ ID NO: 616648 - DNA, 20 bp, mouse
gctaggccgggagacttctc

SEQ ID NO: 616649 - DNA, 20 bp, mouse
gggagaaacacctgcagaga

SEQ ID NO: 616650 - DNA, 20 bp, mouse
ggtgctccagagaagtctcc

SEQ ID NO: 616651 - DNA, 20 bp, mouse
gtctggagcaccccgtgtgg

SEQ ID NO: 616652 - DNA, 20 bp, mouse
gggccggcaggaaacgcaag

SEQ ID NO: 616653 - DNA, 20 bp, mouse
gtccccgggacaggttggtg

SEQ ID NO: 616654 - DNA, 20 bp, mouse
gtgcaggtgtttctcctggc

SEQ ID NO: 616655 - DNA, 20 bp, mouse
ggcgctctgccagccacaga

SEQ ID NO: 616656 - DNA, 20 bp, mouse
gggaccgtgaggggccaaga

SEQ ID NO: 616657 - DNA, 20 bp, mouse
gctctgaaaggggttcccac

SEQ ID NO: 616658 - DNA, 20 bp, mouse
ggaagtgggcaagtgcctgt

SEQ ID NO: 616659 - DNA, 20 bp, mouse
gtgttggacatggaccgtga

SEQ ID NO: 616660 - DNA, 20 bp, mouse
ggaggtcaggtagtagaggg

SEQ ID NO: 616661 - DNA, 20 bp, mouse
gagcattactctgttggaca

SEQ ID NO: 616662 - DNA, 20 bp, mouse
ggccgaggtcaggtagtaga

SEQ ID NO: 616663 - DNA, 20 bp, mouse
gcaacagagtaatgctccca

SEQ ID NO: 616664 - DNA, 20 bp, mouse
ggtctcaggagaatgaacag

SEQ ID NO: 616665 - DNA, 20 bp, mouse
gtgagacgctctagaggatt

SEQ ID NO: 616666 - DNA, 20 bp, mouse
ggcagctcaggagagtcccg

SEQ ID NO: 616667 - DNA, 20 bp, mouse
gggagagtcccgtggcatcc

SEQ ID NO: 616668 - DNA, 20 bp, mouse
ggacttacttacctagggag

SEQ ID NO: 616669 - DNA, 20 bp, mouse
gtacttacctagggagtggt

SEQ ID NO: 616670 - DNA, 20 bp, mouse
gcttaggtccacagagcaag

SEQ ID NO: 616671 - DNA, 20 bp, mouse
ggctgccaggcagaggagta

SEQ ID NO: 616672 - DNA, 20 bp, mouse
gggccgctctcacatccata

SEQ ID NO: 616673 - DNA, 20 bp, mouse
gctccaggcttacctccata

SEQ ID NO: 616674 - DNA, 20 bp, mouse
gtgcaagacttacttaccta

SEQ ID NO: 616675 - DNA, 20 bp, mouse
gcagtaactatgagtgcatc

SEQ ID NO: 616676 - DNA, 20 bp, mouse
gtccatacccgcccgaccgg

SEQ ID NO: 616677 - DNA, 20 bp, mouse
ggacgctgatgccaccggtc

SEQ ID NO: 616678 - DNA, 20 bp, mouse
ggccgggcggcggcgtctcg

SEQ ID NO: 616679 - DNA, 20 bp, mouse
ggtctggacgctgatgccac

SEQ ID NO: 616680 - DNA, 20 bp, mouse
gtccatcctctccagccggg

SEQ ID NO: 616681 - DNA, 20 bp, mouse
ggcctccatacccgcccgac

SEQ ID NO: 616682 - DNA, 20 bp, mouse
ggccaccggtcgggcgggta

SEQ ID NO: 616683 - DNA, 20 bp, mouse
gctgatgccaccggtcgggc

SEQ ID NO: 616684 - DNA, 20 bp, mouse
gagtagggtgagcaggttcg

SEQ ID NO: 616685 - DNA, 20 bp, mouse
ggcggcggcgtctcggggtc

SEQ ID NO: 616686 - DNA, 20 bp, mouse
gttcctagggacacagggcc

SEQ ID NO: 616687 - DNA, 20 bp, mouse
gcctagaatgactcctccat

SEQ ID NO: 616688 - DNA, 20 bp, mouse
gttctggctgtgagcagtgg

SEQ ID NO: 616689 - DNA, 20 bp, mouse
gtgagggtggttccagccca

SEQ ID NO: 616690 - DNA, 20 bp, mouse
gcagggccaggctttgagac

SEQ ID NO: 616691 - DNA, 20 bp, mouse
gtccctctgaagccaccctc

SEQ ID NO: 616692 - DNA, 20 bp, mouse
gtctcaggctgagaataacg

SEQ ID NO: 616693 - DNA, 20 bp, mouse
gcctgtgttcctagggacac

SEQ ID NO: 616694 - DNA, 20 bp, mouse
gcagaaaacgtgccagaggg

SEQ ID NO: 616695 - DNA, 20 bp, mouse
ggaatgactcctccatgggc

SEQ ID NO: 616696 - DNA, 20 bp, mouse
ggtcgcgggcggaggaagaa

SEQ ID NO: 616697 - DNA, 20 bp, mouse
gcgccagtccgtggcccgag

SEQ ID NO: 616698 - DNA, 20 bp, mouse
gctgggcgctcggtcgcggg

SEQ ID NO: 616699 - DNA, 20 bp, mouse
ggcctgggccgggcccgtga

SEQ ID NO: 616700 - DNA, 20 bp, mouse
gcgaccagaccggaccgatg

SEQ ID NO: 616701 - DNA, 20 bp, mouse
gctggctgggcgctcggtcg

SEQ ID NO: 616702 - DNA, 20 bp, mouse
gcgaggagaacgcccgcctg

SEQ ID NO: 616703 - DNA, 20 bp, mouse
gcgcgcgggacgagcgggac

SEQ ID NO: 616704 - DNA, 20 bp, mouse
gccgcagagcctggcggaag

SEQ ID NO: 616705 - DNA, 20 bp, mouse
gggcccctcgggccacggac

SEQ ID NO: 616706 - DNA, 20 bp, mouse
ggcacctgcgagtggaagct

SEQ ID NO: 616707 - DNA, 20 bp, mouse
gcagcagagcctgcggaagg

SEQ ID NO: 616708 - DNA, 20 bp, mouse
gccgcgctgtgagagcggag

SEQ ID NO: 616709 - DNA, 20 bp, mouse
gagacagcagagcctgcgga

SEQ ID NO: 616710 - DNA, 20 bp, mouse
ggcaggctccgagcagtctc

SEQ ID NO: 616711 - DNA, 20 bp, mouse
gacgaagggaggcactgctc

SEQ ID NO: 616712 - DNA, 20 bp, mouse
ggggcgcatggcggacccag

SEQ ID NO: 616713 - DNA, 20 bp, mouse
ggcccgccgcgctgtgagag

SEQ ID NO: 616714 - DNA, 20 bp, mouse
ggcgccgcgggtaagggcat

SEQ ID NO: 616715 - DNA, 20 bp, mouse
gagcggaagtgaggtttccg

SEQ ID NO: 616716 - DNA, 20 bp, mouse
gggtggcagcggcttctcca

SEQ ID NO: 616717 - DNA, 20 bp, mouse
gccgaggccttggccaggag

SEQ ID NO: 616718 - DNA, 20 bp, mouse
gggaagggaaagctaccagt

SEQ ID NO: 616719 - DNA, 20 bp, mouse
gtgggtggaggctaaggacg

SEQ ID NO: 616720 - DNA, 20 bp, mouse
ggtggaggctaaggacgcgg

SEQ ID NO: 616721 - DNA, 20 bp, mouse
gagaagccgctgccaccccg

SEQ ID NO: 616722 - DNA, 20 bp, mouse
gcaaggcctcggggtggcag

SEQ ID NO: 616723 - DNA, 20 bp, mouse
ggggagctgggtggaggcta

SEQ ID NO: 616724 - DNA, 20 bp, mouse
gtgctctgcatccagctcgg

SEQ ID NO: 616725 - DNA, 20 bp, mouse
gaccaggagagggacaagaa

SEQ ID NO: 616726 - DNA, 20 bp, mouse
gtgctgactgcacagacggg

SEQ ID NO: 616727 - DNA, 20 bp, mouse
gcggggaagcaagagaaagc

SEQ ID NO: 616728 - DNA, 20 bp, mouse
ggagctgctgactgcacaga

SEQ ID NO: 616729 - DNA, 20 bp, mouse
gtcattcactggagagcaga

SEQ ID NO: 616730 - DNA, 20 bp, mouse
gctttctcaccctcattcac

SEQ ID NO: 616731 - DNA, 20 bp, mouse
gagcagcagcagtccagctg

SEQ ID NO: 616732 - DNA, 20 bp, mouse
gagcctgggtcctgaagcgg

SEQ ID NO: 616733 - DNA, 20 bp, mouse
gtcaggcagttccaagggtg

SEQ ID NO: 616734 - DNA, 20 bp, mouse
gtggagcctgggtcctgaag

SEQ ID NO: 616735 - DNA, 20 bp, mouse
ggtttcttcaagtccaggta

SEQ ID NO: 616736 - DNA, 20 bp, mouse
gtaccggagagtggctatgg

SEQ ID NO: 616737 - DNA, 20 bp, mouse
gggctgtaggcgttccgtac

SEQ ID NO: 616738 - DNA, 20 bp, mouse
gggctgtagtaacatcgcag

SEQ ID NO: 616739 - DNA, 20 bp, mouse
gcgccgccatagccactctc

SEQ ID NO: 616740 - DNA, 20 bp, mouse
gagcagcgaaagcggccacg

SEQ ID NO: 616741 - DNA, 20 bp, mouse
gggcgttccgtaccggagag

SEQ ID NO: 616742 - DNA, 20 bp, mouse
gcctagggcactggagagtg

SEQ ID NO: 616743 - DNA, 20 bp, mouse
ggcagaggcagcagcgaaag

SEQ ID NO: 616744 - DNA, 20 bp, mouse
gttccggcgaaataggctgt

SEQ ID NO: 616745 - DNA, 20 bp, mouse
gtcagtcggagactccccaa

SEQ ID NO: 616746 - DNA, 20 bp, mouse
gaaggctgggagcatcccac

SEQ ID NO: 616747 - DNA, 20 bp, mouse
gccagcagggagcccgcctg

SEQ ID NO: 616748 - DNA, 20 bp, mouse
gagctctagtgatcgatggg

SEQ ID NO: 616749 - DNA, 20 bp, mouse
gcccgagcagtaaggagggt

SEQ ID NO: 616750 - DNA, 20 bp, mouse
ggggcatcctaaactttggg

SEQ ID NO: 616751 - DNA, 20 bp, mouse
gagcccccgagcagtaagga

SEQ ID NO: 616752 - DNA, 20 bp, mouse
gctaaactttgggcggtgaa

SEQ ID NO: 616753 - DNA, 20 bp, mouse
gggaaagcctagggaactaa

SEQ ID NO: 616754 - DNA, 20 bp, mouse
ggaactaagggaataatgct

SEQ ID NO: 616755 - DNA, 20 bp, mouse
ggtgtcaagtggtacccagg

SEQ ID NO: 616756 - DNA, 20 bp, mouse
gcgtggctctcggaagtggg

SEQ ID NO: 616757 - DNA, 20 bp, mouse
ggctgtagagctggatcgcg

SEQ ID NO: 616758 - DNA, 20 bp, mouse
gagctgtaggaactgcaggt

SEQ ID NO: 616759 - DNA, 20 bp, mouse
gtacagctcaggcagtgggc

SEQ ID NO: 616760 - DNA, 20 bp, mouse
gcatagcctgcccggatgag

SEQ ID NO: 616761 - DNA, 20 bp, mouse
gcaccaggaagccacttggt

SEQ ID NO: 616762 - DNA, 20 bp, mouse
gtgtcgtggctctcggaagt

SEQ ID NO: 616763 - DNA, 20 bp, mouse
gggtgcaccggcgaccccgg

SEQ ID NO: 616764 - DNA, 20 bp, mouse
gcactcgctgcaggatctct

SEQ ID NO: 616765 - DNA, 20 bp, mouse
gcctggtgcgcttgtgacgt

SEQ ID NO: 616766 - DNA, 20 bp, mouse
gcggcggatccaggaagtag

SEQ ID NO: 616767 - DNA, 20 bp, mouse
gccctcgcggccctccccgg

SEQ ID NO: 616768 - DNA, 20 bp, mouse
gccggcgcagggtgcggtag

SEQ ID NO: 616769 - DNA, 20 bp, mouse
ggccgcgagggacacagtcg

SEQ ID NO: 616770 - DNA, 20 bp, mouse
ggtgcggtagcggccccggc

SEQ ID NO: 616771 - DNA, 20 bp, mouse
gcagggtgcggtagcggccc

SEQ ID NO: 616772 - DNA, 20 bp, mouse
gtcgcgggccgatgacgcac

SEQ ID NO: 616773 - DNA, 20 bp, mouse
gaggcggagccgctacttcc

SEQ ID NO: 616774 - DNA, 20 bp, mouse
gttcgggaggcagcctacag

SEQ ID NO: 616775 - DNA, 20 bp, mouse
gagacaggcatccaaggtaa

SEQ ID NO: 616776 - DNA, 20 bp, mouse
gtcgcctggacccagagctc

SEQ ID NO: 616777 - DNA, 20 bp, mouse
gcctggacccagagctccgg

SEQ ID NO: 616778 - DNA, 20 bp, mouse
ggctccggaggatgtggcga

SEQ ID NO: 616779 - DNA, 20 bp, mouse
gaccaagaggagaactccga

SEQ ID NO: 616780 - DNA, 20 bp, mouse
ggagccgggccaggaccaag

SEQ ID NO: 616781 - DNA, 20 bp, mouse
gccacatcctccggagctct

SEQ ID NO: 616782 - DNA, 20 bp, mouse
gcgggaagctgcgcgaggct

SEQ ID NO: 616783 - DNA, 20 bp, mouse
gagcttcccaggagggtaca

SEQ ID NO: 616784 - DNA, 20 bp, mouse
gaacaggaagcttcccagga

SEQ ID NO: 616785 - DNA, 20 bp, mouse
gcaggcgagccgagtcgagc

SEQ ID NO: 616786 - DNA, 20 bp, mouse
gggctcgccagcaccggcac

SEQ ID NO: 616787 - DNA, 20 bp, mouse
gcagcgaggaggagccggac

SEQ ID NO: 616788 - DNA, 20 bp, mouse
gcggctgcgccaggccggaa

SEQ ID NO: 616789 - DNA, 20 bp, mouse
gccgcgaggtgtctgagagt

SEQ ID NO: 616790 - DNA, 20 bp, mouse
gctcgcgggctcgccagcac

SEQ ID NO: 616791 - DNA, 20 bp, mouse
ggccccgaggtccaaaaaga

SEQ ID NO: 616792 - DNA, 20 bp, mouse
gccaaaaagaaggcgcccga

SEQ ID NO: 616793 - DNA, 20 bp, mouse
gggcctcgcggagccgggac

SEQ ID NO: 616794 - DNA, 20 bp, mouse
gggcctggcgcagccggtgc

SEQ ID NO: 616795 - DNA, 20 bp, mouse
gccgcaagcgcgccccgttc

SEQ ID NO: 616796 - DNA, 20 bp, mouse
ggctcccgggtcgctctcaa

SEQ ID NO: 616797 - DNA, 20 bp, mouse
gccgccgagcacaggctccc

SEQ ID NO: 616798 - DNA, 20 bp, mouse
ggtgcaaaaccgaggtctcc

SEQ ID NO: 616799 - DNA, 20 bp, mouse
gcttcctctcccggagacct

SEQ ID NO: 616800 - DNA, 20 bp, mouse
gaaaccgaggtctccgggag

SEQ ID NO: 616801 - DNA, 20 bp, mouse
ggagcctttgagagcgaccc

SEQ ID NO: 616802 - DNA, 20 bp, mouse
ggccggcttgtgcaaaaccg

SEQ ID NO: 616803 - DNA, 20 bp, mouse
gtgtcccccgtggacagtct

SEQ ID NO: 616804 - DNA, 20 bp, mouse
gcgggtaagcgcggcaagaa

SEQ ID NO: 616805 - DNA, 20 bp, mouse
gacgccactggccaagcccg

SEQ ID NO: 616806 - DNA, 20 bp, mouse
gctcatggctgcgggatctg

SEQ ID NO: 616807 - DNA, 20 bp, mouse
ggagtctcagcggtcccagg

SEQ ID NO: 616808 - DNA, 20 bp, mouse
gggcttggctgggtgcttcg

SEQ ID NO: 616809 - DNA, 20 bp, mouse
gccgttggccagcagagacg

SEQ ID NO: 616810 - DNA, 20 bp, mouse
ggagttgccgagctacgcgg

SEQ ID NO: 616811 - DNA, 20 bp, mouse
gccagcggcgccgaaggcga

SEQ ID NO: 616812 - DNA, 20 bp, mouse
gcagcagagacggggctccc

SEQ ID NO: 616813 - DNA, 20 bp, mouse
gaaggcgacggtagacgccg

SEQ ID NO: 616814 - DNA, 20 bp, mouse
gggcctctcggaggccgcct

SEQ ID NO: 616815 - DNA, 20 bp, mouse
gcactcagaggtgaggcggg

SEQ ID NO: 616816 - DNA, 20 bp, mouse
ggagctgcttggaggctcgg

SEQ ID NO: 616817 - DNA, 20 bp, mouse
gccgcggcgccggggttcgc

SEQ ID NO: 616818 - DNA, 20 bp, mouse
ggcgcgggcctgtgtgtccg

SEQ ID NO: 616819 - DNA, 20 bp, mouse
gggaatccaggtgaccgcgg

SEQ ID NO: 616820 - DNA, 20 bp, mouse
gaagcagctcccgcgaaccc

SEQ ID NO: 616821 - DNA, 20 bp, mouse
gcccggacccgaggttccga

SEQ ID NO: 616822 - DNA, 20 bp, mouse
gcggctgggtccgcagggag

SEQ ID NO: 616823 - DNA, 20 bp, mouse
ggggcgccgagaggcccgaa

SEQ ID NO: 616824 - DNA, 20 bp, mouse
gcccgaggttccgaaggcgg

SEQ ID NO: 616825 - DNA, 20 bp, mouse
gcacaggcccgcgctgtccc

SEQ ID NO: 616826 - DNA, 20 bp, mouse
gtgtgtatggccagcaagca

SEQ ID NO: 616827 - DNA, 20 bp, mouse
ggaaccaaggcttctgtgta

SEQ ID NO: 616828 - DNA, 20 bp, mouse
gactcctaggggtcaccagt

SEQ ID NO: 616829 - DNA, 20 bp, mouse
gttcagctctgttccactca

SEQ ID NO: 616830 - DNA, 20 bp, mouse
gaaagatgtgttaccgtgag

SEQ ID NO: 616831 - DNA, 20 bp, mouse
gatcttactcacaagaggac

SEQ ID NO: 616832 - DNA, 20 bp, mouse
gagcccatcttactcacaag

SEQ ID NO: 616833 - DNA, 20 bp, mouse
gtacttgtgacggctatagg

SEQ ID NO: 616834 - DNA, 20 bp, mouse
gggcctgtgacgtttctcac

SEQ ID NO: 616835 - DNA, 20 bp, mouse
gtagcaaaacccactcctag

SEQ ID NO: 616836 - DNA, 20 bp, mouse
gcggtgctcggccggagagg

SEQ ID NO: 616837 - DNA, 20 bp, mouse
gcgtggtgaagtatgtctat

SEQ ID NO: 616838 - DNA, 20 bp, mouse
gccttccctcactcactcag

SEQ ID NO: 616839 - DNA, 20 bp, mouse
gatgtctatgggctgtacgt

SEQ ID NO: 616840 - DNA, 20 bp, mouse
ggctgcccctgagtgagtga

SEQ ID NO: 616841 - DNA, 20 bp, mouse
gggccgagcaccggaaacct

SEQ ID NO: 616842 - DNA, 20 bp, mouse
gctgttggcagcagttacct

SEQ ID NO: 616843 - DNA, 20 bp, mouse
ggtacgcacgcgcaacactg

SEQ ID NO: 616844 - DNA, 20 bp, mouse
ggccccaccaggtcccacgt

SEQ ID NO: 616845 - DNA, 20 bp, mouse
gccggagaggaggacgccgc

SEQ ID NO: 616846 - DNA, 20 bp, mouse
ggaggtggtagagtcagagg

SEQ ID NO: 616847 - DNA, 20 bp, mouse
gaaagaggtggtagagtcag

SEQ ID NO: 616848 - DNA, 20 bp, mouse
ggcagggctgagttcttaca

SEQ ID NO: 616849 - DNA, 20 bp, mouse
ggggctgagttcttacaagg

SEQ ID NO: 616850 - DNA, 20 bp, mouse
ggtcttgtgaagttgaacaa

SEQ ID NO: 616851 - DNA, 20 bp, mouse
gacgccagcaaatggtagaa

SEQ ID NO: 616852 - DNA, 20 bp, mouse
gggctacaggctgcccctca

SEQ ID NO: 616853 - DNA, 20 bp, mouse
gtcatacttaccagaaggaa

SEQ ID NO: 616854 - DNA, 20 bp, mouse
gcacacgcccacaaaaggag

SEQ ID NO: 616855 - DNA, 20 bp, mouse
ggctctgtgcccctccggga

SEQ ID NO: 616856 - DNA, 20 bp, mouse
gaggtaacgcgaggaagagg

SEQ ID NO: 616857 - DNA, 20 bp, mouse
gccgagtcgccatgaggtga

SEQ ID NO: 616858 - DNA, 20 bp, mouse
gggcttgaggaggtaacgcg

SEQ ID NO: 616859 - DNA, 20 bp, mouse
gaggaggtaacgcgaggaag

SEQ ID NO: 616860 - DNA, 20 bp, mouse
gtaacgcgaggaagaggcgg

SEQ ID NO: 616861 - DNA, 20 bp, mouse
gggctgctgccgtcacctca

SEQ ID NO: 616862 - DNA, 20 bp, mouse
gatggcgactcggcttgagg

SEQ ID NO: 616863 - DNA, 20 bp, mouse
gggaagaggcggcggtactg

SEQ ID NO: 616864 - DNA, 20 bp, mouse
gacggcagcagccaaacaag

SEQ ID NO: 616865 - DNA, 20 bp, mouse
gggacactacgcctagtagg

SEQ ID NO: 616866 - DNA, 20 bp, mouse
ggtacgggagatgcactcgt

SEQ ID NO: 616867 - DNA, 20 bp, mouse
gatggatccaaggcgcccaa

SEQ ID NO: 616868 - DNA, 20 bp, mouse
gctcggttgcaagctccgtt

SEQ ID NO: 616869 - DNA, 20 bp, mouse
gccagatggaaatggatcca

SEQ ID NO: 616870 - DNA, 20 bp, mouse
ggcggtggagcatgccctgg

SEQ ID NO: 616871 - DNA, 20 bp, mouse
gggcctgtgtgcgccctcgg

SEQ ID NO: 616872 - DNA, 20 bp, mouse
gaccacgcccccaagaggtg

SEQ ID NO: 616873 - DNA, 20 bp, mouse
gcggagcttgcaaccgagtg

SEQ ID NO: 616874 - DNA, 20 bp, mouse
gcagcgctaggacagtcccc

SEQ ID NO: 616875 - DNA, 20 bp, mouse
gccgcgtactcgagaagtgg

SEQ ID NO: 616876 - DNA, 20 bp, mouse
gcagccggcctgcccgtcaa

SEQ ID NO: 616877 - DNA, 20 bp, mouse
gcccctgaggaagtgacaac

SEQ ID NO: 616878 - DNA, 20 bp, mouse
gcaacaggagtgcccttgac

SEQ ID NO: 616879 - DNA, 20 bp, mouse
gtcccggcagtgcgagcaga

SEQ ID NO: 616880 - DNA, 20 bp, mouse
gggaggtaggagcccttgcg

SEQ ID NO: 616881 - DNA, 20 bp, mouse
gcggagggaagcccaaagaa

SEQ ID NO: 616882 - DNA, 20 bp, mouse
gcgggtggcatgtgtacgga

SEQ ID NO: 616883 - DNA, 20 bp, mouse
ggtaggagcccttgcggggt

SEQ ID NO: 616884 - DNA, 20 bp, mouse
gggtaccaaagtgaagcggg

SEQ ID NO: 616885 - DNA, 20 bp, mouse
ggacgctagacctgcccctg

SEQ ID NO: 616886 - DNA, 20 bp, mouse
gaagcctcctcagggtgtgt

SEQ ID NO: 616887 - DNA, 20 bp, mouse
gcccctcagtacaatgctgg

SEQ ID NO: 616888 - DNA, 20 bp, mouse
gggggtctgcagggtcttag

SEQ ID NO: 616889 - DNA, 20 bp, mouse
gtctccaggaagcctcctca

SEQ ID NO: 616890 - DNA, 20 bp, mouse
ggaccaccagcattgtactg

SEQ ID NO: 616891 - DNA, 20 bp, mouse
ggtcgtcaaacagactctgg

SEQ ID NO: 616892 - DNA, 20 bp, mouse
gctgcagggtcttagaggtg

SEQ ID NO: 616893 - DNA, 20 bp, mouse
gttgtactgaggggtctgca

SEQ ID NO: 616894 - DNA, 20 bp, mouse
ggcactgagatacaggacgt

SEQ ID NO: 616895 - DNA, 20 bp, mouse
gggtgtgtactgtccgggct

SEQ ID NO: 616896 - DNA, 20 bp, mouse
ggtccccgggcccgaggtgg

SEQ ID NO: 616897 - DNA, 20 bp, mouse
gcccgaggtggcggcagcga

SEQ ID NO: 616898 - DNA, 20 bp, mouse
gcacggggagcatgtaatgt

SEQ ID NO: 616899 - DNA, 20 bp, mouse
ggaggtccgggagtgacgtg

SEQ ID NO: 616900 - DNA, 20 bp, mouse
gacggtataaagccggccac

SEQ ID NO: 616901 - DNA, 20 bp, mouse
gtcccggacctcgcagccag

SEQ ID NO: 616902 - DNA, 20 bp, mouse
ggtcaggctcgacttccccg

SEQ ID NO: 616903 - DNA, 20 bp, mouse
gggcagcgacggtataaagc

SEQ ID NO: 616904 - DNA, 20 bp, mouse
gagggcgcagccgagagcca

SEQ ID NO: 616905 - DNA, 20 bp, mouse
gatgtaatgtcggaatgcgg

SEQ ID NO: 616906 - DNA, 20 bp, mouse
ggggctgaacggcgataagg

SEQ ID NO: 616907 - DNA, 20 bp, mouse
gcgaagcgacatctccacgg

SEQ ID NO: 616908 - DNA, 20 bp, mouse
gtcctgttccctcaatccgg

SEQ ID NO: 616909 - DNA, 20 bp, mouse
gggtagttgcacagagccac

SEQ ID NO: 616910 - DNA, 20 bp, mouse
gaaacgaagcgacatctcca

SEQ ID NO: 616911 - DNA, 20 bp, mouse
gcggcgataagggggcagag

SEQ ID NO: 616912 - DNA, 20 bp, mouse
ggccaccggattgagggaac

SEQ ID NO: 616913 - DNA, 20 bp, mouse
ggttgggctgaacggcgata

SEQ ID NO: 616914 - DNA, 20 bp, mouse
gctctgtgcaactaccaccg

SEQ ID NO: 616915 - DNA, 20 bp, mouse
gggtcaggagtaccaggtcc

SEQ ID NO: 616916 - DNA, 20 bp, mouse
gggcgcgcgacagggagccg

SEQ ID NO: 616917 - DNA, 20 bp, mouse
gccgccccagggagactacg

SEQ ID NO: 616918 - DNA, 20 bp, mouse
ggcggcgacagccaccgcgg

SEQ ID NO: 616919 - DNA, 20 bp, mouse
gccccagggagactacgggg

SEQ ID NO: 616920 - DNA, 20 bp, mouse
gcaccgcggtggaagaaaat

SEQ ID NO: 616921 - DNA, 20 bp, mouse
gccgcggcggctggaaggac

SEQ ID NO: 616922 - DNA, 20 bp, mouse
gcgtcggccaggagtcaaga

SEQ ID NO: 616923 - DNA, 20 bp, mouse
gagttgcatggcgcgcgaca

SEQ ID NO: 616924 - DNA, 20 bp, mouse
gcggcggctggaaggactgg

SEQ ID NO: 616925 - DNA, 20 bp, mouse
gtaacggaagcagtctcccg

SEQ ID NO: 616926 - DNA, 20 bp, mouse
gaggcagtgccggccgtggg

SEQ ID NO: 616927 - DNA, 20 bp, mouse
gggcggtgagcttctcaggt

SEQ ID NO: 616928 - DNA, 20 bp, mouse
gcaggggctggtccctacgg

SEQ ID NO: 616929 - DNA, 20 bp, mouse
ggagatggtgacagaaggcg

SEQ ID NO: 616930 - DNA, 20 bp, mouse
gctgagaagctcaccgccca

SEQ ID NO: 616931 - DNA, 20 bp, mouse
ggaagctcaccgcccacggc

SEQ ID NO: 616932 - DNA, 20 bp, mouse
gggagcaggcggagcctcgg

SEQ ID NO: 616933 - DNA, 20 bp, mouse
gtctgagctggaggaaacac

SEQ ID NO: 616934 - DNA, 20 bp, mouse
gcaagagactgattttgcgg

SEQ ID NO: 616935 - DNA, 20 bp, mouse
gatctctgcacgagaatctc

SEQ ID NO: 616936 - DNA, 20 bp, mouse
gacagtgcggagaggagcac

SEQ ID NO: 616937 - DNA, 20 bp, mouse
gggccatgggtacaacagtg

SEQ ID NO: 616938 - DNA, 20 bp, mouse
gtgggtacaacagtgcggag

SEQ ID NO: 616939 - DNA, 20 bp, mouse
ggtgcggagaggagcacggg

SEQ ID NO: 616940 - DNA, 20 bp, mouse
gggcttcgaggagttcgaca

SEQ ID NO: 616941 - DNA, 20 bp, mouse
gccaaggcggggcccaagta

SEQ ID NO: 616942 - DNA, 20 bp, mouse
gccggactgcgtggaaggtg

SEQ ID NO: 616943 - DNA, 20 bp, mouse
gtgaggctgggaccaggact

SEQ ID NO: 616944 - DNA, 20 bp, mouse
gctagggtcctgcgccccca

SEQ ID NO: 616945 - DNA, 20 bp, mouse
gctgcgtggaaggtgaggct

SEQ ID NO: 616946 - DNA, 20 bp, mouse
ggaagaaggatgcacgtgat

SEQ ID NO: 616947 - DNA, 20 bp, mouse
gcctcctctacaaggctcct

SEQ ID NO: 616948 - DNA, 20 bp, mouse
ggtccgtgagtgccacagcc

SEQ ID NO: 616949 - DNA, 20 bp, mouse
gtgtagaggagggttgatat

SEQ ID NO: 616950 - DNA, 20 bp, mouse
ggtgggtatgatcaagactg

SEQ ID NO: 616951 - DNA, 20 bp, mouse
gctcctggctgtggcactca

SEQ ID NO: 616952 - DNA, 20 bp, mouse
gtctcttctaggatggtccc

SEQ ID NO: 616953 - DNA, 20 bp, mouse
gcagcgctaatcggactcag

SEQ ID NO: 616954 - DNA, 20 bp, mouse
ggtgttgagattacatgagg

SEQ ID NO: 616955 - DNA, 20 bp, mouse
gagacggacatggagtgagg

SEQ ID NO: 616956 - DNA, 20 bp, mouse
gctgccaagctatggaacag

SEQ ID NO: 616957 - DNA, 20 bp, mouse
gcccggccagcggctggagg

SEQ ID NO: 616958 - DNA, 20 bp, mouse
gccggcctgcgagctaggaa

SEQ ID NO: 616959 - DNA, 20 bp, mouse
gcctgggcgcgggggcatcg

SEQ ID NO: 616960 - DNA, 20 bp, mouse
ggcggctggaggaggcgtcc

SEQ ID NO: 616961 - DNA, 20 bp, mouse
gcggcagcccggccagcggc

SEQ ID NO: 616962 - DNA, 20 bp, mouse
ggggcgcgggggcatcgtgg

SEQ ID NO: 616963 - DNA, 20 bp, mouse
ggcggctagcgccacgtcag

SEQ ID NO: 616964 - DNA, 20 bp, mouse
gtggtccccggtcccagatc

SEQ ID NO: 616965 - DNA, 20 bp, mouse
gcagcagaaaggaggaaatc

SEQ ID NO: 616966 - DNA, 20 bp, mouse
gccacctgaaccaacaggag

SEQ ID NO: 616967 - DNA, 20 bp, mouse
ggctgctgaccctctcctgt

SEQ ID NO: 616968 - DNA, 20 bp, mouse
gatgatgaatgggacagcta

SEQ ID NO: 616969 - DNA, 20 bp, mouse
gatcctccacctgaaccaac

SEQ ID NO: 616970 - DNA, 20 bp, mouse
gccagaatgccatgatgaat

SEQ ID NO: 616971 - DNA, 20 bp, mouse
ggaccctctcctgttggttc

SEQ ID NO: 616972 - DNA, 20 bp, mouse
ggtgaagaggattaagaaca

SEQ ID NO: 616973 - DNA, 20 bp, mouse
gaagtcccagatgttaatca

SEQ ID NO: 616974 - DNA, 20 bp, mouse
gtagagcaatgaaggaggac

SEQ ID NO: 616975 - DNA, 20 bp, mouse
gttcaccatgattaacatct

SEQ ID NO: 616976 - DNA, 20 bp, mouse
gaggactgtagccaatgaag

SEQ ID NO: 616977 - DNA, 20 bp, mouse
gggctgggagggcctcgtct

SEQ ID NO: 616978 - DNA, 20 bp, mouse
ggttaactccgccacttcat

SEQ ID NO: 616979 - DNA, 20 bp, mouse
gtgggcggctgcggaggcta

SEQ ID NO: 616980 - DNA, 20 bp, mouse
gcatcctcggctgggatcga

SEQ ID NO: 616981 - DNA, 20 bp, mouse
ggtctcttgagctcagggag

SEQ ID NO: 616982 - DNA, 20 bp, mouse
gctggtggagtagttccggg

SEQ ID NO: 616983 - DNA, 20 bp, mouse
gtcccaggatccctaactcg

SEQ ID NO: 616984 - DNA, 20 bp, mouse
gtcggctgggatcgagggag

SEQ ID NO: 616985 - DNA, 20 bp, mouse
ggtcagggcccccagttcgt

SEQ ID NO: 616986 - DNA, 20 bp, mouse
ggaaaccccgagaccagagg

SEQ ID NO: 616987 - DNA, 20 bp, mouse
gctggaaaccccgagaccag

SEQ ID NO: 616988 - DNA, 20 bp, mouse
gtccgcaactggagaaactc

SEQ ID NO: 616989 - DNA, 20 bp, mouse
gctctcctcctctggtctcg

SEQ ID NO: 616990 - DNA, 20 bp, mouse
gtcaagccctgactttacgg

SEQ ID NO: 616991 - DNA, 20 bp, mouse
gtccagagtttctccagttg

SEQ ID NO: 616992 - DNA, 20 bp, mouse
gccgcaagccaggatcctga

SEQ ID NO: 616993 - DNA, 20 bp, mouse
gagaaaaacgaaagccggag

SEQ ID NO: 616994 - DNA, 20 bp, mouse
gccggcaggctgaaacttcc

SEQ ID NO: 616995 - DNA, 20 bp, mouse
gacgaccccgagaaggtgta

SEQ ID NO: 616996 - DNA, 20 bp, mouse
ggctccgggaggacacgtcg

SEQ ID NO: 616997 - DNA, 20 bp, mouse
gcgagtgccgagtcacgcca

SEQ ID NO: 616998 - DNA, 20 bp, mouse
ggcccgagagaggccggaga

SEQ ID NO: 616999 - DNA, 20 bp, mouse
gcgaccacgacgtgtcctcc

SEQ ID NO: 617000 - DNA, 20 bp, mouse
gcctgctccctggcgtgact

SEQ ID NO: 617001 - DNA, 20 bp, mouse
ggcctcctgcagcccgtctc

SEQ ID NO: 617002 - DNA, 20 bp, mouse
gcgagaggacgacccagact

SEQ ID NO: 617003 - DNA, 20 bp, mouse
ggccggagacgggctgcagg

SEQ ID NO: 617004 - DNA, 20 bp, mouse
gagttcaccatgagagggta

SEQ ID NO: 617005 - DNA, 20 bp, mouse
ggactcggcactcgcagctc

SEQ ID NO: 617006 - DNA, 20 bp, mouse
ggacgccgcgagctacctgt

SEQ ID NO: 617007 - DNA, 20 bp, mouse
gcgtctggtgtggccccatg

SEQ ID NO: 617008 - DNA, 20 bp, mouse
ggcgagccgaggccctgtat

SEQ ID NO: 617009 - DNA, 20 bp, mouse
gggccgcgtgggctcacacg

SEQ ID NO: 617010 - DNA, 20 bp, mouse
gtgggctcacacgaggttag

SEQ ID NO: 617011 - DNA, 20 bp, mouse
ggaaaagcgtcagcgcgtga

SEQ ID NO: 617012 - DNA, 20 bp, mouse
gacagggcctcggctcgcac

SEQ ID NO: 617013 - DNA, 20 bp, mouse
gctgtgggtagaaagagcag

SEQ ID NO: 617014 - DNA, 20 bp, mouse
gcagcgcgtgacggcgcggg

SEQ ID NO: 617015 - DNA, 20 bp, mouse
gcacgaggttagaggtcgtc

SEQ ID NO: 617016 - DNA, 20 bp, mouse
ggaaagaccccaactaacct

SEQ ID NO: 617017 - DNA, 20 bp, mouse
gctcctccaccggttagcta

SEQ ID NO: 617018 - DNA, 20 bp, mouse
ggatacagcccaggttagtt

SEQ ID NO: 617019 - DNA, 20 bp, mouse
gttgtgccctagctaaccgg

SEQ ID NO: 617020 - DNA, 20 bp, mouse
ggtcggaggaagcgtttcta

SEQ ID NO: 617021 - DNA, 20 bp, mouse
gtgccctagctaaccggtgg

SEQ ID NO: 617022 - DNA, 20 bp, mouse
ggttagttggggtctttccc

SEQ ID NO: 617023 - DNA, 20 bp, mouse
gtagaccgaagtgtcctcca

SEQ ID NO: 617024 - DNA, 20 bp, mouse
ggtcactttaatctacgtca

SEQ ID NO: 617025 - DNA, 20 bp, mouse
gcagttgtgccctagctaac

SEQ ID NO: 617026 - DNA, 20 bp, mouse
ggcgtccacgcgggaggtgc

SEQ ID NO: 617027 - DNA, 20 bp, mouse
ggcaggctgggaacaagcta

SEQ ID NO: 617028 - DNA, 20 bp, mouse
ggcgggacgccgacaccgcg

SEQ ID NO: 617029 - DNA, 20 bp, mouse
gaccgcggggcgagaagagc

SEQ ID NO: 617030 - DNA, 20 bp, mouse
ggcctgacggaagcaaactg

SEQ ID NO: 617031 - DNA, 20 bp, mouse
gtcttctcgccccgcggtgt

SEQ ID NO: 617032 - DNA, 20 bp, mouse
ggcgtcccgcacctcccgcg

SEQ ID NO: 617033 - DNA, 20 bp, mouse
ggccaggcatcagcagacaa

SEQ ID NO: 617034 - DNA, 20 bp, mouse
gaagagctgcgggttcctag

SEQ ID NO: 617035 - DNA, 20 bp, mouse
gtcaggcctcgcgtccacgc

SEQ ID NO: 617036 - DNA, 20 bp, mouse
gtgaggtccccggaccatgg

SEQ ID NO: 617037 - DNA, 20 bp, mouse
ggacgctcaggcagtgcgaa

SEQ ID NO: 617038 - DNA, 20 bp, mouse
gcggggacctcaggcggtca

SEQ ID NO: 617039 - DNA, 20 bp, mouse
gtcagaaccctggcctgtgt

SEQ ID NO: 617040 - DNA, 20 bp, mouse
gatggtccggggacctcagg

SEQ ID NO: 617041 - DNA, 20 bp, mouse
ggcgagtgcagcgggaggta

SEQ ID NO: 617042 - DNA, 20 bp, mouse
gcacaggagggcctcaggca

SEQ ID NO: 617043 - DNA, 20 bp, mouse
gtcctggaacgtgtccgcgt

SEQ ID NO: 617044 - DNA, 20 bp, mouse
ggccagggttctgattagga

SEQ ID NO: 617045 - DNA, 20 bp, mouse
ggggcagccctgaccgcctg

SEQ ID NO: 617046 - DNA, 20 bp, mouse
gccgggcctgctgaggaacc

SEQ ID NO: 617047 - DNA, 20 bp, mouse
gtgaggaaccgggacgcggg

SEQ ID NO: 617048 - DNA, 20 bp, mouse
ggacgcgggcggccgcctag

SEQ ID NO: 617049 - DNA, 20 bp, mouse
ggccggcgtcgtcccctagg

SEQ ID NO: 617050 - DNA, 20 bp, mouse
gctgctgaggaaccgggacg

SEQ ID NO: 617051 - DNA, 20 bp, mouse
gctcgcgggcctcagaagac

SEQ ID NO: 617052 - DNA, 20 bp, mouse
ggcctgcgggacctcatcga

SEQ ID NO: 617053 - DNA, 20 bp, mouse
gtttgccggcgtcgtcccct

SEQ ID NO: 617054 - DNA, 20 bp, mouse
ggcctgggtgctgtccgtgg

SEQ ID NO: 617055 - DNA, 20 bp, mouse
ggacgggcggctggtcccag

SEQ ID NO: 617056 - DNA, 20 bp, mouse
ggtaggcggtggacttccag

SEQ ID NO: 617057 - DNA, 20 bp, mouse
gccaatggcaagtggcgcgt

SEQ ID NO: 617058 - DNA, 20 bp, mouse
ggcggctccccgaggcagtg

SEQ ID NO: 617059 - DNA, 20 bp, mouse
ggacttccagcggctccccg

SEQ ID NO: 617060 - DNA, 20 bp, mouse
gaccccgccccactgcctcg

SEQ ID NO: 617061 - DNA, 20 bp, mouse
gttgcctgggccagataggt

SEQ ID NO: 617062 - DNA, 20 bp, mouse
ggtcccaagcctgagtactc

SEQ ID NO: 617063 - DNA, 20 bp, mouse
ggcaagtggcgcgtaggcgg

SEQ ID NO: 617064 - DNA, 20 bp, mouse
gatggcaagtggcgcgtagg

SEQ ID NO: 617065 - DNA, 20 bp, mouse
gacccaccagtctcactctg

SEQ ID NO: 617066 - DNA, 20 bp, mouse
gcgcaggactgagggataac

SEQ ID NO: 617067 - DNA, 20 bp, mouse
gtgcgtggacttaggtacag

SEQ ID NO: 617068 - DNA, 20 bp, mouse
gtaagtccacgcaggactga

SEQ ID NO: 617069 - DNA, 20 bp, mouse
gtcctaaccgtaatcctgga

SEQ ID NO: 617070 - DNA, 20 bp, mouse
gccgcctgaagcgagatgga

SEQ ID NO: 617071 - DNA, 20 bp, mouse
gtagtacctattcaattcag

SEQ ID NO: 617072 - DNA, 20 bp, mouse
gaccctgtaagagcaaggtt

SEQ ID NO: 617073 - DNA, 20 bp, mouse
gaccgtccaggattacggtt

SEQ ID NO: 617074 - DNA, 20 bp, mouse
gatagggctgtcccagtagg

SEQ ID NO: 617075 - DNA, 20 bp, mouse
gagttcaccgtccaggatta

SEQ ID NO: 617076 - DNA, 20 bp, mouse
gacagcctgagaggtaactg

SEQ ID NO: 617077 - DNA, 20 bp, mouse
gtcaagaaggaggaccgcac

SEQ ID NO: 617078 - DNA, 20 bp, mouse
gtgagcatcggactgcagct

SEQ ID NO: 617079 - DNA, 20 bp, mouse
gcggcccagagggagggagt

SEQ ID NO: 617080 - DNA, 20 bp, mouse
gaggcacgatacagcctgag

SEQ ID NO: 617081 - DNA, 20 bp, mouse
ggcattagcgggaggacgtc

SEQ ID NO: 617082 - DNA, 20 bp, mouse
gtaacagggactaaggtcaa

SEQ ID NO: 617083 - DNA, 20 bp, mouse
gtgtagtcagcgacaaaacc

SEQ ID NO: 617084 - DNA, 20 bp, mouse
gccagccccagttacctctc

SEQ ID NO: 617085 - DNA, 20 bp, mouse
ggttgtgcggcccagaggga

SEQ ID NO: 617086 - DNA, 20 bp, mouse
gactggacagaaggatatcc

SEQ ID NO: 617087 - DNA, 20 bp, mouse
gcatgtgatagtcactccag

SEQ ID NO: 617088 - DNA, 20 bp, mouse
ggtgacactcattaacctat

SEQ ID NO: 617089 - DNA, 20 bp, mouse
ggactcccatcacccatcca

SEQ ID NO: 617090 - DNA, 20 bp, mouse
gtgaggtccagatggtgcac

SEQ ID NO: 617091 - DNA, 20 bp, mouse
gatacaaaatctgcaccaat

SEQ ID NO: 617092 - DNA, 20 bp, mouse
gaatgctgcccaccatggat

SEQ ID NO: 617093 - DNA, 20 bp, mouse
ggtcatccacccctttgaag

SEQ ID NO: 617094 - DNA, 20 bp, mouse
ggccaacaagttcttagagg

SEQ ID NO: 617095 - DNA, 20 bp, mouse
gaaaatggccatcagagatc

SEQ ID NO: 617096 - DNA, 20 bp, mouse
gcagcagcgaggagtccccg

SEQ ID NO: 617097 - DNA, 20 bp, mouse
gcccgcgagcgcagagagga

SEQ ID NO: 617098 - DNA, 20 bp, mouse
ggcagaagaacatgaatcag

SEQ ID NO: 617099 - DNA, 20 bp, mouse
gtccgcctcagcgccatcgg

SEQ ID NO: 617100 - DNA, 20 bp, mouse
ggaagaacatgaatcagcgg

SEQ ID NO: 617101 - DNA, 20 bp, mouse
gggccgggcccggcatggtg

SEQ ID NO: 617102 - DNA, 20 bp, mouse
gggctgtggaaggagcgcgg

SEQ ID NO: 617103 - DNA, 20 bp, mouse
ggactcctcgctgctgacgg

SEQ ID NO: 617104 - DNA, 20 bp, mouse
gccggcccgcgagcgcagag

SEQ ID NO: 617105 - DNA, 20 bp, mouse
gggtctgcggccgcaggtag

SEQ ID NO: 617106 - DNA, 20 bp, mouse
gatggtggccagatatgcac

SEQ ID NO: 617107 - DNA, 20 bp, mouse
ggcatatctggccaccatgg

SEQ ID NO: 617108 - DNA, 20 bp, mouse
gaggaacagaaggcaccagg

SEQ ID NO: 617109 - DNA, 20 bp, mouse
gccacagtccaggggctggt

SEQ ID NO: 617110 - DNA, 20 bp, mouse
gctcccacagtcaggaggac

SEQ ID NO: 617111 - DNA, 20 bp, mouse
ggcactggacaccacagtcc

SEQ ID NO: 617112 - DNA, 20 bp, mouse
ggtgacgtccaaccaagtga

SEQ ID NO: 617113 - DNA, 20 bp, mouse
ggtggtgtccagtgcatatc

SEQ ID NO: 617114 - DNA, 20 bp, mouse
gacttcctccttcacttggt

SEQ ID NO: 617115 - DNA, 20 bp, mouse
ggccggtactgaccaacatg

SEQ ID NO: 617116 - DNA, 20 bp, mouse
gagattcctcacactgggag

SEQ ID NO: 617117 - DNA, 20 bp, mouse
gctggtgagcagctctgtgg

SEQ ID NO: 617118 - DNA, 20 bp, mouse
gtggcttgggatttactgtc

SEQ ID NO: 617119 - DNA, 20 bp, mouse
gagtgtgaggaatctggctt

SEQ ID NO: 617120 - DNA, 20 bp, mouse
ggcaggtgcccagattctca

SEQ ID NO: 617121 - DNA, 20 bp, mouse
gtatggtagtcaccaactag

SEQ ID NO: 617122 - DNA, 20 bp, mouse
gaagccctccttgagaatct

SEQ ID NO: 617123 - DNA, 20 bp, mouse
gtcagcagagaaaccttcca

SEQ ID NO: 617124 - DNA, 20 bp, mouse
gagtaccatgaatccctgga

SEQ ID NO: 617125 - DNA, 20 bp, mouse
gcaccagtaccatgaatccc

SEQ ID NO: 617126 - DNA, 20 bp, mouse
gggaccctctatgagagtgg

SEQ ID NO: 617127 - DNA, 20 bp, mouse
gtcttggggaagccatgggg

SEQ ID NO: 617128 - DNA, 20 bp, mouse
ggacgtcttggggaagccat

SEQ ID NO: 617129 - DNA, 20 bp, mouse
gtccccaagacgtcgcacaa

SEQ ID NO: 617130 - DNA, 20 bp, mouse
gtgctccgccactctcatag

SEQ ID NO: 617131 - DNA, 20 bp, mouse
gtggggaccctctatgagag

SEQ ID NO: 617132 - DNA, 20 bp, mouse
gaagccatggggcggcaatg

SEQ ID NO: 617133 - DNA, 20 bp, mouse
gcacaacggctgtcaccaca

SEQ ID NO: 617134 - DNA, 20 bp, mouse
gctgtcgcccggcaggaagg

SEQ ID NO: 617135 - DNA, 20 bp, mouse
gggtccccattgccgcccca

SEQ ID NO: 617136 - DNA, 20 bp, mouse
gagagagagggacagcgaac

SEQ ID NO: 617137 - DNA, 20 bp, mouse
gcaggaggattgagtttaca

SEQ ID NO: 617138 - DNA, 20 bp, mouse
gggtctgccgactgcatgca

SEQ ID NO: 617139 - DNA, 20 bp, mouse
gcggcaaacgcaaagagaga

SEQ ID NO: 617140 - DNA, 20 bp, mouse
ggattgagtttacagggaca

SEQ ID NO: 617141 - DNA, 20 bp, mouse
gagcaacctaaggccctcgg

SEQ ID NO: 617142 - DNA, 20 bp, mouse
gtgtcccctgcagccaacgc

SEQ ID NO: 617143 - DNA, 20 bp, mouse
gtcggcagacctgcccgcgt

SEQ ID NO: 617144 - DNA, 20 bp, mouse
gggacagaggcgggcccaga

SEQ ID NO: 617145 - DNA, 20 bp, mouse
gcaagctgagatccacacag

SEQ ID NO: 617146 - DNA, 20 bp, mouse
gagttacgcctacctattat

SEQ ID NO: 617147 - DNA, 20 bp, mouse
gttactcacccataataggt

SEQ ID NO: 617148 - DNA, 20 bp, mouse
ggtaatgtttattatctggg

SEQ ID NO: 617149 - DNA, 20 bp, mouse
gtgagtaatgtttattatct

SEQ ID NO: 617150 - DNA, 20 bp, mouse
gctgtgatgacgtcatttac

SEQ ID NO: 617151 - DNA, 20 bp, mouse
ggggtggaaacatgatattt

SEQ ID NO: 617152 - DNA, 20 bp, mouse
gacgacccgccttcctttga

SEQ ID NO: 617153 - DNA, 20 bp, mouse
gaacattactcacccataat

SEQ ID NO: 617154 - DNA, 20 bp, mouse
gatagttctgcagagttcag

SEQ ID NO: 617155 - DNA, 20 bp, mouse
gtccaccctcaaaggaaggc

SEQ ID NO: 617156 - DNA, 20 bp, mouse
gcgagcgagcgagctggggt

SEQ ID NO: 617157 - DNA, 20 bp, mouse
gcagactctgcgccttccac

SEQ ID NO: 617158 - DNA, 20 bp, mouse
gccggccgaactccgcgcta

SEQ ID NO: 617159 - DNA, 20 bp, mouse
gcctcaccccgtccagaagg

SEQ ID NO: 617160 - DNA, 20 bp, mouse
gaatgacaccggccaccagg

SEQ ID NO: 617161 - DNA, 20 bp, mouse
gggccaccgtggcggcaata

SEQ ID NO: 617162 - DNA, 20 bp, mouse
gaaggcgcagagtctgagca

SEQ ID NO: 617163 - DNA, 20 bp, mouse
gtcctctccggccaccgtgg

SEQ ID NO: 617164 - DNA, 20 bp, mouse
gtgggcgcccgaaggttaag

SEQ ID NO: 617165 - DNA, 20 bp, mouse
gaatgcgccttcttctccat

SEQ ID NO: 617166 - DNA, 20 bp, mouse
ggcagcggccgggaaagcag

SEQ ID NO: 617167 - DNA, 20 bp, mouse
gtagctgcggctgggactag

SEQ ID NO: 617168 - DNA, 20 bp, mouse
gagccgcagctacagcaccg

SEQ ID NO: 617169 - DNA, 20 bp, mouse
ggcccaggcgacggcggcac

SEQ ID NO: 617170 - DNA, 20 bp, mouse
gtggttctctggcgttgctg

SEQ ID NO: 617171 - DNA, 20 bp, mouse
gcgttgctggggctgctcct

SEQ ID NO: 617172 - DNA, 20 bp, mouse
ggcttgagcccaggcgacgg

SEQ ID NO: 617173 - DNA, 20 bp, mouse
gcgggtaaagaagcgagggc

SEQ ID NO: 617174 - DNA, 20 bp, mouse
gtgagaggactcacccgagg

SEQ ID NO: 617175 - DNA, 20 bp, mouse
gccggccgagaagggatctt

SEQ ID NO: 617176 - DNA, 20 bp, mouse
gcgccgcccggcccacgagg

SEQ ID NO: 617177 - DNA, 20 bp, mouse
gggagggacgtcggcgtagt

SEQ ID NO: 617178 - DNA, 20 bp, mouse
gtcggcgtagtcggcagcgt

SEQ ID NO: 617179 - DNA, 20 bp, mouse
gtgccggtcgaggcaagcgg

SEQ ID NO: 617180 - DNA, 20 bp, mouse
ggtcgggtgacgtctccgga

SEQ ID NO: 617181 - DNA, 20 bp, mouse
ggacgtctccggagggacgt

SEQ ID NO: 617182 - DNA, 20 bp, mouse
gtcgcgtcgggtgacgtctc

SEQ ID NO: 617183 - DNA, 20 bp, mouse
gcggtgacgtccaggcgtgg

SEQ ID NO: 617184 - DNA, 20 bp, mouse
gctgctgcccggggcttctg

SEQ ID NO: 617185 - DNA, 20 bp, mouse
gtcccgccgcccggcccacg

SEQ ID NO: 617186 - DNA, 20 bp, mouse
gacgcaaggagcaggcgcgt

SEQ ID NO: 617187 - DNA, 20 bp, mouse
gtggagtgttcgggtaaaaa

SEQ ID NO: 617188 - DNA, 20 bp, mouse
gcaggcgcgttggagtgttc

SEQ ID NO: 617189 - DNA, 20 bp, mouse
ggtccagtcccggggaagaa

SEQ ID NO: 617190 - DNA, 20 bp, mouse
ggaagggtctgtctacccag

SEQ ID NO: 617191 - DNA, 20 bp, mouse
ggagcagttaaccctggaag

SEQ ID NO: 617192 - DNA, 20 bp, mouse
ggggcgtggccggtgttcat

SEQ ID NO: 617193 - DNA, 20 bp, mouse
gggagcaccggtccccgtgc

SEQ ID NO: 617194 - DNA, 20 bp, mouse
gtgacctggaggagggatgg

SEQ ID NO: 617195 - DNA, 20 bp, mouse
gcggaagtgacgcaaggagc

SEQ ID NO: 617196 - DNA, 20 bp, mouse
ggcctccgccgagaccacgt

SEQ ID NO: 617197 - DNA, 20 bp, mouse
gtctcttgttcgcttcccta

SEQ ID NO: 617198 - DNA, 20 bp, mouse
gcggaagtagccggagcggg

SEQ ID NO: 617199 - DNA, 20 bp, mouse
ggcgcgcggcacggacgggg

SEQ ID NO: 617200 - DNA, 20 bp, mouse
gctctcggcgctgagggaag

SEQ ID NO: 617201 - DNA, 20 bp, mouse
gctgaccgcttggacagggt

SEQ ID NO: 617202 - DNA, 20 bp, mouse
gagcgagcgctggaaacctt

SEQ ID NO: 617203 - DNA, 20 bp, mouse
gtcgggcttaatctctagag

SEQ ID NO: 617204 - DNA, 20 bp, mouse
gggaatcccgcgcgctctca

SEQ ID NO: 617205 - DNA, 20 bp, mouse
gcccggacggttaggattgt

SEQ ID NO: 617206 - DNA, 20 bp, mouse
gggaggagcaaagctcaaga

SEQ ID NO: 617207 - DNA, 20 bp, mouse
gacgccaggcggatctcaga

SEQ ID NO: 617208 - DNA, 20 bp, mouse
ggagagacccccctgactga

SEQ ID NO: 617209 - DNA, 20 bp, mouse
gtggccgacaaaacgccagg

SEQ ID NO: 617210 - DNA, 20 bp, mouse
gagatctccgtcagtcaggg

SEQ ID NO: 617211 - DNA, 20 bp, mouse
ggcgctgctgcctccgctga

SEQ ID NO: 617212 - DNA, 20 bp, mouse
gagatggccgacaaaacgcc

SEQ ID NO: 617213 - DNA, 20 bp, mouse
gagctttgctcctccttcag

SEQ ID NO: 617214 - DNA, 20 bp, mouse
gttctgtaggccctcgacca

SEQ ID NO: 617215 - DNA, 20 bp, mouse
gggctgaatcccagtcggga

SEQ ID NO: 617216 - DNA, 20 bp, mouse
ggttaccagtatgaccagga

SEQ ID NO: 617217 - DNA, 20 bp, mouse
gccaggaaggacggagtatc

SEQ ID NO: 617218 - DNA, 20 bp, mouse
gccgtccttcctggtcatac

SEQ ID NO: 617219 - DNA, 20 bp, mouse
gtattcagattgtctgaatg

SEQ ID NO: 617220 - DNA, 20 bp, mouse
gaaaagttaccagtatgacc

SEQ ID NO: 617221 - DNA, 20 bp, mouse
gtaaatagatgagaacatat

SEQ ID NO: 617222 - DNA, 20 bp, mouse
gctaaaaacaaggtgtagaa

SEQ ID NO: 617223 - DNA, 20 bp, mouse
gtgtctagtgagacaagaag

SEQ ID NO: 617224 - DNA, 20 bp, mouse
gttaaagttctaacataacc

SEQ ID NO: 617225 - DNA, 20 bp, mouse
gtcttgtctcactagacatc

SEQ ID NO: 617226 - DNA, 20 bp, mouse
gtcatggccacggctctcaa

SEQ ID NO: 617227 - DNA, 20 bp, mouse
ggagcctcaagtcccgactg

SEQ ID NO: 617228 - DNA, 20 bp, mouse
gtccggggcgtcagcagctc

SEQ ID NO: 617229 - DNA, 20 bp, mouse
gaccagattgcgggctgcga

SEQ ID NO: 617230 - DNA, 20 bp, mouse
gaagagcaggatggcaccac

SEQ ID NO: 617231 - DNA, 20 bp, mouse
ggccctcgcagcccgcaatc

SEQ ID NO: 617232 - DNA, 20 bp, mouse
gggacaagcgaagagcagga

SEQ ID NO: 617233 - DNA, 20 bp, mouse
ggccacggctctcaagggtc

SEQ ID NO: 617234 - DNA, 20 bp, mouse
gcgggttcccaccagattgc

SEQ ID NO: 617235 - DNA, 20 bp, mouse
gcgtgagggacgcaacagag

SEQ ID NO: 617236 - DNA, 20 bp, mouse
ggggattgtcgagggaggta

SEQ ID NO: 617237 - DNA, 20 bp, mouse
gggagccgcgggattgtcga

SEQ ID NO: 617238 - DNA, 20 bp, mouse
ggcggacgccgagcaaggtg

SEQ ID NO: 617239 - DNA, 20 bp, mouse
ggggtccccgcgctaggcat

SEQ ID NO: 617240 - DNA, 20 bp, mouse
ggccgcgggattgtcgaggg

SEQ ID NO: 617241 - DNA, 20 bp, mouse
gagccgagccgaaggagccg

SEQ ID NO: 617242 - DNA, 20 bp, mouse
ggctgctcggagctccggag

SEQ ID NO: 617243 - DNA, 20 bp, mouse
gcaccggtgaaccccagaag

SEQ ID NO: 617244 - DNA, 20 bp, mouse
ggggagcgcgcgcgtgaagg

SEQ ID NO: 617245 - DNA, 20 bp, mouse
gcgcgcgcggagggtcttgg

SEQ ID NO: 617246 - DNA, 20 bp, mouse
gtgcagtatggactcggaga

SEQ ID NO: 617247 - DNA, 20 bp, mouse
gccctgcccccagaacgcgt

SEQ ID NO: 617248 - DNA, 20 bp, mouse
gaagtcacgagtacaggctg

SEQ ID NO: 617249 - DNA, 20 bp, mouse
gtgcagttgcagtatggact

SEQ ID NO: 617250 - DNA, 20 bp, mouse
gggccgctgcagttgcagta

SEQ ID NO: 617251 - DNA, 20 bp, mouse
gcgggcttccggagccaggt

SEQ ID NO: 617252 - DNA, 20 bp, mouse
gcgctgcccacgcgttctgg

SEQ ID NO: 617253 - DNA, 20 bp, mouse
ggcgcacagctgcagcgtgc

SEQ ID NO: 617254 - DNA, 20 bp, mouse
gagcgcgtcggcctccaatg

SEQ ID NO: 617255 - DNA, 20 bp, mouse
gcaggtcggcatagaagcgc

SEQ ID NO: 617256 - DNA, 20 bp, mouse
gccgcggtcggggaaggaga

SEQ ID NO: 617257 - DNA, 20 bp, mouse
gctgctggggtgaaggaggg

SEQ ID NO: 617258 - DNA, 20 bp, mouse
gagcagccgacacaagatgg

SEQ ID NO: 617259 - DNA, 20 bp, mouse
gcccagcagccgacacaaga

SEQ ID NO: 617260 - DNA, 20 bp, mouse
gcacctggctcgaagcgcaa

SEQ ID NO: 617261 - DNA, 20 bp, mouse
gcaaccaccgcggtcgggga

SEQ ID NO: 617262 - DNA, 20 bp, mouse
gaccacaaccaccgcggtcg

SEQ ID NO: 617263 - DNA, 20 bp, mouse
gggcagtgcactcagacatt

SEQ ID NO: 617264 - DNA, 20 bp, mouse
gactaggcaagcgggtgtgg

SEQ ID NO: 617265 - DNA, 20 bp, mouse
ggtctccagaagctgagata

SEQ ID NO: 617266 - DNA, 20 bp, mouse
ggagacaagccgaagccaca

SEQ ID NO: 617267 - DNA, 20 bp, mouse
gcggcttgtctccagaagga

SEQ ID NO: 617268 - DNA, 20 bp, mouse
gttgctcttccgttgccctg

SEQ ID NO: 617269 - DNA, 20 bp, mouse
ggcttcggcttgtctccaga

SEQ ID NO: 617270 - DNA, 20 bp, mouse
gtgtctccagaaggaaggcg

SEQ ID NO: 617271 - DNA, 20 bp, mouse
ggctcacccccagtgctggg

SEQ ID NO: 617272 - DNA, 20 bp, mouse
ggggcccgggtggcattcag

SEQ ID NO: 617273 - DNA, 20 bp, mouse
gtctttttgcacgatcgagg

SEQ ID NO: 617274 - DNA, 20 bp, mouse
gaacttcagggatccctaat

SEQ ID NO: 617275 - DNA, 20 bp, mouse
gttccgttgccctgtggctt

SEQ ID NO: 617276 - DNA, 20 bp, mouse
gtgtttctcgtgtgaggaga

SEQ ID NO: 617277 - DNA, 20 bp, mouse
gcctcacacgagaaacaaga

SEQ ID NO: 617278 - DNA, 20 bp, mouse
ggcgctggcccagtcggaag

SEQ ID NO: 617279 - DNA, 20 bp, mouse
gggcccagtcggaagcggaa

SEQ ID NO: 617280 - DNA, 20 bp, mouse
ggagaaggacgctcattttg

SEQ ID NO: 617281 - DNA, 20 bp, mouse
gccagtcggaagcggaaggg

SEQ ID NO: 617282 - DNA, 20 bp, mouse
gaagatggcgctggcccagt

SEQ ID NO: 617283 - DNA, 20 bp, mouse
gaggacgctcattttgtgga

SEQ ID NO: 617284 - DNA, 20 bp, mouse
gacgagaaacaagatggcgc

SEQ ID NO: 617285 - DNA, 20 bp, mouse
ggtggaggctgctccgttct

SEQ ID NO: 617286 - DNA, 20 bp, mouse
gggaggcgggagaaccagag

SEQ ID NO: 617287 - DNA, 20 bp, mouse
gcccgcctccgactgtgagg

SEQ ID NO: 617288 - DNA, 20 bp, mouse
gcgagccgcctcacagtcgg

SEQ ID NO: 617289 - DNA, 20 bp, mouse
ggctcgtagacgtcccgcca

SEQ ID NO: 617290 - DNA, 20 bp, mouse
gccgcctcggccagctcccg

SEQ ID NO: 617291 - DNA, 20 bp, mouse
gctacgagccgcctcacagt

SEQ ID NO: 617292 - DNA, 20 bp, mouse
gtctcccgcctccgactgtg

SEQ ID NO: 617293 - DNA, 20 bp, mouse
gaacccccgcgacagtgcca

SEQ ID NO: 617294 - DNA, 20 bp, mouse
ggccgcctcacagtcggagg

SEQ ID NO: 617295 - DNA, 20 bp, mouse
gcggttccgggcgggagtca

SEQ ID NO: 617296 - DNA, 20 bp, mouse
ggaagaggcggggaacaata

SEQ ID NO: 617297 - DNA, 20 bp, mouse
ggaggcggggaacaatatgg

SEQ ID NO: 617298 - DNA, 20 bp, mouse
ggcgaggagccgtaagtatc

SEQ ID NO: 617299 - DNA, 20 bp, mouse
gggcgccgcaagggtatggg

SEQ ID NO: 617300 - DNA, 20 bp, mouse
gccctaggcctgggattagg

SEQ ID NO: 617301 - DNA, 20 bp, mouse
gcggggaacaatatggcgga

SEQ ID NO: 617302 - DNA, 20 bp, mouse
gggcaaaatcccgatactta

SEQ ID NO: 617303 - DNA, 20 bp, mouse
gcggagcgccgagttgggct

SEQ ID NO: 617304 - DNA, 20 bp, mouse
gtttgccggagcgccgagtt

SEQ ID NO: 617305 - DNA, 20 bp, mouse
ggggttgtgagagagcgcgg

SEQ ID NO: 617306 - DNA, 20 bp, mouse
ggccggtgtctggacctgga

SEQ ID NO: 617307 - DNA, 20 bp, mouse
gcaccggcgaagcggctcca

SEQ ID NO: 617308 - DNA, 20 bp, mouse
gggtccagacaccggcgaag

SEQ ID NO: 617309 - DNA, 20 bp, mouse
gggcccagcgaggcagcgtg

SEQ ID NO: 617310 - DNA, 20 bp, mouse
gtgggcccacgaagcgcagg

SEQ ID NO: 617311 - DNA, 20 bp, mouse
gagaacccggcgctctggag

SEQ ID NO: 617312 - DNA, 20 bp, mouse
gctccacagcaggaaaggag

SEQ ID NO: 617313 - DNA, 20 bp, mouse
ggagcgccgggttctctccc

SEQ ID NO: 617314 - DNA, 20 bp, mouse
gtcccagtaagacacgtctc

SEQ ID NO: 617315 - DNA, 20 bp, mouse
ggccggagacgtgtcttact

SEQ ID NO: 617316 - DNA, 20 bp, mouse
gagcccagccgcgacgcgga

SEQ ID NO: 617317 - DNA, 20 bp, mouse
ggcgctctcagaggagacta

SEQ ID NO: 617318 - DNA, 20 bp, mouse
ggctgcgggcggaagaccaa

SEQ ID NO: 617319 - DNA, 20 bp, mouse
gacgaggcggccgagcgggt

SEQ ID NO: 617320 - DNA, 20 bp, mouse
gcaacagcccagccgcgacg

SEQ ID NO: 617321 - DNA, 20 bp, mouse
gcggacggcaccaacccgct

SEQ ID NO: 617322 - DNA, 20 bp, mouse
ggttggtgccgtccgcgtcg

SEQ ID NO: 617323 - DNA, 20 bp, mouse
gagaaagaggacagcggaac

SEQ ID NO: 617324 - DNA, 20 bp, mouse
gttcaacgaggcggccgagc

SEQ ID NO: 617325 - DNA, 20 bp, mouse
ggtcggcgaggcgactgtag

SEQ ID NO: 617326 - DNA, 20 bp, mouse
gctgtcggaaggcgatggag

SEQ ID NO: 617327 - DNA, 20 bp, mouse
ggagcaggacgcctcttcac

SEQ ID NO: 617328 - DNA, 20 bp, mouse
gtcagtctgtcggaaggcga

SEQ ID NO: 617329 - DNA, 20 bp, mouse
gctcgctgcagtcagtctgt

SEQ ID NO: 617330 - DNA, 20 bp, mouse
gctgcagtcagtctgtcgga

SEQ ID NO: 617331 - DNA, 20 bp, mouse
gcggaagtcaggtgtcccag

SEQ ID NO: 617332 - DNA, 20 bp, mouse
gccacctcgctagctccctg

SEQ ID NO: 617333 - DNA, 20 bp, mouse
ggaaagcacagccaacggct

SEQ ID NO: 617334 - DNA, 20 bp, mouse
gcacccgcaggctccccagg

SEQ ID NO: 617335 - DNA, 20 bp, mouse
gtctcacccgcaggctcccc

SEQ ID NO: 617336 - DNA, 20 bp, mouse
gaggaggctgtagggctcac

SEQ ID NO: 617337 - DNA, 20 bp, mouse
ggctgtagggctcacaggag

SEQ ID NO: 617338 - DNA, 20 bp, mouse
gtggtttcctgaaatcatag

SEQ ID NO: 617339 - DNA, 20 bp, mouse
gcctgtggttaagaagaagg

SEQ ID NO: 617340 - DNA, 20 bp, mouse
gccagcagcaaccagcgctt

SEQ ID NO: 617341 - DNA, 20 bp, mouse
gcaggcccagtacatacctg

SEQ ID NO: 617342 - DNA, 20 bp, mouse
ggggcctgcctgctatgcag

SEQ ID NO: 617343 - DNA, 20 bp, mouse
ggtgggataaccaagtcggg

SEQ ID NO: 617344 - DNA, 20 bp, mouse
gctcaggtaagagttcttgg

SEQ ID NO: 617345 - DNA, 20 bp, mouse
ggagagcttgggaaggaaca

SEQ ID NO: 617346 - DNA, 20 bp, mouse
gacggaactacaggatggag

SEQ ID NO: 617347 - DNA, 20 bp, mouse
gtgctggttaactgggccag

SEQ ID NO: 617348 - DNA, 20 bp, mouse
gctagagcggctcctcctct

SEQ ID NO: 617349 - DNA, 20 bp, mouse
gcagcttcctgcctctagag

SEQ ID NO: 617350 - DNA, 20 bp, mouse
gcagcccagcctggcccaat

SEQ ID NO: 617351 - DNA, 20 bp, mouse
ggtgtgaggggcctaaaatg

SEQ ID NO: 617352 - DNA, 20 bp, mouse
gtcactgctggcccatctcc

SEQ ID NO: 617353 - DNA, 20 bp, mouse
ggctacgaccggctcacctg

SEQ ID NO: 617354 - DNA, 20 bp, mouse
gcagcagcttttcctagagg

SEQ ID NO: 617355 - DNA, 20 bp, mouse
ggtccctggaggttgagcat

SEQ ID NO: 617356 - DNA, 20 bp, mouse
gaggctggcgggaggaccag

SEQ ID NO: 617357 - DNA, 20 bp, mouse
gccgccgcccgtcactgaag

SEQ ID NO: 617358 - DNA, 20 bp, mouse
ggctacggcgacacgggcag

SEQ ID NO: 617359 - DNA, 20 bp, mouse
ggaggcgaccgaggacacat

SEQ ID NO: 617360 - DNA, 20 bp, mouse
gctgccccttcagtgacggg

SEQ ID NO: 617361 - DNA, 20 bp, mouse
gtgcgaccgcgcgctccggg

SEQ ID NO: 617362 - DNA, 20 bp, mouse
ggcggagctgacaggagccg

SEQ ID NO: 617363 - DNA, 20 bp, mouse
ggaaccagtgaaggtcactg

SEQ ID NO: 617364 - DNA, 20 bp, mouse
ggcgaccgaggacacatcgg

SEQ ID NO: 617365 - DNA, 20 bp, mouse
gggtagagataggagtgtcg

SEQ ID NO: 617366 - DNA, 20 bp, mouse
gccagcgagcgaagtcggcc

SEQ ID NO: 617367 - DNA, 20 bp, mouse
gggagacgccgggagcggaa

SEQ ID NO: 617368 - DNA, 20 bp, mouse
gtccccctgacgccccgcgg

SEQ ID NO: 617369 - DNA, 20 bp, mouse
gatagccccgagggccgagg

SEQ ID NO: 617370 - DNA, 20 bp, mouse
ggagcgaagtcggcccggcg

SEQ ID NO: 617371 - DNA, 20 bp, mouse
ggtccgggaagagctcggaa

SEQ ID NO: 617372 - DNA, 20 bp, mouse
gcaccagcaccggctccagt

SEQ ID NO: 617373 - DNA, 20 bp, mouse
gcggccctcggggctatggt

SEQ ID NO: 617374 - DNA, 20 bp, mouse
ggagctcggaatggagcgaa

SEQ ID NO: 617375 - DNA, 20 bp, mouse
gaagggcggcccaaggatga

SEQ ID NO: 617376 - DNA, 20 bp, mouse
ggcgcgcagggaggccggag

SEQ ID NO: 617377 - DNA, 20 bp, mouse
ggaggtgcgtaggggaaccg

SEQ ID NO: 617378 - DNA, 20 bp, mouse
gcgctaatggtggacgcgtg

SEQ ID NO: 617379 - DNA, 20 bp, mouse
gggcagttcgaggtgcgtag

SEQ ID NO: 617380 - DNA, 20 bp, mouse
ggtgaggctagcgcgcaggg

SEQ ID NO: 617381 - DNA, 20 bp, mouse
gactgctacaagcggcccac

SEQ ID NO: 617382 - DNA, 20 bp, mouse
gcctccagggcccagtgata

SEQ ID NO: 617383 - DNA, 20 bp, mouse
ggcacgactggccaagagtt

SEQ ID NO: 617384 - DNA, 20 bp, mouse
ggcagcacacaggacctcca

SEQ ID NO: 617385 - DNA, 20 bp, mouse
gtgcgtaggggaaccgggga

SEQ ID NO: 617386 - DNA, 20 bp, mouse
gctgcgcgtgggccaatcag

SEQ ID NO: 617387 - DNA, 20 bp, mouse
gccagccgccggctcccaca

SEQ ID NO: 617388 - DNA, 20 bp, mouse
gacgtccgtgtgggagccgg

SEQ ID NO: 617389 - DNA, 20 bp, mouse
gcgccaggcccaacgttcgg

SEQ ID NO: 617390 - DNA, 20 bp, mouse
gtcgaatcgaacgtccgtgt

SEQ ID NO: 617391 - DNA, 20 bp, mouse
gggctggctgggctgcgcgt

SEQ ID NO: 617392 - DNA, 20 bp, mouse
ggtgggccaatcagcggcgt

SEQ ID NO: 617393 - DNA, 20 bp, mouse
gtgggagccggcggctggct

SEQ ID NO: 617394 - DNA, 20 bp, mouse
ggtgagccgacgccgctgat

SEQ ID NO: 617395 - DNA, 20 bp, mouse
gcgaacgtccgtgtgggagc

SEQ ID NO: 617396 - DNA, 20 bp, mouse
gatggcggctgtggtactgg

SEQ ID NO: 617397 - DNA, 20 bp, mouse
ggggaagtaggccttcaaca

SEQ ID NO: 617398 - DNA, 20 bp, mouse
gaacatggcggctgtggtac

SEQ ID NO: 617399 - DNA, 20 bp, mouse
gctggtggtggctacggtga

SEQ ID NO: 617400 - DNA, 20 bp, mouse
gggtggctacggtgacggtc

SEQ ID NO: 617401 - DNA, 20 bp, mouse
gaaaggggcggagcgtcgag

SEQ ID NO: 617402 - DNA, 20 bp, mouse
gggctcggggcgggtagagt

SEQ ID NO: 617403 - DNA, 20 bp, mouse
gcggagcgtcgaggggaagg

SEQ ID NO: 617404 - DNA, 20 bp, mouse
gtgggctcccgctgccccta

SEQ ID NO: 617405 - DNA, 20 bp, mouse
gtgtcagacgcctaaagggg

SEQ ID NO: 617406 - DNA, 20 bp, mouse
gcacattggcaggtaacgag

SEQ ID NO: 617407 - DNA, 20 bp, mouse
gggcaggtaacgagcggcgg

SEQ ID NO: 617408 - DNA, 20 bp, mouse
gctcaggcctggacacacta

SEQ ID NO: 617409 - DNA, 20 bp, mouse
gttaccgctgctgctctcgt

SEQ ID NO: 617410 - DNA, 20 bp, mouse
gagtccaacgagagcagcag

SEQ ID NO: 617411 - DNA, 20 bp, mouse
gattggcaggtaacgagcgg

SEQ ID NO: 617412 - DNA, 20 bp, mouse
gcgctttgtaagaggcacat

SEQ ID NO: 617413 - DNA, 20 bp, mouse
gaagcacagggcaacctgag

SEQ ID NO: 617414 - DNA, 20 bp, mouse
gcaacgtgcagggaccgagg

SEQ ID NO: 617415 - DNA, 20 bp, mouse
ggccgccgccgctttgtaag

SEQ ID NO: 617416 - DNA, 20 bp, mouse
ggtcagtgtggaggagactg

SEQ ID NO: 617417 - DNA, 20 bp, mouse
gggtaaagttgggagcgcag

SEQ ID NO: 617418 - DNA, 20 bp, mouse
gaggagactgaggtaaagtt

SEQ ID NO: 617419 - DNA, 20 bp, mouse
ggcgggacaggaatacggag

SEQ ID NO: 617420 - DNA, 20 bp, mouse
gttcccaagaccagaaggga

SEQ ID NO: 617421 - DNA, 20 bp, mouse
gctaccgcgggacaggaata

SEQ ID NO: 617422 - DNA, 20 bp, mouse
ggttgggagcgcagcggcgt

SEQ ID NO: 617423 - DNA, 20 bp, mouse
gttatatcacgtgacagggg

SEQ ID NO: 617424 - DNA, 20 bp, mouse
gggcggcagcggcaacgcgg

SEQ ID NO: 617425 - DNA, 20 bp, mouse
ggccacatgccccccccctc

SEQ ID NO: 617426 - DNA, 20 bp, mouse
gttgagcttgttggagacct

SEQ ID NO: 617427 - DNA, 20 bp, mouse
ggggcagccagagacccaca

SEQ ID NO: 617428 - DNA, 20 bp, mouse
ggcaggaagacatggctgcg

SEQ ID NO: 617429 - DNA, 20 bp, mouse
gctgcggcccttgagcttgt

SEQ ID NO: 617430 - DNA, 20 bp, mouse
gttcctgcttgctgtacaag

SEQ ID NO: 617431 - DNA, 20 bp, mouse
gagatcagtgactcttacag

SEQ ID NO: 617432 - DNA, 20 bp, mouse
gcgcctcttgtacagcaagc

SEQ ID NO: 617433 - DNA, 20 bp, mouse
gtctagtccttgcagtgagc

SEQ ID NO: 617434 - DNA, 20 bp, mouse
gtagaagccatgtgggtctc

SEQ ID NO: 617435 - DNA, 20 bp, mouse
gcagtcaggctccagggccg

SEQ ID NO: 617436 - DNA, 20 bp, mouse
gtcggggaggagaagctggt

SEQ ID NO: 617437 - DNA, 20 bp, mouse
gcaaattcccggacagctcg

SEQ ID NO: 617438 - DNA, 20 bp, mouse
ggtgccgagtgcccgctcag

SEQ ID NO: 617439 - DNA, 20 bp, mouse
gggagaagctggtggggcgg

SEQ ID NO: 617440 - DNA, 20 bp, mouse
gcccgcgcgccggggactgg

SEQ ID NO: 617441 - DNA, 20 bp, mouse
gtctcctccccgagctgtcc

SEQ ID NO: 617442 - DNA, 20 bp, mouse
gcgatgggcggccactgagc

SEQ ID NO: 617443 - DNA, 20 bp, mouse
ggtgctcccagatctccggg

SEQ ID NO: 617444 - DNA, 20 bp, mouse
gcgagccggagcgaagtcga

SEQ ID NO: 617445 - DNA, 20 bp, mouse
gcccgggcacagtcaagcat

SEQ ID NO: 617446 - DNA, 20 bp, mouse
gcactgagctcagtgacgag

SEQ ID NO: 617447 - DNA, 20 bp, mouse
gcgcgcgccagggagcttaa

SEQ ID NO: 617448 - DNA, 20 bp, mouse
gcgggccttccgggaagagt

SEQ ID NO: 617449 - DNA, 20 bp, mouse
gggagcgaggtgacgtgacg

SEQ ID NO: 617450 - DNA, 20 bp, mouse
gaaagaggtacttctcactc

SEQ ID NO: 617451 - DNA, 20 bp, mouse
ggttaacaggtatttgtcta

SEQ ID NO: 617452 - DNA, 20 bp, mouse
gcccactgaaataaccacga

SEQ ID NO: 617453 - DNA, 20 bp, mouse
gacgcggcaacgggccttcc

SEQ ID NO: 617454 - DNA, 20 bp, mouse
gttccgggaagagtgggcct

SEQ ID NO: 617455 - DNA, 20 bp, mouse
gttaacggacgcttaaccga

SEQ ID NO: 617456 - DNA, 20 bp, mouse
gtcctcaccagcggtggtgg

SEQ ID NO: 617457 - DNA, 20 bp, mouse
gacggaactcgcagtctcca

SEQ ID NO: 617458 - DNA, 20 bp, mouse
gtcccgtccccgaccgggtg

SEQ ID NO: 617459 - DNA, 20 bp, mouse
gggactgccgccaccaccgc

SEQ ID NO: 617460 - DNA, 20 bp, mouse
ggtggcgtccagagattgag

SEQ ID NO: 617461 - DNA, 20 bp, mouse
ggctttctcctcaccagcgg

SEQ ID NO: 617462 - DNA, 20 bp, mouse
ggtctccacggaactagctg

SEQ ID NO: 617463 - DNA, 20 bp, mouse
gcgtgccgcagctagttccg

SEQ ID NO: 617464 - DNA, 20 bp, mouse
gggactgggcggcaagatgg

SEQ ID NO: 617465 - DNA, 20 bp, mouse
gtgacgcgcaggacgaggtt

SEQ ID NO: 617466 - DNA, 20 bp, mouse
gaccccaacttacacaggtg

SEQ ID NO: 617467 - DNA, 20 bp, mouse
gtccgcacctgtgtaagttg

SEQ ID NO: 617468 - DNA, 20 bp, mouse
gaccaaaccccaacttacac

SEQ ID NO: 617469 - DNA, 20 bp, mouse
ggaggggacagtggtctaga

SEQ ID NO: 617470 - DNA, 20 bp, mouse
gtggggtttggtaaacgaat

SEQ ID NO: 617471 - DNA, 20 bp, mouse
gataactgcacaataggaag

SEQ ID NO: 617472 - DNA, 20 bp, mouse
gtcacatataagcagacaca

SEQ ID NO: 617473 - DNA, 20 bp, mouse
ggtttggtaaacgaatggga

SEQ ID NO: 617474 - DNA, 20 bp, mouse
gcagttccacaacttgggag

SEQ ID NO: 617475 - DNA, 20 bp, mouse
gacattgataactgcacaat

SEQ ID NO: 617476 - DNA, 20 bp, mouse
gagccgaggaggcgccgaga

SEQ ID NO: 617477 - DNA, 20 bp, mouse
ggaggaagccggagaagccg

SEQ ID NO: 617478 - DNA, 20 bp, mouse
gccggagccgagggtcggtc

SEQ ID NO: 617479 - DNA, 20 bp, mouse
gccggcgccagaccgaccct

SEQ ID NO: 617480 - DNA, 20 bp, mouse
gccgctccggagccgagggt

SEQ ID NO: 617481 - DNA, 20 bp, mouse
gagcagtcgggcatatacca

SEQ ID NO: 617482 - DNA, 20 bp, mouse
ggcggtccccgaggaagccg

SEQ ID NO: 617483 - DNA, 20 bp, mouse
gaccaccccagagtagacgg

SEQ ID NO: 617484 - DNA, 20 bp, mouse
ggtccctctcggcgcctcct

SEQ ID NO: 617485 - DNA, 20 bp, mouse
ggcggcagtgccgtccctct

SEQ ID NO: 617486 - DNA, 20 bp, mouse
ggcagcggccgaatcactgt

SEQ ID NO: 617487 - DNA, 20 bp, mouse
gtgtcccagaggcccaccta

SEQ ID NO: 617488 - DNA, 20 bp, mouse
ggcggcgacccacagtgatt

SEQ ID NO: 617489 - DNA, 20 bp, mouse
gcccgaagccatggactgta

SEQ ID NO: 617490 - DNA, 20 bp, mouse
gcccccaccccccggcgcag

SEQ ID NO: 617491 - DNA, 20 bp, mouse
ggtttgtgcagtctcggtgg

SEQ ID NO: 617492 - DNA, 20 bp, mouse
ggttgtttgtgcagtctcgg

SEQ ID NO: 617493 - DNA, 20 bp, mouse
gggagggagacgtcattgca

SEQ ID NO: 617494 - DNA, 20 bp, mouse
gcctcctcagggtcaccagg

SEQ ID NO: 617495 - DNA, 20 bp, mouse
gcccactgcccgcctcctca

SEQ ID NO: 617496 - DNA, 20 bp, mouse
ggaggtactggcaccgagac

SEQ ID NO: 617497 - DNA, 20 bp, mouse
ggctgccaggcagctctcat

SEQ ID NO: 617498 - DNA, 20 bp, mouse
gcaggaacgcaggaaatgga

SEQ ID NO: 617499 - DNA, 20 bp, mouse
gagaggaaagggcaactgcg

SEQ ID NO: 617500 - DNA, 20 bp, mouse
ggagcgctggggttaacatg

SEQ ID NO: 617501 - DNA, 20 bp, mouse
gggctttgggacaaatgagg

SEQ ID NO: 617502 - DNA, 20 bp, mouse
gaaggagccgagccctgcgg

SEQ ID NO: 617503 - DNA, 20 bp, mouse
gtggtgcggaggtcaccccg

SEQ ID NO: 617504 - DNA, 20 bp, mouse
ggctgggtcgcggttttgtg

SEQ ID NO: 617505 - DNA, 20 bp, mouse
ggcgttgccgcggttcgaaa

SEQ ID NO: 617506 - DNA, 20 bp, mouse
gactagaacccggacagggt

SEQ ID NO: 617507 - DNA, 20 bp, mouse
gagttactagaacccggaca

SEQ ID NO: 617508 - DNA, 20 bp, mouse
ggacagggtgggagcacgtg

SEQ ID NO: 617509 - DNA, 20 bp, mouse
ggtagcgcgaagggatccgg

SEQ ID NO: 617510 - DNA, 20 bp, mouse
ggagcacgtgcggccgtagc

SEQ ID NO: 617511 - DNA, 20 bp, mouse
gcacgtgcggccgtagcagg

SEQ ID NO: 617512 - DNA, 20 bp, mouse
ggcccacagttactagaacc

SEQ ID NO: 617513 - DNA, 20 bp, mouse
gtccgggttctagtaactgt

SEQ ID NO: 617514 - DNA, 20 bp, mouse
gtagcaggcggctggctccc

SEQ ID NO: 617515 - DNA, 20 bp, mouse
gcttcgcgctaccttggcct

SEQ ID NO: 617516 - DNA, 20 bp, mouse
gacggagcagccctgcgagg

SEQ ID NO: 617517 - DNA, 20 bp, mouse
gggatcggcccgcacaggtg

SEQ ID NO: 617518 - DNA, 20 bp, mouse
gcacacggagcagccctgcg

SEQ ID NO: 617519 - DNA, 20 bp, mouse
gcccgggctgccgcctcgca

SEQ ID NO: 617520 - DNA, 20 bp, mouse
gcggagtgtccgcgtgtccc

SEQ ID NO: 617521 - DNA, 20 bp, mouse
gctgggtacttggaacctcg

SEQ ID NO: 617522 - DNA, 20 bp, mouse
gacactcgcgcaccgcgccc

SEQ ID NO: 617523 - DNA, 20 bp, mouse
gagatgtccccaggaacccg

SEQ ID NO: 617524 - DNA, 20 bp, mouse
gaggggcgcggacactgggg

SEQ ID NO: 617525 - DNA, 20 bp, mouse
ggacaatctggccaccccac

SEQ ID NO: 617526 - DNA, 20 bp, mouse
ggcgcgtagggtgctcgcag

SEQ ID NO: 617527 - DNA, 20 bp, mouse
ggccagcggcggagggatac

SEQ ID NO: 617528 - DNA, 20 bp, mouse
gagggtgggcccaggccgag

SEQ ID NO: 617529 - DNA, 20 bp, mouse
gggccgggccgcgccagcgg

SEQ ID NO: 617530 - DNA, 20 bp, mouse
gcgtagggtgctcgcagggg

SEQ ID NO: 617531 - DNA, 20 bp, mouse
gggccgccggagcgcagggt

SEQ ID NO: 617532 - DNA, 20 bp, mouse
gcccaggccgaggggcaggt

SEQ ID NO: 617533 - DNA, 20 bp, mouse
ggccgtggatccctccgcct

SEQ ID NO: 617534 - DNA, 20 bp, mouse
gcaggccgcagcctattcag

SEQ ID NO: 617535 - DNA, 20 bp, mouse
gctccctggcccgccaatcc

SEQ ID NO: 617536 - DNA, 20 bp, mouse
gcttccgggccagccaccgt

SEQ ID NO: 617537 - DNA, 20 bp, mouse
gggatcagccgcagaagagg

SEQ ID NO: 617538 - DNA, 20 bp, mouse
gccctggcagaatgcgctga

SEQ ID NO: 617539 - DNA, 20 bp, mouse
gcagaatgcgctgagggccg

SEQ ID NO: 617540 - DNA, 20 bp, mouse
gaagacagatacagtgccca

SEQ ID NO: 617541 - DNA, 20 bp, mouse
gcgaggcccactcagcttcc

SEQ ID NO: 617542 - DNA, 20 bp, mouse
ggtaggccccaggtggaagg

SEQ ID NO: 617543 - DNA, 20 bp, mouse
ggaagaagagtcagctactg

SEQ ID NO: 617544 - DNA, 20 bp, mouse
gtgttcagcaggtcctgtcg

SEQ ID NO: 617545 - DNA, 20 bp, mouse
gtgcggcagcacaaaaaagg

SEQ ID NO: 617546 - DNA, 20 bp, mouse
gcgtgcgcgtgagccccgta

SEQ ID NO: 617547 - DNA, 20 bp, mouse
ggtgcctccccggccctacg

SEQ ID NO: 617548 - DNA, 20 bp, mouse
gcgtcagagcggacatcttg

SEQ ID NO: 617549 - DNA, 20 bp, mouse
gcgtgagccccgtagggccg

SEQ ID NO: 617550 - DNA, 20 bp, mouse
ggagagtacggtggtgtcag

SEQ ID NO: 617551 - DNA, 20 bp, mouse
gcgctgcgaggcggagagta

SEQ ID NO: 617552 - DNA, 20 bp, mouse
gggcagtagttccgtcagag

SEQ ID NO: 617553 - DNA, 20 bp, mouse
gagaaggtgctgttccgaca

SEQ ID NO: 617554 - DNA, 20 bp, mouse
ggtccactcggcccgagcga

SEQ ID NO: 617555 - DNA, 20 bp, mouse
gcaccagctgccgcgcgggg

SEQ ID NO: 617556 - DNA, 20 bp, mouse
gggaaccgactgacttacag

SEQ ID NO: 617557 - DNA, 20 bp, mouse
gatgagggcgccacaggact

SEQ ID NO: 617558 - DNA, 20 bp, mouse
gggaacaagtcatcacccac

SEQ ID NO: 617559 - DNA, 20 bp, mouse
gtagtgaaagcaacctctgg

SEQ ID NO: 617560 - DNA, 20 bp, mouse
gtaagtcagtcggttccttc

SEQ ID NO: 617561 - DNA, 20 bp, mouse
gtcattcgggcccaggatgg

SEQ ID NO: 617562 - DNA, 20 bp, mouse
gctgtcattcgggcccagga

SEQ ID NO: 617563 - DNA, 20 bp, mouse
gcttacagcgtggaggatga

SEQ ID NO: 617564 - DNA, 20 bp, mouse
gtggtagtgaaagcaacctc

SEQ ID NO: 617565 - DNA, 20 bp, mouse
gcatttacctggacaccctg

SEQ ID NO: 617566 - DNA, 20 bp, mouse
gctagcagtgcttcaggaca

SEQ ID NO: 617567 - DNA, 20 bp, mouse
gaaacactgctgtctggaca

SEQ ID NO: 617568 - DNA, 20 bp, mouse
gctgctagttgcaagctgtg

SEQ ID NO: 617569 - DNA, 20 bp, mouse
ggagccattgcccccaaact

SEQ ID NO: 617570 - DNA, 20 bp, mouse
ggatggctctgttgcaccta

SEQ ID NO: 617571 - DNA, 20 bp, mouse
ggctggaaggttgtgatgcc

SEQ ID NO: 617572 - DNA, 20 bp, mouse
gggaatccttgtagccctac

SEQ ID NO: 617573 - DNA, 20 bp, mouse
ggaaccatcttcactgagta

SEQ ID NO: 617574 - DNA, 20 bp, mouse
ggctcttggcctaaagcgac

SEQ ID NO: 617575 - DNA, 20 bp, mouse
gggtcccttcagtgagtatc

SEQ ID NO: 617576 - DNA, 20 bp, mouse
ggaaacacctctgtctggac

SEQ ID NO: 617577 - DNA, 20 bp, mouse
ggcttggaaacacctctgtc

SEQ ID NO: 617578 - DNA, 20 bp, mouse
gacaattcggagatggatgg

SEQ ID NO: 617579 - DNA, 20 bp, mouse
ggctggaatgctgtgatgcc

SEQ ID NO: 617580 - DNA, 20 bp, mouse
gagagctaaagaatccgctt

SEQ ID NO: 617581 - DNA, 20 bp, mouse
gggagtccttgtagctctac

SEQ ID NO: 617582 - DNA, 20 bp, mouse
gcttggccggaagcgacagg

SEQ ID NO: 617583 - DNA, 20 bp, mouse
ggatccatcttcaccgagta

SEQ ID NO: 617584 - DNA, 20 bp, mouse
gagcattccagcaacctaag

SEQ ID NO: 617585 - DNA, 20 bp, mouse
ggctcttggccggaagcgac

SEQ ID NO: 617586 - DNA, 20 bp, mouse
gagtgagagcgagacacgag

SEQ ID NO: 617587 - DNA, 20 bp, mouse
gcagggccgggcgaccggga

SEQ ID NO: 617588 - DNA, 20 bp, mouse
gcgagccgagcagcgagagt

SEQ ID NO: 617589 - DNA, 20 bp, mouse
ggcaccggccgaagagacac

SEQ ID NO: 617590 - DNA, 20 bp, mouse
ggccgcgcgaactgtcagag

SEQ ID NO: 617591 - DNA, 20 bp, mouse
ggagcgagacacgagtggcc

SEQ ID NO: 617592 - DNA, 20 bp, mouse
ggggtgagcaagccgagcgt

SEQ ID NO: 617593 - DNA, 20 bp, mouse
ggcagcagggccgggcgacc

SEQ ID NO: 617594 - DNA, 20 bp, mouse
ggaggtgcgggggcccctca

SEQ ID NO: 617595 - DNA, 20 bp, mouse
ggcaacagcaactattaacc

SEQ ID NO: 617596 - DNA, 20 bp, mouse
gacaccgcgaggccgacgtg

SEQ ID NO: 617597 - DNA, 20 bp, mouse
ggcgctgtcgcgggctctca

SEQ ID NO: 617598 - DNA, 20 bp, mouse
ggacagcgcgagccccacgt

SEQ ID NO: 617599 - DNA, 20 bp, mouse
gcgggctctcagggcaggca

SEQ ID NO: 617600 - DNA, 20 bp, mouse
gccgcgaggtgagtaggtga

SEQ ID NO: 617601 - DNA, 20 bp, mouse
ggcgagcgcgcgcttgggag

SEQ ID NO: 617602 - DNA, 20 bp, mouse
ggcgacgccgcgaggtgagt

SEQ ID NO: 617603 - DNA, 20 bp, mouse
gggcgcgcggggaccccacg

SEQ ID NO: 617604 - DNA, 20 bp, mouse
gggaggggagaggtcctcgt

SEQ ID NO: 617605 - DNA, 20 bp, mouse
ggcagggcgagcgcgcgctt

SEQ ID NO: 617606 - DNA, 20 bp, mouse
ggccgagccgagcgcagcgg

SEQ ID NO: 617607 - DNA, 20 bp, mouse
gtcccgggccggagcctcgg

SEQ ID NO: 617608 - DNA, 20 bp, mouse
gcgctccgggagccacggtg

SEQ ID NO: 617609 - DNA, 20 bp, mouse
gtgctgactgcgcgaccggg

SEQ ID NO: 617610 - DNA, 20 bp, mouse
gggctcggctcggctcctcc

SEQ ID NO: 617611 - DNA, 20 bp, mouse
gaggcgaaggcgcagggacg

SEQ ID NO: 617612 - DNA, 20 bp, mouse
gctctgccggccgaaggcga

SEQ ID NO: 617613 - DNA, 20 bp, mouse
gcgccgcgctagtcagtcag

SEQ ID NO: 617614 - DNA, 20 bp, mouse
gggccgaaggcgaaggcgca

SEQ ID NO: 617615 - DNA, 20 bp, mouse
gcccgccgctgcgctcggct

SEQ ID NO: 617616 - DNA, 20 bp, mouse
gaccatgcccggcggagcag

SEQ ID NO: 617617 - DNA, 20 bp, mouse
gtcagtgccgctgctccgcc

SEQ ID NO: 617618 - DNA, 20 bp, mouse
gcacccaaaaccatgcccgg

SEQ ID NO: 617619 - DNA, 20 bp, mouse
gacctcccgcttcccttcag

SEQ ID NO: 617620 - DNA, 20 bp, mouse
gtacctgagcaccgcgagtc

SEQ ID NO: 617621 - DNA, 20 bp, mouse
gggcgggcagcgagccccgg

SEQ ID NO: 617622 - DNA, 20 bp, mouse
ggagccccggcggctctaga

SEQ ID NO: 617623 - DNA, 20 bp, mouse
gctagagggccgggccgagg

SEQ ID NO: 617624 - DNA, 20 bp, mouse
ggccgccgcccgcaaggtca

SEQ ID NO: 617625 - DNA, 20 bp, mouse
ggctcgcctcgcctgactcg

SEQ ID NO: 617626 - DNA, 20 bp, mouse
gcctgcgcgcagtgaggcag

SEQ ID NO: 617627 - DNA, 20 bp, mouse
gtgtgttgaggaacccggac

SEQ ID NO: 617628 - DNA, 20 bp, mouse
gagcggccctgcgcgcagtg

SEQ ID NO: 617629 - DNA, 20 bp, mouse
gaggcaccggtggggccgac

SEQ ID NO: 617630 - DNA, 20 bp, mouse
ggagcgccgaagccgcgggg

SEQ ID NO: 617631 - DNA, 20 bp, mouse
gcgcgcagtgaggcagtggc

SEQ ID NO: 617632 - DNA, 20 bp, mouse
ggcccgcccgtcggccccac

SEQ ID NO: 617633 - DNA, 20 bp, mouse
gggagtgctgcttctgaagg

SEQ ID NO: 617634 - DNA, 20 bp, mouse
ggagcggagcggactcgcat

SEQ ID NO: 617635 - DNA, 20 bp, mouse
gcgaggaaagccgagcggag

SEQ ID NO: 617636 - DNA, 20 bp, mouse
gcgccgtccccgccataccg

SEQ ID NO: 617637 - DNA, 20 bp, mouse
gctgctgaacgcaggttccg

SEQ ID NO: 617638 - DNA, 20 bp, mouse
ggaccggcgcggatgtggcg

SEQ ID NO: 617639 - DNA, 20 bp, mouse
ggcagatgcgcagcacacag

SEQ ID NO: 617640 - DNA, 20 bp, mouse
ggcgacccggaagcagtcgt

SEQ ID NO: 617641 - DNA, 20 bp, mouse
gcttagggaccagacccggg

SEQ ID NO: 617642 - DNA, 20 bp, mouse
ggaacgcaggttccgcggta

SEQ ID NO: 617643 - DNA, 20 bp, mouse
gagtataagcgtgagtcagg

SEQ ID NO: 617644 - DNA, 20 bp, mouse
gacggcgttgaagaggctga

SEQ ID NO: 617645 - DNA, 20 bp, mouse
gggcggggacggcgttgaag

SEQ ID NO: 617646 - DNA, 20 bp, mouse
gggcgcctagagcgaggcta

SEQ ID NO: 617647 - DNA, 20 bp, mouse
gcatcacggcgcctagagcg

SEQ ID NO: 617648 - DNA, 20 bp, mouse
gccctcagatgacgtcacag

SEQ ID NO: 617649 - DNA, 20 bp, mouse
gccgacgactccagctcggt

SEQ ID NO: 617650 - DNA, 20 bp, mouse
gtctaccctagcctcgctct

SEQ ID NO: 617651 - DNA, 20 bp, mouse
ggcactgccccgccgagtgg

SEQ ID NO: 617652 - DNA, 20 bp, mouse
gggcggggcgccggtgggag

SEQ ID NO: 617653 - DNA, 20 bp, mouse
gacctctgtgacgtcatctg

SEQ ID NO: 617654 - DNA, 20 bp, mouse
gtccgaattcccctccatga

SEQ ID NO: 617655 - DNA, 20 bp, mouse
gggaattcggactgcgtgtg

SEQ ID NO: 617656 - DNA, 20 bp, mouse
gacggagcgcaggaccccag

SEQ ID NO: 617657 - DNA, 20 bp, mouse
gcccgaaggccgagactcgg

SEQ ID NO: 617658 - DNA, 20 bp, mouse
gcagttcgccaagagtaggg

SEQ ID NO: 617659 - DNA, 20 bp, mouse
gtgccccgaaggccgagact

SEQ ID NO: 617660 - DNA, 20 bp, mouse
ggagctgggttgcagaggac

SEQ ID NO: 617661 - DNA, 20 bp, mouse
gggaagctcactgggaacgg

SEQ ID NO: 617662 - DNA, 20 bp, mouse
ggaggcgccgagcggagcca

SEQ ID NO: 617663 - DNA, 20 bp, mouse
ggccagcagaagccgcacag

SEQ ID NO: 617664 - DNA, 20 bp, mouse
gaagcaggcggtgccctgaa

SEQ ID NO: 617665 - DNA, 20 bp, mouse
gaccgacggggagagaaatg

SEQ ID NO: 617666 - DNA, 20 bp, mouse
ggctgcggcgccgacgagag

SEQ ID NO: 617667 - DNA, 20 bp, mouse
gttgtagcgggtctccatgg

SEQ ID NO: 617668 - DNA, 20 bp, mouse
gaggttgtagcgggtctcca

SEQ ID NO: 617669 - DNA, 20 bp, mouse
ggccccagcccggctcaccc

SEQ ID NO: 617670 - DNA, 20 bp, mouse
gcgtccgccgcgcgagaccc

SEQ ID NO: 617671 - DNA, 20 bp, mouse
gtccccgctgccgctctcgt

SEQ ID NO: 617672 - DNA, 20 bp, mouse
gcgcgagacccgggcagctg

SEQ ID NO: 617673 - DNA, 20 bp, mouse
ggactgggcggtgtcagcgg

SEQ ID NO: 617674 - DNA, 20 bp, mouse
gtcgctccgcagacaccggg

SEQ ID NO: 617675 - DNA, 20 bp, mouse
gcaggagacagccgagccaa

SEQ ID NO: 617676 - DNA, 20 bp, mouse
gaggctgcttgcggcgggtg

SEQ ID NO: 617677 - DNA, 20 bp, mouse
gcagccggcgacgtaaccaa

SEQ ID NO: 617678 - DNA, 20 bp, mouse
gtgcttgcggcgggtgcggt

SEQ ID NO: 617679 - DNA, 20 bp, mouse
gggacgctcggaagactccg

SEQ ID NO: 617680 - DNA, 20 bp, mouse
gagcagggtgcggaagagtg

SEQ ID NO: 617681 - DNA, 20 bp, mouse
gaccaacgggacccgacgtg

SEQ ID NO: 617682 - DNA, 20 bp, mouse
gacgcggggacgccacacgt

SEQ ID NO: 617683 - DNA, 20 bp, mouse
ggcggcgaggctgcttgcgg

SEQ ID NO: 617684 - DNA, 20 bp, mouse
ggcctaggccgtccccggag

SEQ ID NO: 617685 - DNA, 20 bp, mouse
gccgcacccgcgctgggact

SEQ ID NO: 617686 - DNA, 20 bp, mouse
gacagtgaggaggaacgcga

SEQ ID NO: 617687 - DNA, 20 bp, mouse
gaggaacgcgacggcgaggg

SEQ ID NO: 617688 - DNA, 20 bp, mouse
gaggtgattctacagtgagg

SEQ ID NO: 617689 - DNA, 20 bp, mouse
gaggaggaacgcgacggcga

SEQ ID NO: 617690 - DNA, 20 bp, mouse
gccgcgcccggccaccaaaa

SEQ ID NO: 617691 - DNA, 20 bp, mouse
gatcaagcgggagttcaagg

SEQ ID NO: 617692 - DNA, 20 bp, mouse
gcgcggtgcagcgaatcaag

SEQ ID NO: 617693 - DNA, 20 bp, mouse
gagagacatggccaacatcg

SEQ ID NO: 617694 - DNA, 20 bp, mouse
gtcagctgcgggcagagaca

SEQ ID NO: 617695 - DNA, 20 bp, mouse
gtctgaatcgctgagggagg

SEQ ID NO: 617696 - DNA, 20 bp, mouse
gcgcgtgcggagagatctaa

SEQ ID NO: 617697 - DNA, 20 bp, mouse
gccccgggccgggaccccta

SEQ ID NO: 617698 - DNA, 20 bp, mouse
gggcccggcccacacatcaa

SEQ ID NO: 617699 - DNA, 20 bp, mouse
gtgatccgaagggccggcag

SEQ ID NO: 617700 - DNA, 20 bp, mouse
gtgcatcgcggtaggccagg

SEQ ID NO: 617701 - DNA, 20 bp, mouse
gctgcccaggctgatccgaa

SEQ ID NO: 617702 - DNA, 20 bp, mouse
gtccgaagggccggcagcgg

SEQ ID NO: 617703 - DNA, 20 bp, mouse
ggcgaccgcggcccaggacc

SEQ ID NO: 617704 - DNA, 20 bp, mouse
gcgcaatgagggatgaagaa

SEQ ID NO: 617705 - DNA, 20 bp, mouse
gaccgcggcccaggaccggg

SEQ ID NO: 617706 - DNA, 20 bp, mouse
gggaaagggtcatcctacat

SEQ ID NO: 617707 - DNA, 20 bp, mouse
gcatctcgggttggagcgtg

SEQ ID NO: 617708 - DNA, 20 bp, mouse
gatgatggccagcaagcgag

SEQ ID NO: 617709 - DNA, 20 bp, mouse
gcgcttgctggccatcatct

SEQ ID NO: 617710 - DNA, 20 bp, mouse
gggcgaaagtaagcctatgt

SEQ ID NO: 617711 - DNA, 20 bp, mouse
ggctggccatcatctcgggt

SEQ ID NO: 617712 - DNA, 20 bp, mouse
ggtgtcctgctggaatctgc

SEQ ID NO: 617713 - DNA, 20 bp, mouse
gtcagagagcggtgtcctgc

SEQ ID NO: 617714 - DNA, 20 bp, mouse
gcgcgcgcgcgcgagaagga

SEQ ID NO: 617715 - DNA, 20 bp, mouse
ggggcagggcggaaaggtta

SEQ ID NO: 617716 - DNA, 20 bp, mouse
gagtcggccggcggcaccaa

SEQ ID NO: 617717 - DNA, 20 bp, mouse
gcctagcagagggagcaagt

SEQ ID NO: 617718 - DNA, 20 bp, mouse
gcaggccagagccggactac

SEQ ID NO: 617719 - DNA, 20 bp, mouse
gagccggactacgggagccg

SEQ ID NO: 617720 - DNA, 20 bp, mouse
gcgggtccgaggagcggaag

SEQ ID NO: 617721 - DNA, 20 bp, mouse
gtaccgcagggtaccggtgg

SEQ ID NO: 617722 - DNA, 20 bp, mouse
gggcaggcgcggcttcgatg

SEQ ID NO: 617723 - DNA, 20 bp, mouse
gggcagcagcaagaaggcgt

SEQ ID NO: 617724 - DNA, 20 bp, mouse
gcgcagctccggattcagaa

SEQ ID NO: 617725 - DNA, 20 bp, mouse
gcccaccgcacggcccgcct

SEQ ID NO: 617726 - DNA, 20 bp, mouse
gcactcgagcgtgaggagag

SEQ ID NO: 617727 - DNA, 20 bp, mouse
gacgctcgagtggaagtccc

SEQ ID NO: 617728 - DNA, 20 bp, mouse
gccttagagaggcctctcgg

SEQ ID NO: 617729 - DNA, 20 bp, mouse
ggagaagggtccggcctcgg

SEQ ID NO: 617730 - DNA, 20 bp, mouse
ggaagtcgggcgctgaggag

SEQ ID NO: 617731 - DNA, 20 bp, mouse
gggcatcgcggagaagggtc

SEQ ID NO: 617732 - DNA, 20 bp, mouse
gtccctccgcagcctccgag

SEQ ID NO: 617733 - DNA, 20 bp, mouse
gagtggcccgaagcccgcct

SEQ ID NO: 617734 - DNA, 20 bp, mouse
gaagccgccgaggcccgcac

SEQ ID NO: 617735 - DNA, 20 bp, mouse
gggaccggtgcgggcctcgg

SEQ ID NO: 617736 - DNA, 20 bp, mouse
ggctctgcgcgagtctcggg

SEQ ID NO: 617737 - DNA, 20 bp, mouse
ggactcgcgcagagcagtta

SEQ ID NO: 617738 - DNA, 20 bp, mouse
gtcgcgcagagcagttatgg

SEQ ID NO: 617739 - DNA, 20 bp, mouse
gactgctctgcgcgagtctc

SEQ ID NO: 617740 - DNA, 20 bp, mouse
gtagcggcggcggcagccta

SEQ ID NO: 617741 - DNA, 20 bp, mouse
gggctggtacgcctcatcca

SEQ ID NO: 617742 - DNA, 20 bp, mouse
gctgcgcgagtctcgggcgg

SEQ ID NO: 617743 - DNA, 20 bp, mouse
ggtgcaccgagccgcggtaa

SEQ ID NO: 617744 - DNA, 20 bp, mouse
gcctgaggccgagtccgtag

SEQ ID NO: 617745 - DNA, 20 bp, mouse
gcggccggacaccaggtcgt

SEQ ID NO: 617746 - DNA, 20 bp, mouse
gcaggaagtgcggaccgcgg

SEQ ID NO: 617747 - DNA, 20 bp, mouse
ggaagtgcggaccgcggcgg

SEQ ID NO: 617748 - DNA, 20 bp, mouse
ggatcaggaagtgcggaccg

SEQ ID NO: 617749 - DNA, 20 bp, mouse
ggcgccatcttggcgaaggg

SEQ ID NO: 617750 - DNA, 20 bp, mouse
gcctgtcccggaggtggcgg

SEQ ID NO: 617751 - DNA, 20 bp, mouse
ggagcctccggcctccgctc

SEQ ID NO: 617752 - DNA, 20 bp, mouse
gagggggcctgtcccggagg

SEQ ID NO: 617753 - DNA, 20 bp, mouse
gtcttggcgaaggggggatc

SEQ ID NO: 617754 - DNA, 20 bp, mouse
gcagcaactgggggtccagg

SEQ ID NO: 617755 - DNA, 20 bp, mouse
ggagcggagggggcctgtcc

SEQ ID NO: 617756 - DNA, 20 bp, mouse
gcgggtggagtcggttacaa

SEQ ID NO: 617757 - DNA, 20 bp, mouse
gaggagcgcgaggcctcggc

SEQ ID NO: 617758 - DNA, 20 bp, mouse
gacaaaggcagcagccggcc

SEQ ID NO: 617759 - DNA, 20 bp, mouse
gcgcctcctgcgggtggagt

SEQ ID NO: 617760 - DNA, 20 bp, mouse
gggcgaggagcgcgaggcct

SEQ ID NO: 617761 - DNA, 20 bp, mouse
gggccaccgcctcctgcggg

SEQ ID NO: 617762 - DNA, 20 bp, mouse
ggtggccccgcggcttaaaa

SEQ ID NO: 617763 - DNA, 20 bp, mouse
gaaccgactccacccgcagg

SEQ ID NO: 617764 - DNA, 20 bp, mouse
gcggttacaaaggcagcagc

SEQ ID NO: 617765 - DNA, 20 bp, mouse
ggccgcagtcccgggacaaa

SEQ ID NO: 617766 - DNA, 20 bp, mouse
ggcggcggcggcaacgagag

SEQ ID NO: 617767 - DNA, 20 bp, mouse
gatgtcagcagccgcagcgg

SEQ ID NO: 617768 - DNA, 20 bp, mouse
ggctgctgacattgcagagg

SEQ ID NO: 617769 - DNA, 20 bp, mouse
gccgccagcgcagcacggcc

SEQ ID NO: 617770 - DNA, 20 bp, mouse
gtgcgctggcggctaccgcg

SEQ ID NO: 617771 - DNA, 20 bp, mouse
gacgagagcggcagtggccc

SEQ ID NO: 617772 - DNA, 20 bp, mouse
ggagtctaagagctgcaccg

SEQ ID NO: 617773 - DNA, 20 bp, mouse
gggcagacgaccgcttagtg

SEQ ID NO: 617774 - DNA, 20 bp, mouse
gtgccccggagacagcgagg

SEQ ID NO: 617775 - DNA, 20 bp, mouse
gggccgcgcacaaaggacca

SEQ ID NO: 617776 - DNA, 20 bp, mouse
ggtgcgctggggtctcggga

SEQ ID NO: 617777 - DNA, 20 bp, mouse
ggcccccgcggagaacgaga

SEQ ID NO: 617778 - DNA, 20 bp, mouse
gcgtgagtgaggaggacccc

SEQ ID NO: 617779 - DNA, 20 bp, mouse
gagcgaaggaaggcggcgga

SEQ ID NO: 617780 - DNA, 20 bp, mouse
gcgctggggtctcgggacgg

SEQ ID NO: 617781 - DNA, 20 bp, mouse
gtggggtctcgggacggcgg

SEQ ID NO: 617782 - DNA, 20 bp, mouse
gaagctgggccgagaaaggg

SEQ ID NO: 617783 - DNA, 20 bp, mouse
ggctccgggcctcccccccc

SEQ ID NO: 617784 - DNA, 20 bp, mouse
gcggaggggcgcacgaggga

SEQ ID NO: 617785 - DNA, 20 bp, mouse
ggcccgagtcgtgagtgagg

SEQ ID NO: 617786 - DNA, 20 bp, mouse
gcgcgcggccggttctaccg

SEQ ID NO: 617787 - DNA, 20 bp, mouse
ggaggggccgttggggactc

SEQ ID NO: 617788 - DNA, 20 bp, mouse
gccccggccggctgaagtca

SEQ ID NO: 617789 - DNA, 20 bp, mouse
gcctctgcccgagtccccaa

SEQ ID NO: 617790 - DNA, 20 bp, mouse
ggtgacgcgggaggcccgag

SEQ ID NO: 617791 - DNA, 20 bp, mouse
ggtctgctcctcggtagaac

SEQ ID NO: 617792 - DNA, 20 bp, mouse
gggcagccctcggaaccttg

SEQ ID NO: 617793 - DNA, 20 bp, mouse
gaacgtccggagccaggagt

SEQ ID NO: 617794 - DNA, 20 bp, mouse
ggaggcccgaggggccgttg

SEQ ID NO: 617795 - DNA, 20 bp, mouse
ggccctccccaaggttccga

SEQ ID NO: 617796 - DNA, 20 bp, mouse
gaggcgcgccgcggtaagtg

SEQ ID NO: 617797 - DNA, 20 bp, mouse
ggtgctgcgagtgccacctg

SEQ ID NO: 617798 - DNA, 20 bp, mouse
gtcgggctcgttccctcagg

SEQ ID NO: 617799 - DNA, 20 bp, mouse
gtcagcagccccacttaccg

SEQ ID NO: 617800 - DNA, 20 bp, mouse
gacctcgggctcgttccctc

SEQ ID NO: 617801 - DNA, 20 bp, mouse
ggggaacgagcccgaggtca

SEQ ID NO: 617802 - DNA, 20 bp, mouse
gcgaggtcacggagagtctg

SEQ ID NO: 617803 - DNA, 20 bp, mouse
ggcacagcagaggcgcgccg

SEQ ID NO: 617804 - DNA, 20 bp, mouse
gcaatgcacagaacctgggt

SEQ ID NO: 617805 - DNA, 20 bp, mouse
gagcggccctgggaggaaca

SEQ ID NO: 617806 - DNA, 20 bp, mouse
ggtcaggtagaaagagaact

SEQ ID NO: 617807 - DNA, 20 bp, mouse
gacttcccgaaggaagactg

SEQ ID NO: 617808 - DNA, 20 bp, mouse
ggtgagtaaccgttaaccag

SEQ ID NO: 617809 - DNA, 20 bp, mouse
gcttggccagccaacaactc

SEQ ID NO: 617810 - DNA, 20 bp, mouse
gctttctacctgacaagtaa

SEQ ID NO: 617811 - DNA, 20 bp, mouse
gaacttggcagtgctgcttc

SEQ ID NO: 617812 - DNA, 20 bp, mouse
gaagctgagacagcccagat

SEQ ID NO: 617813 - DNA, 20 bp, mouse
gaaaggctatgttagctcag

SEQ ID NO: 617814 - DNA, 20 bp, mouse
gccagacgggaacttcccga

SEQ ID NO: 617815 - DNA, 20 bp, mouse
gagctttggagtacatactg

SEQ ID NO: 617816 - DNA, 20 bp, mouse
gcgctcacccgagcctgtgg

SEQ ID NO: 617817 - DNA, 20 bp, mouse
gcgcccggagaaaaactcaa

SEQ ID NO: 617818 - DNA, 20 bp, mouse
gcggagaaaaactcaagggg

SEQ ID NO: 617819 - DNA, 20 bp, mouse
gccccgctcacccgagcctg

SEQ ID NO: 617820 - DNA, 20 bp, mouse
gaggcggcggccggaagccc

SEQ ID NO: 617821 - DNA, 20 bp, mouse
gtagaccgggaccaagccca

SEQ ID NO: 617822 - DNA, 20 bp, mouse
gcggcggccggaagcccggg

SEQ ID NO: 617823 - DNA, 20 bp, mouse
gtcccagcgggacctcgccc

SEQ ID NO: 617824 - DNA, 20 bp, mouse
ggtacgcgggcgcaacccta

SEQ ID NO: 617825 - DNA, 20 bp, mouse
gggccgggcctgggaccatc

SEQ ID NO: 617826 - DNA, 20 bp, mouse
gagcgggagcgcggcagacc

SEQ ID NO: 617827 - DNA, 20 bp, mouse
gcccgccggacagaaagcag

SEQ ID NO: 617828 - DNA, 20 bp, mouse
ggagcgcggcagacccggct

SEQ ID NO: 617829 - DNA, 20 bp, mouse
gcgggaggaccggcagatct

SEQ ID NO: 617830 - DNA, 20 bp, mouse
gggcggccctgcgggaggac

SEQ ID NO: 617831 - DNA, 20 bp, mouse
ggacgttgacgccctgcgtg

SEQ ID NO: 617832 - DNA, 20 bp, mouse
ggttgacgccctgcgtgcgg

SEQ ID NO: 617833 - DNA, 20 bp, mouse
ggccgcagcggagccgaggg

SEQ ID NO: 617834 - DNA, 20 bp, mouse
ggctgctgtctggaataaga

SEQ ID NO: 617835 - DNA, 20 bp, mouse
gtccaccctcggctccgctg

SEQ ID NO: 617836 - DNA, 20 bp, mouse
gggagctgctgcagcgggga

SEQ ID NO: 617837 - DNA, 20 bp, mouse
gcggtggccgcggacagtag

SEQ ID NO: 617838 - DNA, 20 bp, mouse
gagcgaggcccgagacgcag

SEQ ID NO: 617839 - DNA, 20 bp, mouse
gcgagggggccatcgagacg

SEQ ID NO: 617840 - DNA, 20 bp, mouse
ggagcggagctgctgcagcg

SEQ ID NO: 617841 - DNA, 20 bp, mouse
gctgggatgcaaggtaccta

SEQ ID NO: 617842 - DNA, 20 bp, mouse
gaggcccgagacgcaggggg

SEQ ID NO: 617843 - DNA, 20 bp, mouse
gtggggggatggtttcatca

SEQ ID NO: 617844 - DNA, 20 bp, mouse
gctccgccagcactgagggt

SEQ ID NO: 617845 - DNA, 20 bp, mouse
gcggcgtgacgcgagcacgg

SEQ ID NO: 617846 - DNA, 20 bp, mouse
gcccggaagcgaagcagcga

SEQ ID NO: 617847 - DNA, 20 bp, mouse
gggaagcgaagcagcgatgg

SEQ ID NO: 617848 - DNA, 20 bp, mouse
ggcggagagtccgactgagg

SEQ ID NO: 617849 - DNA, 20 bp, mouse
gatggcggagagtccgactg

SEQ ID NO: 617850 - DNA, 20 bp, mouse
ggagcagcggccgctctggt

SEQ ID NO: 617851 - DNA, 20 bp, mouse
ggcacgtccgccgaccagag

SEQ ID NO: 617852 - DNA, 20 bp, mouse
gccgctaacgccgaccacac

SEQ ID NO: 617853 - DNA, 20 bp, mouse
gctcggtggtgcgggagcag

SEQ ID NO: 617854 - DNA, 20 bp, mouse
ggaccctgggcccgccgccc

SEQ ID NO: 617855 - DNA, 20 bp, mouse
ggcgggagagagccccgatg

SEQ ID NO: 617856 - DNA, 20 bp, mouse
ggtgactccaggagacgaca

SEQ ID NO: 617857 - DNA, 20 bp, mouse
gagaggagcgccaccatctt

SEQ ID NO: 617858 - DNA, 20 bp, mouse
gctcctggagtcacccaaag

SEQ ID NO: 617859 - DNA, 20 bp, mouse
gcgtatttctcccaagatgg

SEQ ID NO: 617860 - DNA, 20 bp, mouse
ggagcgcaggaggggcgacg

SEQ ID NO: 617861 - DNA, 20 bp, mouse
ggcgatctgtccacagtggg

SEQ ID NO: 617862 - DNA, 20 bp, mouse
gaggtgctggcaaagacgaa

SEQ ID NO: 617863 - DNA, 20 bp, mouse
gagcactggacgagaggact

SEQ ID NO: 617864 - DNA, 20 bp, mouse
gctcctctttgggtgactcc

SEQ ID NO: 617865 - DNA, 20 bp, mouse
ggatctcgcgaacgcagcac

SEQ ID NO: 617866 - DNA, 20 bp, mouse
gccgaggtccgccagccccg

SEQ ID NO: 617867 - DNA, 20 bp, mouse
gaacacccggggcaagatgg

SEQ ID NO: 617868 - DNA, 20 bp, mouse
ggcctcggcacggaaatcaa

SEQ ID NO: 617869 - DNA, 20 bp, mouse
ggttcggagcacaacacccg

SEQ ID NO: 617870 - DNA, 20 bp, mouse
gacggagggaggctatctgg

SEQ ID NO: 617871 - DNA, 20 bp, mouse
gcacaacacccggggcaaga

SEQ ID NO: 617872 - DNA, 20 bp, mouse
gccttagcccgatccccccg

SEQ ID NO: 617873 - DNA, 20 bp, mouse
gcccgtaagccctagatggg

SEQ ID NO: 617874 - DNA, 20 bp, mouse
gccggggcaagatggcggcc

SEQ ID NO: 617875 - DNA, 20 bp, mouse
ggaggcccgacgcctctcac

SEQ ID NO: 617876 - DNA, 20 bp, mouse
ggcgcgccaccgtcaagcga

SEQ ID NO: 617877 - DNA, 20 bp, mouse
ggtgcgggcggtcaccatct

SEQ ID NO: 617878 - DNA, 20 bp, mouse
ggtcaccatcttggtaccta

SEQ ID NO: 617879 - DNA, 20 bp, mouse
gggcgtccctcgcttgacgg

SEQ ID NO: 617880 - DNA, 20 bp, mouse
ggcctgcaccgcgctgccgt

SEQ ID NO: 617881 - DNA, 20 bp, mouse
ggccgcgcagatgggataag

SEQ ID NO: 617882 - DNA, 20 bp, mouse
ggcgcggtgcaggcgcgagt

SEQ ID NO: 617883 - DNA, 20 bp, mouse
ggctgctccgctgtaaggtg

SEQ ID NO: 617884 - DNA, 20 bp, mouse
ggaacgtgcgcggtcatcga

SEQ ID NO: 617885 - DNA, 20 bp, mouse
ggggtctgacagcacccagg

SEQ ID NO: 617886 - DNA, 20 bp, mouse
gctcttaccggagcctgaaa

SEQ ID NO: 617887 - DNA, 20 bp, mouse
gaccggagcctgaaagggca

SEQ ID NO: 617888 - DNA, 20 bp, mouse
gggacgccggagcaccgtaa

SEQ ID NO: 617889 - DNA, 20 bp, mouse
ggtcggaagtaagaaccttt

SEQ ID NO: 617890 - DNA, 20 bp, mouse
gcaggctccggtaagaggca

SEQ ID NO: 617891 - DNA, 20 bp, mouse
ggtaagaggcaaggtataag

SEQ ID NO: 617892 - DNA, 20 bp, mouse
gagggtttccagattagaca

SEQ ID NO: 617893 - DNA, 20 bp, mouse
gcacagctacagcgaccaaa

SEQ ID NO: 617894 - DNA, 20 bp, mouse
gacagggtcgaagttcaaga

SEQ ID NO: 617895 - DNA, 20 bp, mouse
gctaggaaaggcccgagtgt

SEQ ID NO: 617896 - DNA, 20 bp, mouse
gggtaagagtagggttggag

SEQ ID NO: 617897 - DNA, 20 bp, mouse
gattattcatcaaaacaaca

SEQ ID NO: 617898 - DNA, 20 bp, mouse
gaattcttggtggggcgagg

SEQ ID NO: 617899 - DNA, 20 bp, mouse
gtgatgaataattcttggtg

SEQ ID NO: 617900 - DNA, 20 bp, mouse
ggcagagcccagcaccggac

SEQ ID NO: 617901 - DNA, 20 bp, mouse
gtagggtcgccgcgcctcgg

SEQ ID NO: 617902 - DNA, 20 bp, mouse
gggcgaccctacagcagccc

SEQ ID NO: 617903 - DNA, 20 bp, mouse
gcctggagaggaccccatag

SEQ ID NO: 617904 - DNA, 20 bp, mouse
ggagggggtaagagtagggt

SEQ ID NO: 617905 - DNA, 20 bp, mouse
gggactggcgaagccctcgc

SEQ ID NO: 617906 - DNA, 20 bp, mouse
gccgccacactcaccatccg

SEQ ID NO: 617907 - DNA, 20 bp, mouse
ggagccccggatggtgagtg

SEQ ID NO: 617908 - DNA, 20 bp, mouse
ggaggccgaagcagccgtag

SEQ ID NO: 617909 - DNA, 20 bp, mouse
ggtgttgtacacaatcatca

SEQ ID NO: 617910 - DNA, 20 bp, mouse
gcggcccctgcggtcgtggt

SEQ ID NO: 617911 - DNA, 20 bp, mouse
gcccaggcctcggtcagcaa

SEQ ID NO: 617912 - DNA, 20 bp, mouse
ggagccaggcatggacacgg

SEQ ID NO: 617913 - DNA, 20 bp, mouse
gttcttcccggcggcccctg

SEQ ID NO: 617914 - DNA, 20 bp, mouse
gacacccaccacgaccgcag

SEQ ID NO: 617915 - DNA, 20 bp, mouse
gcgtgagcagcccagatagg

SEQ ID NO: 617916 - DNA, 20 bp, mouse
gaggccgacgcacaagatgg

SEQ ID NO: 617917 - DNA, 20 bp, mouse
gctgaggccgacgcacaaga

SEQ ID NO: 617918 - DNA, 20 bp, mouse
gtcagcccgcaacccctatc

SEQ ID NO: 617919 - DNA, 20 bp, mouse
gggcgccgtccgcccgatag

SEQ ID NO: 617920 - DNA, 20 bp, mouse
ggcccgcaacccctatcggg

SEQ ID NO: 617921 - DNA, 20 bp, mouse
gcctgagcgaagcctgtctg

SEQ ID NO: 617922 - DNA, 20 bp, mouse
ggccccaggacggagacagg

SEQ ID NO: 617923 - DNA, 20 bp, mouse
gcctcccaaaccctgaccgg

SEQ ID NO: 617924 - DNA, 20 bp, mouse
gcaaggggaccgccccagga

SEQ ID NO: 617925 - DNA, 20 bp, mouse
ggaggcgggttattgagttg

SEQ ID NO: 617926 - DNA, 20 bp, mouse
ggggctgaggcgatgacagg

SEQ ID NO: 617927 - DNA, 20 bp, mouse
gggctctcgggcaccagcag

SEQ ID NO: 617928 - DNA, 20 bp, mouse
gggcgtgtgggattgagaag

SEQ ID NO: 617929 - DNA, 20 bp, mouse
gtcatcgcctcagcccaaca

SEQ ID NO: 617930 - DNA, 20 bp, mouse
gcctcagcccaacatggcgg

SEQ ID NO: 617931 - DNA, 20 bp, mouse
gaggaggaggcggagagtca

SEQ ID NO: 617932 - DNA, 20 bp, mouse
ggtgtgggattgagaagtgg

SEQ ID NO: 617933 - DNA, 20 bp, mouse
gcggaaggcaggcagcgagg

SEQ ID NO: 617934 - DNA, 20 bp, mouse
gggagagtcagggctctgag

SEQ ID NO: 617935 - DNA, 20 bp, mouse
gaccgagcgcagcgccgggg

SEQ ID NO: 617936 - DNA, 20 bp, mouse
gtccacggcccagtccacta

SEQ ID NO: 617937 - DNA, 20 bp, mouse
ggcgcgcggcaggggaccgt

SEQ ID NO: 617938 - DNA, 20 bp, mouse
ggtcagctgcatggtgtcca

SEQ ID NO: 617939 - DNA, 20 bp, mouse
gcggccaacgcaaacaccaa

SEQ ID NO: 617940 - DNA, 20 bp, mouse
ggcgttggccgtagtggact

SEQ ID NO: 617941 - DNA, 20 bp, mouse
gtgaccgtgaaggcgctcca

SEQ ID NO: 617942 - DNA, 20 bp, mouse
gtgatccggccgaggtggag

SEQ ID NO: 617943 - DNA, 20 bp, mouse
gcggccctggagcgccttca

SEQ ID NO: 617944 - DNA, 20 bp, mouse
ggtgtttgcgttggccgtag

SEQ ID NO: 617945 - DNA, 20 bp, mouse
gaccatgcagctgaccgtga

SEQ ID NO: 617946 - DNA, 20 bp, mouse
gggagttgccctgaaggtgt

SEQ ID NO: 617947 - DNA, 20 bp, mouse
gtgaaggtgtagggcccaat

SEQ ID NO: 617948 - DNA, 20 bp, mouse
gagctagtggctgcccatgt

SEQ ID NO: 617949 - DNA, 20 bp, mouse
ggctctgggagttgccctga

SEQ ID NO: 617950 - DNA, 20 bp, mouse
gtcaggagggatccatgctc

SEQ ID NO: 617951 - DNA, 20 bp, mouse
gttgaccgtgaggaacattg

SEQ ID NO: 617952 - DNA, 20 bp, mouse
gctgtgacagagtcacctat

SEQ ID NO: 617953 - DNA, 20 bp, mouse
gtctgtcacagctcctagta

SEQ ID NO: 617954 - DNA, 20 bp, mouse
ggctgggcccttgccctact

SEQ ID NO: 617955 - DNA, 20 bp, mouse
gctgttccgaggccagctcc

SEQ ID NO: 617956 - DNA, 20 bp, mouse
gtagctcgagcgaggaaccc

SEQ ID NO: 617957 - DNA, 20 bp, mouse
gataggttcgaggatattgg

SEQ ID NO: 617958 - DNA, 20 bp, mouse
gatgagaggcccgagatcac

SEQ ID NO: 617959 - DNA, 20 bp, mouse
gtcgagcgaggaaccccggc

SEQ ID NO: 617960 - DNA, 20 bp, mouse
ggagagctcaacctaggaag

SEQ ID NO: 617961 - DNA, 20 bp, mouse
gccaagacttgggaacctag

SEQ ID NO: 617962 - DNA, 20 bp, mouse
gctgtttgcaggcttaactc

SEQ ID NO: 617963 - DNA, 20 bp, mouse
gtacgagttgtgtcgtcgat

SEQ ID NO: 617964 - DNA, 20 bp, mouse
ggcaggcttaactccggccg

SEQ ID NO: 617965 - DNA, 20 bp, mouse
gtggctggagctacaccagg

SEQ ID NO: 617966 - DNA, 20 bp, mouse
gccagagtgagtgtttacac

SEQ ID NO: 617967 - DNA, 20 bp, mouse
gccccgcgcgcccagggagg

SEQ ID NO: 617968 - DNA, 20 bp, mouse
gccttccgcgggacgggtga

SEQ ID NO: 617969 - DNA, 20 bp, mouse
gtggtcccacgagagaggtg

SEQ ID NO: 617970 - DNA, 20 bp, mouse
gttacaccggcggctcgctg

SEQ ID NO: 617971 - DNA, 20 bp, mouse
ggagtgagtgtttacaccgg

SEQ ID NO: 617972 - DNA, 20 bp, mouse
gagcgccctcacccgtcccg

SEQ ID NO: 617973 - DNA, 20 bp, mouse
gtgcggccgggttccttccg

SEQ ID NO: 617974 - DNA, 20 bp, mouse
ggggcgcgcggggctctcgt

SEQ ID NO: 617975 - DNA, 20 bp, mouse
gggcgctgggccccctccct

SEQ ID NO: 617976 - DNA, 20 bp, mouse
gccggccgcagcggaaccta

SEQ ID NO: 617977 - DNA, 20 bp, mouse
gccgccgcgctccaggtgag

SEQ ID NO: 617978 - DNA, 20 bp, mouse
ggtctccttaggttccgctg

SEQ ID NO: 617979 - DNA, 20 bp, mouse
gcccgggagtatcccaagac

SEQ ID NO: 617980 - DNA, 20 bp, mouse
ggccgcagcgtcgccttcac

SEQ ID NO: 617981 - DNA, 20 bp, mouse
gacgaaaaagccggccgcag

SEQ ID NO: 617982 - DNA, 20 bp, mouse
gtaaggagaccggaagcgag

SEQ ID NO: 617983 - DNA, 20 bp, mouse
gctacagcggacgaaaaagc

SEQ ID NO: 617984 - DNA, 20 bp, mouse
gctccaggtgagaggacgcg

SEQ ID NO: 617985 - DNA, 20 bp, mouse
gcgtcctctcacctggagcg

SEQ ID NO: 617986 - DNA, 20 bp, mouse
ggccgcgccagggtcagtca

SEQ ID NO: 617987 - DNA, 20 bp, mouse
gtcgttgtcacgagccggag

SEQ ID NO: 617988 - DNA, 20 bp, mouse
gccgcggtccaaagcagcgg

SEQ ID NO: 617989 - DNA, 20 bp, mouse
ggcctgcctaacagccgtaa

SEQ ID NO: 617990 - DNA, 20 bp, mouse
ggtcccgggcggataggtgt

SEQ ID NO: 617991 - DNA, 20 bp, mouse
gtagagtcccggaagcgagc

SEQ ID NO: 617992 - DNA, 20 bp, mouse
gcctatccgcccgggacctc

SEQ ID NO: 617993 - DNA, 20 bp, mouse
gcagtctcggtcccagcccg

SEQ ID NO: 617994 - DNA, 20 bp, mouse
gtgtcacgagccggagggga

SEQ ID NO: 617995 - DNA, 20 bp, mouse
gcgtgacaacgaagcatccg

SEQ ID NO: 617996 - DNA, 20 bp, mouse
gggctccaccgccatcgcca

SEQ ID NO: 617997 - DNA, 20 bp, mouse
ggcggcgaccctggcgatgg

SEQ ID NO: 617998 - DNA, 20 bp, mouse
gtgtgggggatccaacatgg

SEQ ID NO: 617999 - DNA, 20 bp, mouse
ggctgcggcgaccctggcga

SEQ ID NO: 618000 - DNA, 20 bp, mouse
gttatgtgggggatccaaca

SEQ ID NO: 618001 - DNA, 20 bp, mouse
ggcgccgagggccagaacag

SEQ ID NO: 618002 - DNA, 20 bp, mouse
gcccgctactacgttctgat

SEQ ID NO: 618003 - DNA, 20 bp, mouse
ggcccatcagaacgtagtag

SEQ ID NO: 618004 - DNA, 20 bp, mouse
gacccggtccgcactcacgg

SEQ ID NO: 618005 - DNA, 20 bp, mouse
gcggcctgcttctatttatg

SEQ ID NO: 618006 - DNA, 20 bp, mouse
gactcacctgaagcccgcga

SEQ ID NO: 618007 - DNA, 20 bp, mouse
ggcggcccgggactggagtt

SEQ ID NO: 618008 - DNA, 20 bp, mouse
gctgtgcattgacttacccg

SEQ ID NO: 618009 - DNA, 20 bp, mouse
gtgcattgacttacccgggg

SEQ ID NO: 618010 - DNA, 20 bp, mouse
gctctcagcatcaccctcta

SEQ ID NO: 618011 - DNA, 20 bp, mouse
ggatgctgagaggtgctccg

SEQ ID NO: 618012 - DNA, 20 bp, mouse
gagggccgctggccggaagt

SEQ ID NO: 618013 - DNA, 20 bp, mouse
gcagcaggcccgggagaacc

SEQ ID NO: 618014 - DNA, 20 bp, mouse
gagctccctaactccagtcc

SEQ ID NO: 618015 - DNA, 20 bp, mouse
gcaacgtaagcggaaggtga

SEQ ID NO: 618016 - DNA, 20 bp, mouse
gcccggacgcagcttcgatg

SEQ ID NO: 618017 - DNA, 20 bp, mouse
gtgcgtccgggccggcggag

SEQ ID NO: 618018 - DNA, 20 bp, mouse
ggcggcgagcgagcccaagc

SEQ ID NO: 618019 - DNA, 20 bp, mouse
ggaagctgcgtccgggccgg

SEQ ID NO: 618020 - DNA, 20 bp, mouse
gacgcgggtgaagcctccgg

SEQ ID NO: 618021 - DNA, 20 bp, mouse
ggacgcggctgagacgagag

SEQ ID NO: 618022 - DNA, 20 bp, mouse
gctccagcgccccttcgccc

SEQ ID NO: 618023 - DNA, 20 bp, mouse
gagctgcggcgggagcgacc

SEQ ID NO: 618024 - DNA, 20 bp, mouse
ggccccagcgcgcatccccc

SEQ ID NO: 618025 - DNA, 20 bp, mouse
gcgaaggggcgctggagcct

SEQ ID NO: 618026 - DNA, 20 bp, mouse
ggagagtccccgcgtccaca

SEQ ID NO: 618027 - DNA, 20 bp, mouse
ggcagccgatcgcccacccg

SEQ ID NO: 618028 - DNA, 20 bp, mouse
gcaggccccgggtgggcgat

SEQ ID NO: 618029 - DNA, 20 bp, mouse
gtggccgagagcgcagagag

SEQ ID NO: 618030 - DNA, 20 bp, mouse
ggccgagggtgcgtggacgc

SEQ ID NO: 618031 - DNA, 20 bp, mouse
ggctggaccgagctgttctc

SEQ ID NO: 618032 - DNA, 20 bp, mouse
gcaggctgcggggccgccga

SEQ ID NO: 618033 - DNA, 20 bp, mouse
gccgagagcgcagagagcgg

SEQ ID NO: 618034 - DNA, 20 bp, mouse
ggcagagcccaagatcatga

SEQ ID NO: 618035 - DNA, 20 bp, mouse
gagctcggtccagcaggtga

SEQ ID NO: 618036 - DNA, 20 bp, mouse
ggcgcgggcagatcacaagg

SEQ ID NO: 618037 - DNA, 20 bp, mouse
gcgggcagatcacaaggcgg

SEQ ID NO: 618038 - DNA, 20 bp, mouse
gtgcgcgcgggcagatcaca

SEQ ID NO: 618039 - DNA, 20 bp, mouse
gcggcgtaggcctcggctga

SEQ ID NO: 618040 - DNA, 20 bp, mouse
gctcggctcggcgtaggcct

SEQ ID NO: 618041 - DNA, 20 bp, mouse
gcggccgccatggctgagaa

SEQ ID NO: 618042 - DNA, 20 bp, mouse
ggcggtgacgcaggctcaca

SEQ ID NO: 618043 - DNA, 20 bp, mouse
gtgacgcaggctcacaggga

SEQ ID NO: 618044 - DNA, 20 bp, mouse
ggagtgcgcagccgacgacc

SEQ ID NO: 618045 - DNA, 20 bp, mouse
gtgcgcactcggctcggcgt

SEQ ID NO: 618046 - DNA, 20 bp, mouse
gtggccccgtccttcctctt

SEQ ID NO: 618047 - DNA, 20 bp, mouse
gctgcctaagaggaaggacg

SEQ ID NO: 618048 - DNA, 20 bp, mouse
ggtggctatacagcaagatg

SEQ ID NO: 618049 - DNA, 20 bp, mouse
gggagggccttggatctaag

SEQ ID NO: 618050 - DNA, 20 bp, mouse
gcagcaagatgagggcagtt

SEQ ID NO: 618051 - DNA, 20 bp, mouse
ggtttggagccctgcctaag

SEQ ID NO: 618052 - DNA, 20 bp, mouse
gtgaatacaggaatagggga

SEQ ID NO: 618053 - DNA, 20 bp, mouse
ggtgaaagggcccaatcagg

SEQ ID NO: 618054 - DNA, 20 bp, mouse
gggacggggccacagcagat

SEQ ID NO: 618055 - DNA, 20 bp, mouse
gccacatggagaggaccact

SEQ ID NO: 618056 - DNA, 20 bp, mouse
gggcatggcggagccgagtg

SEQ ID NO: 618057 - DNA, 20 bp, mouse
ggcctcgtctcagccccact

SEQ ID NO: 618058 - DNA, 20 bp, mouse
gtgacggtgacccgaatctg

SEQ ID NO: 618059 - DNA, 20 bp, mouse
gcggccggggcggaatccag

SEQ ID NO: 618060 - DNA, 20 bp, mouse
ggagcagagagggagacctc

SEQ ID NO: 618061 - DNA, 20 bp, mouse
ggagacgaggccccagattc

SEQ ID NO: 618062 - DNA, 20 bp, mouse
gggccgcccgccagcccgtc

SEQ ID NO: 618063 - DNA, 20 bp, mouse
gcgagggggtcagagcagag

SEQ ID NO: 618064 - DNA, 20 bp, mouse
gacaggcgggagaagcgggt

SEQ ID NO: 618065 - DNA, 20 bp, mouse
ggcggaatccaggggcatac

SEQ ID NO: 618066 - DNA, 20 bp, mouse
gtacagagtggactaagtag

SEQ ID NO: 618067 - DNA, 20 bp, mouse
ggagccacatctggagaatt

SEQ ID NO: 618068 - DNA, 20 bp, mouse
ggtggctactgactcatact

SEQ ID NO: 618069 - DNA, 20 bp, mouse
ggtgatcgagagataatacg

SEQ ID NO: 618070 - DNA, 20 bp, mouse
gtacgcggcatagaccttgt

SEQ ID NO: 618071 - DNA, 20 bp, mouse
gacagctgtcccacccctaa

SEQ ID NO: 618072 - DNA, 20 bp, mouse
gctgctgtatacctgctctg

SEQ ID NO: 618073 - DNA, 20 bp, mouse
gcatctggagaattggggtg

SEQ ID NO: 618074 - DNA, 20 bp, mouse
gggggtgggacagctgtgaa

SEQ ID NO: 618075 - DNA, 20 bp, mouse
gacctgctctggggcatctt

SEQ ID NO: 618076 - DNA, 20 bp, mouse
gtggcggacgaagagatgga

SEQ ID NO: 618077 - DNA, 20 bp, mouse
gaagatggcggacgaagaga

SEQ ID NO: 618078 - DNA, 20 bp, mouse
ggcgttcgtttcccttaaga

SEQ ID NO: 618079 - DNA, 20 bp, mouse
gggctggcaggaatgtgtgt

SEQ ID NO: 618080 - DNA, 20 bp, mouse
gtcttcgtccgccatcttaa

SEQ ID NO: 618081 - DNA, 20 bp, mouse
gatggacggcgccgagagga

SEQ ID NO: 618082 - DNA, 20 bp, mouse
ggccgggggtcgggaactgc

SEQ ID NO: 618083 - DNA, 20 bp, mouse
ggcctcccctggccccgcag

SEQ ID NO: 618084 - DNA, 20 bp, mouse
gttcgtttcccttaagatgg

SEQ ID NO: 618085 - DNA, 20 bp, mouse
gactggggaaggggagtcct

SEQ ID NO: 618086 - DNA, 20 bp, mouse
ggaaggacaccgagaacccc

SEQ ID NO: 618087 - DNA, 20 bp, mouse
ggcgttcaacgccaagagag

SEQ ID NO: 618088 - DNA, 20 bp, mouse
gcctcctcgcccgtgaccgg

SEQ ID NO: 618089 - DNA, 20 bp, mouse
ggagagcacccggggagagg

SEQ ID NO: 618090 - DNA, 20 bp, mouse
gttggcgttgaacgcggtag

SEQ ID NO: 618091 - DNA, 20 bp, mouse
gtgtccggagtgccaggcct

SEQ ID NO: 618092 - DNA, 20 bp, mouse
ggaacgcggtagtggctgtc

SEQ ID NO: 618093 - DNA, 20 bp, mouse
gtgagtgcgggagcccggga

SEQ ID NO: 618094 - DNA, 20 bp, mouse
gacagcggcgagagcacccg

SEQ ID NO: 618095 - DNA, 20 bp, mouse
gaggacaggggtgaccgtcg

SEQ ID NO: 618096 - DNA, 20 bp, mouse
gtgagctctcatcatggcgg

SEQ ID NO: 618097 - DNA, 20 bp, mouse
gaggcacttacaccactcca

SEQ ID NO: 618098 - DNA, 20 bp, mouse
ggggtccccgacggccgccg

SEQ ID NO: 618099 - DNA, 20 bp, mouse
ggctctcatcatggcggcgg

SEQ ID NO: 618100 - DNA, 20 bp, mouse
gagagcggccttcagatgag

SEQ ID NO: 618101 - DNA, 20 bp, mouse
gaccctcccgggaggagccg

SEQ ID NO: 618102 - DNA, 20 bp, mouse
ggcggccttcagatgagcgg

SEQ ID NO: 618103 - DNA, 20 bp, mouse
ggacccgcagccgccccagc

SEQ ID NO: 618104 - DNA, 20 bp, mouse
gtccaccagggcgaccacac

SEQ ID NO: 618105 - DNA, 20 bp, mouse
ggcccctgcgccggcgcctc

SEQ ID NO: 618106 - DNA, 20 bp, mouse
gacgagcggcggcgaagagg

SEQ ID NO: 618107 - DNA, 20 bp, mouse
ggacgaaagatggcgacgag

SEQ ID NO: 618108 - DNA, 20 bp, mouse
ggcgacgagcggcggcgaag

SEQ ID NO: 618109 - DNA, 20 bp, mouse
ggaaagatggcgacgagcgg

SEQ ID NO: 618110 - DNA, 20 bp, mouse
ggtcatcgagaggtaccggg

SEQ ID NO: 618111 - DNA, 20 bp, mouse
gctactgcggctccctccgg

SEQ ID NO: 618112 - DNA, 20 bp, mouse
ggcagtagtacgacgaaaga

SEQ ID NO: 618113 - DNA, 20 bp, mouse
gccggtggcaagcccccgga

SEQ ID NO: 618114 - DNA, 20 bp, mouse
gccgggcaggacacgacccc

SEQ ID NO: 618115 - DNA, 20 bp, mouse
ggagtcccgaaggcatgcgt

SEQ ID NO: 618116 - DNA, 20 bp, mouse
gcggtctacgaagaccaagt

SEQ ID NO: 618117 - DNA, 20 bp, mouse
ggcgtctgggttctggatct

SEQ ID NO: 618118 - DNA, 20 bp, mouse
gtcaatcatggcggtcgcgg

SEQ ID NO: 618119 - DNA, 20 bp, mouse
gggcggtcgcggtggcgtct

SEQ ID NO: 618120 - DNA, 20 bp, mouse
gggtgcttgggcttcaatca

SEQ ID NO: 618121 - DNA, 20 bp, mouse
gctggcggcaggcggtgctt

SEQ ID NO: 618122 - DNA, 20 bp, mouse
ggctgtgctgctcgtccctg

SEQ ID NO: 618123 - DNA, 20 bp, mouse
ggcttcaatcatggcggtcg

SEQ ID NO: 618124 - DNA, 20 bp, mouse
gcgcggtggcgtctgggttc

SEQ ID NO: 618125 - DNA, 20 bp, mouse
gccagactataacttaacgg

SEQ ID NO: 618126 - DNA, 20 bp, mouse
ggcagaagtgaagatggcgg

SEQ ID NO: 618127 - DNA, 20 bp, mouse
gggggcagaagtgaagatgg

SEQ ID NO: 618128 - DNA, 20 bp, mouse
ggctgcgagacggagaaact

SEQ ID NO: 618129 - DNA, 20 bp, mouse
gagcccgcagcgcgcgtcac

SEQ ID NO: 618130 - DNA, 20 bp, mouse
gcggcgcccaggctgcgaga

SEQ ID NO: 618131 - DNA, 20 bp, mouse
gccacggcgcgcacggacga

SEQ ID NO: 618132 - DNA, 20 bp, mouse
ggggtggagaggtgccgggg

SEQ ID NO: 618133 - DNA, 20 bp, mouse
gcccggagcgcggcgagcgg

SEQ ID NO: 618134 - DNA, 20 bp, mouse
gggccggacgacagcgggag

SEQ ID NO: 618135 - DNA, 20 bp, mouse
gcagcgggtggaccacgaaa

SEQ ID NO: 618136 - DNA, 20 bp, mouse
gctccgcctggcactcggtg

SEQ ID NO: 618137 - DNA, 20 bp, mouse
gcggagcccggtgacagttg

SEQ ID NO: 618138 - DNA, 20 bp, mouse
gtccgctgcgtgggcccagg

SEQ ID NO: 618139 - DNA, 20 bp, mouse
gccgcggccgggcccactca

SEQ ID NO: 618140 - DNA, 20 bp, mouse
gggccatcctcaactgtcac

SEQ ID NO: 618141 - DNA, 20 bp, mouse
gcttctcgcgacgcccctgg

SEQ ID NO: 618142 - DNA, 20 bp, mouse
gtggcactcggtggggctct

SEQ ID NO: 618143 - DNA, 20 bp, mouse
gcggccagcgggaaacagac

SEQ ID NO: 618144 - DNA, 20 bp, mouse
gaggcgtgcgccgtcctggg

SEQ ID NO: 618145 - DNA, 20 bp, mouse
gagccccaccgagtgccagg

SEQ ID NO: 618146 - DNA, 20 bp, mouse
gagctcctggatctcccctg

SEQ ID NO: 618147 - DNA, 20 bp, mouse
gtcgggcagagcgctcccca

SEQ ID NO: 618148 - DNA, 20 bp, mouse
gggagcgctctgcccgacgc

SEQ ID NO: 618149 - DNA, 20 bp, mouse
gttgtggcgaagccggcgtc

SEQ ID NO: 618150 - DNA, 20 bp, mouse
ggagcaggtaacgccaggaa

SEQ ID NO: 618151 - DNA, 20 bp, mouse
gcgctccccaggggagatcc

SEQ ID NO: 618152 - DNA, 20 bp, mouse
gactttgcgggccagcggag

SEQ ID NO: 618153 - DNA, 20 bp, mouse
gcacaaactttgcgggccag

SEQ ID NO: 618154 - DNA, 20 bp, mouse
gtggccacctccctctccgc

SEQ ID NO: 618155 - DNA, 20 bp, mouse
gtggctccgagaagccgtgg

SEQ ID NO: 618156 - DNA, 20 bp, mouse
gggccgcggccgccacctca

SEQ ID NO: 618157 - DNA, 20 bp, mouse
gacgcgggagcaggctgagg

SEQ ID NO: 618158 - DNA, 20 bp, mouse
ggcgacgcgggagcaggctg

SEQ ID NO: 618159 - DNA, 20 bp, mouse
gcgggacgagcgccctgagg

SEQ ID NO: 618160 - DNA, 20 bp, mouse
gggccgggacgagcgccctg

SEQ ID NO: 618161 - DNA, 20 bp, mouse
ggacgagcgccctgaggtgg

SEQ ID NO: 618162 - DNA, 20 bp, mouse
ggcccacgcacccgcccatg

SEQ ID NO: 618163 - DNA, 20 bp, mouse
gccgctggaacggcctcgag

SEQ ID NO: 618164 - DNA, 20 bp, mouse
ggcctcaacgagaactcgga

SEQ ID NO: 618165 - DNA, 20 bp, mouse
gggccccacgagccgcaatc

SEQ ID NO: 618166 - DNA, 20 bp, mouse
gcaggagctgccgaccccag

SEQ ID NO: 618167 - DNA, 20 bp, mouse
gtccgcagctgccggcgccc

SEQ ID NO: 618168 - DNA, 20 bp, mouse
gctccagacaaagcccgaga

SEQ ID NO: 618169 - DNA, 20 bp, mouse
gcgctccgcttcgccatctc

SEQ ID NO: 618170 - DNA, 20 bp, mouse
ggtctggagactcgctgccc

SEQ ID NO: 618171 - DNA, 20 bp, mouse
ggcccgggcgccggcagctg

SEQ ID NO: 618172 - DNA, 20 bp, mouse
gcgccaggcagcacggcaag

SEQ ID NO: 618173 - DNA, 20 bp, mouse
gccagcggaagagtcactct

SEQ ID NO: 618174 - DNA, 20 bp, mouse
gccgggggcgccaggcagca

SEQ ID NO: 618175 - DNA, 20 bp, mouse
ggagccggttcaatccagcc

SEQ ID NO: 618176 - DNA, 20 bp, mouse
gaacagcagcttgaactgat

SEQ ID NO: 618177 - DNA, 20 bp, mouse
ggagccaggccgatctaaac

SEQ ID NO: 618178 - DNA, 20 bp, mouse
gatacagattcatcaggctg

SEQ ID NO: 618179 - DNA, 20 bp, mouse
gagcgcagataggcagtcaa

SEQ ID NO: 618180 - DNA, 20 bp, mouse
ggcacagctgaccaaaatcc

SEQ ID NO: 618181 - DNA, 20 bp, mouse
gactttgctccagtttagat

SEQ ID NO: 618182 - DNA, 20 bp, mouse
gtccttgtaaaagcgcagat

SEQ ID NO: 618183 - DNA, 20 bp, mouse
gtgatgtcattagtgcaaac

SEQ ID NO: 618184 - DNA, 20 bp, mouse
gtgacatcacttgataacca

SEQ ID NO: 618185 - DNA, 20 bp, mouse
gcacaaaaataaaatactca

SEQ ID NO: 618186 - DNA, 20 bp, mouse
gttctagactggacattgtg

SEQ ID NO: 618187 - DNA, 20 bp, mouse
gcagccagaaattgtgcagg

SEQ ID NO: 618188 - DNA, 20 bp, mouse
gatccagccagaaattgtgc

SEQ ID NO: 618189 - DNA, 20 bp, mouse
gagaaccgtctcatcaaagt

SEQ ID NO: 618190 - DNA, 20 bp, mouse
ggctcctcctgcacaatttc

SEQ ID NO: 618191 - DNA, 20 bp, mouse
gggtcagcagcaagcgtgaa

SEQ ID NO: 618192 - DNA, 20 bp, mouse
gagaagagagtgttctagac

SEQ ID NO: 618193 - DNA, 20 bp, mouse
gtattctgctagcaaccttc

SEQ ID NO: 618194 - DNA, 20 bp, mouse
gtagcagaatattgactccc

SEQ ID NO: 618195 - DNA, 20 bp, mouse
gtgttcccactttgatgaga

SEQ ID NO: 618196 - DNA, 20 bp, mouse
gtcacggggcgggagaccca

SEQ ID NO: 618197 - DNA, 20 bp, mouse
gggagacccagggacgaggg

SEQ ID NO: 618198 - DNA, 20 bp, mouse
ggcgggagacccagggacga

SEQ ID NO: 618199 - DNA, 20 bp, mouse
gcagcctgcgcggagaaagt

SEQ ID NO: 618200 - DNA, 20 bp, mouse
gaccagaaggaagaccgcaa

SEQ ID NO: 618201 - DNA, 20 bp, mouse
gcccggcgctcgctaactca

SEQ ID NO: 618202 - DNA, 20 bp, mouse
gcgctcgctaactcacgggg

SEQ ID NO: 618203 - DNA, 20 bp, mouse
ggcccgcggcctcccaccac

SEQ ID NO: 618204 - DNA, 20 bp, mouse
gtcgagatgggctttcccag

SEQ ID NO: 618205 - DNA, 20 bp, mouse
ggggggagtagacagtgagt

SEQ ID NO: 618206 - DNA, 20 bp, mouse
gggtcgcagccaggcaccgg

SEQ ID NO: 618207 - DNA, 20 bp, mouse
gcgcagccaggcaccggagg

SEQ ID NO: 618208 - DNA, 20 bp, mouse
gtgggtccccagaaactgag

SEQ ID NO: 618209 - DNA, 20 bp, mouse
ggaggtgagaggcccgctgt

SEQ ID NO: 618210 - DNA, 20 bp, mouse
ggccaggcaccggaggcgga

SEQ ID NO: 618211 - DNA, 20 bp, mouse
ggctggtcgcagccaggcac

SEQ ID NO: 618212 - DNA, 20 bp, mouse
ggagtcggggtcatgtgcag

SEQ ID NO: 618213 - DNA, 20 bp, mouse
gtaagggaatctcctgggag

SEQ ID NO: 618214 - DNA, 20 bp, mouse
ggagtgaagagagagaaccg

SEQ ID NO: 618215 - DNA, 20 bp, mouse
ggtttctggggacccacagc

SEQ ID NO: 618216 - DNA, 20 bp, mouse
gccccgagacaacaagatgg

SEQ ID NO: 618217 - DNA, 20 bp, mouse
ggggccagcgagccgtcccg

SEQ ID NO: 618218 - DNA, 20 bp, mouse
gcggagatggcactcaccac

SEQ ID NO: 618219 - DNA, 20 bp, mouse
gggcctgcgggaagacttag

SEQ ID NO: 618220 - DNA, 20 bp, mouse
ggacaggcggcggaatcctg

SEQ ID NO: 618221 - DNA, 20 bp, mouse
gaccctcggagtcaggacga

SEQ ID NO: 618222 - DNA, 20 bp, mouse
gaggcctgcactctatgtag

SEQ ID NO: 618223 - DNA, 20 bp, mouse
ggtgccaacgtgcccagcaa

SEQ ID NO: 618224 - DNA, 20 bp, mouse
gttagcggggcagaaaggcc

SEQ ID NO: 618225 - DNA, 20 bp, mouse
gaagacttagcggggcagaa

SEQ ID NO: 618226 - DNA, 20 bp, mouse
gcgcgcgccgggcagtctga

SEQ ID NO: 618227 - DNA, 20 bp, mouse
ggaggccggtcagatctgcg

SEQ ID NO: 618228 - DNA, 20 bp, mouse
gctcgccgcgcagatctgac

SEQ ID NO: 618229 - DNA, 20 bp, mouse
ggaggccgctggtcgcgaca

SEQ ID NO: 618230 - DNA, 20 bp, mouse
ggaaaccctgtcgcgaccag

SEQ ID NO: 618231 - DNA, 20 bp, mouse
gcccaggtggcgacttactg

SEQ ID NO: 618232 - DNA, 20 bp, mouse
gcgtcgcaggcgacagccca

SEQ ID NO: 618233 - DNA, 20 bp, mouse
gacagcccagggcgccaccg

SEQ ID NO: 618234 - DNA, 20 bp, mouse
ggaggagcgagcctgactga

SEQ ID NO: 618235 - DNA, 20 bp, mouse
gcggcctccctcagactgcc

SEQ ID NO: 618236 - DNA, 20 bp, mouse
ggccgcaagcgggtgaaaga

SEQ ID NO: 618237 - DNA, 20 bp, mouse
ggcaagcgggtgaaagatgg

SEQ ID NO: 618238 - DNA, 20 bp, mouse
gctgtctccggagaactgga

SEQ ID NO: 618239 - DNA, 20 bp, mouse
ggcgggtgaaagatggcgga

SEQ ID NO: 618240 - DNA, 20 bp, mouse
gccggagacaggctcaggtg

SEQ ID NO: 618241 - DNA, 20 bp, mouse
ggtaccgccgcctgaggcta

SEQ ID NO: 618242 - DNA, 20 bp, mouse
ggagagaccctccagttctc

SEQ ID NO: 618243 - DNA, 20 bp, mouse
ggcaggagcgtgggtcctcc

SEQ ID NO: 618244 - DNA, 20 bp, mouse
ggtaagtcccgcgcacttgg

SEQ ID NO: 618245 - DNA, 20 bp, mouse
gccggggcaggcgccgcaag

SEQ ID NO: 618246 - DNA, 20 bp, mouse
gcctagccgaccaggcaccg

SEQ ID NO: 618247 - DNA, 20 bp, mouse
gtcgcgtctgctaagaggag

SEQ ID NO: 618248 - DNA, 20 bp, mouse
gggagagggcccgagaacgg

SEQ ID NO: 618249 - DNA, 20 bp, mouse
gttcctggagtcggaacccg

SEQ ID NO: 618250 - DNA, 20 bp, mouse
gtcgtggccccggcaaccac

SEQ ID NO: 618251 - DNA, 20 bp, mouse
gtggctgggtcctcagaccg

SEQ ID NO: 618252 - DNA, 20 bp, mouse
gtccgactccaggaagtgga

SEQ ID NO: 618253 - DNA, 20 bp, mouse
gtcgtcgtcacgtgacacag

SEQ ID NO: 618254 - DNA, 20 bp, mouse
ggcgcgccccggtgcctggt

SEQ ID NO: 618255 - DNA, 20 bp, mouse
ggaaggatgactaaccgcta

SEQ ID NO: 618256 - DNA, 20 bp, mouse
gggagcaggcggccaaccac

SEQ ID NO: 618257 - DNA, 20 bp, mouse
gtgtgtggtgtagcacgggt

SEQ ID NO: 618258 - DNA, 20 bp, mouse
gtcctggaagaacttcttca

SEQ ID NO: 618259 - DNA, 20 bp, mouse
gccaaggccacacctttagg

SEQ ID NO: 618260 - DNA, 20 bp, mouse
ggccttggcgaaatgtgggt

SEQ ID NO: 618261 - DNA, 20 bp, mouse
gcaccggaaagaaaatatcg

SEQ ID NO: 618262 - DNA, 20 bp, mouse
gggccggcggttgggtgtca

SEQ ID NO: 618263 - DNA, 20 bp, mouse
gagacagctacaggctacca

SEQ ID NO: 618264 - DNA, 20 bp, mouse
gaccagcgtcacataccctg

SEQ ID NO: 618265 - DNA, 20 bp, mouse
ggctggttgggcgacggaga

SEQ ID NO: 618266 - DNA, 20 bp, mouse
ggacgccgcggagcccccgt

SEQ ID NO: 618267 - DNA, 20 bp, mouse
ggtaagatggctgcccacgg

SEQ ID NO: 618268 - DNA, 20 bp, mouse
ggaggcacaggcgacgacgg

SEQ ID NO: 618269 - DNA, 20 bp, mouse
gccgagtgaggaatgcacca

SEQ ID NO: 618270 - DNA, 20 bp, mouse
gcccagccggtccagtacag

SEQ ID NO: 618271 - DNA, 20 bp, mouse
gtgaggggagagcccgagtg

SEQ ID NO: 618272 - DNA, 20 bp, mouse
ggcggtaagatggctgccca

SEQ ID NO: 618273 - DNA, 20 bp, mouse
gaccgaatccagggactgag

SEQ ID NO: 618274 - DNA, 20 bp, mouse
gttcagcgccgacgacgccg

SEQ ID NO: 618275 - DNA, 20 bp, mouse
gcctgaggcacaggcgacga

SEQ ID NO: 618276 - DNA, 20 bp, mouse
ggagctccagacacaagaga

SEQ ID NO: 618277 - DNA, 20 bp, mouse
gtccgcgccatggcttctcg

SEQ ID NO: 618278 - DNA, 20 bp, mouse
ggccacgagaagccatggcg

SEQ ID NO: 618279 - DNA, 20 bp, mouse
gacgacgccacgagaagcca

SEQ ID NO: 618280 - DNA, 20 bp, mouse
gcggaaggcacggccggaag

SEQ ID NO: 618281 - DNA, 20 bp, mouse
gcagcgagccctccgcgcca

SEQ ID NO: 618282 - DNA, 20 bp, mouse
ggcgggcgcgatggattctg

SEQ ID NO: 618283 - DNA, 20 bp, mouse
gtccagctgggagcaccgag

SEQ ID NO: 618284 - DNA, 20 bp, mouse
gggaggcggttccggaagag

SEQ ID NO: 618285 - DNA, 20 bp, mouse
ggggagcaccgagaggagaa

SEQ ID NO: 618286 - DNA, 20 bp, mouse
gacctgcagacacaaacccg

SEQ ID NO: 618287 - DNA, 20 bp, mouse
gccgatggagattaaccccg

SEQ ID NO: 618288 - DNA, 20 bp, mouse
gggcttcagctgcatcttcg

SEQ ID NO: 618289 - DNA, 20 bp, mouse
gacgatgctcttggaggata

SEQ ID NO: 618290 - DNA, 20 bp, mouse
gtcccctcacggcccaggta

SEQ ID NO: 618291 - DNA, 20 bp, mouse
gtcagctgcatcttcgcgga

SEQ ID NO: 618292 - DNA, 20 bp, mouse
gcttcgcgcgagccacgtgt

SEQ ID NO: 618293 - DNA, 20 bp, mouse
ggacgtgctagggctggagg

SEQ ID NO: 618294 - DNA, 20 bp, mouse
gggtcgcttcgggagaaata

SEQ ID NO: 618295 - DNA, 20 bp, mouse
gcgcggggagcagctctcga

SEQ ID NO: 618296 - DNA, 20 bp, mouse
gagagctggagagcggccgg

SEQ ID NO: 618297 - DNA, 20 bp, mouse
ggtcagagctggagagcggc

SEQ ID NO: 618298 - DNA, 20 bp, mouse
gtggtggcggctgtcagagc

SEQ ID NO: 618299 - DNA, 20 bp, mouse
ggaaggcgggaaggactccg

SEQ ID NO: 618300 - DNA, 20 bp, mouse
gcccggccgcgctcacctca

SEQ ID NO: 618301 - DNA, 20 bp, mouse
ggccgcgctcacctcagggt

SEQ ID NO: 618302 - DNA, 20 bp, mouse
ggggtccgacggagggacag

SEQ ID NO: 618303 - DNA, 20 bp, mouse
gccagggctgagtctccgta

SEQ ID NO: 618304 - DNA, 20 bp, mouse
gtggatccttggggatgcag

SEQ ID NO: 618305 - DNA, 20 bp, mouse
ggagcgcgcgggggcggaag

SEQ ID NO: 618306 - DNA, 20 bp, mouse
gagagctggagagaggccga

SEQ ID NO: 618307 - DNA, 20 bp, mouse
gaacaaggcaaggtcagagc

SEQ ID NO: 618308 - DNA, 20 bp, mouse
gggagtaacactgcgcacac

SEQ ID NO: 618309 - DNA, 20 bp, mouse
gaccttgccttgtttaatat

SEQ ID NO: 618310 - DNA, 20 bp, mouse
gaccaatattaaacaaggca

SEQ ID NO: 618311 - DNA, 20 bp, mouse
ggaagagagagccaaatacc

SEQ ID NO: 618312 - DNA, 20 bp, mouse
gattgcaaacaacaaagaca

SEQ ID NO: 618313 - DNA, 20 bp, mouse
ggtggaacgattggaacgat

SEQ ID NO: 618314 - DNA, 20 bp, mouse
gtcatagttctccaggtatt

SEQ ID NO: 618315 - DNA, 20 bp, mouse
gacaaggtgcactttgaatc

SEQ ID NO: 618316 - DNA, 20 bp, mouse
gaagtaggcggggtgacgtg

SEQ ID NO: 618317 - DNA, 20 bp, mouse
gagagcgcgaggtggaagcg

SEQ ID NO: 618318 - DNA, 20 bp, mouse
gacgtggggttgacgctcgg

SEQ ID NO: 618319 - DNA, 20 bp, mouse
gccgcagcacaagctgccac

SEQ ID NO: 618320 - DNA, 20 bp, mouse
gtccatgagacaccactccc

SEQ ID NO: 618321 - DNA, 20 bp, mouse
gaggattcggtgagcaccag

SEQ ID NO: 618322 - DNA, 20 bp, mouse
ggaggctgtcgggaagtagg

SEQ ID NO: 618323 - DNA, 20 bp, mouse
ggagctcggtgaagaccccg

SEQ ID NO: 618324 - DNA, 20 bp, mouse
gcgacgccgggcgtcggtgg

SEQ ID NO: 618325 - DNA, 20 bp, mouse
gcccaacgcgggcctcctcc

SEQ ID NO: 618326 - DNA, 20 bp, mouse
gactacgtccaggcgggagc

SEQ ID NO: 618327 - DNA, 20 bp, mouse
gtcccgcctggacgtagtga

SEQ ID NO: 618328 - DNA, 20 bp, mouse
ggcaatggcgccccaaccag

SEQ ID NO: 618329 - DNA, 20 bp, mouse
gagcatccgtcactacgtcc

SEQ ID NO: 618330 - DNA, 20 bp, mouse
ggcggttgggccagaggcaa

SEQ ID NO: 618331 - DNA, 20 bp, mouse
gatccgtcactacgtccagg

SEQ ID NO: 618332 - DNA, 20 bp, mouse
ggaagccatatccggagcga

SEQ ID NO: 618333 - DNA, 20 bp, mouse
gctgctagcaacaggtgccg

SEQ ID NO: 618334 - DNA, 20 bp, mouse
ggcgcatgcgctcatgtccc

SEQ ID NO: 618335 - DNA, 20 bp, mouse
gctgttgctagcagctaagg

SEQ ID NO: 618336 - DNA, 20 bp, mouse
gacctccgggaaagccacct

SEQ ID NO: 618337 - DNA, 20 bp, mouse
gaccaccagcagcccaacgg

SEQ ID NO: 618338 - DNA, 20 bp, mouse
ggccgaggtggctttcccgg

SEQ ID NO: 618339 - DNA, 20 bp, mouse
ggagagctctcggcacctcc

SEQ ID NO: 618340 - DNA, 20 bp, mouse
gaaaccccacgggccgccac

SEQ ID NO: 618341 - DNA, 20 bp, mouse
gcgctgctgaggtcgaggct

SEQ ID NO: 618342 - DNA, 20 bp, mouse
gcacgggccgccacgggcac

SEQ ID NO: 618343 - DNA, 20 bp, mouse
gagctctcctgtgcccgtgg

SEQ ID NO: 618344 - DNA, 20 bp, mouse
gcctgggatgtaaaccccac

SEQ ID NO: 618345 - DNA, 20 bp, mouse
gggcagaggtcagcgtgatg

SEQ ID NO: 618346 - DNA, 20 bp, mouse
ggcagactgcaggggcgaag

SEQ ID NO: 618347 - DNA, 20 bp, mouse
ggggccacagcagactgcag

SEQ ID NO: 618348 - DNA, 20 bp, mouse
gtcccggcatctccatagat

SEQ ID NO: 618349 - DNA, 20 bp, mouse
gctggcggccaggcacgtct

SEQ ID NO: 618350 - DNA, 20 bp, mouse
ggaaggggcggcgctcattg

SEQ ID NO: 618351 - DNA, 20 bp, mouse
gcgccaggttcgggacgcca

SEQ ID NO: 618352 - DNA, 20 bp, mouse
ggagatgccgggagccgtcc

SEQ ID NO: 618353 - DNA, 20 bp, mouse
gcggcgctcattgaggccgg

SEQ ID NO: 618354 - DNA, 20 bp, mouse
ggggcggcgctcattgaggc

SEQ ID NO: 618355 - DNA, 20 bp, mouse
gtctcttcctagagccggga

SEQ ID NO: 618356 - DNA, 20 bp, mouse
ggagcacccccagaaaccac

SEQ ID NO: 618357 - DNA, 20 bp, mouse
gcaggacagataataaggtg

SEQ ID NO: 618358 - DNA, 20 bp, mouse
gggcagctgcttcagagtac

SEQ ID NO: 618359 - DNA, 20 bp, mouse
gcaggtggcataggtaggag

SEQ ID NO: 618360 - DNA, 20 bp, mouse
gtatgggagggtcaaagggt

SEQ ID NO: 618361 - DNA, 20 bp, mouse
gacttctgagtcaggcagac

SEQ ID NO: 618362 - DNA, 20 bp, mouse
ggctcctgtgtagtgagtat

SEQ ID NO: 618363 - DNA, 20 bp, mouse
gcctgtagcactgtagggta

SEQ ID NO: 618364 - DNA, 20 bp, mouse
gaagtcctcacttctgagtc

SEQ ID NO: 618365 - DNA, 20 bp, mouse
gttgttcaggtggcataggt

SEQ ID NO: 618366 - DNA, 20 bp, mouse
ggtgtctgcccagtgcaaga

SEQ ID NO: 618367 - DNA, 20 bp, mouse
gacagaccccgtgctcccca

SEQ ID NO: 618368 - DNA, 20 bp, mouse
gagctggagggtctcggcag

SEQ ID NO: 618369 - DNA, 20 bp, mouse
gcacagcgcctagggctggt

SEQ ID NO: 618370 - DNA, 20 bp, mouse
ggcctgccctggacacacag

SEQ ID NO: 618371 - DNA, 20 bp, mouse
gtggagctccatcttgcact

SEQ ID NO: 618372 - DNA, 20 bp, mouse
gccactctgtccccggggac

SEQ ID NO: 618373 - DNA, 20 bp, mouse
ggcggcaccatgatacagag

SEQ ID NO: 618374 - DNA, 20 bp, mouse
ggcgtcttcagcccgtcccc

SEQ ID NO: 618375 - DNA, 20 bp, mouse
gggcaacagctggagggtct

SEQ ID NO: 618376 - DNA, 20 bp, mouse
gtcccacatgatgaccaggt

SEQ ID NO: 618377 - DNA, 20 bp, mouse
ggcccacctggtcatcatgt

SEQ ID NO: 618378 - DNA, 20 bp, mouse
ggacacgggtgtctaggtaa

SEQ ID NO: 618379 - DNA, 20 bp, mouse
gtctcagcggcggccaacat

SEQ ID NO: 618380 - DNA, 20 bp, mouse
gggtggggataggagttcct

SEQ ID NO: 618381 - DNA, 20 bp, mouse
gaggagttcctgggacaaat

SEQ ID NO: 618382 - DNA, 20 bp, mouse
gcgtggtcctgatgttggat

SEQ ID NO: 618383 - DNA, 20 bp, mouse
ggccttcccacatgatgacc

SEQ ID NO: 618384 - DNA, 20 bp, mouse
gctccagagagttctgaggg

SEQ ID NO: 618385 - DNA, 20 bp, mouse
ggaagctgagggtcctgtgg

SEQ ID NO: 618386 - DNA, 20 bp, mouse
gtgtaaaagtggcagatcac

SEQ ID NO: 618387 - DNA, 20 bp, mouse
gctaatgtagacactacatc

SEQ ID NO: 618388 - DNA, 20 bp, mouse
gtggaaatgctcaggtcgag

SEQ ID NO: 618389 - DNA, 20 bp, mouse
gacatatatgcacaggggag

SEQ ID NO: 618390 - DNA, 20 bp, mouse
gtggagcggtttccatagag

SEQ ID NO: 618391 - DNA, 20 bp, mouse
gctgtgatcgttcctctcta

SEQ ID NO: 618392 - DNA, 20 bp, mouse
gctctggtactgattgtagt

SEQ ID NO: 618393 - DNA, 20 bp, mouse
ggttcccggtgggaactcat

SEQ ID NO: 618394 - DNA, 20 bp, mouse
gagtggactttgctctggag

SEQ ID NO: 618395 - DNA, 20 bp, mouse
gaccagggagaaattattca

SEQ ID NO: 618396 - DNA, 20 bp, mouse
ggcgctgtggagcagctcaa

SEQ ID NO: 618397 - DNA, 20 bp, mouse
gcctgcccgagcaagaggaa

SEQ ID NO: 618398 - DNA, 20 bp, mouse
gctaggtagtgccagtgcag

SEQ ID NO: 618399 - DNA, 20 bp, mouse
gcagaagtgccgggcaatct

SEQ ID NO: 618400 - DNA, 20 bp, mouse
gcagtgcagaggcggcgctg

SEQ ID NO: 618401 - DNA, 20 bp, mouse
gtcctccctgcccgagcaag

SEQ ID NO: 618402 - DNA, 20 bp, mouse
gtcagccctgaagacaacag

SEQ ID NO: 618403 - DNA, 20 bp, mouse
gccgggcaatctgggcttaa

SEQ ID NO: 618404 - DNA, 20 bp, mouse
ggtcagggcgcagaagtgcc

SEQ ID NO: 618405 - DNA, 20 bp, mouse
gtggcactacctagcccagg

SEQ ID NO: 618406 - DNA, 20 bp, mouse
gtccgacggcgggagagtgg

SEQ ID NO: 618407 - DNA, 20 bp, mouse
gggcgacccgacgacaccga

SEQ ID NO: 618408 - DNA, 20 bp, mouse
ggtcgggtcgccagcttcct

SEQ ID NO: 618409 - DNA, 20 bp, mouse
gccggaccgcaggagaacac

SEQ ID NO: 618410 - DNA, 20 bp, mouse
ggacccgacgacaccgaggg

SEQ ID NO: 618411 - DNA, 20 bp, mouse
gagaaggctgtgtccgacgg

SEQ ID NO: 618412 - DNA, 20 bp, mouse
ggtgtccgacggcgggagag

SEQ ID NO: 618413 - DNA, 20 bp, mouse
gttccgccctcggtgtcgtc

SEQ ID NO: 618414 - DNA, 20 bp, mouse
gggtcaggctgggaacatcg

SEQ ID NO: 618415 - DNA, 20 bp, mouse
gtgcggccagcgaagggatg

SEQ ID NO: 618416 - DNA, 20 bp, mouse
gtctcgtgcaatggtcttgt

SEQ ID NO: 618417 - DNA, 20 bp, mouse
gctcaggcccgggctggtgg

SEQ ID NO: 618418 - DNA, 20 bp, mouse
gcgcttccaggctcaggccc

SEQ ID NO: 618419 - DNA, 20 bp, mouse
ggtaggcttcgacagtgctc

SEQ ID NO: 618420 - DNA, 20 bp, mouse
ggaccattgcacgagaggaa

SEQ ID NO: 618421 - DNA, 20 bp, mouse
gtgcacgagaggaagggatc

SEQ ID NO: 618422 - DNA, 20 bp, mouse
ggccccctaccagcttgaag

SEQ ID NO: 618423 - DNA, 20 bp, mouse
gaccagcccgggcctgagcc

SEQ ID NO: 618424 - DNA, 20 bp, mouse
ggtatctttgatgaggtcat

SEQ ID NO: 618425 - DNA, 20 bp, mouse
gacagctagactctcttagg

SEQ ID NO: 618426 - DNA, 20 bp, mouse
ggtagtgcagggccacccta

SEQ ID NO: 618427 - DNA, 20 bp, mouse
gcctaaggctccactccatt

SEQ ID NO: 618428 - DNA, 20 bp, mouse
gctgctgctacctaatggag

SEQ ID NO: 618429 - DNA, 20 bp, mouse
ggagacaacagtgaatggtg

SEQ ID NO: 618430 - DNA, 20 bp, mouse
gagatcctgctgctacctaa

SEQ ID NO: 618431 - DNA, 20 bp, mouse
gagcagcaggatctgacggc

SEQ ID NO: 618432 - DNA, 20 bp, mouse
ggccctgcactacccaacct

SEQ ID NO: 618433 - DNA, 20 bp, mouse
gtgtgcgtctagccaaggtt

SEQ ID NO: 618434 - DNA, 20 bp, mouse
ggccaaggttgggtagtgca

SEQ ID NO: 618435 - DNA, 20 bp, mouse
gtactaggtgggagctagac

SEQ ID NO: 618436 - DNA, 20 bp, mouse
gaaggtgcaggcaggtcggg

SEQ ID NO: 618437 - DNA, 20 bp, mouse
gcctgggaaagagtatgtat

SEQ ID NO: 618438 - DNA, 20 bp, mouse
gggagtgactcattcaaggg

SEQ ID NO: 618439 - DNA, 20 bp, mouse
gtcagcaggggcgcgttctt

SEQ ID NO: 618440 - DNA, 20 bp, mouse
ggcgagtgcaggcctggaca

SEQ ID NO: 618441 - DNA, 20 bp, mouse
gtgctaggcaaggtgcaggc

SEQ ID NO: 618442 - DNA, 20 bp, mouse
ggcgcagtgacgagaatgct

SEQ ID NO: 618443 - DNA, 20 bp, mouse
ggaccacagtgctagatgag

SEQ ID NO: 618444 - DNA, 20 bp, mouse
ggaggaagcacggcggagaa

SEQ ID NO: 618445 - DNA, 20 bp, mouse
gagcactgtggtcacattgt

SEQ ID NO: 618446 - DNA, 20 bp, mouse
ggctccctggtccaagatgg

SEQ ID NO: 618447 - DNA, 20 bp, mouse
gggcggacgaggccactcgg

SEQ ID NO: 618448 - DNA, 20 bp, mouse
gcctgctccctggtccaaga

SEQ ID NO: 618449 - DNA, 20 bp, mouse
gtccggctaggagcacagta

SEQ ID NO: 618450 - DNA, 20 bp, mouse
gtcagacacgacccgccgag

SEQ ID NO: 618451 - DNA, 20 bp, mouse
gcgggtcgtgtctgagatcc

SEQ ID NO: 618452 - DNA, 20 bp, mouse
gcgtccgccatcttggacca

SEQ ID NO: 618453 - DNA, 20 bp, mouse
gcgatctcggggtccggcgt

SEQ ID NO: 618454 - DNA, 20 bp, mouse
ggatggcggacgaggccact

SEQ ID NO: 618455 - DNA, 20 bp, mouse
ggcttgaccgcgtagcagag

SEQ ID NO: 618456 - DNA, 20 bp, mouse
gagtggcctggactgcaaag

SEQ ID NO: 618457 - DNA, 20 bp, mouse
gtacggaggcctgaagtcag

SEQ ID NO: 618458 - DNA, 20 bp, mouse
gagaggctcgccggaagtga

SEQ ID NO: 618459 - DNA, 20 bp, mouse
gtttctgggtttcagagcag

SEQ ID NO: 618460 - DNA, 20 bp, mouse
gagctctcgggacagtgtcg

SEQ ID NO: 618461 - DNA, 20 bp, mouse
ggacgcaggcccgggtgact

SEQ ID NO: 618462 - DNA, 20 bp, mouse
gacttccggcgagcctctcg

SEQ ID NO: 618463 - DNA, 20 bp, mouse
ggagagcttctgtcccaagt

SEQ ID NO: 618464 - DNA, 20 bp, mouse
gcggaggtgccgagtcaccc

SEQ ID NO: 618465 - DNA, 20 bp, mouse
ggtaattatgggtcccactt

SEQ ID NO: 618466 - DNA, 20 bp, mouse
gagccgccggatctcctccc

SEQ ID NO: 618467 - DNA, 20 bp, mouse
ggcgagcggagcagtgatgg

SEQ ID NO: 618468 - DNA, 20 bp, mouse
gtcgccccgacacagggaaa

SEQ ID NO: 618469 - DNA, 20 bp, mouse
gggggcgagcggagcagtga

SEQ ID NO: 618470 - DNA, 20 bp, mouse
ggaagtcagccgccagccgc

SEQ ID NO: 618471 - DNA, 20 bp, mouse
ggacagccgccgcagcagac

SEQ ID NO: 618472 - DNA, 20 bp, mouse
ggctggcggctgacttccag

SEQ ID NO: 618473 - DNA, 20 bp, mouse
gctgcggcggctgtcggtag

SEQ ID NO: 618474 - DNA, 20 bp, mouse
ggaggagatccggcggctgg

SEQ ID NO: 618475 - DNA, 20 bp, mouse
ggcagtgatggcggacgcct

SEQ ID NO: 618476 - DNA, 20 bp, mouse
gacagggacggatacttaca

SEQ ID NO: 618477 - DNA, 20 bp, mouse
ggggacggatacttacatgg

SEQ ID NO: 618478 - DNA, 20 bp, mouse
ggggttaaggccgggacaca

SEQ ID NO: 618479 - DNA, 20 bp, mouse
gccctcgcaacgctctgggt

SEQ ID NO: 618480 - DNA, 20 bp, mouse
gatcaaggaagcgcggcggg

SEQ ID NO: 618481 - DNA, 20 bp, mouse
gcccccgctgccggccatca

SEQ ID NO: 618482 - DNA, 20 bp, mouse
gggccatcaaggaagcgcgg

SEQ ID NO: 618483 - DNA, 20 bp, mouse
ggggcctggcgggacagagg

SEQ ID NO: 618484 - DNA, 20 bp, mouse
gcctgccggagagaacgaga

SEQ ID NO: 618485 - DNA, 20 bp, mouse
gccgcgctggagggcgacgt

SEQ ID NO: 618486 - DNA, 20 bp, mouse
ggactagctacgggcagtgt

SEQ ID NO: 618487 - DNA, 20 bp, mouse
gcagtgtgggcacgtagaac

SEQ ID NO: 618488 - DNA, 20 bp, mouse
gcagcaagcaggctagcggc

SEQ ID NO: 618489 - DNA, 20 bp, mouse
gcctgagaggagggccagtc

SEQ ID NO: 618490 - DNA, 20 bp, mouse
ggtcgggcgggatcatggca

SEQ ID NO: 618491 - DNA, 20 bp, mouse
gcggagaactctcagcaagc

SEQ ID NO: 618492 - DNA, 20 bp, mouse
gggccagtcgggcgggatca

SEQ ID NO: 618493 - DNA, 20 bp, mouse
gtccacaggcagacgaatta

SEQ ID NO: 618494 - DNA, 20 bp, mouse
gggtagagcagctgtcatcg

SEQ ID NO: 618495 - DNA, 20 bp, mouse
gaattaaggagccttctaaa

SEQ ID NO: 618496 - DNA, 20 bp, mouse
gtaccaagcaccactggcga

SEQ ID NO: 618497 - DNA, 20 bp, mouse
gcctaggggtaaatacgggg

SEQ ID NO: 618498 - DNA, 20 bp, mouse
ggtgcaagcaagggtcgtcc

SEQ ID NO: 618499 - DNA, 20 bp, mouse
ggtgttcttgccatcgccag

SEQ ID NO: 618500 - DNA, 20 bp, mouse
gacccttgcttgcacgaagt

SEQ ID NO: 618501 - DNA, 20 bp, mouse
gagtcctaggggtaaatacg

SEQ ID NO: 618502 - DNA, 20 bp, mouse
gacctacttcgtgcaagcaa

SEQ ID NO: 618503 - DNA, 20 bp, mouse
gacggttgacgaagtcctag

SEQ ID NO: 618504 - DNA, 20 bp, mouse
gcctgagaggccaaaagtcg

SEQ ID NO: 618505 - DNA, 20 bp, mouse
gcaagatgcactgactgacc

SEQ ID NO: 618506 - DNA, 20 bp, mouse
ggcgggcgtgaggacggaag

SEQ ID NO: 618507 - DNA, 20 bp, mouse
ggcgggccgcgagtggaagg

SEQ ID NO: 618508 - DNA, 20 bp, mouse
ggcccgcgccccgcacccgg

SEQ ID NO: 618509 - DNA, 20 bp, mouse
gcggcgagcgaaagggacga

SEQ ID NO: 618510 - DNA, 20 bp, mouse
ggcgtgaggacggaaggggc

SEQ ID NO: 618511 - DNA, 20 bp, mouse
ggggagaggaagggccggcg

SEQ ID NO: 618512 - DNA, 20 bp, mouse
gcctcggggacgagctggac

SEQ ID NO: 618513 - DNA, 20 bp, mouse
gcccgcggcagcgctgtccg

SEQ ID NO: 618514 - DNA, 20 bp, mouse
gcaggcgtgtgtgcggtgga

SEQ ID NO: 618515 - DNA, 20 bp, mouse
gggactggcaggcgtgtgtg

SEQ ID NO: 618516 - DNA, 20 bp, mouse
ggagcggtgggtagagcctg

SEQ ID NO: 618517 - DNA, 20 bp, mouse
ggtagagcctgcggcttggg

SEQ ID NO: 618518 - DNA, 20 bp, mouse
gaaggcgctgtccgagagaa

SEQ ID NO: 618519 - DNA, 20 bp, mouse
gcacctgggccgcgaggagg

SEQ ID NO: 618520 - DNA, 20 bp, mouse
gcgagagaacgggatctgca

SEQ ID NO: 618521 - DNA, 20 bp, mouse
gtgggtagagcctgcggctt

SEQ ID NO: 618522 - DNA, 20 bp, mouse
gtctcgccgggcccgaaaaa

SEQ ID NO: 618523 - DNA, 20 bp, mouse
gccggggactcggggagcgg

SEQ ID NO: 618524 - DNA, 20 bp, mouse
gtgggtccagaaggaaatag

SEQ ID NO: 618525 - DNA, 20 bp, mouse
gaagcgtccattaggcccca

SEQ ID NO: 618526 - DNA, 20 bp, mouse
gctaggaagcggaagtgcag

SEQ ID NO: 618527 - DNA, 20 bp, mouse
ggaaaccggcttgtgaggag

SEQ ID NO: 618528 - DNA, 20 bp, mouse
ggcgcgtgtcggcttctcac

SEQ ID NO: 618529 - DNA, 20 bp, mouse
ggcgctcgtggagagaacac

SEQ ID NO: 618530 - DNA, 20 bp, mouse
ggtcgttgcagacaccggag

SEQ ID NO: 618531 - DNA, 20 bp, mouse
gcggcgggaaaggcgcgtgt

SEQ ID NO: 618532 - DNA, 20 bp, mouse
ggggtgacaggtaccttggg

SEQ ID NO: 618533 - DNA, 20 bp, mouse
ggcagcggcgatcgccgggg

SEQ ID NO: 618534 - DNA, 20 bp, mouse
gtcttctggggacagagtgg

SEQ ID NO: 618535 - DNA, 20 bp, mouse
gttgtgaggagcggcgggaa

SEQ ID NO: 618536 - DNA, 20 bp, mouse
gccgcaccaaggcacgccga

SEQ ID NO: 618537 - DNA, 20 bp, mouse
gagcgcgagacgccacgcta

SEQ ID NO: 618538 - DNA, 20 bp, mouse
ggtggctctggcccgcacca

SEQ ID NO: 618539 - DNA, 20 bp, mouse
gtccccccaccggaagtgga

SEQ ID NO: 618540 - DNA, 20 bp, mouse
gtggacggcggagcaccggg

SEQ ID NO: 618541 - DNA, 20 bp, mouse
gtgcgggccagagccacgaa

SEQ ID NO: 618542 - DNA, 20 bp, mouse
gggaggaccagaccgtagcg

SEQ ID NO: 618543 - DNA, 20 bp, mouse
gccccaccggaagtggacgg

SEQ ID NO: 618544 - DNA, 20 bp, mouse
ggagacgccacgctacggtc

SEQ ID NO: 618545 - DNA, 20 bp, mouse
gtggcgtctcgcgcttccct

SEQ ID NO: 618546 - DNA, 20 bp, mouse
gcagcttgggagggaactcc

SEQ ID NO: 618547 - DNA, 20 bp, mouse
gggaccgactcagcttggga

SEQ ID NO: 618548 - DNA, 20 bp, mouse
gggtgggaccgactcagctt

SEQ ID NO: 618549 - DNA, 20 bp, mouse
ggtctccagtcgtcccctgt

SEQ ID NO: 618550 - DNA, 20 bp, mouse
gtgaagacggaaaacttggt

SEQ ID NO: 618551 - DNA, 20 bp, mouse
ggttccctcccaagctgagt

SEQ ID NO: 618552 - DNA, 20 bp, mouse
gggagcaggaccccacaagg

SEQ ID NO: 618553 - DNA, 20 bp, mouse
gaggtgtgtggcgaaagtgg

SEQ ID NO: 618554 - DNA, 20 bp, mouse
gagcgatcccgacaccaaca

SEQ ID NO: 618555 - DNA, 20 bp, mouse
gatcctgaagacggaaaact

SEQ ID NO: 618556 - DNA, 20 bp, mouse
ggccagcttgagtagatctc

SEQ ID NO: 618557 - DNA, 20 bp, mouse
gctccagcacaccacagtca

SEQ ID NO: 618558 - DNA, 20 bp, mouse
gacacacacaacagaaggta

SEQ ID NO: 618559 - DNA, 20 bp, mouse
gcagccagctaggagcatac

SEQ ID NO: 618560 - DNA, 20 bp, mouse
gactaacagcctcccagcgt

SEQ ID NO: 618561 - DNA, 20 bp, mouse
gctcccagcgtgggatgcag

SEQ ID NO: 618562 - DNA, 20 bp, mouse
gagctggctcatgacacacg

SEQ ID NO: 618563 - DNA, 20 bp, mouse
gccagtggcttccatccata

SEQ ID NO: 618564 - DNA, 20 bp, mouse
gaggctgttagtgttcccta

SEQ ID NO: 618565 - DNA, 20 bp, mouse
ggccagagatctactcaagc

SEQ ID NO: 618566 - DNA, 20 bp, mouse
gagagctggtttaaaagtag

SEQ ID NO: 618567 - DNA, 20 bp, mouse
gctggactttgaatttacca

SEQ ID NO: 618568 - DNA, 20 bp, mouse
gagcttacagtaaaagcgac

SEQ ID NO: 618569 - DNA, 20 bp, mouse
gtgtacagtgaagacttact

SEQ ID NO: 618570 - DNA, 20 bp, mouse
gactaatgttttcacactct

SEQ ID NO: 618571 - DNA, 20 bp, mouse
gagaggaagagaggtgggaa

SEQ ID NO: 618572 - DNA, 20 bp, mouse
gcacacagaggaagagaggt

SEQ ID NO: 618573 - DNA, 20 bp, mouse
gggaaaggctgcaggaacca

SEQ ID NO: 618574 - DNA, 20 bp, mouse
gaaaagcgactggattgctc

SEQ ID NO: 618575 - DNA, 20 bp, mouse
gctgtgtgtgtgtctgctcc

SEQ ID NO: 618576 - DNA, 20 bp, mouse
ggccctgagattcctcgaag

SEQ ID NO: 618577 - DNA, 20 bp, mouse
ggccccttcgaggaatctca

SEQ ID NO: 618578 - DNA, 20 bp, mouse
gaggtgactgtgcacatcaa

SEQ ID NO: 618579 - DNA, 20 bp, mouse
ggactatgtgtgccccttcg

SEQ ID NO: 618580 - DNA, 20 bp, mouse
gtcttccttggtatatggaa

SEQ ID NO: 618581 - DNA, 20 bp, mouse
gacccatggagggcagccag

SEQ ID NO: 618582 - DNA, 20 bp, mouse
ggccactggctgccctccat

SEQ ID NO: 618583 - DNA, 20 bp, mouse
gcctacagccctcagcattc

SEQ ID NO: 618584 - DNA, 20 bp, mouse
gtgctggtgttacccatgga

SEQ ID NO: 618585 - DNA, 20 bp, mouse
gctgttctcctgaatgctga

SEQ ID NO: 618586 - DNA, 20 bp, mouse
ggccccactaatccttgtag

SEQ ID NO: 618587 - DNA, 20 bp, mouse
ggcccctacaaggattagtg

SEQ ID NO: 618588 - DNA, 20 bp, mouse
ggactccgcatgcccctaca

SEQ ID NO: 618589 - DNA, 20 bp, mouse
gcatccactgaagtgactat

SEQ ID NO: 618590 - DNA, 20 bp, mouse
gagtcccatagtcacttcag

SEQ ID NO: 618591 - DNA, 20 bp, mouse
ggtggatgcgcagaagagtc

SEQ ID NO: 618592 - DNA, 20 bp, mouse
gtcaccttcagtccaaggca

SEQ ID NO: 618593 - DNA, 20 bp, mouse
gtaatccttgtaggggcatg

SEQ ID NO: 618594 - DNA, 20 bp, mouse
gtaagagtcataccctgctg

SEQ ID NO: 618595 - DNA, 20 bp, mouse
ggagtcaggtttcctcagca

SEQ ID NO: 618596 - DNA, 20 bp, mouse
gacactcagtgactgacctc

SEQ ID NO: 618597 - DNA, 20 bp, mouse
gggaggcaccgggaagaaag

SEQ ID NO: 618598 - DNA, 20 bp, mouse
ggtgtgtgtgggggtagctg

SEQ ID NO: 618599 - DNA, 20 bp, mouse
gaggaacaacatgattgtcg

SEQ ID NO: 618600 - DNA, 20 bp, mouse
gggacccatcagggaggcac

SEQ ID NO: 618601 - DNA, 20 bp, mouse
gagaaagtggttgtttccaa

SEQ ID NO: 618602 - DNA, 20 bp, mouse
gttcccggtgcctccctgat

SEQ ID NO: 618603 - DNA, 20 bp, mouse
ggaacgaggacatgacatta

SEQ ID NO: 618604 - DNA, 20 bp, mouse
ggaaacaaccactttcttcc

SEQ ID NO: 618605 - DNA, 20 bp, mouse
gagaaaggcagggagtcctg

SEQ ID NO: 618606 - DNA, 20 bp, mouse
gtccctctttggtggtggtt

SEQ ID NO: 618607 - DNA, 20 bp, mouse
gttcagatgctggctgatgg

SEQ ID NO: 618608 - DNA, 20 bp, mouse
gtgagcaagagtaagaaatc

SEQ ID NO: 618609 - DNA, 20 bp, mouse
ggagtaagaaatctggaagt

SEQ ID NO: 618610 - DNA, 20 bp, mouse
gctcatcacgtgctacctag

SEQ ID NO: 618611 - DNA, 20 bp, mouse
ggaattcagatgctggctga

SEQ ID NO: 618612 - DNA, 20 bp, mouse
gctggctgatggtggctgac

SEQ ID NO: 618613 - DNA, 20 bp, mouse
ggctttgagattagagggaa

SEQ ID NO: 618614 - DNA, 20 bp, mouse
gcatttgggaagctctgcac

SEQ ID NO: 618615 - DNA, 20 bp, mouse
gtcctaaccaccaccaaaga

SEQ ID NO: 618616 - DNA, 20 bp, mouse
gggttgttccggaggtgagt

SEQ ID NO: 618617 - DNA, 20 bp, mouse
gaaaggccatgaggtcgtag

SEQ ID NO: 618618 - DNA, 20 bp, mouse
ggggaggctggaaagtctgc

SEQ ID NO: 618619 - DNA, 20 bp, mouse
gtcctgcgtagatttctctc

SEQ ID NO: 618620 - DNA, 20 bp, mouse
ggtcgtagtggttgttccgg

SEQ ID NO: 618621 - DNA, 20 bp, mouse
gagtaattcgaagaaacctt

SEQ ID NO: 618622 - DNA, 20 bp, mouse
ggaggtcgtagtggttgttc

SEQ ID NO: 618623 - DNA, 20 bp, mouse
gcgtctgcatcgtaaaccag

SEQ ID NO: 618624 - DNA, 20 bp, mouse
ggccagagagaaatctacgc

SEQ ID NO: 618625 - DNA, 20 bp, mouse
gacgcaggaggatttaaacc

SEQ ID NO: 618626 - DNA, 20 bp, mouse
gacagcccaggagaatacat

SEQ ID NO: 618627 - DNA, 20 bp, mouse
gacagcaggcacacacggag

SEQ ID NO: 618628 - DNA, 20 bp, mouse
gcatgggagaaacacagccc

SEQ ID NO: 618629 - DNA, 20 bp, mouse
gcaagccaaaggccaacagc

SEQ ID NO: 618630 - DNA, 20 bp, mouse
gggagaaattgagccacaga

SEQ ID NO: 618631 - DNA, 20 bp, mouse
ggtgagcaaaaaaattgaag

SEQ ID NO: 618632 - DNA, 20 bp, mouse
gtactgaagcattcaggcaa

SEQ ID NO: 618633 - DNA, 20 bp, mouse
gaatgggaaaatcgagaagt

SEQ ID NO: 618634 - DNA, 20 bp, mouse
gaaaattctgtgactttccc

SEQ ID NO: 618635 - DNA, 20 bp, mouse
gttctccacaatcatcttca

SEQ ID NO: 618636 - DNA, 20 bp, mouse
gatagtgacaggattactct

SEQ ID NO: 618637 - DNA, 20 bp, mouse
gagagctggttaaaaaagag

SEQ ID NO: 618638 - DNA, 20 bp, mouse
gatcttgcagtcatagtgac

SEQ ID NO: 618639 - DNA, 20 bp, mouse
gactaacattttcacactgc

SEQ ID NO: 618640 - DNA, 20 bp, mouse
gagaaaaaaggaggtgggaa

SEQ ID NO: 618641 - DNA, 20 bp, mouse
gaggaggtgggaaaggctac

SEQ ID NO: 618642 - DNA, 20 bp, mouse
gctgggctctgattttacca

SEQ ID NO: 618643 - DNA, 20 bp, mouse
gtcttgactggttcagccag

SEQ ID NO: 618644 - DNA, 20 bp, mouse
gacctactgcagtggacaca

SEQ ID NO: 618645 - DNA, 20 bp, mouse
gttttttctctgtctgcttc

SEQ ID NO: 618646 - DNA, 20 bp, mouse
gtaacactgctgtgaagact

SEQ ID NO: 618647 - DNA, 20 bp, mouse
gtatcacacagtataataag

SEQ ID NO: 618648 - DNA, 20 bp, mouse
gtcttcacagcagtgttagc

SEQ ID NO: 618649 - DNA, 20 bp, mouse
gtatactgtgtgatatattt

SEQ ID NO: 618650 - DNA, 20 bp, mouse
gatcagcaatgacaaggttt

SEQ ID NO: 618651 - DNA, 20 bp, mouse
ggaggaaagttcatttaatt

SEQ ID NO: 618652 - DNA, 20 bp, mouse
gtaaaatccatttctctaaa

SEQ ID NO: 618653 - DNA, 20 bp, mouse
gatttgccaataagaaaaag

SEQ ID NO: 618654 - DNA, 20 bp, mouse
gcaaataagcaaaaaaggtt

SEQ ID NO: 618655 - DNA, 20 bp, mouse
gtgaatgttgtatttttcag

SEQ ID NO: 618656 - DNA, 20 bp, mouse
gaacttgaggaggcacaata

SEQ ID NO: 618657 - DNA, 20 bp, mouse
gtttgcgaaacaacttgagg

SEQ ID NO: 618658 - DNA, 20 bp, mouse
gctctccacagggaacgaca

SEQ ID NO: 618659 - DNA, 20 bp, mouse
gcatatcacagggccacacg

SEQ ID NO: 618660 - DNA, 20 bp, mouse
ggccagtggctcatatcaca

SEQ ID NO: 618661 - DNA, 20 bp, mouse
gctgcagcaaggtcctcgtg

SEQ ID NO: 618662 - DNA, 20 bp, mouse
ggccctgtgatatgagccac

SEQ ID NO: 618663 - DNA, 20 bp, mouse
gctgatctatgatgatactg

SEQ ID NO: 618664 - DNA, 20 bp, mouse
ggttccctgtggagagttgg

SEQ ID NO: 618665 - DNA, 20 bp, mouse
gtttctgctgcagctttgct

SEQ ID NO: 618666 - DNA, 20 bp, mouse
ggaagcagaagatatgagaa

SEQ ID NO: 618667 - DNA, 20 bp, mouse
gtattagacctggagcctgt

SEQ ID NO: 618668 - DNA, 20 bp, mouse
gttgctcggcccaatgagga

SEQ ID NO: 618669 - DNA, 20 bp, mouse
gggagcctgtgggaaagtgc

SEQ ID NO: 618670 - DNA, 20 bp, mouse
gcagatgccttggttccctg

SEQ ID NO: 618671 - DNA, 20 bp, mouse
gttcattgctcggcccaatg

SEQ ID NO: 618672 - DNA, 20 bp, mouse
gtccaatggctgtattctgt

SEQ ID NO: 618673 - DNA, 20 bp, mouse
gatcatgtctgaatattcac

SEQ ID NO: 618674 - DNA, 20 bp, mouse
gggtgacgtcatgacctctc

SEQ ID NO: 618675 - DNA, 20 bp, mouse
gtctctggacaagttcatcc

SEQ ID NO: 618676 - DNA, 20 bp, mouse
ggggctgctgtcattttcac

SEQ ID NO: 618677 - DNA, 20 bp, mouse
gtgctcctgctccagctgag

SEQ ID NO: 618678 - DNA, 20 bp, mouse
gtgagcaatcatcctttgga

SEQ ID NO: 618679 - DNA, 20 bp, mouse
gcagataaggagtatgatgt

SEQ ID NO: 618680 - DNA, 20 bp, mouse
gttgtcaacctcataagata

SEQ ID NO: 618681 - DNA, 20 bp, mouse
gaggcatcttggttaacttc

SEQ ID NO: 618682 - DNA, 20 bp, mouse
gtccaaagaagccactcagc

SEQ ID NO: 618683 - DNA, 20 bp, mouse
ggccaatggctgaactccat

SEQ ID NO: 618684 - DNA, 20 bp, mouse
gtcagcatccttatcttatg

SEQ ID NO: 618685 - DNA, 20 bp, mouse
ggcttctttggatctgggac

SEQ ID NO: 618686 - DNA, 20 bp, mouse
ggagcagaaatccacttcac

SEQ ID NO: 618687 - DNA, 20 bp, mouse
gcaggcatcctggaagtcaa

SEQ ID NO: 618688 - DNA, 20 bp, mouse
gatccacttcacaggcatcc

SEQ ID NO: 618689 - DNA, 20 bp, mouse
gagctccccacaggaagcca

SEQ ID NO: 618690 - DNA, 20 bp, mouse
gtaaggcccggcgaatattt

SEQ ID NO: 618691 - DNA, 20 bp, mouse
gtcttcttagataagaggac

SEQ ID NO: 618692 - DNA, 20 bp, mouse
gtccagtgactgaattccag

SEQ ID NO: 618693 - DNA, 20 bp, mouse
gtatttgggatcaacaaaaa

SEQ ID NO: 618694 - DNA, 20 bp, mouse
gcagaagccctttgacttcc

SEQ ID NO: 618695 - DNA, 20 bp, mouse
gtttcttcttcttagataag

SEQ ID NO: 618696 - DNA, 20 bp, mouse
gaaggtcaagcagtgacaga

SEQ ID NO: 618697 - DNA, 20 bp, mouse
gcttcagatctgcaaagtgt

SEQ ID NO: 618698 - DNA, 20 bp, mouse
ggtgtgggaaggtgttggta

SEQ ID NO: 618699 - DNA, 20 bp, mouse
gtggatgaacttaaacagaa

SEQ ID NO: 618700 - DNA, 20 bp, mouse
gcaagaaaaatggaagttga

SEQ ID NO: 618701 - DNA, 20 bp, mouse
ggtggaaagatggacttatg

SEQ ID NO: 618702 - DNA, 20 bp, mouse
gcatcattactgaaagatgt

SEQ ID NO: 618703 - DNA, 20 bp, mouse
gaaggtgttggtatggccgg

SEQ ID NO: 618704 - DNA, 20 bp, mouse
gtctttcagtaatgatgtca

SEQ ID NO: 618705 - DNA, 20 bp, mouse
gcaaatatattttgtaataa

SEQ ID NO: 618706 - DNA, 20 bp, mouse
gcatctttagtgacagatgt

SEQ ID NO: 618707 - DNA, 20 bp, mouse
gtctgtcactaaagatgatc

SEQ ID NO: 618708 - DNA, 20 bp, mouse
gatatgtttgatgaattatc

SEQ ID NO: 618709 - DNA, 20 bp, mouse
gcatacagcttttgaatgtg

SEQ ID NO: 618710 - DNA, 20 bp, mouse
gcaaacatattttgcattaa

SEQ ID NO: 618711 - DNA, 20 bp, mouse
gtgtcagatcctgttgcttt

SEQ ID NO: 618712 - DNA, 20 bp, mouse
gactggatgaactggtacag

SEQ ID NO: 618713 - DNA, 20 bp, mouse
gcaaatgaactgtgaagaga

SEQ ID NO: 618714 - DNA, 20 bp, mouse
gagcaacaggatctgacaaa

SEQ ID NO: 618715 - DNA, 20 bp, mouse
ggagcagaaatccactttcc

SEQ ID NO: 618716 - DNA, 20 bp, mouse
gaagcagtgacaaaagtaaa

SEQ ID NO: 618717 - DNA, 20 bp, mouse
gtaaatggactgtgaagaga

SEQ ID NO: 618718 - DNA, 20 bp, mouse
gtgtctttactgacagatgt

SEQ ID NO: 618719 - DNA, 20 bp, mouse
gtctgtcagtaaagacaatc

SEQ ID NO: 618720 - DNA, 20 bp, mouse
gatgacaaacatgtatccct

SEQ ID NO: 618721 - DNA, 20 bp, mouse
gtggacttatgaaatgccaa

SEQ ID NO: 618722 - DNA, 20 bp, mouse
ggacaaaagcacatcaaact

SEQ ID NO: 618723 - DNA, 20 bp, mouse
gcattaagtttgtggatgtg

SEQ ID NO: 618724 - DNA, 20 bp, mouse
gcaatcatattttgcagtaa

SEQ ID NO: 618725 - DNA, 20 bp, mouse
gaattttttcattaagtttg

SEQ ID NO: 618726 - DNA, 20 bp, mouse
ggcaaatggactgtgagaga

SEQ ID NO: 618727 - DNA, 20 bp, mouse
gaagcagtgacagaagcaaa

SEQ ID NO: 618728 - DNA, 20 bp, mouse
ggatcctgttgcttcctgtg

SEQ ID NO: 618729 - DNA, 20 bp, mouse
gttttgattttcaagatgcc

SEQ ID NO: 618730 - DNA, 20 bp, mouse
gtgtctttactgacagatgt

SEQ ID NO: 618731 - DNA, 20 bp, mouse
gtctgtcagtaaagacaatc

SEQ ID NO: 618732 - DNA, 20 bp, mouse
gagcaacaggatctgacaaa

SEQ ID NO: 618733 - DNA, 20 bp, mouse
gatgacaaacatgtatccct

SEQ ID NO: 618734 - DNA, 20 bp, mouse
gtggacttatgaaatgccaa

SEQ ID NO: 618735 - DNA, 20 bp, mouse
gcattaagtttgtggatgtg

SEQ ID NO: 618736 - DNA, 20 bp, mouse
gtccactaagggatcctgta

SEQ ID NO: 618737 - DNA, 20 bp, mouse
gacatgtgaagccctggcac

SEQ ID NO: 618738 - DNA, 20 bp, mouse
gtagtggagcacagctttct

SEQ ID NO: 618739 - DNA, 20 bp, mouse
gaggtgtagaccacacctgt

SEQ ID NO: 618740 - DNA, 20 bp, mouse
gctccctttaccccatttca

SEQ ID NO: 618741 - DNA, 20 bp, mouse
gagtccatagcccctcccac

SEQ ID NO: 618742 - DNA, 20 bp, mouse
ggatggctgcacatcggagt

SEQ ID NO: 618743 - DNA, 20 bp, mouse
gtgtctgttgccgtgaaatg

SEQ ID NO: 618744 - DNA, 20 bp, mouse
ggcttcacatgttctataga

SEQ ID NO: 618745 - DNA, 20 bp, mouse
gtgccgtgaaatggggtaaa

SEQ ID NO: 618746 - DNA, 20 bp, mouse
gaagagctgtgccccactaa

SEQ ID NO: 618747 - DNA, 20 bp, mouse
ggcttacagggtcccttagt

SEQ ID NO: 618748 - DNA, 20 bp, mouse
ggttgcctcagatggactaa

SEQ ID NO: 618749 - DNA, 20 bp, mouse
gagacagtgctttgtgacag

SEQ ID NO: 618750 - DNA, 20 bp, mouse
gctgccatctgtagaatatg

SEQ ID NO: 618751 - DNA, 20 bp, mouse
gatagcccctgccccaggtg

SEQ ID NO: 618752 - DNA, 20 bp, mouse
ggatggcagcacatcggcgt

SEQ ID NO: 618753 - DNA, 20 bp, mouse
ggagaataacctcaaggaaa

SEQ ID NO: 618754 - DNA, 20 bp, mouse
gtgtaaagttgtgcttagag

SEQ ID NO: 618755 - DNA, 20 bp, mouse
gggtagaaaaacctcatgca

SEQ ID NO: 618756 - DNA, 20 bp, mouse
gcctcggaggctgggcgtga

SEQ ID NO: 618757 - DNA, 20 bp, mouse
gctccacagaccccgtccgg

SEQ ID NO: 618758 - DNA, 20 bp, mouse
gcgcctgccgggcttaagac

SEQ ID NO: 618759 - DNA, 20 bp, mouse
ggcttaagacgggcgctcta

SEQ ID NO: 618760 - DNA, 20 bp, mouse
ggtcgtcgccctcggaggct

SEQ ID NO: 618761 - DNA, 20 bp, mouse
ggcgctgcggccccgagggg

SEQ ID NO: 618762 - DNA, 20 bp, mouse
ggcgcctctgccgccggacg

SEQ ID NO: 618763 - DNA, 20 bp, mouse
gagaccccgtccggcggcag

SEQ ID NO: 618764 - DNA, 20 bp, mouse
gaagctgcggcgcgcctgcc

SEQ ID NO: 618765 - DNA, 20 bp, mouse
ggcgctccacagaccccgtc

SEQ ID NO: 618766 - DNA, 20 bp, mouse
gtgaggtccggggagtcggt

SEQ ID NO: 618767 - DNA, 20 bp, mouse
ggtcatggcggcctgaggtc

SEQ ID NO: 618768 - DNA, 20 bp, mouse
ggctgggtccgagtgcactc

SEQ ID NO: 618769 - DNA, 20 bp, mouse
gggcctgaggtccggggagt

SEQ ID NO: 618770 - DNA, 20 bp, mouse
gagctgtctgaggtatacgg

SEQ ID NO: 618771 - DNA, 20 bp, mouse
gggacatgggcaggacatgg

SEQ ID NO: 618772 - DNA, 20 bp, mouse
gcggacccagccggaagtgg

SEQ ID NO: 618773 - DNA, 20 bp, mouse
gtatgcttgagccgggacat

SEQ ID NO: 618774 - DNA, 20 bp, mouse
gggaggcaggaactgcttga

SEQ ID NO: 618775 - DNA, 20 bp, mouse
ggcggggtccggctgcgcgt

SEQ ID NO: 618776 - DNA, 20 bp, mouse
ggcggctgggtgacccagaa

SEQ ID NO: 618777 - DNA, 20 bp, mouse
ggttctaggctagggctctg

SEQ ID NO: 618778 - DNA, 20 bp, mouse
gcagaagggagccgcgtgag

SEQ ID NO: 618779 - DNA, 20 bp, mouse
gaggctagggctctgcggct

SEQ ID NO: 618780 - DNA, 20 bp, mouse
ggtgcgcctgaccagtaaga

SEQ ID NO: 618781 - DNA, 20 bp, mouse
gctagaaccaggcgttccaa

SEQ ID NO: 618782 - DNA, 20 bp, mouse
gaacgcctggttctaggcta

SEQ ID NO: 618783 - DNA, 20 bp, mouse
ggggtcttcagccactcacg

SEQ ID NO: 618784 - DNA, 20 bp, mouse
gcgcgctctagtgctcactt

SEQ ID NO: 618785 - DNA, 20 bp, mouse
gaagcgtagaagacacccat

SEQ ID NO: 618786 - DNA, 20 bp, mouse
gtcgccacggggatcccgga

SEQ ID NO: 618787 - DNA, 20 bp, mouse
gccaccctccgggatccccg

SEQ ID NO: 618788 - DNA, 20 bp, mouse
ggcggcgccgcaggatcccg

SEQ ID NO: 618789 - DNA, 20 bp, mouse
gcagaccgcacgccaccctc

SEQ ID NO: 618790 - DNA, 20 bp, mouse
gtctgctccgcgggatcctg

SEQ ID NO: 618791 - DNA, 20 bp, mouse
ggatcccggagggtggcgtg

SEQ ID NO: 618792 - DNA, 20 bp, mouse
gtccccgtggcgagagcgca

SEQ ID NO: 618793 - DNA, 20 bp, mouse
gcccgcgccgaggaaggagg

SEQ ID NO: 618794 - DNA, 20 bp, mouse
gtaggggcgacagagagcca

SEQ ID NO: 618795 - DNA, 20 bp, mouse
ggagagcgcacggcgagggg

SEQ ID NO: 618796 - DNA, 20 bp, mouse
gtcatgcttcgggctctcgg

SEQ ID NO: 618797 - DNA, 20 bp, mouse
ggcatcacctaagagaccgg

SEQ ID NO: 618798 - DNA, 20 bp, mouse
gcatgacgctcaggccgccg

SEQ ID NO: 618799 - DNA, 20 bp, mouse
gtccccgcccccggtctctt

SEQ ID NO: 618800 - DNA, 20 bp, mouse
ggcagccaagatggcgctgg

SEQ ID NO: 618801 - DNA, 20 bp, mouse
gagactgccgcgaagtgagg

SEQ ID NO: 618802 - DNA, 20 bp, mouse
gagcccgaagcatgacgctc

SEQ ID NO: 618803 - DNA, 20 bp, mouse
ggcgcaggagcggcccccgg

SEQ ID NO: 618804 - DNA, 20 bp, mouse
gtgcttcgggctctcggcgg

SEQ ID NO: 618805 - DNA, 20 bp, mouse
ggctgcagccaagatggcgc

SEQ ID NO: 618806 - DNA, 20 bp, mouse
gcagcccgcgcctcacaaat

SEQ ID NO: 618807 - DNA, 20 bp, mouse
gggcgccgtgacctccatgt

SEQ ID NO: 618808 - DNA, 20 bp, mouse
gagagaaccggatcctcccg

SEQ ID NO: 618809 - DNA, 20 bp, mouse
gcccgcccgcccctcctcgg

SEQ ID NO: 618810 - DNA, 20 bp, mouse
gcgagcgcagggccagacaa

SEQ ID NO: 618811 - DNA, 20 bp, mouse
gagtgcgcgccgccgagcca

SEQ ID NO: 618812 - DNA, 20 bp, mouse
ggatctcgcgagatccgggt

SEQ ID NO: 618813 - DNA, 20 bp, mouse
ggaaccggatcctcccgggg

SEQ ID NO: 618814 - DNA, 20 bp, mouse
gtccaggtccgcaccatcga

SEQ ID NO: 618815 - DNA, 20 bp, mouse
gaggatccggttctctgcgg

SEQ ID NO: 618816 - DNA, 20 bp, mouse
gagcgcctcctgaacgctgg

SEQ ID NO: 618817 - DNA, 20 bp, mouse
gaggcgacgcgtactcaccg

SEQ ID NO: 618818 - DNA, 20 bp, mouse
gaggcgcgcctcgggagcag

SEQ ID NO: 618819 - DNA, 20 bp, mouse
gcgacggccgcggagtgcag

SEQ ID NO: 618820 - DNA, 20 bp, mouse
ggaacgctgggggtcgcgag

SEQ ID NO: 618821 - DNA, 20 bp, mouse
gagaaagaggagagcccgcg

SEQ ID NO: 618822 - DNA, 20 bp, mouse
gagagggaggggaaccccgg

SEQ ID NO: 618823 - DNA, 20 bp, mouse
ggccgcaactctttagaaag

SEQ ID NO: 618824 - DNA, 20 bp, mouse
ggcgacccccagcgttcagg

SEQ ID NO: 618825 - DNA, 20 bp, mouse
ggagaagcaggcggccccga

SEQ ID NO: 618826 - DNA, 20 bp, mouse
ggtgagttcctgagattcta

SEQ ID NO: 618827 - DNA, 20 bp, mouse
gttctgccccctagaatctc

SEQ ID NO: 618828 - DNA, 20 bp, mouse
gacaacccccacccaggatt

SEQ ID NO: 618829 - DNA, 20 bp, mouse
gaatttccaaatcctgggtg

SEQ ID NO: 618830 - DNA, 20 bp, mouse
gtttaactgtctgaaaggga

SEQ ID NO: 618831 - DNA, 20 bp, mouse
ggagctgactgccagtaaca

SEQ ID NO: 618832 - DNA, 20 bp, mouse
gagagaactcctgaagagag

SEQ ID NO: 618833 - DNA, 20 bp, mouse
gggtttggtaaagaggggag

SEQ ID NO: 618834 - DNA, 20 bp, mouse
gacagttaaaatcgtgcctt

SEQ ID NO: 618835 - DNA, 20 bp, mouse
gaactcctgaagagagaggc

SEQ ID NO: 618836 - DNA, 20 bp, mouse
gccgggcctgactgacgatg

SEQ ID NO: 618837 - DNA, 20 bp, mouse
gcgtcagtcaggcccggact

SEQ ID NO: 618838 - DNA, 20 bp, mouse
gtcgggacccggtccgactc

SEQ ID NO: 618839 - DNA, 20 bp, mouse
ggcggcggcgtcgagaccgt

SEQ ID NO: 618840 - DNA, 20 bp, mouse
gtgcggctcggagccccgca

SEQ ID NO: 618841 - DNA, 20 bp, mouse
gtcagagctgagtcccgagt

SEQ ID NO: 618842 - DNA, 20 bp, mouse
gcagcgccgggagggtaccg

SEQ ID NO: 618843 - DNA, 20 bp, mouse
gcagggaaacaaaagatccg

SEQ ID NO: 618844 - DNA, 20 bp, mouse
gggctcaggcctgcccgatg

SEQ ID NO: 618845 - DNA, 20 bp, mouse
gtcaggcccggacttggagc

SEQ ID NO: 618846 - DNA, 20 bp, mouse
gggctgtgcgggttccaggg

SEQ ID NO: 618847 - DNA, 20 bp, mouse
gcaggcagaagccgccaccg

SEQ ID NO: 618848 - DNA, 20 bp, mouse
gctccgggtacgcccagtga

SEQ ID NO: 618849 - DNA, 20 bp, mouse
gacccgcacagccgcggtgg

SEQ ID NO: 618850 - DNA, 20 bp, mouse
gcgcggctgtgcgggttcca

SEQ ID NO: 618851 - DNA, 20 bp, mouse
gccgcgggcgcaacaagcgg

SEQ ID NO: 618852 - DNA, 20 bp, mouse
gcgggtacgcccagtgacgg

SEQ ID NO: 618853 - DNA, 20 bp, mouse
ggccggtagtcggcgcggag

SEQ ID NO: 618854 - DNA, 20 bp, mouse
gttgggcgctcccgcgaagc

SEQ ID NO: 618855 - DNA, 20 bp, mouse
gggacatagagcgctagggt

SEQ ID NO: 618856 - DNA, 20 bp, mouse
gcgaaccaggaagcacctgg

SEQ ID NO: 618857 - DNA, 20 bp, mouse
gggaacctgcaccccgaacc

SEQ ID NO: 618858 - DNA, 20 bp, mouse
gaccaggaagcacctggcgg

SEQ ID NO: 618859 - DNA, 20 bp, mouse
gccggccagcagagaagctg

SEQ ID NO: 618860 - DNA, 20 bp, mouse
gctgcccaagctggtagagg

SEQ ID NO: 618861 - DNA, 20 bp, mouse
ggatgaaaccgtccagccga

SEQ ID NO: 618862 - DNA, 20 bp, mouse
gagccgagggagaccccagc

SEQ ID NO: 618863 - DNA, 20 bp, mouse
gcccgccgccaggtgcttcc

SEQ ID NO: 618864 - DNA, 20 bp, mouse
gagccgggcttgcagggagt

SEQ ID NO: 618865 - DNA, 20 bp, mouse
gcccggcgccgggacacctc

SEQ ID NO: 618866 - DNA, 20 bp, mouse
ggcttggacagaggaaaccg

SEQ ID NO: 618867 - DNA, 20 bp, mouse
gccaactcccctggacgcgt

SEQ ID NO: 618868 - DNA, 20 bp, mouse
gggctcacccacgcgtccag

SEQ ID NO: 618869 - DNA, 20 bp, mouse
gaccgaggcacccgaagacc

SEQ ID NO: 618870 - DNA, 20 bp, mouse
gccacggcgaggccacagct

SEQ ID NO: 618871 - DNA, 20 bp, mouse
gaagacctggccaactcccc

SEQ ID NO: 618872 - DNA, 20 bp, mouse
gcgcgtctcgcaggttgtca

SEQ ID NO: 618873 - DNA, 20 bp, mouse
gggttgtcatggtgacgcag

SEQ ID NO: 618874 - DNA, 20 bp, mouse
ggcgtccaggggagttggcc

SEQ ID NO: 618875 - DNA, 20 bp, mouse
gggaaagagaccggaatcgt

SEQ ID NO: 618876 - DNA, 20 bp, mouse
gcctgtcctgggttcaggta

SEQ ID NO: 618877 - DNA, 20 bp, mouse
gaatggaccagtcctgtcct

SEQ ID NO: 618878 - DNA, 20 bp, mouse
gatataatgggattagatag

SEQ ID NO: 618879 - DNA, 20 bp, mouse
gtacagccttacctgaaccc

SEQ ID NO: 618880 - DNA, 20 bp, mouse
gtggatgcaagcattaccct

SEQ ID NO: 618881 - DNA, 20 bp, mouse
gtccaaggctgcctccagta

SEQ ID NO: 618882 - DNA, 20 bp, mouse
gtatgctgctgtaaaaccta

SEQ ID NO: 618883 - DNA, 20 bp, mouse
gctaatcccattatatttca

SEQ ID NO: 618884 - DNA, 20 bp, mouse
gatgccatgaaggttagcat

SEQ ID NO: 618885 - DNA, 20 bp, mouse
gcaggtgaaataattccaga

SEQ ID NO: 618886 - DNA, 20 bp, mouse
gggtcctggacatcatcccg

SEQ ID NO: 618887 - DNA, 20 bp, mouse
gcctgcctgcacaccaccac

SEQ ID NO: 618888 - DNA, 20 bp, mouse
ggccaacaggaccagcctca

SEQ ID NO: 618889 - DNA, 20 bp, mouse
gccccacggaccccacacac

SEQ ID NO: 618890 - DNA, 20 bp, mouse
gctaagagtgggtctcaaaa

SEQ ID NO: 618891 - DNA, 20 bp, mouse
gctagtggcagtgacttcag

SEQ ID NO: 618892 - DNA, 20 bp, mouse
gaccgtgaggctggtcctgt

SEQ ID NO: 618893 - DNA, 20 bp, mouse
gtcatcccgtggtggtgtgc

SEQ ID NO: 618894 - DNA, 20 bp, mouse
gtagaggtgaatccagagaa

SEQ ID NO: 618895 - DNA, 20 bp, mouse
gcgagcctggcttaggactc

SEQ ID NO: 618896 - DNA, 20 bp, mouse
gaggtcgccagccaagccct

SEQ ID NO: 618897 - DNA, 20 bp, mouse
gcatacagctcggtgaccaa

SEQ ID NO: 618898 - DNA, 20 bp, mouse
gccagccccgagggacggga

SEQ ID NO: 618899 - DNA, 20 bp, mouse
gcgcaggtcgatgtagactg

SEQ ID NO: 618900 - DNA, 20 bp, mouse
ggcctgcacgtcatacagct

SEQ ID NO: 618901 - DNA, 20 bp, mouse
gagtcaggtaccagccccga

SEQ ID NO: 618902 - DNA, 20 bp, mouse
gcaagggagagccacagacc

SEQ ID NO: 618903 - DNA, 20 bp, mouse
gtccagaccagcagtcggga

SEQ ID NO: 618904 - DNA, 20 bp, mouse
gcgaactgagcgcgcgagaa

SEQ ID NO: 618905 - DNA, 20 bp, mouse
ggacttctgggtgacgtcac

SEQ ID NO: 618906 - DNA, 20 bp, mouse
gctccagccggcgcaagcag

SEQ ID NO: 618907 - DNA, 20 bp, mouse
gcagccggcgcaagcagcgg

SEQ ID NO: 618908 - DNA, 20 bp, mouse
gggcagcgggcgaggatctg

SEQ ID NO: 618909 - DNA, 20 bp, mouse
gcggccccgcgaggccatga

SEQ ID NO: 618910 - DNA, 20 bp, mouse
gccggctggagccaggggaa

SEQ ID NO: 618911 - DNA, 20 bp, mouse
gtgaaggtgaagaaaggcgg

SEQ ID NO: 618912 - DNA, 20 bp, mouse
gcgggccggaggatgtgctg

SEQ ID NO: 618913 - DNA, 20 bp, mouse
gtcaccttcatggcctcgcg

SEQ ID NO: 618914 - DNA, 20 bp, mouse
ggctgagtccgggtccgagt

SEQ ID NO: 618915 - DNA, 20 bp, mouse
ggatcacgggtggtgagcac

SEQ ID NO: 618916 - DNA, 20 bp, mouse
gaagatggccgccacctcag

SEQ ID NO: 618917 - DNA, 20 bp, mouse
ggaggtggcggccatcttgg

SEQ ID NO: 618918 - DNA, 20 bp, mouse
gatgagcgggtcgaacccga

SEQ ID NO: 618919 - DNA, 20 bp, mouse
gagttacggcgcccctgagg

SEQ ID NO: 618920 - DNA, 20 bp, mouse
gttggtggtggagcgatgag

SEQ ID NO: 618921 - DNA, 20 bp, mouse
gtacggcgcccctgaggtgg

SEQ ID NO: 618922 - DNA, 20 bp, mouse
gcatagttacggcgcccctg

SEQ ID NO: 618923 - DNA, 20 bp, mouse
gccgtaactatggagagcgg

SEQ ID NO: 618924 - DNA, 20 bp, mouse
gccgggtcaccgagagtgag

SEQ ID NO: 618925 - DNA, 20 bp, mouse
gcatcgctccaccaccaaga

SEQ ID NO: 618926 - DNA, 20 bp, mouse
gggaagcagggctgtagggt

SEQ ID NO: 618927 - DNA, 20 bp, mouse
gctgcttcctgggcacagac

SEQ ID NO: 618928 - DNA, 20 bp, mouse
ggcgtgctgggtgggtacgt

SEQ ID NO: 618929 - DNA, 20 bp, mouse
gagtgtgatctgtcagtcgg

SEQ ID NO: 618930 - DNA, 20 bp, mouse
gcagtcggtggcgtgctggg

SEQ ID NO: 618931 - DNA, 20 bp, mouse
gtcacgtggcaccaacggtc

SEQ ID NO: 618932 - DNA, 20 bp, mouse
gctgttgccagtctgtgccc

SEQ ID NO: 618933 - DNA, 20 bp, mouse
gtcgacgtggatatcagtgt

SEQ ID NO: 618934 - DNA, 20 bp, mouse
gtgtcagtcggtggcgtgct

SEQ ID NO: 618935 - DNA, 20 bp, mouse
gagcactcacgtggcaccaa

SEQ ID NO: 618936 - DNA, 20 bp, mouse
gggtgctgaagcgacatggc

SEQ ID NO: 618937 - DNA, 20 bp, mouse
ggggtgcagcgcggggctca

SEQ ID NO: 618938 - DNA, 20 bp, mouse
ggggctcagggcttatgccg

SEQ ID NO: 618939 - DNA, 20 bp, mouse
gccaggcggctagagcgcgg

SEQ ID NO: 618940 - DNA, 20 bp, mouse
ggtgacaggaagagcaccta

SEQ ID NO: 618941 - DNA, 20 bp, mouse
gactccaggcggctagagcg

SEQ ID NO: 618942 - DNA, 20 bp, mouse
gggcatactggggatcggag

SEQ ID NO: 618943 - DNA, 20 bp, mouse
ggcgcggcgggtgcagcgcg

SEQ ID NO: 618944 - DNA, 20 bp, mouse
ggagtcgggctgcacagcag

SEQ ID NO: 618945 - DNA, 20 bp, mouse
gtgcgtggatgagccgagtc

SEQ ID NO: 618946 - DNA, 20 bp, mouse
gaggctccgccggcaaactg

SEQ ID NO: 618947 - DNA, 20 bp, mouse
gtcccagccggagtgagggg

SEQ ID NO: 618948 - DNA, 20 bp, mouse
gtcgcagctatggcgcctcg

SEQ ID NO: 618949 - DNA, 20 bp, mouse
gcgaggcggacagcagaggg

SEQ ID NO: 618950 - DNA, 20 bp, mouse
ggggatcccagccggagtga

SEQ ID NO: 618951 - DNA, 20 bp, mouse
gagcctccgccgcacctcgg

SEQ ID NO: 618952 - DNA, 20 bp, mouse
ggaaagagctgaggctccgc

SEQ ID NO: 618953 - DNA, 20 bp, mouse
gccgccggcaaactggggac

SEQ ID NO: 618954 - DNA, 20 bp, mouse
gatccctgcgagagactggg

SEQ ID NO: 618955 - DNA, 20 bp, mouse
ggaagccgcccgggttctca

SEQ ID NO: 618956 - DNA, 20 bp, mouse
gaccatggagagcaatgagt

SEQ ID NO: 618957 - DNA, 20 bp, mouse
gtgggagtttctctaatcca

SEQ ID NO: 618958 - DNA, 20 bp, mouse
gttaaagagactggccacca

SEQ ID NO: 618959 - DNA, 20 bp, mouse
gaaggaagtgaacaaggcac

SEQ ID NO: 618960 - DNA, 20 bp, mouse
gtaactgaatgtgggtgaca

SEQ ID NO: 618961 - DNA, 20 bp, mouse
gtcagagtacgagctctcga

SEQ ID NO: 618962 - DNA, 20 bp, mouse
gggccagcatcactgttctc

SEQ ID NO: 618963 - DNA, 20 bp, mouse
ggccattggcgatagcaact

SEQ ID NO: 618964 - DNA, 20 bp, mouse
ggccgtgaccaacagcgatg

SEQ ID NO: 618965 - DNA, 20 bp, mouse
gagggcatttgacaatttag

SEQ ID NO: 618966 - DNA, 20 bp, mouse
gcagggggtggcagagtgaa

SEQ ID NO: 618967 - DNA, 20 bp, mouse
gacgccgctgggggtgggaa

SEQ ID NO: 618968 - DNA, 20 bp, mouse
gtgatggcctggcgcaagag

SEQ ID NO: 618969 - DNA, 20 bp, mouse
ggcaagagtggacgccgctg

SEQ ID NO: 618970 - DNA, 20 bp, mouse
gggtgtgtcgccatggtggt

SEQ ID NO: 618971 - DNA, 20 bp, mouse
ggcgccaggccatcaagata

SEQ ID NO: 618972 - DNA, 20 bp, mouse
gtgggaaaggtgtgtcgcca

SEQ ID NO: 618973 - DNA, 20 bp, mouse
ggtacccccagggccgtaga

SEQ ID NO: 618974 - DNA, 20 bp, mouse
ggaaaggtgtgtcgccatgg

SEQ ID NO: 618975 - DNA, 20 bp, mouse
gacacctttcccacccccag

SEQ ID NO: 618976 - DNA, 20 bp, mouse
gaagctccaagagccagtgc

SEQ ID NO: 618977 - DNA, 20 bp, mouse
gcggcatctcgcggatccca

SEQ ID NO: 618978 - DNA, 20 bp, mouse
gggcagtcgccggcatctcg

SEQ ID NO: 618979 - DNA, 20 bp, mouse
gcttggccgagtcccgtgaa

SEQ ID NO: 618980 - DNA, 20 bp, mouse
gctaaagactgcgcctgcac

SEQ ID NO: 618981 - DNA, 20 bp, mouse
gcccgtgaagggctagaata

SEQ ID NO: 618982 - DNA, 20 bp, mouse
gacgggactcggccaagacc

SEQ ID NO: 618983 - DNA, 20 bp, mouse
gctgcgcctgcactggctct

SEQ ID NO: 618984 - DNA, 20 bp, mouse
gccccggggtcggaaggtcg

SEQ ID NO: 618985 - DNA, 20 bp, mouse
gacaaggcgaggccaagaag

SEQ ID NO: 618986 - DNA, 20 bp, mouse
gctgcacgatgcctcctcct

SEQ ID NO: 618987 - DNA, 20 bp, mouse
ggtgagtaggctgggagcct

SEQ ID NO: 618988 - DNA, 20 bp, mouse
gcagcagatcaagctgtctg

SEQ ID NO: 618989 - DNA, 20 bp, mouse
gcagatcaagctgtctgagg

SEQ ID NO: 618990 - DNA, 20 bp, mouse
gtggttgaaagagacagata

SEQ ID NO: 618991 - DNA, 20 bp, mouse
ggtgtccccgcagatggcag

SEQ ID NO: 618992 - DNA, 20 bp, mouse
gctgcgaagagggaaacctg

SEQ ID NO: 618993 - DNA, 20 bp, mouse
gtcccatcttctccttaccc

SEQ ID NO: 618994 - DNA, 20 bp, mouse
gggcttgactcccactgaaa

SEQ ID NO: 618995 - DNA, 20 bp, mouse
gagtggtcagtggatttagg

SEQ ID NO: 618996 - DNA, 20 bp, mouse
ggactaccgccaccttccca

SEQ ID NO: 618997 - DNA, 20 bp, mouse
ggcaagtgcgggctacgtag

SEQ ID NO: 618998 - DNA, 20 bp, mouse
ggcgggctacgtagcgggaa

SEQ ID NO: 618999 - DNA, 20 bp, mouse
gctcggctgccctgggaagg

SEQ ID NO: 619000 - DNA, 20 bp, mouse
gccgcacctgaaggccctcg

SEQ ID NO: 619001 - DNA, 20 bp, mouse
ggccctcgaggcctcgtcct

SEQ ID NO: 619002 - DNA, 20 bp, mouse
gttacccagcagctccacgg

SEQ ID NO: 619003 - DNA, 20 bp, mouse
ggcccaggacgaggcctcga

SEQ ID NO: 619004 - DNA, 20 bp, mouse
gggaaggtggcggtagtccc

SEQ ID NO: 619005 - DNA, 20 bp, mouse
gcagcggctgggcgagggac

SEQ ID NO: 619006 - DNA, 20 bp, mouse
gcgcggcgcgtggctcccct

SEQ ID NO: 619007 - DNA, 20 bp, mouse
ggagcgcagcaatgcagccg

SEQ ID NO: 619008 - DNA, 20 bp, mouse
gctgcgctccgggtgcccag

SEQ ID NO: 619009 - DNA, 20 bp, mouse
ggcctgtggccagcgctcct

SEQ ID NO: 619010 - DNA, 20 bp, mouse
gcctctggcatgggccccgg

SEQ ID NO: 619011 - DNA, 20 bp, mouse
gtggccgcgggcggacgagc

SEQ ID NO: 619012 - DNA, 20 bp, mouse
gggacagcgctgcctccggg

SEQ ID NO: 619013 - DNA, 20 bp, mouse
gcggaggcagcgctgtcctc

SEQ ID NO: 619014 - DNA, 20 bp, mouse
ggaggtggggctctcggctg

SEQ ID NO: 619015 - DNA, 20 bp, mouse
ggaagctgcgcagcagcgag

SEQ ID NO: 619016 - DNA, 20 bp, mouse
gccagagccgggatccccag

SEQ ID NO: 619017 - DNA, 20 bp, mouse
gccgcgaagtctgtccgagt

SEQ ID NO: 619018 - DNA, 20 bp, mouse
gcccagtggagtgcgctcag

SEQ ID NO: 619019 - DNA, 20 bp, mouse
gcagcgggagagcgcggaaa

SEQ ID NO: 619020 - DNA, 20 bp, mouse
gattgtggccggcggcaggg

SEQ ID NO: 619021 - DNA, 20 bp, mouse
ggcgcggacggcgctcgcag

SEQ ID NO: 619022 - DNA, 20 bp, mouse
gcccagcggcgtccgactcc

SEQ ID NO: 619023 - DNA, 20 bp, mouse
ggggaggccgcccggcgact

SEQ ID NO: 619024 - DNA, 20 bp, mouse
gggcattgtggccggcggca

SEQ ID NO: 619025 - DNA, 20 bp, mouse
gcgaagttgtgcgatcccag

SEQ ID NO: 619026 - DNA, 20 bp, mouse
gccaggcaggaggctggatc

SEQ ID NO: 619027 - DNA, 20 bp, mouse
gaacagccgaaagcccagcc

SEQ ID NO: 619028 - DNA, 20 bp, mouse
gtcgtcggcagaggtgtacg

SEQ ID NO: 619029 - DNA, 20 bp, mouse
gctgtttgcgcgtctcctgg

SEQ ID NO: 619030 - DNA, 20 bp, mouse
gtctcaggactgcctggcgg

SEQ ID NO: 619031 - DNA, 20 bp, mouse
gggcagaggtgtacggggaa

SEQ ID NO: 619032 - DNA, 20 bp, mouse
ggctggatccggccaccgcc

SEQ ID NO: 619033 - DNA, 20 bp, mouse
gcaaatagaggtagaagaga

SEQ ID NO: 619034 - DNA, 20 bp, mouse
gtccgccgctcaaggtaaga

SEQ ID NO: 619035 - DNA, 20 bp, mouse
gctctgccgacgatgaggaa

SEQ ID NO: 619036 - DNA, 20 bp, mouse
ggcttctggacgggcctagt

SEQ ID NO: 619037 - DNA, 20 bp, mouse
gtgtcggcttgccacccact

SEQ ID NO: 619038 - DNA, 20 bp, mouse
ggggtggcaagccgacatta

SEQ ID NO: 619039 - DNA, 20 bp, mouse
gatgatacttgccttaatgt

SEQ ID NO: 619040 - DNA, 20 bp, mouse
gttaaggcaagtatcatctg

SEQ ID NO: 619041 - DNA, 20 bp, mouse
gtcatctggggccgcaggaa

SEQ ID NO: 619042 - DNA, 20 bp, mouse
ggagagggaactattgcttc

SEQ ID NO: 619043 - DNA, 20 bp, mouse
gcctgtgccatcctacaagg

SEQ ID NO: 619044 - DNA, 20 bp, mouse
gggaactattgcttctggac

SEQ ID NO: 619045 - DNA, 20 bp, mouse
ggacgggtgtcaggagcagg

SEQ ID NO: 619046 - DNA, 20 bp, mouse
gctctgagggtaagaggggt

SEQ ID NO: 619047 - DNA, 20 bp, mouse
gcaggaggtgagggatagat

SEQ ID NO: 619048 - DNA, 20 bp, mouse
gggtgggccccaggaggtga

SEQ ID NO: 619049 - DNA, 20 bp, mouse
gagctcaagtacatctctga

SEQ ID NO: 619050 - DNA, 20 bp, mouse
gaagaggggtgggccccagg

SEQ ID NO: 619051 - DNA, 20 bp, mouse
ggtacttgagcttcaggcac

SEQ ID NO: 619052 - DNA, 20 bp, mouse
gttcctggaaggctagaggg

SEQ ID NO: 619053 - DNA, 20 bp, mouse
ggaacagagagacgctaggt

SEQ ID NO: 619054 - DNA, 20 bp, mouse
ggccagctcttcgacttcac

SEQ ID NO: 619055 - DNA, 20 bp, mouse
ggtacatctctgagggtaag

SEQ ID NO: 619056 - DNA, 20 bp, mouse
gggtagtcccggacccggag

SEQ ID NO: 619057 - DNA, 20 bp, mouse
ggcgccgcaggaggcgatgg

SEQ ID NO: 619058 - DNA, 20 bp, mouse
gcggaacagggatatcagat

SEQ ID NO: 619059 - DNA, 20 bp, mouse
gggaagtccgcgaggaacga

SEQ ID NO: 619060 - DNA, 20 bp, mouse
ggcccgccgtccccgctaag

SEQ ID NO: 619061 - DNA, 20 bp, mouse
ggctcggagcatggggacag

SEQ ID NO: 619062 - DNA, 20 bp, mouse
gccagctccgctccgggtcc

SEQ ID NO: 619063 - DNA, 20 bp, mouse
gggtttggtagtcccggacc

SEQ ID NO: 619064 - DNA, 20 bp, mouse
ggcggtctccaggctcggtt

SEQ ID NO: 619065 - DNA, 20 bp, mouse
gtccgcgaggaacgacggca

SEQ ID NO: 619066 - DNA, 20 bp, mouse
ggcgttgagatcatcgtgta

SEQ ID NO: 619067 - DNA, 20 bp, mouse
gtatccttgtgaagaaatgg

SEQ ID NO: 619068 - DNA, 20 bp, mouse
gggaacttacatatagccat

SEQ ID NO: 619069 - DNA, 20 bp, mouse
gaattcaggattaggcgaga

SEQ ID NO: 619070 - DNA, 20 bp, mouse
gttccacattaggaagaagg

SEQ ID NO: 619071 - DNA, 20 bp, mouse
gcagtttgcccttaggaata

SEQ ID NO: 619072 - DNA, 20 bp, mouse
gaggagagagtggagatata

SEQ ID NO: 619073 - DNA, 20 bp, mouse
gagcaaatacaatgattcta

SEQ ID NO: 619074 - DNA, 20 bp, mouse
gttcatttgcaagattataa

SEQ ID NO: 619075 - DNA, 20 bp, mouse
gaggtggacagagtgttgcc

SEQ ID NO: 619076 - DNA, 20 bp, mouse
gtccttcggacgcagaggtt

SEQ ID NO: 619077 - DNA, 20 bp, mouse
ggaggagcaagcagaaccct

SEQ ID NO: 619078 - DNA, 20 bp, mouse
gtgctggggtgcactccgag

SEQ ID NO: 619079 - DNA, 20 bp, mouse
ggccacaggaaggtctggat

SEQ ID NO: 619080 - DNA, 20 bp, mouse
gggactgtcgacctctgggg

SEQ ID NO: 619081 - DNA, 20 bp, mouse
ggcggcctcttcggcaccca

SEQ ID NO: 619082 - DNA, 20 bp, mouse
ggtcccccacgcggcctctt

SEQ ID NO: 619083 - DNA, 20 bp, mouse
gctctgcctcggggaaggag

SEQ ID NO: 619084 - DNA, 20 bp, mouse
gagaaccctgggtgccgaag

SEQ ID NO: 619085 - DNA, 20 bp, mouse
gcgcgggccgctgtccacag

SEQ ID NO: 619086 - DNA, 20 bp, mouse
gactgcctagcagattcgca

SEQ ID NO: 619087 - DNA, 20 bp, mouse
ggaggcgagcatccactcag

SEQ ID NO: 619088 - DNA, 20 bp, mouse
gtggccgagacagcacaagg

SEQ ID NO: 619089 - DNA, 20 bp, mouse
gtggacactgaactcagctg

SEQ ID NO: 619090 - DNA, 20 bp, mouse
gtgaggaagaagtcaggctg

SEQ ID NO: 619091 - DNA, 20 bp, mouse
gtcagcggaggaaaaaagtc

SEQ ID NO: 619092 - DNA, 20 bp, mouse
gaagttcaggctgggaggag

SEQ ID NO: 619093 - DNA, 20 bp, mouse
gtgtttgttagccttagagg

SEQ ID NO: 619094 - DNA, 20 bp, mouse
gagatggccgagacagcaca

SEQ ID NO: 619095 - DNA, 20 bp, mouse
ggcgagcatccactcagcgg

SEQ ID NO: 619096 - DNA, 20 bp, mouse
gcggccacagggtagagcgg

SEQ ID NO: 619097 - DNA, 20 bp, mouse
ggagcctccgctctaccctg

SEQ ID NO: 619098 - DNA, 20 bp, mouse
gtcctcaaggggatgaagac

SEQ ID NO: 619099 - DNA, 20 bp, mouse
ggaactgcaagcccttgatc

SEQ ID NO: 619100 - DNA, 20 bp, mouse
gcggggccgcgggtcctcaa

SEQ ID NO: 619101 - DNA, 20 bp, mouse
gccctgtaccctaggatgag

SEQ ID NO: 619102 - DNA, 20 bp, mouse
gagccccgcccctcatccta

SEQ ID NO: 619103 - DNA, 20 bp, mouse
gtcatccccttgaggacccg

SEQ ID NO: 619104 - DNA, 20 bp, mouse
gcccatcaggaactccgtgc

SEQ ID NO: 619105 - DNA, 20 bp, mouse
gcatgaccagatccagatca

SEQ ID NO: 619106 - DNA, 20 bp, mouse
ggcgggccgaagcatgtgta

SEQ ID NO: 619107 - DNA, 20 bp, mouse
gccgcgcgcgagatgatgga

SEQ ID NO: 619108 - DNA, 20 bp, mouse
gggcatgcgggtgctccagg

SEQ ID NO: 619109 - DNA, 20 bp, mouse
ggcaggccgtcgatggagaa

SEQ ID NO: 619110 - DNA, 20 bp, mouse
gtcgatggagaagggcaccg

SEQ ID NO: 619111 - DNA, 20 bp, mouse
gccatcgacggcctgctcag

SEQ ID NO: 619112 - DNA, 20 bp, mouse
gagccccgcgcgcgagatga

SEQ ID NO: 619113 - DNA, 20 bp, mouse
ggaagcatgtgtagggctcc

SEQ ID NO: 619114 - DNA, 20 bp, mouse
gcgcaggcagccggcagcag

SEQ ID NO: 619115 - DNA, 20 bp, mouse
gggccagctcgtacacgtgg

SEQ ID NO: 619116 - DNA, 20 bp, mouse
gccctgctcggctggaccat

SEQ ID NO: 619117 - DNA, 20 bp, mouse
ggaccatgggcgtcttgggg

SEQ ID NO: 619118 - DNA, 20 bp, mouse
gctgccgggagtcagagtcg

SEQ ID NO: 619119 - DNA, 20 bp, mouse
gctggaccatgggcgtcttg

SEQ ID NO: 619120 - DNA, 20 bp, mouse
ggtgcagcgggtcccctgct

SEQ ID NO: 619121 - DNA, 20 bp, mouse
gggagcgcagacgggtgcag

SEQ ID NO: 619122 - DNA, 20 bp, mouse
gcgccgccccaagacgccca

SEQ ID NO: 619123 - DNA, 20 bp, mouse
ggtgtggcacggaaagggag

SEQ ID NO: 619124 - DNA, 20 bp, mouse
ggccgaggcactagccaata

SEQ ID NO: 619125 - DNA, 20 bp, mouse
gctgcagccgtgctcacggt

SEQ ID NO: 619126 - DNA, 20 bp, mouse
gtaaaaggggagcggcgaag

SEQ ID NO: 619127 - DNA, 20 bp, mouse
ggcagactgaataataaaag

SEQ ID NO: 619128 - DNA, 20 bp, mouse
gggcccggggcccttcgaca

SEQ ID NO: 619129 - DNA, 20 bp, mouse
gaggggagcggcgaagaggc

SEQ ID NO: 619130 - DNA, 20 bp, mouse
gaagacaggaccatgtcgaa

SEQ ID NO: 619131 - DNA, 20 bp, mouse
gcccagcctccgagtcggaa

SEQ ID NO: 619132 - DNA, 20 bp, mouse
gctgggccgagccggaggaa

SEQ ID NO: 619133 - DNA, 20 bp, mouse
ggcgctgtgggtcttcggcg

SEQ ID NO: 619134 - DNA, 20 bp, mouse
gtgcagcacctgagcggtag

SEQ ID NO: 619135 - DNA, 20 bp, mouse
gagcaggttggaaccggtct

SEQ ID NO: 619136 - DNA, 20 bp, mouse
gccaggcactgacctgtagt

SEQ ID NO: 619137 - DNA, 20 bp, mouse
gccgtcggtttcgaaagcgg

SEQ ID NO: 619138 - DNA, 20 bp, mouse
gatgccgtcggtttcgaaag

SEQ ID NO: 619139 - DNA, 20 bp, mouse
gcgtgacccgcaagagctgg

SEQ ID NO: 619140 - DNA, 20 bp, mouse
gggcgctgccactccacctt

SEQ ID NO: 619141 - DNA, 20 bp, mouse
gggtttctctgtctgcgggg

SEQ ID NO: 619142 - DNA, 20 bp, mouse
ggcggcggcccgcgcctgga

SEQ ID NO: 619143 - DNA, 20 bp, mouse
gagtccagcccccaagccag

SEQ ID NO: 619144 - DNA, 20 bp, mouse
gaggccacggaccgcagccc

SEQ ID NO: 619145 - DNA, 20 bp, mouse
ggccgccgcctaaggtggag

SEQ ID NO: 619146 - DNA, 20 bp, mouse
gaaatcgaacctgaagttaa

SEQ ID NO: 619147 - DNA, 20 bp, mouse
gtaccatgacaactacggaa

SEQ ID NO: 619148 - DNA, 20 bp, mouse
gtcatgcctgggaatcacgg

SEQ ID NO: 619149 - DNA, 20 bp, mouse
ggtgtgaagcgaagagtggt

SEQ ID NO: 619150 - DNA, 20 bp, mouse
gaatggtgtgaagcgaagag

SEQ ID NO: 619151 - DNA, 20 bp, mouse
gtttcaagaatgagacggaa

SEQ ID NO: 619152 - DNA, 20 bp, mouse
gacaactacggaaaggtgag

SEQ ID NO: 619153 - DNA, 20 bp, mouse
gctcctaagacagaggacca

SEQ ID NO: 619154 - DNA, 20 bp, mouse
gtccctcagcctttaacttc

SEQ ID NO: 619155 - DNA, 20 bp, mouse
gacctgaagttaaaggctga

SEQ ID NO: 619156 - DNA, 20 bp, mouse
ggagggcaggccattcgtgt

SEQ ID NO: 619157 - DNA, 20 bp, mouse
gcagcctggcaggtctccag

SEQ ID NO: 619158 - DNA, 20 bp, mouse
gtccccatactccaggccga

SEQ ID NO: 619159 - DNA, 20 bp, mouse
gcttctggccatggcgggac

SEQ ID NO: 619160 - DNA, 20 bp, mouse
ggctcctccagcccacagat

SEQ ID NO: 619161 - DNA, 20 bp, mouse
ggccctcggcctggagtatg

SEQ ID NO: 619162 - DNA, 20 bp, mouse
gaaccagcttctggccatgg

SEQ ID NO: 619163 - DNA, 20 bp, mouse
gcctgggccaaatcgtcagg

SEQ ID NO: 619164 - DNA, 20 bp, mouse
ggactgatgtcccacacgaa

SEQ ID NO: 619165 - DNA, 20 bp, mouse
gtgcaaccagcttctggcca

SEQ ID NO: 619166 - DNA, 20 bp, mouse
gtccaggggtctgagagcgg

SEQ ID NO: 619167 - DNA, 20 bp, mouse
gtcgcgcacgcgcaccgcag

SEQ ID NO: 619168 - DNA, 20 bp, mouse
gggcgagcagcgttacggag

SEQ ID NO: 619169 - DNA, 20 bp, mouse
gacgcgcaccgcagcggtgg

SEQ ID NO: 619170 - DNA, 20 bp, mouse
ggacggcggttcctgtccag

SEQ ID NO: 619171 - DNA, 20 bp, mouse
gcgcacgcgcaccgcagcgg

SEQ ID NO: 619172 - DNA, 20 bp, mouse
gaccgccgctctcagacccc

SEQ ID NO: 619173 - DNA, 20 bp, mouse
gtgctcggcgccgacaccca

SEQ ID NO: 619174 - DNA, 20 bp, mouse
gtttgaggcgagcagcgtta

SEQ ID NO: 619175 - DNA, 20 bp, mouse
gctaggcctaggccgtaatc

SEQ ID NO: 619176 - DNA, 20 bp, mouse
gaggcactaggtgagttccg

SEQ ID NO: 619177 - DNA, 20 bp, mouse
gcctatcgtcggagtggagg

SEQ ID NO: 619178 - DNA, 20 bp, mouse
ggttggtgctgggaaacccg

SEQ ID NO: 619179 - DNA, 20 bp, mouse
gggagcccgagcgctggagt

SEQ ID NO: 619180 - DNA, 20 bp, mouse
ggagggggaaggaggatccc

SEQ ID NO: 619181 - DNA, 20 bp, mouse
gcctccgggagaggggtctg

SEQ ID NO: 619182 - DNA, 20 bp, mouse
gccgcactccagctctccgg

SEQ ID NO: 619183 - DNA, 20 bp, mouse
gctcgtccctatcgtcggag

SEQ ID NO: 619184 - DNA, 20 bp, mouse
gctgcagtctgagggagtgt

SEQ ID NO: 619185 - DNA, 20 bp, mouse
gaccagctcgtccctatcgt

SEQ ID NO: 619186 - DNA, 20 bp, mouse
ggggatgcgctcggaagagg

SEQ ID NO: 619187 - DNA, 20 bp, mouse
gcttccgagcgcatccccac

SEQ ID NO: 619188 - DNA, 20 bp, mouse
gttcgttctcgcggaggtgg

SEQ ID NO: 619189 - DNA, 20 bp, mouse
gcaagcctcgcgaggagaag

SEQ ID NO: 619190 - DNA, 20 bp, mouse
gacgaagcctcgcgaggact

SEQ ID NO: 619191 - DNA, 20 bp, mouse
gcgagcgcatccccaccggc

SEQ ID NO: 619192 - DNA, 20 bp, mouse
gagggctgcgcctaagcctc

SEQ ID NO: 619193 - DNA, 20 bp, mouse
ggagtcaccgcggaaggagt

SEQ ID NO: 619194 - DNA, 20 bp, mouse
gtcaccgcggaaggagtcgg

SEQ ID NO: 619195 - DNA, 20 bp, mouse
gggcttcgttctcgcggagg

SEQ ID NO: 619196 - DNA, 20 bp, mouse
ggtctctcccggagagtcgt

SEQ ID NO: 619197 - DNA, 20 bp, mouse
gtcgtaggtgcccggcgtaa

SEQ ID NO: 619198 - DNA, 20 bp, mouse
gacggttacgctctttagag

SEQ ID NO: 619199 - DNA, 20 bp, mouse
ggagctcctgaggtctctcc

SEQ ID NO: 619200 - DNA, 20 bp, mouse
gagcgtaaccgtggccatga

SEQ ID NO: 619201 - DNA, 20 bp, mouse
gcgggcacctacgactctcc

SEQ ID NO: 619202 - DNA, 20 bp, mouse
ggagcaaggtgcctatcggg

SEQ ID NO: 619203 - DNA, 20 bp, mouse
ggaaggaagaaaaagatcat

SEQ ID NO: 619204 - DNA, 20 bp, mouse
gatcgggtggtggcacaaga

SEQ ID NO: 619205 - DNA, 20 bp, mouse
ggttacgctctttagagcgg

SEQ ID NO: 619206 - DNA, 20 bp, mouse
gcttgagccagtctcagagg

SEQ ID NO: 619207 - DNA, 20 bp, mouse
gtagctggggctgaccagag

SEQ ID NO: 619208 - DNA, 20 bp, mouse
gagcagggcagaagttagga

SEQ ID NO: 619209 - DNA, 20 bp, mouse
ggaggggtttgggcatatat

SEQ ID NO: 619210 - DNA, 20 bp, mouse
gcgagcagcctctaactgca

SEQ ID NO: 619211 - DNA, 20 bp, mouse
gggtgttctgggggttgaca

SEQ ID NO: 619212 - DNA, 20 bp, mouse
ggagcatctcctggtagatg

SEQ ID NO: 619213 - DNA, 20 bp, mouse
gctggctcaaggaggggttt

SEQ ID NO: 619214 - DNA, 20 bp, mouse
gttctctacagaagcctctc

SEQ ID NO: 619215 - DNA, 20 bp, mouse
gaaggtgaggaggtgttctg

SEQ ID NO: 619216 - DNA, 20 bp, mouse
gtgtgcagcaccggagaaga

SEQ ID NO: 619217 - DNA, 20 bp, mouse
ggaagtctctgtactcacac

SEQ ID NO: 619218 - DNA, 20 bp, mouse
gaggagaatagagagccagt

SEQ ID NO: 619219 - DNA, 20 bp, mouse
gacttctcagagcagcccac

SEQ ID NO: 619220 - DNA, 20 bp, mouse
gggagcgtcagaggatacag

SEQ ID NO: 619221 - DNA, 20 bp, mouse
gggaagggtggtctgtgagt

SEQ ID NO: 619222 - DNA, 20 bp, mouse
ggggaggaggcatctcacat

SEQ ID NO: 619223 - DNA, 20 bp, mouse
gtgcgagtacggacaaacag

SEQ ID NO: 619224 - DNA, 20 bp, mouse
ggtggtctgtgagtgggagg

SEQ ID NO: 619225 - DNA, 20 bp, mouse
gtggggtagaaaagcatctc

SEQ ID NO: 619226 - DNA, 20 bp, mouse
gccagcagaatcaggatcag

SEQ ID NO: 619227 - DNA, 20 bp, mouse
gtcaggggcaaggtctggac

SEQ ID NO: 619228 - DNA, 20 bp, mouse
gcaggatcaggggcaaggtc

SEQ ID NO: 619229 - DNA, 20 bp, mouse
gtccagttcccagcgcagta

SEQ ID NO: 619230 - DNA, 20 bp, mouse
ggccatactgcgctgggaac

SEQ ID NO: 619231 - DNA, 20 bp, mouse
gcaggacagccagcagaatc

SEQ ID NO: 619232 - DNA, 20 bp, mouse
ggctctcaaggacagaatgt

SEQ ID NO: 619233 - DNA, 20 bp, mouse
gtggggttgagagttactag

SEQ ID NO: 619234 - DNA, 20 bp, mouse
ggtggatgccatactgcgct

SEQ ID NO: 619235 - DNA, 20 bp, mouse
gggtttcagagcgctagaca

SEQ ID NO: 619236 - DNA, 20 bp, mouse
gcatcgcgaaggctcatctc

SEQ ID NO: 619237 - DNA, 20 bp, mouse
gggagcaggtgcgcgttctc

SEQ ID NO: 619238 - DNA, 20 bp, mouse
gaggcatccgagagccagca

SEQ ID NO: 619239 - DNA, 20 bp, mouse
gcaggcagagtgcatcgcga

SEQ ID NO: 619240 - DNA, 20 bp, mouse
ggccggggagaagacctcca

SEQ ID NO: 619241 - DNA, 20 bp, mouse
ggccctggaggtcttctccc

SEQ ID NO: 619242 - DNA, 20 bp, mouse
ggtgtggctggagtaagccg

SEQ ID NO: 619243 - DNA, 20 bp, mouse
gacaggtgagcggagctgca

SEQ ID NO: 619244 - DNA, 20 bp, mouse
gcgggcgatgctcctgctct

SEQ ID NO: 619245 - DNA, 20 bp, mouse
gtgacccctgaactgagggg

SEQ ID NO: 619246 - DNA, 20 bp, mouse
gtgtaggccagaggtgtcgg

SEQ ID NO: 619247 - DNA, 20 bp, mouse
gcaggcctgaccaggcttag

SEQ ID NO: 619248 - DNA, 20 bp, mouse
gccaagtgaccagcaactgt

SEQ ID NO: 619249 - DNA, 20 bp, mouse
gcacttgatcaggcctgacc

SEQ ID NO: 619250 - DNA, 20 bp, mouse
gtgctccagagagaatgtag

SEQ ID NO: 619251 - DNA, 20 bp, mouse
ggcaccaggagaagcagggg

SEQ ID NO: 619252 - DNA, 20 bp, mouse
gcttggactgccaggagaac

SEQ ID NO: 619253 - DNA, 20 bp, mouse
gtcccccaaagcctgagtct

SEQ ID NO: 619254 - DNA, 20 bp, mouse
gaacagcctgggacctggaa

SEQ ID NO: 619255 - DNA, 20 bp, mouse
gtcggtccaggaggtgtaat

SEQ ID NO: 619256 - DNA, 20 bp, mouse
ggcacagtagaggacctgga

SEQ ID NO: 619257 - DNA, 20 bp, mouse
gagctggggctgcacagtag

SEQ ID NO: 619258 - DNA, 20 bp, mouse
gtgcctgaggctgctcccgg

SEQ ID NO: 619259 - DNA, 20 bp, mouse
gagcctccgggagcagcctc

SEQ ID NO: 619260 - DNA, 20 bp, mouse
gcccgtggggccccatggct

SEQ ID NO: 619261 - DNA, 20 bp, mouse
gtgtttcccgtggggcccca

SEQ ID NO: 619262 - DNA, 20 bp, mouse
gccagctgctctgtccgcct

SEQ ID NO: 619263 - DNA, 20 bp, mouse
gcagtccacaaccaaggaag

SEQ ID NO: 619264 - DNA, 20 bp, mouse
gtgctctgtccgcctgggct

SEQ ID NO: 619265 - DNA, 20 bp, mouse
gggaaactcagcccagccat

SEQ ID NO: 619266 - DNA, 20 bp, mouse
ggcggccaacggggactgag

SEQ ID NO: 619267 - DNA, 20 bp, mouse
gaggtgctggagccacactg

SEQ ID NO: 619268 - DNA, 20 bp, mouse
gtgctccagcgcggccaacg

SEQ ID NO: 619269 - DNA, 20 bp, mouse
gcttcagtccccacctatat

SEQ ID NO: 619270 - DNA, 20 bp, mouse
gctcaccgctcagtccccgt

SEQ ID NO: 619271 - DNA, 20 bp, mouse
gatctgctgagagaggtcat

SEQ ID NO: 619272 - DNA, 20 bp, mouse
gagcagcccgacccacacct

SEQ ID NO: 619273 - DNA, 20 bp, mouse
gagtccccacctatataggc

SEQ ID NO: 619274 - DNA, 20 bp, mouse
gtggctcttcctgcctatat

SEQ ID NO: 619275 - DNA, 20 bp, mouse
ggtgagggtcgcccaggtgt

SEQ ID NO: 619276 - DNA, 20 bp, mouse
ggaggagttcaaaatactca

SEQ ID NO: 619277 - DNA, 20 bp, mouse
gaaggaaacctaagtttgaa

SEQ ID NO: 619278 - DNA, 20 bp, mouse
gccaccttcccttcaaactt

SEQ ID NO: 619279 - DNA, 20 bp, mouse
gtactcagggaagattttag

SEQ ID NO: 619280 - DNA, 20 bp, mouse
gtgacaagaatacatacgag

SEQ ID NO: 619281 - DNA, 20 bp, mouse
gatctgcccaccgcagagta

SEQ ID NO: 619282 - DNA, 20 bp, mouse
gcagtcagacgagtgtccct

SEQ ID NO: 619283 - DNA, 20 bp, mouse
gcaggaaaaagcaatattag

SEQ ID NO: 619284 - DNA, 20 bp, mouse
gaaatggaagccatactctg

SEQ ID NO: 619285 - DNA, 20 bp, mouse
gccaactccataagaagcaa

SEQ ID NO: 619286 - DNA, 20 bp, mouse
gtagaggcctaggggtgaga

SEQ ID NO: 619287 - DNA, 20 bp, mouse
ggcagccagggttagagatt

SEQ ID NO: 619288 - DNA, 20 bp, mouse
gaaggaccgtagaggcctag

SEQ ID NO: 619289 - DNA, 20 bp, mouse
ggccagggttagagatttgg

SEQ ID NO: 619290 - DNA, 20 bp, mouse
gtcctccaaatctctaaccc

SEQ ID NO: 619291 - DNA, 20 bp, mouse
gcgtgcgtcctcctggcccc

SEQ ID NO: 619292 - DNA, 20 bp, mouse
gtagagatttggaggagcca

SEQ ID NO: 619293 - DNA, 20 bp, mouse
gtagcagatgctcgggactt

SEQ ID NO: 619294 - DNA, 20 bp, mouse
ggcatctgctagccgaggac

SEQ ID NO: 619295 - DNA, 20 bp, mouse
gcctcggctagcagatgctc

SEQ ID NO: 619296 - DNA, 20 bp, mouse
gcacccggaaatgattgtgg

SEQ ID NO: 619297 - DNA, 20 bp, mouse
ggccctctccaagcccaacc

SEQ ID NO: 619298 - DNA, 20 bp, mouse
ggcacgcgcgtctccaggtt

SEQ ID NO: 619299 - DNA, 20 bp, mouse
gcgcagcagcgacttaagac

SEQ ID NO: 619300 - DNA, 20 bp, mouse
gtcgctgctgcgcgtcacaa

SEQ ID NO: 619301 - DNA, 20 bp, mouse
gtcatttccgggtgaaaggt

SEQ ID NO: 619302 - DNA, 20 bp, mouse
gaaacaggggtaaggagaag

SEQ ID NO: 619303 - DNA, 20 bp, mouse
gcctgccgtggatctgaatg

SEQ ID NO: 619304 - DNA, 20 bp, mouse
ggggcactgactggaatagg

SEQ ID NO: 619305 - DNA, 20 bp, mouse
gggaacctcattcagatcca

SEQ ID NO: 619306 - DNA, 20 bp, mouse
ggggcaagcggggcccaaga

SEQ ID NO: 619307 - DNA, 20 bp, mouse
gcttaaggaaacgccggtag

SEQ ID NO: 619308 - DNA, 20 bp, mouse
ggaccggaggggaggagggt

SEQ ID NO: 619309 - DNA, 20 bp, mouse
gcttgactactcccccccag

SEQ ID NO: 619310 - DNA, 20 bp, mouse
gcagtggacgagaccaaacg

SEQ ID NO: 619311 - DNA, 20 bp, mouse
ggatggccgctctccgctac

SEQ ID NO: 619312 - DNA, 20 bp, mouse
gggcacgtcgaagcgatggg

SEQ ID NO: 619313 - DNA, 20 bp, mouse
gcgcacgtgcagcctggcag

SEQ ID NO: 619314 - DNA, 20 bp, mouse
gcccaagtcccggccccgtt

SEQ ID NO: 619315 - DNA, 20 bp, mouse
gaacacccaggtgaccggag

SEQ ID NO: 619316 - DNA, 20 bp, mouse
ggcccgcctgaagggtgact

SEQ ID NO: 619317 - DNA, 20 bp, mouse
gcgcctgaagggtgactggg

SEQ ID NO: 619318 - DNA, 20 bp, mouse
gaagcgcagtggcgcgagtt

SEQ ID NO: 619319 - DNA, 20 bp, mouse
gtacgagcacatcaacgagg

SEQ ID NO: 619320 - DNA, 20 bp, mouse
gtagcaaggacggcaggggt

SEQ ID NO: 619321 - DNA, 20 bp, mouse
ggaccttgggcccgcctgaa

SEQ ID NO: 619322 - DNA, 20 bp, mouse
ggagaaatagatgtattaac

SEQ ID NO: 619323 - DNA, 20 bp, mouse
gtcaagggcagatttcagca

SEQ ID NO: 619324 - DNA, 20 bp, mouse
ggcctgggccatcctgacct

SEQ ID NO: 619325 - DNA, 20 bp, mouse
gtcgagcgagccttcgatca

SEQ ID NO: 619326 - DNA, 20 bp, mouse
ggcacatgcgtagtgctcca

SEQ ID NO: 619327 - DNA, 20 bp, mouse
gggctacccaggtcaagctg

SEQ ID NO: 619328 - DNA, 20 bp, mouse
gtgggtaccctggactccta

SEQ ID NO: 619329 - DNA, 20 bp, mouse
gtccgagccgtaggagtcca

SEQ ID NO: 619330 - DNA, 20 bp, mouse
gggtcaagctggggaaaccc

SEQ ID NO: 619331 - DNA, 20 bp, mouse
gagtgcaggtggaagctccg

SEQ ID NO: 619332 - DNA, 20 bp, mouse
gaagtcgccaggctgcacgt

SEQ ID NO: 619333 - DNA, 20 bp, mouse
ggtattgcgggacacagtgc

SEQ ID NO: 619334 - DNA, 20 bp, mouse
gggcgattgcagcttaacct

SEQ ID NO: 619335 - DNA, 20 bp, mouse
gcacctcagacaccgaacga

SEQ ID NO: 619336 - DNA, 20 bp, mouse
gcctctaggacttacccaga

SEQ ID NO: 619337 - DNA, 20 bp, mouse
gccctcaggcaggcccgacc

SEQ ID NO: 619338 - DNA, 20 bp, mouse
gctgcctgagggttagaaca

SEQ ID NO: 619339 - DNA, 20 bp, mouse
gggagcccggcgtgtcctct

SEQ ID NO: 619340 - DNA, 20 bp, mouse
gaagctgtcccaaggcggag

SEQ ID NO: 619341 - DNA, 20 bp, mouse
gtccacgatacccacaaagg

SEQ ID NO: 619342 - DNA, 20 bp, mouse
gaaatggcgggccgatctgc

SEQ ID NO: 619343 - DNA, 20 bp, mouse
gtggcgacccagcagctcaa

SEQ ID NO: 619344 - DNA, 20 bp, mouse
gaggggaaggaggccgaacc

SEQ ID NO: 619345 - DNA, 20 bp, mouse
gtctgccggaaggagcccag

SEQ ID NO: 619346 - DNA, 20 bp, mouse
gcaggccgctcggcagactg

SEQ ID NO: 619347 - DNA, 20 bp, mouse
ggacggaagttagaagatgg

SEQ ID NO: 619348 - DNA, 20 bp, mouse
ggcgtccgcagtctgccgag

SEQ ID NO: 619349 - DNA, 20 bp, mouse
gcagcgcggctctacactga

SEQ ID NO: 619350 - DNA, 20 bp, mouse
gctgccgagcggcctgctcc

SEQ ID NO: 619351 - DNA, 20 bp, mouse
gtcactgccacctcaccgag

SEQ ID NO: 619352 - DNA, 20 bp, mouse
gactgacggaagttagaaga

SEQ ID NO: 619353 - DNA, 20 bp, mouse
gcgtcccggagcaggccgct

SEQ ID NO: 619354 - DNA, 20 bp, mouse
gcgaagtagcacttgcgtcc

SEQ ID NO: 619355 - DNA, 20 bp, mouse
ggaggtggcagtgagacgtt

SEQ ID NO: 619356 - DNA, 20 bp, mouse
gtgtctgcagcggtgaccgt

SEQ ID NO: 619357 - DNA, 20 bp, mouse
gcagcggtgaccgtgggaaa

SEQ ID NO: 619358 - DNA, 20 bp, mouse
gcgcctcgggatcaacccag

SEQ ID NO: 619359 - DNA, 20 bp, mouse
ggaaggacccggccctgctg

SEQ ID NO: 619360 - DNA, 20 bp, mouse
ggtaaaccccgcggagaagg

SEQ ID NO: 619361 - DNA, 20 bp, mouse
gcaaagcaagatggggtcgg

SEQ ID NO: 619362 - DNA, 20 bp, mouse
gatgctcaccgagaaggacc

SEQ ID NO: 619363 - DNA, 20 bp, mouse
ggggcagaggtcgtaggtag

SEQ ID NO: 619364 - DNA, 20 bp, mouse
gcagtgcacaccgggaaact

SEQ ID NO: 619365 - DNA, 20 bp, mouse
ggtcactcgagaagcaggta

SEQ ID NO: 619366 - DNA, 20 bp, mouse
gcgggcggcgaccgacaaca

SEQ ID NO: 619367 - DNA, 20 bp, mouse
ggtccctgtgaccgacgagg

SEQ ID NO: 619368 - DNA, 20 bp, mouse
ggtcgtccctgtgaccgacg

SEQ ID NO: 619369 - DNA, 20 bp, mouse
gcggcccgaagaggagcggg

SEQ ID NO: 619370 - DNA, 20 bp, mouse
gctggccactcagggactcg

SEQ ID NO: 619371 - DNA, 20 bp, mouse
gaaccacctcgtcggtcaca

SEQ ID NO: 619372 - DNA, 20 bp, mouse
ggcgaacgggcccgagcggg

SEQ ID NO: 619373 - DNA, 20 bp, mouse
ggggccgtcgttcgaacgaa

SEQ ID NO: 619374 - DNA, 20 bp, mouse
ggggaagtggccgataggac

SEQ ID NO: 619375 - DNA, 20 bp, mouse
ggccgcagggaacgagatcg

SEQ ID NO: 619376 - DNA, 20 bp, mouse
ggggtttgcggggtccagag

SEQ ID NO: 619377 - DNA, 20 bp, mouse
gggactaagagagccccggg

SEQ ID NO: 619378 - DNA, 20 bp, mouse
ggaattctttggttgacctt

SEQ ID NO: 619379 - DNA, 20 bp, mouse
gctactctggttgcgcttgt

SEQ ID NO: 619380 - DNA, 20 bp, mouse
gacttaccttcagaattctt

SEQ ID NO: 619381 - DNA, 20 bp, mouse
gcagagtagtactccacttc

SEQ ID NO: 619382 - DNA, 20 bp, mouse
gacccggactaagagagccc

SEQ ID NO: 619383 - DNA, 20 bp, mouse
ggctcaacaaagcacctccc

SEQ ID NO: 619384 - DNA, 20 bp, mouse
ggtaacggaaaccacctctc

SEQ ID NO: 619385 - DNA, 20 bp, mouse
gagaggtaaggcttcgaggt

SEQ ID NO: 619386 - DNA, 20 bp, mouse
gtagaggtgaccgatcctgg

SEQ ID NO: 619387 - DNA, 20 bp, mouse
gagccggctcagagctctgg

SEQ ID NO: 619388 - DNA, 20 bp, mouse
ggaaagccggctcagagctc

SEQ ID NO: 619389 - DNA, 20 bp, mouse
gaggtagaggtgaccgatcc

SEQ ID NO: 619390 - DNA, 20 bp, mouse
gtctcgcgaaaaacctccca

SEQ ID NO: 619391 - DNA, 20 bp, mouse
gcgctcctcccggaagtgac

SEQ ID NO: 619392 - DNA, 20 bp, mouse
gggtgaccgatcctgggggt

SEQ ID NO: 619393 - DNA, 20 bp, mouse
gtggccagcgatgacctcag

SEQ ID NO: 619394 - DNA, 20 bp, mouse
gcggcctaacaccgaccccc

SEQ ID NO: 619395 - DNA, 20 bp, mouse
gccagggccgccgtcaccat

SEQ ID NO: 619396 - DNA, 20 bp, mouse
gtgagagcggaccacaggca

SEQ ID NO: 619397 - DNA, 20 bp, mouse
gatggctgatcctggactgg

SEQ ID NO: 619398 - DNA, 20 bp, mouse
gctcgatgagagcggaccac

SEQ ID NO: 619399 - DNA, 20 bp, mouse
gccaggatcagccatggaca

SEQ ID NO: 619400 - DNA, 20 bp, mouse
gctcgggagagcatcaataa

SEQ ID NO: 619401 - DNA, 20 bp, mouse
ggacagcagcggcaatcaga

SEQ ID NO: 619402 - DNA, 20 bp, mouse
gatggtgaaggtcaattcca

SEQ ID NO: 619403 - DNA, 20 bp, mouse
gctcactcgctcgatgagag

SEQ ID NO: 619404 - DNA, 20 bp, mouse
gcgctgggaccagacagcag

SEQ ID NO: 619405 - DNA, 20 bp, mouse
ggcaaacacaacccatgagg

SEQ ID NO: 619406 - DNA, 20 bp, mouse
gaggttgggagcatgctgtg

SEQ ID NO: 619407 - DNA, 20 bp, mouse
ggggtgttgctaggagtcag

SEQ ID NO: 619408 - DNA, 20 bp, mouse
ggagtggaagggcaagtctg

SEQ ID NO: 619409 - DNA, 20 bp, mouse
gccttgggtggagcaggtcc

SEQ ID NO: 619410 - DNA, 20 bp, mouse
gtggggaaggagggatactg

SEQ ID NO: 619411 - DNA, 20 bp, mouse
gcttggtttttgggcctcag

SEQ ID NO: 619412 - DNA, 20 bp, mouse
gtgtgggagcttgggagcaa

SEQ ID NO: 619413 - DNA, 20 bp, mouse
gtaggtggctccaggagttg

SEQ ID NO: 619414 - DNA, 20 bp, mouse
gctccaggcgggacagccgg

SEQ ID NO: 619415 - DNA, 20 bp, mouse
gagaccagagcttcagggca

SEQ ID NO: 619416 - DNA, 20 bp, mouse
gacgcgaccggaagcaccgg

SEQ ID NO: 619417 - DNA, 20 bp, mouse
gcccacgcgaccggaagcac

SEQ ID NO: 619418 - DNA, 20 bp, mouse
gagcaccggcggcaaggaag

SEQ ID NO: 619419 - DNA, 20 bp, mouse
gccccatggcccaaaccacc

SEQ ID NO: 619420 - DNA, 20 bp, mouse
gggtcgcgtgggttttccga

SEQ ID NO: 619421 - DNA, 20 bp, mouse
ggaaaggcggagcctatgag

SEQ ID NO: 619422 - DNA, 20 bp, mouse
gcccaagaggaaggcgtcag

SEQ ID NO: 619423 - DNA, 20 bp, mouse
gcgcgagcggaggagttcac

SEQ ID NO: 619424 - DNA, 20 bp, mouse
ggatgcgcagggcccaggac

SEQ ID NO: 619425 - DNA, 20 bp, mouse
gggcccaggaccgggtgagt

SEQ ID NO: 619426 - DNA, 20 bp, mouse
gtcacctgggacctccacgg

SEQ ID NO: 619427 - DNA, 20 bp, mouse
gggcggcgagccacatgtga

SEQ ID NO: 619428 - DNA, 20 bp, mouse
ggaagcgcctccctcacatg

SEQ ID NO: 619429 - DNA, 20 bp, mouse
gtcgccgccgtggaggtccc

SEQ ID NO: 619430 - DNA, 20 bp, mouse
ggaggtcccaggtgagcgga

SEQ ID NO: 619431 - DNA, 20 bp, mouse
gggcgagccacatgtgaggg

SEQ ID NO: 619432 - DNA, 20 bp, mouse
gtcccaggtgagcggacggt

SEQ ID NO: 619433 - DNA, 20 bp, mouse
gtccaaccgtccgctcacct

SEQ ID NO: 619434 - DNA, 20 bp, mouse
gctacggcgggcaaccgata

SEQ ID NO: 619435 - DNA, 20 bp, mouse
gatgtggctcgccgccgtgg

SEQ ID NO: 619436 - DNA, 20 bp, mouse
ggaaccccgcggctgaggtg

SEQ ID NO: 619437 - DNA, 20 bp, mouse
gcggtcggcgcagacttagg

SEQ ID NO: 619438 - DNA, 20 bp, mouse
gcgcagcgaatagaaccccg

SEQ ID NO: 619439 - DNA, 20 bp, mouse
gtcggcgcagacttaggagg

SEQ ID NO: 619440 - DNA, 20 bp, mouse
gaagtctgcgccgaccgcgg

SEQ ID NO: 619441 - DNA, 20 bp, mouse
gccccgcgcgagttccgccg

SEQ ID NO: 619442 - DNA, 20 bp, mouse
gcccgcgagtcgcccgccag

SEQ ID NO: 619443 - DNA, 20 bp, mouse
gccgcggctgaggtgcggca

SEQ ID NO: 619444 - DNA, 20 bp, mouse
gcctgcggggcagactaaga

SEQ ID NO: 619445 - DNA, 20 bp, mouse
ggcgcgagttccgccgcggt

SEQ ID NO: 619446 - DNA, 20 bp, mouse
ggcggcagccgcgcaagcag

SEQ ID NO: 619447 - DNA, 20 bp, mouse
ggccgcgcaagcagcggagg

SEQ ID NO: 619448 - DNA, 20 bp, mouse
gggcgacgccatgagcgcag

SEQ ID NO: 619449 - DNA, 20 bp, mouse
ggccatgagcgcagcggcct

SEQ ID NO: 619450 - DNA, 20 bp, mouse
gggctacgaccgcccaaggt

SEQ ID NO: 619451 - DNA, 20 bp, mouse
ggaggccgcgggtcgtggac

SEQ ID NO: 619452 - DNA, 20 bp, mouse
ggcccaggccgctgcgctca

SEQ ID NO: 619453 - DNA, 20 bp, mouse
gggtccggccgaggccaagg

SEQ ID NO: 619454 - DNA, 20 bp, mouse
ggtcgtggacaggcacctgg

SEQ ID NO: 619455 - DNA, 20 bp, mouse
gaggcgctccgggtgtgcgg

SEQ ID NO: 619456 - DNA, 20 bp, mouse
ggagcagcaggccctacacc

SEQ ID NO: 619457 - DNA, 20 bp, mouse
gagggcctgctgctccgagg

SEQ ID NO: 619458 - DNA, 20 bp, mouse
gtgtagggcctgctgctccg

SEQ ID NO: 619459 - DNA, 20 bp, mouse
ggcgtggcgcgcctggtgta

SEQ ID NO: 619460 - DNA, 20 bp, mouse
ggcggaggcgcggcagtcgc

SEQ ID NO: 619461 - DNA, 20 bp, mouse
ggcgcggcctcttcagagag

SEQ ID NO: 619462 - DNA, 20 bp, mouse
gagaggcgtgcagtgcatga

SEQ ID NO: 619463 - DNA, 20 bp, mouse
gggtatgcgcgtgtgagatg

SEQ ID NO: 619464 - DNA, 20 bp, mouse
gccgctgcgcgcaccagagg

SEQ ID NO: 619465 - DNA, 20 bp, mouse
ggcctgctgctccgaggcgg

SEQ ID NO: 619466 - DNA, 20 bp, mouse
ggcggcgcccttatgtgtga

SEQ ID NO: 619467 - DNA, 20 bp, mouse
gttcgggtgagtgagatctg

SEQ ID NO: 619468 - DNA, 20 bp, mouse
gactccaccttcacacataa

SEQ ID NO: 619469 - DNA, 20 bp, mouse
gtggcttcgctccatcccca

SEQ ID NO: 619470 - DNA, 20 bp, mouse
gatgtgtgaaggtggagttc

SEQ ID NO: 619471 - DNA, 20 bp, mouse
gagagttgaggcgcacacac

SEQ ID NO: 619472 - DNA, 20 bp, mouse
gtgaggcgcacacacgggta

SEQ ID NO: 619473 - DNA, 20 bp, mouse
ggcgcccttatgtgtgaagg

SEQ ID NO: 619474 - DNA, 20 bp, mouse
gtaagggcgccgccatgttt

SEQ ID NO: 619475 - DNA, 20 bp, mouse
ggggcgctccggaagttaaa

SEQ ID NO: 619476 - DNA, 20 bp, mouse
gcaccaagcacagaacaggt

SEQ ID NO: 619477 - DNA, 20 bp, mouse
gtgatgaggaaccagagacg

SEQ ID NO: 619478 - DNA, 20 bp, mouse
gtgaggaaccagagacgagg

SEQ ID NO: 619479 - DNA, 20 bp, mouse
ggttcctcatcagcaggcgg

SEQ ID NO: 619480 - DNA, 20 bp, mouse
gggtccagcagtgcttggac

SEQ ID NO: 619481 - DNA, 20 bp, mouse
gggctgcccaggccagtgtg

SEQ ID NO: 619482 - DNA, 20 bp, mouse
gggccattaagagtcaataa

SEQ ID NO: 619483 - DNA, 20 bp, mouse
gtctctggttcctcatcagc

SEQ ID NO: 619484 - DNA, 20 bp, mouse
gacctccagactctgatgtt

SEQ ID NO: 619485 - DNA, 20 bp, mouse
gaaactgccgccaaagacta

SEQ ID NO: 619486 - DNA, 20 bp, mouse
gtctcaggaaggggtcgtag

SEQ ID NO: 619487 - DNA, 20 bp, mouse
ggacatgtctgcagaagctg

SEQ ID NO: 619488 - DNA, 20 bp, mouse
gcgaccccggttctcaggaa

SEQ ID NO: 619489 - DNA, 20 bp, mouse
gccttcgctgggagctggta

SEQ ID NO: 619490 - DNA, 20 bp, mouse
gtgactgactgggtagtcag

SEQ ID NO: 619491 - DNA, 20 bp, mouse
ggacagggacagctaatatg

SEQ ID NO: 619492 - DNA, 20 bp, mouse
gcccagcgaccccggttctc

SEQ ID NO: 619493 - DNA, 20 bp, mouse
ggaccccttcctgagaaccg

SEQ ID NO: 619494 - DNA, 20 bp, mouse
gctcccagcgaagggtgagg

SEQ ID NO: 619495 - DNA, 20 bp, mouse
ggagcacagttcctggaggc

SEQ ID NO: 619496 - DNA, 20 bp, mouse
gccatggaggcgaacgggtt

SEQ ID NO: 619497 - DNA, 20 bp, mouse
ggctcagttactgtttacca

SEQ ID NO: 619498 - DNA, 20 bp, mouse
ggcggagcctcagattaaag

SEQ ID NO: 619499 - DNA, 20 bp, mouse
gtccctggaatggagactgc

SEQ ID NO: 619500 - DNA, 20 bp, mouse
gtgtttaccatggaggcgaa

SEQ ID NO: 619501 - DNA, 20 bp, mouse
gcgcacggtagtccctggaa

SEQ ID NO: 619502 - DNA, 20 bp, mouse
gtcccgcagtctccattcca

SEQ ID NO: 619503 - DNA, 20 bp, mouse
gggagactgcgggaagaggg

SEQ ID NO: 619504 - DNA, 20 bp, mouse
gagtcccgcacggtagtccc

SEQ ID NO: 619505 - DNA, 20 bp, mouse
gtaaggacatatccctgaat

SEQ ID NO: 619506 - DNA, 20 bp, mouse
gcctcagacccgaggatccg

SEQ ID NO: 619507 - DNA, 20 bp, mouse
gtcagtggcctcggatcctc

SEQ ID NO: 619508 - DNA, 20 bp, mouse
gccgagagcggcctctcacc

SEQ ID NO: 619509 - DNA, 20 bp, mouse
ggtgcgagcacagccagatg

SEQ ID NO: 619510 - DNA, 20 bp, mouse
ggggtctgaggtacgagcat

SEQ ID NO: 619511 - DNA, 20 bp, mouse
gccaccagtgagcccgaggt

SEQ ID NO: 619512 - DNA, 20 bp, mouse
ggaggccactgacccacatc

SEQ ID NO: 619513 - DNA, 20 bp, mouse
gacgccgagataaccgagag

SEQ ID NO: 619514 - DNA, 20 bp, mouse
gcggtgcagctgccaacctc

SEQ ID NO: 619515 - DNA, 20 bp, mouse
gggagcgctagccgggtgag

SEQ ID NO: 619516 - DNA, 20 bp, mouse
gctgcggcagagcgaggaaa

SEQ ID NO: 619517 - DNA, 20 bp, mouse
gtctccttccaacatcacct

SEQ ID NO: 619518 - DNA, 20 bp, mouse
gtagatctcagactgttcct

SEQ ID NO: 619519 - DNA, 20 bp, mouse
gcttctaaaagacgctgctg

SEQ ID NO: 619520 - DNA, 20 bp, mouse
gacgctgctgcggcagagcg

SEQ ID NO: 619521 - DNA, 20 bp, mouse
gacgccaaggaggatgacag

SEQ ID NO: 619522 - DNA, 20 bp, mouse
gagccctggtcaacccagag

SEQ ID NO: 619523 - DNA, 20 bp, mouse
gggatgggaatgctaacact

SEQ ID NO: 619524 - DNA, 20 bp, mouse
gtgccactctgggttgacca

SEQ ID NO: 619525 - DNA, 20 bp, mouse
gcgcctgtgccgagctaaac

SEQ ID NO: 619526 - DNA, 20 bp, mouse
gtgctgctgtagcccaccag

SEQ ID NO: 619527 - DNA, 20 bp, mouse
gtgagctcggcgcccctggt

SEQ ID NO: 619528 - DNA, 20 bp, mouse
gcaggggcgccgagctcatg

SEQ ID NO: 619529 - DNA, 20 bp, mouse
gcgtcggatcaggttgtcgg

SEQ ID NO: 619530 - DNA, 20 bp, mouse
gggaggctcgggtcccacta

SEQ ID NO: 619531 - DNA, 20 bp, mouse
ggcctcccggggaaccaaga

SEQ ID NO: 619532 - DNA, 20 bp, mouse
gcccggggaaccaagagggt

SEQ ID NO: 619533 - DNA, 20 bp, mouse
gttccggctcagaggaactc

SEQ ID NO: 619534 - DNA, 20 bp, mouse
ggaactccgggcgtcggatc

SEQ ID NO: 619535 - DNA, 20 bp, mouse
gtcagaggaactccgggcgt

SEQ ID NO: 619536 - DNA, 20 bp, mouse
gcgccgcggaccagaaggag

SEQ ID NO: 619537 - DNA, 20 bp, mouse
ggttggagttgaacctggta

SEQ ID NO: 619538 - DNA, 20 bp, mouse
ggtcgccagcgggcgatgat

SEQ ID NO: 619539 - DNA, 20 bp, mouse
ggaggggaaggacctcactc

SEQ ID NO: 619540 - DNA, 20 bp, mouse
ggcctgcagcatgtcttcca

SEQ ID NO: 619541 - DNA, 20 bp, mouse
gtccagggcacccacatact

SEQ ID NO: 619542 - DNA, 20 bp, mouse
gtgtcgctgtgagtcgatgg

SEQ ID NO: 619543 - DNA, 20 bp, mouse
ggcctgtgcgtgaagctgta

SEQ ID NO: 619544 - DNA, 20 bp, mouse
gccaaccgcgacgtcgccag

SEQ ID NO: 619545 - DNA, 20 bp, mouse
gctaagatggcgcaggcgga

SEQ ID NO: 619546 - DNA, 20 bp, mouse
ggcgcatgagcagctgtcta

SEQ ID NO: 619547 - DNA, 20 bp, mouse
gtcccagcctgcggccatgt

SEQ ID NO: 619548 - DNA, 20 bp, mouse
ggctccgcggaggagagacg

SEQ ID NO: 619549 - DNA, 20 bp, mouse
gttcagtcgccgatttcccc

SEQ ID NO: 619550 - DNA, 20 bp, mouse
gcttccgcccctcaccaaca

SEQ ID NO: 619551 - DNA, 20 bp, mouse
gaccaacatggccgcaggct

SEQ ID NO: 619552 - DNA, 20 bp, mouse
gagacggagaaggctgccgg

SEQ ID NO: 619553 - DNA, 20 bp, mouse
gctagatccaaagacggaga

SEQ ID NO: 619554 - DNA, 20 bp, mouse
gcgtcggctgggcgggtcga

SEQ ID NO: 619555 - DNA, 20 bp, mouse
gccctcaccaacatggccgc

SEQ ID NO: 619556 - DNA, 20 bp, mouse
ggccgcgcggcaggagggga

SEQ ID NO: 619557 - DNA, 20 bp, mouse
gtcacgccgcgcggcaggag

SEQ ID NO: 619558 - DNA, 20 bp, mouse
gggaggggacggaggagaca

SEQ ID NO: 619559 - DNA, 20 bp, mouse
gaggccgctcgggatcatgg

SEQ ID NO: 619560 - DNA, 20 bp, mouse
gtgtcggcgcgcttacctgg

SEQ ID NO: 619561 - DNA, 20 bp, mouse
ggcggtgctgaccctagcgg

SEQ ID NO: 619562 - DNA, 20 bp, mouse
gaggaagcgggatccagacc

SEQ ID NO: 619563 - DNA, 20 bp, mouse
gccaggcccggcccccgcta

SEQ ID NO: 619564 - DNA, 20 bp, mouse
gagggacccgaggccgagga

SEQ ID NO: 619565 - DNA, 20 bp, mouse
gcagaggccgctcgggatca

SEQ ID NO: 619566 - DNA, 20 bp, mouse
gagccaggcaccctaagaag

SEQ ID NO: 619567 - DNA, 20 bp, mouse
ggctgcaaagcaactggatc

SEQ ID NO: 619568 - DNA, 20 bp, mouse
gatcaggctcagtcatggac

SEQ ID NO: 619569 - DNA, 20 bp, mouse
gtgaaggacaggggacccag

SEQ ID NO: 619570 - DNA, 20 bp, mouse
gggctcagtcatggaccgga

SEQ ID NO: 619571 - DNA, 20 bp, mouse
gagggaggcaggtcctgtcc

SEQ ID NO: 619572 - DNA, 20 bp, mouse
gactggatcaggctcagtca

SEQ ID NO: 619573 - DNA, 20 bp, mouse
gaccttgtgtcggaattctc

SEQ ID NO: 619574 - DNA, 20 bp, mouse
gtcagtcatggaccggaagg

SEQ ID NO: 619575 - DNA, 20 bp, mouse
gctgctaggaggccaccact

SEQ ID NO: 619576 - DNA, 20 bp, mouse
ggctccgcatccaccatctg

SEQ ID NO: 619577 - DNA, 20 bp, mouse
gctgccgcagatggtggatg

SEQ ID NO: 619578 - DNA, 20 bp, mouse
gcccctgctgccgcagatgg

SEQ ID NO: 619579 - DNA, 20 bp, mouse
ggtcatgccatcctcgtcag

SEQ ID NO: 619580 - DNA, 20 bp, mouse
gctgtagtcgtctgtagtcg

SEQ ID NO: 619581 - DNA, 20 bp, mouse
gtaggcagcccagagagtcg

SEQ ID NO: 619582 - DNA, 20 bp, mouse
gtcgtctgtagtcgcggctc

SEQ ID NO: 619583 - DNA, 20 bp, mouse
gctgcccctgctgccgcaga

SEQ ID NO: 619584 - DNA, 20 bp, mouse
gtgagctgcacaccggggaa

SEQ ID NO: 619585 - DNA, 20 bp, mouse
gcagagggcatactcacccg

SEQ ID NO: 619586 - DNA, 20 bp, mouse
ggttacctgtagctcagtgt

SEQ ID NO: 619587 - DNA, 20 bp, mouse
gctcagtgtaggctgttcgg

SEQ ID NO: 619588 - DNA, 20 bp, mouse
gtagctcagtgtaggctgtt

SEQ ID NO: 619589 - DNA, 20 bp, mouse
gcaggacacctcagttgctg

SEQ ID NO: 619590 - DNA, 20 bp, mouse
ggagtgacaagtctcactca

SEQ ID NO: 619591 - DNA, 20 bp, mouse
gataggccccggcagcatga

SEQ ID NO: 619592 - DNA, 20 bp, mouse
gcctagacgtaatggggagg

SEQ ID NO: 619593 - DNA, 20 bp, mouse
gatcaatacaattacttaca

SEQ ID NO: 619594 - DNA, 20 bp, mouse
gcgtatttggaggttaaata

SEQ ID NO: 619595 - DNA, 20 bp, mouse
gaggtaacccttttgagctc

SEQ ID NO: 619596 - DNA, 20 bp, mouse
ggggaaaggcctgagatcca

SEQ ID NO: 619597 - DNA, 20 bp, mouse
gtcgcagcctcagtagccag

SEQ ID NO: 619598 - DNA, 20 bp, mouse
ggcagcagggtcaaccccca

SEQ ID NO: 619599 - DNA, 20 bp, mouse
gttctggccactggctactg

SEQ ID NO: 619600 - DNA, 20 bp, mouse
gtcaaactccctcaccctgg

SEQ ID NO: 619601 - DNA, 20 bp, mouse
ggagatatgccctggatctc

SEQ ID NO: 619602 - DNA, 20 bp, mouse
gaatggcttgagatatgccc

SEQ ID NO: 619603 - DNA, 20 bp, mouse
gacgccttcagacagctgag

SEQ ID NO: 619604 - DNA, 20 bp, mouse
ggccaaaagtggcccgggag

SEQ ID NO: 619605 - DNA, 20 bp, mouse
gggcctttcccaaggtgctc

SEQ ID NO: 619606 - DNA, 20 bp, mouse
ggtccgaaccccaaactcgg

SEQ ID NO: 619607 - DNA, 20 bp, mouse
gttcgtccgaaccccaaact

SEQ ID NO: 619608 - DNA, 20 bp, mouse
gttggggttcggacgaaggt

SEQ ID NO: 619609 - DNA, 20 bp, mouse
ggagggtcagggccccatgg

SEQ ID NO: 619610 - DNA, 20 bp, mouse
gagacgctggggaatgggaa

SEQ ID NO: 619611 - DNA, 20 bp, mouse
ggacatcggccgccgagttt

SEQ ID NO: 619612 - DNA, 20 bp, mouse
ggagggggcgtcttccggtc

SEQ ID NO: 619613 - DNA, 20 bp, mouse
ggcgacgagctcggcccgac

SEQ ID NO: 619614 - DNA, 20 bp, mouse
ggctaaccgtgcgagccctg

SEQ ID NO: 619615 - DNA, 20 bp, mouse
ggagtgaggccggtcgagag

SEQ ID NO: 619616 - DNA, 20 bp, mouse
ggaggctgctgagtaggagg

SEQ ID NO: 619617 - DNA, 20 bp, mouse
gggagaggctgctgagtagg

SEQ ID NO: 619618 - DNA, 20 bp, mouse
ggtgcggagagccggctcgg

SEQ ID NO: 619619 - DNA, 20 bp, mouse
gtagggcctagcccccgagc

SEQ ID NO: 619620 - DNA, 20 bp, mouse
gcagcacactgaagccgaga

SEQ ID NO: 619621 - DNA, 20 bp, mouse
gtggcggaggccggggagtg

SEQ ID NO: 619622 - DNA, 20 bp, mouse
ggacgctgcgctcaccgtct

SEQ ID NO: 619623 - DNA, 20 bp, mouse
ggggggctaggccctacggg

SEQ ID NO: 619624 - DNA, 20 bp, mouse
gggagtgcggagagccggct

SEQ ID NO: 619625 - DNA, 20 bp, mouse
gccgggccgtggtgacagga

SEQ ID NO: 619626 - DNA, 20 bp, mouse
gggctacgggcgcacagcgg

SEQ ID NO: 619627 - DNA, 20 bp, mouse
gtacgggcgcacagcggtgg

SEQ ID NO: 619628 - DNA, 20 bp, mouse
ggagccgcagggtccccgca

SEQ ID NO: 619629 - DNA, 20 bp, mouse
ggcgccaagttccccctcgg

SEQ ID NO: 619630 - DNA, 20 bp, mouse
gcggccgccgagggggaact

SEQ ID NO: 619631 - DNA, 20 bp, mouse
gagaccagccgggcagagtg

SEQ ID NO: 619632 - DNA, 20 bp, mouse
gaacgcgccaagttccccct

SEQ ID NO: 619633 - DNA, 20 bp, mouse
gggcgcggcgacccccgggg

SEQ ID NO: 619634 - DNA, 20 bp, mouse
gtccccgcacggccgccgag

SEQ ID NO: 619635 - DNA, 20 bp, mouse
gccccctcggcggccgtgcg

SEQ ID NO: 619636 - DNA, 20 bp, mouse
gctgtgcggcgagaagatgg

SEQ ID NO: 619637 - DNA, 20 bp, mouse
gatggcggcgacgggagacg

SEQ ID NO: 619638 - DNA, 20 bp, mouse
gtgtctgtgcggcgagaaga

SEQ ID NO: 619639 - DNA, 20 bp, mouse
ggcgagaagatggcggcgac

SEQ ID NO: 619640 - DNA, 20 bp, mouse
gatggcggcccgtctcaatg

SEQ ID NO: 619641 - DNA, 20 bp, mouse
gggggaagcgcggcactgag

SEQ ID NO: 619642 - DNA, 20 bp, mouse
ggagacgcggcgtgagaagc

SEQ ID NO: 619643 - DNA, 20 bp, mouse
ggggcggctgctccaggcga

SEQ ID NO: 619644 - DNA, 20 bp, mouse
gacgccgcctggctctcccg

SEQ ID NO: 619645 - DNA, 20 bp, mouse
gcacggcccgcgctacctgt

SEQ ID NO: 619646 - DNA, 20 bp, mouse
gtcctcagcagaggccggga

SEQ ID NO: 619647 - DNA, 20 bp, mouse
gggaggaggacagacggtga

SEQ ID NO: 619648 - DNA, 20 bp, mouse
gggacagacggtgatggcgg

SEQ ID NO: 619649 - DNA, 20 bp, mouse
gttgcgtcggcagttggagg

SEQ ID NO: 619650 - DNA, 20 bp, mouse
gcagttgcgtcggcagttgg

SEQ ID NO: 619651 - DNA, 20 bp, mouse
gtgccgacgcaactgaagat

SEQ ID NO: 619652 - DNA, 20 bp, mouse
ggagctggcgaaagctggtg

SEQ ID NO: 619653 - DNA, 20 bp, mouse
ggccagacctggatgaacag

SEQ ID NO: 619654 - DNA, 20 bp, mouse
gccagctgcagctgccgtcc

SEQ ID NO: 619655 - DNA, 20 bp, mouse
gaaaaggcggggcccgagtg

SEQ ID NO: 619656 - DNA, 20 bp, mouse
gcccagcaggctagaagcgt

SEQ ID NO: 619657 - DNA, 20 bp, mouse
ggcaggctagaagcgtgggt

SEQ ID NO: 619658 - DNA, 20 bp, mouse
gtagaagcgtgggtcggcgg

SEQ ID NO: 619659 - DNA, 20 bp, mouse
gcccgcggcgacgacggcag

SEQ ID NO: 619660 - DNA, 20 bp, mouse
gtgagcgcccgcggcgacga

SEQ ID NO: 619661 - DNA, 20 bp, mouse
gggctagaagcgtgggtcgg

SEQ ID NO: 619662 - DNA, 20 bp, mouse
ggaggaagcctgagcgcccg

SEQ ID NO: 619663 - DNA, 20 bp, mouse
gacacgaccaggcccgcggg

SEQ ID NO: 619664 - DNA, 20 bp, mouse
ggctgccgccgcacctacca

SEQ ID NO: 619665 - DNA, 20 bp, mouse
gcctaccatggtacagatgg

SEQ ID NO: 619666 - DNA, 20 bp, mouse
gggagaacaggacctggacg

SEQ ID NO: 619667 - DNA, 20 bp, mouse
ggaacaggacctggacgcgg

SEQ ID NO: 619668 - DNA, 20 bp, mouse
gccccggtaaggaagatcca

SEQ ID NO: 619669 - DNA, 20 bp, mouse
gagacgcggtcccccgacct

SEQ ID NO: 619670 - DNA, 20 bp, mouse
gccccggcgctgcatgaccg

SEQ ID NO: 619671 - DNA, 20 bp, mouse
ggcgggcctggggaggagcg

SEQ ID NO: 619672 - DNA, 20 bp, mouse
ggcatgaccgcggagcgcag

SEQ ID NO: 619673 - DNA, 20 bp, mouse
gacctgggcacgcggatcgt

SEQ ID NO: 619674 - DNA, 20 bp, mouse
gctggacgcggcggtcgcgc

SEQ ID NO: 619675 - DNA, 20 bp, mouse
gccgcccggcacgctgaaca

SEQ ID NO: 619676 - DNA, 20 bp, mouse
gggtggaagcgaggtggagg

SEQ ID NO: 619677 - DNA, 20 bp, mouse
gccagtggccggtttgaatg

SEQ ID NO: 619678 - DNA, 20 bp, mouse
gttcttgggcgaacagcgtg

SEQ ID NO: 619679 - DNA, 20 bp, mouse
gcacagccgtgggacacggt

SEQ ID NO: 619680 - DNA, 20 bp, mouse
gggccggggtggaagcgagg

SEQ ID NO: 619681 - DNA, 20 bp, mouse
gctccccgcggtggcttctt

SEQ ID NO: 619682 - DNA, 20 bp, mouse
gttggagcccagctacgcgt

SEQ ID NO: 619683 - DNA, 20 bp, mouse
gaatacgaagcaactcgtgg

SEQ ID NO: 619684 - DNA, 20 bp, mouse
gggtctgacaagggcagccg

SEQ ID NO: 619685 - DNA, 20 bp, mouse
gcctttcccagcacactcta

SEQ ID NO: 619686 - DNA, 20 bp, mouse
gtacggctagtggaagaaga

SEQ ID NO: 619687 - DNA, 20 bp, mouse
gaagatggcggaaggcggag

SEQ ID NO: 619688 - DNA, 20 bp, mouse
gccgcctccgctacggctag

SEQ ID NO: 619689 - DNA, 20 bp, mouse
gagtggaagaagatggcgga

SEQ ID NO: 619690 - DNA, 20 bp, mouse
gcttccactagccgtagcgg

SEQ ID NO: 619691 - DNA, 20 bp, mouse
gatggcggaaggcggagcgg

SEQ ID NO: 619692 - DNA, 20 bp, mouse
gctccgccaaggccccaagt

SEQ ID NO: 619693 - DNA, 20 bp, mouse
gcaggtgcggacaggtccgg

SEQ ID NO: 619694 - DNA, 20 bp, mouse
gtgacaggtgcggacaggtc

SEQ ID NO: 619695 - DNA, 20 bp, mouse
gggtccggcggcggccgctc

SEQ ID NO: 619696 - DNA, 20 bp, mouse
gctgcgtcacctggaggaag

SEQ ID NO: 619697 - DNA, 20 bp, mouse
gcacctggaggaagcggagc

SEQ ID NO: 619698 - DNA, 20 bp, mouse
gtgacgcagagagagcgacg

SEQ ID NO: 619699 - DNA, 20 bp, mouse
gccgtcgcgggaggcagtta

SEQ ID NO: 619700 - DNA, 20 bp, mouse
ggctccgggcccgtcgcggg

SEQ ID NO: 619701 - DNA, 20 bp, mouse
gggtggccggtactcacccg

SEQ ID NO: 619702 - DNA, 20 bp, mouse
gccggctccgggcccgtcgc

SEQ ID NO: 619703 - DNA, 20 bp, mouse
gcgcagagagagcgacgcgg

SEQ ID NO: 619704 - DNA, 20 bp, mouse
gcggcgggcgacgggaaggg

SEQ ID NO: 619705 - DNA, 20 bp, mouse
gggaagttgcctctccggga

SEQ ID NO: 619706 - DNA, 20 bp, mouse
ggaggtctttgtagacacgg

SEQ ID NO: 619707 - DNA, 20 bp, mouse
gtgagacttaccttcttggg

SEQ ID NO: 619708 - DNA, 20 bp, mouse
gcagtgagacttaccttctt

SEQ ID NO: 619709 - DNA, 20 bp, mouse
gttgctctttcctcccaaga

SEQ ID NO: 619710 - DNA, 20 bp, mouse
gtacagtcagcagcaaacag

SEQ ID NO: 619711 - DNA, 20 bp, mouse
ggcagcaaacagaggggttt

SEQ ID NO: 619712 - DNA, 20 bp, mouse
gactcaattcatcattatgc

SEQ ID NO: 619713 - DNA, 20 bp, mouse
gttgcagagattctctggag

SEQ ID NO: 619714 - DNA, 20 bp, mouse
ggaagaggtctttgtagaca

SEQ ID NO: 619715 - DNA, 20 bp, mouse
gacctcttcaaataactagc

SEQ ID NO: 619716 - DNA, 20 bp, mouse
ggaagttgagtctcataata

SEQ ID NO: 619717 - DNA, 20 bp, mouse
gagtcttctaagggatcagc

SEQ ID NO: 619718 - DNA, 20 bp, mouse
gcagtaatcagcaagcatag

SEQ ID NO: 619719 - DNA, 20 bp, mouse
gctgcataaggaagaattga

SEQ ID NO: 619720 - DNA, 20 bp, mouse
gctagctagctggcataaaa

SEQ ID NO: 619721 - DNA, 20 bp, mouse
gcaggcttttgatgacaaaa

SEQ ID NO: 619722 - DNA, 20 bp, mouse
gaggaagaattgagggtgct

SEQ ID NO: 619723 - DNA, 20 bp, mouse
gcttttgatgacaaaagggc

SEQ ID NO: 619724 - DNA, 20 bp, mouse
gatgaatatctctcagggta

SEQ ID NO: 619725 - DNA, 20 bp, mouse
ggaggtctttgaagtcatgg

SEQ ID NO: 619726 - DNA, 20 bp, mouse
gacgagatgcaatcactgtg

SEQ ID NO: 619727 - DNA, 20 bp, mouse
gaggacagattgagtgtgct

SEQ ID NO: 619728 - DNA, 20 bp, mouse
gactcaatctgtccttatgc

SEQ ID NO: 619729 - DNA, 20 bp, mouse
gtaacatattggtgggtgtt

SEQ ID NO: 619730 - DNA, 20 bp, mouse
gtctaattggctagtttttg

SEQ ID NO: 619731 - DNA, 20 bp, mouse
gcagtaagcagcaagcagag

SEQ ID NO: 619732 - DNA, 20 bp, mouse
ggagtgtgcaagtatctaat

SEQ ID NO: 619733 - DNA, 20 bp, mouse
gagttcctgtctggttttgg

SEQ ID NO: 619734 - DNA, 20 bp, mouse
gggggatgactactctttcc

SEQ ID NO: 619735 - DNA, 20 bp, mouse
gtgtgccccgaatatctctc

SEQ ID NO: 619736 - DNA, 20 bp, mouse
gtaccctggtctatagagta

SEQ ID NO: 619737 - DNA, 20 bp, mouse
gtgcaacttcggagatgaca

SEQ ID NO: 619738 - DNA, 20 bp, mouse
gtccgaagttgcaccattag

SEQ ID NO: 619739 - DNA, 20 bp, mouse
ggcctctaatggtgcaactt

SEQ ID NO: 619740 - DNA, 20 bp, mouse
ggggtaaaatcaaaattctt

SEQ ID NO: 619741 - DNA, 20 bp, mouse
gagaaaatttttgctggtag

SEQ ID NO: 619742 - DNA, 20 bp, mouse
ggtaaggtccaagaaaacca

SEQ ID NO: 619743 - DNA, 20 bp, mouse
gcccaagtactggaatcaca

SEQ ID NO: 619744 - DNA, 20 bp, mouse
gtgcaggcagatttctctgt

SEQ ID NO: 619745 - DNA, 20 bp, mouse
ggaatcaacagtctatttag

SEQ ID NO: 619746 - DNA, 20 bp, mouse
gaaccagacaggaactgatg

SEQ ID NO: 619747 - DNA, 20 bp, mouse
ggtgctccgaatatctctca

SEQ ID NO: 619748 - DNA, 20 bp, mouse
gatgaggtgcaatcactgtg

SEQ ID NO: 619749 - DNA, 20 bp, mouse
gactcaatttgtccttatgc

SEQ ID NO: 619750 - DNA, 20 bp, mouse
gtaacatattggtgggtgtt

SEQ ID NO: 619751 - DNA, 20 bp, mouse
ggtgcaagtatctaattggc

SEQ ID NO: 619752 - DNA, 20 bp, mouse
gtctaattggctggtttttg

SEQ ID NO: 619753 - DNA, 20 bp, mouse
ggatgctctgcccttctaag

SEQ ID NO: 619754 - DNA, 20 bp, mouse
gcagtaagcagcaagcagag

SEQ ID NO: 619755 - DNA, 20 bp, mouse
gagttcctgtctggttttgg

SEQ ID NO: 619756 - DNA, 20 bp, mouse
ggaaggtgagtctcactgtg

SEQ ID NO: 619757 - DNA, 20 bp, mouse
gaaggatgaacagagtgtgc

SEQ ID NO: 619758 - DNA, 20 bp, mouse
gactctgttcatccttatgc

SEQ ID NO: 619759 - DNA, 20 bp, mouse
gatgagatgcaatctctgtg

SEQ ID NO: 619760 - DNA, 20 bp, mouse
gtgtgcctgtaacatattgg

SEQ ID NO: 619761 - DNA, 20 bp, mouse
gttttgtgcctgtaacatat

SEQ ID NO: 619762 - DNA, 20 bp, mouse
gtgagccgtgaatatctctc

SEQ ID NO: 619763 - DNA, 20 bp, mouse
gggagatgactactcttttc

SEQ ID NO: 619764 - DNA, 20 bp, mouse
gcagtaagcagcaagcagag

SEQ ID NO: 619765 - DNA, 20 bp, mouse
gttaccctgagagatattca

SEQ ID NO: 619766 - DNA, 20 bp, mouse
gctgcaaagggctacagaag

SEQ ID NO: 619767 - DNA, 20 bp, mouse
gagaagaggacgcggcaccg

SEQ ID NO: 619768 - DNA, 20 bp, mouse
ggcaagactgctctgctccg

SEQ ID NO: 619769 - DNA, 20 bp, mouse
ggaccgagcagcatctgcaa

SEQ ID NO: 619770 - DNA, 20 bp, mouse
gcctcccagcctctcagctc

SEQ ID NO: 619771 - DNA, 20 bp, mouse
gttggccggcagtgccaggg

SEQ ID NO: 619772 - DNA, 20 bp, mouse
gccttgggttctgcaaatag

SEQ ID NO: 619773 - DNA, 20 bp, mouse
gtgggttctgcaaatagtgg

SEQ ID NO: 619774 - DNA, 20 bp, mouse
gggcttggccggcagtgcca

SEQ ID NO: 619775 - DNA, 20 bp, mouse
gcactcctgagctgagaggc

SEQ ID NO: 619776 - DNA, 20 bp, mouse
gtgttgccagggcccgaaga

SEQ ID NO: 619777 - DNA, 20 bp, mouse
gacagagaggccggccacag

SEQ ID NO: 619778 - DNA, 20 bp, mouse
gctcgctcggtgagtggtgt

SEQ ID NO: 619779 - DNA, 20 bp, mouse
ggccagggcccgaagagggc

SEQ ID NO: 619780 - DNA, 20 bp, mouse
gtggcaggcctgggattcgg

SEQ ID NO: 619781 - DNA, 20 bp, mouse
gtcccccgctgcggccaaac

SEQ ID NO: 619782 - DNA, 20 bp, mouse
gcggctcggtcggcatcggt

SEQ ID NO: 619783 - DNA, 20 bp, mouse
ggctctgaaagccgtcgaag

SEQ ID NO: 619784 - DNA, 20 bp, mouse
gaccgacccgacgccggaac

SEQ ID NO: 619785 - DNA, 20 bp, mouse
gggtgtgggcctcaagtcgc

SEQ ID NO: 619786 - DNA, 20 bp, mouse
gctcgcgcagccaaccgacc

SEQ ID NO: 619787 - DNA, 20 bp, mouse
gcggttggctgcgcgaggtg

SEQ ID NO: 619788 - DNA, 20 bp, mouse
gagcgccgtgcccggtcggt

SEQ ID NO: 619789 - DNA, 20 bp, mouse
gttggctgcgcgaggtgggg

SEQ ID NO: 619790 - DNA, 20 bp, mouse
ggcagccaaccgaccgggca

SEQ ID NO: 619791 - DNA, 20 bp, mouse
gtcgggcagggtcaccgtgt

SEQ ID NO: 619792 - DNA, 20 bp, mouse
ggcgctgggccccgcagtag

SEQ ID NO: 619793 - DNA, 20 bp, mouse
gcgcaaagctggaagctcgg

SEQ ID NO: 619794 - DNA, 20 bp, mouse
gcgcgagcgccgtgcccggt

SEQ ID NO: 619795 - DNA, 20 bp, mouse
gagcagaagccccacgaagg

SEQ ID NO: 619796 - DNA, 20 bp, mouse
gggcgcggcgcagcgagcag

SEQ ID NO: 619797 - DNA, 20 bp, mouse
gtggagctgcggatgagtcc

SEQ ID NO: 619798 - DNA, 20 bp, mouse
ggatgagtcctggctggtac

SEQ ID NO: 619799 - DNA, 20 bp, mouse
ggtcctggctggtactggcg

SEQ ID NO: 619800 - DNA, 20 bp, mouse
ggagcagtggctgacgcaga

SEQ ID NO: 619801 - DNA, 20 bp, mouse
gaggatggacgagtcgaacc

SEQ ID NO: 619802 - DNA, 20 bp, mouse
ggctgcggatgagtcctggc

SEQ ID NO: 619803 - DNA, 20 bp, mouse
ggtctggacgtgagaaatgt

SEQ ID NO: 619804 - DNA, 20 bp, mouse
ggtcgaaccgggcacaagca

SEQ ID NO: 619805 - DNA, 20 bp, mouse
gtcggaaagtagggtgtcaa

SEQ ID NO: 619806 - DNA, 20 bp, mouse
gacggcaggtgagtttctga

SEQ ID NO: 619807 - DNA, 20 bp, mouse
gacaggcggcgcggttgcga

SEQ ID NO: 619808 - DNA, 20 bp, mouse
gggctagcttgactgacagg

SEQ ID NO: 619809 - DNA, 20 bp, mouse
gctctaggcagcgccgcggt

SEQ ID NO: 619810 - DNA, 20 bp, mouse
gtgcccgccccgaaccccca

SEQ ID NO: 619811 - DNA, 20 bp, mouse
ggcttgactgacaggcggcg

SEQ ID NO: 619812 - DNA, 20 bp, mouse
gaagactctaggcagcgccg

SEQ ID NO: 619813 - DNA, 20 bp, mouse
gggccagcaggaggccactc

SEQ ID NO: 619814 - DNA, 20 bp, mouse
gcggcccagcccccggcagc

SEQ ID NO: 619815 - DNA, 20 bp, mouse
ggtccagccgctgggagcag

SEQ ID NO: 619816 - DNA, 20 bp, mouse
ggcggcaccaacaaagatgg

SEQ ID NO: 619817 - DNA, 20 bp, mouse
gcgggcggcaccaacaaaga

SEQ ID NO: 619818 - DNA, 20 bp, mouse
gtaagagactgtgaagccgg

SEQ ID NO: 619819 - DNA, 20 bp, mouse
ggcaagctgggcaacagctg

SEQ ID NO: 619820 - DNA, 20 bp, mouse
gcagcttgctcccgccgcaa

SEQ ID NO: 619821 - DNA, 20 bp, mouse
gaagatggcggcggcccttg

SEQ ID NO: 619822 - DNA, 20 bp, mouse
gccgggtccgcccccctcga

SEQ ID NO: 619823 - DNA, 20 bp, mouse
gagctgcagcccggcctgtg

SEQ ID NO: 619824 - DNA, 20 bp, mouse
gggatggatccagaccccag

SEQ ID NO: 619825 - DNA, 20 bp, mouse
gagactgtgaagccggtggc

SEQ ID NO: 619826 - DNA, 20 bp, mouse
gggcgaggacgacgccaggg

SEQ ID NO: 619827 - DNA, 20 bp, mouse
gagggtgctgcgcgtgcggt

SEQ ID NO: 619828 - DNA, 20 bp, mouse
gaagaccgcgttgagaactc

SEQ ID NO: 619829 - DNA, 20 bp, mouse
gccgccctcctcgaagtcag

SEQ ID NO: 619830 - DNA, 20 bp, mouse
gggcggcgagaacaaagctg

SEQ ID NO: 619831 - DNA, 20 bp, mouse
gccgcgttgagaactcaggc

SEQ ID NO: 619832 - DNA, 20 bp, mouse
gcgcctggctgctcgcacct

SEQ ID NO: 619833 - DNA, 20 bp, mouse
gcaccctctgacttcgagga

SEQ ID NO: 619834 - DNA, 20 bp, mouse
gtcagagggtgctgcgcgtg

SEQ ID NO: 619835 - DNA, 20 bp, mouse
ggggggcgaggacgacgcca

SEQ ID NO: 619836 - DNA, 20 bp, mouse
ggcgcggccccgcgaagagg

SEQ ID NO: 619837 - DNA, 20 bp, mouse
ggaggcgcggccccgcgaag

SEQ ID NO: 619838 - DNA, 20 bp, mouse
ggccggagccatggaatcgg

SEQ ID NO: 619839 - DNA, 20 bp, mouse
gcgagccgagctggggtggt

SEQ ID NO: 619840 - DNA, 20 bp, mouse
gagcggcccggcctcgacta

SEQ ID NO: 619841 - DNA, 20 bp, mouse
gccccgcgaagaggaggagc

SEQ ID NO: 619842 - DNA, 20 bp, mouse
gaggccgccgggccagggtt

SEQ ID NO: 619843 - DNA, 20 bp, mouse
gcatggcggcgcgcagggct

SEQ ID NO: 619844 - DNA, 20 bp, mouse
ggtggtggggcgctcaggcg

SEQ ID NO: 619845 - DNA, 20 bp, mouse
gcagggttaggtgcgcgcgt

SEQ ID NO: 619846 - DNA, 20 bp, mouse
gcgcagtggtccccccggag

SEQ ID NO: 619847 - DNA, 20 bp, mouse
gccggcggcaagcggacgga

SEQ ID NO: 619848 - DNA, 20 bp, mouse
gaggacagcgccattccggg

SEQ ID NO: 619849 - DNA, 20 bp, mouse
gggcaagcggacggagggag

SEQ ID NO: 619850 - DNA, 20 bp, mouse
gtggtccccccggagcggtc

SEQ ID NO: 619851 - DNA, 20 bp, mouse
gttcgcctgaccgctccggg

SEQ ID NO: 619852 - DNA, 20 bp, mouse
gcggaggacagcgccattcc

SEQ ID NO: 619853 - DNA, 20 bp, mouse
ggcttgccgccggcccgcag

SEQ ID NO: 619854 - DNA, 20 bp, mouse
gggggaccactgcgggccgg

SEQ ID NO: 619855 - DNA, 20 bp, mouse
ggagcgcggcgcagaaggtg

SEQ ID NO: 619856 - DNA, 20 bp, mouse
gaccacagacggcgcagcag

SEQ ID NO: 619857 - DNA, 20 bp, mouse
gggcagctgtggcctcgacc

SEQ ID NO: 619858 - DNA, 20 bp, mouse
gcctcgaccgggaactttag

SEQ ID NO: 619859 - DNA, 20 bp, mouse
gagaccggaagtaccacaga

SEQ ID NO: 619860 - DNA, 20 bp, mouse
gggagacaaaaaggtaaaga

SEQ ID NO: 619861 - DNA, 20 bp, mouse
gaaatggaggctgggcaccc

SEQ ID NO: 619862 - DNA, 20 bp, mouse
gcggttcgggagtggtaaag

SEQ ID NO: 619863 - DNA, 20 bp, mouse
gggtaaagacggttcgggag

SEQ ID NO: 619864 - DNA, 20 bp, mouse
ggtaaaggggagcttcgact

SEQ ID NO: 619865 - DNA, 20 bp, mouse
gtgggagggtccacattgac

SEQ ID NO: 619866 - DNA, 20 bp, mouse
gaggcggagacggcggagac

SEQ ID NO: 619867 - DNA, 20 bp, mouse
gaggaaggtggaggcggaga

SEQ ID NO: 619868 - DNA, 20 bp, mouse
gcctgagaggcagcccgaga

SEQ ID NO: 619869 - DNA, 20 bp, mouse
gcagcccgagaaggagccga

SEQ ID NO: 619870 - DNA, 20 bp, mouse
gacccagcgcagagcggtgt

SEQ ID NO: 619871 - DNA, 20 bp, mouse
gcatccttcggctccttctc

SEQ ID NO: 619872 - DNA, 20 bp, mouse
gggaaggtggagatcgcgga

SEQ ID NO: 619873 - DNA, 20 bp, mouse
gcagcgcagagcggtgttgg

SEQ ID NO: 619874 - DNA, 20 bp, mouse
ggcgctgggttctcatcctt

SEQ ID NO: 619875 - DNA, 20 bp, mouse
gccggaacccgaacagaagc

SEQ ID NO: 619876 - DNA, 20 bp, mouse
gtacacgcggagggacacca

SEQ ID NO: 619877 - DNA, 20 bp, mouse
ggaagacgacaacgagagtg

SEQ ID NO: 619878 - DNA, 20 bp, mouse
ggagctgcagcaggacgact

SEQ ID NO: 619879 - DNA, 20 bp, mouse
gagagtggggctacacgcgg

SEQ ID NO: 619880 - DNA, 20 bp, mouse
gacgagagtggggctacacg

SEQ ID NO: 619881 - DNA, 20 bp, mouse
ggggttgcacgtgagatcgt

SEQ ID NO: 619882 - DNA, 20 bp, mouse
ggacaccacggccatgactg

SEQ ID NO: 619883 - DNA, 20 bp, mouse
gcagcaggacgactcggcgg

SEQ ID NO: 619884 - DNA, 20 bp, mouse
ggaagcccgggagcaccggg

SEQ ID NO: 619885 - DNA, 20 bp, mouse
gagctccgcagtcatggccg

SEQ ID NO: 619886 - DNA, 20 bp, mouse
ggcacaccagggcatctcag

SEQ ID NO: 619887 - DNA, 20 bp, mouse
gccagatccgcagcacaaac

SEQ ID NO: 619888 - DNA, 20 bp, mouse
gtggctcacctaaagataaa

SEQ ID NO: 619889 - DNA, 20 bp, mouse
gcacctaaagataaatggtt

SEQ ID NO: 619890 - DNA, 20 bp, mouse
gtccttccactgagatgccc

SEQ ID NO: 619891 - DNA, 20 bp, mouse
gggtcatcctgactactcat

SEQ ID NO: 619892 - DNA, 20 bp, mouse
ggagctgggactgtatcatc

SEQ ID NO: 619893 - DNA, 20 bp, mouse
ggtggtattcagggatccac

SEQ ID NO: 619894 - DNA, 20 bp, mouse
gttacaggcgtagtggttag

SEQ ID NO: 619895 - DNA, 20 bp, mouse
ggataatgttacaggcgtag

SEQ ID NO: 619896 - DNA, 20 bp, mouse
gcccggcactgggcagacgg

SEQ ID NO: 619897 - DNA, 20 bp, mouse
ggacagccgaggctctgggg

SEQ ID NO: 619898 - DNA, 20 bp, mouse
ggacttcagaggctccgtct

SEQ ID NO: 619899 - DNA, 20 bp, mouse
gtcgcttctgacccggcact

SEQ ID NO: 619900 - DNA, 20 bp, mouse
gtctggggtcgcttctgacc

SEQ ID NO: 619901 - DNA, 20 bp, mouse
gctgcagcaccaggacgacg

SEQ ID NO: 619902 - DNA, 20 bp, mouse
gcgcacccgcggcccttcga

SEQ ID NO: 619903 - DNA, 20 bp, mouse
gtccatggccacgaggacgg

SEQ ID NO: 619904 - DNA, 20 bp, mouse
ggccgaggctctggggcgga

SEQ ID NO: 619905 - DNA, 20 bp, mouse
gacggcggcggggacagccg

SEQ ID NO: 619906 - DNA, 20 bp, mouse
gatgaggagcccaagacagg

SEQ ID NO: 619907 - DNA, 20 bp, mouse
gcaggaggctcgcaaagtgg

SEQ ID NO: 619908 - DNA, 20 bp, mouse
gcgcccgccgcagcggaatg

SEQ ID NO: 619909 - DNA, 20 bp, mouse
gtgggctcctcattccgctg

SEQ ID NO: 619910 - DNA, 20 bp, mouse
gccgtcaggtgagtgggtgg

SEQ ID NO: 619911 - DNA, 20 bp, mouse
gaaagtggaggaacccgcgg

SEQ ID NO: 619912 - DNA, 20 bp, mouse
gagacaggaggctcgcaaag

SEQ ID NO: 619913 - DNA, 20 bp, mouse
ggggcggccgtcaggtgagt

SEQ ID NO: 619914 - DNA, 20 bp, mouse
gtcgcggtgaccccagactc

SEQ ID NO: 619915 - DNA, 20 bp, mouse
ggctcctcattccgctgcgg

SEQ ID NO: 619916 - DNA, 20 bp, mouse
gggcgctctgaggtggtgta

SEQ ID NO: 619917 - DNA, 20 bp, mouse
gtctccgcggcgctctgagg

SEQ ID NO: 619918 - DNA, 20 bp, mouse
gcaagagagcggcgaccgag

SEQ ID NO: 619919 - DNA, 20 bp, mouse
gctcttgctcgctctctccg

SEQ ID NO: 619920 - DNA, 20 bp, mouse
ggtcgcgcggccgcccaagt

SEQ ID NO: 619921 - DNA, 20 bp, mouse
gctctctccgcggcgctctg

SEQ ID NO: 619922 - DNA, 20 bp, mouse
gcgtgagctgcccacttggg

SEQ ID NO: 619923 - DNA, 20 bp, mouse
ggtagggcgtgaagcccccc

SEQ ID NO: 619924 - DNA, 20 bp, mouse
gtgcgcctcacccggcccgg

SEQ ID NO: 619925 - DNA, 20 bp, mouse
ggcgtgaagccccccgggcc

SEQ ID NO: 619926 - DNA, 20 bp, mouse
gacgaggaggcgctgaggag

SEQ ID NO: 619927 - DNA, 20 bp, mouse
gtgactcggcatggaggcgg

SEQ ID NO: 619928 - DNA, 20 bp, mouse
gcccccaacactaacaagtg

SEQ ID NO: 619929 - DNA, 20 bp, mouse
gacgtgactcggcatggagg

SEQ ID NO: 619930 - DNA, 20 bp, mouse
gccagccgtgggaatatcga

SEQ ID NO: 619931 - DNA, 20 bp, mouse
gcagctacgaggaggcgctg

SEQ ID NO: 619932 - DNA, 20 bp, mouse
gctgccccagcgactcctcc

SEQ ID NO: 619933 - DNA, 20 bp, mouse
ggcggccgggaggagtcgct

SEQ ID NO: 619934 - DNA, 20 bp, mouse
gcatgggcgccaaggagtca

SEQ ID NO: 619935 - DNA, 20 bp, mouse
ggaggcgctgaggagaggtg

SEQ ID NO: 619936 - DNA, 20 bp, mouse
ggcggagacaccggaaggag

SEQ ID NO: 619937 - DNA, 20 bp, mouse
ggagacaccggaaggagcgg

SEQ ID NO: 619938 - DNA, 20 bp, mouse
gggctgccgagggaagcgtc

SEQ ID NO: 619939 - DNA, 20 bp, mouse
ggcagcggccgcggagacac

SEQ ID NO: 619940 - DNA, 20 bp, mouse
gcggccgcggagacaccgga

SEQ ID NO: 619941 - DNA, 20 bp, mouse
ggaagcgtcgggcagcggtc

SEQ ID NO: 619942 - DNA, 20 bp, mouse
gcgagggaagcgtcgggcag

SEQ ID NO: 619943 - DNA, 20 bp, mouse
gaaggagcggcggctgccga

SEQ ID NO: 619944 - DNA, 20 bp, mouse
gggttctgcgggccgcgctg

SEQ ID NO: 619945 - DNA, 20 bp, mouse
ggatccgcagggccgcaaaa

SEQ ID NO: 619946 - DNA, 20 bp, mouse
gaggcgaaggagccgaagag

SEQ ID NO: 619947 - DNA, 20 bp, mouse
gtgcgcgaggcgcctctctt

SEQ ID NO: 619948 - DNA, 20 bp, mouse
gaggggagcgcaggcctcag

SEQ ID NO: 619949 - DNA, 20 bp, mouse
gcccgagcgctccattaaaa

SEQ ID NO: 619950 - DNA, 20 bp, mouse
gggtggccgcggcgtctggt

SEQ ID NO: 619951 - DNA, 20 bp, mouse
gcaccaccgaccagacgccg

SEQ ID NO: 619952 - DNA, 20 bp, mouse
gtcagcgcgatcctaagcgg

SEQ ID NO: 619953 - DNA, 20 bp, mouse
gggccgcggcgtctggtcgg

SEQ ID NO: 619954 - DNA, 20 bp, mouse
ggccgggaaggcaggcaagg

SEQ ID NO: 619955 - DNA, 20 bp, mouse
ggctctttccgcccaggcga

SEQ ID NO: 619956 - DNA, 20 bp, mouse
gcggtctcagagctgcggga

SEQ ID NO: 619957 - DNA, 20 bp, mouse
gcacaaccctagatggacct

SEQ ID NO: 619958 - DNA, 20 bp, mouse
gagagctgcgggacggaact

SEQ ID NO: 619959 - DNA, 20 bp, mouse
gctgcgcggtctcagagctg

SEQ ID NO: 619960 - DNA, 20 bp, mouse
ggcactgcccaggtccatct

SEQ ID NO: 619961 - DNA, 20 bp, mouse
gcgctccgcacaaccctaga

SEQ ID NO: 619962 - DNA, 20 bp, mouse
gtgcgggacggaactgggag

SEQ ID NO: 619963 - DNA, 20 bp, mouse
gcctgggcagtgcaactgcg

SEQ ID NO: 619964 - DNA, 20 bp, mouse
gatgcgccccgcccaggagt

SEQ ID NO: 619965 - DNA, 20 bp, mouse
ggctgggccagtcgaggtca

SEQ ID NO: 619966 - DNA, 20 bp, mouse
gccttccgcgggttcccgag

SEQ ID NO: 619967 - DNA, 20 bp, mouse
gatgctggcccggcccggat

SEQ ID NO: 619968 - DNA, 20 bp, mouse
gcgagaggcctaggaggtcg

SEQ ID NO: 619969 - DNA, 20 bp, mouse
gggcctaggaggtcgaggtc

SEQ ID NO: 619970 - DNA, 20 bp, mouse
ggtgctgcgcgggccttccg

SEQ ID NO: 619971 - DNA, 20 bp, mouse
gcgcccgacctcgacctcct

SEQ ID NO: 619972 - DNA, 20 bp, mouse
gtgccagggactccgaggaa

SEQ ID NO: 619973 - DNA, 20 bp, mouse
ggaggctctggaggcccgga

SEQ ID NO: 619974 - DNA, 20 bp, mouse
gcagcaccagcgtccgatcc

SEQ ID NO: 619975 - DNA, 20 bp, mouse
ggcgggttcccgagaggcct

SEQ ID NO: 619976 - DNA, 20 bp, mouse
gtagcgggaacaccaagact

SEQ ID NO: 619977 - DNA, 20 bp, mouse
gcaacggatgcaggtgcagt

SEQ ID NO: 619978 - DNA, 20 bp, mouse
gccgctagtgtctgaaagga

SEQ ID NO: 619979 - DNA, 20 bp, mouse
gctccccccaccctgaacct

SEQ ID NO: 619980 - DNA, 20 bp, mouse
ggttcccgctagtgtctgaa

SEQ ID NO: 619981 - DNA, 20 bp, mouse
ggggtggcctaggttcaggg

SEQ ID NO: 619982 - DNA, 20 bp, mouse
gggagggtggcctaggttca

SEQ ID NO: 619983 - DNA, 20 bp, mouse
gggcgttcaagggtcatcat

SEQ ID NO: 619984 - DNA, 20 bp, mouse
ggtgccaatgacattatagt

SEQ ID NO: 619985 - DNA, 20 bp, mouse
gggctatataggaagttgga

SEQ ID NO: 619986 - DNA, 20 bp, mouse
gtcctctccttggcagatcg

SEQ ID NO: 619987 - DNA, 20 bp, mouse
gtgcctcctgactcaaccca

SEQ ID NO: 619988 - DNA, 20 bp, mouse
gcgccctgggttgagtcagg

SEQ ID NO: 619989 - DNA, 20 bp, mouse
gagtcgccctgggttgagtc

SEQ ID NO: 619990 - DNA, 20 bp, mouse
gcgagtacctcgatctgcca

SEQ ID NO: 619991 - DNA, 20 bp, mouse
gagaggtcgcgggcccagcg

SEQ ID NO: 619992 - DNA, 20 bp, mouse
ggcgcggaacaccctgaacc

SEQ ID NO: 619993 - DNA, 20 bp, mouse
gccgggcgcagggaccctcc

SEQ ID NO: 619994 - DNA, 20 bp, mouse
gtccccgcggtccgcctcag

SEQ ID NO: 619995 - DNA, 20 bp, mouse
gggcagttaaaagtcgccct

SEQ ID NO: 619996 - DNA, 20 bp, mouse
gcgcggaagctcctaactgg

SEQ ID NO: 619997 - DNA, 20 bp, mouse
gttcccgcgggtggaaccat

SEQ ID NO: 619998 - DNA, 20 bp, mouse
gggaagctcctaactggtgg

SEQ ID NO: 619999 - DNA, 20 bp, mouse
ggatgtctagccggtccaag

SEQ ID NO: 620000 - DNA, 20 bp, mouse
gcggcgcggaagctcctaac

SEQ ID NO: 620001 - DNA, 20 bp, mouse
gatgggactgccgcttggac

SEQ ID NO: 620002 - DNA, 20 bp, mouse
ggacatcgccaccaccagtt

SEQ ID NO: 620003 - DNA, 20 bp, mouse
gtcggactcacgcttcccgc

SEQ ID NO: 620004 - DNA, 20 bp, mouse
ggattcaagcctggtcaggg

SEQ ID NO: 620005 - DNA, 20 bp, mouse
gcccgagctgccacgagact

SEQ ID NO: 620006 - DNA, 20 bp, mouse
gggcgtttgtggtcaggtag

SEQ ID NO: 620007 - DNA, 20 bp, mouse
gaggagggtgcacggagtct

SEQ ID NO: 620008 - DNA, 20 bp, mouse
gtttgtggtcaggtagagga

SEQ ID NO: 620009 - DNA, 20 bp, mouse
gaagactgaagtccttgagg

SEQ ID NO: 620010 - DNA, 20 bp, mouse
gtcaggtagaggagggtgca

SEQ ID NO: 620011 - DNA, 20 bp, mouse
gcaaacgcccgccctcctca

SEQ ID NO: 620012 - DNA, 20 bp, mouse
ggtgaagactgaagtccttg

SEQ ID NO: 620013 - DNA, 20 bp, mouse
gagggcgggcgtttgtggtc

SEQ ID NO: 620014 - DNA, 20 bp, mouse
ggtgtgactagtggctggag

SEQ ID NO: 620015 - DNA, 20 bp, mouse
gggaacatactgcagctcag

SEQ ID NO: 620016 - DNA, 20 bp, mouse
ggccggggcggcggacgaga

SEQ ID NO: 620017 - DNA, 20 bp, mouse
ggctaggcggatgtccgggc

SEQ ID NO: 620018 - DNA, 20 bp, mouse
ggtgcgctaggcggatgtcc

SEQ ID NO: 620019 - DNA, 20 bp, mouse
gtagcacgccgtgcgctagg

SEQ ID NO: 620020 - DNA, 20 bp, mouse
gacgagatggcggaaggccg

SEQ ID NO: 620021 - DNA, 20 bp, mouse
gctccacatccggtcgctca

SEQ ID NO: 620022 - DNA, 20 bp, mouse
gtggagcgtggtccccatca

SEQ ID NO: 620023 - DNA, 20 bp, mouse
gagccgtgagcgaccggatg

SEQ ID NO: 620024 - DNA, 20 bp, mouse
gcggcggacgagatggcgga

SEQ ID NO: 620025 - DNA, 20 bp, mouse
gcggggcagccgtgagcgac

SEQ ID NO: 620026 - DNA, 20 bp, mouse
gtccagagacacggcctcct

SEQ ID NO: 620027 - DNA, 20 bp, mouse
gaaacgaactcgctccgaac

SEQ ID NO: 620028 - DNA, 20 bp, mouse
gagacacggcctcctcggca

SEQ ID NO: 620029 - DNA, 20 bp, mouse
gaacgggcaccgccatgccg

SEQ ID NO: 620030 - DNA, 20 bp, mouse
ggggcaccgccatgccgagg

SEQ ID NO: 620031 - DNA, 20 bp, mouse
gcacggcctcctcggcatgg

SEQ ID NO: 620032 - DNA, 20 bp, mouse
ggagggacgagggcagcgta

SEQ ID NO: 620033 - DNA, 20 bp, mouse
gggcggcaaggcctctggag

SEQ ID NO: 620034 - DNA, 20 bp, mouse
gtctgctggcagcgcgtcag

SEQ ID NO: 620035 - DNA, 20 bp, mouse
gagagacgccgggcctctgc

SEQ ID NO: 620036 - DNA, 20 bp, mouse
ggcactcgctccatccccct

SEQ ID NO: 620037 - DNA, 20 bp, mouse
ggcggctgggctgtgtgcgg

SEQ ID NO: 620038 - DNA, 20 bp, mouse
gcagcccagccgcccggcgg

SEQ ID NO: 620039 - DNA, 20 bp, mouse
ggtcattgtcccccgccggg

SEQ ID NO: 620040 - DNA, 20 bp, mouse
gtgcggcgctgacccggagg

SEQ ID NO: 620041 - DNA, 20 bp, mouse
ggagcttacctgacccggct

SEQ ID NO: 620042 - DNA, 20 bp, mouse
gggcgggagcttacctgacc

SEQ ID NO: 620043 - DNA, 20 bp, mouse
gcaatgacgtgcctccatcc

SEQ ID NO: 620044 - DNA, 20 bp, mouse
gcccgagcagcggaccgagg

SEQ ID NO: 620045 - DNA, 20 bp, mouse
ggctgggctgtgtgcggcgg

SEQ ID NO: 620046 - DNA, 20 bp, mouse
gggtcctcaccgcctcccgg

SEQ ID NO: 620047 - DNA, 20 bp, mouse
gcaggcggcgaagggaacgg

SEQ ID NO: 620048 - DNA, 20 bp, mouse
gggcgcccggcgcctccggg

SEQ ID NO: 620049 - DNA, 20 bp, mouse
gaagcaggcggcgaagggaa

SEQ ID NO: 620050 - DNA, 20 bp, mouse
gcagcccccgagaccccagg

SEQ ID NO: 620051 - DNA, 20 bp, mouse
gcccggtcctcaccgcctcc

SEQ ID NO: 620052 - DNA, 20 bp, mouse
ggcgcagcccccgagacccc

SEQ ID NO: 620053 - DNA, 20 bp, mouse
ggtccgcacacctggctctc

SEQ ID NO: 620054 - DNA, 20 bp, mouse
gcgagtcccccgagcgggag

SEQ ID NO: 620055 - DNA, 20 bp, mouse
ggaagctgccggcccgcctg

SEQ ID NO: 620056 - DNA, 20 bp, mouse
gcttagtctaaaggccaatt

SEQ ID NO: 620057 - DNA, 20 bp, mouse
ggcaccgaaagcctagcaga

SEQ ID NO: 620058 - DNA, 20 bp, mouse
gagaatccgctgatgagggt

SEQ ID NO: 620059 - DNA, 20 bp, mouse
gggacataataggtaagtat

SEQ ID NO: 620060 - DNA, 20 bp, mouse
gagaggtgagggtctggagt

SEQ ID NO: 620061 - DNA, 20 bp, mouse
gctagagaggtcccgagctc

SEQ ID NO: 620062 - DNA, 20 bp, mouse
ggagcctgctgtaatcggtg

SEQ ID NO: 620063 - DNA, 20 bp, mouse
ggaccgacctcttagtctaa

SEQ ID NO: 620064 - DNA, 20 bp, mouse
gctccgttaggcagaggtga

SEQ ID NO: 620065 - DNA, 20 bp, mouse
gagcaactgcaagctccgtt

SEQ ID NO: 620066 - DNA, 20 bp, mouse
gcggcgggcggggtgagttg

SEQ ID NO: 620067 - DNA, 20 bp, mouse
gtacagtgaccccaaagcct

SEQ ID NO: 620068 - DNA, 20 bp, mouse
ggtggaagctgcggcccggc

SEQ ID NO: 620069 - DNA, 20 bp, mouse
gtgaatctggacgcgagggt

SEQ ID NO: 620070 - DNA, 20 bp, mouse
gccgagtgctggcggcaggg

SEQ ID NO: 620071 - DNA, 20 bp, mouse
gaagtccgggagccggacgt

SEQ ID NO: 620072 - DNA, 20 bp, mouse
ggaagagccggggtcgggga

SEQ ID NO: 620073 - DNA, 20 bp, mouse
gctcccgggccgagtgctgg

SEQ ID NO: 620074 - DNA, 20 bp, mouse
ggcgcagaagctcctgcgtg

SEQ ID NO: 620075 - DNA, 20 bp, mouse
gctgcgaggggagaccccga

SEQ ID NO: 620076 - DNA, 20 bp, mouse
ggcgcagcgaggccgggtgg

SEQ ID NO: 620077 - DNA, 20 bp, mouse
gaaaacgggactgtccatgg

SEQ ID NO: 620078 - DNA, 20 bp, mouse
gggtggcgcgcagcgaggcc

SEQ ID NO: 620079 - DNA, 20 bp, mouse
ggggaaaacgggactgtcca

SEQ ID NO: 620080 - DNA, 20 bp, mouse
gggcaaagaaagggaacccc

SEQ ID NO: 620081 - DNA, 20 bp, mouse
ggcaccgccatctttaccag

SEQ ID NO: 620082 - DNA, 20 bp, mouse
gtcccgagggaggaccatga

SEQ ID NO: 620083 - DNA, 20 bp, mouse
ggccggcttgcagtggggtt

SEQ ID NO: 620084 - DNA, 20 bp, mouse
gagcgagccaggcaaagaaa

SEQ ID NO: 620085 - DNA, 20 bp, mouse
gatctttaccaggggaaaac

SEQ ID NO: 620086 - DNA, 20 bp, mouse
gcttcattcctggttcctag

SEQ ID NO: 620087 - DNA, 20 bp, mouse
gaggagtggtagagcaacca

SEQ ID NO: 620088 - DNA, 20 bp, mouse
gaacaagagagactcctacc

SEQ ID NO: 620089 - DNA, 20 bp, mouse
gcctcccactgcttcattcc

SEQ ID NO: 620090 - DNA, 20 bp, mouse
gctgctgcgagctccttcaa

SEQ ID NO: 620091 - DNA, 20 bp, mouse
gctgcgagctccttcaatgg

SEQ ID NO: 620092 - DNA, 20 bp, mouse
gtgggtctattattgctctg

SEQ ID NO: 620093 - DNA, 20 bp, mouse
gggtgtgaagaccttatgga

SEQ ID NO: 620094 - DNA, 20 bp, mouse
gctgtctcaaaacacagcac

SEQ ID NO: 620095 - DNA, 20 bp, mouse
gctcactggggctcttactt

SEQ ID NO: 620096 - DNA, 20 bp, mouse
ggcgcgcagacaccgaccca

SEQ ID NO: 620097 - DNA, 20 bp, mouse
gctggtgtctaaggcctgag

SEQ ID NO: 620098 - DNA, 20 bp, mouse
gcggcggcggcgccctgggt

SEQ ID NO: 620099 - DNA, 20 bp, mouse
ggtgtctaaggcctgagcgg

SEQ ID NO: 620100 - DNA, 20 bp, mouse
gtgcgctccagcaactgagg

SEQ ID NO: 620101 - DNA, 20 bp, mouse
ggcctgcgctccagcaactg

SEQ ID NO: 620102 - DNA, 20 bp, mouse
gcaggcagggcggagacgag

SEQ ID NO: 620103 - DNA, 20 bp, mouse
gcgtagcgcggcgtaccccg

SEQ ID NO: 620104 - DNA, 20 bp, mouse
gactgaggaggcctccgctc

SEQ ID NO: 620105 - DNA, 20 bp, mouse
gacgtggccccgggaaccag

SEQ ID NO: 620106 - DNA, 20 bp, mouse
gcgctcgtcggagtagacga

SEQ ID NO: 620107 - DNA, 20 bp, mouse
gcccagcgctgccctcagac

SEQ ID NO: 620108 - DNA, 20 bp, mouse
gcccattcgggcggagacgg

SEQ ID NO: 620109 - DNA, 20 bp, mouse
gtgactgctctcctgtctga

SEQ ID NO: 620110 - DNA, 20 bp, mouse
ggtctgtcgggtatcggcgg

SEQ ID NO: 620111 - DNA, 20 bp, mouse
gagcagccgcatcacttcgg

SEQ ID NO: 620112 - DNA, 20 bp, mouse
gtagctagctgccttcacca

SEQ ID NO: 620113 - DNA, 20 bp, mouse
ggctcctgcgacacctcctc

SEQ ID NO: 620114 - DNA, 20 bp, mouse
gggctcggcgagtgctacct

SEQ ID NO: 620115 - DNA, 20 bp, mouse
gattcgggcggagacggagg

SEQ ID NO: 620116 - DNA, 20 bp, mouse
gcccatagcgaaggatcaaa

SEQ ID NO: 620117 - DNA, 20 bp, mouse
gatagcgaaggatcaaaagg

SEQ ID NO: 620118 - DNA, 20 bp, mouse
gacggcggccccctaaacac

SEQ ID NO: 620119 - DNA, 20 bp, mouse
gctggagtctctgagttcga

SEQ ID NO: 620120 - DNA, 20 bp, mouse
gcgccgttcgcgtgaaggtc

SEQ ID NO: 620121 - DNA, 20 bp, mouse
gtctgagttcgagggtttgg

SEQ ID NO: 620122 - DNA, 20 bp, mouse
ggctatgggagtgacgtggt

SEQ ID NO: 620123 - DNA, 20 bp, mouse
gctccagaccttcacgcgaa

SEQ ID NO: 620124 - DNA, 20 bp, mouse
ggtctctgagttcgagggtt

SEQ ID NO: 620125 - DNA, 20 bp, mouse
gaggttctcggttcctcggg

SEQ ID NO: 620126 - DNA, 20 bp, mouse
gggagctgctgccggtgtca

SEQ ID NO: 620127 - DNA, 20 bp, mouse
gagggtgcatcgcaaggagg

SEQ ID NO: 620128 - DNA, 20 bp, mouse
gaggcctggccgaatgacca

SEQ ID NO: 620129 - DNA, 20 bp, mouse
gccttggggacacggatcgt

SEQ ID NO: 620130 - DNA, 20 bp, mouse
ggggcggtactaggtacagt

SEQ ID NO: 620131 - DNA, 20 bp, mouse
gcccagggtgcatcgcaagg

SEQ ID NO: 620132 - DNA, 20 bp, mouse
gcagggcaagggttgagatt

SEQ ID NO: 620133 - DNA, 20 bp, mouse
gtttcatgtgggaggagtag

SEQ ID NO: 620134 - DNA, 20 bp, mouse
gtgcttcacgagaccaggag

SEQ ID NO: 620135 - DNA, 20 bp, mouse
gttggatgcgagagacggag

SEQ ID NO: 620136 - DNA, 20 bp, mouse
ggacagcaacaacacaaagg

SEQ ID NO: 620137 - DNA, 20 bp, mouse
ggaggctcacaggttgtagt

SEQ ID NO: 620138 - DNA, 20 bp, mouse
gggggaggggggcattcaaa

SEQ ID NO: 620139 - DNA, 20 bp, mouse
ggggagggcttacctagagg

SEQ ID NO: 620140 - DNA, 20 bp, mouse
ggccctgagctgactgatca

SEQ ID NO: 620141 - DNA, 20 bp, mouse
gcggtccctgcagacgactt

SEQ ID NO: 620142 - DNA, 20 bp, mouse
gctcctgaggttatctataa

SEQ ID NO: 620143 - DNA, 20 bp, mouse
gcaggtgccatgccccctct

SEQ ID NO: 620144 - DNA, 20 bp, mouse
gtagataacctcaggagtgg

SEQ ID NO: 620145 - DNA, 20 bp, mouse
ggcaacaacacaaagggggg

SEQ ID NO: 620146 - DNA, 20 bp, mouse
gtcatagagaagactggcag

SEQ ID NO: 620147 - DNA, 20 bp, mouse
gagactggcagaggagcgcc

SEQ ID NO: 620148 - DNA, 20 bp, mouse
gtttgttacctggggcccca

SEQ ID NO: 620149 - DNA, 20 bp, mouse
gcaagcgcgcttaggagtag

SEQ ID NO: 620150 - DNA, 20 bp, mouse
gccctaggaaatgagaggac

SEQ ID NO: 620151 - DNA, 20 bp, mouse
gggtctgggtttgttacctg

SEQ ID NO: 620152 - DNA, 20 bp, mouse
gaggacaggagcaagaaacg

SEQ ID NO: 620153 - DNA, 20 bp, mouse
gagcccgcggatttgtaaaa

SEQ ID NO: 620154 - DNA, 20 bp, mouse
ggagtagaggctggaagcat

SEQ ID NO: 620155 - DNA, 20 bp, mouse
gctagatgaagcgcgccttg

SEQ ID NO: 620156 - DNA, 20 bp, mouse
ggcgcacgcccaagacccag

SEQ ID NO: 620157 - DNA, 20 bp, mouse
ggtctggcggctgaaagcgg

SEQ ID NO: 620158 - DNA, 20 bp, mouse
gcgacacgcacagggacaga

SEQ ID NO: 620159 - DNA, 20 bp, mouse
gatgctctgcgcgggtctgg

SEQ ID NO: 620160 - DNA, 20 bp, mouse
ggcgccgggaggtagagctt

SEQ ID NO: 620161 - DNA, 20 bp, mouse
gcgggccagtgggactggaa

SEQ ID NO: 620162 - DNA, 20 bp, mouse
gcgggtctggcggctgaaag

SEQ ID NO: 620163 - DNA, 20 bp, mouse
gaagacccaggggccggtct

SEQ ID NO: 620164 - DNA, 20 bp, mouse
gcaggtgtcactgcccagac

SEQ ID NO: 620165 - DNA, 20 bp, mouse
gagtcgcgggagcccccgct

SEQ ID NO: 620166 - DNA, 20 bp, mouse
gaaactgcaagcactcacaa

SEQ ID NO: 620167 - DNA, 20 bp, mouse
gcactcacaagggcatctgt

SEQ ID NO: 620168 - DNA, 20 bp, mouse
ggtgacacagaccggaacag

SEQ ID NO: 620169 - DNA, 20 bp, mouse
gttttttcctgagctcgaat

SEQ ID NO: 620170 - DNA, 20 bp, mouse
gacagaggctagggtacaga

SEQ ID NO: 620171 - DNA, 20 bp, mouse
gcagaccggaacagaggcta

SEQ ID NO: 620172 - DNA, 20 bp, mouse
gagacaacccattcgagctc

SEQ ID NO: 620173 - DNA, 20 bp, mouse
ggtggggcagtgacacagac

SEQ ID NO: 620174 - DNA, 20 bp, mouse
gcacaaacactactcagtca

SEQ ID NO: 620175 - DNA, 20 bp, mouse
ggctattagaggggtgaggg

SEQ ID NO: 620176 - DNA, 20 bp, mouse
gtcctggaagggaaacaatg

SEQ ID NO: 620177 - DNA, 20 bp, mouse
gaatggggcggagggcactg

SEQ ID NO: 620178 - DNA, 20 bp, mouse
gtgccgggagcctcctggaa

SEQ ID NO: 620179 - DNA, 20 bp, mouse
gtggaagggaaacaatgggg

SEQ ID NO: 620180 - DNA, 20 bp, mouse
gcgcgggaggccgagaggtc

SEQ ID NO: 620181 - DNA, 20 bp, mouse
gagggaaacaatggggcgga

SEQ ID NO: 620182 - DNA, 20 bp, mouse
ggaggccgagaggtccggcg

SEQ ID NO: 620183 - DNA, 20 bp, mouse
gccagtcgcgggaggccgag

SEQ ID NO: 620184 - DNA, 20 bp, mouse
gtcccggcaaagccgagccc

SEQ ID NO: 620185 - DNA, 20 bp, mouse
ggccgagaggtccggcgcgg

SEQ ID NO: 620186 - DNA, 20 bp, mouse
gggggctccggcagcggacg

SEQ ID NO: 620187 - DNA, 20 bp, mouse
ggacgcggcgcccggcggct

SEQ ID NO: 620188 - DNA, 20 bp, mouse
gagtcagccccgcctcggac

SEQ ID NO: 620189 - DNA, 20 bp, mouse
ggcctcctcggcgtcgtcgt

SEQ ID NO: 620190 - DNA, 20 bp, mouse
gagcctgcgggcccgggtgt

SEQ ID NO: 620191 - DNA, 20 bp, mouse
gagcggagcgaacgagacga

SEQ ID NO: 620192 - DNA, 20 bp, mouse
ggcctcggaccgggcgcgga

SEQ ID NO: 620193 - DNA, 20 bp, mouse
gggcgtcgtcgtcggggctc

SEQ ID NO: 620194 - DNA, 20 bp, mouse
gtccgctctcgccccccatg

SEQ ID NO: 620195 - DNA, 20 bp, mouse
gccgcctcggcgccgagatt

SEQ ID NO: 620196 - DNA, 20 bp, mouse
ggctacagagccatgagaca

SEQ ID NO: 620197 - DNA, 20 bp, mouse
gggctgggaactacaggctt

SEQ ID NO: 620198 - DNA, 20 bp, mouse
gagacatggctgggaactac

SEQ ID NO: 620199 - DNA, 20 bp, mouse
ggtagcccagcgagtctagg

SEQ ID NO: 620200 - DNA, 20 bp, mouse
gactacaggcttgggcaaga

SEQ ID NO: 620201 - DNA, 20 bp, mouse
gctagccccctagactcgct

SEQ ID NO: 620202 - DNA, 20 bp, mouse
gcagagccatgagacatggc

SEQ ID NO: 620203 - DNA, 20 bp, mouse
gcgagtctagggggctaggg

SEQ ID NO: 620204 - DNA, 20 bp, mouse
gaaggttctatcgtccacag

SEQ ID NO: 620205 - DNA, 20 bp, mouse
ggcagagttttgaagaatag

SEQ ID NO: 620206 - DNA, 20 bp, mouse
ggccgtgcgtctgagagcga

SEQ ID NO: 620207 - DNA, 20 bp, mouse
gcccgtagggagggacatca

SEQ ID NO: 620208 - DNA, 20 bp, mouse
ggccttcgctctcagacgca

SEQ ID NO: 620209 - DNA, 20 bp, mouse
gcaatgcgaatcgggaagag

SEQ ID NO: 620210 - DNA, 20 bp, mouse
gaggctcgttctccttctgg

SEQ ID NO: 620211 - DNA, 20 bp, mouse
gagggcggccctctccggaa

SEQ ID NO: 620212 - DNA, 20 bp, mouse
gccctccctacgggacagaa

SEQ ID NO: 620213 - DNA, 20 bp, mouse
gcgctgggcaccgtaggagg

SEQ ID NO: 620214 - DNA, 20 bp, mouse
gcgatgggcgtcaggcgagg

SEQ ID NO: 620215 - DNA, 20 bp, mouse
ggtagggagggacatcaggg

SEQ ID NO: 620216 - DNA, 20 bp, mouse
ggcggtggcagtgtcggagg

SEQ ID NO: 620217 - DNA, 20 bp, mouse
gaaacccgcacggccggtgg

SEQ ID NO: 620218 - DNA, 20 bp, mouse
ggtggcagtgtcggaggcgg

SEQ ID NO: 620219 - DNA, 20 bp, mouse
ggggcggtgctgagactagt

SEQ ID NO: 620220 - DNA, 20 bp, mouse
gacagggaggagggccccaa

SEQ ID NO: 620221 - DNA, 20 bp, mouse
gggaagctagagtccgccgg

SEQ ID NO: 620222 - DNA, 20 bp, mouse
gggacagaggcggcgactag

SEQ ID NO: 620223 - DNA, 20 bp, mouse
gctgggagccggtgcaggca

SEQ ID NO: 620224 - DNA, 20 bp, mouse
gagctagagtccgccggtgg

SEQ ID NO: 620225 - DNA, 20 bp, mouse
gagaaaacccgcacggccgg

SEQ ID NO: 620226 - DNA, 20 bp, mouse
gtaactgccggagaaatcag

SEQ ID NO: 620227 - DNA, 20 bp, mouse
ggcacccagcaacagcaatc

SEQ ID NO: 620228 - DNA, 20 bp, mouse
gccaccaacgtgaaggaaag

SEQ ID NO: 620229 - DNA, 20 bp, mouse
gagaggtgactccggaaaaa

SEQ ID NO: 620230 - DNA, 20 bp, mouse
gcggaatgttcagacaggat

SEQ ID NO: 620231 - DNA, 20 bp, mouse
gcttcttagcgtcgtcgttg

SEQ ID NO: 620232 - DNA, 20 bp, mouse
gaaagtgaccaccaacgtga

SEQ ID NO: 620233 - DNA, 20 bp, mouse
ggtgccactttccttcacgt

SEQ ID NO: 620234 - DNA, 20 bp, mouse
gttctcggagatcacaagag

SEQ ID NO: 620235 - DNA, 20 bp, mouse
gctccgagaagtcctagtat

SEQ ID NO: 620236 - DNA, 20 bp, mouse
ggagccgtccgagggaacgt

SEQ ID NO: 620237 - DNA, 20 bp, mouse
ggatggtggggacctcaagc

SEQ ID NO: 620238 - DNA, 20 bp, mouse
gaacgttacggttagatggt

SEQ ID NO: 620239 - DNA, 20 bp, mouse
ggaacgtgggttgaacgtta

SEQ ID NO: 620240 - DNA, 20 bp, mouse
ggtaggaacgaggttgtggt

SEQ ID NO: 620241 - DNA, 20 bp, mouse
gtgggggaggagccgtccga

SEQ ID NO: 620242 - DNA, 20 bp, mouse
ggctccttcttcgcatacag

SEQ ID NO: 620243 - DNA, 20 bp, mouse
ggaaggagcgtacttcggga

SEQ ID NO: 620244 - DNA, 20 bp, mouse
gcctggcggagagggctgtg

SEQ ID NO: 620245 - DNA, 20 bp, mouse
gggggacctcaagctggaag

SEQ ID NO: 620246 - DNA, 20 bp, mouse
ggaccccccgggctttgtgt

SEQ ID NO: 620247 - DNA, 20 bp, mouse
ggcgccagcgtggacccccc

SEQ ID NO: 620248 - DNA, 20 bp, mouse
gcaaggcagggaggatcggg

SEQ ID NO: 620249 - DNA, 20 bp, mouse
gagctagccgagcctgaact

SEQ ID NO: 620250 - DNA, 20 bp, mouse
gcgacccacacaaagcccgg

SEQ ID NO: 620251 - DNA, 20 bp, mouse
ggctttgtgtgggtcgcggg

SEQ ID NO: 620252 - DNA, 20 bp, mouse
ggctcggctagctcaaggca

SEQ ID NO: 620253 - DNA, 20 bp, mouse
gttcaggctcggctagctca

SEQ ID NO: 620254 - DNA, 20 bp, mouse
ggctcaaggcagggaggatc

SEQ ID NO: 620255 - DNA, 20 bp, mouse
gcagctgcccaggcacggag

SEQ ID NO: 620256 - DNA, 20 bp, mouse
ggcatccctgagccaggtag

SEQ ID NO: 620257 - DNA, 20 bp, mouse
gaaaaagcgggcaacctccg

SEQ ID NO: 620258 - DNA, 20 bp, mouse
ggagtgcacgcacctctacc

SEQ ID NO: 620259 - DNA, 20 bp, mouse
ggatgctgcttcgtccccgg

SEQ ID NO: 620260 - DNA, 20 bp, mouse
gtagaggtgcgtgcactcca

SEQ ID NO: 620261 - DNA, 20 bp, mouse
gcgtcggggctagctggcga

SEQ ID NO: 620262 - DNA, 20 bp, mouse
gggcgacggcggagaaaaag

SEQ ID NO: 620263 - DNA, 20 bp, mouse
gccgtctctcgggcactcca

SEQ ID NO: 620264 - DNA, 20 bp, mouse
gcgcacctctacctggctca

SEQ ID NO: 620265 - DNA, 20 bp, mouse
ggagagacggagctacttct

SEQ ID NO: 620266 - DNA, 20 bp, mouse
ggtgggtagtgctgtcgtgg

SEQ ID NO: 620267 - DNA, 20 bp, mouse
ggccgccgacatgcctactg

SEQ ID NO: 620268 - DNA, 20 bp, mouse
ggccgcgtccgccaagacac

SEQ ID NO: 620269 - DNA, 20 bp, mouse
gacctcagtaggcatgtcgg

SEQ ID NO: 620270 - DNA, 20 bp, mouse
gcggaagcaggcccaagacg

SEQ ID NO: 620271 - DNA, 20 bp, mouse
gtagacctcagtaggcatgt

SEQ ID NO: 620272 - DNA, 20 bp, mouse
gtccccgacaaggcacgctg

SEQ ID NO: 620273 - DNA, 20 bp, mouse
gggggtgggtagtgctgtcg

SEQ ID NO: 620274 - DNA, 20 bp, mouse
gaggccctcgcaagcctcag

SEQ ID NO: 620275 - DNA, 20 bp, mouse
ggccttgtcggggagaccca

SEQ ID NO: 620276 - DNA, 20 bp, mouse
gaactcacatgggtcaggaa

SEQ ID NO: 620277 - DNA, 20 bp, mouse
gtgtcgccggtaactcacat

SEQ ID NO: 620278 - DNA, 20 bp, mouse
gctctatcaaagctacgaag

SEQ ID NO: 620279 - DNA, 20 bp, mouse
gccggtaactcacatgggtc

SEQ ID NO: 620280 - DNA, 20 bp, mouse
ggaaggggtaagacgtaaaa

SEQ ID NO: 620281 - DNA, 20 bp, mouse
gaaggagcttgctctctctt

SEQ ID NO: 620282 - DNA, 20 bp, mouse
gaaagggaaaggagattccc

SEQ ID NO: 620283 - DNA, 20 bp, mouse
gtagccgatacattaactac

SEQ ID NO: 620284 - DNA, 20 bp, mouse
gggtaagacgtaaaagggaa

SEQ ID NO: 620285 - DNA, 20 bp, mouse
gtagagttcatcgctgtcgc

SEQ ID NO: 620286 - DNA, 20 bp, mouse
gagagggtccctgaaaactg

SEQ ID NO: 620287 - DNA, 20 bp, mouse
gggaggtaccagcgcccaga

SEQ ID NO: 620288 - DNA, 20 bp, mouse
gccctgaaaactgcgggtgt

SEQ ID NO: 620289 - DNA, 20 bp, mouse
ggccgcgcggcgtccgtggg

SEQ ID NO: 620290 - DNA, 20 bp, mouse
gggtgtgggacaggaaatgc

SEQ ID NO: 620291 - DNA, 20 bp, mouse
ggcggccgcgcggcgtccgt

SEQ ID NO: 620292 - DNA, 20 bp, mouse
gacttaggaggagacaccag

SEQ ID NO: 620293 - DNA, 20 bp, mouse
ggagcccctcaacttagaaa

SEQ ID NO: 620294 - DNA, 20 bp, mouse
gggatcacaagtgacccccg

SEQ ID NO: 620295 - DNA, 20 bp, mouse
gagtcatgagatgcatacat

SEQ ID NO: 620296 - DNA, 20 bp, mouse
gtgcagagcggtatgctgta

SEQ ID NO: 620297 - DNA, 20 bp, mouse
ggctaggagagcgactacag

SEQ ID NO: 620298 - DNA, 20 bp, mouse
gtagggagctggcgaagtct

SEQ ID NO: 620299 - DNA, 20 bp, mouse
gccaggagccggaaacgcgg

SEQ ID NO: 620300 - DNA, 20 bp, mouse
ggggccccgagggtccaccg

SEQ ID NO: 620301 - DNA, 20 bp, mouse
ggcactcgctcaaaatcacg

SEQ ID NO: 620302 - DNA, 20 bp, mouse
ggcggtatgctgtagggagc

SEQ ID NO: 620303 - DNA, 20 bp, mouse
gcaccgaggcaccgatcccc

SEQ ID NO: 620304 - DNA, 20 bp, mouse
gaagtctggggagtcgtcct

SEQ ID NO: 620305 - DNA, 20 bp, mouse
gttgctccagggactgacag

SEQ ID NO: 620306 - DNA, 20 bp, mouse
gcgttcgggcggcatcctca

SEQ ID NO: 620307 - DNA, 20 bp, mouse
ggagccggacgagacgagac

SEQ ID NO: 620308 - DNA, 20 bp, mouse
gtggtactccacgtgaacgt

SEQ ID NO: 620309 - DNA, 20 bp, mouse
ggccgcccgaacgcaagagc

SEQ ID NO: 620310 - DNA, 20 bp, mouse
gtccggctcttgcgttcggg

SEQ ID NO: 620311 - DNA, 20 bp, mouse
gggaaagccagacccgggag

SEQ ID NO: 620312 - DNA, 20 bp, mouse
gtctccggtctcgtctcgtc

SEQ ID NO: 620313 - DNA, 20 bp, mouse
gtcgtccggctcttgcgttc

SEQ ID NO: 620314 - DNA, 20 bp, mouse
gcctagcgcgggatccgcgg

SEQ ID NO: 620315 - DNA, 20 bp, mouse
ggcccctagcgcgggatccg

SEQ ID NO: 620316 - DNA, 20 bp, mouse
ggcattggagagtaccgcgt

SEQ ID NO: 620317 - DNA, 20 bp, mouse
gcgatcagctggtcaggcag

SEQ ID NO: 620318 - DNA, 20 bp, mouse
ggcagaggcagggcgaaccg

SEQ ID NO: 620319 - DNA, 20 bp, mouse
ggcggtactctccaatgctc

SEQ ID NO: 620320 - DNA, 20 bp, mouse
gaagggatccgcgggcactg

SEQ ID NO: 620321 - DNA, 20 bp, mouse
ggcggcactaactacacgtg

SEQ ID NO: 620322 - DNA, 20 bp, mouse
gactacacgtgaggaaaagc

SEQ ID NO: 620323 - DNA, 20 bp, mouse
gggatccgcgggcactgcgg

SEQ ID NO: 620324 - DNA, 20 bp, mouse
gaaagcaggcaccggagcat

SEQ ID NO: 620325 - DNA, 20 bp, mouse
gggagaaagttactcccacg

SEQ ID NO: 620326 - DNA, 20 bp, mouse
gctggtgccggtgagtccgg

SEQ ID NO: 620327 - DNA, 20 bp, mouse
gaggctggtgccggtgagtc

SEQ ID NO: 620328 - DNA, 20 bp, mouse
gtttaagccaccggactcac

SEQ ID NO: 620329 - DNA, 20 bp, mouse
ggccccgcagacccacctcg

SEQ ID NO: 620330 - DNA, 20 bp, mouse
gtgtggcccagagttctcca

SEQ ID NO: 620331 - DNA, 20 bp, mouse
gcagctgtgcaccacgaggt

SEQ ID NO: 620332 - DNA, 20 bp, mouse
gggtctctcccataaggtag

SEQ ID NO: 620333 - DNA, 20 bp, mouse
gccatccagaaggatctggt

SEQ ID NO: 620334 - DNA, 20 bp, mouse
ggacccagctgtgcaccacg

SEQ ID NO: 620335 - DNA, 20 bp, mouse
gaacacgccaagaagcatct

SEQ ID NO: 620336 - DNA, 20 bp, mouse
gaacccaagtcggtgaccac

SEQ ID NO: 620337 - DNA, 20 bp, mouse
gacgctccgcgaacccaagt

SEQ ID NO: 620338 - DNA, 20 bp, mouse
gccaccggagcagagagtct

SEQ ID NO: 620339 - DNA, 20 bp, mouse
ggaatgatgccggcaagcgg

SEQ ID NO: 620340 - DNA, 20 bp, mouse
gctccggtggtcaccgactt

SEQ ID NO: 620341 - DNA, 20 bp, mouse
ggcggagagcaccctgggag

SEQ ID NO: 620342 - DNA, 20 bp, mouse
gagctggagtcccctggaga

SEQ ID NO: 620343 - DNA, 20 bp, mouse
ggggttgccgccctctccag

SEQ ID NO: 620344 - DNA, 20 bp, mouse
gttgccggcatcattctggg

SEQ ID NO: 620345 - DNA, 20 bp, mouse
gcaggcaggtctcaccgcca

SEQ ID NO: 620346 - DNA, 20 bp, mouse
gtaagagtgaggctgaaagg

SEQ ID NO: 620347 - DNA, 20 bp, mouse
gaacttcacaagcagccggg

SEQ ID NO: 620348 - DNA, 20 bp, mouse
gcactaagagtgaggctgaa

SEQ ID NO: 620349 - DNA, 20 bp, mouse
gcagtcaatcactaagagtg

SEQ ID NO: 620350 - DNA, 20 bp, mouse
ggccggtccccgccacacac

SEQ ID NO: 620351 - DNA, 20 bp, mouse
gtagcagagggaaaagtccg

SEQ ID NO: 620352 - DNA, 20 bp, mouse
gctagcccgtcaaggatact

SEQ ID NO: 620353 - DNA, 20 bp, mouse
gctcatggcggagataattc

SEQ ID NO: 620354 - DNA, 20 bp, mouse
gttgtgaagttccagcctca

SEQ ID NO: 620355 - DNA, 20 bp, mouse
gtctacgcttatcggccgcc

SEQ ID NO: 620356 - DNA, 20 bp, mouse
gtgaagccaggcctgatgat

SEQ ID NO: 620357 - DNA, 20 bp, mouse
gtagccttcagaagaggatc

SEQ ID NO: 620358 - DNA, 20 bp, mouse
ggagtttcagtataatccaa

SEQ ID NO: 620359 - DNA, 20 bp, mouse
ggaaggctaaatctgaaaaa

SEQ ID NO: 620360 - DNA, 20 bp, mouse
gcagatttagccttcagaag

SEQ ID NO: 620361 - DNA, 20 bp, mouse
gttcccagatcctcttctga

SEQ ID NO: 620362 - DNA, 20 bp, mouse
gacagagcaatagtcactca

SEQ ID NO: 620363 - DNA, 20 bp, mouse
ggctagcatgaatacctaac

SEQ ID NO: 620364 - DNA, 20 bp, mouse
ggcttcaaggtccccatact

SEQ ID NO: 620365 - DNA, 20 bp, mouse
gcaagctgggagtgtaagat

SEQ ID NO: 620366 - DNA, 20 bp, mouse
ggggcaccctgtccatgatg

SEQ ID NO: 620367 - DNA, 20 bp, mouse
gtgcggcgagaagtccgtct

SEQ ID NO: 620368 - DNA, 20 bp, mouse
gagttctgggtgccactcag

SEQ ID NO: 620369 - DNA, 20 bp, mouse
gtccagagcagacgcccaga

SEQ ID NO: 620370 - DNA, 20 bp, mouse
gtctcgccgcatcatggaca

SEQ ID NO: 620371 - DNA, 20 bp, mouse
ggccactcaggggcaggagg

SEQ ID NO: 620372 - DNA, 20 bp, mouse
gccagtgtccgtgacgggaa

SEQ ID NO: 620373 - DNA, 20 bp, mouse
gtccgtctgggcgtctgctc

SEQ ID NO: 620374 - DNA, 20 bp, mouse
gagcatggttgctcctacag

SEQ ID NO: 620375 - DNA, 20 bp, mouse
gaacgggcaatccctcaatg

SEQ ID NO: 620376 - DNA, 20 bp, mouse
gctcgttcaggggcattcca

SEQ ID NO: 620377 - DNA, 20 bp, mouse
gggcaggctcgctcgttcag

SEQ ID NO: 620378 - DNA, 20 bp, mouse
ggtcaagtcagatacttcaa

SEQ ID NO: 620379 - DNA, 20 bp, mouse
gttggtttctctgttaggac

SEQ ID NO: 620380 - DNA, 20 bp, mouse
ggaattgagggtagtccctg

SEQ ID NO: 620381 - DNA, 20 bp, mouse
ggatcgaaagtcttacaggt

SEQ ID NO: 620382 - DNA, 20 bp, mouse
gatacttcaatggccgtccg

SEQ ID NO: 620383 - DNA, 20 bp, mouse
gtacgaagttatttcactaa

SEQ ID NO: 620384 - DNA, 20 bp, mouse
gttcaggggcattccacgga

SEQ ID NO: 620385 - DNA, 20 bp, mouse
ggacggccacatctgagctc

SEQ ID NO: 620386 - DNA, 20 bp, mouse
gtccttccaccagaagccca

SEQ ID NO: 620387 - DNA, 20 bp, mouse
gtctggacacggccagcatg

SEQ ID NO: 620388 - DNA, 20 bp, mouse
ggaaggaccactgctcggtg

SEQ ID NO: 620389 - DNA, 20 bp, mouse
gctcggtgaggagaacccgt

SEQ ID NO: 620390 - DNA, 20 bp, mouse
gggttctcctcaccgagcag

SEQ ID NO: 620391 - DNA, 20 bp, mouse
gtggtggaaggaccactgct

SEQ ID NO: 620392 - DNA, 20 bp, mouse
gcgtaggtggctacgatgaa

SEQ ID NO: 620393 - DNA, 20 bp, mouse
ggtggccaccggtgtcatcg

SEQ ID NO: 620394 - DNA, 20 bp, mouse
gaccacatagacgtacatgg

SEQ ID NO: 620395 - DNA, 20 bp, mouse
gggccgaggcacgcagaaat

SEQ ID NO: 620396 - DNA, 20 bp, mouse
gtacgtgcggttcacactga

SEQ ID NO: 620397 - DNA, 20 bp, mouse
gtagaggcgagggcgaagag

SEQ ID NO: 620398 - DNA, 20 bp, mouse
gaggttatggacgttacgtg

SEQ ID NO: 620399 - DNA, 20 bp, mouse
gactgctgccctaggtaatg

SEQ ID NO: 620400 - DNA, 20 bp, mouse
gtattctaagaacttcgctt

SEQ ID NO: 620401 - DNA, 20 bp, mouse
gtggctttagggagaggtta

SEQ ID NO: 620402 - DNA, 20 bp, mouse
gcggaaaaggctagaggcga

SEQ ID NO: 620403 - DNA, 20 bp, mouse
gaaagcctggctttagggag

SEQ ID NO: 620404 - DNA, 20 bp, mouse
gctctcactactgctgccct

SEQ ID NO: 620405 - DNA, 20 bp, mouse
gaagatgcagtcaggcctcc

SEQ ID NO: 620406 - DNA, 20 bp, mouse
ggctcttccttagccagcgg

SEQ ID NO: 620407 - DNA, 20 bp, mouse
gcagcggcggtggccagcgc

SEQ ID NO: 620408 - DNA, 20 bp, mouse
ggccggctcacctgctgaga

SEQ ID NO: 620409 - DNA, 20 bp, mouse
gtggccaccgccgctggcta

SEQ ID NO: 620410 - DNA, 20 bp, mouse
gacatgcagggcccgcgcgg

SEQ ID NO: 620411 - DNA, 20 bp, mouse
gagctctgggccgggtggag

SEQ ID NO: 620412 - DNA, 20 bp, mouse
gcccggtttctaggctgtag

SEQ ID NO: 620413 - DNA, 20 bp, mouse
gccttcttggagggatgcgg

SEQ ID NO: 620414 - DNA, 20 bp, mouse
gacgggcccgggggtggcag

SEQ ID NO: 620415 - DNA, 20 bp, mouse
gctgcgaatcacagctcggg

SEQ ID NO: 620416 - DNA, 20 bp, mouse
ggctggtactacgtctcctg

SEQ ID NO: 620417 - DNA, 20 bp, mouse
gcctgcgggccgtgtcaccg

SEQ ID NO: 620418 - DNA, 20 bp, mouse
gtctcctgaggcagcgagtg

SEQ ID NO: 620419 - DNA, 20 bp, mouse
gcctgaggcagcgagtgcgg

SEQ ID NO: 620420 - DNA, 20 bp, mouse
gagcgagtgcggcggactga

SEQ ID NO: 620421 - DNA, 20 bp, mouse
ggccgtgtcaccggggctga

SEQ ID NO: 620422 - DNA, 20 bp, mouse
gagtctctggacaactgcgg

SEQ ID NO: 620423 - DNA, 20 bp, mouse
gtgtctacaccggaaggggt

SEQ ID NO: 620424 - DNA, 20 bp, mouse
gtgcggcggactgagggtcg

SEQ ID NO: 620425 - DNA, 20 bp, mouse
gagccgctccaggcaaatga

SEQ ID NO: 620426 - DNA, 20 bp, mouse
gggcaggccccggacccgag

SEQ ID NO: 620427 - DNA, 20 bp, mouse
gccggacccgagcggttccc

SEQ ID NO: 620428 - DNA, 20 bp, mouse
gccatgcccgggaaccgctc

SEQ ID NO: 620429 - DNA, 20 bp, mouse
gccgccgcgcgggaatgaat

SEQ ID NO: 620430 - DNA, 20 bp, mouse
ggccgccgcgcattgtgctg

SEQ ID NO: 620431 - DNA, 20 bp, mouse
ggtgctgcggctggccggcg

SEQ ID NO: 620432 - DNA, 20 bp, mouse
gccccgagctgtagacactg

SEQ ID NO: 620433 - DNA, 20 bp, mouse
gccgcgcacgcactcacagg

SEQ ID NO: 620434 - DNA, 20 bp, mouse
gcagcaagcaaagcggccag

SEQ ID NO: 620435 - DNA, 20 bp, mouse
ggccgcagcacaatgcgcgg

SEQ ID NO: 620436 - DNA, 20 bp, mouse
gccgcgccacccggaagccg

SEQ ID NO: 620437 - DNA, 20 bp, mouse
gactcaccggtacaggagta

SEQ ID NO: 620438 - DNA, 20 bp, mouse
gttggaactcgttcactcac

SEQ ID NO: 620439 - DNA, 20 bp, mouse
gcgagttccaaaatcgggtt

SEQ ID NO: 620440 - DNA, 20 bp, mouse
gctcccccaggtgcccgtca

SEQ ID NO: 620441 - DNA, 20 bp, mouse
gcagtgagtgacaacgtggg

SEQ ID NO: 620442 - DNA, 20 bp, mouse
gctcgttcactcaccggtac

SEQ ID NO: 620443 - DNA, 20 bp, mouse
ggcacctgggggagtaaagg

SEQ ID NO: 620444 - DNA, 20 bp, mouse
gcgccatgacgggcacctgg

SEQ ID NO: 620445 - DNA, 20 bp, mouse
gttgcagtgagtgacaacgt

SEQ ID NO: 620446 - DNA, 20 bp, mouse
gtctttattcatgttatgct

SEQ ID NO: 620447 - DNA, 20 bp, mouse
gaatagctgctattaaaatt

SEQ ID NO: 620448 - DNA, 20 bp, mouse
gttagggccacaaagccaat

SEQ ID NO: 620449 - DNA, 20 bp, mouse
gaaatatgagagctgatgtg

SEQ ID NO: 620450 - DNA, 20 bp, mouse
gaacactacagtacagtgta

SEQ ID NO: 620451 - DNA, 20 bp, mouse
gggcctggaagacactcaac

SEQ ID NO: 620452 - DNA, 20 bp, mouse
gcaccttcatgttcattcgt

SEQ ID NO: 620453 - DNA, 20 bp, mouse
gctttgagggcagaggatga

SEQ ID NO: 620454 - DNA, 20 bp, mouse
ggactcacggacttgcccat

SEQ ID NO: 620455 - DNA, 20 bp, mouse
gacttttttatgtcttcagg

SEQ ID NO: 620456 - DNA, 20 bp, mouse
ggatgtatcgtgagtagaca

SEQ ID NO: 620457 - DNA, 20 bp, mouse
gctacctaatcatcagtcta

SEQ ID NO: 620458 - DNA, 20 bp, mouse
gtgaccctagactgatgatt

SEQ ID NO: 620459 - DNA, 20 bp, mouse
gggtcagtttgaggaataat

SEQ ID NO: 620460 - DNA, 20 bp, mouse
ggtttagaaccagtcgagat

SEQ ID NO: 620461 - DNA, 20 bp, mouse
gttcctgttaattcaggtaa

SEQ ID NO: 620462 - DNA, 20 bp, mouse
gcacttgttcctgttaattc

SEQ ID NO: 620463 - DNA, 20 bp, mouse
gatttctctccaatctcgac

SEQ ID NO: 620464 - DNA, 20 bp, mouse
gttcctttacctgaattaac

SEQ ID NO: 620465 - DNA, 20 bp, mouse
gatagtgaggaagagagtta

SEQ ID NO: 620466 - DNA, 20 bp, mouse
gaccagctcccgccaggaac

SEQ ID NO: 620467 - DNA, 20 bp, mouse
gcgcgacccggtccgcccca

SEQ ID NO: 620468 - DNA, 20 bp, mouse
ggctggtcgcgtgagccgtg

SEQ ID NO: 620469 - DNA, 20 bp, mouse
ggagcgttgccggttcctgg

SEQ ID NO: 620470 - DNA, 20 bp, mouse
ggcacggcccaggcaacctc

SEQ ID NO: 620471 - DNA, 20 bp, mouse
gtcacgtgacctgagtaaca

SEQ ID NO: 620472 - DNA, 20 bp, mouse
ggaggcaggcgggccctggg

SEQ ID NO: 620473 - DNA, 20 bp, mouse
gggaaccggcaacgctcact

SEQ ID NO: 620474 - DNA, 20 bp, mouse
gggtcgcgcgtgggagagca

SEQ ID NO: 620475 - DNA, 20 bp, mouse
ggagagcagggtcggagcag

SEQ ID NO: 620476 - DNA, 20 bp, mouse
ggacgggcagggagacactg

SEQ ID NO: 620477 - DNA, 20 bp, mouse
gacacccggaactctaactg

SEQ ID NO: 620478 - DNA, 20 bp, mouse
gacactgcggctgaagcaga

SEQ ID NO: 620479 - DNA, 20 bp, mouse
gcccggaactctaactgcgg

SEQ ID NO: 620480 - DNA, 20 bp, mouse
gccgggtgtttcgtgtgagg

SEQ ID NO: 620481 - DNA, 20 bp, mouse
gctggagaatgcaacgagac

SEQ ID NO: 620482 - DNA, 20 bp, mouse
ggttccgggtgtttcgtgtg

SEQ ID NO: 620483 - DNA, 20 bp, mouse
ggcagagtcggacactgcgg

SEQ ID NO: 620484 - DNA, 20 bp, mouse
ggaatgcaacgagacgggca

SEQ ID NO: 620485 - DNA, 20 bp, mouse
gaactgcagctggcactcca

SEQ ID NO: 620486 - DNA, 20 bp, mouse
gcagggtgttagcattctgt

SEQ ID NO: 620487 - DNA, 20 bp, mouse
gcttcctcgatgggaaggca

SEQ ID NO: 620488 - DNA, 20 bp, mouse
ggggggcttcctcgatggga

SEQ ID NO: 620489 - DNA, 20 bp, mouse
gtgagttgaatccttagaag

SEQ ID NO: 620490 - DNA, 20 bp, mouse
gactggtgagtgcggagacc

SEQ ID NO: 620491 - DNA, 20 bp, mouse
ggcccatggaggctactctc

SEQ ID NO: 620492 - DNA, 20 bp, mouse
gtgaatccttagaagaggaa

SEQ ID NO: 620493 - DNA, 20 bp, mouse
ggaccacaggtgctaagtga

SEQ ID NO: 620494 - DNA, 20 bp, mouse
gctcgggcgggcggccacag

SEQ ID NO: 620495 - DNA, 20 bp, mouse
gacaccctgccttcccatcg

SEQ ID NO: 620496 - DNA, 20 bp, mouse
gcgggcagtggacttggcag

SEQ ID NO: 620497 - DNA, 20 bp, mouse
ggcagaggcagtgacggcga

SEQ ID NO: 620498 - DNA, 20 bp, mouse
gggctcgcgctggctccgac

SEQ ID NO: 620499 - DNA, 20 bp, mouse
gacccgggactggaagatgg

SEQ ID NO: 620500 - DNA, 20 bp, mouse
ggggtagcgggcagtggact

SEQ ID NO: 620501 - DNA, 20 bp, mouse
gccgggtagccagcgccagt

SEQ ID NO: 620502 - DNA, 20 bp, mouse
gggcatccgcccgcagtcat

SEQ ID NO: 620503 - DNA, 20 bp, mouse
gcggctgacttacatggcgg

SEQ ID NO: 620504 - DNA, 20 bp, mouse
gaggcggctgacttacatgg

SEQ ID NO: 620505 - DNA, 20 bp, mouse
gggcaggcggctgacttaca

SEQ ID NO: 620506 - DNA, 20 bp, mouse
gctcgcgctgcaggcaaccg

SEQ ID NO: 620507 - DNA, 20 bp, mouse
ggcgaatggccgagggtcga

SEQ ID NO: 620508 - DNA, 20 bp, mouse
gctgcaggcaaccgaggctg

SEQ ID NO: 620509 - DNA, 20 bp, mouse
gggcggcggcgaatggccga

SEQ ID NO: 620510 - DNA, 20 bp, mouse
gggcagacgcggaaggacgg

SEQ ID NO: 620511 - DNA, 20 bp, mouse
gaagcggccgccacaccccg

SEQ ID NO: 620512 - DNA, 20 bp, mouse
ggcgcgagtccgtcgaccct

SEQ ID NO: 620513 - DNA, 20 bp, mouse
ggccgtggtgacgtcacgag

SEQ ID NO: 620514 - DNA, 20 bp, mouse
ggacgctgcgggacgagtcg

SEQ ID NO: 620515 - DNA, 20 bp, mouse
gggcaggagcgggagacctg

SEQ ID NO: 620516 - DNA, 20 bp, mouse
gctgcagcagagcggagcgg

SEQ ID NO: 620517 - DNA, 20 bp, mouse
gcagcagagcggagcggtgg

SEQ ID NO: 620518 - DNA, 20 bp, mouse
gcgagtcgctcgatgagcgg

SEQ ID NO: 620519 - DNA, 20 bp, mouse
gggcagcgcagggcaggcgg

SEQ ID NO: 620520 - DNA, 20 bp, mouse
ggaacagctctccccctgga

SEQ ID NO: 620521 - DNA, 20 bp, mouse
gactgctgccgggagcccat

SEQ ID NO: 620522 - DNA, 20 bp, mouse
ggggagagctgttcccgagg

SEQ ID NO: 620523 - DNA, 20 bp, mouse
ggatcgagttgccctccagg

SEQ ID NO: 620524 - DNA, 20 bp, mouse
gcagccccagcggacgttgg

SEQ ID NO: 620525 - DNA, 20 bp, mouse
gcacctgtacggggagtcgg

SEQ ID NO: 620526 - DNA, 20 bp, mouse
ggccggcgagcaggcagcgg

SEQ ID NO: 620527 - DNA, 20 bp, mouse
gccgctcggggcagaggaat

SEQ ID NO: 620528 - DNA, 20 bp, mouse
gcgggcactgaggccgctcg

SEQ ID NO: 620529 - DNA, 20 bp, mouse
ggcggaggcaatggtgagac

SEQ ID NO: 620530 - DNA, 20 bp, mouse
ggcaatggtgagacgggcag

SEQ ID NO: 620531 - DNA, 20 bp, mouse
ggccgccgctgcctgctcgc

SEQ ID NO: 620532 - DNA, 20 bp, mouse
ggcggcggctgcggaggcaa

SEQ ID NO: 620533 - DNA, 20 bp, mouse
gttcggagtgcgccccgtcg

SEQ ID NO: 620534 - DNA, 20 bp, mouse
gcaaccggggagggagactt

SEQ ID NO: 620535 - DNA, 20 bp, mouse
ggcagagggcgattgtgcag

SEQ ID NO: 620536 - DNA, 20 bp, mouse
gccttgggtggaaacagact

SEQ ID NO: 620537 - DNA, 20 bp, mouse
gaagctgtggctgccttggg

SEQ ID NO: 620538 - DNA, 20 bp, mouse
ggcccaagtgctccgagaca

SEQ ID NO: 620539 - DNA, 20 bp, mouse
gcgaggtcacgggaggaagg

SEQ ID NO: 620540 - DNA, 20 bp, mouse
gcaggaggcgggctgaaagt

SEQ ID NO: 620541 - DNA, 20 bp, mouse
gccagcaccgaggtcacggg

SEQ ID NO: 620542 - DNA, 20 bp, mouse
gtgtgtggcaggagccggag

SEQ ID NO: 620543 - DNA, 20 bp, mouse
gtcgcgggatggtcaggagg

SEQ ID NO: 620544 - DNA, 20 bp, mouse
ggagtcgcgggatggtcagg

SEQ ID NO: 620545 - DNA, 20 bp, mouse
gagacatggtgagtgacgtg

SEQ ID NO: 620546 - DNA, 20 bp, mouse
gcagcagagaccagcggccg

SEQ ID NO: 620547 - DNA, 20 bp, mouse
gtgcagcccagcgcaggccg

SEQ ID NO: 620548 - DNA, 20 bp, mouse
gctcgacccggaggaaccca

SEQ ID NO: 620549 - DNA, 20 bp, mouse
gacccggcacgcgcactcag

SEQ ID NO: 620550 - DNA, 20 bp, mouse
ggcgtgtcggaggcaaccag

SEQ ID NO: 620551 - DNA, 20 bp, mouse
ggggctccgcggcctgcgct

SEQ ID NO: 620552 - DNA, 20 bp, mouse
gcgtctcggggagctcgacc

SEQ ID NO: 620553 - DNA, 20 bp, mouse
gtccagtgctcggagtcctg

SEQ ID NO: 620554 - DNA, 20 bp, mouse
gctcggaccgggagacccct

SEQ ID NO: 620555 - DNA, 20 bp, mouse
gtggaggcacagccccgccg

SEQ ID NO: 620556 - DNA, 20 bp, mouse
gggcactcaggctcccatgg

SEQ ID NO: 620557 - DNA, 20 bp, mouse
gaggggactgcagggcactc

SEQ ID NO: 620558 - DNA, 20 bp, mouse
gtggttctgggtcccgccat

SEQ ID NO: 620559 - DNA, 20 bp, mouse
gacccagaaccaagcaatcg

SEQ ID NO: 620560 - DNA, 20 bp, mouse
gttccccctcgaggccccgg

SEQ ID NO: 620561 - DNA, 20 bp, mouse
ggaatcagatctggagccgg

SEQ ID NO: 620562 - DNA, 20 bp, mouse
gcgcggagttcggaaagacc

SEQ ID NO: 620563 - DNA, 20 bp, mouse
ggccactgcgaacagcccgg

SEQ ID NO: 620564 - DNA, 20 bp, mouse
ggaactccgcgctccagaac

SEQ ID NO: 620565 - DNA, 20 bp, mouse
gtccaccgggctgttcgcag

SEQ ID NO: 620566 - DNA, 20 bp, mouse
gcgggccgcgggggtcccga

SEQ ID NO: 620567 - DNA, 20 bp, mouse
ggagcggacaggctgccctc

SEQ ID NO: 620568 - DNA, 20 bp, mouse
ggcagtgcgcgtggccgcgg

SEQ ID NO: 620569 - DNA, 20 bp, mouse
gacagcgcagcgcagagcgg

SEQ ID NO: 620570 - DNA, 20 bp, mouse
ggctgccctcgggacccccg

SEQ ID NO: 620571 - DNA, 20 bp, mouse
gcgcggcccggcagcaggcg

SEQ ID NO: 620572 - DNA, 20 bp, mouse
gtccgcggagctctaggacg

SEQ ID NO: 620573 - DNA, 20 bp, mouse
gtgcgctgcgctgtctccta

SEQ ID NO: 620574 - DNA, 20 bp, mouse
gtggctgggacgctccggag

SEQ ID NO: 620575 - DNA, 20 bp, mouse
ggaggtctgaaggagggtcg

SEQ ID NO: 620576 - DNA, 20 bp, mouse
gggcggggcgcaggggcgga

SEQ ID NO: 620577 - DNA, 20 bp, mouse
ggcggtgccgggcgagctca

SEQ ID NO: 620578 - DNA, 20 bp, mouse
gcccgggagctgtcactcag

SEQ ID NO: 620579 - DNA, 20 bp, mouse
gtcagcggccggtgccggaa

SEQ ID NO: 620580 - DNA, 20 bp, mouse
gcggaagggacgcgccctga

SEQ ID NO: 620581 - DNA, 20 bp, mouse
gccatggtcctccccgtcgg

SEQ ID NO: 620582 - DNA, 20 bp, mouse
gcccctgcgccccgccaccc

SEQ ID NO: 620583 - DNA, 20 bp, mouse
gagctgatggaagggtactc

SEQ ID NO: 620584 - DNA, 20 bp, mouse
gtgcgtgccgtgagctcgcc

SEQ ID NO: 620585 - DNA, 20 bp, mouse
ggcttcgtgggctgtaaccc

SEQ ID NO: 620586 - DNA, 20 bp, mouse
gagtgacctgaggagagacc

SEQ ID NO: 620587 - DNA, 20 bp, mouse
ggacccggcagattgaggag

SEQ ID NO: 620588 - DNA, 20 bp, mouse
gcgccagcagcgcctagagg

SEQ ID NO: 620589 - DNA, 20 bp, mouse
gggagagacccggcagattg

SEQ ID NO: 620590 - DNA, 20 bp, mouse
gaggctgcaagcagatgcgg

SEQ ID NO: 620591 - DNA, 20 bp, mouse
gaggcgcccggccggaccct

SEQ ID NO: 620592 - DNA, 20 bp, mouse
gcggctgctcggccaggcct

SEQ ID NO: 620593 - DNA, 20 bp, mouse
ggggtcccgcctcctcctct

SEQ ID NO: 620594 - DNA, 20 bp, mouse
gcagcagcgcctagaggagg

SEQ ID NO: 620595 - DNA, 20 bp, mouse
gccaggcctagggtccggcc

SEQ ID NO: 620596 - DNA, 20 bp, mouse
gcgcatggccgaggttgcgg

SEQ ID NO: 620597 - DNA, 20 bp, mouse
ggcctctaactcgaacgtcc

SEQ ID NO: 620598 - DNA, 20 bp, mouse
gcacctcgccatgcacctat

SEQ ID NO: 620599 - DNA, 20 bp, mouse
ggccgggacgttcgagttag

SEQ ID NO: 620600 - DNA, 20 bp, mouse
gtcctgcggatgggagtgaa

SEQ ID NO: 620601 - DNA, 20 bp, mouse
gcggcgaactcagagccgat

SEQ ID NO: 620602 - DNA, 20 bp, mouse
gtgacgcggacacgaaggtt

SEQ ID NO: 620603 - DNA, 20 bp, mouse
gagttagaggcgcatggccg

SEQ ID NO: 620604 - DNA, 20 bp, mouse
gcgttcgagttagaggcgca

SEQ ID NO: 620605 - DNA, 20 bp, mouse
gctcagagccgataggtgca

SEQ ID NO: 620606 - DNA, 20 bp, mouse
ggcagggagccggtgacatt

SEQ ID NO: 620607 - DNA, 20 bp, mouse
gcaaggctgccccaagctac

SEQ ID NO: 620608 - DNA, 20 bp, mouse
gttgggaggtgggatacaca

SEQ ID NO: 620609 - DNA, 20 bp, mouse
ggccggtgacattgggaggt

SEQ ID NO: 620610 - DNA, 20 bp, mouse
gggtgggatacacatggaaa

SEQ ID NO: 620611 - DNA, 20 bp, mouse
gagtgagctcagagtcccca

SEQ ID NO: 620612 - DNA, 20 bp, mouse
gagcttggggcagccttgcc

SEQ ID NO: 620613 - DNA, 20 bp, mouse
gatgaggaagtcagaggcga

SEQ ID NO: 620614 - DNA, 20 bp, mouse
ggcctgccacagaaacacca

SEQ ID NO: 620615 - DNA, 20 bp, mouse
gtggggcagccttgcctgga

SEQ ID NO: 620616 - DNA, 20 bp, mouse
gctgagaaggtgcagcccat

SEQ ID NO: 620617 - DNA, 20 bp, mouse
ggaccggtgtcgagccgggt

SEQ ID NO: 620618 - DNA, 20 bp, mouse
ggtcggtgcgtggatccctg

SEQ ID NO: 620619 - DNA, 20 bp, mouse
ggacgcagcgatcggccgat

SEQ ID NO: 620620 - DNA, 20 bp, mouse
gggagagcaacagcctgaga

SEQ ID NO: 620621 - DNA, 20 bp, mouse
gcgatcgctgcgtcccggct

SEQ ID NO: 620622 - DNA, 20 bp, mouse
gcctcaggctccgcccgtgg

SEQ ID NO: 620623 - DNA, 20 bp, mouse
gcgcccacccggctcgacac

SEQ ID NO: 620624 - DNA, 20 bp, mouse
ggaatccactgacaaagcga

SEQ ID NO: 620625 - DNA, 20 bp, mouse
gtgctgcgctagggttcccg

SEQ ID NO: 620626 - DNA, 20 bp, mouse
gaggcctccctaacaagcag

SEQ ID NO: 620627 - DNA, 20 bp, mouse
gttgctgcagaaggctgttg

SEQ ID NO: 620628 - DNA, 20 bp, mouse
gtctcgcgccagggttcggg

SEQ ID NO: 620629 - DNA, 20 bp, mouse
gaggagcgcggggtgaggag

SEQ ID NO: 620630 - DNA, 20 bp, mouse
gcaatgaggccggcccgagg

SEQ ID NO: 620631 - DNA, 20 bp, mouse
gaacattcgagaatgggaca

SEQ ID NO: 620632 - DNA, 20 bp, mouse
gcagaaggctgttggggttg

SEQ ID NO: 620633 - DNA, 20 bp, mouse
ggctccctcgcgccaacccc

SEQ ID NO: 620634 - DNA, 20 bp, mouse
gcagcctctgcttgttaggg

SEQ ID NO: 620635 - DNA, 20 bp, mouse
gcctgggtccccagatgtgg

SEQ ID NO: 620636 - DNA, 20 bp, mouse
gccggggtcccgggatccag

SEQ ID NO: 620637 - DNA, 20 bp, mouse
gggaaaccccagcccgggac

SEQ ID NO: 620638 - DNA, 20 bp, mouse
gggctgctgcgtcccgtccc

SEQ ID NO: 620639 - DNA, 20 bp, mouse
ggccggtcctgagaggtccg

SEQ ID NO: 620640 - DNA, 20 bp, mouse
gacctctggccggtcctgag

SEQ ID NO: 620641 - DNA, 20 bp, mouse
gcgccagagggcccagtcgt

SEQ ID NO: 620642 - DNA, 20 bp, mouse
ggacgggacgcagcagcctc

SEQ ID NO: 620643 - DNA, 20 bp, mouse
ggtttcccagccccggtctc

SEQ ID NO: 620644 - DNA, 20 bp, mouse
gtctcctggtgagtgtctag

SEQ ID NO: 620645 - DNA, 20 bp, mouse
gtgcgtcccgtcccgggctg

SEQ ID NO: 620646 - DNA, 20 bp, mouse
ggtagtaagagtaaccgcgt

SEQ ID NO: 620647 - DNA, 20 bp, mouse
gtaggtgcagccggccgagg

SEQ ID NO: 620648 - DNA, 20 bp, mouse
gccccgggagcactccccgt

SEQ ID NO: 620649 - DNA, 20 bp, mouse
gtcccctgcgatggaaagcg

SEQ ID NO: 620650 - DNA, 20 bp, mouse
gcctcgccggcgcaccccct

SEQ ID NO: 620651 - DNA, 20 bp, mouse
gcccctgcacttccaatcag

SEQ ID NO: 620652 - DNA, 20 bp, mouse
ggccggcgcaccccctcggc

SEQ ID NO: 620653 - DNA, 20 bp, mouse
gaaggcaccggctcagatct

SEQ ID NO: 620654 - DNA, 20 bp, mouse
gggggtgcgccggcgaggtt

SEQ ID NO: 620655 - DNA, 20 bp, mouse
gtgcagcgtccgaacctcgc

SEQ ID NO: 620656 - DNA, 20 bp, mouse
ggcgagtctagccatgtccg

SEQ ID NO: 620657 - DNA, 20 bp, mouse
gtgagtaccaggcagcgcag

SEQ ID NO: 620658 - DNA, 20 bp, mouse
gtcagctgcttccctctccg

SEQ ID NO: 620659 - DNA, 20 bp, mouse
ggcaccggttctgtacagct

SEQ ID NO: 620660 - DNA, 20 bp, mouse
ggttcccagctgtacagaac

SEQ ID NO: 620661 - DNA, 20 bp, mouse
gtcggtcgccgctgccacag

SEQ ID NO: 620662 - DNA, 20 bp, mouse
gaccgaagccggtgagtacc

SEQ ID NO: 620663 - DNA, 20 bp, mouse
gcagcccccgacagtcgagg

SEQ ID NO: 620664 - DNA, 20 bp, mouse
gtctagccatgtccgcggag

SEQ ID NO: 620665 - DNA, 20 bp, mouse
gggtgcacagctgggaaggg

SEQ ID NO: 620666 - DNA, 20 bp, mouse
gttcaacaggaggaacccgc

SEQ ID NO: 620667 - DNA, 20 bp, mouse
gacaggctgcggttgtgaag

SEQ ID NO: 620668 - DNA, 20 bp, mouse
gggttcctcctgttgaatgt

SEQ ID NO: 620669 - DNA, 20 bp, mouse
gaccgcggctccgctcacag

SEQ ID NO: 620670 - DNA, 20 bp, mouse
gccgcggggcgcacaggctg

SEQ ID NO: 620671 - DNA, 20 bp, mouse
ggtcgggtctgctctcccgc

SEQ ID NO: 620672 - DNA, 20 bp, mouse
gccatgccggagccacagga

SEQ ID NO: 620673 - DNA, 20 bp, mouse
ggagggtgctcgctgactgt

SEQ ID NO: 620674 - DNA, 20 bp, mouse
ggcatcccacattcaacagg

SEQ ID NO: 620675 - DNA, 20 bp, mouse
gctcctgggcatccccgagg

SEQ ID NO: 620676 - DNA, 20 bp, mouse
gccccgaggggccaagtgag

SEQ ID NO: 620677 - DNA, 20 bp, mouse
gtccccactggggcaggcgg

SEQ ID NO: 620678 - DNA, 20 bp, mouse
gcactgtcgccagagctcca

SEQ ID NO: 620679 - DNA, 20 bp, mouse
gcggcggtggtgaaggaacg

SEQ ID NO: 620680 - DNA, 20 bp, mouse
ggaaggaacgagggtgcacg

SEQ ID NO: 620681 - DNA, 20 bp, mouse
ggagaggccggcagccacca

SEQ ID NO: 620682 - DNA, 20 bp, mouse
ggtgcacggggcctccccga

SEQ ID NO: 620683 - DNA, 20 bp, mouse
ggccgccgcctgccccagtg

SEQ ID NO: 620684 - DNA, 20 bp, mouse
gcccggctctggctatggag

SEQ ID NO: 620685 - DNA, 20 bp, mouse
ggcctctcacttggcccctc

SEQ ID NO: 620686 - DNA, 20 bp, mouse
gggcccggcgaacaaagcga

SEQ ID NO: 620687 - DNA, 20 bp, mouse
gccccagcgcctaggagccg

SEQ ID NO: 620688 - DNA, 20 bp, mouse
ggcggggcactgggactccg

SEQ ID NO: 620689 - DNA, 20 bp, mouse
ggggctctacgccactcgcg

SEQ ID NO: 620690 - DNA, 20 bp, mouse
gagtcccagtgccccgcgag

SEQ ID NO: 620691 - DNA, 20 bp, mouse
gcctaggagccgcggagcct

SEQ ID NO: 620692 - DNA, 20 bp, mouse
ggcgcccggagctcagaatg

SEQ ID NO: 620693 - DNA, 20 bp, mouse
gcgagtggcgtagagcccgc

SEQ ID NO: 620694 - DNA, 20 bp, mouse
gaatgcggcgcccagagggg

SEQ ID NO: 620695 - DNA, 20 bp, mouse
gtagtagcccgaagaggagg

SEQ ID NO: 620696 - DNA, 20 bp, mouse
ggtcggaagccagtgctcag

SEQ ID NO: 620697 - DNA, 20 bp, mouse
ggcgggcagcgactctgagg

SEQ ID NO: 620698 - DNA, 20 bp, mouse
ggcactcgctgctgcagcgg

SEQ ID NO: 620699 - DNA, 20 bp, mouse
gaggtcacccgatggttggg

SEQ ID NO: 620700 - DNA, 20 bp, mouse
ggggccgcggcgcatccggg

SEQ ID NO: 620701 - DNA, 20 bp, mouse
gacccgaggcgagtcccacg

SEQ ID NO: 620702 - DNA, 20 bp, mouse
gtccacggctccatgtccga

SEQ ID NO: 620703 - DNA, 20 bp, mouse
gtccccgcccggatgcgccg

SEQ ID NO: 620704 - DNA, 20 bp, mouse
gagcggcgcccgctccagaa

SEQ ID NO: 620705 - DNA, 20 bp, mouse
gtccatacctgggacatctg

SEQ ID NO: 620706 - DNA, 20 bp, mouse
ggccagaccgccgcactcag

SEQ ID NO: 620707 - DNA, 20 bp, mouse
ggtctggcgtggctcctggg

SEQ ID NO: 620708 - DNA, 20 bp, mouse
gaacagtcctctgagtgcgg

SEQ ID NO: 620709 - DNA, 20 bp, mouse
gcccggcaaggtgacgagaa

SEQ ID NO: 620710 - DNA, 20 bp, mouse
ggcggtctggcgtggctcct

SEQ ID NO: 620711 - DNA, 20 bp, mouse
gtggctcctgggcgggggaa

SEQ ID NO: 620712 - DNA, 20 bp, mouse
gtcctctgagtgcggcggtc

SEQ ID NO: 620713 - DNA, 20 bp, mouse
gaagagtgcaggggccgcgg

SEQ ID NO: 620714 - DNA, 20 bp, mouse
gaggggccgcggaggaaagg

SEQ ID NO: 620715 - DNA, 20 bp, mouse
gctgaggcagcccattcaaa

SEQ ID NO: 620716 - DNA, 20 bp, mouse
ggtggcccaagcagcagtgg

SEQ ID NO: 620717 - DNA, 20 bp, mouse
gtaccctgagctaggactag

SEQ ID NO: 620718 - DNA, 20 bp, mouse
gcggcgggcatgggcgatgg

SEQ ID NO: 620719 - DNA, 20 bp, mouse
gcagcagtggcggcgggcat

SEQ ID NO: 620720 - DNA, 20 bp, mouse
gcccaagcagcagtggcggc

SEQ ID NO: 620721 - DNA, 20 bp, mouse
gacctcgtaccaggatgcgg

SEQ ID NO: 620722 - DNA, 20 bp, mouse
gctgcgggctccagggagag

SEQ ID NO: 620723 - DNA, 20 bp, mouse
gatgtcggaggccccaggaa

SEQ ID NO: 620724 - DNA, 20 bp, mouse
gtccagccctgcgggctcca

SEQ ID NO: 620725 - DNA, 20 bp, mouse
gctaggactagcggctgctg

SEQ ID NO: 620726 - DNA, 20 bp, mouse
gcggcggctaaggacggatg

SEQ ID NO: 620727 - DNA, 20 bp, mouse
gagatggcggcggctaagga

SEQ ID NO: 620728 - DNA, 20 bp, mouse
gaactgctgctggaaacggg

SEQ ID NO: 620729 - DNA, 20 bp, mouse
gtgctgctggaaacgggcgg

SEQ ID NO: 620730 - DNA, 20 bp, mouse
gcgggcggcggctccactta

SEQ ID NO: 620731 - DNA, 20 bp, mouse
ggagctaaagggtcccggaa

SEQ ID NO: 620732 - DNA, 20 bp, mouse
gtagaaactgctgctggaaa

SEQ ID NO: 620733 - DNA, 20 bp, mouse
gctcccaacgacccagacct

SEQ ID NO: 620734 - DNA, 20 bp, mouse
gggtcccggaagggaatgtc

SEQ ID NO: 620735 - DNA, 20 bp, mouse
gtgggaggaacagagctaaa

SEQ ID NO: 620736 - DNA, 20 bp, mouse
ggccccacgtgaaaagtgtc

SEQ ID NO: 620737 - DNA, 20 bp, mouse
gttcacgtggggcacaaaga

SEQ ID NO: 620738 - DNA, 20 bp, mouse
gccagcccggctggctttgg

SEQ ID NO: 620739 - DNA, 20 bp, mouse
gcccagctctgtcagaatac

SEQ ID NO: 620740 - DNA, 20 bp, mouse
gcccagacacttttcacgtg

SEQ ID NO: 620741 - DNA, 20 bp, mouse
gtcactcacaccagcccggc

SEQ ID NO: 620742 - DNA, 20 bp, mouse
gaagggtcttgctagagagg

SEQ ID NO: 620743 - DNA, 20 bp, mouse
gatgcctgtgaagatggtcg

SEQ ID NO: 620744 - DNA, 20 bp, mouse
gcagctgaaggggttaacgt

SEQ ID NO: 620745 - DNA, 20 bp, mouse
ggtcttgctagagaggcgga

SEQ ID NO: 620746 - DNA, 20 bp, mouse
gagagaggatgcgctggtag

SEQ ID NO: 620747 - DNA, 20 bp, mouse
gcgaagaactcaaggagcgc

SEQ ID NO: 620748 - DNA, 20 bp, mouse
gagctgccccgagcctttct

SEQ ID NO: 620749 - DNA, 20 bp, mouse
gtttctgggcgaagaactca

SEQ ID NO: 620750 - DNA, 20 bp, mouse
gcttcgcccagaaaggctcg

SEQ ID NO: 620751 - DNA, 20 bp, mouse
gttgccccggaagatcacat

SEQ ID NO: 620752 - DNA, 20 bp, mouse
ggagaggagagaggatgcgc

SEQ ID NO: 620753 - DNA, 20 bp, mouse
gcgcagcagctgtgagcatt

SEQ ID NO: 620754 - DNA, 20 bp, mouse
gctgtgagcattaggtgctg

SEQ ID NO: 620755 - DNA, 20 bp, mouse
gaggtgctgtggccaagcgc

SEQ ID NO: 620756 - DNA, 20 bp, mouse
gcagaaaactgggatccgta

SEQ ID NO: 620757 - DNA, 20 bp, mouse
gccgcgggcaacagaaaact

SEQ ID NO: 620758 - DNA, 20 bp, mouse
ggcgagtgactgactcggag

SEQ ID NO: 620759 - DNA, 20 bp, mouse
gcggcggcgagtgactgact

SEQ ID NO: 620760 - DNA, 20 bp, mouse
gtagcggggcggcgtaccgc

SEQ ID NO: 620761 - DNA, 20 bp, mouse
gggagcggcgactagagtcc

SEQ ID NO: 620762 - DNA, 20 bp, mouse
ggagcgtcgggtggactcca

SEQ ID NO: 620763 - DNA, 20 bp, mouse
gctacgggcgcggtgaggtc

SEQ ID NO: 620764 - DNA, 20 bp, mouse
gaggtccccgacaggctcag

SEQ ID NO: 620765 - DNA, 20 bp, mouse
gccgccggctcccggcccta

SEQ ID NO: 620766 - DNA, 20 bp, mouse
gcggagagtctaggccggga

SEQ ID NO: 620767 - DNA, 20 bp, mouse
ggaaaagccgaatcatcgga

SEQ ID NO: 620768 - DNA, 20 bp, mouse
ggggccgcgtcggagagtct

SEQ ID NO: 620769 - DNA, 20 bp, mouse
ggcgcgcgcagacacttact

SEQ ID NO: 620770 - DNA, 20 bp, mouse
gaggccggcgctgattggtt

SEQ ID NO: 620771 - DNA, 20 bp, mouse
gccgagaaaagccgaatcat

SEQ ID NO: 620772 - DNA, 20 bp, mouse
ggtgctggctaggcccggtc

SEQ ID NO: 620773 - DNA, 20 bp, mouse
gagcgcggacccgacctagg

SEQ ID NO: 620774 - DNA, 20 bp, mouse
ggcgtcggagagtctaggcc

SEQ ID NO: 620775 - DNA, 20 bp, mouse
gtcccaaggccggcgctgat

SEQ ID NO: 620776 - DNA, 20 bp, mouse
ggccgttgccccgaacgtaa

SEQ ID NO: 620777 - DNA, 20 bp, mouse
ggcctgcgcagtctcagtga

SEQ ID NO: 620778 - DNA, 20 bp, mouse
gacgttcggggcaacggcta

SEQ ID NO: 620779 - DNA, 20 bp, mouse
gcgtcccaagcgaccctcaa

SEQ ID NO: 620780 - DNA, 20 bp, mouse
ggtggtggccgttacgttcg

SEQ ID NO: 620781 - DNA, 20 bp, mouse
gacccgaggccgggaagaag

SEQ ID NO: 620782 - DNA, 20 bp, mouse
gggggcaacggctaaggcag

SEQ ID NO: 620783 - DNA, 20 bp, mouse
ggaggtctagtccaggccca

SEQ ID NO: 620784 - DNA, 20 bp, mouse
gtgagtgtgagtgcggggtg

SEQ ID NO: 620785 - DNA, 20 bp, mouse
gtcctcctcctaggcgaagg

SEQ ID NO: 620786 - DNA, 20 bp, mouse
ggcctccgaggtaggcgcag

SEQ ID NO: 620787 - DNA, 20 bp, mouse
gtccgctgcgcctacctcgg

SEQ ID NO: 620788 - DNA, 20 bp, mouse
gccccgggaagggtgaacca

SEQ ID NO: 620789 - DNA, 20 bp, mouse
gccgtcaccgcctccgaggt

SEQ ID NO: 620790 - DNA, 20 bp, mouse
gggagcagcggcagctacgg

SEQ ID NO: 620791 - DNA, 20 bp, mouse
gctctccgctgcgcctacct

SEQ ID NO: 620792 - DNA, 20 bp, mouse
ggatcattgcgggcctggag

SEQ ID NO: 620793 - DNA, 20 bp, mouse
ggaacatgcgaggagcggaa

SEQ ID NO: 620794 - DNA, 20 bp, mouse
gaagcgcttggccccgggaa

SEQ ID NO: 620795 - DNA, 20 bp, mouse
gggctgggagcgcagcgaac

SEQ ID NO: 620796 - DNA, 20 bp, mouse
gcggctggagggcgaagtga

SEQ ID NO: 620797 - DNA, 20 bp, mouse
gggcttgcggcggggcgcaa

SEQ ID NO: 620798 - DNA, 20 bp, mouse
gtgcagccaccgcggctgga

SEQ ID NO: 620799 - DNA, 20 bp, mouse
gcttcgccctccagccgcgg

SEQ ID NO: 620800 - DNA, 20 bp, mouse
gtaatgtccgagctccccag

SEQ ID NO: 620801 - DNA, 20 bp, mouse
gacagtcaaagggtcccctg

SEQ ID NO: 620802 - DNA, 20 bp, mouse
gggcagcctgagtgaactca

SEQ ID NO: 620803 - DNA, 20 bp, mouse
ggccacggcggaacaaggta

SEQ ID NO: 620804 - DNA, 20 bp, mouse
gggacaagaagtgcggtcag

SEQ ID NO: 620805 - DNA, 20 bp, mouse
gcgccctaaggccccagagt

SEQ ID NO: 620806 - DNA, 20 bp, mouse
gcgcctcacctacaacccga

SEQ ID NO: 620807 - DNA, 20 bp, mouse
ggcgcaggcgcagacggcgt

SEQ ID NO: 620808 - DNA, 20 bp, mouse
gcaccctcgggttgtaggtg

SEQ ID NO: 620809 - DNA, 20 bp, mouse
gctagggcgaggcgaggcag

SEQ ID NO: 620810 - DNA, 20 bp, mouse
gcaggcgaccaacagggtcc

SEQ ID NO: 620811 - DNA, 20 bp, mouse
ggctgaggggcgccgaccta

SEQ ID NO: 620812 - DNA, 20 bp, mouse
ggagccggccgaggccacgg

SEQ ID NO: 620813 - DNA, 20 bp, mouse
gcgccctcaggcgaccaaca

SEQ ID NO: 620814 - DNA, 20 bp, mouse
gccgctgccgcgggccgggt

SEQ ID NO: 620815 - DNA, 20 bp, mouse
gggtcgcggccggcccaggg

SEQ ID NO: 620816 - DNA, 20 bp, mouse
gtgaatagggtggagcggga

SEQ ID NO: 620817 - DNA, 20 bp, mouse
gaaaaaatgggtgaataggg

SEQ ID NO: 620818 - DNA, 20 bp, mouse
gtttaaaaaatgggtgaata

SEQ ID NO: 620819 - DNA, 20 bp, mouse
gacacatagctacaacccga

SEQ ID NO: 620820 - DNA, 20 bp, mouse
gcctttgttaaagacatcct

SEQ ID NO: 620821 - DNA, 20 bp, mouse
gatgggtgaatagggtggag

SEQ ID NO: 620822 - DNA, 20 bp, mouse
ggaatacagacaacactctt

SEQ ID NO: 620823 - DNA, 20 bp, mouse
gcagcccagccatagatggt

SEQ ID NO: 620824 - DNA, 20 bp, mouse
gatataaggtctgcaactat

SEQ ID NO: 620825 - DNA, 20 bp, mouse
ggctcaccttcacccaaaag

SEQ ID NO: 620826 - DNA, 20 bp, mouse
ggctgccgagccctaagcac

SEQ ID NO: 620827 - DNA, 20 bp, mouse
gcgatccgcacctggtctgg

SEQ ID NO: 620828 - DNA, 20 bp, mouse
gtggcggtggacacacagct

SEQ ID NO: 620829 - DNA, 20 bp, mouse
gtccaccgccagaccaggtg

SEQ ID NO: 620830 - DNA, 20 bp, mouse
gccccgatccgcacctggtc

SEQ ID NO: 620831 - DNA, 20 bp, mouse
ggtgtgtccaccgccagacc

SEQ ID NO: 620832 - DNA, 20 bp, mouse
gtgaggttgggactctgaga

SEQ ID NO: 620833 - DNA, 20 bp, mouse
ggcttcccgtgcttagggct

SEQ ID NO: 620834 - DNA, 20 bp, mouse
gtccgcacctggtctggcgg

SEQ ID NO: 620835 - DNA, 20 bp, mouse
ggctgtggtgccatgaggtt

SEQ ID NO: 620836 - DNA, 20 bp, mouse
gagaggaacatatactacag

SEQ ID NO: 620837 - DNA, 20 bp, mouse
gttagaaggtgagaaaccct

SEQ ID NO: 620838 - DNA, 20 bp, mouse
gttgatggacagagacaagg

SEQ ID NO: 620839 - DNA, 20 bp, mouse
gtctcggaggacatcactag

SEQ ID NO: 620840 - DNA, 20 bp, mouse
gtggagagccaggtgagagg

SEQ ID NO: 620841 - DNA, 20 bp, mouse
gaaccctttccaccatctcc

SEQ ID NO: 620842 - DNA, 20 bp, mouse
gacagcggctcattgttgcc

SEQ ID NO: 620843 - DNA, 20 bp, mouse
ggctcattgttgccgggaga

SEQ ID NO: 620844 - DNA, 20 bp, mouse
ggatggtggaaagggtttga

SEQ ID NO: 620845 - DNA, 20 bp, mouse
ggaggtggtccgggaattgg

SEQ ID NO: 620846 - DNA, 20 bp, mouse
gagcgaggccgcggcactgg

SEQ ID NO: 620847 - DNA, 20 bp, mouse
gttaccggtgagaagcgcag

SEQ ID NO: 620848 - DNA, 20 bp, mouse
ggcactgggggcgagctgag

SEQ ID NO: 620849 - DNA, 20 bp, mouse
ggacaaggcagactattcag

SEQ ID NO: 620850 - DNA, 20 bp, mouse
gcgcttctcaccggtaacag

SEQ ID NO: 620851 - DNA, 20 bp, mouse
gttctcaccggtaacagcgg

SEQ ID NO: 620852 - DNA, 20 bp, mouse
gctgccgacggtggacgcgg

SEQ ID NO: 620853 - DNA, 20 bp, mouse
gtgagaagcgcagaggcttg

SEQ ID NO: 620854 - DNA, 20 bp, mouse
gtggcgagcgaacagagaga

SEQ ID NO: 620855 - DNA, 20 bp, mouse
gcgttggcacgatttaagag

SEQ ID NO: 620856 - DNA, 20 bp, mouse
gcagcaggcgacggagcagg

SEQ ID NO: 620857 - DNA, 20 bp, mouse
gggcaggcggcctgtagtgg

SEQ ID NO: 620858 - DNA, 20 bp, mouse
gacaggcaggcggcctgtag

SEQ ID NO: 620859 - DNA, 20 bp, mouse
ggctagcgagcgggatgtcg

SEQ ID NO: 620860 - DNA, 20 bp, mouse
gcctagcccggcggcgtggg

SEQ ID NO: 620861 - DNA, 20 bp, mouse
gggacggcgggcaacgggga

SEQ ID NO: 620862 - DNA, 20 bp, mouse
gctgaggatcccctcgacag

SEQ ID NO: 620863 - DNA, 20 bp, mouse
gaggcggcctgtagtggcgg

SEQ ID NO: 620864 - DNA, 20 bp, mouse
ggccgggacggcgggcaacg

SEQ ID NO: 620865 - DNA, 20 bp, mouse
gcgaggttcggagggcacgg

SEQ ID NO: 620866 - DNA, 20 bp, mouse
ggctctggcagccctcacgg

SEQ ID NO: 620867 - DNA, 20 bp, mouse
gctcacataagcgcaggcag

SEQ ID NO: 620868 - DNA, 20 bp, mouse
ggagggctcttcgggacgag

SEQ ID NO: 620869 - DNA, 20 bp, mouse
gggcccgcgaggtgaagcga

SEQ ID NO: 620870 - DNA, 20 bp, mouse
gcgggagccgcgggagaagg

SEQ ID NO: 620871 - DNA, 20 bp, mouse
gacatccgaactgccctcgg

SEQ ID NO: 620872 - DNA, 20 bp, mouse
gcctcgcgggccgccaccga

SEQ ID NO: 620873 - DNA, 20 bp, mouse
gagggacccgagggctcttc

SEQ ID NO: 620874 - DNA, 20 bp, mouse
gggggggacgagggacccga

SEQ ID NO: 620875 - DNA, 20 bp, mouse
gggacgagtggaacatcgcg

SEQ ID NO: 620876 - DNA, 20 bp, mouse
ggacccaggaccacgctcag

SEQ ID NO: 620877 - DNA, 20 bp, mouse
gcgcctgcctgtcctgccgg

SEQ ID NO: 620878 - DNA, 20 bp, mouse
gcccagctgaagtgttccaa

SEQ ID NO: 620879 - DNA, 20 bp, mouse
gggcaggtgcaggcaacaga

SEQ ID NO: 620880 - DNA, 20 bp, mouse
gtgcctctgagcgtggtcct

SEQ ID NO: 620881 - DNA, 20 bp, mouse
gtgtcccgtgctaggaggta

SEQ ID NO: 620882 - DNA, 20 bp, mouse
ggcagggctgcctctgagcg

SEQ ID NO: 620883 - DNA, 20 bp, mouse
gcgtgccagcagccaccggc

SEQ ID NO: 620884 - DNA, 20 bp, mouse
ggctgcatgacaagctcaca

SEQ ID NO: 620885 - DNA, 20 bp, mouse
ggacatgtccctaggcccct

SEQ ID NO: 620886 - DNA, 20 bp, mouse
gcagcggcggctcctcaaca

SEQ ID NO: 620887 - DNA, 20 bp, mouse
gggaggaggcgacaacaaag

SEQ ID NO: 620888 - DNA, 20 bp, mouse
gggaggcgacaacaaagcgg

SEQ ID NO: 620889 - DNA, 20 bp, mouse
gccgctcggggagcctcctc

SEQ ID NO: 620890 - DNA, 20 bp, mouse
gggcgacaacaaagcggcgg

SEQ ID NO: 620891 - DNA, 20 bp, mouse
gcggccgccgaggtgaaagg

SEQ ID NO: 620892 - DNA, 20 bp, mouse
gttaaggccgggccggagag

SEQ ID NO: 620893 - DNA, 20 bp, mouse
gcaccccgcggcccagagaa

SEQ ID NO: 620894 - DNA, 20 bp, mouse
gcgggcgggcggaaaaacaa

SEQ ID NO: 620895 - DNA, 20 bp, mouse
gtggccccccgacccccccg

SEQ ID NO: 620896 - DNA, 20 bp, mouse
gcgtgctgaggcgggtggta

SEQ ID NO: 620897 - DNA, 20 bp, mouse
gtggcggagaaggatgacac

SEQ ID NO: 620898 - DNA, 20 bp, mouse
gcccatcgtgctgaggcggg

SEQ ID NO: 620899 - DNA, 20 bp, mouse
gcggctcctgcccacctcgg

SEQ ID NO: 620900 - DNA, 20 bp, mouse
gcaagtaggccccgaaacag

SEQ ID NO: 620901 - DNA, 20 bp, mouse
gtcaggcggctgcagcaagt

SEQ ID NO: 620902 - DNA, 20 bp, mouse
ggtaggccccgaaacagcgg

SEQ ID NO: 620903 - DNA, 20 bp, mouse
gaacgaggcgcagtccaggg

SEQ ID NO: 620904 - DNA, 20 bp, mouse
gccacctcttcgtcaaactc

SEQ ID NO: 620905 - DNA, 20 bp, mouse
ggattcagaggggagggata

SEQ ID NO: 620906 - DNA, 20 bp, mouse
ggtggctggagtatgagcga

SEQ ID NO: 620907 - DNA, 20 bp, mouse
gggctggcgtcctagaagct

SEQ ID NO: 620908 - DNA, 20 bp, mouse
ggagtatgagcgatggtcga

SEQ ID NO: 620909 - DNA, 20 bp, mouse
gtaccaaagacccttcccgg

SEQ ID NO: 620910 - DNA, 20 bp, mouse
gcagccacggaacagagcca

SEQ ID NO: 620911 - DNA, 20 bp, mouse
gagcaacagcgctctcgctc

SEQ ID NO: 620912 - DNA, 20 bp, mouse
gcactcgtgggcgtgaaggg

SEQ ID NO: 620913 - DNA, 20 bp, mouse
ggcccacgagtgaagagggt

SEQ ID NO: 620914 - DNA, 20 bp, mouse
gccgccttggctctgttccg

SEQ ID NO: 620915 - DNA, 20 bp, mouse
gagcggtgtgcccccgggaa

SEQ ID NO: 620916 - DNA, 20 bp, mouse
gacggccctgtgaggattac

SEQ ID NO: 620917 - DNA, 20 bp, mouse
gcaagggcctggaatctgac

SEQ ID NO: 620918 - DNA, 20 bp, mouse
ggagagggtgaaataaaact

SEQ ID NO: 620919 - DNA, 20 bp, mouse
gctccccacctatcaaatgt

SEQ ID NO: 620920 - DNA, 20 bp, mouse
gttgataggtggggagaccg

SEQ ID NO: 620921 - DNA, 20 bp, mouse
gtttcttgagagaattcata

SEQ ID NO: 620922 - DNA, 20 bp, mouse
gacctatcaaatgtggggat

SEQ ID NO: 620923 - DNA, 20 bp, mouse
ggttctctgaccctcaaagt

SEQ ID NO: 620924 - DNA, 20 bp, mouse
ggacggaggctggagcccaa

SEQ ID NO: 620925 - DNA, 20 bp, mouse
ggtgaaataaaactaggtag

SEQ ID NO: 620926 - DNA, 20 bp, mouse
gtggaaccgccgagatagag

SEQ ID NO: 620927 - DNA, 20 bp, mouse
gacctggtggtagggagtgt

SEQ ID NO: 620928 - DNA, 20 bp, mouse
gccagcccggcggtgctccc

SEQ ID NO: 620929 - DNA, 20 bp, mouse
ggcgcgctgacgctaagagg

SEQ ID NO: 620930 - DNA, 20 bp, mouse
gtcgctcccctctatctcgg

SEQ ID NO: 620931 - DNA, 20 bp, mouse
gtctgcccgggagcaccgcc

SEQ ID NO: 620932 - DNA, 20 bp, mouse
ggcccgagccccggagtcat

SEQ ID NO: 620933 - DNA, 20 bp, mouse
gaactcgctcccctctatct

SEQ ID NO: 620934 - DNA, 20 bp, mouse
gctcccgggcagaagcgcct

SEQ ID NO: 620935 - DNA, 20 bp, mouse
gctcggcggttccagcccgg

SEQ ID NO: 620936 - DNA, 20 bp, mouse
gagcagctgctacccagtcc

SEQ ID NO: 620937 - DNA, 20 bp, mouse
ggagcggccctagcccggac

SEQ ID NO: 620938 - DNA, 20 bp, mouse
gtgctacccagtccgggcta

SEQ ID NO: 620939 - DNA, 20 bp, mouse
gaggcaaccgcatccgagac

SEQ ID NO: 620940 - DNA, 20 bp, mouse
ggccgggagcgagctcggga

SEQ ID NO: 620941 - DNA, 20 bp, mouse
gggctaaggcgggtcctcgg

SEQ ID NO: 620942 - DNA, 20 bp, mouse
gtcctggagcggccctagcc

SEQ ID NO: 620943 - DNA, 20 bp, mouse
gtacgctcctgtctcggatg

SEQ ID NO: 620944 - DNA, 20 bp, mouse
gatataagcgcgagcagagg

SEQ ID NO: 620945 - DNA, 20 bp, mouse
gagcagagggggcacccgga

SEQ ID NO: 620946 - DNA, 20 bp, mouse
gagcttgcagcgggctgtga

SEQ ID NO: 620947 - DNA, 20 bp, mouse
gagctgactgcactgacatg

SEQ ID NO: 620948 - DNA, 20 bp, mouse
gctcaaacaaaacccgtcaa

SEQ ID NO: 620949 - DNA, 20 bp, mouse
gtaccccctcccaaaagcag

SEQ ID NO: 620950 - DNA, 20 bp, mouse
gaagacagaggcccagcctc

SEQ ID NO: 620951 - DNA, 20 bp, mouse
gccttccacaagcccttgac

SEQ ID NO: 620952 - DNA, 20 bp, mouse
gctgacatgcgggctatgct

SEQ ID NO: 620953 - DNA, 20 bp, mouse
ggacttctcgagcccgtctt

SEQ ID NO: 620954 - DNA, 20 bp, mouse
ggtcttagctgagtagctcc

SEQ ID NO: 620955 - DNA, 20 bp, mouse
gcaggctctcctaaaacttc

SEQ ID NO: 620956 - DNA, 20 bp, mouse
gcccggagcgcgtctgggac

SEQ ID NO: 620957 - DNA, 20 bp, mouse
gggattcgcaagctggacgt

SEQ ID NO: 620958 - DNA, 20 bp, mouse
gcgcgctccgggcaacttga

SEQ ID NO: 620959 - DNA, 20 bp, mouse
gttcgcaagctggacgtggg

SEQ ID NO: 620960 - DNA, 20 bp, mouse
gccggtggtaagatcgggta

SEQ ID NO: 620961 - DNA, 20 bp, mouse
gcggaaggcagccagtccag

SEQ ID NO: 620962 - DNA, 20 bp, mouse
ggatctacgcgctccgggac

SEQ ID NO: 620963 - DNA, 20 bp, mouse
gcgtcgaagttgagccacaa

SEQ ID NO: 620964 - DNA, 20 bp, mouse
gagttcaccgagcgcagcac

SEQ ID NO: 620965 - DNA, 20 bp, mouse
gggtgcccggtggtaagatc

SEQ ID NO: 620966 - DNA, 20 bp, mouse
gccaccacctgggagatctt

SEQ ID NO: 620967 - DNA, 20 bp, mouse
gtgccttacctgtctggaag

SEQ ID NO: 620968 - DNA, 20 bp, mouse
gccagacaggtaaggcaatt

SEQ ID NO: 620969 - DNA, 20 bp, mouse
gggaagaggcagccaccacc

SEQ ID NO: 620970 - DNA, 20 bp, mouse
ggacaggtaaggcaattggg

SEQ ID NO: 620971 - DNA, 20 bp, mouse
gtgcctcttccagacaggta

SEQ ID NO: 620972 - DNA, 20 bp, mouse
ggcaattgggtggggacaca

SEQ ID NO: 620973 - DNA, 20 bp, mouse
gtgaccacaggtggttggag

SEQ ID NO: 620974 - DNA, 20 bp, mouse
gggggacacatggtgaccac

SEQ ID NO: 620975 - DNA, 20 bp, mouse
ggacacatggtgaccacagg

SEQ ID NO: 620976 - DNA, 20 bp, mouse
gtgagtgaaggaaggtgcag

SEQ ID NO: 620977 - DNA, 20 bp, mouse
ggaggcagttcccagaaggt

SEQ ID NO: 620978 - DNA, 20 bp, mouse
gagaaggtaggcctggactg

SEQ ID NO: 620979 - DNA, 20 bp, mouse
gccacaggctgagtgaagga

SEQ ID NO: 620980 - DNA, 20 bp, mouse
ggggctcggggatcatacag

SEQ ID NO: 620981 - DNA, 20 bp, mouse
gtgctgggaacgcagaggga

SEQ ID NO: 620982 - DNA, 20 bp, mouse
gtcagcctgtgggcaacact

SEQ ID NO: 620983 - DNA, 20 bp, mouse
gcaggcgaactgactctggg

SEQ ID NO: 620984 - DNA, 20 bp, mouse
gtcccagcaacccctctacc

SEQ ID NO: 620985 - DNA, 20 bp, mouse
gtgaaggctggtaggattga

SEQ ID NO: 620986 - DNA, 20 bp, mouse
ggaaggaagagggtgtgtcc

SEQ ID NO: 620987 - DNA, 20 bp, mouse
gtagcgaggtgtgtccccta

SEQ ID NO: 620988 - DNA, 20 bp, mouse
ggtgtcccctaaggatgaga

SEQ ID NO: 620989 - DNA, 20 bp, mouse
gagcgagaggcaagagggac

SEQ ID NO: 620990 - DNA, 20 bp, mouse
gtgtccgggaccctgtgaga

SEQ ID NO: 620991 - DNA, 20 bp, mouse
gctcgcggcccagctcagaa

SEQ ID NO: 620992 - DNA, 20 bp, mouse
ggtggacgacggctctggga

SEQ ID NO: 620993 - DNA, 20 bp, mouse
gcacccatctcacagggtcc

SEQ ID NO: 620994 - DNA, 20 bp, mouse
ggcggcccagctcagaatgg

SEQ ID NO: 620995 - DNA, 20 bp, mouse
gggcaagagggaccggaacc

SEQ ID NO: 620996 - DNA, 20 bp, mouse
gtggggtcccggagcaagag

SEQ ID NO: 620997 - DNA, 20 bp, mouse
gcaagggaatgagggcgcgg

SEQ ID NO: 620998 - DNA, 20 bp, mouse
gaggagcgctggggtctctg

SEQ ID NO: 620999 - DNA, 20 bp, mouse
gcgcggtggctgtgaatcgt

SEQ ID NO: 621000 - DNA, 20 bp, mouse
gcccggagcaagagtggcag

SEQ ID NO: 621001 - DNA, 20 bp, mouse
ggtgaatcgtaggagcgctg

SEQ ID NO: 621002 - DNA, 20 bp, mouse
gaactgcaacaagggaatga

SEQ ID NO: 621003 - DNA, 20 bp, mouse
gcaacaagggaatgagggcg

SEQ ID NO: 621004 - DNA, 20 bp, mouse
ggaggactggacaacgccaa

SEQ ID NO: 621005 - DNA, 20 bp, mouse
gaaggtgggctggcttgctg

SEQ ID NO: 621006 - DNA, 20 bp, mouse
gtcctcatcgcgatccatgg

SEQ ID NO: 621007 - DNA, 20 bp, mouse
gccggaagcgcagagcagag

SEQ ID NO: 621008 - DNA, 20 bp, mouse
ggcgagcgcccgcccagcta

SEQ ID NO: 621009 - DNA, 20 bp, mouse
ggcgccggcctcgcggacag

SEQ ID NO: 621010 - DNA, 20 bp, mouse
gggttcctcatcgcgatcca

SEQ ID NO: 621011 - DNA, 20 bp, mouse
gggagcagcgggcttgtcgt

SEQ ID NO: 621012 - DNA, 20 bp, mouse
ggctagggcgacttcgagaa

SEQ ID NO: 621013 - DNA, 20 bp, mouse
ggccgccatggatcgcgatg

SEQ ID NO: 621014 - DNA, 20 bp, mouse
gggcttgtcgttggtggcgg

SEQ ID NO: 621015 - DNA, 20 bp, mouse
ggtctccagcgccggcctcg

SEQ ID NO: 621016 - DNA, 20 bp, mouse
gccaggaaccgggaacagac

SEQ ID NO: 621017 - DNA, 20 bp, mouse
ggcttcgtggcagctgtcta

SEQ ID NO: 621018 - DNA, 20 bp, mouse
gccggttcctggggaacggt

SEQ ID NO: 621019 - DNA, 20 bp, mouse
gctacagccaaccgttcccc

SEQ ID NO: 621020 - DNA, 20 bp, mouse
ggttcccggttcctggggaa

SEQ ID NO: 621021 - DNA, 20 bp, mouse
gagctgccacgaagccggaa

SEQ ID NO: 621022 - DNA, 20 bp, mouse
gggctccaccagtctgttcc

SEQ ID NO: 621023 - DNA, 20 bp, mouse
gtgtcactgggactttgaat

SEQ ID NO: 621024 - DNA, 20 bp, mouse
gtgcctgaaggaaacagcca

SEQ ID NO: 621025 - DNA, 20 bp, mouse
gggctgcctttccggcttcg

SEQ ID NO: 621026 - DNA, 20 bp, mouse
gcctttctaaacaggctgtg

SEQ ID NO: 621027 - DNA, 20 bp, mouse
gtttagaaaggctggtccag

SEQ ID NO: 621028 - DNA, 20 bp, mouse
gagacacgaggcctagacag

SEQ ID NO: 621029 - DNA, 20 bp, mouse
ggagtggtcccgacagaaga

SEQ ID NO: 621030 - DNA, 20 bp, mouse
gaggcatagagaagagcaga

SEQ ID NO: 621031 - DNA, 20 bp, mouse
gttctgtcgggaccactctt

SEQ ID NO: 621032 - DNA, 20 bp, mouse
gggtcccgacagaagaaggt

SEQ ID NO: 621033 - DNA, 20 bp, mouse
gtgagaaggagcgctcggtg

SEQ ID NO: 621034 - DNA, 20 bp, mouse
gaggtcggagtgagagtgta

SEQ ID NO: 621035 - DNA, 20 bp, mouse
gatctcggagctcccaagag

SEQ ID NO: 621036 - DNA, 20 bp, mouse
gcgttagccacagaccccgt

SEQ ID NO: 621037 - DNA, 20 bp, mouse
ggcagccgagagcgcctacg

SEQ ID NO: 621038 - DNA, 20 bp, mouse
gagagcgcctacggggtctg

SEQ ID NO: 621039 - DNA, 20 bp, mouse
gggcaggcggtaggctcgga

SEQ ID NO: 621040 - DNA, 20 bp, mouse
gatggtccgccctgagcccg

SEQ ID NO: 621041 - DNA, 20 bp, mouse
gtccgccctgagcccgcggc

SEQ ID NO: 621042 - DNA, 20 bp, mouse
gaggcgtgggagctcggtag

SEQ ID NO: 621043 - DNA, 20 bp, mouse
gacgtggggaggagaactgt

SEQ ID NO: 621044 - DNA, 20 bp, mouse
gctaacgcagcgcgggagag

SEQ ID NO: 621045 - DNA, 20 bp, mouse
gtcatcgcaaggcaagtctg

SEQ ID NO: 621046 - DNA, 20 bp, mouse
ggctgaggcgccaaggaccg

SEQ ID NO: 621047 - DNA, 20 bp, mouse
gcgctcgtgctgggactcgg

SEQ ID NO: 621048 - DNA, 20 bp, mouse
ggctgggaggcccggagcag

SEQ ID NO: 621049 - DNA, 20 bp, mouse
gccaccgacgccctcatctt

SEQ ID NO: 621050 - DNA, 20 bp, mouse
gtcctctgcgaccccactgt

SEQ ID NO: 621051 - DNA, 20 bp, mouse
gcctgggctgctggactcag

SEQ ID NO: 621052 - DNA, 20 bp, mouse
gacttctggcgaacccgcaa

SEQ ID NO: 621053 - DNA, 20 bp, mouse
gctctccaaaggcttgaaca

SEQ ID NO: 621054 - DNA, 20 bp, mouse
gtgcagcctggaaggcggag

SEQ ID NO: 621055 - DNA, 20 bp, mouse
ggaaggagcgcgagagagca

SEQ ID NO: 621056 - DNA, 20 bp, mouse
gaagaagcaagaggaggtcg

SEQ ID NO: 621057 - DNA, 20 bp, mouse
gcttcttctttagaataatt

SEQ ID NO: 621058 - DNA, 20 bp, mouse
gtttccaaagggctgagaac

SEQ ID NO: 621059 - DNA, 20 bp, mouse
gctggataggaatgtttgct

SEQ ID NO: 621060 - DNA, 20 bp, mouse
ggtctgatgaattactaaag

SEQ ID NO: 621061 - DNA, 20 bp, mouse
gtatccagttctcagccctt

SEQ ID NO: 621062 - DNA, 20 bp, mouse
gagagagttgcgatagaagt

SEQ ID NO: 621063 - DNA, 20 bp, mouse
ggatagaagtcggtgctagc

SEQ ID NO: 621064 - DNA, 20 bp, mouse
gtacaaaatgccctttccaa

SEQ ID NO: 621065 - DNA, 20 bp, mouse
gatatttttgtaagattgaa

SEQ ID NO: 621066 - DNA, 20 bp, mouse
gtgggctgtactgtcgacat

SEQ ID NO: 621067 - DNA, 20 bp, mouse
gtgcaagccgcacgagtcca

SEQ ID NO: 621068 - DNA, 20 bp, mouse
ggaggagccctggactcgtg

SEQ ID NO: 621069 - DNA, 20 bp, mouse
gagtacagcccagggacagg

SEQ ID NO: 621070 - DNA, 20 bp, mouse
ggtgcagtgcgtacagtgag

SEQ ID NO: 621071 - DNA, 20 bp, mouse
gcaccgagaggagaagacgc

SEQ ID NO: 621072 - DNA, 20 bp, mouse
gattcttccctcctgtccct

SEQ ID NO: 621073 - DNA, 20 bp, mouse
gcaggagggaagaatcgcca

SEQ ID NO: 621074 - DNA, 20 bp, mouse
gggtcgcagtgtccacagaa

SEQ ID NO: 621075 - DNA, 20 bp, mouse
gctctcggtgcgtgcagaca

SEQ ID NO: 621076 - DNA, 20 bp, mouse
gcgccccgagaggagtgagg

SEQ ID NO: 621077 - DNA, 20 bp, mouse
ggagaggagtgaggcggact

SEQ ID NO: 621078 - DNA, 20 bp, mouse
gaaccgccccgagaggagtg

SEQ ID NO: 621079 - DNA, 20 bp, mouse
gaggcgcgcgcggacacaga

SEQ ID NO: 621080 - DNA, 20 bp, mouse
ggcggcccaaccgccccgag

SEQ ID NO: 621081 - DNA, 20 bp, mouse
gcgcgcgcggacacagaggg

SEQ ID NO: 621082 - DNA, 20 bp, mouse
gttgggccgcgcgcctgtgg

SEQ ID NO: 621083 - DNA, 20 bp, mouse
gcgccgcaccgcctccctgg

SEQ ID NO: 621084 - DNA, 20 bp, mouse
gaggagtgaggcggactggg

SEQ ID NO: 621085 - DNA, 20 bp, mouse
gggaggcgaccgagccaatg

SEQ ID NO: 621086 - DNA, 20 bp, mouse
ggagcgaacggcgacaacga

SEQ ID NO: 621087 - DNA, 20 bp, mouse
gcgcgacggaggcaccatcc

SEQ ID NO: 621088 - DNA, 20 bp, mouse
ggacaacgacggcgcgacgg

SEQ ID NO: 621089 - DNA, 20 bp, mouse
ggagaggcgcctgctaggag

SEQ ID NO: 621090 - DNA, 20 bp, mouse
gccatccgggcgggcagcat

SEQ ID NO: 621091 - DNA, 20 bp, mouse
gacggaggcaccatccgggc

SEQ ID NO: 621092 - DNA, 20 bp, mouse
gagttaccagcccttcggag

SEQ ID NO: 621093 - DNA, 20 bp, mouse
gggcgacaacgacggcgcga

SEQ ID NO: 621094 - DNA, 20 bp, mouse
gacttgttgtgcggagcgaa

SEQ ID NO: 621095 - DNA, 20 bp, mouse
gctcggctctgacagctcag

SEQ ID NO: 621096 - DNA, 20 bp, mouse
ggctaacagggtgacagtct

SEQ ID NO: 621097 - DNA, 20 bp, mouse
gacagggtgacagtctaggc

SEQ ID NO: 621098 - DNA, 20 bp, mouse
gcgcgagcgtgcttcggcag

SEQ ID NO: 621099 - DNA, 20 bp, mouse
ggcgccacgcgagcgtgctt

SEQ ID NO: 621100 - DNA, 20 bp, mouse
ggcgccaggccagagccgag

SEQ ID NO: 621101 - DNA, 20 bp, mouse
gaaagcagccaaacagggag

SEQ ID NO: 621102 - DNA, 20 bp, mouse
gtggccccagggcaggcagg

SEQ ID NO: 621103 - DNA, 20 bp, mouse
gtcaccgcaggctgatgaag

SEQ ID NO: 621104 - DNA, 20 bp, mouse
gcagtctaggccggtcgcgc

SEQ ID NO: 621105 - DNA, 20 bp, mouse
gtagtgtgtgaatacagtgg

SEQ ID NO: 621106 - DNA, 20 bp, mouse
gctccatggcgtggtcagga

SEQ ID NO: 621107 - DNA, 20 bp, mouse
gtgccctcctgaccacgcca

SEQ ID NO: 621108 - DNA, 20 bp, mouse
gaatatgttacaaagttccg

SEQ ID NO: 621109 - DNA, 20 bp, mouse
ggtcacatttggctaaattt

SEQ ID NO: 621110 - DNA, 20 bp, mouse
ggacgctccatggcgtggtc

SEQ ID NO: 621111 - DNA, 20 bp, mouse
gctggccctgtttgtctata

SEQ ID NO: 621112 - DNA, 20 bp, mouse
gtctctattagacattccaa

SEQ ID NO: 621113 - DNA, 20 bp, mouse
ggcaacaacagcaacaattg

SEQ ID NO: 621114 - DNA, 20 bp, mouse
gacttttcatttctgaactt

SEQ ID NO: 621115 - DNA, 20 bp, mouse
ggaatgaaggctcacgacag

SEQ ID NO: 621116 - DNA, 20 bp, mouse
gccacctctgcagatccggg

SEQ ID NO: 621117 - DNA, 20 bp, mouse
gtcgcctcccggatctgcag

SEQ ID NO: 621118 - DNA, 20 bp, mouse
ggcgcgacccagctcatcca

SEQ ID NO: 621119 - DNA, 20 bp, mouse
gccgccacctctgcagatcc

SEQ ID NO: 621120 - DNA, 20 bp, mouse
ggctgggtcgcgccaaggac

SEQ ID NO: 621121 - DNA, 20 bp, mouse
gggcccggcggacatcccaa

SEQ ID NO: 621122 - DNA, 20 bp, mouse
ggctgcgcgtcggtgcacgg

SEQ ID NO: 621123 - DNA, 20 bp, mouse
gccggcggacatcccaaagg

SEQ ID NO: 621124 - DNA, 20 bp, mouse
ggtgcagctccggctaacta

SEQ ID NO: 621125 - DNA, 20 bp, mouse
gggcccacatcggtagacaa

SEQ ID NO: 621126 - DNA, 20 bp, mouse
gaccatgctgagaagatagg

SEQ ID NO: 621127 - DNA, 20 bp, mouse
gtattaagtggatgagaata

SEQ ID NO: 621128 - DNA, 20 bp, mouse
gtggctatatctttgatccc

SEQ ID NO: 621129 - DNA, 20 bp, mouse
gtggaccatgctgagaagat

SEQ ID NO: 621130 - DNA, 20 bp, mouse
gatcattatattgtcgtcca

SEQ ID NO: 621131 - DNA, 20 bp, mouse
gttgtccaaaaggtgatctt

SEQ ID NO: 621132 - DNA, 20 bp, mouse
ggatcaaagatatagccaat

SEQ ID NO: 621133 - DNA, 20 bp, mouse
gggttggtttctggcaatgg

SEQ ID NO: 621134 - DNA, 20 bp, mouse
gagcagttagtggtgtgaac

SEQ ID NO: 621135 - DNA, 20 bp, mouse
gagtcacttgagagtacatc

SEQ ID NO: 621136 - DNA, 20 bp, mouse
gtccgagacagccatagtgt

SEQ ID NO: 621137 - DNA, 20 bp, mouse
gacccagtatacaatatcaa

SEQ ID NO: 621138 - DNA, 20 bp, mouse
gtccatctcagcccacacta

SEQ ID NO: 621139 - DNA, 20 bp, mouse
gggccagcagcatcacgatg

SEQ ID NO: 621140 - DNA, 20 bp, mouse
gtctcggaatggataaatca

SEQ ID NO: 621141 - DNA, 20 bp, mouse
gcttagagccaggacaccaa

SEQ ID NO: 621142 - DNA, 20 bp, mouse
ggaccacgtgggagagcagg

SEQ ID NO: 621143 - DNA, 20 bp, mouse
ggcccacactatggctgtct

SEQ ID NO: 621144 - DNA, 20 bp, mouse
ggacagcagtgggtaataac

SEQ ID NO: 621145 - DNA, 20 bp, mouse
ggccatagtgtgggctgaga

SEQ ID NO: 621146 - DNA, 20 bp, mouse
gcaaatgcataagaaaacac

SEQ ID NO: 621147 - DNA, 20 bp, mouse
gagtcccaatacctctttga

SEQ ID NO: 621148 - DNA, 20 bp, mouse
gttaaattttgccatcaaag

SEQ ID NO: 621149 - DNA, 20 bp, mouse
gaaaagaagaagaaccatat

SEQ ID NO: 621150 - DNA, 20 bp, mouse
gcaaaaactgaaaaaataca

SEQ ID NO: 621151 - DNA, 20 bp, mouse
gacctttgttcacataataa

SEQ ID NO: 621152 - DNA, 20 bp, mouse
gtgcatttggtctttcaatt

SEQ ID NO: 621153 - DNA, 20 bp, mouse
gacaattttttatattagca

SEQ ID NO: 621154 - DNA, 20 bp, mouse
gaagaagaaccatattggct

SEQ ID NO: 621155 - DNA, 20 bp, mouse
gtggaacacactcagaagac

SEQ ID NO: 621156 - DNA, 20 bp, mouse
gacatatgcagggtaatgag

SEQ ID NO: 621157 - DNA, 20 bp, mouse
gagtctgttgacaggagatt

SEQ ID NO: 621158 - DNA, 20 bp, mouse
gaagaagacacatattagct

SEQ ID NO: 621159 - DNA, 20 bp, mouse
gtaatgctgttcttcactgc

SEQ ID NO: 621160 - DNA, 20 bp, mouse
gaacaactttttacatatgc

SEQ ID NO: 621161 - DNA, 20 bp, mouse
gcaatgagaacataagtgag

SEQ ID NO: 621162 - DNA, 20 bp, mouse
gctatattttcataatccta

SEQ ID NO: 621163 - DNA, 20 bp, mouse
gagcgaggtattgggactga

SEQ ID NO: 621164 - DNA, 20 bp, mouse
gagtcccaatacctcgctgt

SEQ ID NO: 621165 - DNA, 20 bp, mouse
gtgctctttatatccaagct

SEQ ID NO: 621166 - DNA, 20 bp, mouse
gactcatcgttagagaatgg

SEQ ID NO: 621167 - DNA, 20 bp, mouse
gagtcacaggaactccttgt

SEQ ID NO: 621168 - DNA, 20 bp, mouse
gtgaactcatcgttagagaa

SEQ ID NO: 621169 - DNA, 20 bp, mouse
gggctgtcatgatcagtcac

SEQ ID NO: 621170 - DNA, 20 bp, mouse
gggatattctctaataatga

SEQ ID NO: 621171 - DNA, 20 bp, mouse
gtctaataatgaaggcataa

SEQ ID NO: 621172 - DNA, 20 bp, mouse
gacataatgatgttctttgc

SEQ ID NO: 621173 - DNA, 20 bp, mouse
gcaacacattattttatatt

SEQ ID NO: 621174 - DNA, 20 bp, mouse
gtgtttaatttttgccaaca

SEQ ID NO: 621175 - DNA, 20 bp, mouse
gtgcttggtctgactcacat

SEQ ID NO: 621176 - DNA, 20 bp, mouse
gagatcaggtcaatgagctt

SEQ ID NO: 621177 - DNA, 20 bp, mouse
gggcaactttatacacaaac

SEQ ID NO: 621178 - DNA, 20 bp, mouse
ggtatcctgatcttctatac

SEQ ID NO: 621179 - DNA, 20 bp, mouse
gtcctgatcttctatactgg

SEQ ID NO: 621180 - DNA, 20 bp, mouse
gcataaactaagaaaacaca

SEQ ID NO: 621181 - DNA, 20 bp, mouse
gtgcctcctgagtgtgatcc

SEQ ID NO: 621182 - DNA, 20 bp, mouse
gatcatcaatatgtgaacga

SEQ ID NO: 621183 - DNA, 20 bp, mouse
gagtccgagtacctctatgc

SEQ ID NO: 621184 - DNA, 20 bp, mouse
gcatgacatttcctccagtg

SEQ ID NO: 621185 - DNA, 20 bp, mouse
gtgcttctttcttttatatt

SEQ ID NO: 621186 - DNA, 20 bp, mouse
gcagagacgttcctcaattt

SEQ ID NO: 621187 - DNA, 20 bp, mouse
gtttcctagtgcctaaattg

SEQ ID NO: 621188 - DNA, 20 bp, mouse
gctgcagagcacagcttcta

SEQ ID NO: 621189 - DNA, 20 bp, mouse
gaatgcaatgaaattcagaa

SEQ ID NO: 621190 - DNA, 20 bp, mouse
gctgactgaggctcagaagg

SEQ ID NO: 621191 - DNA, 20 bp, mouse
gtctccacgcaatgctgtaa

SEQ ID NO: 621192 - DNA, 20 bp, mouse
gaattttaagcagaagtcta

SEQ ID NO: 621193 - DNA, 20 bp, mouse
gtctgcaggttaacttaaat

SEQ ID NO: 621194 - DNA, 20 bp, mouse
gttctcttgagtactaatct

SEQ ID NO: 621195 - DNA, 20 bp, mouse
gacaagggcctccatccacc

SEQ ID NO: 621196 - DNA, 20 bp, mouse
gttggggtcagtgacaaata

SEQ ID NO: 621197 - DNA, 20 bp, mouse
gttttaactcatacttctaa

SEQ ID NO: 621198 - DNA, 20 bp, mouse
gagaagtatgagttaaaaca

SEQ ID NO: 621199 - DNA, 20 bp, mouse
gctgaccccaatcaattgtt

SEQ ID NO: 621200 - DNA, 20 bp, mouse
gacagccaaacaattgattg

SEQ ID NO: 621201 - DNA, 20 bp, mouse
gtaggctataatgtacacta

SEQ ID NO: 621202 - DNA, 20 bp, mouse
gtgaggaaatttatataaat

SEQ ID NO: 621203 - DNA, 20 bp, mouse
gaacctttctctttaacatt

SEQ ID NO: 621204 - DNA, 20 bp, mouse
gtatggaagaattagaaaaa

SEQ ID NO: 621205 - DNA, 20 bp, mouse
gtgtatatacaggaaataca

SEQ ID NO: 621206 - DNA, 20 bp, mouse
gctgcagagcacagcttcta

SEQ ID NO: 621207 - DNA, 20 bp, mouse
gaatgcaatgaaattcagaa

SEQ ID NO: 621208 - DNA, 20 bp, mouse
gctgactgaggctcagaagg

SEQ ID NO: 621209 - DNA, 20 bp, mouse
gaattttaagcagaagtcta

SEQ ID NO: 621210 - DNA, 20 bp, mouse
gtctgcaggttaacttaaat

SEQ ID NO: 621211 - DNA, 20 bp, mouse
gttctcttgagtactaatct

SEQ ID NO: 621212 - DNA, 20 bp, mouse
gacaagggcctccatccacc

SEQ ID NO: 621213 - DNA, 20 bp, mouse
ggataatgaattatacctgg

SEQ ID NO: 621214 - DNA, 20 bp, mouse
gtgagataatgaattatacc

SEQ ID NO: 621215 - DNA, 20 bp, mouse
gtctgcttgcaaagggtatt

SEQ ID NO: 621216 - DNA, 20 bp, mouse
gaagaagaaacacattgggt

SEQ ID NO: 621217 - DNA, 20 bp, mouse
gatacaagtagggtaacgag

SEQ ID NO: 621218 - DNA, 20 bp, mouse
gtaaaggacattctctaccg

SEQ ID NO: 621219 - DNA, 20 bp, mouse
gtttggctcgcagacatatt

SEQ ID NO: 621220 - DNA, 20 bp, mouse
gaatgtcagtgagaccaagc

SEQ ID NO: 621221 - DNA, 20 bp, mouse
gacatgcttttctttgttgg

SEQ ID NO: 621222 - DNA, 20 bp, mouse
gaaagaagaagaaacacatt

SEQ ID NO: 621223 - DNA, 20 bp, mouse
gtactctgcatttatgtcct

SEQ ID NO: 621224 - DNA, 20 bp, mouse
gttagtgactttcacctgct

SEQ ID NO: 621225 - DNA, 20 bp, mouse
ggtaacatgcttttctttgt

SEQ ID NO: 621226 - DNA, 20 bp, mouse
ggtagtgctgccctttgtgg

SEQ ID NO: 621227 - DNA, 20 bp, mouse
gagaagaacaaatttggtgt

SEQ ID NO: 621228 - DNA, 20 bp, mouse
gttgttcttcttataacgtg

SEQ ID NO: 621229 - DNA, 20 bp, mouse
gcacacacagatctatcatg

SEQ ID NO: 621230 - DNA, 20 bp, mouse
gggtgttggacagttggttc

SEQ ID NO: 621231 - DNA, 20 bp, mouse
gaaatttggtgttggacagt

SEQ ID NO: 621232 - DNA, 20 bp, mouse
gcaacggaatagtgatcatg

SEQ ID NO: 621233 - DNA, 20 bp, mouse
gacaagcatgtatttttgct

SEQ ID NO: 621234 - DNA, 20 bp, mouse
gaagtatttttcccccacaa

SEQ ID NO: 621235 - DNA, 20 bp, mouse
gaaagtagtgctgccctttg

SEQ ID NO: 621236 - DNA, 20 bp, mouse
gcttcctttgaagactctct

SEQ ID NO: 621237 - DNA, 20 bp, mouse
gcctgatccttgatgtgatt

SEQ ID NO: 621238 - DNA, 20 bp, mouse
gatccttgatgtgatttggc

SEQ ID NO: 621239 - DNA, 20 bp, mouse
gtcaactgtgatgatgttat

SEQ ID NO: 621240 - DNA, 20 bp, mouse
gttggtttgagcatggttgt

SEQ ID NO: 621241 - DNA, 20 bp, mouse
gatgcccagagagtcttcaa

SEQ ID NO: 621242 - DNA, 20 bp, mouse
gcaaggatcaggtggctcac

SEQ ID NO: 621243 - DNA, 20 bp, mouse
gacactgggagtgagagagt

SEQ ID NO: 621244 - DNA, 20 bp, mouse
gcacctgccaaatcacatca

SEQ ID NO: 621245 - DNA, 20 bp, mouse
gtcagtaaatgctaagaaga

SEQ ID NO: 621246 - DNA, 20 bp, mouse
gcaaaaactatgatattgct

SEQ ID NO: 621247 - DNA, 20 bp, mouse
gtcattctactccatttgcc

SEQ ID NO: 621248 - DNA, 20 bp, mouse
gcgttcttgttcctggcaaa

SEQ ID NO: 621249 - DNA, 20 bp, mouse
gcacagctgcaataccaacc

SEQ ID NO: 621250 - DNA, 20 bp, mouse
ggagcagacatagaaagact

SEQ ID NO: 621251 - DNA, 20 bp, mouse
gcaaagcaagatgatttgaa

SEQ ID NO: 621252 - DNA, 20 bp, mouse
gaaagttaggagataaatta

SEQ ID NO: 621253 - DNA, 20 bp, mouse
gagattgcctacagtaatgt

SEQ ID NO: 621254 - DNA, 20 bp, mouse
gttcttgcccacattactgt

SEQ ID NO: 621255 - DNA, 20 bp, mouse
ggttgagggccagcaaagtt

SEQ ID NO: 621256 - DNA, 20 bp, mouse
ggtttgcacttcgagccacc

SEQ ID NO: 621257 - DNA, 20 bp, mouse
gcaaaaactgtcatattgct

SEQ ID NO: 621258 - DNA, 20 bp, mouse
ggataaactggtaagagctc

SEQ ID NO: 621259 - DNA, 20 bp, mouse
gcttgagtacttcattcgcc

SEQ ID NO: 621260 - DNA, 20 bp, mouse
gcacagctgcaataccaacc

SEQ ID NO: 621261 - DNA, 20 bp, mouse
ggagcagacatagaaagact

SEQ ID NO: 621262 - DNA, 20 bp, mouse
gcaaagcaagatgatttgaa

SEQ ID NO: 621263 - DNA, 20 bp, mouse
gaaagttaggagataaatta

SEQ ID NO: 621264 - DNA, 20 bp, mouse
gagattgcccacagtaatgt

SEQ ID NO: 621265 - DNA, 20 bp, mouse
gattgcttggaaacccagtg

SEQ ID NO: 621266 - DNA, 20 bp, mouse
gtgaagagtcatgtcatcag

SEQ ID NO: 621267 - DNA, 20 bp, mouse
gagagggttttaacctaccc

SEQ ID NO: 621268 - DNA, 20 bp, mouse
gagaataactcgtcaagttt

SEQ ID NO: 621269 - DNA, 20 bp, mouse
gttggaatactttagtcgcc

SEQ ID NO: 621270 - DNA, 20 bp, mouse
ggaagtgaggaagagaatca

SEQ ID NO: 621271 - DNA, 20 bp, mouse
gcatgtctggaaatgaagtg

SEQ ID NO: 621272 - DNA, 20 bp, mouse
gggtgagttggagaatttct

SEQ ID NO: 621273 - DNA, 20 bp, mouse
gaatatctacattgcaatta

SEQ ID NO: 621274 - DNA, 20 bp, mouse
gcacaaactggcaaagcagg

SEQ ID NO: 621275 - DNA, 20 bp, mouse
gcaagactggagagatatta

SEQ ID NO: 621276 - DNA, 20 bp, mouse
gagagggctttcgcagacac

SEQ ID NO: 621277 - DNA, 20 bp, mouse
gtcaagcgtacacatagaga

SEQ ID NO: 621278 - DNA, 20 bp, mouse
gactggagtgatgattagat

SEQ ID NO: 621279 - DNA, 20 bp, mouse
gggagcaaaagtcatcacat

SEQ ID NO: 621280 - DNA, 20 bp, mouse
gagaataccttgccaaactt

SEQ ID NO: 621281 - DNA, 20 bp, mouse
ggaattcttcattcgcctag

SEQ ID NO: 621282 - DNA, 20 bp, mouse
gaagtgtcccaagtttggca

SEQ ID NO: 621283 - DNA, 20 bp, mouse
gagagcaagtgtcccaagtt

SEQ ID NO: 621284 - DNA, 20 bp, mouse
gcacagttccaacaccaaac

SEQ ID NO: 621285 - DNA, 20 bp, mouse
gcaaaagtcatcacattggt

SEQ ID NO: 621286 - DNA, 20 bp, mouse
ggcaggacactgctatcatc

SEQ ID NO: 621287 - DNA, 20 bp, mouse
ggtttagaaccagtcaggat

SEQ ID NO: 621288 - DNA, 20 bp, mouse
gcacaaacaggaactttgcc

SEQ ID NO: 621289 - DNA, 20 bp, mouse
gactacatttccaaacaaca

SEQ ID NO: 621290 - DNA, 20 bp, mouse
ggagcaaaagccatgttgtt

SEQ ID NO: 621291 - DNA, 20 bp, mouse
ggaattcttcattcgcatgg

SEQ ID NO: 621292 - DNA, 20 bp, mouse
gacacttttctatcacaaac

SEQ ID NO: 621293 - DNA, 20 bp, mouse
gatttctttccaatcctgac

SEQ ID NO: 621294 - DNA, 20 bp, mouse
gggtcattttgaggacttct

SEQ ID NO: 621295 - DNA, 20 bp, mouse
gttggaattcttcattcgca

SEQ ID NO: 621296 - DNA, 20 bp, mouse
gctggcagccagattccaga

SEQ ID NO: 621297 - DNA, 20 bp, mouse
gcaggagtgccccacataat

SEQ ID NO: 621298 - DNA, 20 bp, mouse
gtgtgataataaagtgattc

SEQ ID NO: 621299 - DNA, 20 bp, mouse
gcccacataataggactttg

SEQ ID NO: 621300 - DNA, 20 bp, mouse
gtccccaaagtcctattatg

SEQ ID NO: 621301 - DNA, 20 bp, mouse
gatgtgcaagatccacatga

SEQ ID NO: 621302 - DNA, 20 bp, mouse
gaagatccacatgagggaaa

SEQ ID NO: 621303 - DNA, 20 bp, mouse
gactattcatttttataaat

SEQ ID NO: 621304 - DNA, 20 bp, mouse
gttttataaatgggtacaca

SEQ ID NO: 621305 - DNA, 20 bp, mouse
ggaagcacagaatagccttc

SEQ ID NO: 621306 - DNA, 20 bp, mouse
gtccccaaaatgctattatg

SEQ ID NO: 621307 - DNA, 20 bp, mouse
gtgggataataaaatgattc

SEQ ID NO: 621308 - DNA, 20 bp, mouse
gcccacataatagcattttg

SEQ ID NO: 621309 - DNA, 20 bp, mouse
gtcaaagctataatgcacaa

SEQ ID NO: 621310 - DNA, 20 bp, mouse
gcagaattccaactgtagtt

SEQ ID NO: 621311 - DNA, 20 bp, mouse
ggaagcacagaatagacttc

SEQ ID NO: 621312 - DNA, 20 bp, mouse
gaccaactgattatagctgg

SEQ ID NO: 621313 - DNA, 20 bp, mouse
gtggtgaggatatattctaa

SEQ ID NO: 621314 - DNA, 20 bp, mouse
gacctccagctataatcagt

SEQ ID NO: 621315 - DNA, 20 bp, mouse
gtctgaagctccatggttaa

SEQ ID NO: 621316 - DNA, 20 bp, mouse
gcatcagtcccacaggatct

SEQ ID NO: 621317 - DNA, 20 bp, mouse
gctcctccacccagatcctg

SEQ ID NO: 621318 - DNA, 20 bp, mouse
gatatatcacagcttaggaa

SEQ ID NO: 621319 - DNA, 20 bp, mouse
gccatcatcatcagtcccac

SEQ ID NO: 621320 - DNA, 20 bp, mouse
gcacattccattagaagtac

SEQ ID NO: 621321 - DNA, 20 bp, mouse
gacttctaatggaatgtgtt

SEQ ID NO: 621322 - DNA, 20 bp, mouse
gcttacagcctatatcatcc

SEQ ID NO: 621323 - DNA, 20 bp, mouse
ggaaacagaaatattcccca

SEQ ID NO: 621324 - DNA, 20 bp, mouse
ggactatgattggcaccctg

SEQ ID NO: 621325 - DNA, 20 bp, mouse
gcagtcccacaggatctggg

SEQ ID NO: 621326 - DNA, 20 bp, mouse
gacttgacaagggtggcccg

SEQ ID NO: 621327 - DNA, 20 bp, mouse
ggataattgtttacttgaca

SEQ ID NO: 621328 - DNA, 20 bp, mouse
gaccacagtgaggagacttc

SEQ ID NO: 621329 - DNA, 20 bp, mouse
gattgtttacttgacaaggg

SEQ ID NO: 621330 - DNA, 20 bp, mouse
ggccccagtaatcctagaca

SEQ ID NO: 621331 - DNA, 20 bp, mouse
gatccatgtctaggattact

SEQ ID NO: 621332 - DNA, 20 bp, mouse
ggaaccatttcttcctttct

SEQ ID NO: 621333 - DNA, 20 bp, mouse
gtgactttttctacctagaa

SEQ ID NO: 621334 - DNA, 20 bp, mouse
gtcaaaacgtctttgcatac

SEQ ID NO: 621335 - DNA, 20 bp, mouse
gattttgcaatagcattttc

SEQ ID NO: 621336 - DNA, 20 bp, mouse
gatgaactacagttctacta

SEQ ID NO: 621337 - DNA, 20 bp, mouse
gacagttctactatggtctt

SEQ ID NO: 621338 - DNA, 20 bp, mouse
gaaaaaaggagaaacatatt

SEQ ID NO: 621339 - DNA, 20 bp, mouse
gctatgcttttttctatctc

SEQ ID NO: 621340 - DNA, 20 bp, mouse
gaaggagaaacatatttggt

SEQ ID NO: 621341 - DNA, 20 bp, mouse
gagcctgggatacactcaag

SEQ ID NO: 621342 - DNA, 20 bp, mouse
gcaagaaatgtgtgattcat

SEQ ID NO: 621343 - DNA, 20 bp, mouse
gggactgattgtgatagcct

SEQ ID NO: 621344 - DNA, 20 bp, mouse
gtgggatacactcaagaggc

SEQ ID NO: 621345 - DNA, 20 bp, mouse
gtaaaggacattctcaaatg

SEQ ID NO: 621346 - DNA, 20 bp, mouse
gtcctcttcatgattctggt

SEQ ID NO: 621347 - DNA, 20 bp, mouse
gtctatctaggaagtgaaaa

SEQ ID NO: 621348 - DNA, 20 bp, mouse
gcagttggtggaggagcact

SEQ ID NO: 621349 - DNA, 20 bp, mouse
gctagatgacataggttgta

SEQ ID NO: 621350 - DNA, 20 bp, mouse
gttatatgctcagttggtgg

SEQ ID NO: 621351 - DNA, 20 bp, mouse
gaggagactgctagtgcaaa

SEQ ID NO: 621352 - DNA, 20 bp, mouse
ggttttcctcttcatgattc

SEQ ID NO: 621353 - DNA, 20 bp, mouse
ggccaaccagaatcatgaag

SEQ ID NO: 621354 - DNA, 20 bp, mouse
gttgaagtttattgagaaaa

SEQ ID NO: 621355 - DNA, 20 bp, mouse
gggatgtgccatgcagacgt

SEQ ID NO: 621356 - DNA, 20 bp, mouse
ggaaaatcttacatgtgtta

SEQ ID NO: 621357 - DNA, 20 bp, mouse
gatatgtctcacaaatatta

SEQ ID NO: 621358 - DNA, 20 bp, mouse
gggctttttctcaatccaca

SEQ ID NO: 621359 - DNA, 20 bp, mouse
gtttgtccaaagggcagtcc

SEQ ID NO: 621360 - DNA, 20 bp, mouse
ggggtatttcccagaattcc

SEQ ID NO: 621361 - DNA, 20 bp, mouse
gcagtcccaggactgccctt

SEQ ID NO: 621362 - DNA, 20 bp, mouse
gctgactggacctggaattc

SEQ ID NO: 621363 - DNA, 20 bp, mouse
gtgactttatgcataacagt

SEQ ID NO: 621364 - DNA, 20 bp, mouse
gtatattagaaaaagccaag

SEQ ID NO: 621365 - DNA, 20 bp, mouse
gtttacaaccagtatcacct

SEQ ID NO: 621366 - DNA, 20 bp, mouse
gtccaagtccaacaagtgaa

SEQ ID NO: 621367 - DNA, 20 bp, mouse
ggaacatgccatgtggtctg

SEQ ID NO: 621368 - DNA, 20 bp, mouse
ggctcaaaccacagaccaca

SEQ ID NO: 621369 - DNA, 20 bp, mouse
gcatttgtatgcagtcatca

SEQ ID NO: 621370 - DNA, 20 bp, mouse
gcaattttcctttcacttgt

SEQ ID NO: 621371 - DNA, 20 bp, mouse
gttggagtgacctcatcgag

SEQ ID NO: 621372 - DNA, 20 bp, mouse
ggaaaattgtcccctcgatg

SEQ ID NO: 621373 - DNA, 20 bp, mouse
gtcctttcacttgttggact

SEQ ID NO: 621374 - DNA, 20 bp, mouse
gaagacaagaacatgccatg

SEQ ID NO: 621375 - DNA, 20 bp, mouse
gagcaagttggagcttatca

SEQ ID NO: 621376 - DNA, 20 bp, mouse
ggacagcctggactgtactg

SEQ ID NO: 621377 - DNA, 20 bp, mouse
gactatataacagcaggcag

SEQ ID NO: 621378 - DNA, 20 bp, mouse
gggccaaaccacagacttcg

SEQ ID NO: 621379 - DNA, 20 bp, mouse
ggaacttgcctcgaagtctg

SEQ ID NO: 621380 - DNA, 20 bp, mouse
ggcagtggcatgaacagatc

SEQ ID NO: 621381 - DNA, 20 bp, mouse
gggatgagaataagattgac

SEQ ID NO: 621382 - DNA, 20 bp, mouse
gggctttttctcagtcctga

SEQ ID NO: 621383 - DNA, 20 bp, mouse
gggaacttgtgagaatatta

SEQ ID NO: 621384 - DNA, 20 bp, mouse
gtgcctcgaagtctgtggtt

SEQ ID NO: 621385 - DNA, 20 bp, mouse
gtgtgtacacttcagccttc

SEQ ID NO: 621386 - DNA, 20 bp, mouse
gagaaaggaagattactcgt

SEQ ID NO: 621387 - DNA, 20 bp, mouse
gctgaggtcaaaagatgatt

SEQ ID NO: 621388 - DNA, 20 bp, mouse
gtttggctagttctcacctg

SEQ ID NO: 621389 - DNA, 20 bp, mouse
ggtgttcctcaaagtggatt

SEQ ID NO: 621390 - DNA, 20 bp, mouse
ggttcagaccacaaacaata

SEQ ID NO: 621391 - DNA, 20 bp, mouse
gcagatgagtgaagataata

SEQ ID NO: 621392 - DNA, 20 bp, mouse
gaacattaaagatacaaagg

SEQ ID NO: 621393 - DNA, 20 bp, mouse
gtgaagataataaggtctat

SEQ ID NO: 621394 - DNA, 20 bp, mouse
gacacaaatgatcacctcca

SEQ ID NO: 621395 - DNA, 20 bp, mouse
gaatcattattggtacttcg

SEQ ID NO: 621396 - DNA, 20 bp, mouse
gttcactggacttggcactg

SEQ ID NO: 621397 - DNA, 20 bp, mouse
gagccccagagcctcctggt

SEQ ID NO: 621398 - DNA, 20 bp, mouse
ggctcagactaaggtctaaa

SEQ ID NO: 621399 - DNA, 20 bp, mouse
ggtgggggaggctcagacta

SEQ ID NO: 621400 - DNA, 20 bp, mouse
gctaaagctgcaattgtcac

SEQ ID NO: 621401 - DNA, 20 bp, mouse
gacttcatgggtagaaaatt

SEQ ID NO: 621402 - DNA, 20 bp, mouse
gtagggttgagacactttct

SEQ ID NO: 621403 - DNA, 20 bp, mouse
gtacagacaccttacaactg

SEQ ID NO: 621404 - DNA, 20 bp, mouse
gatctagaaaggatggcccg

SEQ ID NO: 621405 - DNA, 20 bp, mouse
gcatgagccccagagcctcc

SEQ ID NO: 621406 - DNA, 20 bp, mouse
ggagtccaagacactcaatg

SEQ ID NO: 621407 - DNA, 20 bp, mouse
gtaaatgcttctattgtctt

SEQ ID NO: 621408 - DNA, 20 bp, mouse
gaggtttctgctcagtgctt

SEQ ID NO: 621409 - DNA, 20 bp, mouse
gaagacactcaatgtggcag

SEQ ID NO: 621410 - DNA, 20 bp, mouse
gtgtcttggactcatggtga

SEQ ID NO: 621411 - DNA, 20 bp, mouse
gtgtaaagctgttgtttact

SEQ ID NO: 621412 - DNA, 20 bp, mouse
gtgacatttttaatgtaata

SEQ ID NO: 621413 - DNA, 20 bp, mouse
gagtgtgctgtggggtcttt

SEQ ID NO: 621414 - DNA, 20 bp, mouse
gcaatagaagcatttaattt

SEQ ID NO: 621415 - DNA, 20 bp, mouse
gcgagaaaagagtgtgctgt

SEQ ID NO: 621416 - DNA, 20 bp, mouse
gcccaagtctcgcaaacatt

SEQ ID NO: 621417 - DNA, 20 bp, mouse
gggatatttcccataattcc

SEQ ID NO: 621418 - DNA, 20 bp, mouse
gtactctcttacattaaagg

SEQ ID NO: 621419 - DNA, 20 bp, mouse
gtggatgagaattacgtcaa

SEQ ID NO: 621420 - DNA, 20 bp, mouse
gtcctaatgtttgcgagact

SEQ ID NO: 621421 - DNA, 20 bp, mouse
gttgagttttgtccaaaagg

SEQ ID NO: 621422 - DNA, 20 bp, mouse
gttaatgtaagagagtaagt

SEQ ID NO: 621423 - DNA, 20 bp, mouse
gcatattagaaaacaccaag

SEQ ID NO: 621424 - DNA, 20 bp, mouse
gctgtggctataatgtacat

SEQ ID NO: 621425 - DNA, 20 bp, mouse
gcttattggacctggaatta

SEQ ID NO: 621426 - DNA, 20 bp, mouse
gactgctggcgcagagagag

SEQ ID NO: 621427 - DNA, 20 bp, mouse
gtttgcatgagagcattttc

SEQ ID NO: 621428 - DNA, 20 bp, mouse
ggaaatttcctagatgactc

SEQ ID NO: 621429 - DNA, 20 bp, mouse
gtatttgcatcctgcacaca

SEQ ID NO: 621430 - DNA, 20 bp, mouse
ggatcattgtttacttggaa

SEQ ID NO: 621431 - DNA, 20 bp, mouse
ggacagtgtttgtaaaagcc

SEQ ID NO: 621432 - DNA, 20 bp, mouse
gattgtttacttggaaaggg

SEQ ID NO: 621433 - DNA, 20 bp, mouse
gggataagaataaggtgtac

SEQ ID NO: 621434 - DNA, 20 bp, mouse
gcctccatccagatgctctg

SEQ ID NO: 621435 - DNA, 20 bp, mouse
gtgactgtgcttggcattat

SEQ ID NO: 621436 - DNA, 20 bp, mouse
gacctggaaagggtatcccg

SEQ ID NO: 621437 - DNA, 20 bp, mouse
ggccacgggataccctttcc

SEQ ID NO: 621438 - DNA, 20 bp, mouse
gagaaaatcttcagaatgtt

SEQ ID NO: 621439 - DNA, 20 bp, mouse
gatcttcagaatgttaggca

SEQ ID NO: 621440 - DNA, 20 bp, mouse
gagcattgtctacctggaaa

SEQ ID NO: 621441 - DNA, 20 bp, mouse
ggccaagcactgtcatggag

SEQ ID NO: 621442 - DNA, 20 bp, mouse
gccagatgctctgggactga

SEQ ID NO: 621443 - DNA, 20 bp, mouse
gagagtgccaagcactgtca

SEQ ID NO: 621444 - DNA, 20 bp, mouse
gtcccctccatgacagtgct

SEQ ID NO: 621445 - DNA, 20 bp, mouse
gaaagaatagcaagaatgga

SEQ ID NO: 621446 - DNA, 20 bp, mouse
gggatgagaatgaggtcgag

SEQ ID NO: 621447 - DNA, 20 bp, mouse
gataaaatcagaacatgaac

SEQ ID NO: 621448 - DNA, 20 bp, mouse
gtgtaaagctgcagtttatc

SEQ ID NO: 621449 - DNA, 20 bp, mouse
gctgtagttgcaacgtacat

SEQ ID NO: 621450 - DNA, 20 bp, mouse
ggaacttggaaagatgtctg

SEQ ID NO: 621451 - DNA, 20 bp, mouse
ggaatatttcctacaattcc

SEQ ID NO: 621452 - DNA, 20 bp, mouse
gtgtgcacaattctgccttg

SEQ ID NO: 621453 - DNA, 20 bp, mouse
gtgtctcctcagtgtgctcc

SEQ ID NO: 621454 - DNA, 20 bp, mouse
gtccaggtccagctagagaa

SEQ ID NO: 621455 - DNA, 20 bp, mouse
gtcctttctctagctggacc

SEQ ID NO: 621456 - DNA, 20 bp, mouse
gaacaggtctgtagttggga

SEQ ID NO: 621457 - DNA, 20 bp, mouse
gtttctaatataaaaaatca

SEQ ID NO: 621458 - DNA, 20 bp, mouse
ggaaactttctagatgatgt

SEQ ID NO: 621459 - DNA, 20 bp, mouse
gattaaacatccaaaagaga

SEQ ID NO: 621460 - DNA, 20 bp, mouse
ggctcaaacctcagacacca

SEQ ID NO: 621461 - DNA, 20 bp, mouse
ggaacatgccatggtgtctg

SEQ ID NO: 621462 - DNA, 20 bp, mouse
gaaaaattactctttggata

SEQ ID NO: 621463 - DNA, 20 bp, mouse
gatataaaaaatcatggcta

SEQ ID NO: 621464 - DNA, 20 bp, mouse
gcatgaacaggtctgtagtt

SEQ ID NO: 621465 - DNA, 20 bp, mouse
gtctgagcatgaagataatt

SEQ ID NO: 621466 - DNA, 20 bp, mouse
gctgcctaggaaggaaaaaa

SEQ ID NO: 621467 - DNA, 20 bp, mouse
gagccatgtggatcagaatg

SEQ ID NO: 621468 - DNA, 20 bp, mouse
gatggttttgaagtatatta

SEQ ID NO: 621469 - DNA, 20 bp, mouse
ggaaaaacttgcatccaaga

SEQ ID NO: 621470 - DNA, 20 bp, mouse
gtccaaaagtgtttccatct

SEQ ID NO: 621471 - DNA, 20 bp, mouse
gtccaagatggaaacacttt

SEQ ID NO: 621472 - DNA, 20 bp, mouse
ggaattatacattcagttgt

SEQ ID NO: 621473 - DNA, 20 bp, mouse
gaccctctctaggtaaacaa

SEQ ID NO: 621474 - DNA, 20 bp, mouse
ggatgcaagtttttctgcct

SEQ ID NO: 621475 - DNA, 20 bp, mouse
gctcctccacccagatgttc

SEQ ID NO: 621476 - DNA, 20 bp, mouse
gtccaagtaaaataagtgaa

SEQ ID NO: 621477 - DNA, 20 bp, mouse
ggaatatgccatgccgtctg

SEQ ID NO: 621478 - DNA, 20 bp, mouse
ggttcaaaccacagacggca

SEQ ID NO: 621479 - DNA, 20 bp, mouse
gtcctttcacttattttact

SEQ ID NO: 621480 - DNA, 20 bp, mouse
ggatgttattctagtccact

SEQ ID NO: 621481 - DNA, 20 bp, mouse
gcatgaacagttctgaagtt

SEQ ID NO: 621482 - DNA, 20 bp, mouse
gcatctattattttcttctc

SEQ ID NO: 621483 - DNA, 20 bp, mouse
gttggagtgacctcatcgcg

SEQ ID NO: 621484 - DNA, 20 bp, mouse
ggaaaattgtccccgcgatg

SEQ ID NO: 621485 - DNA, 20 bp, mouse
gatttatatgtagtcatcat

SEQ ID NO: 621486 - DNA, 20 bp, mouse
gcccatgtctaggattgcag

SEQ ID NO: 621487 - DNA, 20 bp, mouse
ggcctctgcaatcctagaca

SEQ ID NO: 621488 - DNA, 20 bp, mouse
ggcaatcctagacatgggtt

SEQ ID NO: 621489 - DNA, 20 bp, mouse
ggtgccaaacatagtcataa

SEQ ID NO: 621490 - DNA, 20 bp, mouse
gttccctttatgactatgtt

SEQ ID NO: 621491 - DNA, 20 bp, mouse
ggctatccaaacccatgtct

SEQ ID NO: 621492 - DNA, 20 bp, mouse
ggtatgtatatgctttttga

SEQ ID NO: 621493 - DNA, 20 bp, mouse
gccaagactattttagtttt

SEQ ID NO: 621494 - DNA, 20 bp, mouse
gaaacttcctagatgatata

SEQ ID NO: 621495 - DNA, 20 bp, mouse
gcttacaccctatatcatct

SEQ ID NO: 621496 - DNA, 20 bp, mouse
gttaaaaaaatcttgtatcc

SEQ ID NO: 621497 - DNA, 20 bp, mouse
gttcaaaagtctgtgcatcc

SEQ ID NO: 621498 - DNA, 20 bp, mouse
gttaactaggaagaaaggaa

SEQ ID NO: 621499 - DNA, 20 bp, mouse
gtttttttaactaggaagaa

SEQ ID NO: 621500 - DNA, 20 bp, mouse
gatacaagatttttttaact

SEQ ID NO: 621501 - DNA, 20 bp, mouse
gtcatctttataactgtgat

SEQ ID NO: 621502 - DNA, 20 bp, mouse
gacctcagtaattctagaca

SEQ ID NO: 621503 - DNA, 20 bp, mouse
ggtggagcagactaagacca

SEQ ID NO: 621504 - DNA, 20 bp, mouse
gacaatgatcttacaaccta

SEQ ID NO: 621505 - DNA, 20 bp, mouse
gctgtacagatttcttctca

SEQ ID NO: 621506 - DNA, 20 bp, mouse
ggttttgaagtatattaata

SEQ ID NO: 621507 - DNA, 20 bp, mouse
ggacagcctggacaacagtg

SEQ ID NO: 621508 - DNA, 20 bp, mouse
gatagtctttggcaatcctt

SEQ ID NO: 621509 - DNA, 20 bp, mouse
gtcctaatacttcttaccaa

SEQ ID NO: 621510 - DNA, 20 bp, mouse
gattatactttcagttattg

SEQ ID NO: 621511 - DNA, 20 bp, mouse
gaaagcattgagtatccaaa

SEQ ID NO: 621512 - DNA, 20 bp, mouse
ggatgtttgtaaaagccaga

SEQ ID NO: 621513 - DNA, 20 bp, mouse
gatctgggtggaacagactc

SEQ ID NO: 621514 - DNA, 20 bp, mouse
gagccagatggatcagaata

SEQ ID NO: 621515 - DNA, 20 bp, mouse
gacaacagtgaggaaactgc

SEQ ID NO: 621516 - DNA, 20 bp, mouse
ggtgccaaccacagttataa

SEQ ID NO: 621517 - DNA, 20 bp, mouse
gatctgtacttgtgatagaa

SEQ ID NO: 621518 - DNA, 20 bp, mouse
gtcacctttataactgtggt

SEQ ID NO: 621519 - DNA, 20 bp, mouse
gaaagtataggaagaataaa

SEQ ID NO: 621520 - DNA, 20 bp, mouse
gattttcacctttataactg

SEQ ID NO: 621521 - DNA, 20 bp, mouse
gattgagtatccaaaagtat

SEQ ID NO: 621522 - DNA, 20 bp, mouse
gatctaggtggagcagacta

SEQ ID NO: 621523 - DNA, 20 bp, mouse
gacaatgatcttacaaccta

SEQ ID NO: 621524 - DNA, 20 bp, mouse
ggccatgggccaccctcccc

SEQ ID NO: 621525 - DNA, 20 bp, mouse
gctgtacagatttcttctca

SEQ ID NO: 621526 - DNA, 20 bp, mouse
gtaaaggacagtatttgatg

SEQ ID NO: 621527 - DNA, 20 bp, mouse
gctcatcataaaagctgaga

SEQ ID NO: 621528 - DNA, 20 bp, mouse
gttgcaaacaagaaggtatt

SEQ ID NO: 621529 - DNA, 20 bp, mouse
gaatgatgattctcactggt

SEQ ID NO: 621530 - DNA, 20 bp, mouse
gctactgaataatacattga

SEQ ID NO: 621531 - DNA, 20 bp, mouse
ggatggttcttctacgttgc

SEQ ID NO: 621532 - DNA, 20 bp, mouse
gaaatccagcttggaagtaa

SEQ ID NO: 621533 - DNA, 20 bp, mouse
ggagagggaaaaaagcagag

SEQ ID NO: 621534 - DNA, 20 bp, mouse
ggtccatgggcttaggtctg

SEQ ID NO: 621535 - DNA, 20 bp, mouse
gtgtattattcagtagtaga

SEQ ID NO: 621536 - DNA, 20 bp, mouse
ggccccgtgccaccctttct

SEQ ID NO: 621537 - DNA, 20 bp, mouse
gacctagaaagggtggcacg

SEQ ID NO: 621538 - DNA, 20 bp, mouse
gtttatacttgcacttttaa

SEQ ID NO: 621539 - DNA, 20 bp, mouse
gtcctagaggatctggatgg

SEQ ID NO: 621540 - DNA, 20 bp, mouse
gaaacttcctagatgacata

SEQ ID NO: 621541 - DNA, 20 bp, mouse
gctctctttatgactgtgtt

SEQ ID NO: 621542 - DNA, 20 bp, mouse
gattgtttacctagaaaggg

SEQ ID NO: 621543 - DNA, 20 bp, mouse
ggatcattgtttacctagaa

SEQ ID NO: 621544 - DNA, 20 bp, mouse
gagtctcctcactgtggtac

SEQ ID NO: 621545 - DNA, 20 bp, mouse
gttatcagtcctagaggatc

SEQ ID NO: 621546 - DNA, 20 bp, mouse
gaggtaggaatacttgatct

SEQ ID NO: 621547 - DNA, 20 bp, mouse
gaagggattcgaaggacaat

SEQ ID NO: 621548 - DNA, 20 bp, mouse
gatgatcaagaaatcatgat

SEQ ID NO: 621549 - DNA, 20 bp, mouse
gtgatctgggaaatgccttt

SEQ ID NO: 621550 - DNA, 20 bp, mouse
gattgagtatccacaggcag

SEQ ID NO: 621551 - DNA, 20 bp, mouse
gtgaggaaagaatgtgctgt

SEQ ID NO: 621552 - DNA, 20 bp, mouse
gcagacactcaatgtgtcag

SEQ ID NO: 621553 - DNA, 20 bp, mouse
ggggtttctgctcagtactt

SEQ ID NO: 621554 - DNA, 20 bp, mouse
gtttttcaaaagggattcga

SEQ ID NO: 621555 - DNA, 20 bp, mouse
gtagacagcaactttacagc

SEQ ID NO: 621556 - DNA, 20 bp, mouse
gagaatgccaaccacagtca

SEQ ID NO: 621557 - DNA, 20 bp, mouse
gttcacctaggatgtaaaaa

SEQ ID NO: 621558 - DNA, 20 bp, mouse
gcttttcccatccatgactg

SEQ ID NO: 621559 - DNA, 20 bp, mouse
ggtgtatgagctttttctca

SEQ ID NO: 621560 - DNA, 20 bp, mouse
gtgtttgtttgttttcacct

SEQ ID NO: 621561 - DNA, 20 bp, mouse
gtacctggagaggatggccc

SEQ ID NO: 621562 - DNA, 20 bp, mouse
gaaaaccatttttacatcct

SEQ ID NO: 621563 - DNA, 20 bp, mouse
gattgtttacctggagagga

SEQ ID NO: 621564 - DNA, 20 bp, mouse
gccagatgctctgggactga

SEQ ID NO: 621565 - DNA, 20 bp, mouse
gcccaaaagaatgacaagaa

SEQ ID NO: 621566 - DNA, 20 bp, mouse
gtaaaatgtatttgcataca

SEQ ID NO: 621567 - DNA, 20 bp, mouse
gttctcatcatgacagtgct

SEQ ID NO: 621568 - DNA, 20 bp, mouse
gtaataatccttcttgtaaa

SEQ ID NO: 621569 - DNA, 20 bp, mouse
gaggcaatccttttacaaga

SEQ ID NO: 621570 - DNA, 20 bp, mouse
gggtagacaaggagtcagtg

SEQ ID NO: 621571 - DNA, 20 bp, mouse
gcaaacagacacatacacca

SEQ ID NO: 621572 - DNA, 20 bp, mouse
gctcaaccctcagggaatca

SEQ ID NO: 621573 - DNA, 20 bp, mouse
gcattcagatcaacactccc

SEQ ID NO: 621574 - DNA, 20 bp, mouse
gtgggaccctgattccctga

SEQ ID NO: 621575 - DNA, 20 bp, mouse
ggtgggtccctcaaccctca

SEQ ID NO: 621576 - DNA, 20 bp, mouse
gccagagtccacagaaagag

SEQ ID NO: 621577 - DNA, 20 bp, mouse
gtgggtctgagcaccacagt

SEQ ID NO: 621578 - DNA, 20 bp, mouse
gcatcagtaatgctagacat

SEQ ID NO: 621579 - DNA, 20 bp, mouse
gaatgctattataccaactg

SEQ ID NO: 621580 - DNA, 20 bp, mouse
gttctcttcatgaccatgct

SEQ ID NO: 621581 - DNA, 20 bp, mouse
gagtccacagaaagagaggc

SEQ ID NO: 621582 - DNA, 20 bp, mouse
gactcctgcctctctttctg

SEQ ID NO: 621583 - DNA, 20 bp, mouse
ggaaacttcctaaataactt

SEQ ID NO: 621584 - DNA, 20 bp, mouse
gcttacagcctaagttattt

SEQ ID NO: 621585 - DNA, 20 bp, mouse
gtagacgcatgttgcagatg

SEQ ID NO: 621586 - DNA, 20 bp, mouse
gtgccaagtggattacaata

SEQ ID NO: 621587 - DNA, 20 bp, mouse
ggaccttattgtaatccact

SEQ ID NO: 621588 - DNA, 20 bp, mouse
gttctggcaaggatggcaag

SEQ ID NO: 621589 - DNA, 20 bp, mouse
gatccaaaagacaagaataa

SEQ ID NO: 621590 - DNA, 20 bp, mouse
gtttgtccaaagggaagttc

SEQ ID NO: 621591 - DNA, 20 bp, mouse
gcatatatacatgcctgcct

SEQ ID NO: 621592 - DNA, 20 bp, mouse
gtgattactatttgtacaac

SEQ ID NO: 621593 - DNA, 20 bp, mouse
gtgactttaagcacaacact

SEQ ID NO: 621594 - DNA, 20 bp, mouse
gaagaataaagggaataatt

SEQ ID NO: 621595 - DNA, 20 bp, mouse
gcagtcccagaacttccctt

SEQ ID NO: 621596 - DNA, 20 bp, mouse
gactaggaaaaaaccttaga

SEQ ID NO: 621597 - DNA, 20 bp, mouse
gtttggagtgatctcgtcca

SEQ ID NO: 621598 - DNA, 20 bp, mouse
gaaaaaaccttagaaggcta

SEQ ID NO: 621599 - DNA, 20 bp, mouse
gttacttccttagccttcta

SEQ ID NO: 621600 - DNA, 20 bp, mouse
gaagaaaacagaaaatgcac

SEQ ID NO: 621601 - DNA, 20 bp, mouse
gcattttctgttttctttaa

SEQ ID NO: 621602 - DNA, 20 bp, mouse
gtttacaaccaacatcactt

SEQ ID NO: 621603 - DNA, 20 bp, mouse
gatgtatatactttcattat

SEQ ID NO: 621604 - DNA, 20 bp, mouse
gtcatttcacttactggatt

SEQ ID NO: 621605 - DNA, 20 bp, mouse
gtatcttcatggttaaaact

SEQ ID NO: 621606 - DNA, 20 bp, mouse
gaagatgaataaaattactc

SEQ ID NO: 621607 - DNA, 20 bp, mouse
gagatatttcctacaactcc

SEQ ID NO: 621608 - DNA, 20 bp, mouse
ggatattggctgtaaaatga

SEQ ID NO: 621609 - DNA, 20 bp, mouse
gtgtaaaatgatggtttatc

SEQ ID NO: 621610 - DNA, 20 bp, mouse
ggaacttggcatgacgtctg

SEQ ID NO: 621611 - DNA, 20 bp, mouse
gggatgagaataagatctat

SEQ ID NO: 621612 - DNA, 20 bp, mouse
gtatgtgtacacttctgcct

SEQ ID NO: 621613 - DNA, 20 bp, mouse
gtccaggtccagctagagaa

SEQ ID NO: 621614 - DNA, 20 bp, mouse
gtagctggacctggagttgt

SEQ ID NO: 621615 - DNA, 20 bp, mouse
gtcctttctctagctggacc

SEQ ID NO: 621616 - DNA, 20 bp, mouse
ggtaaggcaactttttacac

SEQ ID NO: 621617 - DNA, 20 bp, mouse
gactgatgttcctcactgca

SEQ ID NO: 621618 - DNA, 20 bp, mouse
gggcaactttttacactggt

SEQ ID NO: 621619 - DNA, 20 bp, mouse
gatgtgcatcacatgcctcc

SEQ ID NO: 621620 - DNA, 20 bp, mouse
gagcctggaacacacccagg

SEQ ID NO: 621621 - DNA, 20 bp, mouse
ggacagcctggaacacaccc

SEQ ID NO: 621622 - DNA, 20 bp, mouse
gccaaatatcccctgcagtg

SEQ ID NO: 621623 - DNA, 20 bp, mouse
gggaaaattgacataagatc

SEQ ID NO: 621624 - DNA, 20 bp, mouse
gacactggtagggtgatgag

SEQ ID NO: 621625 - DNA, 20 bp, mouse
gatttatcttaatagcataa

SEQ ID NO: 621626 - DNA, 20 bp, mouse
gaccacagtgaggacactgc

SEQ ID NO: 621627 - DNA, 20 bp, mouse
ggccccgggccactctctcc

SEQ ID NO: 621628 - DNA, 20 bp, mouse
gtccattcgattagaagtaa

SEQ ID NO: 621629 - DNA, 20 bp, mouse
gattgtttacctggagagag

SEQ ID NO: 621630 - DNA, 20 bp, mouse
gatttttcttttcatgacta

SEQ ID NO: 621631 - DNA, 20 bp, mouse
ggcctttacttctaatcgaa

SEQ ID NO: 621632 - DNA, 20 bp, mouse
gaaaagacaataatagtttt

SEQ ID NO: 621633 - DNA, 20 bp, mouse
gtctacctagaaagtaaaaa

SEQ ID NO: 621634 - DNA, 20 bp, mouse
gttcttttcatgactatggt

SEQ ID NO: 621635 - DNA, 20 bp, mouse
gacttctaatcgaatggatt

SEQ ID NO: 621636 - DNA, 20 bp, mouse
gagccaagtggataagaatg

SEQ ID NO: 621637 - DNA, 20 bp, mouse
gggtgcagatggacaggccc

SEQ ID NO: 621638 - DNA, 20 bp, mouse
gtcaatctagtaaataaaaa

SEQ ID NO: 621639 - DNA, 20 bp, mouse
gtaaagactttttcaagaaa

SEQ ID NO: 621640 - DNA, 20 bp, mouse
gtgaaaaagtctttaggtct

SEQ ID NO: 621641 - DNA, 20 bp, mouse
ggaaacagaaatattcccca

SEQ ID NO: 621642 - DNA, 20 bp, mouse
ggactatgattggcaccctg

SEQ ID NO: 621643 - DNA, 20 bp, mouse
gcttaacaccttctaataaa

SEQ ID NO: 621644 - DNA, 20 bp, mouse
ggaatgtgccatgcatactt

SEQ ID NO: 621645 - DNA, 20 bp, mouse
gcccaaaagaatgacaagaa

SEQ ID NO: 621646 - DNA, 20 bp, mouse
gtggagatgatgatgacaat

SEQ ID NO: 621647 - DNA, 20 bp, mouse
gtaatacactgttcattcca

SEQ ID NO: 621648 - DNA, 20 bp, mouse
gcaatggaacaaagaacaga

SEQ ID NO: 621649 - DNA, 20 bp, mouse
gatcatcatctccatgtcaa

SEQ ID NO: 621650 - DNA, 20 bp, mouse
gtgatctagttcatgtctgt

SEQ ID NO: 621651 - DNA, 20 bp, mouse
ggaaaaacctgagaaacaca

SEQ ID NO: 621652 - DNA, 20 bp, mouse
gagatacctgcttttattct

SEQ ID NO: 621653 - DNA, 20 bp, mouse
ggttctttgttccattgaca

SEQ ID NO: 621654 - DNA, 20 bp, mouse
gggttttctgttttcttccg

SEQ ID NO: 621655 - DNA, 20 bp, mouse
gtatcttcatggctaaagct

SEQ ID NO: 621656 - DNA, 20 bp, mouse
gacctcaaggatttgataat

SEQ ID NO: 621657 - DNA, 20 bp, mouse
gaatgacagaatggacctca

SEQ ID NO: 621658 - DNA, 20 bp, mouse
gtttactatagtaattgaat

SEQ ID NO: 621659 - DNA, 20 bp, mouse
gtggtctcttcacttctctt

SEQ ID NO: 621660 - DNA, 20 bp, mouse
gtagtaattgaataggtagc

SEQ ID NO: 621661 - DNA, 20 bp, mouse
gtggaagacactcaagaagc

SEQ ID NO: 621662 - DNA, 20 bp, mouse
gaagaagcaggtggtactaa

SEQ ID NO: 621663 - DNA, 20 bp, mouse
gtcattgaaaaagaggtcct

SEQ ID NO: 621664 - DNA, 20 bp, mouse
gttttgtatattcaaagact

SEQ ID NO: 621665 - DNA, 20 bp, mouse
gcaaaaagttggctgtgaat

SEQ ID NO: 621666 - DNA, 20 bp, mouse
gaaactactaaacgacagaa

SEQ ID NO: 621667 - DNA, 20 bp, mouse
gttttggtggatgcattcaa

SEQ ID NO: 621668 - DNA, 20 bp, mouse
gtccaacatcattgaagaac

SEQ ID NO: 621669 - DNA, 20 bp, mouse
gactcttgattttactctgc

SEQ ID NO: 621670 - DNA, 20 bp, mouse
gaaacgacagaatggagtcc

SEQ ID NO: 621671 - DNA, 20 bp, mouse
gtcaaaactacaaagttaat

SEQ ID NO: 621672 - DNA, 20 bp, mouse
gaaaataagacacaaaagag

SEQ ID NO: 621673 - DNA, 20 bp, mouse
gacatattttatatattcaa

SEQ ID NO: 621674 - DNA, 20 bp, mouse
gaagctgccattatctgggc

SEQ ID NO: 621675 - DNA, 20 bp, mouse
gaaaaaaagtatttactagc

SEQ ID NO: 621676 - DNA, 20 bp, mouse
gacttgaggaccatgatagt

SEQ ID NO: 621677 - DNA, 20 bp, mouse
gttcattgtaataaatgatt

SEQ ID NO: 621678 - DNA, 20 bp, mouse
ggaattgctgaataacagaa

SEQ ID NO: 621679 - DNA, 20 bp, mouse
ggtgctgatggacatactcc

SEQ ID NO: 621680 - DNA, 20 bp, mouse
gactacttcagggagtcctt

SEQ ID NO: 621681 - DNA, 20 bp, mouse
gagcagttattcagtgatgt

SEQ ID NO: 621682 - DNA, 20 bp, mouse
gaaaagctttcactacttca

SEQ ID NO: 621683 - DNA, 20 bp, mouse
ggaaagaatagttaagaagt

SEQ ID NO: 621684 - DNA, 20 bp, mouse
gtattggtagctgtataaat

SEQ ID NO: 621685 - DNA, 20 bp, mouse
gagcaatcaccattagcccc

SEQ ID NO: 621686 - DNA, 20 bp, mouse
ggcacctatgttcaaagtca

SEQ ID NO: 621687 - DNA, 20 bp, mouse
gcctatgttcaaagtcatgg

SEQ ID NO: 621688 - DNA, 20 bp, mouse
gctcaaatttctccagaatg

SEQ ID NO: 621689 - DNA, 20 bp, mouse
gaaaagttcaaaccatgttg

SEQ ID NO: 621690 - DNA, 20 bp, mouse
gatgtgtgttcaagcattac

SEQ ID NO: 621691 - DNA, 20 bp, mouse
gcagaatatccaccacattc

SEQ ID NO: 621692 - DNA, 20 bp, mouse
gaatgacagaatggacttta

SEQ ID NO: 621693 - DNA, 20 bp, mouse
ggcaattccttctcactgaa

SEQ ID NO: 621694 - DNA, 20 bp, mouse
gatgtctctgagccacaaca

SEQ ID NO: 621695 - DNA, 20 bp, mouse
ggatactccattcagtgaga

SEQ ID NO: 621696 - DNA, 20 bp, mouse
gttctccaaaggacttccag

SEQ ID NO: 621697 - DNA, 20 bp, mouse
gtgacttattcgatgatgtt

SEQ ID NO: 621698 - DNA, 20 bp, mouse
gagtacctctggaagtcctt

SEQ ID NO: 621699 - DNA, 20 bp, mouse
gaatttgctgaatgacataa

SEQ ID NO: 621700 - DNA, 20 bp, mouse
gcaaaaactgcaagtacctc

SEQ ID NO: 621701 - DNA, 20 bp, mouse
gtctcacttcagagtgcact

SEQ ID NO: 621702 - DNA, 20 bp, mouse
gggtacttgcagtttttgga

SEQ ID NO: 621703 - DNA, 20 bp, mouse
gagcaaacagcaaagttcat

SEQ ID NO: 621704 - DNA, 20 bp, mouse
gtgttggttgatgtatatac

SEQ ID NO: 621705 - DNA, 20 bp, mouse
ggaatgacataatggatttt

SEQ ID NO: 621706 - DNA, 20 bp, mouse
gattcctgttcccaaattcc

SEQ ID NO: 621707 - DNA, 20 bp, mouse
gaatatggatgccaggaatt

SEQ ID NO: 621708 - DNA, 20 bp, mouse
gttgaagcatgagaagtgtt

SEQ ID NO: 621709 - DNA, 20 bp, mouse
gaataatcaagtagtaggaa

SEQ ID NO: 621710 - DNA, 20 bp, mouse
gcagtcataatatggatgcc

SEQ ID NO: 621711 - DNA, 20 bp, mouse
gcttccaacaggagtttctt

SEQ ID NO: 621712 - DNA, 20 bp, mouse
gtaataaataatcaagtagt

SEQ ID NO: 621713 - DNA, 20 bp, mouse
gtcttgatcatgctctcgaa

SEQ ID NO: 621714 - DNA, 20 bp, mouse
gtttcttgggatgatagtga

SEQ ID NO: 621715 - DNA, 20 bp, mouse
gtctatcacaatgggagctt

SEQ ID NO: 621716 - DNA, 20 bp, mouse
gaattcccactgaacattga

SEQ ID NO: 621717 - DNA, 20 bp, mouse
gaagatggattccaaaaatc

SEQ ID NO: 621718 - DNA, 20 bp, mouse
gattatggttaatgacaaga

SEQ ID NO: 621719 - DNA, 20 bp, mouse
gctatgtatactgaaagagt

SEQ ID NO: 621720 - DNA, 20 bp, mouse
gctcatccttcaatgttcag

SEQ ID NO: 621721 - DNA, 20 bp, mouse
gacaatgcaaacttttggga

SEQ ID NO: 621722 - DNA, 20 bp, mouse
gccattaaggcacgagtcac

SEQ ID NO: 621723 - DNA, 20 bp, mouse
gttttactttaaggccatta

SEQ ID NO: 621724 - DNA, 20 bp, mouse
gacaaatattgccagatttt

SEQ ID NO: 621725 - DNA, 20 bp, mouse
gcatatttaaccccaaaaac

SEQ ID NO: 621726 - DNA, 20 bp, mouse
gtgctgtgtgacttggaaat

SEQ ID NO: 621727 - DNA, 20 bp, mouse
gggaacatggcaataggagt

SEQ ID NO: 621728 - DNA, 20 bp, mouse
gttctttgtagtataggatt

SEQ ID NO: 621729 - DNA, 20 bp, mouse
gtatgctatgctgtgtgact

SEQ ID NO: 621730 - DNA, 20 bp, mouse
ggaatgacctaatggagtcc

SEQ ID NO: 621731 - DNA, 20 bp, mouse
ggaagtaagttttctaagtt

SEQ ID NO: 621732 - DNA, 20 bp, mouse
gaaaagctcccattatctgg

SEQ ID NO: 621733 - DNA, 20 bp, mouse
gcctttggagataatgatca

SEQ ID NO: 621734 - DNA, 20 bp, mouse
gaaggtttcccccagataat

SEQ ID NO: 621735 - DNA, 20 bp, mouse
gaaaacgttgaatgacctaa

SEQ ID NO: 621736 - DNA, 20 bp, mouse
gatgccagtgaactgtctgt

SEQ ID NO: 621737 - DNA, 20 bp, mouse
gactcctacagacagttcac

SEQ ID NO: 621738 - DNA, 20 bp, mouse
gtagtatcctcaatgagagg

SEQ ID NO: 621739 - DNA, 20 bp, mouse
ggcttagtatcctcaatgag

SEQ ID NO: 621740 - DNA, 20 bp, mouse
ggatggcctggtagacactg

SEQ ID NO: 621741 - DNA, 20 bp, mouse
gaagaaacatatagtggtag

SEQ ID NO: 621742 - DNA, 20 bp, mouse
gtcttaacagtactgttcaa

SEQ ID NO: 621743 - DNA, 20 bp, mouse
gcctttcgcagaataggtag

SEQ ID NO: 621744 - DNA, 20 bp, mouse
gatgtttctttacttaacaa

SEQ ID NO: 621745 - DNA, 20 bp, mouse
ggccaaaagctgctattgtc

SEQ ID NO: 621746 - DNA, 20 bp, mouse
gccgaggattctgcatgagg

SEQ ID NO: 621747 - DNA, 20 bp, mouse
gctgcatgaggaggtaggca

SEQ ID NO: 621748 - DNA, 20 bp, mouse
gatgcagaatcctcgggatc

SEQ ID NO: 621749 - DNA, 20 bp, mouse
gaaaggtgttccacaagcaa

SEQ ID NO: 621750 - DNA, 20 bp, mouse
gatcctcgggatcaggcaga

SEQ ID NO: 621751 - DNA, 20 bp, mouse
gttgtggaacacctttacat

SEQ ID NO: 621752 - DNA, 20 bp, mouse
gtctggtgatatggctatag

SEQ ID NO: 621753 - DNA, 20 bp, mouse
ggcctcttcccaccctatga

SEQ ID NO: 621754 - DNA, 20 bp, mouse
gaccttcatagggtgggaag

SEQ ID NO: 621755 - DNA, 20 bp, mouse
gagaatccaagtcaagtata

SEQ ID NO: 621756 - DNA, 20 bp, mouse
ggtcgtttgatgtaagactg

SEQ ID NO: 621757 - DNA, 20 bp, mouse
gtatttgtctaagttgagaa

SEQ ID NO: 621758 - DNA, 20 bp, mouse
gaggacatataatacctgta

SEQ ID NO: 621759 - DNA, 20 bp, mouse
gggtttcagacgatctttcc

SEQ ID NO: 621760 - DNA, 20 bp, mouse
gagatcgtctgaaaccatac

SEQ ID NO: 621761 - DNA, 20 bp, mouse
gtttggacgtaattcatgat

SEQ ID NO: 621762 - DNA, 20 bp, mouse
gtattatatgtcctcaagtt

SEQ ID NO: 621763 - DNA, 20 bp, mouse
gctaaactgtgttcatcaca

SEQ ID NO: 621764 - DNA, 20 bp, mouse
ggtagaaatattttgttatc

SEQ ID NO: 621765 - DNA, 20 bp, mouse
gtgaattacgtccaaacttg

SEQ ID NO: 621766 - DNA, 20 bp, mouse
gatcctgcacggcaaggtga

SEQ ID NO: 621767 - DNA, 20 bp, mouse
ggactataattggaattcta

SEQ ID NO: 621768 - DNA, 20 bp, mouse
gaagccagtgagttgtctat

SEQ ID NO: 621769 - DNA, 20 bp, mouse
gtaggaaggggtacaggtat

SEQ ID NO: 621770 - DNA, 20 bp, mouse
gtcaaactgaggatcctgca

SEQ ID NO: 621771 - DNA, 20 bp, mouse
gcctaacaaggtacaagtta

SEQ ID NO: 621772 - DNA, 20 bp, mouse
gacatgttgaatatatctta

SEQ ID NO: 621773 - DNA, 20 bp, mouse
gattcctatagacaactcac

SEQ ID NO: 621774 - DNA, 20 bp, mouse
gcaagttaaggtctacagac

SEQ ID NO: 621775 - DNA, 20 bp, mouse
gacagagtaggaaggggtac

SEQ ID NO: 621776 - DNA, 20 bp, mouse
gtaagagttctgacatggga

SEQ ID NO: 621777 - DNA, 20 bp, mouse
gagactgtagttgggatcct

SEQ ID NO: 621778 - DNA, 20 bp, mouse
gggtcttaagagttctgaca

SEQ ID NO: 621779 - DNA, 20 bp, mouse
gcccaaaggcagacacagta

SEQ ID NO: 621780 - DNA, 20 bp, mouse
gaaaggcagacacagtatgg

SEQ ID NO: 621781 - DNA, 20 bp, mouse
ggtagtaaagcatcagataa

SEQ ID NO: 621782 - DNA, 20 bp, mouse
gatcttcacagaatagggag

SEQ ID NO: 621783 - DNA, 20 bp, mouse
gtccatgctttcaaaatttg

SEQ ID NO: 621784 - DNA, 20 bp, mouse
ggcccaactcatgtacacac

SEQ ID NO: 621785 - DNA, 20 bp, mouse
ggactaagaaggagttgccc

SEQ ID NO: 621786 - DNA, 20 bp, mouse
gaggcttaggactgtgacat

SEQ ID NO: 621787 - DNA, 20 bp, mouse
gacagcctggaatacactca

SEQ ID NO: 621788 - DNA, 20 bp, mouse
gcctcactggatgggatatc

SEQ ID NO: 621789 - DNA, 20 bp, mouse
gattcatcttaaaatcataa

SEQ ID NO: 621790 - DNA, 20 bp, mouse
ggacaggagatcaggtccac

SEQ ID NO: 621791 - DNA, 20 bp, mouse
gtttatttccaagctggtct

SEQ ID NO: 621792 - DNA, 20 bp, mouse
gtggaatacactcagggggc

SEQ ID NO: 621793 - DNA, 20 bp, mouse
gtcttgattgaagacataaa

SEQ ID NO: 621794 - DNA, 20 bp, mouse
gtaggactcctagaccagct

SEQ ID NO: 621795 - DNA, 20 bp, mouse
gagatcaggtccacaggctt

SEQ ID NO: 621796 - DNA, 20 bp, mouse
gtatatgagcaagggtcagt

SEQ ID NO: 621797 - DNA, 20 bp, mouse
gtgagcaagggtcagttggc

SEQ ID NO: 621798 - DNA, 20 bp, mouse
gaccaccaacatagactaac

SEQ ID NO: 621799 - DNA, 20 bp, mouse
gttgtttttgctagctggag

SEQ ID NO: 621800 - DNA, 20 bp, mouse
gcaaaaacaatatatgagca

SEQ ID NO: 621801 - DNA, 20 bp, mouse
gagcctggaacacactcagt

SEQ ID NO: 621802 - DNA, 20 bp, mouse
gtggcaggaggtcagatcca

SEQ ID NO: 621803 - DNA, 20 bp, mouse
gtaaaggatattcgttaatg

SEQ ID NO: 621804 - DNA, 20 bp, mouse
ggggctttgatctatgacat

SEQ ID NO: 621805 - DNA, 20 bp, mouse
gagtccccatacctcattgt

SEQ ID NO: 621806 - DNA, 20 bp, mouse
ggtactgggactcatagtga

SEQ ID NO: 621807 - DNA, 20 bp, mouse
ggggactcatagtgacggcc

SEQ ID NO: 621808 - DNA, 20 bp, mouse
gttgctgatcttcatttggt

SEQ ID NO: 621809 - DNA, 20 bp, mouse
gaatgatgttccttactgca

SEQ ID NO: 621810 - DNA, 20 bp, mouse
gtgaacaaagtttagttgac

SEQ ID NO: 621811 - DNA, 20 bp, mouse
gtctatattttcatagtctt

SEQ ID NO: 621812 - DNA, 20 bp, mouse
ggtatttgctgatcttcatt

SEQ ID NO: 621813 - DNA, 20 bp, mouse
ggtaaccagctcttctctgc

SEQ ID NO: 621814 - DNA, 20 bp, mouse
gtgacaggagatcaggtcta

SEQ ID NO: 621815 - DNA, 20 bp, mouse
gagcaccagcagagaagagc

SEQ ID NO: 621816 - DNA, 20 bp, mouse
gctgaccttcattcatataa

SEQ ID NO: 621817 - DNA, 20 bp, mouse
gatataatggtgtgcctcac

SEQ ID NO: 621818 - DNA, 20 bp, mouse
gggatttagtgatctgcatc

SEQ ID NO: 621819 - DNA, 20 bp, mouse
gaatggtgtgcctcactgga

SEQ ID NO: 621820 - DNA, 20 bp, mouse
gtgaatgaaggtcagctgac

SEQ ID NO: 621821 - DNA, 20 bp, mouse
gcacaccattatatgaatga

SEQ ID NO: 621822 - DNA, 20 bp, mouse
gaagaagagacatatttgct

SEQ ID NO: 621823 - DNA, 20 bp, mouse
gtctatattttcataattgt

SEQ ID NO: 621824 - DNA, 20 bp, mouse
gttgccaaacaagaagtact

SEQ ID NO: 621825 - DNA, 20 bp, mouse
gactcccagtacttcttgtt

SEQ ID NO: 621826 - DNA, 20 bp, mouse
gattatttttgctagcggga

SEQ ID NO: 621827 - DNA, 20 bp, mouse
gtgagcaaatgtcagttggc

SEQ ID NO: 621828 - DNA, 20 bp, mouse
gcatatattatttttgctag

SEQ ID NO: 621829 - DNA, 20 bp, mouse
gtagaatatcatgtgactat

SEQ ID NO: 621830 - DNA, 20 bp, mouse
gtatatgagcaaatgtcagt

SEQ ID NO: 621831 - DNA, 20 bp, mouse
gatgtcagttggcaggaggt

SEQ ID NO: 621832 - DNA, 20 bp, mouse
gattcatcttaagagcatat

SEQ ID NO: 621833 - DNA, 20 bp, mouse
gtggcaggaggtcggatcca

SEQ ID NO: 621834 - DNA, 20 bp, mouse
ggggctttgatctatgacct

SEQ ID NO: 621835 - DNA, 20 bp, mouse
gctatgctgttttatatatt

SEQ ID NO: 621836 - DNA, 20 bp, mouse
ggggctgttggcaaaagtat

SEQ ID NO: 621837 - DNA, 20 bp, mouse
ggacaggaaaggctagtagg

SEQ ID NO: 621838 - DNA, 20 bp, mouse
ggacagtagaagggggctgt

SEQ ID NO: 621839 - DNA, 20 bp, mouse
gggtttcatgacagtagaag

SEQ ID NO: 621840 - DNA, 20 bp, mouse
gtggcaaaagtatgggtgtc

SEQ ID NO: 621841 - DNA, 20 bp, mouse
ggtagggggaagacaagcaa

SEQ ID NO: 621842 - DNA, 20 bp, mouse
gaattcatagtgagatatac

SEQ ID NO: 621843 - DNA, 20 bp, mouse
gaatattgagagctgtaagt

SEQ ID NO: 621844 - DNA, 20 bp, mouse
gattgagagctgtaagtagg

SEQ ID NO: 621845 - DNA, 20 bp, mouse
gcttagggcctcattctgta

SEQ ID NO: 621846 - DNA, 20 bp, mouse
ggtgacaactatacttccag

SEQ ID NO: 621847 - DNA, 20 bp, mouse
ggctgattcagagcagccac

SEQ ID NO: 621848 - DNA, 20 bp, mouse
gtccacttatgagcacgctt

SEQ ID NO: 621849 - DNA, 20 bp, mouse
gtaccaatataatattaatc

SEQ ID NO: 621850 - DNA, 20 bp, mouse
gttgactgtacaatatactc

SEQ ID NO: 621851 - DNA, 20 bp, mouse
gtgaacccattgtgatacat

SEQ ID NO: 621852 - DNA, 20 bp, mouse
gcccaaagcgtgctcataag

SEQ ID NO: 621853 - DNA, 20 bp, mouse
gcgtaatagtgtgcaggtct

SEQ ID NO: 621854 - DNA, 20 bp, mouse
ggtatagttgtcactatttc

SEQ ID NO: 621855 - DNA, 20 bp, mouse
gttttacaatctacactaat

SEQ ID NO: 621856 - DNA, 20 bp, mouse
gggatttagtcaccttcagc

SEQ ID NO: 621857 - DNA, 20 bp, mouse
gtatccttaattttcaaact

SEQ ID NO: 621858 - DNA, 20 bp, mouse
gtgaatgaaggtcaactgaa

SEQ ID NO: 621859 - DNA, 20 bp, mouse
gcttggcttaaagatttctt

SEQ ID NO: 621860 - DNA, 20 bp, mouse
gaagcccagtttgaaaatta

SEQ ID NO: 621861 - DNA, 20 bp, mouse
gagcgccagtatagatgatc

SEQ ID NO: 621862 - DNA, 20 bp, mouse
gttagtcaccttcagctggt

SEQ ID NO: 621863 - DNA, 20 bp, mouse
gtcttagggtcattgaacat

SEQ ID NO: 621864 - DNA, 20 bp, mouse
gtctcactggagggcatgct

SEQ ID NO: 621865 - DNA, 20 bp, mouse
gagtgagaccaaccagctga

SEQ ID NO: 621866 - DNA, 20 bp, mouse
gcgatcttactgtggactat

SEQ ID NO: 621867 - DNA, 20 bp, mouse
ggtccatgaaggctaggacg

SEQ ID NO: 621868 - DNA, 20 bp, mouse
gtccgggtcaccaggattct

SEQ ID NO: 621869 - DNA, 20 bp, mouse
gcgacacccagcaggctcag

SEQ ID NO: 621870 - DNA, 20 bp, mouse
gtaggcacagcatagcatcc

SEQ ID NO: 621871 - DNA, 20 bp, mouse
gcatctgtaacccagaatcc

SEQ ID NO: 621872 - DNA, 20 bp, mouse
gcgaggcacagtttctgagt

SEQ ID NO: 621873 - DNA, 20 bp, mouse
gacctgcgcagtagcatcct

SEQ ID NO: 621874 - DNA, 20 bp, mouse
ggcgcagtagcatcctgggt

SEQ ID NO: 621875 - DNA, 20 bp, mouse
gggcacagtttctgagtggg

SEQ ID NO: 621876 - DNA, 20 bp, mouse
gttgtcagttcggagcatat

SEQ ID NO: 621877 - DNA, 20 bp, mouse
gaccaaggatcatgcagacg

SEQ ID NO: 621878 - DNA, 20 bp, mouse
gttctctgaggtcaaattgt

SEQ ID NO: 621879 - DNA, 20 bp, mouse
gttgcatgtctttgtcagtt

SEQ ID NO: 621880 - DNA, 20 bp, mouse
gacagaaacttctagaacta

SEQ ID NO: 621881 - DNA, 20 bp, mouse
gtggacatgtttctatctca

SEQ ID NO: 621882 - DNA, 20 bp, mouse
gaatctcctcatcatatctc

SEQ ID NO: 621883 - DNA, 20 bp, mouse
gcccacgtctgcatgatcct

SEQ ID NO: 621884 - DNA, 20 bp, mouse
gagcaataatcgatatgaag

SEQ ID NO: 621885 - DNA, 20 bp, mouse
ggcagacgtgggcaataaaa

SEQ ID NO: 621886 - DNA, 20 bp, mouse
ggtatcagtgtagagtaggt

SEQ ID NO: 621887 - DNA, 20 bp, mouse
ggtttgtatcagtgtagagt

SEQ ID NO: 621888 - DNA, 20 bp, mouse
gaccaaggagtatgcagatg

SEQ ID NO: 621889 - DNA, 20 bp, mouse
gttattcatcatatgtggat

SEQ ID NO: 621890 - DNA, 20 bp, mouse
gtggctttattcatcatatg

SEQ ID NO: 621891 - DNA, 20 bp, mouse
gaagcaatatagaggttaat

SEQ ID NO: 621892 - DNA, 20 bp, mouse
gagataagaaagcaatatag

SEQ ID NO: 621893 - DNA, 20 bp, mouse
gatctgcacaggcttttaag

SEQ ID NO: 621894 - DNA, 20 bp, mouse
gagcaataattgataagaag

SEQ ID NO: 621895 - DNA, 20 bp, mouse
gtatagaggttaatgggctt

SEQ ID NO: 621896 - DNA, 20 bp, mouse
gagtgtcttgcacccaagtg

SEQ ID NO: 621897 - DNA, 20 bp, mouse
gtgatggtggaagaatcctc

SEQ ID NO: 621898 - DNA, 20 bp, mouse
gacccaagtgtggaatcaca

SEQ ID NO: 621899 - DNA, 20 bp, mouse
gcaagacgactctgtgccag

SEQ ID NO: 621900 - DNA, 20 bp, mouse
gtgacatcgcctcagcacag

SEQ ID NO: 621901 - DNA, 20 bp, mouse
gcacaaggtggtatgggccc

SEQ ID NO: 621902 - DNA, 20 bp, mouse
ggactcccttaatcctgttc

SEQ ID NO: 621903 - DNA, 20 bp, mouse
gcaccttgtgattccacact

SEQ ID NO: 621904 - DNA, 20 bp, mouse
gtggaatcacaaggtggtat

SEQ ID NO: 621905 - DNA, 20 bp, mouse
gaatagagtcctctgtgctg

SEQ ID NO: 621906 - DNA, 20 bp, mouse
gagagttgcccaggagggat

SEQ ID NO: 621907 - DNA, 20 bp, mouse
gtatgtgagaacattgactg

SEQ ID NO: 621908 - DNA, 20 bp, mouse
ggggagcagagttgcccagg

SEQ ID NO: 621909 - DNA, 20 bp, mouse
ggaatatcacccatccctcc

SEQ ID NO: 621910 - DNA, 20 bp, mouse
gtacatactcattctatcat

SEQ ID NO: 621911 - DNA, 20 bp, mouse
gtatctcctcatcacatatc

SEQ ID NO: 621912 - DNA, 20 bp, mouse
gttcagtggattatgctgag

SEQ ID NO: 621913 - DNA, 20 bp, mouse
ggaggggagcagagttgccc

SEQ ID NO: 621914 - DNA, 20 bp, mouse
gtggcacctgatatgtgatg

SEQ ID NO: 621915 - DNA, 20 bp, mouse
gacgaatgaactttaggatg

SEQ ID NO: 621916 - DNA, 20 bp, mouse
ggggaacagagttgccaagg

SEQ ID NO: 621917 - DNA, 20 bp, mouse
gtttattggattatggtgag

SEQ ID NO: 621918 - DNA, 20 bp, mouse
gtgaggtctttattggatta

SEQ ID NO: 621919 - DNA, 20 bp, mouse
gtatgtgagaacagtgaaca

SEQ ID NO: 621920 - DNA, 20 bp, mouse
gacatactaattctaacatt

SEQ ID NO: 621921 - DNA, 20 bp, mouse
gaaattggcattggcatcac

SEQ ID NO: 621922 - DNA, 20 bp, mouse
gtgcttgaactttgataaac

SEQ ID NO: 621923 - DNA, 20 bp, mouse
gaatcttactcatccctcct

SEQ ID NO: 621924 - DNA, 20 bp, mouse
gcttctgggactaagaatga

SEQ ID NO: 621925 - DNA, 20 bp, mouse
gacccctcaaaactctgtac

SEQ ID NO: 621926 - DNA, 20 bp, mouse
ggtttggcatttctgggtaa

SEQ ID NO: 621927 - DNA, 20 bp, mouse
gctgccagctcagtgttgtt

SEQ ID NO: 621928 - DNA, 20 bp, mouse
gatgccaaacaacactgagc

SEQ ID NO: 621929 - DNA, 20 bp, mouse
gcagtgttgtttggcatttc

SEQ ID NO: 621930 - DNA, 20 bp, mouse
gacactcacttcagcaagca

SEQ ID NO: 621931 - DNA, 20 bp, mouse
gttttatgtttgtgtcaatg

SEQ ID NO: 621932 - DNA, 20 bp, mouse
gcaacactgagctggcagca

SEQ ID NO: 621933 - DNA, 20 bp, mouse
gagaaaatagcaaaaatctg

SEQ ID NO: 621934 - DNA, 20 bp, mouse
gaagcagcattagttgagtt

SEQ ID NO: 621935 - DNA, 20 bp, mouse
ggcagaggtaggctataaaa

SEQ ID NO: 621936 - DNA, 20 bp, mouse
gtatgcaacatgcaacataa

SEQ ID NO: 621937 - DNA, 20 bp, mouse
gcttttcaagatgcatgcaa

SEQ ID NO: 621938 - DNA, 20 bp, mouse
ggggaatggttttgatttag

SEQ ID NO: 621939 - DNA, 20 bp, mouse
gctgggacccagccaccttc

SEQ ID NO: 621940 - DNA, 20 bp, mouse
gaggagctctggagctgcag

SEQ ID NO: 621941 - DNA, 20 bp, mouse
gattgatatcttataaaatt

SEQ ID NO: 621942 - DNA, 20 bp, mouse
gtatacaattatggatgata

SEQ ID NO: 621943 - DNA, 20 bp, mouse
gtttgaaggacctcagtaca

SEQ ID NO: 621944 - DNA, 20 bp, mouse
gatggatgataaggtaaatt

SEQ ID NO: 621945 - DNA, 20 bp, mouse
gtaattactctatacaatta

SEQ ID NO: 621946 - DNA, 20 bp, mouse
ggtgtcggtgcagaatatgt

SEQ ID NO: 621947 - DNA, 20 bp, mouse
ggttacaagcagcattaggt

SEQ ID NO: 621948 - DNA, 20 bp, mouse
gaccaaggaacatgcagagg

SEQ ID NO: 621949 - DNA, 20 bp, mouse
gatgactttcatgtttgtgt

SEQ ID NO: 621950 - DNA, 20 bp, mouse
ggcaggtagcacaaagtgtg

SEQ ID NO: 621951 - DNA, 20 bp, mouse
gggatatgtttatgcctggg

SEQ ID NO: 621952 - DNA, 20 bp, mouse
gggtccaaaggacattcagc

SEQ ID NO: 621953 - DNA, 20 bp, mouse
gtacataagaaatgtgcatg

SEQ ID NO: 621954 - DNA, 20 bp, mouse
gcaggagtttcttggactaa

SEQ ID NO: 621955 - DNA, 20 bp, mouse
gctgtggatatgtttatgcc

SEQ ID NO: 621956 - DNA, 20 bp, mouse
gttattcatggtcaaattga

SEQ ID NO: 621957 - DNA, 20 bp, mouse
gggcagtgatggatataaag

SEQ ID NO: 621958 - DNA, 20 bp, mouse
gactgctaattgacatatac

SEQ ID NO: 621959 - DNA, 20 bp, mouse
gtcatcgcaagtgagaacag

SEQ ID NO: 621960 - DNA, 20 bp, mouse
gcaagtgagaacagtggcta

SEQ ID NO: 621961 - DNA, 20 bp, mouse
gacctgtacagaagtttgag

SEQ ID NO: 621962 - DNA, 20 bp, mouse
gtatcatcaagttctttcgt

SEQ ID NO: 621963 - DNA, 20 bp, mouse
gacccctcaaacttctgtac

SEQ ID NO: 621964 - DNA, 20 bp, mouse
gctgatgctactggttgcag

SEQ ID NO: 621965 - DNA, 20 bp, mouse
gttcatggtcaaattgaggg

SEQ ID NO: 621966 - DNA, 20 bp, mouse
gggcagtgatggatataagg

SEQ ID NO: 621967 - DNA, 20 bp, mouse
gtcatcgcaagtgagaacag

SEQ ID NO: 621968 - DNA, 20 bp, mouse
gcaagtgagaacagtggcta

SEQ ID NO: 621969 - DNA, 20 bp, mouse
gacctgtacagaagtttgag

SEQ ID NO: 621970 - DNA, 20 bp, mouse
gtatcatcaagttctttcgt

SEQ ID NO: 621971 - DNA, 20 bp, mouse
gacccctcaaacttctgtac

SEQ ID NO: 621972 - DNA, 20 bp, mouse
gctgatgctactggttgcag

SEQ ID NO: 621973 - DNA, 20 bp, mouse
gtcattcatggtcaaattgg

SEQ ID NO: 621974 - DNA, 20 bp, mouse
gaagtcattcatggtcaaat

SEQ ID NO: 621975 - DNA, 20 bp, mouse
gttagctaaacagtagcttc

SEQ ID NO: 621976 - DNA, 20 bp, mouse
gttactcattgtatgtaggt

SEQ ID NO: 621977 - DNA, 20 bp, mouse
gcccgcctctgcaagctcct

SEQ ID NO: 621978 - DNA, 20 bp, mouse
gactgctaaaagacatatag

SEQ ID NO: 621979 - DNA, 20 bp, mouse
gaagtagcattagttgggtc

SEQ ID NO: 621980 - DNA, 20 bp, mouse
ggcagaggcgggcaaaaaag

SEQ ID NO: 621981 - DNA, 20 bp, mouse
gtgctttactcattgtatgt

SEQ ID NO: 621982 - DNA, 20 bp, mouse
gtttaggcttgttctcacca

SEQ ID NO: 621983 - DNA, 20 bp, mouse
gaccaaggagcttgcagagg

SEQ ID NO: 621984 - DNA, 20 bp, mouse
gtttcatgttattgtcagtg

SEQ ID NO: 621985 - DNA, 20 bp, mouse
gacaggtagcagaaagggcg

SEQ ID NO: 621986 - DNA, 20 bp, mouse
gattcatctgaagagcttag

SEQ ID NO: 621987 - DNA, 20 bp, mouse
gttgccagcaatgtagtact

SEQ ID NO: 621988 - DNA, 20 bp, mouse
gtgtcccagtactacattgc

SEQ ID NO: 621989 - DNA, 20 bp, mouse
gaagatctggttactattga

SEQ ID NO: 621990 - DNA, 20 bp, mouse
ggcaggtggtgcacatagag

SEQ ID NO: 621991 - DNA, 20 bp, mouse
gatataatcatgtttctcac

SEQ ID NO: 621992 - DNA, 20 bp, mouse
gaacatgattatatgaacga

SEQ ID NO: 621993 - DNA, 20 bp, mouse
gctattgaaggacaaattga

SEQ ID NO: 621994 - DNA, 20 bp, mouse
gaaacaaacaagaaacagat

SEQ ID NO: 621995 - DNA, 20 bp, mouse
ggtaaccagatcttctttgt

SEQ ID NO: 621996 - DNA, 20 bp, mouse
ggcagaggtggacaacaaaa

SEQ ID NO: 621997 - DNA, 20 bp, mouse
gttgctttactcattgtatc

SEQ ID NO: 621998 - DNA, 20 bp, mouse
gttactcattgtatctgggt

SEQ ID NO: 621999 - DNA, 20 bp, mouse
gagcaataattgatactaat

SEQ ID NO: 622000 - DNA, 20 bp, mouse
gtttgggcttgttctcatga

SEQ ID NO: 622001 - DNA, 20 bp, mouse
gcttctaggactaagagtga

SEQ ID NO: 622002 - DNA, 20 bp, mouse
gctcatgaaggagcttgcag

SEQ ID NO: 622003 - DNA, 20 bp, mouse
gacactcacttcagagaata

SEQ ID NO: 622004 - DNA, 20 bp, mouse
gatgaaggagcttgcagagg

SEQ ID NO: 622005 - DNA, 20 bp, mouse
gtttcatgttattgtcagtg

SEQ ID NO: 622006 - DNA, 20 bp, mouse
ggctctttacacaccgaaca

SEQ ID NO: 622007 - DNA, 20 bp, mouse
ggccatgtgcttgtatcagg

SEQ ID NO: 622008 - DNA, 20 bp, mouse
gttaaaatggcagatttggg

SEQ ID NO: 622009 - DNA, 20 bp, mouse
ggggtcatacttggttaaaa

SEQ ID NO: 622010 - DNA, 20 bp, mouse
gtccacctgatacaagcaca

SEQ ID NO: 622011 - DNA, 20 bp, mouse
gtagacagttttactatgtt

SEQ ID NO: 622012 - DNA, 20 bp, mouse
gaatggcagatttgggtgga

SEQ ID NO: 622013 - DNA, 20 bp, mouse
gaaactgtctataacgtttc

SEQ ID NO: 622014 - DNA, 20 bp, mouse
ggcagtgttccagtacaaga

SEQ ID NO: 622015 - DNA, 20 bp, mouse
gcaaacatgaggcactgcat

SEQ ID NO: 622016 - DNA, 20 bp, mouse
gtgtatggtgcagtttctag

SEQ ID NO: 622017 - DNA, 20 bp, mouse
ggtttgaaggtcctcagcac

SEQ ID NO: 622018 - DNA, 20 bp, mouse
gttgtcatccataagttgta

SEQ ID NO: 622019 - DNA, 20 bp, mouse
gaggaatagtgttgatacac

SEQ ID NO: 622020 - DNA, 20 bp, mouse
ggttgattatgtaccatgaa

SEQ ID NO: 622021 - DNA, 20 bp, mouse
gactttttatgcatcttgaa

SEQ ID NO: 622022 - DNA, 20 bp, mouse
gcatacagtaccctgtgctg

SEQ ID NO: 622023 - DNA, 20 bp, mouse
gatggatgacaaagtaaatt

SEQ ID NO: 622024 - DNA, 20 bp, mouse
gaactgcaccatacaactta

SEQ ID NO: 622025 - DNA, 20 bp, mouse
gataaaatttaagtaatttt

SEQ ID NO: 622026 - DNA, 20 bp, mouse
gcaaaggtgatattttgtgt

SEQ ID NO: 622027 - DNA, 20 bp, mouse
gaatagctgctattaaaata

SEQ ID NO: 622028 - DNA, 20 bp, mouse
gtctttattcatgttatact

SEQ ID NO: 622029 - DNA, 20 bp, mouse
gttagggccacaaagccaat

SEQ ID NO: 622030 - DNA, 20 bp, mouse
gaaatatgagagctgatgtg

SEQ ID NO: 622031 - DNA, 20 bp, mouse
gaacactacagtacagtgta

SEQ ID NO: 622032 - DNA, 20 bp, mouse
gggcctggaagacactcaac

SEQ ID NO: 622033 - DNA, 20 bp, mouse
gcaccttcatgttcattcgt

SEQ ID NO: 622034 - DNA, 20 bp, mouse
gctttgagggcagaggatga

SEQ ID NO: 622035 - DNA, 20 bp, mouse
ggactcacggacttgcccat

SEQ ID NO: 622036 - DNA, 20 bp, mouse
gagcaaatagcaacaaactg

SEQ ID NO: 622037 - DNA, 20 bp, mouse
gcttgttgccaggttggtga

SEQ ID NO: 622038 - DNA, 20 bp, mouse
gaactcttcattacatatta

SEQ ID NO: 622039 - DNA, 20 bp, mouse
ggcagagatgggcaaaaata

SEQ ID NO: 622040 - DNA, 20 bp, mouse
gaccaaggagcatgcagaga

SEQ ID NO: 622041 - DNA, 20 bp, mouse
gggggtgaaatcttgttgcc

SEQ ID NO: 622042 - DNA, 20 bp, mouse
gttattcattgtacatgtgt

SEQ ID NO: 622043 - DNA, 20 bp, mouse
gattccaaccatcaccaacc

SEQ ID NO: 622044 - DNA, 20 bp, mouse
gttgccaggttggtgatggt

SEQ ID NO: 622045 - DNA, 20 bp, mouse
gtgaaatcttgttgccaggt

SEQ ID NO: 622046 - DNA, 20 bp, mouse
gacgaatgtacttgaagatg

SEQ ID NO: 622047 - DNA, 20 bp, mouse
gagcatcaccaggtggatta

SEQ ID NO: 622048 - DNA, 20 bp, mouse
gtaaatagcatttcttatct

SEQ ID NO: 622049 - DNA, 20 bp, mouse
gcaagtacattcgtgggcag

SEQ ID NO: 622050 - DNA, 20 bp, mouse
gctcttgtccctaatccacc

SEQ ID NO: 622051 - DNA, 20 bp, mouse
gatgggcaggtcaatatgtc

SEQ ID NO: 622052 - DNA, 20 bp, mouse
gtgtcaccccatctccccca

SEQ ID NO: 622053 - DNA, 20 bp, mouse
gaagactgagagaagcgggt

SEQ ID NO: 622054 - DNA, 20 bp, mouse
gatgctatttattctggagt

SEQ ID NO: 622055 - DNA, 20 bp, mouse
gttatgccatgggggagatg

SEQ ID NO: 622056 - DNA, 20 bp, mouse
ggtgtgcaagtttgcatttg

SEQ ID NO: 622057 - DNA, 20 bp, mouse
gttattctgagacaacatgg

SEQ ID NO: 622058 - DNA, 20 bp, mouse
gatactcttgttacagttgc

SEQ ID NO: 622059 - DNA, 20 bp, mouse
ggcacagtggtgtaatgatc

SEQ ID NO: 622060 - DNA, 20 bp, mouse
gcaagagtatctcacgacct

SEQ ID NO: 622061 - DNA, 20 bp, mouse
gaggtatcttcatagcacag

SEQ ID NO: 622062 - DNA, 20 bp, mouse
gagtggtgtaatgatcaggt

SEQ ID NO: 622063 - DNA, 20 bp, mouse
gggtcagttggagggttctt

SEQ ID NO: 622064 - DNA, 20 bp, mouse
gatgtgaatatgtcaagaga

SEQ ID NO: 622065 - DNA, 20 bp, mouse
ggcatttgaggtcagttgga

SEQ ID NO: 622066 - DNA, 20 bp, mouse
gttattctgagacaaccttt

SEQ ID NO: 622067 - DNA, 20 bp, mouse
ggtgctatgaagataccaaa

SEQ ID NO: 622068 - DNA, 20 bp, mouse
ggtcgggaatcagtcaagat

SEQ ID NO: 622069 - DNA, 20 bp, mouse
gcacagtcccaactacaaca

SEQ ID NO: 622070 - DNA, 20 bp, mouse
gctgagattttcaactgatt

SEQ ID NO: 622071 - DNA, 20 bp, mouse
ggctttgccatgttgtagtt

SEQ ID NO: 622072 - DNA, 20 bp, mouse
ggttcctggtaactgcgcta

SEQ ID NO: 622073 - DNA, 20 bp, mouse
gcttgactgattcccgactg

SEQ ID NO: 622074 - DNA, 20 bp, mouse
gtggtatcttcatagcacag

SEQ ID NO: 622075 - DNA, 20 bp, mouse
gggtcagttggagggttctt

SEQ ID NO: 622076 - DNA, 20 bp, mouse
gttctccttcctaaactcca

SEQ ID NO: 622077 - DNA, 20 bp, mouse
gtgtatacatgtcacgttaa

SEQ ID NO: 622078 - DNA, 20 bp, mouse
gatatatctcatgttttttc

SEQ ID NO: 622079 - DNA, 20 bp, mouse
ggcttaggaccagcaaatat

SEQ ID NO: 622080 - DNA, 20 bp, mouse
gtaggggaaaaaatgaagtc

SEQ ID NO: 622081 - DNA, 20 bp, mouse
gagaaatgatgtctatttca

SEQ ID NO: 622082 - DNA, 20 bp, mouse
gcatgtatacattaaataac

SEQ ID NO: 622083 - DNA, 20 bp, mouse
gtgagtgaccccatatttgc

SEQ ID NO: 622084 - DNA, 20 bp, mouse
gaaaggacaccttggagttt

SEQ ID NO: 622085 - DNA, 20 bp, mouse
gaggactttatgggagaggt

SEQ ID NO: 622086 - DNA, 20 bp, mouse
gtttgccaaaaaagtagtat

SEQ ID NO: 622087 - DNA, 20 bp, mouse
gagtcccaatactacttttt

SEQ ID NO: 622088 - DNA, 20 bp, mouse
gtctcactggaggggatgtt

SEQ ID NO: 622089 - DNA, 20 bp, mouse
gagcttggaacacactgagg

SEQ ID NO: 622090 - DNA, 20 bp, mouse
ggacagcttggaacacactg

SEQ ID NO: 622091 - DNA, 20 bp, mouse
gaacatcattatgtgaacca

SEQ ID NO: 622092 - DNA, 20 bp, mouse
ggggcttaggtctgtgtcct

SEQ ID NO: 622093 - DNA, 20 bp, mouse
gaagatcctgttactactga

SEQ ID NO: 622094 - DNA, 20 bp, mouse
gtattctcttaagatctcag

SEQ ID NO: 622095 - DNA, 20 bp, mouse
gaaacaaacaagaaacatgt

SEQ ID NO: 622096 - DNA, 20 bp, mouse
gtccagactgaaacccatac

SEQ ID NO: 622097 - DNA, 20 bp, mouse
ggtttacatttgacttcagt

SEQ ID NO: 622098 - DNA, 20 bp, mouse
gacctgtatgggtttcagtc

SEQ ID NO: 622099 - DNA, 20 bp, mouse
gcttgcacatttctttcacc

SEQ ID NO: 622100 - DNA, 20 bp, mouse
ggaagttatggacaaactga

SEQ ID NO: 622101 - DNA, 20 bp, mouse
gagaaggagcatgattgcat

SEQ ID NO: 622102 - DNA, 20 bp, mouse
ggcacatttctttcacctgg

SEQ ID NO: 622103 - DNA, 20 bp, mouse
gctctgattctaaagacaat

SEQ ID NO: 622104 - DNA, 20 bp, mouse
gcaagattcgagagaagtta

SEQ ID NO: 622105 - DNA, 20 bp, mouse
gacttcagttggaggcttcc

SEQ ID NO: 622106 - DNA, 20 bp, mouse
gcatatttgatcaagtgtta

SEQ ID NO: 622107 - DNA, 20 bp, mouse
gacaaattttaatacaacat

SEQ ID NO: 622108 - DNA, 20 bp, mouse
ggtgtgtatctccaattcca

SEQ ID NO: 622109 - DNA, 20 bp, mouse
gtctatttctaacactgcaa

SEQ ID NO: 622110 - DNA, 20 bp, mouse
gagtgttagggagatttctc

SEQ ID NO: 622111 - DNA, 20 bp, mouse
gcagtgttagaaatagaata

SEQ ID NO: 622112 - DNA, 20 bp, mouse
ggaaatagaatatggtaatc

SEQ ID NO: 622113 - DNA, 20 bp, mouse
gacacaagcaaagcagtaat

SEQ ID NO: 622114 - DNA, 20 bp, mouse
gagtccaaatgccttggaat

SEQ ID NO: 622115 - DNA, 20 bp, mouse
gtctccaattccaaggcatt

SEQ ID NO: 622116 - DNA, 20 bp, mouse
gtaggggaataaataaagtc

SEQ ID NO: 622117 - DNA, 20 bp, mouse
gatatagcttacgctttttc

SEQ ID NO: 622118 - DNA, 20 bp, mouse
gttctccctcctaaaatcca

SEQ ID NO: 622119 - DNA, 20 bp, mouse
gggacaccttggattttagg

SEQ ID NO: 622120 - DNA, 20 bp, mouse
gtgaaaacattgacataatt

SEQ ID NO: 622121 - DNA, 20 bp, mouse
gtaaagacatgtctatttca

SEQ ID NO: 622122 - DNA, 20 bp, mouse
gctaaaaaccagttatctaa

SEQ ID NO: 622123 - DNA, 20 bp, mouse
gcatgtatccattagataac

SEQ ID NO: 622124 - DNA, 20 bp, mouse
ggcaaagcatttaatagtga

SEQ ID NO: 622125 - DNA, 20 bp, mouse
gtgagcaacaccatatttgc

SEQ ID NO: 622126 - DNA, 20 bp, mouse
ggacaaactggtaggtactg

SEQ ID NO: 622127 - DNA, 20 bp, mouse
gcaacacttccatggttttt

SEQ ID NO: 622128 - DNA, 20 bp, mouse
gcttgcatacttctttaaca

SEQ ID NO: 622129 - DNA, 20 bp, mouse
ggcatacttctttaacatgg

SEQ ID NO: 622130 - DNA, 20 bp, mouse
ggtcgggagtcagtcaagac

SEQ ID NO: 622131 - DNA, 20 bp, mouse
gtaggtactgaggagacagg

SEQ ID NO: 622132 - DNA, 20 bp, mouse
gtctttaacatggtggctca

SEQ ID NO: 622133 - DNA, 20 bp, mouse
gcaacaatagctcacaacct

SEQ ID NO: 622134 - DNA, 20 bp, mouse
gtggtaggtactgaggagac

SEQ ID NO: 622135 - DNA, 20 bp, mouse
gatatgaatatgcaaacaga

SEQ ID NO: 622136 - DNA, 20 bp, mouse
gcacagtgaagatctttgag

SEQ ID NO: 622137 - DNA, 20 bp, mouse
gaatacactagatcttagga

SEQ ID NO: 622138 - DNA, 20 bp, mouse
ggcccagtctccacaagggt

SEQ ID NO: 622139 - DNA, 20 bp, mouse
gcctcacaagtgaccaaagt

SEQ ID NO: 622140 - DNA, 20 bp, mouse
gtcattctaatgattaatac

SEQ ID NO: 622141 - DNA, 20 bp, mouse
gtgcagtcccgggcgcctat

SEQ ID NO: 622142 - DNA, 20 bp, mouse
gaagggtggggttgctcaca

SEQ ID NO: 622143 - DNA, 20 bp, mouse
gggcagtcccataggcgccc

SEQ ID NO: 622144 - DNA, 20 bp, mouse
gtgtttctgcagtaactatc

SEQ ID NO: 622145 - DNA, 20 bp, mouse
gctctacagttcacctactt

SEQ ID NO: 622146 - DNA, 20 bp, mouse
gacaggagtgccctacacaa

SEQ ID NO: 622147 - DNA, 20 bp, mouse
gtaagtctaataagactttc

SEQ ID NO: 622148 - DNA, 20 bp, mouse
gaggcttgaggacgcacatg

SEQ ID NO: 622149 - DNA, 20 bp, mouse
gactcttataagatagttga

SEQ ID NO: 622150 - DNA, 20 bp, mouse
gtgaggacgcacatgtggat

SEQ ID NO: 622151 - DNA, 20 bp, mouse
gtaagatagttgaaggcttg

SEQ ID NO: 622152 - DNA, 20 bp, mouse
gtgattctcatgcacctctg

SEQ ID NO: 622153 - DNA, 20 bp, mouse
gcaaaagctgccattgtgta

SEQ ID NO: 622154 - DNA, 20 bp, mouse
ggatttgaaaaactactaag

SEQ ID NO: 622155 - DNA, 20 bp, mouse
gctaagtctattttatgatt

SEQ ID NO: 622156 - DNA, 20 bp, mouse
gtcaggcccaatcacagaat

SEQ ID NO: 622157 - DNA, 20 bp, mouse
gacaggaatgcctcacacat

SEQ ID NO: 622158 - DNA, 20 bp, mouse
gagaatgggcttcagaaatc

SEQ ID NO: 622159 - DNA, 20 bp, mouse
gtgaagcccattctgtgatt

SEQ ID NO: 622160 - DNA, 20 bp, mouse
gcaaaagctgccaatgtgtg

SEQ ID NO: 622161 - DNA, 20 bp, mouse
gtgtactaacggacacactc

SEQ ID NO: 622162 - DNA, 20 bp, mouse
gtcttatcacaaattacaag

SEQ ID NO: 622163 - DNA, 20 bp, mouse
gattgggcctgattctcttt

SEQ ID NO: 622164 - DNA, 20 bp, mouse
gttgattctcatgcacctaa

SEQ ID NO: 622165 - DNA, 20 bp, mouse
gaagagacaggttgtactaa

SEQ ID NO: 622166 - DNA, 20 bp, mouse
gagatggatttctggaatat

SEQ ID NO: 622167 - DNA, 20 bp, mouse
gcagaaatccatcttcgact

SEQ ID NO: 622168 - DNA, 20 bp, mouse
gaatcagacccagtcgaaga

SEQ ID NO: 622169 - DNA, 20 bp, mouse
gttcatttgggttagaaaat

SEQ ID NO: 622170 - DNA, 20 bp, mouse
ggccattacaatcagtcata

SEQ ID NO: 622171 - DNA, 20 bp, mouse
gcaaggcattcgatgtcatt

SEQ ID NO: 622172 - DNA, 20 bp, mouse
gacaatggcagcttttggct

SEQ ID NO: 622173 - DNA, 20 bp, mouse
gtcttatcacaaactacaac

SEQ ID NO: 622174 - DNA, 20 bp, mouse
gagtgccaatggatgtactt

SEQ ID NO: 622175 - DNA, 20 bp, mouse
gacaggagtgcttcacacaa

SEQ ID NO: 622176 - DNA, 20 bp, mouse
gctcatctaatagtaagtgg

SEQ ID NO: 622177 - DNA, 20 bp, mouse
gccatttagaatatatctat

SEQ ID NO: 622178 - DNA, 20 bp, mouse
ggtctgttctgttagagagc

SEQ ID NO: 622179 - DNA, 20 bp, mouse
gcatcatatacatcctgagt

SEQ ID NO: 622180 - DNA, 20 bp, mouse
gattctcatctaatagtaag

SEQ ID NO: 622181 - DNA, 20 bp, mouse
gataccagtaattcctactc

SEQ ID NO: 622182 - DNA, 20 bp, mouse
gtttttggcatgttcttatt

SEQ ID NO: 622183 - DNA, 20 bp, mouse
gcttattaagataaaaacta

SEQ ID NO: 622184 - DNA, 20 bp, mouse
gaatgttcagcggaactttt

SEQ ID NO: 622185 - DNA, 20 bp, mouse
gcttttctttaaatgttcag

SEQ ID NO: 622186 - DNA, 20 bp, mouse
gtcctttgttcacataatgg

SEQ ID NO: 622187 - DNA, 20 bp, mouse
gctgtcctttgttcacataa

SEQ ID NO: 622188 - DNA, 20 bp, mouse
gtatgctctattattttttc

SEQ ID NO: 622189 - DNA, 20 bp, mouse
gattcatattaacagcatat

SEQ ID NO: 622190 - DNA, 20 bp, mouse
gtaggactccaagtccggtt

SEQ ID NO: 622191 - DNA, 20 bp, mouse
gacataatggtggttctcat

SEQ ID NO: 622192 - DNA, 20 bp, mouse
gaaaaacagaagaactgtat

SEQ ID NO: 622193 - DNA, 20 bp, mouse
gcagaagaactgtattggct

SEQ ID NO: 622194 - DNA, 20 bp, mouse
gaatggtggttctcattgga

SEQ ID NO: 622195 - DNA, 20 bp, mouse
gtaaagaacatttttgaatg

SEQ ID NO: 622196 - DNA, 20 bp, mouse
gcctccagagacctaacctt

SEQ ID NO: 622197 - DNA, 20 bp, mouse
ggacagaaaaaagatcccca

SEQ ID NO: 622198 - DNA, 20 bp, mouse
gatcatcgctgacttcactg

SEQ ID NO: 622199 - DNA, 20 bp, mouse
gagattgtgctaggaatgct

SEQ ID NO: 622200 - DNA, 20 bp, mouse
gtaggcacagggaccagcac

SEQ ID NO: 622201 - DNA, 20 bp, mouse
gatccccaaggttaggtctc

SEQ ID NO: 622202 - DNA, 20 bp, mouse
ggtcactgttaggatcatga

SEQ ID NO: 622203 - DNA, 20 bp, mouse
gaacagacatgtgcaaccaa

SEQ ID NO: 622204 - DNA, 20 bp, mouse
gtcatggttgttctctgcaa

SEQ ID NO: 622205 - DNA, 20 bp, mouse
gtgctgacttggaattgttg

SEQ ID NO: 622206 - DNA, 20 bp, mouse
gtatatctttagtcttctaa

SEQ ID NO: 622207 - DNA, 20 bp, mouse
gccttcaggtgaggtcaaaa

SEQ ID NO: 622208 - DNA, 20 bp, mouse
gaatggaatgtggtagatgt

SEQ ID NO: 622209 - DNA, 20 bp, mouse
ggtgaggtcaaaatggaatg

SEQ ID NO: 622210 - DNA, 20 bp, mouse
gttttctgcttgggtcctgt

SEQ ID NO: 622211 - DNA, 20 bp, mouse
gcaatagtggcctatgagaa

SEQ ID NO: 622212 - DNA, 20 bp, mouse
ggtttcagattaaaaccaac

SEQ ID NO: 622213 - DNA, 20 bp, mouse
gactcaggataatgcaatag

SEQ ID NO: 622214 - DNA, 20 bp, mouse
gtttttctttccttcaggtg

SEQ ID NO: 622215 - DNA, 20 bp, mouse
gtctagaatgtgccgcactc

SEQ ID NO: 622216 - DNA, 20 bp, mouse
gagaggtattccgcagacac

SEQ ID NO: 622217 - DNA, 20 bp, mouse
gcagccctttggagttatta

SEQ ID NO: 622218 - DNA, 20 bp, mouse
gcttctgaaaatgttgcaat

SEQ ID NO: 622219 - DNA, 20 bp, mouse
gtgtattaacttttttcata

SEQ ID NO: 622220 - DNA, 20 bp, mouse
gaagatttcctggatgtcac

SEQ ID NO: 622221 - DNA, 20 bp, mouse
gggcattaaattctttccgg

SEQ ID NO: 622222 - DNA, 20 bp, mouse
gtcagccctaataactccaa

SEQ ID NO: 622223 - DNA, 20 bp, mouse
gtgtttaagcatcagccctt

SEQ ID NO: 622224 - DNA, 20 bp, mouse
gatgtgattttgatgtccac

SEQ ID NO: 622225 - DNA, 20 bp, mouse
gatttacagaataacaagag

SEQ ID NO: 622226 - DNA, 20 bp, mouse
gagcattcccactgtagtct

SEQ ID NO: 622227 - DNA, 20 bp, mouse
gttctgaagactttgcaatg

SEQ ID NO: 622228 - DNA, 20 bp, mouse
gtagccccaacaactacagg

SEQ ID NO: 622229 - DNA, 20 bp, mouse
gattggtccctcctgctcag

SEQ ID NO: 622230 - DNA, 20 bp, mouse
gcataattcaacagtgtctg

SEQ ID NO: 622231 - DNA, 20 bp, mouse
gaattagccccaacaactac

SEQ ID NO: 622232 - DNA, 20 bp, mouse
gactaagagtatcaggtccc

SEQ ID NO: 622233 - DNA, 20 bp, mouse
gagtatgcacattgaataca

SEQ ID NO: 622234 - DNA, 20 bp, mouse
gacaagccagcccactgagc

SEQ ID NO: 622235 - DNA, 20 bp, mouse
gcacccacctgtagttgttg

SEQ ID NO: 622236 - DNA, 20 bp, mouse
gagattgccatgggaataat

SEQ ID NO: 622237 - DNA, 20 bp, mouse
gtcttcttccagattgccat

SEQ ID NO: 622238 - DNA, 20 bp, mouse
ggaattgccaattattccca

SEQ ID NO: 622239 - DNA, 20 bp, mouse
gtgcttatcgaataacaaga

SEQ ID NO: 622240 - DNA, 20 bp, mouse
gcatccatctggaatagttg

SEQ ID NO: 622241 - DNA, 20 bp, mouse
gttcttctttaataggaatc

SEQ ID NO: 622242 - DNA, 20 bp, mouse
gcttttgaaaatattgtact

SEQ ID NO: 622243 - DNA, 20 bp, mouse
gtattaacaggatgcatctt

SEQ ID NO: 622244 - DNA, 20 bp, mouse
gcaacaaaaatactattaac

SEQ ID NO: 622245 - DNA, 20 bp, mouse
gacaagccagcaaagtgagc

SEQ ID NO: 622246 - DNA, 20 bp, mouse
gcacgggcaatgtcagattg

SEQ ID NO: 622247 - DNA, 20 bp, mouse
gatgtcagattgtggactta

SEQ ID NO: 622248 - DNA, 20 bp, mouse
gctaccaggcattttgcaat

SEQ ID NO: 622249 - DNA, 20 bp, mouse
gattcccattgcaaaatgcc

SEQ ID NO: 622250 - DNA, 20 bp, mouse
gtatcaaccctagcaactgc

SEQ ID NO: 622251 - DNA, 20 bp, mouse
gacatctttttgatactcac

SEQ ID NO: 622252 - DNA, 20 bp, mouse
gtgtgactaacatgagttat

SEQ ID NO: 622253 - DNA, 20 bp, mouse
gagtattcccaatgtaatct

SEQ ID NO: 622254 - DNA, 20 bp, mouse
gatctcaagaggcattccac

SEQ ID NO: 622255 - DNA, 20 bp, mouse
gagaaatgagaatggctacc

SEQ ID NO: 622256 - DNA, 20 bp, mouse
ggtttatagaataacaaggg

SEQ ID NO: 622257 - DNA, 20 bp, mouse
gaacttacaatgtgtttctc

SEQ ID NO: 622258 - DNA, 20 bp, mouse
gttcctcctgctcaatcagt

SEQ ID NO: 622259 - DNA, 20 bp, mouse
gttttcaataggaataaaag

SEQ ID NO: 622260 - DNA, 20 bp, mouse
gaataaaataaatttattat

SEQ ID NO: 622261 - DNA, 20 bp, mouse
gacatagtaaaatagtatta

SEQ ID NO: 622262 - DNA, 20 bp, mouse
ggaggaaccaaagtacttgg

SEQ ID NO: 622263 - DNA, 20 bp, mouse
ggccttttgagatgatacac

SEQ ID NO: 622264 - DNA, 20 bp, mouse
gacagagccaccaagtactt

SEQ ID NO: 622265 - DNA, 20 bp, mouse
gtatgtttatagaataacaa

SEQ ID NO: 622266 - DNA, 20 bp, mouse
ggtgtcaggccccagttcca

SEQ ID NO: 622267 - DNA, 20 bp, mouse
gccaagagactaagcagaag

SEQ ID NO: 622268 - DNA, 20 bp, mouse
gctgttagtcacattttcct

SEQ ID NO: 622269 - DNA, 20 bp, mouse
gtttggctttaatattttcc

SEQ ID NO: 622270 - DNA, 20 bp, mouse
gtcacattttccttggaact

SEQ ID NO: 622271 - DNA, 20 bp, mouse
gtttctgaaaacgttacaat

SEQ ID NO: 622272 - DNA, 20 bp, mouse
gcagatccagcaacttcaag

SEQ ID NO: 622273 - DNA, 20 bp, mouse
gaattatttactttttaaat

SEQ ID NO: 622274 - DNA, 20 bp, mouse
gtttacatccaatgtcatcc

SEQ ID NO: 622275 - DNA, 20 bp, mouse
gagattatagtgggagtgct

SEQ ID NO: 622276 - DNA, 20 bp, mouse
gactcctgcaagcttggcaa

SEQ ID NO: 622277 - DNA, 20 bp, mouse
gcagccccagcaacaccagg

SEQ ID NO: 622278 - DNA, 20 bp, mouse
gggacatccccctcattatt

SEQ ID NO: 622279 - DNA, 20 bp, mouse
gttcccgttgccaagcttgc

SEQ ID NO: 622280 - DNA, 20 bp, mouse
ggcttaactatcatttcaaa

SEQ ID NO: 622281 - DNA, 20 bp, mouse
ggatgatattggttgtaaat

SEQ ID NO: 622282 - DNA, 20 bp, mouse
gttgggatttaaatatttcc

SEQ ID NO: 622283 - DNA, 20 bp, mouse
gtgctttataatcacatctt

SEQ ID NO: 622284 - DNA, 20 bp, mouse
gttatccacctggtgttgct

SEQ ID NO: 622285 - DNA, 20 bp, mouse
gtgtttaaacattatccacc

SEQ ID NO: 622286 - DNA, 20 bp, mouse
gattcatcttagtagcatat

SEQ ID NO: 622287 - DNA, 20 bp, mouse
gaccatcattatgtgcacaa

SEQ ID NO: 622288 - DNA, 20 bp, mouse
gtcctttgtgcacataatga

SEQ ID NO: 622289 - DNA, 20 bp, mouse
gtatatctgaaaaaaaataa

SEQ ID NO: 622290 - DNA, 20 bp, mouse
gtaggactccaagtccggtt

SEQ ID NO: 622291 - DNA, 20 bp, mouse
gacataatgatggttctcat

SEQ ID NO: 622292 - DNA, 20 bp, mouse
gaaaaacagaagaactgtat

SEQ ID NO: 622293 - DNA, 20 bp, mouse
gcagaagaactgtattggct

SEQ ID NO: 622294 - DNA, 20 bp, mouse
gtaaagaacatttttgaatg

SEQ ID NO: 622295 - DNA, 20 bp, mouse
gaatgatggttctcattgga

SEQ ID NO: 622296 - DNA, 20 bp, mouse
gcactgtaatctgggagaag

SEQ ID NO: 622297 - DNA, 20 bp, mouse
gatcattcccactgtaatct

SEQ ID NO: 622298 - DNA, 20 bp, mouse
gcccagtgcaatattttcaa

SEQ ID NO: 622299 - DNA, 20 bp, mouse
gtccctcttgctcacttagc

SEQ ID NO: 622300 - DNA, 20 bp, mouse
gagccagctaagtgagcaag

SEQ ID NO: 622301 - DNA, 20 bp, mouse
gcaactaacaggatgattta

SEQ ID NO: 622302 - DNA, 20 bp, mouse
gcagcaaaaatacaactaac

SEQ ID NO: 622303 - DNA, 20 bp, mouse
gttgtatttttgctgtaact

SEQ ID NO: 622304 - DNA, 20 bp, mouse
gcttttataatagaatgaaa

SEQ ID NO: 622305 - DNA, 20 bp, mouse
ggccttttgagatgataaac

SEQ ID NO: 622306 - DNA, 20 bp, mouse
gaaaagaggaatattcccat

SEQ ID NO: 622307 - DNA, 20 bp, mouse
gaagattcccattacaatct

SEQ ID NO: 622308 - DNA, 20 bp, mouse
gtcttttcccagattgtaat

SEQ ID NO: 622309 - DNA, 20 bp, mouse
ggaagaaccaatatactttg

SEQ ID NO: 622310 - DNA, 20 bp, mouse
gattgatttatcttttcaat

SEQ ID NO: 622311 - DNA, 20 bp, mouse
gacagagccacaaagtatat

SEQ ID NO: 622312 - DNA, 20 bp, mouse
ggcttgtctctaatctcaaa

SEQ ID NO: 622313 - DNA, 20 bp, mouse
gtatatttaccgagtaacaa

SEQ ID NO: 622314 - DNA, 20 bp, mouse
gatgtcattttcatattcag

SEQ ID NO: 622315 - DNA, 20 bp, mouse
gctgtatgcaatgtgcctac

SEQ ID NO: 622316 - DNA, 20 bp, mouse
gtcatcctgcagactactgt

SEQ ID NO: 622317 - DNA, 20 bp, mouse
gaaccagagaacatggtaat

SEQ ID NO: 622318 - DNA, 20 bp, mouse
gcagactactgtaggaatcc

SEQ ID NO: 622319 - DNA, 20 bp, mouse
gagaggaattccacagataa

SEQ ID NO: 622320 - DNA, 20 bp, mouse
gcccccgggatactctataa

SEQ ID NO: 622321 - DNA, 20 bp, mouse
gacctttcccagtaaatcct

SEQ ID NO: 622322 - DNA, 20 bp, mouse
gcttagtcccaggatttact

SEQ ID NO: 622323 - DNA, 20 bp, mouse
gtacccattaccatgttctc

SEQ ID NO: 622324 - DNA, 20 bp, mouse
gcctctagagataatagaca

SEQ ID NO: 622325 - DNA, 20 bp, mouse
ggtatatagtgaaacccccc

SEQ ID NO: 622326 - DNA, 20 bp, mouse
gatgtatttaccttttcaat

SEQ ID NO: 622327 - DNA, 20 bp, mouse
gtcttctcccagattgtcat

SEQ ID NO: 622328 - DNA, 20 bp, mouse
ggagggaccaacgtacttca

SEQ ID NO: 622329 - DNA, 20 bp, mouse
gaaggtaaatacatttattg

SEQ ID NO: 622330 - DNA, 20 bp, mouse
gcatcttcaaacttggtagt

SEQ ID NO: 622331 - DNA, 20 bp, mouse
gaatcagctccgggaactcc

SEQ ID NO: 622332 - DNA, 20 bp, mouse
ggcttgtctattatctcaaa

SEQ ID NO: 622333 - DNA, 20 bp, mouse
gaagcattcccatgacaatc

SEQ ID NO: 622334 - DNA, 20 bp, mouse
gacagagccgtgaagtacgt

SEQ ID NO: 622335 - DNA, 20 bp, mouse
ggcatacttaatatattagc

SEQ ID NO: 622336 - DNA, 20 bp, mouse
gtccccactggcaagttctc

SEQ ID NO: 622337 - DNA, 20 bp, mouse
gatcccaggtgaaaagaaca

SEQ ID NO: 622338 - DNA, 20 bp, mouse
ggctcctgagaacttgccag

SEQ ID NO: 622339 - DNA, 20 bp, mouse
gcatcagcctggagtgactg

SEQ ID NO: 622340 - DNA, 20 bp, mouse
gagagtaacacctcacataa

SEQ ID NO: 622341 - DNA, 20 bp, mouse
gctttctgggtgtattgatg

SEQ ID NO: 622342 - DNA, 20 bp, mouse
gggttaaatttgtttatccc

SEQ ID NO: 622343 - DNA, 20 bp, mouse
gacagcaatcgagtgtcccg

SEQ ID NO: 622344 - DNA, 20 bp, mouse
gaagaattgaccagttacca

SEQ ID NO: 622345 - DNA, 20 bp, mouse
gatgtcacatctgtaatcac

SEQ ID NO: 622346 - DNA, 20 bp, mouse
gccaagcaacactatcttgg

SEQ ID NO: 622347 - DNA, 20 bp, mouse
ggttttgtgtgggagtctta

SEQ ID NO: 622348 - DNA, 20 bp, mouse
gagaaaactaggcactccaa

SEQ ID NO: 622349 - DNA, 20 bp, mouse
ggtcatatctgagttttgtg

SEQ ID NO: 622350 - DNA, 20 bp, mouse
gtatatctatagagtctccc

SEQ ID NO: 622351 - DNA, 20 bp, mouse
gcaaaggatgatgtgatata

SEQ ID NO: 622352 - DNA, 20 bp, mouse
ggttgaatatatacagcatg

SEQ ID NO: 622353 - DNA, 20 bp, mouse
gctgcatgatgctggctgta

SEQ ID NO: 622354 - DNA, 20 bp, mouse
gacgcccacttagaattact

SEQ ID NO: 622355 - DNA, 20 bp, mouse
gtagcaaaaactaattacac

SEQ ID NO: 622356 - DNA, 20 bp, mouse
gtacgggtatatgcttgatt

SEQ ID NO: 622357 - DNA, 20 bp, mouse
gataagtagattaatcagcc

SEQ ID NO: 622358 - DNA, 20 bp, mouse
gaaacaaataacagtcacgt

SEQ ID NO: 622359 - DNA, 20 bp, mouse
gcatgatgctaatgtgcttc

SEQ ID NO: 622360 - DNA, 20 bp, mouse
gataacagtcacgttggccg

SEQ ID NO: 622361 - DNA, 20 bp, mouse
gctggatgatattggttgta

SEQ ID NO: 622362 - DNA, 20 bp, mouse
gagtcttggcttaagccagg

SEQ ID NO: 622363 - DNA, 20 bp, mouse
gtctggaagatggtgtcact

SEQ ID NO: 622364 - DNA, 20 bp, mouse
gaggcccacttagagttact

SEQ ID NO: 622365 - DNA, 20 bp, mouse
gtaactctaagtgggcctcc

SEQ ID NO: 622366 - DNA, 20 bp, mouse
gctacgggcttcttctgatg

SEQ ID NO: 622367 - DNA, 20 bp, mouse
ggtgtgaagatcatatctac

SEQ ID NO: 622368 - DNA, 20 bp, mouse
ggtacatgtatagtatgaag

SEQ ID NO: 622369 - DNA, 20 bp, mouse
gtagtagcaagatagtacag

SEQ ID NO: 622370 - DNA, 20 bp, mouse
gcaagatagtacagagggaa

SEQ ID NO: 622371 - DNA, 20 bp, mouse
gagttctaaacattccaagt

SEQ ID NO: 622372 - DNA, 20 bp, mouse
gctacttcggcagtatatct

SEQ ID NO: 622373 - DNA, 20 bp, mouse
gaagttttcattggactcat

SEQ ID NO: 622374 - DNA, 20 bp, mouse
gtccaatgaaaacttctgac

SEQ ID NO: 622375 - DNA, 20 bp, mouse
gtccacatgatgaggaataa

SEQ ID NO: 622376 - DNA, 20 bp, mouse
gggagtgatggtgatgactt

SEQ ID NO: 622377 - DNA, 20 bp, mouse
gcggccaacgagagtcatat

SEQ ID NO: 622378 - DNA, 20 bp, mouse
gtttcactcagagtcagtcg

SEQ ID NO: 622379 - DNA, 20 bp, mouse
gagacaaacgtaggattatt

SEQ ID NO: 622380 - DNA, 20 bp, mouse
gataagtagattaataatcc

SEQ ID NO: 622381 - DNA, 20 bp, mouse
gtggaggcattatgttaaag

SEQ ID NO: 622382 - DNA, 20 bp, mouse
gtacgggtttatgattgact

SEQ ID NO: 622383 - DNA, 20 bp, mouse
gtaatcctacgtttgtctcc

SEQ ID NO: 622384 - DNA, 20 bp, mouse
gaaaccaatatgactctcgt

SEQ ID NO: 622385 - DNA, 20 bp, mouse
ggtaggattattgggagtga

SEQ ID NO: 622386 - DNA, 20 bp, mouse
ggaaaacatgatgttaaagt

SEQ ID NO: 622387 - DNA, 20 bp, mouse
gtattaacctagtcatctac

SEQ ID NO: 622388 - DNA, 20 bp, mouse
ggagagtctaggcttgagcc

SEQ ID NO: 622389 - DNA, 20 bp, mouse
gaagatatcatgttatcctt

SEQ ID NO: 622390 - DNA, 20 bp, mouse
gcatatacccgtagatgact

SEQ ID NO: 622391 - DNA, 20 bp, mouse
gagaaaatttggtactccaa

SEQ ID NO: 622392 - DNA, 20 bp, mouse
gtacgggtatatgcttgaca

SEQ ID NO: 622393 - DNA, 20 bp, mouse
ggaatatccattgccaacat

SEQ ID NO: 622394 - DNA, 20 bp, mouse
gatgactaggttaataagcc

SEQ ID NO: 622395 - DNA, 20 bp, mouse
gttgccaacatgggttttat

SEQ ID NO: 622396 - DNA, 20 bp, mouse
ggcttcttgctaccatgcgt

SEQ ID NO: 622397 - DNA, 20 bp, mouse
ggtcagaggaagaaggtcca

SEQ ID NO: 622398 - DNA, 20 bp, mouse
gaacaacaaacacattgttt

SEQ ID NO: 622399 - DNA, 20 bp, mouse
gctcttcttcctggcaattt

SEQ ID NO: 622400 - DNA, 20 bp, mouse
gtcatctcaccaaaattgcc

SEQ ID NO: 622401 - DNA, 20 bp, mouse
gcttgaatacttcctacgca

SEQ ID NO: 622402 - DNA, 20 bp, mouse
ggaaagacttctgtgccaat

SEQ ID NO: 622403 - DNA, 20 bp, mouse
ggctttgtcagtttggaata

SEQ ID NO: 622404 - DNA, 20 bp, mouse
gcaatgtgtttgttgttcaa

SEQ ID NO: 622405 - DNA, 20 bp, mouse
ggatgatggtcagaggaaga

SEQ ID NO: 622406 - DNA, 20 bp, mouse
gactgtaacaatcttcactt

SEQ ID NO: 622407 - DNA, 20 bp, mouse
gcagtcagtgaataatcttt

SEQ ID NO: 622408 - DNA, 20 bp, mouse
gcagtcccatgaagaaatca

SEQ ID NO: 622409 - DNA, 20 bp, mouse
gtcaaccttgatttcttcat

SEQ ID NO: 622410 - DNA, 20 bp, mouse
gattcaacagcacatcggaa

SEQ ID NO: 622411 - DNA, 20 bp, mouse
gtgaagcatgagttcatggt

SEQ ID NO: 622412 - DNA, 20 bp, mouse
gtgtaagaacagcaataaaa

SEQ ID NO: 622413 - DNA, 20 bp, mouse
gttctgagtctatactggag

SEQ ID NO: 622414 - DNA, 20 bp, mouse
gcatgagttcatggtaggtg

SEQ ID NO: 622415 - DNA, 20 bp, mouse
gttgttgaagcatgagttca

SEQ ID NO: 622416 - DNA, 20 bp, mouse
gggatttcttgcatttttgt

SEQ ID NO: 622417 - DNA, 20 bp, mouse
gcttcacacatgggtgatac

SEQ ID NO: 622418 - DNA, 20 bp, mouse
gtactgggatgattctggag

SEQ ID NO: 622419 - DNA, 20 bp, mouse
ggctaggcatgtacagttaa

SEQ ID NO: 622420 - DNA, 20 bp, mouse
gctcctcacagagtgctctg

SEQ ID NO: 622421 - DNA, 20 bp, mouse
ggaagtacaatgcagattga

SEQ ID NO: 622422 - DNA, 20 bp, mouse
gattcaggtggtgggcgaac

SEQ ID NO: 622423 - DNA, 20 bp, mouse
ggcatttttgtgggctgtat

SEQ ID NO: 622424 - DNA, 20 bp, mouse
gttcttgtcaattcaggtgg

SEQ ID NO: 622425 - DNA, 20 bp, mouse
gaaaactcgctttattaaaa

SEQ ID NO: 622426 - DNA, 20 bp, mouse
gcaagatcagagaaaactcc

SEQ ID NO: 622427 - DNA, 20 bp, mouse
gtatatctaatacctaacat

SEQ ID NO: 622428 - DNA, 20 bp, mouse
gaggtttttcatatctgcta

SEQ ID NO: 622429 - DNA, 20 bp, mouse
ggctggaaaatgaaagggat

SEQ ID NO: 622430 - DNA, 20 bp, mouse
gactctttcctttttcctcc

SEQ ID NO: 622431 - DNA, 20 bp, mouse
gtattataagagtcgtcagt

SEQ ID NO: 622432 - DNA, 20 bp, mouse
ggaaaactccaggaggaaaa

SEQ ID NO: 622433 - DNA, 20 bp, mouse
gggaaagagtgaaaacacac

SEQ ID NO: 622434 - DNA, 20 bp, mouse
gacaatgctggaaaatgaaa

SEQ ID NO: 622435 - DNA, 20 bp, mouse
gtggttcttaaagttacatg

SEQ ID NO: 622436 - DNA, 20 bp, mouse
gagacagaagataaaaatac

SEQ ID NO: 622437 - DNA, 20 bp, mouse
gaaagtatgcagggggaaaa

SEQ ID NO: 622438 - DNA, 20 bp, mouse
gatgaggaaaataatctacc

SEQ ID NO: 622439 - DNA, 20 bp, mouse
gtatggataccattcaaaga

SEQ ID NO: 622440 - DNA, 20 bp, mouse
ggattattttcctcattcag

SEQ ID NO: 622441 - DNA, 20 bp, mouse
gagtgtagaaagtatgcagg

SEQ ID NO: 622442 - DNA, 20 bp, mouse
gctcagtgtagaaagtatgc

SEQ ID NO: 622443 - DNA, 20 bp, mouse
gtttcctttccccctgaatg

SEQ ID NO: 622444 - DNA, 20 bp, mouse
gtaatggcagatataaattt

SEQ ID NO: 622445 - DNA, 20 bp, mouse
gtttagtttccttctttgaa

SEQ ID NO: 622446 - DNA, 20 bp, mouse
gatccagaggagcatcctat

SEQ ID NO: 622447 - DNA, 20 bp, mouse
gagcagacccatgtaccaat

SEQ ID NO: 622448 - DNA, 20 bp, mouse
ggagcatcctattggtacat

SEQ ID NO: 622449 - DNA, 20 bp, mouse
ggtcataagaattctgaact

SEQ ID NO: 622450 - DNA, 20 bp, mouse
gcactcagccagaatggaaa

SEQ ID NO: 622451 - DNA, 20 bp, mouse
gcctgaagataaaaatccag

SEQ ID NO: 622452 - DNA, 20 bp, mouse
ggatgtttccatttccattc

SEQ ID NO: 622453 - DNA, 20 bp, mouse
gatttttatcttcaggcttt

SEQ ID NO: 622454 - DNA, 20 bp, mouse
gctttagttttttctttgat

SEQ ID NO: 622455 - DNA, 20 bp, mouse
gcatatggtacagttgaatg

SEQ ID NO: 622456 - DNA, 20 bp, mouse
gtacaaataagatgttgtcc

SEQ ID NO: 622457 - DNA, 20 bp, mouse
ggtcctggatgtttttcttc

SEQ ID NO: 622458 - DNA, 20 bp, mouse
gtagaacattttcctcacgt

SEQ ID NO: 622459 - DNA, 20 bp, mouse
gactcagaattcttatgact

SEQ ID NO: 622460 - DNA, 20 bp, mouse
gtttcctcacgtaggcagaa

SEQ ID NO: 622461 - DNA, 20 bp, mouse
gacaacatcttatttgtaca

SEQ ID NO: 622462 - DNA, 20 bp, mouse
gtttcctttctgcctacgtg

SEQ ID NO: 622463 - DNA, 20 bp, mouse
gagcctgaagaaaaacatcc

SEQ ID NO: 622464 - DNA, 20 bp, mouse
ggatatggtacagttttatg

SEQ ID NO: 622465 - DNA, 20 bp, mouse
ggtgaggaaaatgttctaag

SEQ ID NO: 622466 - DNA, 20 bp, mouse
gtataaataggatgttcacc

SEQ ID NO: 622467 - DNA, 20 bp, mouse
gcacctggatttttttcttc

SEQ ID NO: 622468 - DNA, 20 bp, mouse
gtagaacattttcctcactc

SEQ ID NO: 622469 - DNA, 20 bp, mouse
gaacagaaccatgtataaat

SEQ ID NO: 622470 - DNA, 20 bp, mouse
gagcctgaagaaaaaaatcc

SEQ ID NO: 622471 - DNA, 20 bp, mouse
ggatatagtacagttttatg

SEQ ID NO: 622472 - DNA, 20 bp, mouse
gcactcaggcagaaaggaaa

SEQ ID NO: 622473 - DNA, 20 bp, mouse
gtgaacatcctatttataca

SEQ ID NO: 622474 - DNA, 20 bp, mouse
gattcagaaaacttatcact

SEQ ID NO: 622475 - DNA, 20 bp, mouse
gcaccatgaaggagatgttg

SEQ ID NO: 622476 - DNA, 20 bp, mouse
ggtgacatgaacagtatcag

SEQ ID NO: 622477 - DNA, 20 bp, mouse
gagccatgcgaaaaaaatcc

SEQ ID NO: 622478 - DNA, 20 bp, mouse
gcatatggcttagttgaatg

SEQ ID NO: 622479 - DNA, 20 bp, mouse
gaatagtccaagtatacata

SEQ ID NO: 622480 - DNA, 20 bp, mouse
gtaacatgcactaaaatttt

SEQ ID NO: 622481 - DNA, 20 bp, mouse
gactaagccatatgtatact

SEQ ID NO: 622482 - DNA, 20 bp, mouse
gctcctggatttttttcgca

SEQ ID NO: 622483 - DNA, 20 bp, mouse
gttcacttcgattgcctggt

SEQ ID NO: 622484 - DNA, 20 bp, mouse
gtattttcacttcgattgcc

SEQ ID NO: 622485 - DNA, 20 bp, mouse
gagaattcttttgatttata

SEQ ID NO: 622486 - DNA, 20 bp, mouse
gtaggaatctgcaaaaacaa

SEQ ID NO: 622487 - DNA, 20 bp, mouse
gagtatggtagatatgggtg

SEQ ID NO: 622488 - DNA, 20 bp, mouse
gtataatagtatggtagata

SEQ ID NO: 622489 - DNA, 20 bp, mouse
gaattgtccatataatagta

SEQ ID NO: 622490 - DNA, 20 bp, mouse
gagaattatcataacttagt

SEQ ID NO: 622491 - DNA, 20 bp, mouse
gcacaaacccatgtagtaat

SEQ ID NO: 622492 - DNA, 20 bp, mouse
gaaattagtgcacttactgt

SEQ ID NO: 622493 - DNA, 20 bp, mouse
gtggtgtggtacgtatgaat

SEQ ID NO: 622494 - DNA, 20 bp, mouse
gtacagtcatcaatcaagtg

SEQ ID NO: 622495 - DNA, 20 bp, mouse
gtggaactttgttcatggtg

SEQ ID NO: 622496 - DNA, 20 bp, mouse
gctgatattcacagtcataa

SEQ ID NO: 622497 - DNA, 20 bp, mouse
ggattatctagataatagta

SEQ ID NO: 622498 - DNA, 20 bp, mouse
gtatcaataggatgttgtac

SEQ ID NO: 622499 - DNA, 20 bp, mouse
gagctgatgagtgtatcaat

SEQ ID NO: 622500 - DNA, 20 bp, mouse
ggttacactttattaatcaa

SEQ ID NO: 622501 - DNA, 20 bp, mouse
ggtactggacttttattctc

SEQ ID NO: 622502 - DNA, 20 bp, mouse
gcactttattaatcaaagga

SEQ ID NO: 622503 - DNA, 20 bp, mouse
ggataatagtatggtagaaa

SEQ ID NO: 622504 - DNA, 20 bp, mouse
gagtatggtagaaatggatg

SEQ ID NO: 622505 - DNA, 20 bp, mouse
gtctctcaggtggaataaaa

SEQ ID NO: 622506 - DNA, 20 bp, mouse
gaaatcagaagagacaaatt

SEQ ID NO: 622507 - DNA, 20 bp, mouse
gtatataaccgtccaaatat

SEQ ID NO: 622508 - DNA, 20 bp, mouse
gaagagaccaatgtgctaat

SEQ ID NO: 622509 - DNA, 20 bp, mouse
ggaacatcctattagcacat

SEQ ID NO: 622510 - DNA, 20 bp, mouse
gagaattcttatgacgtaat

SEQ ID NO: 622511 - DNA, 20 bp, mouse
ggaaaactgtccagacattg

SEQ ID NO: 622512 - DNA, 20 bp, mouse
gtaccataccaatatttgga

SEQ ID NO: 622513 - DNA, 20 bp, mouse
gtttcatttcctcctgagtg

SEQ ID NO: 622514 - DNA, 20 bp, mouse
gaaccgtccaaatattggta

SEQ ID NO: 622515 - DNA, 20 bp, mouse
gaaaaatcagtaaatcttaa

SEQ ID NO: 622516 - DNA, 20 bp, mouse
gataaaggtaaggacaaatt

SEQ ID NO: 622517 - DNA, 20 bp, mouse
gttggcaatcagaagtagtg

SEQ ID NO: 622518 - DNA, 20 bp, mouse
gattaacatgcataaaggta

SEQ ID NO: 622519 - DNA, 20 bp, mouse
ggaagcagactcatattatt

SEQ ID NO: 622520 - DNA, 20 bp, mouse
gaatatggtagataagaatg

SEQ ID NO: 622521 - DNA, 20 bp, mouse
gtaataattgtacttactgg

SEQ ID NO: 622522 - DNA, 20 bp, mouse
gaggtaaaagcaaccaaata

SEQ ID NO: 622523 - DNA, 20 bp, mouse
gaaccagaatagctaataag

SEQ ID NO: 622524 - DNA, 20 bp, mouse
gcgtatagtacgtatgaaga

SEQ ID NO: 622525 - DNA, 20 bp, mouse
gctattctggttaggccata

SEQ ID NO: 622526 - DNA, 20 bp, mouse
gctgatattcatagttataa

SEQ ID NO: 622527 - DNA, 20 bp, mouse
gttgggaatctgtaagaacc

SEQ ID NO: 622528 - DNA, 20 bp, mouse
gatcatggtgaaaatcttca

SEQ ID NO: 622529 - DNA, 20 bp, mouse
gtatattggtatggaagaaa

SEQ ID NO: 622530 - DNA, 20 bp, mouse
gaatcatcacatctccatca

SEQ ID NO: 622531 - DNA, 20 bp, mouse
gctactggatttttatttcc

SEQ ID NO: 622532 - DNA, 20 bp, mouse
gaacaacaactgtaaagaag

SEQ ID NO: 622533 - DNA, 20 bp, mouse
gtctttttttcctctctcag

SEQ ID NO: 622534 - DNA, 20 bp, mouse
ggaaaactattctgatattc

SEQ ID NO: 622535 - DNA, 20 bp, mouse
gtatcaataagatgttctac

SEQ ID NO: 622536 - DNA, 20 bp, mouse
gtaggacagaccctcacagt

SEQ ID NO: 622537 - DNA, 20 bp, mouse
gtaatatataacattgaagt

SEQ ID NO: 622538 - DNA, 20 bp, mouse
gctgtgtacaccaactgtga

SEQ ID NO: 622539 - DNA, 20 bp, mouse
gaagttacatgaataacaat

SEQ ID NO: 622540 - DNA, 20 bp, mouse
gattgtagggcattgtgtac

SEQ ID NO: 622541 - DNA, 20 bp, mouse
ggagactggattctatctgt

SEQ ID NO: 622542 - DNA, 20 bp, mouse
gtatttcctttggacattcg

SEQ ID NO: 622543 - DNA, 20 bp, mouse
gagtttcctcgaatgtccaa

SEQ ID NO: 622544 - DNA, 20 bp, mouse
gttatcctccaaaaacaaat

SEQ ID NO: 622545 - DNA, 20 bp, mouse
gtccagtctctctcattgta

SEQ ID NO: 622546 - DNA, 20 bp, mouse
gatagcctcagaaacaactt

SEQ ID NO: 622547 - DNA, 20 bp, mouse
gtccacctgagagaggaaag

SEQ ID NO: 622548 - DNA, 20 bp, mouse
gtgtatggtactgatggatg

SEQ ID NO: 622549 - DNA, 20 bp, mouse
gatttccaaagttgtttctg

SEQ ID NO: 622550 - DNA, 20 bp, mouse
gcttggaattataacttaat

SEQ ID NO: 622551 - DNA, 20 bp, mouse
gtcagtaccatacaaatata

SEQ ID NO: 622552 - DNA, 20 bp, mouse
gttggaaatatgtaagaagc

SEQ ID NO: 622553 - DNA, 20 bp, mouse
gatggatgaggaactttgtt

SEQ ID NO: 622554 - DNA, 20 bp, mouse
gattttagaatatctgtaag

SEQ ID NO: 622555 - DNA, 20 bp, mouse
gttaaaatatactaatattt

SEQ ID NO: 622556 - DNA, 20 bp, mouse
gtgtactgcatgaatcacaa

SEQ ID NO: 622557 - DNA, 20 bp, mouse
gtgtctaggagagatattta

SEQ ID NO: 622558 - DNA, 20 bp, mouse
gtacattggctcctgtgaaa

SEQ ID NO: 622559 - DNA, 20 bp, mouse
ggtgttttcagcctgcaacc

SEQ ID NO: 622560 - DNA, 20 bp, mouse
gaatattttaagttctttcc

SEQ ID NO: 622561 - DNA, 20 bp, mouse
gaatctgtgtcaagttaaac

SEQ ID NO: 622562 - DNA, 20 bp, mouse
gcttgttaatgagatactga

SEQ ID NO: 622563 - DNA, 20 bp, mouse
gtagacagtttccatttcac

SEQ ID NO: 622564 - DNA, 20 bp, mouse
gtaagttctttcctggttgc

SEQ ID NO: 622565 - DNA, 20 bp, mouse
gagtatctcattaacaagga

SEQ ID NO: 622566 - DNA, 20 bp, mouse
gtgtactgcttgaatcacga

SEQ ID NO: 622567 - DNA, 20 bp, mouse
gcatcagtaaatcattaaca

SEQ ID NO: 622568 - DNA, 20 bp, mouse
gatatttatgtaactgataa

SEQ ID NO: 622569 - DNA, 20 bp, mouse
gatacattgcctctgtgaaa

SEQ ID NO: 622570 - DNA, 20 bp, mouse
gtaaaatcagccacatgaag

SEQ ID NO: 622571 - DNA, 20 bp, mouse
gagtaaatcattaacaggga

SEQ ID NO: 622572 - DNA, 20 bp, mouse
gaatgttcagtagcaagaag

SEQ ID NO: 622573 - DNA, 20 bp, mouse
gcaagcagtacaacaacctg

SEQ ID NO: 622574 - DNA, 20 bp, mouse
gactttgtgtcaatttaaag

SEQ ID NO: 622575 - DNA, 20 bp, mouse
gctgaacattccacttcatg

SEQ ID NO: 622576 - DNA, 20 bp, mouse
gtttaatctgtctcacattt

SEQ ID NO: 622577 - DNA, 20 bp, mouse
gaagttcttgtttgttttgc

SEQ ID NO: 622578 - DNA, 20 bp, mouse
gataccattggcttgtgaaa

SEQ ID NO: 622579 - DNA, 20 bp, mouse
gtttccatttcacaagccaa

SEQ ID NO: 622580 - DNA, 20 bp, mouse
ggaaaacagggacagaaacc

SEQ ID NO: 622581 - DNA, 20 bp, mouse
gcatgcagtacaacggcctg

SEQ ID NO: 622582 - DNA, 20 bp, mouse
gaatgaagcagaatgaaaac

SEQ ID NO: 622583 - DNA, 20 bp, mouse
ggggacagaaaccagggaac

SEQ ID NO: 622584 - DNA, 20 bp, mouse
gtgtactgcatgaatcatga

SEQ ID NO: 622585 - DNA, 20 bp, mouse
gtatttctcctagatgcttt

SEQ ID NO: 622586 - DNA, 20 bp, mouse
gtcagcctcgcacataggaa

SEQ ID NO: 622587 - DNA, 20 bp, mouse
gttaaatcagcctcgcacat

SEQ ID NO: 622588 - DNA, 20 bp, mouse
gataccattggtttatgaaa

SEQ ID NO: 622589 - DNA, 20 bp, mouse
ggtttccattcctatgtgcg

SEQ ID NO: 622590 - DNA, 20 bp, mouse
gtttccatttcataaaccaa

SEQ ID NO: 622591 - DNA, 20 bp, mouse
ggaaaacagggacagaaacc

SEQ ID NO: 622592 - DNA, 20 bp, mouse
gcatgcagtacaacggcctg

SEQ ID NO: 622593 - DNA, 20 bp, mouse
gaatgaagcagaatgaaaac

SEQ ID NO: 622594 - DNA, 20 bp, mouse
ggggacagaaaccagggaac

SEQ ID NO: 622595 - DNA, 20 bp, mouse
gtgtactgcatgaatcatga

SEQ ID NO: 622596 - DNA, 20 bp, mouse
gaatacagggatagacacca

SEQ ID NO: 622597 - DNA, 20 bp, mouse
ggaagatacatcctgtacca

SEQ ID NO: 622598 - DNA, 20 bp, mouse
ggtatcacattaacagggat

SEQ ID NO: 622599 - DNA, 20 bp, mouse
ggggatagacaccatggtac

SEQ ID NO: 622600 - DNA, 20 bp, mouse
gctgttgtattgcaagaatc

SEQ ID NO: 622601 - DNA, 20 bp, mouse
gatatttaagtgacaggtaa

SEQ ID NO: 622602 - DNA, 20 bp, mouse
gagggagatatttaagtgac

SEQ ID NO: 622603 - DNA, 20 bp, mouse
gtcatcagtatcacattaac

SEQ ID NO: 622604 - DNA, 20 bp, mouse
gtagacaatttccatttcat

SEQ ID NO: 622605 - DNA, 20 bp, mouse
gaatgttcaggaacaagaag

SEQ ID NO: 622606 - DNA, 20 bp, mouse
gtcagcctcacacttaggaa

SEQ ID NO: 622607 - DNA, 20 bp, mouse
ggtctgattttatttatccg

SEQ ID NO: 622608 - DNA, 20 bp, mouse
ggtttccattcctaagtgtg

SEQ ID NO: 622609 - DNA, 20 bp, mouse
gtttaatcagcctcacactt

SEQ ID NO: 622610 - DNA, 20 bp, mouse
ggtttccatttcacaaccaa

SEQ ID NO: 622611 - DNA, 20 bp, mouse
ggataccattggttgtgaaa

SEQ ID NO: 622612 - DNA, 20 bp, mouse
gttctagctctttcctgtta

SEQ ID NO: 622613 - DNA, 20 bp, mouse
gtatgaggcttttccataac

SEQ ID NO: 622614 - DNA, 20 bp, mouse
gatactctatcaatttaaat

SEQ ID NO: 622615 - DNA, 20 bp, mouse
gaatggaaactgcctaggag

SEQ ID NO: 622616 - DNA, 20 bp, mouse
gtgaattgcacagaagaaga

SEQ ID NO: 622617 - DNA, 20 bp, mouse
gcagaagaagagggagcttc

SEQ ID NO: 622618 - DNA, 20 bp, mouse
gcttcagagtgactgataca

SEQ ID NO: 622619 - DNA, 20 bp, mouse
gtgtgtctatgagaatcatg

SEQ ID NO: 622620 - DNA, 20 bp, mouse
gggagaaaagcacagtcctg

SEQ ID NO: 622621 - DNA, 20 bp, mouse
ggtgtcagagactctctaca

SEQ ID NO: 622622 - DNA, 20 bp, mouse
gaaaatcctcaaatacacta

SEQ ID NO: 622623 - DNA, 20 bp, mouse
gagggtccacttgtgtgtaa

SEQ ID NO: 622624 - DNA, 20 bp, mouse
gaactcaatgaaaactgcga

SEQ ID NO: 622625 - DNA, 20 bp, mouse
gaaagtatctctttaaatcg

SEQ ID NO: 622626 - DNA, 20 bp, mouse
ggctggacaatgagagtgtc

SEQ ID NO: 622627 - DNA, 20 bp, mouse
gatattataaatttggtcaa

SEQ ID NO: 622628 - DNA, 20 bp, mouse
gttataatatttctaatttt

SEQ ID NO: 622629 - DNA, 20 bp, mouse
gattagaaatattataaatt

SEQ ID NO: 622630 - DNA, 20 bp, mouse
ggaactccaattcacaatgc

SEQ ID NO: 622631 - DNA, 20 bp, mouse
gtacatctaatacataacat

SEQ ID NO: 622632 - DNA, 20 bp, mouse
ggcaaatgggttcagttaag

SEQ ID NO: 622633 - DNA, 20 bp, mouse
gatgttacagggggaagaag

SEQ ID NO: 622634 - DNA, 20 bp, mouse
gtctatctgttgagtctttg

SEQ ID NO: 622635 - DNA, 20 bp, mouse
gtagcttcttcatatctgct

SEQ ID NO: 622636 - DNA, 20 bp, mouse
gtaaacccaggatgctctct

SEQ ID NO: 622637 - DNA, 20 bp, mouse
gcctgtgagccaataaaccc

SEQ ID NO: 622638 - DNA, 20 bp, mouse
gttggctcacaggaagctac

SEQ ID NO: 622639 - DNA, 20 bp, mouse
gcagatgctatattccagga

SEQ ID NO: 622640 - DNA, 20 bp, mouse
gttccaggatggagatgtat

SEQ ID NO: 622641 - DNA, 20 bp, mouse
gggtacttactgtttcatag

SEQ ID NO: 622642 - DNA, 20 bp, mouse
gtaacatcaccacaactata

SEQ ID NO: 622643 - DNA, 20 bp, mouse
gtttttatatctgaatgtca

SEQ ID NO: 622644 - DNA, 20 bp, mouse
gatgttagatatgcatgaag

SEQ ID NO: 622645 - DNA, 20 bp, mouse
gaaccaatacatctccatcc

SEQ ID NO: 622646 - DNA, 20 bp, mouse
gagccttcaaacagacatat

SEQ ID NO: 622647 - DNA, 20 bp, mouse
gtgaaatccgtttctaatgt

SEQ ID NO: 622648 - DNA, 20 bp, mouse
gagattcatcaattaaccaa

SEQ ID NO: 622649 - DNA, 20 bp, mouse
gaatgtccagcattgtaaac

SEQ ID NO: 622650 - DNA, 20 bp, mouse
gtgtttcagatttaaatttt

SEQ ID NO: 622651 - DNA, 20 bp, mouse
gtgttttcctacattagaaa

SEQ ID NO: 622652 - DNA, 20 bp, mouse
gcacctatatgtctgtttga

SEQ ID NO: 622653 - DNA, 20 bp, mouse
gaaactaataacattgacaa

SEQ ID NO: 622654 - DNA, 20 bp, mouse
gatactccagtttacaatgc

SEQ ID NO: 622655 - DNA, 20 bp, mouse
gggaatagtgaagatagtga

SEQ ID NO: 622656 - DNA, 20 bp, mouse
gagccagagtataaaaatcc

SEQ ID NO: 622657 - DNA, 20 bp, mouse
gtggataattacatacagta

SEQ ID NO: 622658 - DNA, 20 bp, mouse
gctcctggatttttatactc

SEQ ID NO: 622659 - DNA, 20 bp, mouse
gcttttagattattttcctc

SEQ ID NO: 622660 - DNA, 20 bp, mouse
gttattttcctcaggggaaa

SEQ ID NO: 622661 - DNA, 20 bp, mouse
gtcctcaggggaaaaggaaa

SEQ ID NO: 622662 - DNA, 20 bp, mouse
gaattatccaaataaagata

SEQ ID NO: 622663 - DNA, 20 bp, mouse
gactgtaccatatctttatt

SEQ ID NO: 622664 - DNA, 20 bp, mouse
gaacaataagtaaattttaa

SEQ ID NO: 622665 - DNA, 20 bp, mouse
gtccatttccttttcccctg

SEQ ID NO: 622666 - DNA, 20 bp, mouse
gtagatcctagcagatatga

SEQ ID NO: 622667 - DNA, 20 bp, mouse
gtttttgtgggtatcatatg

SEQ ID NO: 622668 - DNA, 20 bp, mouse
gactatctgttaagtttttg

SEQ ID NO: 622669 - DNA, 20 bp, mouse
ggcaaatgggttcagttaaa

SEQ ID NO: 622670 - DNA, 20 bp, mouse
gcaagatgagagaaaatttc

SEQ ID NO: 622671 - DNA, 20 bp, mouse
gtacatcaaatacataacat

SEQ ID NO: 622672 - DNA, 20 bp, mouse
gtagctccttcatatctgct

SEQ ID NO: 622673 - DNA, 20 bp, mouse
gatcagaaatattatatatt

SEQ ID NO: 622674 - DNA, 20 bp, mouse
gaaatacataacattggagc

SEQ ID NO: 622675 - DNA, 20 bp, mouse
gcagtggttcttaatgttac

SEQ ID NO: 622676 - DNA, 20 bp, mouse
gcaggttcttcatatctact

SEQ ID NO: 622677 - DNA, 20 bp, mouse
gtgtacacaactaaatacat

SEQ ID NO: 622678 - DNA, 20 bp, mouse
gtagatatgaagaacctgcg

SEQ ID NO: 622679 - DNA, 20 bp, mouse
gcacaatgctggacaatgag

SEQ ID NO: 622680 - DNA, 20 bp, mouse
ggctggacaatgagagggac

SEQ ID NO: 622681 - DNA, 20 bp, mouse
gcaactaaatacattggagc

SEQ ID NO: 622682 - DNA, 20 bp, mouse
gtattataagtgtggtcaat

SEQ ID NO: 622683 - DNA, 20 bp, mouse
gggaaagaccaaaaccacgc

SEQ ID NO: 622684 - DNA, 20 bp, mouse
gtctactaggatctaagatc

SEQ ID NO: 622685 - DNA, 20 bp, mouse
gtgaagaacctgcgtggttt

SEQ ID NO: 622686 - DNA, 20 bp, mouse
ggtatcctccaaaagcaatt

SEQ ID NO: 622687 - DNA, 20 bp, mouse
ggaaaacttcaggagtgaga

SEQ ID NO: 622688 - DNA, 20 bp, mouse
gagatgtgctgaaagagtgt

SEQ ID NO: 622689 - DNA, 20 bp, mouse
gattctaaaaccaagttaaa

SEQ ID NO: 622690 - DNA, 20 bp, mouse
gattaatgacctacctaaaa

SEQ ID NO: 622691 - DNA, 20 bp, mouse
gtactattagctatgttact

SEQ ID NO: 622692 - DNA, 20 bp, mouse
gaatgtgtcaccatttaact

SEQ ID NO: 622693 - DNA, 20 bp, mouse
gttgttcttttcacatacga

SEQ ID NO: 622694 - DNA, 20 bp, mouse
gagttacatatttctaattc

SEQ ID NO: 622695 - DNA, 20 bp, mouse
gtaacttggttttagaatat

SEQ ID NO: 622696 - DNA, 20 bp, mouse
gtggatacgccaaaagcaac

SEQ ID NO: 622697 - DNA, 20 bp, mouse
gtagatgcatatacaaactg

SEQ ID NO: 622698 - DNA, 20 bp, mouse
gtcttcttgtgcagtttgac

SEQ ID NO: 622699 - DNA, 20 bp, mouse
gtagtttggtttcagtacag

SEQ ID NO: 622700 - DNA, 20 bp, mouse
gatgttacaatgggaagaac

SEQ ID NO: 622701 - DNA, 20 bp, mouse
gtggttcttaatgttacaat

SEQ ID NO: 622702 - DNA, 20 bp, mouse
gatctgttactattagctag

SEQ ID NO: 622703 - DNA, 20 bp, mouse
gatcattatcttcattattc

SEQ ID NO: 622704 - DNA, 20 bp, mouse
gtaactcataacatttaagc

SEQ ID NO: 622705 - DNA, 20 bp, mouse
ggagatcaacacattttata

SEQ ID NO: 622706 - DNA, 20 bp, mouse
gggaaacccaaggtaacatt

SEQ ID NO: 622707 - DNA, 20 bp, mouse
gggtaacattgggaagcagg

SEQ ID NO: 622708 - DNA, 20 bp, mouse
ggccattgatgaaatcaata

SEQ ID NO: 622709 - DNA, 20 bp, mouse
gtgcttcccaatgttacctt

SEQ ID NO: 622710 - DNA, 20 bp, mouse
ggttcttgggtgaaaattaa

SEQ ID NO: 622711 - DNA, 20 bp, mouse
gattgtagtctaaatgggag

SEQ ID NO: 622712 - DNA, 20 bp, mouse
gaagttgtctattttatgat

SEQ ID NO: 622713 - DNA, 20 bp, mouse
gaaactcaatacaaagctct

SEQ ID NO: 622714 - DNA, 20 bp, mouse
gattccacaatgttcactaa

SEQ ID NO: 622715 - DNA, 20 bp, mouse
gtttccattagtgaacattg

SEQ ID NO: 622716 - DNA, 20 bp, mouse
ggagacagtggacattgggg

SEQ ID NO: 622717 - DNA, 20 bp, mouse
ggagagcatgaacttgagac

SEQ ID NO: 622718 - DNA, 20 bp, mouse
gacaggagacagtggacatt

SEQ ID NO: 622719 - DNA, 20 bp, mouse
gcgtctaatcatcactctaa

SEQ ID NO: 622720 - DNA, 20 bp, mouse
gattattctcattgtgttcc

SEQ ID NO: 622721 - DNA, 20 bp, mouse
gagtagattaaaaagtgaga

SEQ ID NO: 622722 - DNA, 20 bp, mouse
gttctttatgcgtaagtgtt

SEQ ID NO: 622723 - DNA, 20 bp, mouse
ggggtggggggaagcagtag

SEQ ID NO: 622724 - DNA, 20 bp, mouse
gtaatctactgagttcattt

SEQ ID NO: 622725 - DNA, 20 bp, mouse
gacagtggacattggggtgg

SEQ ID NO: 622726 - DNA, 20 bp, mouse
ggggttaactgtatttctat

SEQ ID NO: 622727 - DNA, 20 bp, mouse
ggtcaaccaagaaccctctt

SEQ ID NO: 622728 - DNA, 20 bp, mouse
gcgtatcagccatgtgcgag

SEQ ID NO: 622729 - DNA, 20 bp, mouse
gcaaactcaccatattaaaa

SEQ ID NO: 622730 - DNA, 20 bp, mouse
gtcttagacatatggaacca

SEQ ID NO: 622731 - DNA, 20 bp, mouse
gttcgtcagagttatttgtt

SEQ ID NO: 622732 - DNA, 20 bp, mouse
gagttcacgttcttaatatc

SEQ ID NO: 622733 - DNA, 20 bp, mouse
gatcacttacccctcgcaca

SEQ ID NO: 622734 - DNA, 20 bp, mouse
gctgaaaagactggttagca

SEQ ID NO: 622735 - DNA, 20 bp, mouse
gtgcgcaagttcaatttgtc

SEQ ID NO: 622736 - DNA, 20 bp, mouse
gagtggaagggtagcagtag

SEQ ID NO: 622737 - DNA, 20 bp, mouse
ggaacacactggacagtgga

SEQ ID NO: 622738 - DNA, 20 bp, mouse
ggcaaactaaagctcctaga

SEQ ID NO: 622739 - DNA, 20 bp, mouse
gtctgtctctctcaacttca

SEQ ID NO: 622740 - DNA, 20 bp, mouse
gtcttatcccttaaagtgtc

SEQ ID NO: 622741 - DNA, 20 bp, mouse
gatatttgaatatatatata

SEQ ID NO: 622742 - DNA, 20 bp, mouse
ggtttacatgtaagtttttt

SEQ ID NO: 622743 - DNA, 20 bp, mouse
gagaagcagaaatacttaaa

SEQ ID NO: 622744 - DNA, 20 bp, mouse
gccagtacaacaggagtata

SEQ ID NO: 622745 - DNA, 20 bp, mouse
ggagagaacacactggacag

SEQ ID NO: 622746 - DNA, 20 bp, mouse
gagtggaagggtagcagtag

SEQ ID NO: 622747 - DNA, 20 bp, mouse
ggaacacactggacagtgga

SEQ ID NO: 622748 - DNA, 20 bp, mouse
ggcaaactaaagctcctaga

SEQ ID NO: 622749 - DNA, 20 bp, mouse
gtctgtctctctcaacttca

SEQ ID NO: 622750 - DNA, 20 bp, mouse
gtcttatcccttaaagtgtc

SEQ ID NO: 622751 - DNA, 20 bp, mouse
gatatttgaatatatatata

SEQ ID NO: 622752 - DNA, 20 bp, mouse
ggtttacatgtaagtttttt

SEQ ID NO: 622753 - DNA, 20 bp, mouse
gagaagcagaaatacttaaa

SEQ ID NO: 622754 - DNA, 20 bp, mouse
gccagtacaacaggagtata

SEQ ID NO: 622755 - DNA, 20 bp, mouse
ggagagaacacactggacag

SEQ ID NO: 622756 - DNA, 20 bp, mouse
gagtggaagtgtagcggtag

SEQ ID NO: 622757 - DNA, 20 bp, mouse
gctggacagtggaagtgtag

SEQ ID NO: 622758 - DNA, 20 bp, mouse
gagtgagacagaatccatga

SEQ ID NO: 622759 - DNA, 20 bp, mouse
gtcttctcccttaaattgtc

SEQ ID NO: 622760 - DNA, 20 bp, mouse
ggaagtgtagcggtagagga

SEQ ID NO: 622761 - DNA, 20 bp, mouse
gtttgagagagagaagacac

SEQ ID NO: 622762 - DNA, 20 bp, mouse
gtgtctacctgacaatttaa

SEQ ID NO: 622763 - DNA, 20 bp, mouse
gtctctctttctcaccttca

SEQ ID NO: 622764 - DNA, 20 bp, mouse
ggagagaagacactggacag

SEQ ID NO: 622765 - DNA, 20 bp, mouse
gccagtacaacaggagtata

SEQ ID NO: 622766 - DNA, 20 bp, mouse
ggagaggaagcagtagagct

SEQ ID NO: 622767 - DNA, 20 bp, mouse
ggagacactagaagtagatt

SEQ ID NO: 622768 - DNA, 20 bp, mouse
gacagatacaattcatatac

SEQ ID NO: 622769 - DNA, 20 bp, mouse
gatataccggaatatgttta

SEQ ID NO: 622770 - DNA, 20 bp, mouse
gattgttctaattatattcc

SEQ ID NO: 622771 - DNA, 20 bp, mouse
gctttaaaaaatattgtttt

SEQ ID NO: 622772 - DNA, 20 bp, mouse
gggagaagcaggtatattta

SEQ ID NO: 622773 - DNA, 20 bp, mouse
ggtctccagcagtcactcta

SEQ ID NO: 622774 - DNA, 20 bp, mouse
gatgtttatgggtaagtgtt

SEQ ID NO: 622775 - DNA, 20 bp, mouse
gactccatgaagttgaagac

SEQ ID NO: 622776 - DNA, 20 bp, mouse
gaaaaaatgagaacaatcag

SEQ ID NO: 622777 - DNA, 20 bp, mouse
ggatttagctaagtaaaaac

SEQ ID NO: 622778 - DNA, 20 bp, mouse
ggaagggaagtagtagagat

SEQ ID NO: 622779 - DNA, 20 bp, mouse
gtccaccaagagtcattcta

SEQ ID NO: 622780 - DNA, 20 bp, mouse
gaaagataaaacggatacac

SEQ ID NO: 622781 - DNA, 20 bp, mouse
gttagccttagaatgactct

SEQ ID NO: 622782 - DNA, 20 bp, mouse
gttgttcatgtgtaagtgct

SEQ ID NO: 622783 - DNA, 20 bp, mouse
gaaagagaattttaggttta

SEQ ID NO: 622784 - DNA, 20 bp, mouse
gaagacaggagacactggaa

SEQ ID NO: 622785 - DNA, 20 bp, mouse
ggccttagaatgactcttgg

SEQ ID NO: 622786 - DNA, 20 bp, mouse
gtaaaatgagaacaactagg

SEQ ID NO: 622787 - DNA, 20 bp, mouse
ggagtgtaggcaagctacta

SEQ ID NO: 622788 - DNA, 20 bp, mouse
ggtaacaagaaatatgttcc

SEQ ID NO: 622789 - DNA, 20 bp, mouse
gatttgaagacaggagatat

SEQ ID NO: 622790 - DNA, 20 bp, mouse
gaaaaacatattctggtata

SEQ ID NO: 622791 - DNA, 20 bp, mouse
gcttacgcaaaaacatattc

SEQ ID NO: 622792 - DNA, 20 bp, mouse
ggaataaaatgagaacaact

SEQ ID NO: 622793 - DNA, 20 bp, mouse
ggaggggaagcaatagaggt

SEQ ID NO: 622794 - DNA, 20 bp, mouse
gtgaagacaggagatattgg

SEQ ID NO: 622795 - DNA, 20 bp, mouse
gattggaggggaagcaatag

SEQ ID NO: 622796 - DNA, 20 bp, mouse
ggagtgtagacaagctacaa

SEQ ID NO: 622797 - DNA, 20 bp, mouse
gattggaggggaagcagtag

SEQ ID NO: 622798 - DNA, 20 bp, mouse
gttaggagtgccagtactac

SEQ ID NO: 622799 - DNA, 20 bp, mouse
gtcctatattcctgtagtac

SEQ ID NO: 622800 - DNA, 20 bp, mouse
gaaaaacatattctgctata

SEQ ID NO: 622801 - DNA, 20 bp, mouse
gaataaaatgagaacaacta

SEQ ID NO: 622802 - DNA, 20 bp, mouse
ggaggggaagcagtagaggt

SEQ ID NO: 622803 - DNA, 20 bp, mouse
ggccagtactacaggaatat

SEQ ID NO: 622804 - DNA, 20 bp, mouse
gtacaagggcaaacctccta

SEQ ID NO: 622805 - DNA, 20 bp, mouse
ggttgttctcattttattcc

SEQ ID NO: 622806 - DNA, 20 bp, mouse
ggaggggaagcggtagagat

SEQ ID NO: 622807 - DNA, 20 bp, mouse
gagacaatgaatatgacata

SEQ ID NO: 622808 - DNA, 20 bp, mouse
gagttgaaggcaggatacat

SEQ ID NO: 622809 - DNA, 20 bp, mouse
gtcttatacgtctagagtac

SEQ ID NO: 622810 - DNA, 20 bp, mouse
gattgttctcatttcattcc

SEQ ID NO: 622811 - DNA, 20 bp, mouse
gtcctgccttcaactttatg

SEQ ID NO: 622812 - DNA, 20 bp, mouse
ggattgtagccaggagaatc

SEQ ID NO: 622813 - DNA, 20 bp, mouse
gtaagtgtacctgattctcc

SEQ ID NO: 622814 - DNA, 20 bp, mouse
gttctcgaccagtcactcta

SEQ ID NO: 622815 - DNA, 20 bp, mouse
gcaaacagacagagagatag

SEQ ID NO: 622816 - DNA, 20 bp, mouse
gcaacctgcaagtcatattc

SEQ ID NO: 622817 - DNA, 20 bp, mouse
gcctcacacatgggagattc

SEQ ID NO: 622818 - DNA, 20 bp, mouse
gtaggggaagtggttttcta

SEQ ID NO: 622819 - DNA, 20 bp, mouse
gttgagtagccagaaaagag

SEQ ID NO: 622820 - DNA, 20 bp, mouse
gaactgaaatctaggctcca

SEQ ID NO: 622821 - DNA, 20 bp, mouse
gagaccagaatatgacttgc

SEQ ID NO: 622822 - DNA, 20 bp, mouse
gcctcagtttataggggaag

SEQ ID NO: 622823 - DNA, 20 bp, mouse
gcaaggtatccactcttttc

SEQ ID NO: 622824 - DNA, 20 bp, mouse
gtgactttacctcagtttat

SEQ ID NO: 622825 - DNA, 20 bp, mouse
gggaagtggttttctatggc

SEQ ID NO: 622826 - DNA, 20 bp, mouse
ggcaagagtgagaacttcaa

SEQ ID NO: 622827 - DNA, 20 bp, mouse
gtccttgtgaaaaagaatgg

SEQ ID NO: 622828 - DNA, 20 bp, mouse
gagctccttgtgaaaaagaa

SEQ ID NO: 622829 - DNA, 20 bp, mouse
gacccccattctttttcaca

SEQ ID NO: 622830 - DNA, 20 bp, mouse
gtttcacaaggagctgcgac

SEQ ID NO: 622831 - DNA, 20 bp, mouse
gaccattctgttgttattgg

SEQ ID NO: 622832 - DNA, 20 bp, mouse
gggatttactgtgtttttgt

SEQ ID NO: 622833 - DNA, 20 bp, mouse
gtgggtggctagaaaagaat

SEQ ID NO: 622834 - DNA, 20 bp, mouse
gcagcatacaaggacaggga

SEQ ID NO: 622835 - DNA, 20 bp, mouse
ggggacagcatacaaggaca

SEQ ID NO: 622836 - DNA, 20 bp, mouse
gaataactctgacacggaac

SEQ ID NO: 622837 - DNA, 20 bp, mouse
ggccacccagattaatgtga

SEQ ID NO: 622838 - DNA, 20 bp, mouse
gcgaatcagccatgtgtgaa

SEQ ID NO: 622839 - DNA, 20 bp, mouse
gccaataaataactctgaca

SEQ ID NO: 622840 - DNA, 20 bp, mouse
gactttgtcaaagtttatag

SEQ ID NO: 622841 - DNA, 20 bp, mouse
gtgaaaggactggttatcat

SEQ ID NO: 622842 - DNA, 20 bp, mouse
ggtcagcagagaacactttt

SEQ ID NO: 622843 - DNA, 20 bp, mouse
gtgttagaaatatagaacct

SEQ ID NO: 622844 - DNA, 20 bp, mouse
gggatggttctagtatgaat

SEQ ID NO: 622845 - DNA, 20 bp, mouse
gagaacttaaactggaatac

SEQ ID NO: 622846 - DNA, 20 bp, mouse
gctcaatgttgaacttctca

SEQ ID NO: 622847 - DNA, 20 bp, mouse
gtaaacctgaatgaagtcaa

SEQ ID NO: 622848 - DNA, 20 bp, mouse
gacatttcttgagggctctg

SEQ ID NO: 622849 - DNA, 20 bp, mouse
gtaacttgaacatttcttga

SEQ ID NO: 622850 - DNA, 20 bp, mouse
gtgcagtgaaaactgttaat

SEQ ID NO: 622851 - DNA, 20 bp, mouse
ggtgaaaactgttaatagga

SEQ ID NO: 622852 - DNA, 20 bp, mouse
gggctctgaggataaagatt

SEQ ID NO: 622853 - DNA, 20 bp, mouse
gtagactctgacttaaatac

SEQ ID NO: 622854 - DNA, 20 bp, mouse
gatggaaaaatataatttca

SEQ ID NO: 622855 - DNA, 20 bp, mouse
gagaataccaaaaccttcat

SEQ ID NO: 622856 - DNA, 20 bp, mouse
gatattctccatgtttaaca

SEQ ID NO: 622857 - DNA, 20 bp, mouse
gttttctggtatactgcata

SEQ ID NO: 622858 - DNA, 20 bp, mouse
gagacatttcctcagttttc

SEQ ID NO: 622859 - DNA, 20 bp, mouse
gatgtggtgcagtctcttaa

SEQ ID NO: 622860 - DNA, 20 bp, mouse
gcagcagtgagcagctgctg

SEQ ID NO: 622861 - DNA, 20 bp, mouse
ggagagaaccatgttaaaca

SEQ ID NO: 622862 - DNA, 20 bp, mouse
gtgcagtctcttaatggtga

SEQ ID NO: 622863 - DNA, 20 bp, mouse
gacccggtagctccacatgg

SEQ ID NO: 622864 - DNA, 20 bp, mouse
ggctacccggtagctccaca

SEQ ID NO: 622865 - DNA, 20 bp, mouse
gctccacatggaggcactga

SEQ ID NO: 622866 - DNA, 20 bp, mouse
gacatttttttcaatgcagg

SEQ ID NO: 622867 - DNA, 20 bp, mouse
gctcacatttttttcaatgc

SEQ ID NO: 622868 - DNA, 20 bp, mouse
ggacgaaactctgggtcacc

SEQ ID NO: 622869 - DNA, 20 bp, mouse
gacccggtagccccacatgg

SEQ ID NO: 622870 - DNA, 20 bp, mouse
gtccctcagtgcctccatgt

SEQ ID NO: 622871 - DNA, 20 bp, mouse
gatggaggaaagaaccatgt

SEQ ID NO: 622872 - DNA, 20 bp, mouse
ggtcacccggtagccccaca

SEQ ID NO: 622873 - DNA, 20 bp, mouse
gccccacatggaggcactga

SEQ ID NO: 622874 - DNA, 20 bp, mouse
gacatggggagaatatttca

SEQ ID NO: 622875 - DNA, 20 bp, mouse
gaaagaaccatgttggacat

SEQ ID NO: 622876 - DNA, 20 bp, mouse
gctcacattttttaatgcag

SEQ ID NO: 622877 - DNA, 20 bp, mouse
ggggctgtacaagttttccc

SEQ ID NO: 622878 - DNA, 20 bp, mouse
gatggaggagagaactatgt

SEQ ID NO: 622879 - DNA, 20 bp, mouse
gtccatgtggggctaccggg

SEQ ID NO: 622880 - DNA, 20 bp, mouse
gccccacatggagacactga

SEQ ID NO: 622881 - DNA, 20 bp, mouse
gtccctcagtgtctccatgt

SEQ ID NO: 622882 - DNA, 20 bp, mouse
gagaactatgttggacatgg

SEQ ID NO: 622883 - DNA, 20 bp, mouse
ggtctccatgtggggctacc

SEQ ID NO: 622884 - DNA, 20 bp, mouse
gacatggggggaatatttca

SEQ ID NO: 622885 - DNA, 20 bp, mouse
gctaaattgtcaatacatgg

SEQ ID NO: 622886 - DNA, 20 bp, mouse
gcagtgtcaaattaggcaac

SEQ ID NO: 622887 - DNA, 20 bp, mouse
gtccctcagcgtttccatgt

SEQ ID NO: 622888 - DNA, 20 bp, mouse
gactctggggactcagcgca

SEQ ID NO: 622889 - DNA, 20 bp, mouse
gcttctctattcgaaactct

SEQ ID NO: 622890 - DNA, 20 bp, mouse
gctcctcaggctgctttggt

SEQ ID NO: 622891 - DNA, 20 bp, mouse
ggagccctctatgaaacaat

SEQ ID NO: 622892 - DNA, 20 bp, mouse
gccacattcactaaacaata

SEQ ID NO: 622893 - DNA, 20 bp, mouse
gaaagcccattgtttcatag

SEQ ID NO: 622894 - DNA, 20 bp, mouse
gtctgtttttttgtcaatgc

SEQ ID NO: 622895 - DNA, 20 bp, mouse
gtccatgtggggctaccggg

SEQ ID NO: 622896 - DNA, 20 bp, mouse
gtagcacatatatccagtaa

SEQ ID NO: 622897 - DNA, 20 bp, mouse
gcatatcctggaagtagtat

SEQ ID NO: 622898 - DNA, 20 bp, mouse
gatgtgctatgaaacaatcg

SEQ ID NO: 622899 - DNA, 20 bp, mouse
gagtatgggtccaattcatg

SEQ ID NO: 622900 - DNA, 20 bp, mouse
ggtgtgctgtaaatatgaag

SEQ ID NO: 622901 - DNA, 20 bp, mouse
gttggacccatactacttcc

SEQ ID NO: 622902 - DNA, 20 bp, mouse
gatggatgaaaactctcatg

SEQ ID NO: 622903 - DNA, 20 bp, mouse
gatttgagagtgaaaaacag

SEQ ID NO: 622904 - DNA, 20 bp, mouse
gaaccatgttccacatgaat

SEQ ID NO: 622905 - DNA, 20 bp, mouse
gatttaatctaagtatgatc

SEQ ID NO: 622906 - DNA, 20 bp, mouse
gtgtatggcagatatttacc

SEQ ID NO: 622907 - DNA, 20 bp, mouse
gacacaggaaacaaagttcc

SEQ ID NO: 622908 - DNA, 20 bp, mouse
gacttctttttcttcttata

SEQ ID NO: 622909 - DNA, 20 bp, mouse
ggacagatacacatcttaat

SEQ ID NO: 622910 - DNA, 20 bp, mouse
gttcttcttataaggaaaaa

SEQ ID NO: 622911 - DNA, 20 bp, mouse
gcacaaaaatgggaatacat

SEQ ID NO: 622912 - DNA, 20 bp, mouse
gggaatacataggagcccaa

SEQ ID NO: 622913 - DNA, 20 bp, mouse
gttatgacttattaggtata

SEQ ID NO: 622914 - DNA, 20 bp, mouse
ggtgattacttttaccgtga

SEQ ID NO: 622915 - DNA, 20 bp, mouse
ggatttttgaatggaaaaga

SEQ ID NO: 622916 - DNA, 20 bp, mouse
gcaaacaaattggaatatac

SEQ ID NO: 622917 - DNA, 20 bp, mouse
gtaaaggcacacaaacaaat

SEQ ID NO: 622918 - DNA, 20 bp, mouse
ggatttttgaatggaaaggt

SEQ ID NO: 622919 - DNA, 20 bp, mouse
gaaatattcaaattatatgg

SEQ ID NO: 622920 - DNA, 20 bp, mouse
gcatgacaaacaaacgatta

SEQ ID NO: 622921 - DNA, 20 bp, mouse
gatggatattaaataacagc

SEQ ID NO: 622922 - DNA, 20 bp, mouse
gttatgacttattagataca

SEQ ID NO: 622923 - DNA, 20 bp, mouse
ggtgttatgatttcagtgta

SEQ ID NO: 622924 - DNA, 20 bp, mouse
gggaatatacaggaagacaa

SEQ ID NO: 622925 - DNA, 20 bp, mouse
gtgtatggcatatatttatc

SEQ ID NO: 622926 - DNA, 20 bp, mouse
gctccttgtgaaaaaaatgg

SEQ ID NO: 622927 - DNA, 20 bp, mouse
gcagctccttgtgaaaaaaa

SEQ ID NO: 622928 - DNA, 20 bp, mouse
gtacccccatttttttcaca

SEQ ID NO: 622929 - DNA, 20 bp, mouse
gtagtgcctttatctttcaa

SEQ ID NO: 622930 - DNA, 20 bp, mouse
gtgaaaaaaatgggggtatc

SEQ ID NO: 622931 - DNA, 20 bp, mouse
ggagacatctcagaagcctg

SEQ ID NO: 622932 - DNA, 20 bp, mouse
gggatttactgtgtttttgt

SEQ ID NO: 622933 - DNA, 20 bp, mouse
gtgggtggctagaaaagaat

SEQ ID NO: 622934 - DNA, 20 bp, mouse
gtaacattctggtcaatatg

SEQ ID NO: 622935 - DNA, 20 bp, mouse
ggggacagcatacaaggaca

SEQ ID NO: 622936 - DNA, 20 bp, mouse
gggaaaatacaggaacacaa

SEQ ID NO: 622937 - DNA, 20 bp, mouse
ggaacacaaaggtaaaaatc

SEQ ID NO: 622938 - DNA, 20 bp, mouse
gctatatctaataaatcata

SEQ ID NO: 622939 - DNA, 20 bp, mouse
ggatagtcttgaaaattata

SEQ ID NO: 622940 - DNA, 20 bp, mouse
gcatggtacacaaaagataa

SEQ ID NO: 622941 - DNA, 20 bp, mouse
gcataaaaatgggaaaatac

SEQ ID NO: 622942 - DNA, 20 bp, mouse
gaaggattgtgaaaaaataa

SEQ ID NO: 622943 - DNA, 20 bp, mouse
gacttgaggagatttgagaa

SEQ ID NO: 622944 - DNA, 20 bp, mouse
gtaatcttgtgttacacaca

SEQ ID NO: 622945 - DNA, 20 bp, mouse
ggtaaaggcacacataaaaa

SEQ ID NO: 622946 - DNA, 20 bp, mouse
gggcaggtgtatacattaat

SEQ ID NO: 622947 - DNA, 20 bp, mouse
gagttattattcaatatcca

SEQ ID NO: 622948 - DNA, 20 bp, mouse
gacaagaagacatacttgaa

SEQ ID NO: 622949 - DNA, 20 bp, mouse
gtgtatggcaaaaatttatc

SEQ ID NO: 622950 - DNA, 20 bp, mouse
gttcttataacattatgtat

SEQ ID NO: 622951 - DNA, 20 bp, mouse
gcatgacaaagaaaagaccc

SEQ ID NO: 622952 - DNA, 20 bp, mouse
ggatttttgaaacgaaaaga

SEQ ID NO: 622953 - DNA, 20 bp, mouse
gattacttttccttttacag

SEQ ID NO: 622954 - DNA, 20 bp, mouse
gagaaaatatttaatttatc

SEQ ID NO: 622955 - DNA, 20 bp, mouse
gggaatatacaggagcccat

SEQ ID NO: 622956 - DNA, 20 bp, mouse
gaagtgctatggaacaatca

SEQ ID NO: 622957 - DNA, 20 bp, mouse
gcatatcctggaaaaagtat

SEQ ID NO: 622958 - DNA, 20 bp, mouse
gttactgtgtgaacatatcc

SEQ ID NO: 622959 - DNA, 20 bp, mouse
gcagcgattgtgaaaaactc

SEQ ID NO: 622960 - DNA, 20 bp, mouse
gagtatgggtcaatttcatg

SEQ ID NO: 622961 - DNA, 20 bp, mouse
gaacttcaaagctttgagag

SEQ ID NO: 622962 - DNA, 20 bp, mouse
gattgacccatactttttcc

SEQ ID NO: 622963 - DNA, 20 bp, mouse
ggtcaatttcatggggaaca

SEQ ID NO: 622964 - DNA, 20 bp, mouse
gtagcacttatcaccagtaa

SEQ ID NO: 622965 - DNA, 20 bp, mouse
ggaagttctaatatgatata

SEQ ID NO: 622966 - DNA, 20 bp, mouse
gtagtatagttcaatttcat

SEQ ID NO: 622967 - DNA, 20 bp, mouse
gttcaatttcatgggaaaca

SEQ ID NO: 622968 - DNA, 20 bp, mouse
gaaatgctatggaaaaatca

SEQ ID NO: 622969 - DNA, 20 bp, mouse
gaacttcagagatttgagag

SEQ ID NO: 622970 - DNA, 20 bp, mouse
gacttctttttctctttcaa

SEQ ID NO: 622971 - DNA, 20 bp, mouse
gattgaactatactatttcc

SEQ ID NO: 622972 - DNA, 20 bp, mouse
gttgtgacataaaggaagta

SEQ ID NO: 622973 - DNA, 20 bp, mouse
gaattgtcacatctccttct

SEQ ID NO: 622974 - DNA, 20 bp, mouse
ggaataattgtacttacttt

SEQ ID NO: 622975 - DNA, 20 bp, mouse
gaggaatatacttaccaaga

SEQ ID NO: 622976 - DNA, 20 bp, mouse
gcaagaaatactccaggatt

SEQ ID NO: 622977 - DNA, 20 bp, mouse
ggtgtactagggataaagat

SEQ ID NO: 622978 - DNA, 20 bp, mouse
gtagtaaataatgtgtacta

SEQ ID NO: 622979 - DNA, 20 bp, mouse
gatgtctttcttcctaatcc

SEQ ID NO: 622980 - DNA, 20 bp, mouse
gaagtagacatagagaatta

SEQ ID NO: 622981 - DNA, 20 bp, mouse
ggaggcacttacaaaatatc

SEQ ID NO: 622982 - DNA, 20 bp, mouse
gtatctggatttccattgaa

SEQ ID NO: 622983 - DNA, 20 bp, mouse
gaatgcctaatccagaaata

SEQ ID NO: 622984 - DNA, 20 bp, mouse
gagtggtttaggtaggaaat

SEQ ID NO: 622985 - DNA, 20 bp, mouse
gtactgaatgatcctttcaa

SEQ ID NO: 622986 - DNA, 20 bp, mouse
ggtagcaagaccaataccat

SEQ ID NO: 622987 - DNA, 20 bp, mouse
gtcaaaaatgtagaacaata

SEQ ID NO: 622988 - DNA, 20 bp, mouse
gtagaatgctttgtctcaca

SEQ ID NO: 622989 - DNA, 20 bp, mouse
gaatgaatgacccatggtat

SEQ ID NO: 622990 - DNA, 20 bp, mouse
gattttgttatctcctagaa

SEQ ID NO: 622991 - DNA, 20 bp, mouse
gttatctcctagatggtttt

SEQ ID NO: 622992 - DNA, 20 bp, mouse
gctcaaatgacaaaaaatag

SEQ ID NO: 622993 - DNA, 20 bp, mouse
ggggagagccagaagacgca

SEQ ID NO: 622994 - DNA, 20 bp, mouse
gcatgataccatgcgtcttc

SEQ ID NO: 622995 - DNA, 20 bp, mouse
gaagacaccaaaaaccatct

SEQ ID NO: 622996 - DNA, 20 bp, mouse
ggtatctcctagattttttt

SEQ ID NO: 622997 - DNA, 20 bp, mouse
gatctgaagaaaaaataact

SEQ ID NO: 622998 - DNA, 20 bp, mouse
gttcacataaccgcgctttg

SEQ ID NO: 622999 - DNA, 20 bp, mouse
gctagcaaatttttcaattc

SEQ ID NO: 623000 - DNA, 20 bp, mouse
gctcaaatgacaaaacataa

SEQ ID NO: 623001 - DNA, 20 bp, mouse
gtgaccccaaatgcttttgg

SEQ ID NO: 623002 - DNA, 20 bp, mouse
gcagaattcacatagtatca

SEQ ID NO: 623003 - DNA, 20 bp, mouse
gaagataccaaaaaaaatct

SEQ ID NO: 623004 - DNA, 20 bp, mouse
gaagctgaatgaatgacaca

SEQ ID NO: 623005 - DNA, 20 bp, mouse
gtatcctccaaaagcatttg

SEQ ID NO: 623006 - DNA, 20 bp, mouse
gggcagtctctctactagca

SEQ ID NO: 623007 - DNA, 20 bp, mouse
gttcacataaccatgccttg

SEQ ID NO: 623008 - DNA, 20 bp, mouse
gtttggaaattgtcaaatta

SEQ ID NO: 623009 - DNA, 20 bp, mouse
gtttctatttccacaaggca

SEQ ID NO: 623010 - DNA, 20 bp, mouse
gtctgtcatctggtttctga

SEQ ID NO: 623011 - DNA, 20 bp, mouse
gtttggatatgtcctagaaa

SEQ ID NO: 623012 - DNA, 20 bp, mouse
gcagaattcacatagtctca

SEQ ID NO: 623013 - DNA, 20 bp, mouse
gcaagatattatagagatac

SEQ ID NO: 623014 - DNA, 20 bp, mouse
gcttgtaattttttcaattc

SEQ ID NO: 623015 - DNA, 20 bp, mouse
gaagatactgaaaataatct

SEQ ID NO: 623016 - DNA, 20 bp, mouse
gaatatagacaagaagtaag

SEQ ID NO: 623017 - DNA, 20 bp, mouse
gagaagcatggtcaatacat

SEQ ID NO: 623018 - DNA, 20 bp, mouse
ggggagtctctttagaagca

SEQ ID NO: 623019 - DNA, 20 bp, mouse
gtgttttatgagtaccttat

SEQ ID NO: 623020 - DNA, 20 bp, mouse
gtgaaaaaaaaaaaccaata

SEQ ID NO: 623021 - DNA, 20 bp, mouse
gaagaaactgaaaatgatct

SEQ ID NO: 623022 - DNA, 20 bp, mouse
gaatgctgggatgtagacca

SEQ ID NO: 623023 - DNA, 20 bp, mouse
gtttattctccaaaagcaac

SEQ ID NO: 623024 - DNA, 20 bp, mouse
gcatggaaccatgtgccttc

SEQ ID NO: 623025 - DNA, 20 bp, mouse
gctagaaagggagagccaga

SEQ ID NO: 623026 - DNA, 20 bp, mouse
gttcttaattctttatacgt

SEQ ID NO: 623027 - DNA, 20 bp, mouse
ggtcacaggagtaggctcat

SEQ ID NO: 623028 - DNA, 20 bp, mouse
gctcatgggaaccgtaagtg

SEQ ID NO: 623029 - DNA, 20 bp, mouse
ggatgaatatcttagatctc

SEQ ID NO: 623030 - DNA, 20 bp, mouse
gtggtctacaaataacccag

SEQ ID NO: 623031 - DNA, 20 bp, mouse
gatatagtcaatgcagtgaa

SEQ ID NO: 623032 - DNA, 20 bp, mouse
ggtgtaacaccaccacaaaa

SEQ ID NO: 623033 - DNA, 20 bp, mouse
gtatttatgagcttgtaata

SEQ ID NO: 623034 - DNA, 20 bp, mouse
gcatactgactgctgaccac

SEQ ID NO: 623035 - DNA, 20 bp, mouse
gatttctacagaataagtag

SEQ ID NO: 623036 - DNA, 20 bp, mouse
ggtagaaatttctataccgt

SEQ ID NO: 623037 - DNA, 20 bp, mouse
gttattttatgtttaaatgg

SEQ ID NO: 623038 - DNA, 20 bp, mouse
gaaccagaagacagagttca

SEQ ID NO: 623039 - DNA, 20 bp, mouse
gaagacactgaaaataatat

SEQ ID NO: 623040 - DNA, 20 bp, mouse
gaagacattatagagatact

SEQ ID NO: 623041 - DNA, 20 bp, mouse
gttaaacataaaataaaatt

SEQ ID NO: 623042 - DNA, 20 bp, mouse
gaatttggttatctcctaga

SEQ ID NO: 623043 - DNA, 20 bp, mouse
gtcttctggctcttccttct

SEQ ID NO: 623044 - DNA, 20 bp, mouse
ggaaaaaatacgttggaaat

SEQ ID NO: 623045 - DNA, 20 bp, mouse
gtggtattttctttcaattc

SEQ ID NO: 623046 - DNA, 20 bp, mouse
gttctggctctccctttcta

SEQ ID NO: 623047 - DNA, 20 bp, mouse
ggtagcatggtcaataccat

SEQ ID NO: 623048 - DNA, 20 bp, mouse
gtactaaatgaatgacccca

SEQ ID NO: 623049 - DNA, 20 bp, mouse
gttttggatattccctagaa

SEQ ID NO: 623050 - DNA, 20 bp, mouse
gctcagaaatgaaaaaaata

SEQ ID NO: 623051 - DNA, 20 bp, mouse
gaatctagacaagcagtaag

SEQ ID NO: 623052 - DNA, 20 bp, mouse
gttccaacttattgtgtctt

SEQ ID NO: 623053 - DNA, 20 bp, mouse
gtattttttgtttcaatttt

SEQ ID NO: 623054 - DNA, 20 bp, mouse
gaaagctgggatatagacca

SEQ ID NO: 623055 - DNA, 20 bp, mouse
ggggagtctctctagtagca

SEQ ID NO: 623056 - DNA, 20 bp, mouse
gagtatcaaggtcaatacag

SEQ ID NO: 623057 - DNA, 20 bp, mouse
gtgcaaagcatggttatata

SEQ ID NO: 623058 - DNA, 20 bp, mouse
gctctttgatcttcattttc

SEQ ID NO: 623059 - DNA, 20 bp, mouse
gaagacaccaaagacaaact

SEQ ID NO: 623060 - DNA, 20 bp, mouse
gttatctcctagtttgtctt

SEQ ID NO: 623061 - DNA, 20 bp, mouse
gtagaaattgaaactcaaaa

SEQ ID NO: 623062 - DNA, 20 bp, mouse
gtttgatttttctcctagaa

SEQ ID NO: 623063 - DNA, 20 bp, mouse
gctcaaatgacaaaaaatat

SEQ ID NO: 623064 - DNA, 20 bp, mouse
gttccaacttattatttctt

SEQ ID NO: 623065 - DNA, 20 bp, mouse
ggttggaaattgacaaattg

SEQ ID NO: 623066 - DNA, 20 bp, mouse
gtaatgggagtctctctaat

SEQ ID NO: 623067 - DNA, 20 bp, mouse
gtttggttatctcctagcaa

SEQ ID NO: 623068 - DNA, 20 bp, mouse
gtttactttaacacgaggca

SEQ ID NO: 623069 - DNA, 20 bp, mouse
gcatattttactttaacacg

SEQ ID NO: 623070 - DNA, 20 bp, mouse
gtgattttatgtttctatgg

SEQ ID NO: 623071 - DNA, 20 bp, mouse
ggggagtctctctaatagga

SEQ ID NO: 623072 - DNA, 20 bp, mouse
gttggaaattgtcaaataat

SEQ ID NO: 623073 - DNA, 20 bp, mouse
gaattgattttatgtttcta

SEQ ID NO: 623074 - DNA, 20 bp, mouse
gccaacttatttttcccctt

SEQ ID NO: 623075 - DNA, 20 bp, mouse
gaataggaaggtcaacacca

SEQ ID NO: 623076 - DNA, 20 bp, mouse
gcctagaaagaaatagccag

SEQ ID NO: 623077 - DNA, 20 bp, mouse
gagaggagcacatggtatca

SEQ ID NO: 623078 - DNA, 20 bp, mouse
gaaatagccagaggagcaca

SEQ ID NO: 623079 - DNA, 20 bp, mouse
ggttggaaactggcaattaa

SEQ ID NO: 623080 - DNA, 20 bp, mouse
gtactgtgggttatttattc

SEQ ID NO: 623081 - DNA, 20 bp, mouse
gacataaaaaaatcagaatt

SEQ ID NO: 623082 - DNA, 20 bp, mouse
gatttattttgtttcaattc

SEQ ID NO: 623083 - DNA, 20 bp, mouse
gtttctatttacactaagca

SEQ ID NO: 623084 - DNA, 20 bp, mouse
gatagcaaggtcaatactgt

SEQ ID NO: 623085 - DNA, 20 bp, mouse
ggggtgtctttctaatagca

SEQ ID NO: 623086 - DNA, 20 bp, mouse
gcaatgactgagagactggt

SEQ ID NO: 623087 - DNA, 20 bp, mouse
gcatagatactaggtagtga

SEQ ID NO: 623088 - DNA, 20 bp, mouse
gaaaaacaaggatggcgata

SEQ ID NO: 623089 - DNA, 20 bp, mouse
gtaaaaattggtgttactct

SEQ ID NO: 623090 - DNA, 20 bp, mouse
gggaaagtatcactaaaaat

SEQ ID NO: 623091 - DNA, 20 bp, mouse
gaggggaaagcataacagct

SEQ ID NO: 623092 - DNA, 20 bp, mouse
gtgtccatgcttagtataaa

SEQ ID NO: 623093 - DNA, 20 bp, mouse
gtgaagaatgaacattttag

SEQ ID NO: 623094 - DNA, 20 bp, mouse
gggagatatatgttttatca

SEQ ID NO: 623095 - DNA, 20 bp, mouse
gtaaaacatatatctccttc

SEQ ID NO: 623096 - DNA, 20 bp, mouse
gggatagtcagaagtcacat

SEQ ID NO: 623097 - DNA, 20 bp, mouse
gagcattccaattatggtga

SEQ ID NO: 623098 - DNA, 20 bp, mouse
gatctatccctcaccataat

SEQ ID NO: 623099 - DNA, 20 bp, mouse
gatgaaaattggaatataaa

SEQ ID NO: 623100 - DNA, 20 bp, mouse
gcactaattatggtagttta

SEQ ID NO: 623101 - DNA, 20 bp, mouse
gttctgactatccagtttct

SEQ ID NO: 623102 - DNA, 20 bp, mouse
gcattctttcagcatctaac

SEQ ID NO: 623103 - DNA, 20 bp, mouse
ggggaatatctctaagagca

SEQ ID NO: 623104 - DNA, 20 bp, mouse
gtattccaattttcatctta

SEQ ID NO: 623105 - DNA, 20 bp, mouse
gttattttatgtttcatggc

SEQ ID NO: 623106 - DNA, 20 bp, mouse
gggcacctatcttggtgatg

SEQ ID NO: 623107 - DNA, 20 bp, mouse
gtttatgcataaatgaaaca

SEQ ID NO: 623108 - DNA, 20 bp, mouse
gttggaaaaatgaccagctg

SEQ ID NO: 623109 - DNA, 20 bp, mouse
gtttagttttgtgccagaga

SEQ ID NO: 623110 - DNA, 20 bp, mouse
gtttgccacatcaccaagat

SEQ ID NO: 623111 - DNA, 20 bp, mouse
gcttaaactgcaaaaaagaa

SEQ ID NO: 623112 - DNA, 20 bp, mouse
gttttctcaggcacctatct

SEQ ID NO: 623113 - DNA, 20 bp, mouse
gttgcagtttaagtgacccc

SEQ ID NO: 623114 - DNA, 20 bp, mouse
gatattttatgttccacagc

SEQ ID NO: 623115 - DNA, 20 bp, mouse
ggcagcatgaagtgtcaggc

SEQ ID NO: 623116 - DNA, 20 bp, mouse
gtttgcagtgccatcaagat

SEQ ID NO: 623117 - DNA, 20 bp, mouse
gtattcattctacatctaac

SEQ ID NO: 623118 - DNA, 20 bp, mouse
gtaaccatgctttgtataca

SEQ ID NO: 623119 - DNA, 20 bp, mouse
gtttccatgtatacaaagca

SEQ ID NO: 623120 - DNA, 20 bp, mouse
gctagcacataactaaaaca

SEQ ID NO: 623121 - DNA, 20 bp, mouse
gatataaattgtcatataaa

SEQ ID NO: 623122 - DNA, 20 bp, mouse
gttcatgtgatgctagtcta

SEQ ID NO: 623123 - DNA, 20 bp, mouse
gtttagttatgtgctagaga

SEQ ID NO: 623124 - DNA, 20 bp, mouse
gtctttgacttttgtcttct

SEQ ID NO: 623125 - DNA, 20 bp, mouse
gcacataactaaaacatggc

SEQ ID NO: 623126 - DNA, 20 bp, mouse
gactttcatagtctgtccaa

SEQ ID NO: 623127 - DNA, 20 bp, mouse
gtctaactgttgagtatttg

SEQ ID NO: 623128 - DNA, 20 bp, mouse
gagtatttgtggatatcata

SEQ ID NO: 623129 - DNA, 20 bp, mouse
gaaagtacacgaggaagaac

SEQ ID NO: 623130 - DNA, 20 bp, mouse
gtaatacataacattgaaat

SEQ ID NO: 623131 - DNA, 20 bp, mouse
ggtggttaataaagtacacg

SEQ ID NO: 623132 - DNA, 20 bp, mouse
gtgactgtaattttctcctt

SEQ ID NO: 623133 - DNA, 20 bp, mouse
ggcaaatgggatcagttaca

SEQ ID NO: 623134 - DNA, 20 bp, mouse
ggctgtgtacaacaactgtg

SEQ ID NO: 623135 - DNA, 20 bp, mouse
ggccagacaatgagagagac

SEQ ID NO: 623136 - DNA, 20 bp, mouse
gaaacaaaattagagaactt

SEQ ID NO: 623137 - DNA, 20 bp, mouse
gaataattatccgtgtccat

SEQ ID NO: 623138 - DNA, 20 bp, mouse
gtgttaagatctaagtcgtg

SEQ ID NO: 623139 - DNA, 20 bp, mouse
gaaatacttgcctatggaca

SEQ ID NO: 623140 - DNA, 20 bp, mouse
ggaatggaaatacttgccta

SEQ ID NO: 623141 - DNA, 20 bp, mouse
gatacctaatacactatgat

SEQ ID NO: 623142 - DNA, 20 bp, mouse
ggaggaatttcaggtagcat

SEQ ID NO: 623143 - DNA, 20 bp, mouse
gccaagtatttctcatcacg

SEQ ID NO: 623144 - DNA, 20 bp, mouse
gtctgattctgaggaatttc

SEQ ID NO: 623145 - DNA, 20 bp, mouse
ggaacttgggagggaatata

SEQ ID NO: 623146 - DNA, 20 bp, mouse
gaataattatctgaatccat

SEQ ID NO: 623147 - DNA, 20 bp, mouse
gtgtacgtacaacaacagat

SEQ ID NO: 623148 - DNA, 20 bp, mouse
gccaagtatttcttatcatg

SEQ ID NO: 623149 - DNA, 20 bp, mouse
ggattggaaatactttccta

SEQ ID NO: 623150 - DNA, 20 bp, mouse
gtagaatacatattaaaatc

SEQ ID NO: 623151 - DNA, 20 bp, mouse
gagttccatcagagtatatt

SEQ ID NO: 623152 - DNA, 20 bp, mouse
gaatacctaatatactctga

SEQ ID NO: 623153 - DNA, 20 bp, mouse
gctcttggcttcttatcgtt

SEQ ID NO: 623154 - DNA, 20 bp, mouse
gctgttaagatctaagtcaa

SEQ ID NO: 623155 - DNA, 20 bp, mouse
gtaagatctaagtcaagggg

SEQ ID NO: 623156 - DNA, 20 bp, mouse
gggagtgcactcttagtctg

SEQ ID NO: 623157 - DNA, 20 bp, mouse
gtgtaagtaaaataatagat

SEQ ID NO: 623158 - DNA, 20 bp, mouse
ggattggagatattttccta

SEQ ID NO: 623159 - DNA, 20 bp, mouse
gcccaagtatttctcatcgt

SEQ ID NO: 623160 - DNA, 20 bp, mouse
gaataatcatctgagtccat

SEQ ID NO: 623161 - DNA, 20 bp, mouse
gatttttcttctcactttac

SEQ ID NO: 623162 - DNA, 20 bp, mouse
gtaggtgtttagtgtcagtt

SEQ ID NO: 623163 - DNA, 20 bp, mouse
gagttccatcagagtgtatt

SEQ ID NO: 623164 - DNA, 20 bp, mouse
gaacacctaatacactctga

SEQ ID NO: 623165 - DNA, 20 bp, mouse
gccccacgatgagaaatact

SEQ ID NO: 623166 - DNA, 20 bp, mouse
gtactctgactcagatagac

SEQ ID NO: 623167 - DNA, 20 bp, mouse
gcaagttctaggccatggga

SEQ ID NO: 623168 - DNA, 20 bp, mouse
gcaaatccacacttaaccta

SEQ ID NO: 623169 - DNA, 20 bp, mouse
gacaaatgccaactctcatc

SEQ ID NO: 623170 - DNA, 20 bp, mouse
ggtatctactacaccatgat

SEQ ID NO: 623171 - DNA, 20 bp, mouse
gtaaagagagggtcttggat

SEQ ID NO: 623172 - DNA, 20 bp, mouse
ggttggcatttgtagcagcc

SEQ ID NO: 623173 - DNA, 20 bp, mouse
gctgccaagttctaggccat

SEQ ID NO: 623174 - DNA, 20 bp, mouse
gtgtaagtgaaacaatagat

SEQ ID NO: 623175 - DNA, 20 bp, mouse
gatgttccctaggttaagtg

SEQ ID NO: 623176 - DNA, 20 bp, mouse
ggctggacaatgagatagga

SEQ ID NO: 623177 - DNA, 20 bp, mouse
ggttccactccctgtaactt

SEQ ID NO: 623178 - DNA, 20 bp, mouse
gctcccaaagttacagggag

SEQ ID NO: 623179 - DNA, 20 bp, mouse
gcagtgctggacaatgagat

SEQ ID NO: 623180 - DNA, 20 bp, mouse
gtgagtgtggttatttcgtt

SEQ ID NO: 623181 - DNA, 20 bp, mouse
ggatttttataatgtatggt

SEQ ID NO: 623182 - DNA, 20 bp, mouse
ggttctccagttcacagtgc

SEQ ID NO: 623183 - DNA, 20 bp, mouse
gagtggctcccaaagttaca

SEQ ID NO: 623184 - DNA, 20 bp, mouse
gtaatgtatggttggatttt

SEQ ID NO: 623185 - DNA, 20 bp, mouse
gaaagtagtgaatataatga

SEQ ID NO: 623186 - DNA, 20 bp, mouse
gtagttcctaaagttgcagg

SEQ ID NO: 623187 - DNA, 20 bp, mouse
gtgttgaaattgttaagctt

SEQ ID NO: 623188 - DNA, 20 bp, mouse
gcagtagttcctaaagttgc

SEQ ID NO: 623189 - DNA, 20 bp, mouse
ggctggacaatgagacagtc

SEQ ID NO: 623190 - DNA, 20 bp, mouse
gaagtttcttcatggtccaa

SEQ ID NO: 623191 - DNA, 20 bp, mouse
ggatttttataatgtaagat

SEQ ID NO: 623192 - DNA, 20 bp, mouse
gaagttgcagggggtgaaac

SEQ ID NO: 623193 - DNA, 20 bp, mouse
gtaatgtaagattggatttt

SEQ ID NO: 623194 - DNA, 20 bp, mouse
gtaattattgacattgacaa

SEQ ID NO: 623195 - DNA, 20 bp, mouse
gtgagtgtggttatttcctt

SEQ ID NO: 623196 - DNA, 20 bp, mouse
gtggacaatggagaaaccta

SEQ ID NO: 623197 - DNA, 20 bp, mouse
gtggtttctaaagttacatt

SEQ ID NO: 623198 - DNA, 20 bp, mouse
gaagttacattgggaggaac

SEQ ID NO: 623199 - DNA, 20 bp, mouse
ggctggacaatgagataatc

SEQ ID NO: 623200 - DNA, 20 bp, mouse
gggtttcttcctttggacaa

SEQ ID NO: 623201 - DNA, 20 bp, mouse
gtagtttagtctttatacat

SEQ ID NO: 623202 - DNA, 20 bp, mouse
gtttctaaagttacattggg

SEQ ID NO: 623203 - DNA, 20 bp, mouse
gtgagtgtggtttcttcctt

SEQ ID NO: 623204 - DNA, 20 bp, mouse
gagataatctggattctgtg

SEQ ID NO: 623205 - DNA, 20 bp, mouse
gtataaaaatcatcttccat

SEQ ID NO: 623206 - DNA, 20 bp, mouse
ggagggcagaacctcacagt

SEQ ID NO: 623207 - DNA, 20 bp, mouse
gttactacaatggattgtga

SEQ ID NO: 623208 - DNA, 20 bp, mouse
gctacaatggattgtgatgg

SEQ ID NO: 623209 - DNA, 20 bp, mouse
gacttctgtgttatatcagt

SEQ ID NO: 623210 - DNA, 20 bp, mouse
gactttcatcgtatgtccaa

SEQ ID NO: 623211 - DNA, 20 bp, mouse
gctattttttaatggggtgt

SEQ ID NO: 623212 - DNA, 20 bp, mouse
gatggggtgtgggataatac

SEQ ID NO: 623213 - DNA, 20 bp, mouse
gtttccactattttttaatg

SEQ ID NO: 623214 - DNA, 20 bp, mouse
gaagtacacgaggaagaaga

SEQ ID NO: 623215 - DNA, 20 bp, mouse
gtaatacataacattgaaat

SEQ ID NO: 623216 - DNA, 20 bp, mouse
ggcaggtagaagagggaacg

SEQ ID NO: 623217 - DNA, 20 bp, mouse
gctctgaggcaggtagaaga

SEQ ID NO: 623218 - DNA, 20 bp, mouse
gcagcgggagttgagggata

SEQ ID NO: 623219 - DNA, 20 bp, mouse
gaactgctatacaacaatca

SEQ ID NO: 623220 - DNA, 20 bp, mouse
ggagatgcagcgggagttga

SEQ ID NO: 623221 - DNA, 20 bp, mouse
ggctgcatctctcttcgctg

SEQ ID NO: 623222 - DNA, 20 bp, mouse
gcacatccttgaaatagtat

SEQ ID NO: 623223 - DNA, 20 bp, mouse
gttaaaggagatgtgaagat

SEQ ID NO: 623224 - DNA, 20 bp, mouse
gagtatgggtctattgtatc

SEQ ID NO: 623225 - DNA, 20 bp, mouse
gatagacccatactatttca

SEQ ID NO: 623226 - DNA, 20 bp, mouse
gttattttcctcactgaggg

SEQ ID NO: 623227 - DNA, 20 bp, mouse
gcactgagggtgggggaggt

SEQ ID NO: 623228 - DNA, 20 bp, mouse
gtggattattttcctcactg

SEQ ID NO: 623229 - DNA, 20 bp, mouse
gagccagaagattaaaatcc

SEQ ID NO: 623230 - DNA, 20 bp, mouse
gcagaagattaaaatccagg

SEQ ID NO: 623231 - DNA, 20 bp, mouse
gagaattcttatgactttga

SEQ ID NO: 623232 - DNA, 20 bp, mouse
gtaatagcagagaaaaattt

SEQ ID NO: 623233 - DNA, 20 bp, mouse
ggatatggtacagctgaatt

SEQ ID NO: 623234 - DNA, 20 bp, mouse
gtcctcactgagggtggggg

SEQ ID NO: 623235 - DNA, 20 bp, mouse
gaataagaatagccaataag

SEQ ID NO: 623236 - DNA, 20 bp, mouse
gatgagaaaaacaatccaag

SEQ ID NO: 623237 - DNA, 20 bp, mouse
gtgtttttctcattggggtg

SEQ ID NO: 623238 - DNA, 20 bp, mouse
gtggattgtttttctcattg

SEQ ID NO: 623239 - DNA, 20 bp, mouse
gcagaagattaaaatcaagg

SEQ ID NO: 623240 - DNA, 20 bp, mouse
ggctgtaccatataaatatt

SEQ ID NO: 623241 - DNA, 20 bp, mouse
gcagaattcttatgacttcg

SEQ ID NO: 623242 - DNA, 20 bp, mouse
gtatatggtacagctgaatt

SEQ ID NO: 623243 - DNA, 20 bp, mouse
gagccagaagattaaaatca

SEQ ID NO: 623244 - DNA, 20 bp, mouse
gtaatagaagagaaaaattt

SEQ ID NO: 623245 - DNA, 20 bp, mouse
gtcattggggtgggggaggt

SEQ ID NO: 623246 - DNA, 20 bp, mouse
gagcagatccttgtactaat

SEQ ID NO: 623247 - DNA, 20 bp, mouse
gtaccatacacatatttgga

SEQ ID NO: 623248 - DNA, 20 bp, mouse
gactataccatacacatatt

SEQ ID NO: 623249 - DNA, 20 bp, mouse
gagccatccaaatatgtgta

SEQ ID NO: 623250 - DNA, 20 bp, mouse
gggtgactgtattcaattta

SEQ ID NO: 623251 - DNA, 20 bp, mouse
gtttcttttggattattttc

SEQ ID NO: 623252 - DNA, 20 bp, mouse
gctcctggatttttattttc

SEQ ID NO: 623253 - DNA, 20 bp, mouse
ggtcattaaaatctactcct

SEQ ID NO: 623254 - DNA, 20 bp, mouse
gagtgttacgatttcagaga

SEQ ID NO: 623255 - DNA, 20 bp, mouse
gcatcaacttgtttttcttt

SEQ ID NO: 623256 - DNA, 20 bp, mouse
ggatatggtttagctgaatg

SEQ ID NO: 623257 - DNA, 20 bp, mouse
ggctaaaccatatcaatact

SEQ ID NO: 623258 - DNA, 20 bp, mouse
gaaaattcttatgatttaga

SEQ ID NO: 623259 - DNA, 20 bp, mouse
gattattttcctcactcaag

SEQ ID NO: 623260 - DNA, 20 bp, mouse
gaatgtcagataaacgttta

SEQ ID NO: 623261 - DNA, 20 bp, mouse
gtgaggaaaataatctaaaa

SEQ ID NO: 623262 - DNA, 20 bp, mouse
ggagatagatggaacatcta

SEQ ID NO: 623263 - DNA, 20 bp, mouse
gtgttaaaaacaacaaggtc

SEQ ID NO: 623264 - DNA, 20 bp, mouse
gtgacatcatctaatatcac

SEQ ID NO: 623265 - DNA, 20 bp, mouse
gcaaaatgttaaaaacaaca

SEQ ID NO: 623266 - DNA, 20 bp, mouse
gctacaatgtcagacacatt

SEQ ID NO: 623267 - DNA, 20 bp, mouse
gttgcagagcgagaatatac

SEQ ID NO: 623268 - DNA, 20 bp, mouse
gcaaaaccaagagatatgtt

SEQ ID NO: 623269 - DNA, 20 bp, mouse
gggctcacagctcttggtga

SEQ ID NO: 623270 - DNA, 20 bp, mouse
ggctctgcaatttgccattg

SEQ ID NO: 623271 - DNA, 20 bp, mouse
gttttacccaacatatctct

SEQ ID NO: 623272 - DNA, 20 bp, mouse
gggtgagtcttgaaacttag

SEQ ID NO: 623273 - DNA, 20 bp, mouse
gtcaattggctcacagctct

SEQ ID NO: 623274 - DNA, 20 bp, mouse
gtctttttacaattgtaatt

SEQ ID NO: 623275 - DNA, 20 bp, mouse
gtcatagtaatactttcaat

SEQ ID NO: 623276 - DNA, 20 bp, mouse
gtatggtgagattgattcac

SEQ ID NO: 623277 - DNA, 20 bp, mouse
ggttcattttaggtggacat

SEQ ID NO: 623278 - DNA, 20 bp, mouse
ggtgagattgattcactgga

SEQ ID NO: 623279 - DNA, 20 bp, mouse
ggttattgacatggaatgtg

SEQ ID NO: 623280 - DNA, 20 bp, mouse
gtgaaccatcaatgaaacaa

SEQ ID NO: 623281 - DNA, 20 bp, mouse
ggggccatctggtagagaga

SEQ ID NO: 623282 - DNA, 20 bp, mouse
gtcctttgtggtcattggga

SEQ ID NO: 623283 - DNA, 20 bp, mouse
gtccttcccaatgaccacaa

SEQ ID NO: 623284 - DNA, 20 bp, mouse
gattttaggtggacatgggt

SEQ ID NO: 623285 - DNA, 20 bp, mouse
gttcattgatggttcatttt

SEQ ID NO: 623286 - DNA, 20 bp, mouse
ggaacatcctattagatcgt

SEQ ID NO: 623287 - DNA, 20 bp, mouse
gtagattattatcctcactc

SEQ ID NO: 623288 - DNA, 20 bp, mouse
ggatttcttttccctgagtg

SEQ ID NO: 623289 - DNA, 20 bp, mouse
gagcagacccacgatctaat

SEQ ID NO: 623290 - DNA, 20 bp, mouse
ggaaaaagcagagaaaaaat

SEQ ID NO: 623291 - DNA, 20 bp, mouse
gtaacatgtactgatgttat

SEQ ID NO: 623292 - DNA, 20 bp, mouse
ggaaaaaattggaaatttgc

SEQ ID NO: 623293 - DNA, 20 bp, mouse
gaattacaacatccccttca

SEQ ID NO: 623294 - DNA, 20 bp, mouse
gagaattcttatatcttcga

SEQ ID NO: 623295 - DNA, 20 bp, mouse
ggaagaatttcaccgtgaag

SEQ ID NO: 623296 - DNA, 20 bp, mouse
ggatcatcctattagatcaa

SEQ ID NO: 623297 - DNA, 20 bp, mouse
gattattatcctcactcaga

SEQ ID NO: 623298 - DNA, 20 bp, mouse
gatctaataggatgatctct

SEQ ID NO: 623299 - DNA, 20 bp, mouse
ggaaaaagcagagaaaaaat

SEQ ID NO: 623300 - DNA, 20 bp, mouse
gtaacatgtactgatgttat

SEQ ID NO: 623301 - DNA, 20 bp, mouse
gagcagacccttgatctaat

SEQ ID NO: 623302 - DNA, 20 bp, mouse
gtatcctcactcagagggaa

SEQ ID NO: 623303 - DNA, 20 bp, mouse
ggaaaaaattggaaatttgc

SEQ ID NO: 623304 - DNA, 20 bp, mouse
gaattacaacatccccttca

SEQ ID NO: 623305 - DNA, 20 bp, mouse
gagaattcttatatcttcga

SEQ ID NO: 623306 - DNA, 20 bp, mouse
gaactaataggatggtcgct

SEQ ID NO: 623307 - DNA, 20 bp, mouse
gcacacatttcacactaaga

SEQ ID NO: 623308 - DNA, 20 bp, mouse
gcagattattttcttcactc

SEQ ID NO: 623309 - DNA, 20 bp, mouse
gtaataacaactactgatat

SEQ ID NO: 623310 - DNA, 20 bp, mouse
ggacccatgaactaatagga

SEQ ID NO: 623311 - DNA, 20 bp, mouse
gttcttcactcagggggaaa

SEQ ID NO: 623312 - DNA, 20 bp, mouse
gattattttcttcactcagg

SEQ ID NO: 623313 - DNA, 20 bp, mouse
gattgtccaaatagtagtat

SEQ ID NO: 623314 - DNA, 20 bp, mouse
gaataacaaataagagttta

SEQ ID NO: 623315 - DNA, 20 bp, mouse
gagcattcttatatcttaag

SEQ ID NO: 623316 - DNA, 20 bp, mouse
gcccagcagcagtaacagcc

SEQ ID NO: 623317 - DNA, 20 bp, mouse
gggctccacctaggtcagga

SEQ ID NO: 623318 - DNA, 20 bp, mouse
gcctaggtggagccccctca

SEQ ID NO: 623319 - DNA, 20 bp, mouse
gagaagtgaggtccactgag

SEQ ID NO: 623320 - DNA, 20 bp, mouse
gtcatgcaggatggagttgc

SEQ ID NO: 623321 - DNA, 20 bp, mouse
gctccaggaatgccttgagg

SEQ ID NO: 623322 - DNA, 20 bp, mouse
gaaggtgaaggttcagacct

SEQ ID NO: 623323 - DNA, 20 bp, mouse
ggactgggactccacgacgt

SEQ ID NO: 623324 - DNA, 20 bp, mouse
gagggaccaaagacccaacg

SEQ ID NO: 623325 - DNA, 20 bp, mouse
gccggctacactgcactcga

SEQ ID NO: 623326 - DNA, 20 bp, mouse
ggatcgcaggatcctggaag

SEQ ID NO: 623327 - DNA, 20 bp, mouse
gcacctacccgctcagaccc

SEQ ID NO: 623328 - DNA, 20 bp, mouse
gctgcgatccggagaagccg

SEQ ID NO: 623329 - DNA, 20 bp, mouse
ggagaagccggggtctgagc

SEQ ID NO: 623330 - DNA, 20 bp, mouse
ggttggctggagcccagcgg

SEQ ID NO: 623331 - DNA, 20 bp, mouse
gtctccggatcgcaggatcc

SEQ ID NO: 623332 - DNA, 20 bp, mouse
gggtgttgtgagccgcttcc

SEQ ID NO: 623333 - DNA, 20 bp, mouse
ggacgcgagcgagttccggt

SEQ ID NO: 623334 - DNA, 20 bp, mouse
gctgtgggaaagctcggctt

SEQ ID NO: 623335 - DNA, 20 bp, mouse
ggcgggtaggtgagcgaaag

SEQ ID NO: 623336 - DNA, 20 bp, mouse
gcagcatgggcatgtcttgg

SEQ ID NO: 623337 - DNA, 20 bp, mouse
gagtctttggacttcagcat

SEQ ID NO: 623338 - DNA, 20 bp, mouse
gcttcagcatgggcatgtct

SEQ ID NO: 623339 - DNA, 20 bp, mouse
gctggcttttaagacacaga

SEQ ID NO: 623340 - DNA, 20 bp, mouse
gtcctcaggactcggtactc

SEQ ID NO: 623341 - DNA, 20 bp, mouse
ggactcggtactcgggagag

SEQ ID NO: 623342 - DNA, 20 bp, mouse
gaggaaagtatccagcgaac

SEQ ID NO: 623343 - DNA, 20 bp, mouse
gctggcaacagggtgtcctt

SEQ ID NO: 623344 - DNA, 20 bp, mouse
ggctatgctaatgtagtgag

SEQ ID NO: 623345 - DNA, 20 bp, mouse
gggaccgtgtggtagggata

SEQ ID NO: 623346 - DNA, 20 bp, mouse
gtcttctactgtatctcagt

SEQ ID NO: 623347 - DNA, 20 bp, mouse
gatattcacaggcagctggc

SEQ ID NO: 623348 - DNA, 20 bp, mouse
ggcccaggctgtgggttcaa

SEQ ID NO: 623349 - DNA, 20 bp, mouse
ggtgatctctgaaaatcaga

SEQ ID NO: 623350 - DNA, 20 bp, mouse
gtccattgaacccacagcct

SEQ ID NO: 623351 - DNA, 20 bp, mouse
ggaacagggttatgcaagat

SEQ ID NO: 623352 - DNA, 20 bp, mouse
gattatggaacacggcattg

SEQ ID NO: 623353 - DNA, 20 bp, mouse
gtatggttggatcttcacca

SEQ ID NO: 623354 - DNA, 20 bp, mouse
gaccctgctcaaaacagaca

SEQ ID NO: 623355 - DNA, 20 bp, mouse
gtaggggtaaatggtctccc

SEQ ID NO: 623356 - DNA, 20 bp, mouse
ggacgggcgggtggactccg

SEQ ID NO: 623357 - DNA, 20 bp, mouse
ggccagtccgcaccccggga

SEQ ID NO: 623358 - DNA, 20 bp, mouse
gaagccggcagaaggacgcg

SEQ ID NO: 623359 - DNA, 20 bp, mouse
gaggcgcgcagggaggacag

SEQ ID NO: 623360 - DNA, 20 bp, mouse
gcgggctgctagtggaggta

SEQ ID NO: 623361 - DNA, 20 bp, mouse
gcgcccgtgaggtggatcgg

SEQ ID NO: 623362 - DNA, 20 bp, mouse
gaggacgcgcggcaagccgg

SEQ ID NO: 623363 - DNA, 20 bp, mouse
ggagtccacccgcccgtccc

SEQ ID NO: 623364 - DNA, 20 bp, mouse
gaagcagcgagagggaaacg

SEQ ID NO: 623365 - DNA, 20 bp, mouse
gcggcttcagctcgtatccc

SEQ ID NO: 623366 - DNA, 20 bp, mouse
gagagtgagtgcgggaccag

SEQ ID NO: 623367 - DNA, 20 bp, mouse
gcgcgaccacggctcctgag

SEQ ID NO: 623368 - DNA, 20 bp, mouse
gaggcagtgtgtgagaaccg

SEQ ID NO: 623369 - DNA, 20 bp, mouse
gcgagtgacgcataatatgt

SEQ ID NO: 623370 - DNA, 20 bp, mouse
gctccccccgacccctccag

SEQ ID NO: 623371 - DNA, 20 bp, mouse
gcacacacacagcgcgacca

SEQ ID NO: 623372 - DNA, 20 bp, mouse
gctgggcgagcccaccgagg

SEQ ID NO: 623373 - DNA, 20 bp, mouse
gaggtgagcggggttaggaa

SEQ ID NO: 623374 - DNA, 20 bp, mouse
gggaggggcggcacctgctt

SEQ ID NO: 623375 - DNA, 20 bp, mouse
gagaaccgtggccgctggag

SEQ ID NO: 623376 - DNA, 20 bp, mouse
ggccggagcgagaggcgcag

SEQ ID NO: 623377 - DNA, 20 bp, mouse
ggagaggcgcagcggcacgg

SEQ ID NO: 623378 - DNA, 20 bp, mouse
gaaagcacagccggagcgag

SEQ ID NO: 623379 - DNA, 20 bp, mouse
gagttcgtgagtggccaccg

SEQ ID NO: 623380 - DNA, 20 bp, mouse
ggccgctgcgcctctcgctc

SEQ ID NO: 623381 - DNA, 20 bp, mouse
gggcacggcgggtgagcagt

SEQ ID NO: 623382 - DNA, 20 bp, mouse
gtgctggctgctcgaggaag

SEQ ID NO: 623383 - DNA, 20 bp, mouse
gcgggtgagcagtgggatgc

SEQ ID NO: 623384 - DNA, 20 bp, mouse
gccggaagtgagttcgtgag

SEQ ID NO: 623385 - DNA, 20 bp, mouse
gccggctgtgctttccccgg

SEQ ID NO: 623386 - DNA, 20 bp, mouse
gtacagagcccagaaaacct

SEQ ID NO: 623387 - DNA, 20 bp, mouse
gtgctgctggcccacctcac

SEQ ID NO: 623388 - DNA, 20 bp, mouse
gtggcccacctcacaggtaa

SEQ ID NO: 623389 - DNA, 20 bp, mouse
gagggaactcttggggtcca

SEQ ID NO: 623390 - DNA, 20 bp, mouse
gggcttccttgctcctcctg

SEQ ID NO: 623391 - DNA, 20 bp, mouse
gagttcccttacctgtgagg

SEQ ID NO: 623392 - DNA, 20 bp, mouse
gaagagttcccttacctgtg

SEQ ID NO: 623393 - DNA, 20 bp, mouse
gggcagagcaaggccacagg

SEQ ID NO: 623394 - DNA, 20 bp, mouse
gtcccagctggtcaggtccc

SEQ ID NO: 623395 - DNA, 20 bp, mouse
ggcactttccttcctgcttt

SEQ ID NO: 623396 - DNA, 20 bp, mouse
ggagcagaggcaggcaacca

SEQ ID NO: 623397 - DNA, 20 bp, mouse
gaggttcctatcaggagcag

SEQ ID NO: 623398 - DNA, 20 bp, mouse
gcacagtactgcagaactct

SEQ ID NO: 623399 - DNA, 20 bp, mouse
gcaactctgtccaggactag

SEQ ID NO: 623400 - DNA, 20 bp, mouse
gagagcagagagccggctgt

SEQ ID NO: 623401 - DNA, 20 bp, mouse
ggatcctaggagaggcattg

SEQ ID NO: 623402 - DNA, 20 bp, mouse
ggcattctgagaggtctgga

SEQ ID NO: 623403 - DNA, 20 bp, mouse
gttctggccatggcctgccc

SEQ ID NO: 623404 - DNA, 20 bp, mouse
gtgtgccgtacctgccacaa

SEQ ID NO: 623405 - DNA, 20 bp, mouse
gtgaatcaacagggtaaggg

SEQ ID NO: 623406 - DNA, 20 bp, mouse
gaaacgccgccactgcaggt

SEQ ID NO: 623407 - DNA, 20 bp, mouse
gggcggcctacctgcagtgg

SEQ ID NO: 623408 - DNA, 20 bp, mouse
gcagccccatcattacccag

SEQ ID NO: 623409 - DNA, 20 bp, mouse
gggggccttcggcaagatgg

SEQ ID NO: 623410 - DNA, 20 bp, mouse
gtgccgaaggcccccgcctc

SEQ ID NO: 623411 - DNA, 20 bp, mouse
gggagccgctgggtaatgat

SEQ ID NO: 623412 - DNA, 20 bp, mouse
gaagcagcggatcccgacac

SEQ ID NO: 623413 - DNA, 20 bp, mouse
gatttcgcttccggaggcgg

SEQ ID NO: 623414 - DNA, 20 bp, mouse
gcacgtgatttcgcttccgg

SEQ ID NO: 623415 - DNA, 20 bp, mouse
ggcggatcccgacacaggcg

SEQ ID NO: 623416 - DNA, 20 bp, mouse
gcgaccgcgagccccacaga

SEQ ID NO: 623417 - DNA, 20 bp, mouse
gggctcgcggtcgggttgag

SEQ ID NO: 623418 - DNA, 20 bp, mouse
gtcccggcccgctccagcta

SEQ ID NO: 623419 - DNA, 20 bp, mouse
ggcccgctccagctacggtg

SEQ ID NO: 623420 - DNA, 20 bp, mouse
gcggctaccttccttctgtg

SEQ ID NO: 623421 - DNA, 20 bp, mouse
ggtctcccgcgaccctggag

SEQ ID NO: 623422 - DNA, 20 bp, mouse
gcggtcgggttgaggggacc

SEQ ID NO: 623423 - DNA, 20 bp, mouse
gctacggtgcgggtgctgcc

SEQ ID NO: 623424 - DNA, 20 bp, mouse
gcggttcctgggagactatg

SEQ ID NO: 623425 - DNA, 20 bp, mouse
gggctgctcctccctcgaga

SEQ ID NO: 623426 - DNA, 20 bp, mouse
ggcggacgccaggtacccgg

SEQ ID NO: 623427 - DNA, 20 bp, mouse
gtaaacacgccacagagcgg

SEQ ID NO: 623428 - DNA, 20 bp, mouse
ggcctcacctgacgaggagt

SEQ ID NO: 623429 - DNA, 20 bp, mouse
gtggcgtgtttaccttggag

SEQ ID NO: 623430 - DNA, 20 bp, mouse
gtaccttggagcgggtgcgg

SEQ ID NO: 623431 - DNA, 20 bp, mouse
gagcgcacgccgccgctctg

SEQ ID NO: 623432 - DNA, 20 bp, mouse
ggtttaccttggagcgggtg

SEQ ID NO: 623433 - DNA, 20 bp, mouse
ggcggcggacgccaggtacc

SEQ ID NO: 623434 - DNA, 20 bp, mouse
gtccggccataggaccgagc

SEQ ID NO: 623435 - DNA, 20 bp, mouse
ggcctactcctcgtcaggtg

SEQ ID NO: 623436 - DNA, 20 bp, mouse
gcacgtagtcccctaggaag

SEQ ID NO: 623437 - DNA, 20 bp, mouse
gtgtcgatgtagccacacag

SEQ ID NO: 623438 - DNA, 20 bp, mouse
ggttctccacgtagtcccct

SEQ ID NO: 623439 - DNA, 20 bp, mouse
gcaccatggcggggaccagg

SEQ ID NO: 623440 - DNA, 20 bp, mouse
gcagcccggggaggtaggat

SEQ ID NO: 623441 - DNA, 20 bp, mouse
ggtggctacatcgacagcag

SEQ ID NO: 623442 - DNA, 20 bp, mouse
ggggaccaggaggcgggaga

SEQ ID NO: 623443 - DNA, 20 bp, mouse
gttgctgaaccgcttcctag

SEQ ID NO: 623444 - DNA, 20 bp, mouse
gcagcaccatggcggggacc

SEQ ID NO: 623445 - DNA, 20 bp, mouse
gagctaaagctggggatctg

SEQ ID NO: 623446 - DNA, 20 bp, mouse
gagctgcagtcagtgctcaa

SEQ ID NO: 623447 - DNA, 20 bp, mouse
gacgttcttgggaagtagaa

SEQ ID NO: 623448 - DNA, 20 bp, mouse
gtggcctctagtactttcca

SEQ ID NO: 623449 - DNA, 20 bp, mouse
ggccaaatgggaacaaaggt

SEQ ID NO: 623450 - DNA, 20 bp, mouse
ggagtctttagtcacctaaa

SEQ ID NO: 623451 - DNA, 20 bp, mouse
gaccactctacccaactggg

SEQ ID NO: 623452 - DNA, 20 bp, mouse
gacctcccagttgggtagag

SEQ ID NO: 623453 - DNA, 20 bp, mouse
gccaccatggaaagtactag

SEQ ID NO: 623454 - DNA, 20 bp, mouse
gcctgagaaacggatgagaa

SEQ ID NO: 623455 - DNA, 20 bp, mouse
gtatagagaagggtgtgcat

SEQ ID NO: 623456 - DNA, 20 bp, mouse
gccgccagctgtactagaca

SEQ ID NO: 623457 - DNA, 20 bp, mouse
gaaaaggcagagtccccgag

SEQ ID NO: 623458 - DNA, 20 bp, mouse
ggcgaactggaatccactcg

SEQ ID NO: 623459 - DNA, 20 bp, mouse
gcgctaggcgggtttttcct

SEQ ID NO: 623460 - DNA, 20 bp, mouse
gggactgttacactgcgaac

SEQ ID NO: 623461 - DNA, 20 bp, mouse
gctggcgtccgtccctatgg

SEQ ID NO: 623462 - DNA, 20 bp, mouse
gtgctgaagtcggaccacag

SEQ ID NO: 623463 - DNA, 20 bp, mouse
gcgtaaagtggcagacgctc

SEQ ID NO: 623464 - DNA, 20 bp, mouse
ggtgctggcgtccgtcccta

SEQ ID NO: 623465 - DNA, 20 bp, mouse
gagtccatgtctagtacagc

SEQ ID NO: 623466 - DNA, 20 bp, mouse
gtccagtcccaagagattat

SEQ ID NO: 623467 - DNA, 20 bp, mouse
gttacctgggatctgctaag

SEQ ID NO: 623468 - DNA, 20 bp, mouse
gggtaatcacaacctcgccc

SEQ ID NO: 623469 - DNA, 20 bp, mouse
ggctccccttagcagatccc

SEQ ID NO: 623470 - DNA, 20 bp, mouse
gtcataagcacgcgtcacgg

SEQ ID NO: 623471 - DNA, 20 bp, mouse
gaggagccccaactagtcca

SEQ ID NO: 623472 - DNA, 20 bp, mouse
gggggagcctataatctctt

SEQ ID NO: 623473 - DNA, 20 bp, mouse
gagactggttgccctagcgt

SEQ ID NO: 623474 - DNA, 20 bp, mouse
gcaggatctgtcagacgctg

SEQ ID NO: 623475 - DNA, 20 bp, mouse
gtaagcacgcgtcacggggg

SEQ ID NO: 623476 - DNA, 20 bp, mouse
gcgtaaagaagggcgggaag

SEQ ID NO: 623477 - DNA, 20 bp, mouse
ggcctcacgtaaagaagggc

SEQ ID NO: 623478 - DNA, 20 bp, mouse
ggatggcgatgagtttcgag

SEQ ID NO: 623479 - DNA, 20 bp, mouse
ggcgggaagcggtactgcca

SEQ ID NO: 623480 - DNA, 20 bp, mouse
ggagaccggaagccccttgt

SEQ ID NO: 623481 - DNA, 20 bp, mouse
gagcctagcagcacgttagg

SEQ ID NO: 623482 - DNA, 20 bp, mouse
ggatgagtttcgagtggccg

SEQ ID NO: 623483 - DNA, 20 bp, mouse
gattaaagcgtggaagaggg

SEQ ID NO: 623484 - DNA, 20 bp, mouse
gcgtagtagcccagaaaacc

SEQ ID NO: 623485 - DNA, 20 bp, mouse
ggggcgaagggagcaggacg

SEQ ID NO: 623486 - DNA, 20 bp, mouse
gtgggtgagatggcgaggag

SEQ ID NO: 623487 - DNA, 20 bp, mouse
gcggctcgggccggggatat

SEQ ID NO: 623488 - DNA, 20 bp, mouse
gcgccgtgccagcccctccg

SEQ ID NO: 623489 - DNA, 20 bp, mouse
gcagcagcaacagcggaggg

SEQ ID NO: 623490 - DNA, 20 bp, mouse
ggaagcggcgcagcttcctg

SEQ ID NO: 623491 - DNA, 20 bp, mouse
gcagcagcagcaacagcgga

SEQ ID NO: 623492 - DNA, 20 bp, mouse
gctcccacccgggcccgaca

SEQ ID NO: 623493 - DNA, 20 bp, mouse
gagctgcgccgcttcctcgg

SEQ ID NO: 623494 - DNA, 20 bp, mouse
ggcgggggcgcctatatccc

SEQ ID NO: 623495 - DNA, 20 bp, mouse
gagatgtgggaggtccggga

SEQ ID NO: 623496 - DNA, 20 bp, mouse
gcttctgagggaaagccgag

SEQ ID NO: 623497 - DNA, 20 bp, mouse
gcaggctgggagttcttctg

SEQ ID NO: 623498 - DNA, 20 bp, mouse
gagtggagtgggcgacccgg

SEQ ID NO: 623499 - DNA, 20 bp, mouse
gagggaaagccgagtggagt

SEQ ID NO: 623500 - DNA, 20 bp, mouse
ggacccggcggcggtgacaa

SEQ ID NO: 623501 - DNA, 20 bp, mouse
gccgagtggagtgggcgacc

SEQ ID NO: 623502 - DNA, 20 bp, mouse
gcgcgcggcgggactcccaa

SEQ ID NO: 623503 - DNA, 20 bp, mouse
gtggcctacggtcacgtgac

SEQ ID NO: 623504 - DNA, 20 bp, mouse
ggcgggcagaggctccgaca

SEQ ID NO: 623505 - DNA, 20 bp, mouse
gggtcacgtgacgggcggcg

SEQ ID NO: 623506 - DNA, 20 bp, mouse
gagaactgcctggactcccg

SEQ ID NO: 623507 - DNA, 20 bp, mouse
gacgcaccgaagtgctacgg

SEQ ID NO: 623508 - DNA, 20 bp, mouse
gcgttacgccgcgggagtcc

SEQ ID NO: 623509 - DNA, 20 bp, mouse
gactagggccctgggaggaa

SEQ ID NO: 623510 - DNA, 20 bp, mouse
ggtaacgcaccgaagtgcta

SEQ ID NO: 623511 - DNA, 20 bp, mouse
gcagcgactagggccctggg

SEQ ID NO: 623512 - DNA, 20 bp, mouse
ggtaccaacgcagatcctgg

SEQ ID NO: 623513 - DNA, 20 bp, mouse
gccgccctgcctcaccccag

SEQ ID NO: 623514 - DNA, 20 bp, mouse
gcggcgccgccgtagcactt

SEQ ID NO: 623515 - DNA, 20 bp, mouse
gagagcagcgatgcaccgag

SEQ ID NO: 623516 - DNA, 20 bp, mouse
gcaccgccgctgtgtacctg

SEQ ID NO: 623517 - DNA, 20 bp, mouse
gcgccccaggtacacagcgg

SEQ ID NO: 623518 - DNA, 20 bp, mouse
gagcttctgtcgccatctcc

SEQ ID NO: 623519 - DNA, 20 bp, mouse
gggccgggtcccctcttcat

SEQ ID NO: 623520 - DNA, 20 bp, mouse
ggcctgccgggaaacccgat

SEQ ID NO: 623521 - DNA, 20 bp, mouse
gcggaggcaaggcccaggat

SEQ ID NO: 623522 - DNA, 20 bp, mouse
gggagcagcgagagctaccg

SEQ ID NO: 623523 - DNA, 20 bp, mouse
gcggcggagtcgcagaagaa

SEQ ID NO: 623524 - DNA, 20 bp, mouse
gaccgggacacctagaccaa

SEQ ID NO: 623525 - DNA, 20 bp, mouse
gcctggggcgtttggagtcc

SEQ ID NO: 623526 - DNA, 20 bp, mouse
gaggatggtgagccccacgg

SEQ ID NO: 623527 - DNA, 20 bp, mouse
gagcctgaggaagagggcgg

SEQ ID NO: 623528 - DNA, 20 bp, mouse
ggctcaccatcctgtcacca

SEQ ID NO: 623529 - DNA, 20 bp, mouse
ggggtcgaccgaggagcctg

SEQ ID NO: 623530 - DNA, 20 bp, mouse
gggcgttcgtggtgattgaa

SEQ ID NO: 623531 - DNA, 20 bp, mouse
gcagcatcccggccccaccc

SEQ ID NO: 623532 - DNA, 20 bp, mouse
gtggtgattgaacggagccc

SEQ ID NO: 623533 - DNA, 20 bp, mouse
gcgtgggcggggcaaaggaa

SEQ ID NO: 623534 - DNA, 20 bp, mouse
gcattggtggcggaagaagt

SEQ ID NO: 623535 - DNA, 20 bp, mouse
gaagagggcggcggcgttcg

SEQ ID NO: 623536 - DNA, 20 bp, mouse
gggcggcgcacctgtcgtac

SEQ ID NO: 623537 - DNA, 20 bp, mouse
ggtgcgccgccatcttgccc

SEQ ID NO: 623538 - DNA, 20 bp, mouse
gtgcgggtgcccgggcaaga

SEQ ID NO: 623539 - DNA, 20 bp, mouse
gcgcctcgcgcagcacgttc

SEQ ID NO: 623540 - DNA, 20 bp, mouse
ggttcactcgcccgtacgac

SEQ ID NO: 623541 - DNA, 20 bp, mouse
gtggggaaatgcgggtgccc

SEQ ID NO: 623542 - DNA, 20 bp, mouse
ggcggcgtctggggaaatgc

SEQ ID NO: 623543 - DNA, 20 bp, mouse
gtcccgtcacgtgacgcagg

SEQ ID NO: 623544 - DNA, 20 bp, mouse
gtgcgctgggagcaaggtga

SEQ ID NO: 623545 - DNA, 20 bp, mouse
ggctgtgtgccgagggctgt

SEQ ID NO: 623546 - DNA, 20 bp, mouse
gtgacaggctgagtggactc

SEQ ID NO: 623547 - DNA, 20 bp, mouse
ggggcgggaccagtgactat

SEQ ID NO: 623548 - DNA, 20 bp, mouse
gcagtgactataggtctcca

SEQ ID NO: 623549 - DNA, 20 bp, mouse
gcgttgggaatcctgctgac

SEQ ID NO: 623550 - DNA, 20 bp, mouse
gcaggctgagtggactcggg

SEQ ID NO: 623551 - DNA, 20 bp, mouse
gcagcctgcagtaacacctt

SEQ ID NO: 623552 - DNA, 20 bp, mouse
gcggcacgctgccgagtgtg

SEQ ID NO: 623553 - DNA, 20 bp, mouse
gtccagagcccaggcaagcg

SEQ ID NO: 623554 - DNA, 20 bp, mouse
gcgagtgtgcggatgtcgtt

SEQ ID NO: 623555 - DNA, 20 bp, mouse
gtgaccgaccacctcccgga

SEQ ID NO: 623556 - DNA, 20 bp, mouse
ggcaaggctcggtcacctga

SEQ ID NO: 623557 - DNA, 20 bp, mouse
ggagtcgccatggtgagtga

SEQ ID NO: 623558 - DNA, 20 bp, mouse
ggagatccgcggccgaggaa

SEQ ID NO: 623559 - DNA, 20 bp, mouse
gaggctcggtcacctgacgg

SEQ ID NO: 623560 - DNA, 20 bp, mouse
gactcaccatggcgactccg

SEQ ID NO: 623561 - DNA, 20 bp, mouse
ggtggtccccggagtcgcca

SEQ ID NO: 623562 - DNA, 20 bp, mouse
gcccgcgacacccctaaggg

SEQ ID NO: 623563 - DNA, 20 bp, mouse
gcagcccgcgacacccctaa

SEQ ID NO: 623564 - DNA, 20 bp, mouse
gcgggcggctccggcggggt

SEQ ID NO: 623565 - DNA, 20 bp, mouse
gcgccagctcagaagctcgg

SEQ ID NO: 623566 - DNA, 20 bp, mouse
gccgcgctgctggataacca

SEQ ID NO: 623567 - DNA, 20 bp, mouse
ggtccacacgaagcggtcca

SEQ ID NO: 623568 - DNA, 20 bp, mouse
gaccgcttcgtgtggaccag

SEQ ID NO: 623569 - DNA, 20 bp, mouse
gggtctcgttgatctccagg

SEQ ID NO: 623570 - DNA, 20 bp, mouse
ggcagaagccggccgggtgg

SEQ ID NO: 623571 - DNA, 20 bp, mouse
ggccgctcgccggtgctccc

SEQ ID NO: 623572 - DNA, 20 bp, mouse
gtccatggccgccacccggc

SEQ ID NO: 623573 - DNA, 20 bp, mouse
gccagccgcacggtggacag

SEQ ID NO: 623574 - DNA, 20 bp, mouse
gggctccgctgtccaccgtg

SEQ ID NO: 623575 - DNA, 20 bp, mouse
gggccatggaccgcttcgtg

SEQ ID NO: 623576 - DNA, 20 bp, mouse
gtagctaactgaccccgggg

SEQ ID NO: 623577 - DNA, 20 bp, mouse
gccgggccaccaccaccccg

SEQ ID NO: 623578 - DNA, 20 bp, mouse
gctggagaagggcgactcgt

SEQ ID NO: 623579 - DNA, 20 bp, mouse
gcgtcggctggacggaaccc

SEQ ID NO: 623580 - DNA, 20 bp, mouse
gggtggcccggagcacaccg

SEQ ID NO: 623581 - DNA, 20 bp, mouse
gcgatcgcccgggaagcact

SEQ ID NO: 623582 - DNA, 20 bp, mouse
gctaactgaccccggggtgg

SEQ ID NO: 623583 - DNA, 20 bp, mouse
gagcaggccagaaccttgta

SEQ ID NO: 623584 - DNA, 20 bp, mouse
ggggcaggtgacgaacgccc

SEQ ID NO: 623585 - DNA, 20 bp, mouse
ggtgacgaacgccccggcgt

SEQ ID NO: 623586 - DNA, 20 bp, mouse
gagcttggcggcccgagtgg

SEQ ID NO: 623587 - DNA, 20 bp, mouse
gcagcgtccgagtggcggga

SEQ ID NO: 623588 - DNA, 20 bp, mouse
ggcgaagcgcgcctcgctca

SEQ ID NO: 623589 - DNA, 20 bp, mouse
ggccctgacgcgagaatcgg

SEQ ID NO: 623590 - DNA, 20 bp, mouse
gggcggcagcgtccgagtgg

SEQ ID NO: 623591 - DNA, 20 bp, mouse
gttggcggcccgagtggcgg

SEQ ID NO: 623592 - DNA, 20 bp, mouse
gtgagggcggcgcttccggt

SEQ ID NO: 623593 - DNA, 20 bp, mouse
ggagtccttgggagattcag

SEQ ID NO: 623594 - DNA, 20 bp, mouse
gcggagcttggcggcccgag

SEQ ID NO: 623595 - DNA, 20 bp, mouse
gtcgcgtcagggccccactc

SEQ ID NO: 623596 - DNA, 20 bp, mouse
gtcctgccttgtaggcctag

SEQ ID NO: 623597 - DNA, 20 bp, mouse
gggccacccctaggcctaca

SEQ ID NO: 623598 - DNA, 20 bp, mouse
gcgtctgagtgcaggtatcg

SEQ ID NO: 623599 - DNA, 20 bp, mouse
gaggtatcgtggccacccct

SEQ ID NO: 623600 - DNA, 20 bp, mouse
gcgcccgagaccttccccag

SEQ ID NO: 623601 - DNA, 20 bp, mouse
gacctgcactcagacgctgg

SEQ ID NO: 623602 - DNA, 20 bp, mouse
gcagcggcgctcacctaccg

SEQ ID NO: 623603 - DNA, 20 bp, mouse
ggcttcaggcgccacacccg

SEQ ID NO: 623604 - DNA, 20 bp, mouse
gcgccgctggggaaggtctc

SEQ ID NO: 623605 - DNA, 20 bp, mouse
ggccaccagcgtctgagtgc

SEQ ID NO: 623606 - DNA, 20 bp, mouse
gggtatgtaccgggcccggg

SEQ ID NO: 623607 - DNA, 20 bp, mouse
ggagccagcagccgagctgg

SEQ ID NO: 623608 - DNA, 20 bp, mouse
ggacccggagacccagccag

SEQ ID NO: 623609 - DNA, 20 bp, mouse
ggcgggcgggcggtatgtac

SEQ ID NO: 623610 - DNA, 20 bp, mouse
ggggcggagcggggccgatc

SEQ ID NO: 623611 - DNA, 20 bp, mouse
gcagcaggaaggtaacgcgg

SEQ ID NO: 623612 - DNA, 20 bp, mouse
gtgccaggcctcgggatcat

SEQ ID NO: 623613 - DNA, 20 bp, mouse
gcaagctggaccggatcgtg

SEQ ID NO: 623614 - DNA, 20 bp, mouse
gccccggagcatcctcggga

SEQ ID NO: 623615 - DNA, 20 bp, mouse
gcgaggcctggcagctccag

SEQ ID NO: 623616 - DNA, 20 bp, mouse
gctgtagcaggggtccctgg

SEQ ID NO: 623617 - DNA, 20 bp, mouse
gaaggcaacaggaagtccgg

SEQ ID NO: 623618 - DNA, 20 bp, mouse
ggaagactcgtattccacca

SEQ ID NO: 623619 - DNA, 20 bp, mouse
gccaggcagtcgatctgcag

SEQ ID NO: 623620 - DNA, 20 bp, mouse
gctcacgccgagctatagag

SEQ ID NO: 623621 - DNA, 20 bp, mouse
gagcctgccgtccgaaaaca

SEQ ID NO: 623622 - DNA, 20 bp, mouse
gaggccccgcggctcacccc

SEQ ID NO: 623623 - DNA, 20 bp, mouse
ggccctgtagcaggggtccc

SEQ ID NO: 623624 - DNA, 20 bp, mouse
gcgcaggctgtcagagaggg

SEQ ID NO: 623625 - DNA, 20 bp, mouse
gggaagtccggcggcgagga

SEQ ID NO: 623626 - DNA, 20 bp, mouse
gcagaggagcaggtaaacgc

SEQ ID NO: 623627 - DNA, 20 bp, mouse
gcgctggcagaactagttcg

SEQ ID NO: 623628 - DNA, 20 bp, mouse
gtgactctcaggctgcgcta

SEQ ID NO: 623629 - DNA, 20 bp, mouse
gctctcaggctgcgctatgg

SEQ ID NO: 623630 - DNA, 20 bp, mouse
ggtcccagaacccctcgctc

SEQ ID NO: 623631 - DNA, 20 bp, mouse
gagctggagacccgagcgag

SEQ ID NO: 623632 - DNA, 20 bp, mouse
ggaactagttcggggcagcc

SEQ ID NO: 623633 - DNA, 20 bp, mouse
gacgcggagtgccaggaacg

SEQ ID NO: 623634 - DNA, 20 bp, mouse
ggtccgagccggccttgcct

SEQ ID NO: 623635 - DNA, 20 bp, mouse
ggaacgtggcagctctgacc

SEQ ID NO: 623636 - DNA, 20 bp, mouse
gttcatggtggcgaattgac

SEQ ID NO: 623637 - DNA, 20 bp, mouse
gtcctggctgaattaacctc

SEQ ID NO: 623638 - DNA, 20 bp, mouse
gacagcaaagaccacattca

SEQ ID NO: 623639 - DNA, 20 bp, mouse
gacggggccagcaattctaa

SEQ ID NO: 623640 - DNA, 20 bp, mouse
ggttaattcagccaggaaag

SEQ ID NO: 623641 - DNA, 20 bp, mouse
ggccagcaattctaaaggaa

SEQ ID NO: 623642 - DNA, 20 bp, mouse
ggcctgaggttaattcagcc

SEQ ID NO: 623643 - DNA, 20 bp, mouse
ggaaatgctaagttctacag

SEQ ID NO: 623644 - DNA, 20 bp, mouse
gggcatgaaggtacttctca

SEQ ID NO: 623645 - DNA, 20 bp, mouse
gtaagttctacagcggaacg

SEQ ID NO: 623646 - DNA, 20 bp, mouse
ggacctgccgggctcctaag

SEQ ID NO: 623647 - DNA, 20 bp, mouse
gactcggctcccactgctag

SEQ ID NO: 623648 - DNA, 20 bp, mouse
ggcagagctgccactagcag

SEQ ID NO: 623649 - DNA, 20 bp, mouse
gctgccgggctcctaagcgg

SEQ ID NO: 623650 - DNA, 20 bp, mouse
gtcggaggagccgaggtggt

SEQ ID NO: 623651 - DNA, 20 bp, mouse
gagcggcggacccaccacct

SEQ ID NO: 623652 - DNA, 20 bp, mouse
gcagtgggagccgagtccga

SEQ ID NO: 623653 - DNA, 20 bp, mouse
ggcaggtcggctctcggcgc

SEQ ID NO: 623654 - DNA, 20 bp, mouse
gagcccggcaggtcggctct

SEQ ID NO: 623655 - DNA, 20 bp, mouse
ggccaggccgggctccgagg

SEQ ID NO: 623656 - DNA, 20 bp, mouse
gggctctgagacccccccag

SEQ ID NO: 623657 - DNA, 20 bp, mouse
ggccatggtggagatccgag

SEQ ID NO: 623658 - DNA, 20 bp, mouse
gttttgtgcggagggtcggg

SEQ ID NO: 623659 - DNA, 20 bp, mouse
ggaggagcccagaaggaccg

SEQ ID NO: 623660 - DNA, 20 bp, mouse
ggctctccagaggggcccag

SEQ ID NO: 623661 - DNA, 20 bp, mouse
ggcccgcggggaaggagtgg

SEQ ID NO: 623662 - DNA, 20 bp, mouse
ggcgtgtgcggatgacgaag

SEQ ID NO: 623663 - DNA, 20 bp, mouse
gagacgggacccgggcgaag

SEQ ID NO: 623664 - DNA, 20 bp, mouse
gaagttttgtgcggagggtc

SEQ ID NO: 623665 - DNA, 20 bp, mouse
gtctgtagtaggggacccct

SEQ ID NO: 623666 - DNA, 20 bp, mouse
ggttgaggttggagctatgg

SEQ ID NO: 623667 - DNA, 20 bp, mouse
ggtctccaggcccggaccct

SEQ ID NO: 623668 - DNA, 20 bp, mouse
gctccaacctcaactcaaag

SEQ ID NO: 623669 - DNA, 20 bp, mouse
gtgagttgaggttggagcta

SEQ ID NO: 623670 - DNA, 20 bp, mouse
gggcggctgcggcagctgtg

SEQ ID NO: 623671 - DNA, 20 bp, mouse
ggactccccagaaggtcccg

SEQ ID NO: 623672 - DNA, 20 bp, mouse
gtccccagaaggtcccgagg

SEQ ID NO: 623673 - DNA, 20 bp, mouse
ggacccaaccgatctcaatg

SEQ ID NO: 623674 - DNA, 20 bp, mouse
gtggggcctggcctagggtc

SEQ ID NO: 623675 - DNA, 20 bp, mouse
ggcgtcggcggaaggctcac

SEQ ID NO: 623676 - DNA, 20 bp, mouse
gcggtcaagtgcaaacagga

SEQ ID NO: 623677 - DNA, 20 bp, mouse
ggcagccgcagcgaccatgg

SEQ ID NO: 623678 - DNA, 20 bp, mouse
gggctccagcctctccggtt

SEQ ID NO: 623679 - DNA, 20 bp, mouse
gcgatcggctccagcctctc

SEQ ID NO: 623680 - DNA, 20 bp, mouse
gatggcagccgcagcgacca

SEQ ID NO: 623681 - DNA, 20 bp, mouse
ggtcggaagtgaagctgcgg

SEQ ID NO: 623682 - DNA, 20 bp, mouse
ggggcgcggagcgaaggttc

SEQ ID NO: 623683 - DNA, 20 bp, mouse
gctccgcgcccacacaagaa

SEQ ID NO: 623684 - DNA, 20 bp, mouse
ggcctcagatgtagaggagg

SEQ ID NO: 623685 - DNA, 20 bp, mouse
gttgtgtgggcgcggagcga

SEQ ID NO: 623686 - DNA, 20 bp, mouse
gaggctagccgagtaagtag

SEQ ID NO: 623687 - DNA, 20 bp, mouse
gcctcgagccccgtacctgg

SEQ ID NO: 623688 - DNA, 20 bp, mouse
ggagcaagcctccaggtacg

SEQ ID NO: 623689 - DNA, 20 bp, mouse
ggagggagccgctacttact

SEQ ID NO: 623690 - DNA, 20 bp, mouse
gctccctcgagccccgtacc

SEQ ID NO: 623691 - DNA, 20 bp, mouse
ggaggaagctgcggtggaag

SEQ ID NO: 623692 - DNA, 20 bp, mouse
gctggcacttccggagaact

SEQ ID NO: 623693 - DNA, 20 bp, mouse
ggacaggtcgcgagcaggat

SEQ ID NO: 623694 - DNA, 20 bp, mouse
ggtgagcgctccaccccctc

SEQ ID NO: 623695 - DNA, 20 bp, mouse
gcctcgggaggaagctgcgg

SEQ ID NO: 623696 - DNA, 20 bp, mouse
ggcctgctgcacgctctccg

SEQ ID NO: 623697 - DNA, 20 bp, mouse
ggctggctgacaggacaccc

SEQ ID NO: 623698 - DNA, 20 bp, mouse
gtcacgccaccggcccggcg

SEQ ID NO: 623699 - DNA, 20 bp, mouse
gagcggcgctgggctcgaga

SEQ ID NO: 623700 - DNA, 20 bp, mouse
gcacccgggcgagacgtgag

SEQ ID NO: 623701 - DNA, 20 bp, mouse
ggccgcccgcctcacgccac

SEQ ID NO: 623702 - DNA, 20 bp, mouse
gttacgaggacgacaggggg

SEQ ID NO: 623703 - DNA, 20 bp, mouse
gcgacgccgcggtggattgt

SEQ ID NO: 623704 - DNA, 20 bp, mouse
gacctacctgcggtcccggg

SEQ ID NO: 623705 - DNA, 20 bp, mouse
gggctgcggcggcctggcgg

SEQ ID NO: 623706 - DNA, 20 bp, mouse
ggcggcagcgcagtcgctgt

SEQ ID NO: 623707 - DNA, 20 bp, mouse
gagaaccccgagctgggcca

SEQ ID NO: 623708 - DNA, 20 bp, mouse
gcagcccctggcccagctcg

SEQ ID NO: 623709 - DNA, 20 bp, mouse
ggctgtaggcggtatgagtt

SEQ ID NO: 623710 - DNA, 20 bp, mouse
gtctgcgagaaccccgagct

SEQ ID NO: 623711 - DNA, 20 bp, mouse
gaagagccgggcccaggaag

SEQ ID NO: 623712 - DNA, 20 bp, mouse
ggcggtatgagtttggctgg

SEQ ID NO: 623713 - DNA, 20 bp, mouse
gggccccacggaaaaccgct

SEQ ID NO: 623714 - DNA, 20 bp, mouse
ggggaaaaccctggacaaag

SEQ ID NO: 623715 - DNA, 20 bp, mouse
ggattgagaaaggctcggaa

SEQ ID NO: 623716 - DNA, 20 bp, mouse
ggtgtgctggggtcccgtca

SEQ ID NO: 623717 - DNA, 20 bp, mouse
ggtcccgtcaaggcagacgc

SEQ ID NO: 623718 - DNA, 20 bp, mouse
gagccggcgtctgccttgac

SEQ ID NO: 623719 - DNA, 20 bp, mouse
gagcacacgtgaccccgcgg

SEQ ID NO: 623720 - DNA, 20 bp, mouse
gccgccccgccccacccgtt

SEQ ID NO: 623721 - DNA, 20 bp, mouse
ggggtctgcgggagccactg

SEQ ID NO: 623722 - DNA, 20 bp, mouse
gggtaacacgtattccgaac

SEQ ID NO: 623723 - DNA, 20 bp, mouse
gcccagcacacgtgaccccg

SEQ ID NO: 623724 - DNA, 20 bp, mouse
ggaatacgtgttacctgagc

SEQ ID NO: 623725 - DNA, 20 bp, mouse
gcaggtgtgccccaatccga

SEQ ID NO: 623726 - DNA, 20 bp, mouse
gaggccatcgagctagacac

SEQ ID NO: 623727 - DNA, 20 bp, mouse
gccgctgcggccggggacgg

SEQ ID NO: 623728 - DNA, 20 bp, mouse
ggtttcatggcgctctgcag

SEQ ID NO: 623729 - DNA, 20 bp, mouse
gggcttcgccccgccgtccc

SEQ ID NO: 623730 - DNA, 20 bp, mouse
gcccggggcccggaggctaa

SEQ ID NO: 623731 - DNA, 20 bp, mouse
gtctagctcgatggccttgt

SEQ ID NO: 623732 - DNA, 20 bp, mouse
ggcgggcgtgtagagggatt

SEQ ID NO: 623733 - DNA, 20 bp, mouse
ggcggtgtgacataaggagg

SEQ ID NO: 623734 - DNA, 20 bp, mouse
ggaggccctttgcccctggt

SEQ ID NO: 623735 - DNA, 20 bp, mouse
ggaggcggtgtgacataagg

SEQ ID NO: 623736 - DNA, 20 bp, mouse
gacccagagcggccaactcg

SEQ ID NO: 623737 - DNA, 20 bp, mouse
gtagtcccgccaccacccca

SEQ ID NO: 623738 - DNA, 20 bp, mouse
gtgggtaggtcgcgagtcta

SEQ ID NO: 623739 - DNA, 20 bp, mouse
gcacggctccctacccagag

SEQ ID NO: 623740 - DNA, 20 bp, mouse
gtacgctgtggaccgcgagt

SEQ ID NO: 623741 - DNA, 20 bp, mouse
gcccggtgcagtgtcttcag

SEQ ID NO: 623742 - DNA, 20 bp, mouse
gagcctagccgggaccaggg

SEQ ID NO: 623743 - DNA, 20 bp, mouse
gggtcgcgagtctagggaag

SEQ ID NO: 623744 - DNA, 20 bp, mouse
gcgcgagtctagggaagcgg

SEQ ID NO: 623745 - DNA, 20 bp, mouse
gcagagaagcgaggattccc

SEQ ID NO: 623746 - DNA, 20 bp, mouse
gagcgctgtggggactccgg

SEQ ID NO: 623747 - DNA, 20 bp, mouse
ggagcccggagaggcccacc

SEQ ID NO: 623748 - DNA, 20 bp, mouse
gtaaggcctcgcagccaggt

SEQ ID NO: 623749 - DNA, 20 bp, mouse
ggcgtcggagccggggtgga

SEQ ID NO: 623750 - DNA, 20 bp, mouse
gcagccaggtgggcctctcc

SEQ ID NO: 623751 - DNA, 20 bp, mouse
gtcgccgctcaaggccggga

SEQ ID NO: 623752 - DNA, 20 bp, mouse
gcggcctccgccagactctg

SEQ ID NO: 623753 - DNA, 20 bp, mouse
ggaacccagtgcctccgagg

SEQ ID NO: 623754 - DNA, 20 bp, mouse
ggcgggccgggacaacgccg

SEQ ID NO: 623755 - DNA, 20 bp, mouse
gaaccgggcgagcgtcaccc

SEQ ID NO: 623756 - DNA, 20 bp, mouse
gccgatccggagcagaaact

SEQ ID NO: 623757 - DNA, 20 bp, mouse
gttctgcggggcaactgtaa

SEQ ID NO: 623758 - DNA, 20 bp, mouse
gccggactctcactccgatc

SEQ ID NO: 623759 - DNA, 20 bp, mouse
gtgccccgcagaaacttccg

SEQ ID NO: 623760 - DNA, 20 bp, mouse
gccctccccggaagtttctg

SEQ ID NO: 623761 - DNA, 20 bp, mouse
gcccgcagaaacttccgggg

SEQ ID NO: 623762 - DNA, 20 bp, mouse
gtgggcgccggggtttctca

SEQ ID NO: 623763 - DNA, 20 bp, mouse
gggaaggcggaggccgacca

SEQ ID NO: 623764 - DNA, 20 bp, mouse
gtccgggccgtgagaaaccc

SEQ ID NO: 623765 - DNA, 20 bp, mouse
gctccttcaccctccctccc

SEQ ID NO: 623766 - DNA, 20 bp, mouse
gtgagagtggagatcagcaa

SEQ ID NO: 623767 - DNA, 20 bp, mouse
ggtagaccatccatgctcaa

SEQ ID NO: 623768 - DNA, 20 bp, mouse
ggatcctgaagtcaacccct

SEQ ID NO: 623769 - DNA, 20 bp, mouse
gtcagcaagggacgctctcc

SEQ ID NO: 623770 - DNA, 20 bp, mouse
gtacagatatgagactggtt

SEQ ID NO: 623771 - DNA, 20 bp, mouse
gctaccgggagaggtcttcc

SEQ ID NO: 623772 - DNA, 20 bp, mouse
gtaaggcaccctaccgggag

SEQ ID NO: 623773 - DNA, 20 bp, mouse
gttcactacagatatgagac

SEQ ID NO: 623774 - DNA, 20 bp, mouse
gccccacccggcaagcacaa

SEQ ID NO: 623775 - DNA, 20 bp, mouse
gactggtttggccgtgagag

SEQ ID NO: 623776 - DNA, 20 bp, mouse
ggccaggctggaccactcga

SEQ ID NO: 623777 - DNA, 20 bp, mouse
gagtggtccagcctggctga

SEQ ID NO: 623778 - DNA, 20 bp, mouse
ggcctacgctatataggaag

SEQ ID NO: 623779 - DNA, 20 bp, mouse
gctcgcaccatccctcagcc

SEQ ID NO: 623780 - DNA, 20 bp, mouse
gaaggcagccagtgtggaaa

SEQ ID NO: 623781 - DNA, 20 bp, mouse
gagtaggcccgggtagggtg

SEQ ID NO: 623782 - DNA, 20 bp, mouse
gtaggacagtaggcccgggt

SEQ ID NO: 623783 - DNA, 20 bp, mouse
gaaaggcaggcggctgcagg

SEQ ID NO: 623784 - DNA, 20 bp, mouse
gagtccagcctacgctatat

SEQ ID NO: 623785 - DNA, 20 bp, mouse
ggcctcttcctatatagcgt

SEQ ID NO: 623786 - DNA, 20 bp, mouse
ggttcaggcagccttcggac

SEQ ID NO: 623787 - DNA, 20 bp, mouse
ggcagcaggtgccagtccga

SEQ ID NO: 623788 - DNA, 20 bp, mouse
gctgccttgcaggtaaggaa

SEQ ID NO: 623789 - DNA, 20 bp, mouse
ggcctagttcaggcagcctt

SEQ ID NO: 623790 - DNA, 20 bp, mouse
gttgaaactcagcctagttc

SEQ ID NO: 623791 - DNA, 20 bp, mouse
gcatcatgctgaaagtcgct

SEQ ID NO: 623792 - DNA, 20 bp, mouse
gagtgagcttaggggaaaca

SEQ ID NO: 623793 - DNA, 20 bp, mouse
gactaggctgagtttcaaat

SEQ ID NO: 623794 - DNA, 20 bp, mouse
ggaaagtcgcttggagcagc

SEQ ID NO: 623795 - DNA, 20 bp, mouse
ggtgttcggtgttgatgatt

SEQ ID NO: 623796 - DNA, 20 bp, mouse
gccagcggcgaggggctccc

SEQ ID NO: 623797 - DNA, 20 bp, mouse
gcctaggactccccggccag

SEQ ID NO: 623798 - DNA, 20 bp, mouse
gtgcggcaggacccaccgag

SEQ ID NO: 623799 - DNA, 20 bp, mouse
ggccccagaggcgatcgtcg

SEQ ID NO: 623800 - DNA, 20 bp, mouse
gaccccgacgatcgcctctg

SEQ ID NO: 623801 - DNA, 20 bp, mouse
gggcgatcgtcggggttcgg

SEQ ID NO: 623802 - DNA, 20 bp, mouse
gggcgaggggctccccggct

SEQ ID NO: 623803 - DNA, 20 bp, mouse
gcggggtgcacggggctcct

SEQ ID NO: 623804 - DNA, 20 bp, mouse
gcggggctcctaggactccc

SEQ ID NO: 623805 - DNA, 20 bp, mouse
gtcggcgggagcatcctagc

SEQ ID NO: 623806 - DNA, 20 bp, mouse
gtgatggtcacactccagag

SEQ ID NO: 623807 - DNA, 20 bp, mouse
gacttacccaggagtaggaa

SEQ ID NO: 623808 - DNA, 20 bp, mouse
gcacgagaggcccatggtga

SEQ ID NO: 623809 - DNA, 20 bp, mouse
gagggaacttacccaggagt

SEQ ID NO: 623810 - DNA, 20 bp, mouse
gtggagtgtgaccatcacca

SEQ ID NO: 623811 - DNA, 20 bp, mouse
ggagcccatggagtgtgagg

SEQ ID NO: 623812 - DNA, 20 bp, mouse
ggagcccaaagctggctgga

SEQ ID NO: 623813 - DNA, 20 bp, mouse
gaagtcccgagaggagccca

SEQ ID NO: 623814 - DNA, 20 bp, mouse
gtgctggacttgtcagacct

SEQ ID NO: 623815 - DNA, 20 bp, mouse
gtccccagcagcccactccc

SEQ ID NO: 623816 - DNA, 20 bp, mouse
gatcggtctgaaggatgtaa

SEQ ID NO: 623817 - DNA, 20 bp, mouse
gagggcagccgccttgtgtt

SEQ ID NO: 623818 - DNA, 20 bp, mouse
gctgaaggatgtaagggtct

SEQ ID NO: 623819 - DNA, 20 bp, mouse
ggccaggtatgaggatgtgt

SEQ ID NO: 623820 - DNA, 20 bp, mouse
gagggtctaggaaagcccga

SEQ ID NO: 623821 - DNA, 20 bp, mouse
ggggatcaaggcgagagctg

SEQ ID NO: 623822 - DNA, 20 bp, mouse
gtccgggtcctgttctctat

SEQ ID NO: 623823 - DNA, 20 bp, mouse
ggcaggaactgagcaggcct

SEQ ID NO: 623824 - DNA, 20 bp, mouse
gaaaggaaagcccccaccag

SEQ ID NO: 623825 - DNA, 20 bp, mouse
gcaaggcgagagctggggca

SEQ ID NO: 623826 - DNA, 20 bp, mouse
gggcagctaccagcacttcc

SEQ ID NO: 623827 - DNA, 20 bp, mouse
gaatagaagtagcttcaaat

SEQ ID NO: 623828 - DNA, 20 bp, mouse
gctgaagaacctggaagtgc

SEQ ID NO: 623829 - DNA, 20 bp, mouse
ggaagtagcttcaaatagga

SEQ ID NO: 623830 - DNA, 20 bp, mouse
gataggatggagatctcatc

SEQ ID NO: 623831 - DNA, 20 bp, mouse
gaccataggtgagcactatt

SEQ ID NO: 623832 - DNA, 20 bp, mouse
gataggtgagcactattagg

SEQ ID NO: 623833 - DNA, 20 bp, mouse
gcatcaggcttgctgttcct

SEQ ID NO: 623834 - DNA, 20 bp, mouse
gcaatatcctgccttaccat

SEQ ID NO: 623835 - DNA, 20 bp, mouse
gcagttgcctgcaattctac

SEQ ID NO: 623836 - DNA, 20 bp, mouse
ggcccagacactgcccgggg

SEQ ID NO: 623837 - DNA, 20 bp, mouse
ggcctgagctgggctccagt

SEQ ID NO: 623838 - DNA, 20 bp, mouse
gagggcccagacactgcccg

SEQ ID NO: 623839 - DNA, 20 bp, mouse
gtggagcccagctcaggcgg

SEQ ID NO: 623840 - DNA, 20 bp, mouse
gtgatccgagaggcactggt

SEQ ID NO: 623841 - DNA, 20 bp, mouse
gtgccaccccgggcagtgtc

SEQ ID NO: 623842 - DNA, 20 bp, mouse
gcacggatggatgatccgag

SEQ ID NO: 623843 - DNA, 20 bp, mouse
gagcatgatgccaaaggtca

SEQ ID NO: 623844 - DNA, 20 bp, mouse
gcacagaggagcctcacgga

SEQ ID NO: 623845 - DNA, 20 bp, mouse
gcaggagagccagtacctga

SEQ ID NO: 623846 - DNA, 20 bp, mouse
gcggccgctgcaacacgctc

SEQ ID NO: 623847 - DNA, 20 bp, mouse
gttgcgccctgcaagcccag

SEQ ID NO: 623848 - DNA, 20 bp, mouse
gtcacccgagcgtgttgcag

SEQ ID NO: 623849 - DNA, 20 bp, mouse
ggcttgcgcacgcagctcca

SEQ ID NO: 623850 - DNA, 20 bp, mouse
gggaatcccatagaaaacct

SEQ ID NO: 623851 - DNA, 20 bp, mouse
gtgaatctctgctgcagatt

SEQ ID NO: 623852 - DNA, 20 bp, mouse
gagggaccctaggttttcta

SEQ ID NO: 623853 - DNA, 20 bp, mouse
ggcgtgttgcagcggccgct

SEQ ID NO: 623854 - DNA, 20 bp, mouse
ggacccactaacgttaacca

SEQ ID NO: 623855 - DNA, 20 bp, mouse
gcggcgtgttccggggactt

SEQ ID NO: 623856 - DNA, 20 bp, mouse
gcggcggcggagacacttca

SEQ ID NO: 623857 - DNA, 20 bp, mouse
gagcggaagcagccagccgg

SEQ ID NO: 623858 - DNA, 20 bp, mouse
gggcttcaaggcacagaccc

SEQ ID NO: 623859 - DNA, 20 bp, mouse
ggaccgagctggctgcgatc

SEQ ID NO: 623860 - DNA, 20 bp, mouse
gctgcgatccggaggcttca

SEQ ID NO: 623861 - DNA, 20 bp, mouse
gcgagctggctgcgatccgg

SEQ ID NO: 623862 - DNA, 20 bp, mouse
ggggacgaactgccaggtag

SEQ ID NO: 623863 - DNA, 20 bp, mouse
gaagagtagcttggacacag

SEQ ID NO: 623864 - DNA, 20 bp, mouse
gcaagccgagcgactgacgt

SEQ ID NO: 623865 - DNA, 20 bp, mouse
gcttcacggcgtggcaaccc

SEQ ID NO: 623866 - DNA, 20 bp, mouse
gacgccaggtctgcacgccg

SEQ ID NO: 623867 - DNA, 20 bp, mouse
gcagccgcggcgtgcagacc

SEQ ID NO: 623868 - DNA, 20 bp, mouse
gcgccttgaagagtgagcgg

SEQ ID NO: 623869 - DNA, 20 bp, mouse
gctctccccgcgctgcgcta

SEQ ID NO: 623870 - DNA, 20 bp, mouse
gactcgccttgaagagtgag

SEQ ID NO: 623871 - DNA, 20 bp, mouse
gctccaccgctcactcttca

SEQ ID NO: 623872 - DNA, 20 bp, mouse
gccccgcgctgcgctacggt

SEQ ID NO: 623873 - DNA, 20 bp, mouse
ggcggtggagaaaccagcgg

SEQ ID NO: 623874 - DNA, 20 bp, mouse
gtgagcggtggagaaaccag

SEQ ID NO: 623875 - DNA, 20 bp, mouse
ggagaccaggaggcagacgt

SEQ ID NO: 623876 - DNA, 20 bp, mouse
gcgaagagtcccgcagtcgg

SEQ ID NO: 623877 - DNA, 20 bp, mouse
gagagtcccgcagtcggagg

SEQ ID NO: 623878 - DNA, 20 bp, mouse
gcagcaggagagggcggcgg

SEQ ID NO: 623879 - DNA, 20 bp, mouse
ggtcccgcagtcggaggcgg

SEQ ID NO: 623880 - DNA, 20 bp, mouse
gctgggcgccctccactacc

SEQ ID NO: 623881 - DNA, 20 bp, mouse
gtctcctgctggccccggcc

SEQ ID NO: 623882 - DNA, 20 bp, mouse
gggcggcgccgggcagggta

SEQ ID NO: 623883 - DNA, 20 bp, mouse
gctggccccgataggagaca

SEQ ID NO: 623884 - DNA, 20 bp, mouse
gaagcgaagagtcccgcagt

SEQ ID NO: 623885 - DNA, 20 bp, mouse
gcgctcgctgcctgcagccg

SEQ ID NO: 623886 - DNA, 20 bp, mouse
ggcagcgctggcccgaactg

SEQ ID NO: 623887 - DNA, 20 bp, mouse
gcggaggcggcgggaagatg

SEQ ID NO: 623888 - DNA, 20 bp, mouse
gtcacagcgccgggcggagg

SEQ ID NO: 623889 - DNA, 20 bp, mouse
gctacgccgagctggaggag

SEQ ID NO: 623890 - DNA, 20 bp, mouse
ggaccggaggagacctgagt

SEQ ID NO: 623891 - DNA, 20 bp, mouse
gccgcccggcgctgtgaccc

SEQ ID NO: 623892 - DNA, 20 bp, mouse
gcggcctccagccacagttc

SEQ ID NO: 623893 - DNA, 20 bp, mouse
gcgggcggcggcgctctccc

SEQ ID NO: 623894 - DNA, 20 bp, mouse
gcgctggcccgaactgtggc

SEQ ID NO: 623895 - DNA, 20 bp, mouse
ggggcaggactagggaccgg

SEQ ID NO: 623896 - DNA, 20 bp, mouse
gagcagagccaaggcttggg

SEQ ID NO: 623897 - DNA, 20 bp, mouse
gcctgattgggagacctcgt

SEQ ID NO: 623898 - DNA, 20 bp, mouse
ggacccaaggcatcccgctg

SEQ ID NO: 623899 - DNA, 20 bp, mouse
gggcgcagctggagagtcct

SEQ ID NO: 623900 - DNA, 20 bp, mouse
gaggctggcgcgctacgctg

SEQ ID NO: 623901 - DNA, 20 bp, mouse
gcgccccgccagcttagagg

SEQ ID NO: 623902 - DNA, 20 bp, mouse
gtaggtgggagcaacatgga

SEQ ID NO: 623903 - DNA, 20 bp, mouse
gcctcccgacagcaccatag

SEQ ID NO: 623904 - DNA, 20 bp, mouse
gcctgcagctgctccgccag

SEQ ID NO: 623905 - DNA, 20 bp, mouse
gctgagggcgagcattggac

SEQ ID NO: 623906 - DNA, 20 bp, mouse
ggccagagaggactcaactc

SEQ ID NO: 623907 - DNA, 20 bp, mouse
gtccaacagcggagatccag

SEQ ID NO: 623908 - DNA, 20 bp, mouse
gctgagaagcatgactggac

SEQ ID NO: 623909 - DNA, 20 bp, mouse
ggaggactgagaagcatgac

SEQ ID NO: 623910 - DNA, 20 bp, mouse
gtgcagaagaggctagctct

SEQ ID NO: 623911 - DNA, 20 bp, mouse
gaagcatgactggacgggat

SEQ ID NO: 623912 - DNA, 20 bp, mouse
gctgggctaagatccaacag

SEQ ID NO: 623913 - DNA, 20 bp, mouse
gcagcgcgcacgagcggcgg

SEQ ID NO: 623914 - DNA, 20 bp, mouse
gcgctccaggagtagagccc

SEQ ID NO: 623915 - DNA, 20 bp, mouse
gcgccaggctgtcctcccac

SEQ ID NO: 623916 - DNA, 20 bp, mouse
ggagcattagacaccggagg

SEQ ID NO: 623917 - DNA, 20 bp, mouse
ggctccagagcattagacac

SEQ ID NO: 623918 - DNA, 20 bp, mouse
gtggtcccaggtgccccctc

SEQ ID NO: 623919 - DNA, 20 bp, mouse
gcacgaagcggggagcccgg

SEQ ID NO: 623920 - DNA, 20 bp, mouse
gccagagcattagacaccgg

SEQ ID NO: 623921 - DNA, 20 bp, mouse
gtagctgcgacagatccctg

SEQ ID NO: 623922 - DNA, 20 bp, mouse
gccaggggccaggccgtcga

SEQ ID NO: 623923 - DNA, 20 bp, mouse
ggacaccggagggggcacct

SEQ ID NO: 623924 - DNA, 20 bp, mouse
gtcgagggcagcccgcgggt

SEQ ID NO: 623925 - DNA, 20 bp, mouse
gtgggaccaacttcacgaag

SEQ ID NO: 623926 - DNA, 20 bp, mouse
gtaaactgcgcgggcagcgg

SEQ ID NO: 623927 - DNA, 20 bp, mouse
ggcgcttccgggagtggaga

SEQ ID NO: 623928 - DNA, 20 bp, mouse
ggaagtagcgcttccgggag

SEQ ID NO: 623929 - DNA, 20 bp, mouse
ggtatctgtgaccggcgagt

SEQ ID NO: 623930 - DNA, 20 bp, mouse
gagtaggaagtagcgcttcc

SEQ ID NO: 623931 - DNA, 20 bp, mouse
ggcggggcgggcctcaagag

SEQ ID NO: 623932 - DNA, 20 bp, mouse
gtcttaaactgcgcgggcag

SEQ ID NO: 623933 - DNA, 20 bp, mouse
gggagtggagatggccgcgc

SEQ ID NO: 623934 - DNA, 20 bp, mouse
gagaattgcccgctcggagg

SEQ ID NO: 623935 - DNA, 20 bp, mouse
gaagcggaagtatctgtgac

SEQ ID NO: 623936 - DNA, 20 bp, mouse
gggaggtgctaagaacctgt

SEQ ID NO: 623937 - DNA, 20 bp, mouse
gtgtgtgtggggccagattt

SEQ ID NO: 623938 - DNA, 20 bp, mouse
gccccaaggaagccatggag

SEQ ID NO: 623939 - DNA, 20 bp, mouse
ggatgtgagtcacaacaccc

SEQ ID NO: 623940 - DNA, 20 bp, mouse
gacacagcaggactgtggga

SEQ ID NO: 623941 - DNA, 20 bp, mouse
ggtgagtcacaacacccagg

SEQ ID NO: 623942 - DNA, 20 bp, mouse
gccacagtcctgctgtgtgt

SEQ ID NO: 623943 - DNA, 20 bp, mouse
gaccctgtagcacagcccac

SEQ ID NO: 623944 - DNA, 20 bp, mouse
ggtccacagctgccttagta

SEQ ID NO: 623945 - DNA, 20 bp, mouse
gagctccactcaccaaaatc

SEQ ID NO: 623946 - DNA, 20 bp, mouse
gtcagagcgggactcgccaa

SEQ ID NO: 623947 - DNA, 20 bp, mouse
gcgggttctagcgctcagag

SEQ ID NO: 623948 - DNA, 20 bp, mouse
gggccgggcagggtactcac

SEQ ID NO: 623949 - DNA, 20 bp, mouse
gggcagggtactcaccggga

SEQ ID NO: 623950 - DNA, 20 bp, mouse
gccacagcacagcgggaacc

SEQ ID NO: 623951 - DNA, 20 bp, mouse
gagggtccctgcgccgaggc

SEQ ID NO: 623952 - DNA, 20 bp, mouse
gtcggaagacatggcagctc

SEQ ID NO: 623953 - DNA, 20 bp, mouse
gactcaccgggagggagccg

SEQ ID NO: 623954 - DNA, 20 bp, mouse
gccttcgaagtcggaagaca

SEQ ID NO: 623955 - DNA, 20 bp, mouse
gaccaggaagcggcagggct

SEQ ID NO: 623956 - DNA, 20 bp, mouse
gcgaggtgcggctgcagtga

SEQ ID NO: 623957 - DNA, 20 bp, mouse
ggctgggcagctgattgctg

SEQ ID NO: 623958 - DNA, 20 bp, mouse
gggcagctgattgctgaggt

SEQ ID NO: 623959 - DNA, 20 bp, mouse
gggaagcgcctgattccggg

SEQ ID NO: 623960 - DNA, 20 bp, mouse
gcgacctggagacaaacagt

SEQ ID NO: 623961 - DNA, 20 bp, mouse
gcttacaaggggtgccggag

SEQ ID NO: 623962 - DNA, 20 bp, mouse
gaggccgggaggactccgca

SEQ ID NO: 623963 - DNA, 20 bp, mouse
gcccggaagcgcctgattcc

SEQ ID NO: 623964 - DNA, 20 bp, mouse
gcagtgatggcttcggggct

SEQ ID NO: 623965 - DNA, 20 bp, mouse
gtcgcgccaagacgagccgg

SEQ ID NO: 623966 - DNA, 20 bp, mouse
gaggtttacagcccaatcta

SEQ ID NO: 623967 - DNA, 20 bp, mouse
gctgggctagaggcctgcca

SEQ ID NO: 623968 - DNA, 20 bp, mouse
gggcagaaacccagggaact

SEQ ID NO: 623969 - DNA, 20 bp, mouse
gtgggcaggtgccctagatt

SEQ ID NO: 623970 - DNA, 20 bp, mouse
gctctatgggagggaatatc

SEQ ID NO: 623971 - DNA, 20 bp, mouse
gctccgcgcccagcttgcca

SEQ ID NO: 623972 - DNA, 20 bp, mouse
gcttgcatgactctatggga

SEQ ID NO: 623973 - DNA, 20 bp, mouse
ggcctcaggggtgccatggc

SEQ ID NO: 623974 - DNA, 20 bp, mouse
gaagctgggcgcggagcttc

SEQ ID NO: 623975 - DNA, 20 bp, mouse
gcggcccttgcatgactcta

SEQ ID NO: 623976 - DNA, 20 bp, mouse
gagcatcgcgcctggagtgg

SEQ ID NO: 623977 - DNA, 20 bp, mouse
gaacagcatcgcgcctggag

SEQ ID NO: 623978 - DNA, 20 bp, mouse
gctactgagggacctttcag

SEQ ID NO: 623979 - DNA, 20 bp, mouse
gatcaagagcccgccactcc

SEQ ID NO: 623980 - DNA, 20 bp, mouse
ggtggggcctgactcacggt

SEQ ID NO: 623981 - DNA, 20 bp, mouse
gggcctgactcacggtagga

SEQ ID NO: 623982 - DNA, 20 bp, mouse
gcagccgccgaaccagtagg

SEQ ID NO: 623983 - DNA, 20 bp, mouse
ggtgggtggggcctgactca

SEQ ID NO: 623984 - DNA, 20 bp, mouse
gcagtaggtgggaaggccgg

SEQ ID NO: 623985 - DNA, 20 bp, mouse
ggccgaaccagtaggtggga

SEQ ID NO: 623986 - DNA, 20 bp, mouse
gcggcttggctgggcaggta

SEQ ID NO: 623987 - DNA, 20 bp, mouse
gacaaagcgaacaaagccgg

SEQ ID NO: 623988 - DNA, 20 bp, mouse
gagcgagcgtgtggaacccc

SEQ ID NO: 623989 - DNA, 20 bp, mouse
gggcggcactcggcttggct

SEQ ID NO: 623990 - DNA, 20 bp, mouse
gtgctctgagagcgagacag

SEQ ID NO: 623991 - DNA, 20 bp, mouse
gaagccggcggcactcggct

SEQ ID NO: 623992 - DNA, 20 bp, mouse
ggcggcgtcgcaccaggtaa

SEQ ID NO: 623993 - DNA, 20 bp, mouse
gagccgcagcgccccccgaa

SEQ ID NO: 623994 - DNA, 20 bp, mouse
gtcttccaggccggccgctt

SEQ ID NO: 623995 - DNA, 20 bp, mouse
ggaacaaagccggcggcact

SEQ ID NO: 623996 - DNA, 20 bp, mouse
gatggaggtgagtgtcacaa

SEQ ID NO: 623997 - DNA, 20 bp, mouse
gccactgtggggtaacacgt

SEQ ID NO: 623998 - DNA, 20 bp, mouse
gggtaacacgtaggattctg

SEQ ID NO: 623999 - DNA, 20 bp, mouse
gcatttacatctccatcttt

SEQ ID NO: 624000 - DNA, 20 bp, mouse
gaggtgagtgtcacaagggt

SEQ ID NO: 624001 - DNA, 20 bp, mouse
gagcagagcgggtgacgggt

SEQ ID NO: 624002 - DNA, 20 bp, mouse
gcagctaacacttatctcac

SEQ ID NO: 624003 - DNA, 20 bp, mouse
gctctatagcgtttgtttgg

SEQ ID NO: 624004 - DNA, 20 bp, mouse
gctgctctatagcgtttgtt

SEQ ID NO: 624005 - DNA, 20 bp, mouse
gtgggacccaagagttacca

SEQ ID NO: 624006 - DNA, 20 bp, mouse
gactccacaacttcagtctt

SEQ ID NO: 624007 - DNA, 20 bp, mouse
gcttagtttttacaacatgg

SEQ ID NO: 624008 - DNA, 20 bp, mouse
gagagtggctacccacaagt

SEQ ID NO: 624009 - DNA, 20 bp, mouse
gggtggctacttaagagatc

SEQ ID NO: 624010 - DNA, 20 bp, mouse
gggtctcgatccaccaaact

SEQ ID NO: 624011 - DNA, 20 bp, mouse
ggagccctagcctgtaaact

SEQ ID NO: 624012 - DNA, 20 bp, mouse
gagtttggctttggttaagt

SEQ ID NO: 624013 - DNA, 20 bp, mouse
ggcttcgttcaagtccacaa

SEQ ID NO: 624014 - DNA, 20 bp, mouse
gctgttcaaatcccacttgt

SEQ ID NO: 624015 - DNA, 20 bp, mouse
gctccttcctttctgcacac

SEQ ID NO: 624016 - DNA, 20 bp, mouse
gaccttttagagggatcagt

SEQ ID NO: 624017 - DNA, 20 bp, mouse
gttaaagctgcggagacttt

SEQ ID NO: 624018 - DNA, 20 bp, mouse
gaaggctcttaccttttaga

SEQ ID NO: 624019 - DNA, 20 bp, mouse
ggtggggaagaaactaatcc

SEQ ID NO: 624020 - DNA, 20 bp, mouse
ggtttccagaagatttttct

SEQ ID NO: 624021 - DNA, 20 bp, mouse
ggctggaatcaattgcagga

SEQ ID NO: 624022 - DNA, 20 bp, mouse
gactttcacttttaaagctg

SEQ ID NO: 624023 - DNA, 20 bp, mouse
gagctctccttgtaaatcga

SEQ ID NO: 624024 - DNA, 20 bp, mouse
gccttgtaaatcgaaggaag

SEQ ID NO: 624025 - DNA, 20 bp, mouse
gtctatagagaagggtttat

SEQ ID NO: 624026 - DNA, 20 bp, mouse
ggctactggagaggactccc

SEQ ID NO: 624027 - DNA, 20 bp, mouse
gaacattgcgatggctgttt

SEQ ID NO: 624028 - DNA, 20 bp, mouse
gggtacccaagcccagtgcc

SEQ ID NO: 624029 - DNA, 20 bp, mouse
gttgctcctgggacaaggta

SEQ ID NO: 624030 - DNA, 20 bp, mouse
gtacgctctgacaaaacaaa

SEQ ID NO: 624031 - DNA, 20 bp, mouse
gttgatcaagccagctgcca

SEQ ID NO: 624032 - DNA, 20 bp, mouse
gatcaatgccaacattgcga

SEQ ID NO: 624033 - DNA, 20 bp, mouse
ggccagctgccagggcagcc

SEQ ID NO: 624034 - DNA, 20 bp, mouse
gattgcgatggctgtttagg

SEQ ID NO: 624035 - DNA, 20 bp, mouse
ggcacagggaggcagctgcg

SEQ ID NO: 624036 - DNA, 20 bp, mouse
gtcaagcccaaaccacagac

SEQ ID NO: 624037 - DNA, 20 bp, mouse
gggatttggctgccagtctg

SEQ ID NO: 624038 - DNA, 20 bp, mouse
ggatttctagggataacaag

SEQ ID NO: 624039 - DNA, 20 bp, mouse
ggcatgtctgggacagtagt

SEQ ID NO: 624040 - DNA, 20 bp, mouse
gtggctgccagtctgtggtt

SEQ ID NO: 624041 - DNA, 20 bp, mouse
gttaaggcatgatgtagggt

SEQ ID NO: 624042 - DNA, 20 bp, mouse
gccccaaaactgaggtaaga

SEQ ID NO: 624043 - DNA, 20 bp, mouse
gaggcatgatgtagggtggg

SEQ ID NO: 624044 - DNA, 20 bp, mouse
gccttttaaggcatgatgta

SEQ ID NO: 624045 - DNA, 20 bp, mouse
ggcattaacttagatactca

SEQ ID NO: 624046 - DNA, 20 bp, mouse
ggcgcaggtgcaggaacaag

SEQ ID NO: 624047 - DNA, 20 bp, mouse
ggtcgcgaccagacaagagt

SEQ ID NO: 624048 - DNA, 20 bp, mouse
gcagatgtgcagaggtgtcg

SEQ ID NO: 624049 - DNA, 20 bp, mouse
ggcacctgcgcgatccacct

SEQ ID NO: 624050 - DNA, 20 bp, mouse
gctcagtggtagttccgagg

SEQ ID NO: 624051 - DNA, 20 bp, mouse
ggatctcagtggtagttccg

SEQ ID NO: 624052 - DNA, 20 bp, mouse
ggttccgaggtggatcgcgc

SEQ ID NO: 624053 - DNA, 20 bp, mouse
gagccacaggggatgctaca

SEQ ID NO: 624054 - DNA, 20 bp, mouse
gatcctgtgagtcgggagag

SEQ ID NO: 624055 - DNA, 20 bp, mouse
gtagctcacaagggtcccca

SEQ ID NO: 624056 - DNA, 20 bp, mouse
gggagacccagcttccaggt

SEQ ID NO: 624057 - DNA, 20 bp, mouse
ggatgtagcgaaagccgggg

SEQ ID NO: 624058 - DNA, 20 bp, mouse
gacatcttgtggctctgggt

SEQ ID NO: 624059 - DNA, 20 bp, mouse
ggcccagggcaggcctccgc

SEQ ID NO: 624060 - DNA, 20 bp, mouse
gtagcaaggggattgaggac

SEQ ID NO: 624061 - DNA, 20 bp, mouse
gagtgcagtgaggtgaactg

SEQ ID NO: 624062 - DNA, 20 bp, mouse
gcaagatgtagcgaaagccg

SEQ ID NO: 624063 - DNA, 20 bp, mouse
gcccagcttccaggtaggag

SEQ ID NO: 624064 - DNA, 20 bp, mouse
gcctcagtagagtgagaggg

SEQ ID NO: 624065 - DNA, 20 bp, mouse
ggcagtgaggtgaactgggg

SEQ ID NO: 624066 - DNA, 20 bp, mouse
gcggcgagcgggacaggaag

SEQ ID NO: 624067 - DNA, 20 bp, mouse
gggcatgcgtgggacctcca

SEQ ID NO: 624068 - DNA, 20 bp, mouse
gcaagcacagtccctggacc

SEQ ID NO: 624069 - DNA, 20 bp, mouse
gtggtgcaggaggcatgcgt

SEQ ID NO: 624070 - DNA, 20 bp, mouse
ggccgggcggggaccagcag

SEQ ID NO: 624071 - DNA, 20 bp, mouse
gtcgcctcctgcccggtcca

SEQ ID NO: 624072 - DNA, 20 bp, mouse
gttcggacaagcacagtccc

SEQ ID NO: 624073 - DNA, 20 bp, mouse
gagcgggacaggaagcggca

SEQ ID NO: 624074 - DNA, 20 bp, mouse
gggcgatcggcgagcgggac

SEQ ID NO: 624075 - DNA, 20 bp, mouse
ggccgcccggggctcctagg

SEQ ID NO: 624076 - DNA, 20 bp, mouse
gatgggctccgggtaagtca

SEQ ID NO: 624077 - DNA, 20 bp, mouse
gcgcggacggaaggtttaag

SEQ ID NO: 624078 - DNA, 20 bp, mouse
gggtttaagcggacggacag

SEQ ID NO: 624079 - DNA, 20 bp, mouse
gcgtagggtggcggtctcag

SEQ ID NO: 624080 - DNA, 20 bp, mouse
ggctatggcgcgcggacgga

SEQ ID NO: 624081 - DNA, 20 bp, mouse
gcaagacccgggccacacag

SEQ ID NO: 624082 - DNA, 20 bp, mouse
gcgccatagccggaacttaa

SEQ ID NO: 624083 - DNA, 20 bp, mouse
gtaagcggacggacagaggc

SEQ ID NO: 624084 - DNA, 20 bp, mouse
ggacggaaggtttaagcgga

SEQ ID NO: 624085 - DNA, 20 bp, mouse
ggcgacataagggaacccgg

SEQ ID NO: 624086 - DNA, 20 bp, mouse
gaccgagctcgcggaccagt

SEQ ID NO: 624087 - DNA, 20 bp, mouse
gcctctcccccagggcgcag

SEQ ID NO: 624088 - DNA, 20 bp, mouse
gctagcaaggagagcaagac

SEQ ID NO: 624089 - DNA, 20 bp, mouse
gggagagcaagactgggctc

SEQ ID NO: 624090 - DNA, 20 bp, mouse
gcctagagcacgcttcatgg

SEQ ID NO: 624091 - DNA, 20 bp, mouse
gtcatggtggagactcaggg

SEQ ID NO: 624092 - DNA, 20 bp, mouse
ggcttcatggtggagactca

SEQ ID NO: 624093 - DNA, 20 bp, mouse
gaccagcgcagggcggaccg

SEQ ID NO: 624094 - DNA, 20 bp, mouse
ggcccggccggtaccaggat

SEQ ID NO: 624095 - DNA, 20 bp, mouse
gctcagggaggagaaaccca

SEQ ID NO: 624096 - DNA, 20 bp, mouse
gagtcgcattcacagcccgg

SEQ ID NO: 624097 - DNA, 20 bp, mouse
gggcgactccaggctggcag

SEQ ID NO: 624098 - DNA, 20 bp, mouse
gagggacggcgactccaggc

SEQ ID NO: 624099 - DNA, 20 bp, mouse
gccgcagggacggcgactcc

SEQ ID NO: 624100 - DNA, 20 bp, mouse
ggcagtacaactgagctccg

SEQ ID NO: 624101 - DNA, 20 bp, mouse
gggcgcgcctcgagggacga

SEQ ID NO: 624102 - DNA, 20 bp, mouse
ggcgccaactgccatcgcag

SEQ ID NO: 624103 - DNA, 20 bp, mouse
gactgcacagagccaccatc

SEQ ID NO: 624104 - DNA, 20 bp, mouse
gggcatcccctaccacgtcc

SEQ ID NO: 624105 - DNA, 20 bp, mouse
gctgccatcgcagaggagct

SEQ ID NO: 624106 - DNA, 20 bp, mouse
ggggctcagaagccagttgt

SEQ ID NO: 624107 - DNA, 20 bp, mouse
gtacggcagtagaggtgact

SEQ ID NO: 624108 - DNA, 20 bp, mouse
gcagttgttggcgctgtccg

SEQ ID NO: 624109 - DNA, 20 bp, mouse
gaaaggcgcaactttaactg

SEQ ID NO: 624110 - DNA, 20 bp, mouse
gaactgtggatgtgaagcaa

SEQ ID NO: 624111 - DNA, 20 bp, mouse
gcgcaactttaactggggtt

SEQ ID NO: 624112 - DNA, 20 bp, mouse
gggaattcccggctgccggc

SEQ ID NO: 624113 - DNA, 20 bp, mouse
gagtttgcagactgctgatt

SEQ ID NO: 624114 - DNA, 20 bp, mouse
gcagtagaggtgacttggct

SEQ ID NO: 624115 - DNA, 20 bp, mouse
ggtgtttgctacggcagtag

SEQ ID NO: 624116 - DNA, 20 bp, mouse
gggactgcctaggcgggtgg

SEQ ID NO: 624117 - DNA, 20 bp, mouse
gacgcctcccggagaggcac

SEQ ID NO: 624118 - DNA, 20 bp, mouse
gctcccggagaggcaccggc

SEQ ID NO: 624119 - DNA, 20 bp, mouse
gtaggggaggactgcctagg

SEQ ID NO: 624120 - DNA, 20 bp, mouse
gactgaggacgacgagaaga

SEQ ID NO: 624121 - DNA, 20 bp, mouse
ggagggctggtggttagggg

SEQ ID NO: 624122 - DNA, 20 bp, mouse
gccggagaggcaccggcggg

SEQ ID NO: 624123 - DNA, 20 bp, mouse
gagcaacgggatcaagatgt

SEQ ID NO: 624124 - DNA, 20 bp, mouse
ggcagtggcgctagaaggct

SEQ ID NO: 624125 - DNA, 20 bp, mouse
gcctctgctgccagtcatgt

SEQ ID NO: 624126 - DNA, 20 bp, mouse
ggagaaagtccagggagtag

SEQ ID NO: 624127 - DNA, 20 bp, mouse
gtccagggagtagaggactg

SEQ ID NO: 624128 - DNA, 20 bp, mouse
gggactcgtagctcctatga

SEQ ID NO: 624129 - DNA, 20 bp, mouse
gggctggagagggcgcatag

SEQ ID NO: 624130 - DNA, 20 bp, mouse
gggacgagcggctgaatcac

SEQ ID NO: 624131 - DNA, 20 bp, mouse
gggagtagaggactggggtc

SEQ ID NO: 624132 - DNA, 20 bp, mouse
ggaagctgagttaggacgag

SEQ ID NO: 624133 - DNA, 20 bp, mouse
gtccaaatgagtgcttctaa

SEQ ID NO: 624134 - DNA, 20 bp, mouse
gcaaggtaagtggctggaga

SEQ ID NO: 624135 - DNA, 20 bp, mouse
gtggcgtcccccagacatct

SEQ ID NO: 624136 - DNA, 20 bp, mouse
gttggagctattgcaggcag

SEQ ID NO: 624137 - DNA, 20 bp, mouse
gaggtggcaccactgagtag

SEQ ID NO: 624138 - DNA, 20 bp, mouse
gctgctgtcaagttgtccag

SEQ ID NO: 624139 - DNA, 20 bp, mouse
gaccttgcccatacaaacag

SEQ ID NO: 624140 - DNA, 20 bp, mouse
ggcaacagcagagggaccat

SEQ ID NO: 624141 - DNA, 20 bp, mouse
ggcaggcagaggaatgggct

SEQ ID NO: 624142 - DNA, 20 bp, mouse
gagcggctgggtttcctcaa

SEQ ID NO: 624143 - DNA, 20 bp, mouse
gggtaattaagagaaggcca

SEQ ID NO: 624144 - DNA, 20 bp, mouse
gaaacccagccgctactcag

SEQ ID NO: 624145 - DNA, 20 bp, mouse
gcccgctggtaattaagaga

SEQ ID NO: 624146 - DNA, 20 bp, mouse
gccttcgggaagagaaccgt

SEQ ID NO: 624147 - DNA, 20 bp, mouse
gagagaaccgtggggcgcga

SEQ ID NO: 624148 - DNA, 20 bp, mouse
gggcgcgagggacgccatct

SEQ ID NO: 624149 - DNA, 20 bp, mouse
gaggaaagcagcaaccggaa

SEQ ID NO: 624150 - DNA, 20 bp, mouse
ggcctccgggctgcgcaggg

SEQ ID NO: 624151 - DNA, 20 bp, mouse
gggcgagccccggggcctcc

SEQ ID NO: 624152 - DNA, 20 bp, mouse
gcccagccggccctaagcgg

SEQ ID NO: 624153 - DNA, 20 bp, mouse
gtctcggactaaatgcggag

SEQ ID NO: 624154 - DNA, 20 bp, mouse
ggtgctccggagcctgcgtg

SEQ ID NO: 624155 - DNA, 20 bp, mouse
ggccggcgccagtaacgggg

SEQ ID NO: 624156 - DNA, 20 bp, mouse
gtgagcgagggccacctcca

SEQ ID NO: 624157 - DNA, 20 bp, mouse
ggccaagaacaaggctgatg

SEQ ID NO: 624158 - DNA, 20 bp, mouse
ggccctcgctcagaacctag

SEQ ID NO: 624159 - DNA, 20 bp, mouse
gcccctagagaagaatccaa

SEQ ID NO: 624160 - DNA, 20 bp, mouse
gatgaggcaacgcatggtac

SEQ ID NO: 624161 - DNA, 20 bp, mouse
gaggctgatgaggcaacgca

SEQ ID NO: 624162 - DNA, 20 bp, mouse
ggtgtcaggcaagtgactga

SEQ ID NO: 624163 - DNA, 20 bp, mouse
ggctgtacagccaggaacct

SEQ ID NO: 624164 - DNA, 20 bp, mouse
gacccttggattcttctcta

SEQ ID NO: 624165 - DNA, 20 bp, mouse
gtcctctaggttctgagcga

SEQ ID NO: 624166 - DNA, 20 bp, mouse
gcctgtgggaagcggagtga

SEQ ID NO: 624167 - DNA, 20 bp, mouse
gcggagcgagcggctgttgg

SEQ ID NO: 624168 - DNA, 20 bp, mouse
gagcggagtgacggagcgag

SEQ ID NO: 624169 - DNA, 20 bp, mouse
gcagcgctggagtttgaaca

SEQ ID NO: 624170 - DNA, 20 bp, mouse
gtccagcgctgaccattcac

SEQ ID NO: 624171 - DNA, 20 bp, mouse
ggcgagcggctgttggagga

SEQ ID NO: 624172 - DNA, 20 bp, mouse
gtgacggagcgagcggctgt

SEQ ID NO: 624173 - DNA, 20 bp, mouse
gcggccggcgcgcctgaggt

SEQ ID NO: 624174 - DNA, 20 bp, mouse
gagcccctcgcccctctcgg

SEQ ID NO: 624175 - DNA, 20 bp, mouse
gcaggcgcgccggccggaca

SEQ ID NO: 624176 - DNA, 20 bp, mouse
ggacgcccaagaggtaccgg

SEQ ID NO: 624177 - DNA, 20 bp, mouse
gtaccggtggctgaacttgg

SEQ ID NO: 624178 - DNA, 20 bp, mouse
gacggacgcccaagaggtac

SEQ ID NO: 624179 - DNA, 20 bp, mouse
gtgtaccacgagggaccggg

SEQ ID NO: 624180 - DNA, 20 bp, mouse
gtcagccaccggtacctctt

SEQ ID NO: 624181 - DNA, 20 bp, mouse
gactggtggggccgaagtgg

SEQ ID NO: 624182 - DNA, 20 bp, mouse
ggccgccggtaagtgaggag

SEQ ID NO: 624183 - DNA, 20 bp, mouse
gttaccggcggcccccactt

SEQ ID NO: 624184 - DNA, 20 bp, mouse
gccccctcctcacttaccgg

SEQ ID NO: 624185 - DNA, 20 bp, mouse
gcacccccaagttcagccac

SEQ ID NO: 624186 - DNA, 20 bp, mouse
ggagtgctggcgcttcatcc

SEQ ID NO: 624187 - DNA, 20 bp, mouse
gatgaagcgccagcactcac

SEQ ID NO: 624188 - DNA, 20 bp, mouse
gtcatccgggcacttcacaa

SEQ ID NO: 624189 - DNA, 20 bp, mouse
gggacctcggagagaaagtg

SEQ ID NO: 624190 - DNA, 20 bp, mouse
gaaaggacccgcagcaactc

SEQ ID NO: 624191 - DNA, 20 bp, mouse
gcctcggagagaaagtgtgg

SEQ ID NO: 624192 - DNA, 20 bp, mouse
gctgagttggggacagtcat

SEQ ID NO: 624193 - DNA, 20 bp, mouse
ggaccggctcgggttacctg

SEQ ID NO: 624194 - DNA, 20 bp, mouse
gaccccgggaagttgtaagg

SEQ ID NO: 624195 - DNA, 20 bp, mouse
ggtcataggctagtggacct

SEQ ID NO: 624196 - DNA, 20 bp, mouse
gcagaaggcagcatgaatag

SEQ ID NO: 624197 - DNA, 20 bp, mouse
gccccaggcctgcctcctac

SEQ ID NO: 624198 - DNA, 20 bp, mouse
gctgggtgcagggtaagaag

SEQ ID NO: 624199 - DNA, 20 bp, mouse
gatagtggccctggccctgt

SEQ ID NO: 624200 - DNA, 20 bp, mouse
gcggggaagaagaagtagag

SEQ ID NO: 624201 - DNA, 20 bp, mouse
gagctgtagccaggaggaag

SEQ ID NO: 624202 - DNA, 20 bp, mouse
ggcagcatgaatagtggccc

SEQ ID NO: 624203 - DNA, 20 bp, mouse
gaatctgaggagaggagatg

SEQ ID NO: 624204 - DNA, 20 bp, mouse
gggtagccagtgtctaggag

SEQ ID NO: 624205 - DNA, 20 bp, mouse
gggtgagttgggagatctcc

SEQ ID NO: 624206 - DNA, 20 bp, mouse
gccgccgggaatgccgccgg

SEQ ID NO: 624207 - DNA, 20 bp, mouse
gcgcggctcgggcgagcagt

SEQ ID NO: 624208 - DNA, 20 bp, mouse
gccgtccgtgggcaagagga

SEQ ID NO: 624209 - DNA, 20 bp, mouse
ggtcgagcgcaccgcggctc

SEQ ID NO: 624210 - DNA, 20 bp, mouse
gtcgcgcgtcgagcgcaccg

SEQ ID NO: 624211 - DNA, 20 bp, mouse
ggtacggcgcgagcccccca

SEQ ID NO: 624212 - DNA, 20 bp, mouse
gcagtgcggagccggaccgg

SEQ ID NO: 624213 - DNA, 20 bp, mouse
gctcaccgcgaaaccgtggg

SEQ ID NO: 624214 - DNA, 20 bp, mouse
ggccgccgaagcatgtagaa

SEQ ID NO: 624215 - DNA, 20 bp, mouse
ggatgagccggggtctgcag

SEQ ID NO: 624216 - DNA, 20 bp, mouse
ggactcaggccggtggagtg

SEQ ID NO: 624217 - DNA, 20 bp, mouse
gtagcagcccgcgaagcagt

SEQ ID NO: 624218 - DNA, 20 bp, mouse
ggggcgtagcgcgctgaggg

SEQ ID NO: 624219 - DNA, 20 bp, mouse
ggcccccagccgcactccac

SEQ ID NO: 624220 - DNA, 20 bp, mouse
gcacccctgcaagggtccgg

SEQ ID NO: 624221 - DNA, 20 bp, mouse
gtgccaccggacccttgcag

SEQ ID NO: 624222 - DNA, 20 bp, mouse
ggggcggggaaatcgcgtaa

SEQ ID NO: 624223 - DNA, 20 bp, mouse
gcgtaatggcggactcaggc

SEQ ID NO: 624224 - DNA, 20 bp, mouse
ggggcgcgcccggctgtgag

SEQ ID NO: 624225 - DNA, 20 bp, mouse
gcagccggtccgcgtcccca

SEQ ID NO: 624226 - DNA, 20 bp, mouse
ggtcggcccggagcctggga

SEQ ID NO: 624227 - DNA, 20 bp, mouse
gcgcgcagcggcgacagacg

SEQ ID NO: 624228 - DNA, 20 bp, mouse
gctgcggccgggagggacca

SEQ ID NO: 624229 - DNA, 20 bp, mouse
gacgcgggacgggagcaatc

SEQ ID NO: 624230 - DNA, 20 bp, mouse
gggcggcaggacgatgaagc

SEQ ID NO: 624231 - DNA, 20 bp, mouse
gtgaagccgggagcgcggcg

SEQ ID NO: 624232 - DNA, 20 bp, mouse
ggccaggccgcacgcgggac

SEQ ID NO: 624233 - DNA, 20 bp, mouse
gcgcaggccaggccgcacgc

SEQ ID NO: 624234 - DNA, 20 bp, mouse
gacgcggggcgggattccgg

SEQ ID NO: 624235 - DNA, 20 bp, mouse
ggctccgggccgacctccgg

SEQ ID NO: 624236 - DNA, 20 bp, mouse
gctgcacacttaccccaagg

SEQ ID NO: 624237 - DNA, 20 bp, mouse
gaccctgcacacttacccca

SEQ ID NO: 624238 - DNA, 20 bp, mouse
ggggcggggacgctcacgtg

SEQ ID NO: 624239 - DNA, 20 bp, mouse
gcggagagccgagcttacag

SEQ ID NO: 624240 - DNA, 20 bp, mouse
gagtgtgcagggtgggcgag

SEQ ID NO: 624241 - DNA, 20 bp, mouse
ggggtgggcgaggggcggac

SEQ ID NO: 624242 - DNA, 20 bp, mouse
gtcactcgcctccagccggt

SEQ ID NO: 624243 - DNA, 20 bp, mouse
gcggactgggagcgcaggac

SEQ ID NO: 624244 - DNA, 20 bp, mouse
gtgggagtgcgggtcaccgg

SEQ ID NO: 624245 - DNA, 20 bp, mouse
gctccagccggtgggcggca

SEQ ID NO: 624246 - DNA, 20 bp, mouse
ggcagccgcacaatccaaca

SEQ ID NO: 624247 - DNA, 20 bp, mouse
gcaatccaacatggcagcgg

SEQ ID NO: 624248 - DNA, 20 bp, mouse
gagcagcagggagcccacgt

SEQ ID NO: 624249 - DNA, 20 bp, mouse
gccctactcctccagtcctc

SEQ ID NO: 624250 - DNA, 20 bp, mouse
gcgttgtcctagcactccgg

SEQ ID NO: 624251 - DNA, 20 bp, mouse
gcgggggcgggcgagaccac

SEQ ID NO: 624252 - DNA, 20 bp, mouse
ggctgccatgttggattgtg

SEQ ID NO: 624253 - DNA, 20 bp, mouse
ggagcgacgacgggatgctg

SEQ ID NO: 624254 - DNA, 20 bp, mouse
ggcgccggaggagcgacgac

SEQ ID NO: 624255 - DNA, 20 bp, mouse
gcacgggacgcgggacgcgg

SEQ ID NO: 624256 - DNA, 20 bp, mouse
gtccggccgcggagtgatgg

SEQ ID NO: 624257 - DNA, 20 bp, mouse
gccggggagagcacctccag

SEQ ID NO: 624258 - DNA, 20 bp, mouse
gctgcccggcccatcgccac

SEQ ID NO: 624259 - DNA, 20 bp, mouse
gcggtgccaccatcactccg

SEQ ID NO: 624260 - DNA, 20 bp, mouse
gcgggcagggaccatggaag

SEQ ID NO: 624261 - DNA, 20 bp, mouse
gagctccggccgcggagtga

SEQ ID NO: 624262 - DNA, 20 bp, mouse
gcagcagcgaagaggcctgg

SEQ ID NO: 624263 - DNA, 20 bp, mouse
gacctctgccgccacttcca

SEQ ID NO: 624264 - DNA, 20 bp, mouse
ggacagagggaacctccctg

SEQ ID NO: 624265 - DNA, 20 bp, mouse
gagcaggaacagcagcgaag

SEQ ID NO: 624266 - DNA, 20 bp, mouse
gtcccgggtggttgaccgag

SEQ ID NO: 624267 - DNA, 20 bp, mouse
ggcccctcggtcaaccaccc

SEQ ID NO: 624268 - DNA, 20 bp, mouse
gcaagatggcggttcccggg

SEQ ID NO: 624269 - DNA, 20 bp, mouse
ggtggttgaccgaggggcag

SEQ ID NO: 624270 - DNA, 20 bp, mouse
ggcgcgaggtttcaagatgg

SEQ ID NO: 624271 - DNA, 20 bp, mouse
gggggcgcgaggtttcaaga

SEQ ID NO: 624272 - DNA, 20 bp, mouse
ggactgcgaggctcccggga

SEQ ID NO: 624273 - DNA, 20 bp, mouse
gcggaggactctctgcgaag

SEQ ID NO: 624274 - DNA, 20 bp, mouse
ggaccgaggggcagaggtga

SEQ ID NO: 624275 - DNA, 20 bp, mouse
gggacggcgagagcagctag

SEQ ID NO: 624276 - DNA, 20 bp, mouse
gagtgagcatggcccgtggt

SEQ ID NO: 624277 - DNA, 20 bp, mouse
gtcggagtgagcatggcccg

SEQ ID NO: 624278 - DNA, 20 bp, mouse
gcggctcgggaagggaggca

SEQ ID NO: 624279 - DNA, 20 bp, mouse
gggtcacctcagggacatgg

SEQ ID NO: 624280 - DNA, 20 bp, mouse
gctccgtgctctccgttctc

SEQ ID NO: 624281 - DNA, 20 bp, mouse
gtgtccctgaggtgacccta

SEQ ID NO: 624282 - DNA, 20 bp, mouse
gatcttcggctcgggaaggg

SEQ ID NO: 624283 - DNA, 20 bp, mouse
gtaaggtctcggagtgagca

SEQ ID NO: 624284 - DNA, 20 bp, mouse
gaaagggctctcaaaagtta

SEQ ID NO: 624285 - DNA, 20 bp, mouse
gtacctgtctaagcccccag

SEQ ID NO: 624286 - DNA, 20 bp, mouse
gaccccagtgggagagacta

SEQ ID NO: 624287 - DNA, 20 bp, mouse
gcgagtctcgggaccccagt

SEQ ID NO: 624288 - DNA, 20 bp, mouse
ggcagagcgttgcgagtctc

SEQ ID NO: 624289 - DNA, 20 bp, mouse
gctgagaggtgaaaacacgg

SEQ ID NO: 624290 - DNA, 20 bp, mouse
ggaagccgagtgaggcccac

SEQ ID NO: 624291 - DNA, 20 bp, mouse
gggtgggcggtgggatatgg

SEQ ID NO: 624292 - DNA, 20 bp, mouse
gttgatggagcgctgtgggg

SEQ ID NO: 624293 - DNA, 20 bp, mouse
gggttcaagaaatcacccgt

SEQ ID NO: 624294 - DNA, 20 bp, mouse
gtgtggtgggcggtgggata

SEQ ID NO: 624295 - DNA, 20 bp, mouse
gccggagtgctgatcagctg

SEQ ID NO: 624296 - DNA, 20 bp, mouse
ggtgaaccagaaccatacag

SEQ ID NO: 624297 - DNA, 20 bp, mouse
gccaacggcggtccactgta

SEQ ID NO: 624298 - DNA, 20 bp, mouse
gagggatggcggcccaacgg

SEQ ID NO: 624299 - DNA, 20 bp, mouse
gccatttgaagagctggcgg

SEQ ID NO: 624300 - DNA, 20 bp, mouse
ggcatgcgttcaaacgtcag

SEQ ID NO: 624301 - DNA, 20 bp, mouse
ggggcggagctccgaggaaa

SEQ ID NO: 624302 - DNA, 20 bp, mouse
gcggagctccgaggaaaggg

SEQ ID NO: 624303 - DNA, 20 bp, mouse
gtgcgttcaaacgtcagggg

SEQ ID NO: 624304 - DNA, 20 bp, mouse
gtttgaagagctggcggcgg

SEQ ID NO: 624305 - DNA, 20 bp, mouse
gatgagggatggcggcccaa

SEQ ID NO: 624306 - DNA, 20 bp, mouse
gggctcaagccaggacctct

SEQ ID NO: 624307 - DNA, 20 bp, mouse
gcggtctcggcgtccccccc

SEQ ID NO: 624308 - DNA, 20 bp, mouse
gcgccgagaccgagaggtcc

SEQ ID NO: 624309 - DNA, 20 bp, mouse
gggaaacgccgtacccgggg

SEQ ID NO: 624310 - DNA, 20 bp, mouse
gggccgccgtagtccacccg

SEQ ID NO: 624311 - DNA, 20 bp, mouse
gcgtttccacgggtggacta

SEQ ID NO: 624312 - DNA, 20 bp, mouse
gagccaggacctctcggtct

SEQ ID NO: 624313 - DNA, 20 bp, mouse
gccgggtacggcgtttccac

SEQ ID NO: 624314 - DNA, 20 bp, mouse
ggctcactgatgtccgccgg

SEQ ID NO: 624315 - DNA, 20 bp, mouse
gtcctggcttgagccaccgg

SEQ ID NO: 624316 - DNA, 20 bp, mouse
gcggtggtgcgagaggccag

SEQ ID NO: 624317 - DNA, 20 bp, mouse
gcctttagccttgcagacgg

SEQ ID NO: 624318 - DNA, 20 bp, mouse
gctggtccttgtttccatct

SEQ ID NO: 624319 - DNA, 20 bp, mouse
gttgcagacggtggtgcgag

SEQ ID NO: 624320 - DNA, 20 bp, mouse
gctccctttagccttgcaga

SEQ ID NO: 624321 - DNA, 20 bp, mouse
gtgtagtttacagtggtcta

SEQ ID NO: 624322 - DNA, 20 bp, mouse
gtgtaaactacaaaaatcct

SEQ ID NO: 624323 - DNA, 20 bp, mouse
gcacttgtgaaacgactagg

SEQ ID NO: 624324 - DNA, 20 bp, mouse
gggtcccaagagaaaacaag

SEQ ID NO: 624325 - DNA, 20 bp, mouse
ggctaacttgcggggtggga

SEQ ID NO: 624326 - DNA, 20 bp, mouse
gggcgtgacgcggaggatgt

SEQ ID NO: 624327 - DNA, 20 bp, mouse
gagatggcggcgcccataag

SEQ ID NO: 624328 - DNA, 20 bp, mouse
gaagcggttgaggcgtgacg

SEQ ID NO: 624329 - DNA, 20 bp, mouse
gcaagggtgacacaagatgg

SEQ ID NO: 624330 - DNA, 20 bp, mouse
gcgcggcccccgcagagccc

SEQ ID NO: 624331 - DNA, 20 bp, mouse
gccgccaggctagaggtcaa

SEQ ID NO: 624332 - DNA, 20 bp, mouse
gcggttgaggcgtgacgcgg

SEQ ID NO: 624333 - DNA, 20 bp, mouse
gacgcggaggatgttggcgg

SEQ ID NO: 624334 - DNA, 20 bp, mouse
gcggcgcccataagcggttg

SEQ ID NO: 624335 - DNA, 20 bp, mouse
gctgcagagggaggcatgag

SEQ ID NO: 624336 - DNA, 20 bp, mouse
ggcgtgactgcggagcctgg

SEQ ID NO: 624337 - DNA, 20 bp, mouse
gcgcctgcgggcgagagtgt

SEQ ID NO: 624338 - DNA, 20 bp, mouse
ggtcccctagagggaatggt

SEQ ID NO: 624339 - DNA, 20 bp, mouse
gtctccatcactctgagaag

SEQ ID NO: 624340 - DNA, 20 bp, mouse
gctgcggagcgcacagctag

SEQ ID NO: 624341 - DNA, 20 bp, mouse
gaggccccggaggctcgtgt

SEQ ID NO: 624342 - DNA, 20 bp, mouse
ggcaaaggacccgctcctca

SEQ ID NO: 624343 - DNA, 20 bp, mouse
ggtacacacggtcccctaga

SEQ ID NO: 624344 - DNA, 20 bp, mouse
ggggaccgcgaaggaggagt

SEQ ID NO: 624345 - DNA, 20 bp, mouse
gagacacccgccctgaggag

SEQ ID NO: 624346 - DNA, 20 bp, mouse
ggccggagacccgaacacag

SEQ ID NO: 624347 - DNA, 20 bp, mouse
gggtatggcaacgctgggac

SEQ ID NO: 624348 - DNA, 20 bp, mouse
gcgttgccataccatcgaga

SEQ ID NO: 624349 - DNA, 20 bp, mouse
gctacgagatgccatctcga

SEQ ID NO: 624350 - DNA, 20 bp, mouse
gtccgctgtgttcgggtctc

SEQ ID NO: 624351 - DNA, 20 bp, mouse
gcaagggacgcccataatcg

SEQ ID NO: 624352 - DNA, 20 bp, mouse
ggggctctcaccagctccgg

SEQ ID NO: 624353 - DNA, 20 bp, mouse
gccggcggtccgctgtgttc

SEQ ID NO: 624354 - DNA, 20 bp, mouse
gctgttgagcggcatcgcgg

SEQ ID NO: 624355 - DNA, 20 bp, mouse
gtgagagccccgccaggtct

SEQ ID NO: 624356 - DNA, 20 bp, mouse
ggcgcggaacccccttctcc

SEQ ID NO: 624357 - DNA, 20 bp, mouse
gaggctcagaactcaccgcg

SEQ ID NO: 624358 - DNA, 20 bp, mouse
gcttctccaggcagacccga

SEQ ID NO: 624359 - DNA, 20 bp, mouse
gaccttcttggagacccttg

SEQ ID NO: 624360 - DNA, 20 bp, mouse
gcagacccgagggaagtgga

SEQ ID NO: 624361 - DNA, 20 bp, mouse
gcaggcagacccgagggaag

SEQ ID NO: 624362 - DNA, 20 bp, mouse
gacgcccctccacttccctc

SEQ ID NO: 624363 - DNA, 20 bp, mouse
ggccaggtcggtgataccgt

SEQ ID NO: 624364 - DNA, 20 bp, mouse
gattcccggaggtggatcgg

SEQ ID NO: 624365 - DNA, 20 bp, mouse
ggagggaggacggaagactg

SEQ ID NO: 624366 - DNA, 20 bp, mouse
gaatgggtggaggccagaca

SEQ ID NO: 624367 - DNA, 20 bp, mouse
ggaaggccagatctgacccg

SEQ ID NO: 624368 - DNA, 20 bp, mouse
gctctcctggctggaggaat

SEQ ID NO: 624369 - DNA, 20 bp, mouse
gccagatctgacccggggag

SEQ ID NO: 624370 - DNA, 20 bp, mouse
gagacatggaggccgctccc

SEQ ID NO: 624371 - DNA, 20 bp, mouse
gcctccagccaggagaggca

SEQ ID NO: 624372 - DNA, 20 bp, mouse
gaattcttctgcgggctggg

SEQ ID NO: 624373 - DNA, 20 bp, mouse
gtcaccctgcctctcctggc

SEQ ID NO: 624374 - DNA, 20 bp, mouse
gtggtaagcagggtatggag

SEQ ID NO: 624375 - DNA, 20 bp, mouse
ggctgggaggctctctgcac

SEQ ID NO: 624376 - DNA, 20 bp, mouse
gggccgcggctcgaacatgg

SEQ ID NO: 624377 - DNA, 20 bp, mouse
gggaggccgcggctcgaaca

SEQ ID NO: 624378 - DNA, 20 bp, mouse
ggcaccgggcggctgctctg

SEQ ID NO: 624379 - DNA, 20 bp, mouse
gggcggcggagatccactcc

SEQ ID NO: 624380 - DNA, 20 bp, mouse
ggctgatgggccgcccgcgg

SEQ ID NO: 624381 - DNA, 20 bp, mouse
gcacgaggcgtggggatcgt

SEQ ID NO: 624382 - DNA, 20 bp, mouse
gcgcccggcggtcagctgat

SEQ ID NO: 624383 - DNA, 20 bp, mouse
gagagtctgggagcacgcgg

SEQ ID NO: 624384 - DNA, 20 bp, mouse
gggggtgacaacaagaaggg

SEQ ID NO: 624385 - DNA, 20 bp, mouse
ggcgaggacaggtagagtct

SEQ ID NO: 624386 - DNA, 20 bp, mouse
gcggcttgcggctagtgtgg

SEQ ID NO: 624387 - DNA, 20 bp, mouse
ggctagtgtggcggcggtgt

SEQ ID NO: 624388 - DNA, 20 bp, mouse
gcgccacctaagagagtagg

SEQ ID NO: 624389 - DNA, 20 bp, mouse
gccagggaatgtgcccgctc

SEQ ID NO: 624390 - DNA, 20 bp, mouse
gcggcgccacctaagagagt

SEQ ID NO: 624391 - DNA, 20 bp, mouse
gcgccccctactctcttagg

SEQ ID NO: 624392 - DNA, 20 bp, mouse
gcttgcggctagtgtggcgg

SEQ ID NO: 624393 - DNA, 20 bp, mouse
gcgccggcttgcggctagtg

SEQ ID NO: 624394 - DNA, 20 bp, mouse
ggcgggcacattccctggac

SEQ ID NO: 624395 - DNA, 20 bp, mouse
gtcgcaggaggtggtcaaca

SEQ ID NO: 624396 - DNA, 20 bp, mouse
gacatggtgaagaggatcat

SEQ ID NO: 624397 - DNA, 20 bp, mouse
gcagctcggtgaagagccgg

SEQ ID NO: 624398 - DNA, 20 bp, mouse
gcggaggtgcatcaggccta

SEQ ID NO: 624399 - DNA, 20 bp, mouse
gctcggtgaagagccggcgg

SEQ ID NO: 624400 - DNA, 20 bp, mouse
gccactgctggcgataacat

SEQ ID NO: 624401 - DNA, 20 bp, mouse
gccaccagccaagatgaaca

SEQ ID NO: 624402 - DNA, 20 bp, mouse
ggagccggcggaggtgcatc

SEQ ID NO: 624403 - DNA, 20 bp, mouse
ggcccgcaagacaacgcctt

SEQ ID NO: 624404 - DNA, 20 bp, mouse
gatcatggggcggcctcggc

SEQ ID NO: 624405 - DNA, 20 bp, mouse
ggaggatcatggggcggcct

SEQ ID NO: 624406 - DNA, 20 bp, mouse
gaggggaacagaccaagacc

SEQ ID NO: 624407 - DNA, 20 bp, mouse
gaccaagacctggcctcgca

SEQ ID NO: 624408 - DNA, 20 bp, mouse
ggccatgcgaggccaggtct

SEQ ID NO: 624409 - DNA, 20 bp, mouse
gaagtgacaagggtgctgag

SEQ ID NO: 624410 - DNA, 20 bp, mouse
gcaagggtggggccagctaa

SEQ ID NO: 624411 - DNA, 20 bp, mouse
gacttagtctgaatgcgggg

SEQ ID NO: 624412 - DNA, 20 bp, mouse
gacgattggcaggaagtgag

SEQ ID NO: 624413 - DNA, 20 bp, mouse
gggacttaacccgtggtcag

SEQ ID NO: 624414 - DNA, 20 bp, mouse
gatggctgccatgcgaggcc

SEQ ID NO: 624415 - DNA, 20 bp, mouse
gtgttgatggctgccatgcg

SEQ ID NO: 624416 - DNA, 20 bp, mouse
ggaggtacggacatacggaa

SEQ ID NO: 624417 - DNA, 20 bp, mouse
gctttcccctctgcaagcac

SEQ ID NO: 624418 - DNA, 20 bp, mouse
gcttccatcagagcagacgc

SEQ ID NO: 624419 - DNA, 20 bp, mouse
ggctgcccgtgcttgcagag

SEQ ID NO: 624420 - DNA, 20 bp, mouse
ggtctgctctgatggaagca

SEQ ID NO: 624421 - DNA, 20 bp, mouse
gcgcgccagagcgcgggaag

SEQ ID NO: 624422 - DNA, 20 bp, mouse
ggcaccagcgtctgctctga

SEQ ID NO: 624423 - DNA, 20 bp, mouse
gggccacacagaagcccatg

SEQ ID NO: 624424 - DNA, 20 bp, mouse
gcccatgaggtacggacata

SEQ ID NO: 624425 - DNA, 20 bp, mouse
gggcgagcgcgccagagcgc

SEQ ID NO: 624426 - DNA, 20 bp, mouse
gtctggagagcgctcaggtg

SEQ ID NO: 624427 - DNA, 20 bp, mouse
ggggccgagctcaccagcct

SEQ ID NO: 624428 - DNA, 20 bp, mouse
gcttggtctggagagcgctc

SEQ ID NO: 624429 - DNA, 20 bp, mouse
gtcaccgttgctaggcgacg

SEQ ID NO: 624430 - DNA, 20 bp, mouse
gctggtgagctcggccccga

SEQ ID NO: 624431 - DNA, 20 bp, mouse
gggaggtcgcccacaaccac

SEQ ID NO: 624432 - DNA, 20 bp, mouse
gagctgtgttctcacgtccc

SEQ ID NO: 624433 - DNA, 20 bp, mouse
gacacagctccacaagctct

SEQ ID NO: 624434 - DNA, 20 bp, mouse
gttgacgcttgcggaagaac

SEQ ID NO: 624435 - DNA, 20 bp, mouse
gccccagataaaaaccctcg

SEQ ID NO: 624436 - DNA, 20 bp, mouse
ggcgcagcgccgtaacaagt

SEQ ID NO: 624437 - DNA, 20 bp, mouse
gctcgagtggaacctcgcag

SEQ ID NO: 624438 - DNA, 20 bp, mouse
gcatcctcgcccacttgtta

SEQ ID NO: 624439 - DNA, 20 bp, mouse
gcgcactcactgatctcgta

SEQ ID NO: 624440 - DNA, 20 bp, mouse
gagctgcgggagggaccccg

SEQ ID NO: 624441 - DNA, 20 bp, mouse
gttacggcgctgcgctcgag

SEQ ID NO: 624442 - DNA, 20 bp, mouse
gacccgaccccagaagccgg

SEQ ID NO: 624443 - DNA, 20 bp, mouse
gctcgcagtggccgagccca

SEQ ID NO: 624444 - DNA, 20 bp, mouse
ggcgccgtaacaagtgggcg

SEQ ID NO: 624445 - DNA, 20 bp, mouse
gagcccagggacagcgcgga

SEQ ID NO: 624446 - DNA, 20 bp, mouse
ggcaccccggccctccccac

SEQ ID NO: 624447 - DNA, 20 bp, mouse
gacggtgtagggtaacatcg

SEQ ID NO: 624448 - DNA, 20 bp, mouse
ggtgtagggtaacatcgcgg

SEQ ID NO: 624449 - DNA, 20 bp, mouse
ggactacccggactttggaa

SEQ ID NO: 624450 - DNA, 20 bp, mouse
gtcgcttcctgcctgccggt

SEQ ID NO: 624451 - DNA, 20 bp, mouse
gtaacatcgcggcggcaccc

SEQ ID NO: 624452 - DNA, 20 bp, mouse
ggcgttgagagccccggtga

SEQ ID NO: 624453 - DNA, 20 bp, mouse
gcggtctaggcgaggaaaac

SEQ ID NO: 624454 - DNA, 20 bp, mouse
gcaaggagagaagccctccc

SEQ ID NO: 624455 - DNA, 20 bp, mouse
gctcaacgcgcacaacaagg

SEQ ID NO: 624456 - DNA, 20 bp, mouse
ggatcggctcctggaagaca

SEQ ID NO: 624457 - DNA, 20 bp, mouse
ggagaacaagaagtaagtaa

SEQ ID NO: 624458 - DNA, 20 bp, mouse
gaagtgcggggcacgtgaag

SEQ ID NO: 624459 - DNA, 20 bp, mouse
gacagcaaggatcaaatcga

SEQ ID NO: 624460 - DNA, 20 bp, mouse
gtgacgtgtgtggaggacca

SEQ ID NO: 624461 - DNA, 20 bp, mouse
ggatactacaaaccccagaa

SEQ ID NO: 624462 - DNA, 20 bp, mouse
gtggtggaaatcgaacctcg

SEQ ID NO: 624463 - DNA, 20 bp, mouse
gaggagtcttcaaacgagat

SEQ ID NO: 624464 - DNA, 20 bp, mouse
ggagacagggcagaagtgcg

SEQ ID NO: 624465 - DNA, 20 bp, mouse
gctagctcctgctgcgcttg

SEQ ID NO: 624466 - DNA, 20 bp, mouse
gttgcctggagcttgagaca

SEQ ID NO: 624467 - DNA, 20 bp, mouse
gagaaggaaccggtgacact

SEQ ID NO: 624468 - DNA, 20 bp, mouse
gccggagtgctgcccaggaa

SEQ ID NO: 624469 - DNA, 20 bp, mouse
gggatccaggaccacctccg

SEQ ID NO: 624470 - DNA, 20 bp, mouse
gtagcagtggacgcgaggtg

SEQ ID NO: 624471 - DNA, 20 bp, mouse
gggagggcagaaggcttgat

SEQ ID NO: 624472 - DNA, 20 bp, mouse
gttgctacggcaactggaga

SEQ ID NO: 624473 - DNA, 20 bp, mouse
gggggcgcctcaagagctag

SEQ ID NO: 624474 - DNA, 20 bp, mouse
gtctaggactagaaaaggga

SEQ ID NO: 624475 - DNA, 20 bp, mouse
gaacaagacttgctatgggg

SEQ ID NO: 624476 - DNA, 20 bp, mouse
ggagctgaaactctccagga

SEQ ID NO: 624477 - DNA, 20 bp, mouse
gtgacctggtagcgcctgag

SEQ ID NO: 624478 - DNA, 20 bp, mouse
gaccacccgccccaggatgg

SEQ ID NO: 624479 - DNA, 20 bp, mouse
gtccagggtgcagcgtctcc

SEQ ID NO: 624480 - DNA, 20 bp, mouse
gtagcggcaagagtgtggcc

SEQ ID NO: 624481 - DNA, 20 bp, mouse
gggacagtgagacgctgacc

SEQ ID NO: 624482 - DNA, 20 bp, mouse
gtccctgaggcatcaaatca

SEQ ID NO: 624483 - DNA, 20 bp, mouse
ggtagcgcctgagaggcagt

SEQ ID NO: 624484 - DNA, 20 bp, mouse
gacacccatgccagttcctg

SEQ ID NO: 624485 - DNA, 20 bp, mouse
ggtttaagaccaggatagaa

SEQ ID NO: 624486 - DNA, 20 bp, mouse
gctgctgtctccttcaggta

SEQ ID NO: 624487 - DNA, 20 bp, mouse
gcttcaggtaaggctcaagt

SEQ ID NO: 624488 - DNA, 20 bp, mouse
gtgcctgaggagctaatccc

SEQ ID NO: 624489 - DNA, 20 bp, mouse
gtgcagctctggacaaccgc

SEQ ID NO: 624490 - DNA, 20 bp, mouse
ggagacagcagttgcagctc

SEQ ID NO: 624491 - DNA, 20 bp, mouse
ggttggtgaccagcactcta

SEQ ID NO: 624492 - DNA, 20 bp, mouse
gcaaccgcaggtgctgaagc

SEQ ID NO: 624493 - DNA, 20 bp, mouse
gtcaagtggggttgcagtgt

SEQ ID NO: 624494 - DNA, 20 bp, mouse
gccgcccctgagagctgagt

SEQ ID NO: 624495 - DNA, 20 bp, mouse
gcacacacctgagtattata

SEQ ID NO: 624496 - DNA, 20 bp, mouse
gtacacaccaccacttccat

SEQ ID NO: 624497 - DNA, 20 bp, mouse
gatggcggcgcccatggaag

SEQ ID NO: 624498 - DNA, 20 bp, mouse
gcgggactggcagagcaaga

SEQ ID NO: 624499 - DNA, 20 bp, mouse
ggtggtgtgtactgacgccg

SEQ ID NO: 624500 - DNA, 20 bp, mouse
gcctcggtaggtgagcaggt

SEQ ID NO: 624501 - DNA, 20 bp, mouse
gcagctccagagctgtgccg

SEQ ID NO: 624502 - DNA, 20 bp, mouse
gtgggattcaggggcgggac

SEQ ID NO: 624503 - DNA, 20 bp, mouse
gtgacgccgcggcacagctc

SEQ ID NO: 624504 - DNA, 20 bp, mouse
gctgtcacgcagccacccca

SEQ ID NO: 624505 - DNA, 20 bp, mouse
gtggtgtgggagcttcattc

SEQ ID NO: 624506 - DNA, 20 bp, mouse
gtgcgcacttacaagaacgg

SEQ ID NO: 624507 - DNA, 20 bp, mouse
gccagcggattgagaagatg

SEQ ID NO: 624508 - DNA, 20 bp, mouse
ggcctgcgcacttacaagaa

SEQ ID NO: 624509 - DNA, 20 bp, mouse
gccactggcccagagcccta

SEQ ID NO: 624510 - DNA, 20 bp, mouse
ggagagtttaggaaatacag

SEQ ID NO: 624511 - DNA, 20 bp, mouse
gaataacttacaagtgccag

SEQ ID NO: 624512 - DNA, 20 bp, mouse
ggcggaagtgctgaggatag

SEQ ID NO: 624513 - DNA, 20 bp, mouse
ggcctgtgccctctggaatc

SEQ ID NO: 624514 - DNA, 20 bp, mouse
gatgcagggaaaggaagctc

SEQ ID NO: 624515 - DNA, 20 bp, mouse
gggcttctaccagattccag

SEQ ID NO: 624516 - DNA, 20 bp, mouse
gccttcccgggtggtgaatt

SEQ ID NO: 624517 - DNA, 20 bp, mouse
gagcttgtacagaccttccc

SEQ ID NO: 624518 - DNA, 20 bp, mouse
gttgtacagaccttcccggg

SEQ ID NO: 624519 - DNA, 20 bp, mouse
gaggcgggccgaagcgaagg

SEQ ID NO: 624520 - DNA, 20 bp, mouse
gctcctccggagcacctcag

SEQ ID NO: 624521 - DNA, 20 bp, mouse
gggcgagccagcccccacga

SEQ ID NO: 624522 - DNA, 20 bp, mouse
gcggcagcgctgcctcctag

SEQ ID NO: 624523 - DNA, 20 bp, mouse
gtgaacgctgctttccaaga

SEQ ID NO: 624524 - DNA, 20 bp, mouse
gtcaacgaccagtctggcaa

SEQ ID NO: 624525 - DNA, 20 bp, mouse
gccggcccacattgaagcag

SEQ ID NO: 624526 - DNA, 20 bp, mouse
gtagatatctgtaaatgtag

SEQ ID NO: 624527 - DNA, 20 bp, mouse
gagggcaggcaggatgaacg

SEQ ID NO: 624528 - DNA, 20 bp, mouse
ggtagacacagcctgcgtgg

SEQ ID NO: 624529 - DNA, 20 bp, mouse
ggttaacagatgtacagata

SEQ ID NO: 624530 - DNA, 20 bp, mouse
gttccctccgtcgccatctt

SEQ ID NO: 624531 - DNA, 20 bp, mouse
gccttctcgggtggtgaaat

SEQ ID NO: 624532 - DNA, 20 bp, mouse
gctgtacagaccttctcggg

SEQ ID NO: 624533 - DNA, 20 bp, mouse
gtcaacgaccagactggtaa

SEQ ID NO: 624534 - DNA, 20 bp, mouse
gggggctttaagaaacattt

SEQ ID NO: 624535 - DNA, 20 bp, mouse
gccgggcacttagggcaggc

SEQ ID NO: 624536 - DNA, 20 bp, mouse
gaaatgactggcgtgcgacg

SEQ ID NO: 624537 - DNA, 20 bp, mouse
ggaagccccgcaatcctcgg

SEQ ID NO: 624538 - DNA, 20 bp, mouse
gaccgtgcagcggcaactga

SEQ ID NO: 624539 - DNA, 20 bp, mouse
gtggtcttcagctacagtac

SEQ ID NO: 624540 - DNA, 20 bp, mouse
gctggcgtgcgacggggcag

SEQ ID NO: 624541 - DNA, 20 bp, mouse
gtccatcagtgagatcctgg

SEQ ID NO: 624542 - DNA, 20 bp, mouse
gaggctccagagctaacctg

SEQ ID NO: 624543 - DNA, 20 bp, mouse
gaagggcagagaagctagat

SEQ ID NO: 624544 - DNA, 20 bp, mouse
gctcaggccgaaggttcgag

SEQ ID NO: 624545 - DNA, 20 bp, mouse
gggattgcggggcttccaag

SEQ ID NO: 624546 - DNA, 20 bp, mouse
ggctggccggaccgttgtag

SEQ ID NO: 624547 - DNA, 20 bp, mouse
gctaagaagcgagaagcatg

SEQ ID NO: 624548 - DNA, 20 bp, mouse
gtcttggtccacccctacaa

SEQ ID NO: 624549 - DNA, 20 bp, mouse
ggaggccatggatacaggat

SEQ ID NO: 624550 - DNA, 20 bp, mouse
ggcatgcggccgccacatcc

SEQ ID NO: 624551 - DNA, 20 bp, mouse
gggccggaccgttgtagggg

SEQ ID NO: 624552 - DNA, 20 bp, mouse
gaacggtccggccagcactc

SEQ ID NO: 624553 - DNA, 20 bp, mouse
ggtccacccctacaacggtc

SEQ ID NO: 624554 - DNA, 20 bp, mouse
gatgaacgggaagaacagga

SEQ ID NO: 624555 - DNA, 20 bp, mouse
gtgtgtgtgtggtgagcggc

SEQ ID NO: 624556 - DNA, 20 bp, mouse
gtccattagacagcagctgg

SEQ ID NO: 624557 - DNA, 20 bp, mouse
gaacacaccagggagcggag

SEQ ID NO: 624558 - DNA, 20 bp, mouse
gcgcggacccagcaccgagg

SEQ ID NO: 624559 - DNA, 20 bp, mouse
ggggaagaatcaacacacca

SEQ ID NO: 624560 - DNA, 20 bp, mouse
gcggcgcggacccagcaccg

SEQ ID NO: 624561 - DNA, 20 bp, mouse
gaagctgggagcccggacgg

SEQ ID NO: 624562 - DNA, 20 bp, mouse
gaccagggagcggagcggcg

SEQ ID NO: 624563 - DNA, 20 bp, mouse
gctgctgtctaatggagtcc

SEQ ID NO: 624564 - DNA, 20 bp, mouse
gcgccgagagaggccgtggt

SEQ ID NO: 624565 - DNA, 20 bp, mouse
gctcccaccacggcctctct

SEQ ID NO: 624566 - DNA, 20 bp, mouse
gtgtcgcaagctgcaatccc

SEQ ID NO: 624567 - DNA, 20 bp, mouse
gggtgagttccggggaaagt

SEQ ID NO: 624568 - DNA, 20 bp, mouse
gctcccttgaggggatgact

SEQ ID NO: 624569 - DNA, 20 bp, mouse
gttcccagtcatcccctcaa

SEQ ID NO: 624570 - DNA, 20 bp, mouse
ggtgggctggacggtcggtg

SEQ ID NO: 624571 - DNA, 20 bp, mouse
gggaaagtgggctggacggt

SEQ ID NO: 624572 - DNA, 20 bp, mouse
ggcgtggtcggtgagttccg

SEQ ID NO: 624573 - DNA, 20 bp, mouse
gtgcgacaagctcccttgag

SEQ ID NO: 624574 - DNA, 20 bp, mouse
gcggtgctgcccgcactcag

SEQ ID NO: 624575 - DNA, 20 bp, mouse
gtgggaagcctgctcccgga

SEQ ID NO: 624576 - DNA, 20 bp, mouse
gcggaagtggcgggtctcgt

SEQ ID NO: 624577 - DNA, 20 bp, mouse
ggctgtctgctggagcctcg

SEQ ID NO: 624578 - DNA, 20 bp, mouse
gactcacctcactctccacg

SEQ ID NO: 624579 - DNA, 20 bp, mouse
gtctgcatcgcagaacccag

SEQ ID NO: 624580 - DNA, 20 bp, mouse
gcgtaggcagcgctgtctgc

SEQ ID NO: 624581 - DNA, 20 bp, mouse
gcaatcggaccggaagtggc

SEQ ID NO: 624582 - DNA, 20 bp, mouse
gagagtgaggtgagtgttgc

SEQ ID NO: 624583 - DNA, 20 bp, mouse
gctccgcgctaagggcacta

SEQ ID NO: 624584 - DNA, 20 bp, mouse
ggaaataatccaaggaaatc

SEQ ID NO: 624585 - DNA, 20 bp, mouse
gtgttcacggtgagccgacg

SEQ ID NO: 624586 - DNA, 20 bp, mouse
gcaccgaggcccgaaagcac

SEQ ID NO: 624587 - DNA, 20 bp, mouse
gcgggaacctgtggaagcta

SEQ ID NO: 624588 - DNA, 20 bp, mouse
gacgcgcgcctggttgctag

SEQ ID NO: 624589 - DNA, 20 bp, mouse
gggtctgggagggtatgtgt

SEQ ID NO: 624590 - DNA, 20 bp, mouse
ggggctccatacccaccggt

SEQ ID NO: 624591 - DNA, 20 bp, mouse
gaggcatccttagcttccac

SEQ ID NO: 624592 - DNA, 20 bp, mouse
ggcctggttgctaggggcgg

SEQ ID NO: 624593 - DNA, 20 bp, mouse
gtgggtatggagcccgaggt

SEQ ID NO: 624594 - DNA, 20 bp, mouse
gaaccaggcgcgcgtcgcta

SEQ ID NO: 624595 - DNA, 20 bp, mouse
gtcggtgctagcccaccggt

SEQ ID NO: 624596 - DNA, 20 bp, mouse
gggctcctcgggtaagatgg

SEQ ID NO: 624597 - DNA, 20 bp, mouse
gggagaggaattgaagagtg

SEQ ID NO: 624598 - DNA, 20 bp, mouse
gggtggctcctcgggtaaga

SEQ ID NO: 624599 - DNA, 20 bp, mouse
ggcagccgccatcttacccg

SEQ ID NO: 624600 - DNA, 20 bp, mouse
gggacccccgaagcacgcaa

SEQ ID NO: 624601 - DNA, 20 bp, mouse
gcgcacaggcgtacgctcgg

SEQ ID NO: 624602 - DNA, 20 bp, mouse
gtcccggcggaggaactctg

SEQ ID NO: 624603 - DNA, 20 bp, mouse
ggtacgctcggtggctcctc

SEQ ID NO: 624604 - DNA, 20 bp, mouse
gatggcggctgcatctttga

SEQ ID NO: 624605 - DNA, 20 bp, mouse
gagggaacgtctctccagtc

SEQ ID NO: 624606 - DNA, 20 bp, mouse
gcaacgcgccgaaaaggcct

SEQ ID NO: 624607 - DNA, 20 bp, mouse
gagcgctggagctgctgccc

SEQ ID NO: 624608 - DNA, 20 bp, mouse
gccagggcgcaggcgcgaga

SEQ ID NO: 624609 - DNA, 20 bp, mouse
gcgcttccaacgcgccgaaa

SEQ ID NO: 624610 - DNA, 20 bp, mouse
gggcgacgcgcacattgcca

SEQ ID NO: 624611 - DNA, 20 bp, mouse
gtgagggcgcgggcccgcta

SEQ ID NO: 624612 - DNA, 20 bp, mouse
gatccgcggggagacggtga

SEQ ID NO: 624613 - DNA, 20 bp, mouse
gtggcggcgccgaacggcga

SEQ ID NO: 624614 - DNA, 20 bp, mouse
ggagggcgggaccgtcgcca

SEQ ID NO: 624615 - DNA, 20 bp, mouse
gggagcgtccaggggatccg

SEQ ID NO: 624616 - DNA, 20 bp, mouse
gcggcgggctacaggaatgg

SEQ ID NO: 624617 - DNA, 20 bp, mouse
gcaccagtgctcgcaaatgg

SEQ ID NO: 624618 - DNA, 20 bp, mouse
gaaggcacgctaatatataa

SEQ ID NO: 624619 - DNA, 20 bp, mouse
gggcggtggttgccaggcga

SEQ ID NO: 624620 - DNA, 20 bp, mouse
gagacgacccacagcggtca

SEQ ID NO: 624621 - DNA, 20 bp, mouse
ggagacctgtgagaggagat

SEQ ID NO: 624622 - DNA, 20 bp, mouse
gtcaggtagaagaacatcgt

SEQ ID NO: 624623 - DNA, 20 bp, mouse
gtgcagtcccgggagaatgc

SEQ ID NO: 624624 - DNA, 20 bp, mouse
gcaccggcgggctacaggaa

SEQ ID NO: 624625 - DNA, 20 bp, mouse
gaagcgccccggatgcgact

SEQ ID NO: 624626 - DNA, 20 bp, mouse
gccggcacgggctcttcctg

SEQ ID NO: 624627 - DNA, 20 bp, mouse
ggagagccgcaacacgcccc

SEQ ID NO: 624628 - DNA, 20 bp, mouse
gcactcagctcgcggcccgg

SEQ ID NO: 624629 - DNA, 20 bp, mouse
gcgctctcctgctccggcac

SEQ ID NO: 624630 - DNA, 20 bp, mouse
gacgcctcgctctcctgctc

SEQ ID NO: 624631 - DNA, 20 bp, mouse
ggaagagcccgtgccggagc

SEQ ID NO: 624632 - DNA, 20 bp, mouse
gccaggtgaactaagtgcaa

SEQ ID NO: 624633 - DNA, 20 bp, mouse
gctcttcctggggcgtgttg

SEQ ID NO: 624634 - DNA, 20 bp, mouse
gcgaaagtgggactataccg

SEQ ID NO: 624635 - DNA, 20 bp, mouse
gctgagtggaatcccgtcta

SEQ ID NO: 624636 - DNA, 20 bp, mouse
gccccgcgacgaggctcccg

SEQ ID NO: 624637 - DNA, 20 bp, mouse
gccgcagttaccggaagtac

SEQ ID NO: 624638 - DNA, 20 bp, mouse
gttcccgcactgacacaacc

SEQ ID NO: 624639 - DNA, 20 bp, mouse
gacaacccggcgacccgaac

SEQ ID NO: 624640 - DNA, 20 bp, mouse
gtgtcagtgcgggaatcggc

SEQ ID NO: 624641 - DNA, 20 bp, mouse
gtggggacgaggcttcgagg

SEQ ID NO: 624642 - DNA, 20 bp, mouse
gcgccgggttgtgtcagtgc

SEQ ID NO: 624643 - DNA, 20 bp, mouse
gtgcctcgggagcctcgtcg

SEQ ID NO: 624644 - DNA, 20 bp, mouse
ggaagtcccgccctcagaga

SEQ ID NO: 624645 - DNA, 20 bp, mouse
gagtacgggcgcgccagttc

SEQ ID NO: 624646 - DNA, 20 bp, mouse
ggcccactccataacccgga

SEQ ID NO: 624647 - DNA, 20 bp, mouse
gaagcgggcaccagtcccgt

SEQ ID NO: 624648 - DNA, 20 bp, mouse
ggaacggaggcccctccgac

SEQ ID NO: 624649 - DNA, 20 bp, mouse
gggcaccagtcccgtcggag

SEQ ID NO: 624650 - DNA, 20 bp, mouse
ggaggcccctccgacgggac

SEQ ID NO: 624651 - DNA, 20 bp, mouse
ggactggtgcccgcttagga

SEQ ID NO: 624652 - DNA, 20 bp, mouse
gagccctccgggttatggag

SEQ ID NO: 624653 - DNA, 20 bp, mouse
gcgcttaggagggagccctc

SEQ ID NO: 624654 - DNA, 20 bp, mouse
gttggggctctgatgttcat

SEQ ID NO: 624655 - DNA, 20 bp, mouse
gggggcctccgttcctaaca

SEQ ID NO: 624656 - DNA, 20 bp, mouse
ggccccgcagagctcgccat

SEQ ID NO: 624657 - DNA, 20 bp, mouse
ggcgcgtcgcacgtgtccgg

SEQ ID NO: 624658 - DNA, 20 bp, mouse
gcgtcgcacgtgtccggagg

SEQ ID NO: 624659 - DNA, 20 bp, mouse
gtgacaagcgccaacaggaa

SEQ ID NO: 624660 - DNA, 20 bp, mouse
gagacgctggtggtgcgagg

SEQ ID NO: 624661 - DNA, 20 bp, mouse
ggcagcgcgtcgcacgtgtc

SEQ ID NO: 624662 - DNA, 20 bp, mouse
gctgtgcgcccagacgctgg

SEQ ID NO: 624663 - DNA, 20 bp, mouse
ggggcccatggcgagctctg

SEQ ID NO: 624664 - DNA, 20 bp, mouse
gagtggagaaggctaggaac

SEQ ID NO: 624665 - DNA, 20 bp, mouse
ggcactgtgcgcccagacgc

SEQ ID NO: 624666 - DNA, 20 bp, mouse
gggttacagaccagagttaa

SEQ ID NO: 624667 - DNA, 20 bp, mouse
gggcgagatcagggcaaggt

SEQ ID NO: 624668 - DNA, 20 bp, mouse
gagagttaagggcgagatca

SEQ ID NO: 624669 - DNA, 20 bp, mouse
ggggcaggcccaaatcggag

SEQ ID NO: 624670 - DNA, 20 bp, mouse
ggccctactgctggtatggt

SEQ ID NO: 624671 - DNA, 20 bp, mouse
gtaagggcgagatcagggca

SEQ ID NO: 624672 - DNA, 20 bp, mouse
gacctaccataccagcagta

SEQ ID NO: 624673 - DNA, 20 bp, mouse
ggattctagctgtgcaattt

SEQ ID NO: 624674 - DNA, 20 bp, mouse
gtcaagaccacgcccctact

SEQ ID NO: 624675 - DNA, 20 bp, mouse
gtcttggagatacaactcgg

SEQ ID NO: 624676 - DNA, 20 bp, mouse
gctgcggccgagtgagcctg

SEQ ID NO: 624677 - DNA, 20 bp, mouse
ggcactgaaggccgcgacgg

SEQ ID NO: 624678 - DNA, 20 bp, mouse
gcccacgcgcgtgctcactg

SEQ ID NO: 624679 - DNA, 20 bp, mouse
gctgaaggccgcgacggcgg

SEQ ID NO: 624680 - DNA, 20 bp, mouse
ggaaaacagaagtctcgttg

SEQ ID NO: 624681 - DNA, 20 bp, mouse
ggttggggcgcccgcactga

SEQ ID NO: 624682 - DNA, 20 bp, mouse
gtgctgcgctggctgatcgg

SEQ ID NO: 624683 - DNA, 20 bp, mouse
gcacggagcgagggccgccg

SEQ ID NO: 624684 - DNA, 20 bp, mouse
ggggcccccgcgcattacct

SEQ ID NO: 624685 - DNA, 20 bp, mouse
gacctccgcctccgccgtcg

SEQ ID NO: 624686 - DNA, 20 bp, mouse
ggagcagcaatggcggccgg

SEQ ID NO: 624687 - DNA, 20 bp, mouse
gcacggctgcaggccaaggt

SEQ ID NO: 624688 - DNA, 20 bp, mouse
gcattgctgctctggctccg

SEQ ID NO: 624689 - DNA, 20 bp, mouse
gctgcgcccgggcgaacacg

SEQ ID NO: 624690 - DNA, 20 bp, mouse
gtacgaccccttggccccgg

SEQ ID NO: 624691 - DNA, 20 bp, mouse
gctagaggctaaagcgaagt

SEQ ID NO: 624692 - DNA, 20 bp, mouse
gagctacgaccccttggccc

SEQ ID NO: 624693 - DNA, 20 bp, mouse
gggcggtagctacgacccct

SEQ ID NO: 624694 - DNA, 20 bp, mouse
gtgccttccgcgcacctcag

SEQ ID NO: 624695 - DNA, 20 bp, mouse
gcgaagtaggcttgactgtc

SEQ ID NO: 624696 - DNA, 20 bp, mouse
gttgccgctgcgggagaaat

SEQ ID NO: 624697 - DNA, 20 bp, mouse
gccccgggcgacactgagga

SEQ ID NO: 624698 - DNA, 20 bp, mouse
gagcgctagagaagaggctg

SEQ ID NO: 624699 - DNA, 20 bp, mouse
gcccaggtgcacatcttcag

SEQ ID NO: 624700 - DNA, 20 bp, mouse
gatggagagcgctagagaag

SEQ ID NO: 624701 - DNA, 20 bp, mouse
ggctccaatttctcccgcag

SEQ ID NO: 624702 - DNA, 20 bp, mouse
gacgcccgctgcctgctctc

SEQ ID NO: 624703 - DNA, 20 bp, mouse
gtggagtgagaagtcaaccc

SEQ ID NO: 624704 - DNA, 20 bp, mouse
gctgtggcgcttctccgtcc

SEQ ID NO: 624705 - DNA, 20 bp, mouse
gaaattggagctgctgtcgc

SEQ ID NO: 624706 - DNA, 20 bp, mouse
gcaggcggcaccaacggcta

SEQ ID NO: 624707 - DNA, 20 bp, mouse
gcggggaggggtgatcaagt

SEQ ID NO: 624708 - DNA, 20 bp, mouse
gcgacccctgccctagccgt

SEQ ID NO: 624709 - DNA, 20 bp, mouse
gctgggcaccaaagcccggg

SEQ ID NO: 624710 - DNA, 20 bp, mouse
gtgatgtaaacagcagagct

SEQ ID NO: 624711 - DNA, 20 bp, mouse
gggcaccaacggctagggca

SEQ ID NO: 624712 - DNA, 20 bp, mouse
gcagaaatttgtgccgcagg

SEQ ID NO: 624713 - DNA, 20 bp, mouse
gcatctggagcaagatccaa

SEQ ID NO: 624714 - DNA, 20 bp, mouse
ggctagtgctctccagagta

SEQ ID NO: 624715 - DNA, 20 bp, mouse
ggataggtgtgcctgaagag

SEQ ID NO: 624716 - DNA, 20 bp, mouse
gcgcaaccaggcgatctctc

SEQ ID NO: 624717 - DNA, 20 bp, mouse
gcgttgccgtgagggttaca

SEQ ID NO: 624718 - DNA, 20 bp, mouse
gggagccacagtccctacga

SEQ ID NO: 624719 - DNA, 20 bp, mouse
ggagatcgcctggttgcgag

SEQ ID NO: 624720 - DNA, 20 bp, mouse
gcgcgaccggagagatcgcc

SEQ ID NO: 624721 - DNA, 20 bp, mouse
gggcgccgtcgtagggactg

SEQ ID NO: 624722 - DNA, 20 bp, mouse
gggttcatggcgccgtcgta

SEQ ID NO: 624723 - DNA, 20 bp, mouse
gggccctagcgccgcgcgac

SEQ ID NO: 624724 - DNA, 20 bp, mouse
ggggtcggggtctcccggaa

SEQ ID NO: 624725 - DNA, 20 bp, mouse
gctccggtcgcgcggcgcta

SEQ ID NO: 624726 - DNA, 20 bp, mouse
gccgccgagctactactcaa

SEQ ID NO: 624727 - DNA, 20 bp, mouse
gtagcgccgcggtttctaag

SEQ ID NO: 624728 - DNA, 20 bp, mouse
gaaaccgcggcgctactggg

SEQ ID NO: 624729 - DNA, 20 bp, mouse
gcagcccccaagccgggtag

SEQ ID NO: 624730 - DNA, 20 bp, mouse
gacacccctacccggcttgg

SEQ ID NO: 624731 - DNA, 20 bp, mouse
gtgggtgggacacccctacc

SEQ ID NO: 624732 - DNA, 20 bp, mouse
ggagcctggcgaggacaagg

SEQ ID NO: 624733 - DNA, 20 bp, mouse
gtcgcacgtggatcgttgtt

SEQ ID NO: 624734 - DNA, 20 bp, mouse
gcgttgttcggtcttggaga

SEQ ID NO: 624735 - DNA, 20 bp, mouse
gccgcggcgctactgggagg

SEQ ID NO: 624736 - DNA, 20 bp, mouse
gcgcagtccgcggagcggag

SEQ ID NO: 624737 - DNA, 20 bp, mouse
ggtcggaggcgggatcgggg

SEQ ID NO: 624738 - DNA, 20 bp, mouse
ggggcggacgcgagcaggac

SEQ ID NO: 624739 - DNA, 20 bp, mouse
gacaaccgcagtccgcggag

SEQ ID NO: 624740 - DNA, 20 bp, mouse
ggcttgacaaccgcagtccg

SEQ ID NO: 624741 - DNA, 20 bp, mouse
ggcggtcggaggcgggatcg

SEQ ID NO: 624742 - DNA, 20 bp, mouse
ggtccgcggagcggagcggt

SEQ ID NO: 624743 - DNA, 20 bp, mouse
gctcacctgagagctccggg

SEQ ID NO: 624744 - DNA, 20 bp, mouse
gtccagggacgagcagtgat

SEQ ID NO: 624745 - DNA, 20 bp, mouse
gcgcggagcggagcggtcgg

SEQ ID NO: 624746 - DNA, 20 bp, mouse
gcaagatggcggcccatcac

SEQ ID NO: 624747 - DNA, 20 bp, mouse
gccggcagaacacagccggg

SEQ ID NO: 624748 - DNA, 20 bp, mouse
ggccgggcggaggaaagtgc

SEQ ID NO: 624749 - DNA, 20 bp, mouse
ggcagaacacagccgggcgg

SEQ ID NO: 624750 - DNA, 20 bp, mouse
gactctcccggaagtgacgt

SEQ ID NO: 624751 - DNA, 20 bp, mouse
gggagtgtcaacatgcaaga

SEQ ID NO: 624752 - DNA, 20 bp, mouse
ggtgtcaacatgcaagatgg

SEQ ID NO: 624753 - DNA, 20 bp, mouse
gggaaggcggccgagagcag

SEQ ID NO: 624754 - DNA, 20 bp, mouse
ggggcgccaacggcctgagg

SEQ ID NO: 624755 - DNA, 20 bp, mouse
ggctgtgttctgccggtgat

SEQ ID NO: 624756 - DNA, 20 bp, mouse
ggaagaatttgtacagaaga

SEQ ID NO: 624757 - DNA, 20 bp, mouse
gagaagatggcagaaactgt

SEQ ID NO: 624758 - DNA, 20 bp, mouse
gtctgtacaaattcttctct

SEQ ID NO: 624759 - DNA, 20 bp, mouse
gactgtgggttggggcacaa

SEQ ID NO: 624760 - DNA, 20 bp, mouse
gggcaacagtcgttccccaa

SEQ ID NO: 624761 - DNA, 20 bp, mouse
ggagagagatgaacgagcaa

SEQ ID NO: 624762 - DNA, 20 bp, mouse
gggggcacaaaggaagagta

SEQ ID NO: 624763 - DNA, 20 bp, mouse
gatggtttgactcggatctt

SEQ ID NO: 624764 - DNA, 20 bp, mouse
gtgatggcatctgaagtgat

SEQ ID NO: 624765 - DNA, 20 bp, mouse
gatggcagaaactgtgggtt

SEQ ID NO: 624766 - DNA, 20 bp, mouse
ggacgatctgctggactagg

SEQ ID NO: 624767 - DNA, 20 bp, mouse
gccgtggcggccacaagggg

SEQ ID NO: 624768 - DNA, 20 bp, mouse
ggggcgctctggcgtcgcgt

SEQ ID NO: 624769 - DNA, 20 bp, mouse
ggcagacgatctgctggact

SEQ ID NO: 624770 - DNA, 20 bp, mouse
gtcgtctgctctcgcgcgta

SEQ ID NO: 624771 - DNA, 20 bp, mouse
gcgcaggactaagggtctag

SEQ ID NO: 624772 - DNA, 20 bp, mouse
gttacctgccggggccgcgg

SEQ ID NO: 624773 - DNA, 20 bp, mouse
ggcgagagcagacgatctgc

SEQ ID NO: 624774 - DNA, 20 bp, mouse
gggcgtagcaggggccgcag

SEQ ID NO: 624775 - DNA, 20 bp, mouse
gctgctggactaggcggcag

SEQ ID NO: 624776 - DNA, 20 bp, mouse
gctaagagcccacttaccgg

SEQ ID NO: 624777 - DNA, 20 bp, mouse
gaggctaagagcccacttac

SEQ ID NO: 624778 - DNA, 20 bp, mouse
gctgctgtagcgaacacctc

SEQ ID NO: 624779 - DNA, 20 bp, mouse
gagtaaacggagtccttggg

SEQ ID NO: 624780 - DNA, 20 bp, mouse
ggcgaacacctccggtaagt

SEQ ID NO: 624781 - DNA, 20 bp, mouse
gcgcagtaaacggagtcctt

SEQ ID NO: 624782 - DNA, 20 bp, mouse
gaaggctcacagctaagggt

SEQ ID NO: 624783 - DNA, 20 bp, mouse
gttctagtcacacccgccca

SEQ ID NO: 624784 - DNA, 20 bp, mouse
gaggcggagggacgttgcta

SEQ ID NO: 624785 - DNA, 20 bp, mouse
ggatttaagggagacttatg

SEQ ID NO: 624786 - DNA, 20 bp, mouse
gggccaacagcctcatacct

SEQ ID NO: 624787 - DNA, 20 bp, mouse
gcaccgggaacgggaagccc

SEQ ID NO: 624788 - DNA, 20 bp, mouse
ggtgagacgggaaactccgt

SEQ ID NO: 624789 - DNA, 20 bp, mouse
gagcccaggtatgaggctgt

SEQ ID NO: 624790 - DNA, 20 bp, mouse
gatgaggctgttggccagcg

SEQ ID NO: 624791 - DNA, 20 bp, mouse
ggctcggcgccaccgggaac

SEQ ID NO: 624792 - DNA, 20 bp, mouse
gggttctggtgagtccccta

SEQ ID NO: 624793 - DNA, 20 bp, mouse
ggctgttggccagcggggtt

SEQ ID NO: 624794 - DNA, 20 bp, mouse
ggaacagatccgaaccccgc

SEQ ID NO: 624795 - DNA, 20 bp, mouse
gccaagcgacctgaaggtga

SEQ ID NO: 624796 - DNA, 20 bp, mouse
gaggatcgcggcgtcaggca

SEQ ID NO: 624797 - DNA, 20 bp, mouse
gtggtggcggcggatttgga

SEQ ID NO: 624798 - DNA, 20 bp, mouse
gtggagggaccttaggatcg

SEQ ID NO: 624799 - DNA, 20 bp, mouse
gcggtgcgtcgtctctatgg

SEQ ID NO: 624800 - DNA, 20 bp, mouse
gggcaaggcacacttgaggg

SEQ ID NO: 624801 - DNA, 20 bp, mouse
gcgtcggtgcgtcgtctcta

SEQ ID NO: 624802 - DNA, 20 bp, mouse
gtctatggtggcggcggatt

SEQ ID NO: 624803 - DNA, 20 bp, mouse
gagccacaggccacgcccag

SEQ ID NO: 624804 - DNA, 20 bp, mouse
gggcacacttgagggtggtg

SEQ ID NO: 624805 - DNA, 20 bp, mouse
gtcaggcaaggcacacttga

SEQ ID NO: 624806 - DNA, 20 bp, mouse
gcaagcgcgcgtggatccta

SEQ ID NO: 624807 - DNA, 20 bp, mouse
gcttcacacgtggggtccat

SEQ ID NO: 624808 - DNA, 20 bp, mouse
ggcgcttgggaccaacttca

SEQ ID NO: 624809 - DNA, 20 bp, mouse
gactgctctggatggaggta

SEQ ID NO: 624810 - DNA, 20 bp, mouse
gttcgtgtgagtggggcgta

SEQ ID NO: 624811 - DNA, 20 bp, mouse
gctcccggaagcaactgctt

SEQ ID NO: 624812 - DNA, 20 bp, mouse
ggaggtaggggtaggaagtg

SEQ ID NO: 624813 - DNA, 20 bp, mouse
gctggggtatcacggatccg

SEQ ID NO: 624814 - DNA, 20 bp, mouse
gggatcggaagtgcactggg

SEQ ID NO: 624815 - DNA, 20 bp, mouse
gagttggtcccaagcgcgcg

SEQ ID NO: 624816 - DNA, 20 bp, mouse
gctgctggcaccccacgatc

SEQ ID NO: 624817 - DNA, 20 bp, mouse
gcgggtgagggtgtaaacca

SEQ ID NO: 624818 - DNA, 20 bp, mouse
gtggagcagcgagaacgtgg

SEQ ID NO: 624819 - DNA, 20 bp, mouse
gttactcacgcggggagtct

SEQ ID NO: 624820 - DNA, 20 bp, mouse
ggatcgggctagtgagatgg

SEQ ID NO: 624821 - DNA, 20 bp, mouse
ggcggggagtctcggacttg

SEQ ID NO: 624822 - DNA, 20 bp, mouse
gatctcactagcccgatcgt

SEQ ID NO: 624823 - DNA, 20 bp, mouse
gcagggtgggaagatggacg

SEQ ID NO: 624824 - DNA, 20 bp, mouse
gcgctggagcagcgagaacg

SEQ ID NO: 624825 - DNA, 20 bp, mouse
gcccaccctgagcaaaggga

SEQ ID NO: 624826 - DNA, 20 bp, mouse
gcacggatcacagtgatcct

SEQ ID NO: 624827 - DNA, 20 bp, mouse
gcagatgctgtcaaaggact

SEQ ID NO: 624828 - DNA, 20 bp, mouse
gacagcatctgacacgagta

SEQ ID NO: 624829 - DNA, 20 bp, mouse
gggactaggccgatccgcgg

SEQ ID NO: 624830 - DNA, 20 bp, mouse
gtgacacgagtacggatccc

SEQ ID NO: 624831 - DNA, 20 bp, mouse
gtcgtgtcagatgctgtcaa

SEQ ID NO: 624832 - DNA, 20 bp, mouse
gtatagaagaaagcaagacg

SEQ ID NO: 624833 - DNA, 20 bp, mouse
gtgctcggtcgccatagatc

SEQ ID NO: 624834 - DNA, 20 bp, mouse
gctgggaacggaccttatag

SEQ ID NO: 624835 - DNA, 20 bp, mouse
ggccccgaacccccgcggat

SEQ ID NO: 624836 - DNA, 20 bp, mouse
gagcagctccaggaacgtca

SEQ ID NO: 624837 - DNA, 20 bp, mouse
gggcggggctcgagagacag

SEQ ID NO: 624838 - DNA, 20 bp, mouse
gggtgcgaccacccagggag

SEQ ID NO: 624839 - DNA, 20 bp, mouse
gtgagctcggaagtcgcccg

SEQ ID NO: 624840 - DNA, 20 bp, mouse
gtgtccggtgcgaccaccca

SEQ ID NO: 624841 - DNA, 20 bp, mouse
ggcagctctcttcttgtccg

SEQ ID NO: 624842 - DNA, 20 bp, mouse
gaccgggaggagtatgagct

SEQ ID NO: 624843 - DNA, 20 bp, mouse
gcggacaaagggatgccctg

SEQ ID NO: 624844 - DNA, 20 bp, mouse
gtgcagcgcggctctccaga

SEQ ID NO: 624845 - DNA, 20 bp, mouse
gctccagacccgtaaccggg

SEQ ID NO: 624846 - DNA, 20 bp, mouse
gaagtcgcagcaggcctggc

SEQ ID NO: 624847 - DNA, 20 bp, mouse
gcggggacgccggccctcct

SEQ ID NO: 624848 - DNA, 20 bp, mouse
gtgcgacttgggtcccagga

SEQ ID NO: 624849 - DNA, 20 bp, mouse
gacccaagtcgcagcaggcc

SEQ ID NO: 624850 - DNA, 20 bp, mouse
gtcctcctgggcctgcactt

SEQ ID NO: 624851 - DNA, 20 bp, mouse
gacttgggtcccaggagggc

SEQ ID NO: 624852 - DNA, 20 bp, mouse
gggcccgttgctaggaggcg

SEQ ID NO: 624853 - DNA, 20 bp, mouse
gcccagcaggcgcgggccac

SEQ ID NO: 624854 - DNA, 20 bp, mouse
gccttcggcccgttgctagg

SEQ ID NO: 624855 - DNA, 20 bp, mouse
gcgatggagcctgggaaggt

SEQ ID NO: 624856 - DNA, 20 bp, mouse
gcgcgaggcacgagtcccaa

SEQ ID NO: 624857 - DNA, 20 bp, mouse
gtgtgcggctggctgtacgg

SEQ ID NO: 624858 - DNA, 20 bp, mouse
gtggctgtacggtggtgagt

SEQ ID NO: 624859 - DNA, 20 bp, mouse
gggtggtgagttggtgtgct

SEQ ID NO: 624860 - DNA, 20 bp, mouse
ggtcgccctctcgccctagt

SEQ ID NO: 624861 - DNA, 20 bp, mouse
ggggcagacagaaggcccat

SEQ ID NO: 624862 - DNA, 20 bp, mouse
gtgctgtgcggctggctgta

SEQ ID NO: 624863 - DNA, 20 bp, mouse
gcagacagaaggcccatagg

SEQ ID NO: 624864 - DNA, 20 bp, mouse
gttggtgctgttgcctacta

SEQ ID NO: 624865 - DNA, 20 bp, mouse
ggtcgtgctccactgacgtc

SEQ ID NO: 624866 - DNA, 20 bp, mouse
gcggctgttaagaagcgtaa

SEQ ID NO: 624867 - DNA, 20 bp, mouse
gagtgggtgctggctacagg

SEQ ID NO: 624868 - DNA, 20 bp, mouse
gccccgaggcgggaccaagg

SEQ ID NO: 624869 - DNA, 20 bp, mouse
ggtataacctccggccgcta

SEQ ID NO: 624870 - DNA, 20 bp, mouse
gctggtctccgacagcatga

SEQ ID NO: 624871 - DNA, 20 bp, mouse
gaaggcagccatcatgctgt

SEQ ID NO: 624872 - DNA, 20 bp, mouse
gtaagaagcgtaacggacac

SEQ ID NO: 624873 - DNA, 20 bp, mouse
ggaggacactgtgcagaacc

SEQ ID NO: 624874 - DNA, 20 bp, mouse
gtcactccgcgtataacctc

SEQ ID NO: 624875 - DNA, 20 bp, mouse
gggccattcgctattcgagt

SEQ ID NO: 624876 - DNA, 20 bp, mouse
gacgctccttcgagagtagg

SEQ ID NO: 624877 - DNA, 20 bp, mouse
gctccttcgagagtaggagg

SEQ ID NO: 624878 - DNA, 20 bp, mouse
gatttccagcaacagcgggc

SEQ ID NO: 624879 - DNA, 20 bp, mouse
ggaaacgctccttcgagagt

SEQ ID NO: 624880 - DNA, 20 bp, mouse
gtcccacctcctactctcga

SEQ ID NO: 624881 - DNA, 20 bp, mouse
gtcccagaaagtgctagaga

SEQ ID NO: 624882 - DNA, 20 bp, mouse
gcgctgttgctggaaatttg

SEQ ID NO: 624883 - DNA, 20 bp, mouse
ggctatgagagagcagttaa

SEQ ID NO: 624884 - DNA, 20 bp, mouse
gggtaagggcggttcagaac

SEQ ID NO: 624885 - DNA, 20 bp, mouse
ggaatgtcgggaaccgagag

SEQ ID NO: 624886 - DNA, 20 bp, mouse
ggtcagaggaatgagaccta

SEQ ID NO: 624887 - DNA, 20 bp, mouse
gtttctagcaggttagcagg

SEQ ID NO: 624888 - DNA, 20 bp, mouse
gctccttgttcctctagaac

SEQ ID NO: 624889 - DNA, 20 bp, mouse
gaacccaagacactgaatgg

SEQ ID NO: 624890 - DNA, 20 bp, mouse
gttggcatccatacagacat

SEQ ID NO: 624891 - DNA, 20 bp, mouse
gagtttattgaactcaacca

SEQ ID NO: 624892 - DNA, 20 bp, mouse
gagtaagagttgtttctagc

SEQ ID NO: 624893 - DNA, 20 bp, mouse
gttttatatccctgttctag

SEQ ID NO: 624894 - DNA, 20 bp, mouse
ggagactccctatgtctgta

SEQ ID NO: 624895 - DNA, 20 bp, mouse
gttgaaccgcttctcatcct

SEQ ID NO: 624896 - DNA, 20 bp, mouse
gagactacgtagggatcagt

SEQ ID NO: 624897 - DNA, 20 bp, mouse
gctgggttactagactacgt

SEQ ID NO: 624898 - DNA, 20 bp, mouse
gtaaagatccgaagcaatcc

SEQ ID NO: 624899 - DNA, 20 bp, mouse
ggggcgtgcccggattgctt

SEQ ID NO: 624900 - DNA, 20 bp, mouse
gaggaactgctctagcgttt

SEQ ID NO: 624901 - DNA, 20 bp, mouse
gcccagagccgtgaagcaag

SEQ ID NO: 624902 - DNA, 20 bp, mouse
gtgaagcgcctgagctacca

SEQ ID NO: 624903 - DNA, 20 bp, mouse
gccgccctcagatccttagg

SEQ ID NO: 624904 - DNA, 20 bp, mouse
gccaccgccctcagatcctt

SEQ ID NO: 624905 - DNA, 20 bp, mouse
gggtcctcctaaggatctga

SEQ ID NO: 624906 - DNA, 20 bp, mouse
gtatggacaggagcccctgg

SEQ ID NO: 624907 - DNA, 20 bp, mouse
ggtcactagggagtatggac

SEQ ID NO: 624908 - DNA, 20 bp, mouse
gtggttggcaaccgtcacta

SEQ ID NO: 624909 - DNA, 20 bp, mouse
gcaaccgtcactagggagta

SEQ ID NO: 624910 - DNA, 20 bp, mouse
gggtctcttgggatttcccg

SEQ ID NO: 624911 - DNA, 20 bp, mouse
ggagtatggacaggagcccc

SEQ ID NO: 624912 - DNA, 20 bp, mouse
gcatagggacggagcttggt

SEQ ID NO: 624913 - DNA, 20 bp, mouse
gctagccgttgccataggga

SEQ ID NO: 624914 - DNA, 20 bp, mouse
gggagcccctggaggtctct

SEQ ID NO: 624915 - DNA, 20 bp, mouse
gccttgggtcgtccagcctc

SEQ ID NO: 624916 - DNA, 20 bp, mouse
gttgcaaccaggcagggtga

SEQ ID NO: 624917 - DNA, 20 bp, mouse
gagggtgagggcggctacat

SEQ ID NO: 624918 - DNA, 20 bp, mouse
gggctccttgcaaccaggca

SEQ ID NO: 624919 - DNA, 20 bp, mouse
ggcggtggctccttgcaacc

SEQ ID NO: 624920 - DNA, 20 bp, mouse
gagcgaggcaaagcccgggt

SEQ ID NO: 624921 - DNA, 20 bp, mouse
gcccgggtgggcgaccccga

SEQ ID NO: 624922 - DNA, 20 bp, mouse
gatcggcgtggggtccctcg

SEQ ID NO: 624923 - DNA, 20 bp, mouse
gagggcggctacatcggcgt

SEQ ID NO: 624924 - DNA, 20 bp, mouse
gaaggcaaaggaggaggtgt

SEQ ID NO: 624925 - DNA, 20 bp, mouse
gtaggcgaggaggaccagcg

SEQ ID NO: 624926 - DNA, 20 bp, mouse
gctcgggaaccagcgaaggt

SEQ ID NO: 624927 - DNA, 20 bp, mouse
gagcactcgggaaccagcga

SEQ ID NO: 624928 - DNA, 20 bp, mouse
gcgactcccggcaagcccga

SEQ ID NO: 624929 - DNA, 20 bp, mouse
gccagcacggccctccaccc

SEQ ID NO: 624930 - DNA, 20 bp, mouse
ggaaccagcgaaggtgggtg

SEQ ID NO: 624931 - DNA, 20 bp, mouse
ggggcttgcgagtaaagggt

SEQ ID NO: 624932 - DNA, 20 bp, mouse
gggaaggcgccggtcaaaag

SEQ ID NO: 624933 - DNA, 20 bp, mouse
gtgcagcagcgcgcgactcc

SEQ ID NO: 624934 - DNA, 20 bp, mouse
gcggtgacgacacttccgtc

SEQ ID NO: 624935 - DNA, 20 bp, mouse
ggcaagccccgggcgaagtc

SEQ ID NO: 624936 - DNA, 20 bp, mouse
gtgggagtctgaacatccgt

SEQ ID NO: 624937 - DNA, 20 bp, mouse
gttcagactcccagagaggg

SEQ ID NO: 624938 - DNA, 20 bp, mouse
gtctgaacatccgtgggagt

SEQ ID NO: 624939 - DNA, 20 bp, mouse
gagtaggaagaacccggtgg

SEQ ID NO: 624940 - DNA, 20 bp, mouse
gagcagtaggaagaacccgg

SEQ ID NO: 624941 - DNA, 20 bp, mouse
ggctagcaagactccctcta

SEQ ID NO: 624942 - DNA, 20 bp, mouse
ggcttggttcagctccggga

SEQ ID NO: 624943 - DNA, 20 bp, mouse
gcgcagcagtaggaagaacc

SEQ ID NO: 624944 - DNA, 20 bp, mouse
gttcccagcagaacccaaag

SEQ ID NO: 624945 - DNA, 20 bp, mouse
gggctgtctcggctacaggt

SEQ ID NO: 624946 - DNA, 20 bp, mouse
gtatggagctcgctgaggac

SEQ ID NO: 624947 - DNA, 20 bp, mouse
ggctggcggaagtggagcga

SEQ ID NO: 624948 - DNA, 20 bp, mouse
ggttgctatggagctcgctg

SEQ ID NO: 624949 - DNA, 20 bp, mouse
gctcgctgaggactggctcg

SEQ ID NO: 624950 - DNA, 20 bp, mouse
gtccgccagccagacttcct

SEQ ID NO: 624951 - DNA, 20 bp, mouse
ggcccgtgggcgggtctgat

SEQ ID NO: 624952 - DNA, 20 bp, mouse
gtgcccatcagacccgccca

SEQ ID NO: 624953 - DNA, 20 bp, mouse
gcgcgcctgcccaggaagtc

SEQ ID NO: 624954 - DNA, 20 bp, mouse
gcgattgtaaattggcccgt

SEQ ID NO: 624955 - DNA, 20 bp, mouse
gagcccggtctcatacacca

SEQ ID NO: 624956 - DNA, 20 bp, mouse
gtgtgggtcggcactgagac

SEQ ID NO: 624957 - DNA, 20 bp, mouse
gctgagaccggcatcctgaa

SEQ ID NO: 624958 - DNA, 20 bp, mouse
ggccatcgcagaccagcccg

SEQ ID NO: 624959 - DNA, 20 bp, mouse
gacatggttccagcgagccg

SEQ ID NO: 624960 - DNA, 20 bp, mouse
gctcagtgccgacccacaca

SEQ ID NO: 624961 - DNA, 20 bp, mouse
gcgccggaagtgcaagccac

SEQ ID NO: 624962 - DNA, 20 bp, mouse
gggaagtgcaagccacgggc

SEQ ID NO: 624963 - DNA, 20 bp, mouse
ggccacgggctggtctgcga

SEQ ID NO: 624964 - DNA, 20 bp, mouse
gctgtgcggacagaaccgtg

SEQ ID NO: 624965 - DNA, 20 bp, mouse
gcccgccgcggctgtccgga

SEQ ID NO: 624966 - DNA, 20 bp, mouse
ggagtccgcgtggttcgctg

SEQ ID NO: 624967 - DNA, 20 bp, mouse
ggccgccgcagcgaaccacg

SEQ ID NO: 624968 - DNA, 20 bp, mouse
gagccggctgaacttcagga

SEQ ID NO: 624969 - DNA, 20 bp, mouse
ggtagaagagggagtccgcg

SEQ ID NO: 624970 - DNA, 20 bp, mouse
gagtaggctgcgggtcaaca

SEQ ID NO: 624971 - DNA, 20 bp, mouse
gggaaggttggcggttacag

SEQ ID NO: 624972 - DNA, 20 bp, mouse
gtccgcgtggttcgctgcgg

SEQ ID NO: 624973 - DNA, 20 bp, mouse
gtcctgcgcctgcgtgaaga

SEQ ID NO: 624974 - DNA, 20 bp, mouse
gcgcagcgcatggaccgacc

SEQ ID NO: 624975 - DNA, 20 bp, mouse
gggccctcctgaagttcagc

SEQ ID NO: 624976 - DNA, 20 bp, mouse
gcagttctggaaaatgtcga

SEQ ID NO: 624977 - DNA, 20 bp, mouse
gcggatcgcttaaagggcta

SEQ ID NO: 624978 - DNA, 20 bp, mouse
gggcgggaaacttgctcgaa

SEQ ID NO: 624979 - DNA, 20 bp, mouse
gtttagcactgggatgaccg

SEQ ID NO: 624980 - DNA, 20 bp, mouse
gttctggaaaatgtcgaagg

SEQ ID NO: 624981 - DNA, 20 bp, mouse
ggacattttccagaactgga

SEQ ID NO: 624982 - DNA, 20 bp, mouse
gcggatacgtgggtcacgca

SEQ ID NO: 624983 - DNA, 20 bp, mouse
gaattctaggagtattacat

SEQ ID NO: 624984 - DNA, 20 bp, mouse
gtttttggtaaggtccaaga

SEQ ID NO: 624985 - DNA, 20 bp, mouse
gtaaaggaggaaatccgtta

SEQ ID NO: 624986 - DNA, 20 bp, mouse
gtccctccggcgccgagtca

SEQ ID NO: 624987 - DNA, 20 bp, mouse
gtcgacgagagaccctgact

SEQ ID NO: 624988 - DNA, 20 bp, mouse
gaccacgtgtgcggtccctc

SEQ ID NO: 624989 - DNA, 20 bp, mouse
gagggtctctcgtcgagtct

SEQ ID NO: 624990 - DNA, 20 bp, mouse
ggcgctgggaggactcgaga

SEQ ID NO: 624991 - DNA, 20 bp, mouse
ggaattccctcggagagggg

SEQ ID NO: 624992 - DNA, 20 bp, mouse
gcagaggtacaccacgtgtg

SEQ ID NO: 624993 - DNA, 20 bp, mouse
gagcagaagggaaccatcta

SEQ ID NO: 624994 - DNA, 20 bp, mouse
gagagggcacccgagactgg

SEQ ID NO: 624995 - DNA, 20 bp, mouse
gtctcgtcgagtctgggtct

SEQ ID NO: 624996 - DNA, 20 bp, mouse
gagcgggcagttgggagtcc

SEQ ID NO: 624997 - DNA, 20 bp, mouse
gggcatcgccgaacctgctg

SEQ ID NO: 624998 - DNA, 20 bp, mouse
gctgtctctccgggatctag

SEQ ID NO: 624999 - DNA, 20 bp, mouse
ggtcggagagctatgcatgg

SEQ ID NO: 625000 - DNA, 20 bp, mouse
gccaggctccgcggtcgcca

SEQ ID NO: 625001 - DNA, 20 bp, mouse
gcccccttccccagcaggtt

SEQ ID NO: 625002 - DNA, 20 bp, mouse
gggagagacagccagccctt

SEQ ID NO: 625003 - DNA, 20 bp, mouse
gctcgtcggagagctatgca

SEQ ID NO: 625004 - DNA, 20 bp, mouse
gcgccgaacctgctggggaa

SEQ ID NO: 625005 - DNA, 20 bp, mouse
gctccgggatctagaggaac

SEQ ID NO: 625006 - DNA, 20 bp, mouse
gcgcatcagctgacccgtca

SEQ ID NO: 625007 - DNA, 20 bp, mouse
gagcgcaggaccctgcggag

SEQ ID NO: 625008 - DNA, 20 bp, mouse
gatcagctgacccgtcacgg

SEQ ID NO: 625009 - DNA, 20 bp, mouse
gtgcgctccggggcgcagca

SEQ ID NO: 625010 - DNA, 20 bp, mouse
gagccaacgcgtggacacta

SEQ ID NO: 625011 - DNA, 20 bp, mouse
ggccacggccctcctcgcag

SEQ ID NO: 625012 - DNA, 20 bp, mouse
gtccccgccctgctgcgccc

SEQ ID NO: 625013 - DNA, 20 bp, mouse
gccaggaccaaatggcccag

SEQ ID NO: 625014 - DNA, 20 bp, mouse
gcccggaagccactgcgagg

SEQ ID NO: 625015 - DNA, 20 bp, mouse
gccaggcggccaggaccaaa

SEQ ID NO: 625016 - DNA, 20 bp, mouse
gcttctccggagtcaattca

SEQ ID NO: 625017 - DNA, 20 bp, mouse
ggatggcggacacaatgagc

SEQ ID NO: 625018 - DNA, 20 bp, mouse
ggagtcaattcagggccaac

SEQ ID NO: 625019 - DNA, 20 bp, mouse
gaattgactccggagaagaa

SEQ ID NO: 625020 - DNA, 20 bp, mouse
gttgtgtccgccatcttgaa

SEQ ID NO: 625021 - DNA, 20 bp, mouse
gggccgagaggcgagcgatc

SEQ ID NO: 625022 - DNA, 20 bp, mouse
gctcgctgaccgttcttctc

SEQ ID NO: 625023 - DNA, 20 bp, mouse
ggcttctcccttcaagatgg

SEQ ID NO: 625024 - DNA, 20 bp, mouse
ggagaggcgagcgatcgggc

SEQ ID NO: 625025 - DNA, 20 bp, mouse
gggcggacacaatgagccgg

SEQ ID NO: 625026 - DNA, 20 bp, mouse
gacgcccgggaggaaggcga

SEQ ID NO: 625027 - DNA, 20 bp, mouse
ggtctctttgaaagcttggg

SEQ ID NO: 625028 - DNA, 20 bp, mouse
gggagcgcagaggctagcta

SEQ ID NO: 625029 - DNA, 20 bp, mouse
gcaagtctctttgaaagctt

SEQ ID NO: 625030 - DNA, 20 bp, mouse
gggctacgaagtgctagatg

SEQ ID NO: 625031 - DNA, 20 bp, mouse
gtccctccacccgagaccgg

SEQ ID NO: 625032 - DNA, 20 bp, mouse
ggcaactactgcctgacgtg

SEQ ID NO: 625033 - DNA, 20 bp, mouse
gctcgggtggagggacgccc

SEQ ID NO: 625034 - DNA, 20 bp, mouse
ggcgccttcgccttcctccc

SEQ ID NO: 625035 - DNA, 20 bp, mouse
gcgctgctgcggacctacag

SEQ ID NO: 625036 - DNA, 20 bp, mouse
gtaccggcttcagacctggt

SEQ ID NO: 625037 - DNA, 20 bp, mouse
gaccttctcggggctcagga

SEQ ID NO: 625038 - DNA, 20 bp, mouse
gctgcgcagaggagcccacc

SEQ ID NO: 625039 - DNA, 20 bp, mouse
gggtagaagaacccgagaag

SEQ ID NO: 625040 - DNA, 20 bp, mouse
ggcccggccaggaccacgag

SEQ ID NO: 625041 - DNA, 20 bp, mouse
gcctactcagaaccttctcg

SEQ ID NO: 625042 - DNA, 20 bp, mouse
gggtgggcgcttctgcgcag

SEQ ID NO: 625043 - DNA, 20 bp, mouse
gcttctaccggcttcagacc

SEQ ID NO: 625044 - DNA, 20 bp, mouse
gcccctcctgagccccgaga

SEQ ID NO: 625045 - DNA, 20 bp, mouse
gagaaggttctgagtagggg

SEQ ID NO: 625046 - DNA, 20 bp, mouse
gtccgcagcaaaccccacac

SEQ ID NO: 625047 - DNA, 20 bp, mouse
gtgaagcagagaccttcggg

SEQ ID NO: 625048 - DNA, 20 bp, mouse
gggcgggcagctctctcgac

SEQ ID NO: 625049 - DNA, 20 bp, mouse
gccacgcgcgtgccacccag

SEQ ID NO: 625050 - DNA, 20 bp, mouse
gtcgaccggcggccactggg

SEQ ID NO: 625051 - DNA, 20 bp, mouse
gcggagttccagccggccgt

SEQ ID NO: 625052 - DNA, 20 bp, mouse
gtggcatggaccccacatcc

SEQ ID NO: 625053 - DNA, 20 bp, mouse
gctgactgggagggaggtag

SEQ ID NO: 625054 - DNA, 20 bp, mouse
gtggggtccatgccacccga

SEQ ID NO: 625055 - DNA, 20 bp, mouse
ggcatgcgcagggaccgcgt

SEQ ID NO: 625056 - DNA, 20 bp, mouse
ggcgccatggccggaggtag

SEQ ID NO: 625057 - DNA, 20 bp, mouse
gccgcctgagcaccgatctg

SEQ ID NO: 625058 - DNA, 20 bp, mouse
ggcgagacgcgctgtcgtca

SEQ ID NO: 625059 - DNA, 20 bp, mouse
ggcgccgctacctccggcca

SEQ ID NO: 625060 - DNA, 20 bp, mouse
gcgagctgtagcgccatggc

SEQ ID NO: 625061 - DNA, 20 bp, mouse
gtccagcaaagagggagatg

SEQ ID NO: 625062 - DNA, 20 bp, mouse
gtccaagctgggcacctcgg

SEQ ID NO: 625063 - DNA, 20 bp, mouse
gagcgcgagctgtagcgcca

SEQ ID NO: 625064 - DNA, 20 bp, mouse
gaggagcaggaaggaccccg

SEQ ID NO: 625065 - DNA, 20 bp, mouse
gtcccgcgggcggaggtgga

SEQ ID NO: 625066 - DNA, 20 bp, mouse
gcgcgcgcgcgcagcgatgg

SEQ ID NO: 625067 - DNA, 20 bp, mouse
gcagtgtgtgcgtgaagcca

SEQ ID NO: 625068 - DNA, 20 bp, mouse
gtgtcaagcgagggccagac

SEQ ID NO: 625069 - DNA, 20 bp, mouse
gcgagccgctcagggcggag

SEQ ID NO: 625070 - DNA, 20 bp, mouse
gagacccgagccgctcaggg

SEQ ID NO: 625071 - DNA, 20 bp, mouse
gacggaagagcaggtactcc

SEQ ID NO: 625072 - DNA, 20 bp, mouse
ggtggagcgcacagacgagc

SEQ ID NO: 625073 - DNA, 20 bp, mouse
ggcgcacagacgagctggtc

SEQ ID NO: 625074 - DNA, 20 bp, mouse
gcagcgcgcgcgcgcagcga

SEQ ID NO: 625075 - DNA, 20 bp, mouse
gcagctggatgcggagatca

SEQ ID NO: 625076 - DNA, 20 bp, mouse
ggaatgtggacaatgatctg

SEQ ID NO: 625077 - DNA, 20 bp, mouse
gatgatctgaggcttctcga

SEQ ID NO: 625078 - DNA, 20 bp, mouse
gggcttctcgaaggtggaca

SEQ ID NO: 625079 - DNA, 20 bp, mouse
gggactgcacggaggatggt

SEQ ID NO: 625080 - DNA, 20 bp, mouse
gtggttaccaagttagcgtt

SEQ ID NO: 625081 - DNA, 20 bp, mouse
gtcattgtccacattcaaaa

SEQ ID NO: 625082 - DNA, 20 bp, mouse
gtccgggtagaatgcggcta

SEQ ID NO: 625083 - DNA, 20 bp, mouse
ggacctcaagctgctgcggg

SEQ ID NO: 625084 - DNA, 20 bp, mouse
ggtgcaggcttggaccgttt

SEQ ID NO: 625085 - DNA, 20 bp, mouse
ggttgaggcccttttgaatg

SEQ ID NO: 625086 - DNA, 20 bp, mouse
gccggaagtggtagttacta

SEQ ID NO: 625087 - DNA, 20 bp, mouse
gagtagagctgagtttcaca

SEQ ID NO: 625088 - DNA, 20 bp, mouse
gtccaggtagaggcactgag

SEQ ID NO: 625089 - DNA, 20 bp, mouse
gtggaaaccaagacgggaga

SEQ ID NO: 625090 - DNA, 20 bp, mouse
gcccactcagtgcctctacc

SEQ ID NO: 625091 - DNA, 20 bp, mouse
ggctgagtttcacaaggtcg

SEQ ID NO: 625092 - DNA, 20 bp, mouse
gtcgtggccttctcccgtct

SEQ ID NO: 625093 - DNA, 20 bp, mouse
gagaagagtgggagtaaagt

SEQ ID NO: 625094 - DNA, 20 bp, mouse
ggtgtttctagcagaagagt

SEQ ID NO: 625095 - DNA, 20 bp, mouse
gttggagttccggttagtac

SEQ ID NO: 625096 - DNA, 20 bp, mouse
gggatagctatcctcggtat

SEQ ID NO: 625097 - DNA, 20 bp, mouse
gggtatgggatagctatcct

SEQ ID NO: 625098 - DNA, 20 bp, mouse
gcactaataacaccaggtat

SEQ ID NO: 625099 - DNA, 20 bp, mouse
gtttagcggtgccaataccg

SEQ ID NO: 625100 - DNA, 20 bp, mouse
ggcaccgctaaagtagtcac

SEQ ID NO: 625101 - DNA, 20 bp, mouse
gagtccagtgactactttag

SEQ ID NO: 625102 - DNA, 20 bp, mouse
gggtagctaggtggactgga

SEQ ID NO: 625103 - DNA, 20 bp, mouse
gtgctaacactaataacacc

SEQ ID NO: 625104 - DNA, 20 bp, mouse
gtagtcactggactggatcg

SEQ ID NO: 625105 - DNA, 20 bp, mouse
gtaggtaactaactgttggg

SEQ ID NO: 625106 - DNA, 20 bp, mouse
gcggccgggccaaggagtaa

SEQ ID NO: 625107 - DNA, 20 bp, mouse
ggtcggcatgtcgcaagacc

SEQ ID NO: 625108 - DNA, 20 bp, mouse
gagggaggatccggagtagt

SEQ ID NO: 625109 - DNA, 20 bp, mouse
ggatccggagtagtgggcag

SEQ ID NO: 625110 - DNA, 20 bp, mouse
ggtaccaccgaggcaggaag

SEQ ID NO: 625111 - DNA, 20 bp, mouse
gccgactcccagcgcacccg

SEQ ID NO: 625112 - DNA, 20 bp, mouse
ggagtaacggccgcagcccc

SEQ ID NO: 625113 - DNA, 20 bp, mouse
gctggggttgagtaccaccg

SEQ ID NO: 625114 - DNA, 20 bp, mouse
gtttgcttggaggattcgag

SEQ ID NO: 625115 - DNA, 20 bp, mouse
gccgaggggtccaactgaag

SEQ ID NO: 625116 - DNA, 20 bp, mouse
gcagctcggggcccagcccg

SEQ ID NO: 625117 - DNA, 20 bp, mouse
gctgggctgggctgctcact

SEQ ID NO: 625118 - DNA, 20 bp, mouse
gaggcagagcccgactcact

SEQ ID NO: 625119 - DNA, 20 bp, mouse
gagcccagcagcccagctcg

SEQ ID NO: 625120 - DNA, 20 bp, mouse
gcaggaccgggccaccgggt

SEQ ID NO: 625121 - DNA, 20 bp, mouse
gacacgtgacccagtgagtc

SEQ ID NO: 625122 - DNA, 20 bp, mouse
gtggtgacctcagaacccgg

SEQ ID NO: 625123 - DNA, 20 bp, mouse
gcaggggaggagccgcccgg

SEQ ID NO: 625124 - DNA, 20 bp, mouse
gcgaccccggagccgcgcag

SEQ ID NO: 625125 - DNA, 20 bp, mouse
ggtgaccgcagcccacccgg

SEQ ID NO: 625126 - DNA, 20 bp, mouse
gtggaggagataaacagagg

SEQ ID NO: 625127 - DNA, 20 bp, mouse
ggcagggagccggcccagag

SEQ ID NO: 625128 - DNA, 20 bp, mouse
gagtcccgcaggctccaccg

SEQ ID NO: 625129 - DNA, 20 bp, mouse
gtcctgggaagagacctgac

SEQ ID NO: 625130 - DNA, 20 bp, mouse
ggagcaggggtgcggatccc

SEQ ID NO: 625131 - DNA, 20 bp, mouse
gggcccccccggaccgacat

SEQ ID NO: 625132 - DNA, 20 bp, mouse
gctcttcccaggaccagcag

SEQ ID NO: 625133 - DNA, 20 bp, mouse
gggtgcggatcccgggaagg

SEQ ID NO: 625134 - DNA, 20 bp, mouse
gcggcgaggaagggcagaaa

SEQ ID NO: 625135 - DNA, 20 bp, mouse
ggaagaggctagagctgccc

SEQ ID NO: 625136 - DNA, 20 bp, mouse
gttgtcgccagtctcccagg

SEQ ID NO: 625137 - DNA, 20 bp, mouse
ggccaggacagtttccgggt

SEQ ID NO: 625138 - DNA, 20 bp, mouse
gtcccacccggaaactgtcc

SEQ ID NO: 625139 - DNA, 20 bp, mouse
gcaattgtcgccagtctccc

SEQ ID NO: 625140 - DNA, 20 bp, mouse
gggccagcagcagcactcag

SEQ ID NO: 625141 - DNA, 20 bp, mouse
gtcctctcctcctgggagac

SEQ ID NO: 625142 - DNA, 20 bp, mouse
gggcggccaggacagtttcc

SEQ ID NO: 625143 - DNA, 20 bp, mouse
ggacaacagagtaggcggcc

SEQ ID NO: 625144 - DNA, 20 bp, mouse
gtcatcccggcgctaaaccc

SEQ ID NO: 625145 - DNA, 20 bp, mouse
gcgtcccgcgtaggacagac

SEQ ID NO: 625146 - DNA, 20 bp, mouse
gtgcggcgcgggatgtccag

SEQ ID NO: 625147 - DNA, 20 bp, mouse
ggcccgtcaagctcacgacg

SEQ ID NO: 625148 - DNA, 20 bp, mouse
gagactggccggtccagtgc

SEQ ID NO: 625149 - DNA, 20 bp, mouse
gaggaccggcgagcagaggc

SEQ ID NO: 625150 - DNA, 20 bp, mouse
gaggagccgcttacagtctg

SEQ ID NO: 625151 - DNA, 20 bp, mouse
gtgcagtcacggcggagcac

SEQ ID NO: 625152 - DNA, 20 bp, mouse
gggcagcggccacagtacgg

SEQ ID NO: 625153 - DNA, 20 bp, mouse
gatgtccagcggagactggc

SEQ ID NO: 625154 - DNA, 20 bp, mouse
gacacaggaccggcgagcag

SEQ ID NO: 625155 - DNA, 20 bp, mouse
ggccgcggaacccgaacttg

SEQ ID NO: 625156 - DNA, 20 bp, mouse
gggctggcccagagaagaag

SEQ ID NO: 625157 - DNA, 20 bp, mouse
gggagaactgacctactcgg

SEQ ID NO: 625158 - DNA, 20 bp, mouse
gtgggagcaaggccaacaac

SEQ ID NO: 625159 - DNA, 20 bp, mouse
gagtgatgtgacgcgaggaa

SEQ ID NO: 625160 - DNA, 20 bp, mouse
ggaactgacctactcggagg

SEQ ID NO: 625161 - DNA, 20 bp, mouse
gaagggagaactgacctact

SEQ ID NO: 625162 - DNA, 20 bp, mouse
gttccccaccgcctccgagt

SEQ ID NO: 625163 - DNA, 20 bp, mouse
gtggcaagtgatgtgacgcg

SEQ ID NO: 625164 - DNA, 20 bp, mouse
ggtggggctgaggaagacaa

SEQ ID NO: 625165 - DNA, 20 bp, mouse
gagcaaggccaacaaccggc

SEQ ID NO: 625166 - DNA, 20 bp, mouse
gctgccaccagcctcgggat

SEQ ID NO: 625167 - DNA, 20 bp, mouse
ggccgcagttacccatcccg

SEQ ID NO: 625168 - DNA, 20 bp, mouse
gcaggaaactcagagcccga

SEQ ID NO: 625169 - DNA, 20 bp, mouse
gttacccatcccgaggctgg

SEQ ID NO: 625170 - DNA, 20 bp, mouse
gtgcggcagaaaagtccttc

SEQ ID NO: 625171 - DNA, 20 bp, mouse
gactggagcccagtagcaac

SEQ ID NO: 625172 - DNA, 20 bp, mouse
gtcctctccccggcctgcgg

SEQ ID NO: 625173 - DNA, 20 bp, mouse
gcagttacccatcccgaggc

SEQ ID NO: 625174 - DNA, 20 bp, mouse
ggggccacctcccatcacag

SEQ ID NO: 625175 - DNA, 20 bp, mouse
gtgacctcctccgcaggccg

SEQ ID NO: 625176 - DNA, 20 bp, mouse
gagcataactgcgacccagg

SEQ ID NO: 625177 - DNA, 20 bp, mouse
gagatctgagctcaccgcct

SEQ ID NO: 625178 - DNA, 20 bp, mouse
gagctcagatctagtctgga

SEQ ID NO: 625179 - DNA, 20 bp, mouse
gcttcgctggacccctccgt

SEQ ID NO: 625180 - DNA, 20 bp, mouse
ggacagcataactgcgaccc

SEQ ID NO: 625181 - DNA, 20 bp, mouse
gtggacccctccgtcggcta

SEQ ID NO: 625182 - DNA, 20 bp, mouse
gctttccctagccgacggag

SEQ ID NO: 625183 - DNA, 20 bp, mouse
gggtgagctcagatctagtc

SEQ ID NO: 625184 - DNA, 20 bp, mouse
gagaggccccgtcctgctgt

SEQ ID NO: 625185 - DNA, 20 bp, mouse
gctctcagaggtgttcagtg

SEQ ID NO: 625186 - DNA, 20 bp, mouse
gagaggcgctgataaccact

SEQ ID NO: 625187 - DNA, 20 bp, mouse
ggcgcctctggctgagaggt

SEQ ID NO: 625188 - DNA, 20 bp, mouse
ggagagcgccactagccaag

SEQ ID NO: 625189 - DNA, 20 bp, mouse
gtaggtagagagggaggccc

SEQ ID NO: 625190 - DNA, 20 bp, mouse
gtcacagagcaagtaatgac

SEQ ID NO: 625191 - DNA, 20 bp, mouse
gcaggtctcaagccctttgt

SEQ ID NO: 625192 - DNA, 20 bp, mouse
gggtctcgcattagaacctc

SEQ ID NO: 625193 - DNA, 20 bp, mouse
gcttaggcaacccttgtgat

SEQ ID NO: 625194 - DNA, 20 bp, mouse
gtttggggcttgcttaccag

SEQ ID NO: 625195 - DNA, 20 bp, mouse
gctgtagagactgtgatttg

SEQ ID NO: 625196 - DNA, 20 bp, mouse
gctgagactgaggctggtgc

SEQ ID NO: 625197 - DNA, 20 bp, mouse
gtaacgggaggtggagtcaa

SEQ ID NO: 625198 - DNA, 20 bp, mouse
gttggccacatgttgctgtg

SEQ ID NO: 625199 - DNA, 20 bp, mouse
ggtcaaaggcgagggtaagt

SEQ ID NO: 625200 - DNA, 20 bp, mouse
gaggcgagctgcctagagct

SEQ ID NO: 625201 - DNA, 20 bp, mouse
gatgggaactcccagattat

SEQ ID NO: 625202 - DNA, 20 bp, mouse
gtgaggaccaagatactgtt

SEQ ID NO: 625203 - DNA, 20 bp, mouse
gaactcccagattataggaa

SEQ ID NO: 625204 - DNA, 20 bp, mouse
gggcgagggtaagtgggtac

SEQ ID NO: 625205 - DNA, 20 bp, mouse
gatcggcagggggggtgtgt

SEQ ID NO: 625206 - DNA, 20 bp, mouse
gatcctggccgagggtggtt

SEQ ID NO: 625207 - DNA, 20 bp, mouse
gtggccgagggtggttaggt

SEQ ID NO: 625208 - DNA, 20 bp, mouse
gaactctgccgggagaagag

SEQ ID NO: 625209 - DNA, 20 bp, mouse
gaggctcagagatggctgta

SEQ ID NO: 625210 - DNA, 20 bp, mouse
gggtgaatcctggccgaggg

SEQ ID NO: 625211 - DNA, 20 bp, mouse
gctcgatgtgtggtgaatcc

SEQ ID NO: 625212 - DNA, 20 bp, mouse
gtgtgctccaggggagggac

SEQ ID NO: 625213 - DNA, 20 bp, mouse
gaggttggtccaaactctgc

SEQ ID NO: 625214 - DNA, 20 bp, mouse
gggagaagggactatctcgg

SEQ ID NO: 625215 - DNA, 20 bp, mouse
gggttagcgcctgtggagaa

SEQ ID NO: 625216 - DNA, 20 bp, mouse
gtatccacggcccagcgcag

SEQ ID NO: 625217 - DNA, 20 bp, mouse
ggggccgtggataaccagca

SEQ ID NO: 625218 - DNA, 20 bp, mouse
gtcctccctccatgttcaca

SEQ ID NO: 625219 - DNA, 20 bp, mouse
gcttccctgctggttatcca

SEQ ID NO: 625220 - DNA, 20 bp, mouse
gagctacctggtcctcggag

SEQ ID NO: 625221 - DNA, 20 bp, mouse
gacagggcagtcaatcctct

SEQ ID NO: 625222 - DNA, 20 bp, mouse
gattgactgccctgtgaaca

SEQ ID NO: 625223 - DNA, 20 bp, mouse
gcactgctgggacccctccg

SEQ ID NO: 625224 - DNA, 20 bp, mouse
ggccgtgataaagggtgcaa

SEQ ID NO: 625225 - DNA, 20 bp, mouse
gtctaggctgcgccatgctg

SEQ ID NO: 625226 - DNA, 20 bp, mouse
gtcagtgtgtcccaagggag

SEQ ID NO: 625227 - DNA, 20 bp, mouse
gagctttctttcgcatacgg

SEQ ID NO: 625228 - DNA, 20 bp, mouse
gagaggagtgctgccctgga

SEQ ID NO: 625229 - DNA, 20 bp, mouse
gatacggaggacagttctgc

SEQ ID NO: 625230 - DNA, 20 bp, mouse
gtctcctgtagaaataaacg

SEQ ID NO: 625231 - DNA, 20 bp, mouse
ggccctggacggcatggaaa

SEQ ID NO: 625232 - DNA, 20 bp, mouse
gcctccacgtttatttctac

SEQ ID NO: 625233 - DNA, 20 bp, mouse
gtttagctttctttcgcata

SEQ ID NO: 625234 - DNA, 20 bp, mouse
gcgaagagagggtccgaagg

SEQ ID NO: 625235 - DNA, 20 bp, mouse
gtgagagagaagaacataca

SEQ ID NO: 625236 - DNA, 20 bp, mouse
gggtcactgcgagtagagag

SEQ ID NO: 625237 - DNA, 20 bp, mouse
gactgtgcaggtgagcgtgg

SEQ ID NO: 625238 - DNA, 20 bp, mouse
gccatgggagagcccagaat

SEQ ID NO: 625239 - DNA, 20 bp, mouse
ggaaatgcgtgtggagtcaa

SEQ ID NO: 625240 - DNA, 20 bp, mouse
ggcagggaacccgatactct

SEQ ID NO: 625241 - DNA, 20 bp, mouse
gtcacctgcacagttttctt

SEQ ID NO: 625242 - DNA, 20 bp, mouse
gatgcgctgtgtggatccat

SEQ ID NO: 625243 - DNA, 20 bp, mouse
gtttaggtataaggacaaag

SEQ ID NO: 625244 - DNA, 20 bp, mouse
gtcttgggagcgaagtacca

SEQ ID NO: 625245 - DNA, 20 bp, mouse
gataaagaagaagaacggtg

SEQ ID NO: 625246 - DNA, 20 bp, mouse
gaggtgtgagtggctccact

SEQ ID NO: 625247 - DNA, 20 bp, mouse
gcactgggcaacggaaaaga

SEQ ID NO: 625248 - DNA, 20 bp, mouse
gcaacggaaaagaaggtgag

SEQ ID NO: 625249 - DNA, 20 bp, mouse
ggagctgacctcaggcaaga

SEQ ID NO: 625250 - DNA, 20 bp, mouse
gatggtagtgtggacggagg

SEQ ID NO: 625251 - DNA, 20 bp, mouse
gctcaggcaagatggtagtg

SEQ ID NO: 625252 - DNA, 20 bp, mouse
gttgcaacaggacctgtgag

SEQ ID NO: 625253 - DNA, 20 bp, mouse
gcccggttggcctcatgaag

SEQ ID NO: 625254 - DNA, 20 bp, mouse
gtgggaggccaggcaggcat

SEQ ID NO: 625255 - DNA, 20 bp, mouse
gggcaagatggtagtgtgga

SEQ ID NO: 625256 - DNA, 20 bp, mouse
gttggggcaagacactacat

SEQ ID NO: 625257 - DNA, 20 bp, mouse
ggccacagtcttgtttctgg

SEQ ID NO: 625258 - DNA, 20 bp, mouse
gtggtggctttgatcactgt

SEQ ID NO: 625259 - DNA, 20 bp, mouse
gacagccacagtcttgtttc

SEQ ID NO: 625260 - DNA, 20 bp, mouse
gatgggtctggtgtaaagag

SEQ ID NO: 625261 - DNA, 20 bp, mouse
gcaggggatgcattattaca

SEQ ID NO: 625262 - DNA, 20 bp, mouse
gcccacaggactctaatgca

SEQ ID NO: 625263 - DNA, 20 bp, mouse
gttgctcagagatgaaccat

SEQ ID NO: 625264 - DNA, 20 bp, mouse
gtctgtctttaagaacgcta

SEQ ID NO: 625265 - DNA, 20 bp, mouse
ggtgtaaagacaggctacga

SEQ ID NO: 625266 - DNA, 20 bp, mouse
ggctaccagaacaaagactg

SEQ ID NO: 625267 - DNA, 20 bp, mouse
gttggggttagacagagccc

SEQ ID NO: 625268 - DNA, 20 bp, mouse
gtggggatgagctaacacag

SEQ ID NO: 625269 - DNA, 20 bp, mouse
gctcatccccaggtcctagt

SEQ ID NO: 625270 - DNA, 20 bp, mouse
gcaaaacccactaggacctg

SEQ ID NO: 625271 - DNA, 20 bp, mouse
ggtcactattatagccccaa

SEQ ID NO: 625272 - DNA, 20 bp, mouse
gcatgacaatgactactgcc

SEQ ID NO: 625273 - DNA, 20 bp, mouse
gcacatctccaaactagggc

SEQ ID NO: 625274 - DNA, 20 bp, mouse
gcagggcacctgccctagtt

SEQ ID NO: 625275 - DNA, 20 bp, mouse
ggaatcaaatttgctccttt

SEQ ID NO: 625276 - DNA, 20 bp, mouse
ggccagcggccagcaagcag

SEQ ID NO: 625277 - DNA, 20 bp, mouse
gtcacctgtggctgagatgg

SEQ ID NO: 625278 - DNA, 20 bp, mouse
gggccgctggcctcctacta

SEQ ID NO: 625279 - DNA, 20 bp, mouse
ggaacagtagcaaccctagt

SEQ ID NO: 625280 - DNA, 20 bp, mouse
gcagtagcaaccctagtagg

SEQ ID NO: 625281 - DNA, 20 bp, mouse
gaaccctagtaggaggccag

SEQ ID NO: 625282 - DNA, 20 bp, mouse
ggccagcaagcagaggcgac

SEQ ID NO: 625283 - DNA, 20 bp, mouse
gtctgagactccggcactct

SEQ ID NO: 625284 - DNA, 20 bp, mouse
gtagggtccggggaatgtac

SEQ ID NO: 625285 - DNA, 20 bp, mouse
gggctcaagtcccagaggac

SEQ ID NO: 625286 - DNA, 20 bp, mouse
gagacgaggtggctcctagg

SEQ ID NO: 625287 - DNA, 20 bp, mouse
ggtccccgacaccaaagacg

SEQ ID NO: 625288 - DNA, 20 bp, mouse
gcaaagacgaggtggctcct

SEQ ID NO: 625289 - DNA, 20 bp, mouse
gcccgacaccaaagacgagg

SEQ ID NO: 625290 - DNA, 20 bp, mouse
gcccagccgttgtctcccag

SEQ ID NO: 625291 - DNA, 20 bp, mouse
gggtgtcggggacgacgttg

SEQ ID NO: 625292 - DNA, 20 bp, mouse
ggggaaccgaactgccgcct

SEQ ID NO: 625293 - DNA, 20 bp, mouse
gtgcgccgtggggttgctat

SEQ ID NO: 625294 - DNA, 20 bp, mouse
gacggctggggaccgagtgt

SEQ ID NO: 625295 - DNA, 20 bp, mouse
gtggctcctaggcggcagtt

SEQ ID NO: 625296 - DNA, 20 bp, mouse
ggactagagggtgaccaggg

SEQ ID NO: 625297 - DNA, 20 bp, mouse
gccccccactctccacagaa

SEQ ID NO: 625298 - DNA, 20 bp, mouse
gtcagcagaagaggactaga

SEQ ID NO: 625299 - DNA, 20 bp, mouse
gcaaagccaggaggactacc

SEQ ID NO: 625300 - DNA, 20 bp, mouse
gtctgctgactcaactgctc

SEQ ID NO: 625301 - DNA, 20 bp, mouse
gtctgagctctgagcttatt

SEQ ID NO: 625302 - DNA, 20 bp, mouse
gcgggaagcacaagccaccc

SEQ ID NO: 625303 - DNA, 20 bp, mouse
ggggagagccagtgataagt

SEQ ID NO: 625304 - DNA, 20 bp, mouse
ggactctcatgtttctttcg

SEQ ID NO: 625305 - DNA, 20 bp, mouse
gcacacaccccacttatcac

SEQ ID NO: 625306 - DNA, 20 bp, mouse
gcgtggaaggcagccaaggt

SEQ ID NO: 625307 - DNA, 20 bp, mouse
ggtctctggccactcaggag

SEQ ID NO: 625308 - DNA, 20 bp, mouse
gtttcccagggtcaaattgg

SEQ ID NO: 625309 - DNA, 20 bp, mouse
gtggaggctggaagttttct

SEQ ID NO: 625310 - DNA, 20 bp, mouse
gccagggtcaaattggaggc

SEQ ID NO: 625311 - DNA, 20 bp, mouse
gacttttcccagggtcaaat

SEQ ID NO: 625312 - DNA, 20 bp, mouse
gcctgggaaaagtaagattc

SEQ ID NO: 625313 - DNA, 20 bp, mouse
gcccacgaccagtcctacct

SEQ ID NO: 625314 - DNA, 20 bp, mouse
gggatctgacatgctggtcg

SEQ ID NO: 625315 - DNA, 20 bp, mouse
gttacagttccagcccatcg

SEQ ID NO: 625316 - DNA, 20 bp, mouse
gggaagggaaccgccagcag

SEQ ID NO: 625317 - DNA, 20 bp, mouse
gtggtcagggcctctgctgg

SEQ ID NO: 625318 - DNA, 20 bp, mouse
ggaggtcaaatcctgtctca

SEQ ID NO: 625319 - DNA, 20 bp, mouse
ggaacctgcgctggcagagg

SEQ ID NO: 625320 - DNA, 20 bp, mouse
gacaggatttgacctctccc

SEQ ID NO: 625321 - DNA, 20 bp, mouse
ggttcttaagaaacttgatg

SEQ ID NO: 625322 - DNA, 20 bp, mouse
ggatttgacctctcccaggc

SEQ ID NO: 625323 - DNA, 20 bp, mouse
gggtctttataagtaagtac

SEQ ID NO: 625324 - DNA, 20 bp, mouse
gagaccccctctgccagcgc

SEQ ID NO: 625325 - DNA, 20 bp, mouse
gcagtgtttccccatatcct

SEQ ID NO: 625326 - DNA, 20 bp, mouse
gggaagggaaccgccagcag

SEQ ID NO: 625327 - DNA, 20 bp, mouse
gtggtcagggcctctgctgg

SEQ ID NO: 625328 - DNA, 20 bp, mouse
ggaggtcaaatcctgtctca

SEQ ID NO: 625329 - DNA, 20 bp, mouse
gacaggatttgacctctccc

SEQ ID NO: 625330 - DNA, 20 bp, mouse
gagacattgtaaggagacaa

SEQ ID NO: 625331 - DNA, 20 bp, mouse
gcctctaaggcaggagaaca

SEQ ID NO: 625332 - DNA, 20 bp, mouse
ggatttgacctctcccaggc

SEQ ID NO: 625333 - DNA, 20 bp, mouse
gctcaaggaaaagagaagga

SEQ ID NO: 625334 - DNA, 20 bp, mouse
gcagagatgaggagaatcag

SEQ ID NO: 625335 - DNA, 20 bp, mouse
gccaggagatggcacctcta

SEQ ID NO: 625336 - DNA, 20 bp, mouse
ggggaccacggctccagcac

SEQ ID NO: 625337 - DNA, 20 bp, mouse
ggctccagcacaggaacctt

SEQ ID NO: 625338 - DNA, 20 bp, mouse
gattgttactctggggacca

SEQ ID NO: 625339 - DNA, 20 bp, mouse
gtcctgtaggccaagttgag

SEQ ID NO: 625340 - DNA, 20 bp, mouse
gaggaaaatggtacctgctg

SEQ ID NO: 625341 - DNA, 20 bp, mouse
gtgaggggaaactgatgagg

SEQ ID NO: 625342 - DNA, 20 bp, mouse
gtcttactattgttactctg

SEQ ID NO: 625343 - DNA, 20 bp, mouse
gtttgtagtctgttccccaa

SEQ ID NO: 625344 - DNA, 20 bp, mouse
gatctcaaggggatgaggta

SEQ ID NO: 625345 - DNA, 20 bp, mouse
ggagggatataacctttaag

SEQ ID NO: 625346 - DNA, 20 bp, mouse
gtgggtaggcgggacacagg

SEQ ID NO: 625347 - DNA, 20 bp, mouse
gcacaggaggatccagattg

SEQ ID NO: 625348 - DNA, 20 bp, mouse
gcactgggtaggcgggacac

SEQ ID NO: 625349 - DNA, 20 bp, mouse
gtcctccctgaatagagggt

SEQ ID NO: 625350 - DNA, 20 bp, mouse
gagaagggccagctcaatca

SEQ ID NO: 625351 - DNA, 20 bp, mouse
gctatgggctggcctcaatc

SEQ ID NO: 625352 - DNA, 20 bp, mouse
gttgctatgtagctatgggc

SEQ ID NO: 625353 - DNA, 20 bp, mouse
gatggagtaagaaaccccta

SEQ ID NO: 625354 - DNA, 20 bp, mouse
gtacaagctggagcccaaca

SEQ ID NO: 625355 - DNA, 20 bp, mouse
ggaccactagggtcaccaag

SEQ ID NO: 625356 - DNA, 20 bp, mouse
gaggagaggctcacttgcta

SEQ ID NO: 625357 - DNA, 20 bp, mouse
ggcagtgctaggcctcgaag

SEQ ID NO: 625358 - DNA, 20 bp, mouse
gtggagaagaaggcccccgt

SEQ ID NO: 625359 - DNA, 20 bp, mouse
gcaagagctgatgcccacgg

SEQ ID NO: 625360 - DNA, 20 bp, mouse
gccgcatgggagtatcggat

SEQ ID NO: 625361 - DNA, 20 bp, mouse
gtggcttcagctgctgtgac

SEQ ID NO: 625362 - DNA, 20 bp, mouse
gcatgggagtatcggatggg

SEQ ID NO: 625363 - DNA, 20 bp, mouse
ggtgtgccccagggtatcat

SEQ ID NO: 625364 - DNA, 20 bp, mouse
gcagaaccgatgataccctg

SEQ ID NO: 625365 - DNA, 20 bp, mouse
ggcctcgaaggggagcctcg

SEQ ID NO: 625366 - DNA, 20 bp, mouse
ggaaaccgcggagattgcag

SEQ ID NO: 625367 - DNA, 20 bp, mouse
gcggggccgcgctgaatgta

SEQ ID NO: 625368 - DNA, 20 bp, mouse
gcggtttcggagcaacttcg

SEQ ID NO: 625369 - DNA, 20 bp, mouse
gtcgccaggaggacagatgg

SEQ ID NO: 625370 - DNA, 20 bp, mouse
ggggctctgccacccatcag

SEQ ID NO: 625371 - DNA, 20 bp, mouse
gcgggagtgccgggactcca

SEQ ID NO: 625372 - DNA, 20 bp, mouse
gcgtggagcagcgagagtcc

SEQ ID NO: 625373 - DNA, 20 bp, mouse
gtggggcagctctggagcgt

SEQ ID NO: 625374 - DNA, 20 bp, mouse
ggtcctgggtagggagtcca

SEQ ID NO: 625375 - DNA, 20 bp, mouse
gagacacacggctcctgggt

SEQ ID NO: 625376 - DNA, 20 bp, mouse
ggtggcctgtcgcagtctaa

SEQ ID NO: 625377 - DNA, 20 bp, mouse
gagcagcccgacagcctgga

SEQ ID NO: 625378 - DNA, 20 bp, mouse
gtcgggctgctcgctgtcca

SEQ ID NO: 625379 - DNA, 20 bp, mouse
gggaagaggtcctcacgcag

SEQ ID NO: 625380 - DNA, 20 bp, mouse
gcagcggaacccagccatcc

SEQ ID NO: 625381 - DNA, 20 bp, mouse
ggtcgcagtctaagggtgtg

SEQ ID NO: 625382 - DNA, 20 bp, mouse
gcggctcccggaaaatgtcg

SEQ ID NO: 625383 - DNA, 20 bp, mouse
gtgcgcgccgcggaacccgg

SEQ ID NO: 625384 - DNA, 20 bp, mouse
gcaggcgccggccacaggag

SEQ ID NO: 625385 - DNA, 20 bp, mouse
gcccgacagcctggatggct

SEQ ID NO: 625386 - DNA, 20 bp, mouse
gcgaactgttgagcagctct

SEQ ID NO: 625387 - DNA, 20 bp, mouse
ggggcgcacacggagccacg

SEQ ID NO: 625388 - DNA, 20 bp, mouse
gcggcggcgtcggaactcgc

SEQ ID NO: 625389 - DNA, 20 bp, mouse
gtcaacagttcgcaaagtcc

SEQ ID NO: 625390 - DNA, 20 bp, mouse
gttagggcgccggtcaatct

SEQ ID NO: 625391 - DNA, 20 bp, mouse
gcgagatgcccgttcctcta

SEQ ID NO: 625392 - DNA, 20 bp, mouse
gcccccagccctagaggaac

SEQ ID NO: 625393 - DNA, 20 bp, mouse
gaagtcccggctggcgacgg

SEQ ID NO: 625394 - DNA, 20 bp, mouse
gtcggaggacgaagagacgg

SEQ ID NO: 625395 - DNA, 20 bp, mouse
gactctgagcctagattgac

SEQ ID NO: 625396 - DNA, 20 bp, mouse
gtgtccggcgacggcagcgg

SEQ ID NO: 625397 - DNA, 20 bp, mouse
gggcagcggctgtccggcga

SEQ ID NO: 625398 - DNA, 20 bp, mouse
gccgggagatcgaggcccga

SEQ ID NO: 625399 - DNA, 20 bp, mouse
gtacgctgcaacgcatcctc

SEQ ID NO: 625400 - DNA, 20 bp, mouse
gggctgtccggcgacggcag

SEQ ID NO: 625401 - DNA, 20 bp, mouse
gtcgaggcccgagggctgag

SEQ ID NO: 625402 - DNA, 20 bp, mouse
ggttgcagcgtaggtcactg

SEQ ID NO: 625403 - DNA, 20 bp, mouse
ggcgagggtggaggatcgga

SEQ ID NO: 625404 - DNA, 20 bp, mouse
gagccagcggttagttcccg

SEQ ID NO: 625405 - DNA, 20 bp, mouse
gctgtccggcagcggctgtc

SEQ ID NO: 625406 - DNA, 20 bp, mouse
gggcggcgcggagatccgga

SEQ ID NO: 625407 - DNA, 20 bp, mouse
gagctggcggcgcggagatc

SEQ ID NO: 625408 - DNA, 20 bp, mouse
gggcgcggagatccggacgg

SEQ ID NO: 625409 - DNA, 20 bp, mouse
gcgtcagccgcggagaggag

SEQ ID NO: 625410 - DNA, 20 bp, mouse
gcgggcgacgcggagcgaag

SEQ ID NO: 625411 - DNA, 20 bp, mouse
gcccggtctcggcctccgtc

SEQ ID NO: 625412 - DNA, 20 bp, mouse
ggcgacgcggagcgaagggg

SEQ ID NO: 625413 - DNA, 20 bp, mouse
ggaaggcaccccgatctccc

SEQ ID NO: 625414 - DNA, 20 bp, mouse
ggtggctgcccgggagatcg

SEQ ID NO: 625415 - DNA, 20 bp, mouse
gtcggcgctgagagcgaagg

SEQ ID NO: 625416 - DNA, 20 bp, mouse
gatgtaactgacgagaccgg

SEQ ID NO: 625417 - DNA, 20 bp, mouse
gccaagaatcccgggagagg

SEQ ID NO: 625418 - DNA, 20 bp, mouse
gaacccaagaatcccgggag

SEQ ID NO: 625419 - DNA, 20 bp, mouse
gcctatgtaactgacgagac

SEQ ID NO: 625420 - DNA, 20 bp, mouse
gaaaacacgagaccagaagg

SEQ ID NO: 625421 - DNA, 20 bp, mouse
ggtggttcgggttctcaaga

SEQ ID NO: 625422 - DNA, 20 bp, mouse
gcccctaacccaagaatccc

SEQ ID NO: 625423 - DNA, 20 bp, mouse
ggcggtgagtgcggggatcg

SEQ ID NO: 625424 - DNA, 20 bp, mouse
gtcgcctgcaccaaacccta

SEQ ID NO: 625425 - DNA, 20 bp, mouse
gtcgcggagccgcctctccc

SEQ ID NO: 625426 - DNA, 20 bp, mouse
gctcccaggctcactcgcaa

SEQ ID NO: 625427 - DNA, 20 bp, mouse
gtgttcctacttaaacgact

SEQ ID NO: 625428 - DNA, 20 bp, mouse
ggctcactcgcaacggagac

SEQ ID NO: 625429 - DNA, 20 bp, mouse
gcctgctgcgagcggatgca

SEQ ID NO: 625430 - DNA, 20 bp, mouse
gtagaggagcacactcgaga

SEQ ID NO: 625431 - DNA, 20 bp, mouse
gcacgcccagtcgtttaagt

SEQ ID NO: 625432 - DNA, 20 bp, mouse
gcggagcgcgaaagcaggga

SEQ ID NO: 625433 - DNA, 20 bp, mouse
gggtacaagctctcctcagg

SEQ ID NO: 625434 - DNA, 20 bp, mouse
gagtgctcataggtaaggtc

SEQ ID NO: 625435 - DNA, 20 bp, mouse
gatcaggctagagtgctcat

SEQ ID NO: 625436 - DNA, 20 bp, mouse
gaaaagcgctccgcgccggg

SEQ ID NO: 625437 - DNA, 20 bp, mouse
gccagcccgcgcgggaggaa

SEQ ID NO: 625438 - DNA, 20 bp, mouse
gtctcggcgaagttcccgga

SEQ ID NO: 625439 - DNA, 20 bp, mouse
gcgggaggctgcgaccatcc

SEQ ID NO: 625440 - DNA, 20 bp, mouse
gggacgcgccctgcatggtg

SEQ ID NO: 625441 - DNA, 20 bp, mouse
gcggagccgctgcacggtaa

SEQ ID NO: 625442 - DNA, 20 bp, mouse
gttctgggaaacttctctct

SEQ ID NO: 625443 - DNA, 20 bp, mouse
gagggggagggcgcacatct

SEQ ID NO: 625444 - DNA, 20 bp, mouse
gacggagttggggtgcagac

SEQ ID NO: 625445 - DNA, 20 bp, mouse
ggcgcttttcctgcccgccc

SEQ ID NO: 625446 - DNA, 20 bp, mouse
ggctcagtcgctgttctcag

SEQ ID NO: 625447 - DNA, 20 bp, mouse
ggaaaggcagtcaaacaggt

SEQ ID NO: 625448 - DNA, 20 bp, mouse
gcagcggattaaagcaacac

SEQ ID NO: 625449 - DNA, 20 bp, mouse
gataaagtcagctcaaggaa

SEQ ID NO: 625450 - DNA, 20 bp, mouse
gcaaggaaaggcagtcaaac

SEQ ID NO: 625451 - DNA, 20 bp, mouse
gtctttctgaaaaccctcca

SEQ ID NO: 625452 - DNA, 20 bp, mouse
ggggtatttcagagccacca

SEQ ID NO: 625453 - DNA, 20 bp, mouse
gggtaaccacacgttgttag

SEQ ID NO: 625454 - DNA, 20 bp, mouse
gggcatagaagttctaaaca

SEQ ID NO: 625455 - DNA, 20 bp, mouse
gcatgtgtggggcgtctgtg

SEQ ID NO: 625456 - DNA, 20 bp, mouse
gtccgggttggtaaaagggg

SEQ ID NO: 625457 - DNA, 20 bp, mouse
ggcgtccgcgaacaaaatgg

SEQ ID NO: 625458 - DNA, 20 bp, mouse
gtgttcgcggacgctgggga

SEQ ID NO: 625459 - DNA, 20 bp, mouse
gtgggagcggatccatttcc

SEQ ID NO: 625460 - DNA, 20 bp, mouse
gtcgcggacgctggggacgg

SEQ ID NO: 625461 - DNA, 20 bp, mouse
gacgctggggacggtgggag

SEQ ID NO: 625462 - DNA, 20 bp, mouse
gggtccgcaggtcacctcag

SEQ ID NO: 625463 - DNA, 20 bp, mouse
gatttccgggttggtaaaag

SEQ ID NO: 625464 - DNA, 20 bp, mouse
gaccaggactgaggtgacgg

SEQ ID NO: 625465 - DNA, 20 bp, mouse
ggggttggtaaaaggggcgg

SEQ ID NO: 625466 - DNA, 20 bp, mouse
gcgcctcgaggatcccggct

SEQ ID NO: 625467 - DNA, 20 bp, mouse
gagcccagccgggatcctcg

SEQ ID NO: 625468 - DNA, 20 bp, mouse
gggcgcgcagaagcaacgcc

SEQ ID NO: 625469 - DNA, 20 bp, mouse
gcgggatcctcgaggcgacg

SEQ ID NO: 625470 - DNA, 20 bp, mouse
gctcgaggcgacggggacga

SEQ ID NO: 625471 - DNA, 20 bp, mouse
gctgtcctgggaggtcacca

SEQ ID NO: 625472 - DNA, 20 bp, mouse
ggcccggctgggagcgagcg

SEQ ID NO: 625473 - DNA, 20 bp, mouse
gaggtcaccagggagccctg

SEQ ID NO: 625474 - DNA, 20 bp, mouse
gggacagtcccgaggtagag

SEQ ID NO: 625475 - DNA, 20 bp, mouse
gaagcgctgccgggacgcgg

SEQ ID NO: 625476 - DNA, 20 bp, mouse
gcggcttcggcctccatcgg

SEQ ID NO: 625477 - DNA, 20 bp, mouse
gctcagagctgcggcttctc

SEQ ID NO: 625478 - DNA, 20 bp, mouse
ggcctccactcggcccggag

SEQ ID NO: 625479 - DNA, 20 bp, mouse
gcggcccggaggggcatctg

SEQ ID NO: 625480 - DNA, 20 bp, mouse
gcgggtcgagcccccgatgg

SEQ ID NO: 625481 - DNA, 20 bp, mouse
gtctcgggtcgagcccccga

SEQ ID NO: 625482 - DNA, 20 bp, mouse
gctgcggcttcggcctccat

SEQ ID NO: 625483 - DNA, 20 bp, mouse
ggacgcggcaagccggccca

SEQ ID NO: 625484 - DNA, 20 bp, mouse
gctgcgcgccgatggtacct

SEQ ID NO: 625485 - DNA, 20 bp, mouse
ggcaagccggcccacggagc

SEQ ID NO: 625486 - DNA, 20 bp, mouse
ggtccccgcgcagcgagagg

SEQ ID NO: 625487 - DNA, 20 bp, mouse
gcaagagtggggacgggatg

SEQ ID NO: 625488 - DNA, 20 bp, mouse
gtcaggatcgacgtccggtc

SEQ ID NO: 625489 - DNA, 20 bp, mouse
gctggagcataaacaagagt

SEQ ID NO: 625490 - DNA, 20 bp, mouse
gcataaacaagagtggggac

SEQ ID NO: 625491 - DNA, 20 bp, mouse
gttggtccccgcgcagcgag

SEQ ID NO: 625492 - DNA, 20 bp, mouse
ggcaagcgcgcagcccgtcc

SEQ ID NO: 625493 - DNA, 20 bp, mouse
ggcgggagcacgctacactc

SEQ ID NO: 625494 - DNA, 20 bp, mouse
gtgaacctggcgagccagag

SEQ ID NO: 625495 - DNA, 20 bp, mouse
ggcgctcgcagccatgaacc

SEQ ID NO: 625496 - DNA, 20 bp, mouse
ggtcagcgtcacaggagcta

SEQ ID NO: 625497 - DNA, 20 bp, mouse
gggatgcggatgcctctcca

SEQ ID NO: 625498 - DNA, 20 bp, mouse
gagaggcatccgcatcctct

SEQ ID NO: 625499 - DNA, 20 bp, mouse
gtgaggcccgagggactggg

SEQ ID NO: 625500 - DNA, 20 bp, mouse
gccacggctgccagcgtcca

SEQ ID NO: 625501 - DNA, 20 bp, mouse
gtccctcgggcctcagaacc

SEQ ID NO: 625502 - DNA, 20 bp, mouse
gggctctccgctgctctgat

SEQ ID NO: 625503 - DNA, 20 bp, mouse
ggcctggaagtcagcgtcac

SEQ ID NO: 625504 - DNA, 20 bp, mouse
gagatcacagggccagtcca

SEQ ID NO: 625505 - DNA, 20 bp, mouse
gtgatgggccagcccagtcc

SEQ ID NO: 625506 - DNA, 20 bp, mouse
gtcagggctcaggacaccgt

SEQ ID NO: 625507 - DNA, 20 bp, mouse
ggctctgcagatctgaccca

SEQ ID NO: 625508 - DNA, 20 bp, mouse
gccggggtcctctggagatc

SEQ ID NO: 625509 - DNA, 20 bp, mouse
gaggcccctgtcccagcccg

SEQ ID NO: 625510 - DNA, 20 bp, mouse
gagcagctgcagcctcgcca

SEQ ID NO: 625511 - DNA, 20 bp, mouse
gctccagaggaccccgggct

SEQ ID NO: 625512 - DNA, 20 bp, mouse
gcagttacctgaggccgagg

SEQ ID NO: 625513 - DNA, 20 bp, mouse
gtgggacaggggccttggcg

SEQ ID NO: 625514 - DNA, 20 bp, mouse
gaggaccccgggctgggaca

SEQ ID NO: 625515 - DNA, 20 bp, mouse
ggccgaggaggccaccaaga

SEQ ID NO: 625516 - DNA, 20 bp, mouse
gactgggacagatcctcaga

SEQ ID NO: 625517 - DNA, 20 bp, mouse
gcagacggaaagtgcaaccc

SEQ ID NO: 625518 - DNA, 20 bp, mouse
gaaccacgtctccacctcct

SEQ ID NO: 625519 - DNA, 20 bp, mouse
gagcccaggaggtggagacg

SEQ ID NO: 625520 - DNA, 20 bp, mouse
gaagtccagtgaaatccgca

SEQ ID NO: 625521 - DNA, 20 bp, mouse
gagtgccctgcggatttcac

SEQ ID NO: 625522 - DNA, 20 bp, mouse
gtcctcccggcatcatgcgt

SEQ ID NO: 625523 - DNA, 20 bp, mouse
gagtgtgtacacctcaaagg

SEQ ID NO: 625524 - DNA, 20 bp, mouse
gacccatccgagagctgggg

SEQ ID NO: 625525 - DNA, 20 bp, mouse
gggacttctagaagctcctt

SEQ ID NO: 625526 - DNA, 20 bp, mouse
gactcggcactgggcggtgg

SEQ ID NO: 625527 - DNA, 20 bp, mouse
ggcgtgcgccggagccaaga

SEQ ID NO: 625528 - DNA, 20 bp, mouse
gtttgtcactcggcactggg

SEQ ID NO: 625529 - DNA, 20 bp, mouse
gcagtgccgagtgacaaaag

SEQ ID NO: 625530 - DNA, 20 bp, mouse
gaaagcggagagcaaggcgg

SEQ ID NO: 625531 - DNA, 20 bp, mouse
ggtcactcggcactgggcgg

SEQ ID NO: 625532 - DNA, 20 bp, mouse
ggcggtggaggcggccatct

SEQ ID NO: 625533 - DNA, 20 bp, mouse
gccgcctcaggcgagagcag

SEQ ID NO: 625534 - DNA, 20 bp, mouse
ggaagcctgggacctccagg

SEQ ID NO: 625535 - DNA, 20 bp, mouse
gctggcgagggcgcccccgt

SEQ ID NO: 625536 - DNA, 20 bp, mouse
ggtggcaccggcaccaagag

SEQ ID NO: 625537 - DNA, 20 bp, mouse
gagaggggcagcagctgtag

SEQ ID NO: 625538 - DNA, 20 bp, mouse
ggacaatgtcccccgagctg

SEQ ID NO: 625539 - DNA, 20 bp, mouse
ggctgcggaggccgtggcac

SEQ ID NO: 625540 - DNA, 20 bp, mouse
gcgacggccctatgaagtag

SEQ ID NO: 625541 - DNA, 20 bp, mouse
gggaactcccctacttcata

SEQ ID NO: 625542 - DNA, 20 bp, mouse
gggccgggcgggaccccctg

SEQ ID NO: 625543 - DNA, 20 bp, mouse
gctgggtcgagcctcaccgg

SEQ ID NO: 625544 - DNA, 20 bp, mouse
ggcaggggtcgcagaggtag

SEQ ID NO: 625545 - DNA, 20 bp, mouse
ggggaggcctgggcccggtc

SEQ ID NO: 625546 - DNA, 20 bp, mouse
gtgcctgggcgaagccgctt

SEQ ID NO: 625547 - DNA, 20 bp, mouse
gggcatctggggagcccaag

SEQ ID NO: 625548 - DNA, 20 bp, mouse
gtctcagctctgggcatctg

SEQ ID NO: 625549 - DNA, 20 bp, mouse
ggtgcgttagcagaggaggt

SEQ ID NO: 625550 - DNA, 20 bp, mouse
gaagggtgcgttagcagagg

SEQ ID NO: 625551 - DNA, 20 bp, mouse
gagcccaagcggcttcgccc

SEQ ID NO: 625552 - DNA, 20 bp, mouse
gaggaggtgggacagaccgc

SEQ ID NO: 625553 - DNA, 20 bp, mouse
gatgcccagagctgagactg

SEQ ID NO: 625554 - DNA, 20 bp, mouse
gggcgcccgcgcggatgcct

SEQ ID NO: 625555 - DNA, 20 bp, mouse
gttcaagggtgcgttagcag

SEQ ID NO: 625556 - DNA, 20 bp, mouse
gacatcggcgccatttaaag

SEQ ID NO: 625557 - DNA, 20 bp, mouse
ggccttctgtcagcgaagaa

SEQ ID NO: 625558 - DNA, 20 bp, mouse
ggtccaagcgggctgtgtgg

SEQ ID NO: 625559 - DNA, 20 bp, mouse
gagaaggagcgcgtccgccc

SEQ ID NO: 625560 - DNA, 20 bp, mouse
gtaaagcggagagttttccc

SEQ ID NO: 625561 - DNA, 20 bp, mouse
ggtgtggaggcttcagacat

SEQ ID NO: 625562 - DNA, 20 bp, mouse
gctcctggccagagaagtag

SEQ ID NO: 625563 - DNA, 20 bp, mouse
gccccggcgccggccagaga

SEQ ID NO: 625564 - DNA, 20 bp, mouse
gtgacagaaggcgcctagtg

SEQ ID NO: 625565 - DNA, 20 bp, mouse
gagcggagagttttcccggg

SEQ ID NO: 625566 - DNA, 20 bp, mouse
gcccgagggagcagcatcgt

SEQ ID NO: 625567 - DNA, 20 bp, mouse
gggagccggcaggagcacgc

SEQ ID NO: 625568 - DNA, 20 bp, mouse
gcagcatcgtaggagcagaa

SEQ ID NO: 625569 - DNA, 20 bp, mouse
gcgcgacgcggccccgagag

SEQ ID NO: 625570 - DNA, 20 bp, mouse
ggggagagctcgatactcac

SEQ ID NO: 625571 - DNA, 20 bp, mouse
ggatgctgctccctcgggcc

SEQ ID NO: 625572 - DNA, 20 bp, mouse
gggacccgggcgagcgagga

SEQ ID NO: 625573 - DNA, 20 bp, mouse
gcgctcccgcgtgctcctgc

SEQ ID NO: 625574 - DNA, 20 bp, mouse
gagctacagaagggctcggg

SEQ ID NO: 625575 - DNA, 20 bp, mouse
gccctcgggccgggccgctg

SEQ ID NO: 625576 - DNA, 20 bp, mouse
gacaatggccactgattctg

SEQ ID NO: 625577 - DNA, 20 bp, mouse
ggtgccaaccttagttacaa

SEQ ID NO: 625578 - DNA, 20 bp, mouse
ggtcagaggggcaacagccc

SEQ ID NO: 625579 - DNA, 20 bp, mouse
gtacaaatgtgctaagaggt

SEQ ID NO: 625580 - DNA, 20 bp, mouse
gcgggcagccctgttttcaa

SEQ ID NO: 625581 - DNA, 20 bp, mouse
gttcagtctacttacatctc

SEQ ID NO: 625582 - DNA, 20 bp, mouse
gttcaggaacctgccactag

SEQ ID NO: 625583 - DNA, 20 bp, mouse
gctcgcttctacagtcagag

SEQ ID NO: 625584 - DNA, 20 bp, mouse
gggaaaacatcgaaagaaag

SEQ ID NO: 625585 - DNA, 20 bp, mouse
gctgttgcaacttcccctag

SEQ ID NO: 625586 - DNA, 20 bp, mouse
gagggccaggcgccgcagaa

SEQ ID NO: 625587 - DNA, 20 bp, mouse
gcccagccggtctgcctgtc

SEQ ID NO: 625588 - DNA, 20 bp, mouse
gcgaggtgctagcatgggaa

SEQ ID NO: 625589 - DNA, 20 bp, mouse
ggcagcaacctccagcctcc

SEQ ID NO: 625590 - DNA, 20 bp, mouse
gcgcggggcaggccagtcgg

SEQ ID NO: 625591 - DNA, 20 bp, mouse
gctcctggctttccgttctg

SEQ ID NO: 625592 - DNA, 20 bp, mouse
gtatttcgaggtgctagcat

SEQ ID NO: 625593 - DNA, 20 bp, mouse
gtgctagcatgggaagggcc

SEQ ID NO: 625594 - DNA, 20 bp, mouse
gtgggtacaccgcgctccag

SEQ ID NO: 625595 - DNA, 20 bp, mouse
ggctctaaagaaccccccga

SEQ ID NO: 625596 - DNA, 20 bp, mouse
gtgagtggcgagcgaagctg

SEQ ID NO: 625597 - DNA, 20 bp, mouse
gggcggcactaaaagcacca

SEQ ID NO: 625598 - DNA, 20 bp, mouse
gacggtgggactggacacag

SEQ ID NO: 625599 - DNA, 20 bp, mouse
gcgctgactgcagtgagaag

SEQ ID NO: 625600 - DNA, 20 bp, mouse
gcaccagggcgcactggtca

SEQ ID NO: 625601 - DNA, 20 bp, mouse
gtaaaagcaccagggcgcac

SEQ ID NO: 625602 - DNA, 20 bp, mouse
gggactggacacagcggtga

SEQ ID NO: 625603 - DNA, 20 bp, mouse
ggagaagaggctgcccctcc

SEQ ID NO: 625604 - DNA, 20 bp, mouse
gctggctctaataagtctgg

SEQ ID NO: 625605 - DNA, 20 bp, mouse
gggcagtgatgcgagttccc

SEQ ID NO: 625606 - DNA, 20 bp, mouse
gcagtgggactggcgaacca

SEQ ID NO: 625607 - DNA, 20 bp, mouse
gagggtcgccggcgcatgat

SEQ ID NO: 625608 - DNA, 20 bp, mouse
ggccggcgcatgatcggcag

SEQ ID NO: 625609 - DNA, 20 bp, mouse
ggcgcatgatcggcaggggt

SEQ ID NO: 625610 - DNA, 20 bp, mouse
ggctcacagcccagtgggac

SEQ ID NO: 625611 - DNA, 20 bp, mouse
gactggcgaaccagggtcgc

SEQ ID NO: 625612 - DNA, 20 bp, mouse
ggggtcctagctctccaaga

SEQ ID NO: 625613 - DNA, 20 bp, mouse
ggccgtgacaggccaggagt

SEQ ID NO: 625614 - DNA, 20 bp, mouse
gtccaagagggcggagcatg

SEQ ID NO: 625615 - DNA, 20 bp, mouse
gcgacacacagctcctactc

SEQ ID NO: 625616 - DNA, 20 bp, mouse
gctggtgcgcacaggctcgt

SEQ ID NO: 625617 - DNA, 20 bp, mouse
gcgggagccaagccacacag

SEQ ID NO: 625618 - DNA, 20 bp, mouse
gacgaccttagggttactga

SEQ ID NO: 625619 - DNA, 20 bp, mouse
ggagaccgtcagtaacccta

SEQ ID NO: 625620 - DNA, 20 bp, mouse
ggagagtgcggtgaccccaa

SEQ ID NO: 625621 - DNA, 20 bp, mouse
gacccgcgacgaagcaccgg

SEQ ID NO: 625622 - DNA, 20 bp, mouse
gctacagcctcgggagaccc

SEQ ID NO: 625623 - DNA, 20 bp, mouse
gagagtgccctggtgcgcac

SEQ ID NO: 625624 - DNA, 20 bp, mouse
ggcccgccgggaggaaggga

SEQ ID NO: 625625 - DNA, 20 bp, mouse
gggccgcccgccgggaggaa

SEQ ID NO: 625626 - DNA, 20 bp, mouse
gagagagctccggagatccg

SEQ ID NO: 625627 - DNA, 20 bp, mouse
gccgggcgaggagagagctc

SEQ ID NO: 625628 - DNA, 20 bp, mouse
gtcgggcgcggacgccaagg

SEQ ID NO: 625629 - DNA, 20 bp, mouse
ggcctgcgcccgcggatctc

SEQ ID NO: 625630 - DNA, 20 bp, mouse
gcgccgggagagcgtcccaa

SEQ ID NO: 625631 - DNA, 20 bp, mouse
gaactcgggcgcggacgcca

SEQ ID NO: 625632 - DNA, 20 bp, mouse
gcctcgcccggcacgatctg

SEQ ID NO: 625633 - DNA, 20 bp, mouse
gcgggcgccgcagatcgtgc

SEQ ID NO: 625634 - DNA, 20 bp, mouse
gccgcactcgcaactcctgg

SEQ ID NO: 625635 - DNA, 20 bp, mouse
ggaaatgctgcggaggagag

SEQ ID NO: 625636 - DNA, 20 bp, mouse
gcaggcggcggagttcggtg

SEQ ID NO: 625637 - DNA, 20 bp, mouse
ggcaatcacggagaacaggg

SEQ ID NO: 625638 - DNA, 20 bp, mouse
ggcgcgcccggcgctcccgg

SEQ ID NO: 625639 - DNA, 20 bp, mouse
gaacagcagcggtggcctgc

SEQ ID NO: 625640 - DNA, 20 bp, mouse
ggcatcaagtggctgtaagt

SEQ ID NO: 625641 - DNA, 20 bp, mouse
ggcagagcctcgcagacctg

SEQ ID NO: 625642 - DNA, 20 bp, mouse
ggaagtcgccgagctaagaa

SEQ ID NO: 625643 - DNA, 20 bp, mouse
gcctgcaatcacggagaaca

SEQ ID NO: 625644 - DNA, 20 bp, mouse
gcgggcgcgcgcgacgatga

SEQ ID NO: 625645 - DNA, 20 bp, mouse
gcgtgtgctatggcatcaag

SEQ ID NO: 625646 - DNA, 20 bp, mouse
gctctgcgccagaggacctt

SEQ ID NO: 625647 - DNA, 20 bp, mouse
gttctcaccttggaaagtga

SEQ ID NO: 625648 - DNA, 20 bp, mouse
gtcccctaggcaagataagg

SEQ ID NO: 625649 - DNA, 20 bp, mouse
gaaagtagcctaaggtcctc

SEQ ID NO: 625650 - DNA, 20 bp, mouse
ggaggatgagctggagatgc

SEQ ID NO: 625651 - DNA, 20 bp, mouse
ggagcttccctcactttcca

SEQ ID NO: 625652 - DNA, 20 bp, mouse
gggctctgtggaggcatata

SEQ ID NO: 625653 - DNA, 20 bp, mouse
gtctgtggaggcatataggg

SEQ ID NO: 625654 - DNA, 20 bp, mouse
gtgctcccctgcggaaccca

SEQ ID NO: 625655 - DNA, 20 bp, mouse
ggcgtgggccatggacagag

SEQ ID NO: 625656 - DNA, 20 bp, mouse
gctccgggagcgcctcgtca

SEQ ID NO: 625657 - DNA, 20 bp, mouse
gtcaggtcagactccgtgtg

SEQ ID NO: 625658 - DNA, 20 bp, mouse
gcacgcatggcgcccgcaca

SEQ ID NO: 625659 - DNA, 20 bp, mouse
gcgggactgggaatcagcca

SEQ ID NO: 625660 - DNA, 20 bp, mouse
gtggtcgtagagaccctccc

SEQ ID NO: 625661 - DNA, 20 bp, mouse
ggagccagattccaccgaga

SEQ ID NO: 625662 - DNA, 20 bp, mouse
gagggtctctacgaccagta

SEQ ID NO: 625663 - DNA, 20 bp, mouse
gggcgccggcagccgtgacg

SEQ ID NO: 625664 - DNA, 20 bp, mouse
gcatgaagagctgacctcag

SEQ ID NO: 625665 - DNA, 20 bp, mouse
gcttctgctccgggcacgca

SEQ ID NO: 625666 - DNA, 20 bp, mouse
ggcacccgaccgcccacacc

SEQ ID NO: 625667 - DNA, 20 bp, mouse
gagcccgggagccagacgca

SEQ ID NO: 625668 - DNA, 20 bp, mouse
gcggtcgggtgcggtgtcag

SEQ ID NO: 625669 - DNA, 20 bp, mouse
ggggttcccaagagcgtgca

SEQ ID NO: 625670 - DNA, 20 bp, mouse
gcccaagagcgtgcagggcc

SEQ ID NO: 625671 - DNA, 20 bp, mouse
gcagcaggcaggcaagaccc

SEQ ID NO: 625672 - DNA, 20 bp, mouse
ggagccgggtgtgggcggtc

SEQ ID NO: 625673 - DNA, 20 bp, mouse
gagcccgcagggccgtggac

SEQ ID NO: 625674 - DNA, 20 bp, mouse
gtgcggtgtcagtggctccg

SEQ ID NO: 625675 - DNA, 20 bp, mouse
gccgtggacgggcactgtct

SEQ ID NO: 625676 - DNA, 20 bp, mouse
ggagcgacgcccccaatagt

SEQ ID NO: 625677 - DNA, 20 bp, mouse
gtgccggcgatcatgaagag

SEQ ID NO: 625678 - DNA, 20 bp, mouse
ggtagcagcccgagcaggtg

SEQ ID NO: 625679 - DNA, 20 bp, mouse
gtccattagaagcagcgccg

SEQ ID NO: 625680 - DNA, 20 bp, mouse
gattagaagcagcgccgagg

SEQ ID NO: 625681 - DNA, 20 bp, mouse
gactttgttccaactattgg

SEQ ID NO: 625682 - DNA, 20 bp, mouse
gcgccggcaaacttcctcct

SEQ ID NO: 625683 - DNA, 20 bp, mouse
gggccgcacccggggacggt

SEQ ID NO: 625684 - DNA, 20 bp, mouse
ggggtgcggccgagagatcg

SEQ ID NO: 625685 - DNA, 20 bp, mouse
gtactcggcctcctgctcag

SEQ ID NO: 625686 - DNA, 20 bp, mouse
ggcagccgcgccacctccca

SEQ ID NO: 625687 - DNA, 20 bp, mouse
gctggcccggccctgggagg

SEQ ID NO: 625688 - DNA, 20 bp, mouse
gagtggcgctgggccctctg

SEQ ID NO: 625689 - DNA, 20 bp, mouse
gtagggcaaccgcccccctg

SEQ ID NO: 625690 - DNA, 20 bp, mouse
gcccgagagcgcggacgcct

SEQ ID NO: 625691 - DNA, 20 bp, mouse
gccggccctgggaggtggcg

SEQ ID NO: 625692 - DNA, 20 bp, mouse
gggagtccaccccgagagcg

SEQ ID NO: 625693 - DNA, 20 bp, mouse
gggcttgagcgcgcagcggg

SEQ ID NO: 625694 - DNA, 20 bp, mouse
gcagccagtgcgcggagcaa

SEQ ID NO: 625695 - DNA, 20 bp, mouse
gcaggctgcagagcactaag

SEQ ID NO: 625696 - DNA, 20 bp, mouse
gggcgcggccggctgctcgg

SEQ ID NO: 625697 - DNA, 20 bp, mouse
gctcgcggcggccgagaaca

SEQ ID NO: 625698 - DNA, 20 bp, mouse
gccgcatcccggctctgggg

SEQ ID NO: 625699 - DNA, 20 bp, mouse
gagtcgggtccgccgggcag

SEQ ID NO: 625700 - DNA, 20 bp, mouse
ggctgacagtcgggtccgcc

SEQ ID NO: 625701 - DNA, 20 bp, mouse
gagggaagaccggacagtgg

SEQ ID NO: 625702 - DNA, 20 bp, mouse
gctggggcggcgctgacagt

SEQ ID NO: 625703 - DNA, 20 bp, mouse
gccgccgcatcccggctctg

SEQ ID NO: 625704 - DNA, 20 bp, mouse
gggaccgcaggcacgaacgg

SEQ ID NO: 625705 - DNA, 20 bp, mouse
gcagagggaagaccggacag

SEQ ID NO: 625706 - DNA, 20 bp, mouse
gcagcaagcgcagggccgag

SEQ ID NO: 625707 - DNA, 20 bp, mouse
gggagccgcgggtccgacga

SEQ ID NO: 625708 - DNA, 20 bp, mouse
gcgggcgagcagcaagcgca

SEQ ID NO: 625709 - DNA, 20 bp, mouse
gccgagcggggacacagtgc

SEQ ID NO: 625710 - DNA, 20 bp, mouse
gcgcgcaggcgactgttccg

SEQ ID NO: 625711 - DNA, 20 bp, mouse
ggtcgcctgcgcgccctcgt

SEQ ID NO: 625712 - DNA, 20 bp, mouse
ggacacagtgcaggagccgc

SEQ ID NO: 625713 - DNA, 20 bp, mouse
gcgcgccctcgtcggacccg

SEQ ID NO: 625714 - DNA, 20 bp, mouse
gtgggcgcagcgacccggag

SEQ ID NO: 625715 - DNA, 20 bp, mouse
ggtcgccacccgagcgaagg

SEQ ID NO: 625716 - DNA, 20 bp, mouse
gaaagttgcagaaccaaaca

SEQ ID NO: 625717 - DNA, 20 bp, mouse
ggaaggagatggcaatgcag

SEQ ID NO: 625718 - DNA, 20 bp, mouse
gagggcgcagagctccgcgg

SEQ ID NO: 625719 - DNA, 20 bp, mouse
gagagggagggcgaaagtga

SEQ ID NO: 625720 - DNA, 20 bp, mouse
gacggctggagaggcaaagg

SEQ ID NO: 625721 - DNA, 20 bp, mouse
gcggaggccgcggaaggaga

SEQ ID NO: 625722 - DNA, 20 bp, mouse
ggaaccaaacacggctggag

SEQ ID NO: 625723 - DNA, 20 bp, mouse
ggcacaatccggactccgga

SEQ ID NO: 625724 - DNA, 20 bp, mouse
gtccagactcctctttccct

SEQ ID NO: 625725 - DNA, 20 bp, mouse
gcggccgcgaccgaggaggt

SEQ ID NO: 625726 - DNA, 20 bp, mouse
gcaacggtgccgctaagtcg

SEQ ID NO: 625727 - DNA, 20 bp, mouse
gctcgagccgtggccgccaa

SEQ ID NO: 625728 - DNA, 20 bp, mouse
ggcgggaccccgagaagttt

SEQ ID NO: 625729 - DNA, 20 bp, mouse
gtcggggccgaaacttctcg

SEQ ID NO: 625730 - DNA, 20 bp, mouse
gagtttcggccccgacttag

SEQ ID NO: 625731 - DNA, 20 bp, mouse
gctagcggcgcctgaaggga

SEQ ID NO: 625732 - DNA, 20 bp, mouse
gcggcgcctgaagggacggt

SEQ ID NO: 625733 - DNA, 20 bp, mouse
ggccccgcactcctcatccg

SEQ ID NO: 625734 - DNA, 20 bp, mouse
gcgcccagcgcccatcaggg

SEQ ID NO: 625735 - DNA, 20 bp, mouse
gcggcgctgcactcgagccg

SEQ ID NO: 625736 - DNA, 20 bp, mouse
gcgagctccgcaggagacac

SEQ ID NO: 625737 - DNA, 20 bp, mouse
gcgcctccccggccagactg

SEQ ID NO: 625738 - DNA, 20 bp, mouse
gcggcgggggggcccatccc

SEQ ID NO: 625739 - DNA, 20 bp, mouse
gggcccatcccgggcgagga

SEQ ID NO: 625740 - DNA, 20 bp, mouse
gccagcgcctgtgtctcctg

SEQ ID NO: 625741 - DNA, 20 bp, mouse
ggcagcagtccgaggcggga

SEQ ID NO: 625742 - DNA, 20 bp, mouse
gggcggcggcccggagacta

SEQ ID NO: 625743 - DNA, 20 bp, mouse
gcagcagcagcagtccgagg

SEQ ID NO: 625744 - DNA, 20 bp, mouse
ggagactagggctccggcgg

SEQ ID NO: 625745 - DNA, 20 bp, mouse
ggtccgaggcgggagggcac

SEQ ID NO: 625746 - DNA, 20 bp, mouse
ggcgggagccgcggagccag

SEQ ID NO: 625747 - DNA, 20 bp, mouse
ggggagaacaagcgcaacaa

SEQ ID NO: 625748 - DNA, 20 bp, mouse
ggcccaacttagctcaggag

SEQ ID NO: 625749 - DNA, 20 bp, mouse
gccgtgagcggacaacccag

SEQ ID NO: 625750 - DNA, 20 bp, mouse
gaccagcggggactatgacc

SEQ ID NO: 625751 - DNA, 20 bp, mouse
gcgctgcgcgccagcgatcg

SEQ ID NO: 625752 - DNA, 20 bp, mouse
ggtcggtccgcgctaggcac

SEQ ID NO: 625753 - DNA, 20 bp, mouse
gggaggtgcaggaaccctga

SEQ ID NO: 625754 - DNA, 20 bp, mouse
gccggaggtagactatgccc

SEQ ID NO: 625755 - DNA, 20 bp, mouse
gtggagactgtcccagagcg

SEQ ID NO: 625756 - DNA, 20 bp, mouse
gcggggccgcgagtcacctg

SEQ ID NO: 625757 - DNA, 20 bp, mouse
gcgcctccccaggtgactcg

SEQ ID NO: 625758 - DNA, 20 bp, mouse
gctggggaggcggacaagtg

SEQ ID NO: 625759 - DNA, 20 bp, mouse
gaggcgagcgcgccccaggt

SEQ ID NO: 625760 - DNA, 20 bp, mouse
gagcccagcggagtgaccgt

SEQ ID NO: 625761 - DNA, 20 bp, mouse
gcggacaagtgcggacacat

SEQ ID NO: 625762 - DNA, 20 bp, mouse
gaggcggatcctcctacctg

SEQ ID NO: 625763 - DNA, 20 bp, mouse
gaggcgcgcacggccccagg

SEQ ID NO: 625764 - DNA, 20 bp, mouse
ggagcaggcgagcgcgcccc

SEQ ID NO: 625765 - DNA, 20 bp, mouse
gcgagcgcgccccaggtagg

SEQ ID NO: 625766 - DNA, 20 bp, mouse
ggaggaccagacagccacta

SEQ ID NO: 625767 - DNA, 20 bp, mouse
gggcagtaagcgctccttag

SEQ ID NO: 625768 - DNA, 20 bp, mouse
ggcgctggggctggagttcg

SEQ ID NO: 625769 - DNA, 20 bp, mouse
gaccggttcgcaccgacaga

SEQ ID NO: 625770 - DNA, 20 bp, mouse
gttcggggcaggggcccgga

SEQ ID NO: 625771 - DNA, 20 bp, mouse
gagggctcctgcgccaactg

SEQ ID NO: 625772 - DNA, 20 bp, mouse
gtggtcctctgtccgtctgt

SEQ ID NO: 625773 - DNA, 20 bp, mouse
gccagagtgagcgacagaac

SEQ ID NO: 625774 - DNA, 20 bp, mouse
ggcgacaggaggagcatggt

SEQ ID NO: 625775 - DNA, 20 bp, mouse
ggccagggctcggggaccgg

SEQ ID NO: 625776 - DNA, 20 bp, mouse
gccatggtcctgcccagtcc

SEQ ID NO: 625777 - DNA, 20 bp, mouse
ggaccaagcgcagagaagta

SEQ ID NO: 625778 - DNA, 20 bp, mouse
gtggtcctggttcccggact

SEQ ID NO: 625779 - DNA, 20 bp, mouse
gtaccaggcagaagcaccca

SEQ ID NO: 625780 - DNA, 20 bp, mouse
gggctggagagtgacttacc

SEQ ID NO: 625781 - DNA, 20 bp, mouse
gcacttgttaatgctgtggg

SEQ ID NO: 625782 - DNA, 20 bp, mouse
gtgataacccgtcccaaggt

SEQ ID NO: 625783 - DNA, 20 bp, mouse
gagcattaacaagtgtccca

SEQ ID NO: 625784 - DNA, 20 bp, mouse
ggttctatcagagactccag

SEQ ID NO: 625785 - DNA, 20 bp, mouse
gcctttcttggtatttatgt

SEQ ID NO: 625786 - DNA, 20 bp, mouse
gtgggaagcattctcctcgg

SEQ ID NO: 625787 - DNA, 20 bp, mouse
gattctcctcggaggcagag

SEQ ID NO: 625788 - DNA, 20 bp, mouse
gggcagaggggtggctacct

SEQ ID NO: 625789 - DNA, 20 bp, mouse
gtgggatcgcttacacacca

SEQ ID NO: 625790 - DNA, 20 bp, mouse
gagatgggaagcattctcct

SEQ ID NO: 625791 - DNA, 20 bp, mouse
ggatcccaaacagtgttaag

SEQ ID NO: 625792 - DNA, 20 bp, mouse
gcccaaacagtgttaagggg

SEQ ID NO: 625793 - DNA, 20 bp, mouse
ggaggccagccgcacactta

SEQ ID NO: 625794 - DNA, 20 bp, mouse
gtggctggagagatgcgcca

SEQ ID NO: 625795 - DNA, 20 bp, mouse
gtgtgctggagaaatcaagg

SEQ ID NO: 625796 - DNA, 20 bp, mouse
ggcgcggcaagatgctggat

SEQ ID NO: 625797 - DNA, 20 bp, mouse
ggccagccagcgcgccagaa

SEQ ID NO: 625798 - DNA, 20 bp, mouse
gggctgcggacgctataaga

SEQ ID NO: 625799 - DNA, 20 bp, mouse
gtgcggacgctataagaggg

SEQ ID NO: 625800 - DNA, 20 bp, mouse
gagcgtcagcccgaaggccg

SEQ ID NO: 625801 - DNA, 20 bp, mouse
gacctggcgagtgctacccc

SEQ ID NO: 625802 - DNA, 20 bp, mouse
gtataagagggcggcggtcg

SEQ ID NO: 625803 - DNA, 20 bp, mouse
ggcgggcacctacccgaagt

SEQ ID NO: 625804 - DNA, 20 bp, mouse
gggaacaccgcggcctaagg

SEQ ID NO: 625805 - DNA, 20 bp, mouse
gggacgctataagagggcgg

SEQ ID NO: 625806 - DNA, 20 bp, mouse
gaggagatgcgagagtgcac

SEQ ID NO: 625807 - DNA, 20 bp, mouse
gagcggcaggcagcaccagc

SEQ ID NO: 625808 - DNA, 20 bp, mouse
ggtctgagcacagagagcga

SEQ ID NO: 625809 - DNA, 20 bp, mouse
gaccggcactgacccgaagt

SEQ ID NO: 625810 - DNA, 20 bp, mouse
gcggcgctacgagcgcctag

SEQ ID NO: 625811 - DNA, 20 bp, mouse
gagcgcaagggacctagact

SEQ ID NO: 625812 - DNA, 20 bp, mouse
ggaggaaccgggaagcgcaa

SEQ ID NO: 625813 - DNA, 20 bp, mouse
gtcgcagggacccgagccgg

SEQ ID NO: 625814 - DNA, 20 bp, mouse
gactgacccgaagtaggcgg

SEQ ID NO: 625815 - DNA, 20 bp, mouse
ggccgcccggcagaggaacc

SEQ ID NO: 625816 - DNA, 20 bp, mouse
ggaacctaaagcaatcacca

SEQ ID NO: 625817 - DNA, 20 bp, mouse
gccgcgagagcaagaagccc

SEQ ID NO: 625818 - DNA, 20 bp, mouse
gtgtagagtaagcccccgga

SEQ ID NO: 625819 - DNA, 20 bp, mouse
ggtccaaagccaagcgccta

SEQ ID NO: 625820 - DNA, 20 bp, mouse
gggcggcgcctagcgaccct

SEQ ID NO: 625821 - DNA, 20 bp, mouse
ggaccctaggcgcttggctt

SEQ ID NO: 625822 - DNA, 20 bp, mouse
ggtaagcccccggaaggcag

SEQ ID NO: 625823 - DNA, 20 bp, mouse
gcccgacctctgccttccgg

SEQ ID NO: 625824 - DNA, 20 bp, mouse
gtacagaatgaagacgtcgg

SEQ ID NO: 625825 - DNA, 20 bp, mouse
gccaagcgcctagggtcgct

SEQ ID NO: 625826 - DNA, 20 bp, mouse
ggcagcggccggaagtacag

SEQ ID NO: 625827 - DNA, 20 bp, mouse
ggcggttgcgggaggtactt

SEQ ID NO: 625828 - DNA, 20 bp, mouse
ggccgtggccatgaacttct

SEQ ID NO: 625829 - DNA, 20 bp, mouse
gctgggcggaacctaagtgt

SEQ ID NO: 625830 - DNA, 20 bp, mouse
gccgcaaccgccccaggcag

SEQ ID NO: 625831 - DNA, 20 bp, mouse
ggactcaggctggacttagg

SEQ ID NO: 625832 - DNA, 20 bp, mouse
gctgctctgcaggttctccc

SEQ ID NO: 625833 - DNA, 20 bp, mouse
gaatgactccgagaagttca

SEQ ID NO: 625834 - DNA, 20 bp, mouse
ggcggccggaagtacagggg

SEQ ID NO: 625835 - DNA, 20 bp, mouse
gtccccggacggcaagtacc

SEQ ID NO: 625836 - DNA, 20 bp, mouse
ggaagctcggaggcacctgg

SEQ ID NO: 625837 - DNA, 20 bp, mouse
gcaccatggcgctgtcgtag

SEQ ID NO: 625838 - DNA, 20 bp, mouse
gcgcggaggcgcggtcacca

SEQ ID NO: 625839 - DNA, 20 bp, mouse
gcacgcccagcggtccgtct

SEQ ID NO: 625840 - DNA, 20 bp, mouse
gcaggcgtaggcgagcgcgg

SEQ ID NO: 625841 - DNA, 20 bp, mouse
gggctgcagtgcgcaggcgt

SEQ ID NO: 625842 - DNA, 20 bp, mouse
gcaccgctacgacagcgcca

SEQ ID NO: 625843 - DNA, 20 bp, mouse
gttacaaacgaggacaggga

SEQ ID NO: 625844 - DNA, 20 bp, mouse
gagcatgagcgcgtccgaga

SEQ ID NO: 625845 - DNA, 20 bp, mouse
gtcccacggacagaacagaa

SEQ ID NO: 625846 - DNA, 20 bp, mouse
gagtgcaccgaggcgcccgt

SEQ ID NO: 625847 - DNA, 20 bp, mouse
gaggacccaggcatcgagag

SEQ ID NO: 625848 - DNA, 20 bp, mouse
gccagaccagaagtgcaccg

SEQ ID NO: 625849 - DNA, 20 bp, mouse
gccccaagagaaagcctcgt

SEQ ID NO: 625850 - DNA, 20 bp, mouse
gtagcccagggtacgcaaag

SEQ ID NO: 625851 - DNA, 20 bp, mouse
gccagcaggatgatttatgg

SEQ ID NO: 625852 - DNA, 20 bp, mouse
gagcccactgacgggaccag

SEQ ID NO: 625853 - DNA, 20 bp, mouse
ggaggtaactgagtccgggg

SEQ ID NO: 625854 - DNA, 20 bp, mouse
gccactgacgggaccagagg

SEQ ID NO: 625855 - DNA, 20 bp, mouse
ggatgcgtagatatagccca

SEQ ID NO: 625856 - DNA, 20 bp, mouse
gtagggagcaggacacgcac

SEQ ID NO: 625857 - DNA, 20 bp, mouse
gacacgcacgggccgaggga

SEQ ID NO: 625858 - DNA, 20 bp, mouse
ggccgcacgggcgccaggga

SEQ ID NO: 625859 - DNA, 20 bp, mouse
gcgcgggagctcaggacgtg

SEQ ID NO: 625860 - DNA, 20 bp, mouse
gcgggcatcggcgttctcag

SEQ ID NO: 625861 - DNA, 20 bp, mouse
ggccgagggcgagttgacgc

SEQ ID NO: 625862 - DNA, 20 bp, mouse
gtccggcccgctcacctcca

SEQ ID NO: 625863 - DNA, 20 bp, mouse
gcgcgcggcaccgggcctag

SEQ ID NO: 625864 - DNA, 20 bp, mouse
gcaggacacgcacgggccga

SEQ ID NO: 625865 - DNA, 20 bp, mouse
ggtgcaactgcgacaggaag

SEQ ID NO: 625866 - DNA, 20 bp, mouse
gtggcggcggaagcattggc

SEQ ID NO: 625867 - DNA, 20 bp, mouse
gcggacgcgacaacagagaa

SEQ ID NO: 625868 - DNA, 20 bp, mouse
gcagagaagggactcagcgg

SEQ ID NO: 625869 - DNA, 20 bp, mouse
gcttgtctcagtgtctggtt

SEQ ID NO: 625870 - DNA, 20 bp, mouse
gctgtgagtggaaggcgcgc

SEQ ID NO: 625871 - DNA, 20 bp, mouse
gggaaagctggccatctatg

SEQ ID NO: 625872 - DNA, 20 bp, mouse
gagacactgagacaagatgg

SEQ ID NO: 625873 - DNA, 20 bp, mouse
gtgattccgggaactcgatt

SEQ ID NO: 625874 - DNA, 20 bp, mouse
gtcagtgtctggtttggcgg

SEQ ID NO: 625875 - DNA, 20 bp, mouse
gactgagacaagatggcggg

SEQ ID NO: 625876 - DNA, 20 bp, mouse
gagctgatggcctctgcggg

SEQ ID NO: 625877 - DNA, 20 bp, mouse
gtggcctctgcgggcggcag

SEQ ID NO: 625878 - DNA, 20 bp, mouse
gcagtgggctcgctcaggga

SEQ ID NO: 625879 - DNA, 20 bp, mouse
gcccgccggccgccatgtga

SEQ ID NO: 625880 - DNA, 20 bp, mouse
gtaggtcccgacaccctagt

SEQ ID NO: 625881 - DNA, 20 bp, mouse
gtgggctcgctcagggacgg

SEQ ID NO: 625882 - DNA, 20 bp, mouse
gctgtggacctcacccacta

SEQ ID NO: 625883 - DNA, 20 bp, mouse
gcggcggccggtccccgcgg

SEQ ID NO: 625884 - DNA, 20 bp, mouse
gtgagcgagcccactggact

SEQ ID NO: 625885 - DNA, 20 bp, mouse
gctgccccggggtgacacgt

SEQ ID NO: 625886 - DNA, 20 bp, mouse
gacaggtgaccgccagactg

SEQ ID NO: 625887 - DNA, 20 bp, mouse
ggacagcagcttccccagtc

SEQ ID NO: 625888 - DNA, 20 bp, mouse
ggctgtctgcccaagaccga

SEQ ID NO: 625889 - DNA, 20 bp, mouse
gatgatctctccttccccag

SEQ ID NO: 625890 - DNA, 20 bp, mouse
gagatcatacttcagaacac

SEQ ID NO: 625891 - DNA, 20 bp, mouse
gtcctctctccctcggtctt

SEQ ID NO: 625892 - DNA, 20 bp, mouse
ggggcctcctacgttcccca

SEQ ID NO: 625893 - DNA, 20 bp, mouse
gagtctggacacagggaacc

SEQ ID NO: 625894 - DNA, 20 bp, mouse
ggggtctgtagagagtgtgt

SEQ ID NO: 625895 - DNA, 20 bp, mouse
gtttctaccatggggaacgt

SEQ ID NO: 625896 - DNA, 20 bp, mouse
ggggcgcggagtacagcgag

SEQ ID NO: 625897 - DNA, 20 bp, mouse
gcgcggagtacagcgagtgg

SEQ ID NO: 625898 - DNA, 20 bp, mouse
gccagccaggaccctagcac

SEQ ID NO: 625899 - DNA, 20 bp, mouse
gcgcgtcgcgcagctccccg

SEQ ID NO: 625900 - DNA, 20 bp, mouse
ggcgcagctccccgaggctg

SEQ ID NO: 625901 - DNA, 20 bp, mouse
gggaaggcgggtgccccaat

SEQ ID NO: 625902 - DNA, 20 bp, mouse
gcggctcgcagcccgtgcta

SEQ ID NO: 625903 - DNA, 20 bp, mouse
gcccggggcgggggtagatc

SEQ ID NO: 625904 - DNA, 20 bp, mouse
gcgagtgagcatgtgcagac

SEQ ID NO: 625905 - DNA, 20 bp, mouse
gcagcgatcacagccgattg

SEQ ID NO: 625906 - DNA, 20 bp, mouse
gggcgaaatgcaccgagacg

SEQ ID NO: 625907 - DNA, 20 bp, mouse
gccgagacggggtgaagggc

SEQ ID NO: 625908 - DNA, 20 bp, mouse
gtgcaccgagacggggtgaa

SEQ ID NO: 625909 - DNA, 20 bp, mouse
gccagcagggccgggagtac

SEQ ID NO: 625910 - DNA, 20 bp, mouse
gcccgcaccacgctcaagcc

SEQ ID NO: 625911 - DNA, 20 bp, mouse
gcgccgcaggcctgggatcc

SEQ ID NO: 625912 - DNA, 20 bp, mouse
gtttcgccgcagcccaggag

SEQ ID NO: 625913 - DNA, 20 bp, mouse
gagagtggtgcgcggagcca

SEQ ID NO: 625914 - DNA, 20 bp, mouse
gccggcgcctggcttgagcg

SEQ ID NO: 625915 - DNA, 20 bp, mouse
ggcctggcttgagcgtggtg

SEQ ID NO: 625916 - DNA, 20 bp, mouse
gaaggcagcgcccacacccg

SEQ ID NO: 625917 - DNA, 20 bp, mouse
gtgcggagagccccgggtgt

SEQ ID NO: 625918 - DNA, 20 bp, mouse
gcaggcaggcggtcgggttg

SEQ ID NO: 625919 - DNA, 20 bp, mouse
gggggagcaggcaggcggtc

SEQ ID NO: 625920 - DNA, 20 bp, mouse
gctgcgacaggaggaagtcc

SEQ ID NO: 625921 - DNA, 20 bp, mouse
gcacccacccacccagagag

SEQ ID NO: 625922 - DNA, 20 bp, mouse
gatccgcaggatcgcaggag

SEQ ID NO: 625923 - DNA, 20 bp, mouse
ggtcgggttgcggagagccc

SEQ ID NO: 625924 - DNA, 20 bp, mouse
gggagcgtgtgctgagacgc

SEQ ID NO: 625925 - DNA, 20 bp, mouse
gcatccgagccgcacctcat

SEQ ID NO: 625926 - DNA, 20 bp, mouse
gaaggttctcgccagcgctg

SEQ ID NO: 625927 - DNA, 20 bp, mouse
gcgggcgccgccagtcacac

SEQ ID NO: 625928 - DNA, 20 bp, mouse
gctgcgagacccgcaaataa

SEQ ID NO: 625929 - DNA, 20 bp, mouse
ggggtctcgcagccacaaaa

SEQ ID NO: 625930 - DNA, 20 bp, mouse
gaagcggccggagagaaggg

SEQ ID NO: 625931 - DNA, 20 bp, mouse
gagcggtgcaaggatcccca

SEQ ID NO: 625932 - DNA, 20 bp, mouse
gtggccagtcagccccgaga

SEQ ID NO: 625933 - DNA, 20 bp, mouse
gccgccagtcacacaggccg

SEQ ID NO: 625934 - DNA, 20 bp, mouse
gaatgcactccgggccggaa

SEQ ID NO: 625935 - DNA, 20 bp, mouse
gccgggccggaagggcgacc

SEQ ID NO: 625936 - DNA, 20 bp, mouse
gctctcgcgcggggccgtgg

SEQ ID NO: 625937 - DNA, 20 bp, mouse
gggtcgcggtcgctcggcgt

SEQ ID NO: 625938 - DNA, 20 bp, mouse
gccgagggccgtggacgagg

SEQ ID NO: 625939 - DNA, 20 bp, mouse
gacggccccgcgcgagagtg

SEQ ID NO: 625940 - DNA, 20 bp, mouse
gtgcgggccggcggacgatg

SEQ ID NO: 625941 - DNA, 20 bp, mouse
ggcctcgcgggctcggacgg

SEQ ID NO: 625942 - DNA, 20 bp, mouse
gcgggccgccgaggcaaggg

SEQ ID NO: 625943 - DNA, 20 bp, mouse
ggccgaccgccggctcccca

SEQ ID NO: 625944 - DNA, 20 bp, mouse
ggccatgcagcgctcgcgga

SEQ ID NO: 625945 - DNA, 20 bp, mouse
gcagcccgccccgggacccc

SEQ ID NO: 625946 - DNA, 20 bp, mouse
gccgccggagccacacctgg

SEQ ID NO: 625947 - DNA, 20 bp, mouse
gccggagccacacctggcgg

SEQ ID NO: 625948 - DNA, 20 bp, mouse
gtggcggaggcagaagtctc

SEQ ID NO: 625949 - DNA, 20 bp, mouse
gcgcagggccgcatggacag

SEQ ID NO: 625950 - DNA, 20 bp, mouse
ggctccgcctcccgtttccg

SEQ ID NO: 625951 - DNA, 20 bp, mouse
ggcgctgccccggaaacggg

SEQ ID NO: 625952 - DNA, 20 bp, mouse
gcagccgccacggggctcag

SEQ ID NO: 625953 - DNA, 20 bp, mouse
gcacatggcagcgtgagagg

SEQ ID NO: 625954 - DNA, 20 bp, mouse
ggcgcacatggcagcgtgag

SEQ ID NO: 625955 - DNA, 20 bp, mouse
gagtggcgcccacggatcgg

SEQ ID NO: 625956 - DNA, 20 bp, mouse
ggacatggtggactgatctc

SEQ ID NO: 625957 - DNA, 20 bp, mouse
gctgagagcagggatccccg

SEQ ID NO: 625958 - DNA, 20 bp, mouse
gggtggactgatctccggca

SEQ ID NO: 625959 - DNA, 20 bp, mouse
gtgttccgacgcagacatgg

SEQ ID NO: 625960 - DNA, 20 bp, mouse
gaggaggccagggactacga

SEQ ID NO: 625961 - DNA, 20 bp, mouse
gggcagcggcggcaaggagg

SEQ ID NO: 625962 - DNA, 20 bp, mouse
ggcccgctcccggccctcct

SEQ ID NO: 625963 - DNA, 20 bp, mouse
ggtctgttccgacgcagaca

SEQ ID NO: 625964 - DNA, 20 bp, mouse
gctacgcgcggggaagcctc

SEQ ID NO: 625965 - DNA, 20 bp, mouse
gggcagctgccgctaccccg

SEQ ID NO: 625966 - DNA, 20 bp, mouse
gtctcctcagcaactcactc

SEQ ID NO: 625967 - DNA, 20 bp, mouse
gaagccagagtgagttgctg

SEQ ID NO: 625968 - DNA, 20 bp, mouse
ggcgccgcgcgcgtccggga

SEQ ID NO: 625969 - DNA, 20 bp, mouse
gcaagtaagcggccttggag

SEQ ID NO: 625970 - DNA, 20 bp, mouse
gtgcagtgccacctagtgag

SEQ ID NO: 625971 - DNA, 20 bp, mouse
ggtccaggcctcgcaggaca

SEQ ID NO: 625972 - DNA, 20 bp, mouse
gtgcgcaggcgcgagcggtc

SEQ ID NO: 625973 - DNA, 20 bp, mouse
gtatgcgggcctggacgaca

SEQ ID NO: 625974 - DNA, 20 bp, mouse
gctttagaggagtaagacct

SEQ ID NO: 625975 - DNA, 20 bp, mouse
gcctccagatcaggtcccca

SEQ ID NO: 625976 - DNA, 20 bp, mouse
gttggcgtgcgggatccgag

SEQ ID NO: 625977 - DNA, 20 bp, mouse
ggccatctcgcagcaggcgt

SEQ ID NO: 625978 - DNA, 20 bp, mouse
gctcgcagcaggcgtcggcc

SEQ ID NO: 625979 - DNA, 20 bp, mouse
ggggatccgggtgaaagtca

SEQ ID NO: 625980 - DNA, 20 bp, mouse
ggggcccgcagccaccgcgg

SEQ ID NO: 625981 - DNA, 20 bp, mouse
gggatccgagtggctgcggg

SEQ ID NO: 625982 - DNA, 20 bp, mouse
ggctgcgagatggcgatctt

SEQ ID NO: 625983 - DNA, 20 bp, mouse
ggctcgctgcgcatgctcga

SEQ ID NO: 625984 - DNA, 20 bp, mouse
ggagatggcgatcttgggcg

SEQ ID NO: 625985 - DNA, 20 bp, mouse
gtggcgatcttgggcgcgga

SEQ ID NO: 625986 - DNA, 20 bp, mouse
gcctgccgcggccacaccag

SEQ ID NO: 625987 - DNA, 20 bp, mouse
gctggaaggcggaagtggag

SEQ ID NO: 625988 - DNA, 20 bp, mouse
ggagttaggcgccgctggtg

SEQ ID NO: 625989 - DNA, 20 bp, mouse
gcctccgaggagggatgtcc

SEQ ID NO: 625990 - DNA, 20 bp, mouse
gcgtgacccggcccgagtgc

SEQ ID NO: 625991 - DNA, 20 bp, mouse
ggtggcgcgggggcactggg

SEQ ID NO: 625992 - DNA, 20 bp, mouse
ggagccgggacatccctcct

SEQ ID NO: 625993 - DNA, 20 bp, mouse
gccgcgccacctacctgccg

SEQ ID NO: 625994 - DNA, 20 bp, mouse
gcccgagtgcgggcgctgga

SEQ ID NO: 625995 - DNA, 20 bp, mouse
ggagcggagttaggcgccgc

SEQ ID NO: 625996 - DNA, 20 bp, mouse
gtgggacagtccgggagccg

SEQ ID NO: 625997 - DNA, 20 bp, mouse
ggcgctcccactgcgcgagg

SEQ ID NO: 625998 - DNA, 20 bp, mouse
gtagacgagcgcagccgccg

SEQ ID NO: 625999 - DNA, 20 bp, mouse
gcggcccgcctctttcctaa

SEQ ID NO: 626000 - DNA, 20 bp, mouse
gaccccaggcgtcccgactg

SEQ ID NO: 626001 - DNA, 20 bp, mouse
gtaagagccggacgccacag

SEQ ID NO: 626002 - DNA, 20 bp, mouse
gggagctacctggggactcg

SEQ ID NO: 626003 - DNA, 20 bp, mouse
gccgcctctttcctaagggt

SEQ ID NO: 626004 - DNA, 20 bp, mouse
gccggttccggggatgtaag

SEQ ID NO: 626005 - DNA, 20 bp, mouse
gaggcagccgcgggaggaag

SEQ ID NO: 626006 - DNA, 20 bp, mouse
gcgagccatgagggtacgta

SEQ ID NO: 626007 - DNA, 20 bp, mouse
ggcgagttccgcgttccgag

SEQ ID NO: 626008 - DNA, 20 bp, mouse
gggtccggccgctcggaacg

SEQ ID NO: 626009 - DNA, 20 bp, mouse
ggacgagagtcgcgctctag

SEQ ID NO: 626010 - DNA, 20 bp, mouse
gcgtctgtacctggagagcc

SEQ ID NO: 626011 - DNA, 20 bp, mouse
gggtggagggtgattcgcta

SEQ ID NO: 626012 - DNA, 20 bp, mouse
gtaagtctgcagcgaggtgg

SEQ ID NO: 626013 - DNA, 20 bp, mouse
gctcctcactcgagccatga

SEQ ID NO: 626014 - DNA, 20 bp, mouse
gcgcgactctcgtctgtacc

SEQ ID NO: 626015 - DNA, 20 bp, mouse
gttgtaagtctgcagcgagg

SEQ ID NO: 626016 - DNA, 20 bp, mouse
gactgcaggaagcttgacca

SEQ ID NO: 626017 - DNA, 20 bp, mouse
gacttggaagtcagcctcca

SEQ ID NO: 626018 - DNA, 20 bp, mouse
gcagggctggccagacagag

SEQ ID NO: 626019 - DNA, 20 bp, mouse
gcttccaagtgtgcaggaac

SEQ ID NO: 626020 - DNA, 20 bp, mouse
gaccagagggcaagccgaag

SEQ ID NO: 626021 - DNA, 20 bp, mouse
gggtcctctcacagatgggt

SEQ ID NO: 626022 - DNA, 20 bp, mouse
ggagcttagatccgtagcag

SEQ ID NO: 626023 - DNA, 20 bp, mouse
ggatccgtagcaggggtggg

SEQ ID NO: 626024 - DNA, 20 bp, mouse
gaccctggaacatctctcaa

SEQ ID NO: 626025 - DNA, 20 bp, mouse
gcggaggacaggaataaccc

SEQ ID NO: 626026 - DNA, 20 bp, mouse
ggcggaccgggtaccatgag

SEQ ID NO: 626027 - DNA, 20 bp, mouse
ggcgccgagcgcggccacgg

SEQ ID NO: 626028 - DNA, 20 bp, mouse
ggcggcaggaggccacgggg

SEQ ID NO: 626029 - DNA, 20 bp, mouse
ggataagagtagcactttgg

SEQ ID NO: 626030 - DNA, 20 bp, mouse
gcgtttcctggctatggtgg

SEQ ID NO: 626031 - DNA, 20 bp, mouse
gggcgcggcaggaggccacg

SEQ ID NO: 626032 - DNA, 20 bp, mouse
gagcgcccggccgccggagg

SEQ ID NO: 626033 - DNA, 20 bp, mouse
gagacgtttcctggctatgg

SEQ ID NO: 626034 - DNA, 20 bp, mouse
gcccggaggagaaagcgctg

SEQ ID NO: 626035 - DNA, 20 bp, mouse
ggacaccgcaggctcgcaag

SEQ ID NO: 626036 - DNA, 20 bp, mouse
ggtcaggaggagaagtctca

SEQ ID NO: 626037 - DNA, 20 bp, mouse
gggtgaggcagcagactccc

SEQ ID NO: 626038 - DNA, 20 bp, mouse
ggcagactcccaggaaagtc

SEQ ID NO: 626039 - DNA, 20 bp, mouse
ggtctgctgcctcaccccat

SEQ ID NO: 626040 - DNA, 20 bp, mouse
ggggctgtgcaagaagaatg

SEQ ID NO: 626041 - DNA, 20 bp, mouse
gcttaccttccacaacccat

SEQ ID NO: 626042 - DNA, 20 bp, mouse
gctcatggctgaggtcttgc

SEQ ID NO: 626043 - DNA, 20 bp, mouse
gtcaccccatgggttgtgga

SEQ ID NO: 626044 - DNA, 20 bp, mouse
gcatatgctaggtttgactt

SEQ ID NO: 626045 - DNA, 20 bp, mouse
gagaggtgggctcatatgct

SEQ ID NO: 626046 - DNA, 20 bp, mouse
gctacgtgaaactctagcac

SEQ ID NO: 626047 - DNA, 20 bp, mouse
gctgacatggactcagagtc

SEQ ID NO: 626048 - DNA, 20 bp, mouse
gcagacttgaaaccctgaca

SEQ ID NO: 626049 - DNA, 20 bp, mouse
gtctaaaagtacaaatcctt

SEQ ID NO: 626050 - DNA, 20 bp, mouse
gtagaacctttatcaagcat

SEQ ID NO: 626051 - DNA, 20 bp, mouse
gataaaccttaagagttccg

SEQ ID NO: 626052 - DNA, 20 bp, mouse
gttgggaaagctcagataaa

SEQ ID NO: 626053 - DNA, 20 bp, mouse
gttggcccatgagataattt

SEQ ID NO: 626054 - DNA, 20 bp, mouse
gaactgttctattcaaggaa

SEQ ID NO: 626055 - DNA, 20 bp, mouse
ggcaagcctcggaactctta

SEQ ID NO: 626056 - DNA, 20 bp, mouse
ggtcacgatgacgaggacaa

SEQ ID NO: 626057 - DNA, 20 bp, mouse
gaggacaacggtagatgagt

SEQ ID NO: 626058 - DNA, 20 bp, mouse
gtccggccgtcacgatgacg

SEQ ID NO: 626059 - DNA, 20 bp, mouse
gcgcagcagctcggggactc

SEQ ID NO: 626060 - DNA, 20 bp, mouse
gtgaatggcaaaaaggtaag

SEQ ID NO: 626061 - DNA, 20 bp, mouse
gtctatgctagaggacacac

SEQ ID NO: 626062 - DNA, 20 bp, mouse
gagcacctcgcagcagctcg

SEQ ID NO: 626063 - DNA, 20 bp, mouse
gtttagagcaagatgaacac

SEQ ID NO: 626064 - DNA, 20 bp, mouse
gacacaggcaagacgctcag

SEQ ID NO: 626065 - DNA, 20 bp, mouse
ggacacactggctcagaggt

SEQ ID NO: 626066 - DNA, 20 bp, mouse
ggcttccaggggcaatcccg

SEQ ID NO: 626067 - DNA, 20 bp, mouse
gatcccggggagcctggata

SEQ ID NO: 626068 - DNA, 20 bp, mouse
gccctacccacggcttccag

SEQ ID NO: 626069 - DNA, 20 bp, mouse
gagagctagcccaggcggaa

SEQ ID NO: 626070 - DNA, 20 bp, mouse
gccgcggggaatgctggact

SEQ ID NO: 626071 - DNA, 20 bp, mouse
ggccgctcggccagagaggt

SEQ ID NO: 626072 - DNA, 20 bp, mouse
gtagcccaggcggaagggag

SEQ ID NO: 626073 - DNA, 20 bp, mouse
ggcggccttcccgcccaact

SEQ ID NO: 626074 - DNA, 20 bp, mouse
gtaggcagagctagcccagg

SEQ ID NO: 626075 - DNA, 20 bp, mouse
gaagccagcccccctaccca

SEQ ID NO: 626076 - DNA, 20 bp, mouse
ggaacggagacctagagcca

SEQ ID NO: 626077 - DNA, 20 bp, mouse
gggcagagcgacagacccca

SEQ ID NO: 626078 - DNA, 20 bp, mouse
ggtgtcaggagggagtctag

SEQ ID NO: 626079 - DNA, 20 bp, mouse
gataaaggcagctgcctggt

SEQ ID NO: 626080 - DNA, 20 bp, mouse
gggagggagtctagcggtag

SEQ ID NO: 626081 - DNA, 20 bp, mouse
gaggggagggtactcaccaa

SEQ ID NO: 626082 - DNA, 20 bp, mouse
gcccacgctgcaaggtccag

SEQ ID NO: 626083 - DNA, 20 bp, mouse
gagtctagcggtagcgggga

SEQ ID NO: 626084 - DNA, 20 bp, mouse
gtagcggggaaggtgtggag

SEQ ID NO: 626085 - DNA, 20 bp, mouse
gagggtactcaccaagggtc

SEQ ID NO: 626086 - DNA, 20 bp, mouse
gctctgctggttgctttcag

SEQ ID NO: 626087 - DNA, 20 bp, mouse
gctccaccgaagagtctatg

SEQ ID NO: 626088 - DNA, 20 bp, mouse
ggcttgcctcatagactctt

SEQ ID NO: 626089 - DNA, 20 bp, mouse
gtgctgtgtgtcaaacaggg

SEQ ID NO: 626090 - DNA, 20 bp, mouse
gttataaccttggcacacac

SEQ ID NO: 626091 - DNA, 20 bp, mouse
ggtctatgaggcaagcaggc

SEQ ID NO: 626092 - DNA, 20 bp, mouse
gccttctggctgtaaattgt

SEQ ID NO: 626093 - DNA, 20 bp, mouse
gacggagctagggtcaattc

SEQ ID NO: 626094 - DNA, 20 bp, mouse
gaatccatagagcatttcta

SEQ ID NO: 626095 - DNA, 20 bp, mouse
gggagagagattaacacatg

SEQ ID NO: 626096 - DNA, 20 bp, mouse
ggcgctgccacccggcctgg

SEQ ID NO: 626097 - DNA, 20 bp, mouse
ggggcccgcgagccctcagc

SEQ ID NO: 626098 - DNA, 20 bp, mouse
ggccgcggtgcgagtccctg

SEQ ID NO: 626099 - DNA, 20 bp, mouse
gtcggccacgaacaggaaca

SEQ ID NO: 626100 - DNA, 20 bp, mouse
gaggagcgtgaactgcacca

SEQ ID NO: 626101 - DNA, 20 bp, mouse
gaccagggcgcagggcatca

SEQ ID NO: 626102 - DNA, 20 bp, mouse
gggtgcgagtccctgaggca

SEQ ID NO: 626103 - DNA, 20 bp, mouse
gggggcaaccgaaacagcgg

SEQ ID NO: 626104 - DNA, 20 bp, mouse
ggaggtcgcggtggacgaag

SEQ ID NO: 626105 - DNA, 20 bp, mouse
gcccggcgcgcgctgccacc

SEQ ID NO: 626106 - DNA, 20 bp, mouse
gggtccgaggagctccgcgg

SEQ ID NO: 626107 - DNA, 20 bp, mouse
gcggccgccgcggagctcct

SEQ ID NO: 626108 - DNA, 20 bp, mouse
gagaggaatgtgcaggtccg

SEQ ID NO: 626109 - DNA, 20 bp, mouse
gccagggcgaggcgaggagg

SEQ ID NO: 626110 - DNA, 20 bp, mouse
gggccgctaagtcagacggg

SEQ ID NO: 626111 - DNA, 20 bp, mouse
gggctcgtgctgcagccgcg

SEQ ID NO: 626112 - DNA, 20 bp, mouse
gggcgagcgggcgctggagt

SEQ ID NO: 626113 - DNA, 20 bp, mouse
gcatggccgctaagtcagac

SEQ ID NO: 626114 - DNA, 20 bp, mouse
gggccatgatgcctcggcag

SEQ ID NO: 626115 - DNA, 20 bp, mouse
gctcggcgcaggcagccagg

SEQ ID NO: 626116 - DNA, 20 bp, mouse
gttggagtagggtattggag

SEQ ID NO: 626117 - DNA, 20 bp, mouse
gtggaggggtgagcactcgc

SEQ ID NO: 626118 - DNA, 20 bp, mouse
ggtgctctgcaggctaggac

SEQ ID NO: 626119 - DNA, 20 bp, mouse
gcatggtgaggggatcacac

SEQ ID NO: 626120 - DNA, 20 bp, mouse
gagctcagaagatgcacgcg

SEQ ID NO: 626121 - DNA, 20 bp, mouse
gcggtcccgggcaggggaag

SEQ ID NO: 626122 - DNA, 20 bp, mouse
ggccggaagcctccccaacc

SEQ ID NO: 626123 - DNA, 20 bp, mouse
gcgcacactgggttggagta

SEQ ID NO: 626124 - DNA, 20 bp, mouse
gagcaaagcgcgcgtgagtg

SEQ ID NO: 626125 - DNA, 20 bp, mouse
gtggaggggtgggatcccaa

SEQ ID NO: 626126 - DNA, 20 bp, mouse
gagctgcgacgcagaggaag

SEQ ID NO: 626127 - DNA, 20 bp, mouse
ggctgagagctgcgacgcag

SEQ ID NO: 626128 - DNA, 20 bp, mouse
gccaaagtgttccctggagg

SEQ ID NO: 626129 - DNA, 20 bp, mouse
gcagccgggagggtgttagg

SEQ ID NO: 626130 - DNA, 20 bp, mouse
gcgagcgcaggcaggcggag

SEQ ID NO: 626131 - DNA, 20 bp, mouse
ggacggtccaaagtgttccc

SEQ ID NO: 626132 - DNA, 20 bp, mouse
gggtccaaagtgttccctgg

SEQ ID NO: 626133 - DNA, 20 bp, mouse
ggaggcagtgccagacgttt

SEQ ID NO: 626134 - DNA, 20 bp, mouse
gcatcttggccggtagggta

SEQ ID NO: 626135 - DNA, 20 bp, mouse
gcagctgaggcacaggaggg

SEQ ID NO: 626136 - DNA, 20 bp, mouse
ggccgcgaagtcggatggag

SEQ ID NO: 626137 - DNA, 20 bp, mouse
ggaggccgccagccacaggt

SEQ ID NO: 626138 - DNA, 20 bp, mouse
gggccggcgggagcagatcg

SEQ ID NO: 626139 - DNA, 20 bp, mouse
ggcgaagtcggatggagcgg

SEQ ID NO: 626140 - DNA, 20 bp, mouse
gagcagggtgaggccgaagt

SEQ ID NO: 626141 - DNA, 20 bp, mouse
gatgttggcggagcaggagg

SEQ ID NO: 626142 - DNA, 20 bp, mouse
ggcagctgcacgaccagtga

SEQ ID NO: 626143 - DNA, 20 bp, mouse
gacatggccgcgaagtcgga

SEQ ID NO: 626144 - DNA, 20 bp, mouse
ggacttcgcggccatgttgg

SEQ ID NO: 626145 - DNA, 20 bp, mouse
ggtaggaggccgccagccac

SEQ ID NO: 626146 - DNA, 20 bp, mouse
gcatggtggtgcacggacag

SEQ ID NO: 626147 - DNA, 20 bp, mouse
gcacgtctaaggccacatgg

SEQ ID NO: 626148 - DNA, 20 bp, mouse
gcgctagtccggcaggaagg

SEQ ID NO: 626149 - DNA, 20 bp, mouse
gccaagcaaccacacaaccg

SEQ ID NO: 626150 - DNA, 20 bp, mouse
ggggcaggtccgcggttgtg

SEQ ID NO: 626151 - DNA, 20 bp, mouse
gccctcccgccccgctagtc

SEQ ID NO: 626152 - DNA, 20 bp, mouse
gcagcgcggcccacagataa

SEQ ID NO: 626153 - DNA, 20 bp, mouse
gaggcctacgaccacgtcta

SEQ ID NO: 626154 - DNA, 20 bp, mouse
gtcctgccggactagcgggg

SEQ ID NO: 626155 - DNA, 20 bp, mouse
gaaggccacatggtggtgca

SEQ ID NO: 626156 - DNA, 20 bp, mouse
ggccagctagccatacagct

SEQ ID NO: 626157 - DNA, 20 bp, mouse
ggaaaaacgatcgtgtacta

SEQ ID NO: 626158 - DNA, 20 bp, mouse
gcttcactgtctaactcttt

SEQ ID NO: 626159 - DNA, 20 bp, mouse
gagtggcacacgtgactaac

SEQ ID NO: 626160 - DNA, 20 bp, mouse
gagagacattgagttaaaga

SEQ ID NO: 626161 - DNA, 20 bp, mouse
gttaactcaatgtctcttct

SEQ ID NO: 626162 - DNA, 20 bp, mouse
gttggaacagtgatcaactg

SEQ ID NO: 626163 - DNA, 20 bp, mouse
gaaaatgtggcttctactca

SEQ ID NO: 626164 - DNA, 20 bp, mouse
gaaatattcagagagttgtg

SEQ ID NO: 626165 - DNA, 20 bp, mouse
ggggcaaagattatatattt

SEQ ID NO: 626166 - DNA, 20 bp, mouse
gtgcgagcaggctagctaat

SEQ ID NO: 626167 - DNA, 20 bp, mouse
gcccccgaggctcctttcag

SEQ ID NO: 626168 - DNA, 20 bp, mouse
gtgtctcaggacctgtaggg

SEQ ID NO: 626169 - DNA, 20 bp, mouse
ggcacaacctagcagcacat

SEQ ID NO: 626170 - DNA, 20 bp, mouse
gtgctgtctcaggacctgta

SEQ ID NO: 626171 - DNA, 20 bp, mouse
ggggagtagccactttgagg

SEQ ID NO: 626172 - DNA, 20 bp, mouse
gagcctgctcgcaggctcag

SEQ ID NO: 626173 - DNA, 20 bp, mouse
gagaagagggagcgcagcct

SEQ ID NO: 626174 - DNA, 20 bp, mouse
gatccatccaatgtgctgct

SEQ ID NO: 626175 - DNA, 20 bp, mouse
gacacggatgagaatcccta

SEQ ID NO: 626176 - DNA, 20 bp, mouse
gggggcggacgtgctacttc

SEQ ID NO: 626177 - DNA, 20 bp, mouse
ggagaccctgaaagtctttc

SEQ ID NO: 626178 - DNA, 20 bp, mouse
ggagaggaggtgaccctcac

SEQ ID NO: 626179 - DNA, 20 bp, mouse
gctacttcaggagtaaggag

SEQ ID NO: 626180 - DNA, 20 bp, mouse
gtgaggaagcgaagttcttg

SEQ ID NO: 626181 - DNA, 20 bp, mouse
gtctccacagaggcctaggt

SEQ ID NO: 626182 - DNA, 20 bp, mouse
gcaaagcatactgggtaaca

SEQ ID NO: 626183 - DNA, 20 bp, mouse
gacagtccagagtcccgtga

SEQ ID NO: 626184 - DNA, 20 bp, mouse
gttcttgaggtatcatggta

SEQ ID NO: 626185 - DNA, 20 bp, mouse
gcttcaggagtaaggagagg

SEQ ID NO: 626186 - DNA, 20 bp, mouse
gacgacgatgagaacaacaa

SEQ ID NO: 626187 - DNA, 20 bp, mouse
gggggggtgtggacgtccca

SEQ ID NO: 626188 - DNA, 20 bp, mouse
ggtgacgagttttgccgggg

SEQ ID NO: 626189 - DNA, 20 bp, mouse
gagtgggatgaacctctgtg

SEQ ID NO: 626190 - DNA, 20 bp, mouse
gggatgaacctctgtgtgga

SEQ ID NO: 626191 - DNA, 20 bp, mouse
ggggtgtggacgtcccacgg

SEQ ID NO: 626192 - DNA, 20 bp, mouse
gacgagttttgccggggggg

SEQ ID NO: 626193 - DNA, 20 bp, mouse
ggcagcctccttccacacag

SEQ ID NO: 626194 - DNA, 20 bp, mouse
gtgaacctctgtgtggaagg

SEQ ID NO: 626195 - DNA, 20 bp, mouse
gacccccggagtcccaccgt

SEQ ID NO: 626196 - DNA, 20 bp, mouse
ggggtggggacgttccacag

SEQ ID NO: 626197 - DNA, 20 bp, mouse
gcacagtgggactccgcggg

SEQ ID NO: 626198 - DNA, 20 bp, mouse
gttccacagtgggactccgc

SEQ ID NO: 626199 - DNA, 20 bp, mouse
gggtgcctcctaaccacccg

SEQ ID NO: 626200 - DNA, 20 bp, mouse
ggtggggtcacagaatatga

SEQ ID NO: 626201 - DNA, 20 bp, mouse
gtagttagtctgaagcggaa

SEQ ID NO: 626202 - DNA, 20 bp, mouse
gcgagttttgccggggggtg

SEQ ID NO: 626203 - DNA, 20 bp, mouse
gatgacgacgaggacaacaa

SEQ ID NO: 626204 - DNA, 20 bp, mouse
gtgaacctctgagtggaagg

SEQ ID NO: 626205 - DNA, 20 bp, mouse
ggcagcctccttccactcag

SEQ ID NO: 626206 - DNA, 20 bp, mouse
gaggcccgaccaagtgggag

SEQ ID NO: 626207 - DNA, 20 bp, mouse
gccgaccaagtgggagtgga

SEQ ID NO: 626208 - DNA, 20 bp, mouse
gttgcgggggggacgtccca

SEQ ID NO: 626209 - DNA, 20 bp, mouse
gtgggtgaagagttttgcgg

SEQ ID NO: 626210 - DNA, 20 bp, mouse
gtgagcaggatagtctgaag

SEQ ID NO: 626211 - DNA, 20 bp, mouse
ggttttgttagtttttgtgg

SEQ ID NO: 626212 - DNA, 20 bp, mouse
gcaggatagtctgaagcgga

SEQ ID NO: 626213 - DNA, 20 bp, mouse
gaccaagtgggagtggaagg

SEQ ID NO: 626214 - DNA, 20 bp, mouse
ggcctccttccactcccact

SEQ ID NO: 626215 - DNA, 20 bp, mouse
gaggtgggtgaagagttttg

SEQ ID NO: 626216 - DNA, 20 bp, mouse
gggactggacgagcccccaa

SEQ ID NO: 626217 - DNA, 20 bp, mouse
gctggacgagcccccaaggg

SEQ ID NO: 626218 - DNA, 20 bp, mouse
ggaaggaacgaaggaacaaa

SEQ ID NO: 626219 - DNA, 20 bp, mouse
gctttcccaaccacccttgg

SEQ ID NO: 626220 - DNA, 20 bp, mouse
gaacctgtgaagtgatgttc

SEQ ID NO: 626221 - DNA, 20 bp, mouse
gcaaagggacgctgtggtaa

SEQ ID NO: 626222 - DNA, 20 bp, mouse
gtggttgggaaaggacccga

SEQ ID NO: 626223 - DNA, 20 bp, mouse
gaacccgaacgaaggaacga

SEQ ID NO: 626224 - DNA, 20 bp, mouse
ggaagtactaacccgaacga

SEQ ID NO: 626225 - DNA, 20 bp, mouse
gagaggaaggtgacgcggaa

SEQ ID NO: 626226 - DNA, 20 bp, mouse
gactcttgaatgtgataccc

SEQ ID NO: 626227 - DNA, 20 bp, mouse
gagatactcagtgttaaccc

SEQ ID NO: 626228 - DNA, 20 bp, mouse
gcatatttgtaatttacaaa

SEQ ID NO: 626229 - DNA, 20 bp, mouse
gccttaaagtgaggaagagt

SEQ ID NO: 626230 - DNA, 20 bp, mouse
ggtggcacacaaattcttta

SEQ ID NO: 626231 - DNA, 20 bp, mouse
gtgattgagtatctgctata

SEQ ID NO: 626232 - DNA, 20 bp, mouse
gcttcagcaggagaaaataa

SEQ ID NO: 626233 - DNA, 20 bp, mouse
gccatcagagaattctgcag

SEQ ID NO: 626234 - DNA, 20 bp, mouse
gagaattctctgatggtcat

SEQ ID NO: 626235 - DNA, 20 bp, mouse
gaagtcacttcaaatacctt

SEQ ID NO: 626236 - DNA, 20 bp, mouse
gtcccgagggtggttgcgaa

SEQ ID NO: 626237 - DNA, 20 bp, mouse
gggactggacaagctcccga

SEQ ID NO: 626238 - DNA, 20 bp, mouse
gacccgaacgaaggaacgaa

SEQ ID NO: 626239 - DNA, 20 bp, mouse
gctggacaagctcccgaggg

SEQ ID NO: 626240 - DNA, 20 bp, mouse
gtcctttcgcaaccaccctc

SEQ ID NO: 626241 - DNA, 20 bp, mouse
gtggttgcgaaaggacccga

SEQ ID NO: 626242 - DNA, 20 bp, mouse
ggaaggaacgaagggacgaa

SEQ ID NO: 626243 - DNA, 20 bp, mouse
gatcaaagtgaggaggctaa

SEQ ID NO: 626244 - DNA, 20 bp, mouse
gagaggaaggtgacgcggaa

SEQ ID NO: 626245 - DNA, 20 bp, mouse
ggaagtactaacccgaacga

SEQ ID NO: 626246 - DNA, 20 bp, mouse
ggaaaggaggaggggatgga

SEQ ID NO: 626247 - DNA, 20 bp, mouse
ggcgacctggtatctatcat

SEQ ID NO: 626248 - DNA, 20 bp, mouse
gggggcctatgatagatacc

SEQ ID NO: 626249 - DNA, 20 bp, mouse
gcacgtccctttgaccctcc

SEQ ID NO: 626250 - DNA, 20 bp, mouse
gagtgctctgccatcactta

SEQ ID NO: 626251 - DNA, 20 bp, mouse
gggctttgtgggatcttcgg

SEQ ID NO: 626252 - DNA, 20 bp, mouse
gtgagcggccaggtatctcc

SEQ ID NO: 626253 - DNA, 20 bp, mouse
gccaggagaggcccaagggt

SEQ ID NO: 626254 - DNA, 20 bp, mouse
gcccactcaccctcgcgggt

SEQ ID NO: 626255 - DNA, 20 bp, mouse
ggagaggcccaagggtagga

SEQ ID NO: 626256 - DNA, 20 bp, mouse
ggcgacaaggtatctatcgt

SEQ ID NO: 626257 - DNA, 20 bp, mouse
gaatgctcctccatcactta

SEQ ID NO: 626258 - DNA, 20 bp, mouse
gctcctccatcacttaagga

SEQ ID NO: 626259 - DNA, 20 bp, mouse
ggtggggggaggattgtagg

SEQ ID NO: 626260 - DNA, 20 bp, mouse
gccctttgaccctccagaga

SEQ ID NO: 626261 - DNA, 20 bp, mouse
gggaatgtgtcagccttctc

SEQ ID NO: 626262 - DNA, 20 bp, mouse
gatgtgtcagccttctctgg

SEQ ID NO: 626263 - DNA, 20 bp, mouse
gacccttccttaagtgatgg

SEQ ID NO: 626264 - DNA, 20 bp, mouse
gggctttgtgggatcttcgg

SEQ ID NO: 626265 - DNA, 20 bp, mouse
gtgagcggccaggtatctcc

SEQ ID NO: 626266 - DNA, 20 bp, mouse
gtgtccgtacccactctgga

SEQ ID NO: 626267 - DNA, 20 bp, mouse
gacccgttaccctccagagt

SEQ ID NO: 626268 - DNA, 20 bp, mouse
ggcgacctggtatctatcat

SEQ ID NO: 626269 - DNA, 20 bp, mouse
gggggcctatgatagatacc

SEQ ID NO: 626270 - DNA, 20 bp, mouse
ggcaatgtccgtacccactc

SEQ ID NO: 626271 - DNA, 20 bp, mouse
gttgcatgttacttccggga

SEQ ID NO: 626272 - DNA, 20 bp, mouse
gtacccactctggagggtaa

SEQ ID NO: 626273 - DNA, 20 bp, mouse
gagtgctctgccatcactta

SEQ ID NO: 626274 - DNA, 20 bp, mouse
gcacgtccctttgaccctcc

SEQ ID NO: 626275 - DNA, 20 bp, mouse
gtggtttgggggattttagg

SEQ ID NO: 626276 - DNA, 20 bp, mouse
ggcgacaaggtatctatcgt

SEQ ID NO: 626277 - DNA, 20 bp, mouse
gaatgctcctccatcactta

SEQ ID NO: 626278 - DNA, 20 bp, mouse
gctcctccatcacttaagga

SEQ ID NO: 626279 - DNA, 20 bp, mouse
ggtggggggaggattgtagg

SEQ ID NO: 626280 - DNA, 20 bp, mouse
gccctttgaccctccagaga

SEQ ID NO: 626281 - DNA, 20 bp, mouse
gggaatgtgtcagccttctc

SEQ ID NO: 626282 - DNA, 20 bp, mouse
gatgtgtcagccttctctgg

SEQ ID NO: 626283 - DNA, 20 bp, mouse
gacccttccttaagtgatgg

SEQ ID NO: 626284 - DNA, 20 bp, mouse
gggctttgtgggatcttcgg

SEQ ID NO: 626285 - DNA, 20 bp, mouse
gtgagcggccaggtatctcc

SEQ ID NO: 626286 - DNA, 20 bp, mouse
ggagtagggccgggtacttg

SEQ ID NO: 626287 - DNA, 20 bp, mouse
gccggccctactccatcacc

SEQ ID NO: 626288 - DNA, 20 bp, mouse
gcatcgcctacacactccgt

SEQ ID NO: 626289 - DNA, 20 bp, mouse
gggaagggaacgcgtattgt

SEQ ID NO: 626290 - DNA, 20 bp, mouse
gcctacacactccgtaggaa

SEQ ID NO: 626291 - DNA, 20 bp, mouse
gccttgcctggtgatggagt

SEQ ID NO: 626292 - DNA, 20 bp, mouse
gaatacgcgttcccttccta

SEQ ID NO: 626293 - DNA, 20 bp, mouse
ggctgcgcggccctaccccg

SEQ ID NO: 626294 - DNA, 20 bp, mouse
gccgggcaaagggcacgaca

SEQ ID NO: 626295 - DNA, 20 bp, mouse
gatgcgcagtcgaggagtcc

SEQ ID NO: 626296 - DNA, 20 bp, mouse
ggcgggcacgcggagacctg

SEQ ID NO: 626297 - DNA, 20 bp, mouse
gtagtcccgaggaacgcctc

SEQ ID NO: 626298 - DNA, 20 bp, mouse
ggcgcaccgcagacggaagg

SEQ ID NO: 626299 - DNA, 20 bp, mouse
gttggggccatgctagccag

SEQ ID NO: 626300 - DNA, 20 bp, mouse
ggtcctgcgcggtagtcccg

SEQ ID NO: 626301 - DNA, 20 bp, mouse
gcaccgcagacggaaggcgg

SEQ ID NO: 626302 - DNA, 20 bp, mouse
gaaagcgcaccgcagacgga

SEQ ID NO: 626303 - DNA, 20 bp, mouse
gctagccagaggcgttcctc

SEQ ID NO: 626304 - DNA, 20 bp, mouse
gagacctgcggcgtcctgcg

SEQ ID NO: 626305 - DNA, 20 bp, mouse
gttccgccgccttccgtctg

SEQ ID NO: 626306 - DNA, 20 bp, mouse
gtctggaggctgccattcgg

SEQ ID NO: 626307 - DNA, 20 bp, mouse
ggtgccccagcccacgtcag

SEQ ID NO: 626308 - DNA, 20 bp, mouse
ggtctgcgctcccctgacgt

SEQ ID NO: 626309 - DNA, 20 bp, mouse
gactcgcggcggctttctgg

SEQ ID NO: 626310 - DNA, 20 bp, mouse
gccgccgcgagtaaggtgag

SEQ ID NO: 626311 - DNA, 20 bp, mouse
ggctcccctgacgtgggctg

SEQ ID NO: 626312 - DNA, 20 bp, mouse
gacgccacagaggggaggag

SEQ ID NO: 626313 - DNA, 20 bp, mouse
gctgcacccccgggagggta

SEQ ID NO: 626314 - DNA, 20 bp, mouse
gtgagcacgccacagagggg

SEQ ID NO: 626315 - DNA, 20 bp, mouse
gctttctggaggctgccatt

SEQ ID NO: 626316 - DNA, 20 bp, mouse
gcgaggcacactctccacgg

SEQ ID NO: 626317 - DNA, 20 bp, mouse
ggaagtctgggaagccaccg

SEQ ID NO: 626318 - DNA, 20 bp, mouse
gcaggcgacgagtagatcaa

SEQ ID NO: 626319 - DNA, 20 bp, mouse
gtggggtgcacataccacag

SEQ ID NO: 626320 - DNA, 20 bp, mouse
gcaggggtagcactgccagt

SEQ ID NO: 626321 - DNA, 20 bp, mouse
gagggtgtgagcctgcccct

SEQ ID NO: 626322 - DNA, 20 bp, mouse
ggtcatgaaggccccaccag

SEQ ID NO: 626323 - DNA, 20 bp, mouse
gcctgcatctggagacccaa

SEQ ID NO: 626324 - DNA, 20 bp, mouse
gtgtgtctcgatgttagatg

SEQ ID NO: 626325 - DNA, 20 bp, mouse
gtagcactgccagtaggctt

SEQ ID NO: 626326 - DNA, 20 bp, mouse
gcggcatggcctgtaaccac

SEQ ID NO: 626327 - DNA, 20 bp, mouse
gagaacgggagccagcttgg

SEQ ID NO: 626328 - DNA, 20 bp, mouse
gtggcctgtaaccactggtc

SEQ ID NO: 626329 - DNA, 20 bp, mouse
gggcgacgcggctgtgctag

SEQ ID NO: 626330 - DNA, 20 bp, mouse
ggttgagagcagagacggca

SEQ ID NO: 626331 - DNA, 20 bp, mouse
gcgcggagccttgctagaac

SEQ ID NO: 626332 - DNA, 20 bp, mouse
gcaggaaaagtacaaactct

SEQ ID NO: 626333 - DNA, 20 bp, mouse
gactctaacctgagaggccg

SEQ ID NO: 626334 - DNA, 20 bp, mouse
ggatcccccctcaccaccca

SEQ ID NO: 626335 - DNA, 20 bp, mouse
gaaggggccgagcagttgac

SEQ ID NO: 626336 - DNA, 20 bp, mouse
gtgagcgagggagccctgtg

SEQ ID NO: 626337 - DNA, 20 bp, mouse
gacagtagctacagccccgg

SEQ ID NO: 626338 - DNA, 20 bp, mouse
gttgaggcactaggaggagg

SEQ ID NO: 626339 - DNA, 20 bp, mouse
gggagccggactgcaactgg

SEQ ID NO: 626340 - DNA, 20 bp, mouse
gccgagtttgaggcactagg

SEQ ID NO: 626341 - DNA, 20 bp, mouse
gctgcagcaaaggctggaac

SEQ ID NO: 626342 - DNA, 20 bp, mouse
gggaacaggcacggccgccg

SEQ ID NO: 626343 - DNA, 20 bp, mouse
gagtttgaggcactaggagg

SEQ ID NO: 626344 - DNA, 20 bp, mouse
ggcagcagcgcgagtccgta

SEQ ID NO: 626345 - DNA, 20 bp, mouse
ggagggagccctgtgtggta

SEQ ID NO: 626346 - DNA, 20 bp, mouse
ggccaggcggaggaacaagg

SEQ ID NO: 626347 - DNA, 20 bp, mouse
gaccaaggcaagaggaaagt

SEQ ID NO: 626348 - DNA, 20 bp, mouse
gagagagaccatgatggcgg

SEQ ID NO: 626349 - DNA, 20 bp, mouse
ggtcctcaccatcagaactt

SEQ ID NO: 626350 - DNA, 20 bp, mouse
gaggtatggagcgaagctgg

SEQ ID NO: 626351 - DNA, 20 bp, mouse
gcagtctgcctagcgaggta

SEQ ID NO: 626352 - DNA, 20 bp, mouse
gggaacaaggcggtcaggga

SEQ ID NO: 626353 - DNA, 20 bp, mouse
gactagaaagtaaagaacca

SEQ ID NO: 626354 - DNA, 20 bp, mouse
gacaagcgtgagcccggtcg

SEQ ID NO: 626355 - DNA, 20 bp, mouse
gttcctggccaccaacccag

SEQ ID NO: 626356 - DNA, 20 bp, mouse
gcaacgtgtggtcccgccag

SEQ ID NO: 626357 - DNA, 20 bp, mouse
gctagagccgggaaccccac

SEQ ID NO: 626358 - DNA, 20 bp, mouse
ggagcgtgagtcccagaagt

SEQ ID NO: 626359 - DNA, 20 bp, mouse
gaggttacgcacagttcccc

SEQ ID NO: 626360 - DNA, 20 bp, mouse
ggcctgggatagggttctcg

SEQ ID NO: 626361 - DNA, 20 bp, mouse
ggcggcccggtatcaacgtg

SEQ ID NO: 626362 - DNA, 20 bp, mouse
gctcaagtgggaggaggtga

SEQ ID NO: 626363 - DNA, 20 bp, mouse
gtaccggctggaagccctca

SEQ ID NO: 626364 - DNA, 20 bp, mouse
gggaagatcaaaggccgcat

SEQ ID NO: 626365 - DNA, 20 bp, mouse
ggggaccacacgttgatacc

SEQ ID NO: 626366 - DNA, 20 bp, mouse
ggcctcagccgagactgaag

SEQ ID NO: 626367 - DNA, 20 bp, mouse
gcccgccgcgaggacagagg

SEQ ID NO: 626368 - DNA, 20 bp, mouse
gtgcgcgccaccagtagccg

SEQ ID NO: 626369 - DNA, 20 bp, mouse
gcagcccaacgcgccggaag

SEQ ID NO: 626370 - DNA, 20 bp, mouse
gggcagagggtggccgcgag

SEQ ID NO: 626371 - DNA, 20 bp, mouse
ggagcccgccgcgaggacag

SEQ ID NO: 626372 - DNA, 20 bp, mouse
gagccgcggctcgcccctcg

SEQ ID NO: 626373 - DNA, 20 bp, mouse
gctggtggcgcgcagggatg

SEQ ID NO: 626374 - DNA, 20 bp, mouse
gcccgcagcctccctctcgg

SEQ ID NO: 626375 - DNA, 20 bp, mouse
gggaagtggcgagcaccagg

SEQ ID NO: 626376 - DNA, 20 bp, mouse
gggcctgagaggagcatgaa

SEQ ID NO: 626377 - DNA, 20 bp, mouse
ggcggctcggcggctctgag

SEQ ID NO: 626378 - DNA, 20 bp, mouse
ggccgaggtgcgcgctggtg

SEQ ID NO: 626379 - DNA, 20 bp, mouse
gccagcgcgcacctcggccg

SEQ ID NO: 626380 - DNA, 20 bp, mouse
gcgcgcaggcgcagcggcga

SEQ ID NO: 626381 - DNA, 20 bp, mouse
ggcctgtcggggccccgggt

SEQ ID NO: 626382 - DNA, 20 bp, mouse
gtccccaccagcgcgcacct

SEQ ID NO: 626383 - DNA, 20 bp, mouse
ggctcggcggctctgagcgg

SEQ ID NO: 626384 - DNA, 20 bp, mouse
gtggaggaggcccccggtcc

SEQ ID NO: 626385 - DNA, 20 bp, mouse
gctccattcatgctcctctc

SEQ ID NO: 626386 - DNA, 20 bp, mouse
ggtgcctcgcgctgactcag

SEQ ID NO: 626387 - DNA, 20 bp, mouse
gcctcgcgctgactcagcgg

SEQ ID NO: 626388 - DNA, 20 bp, mouse
gtctgcactctacttccatg

SEQ ID NO: 626389 - DNA, 20 bp, mouse
ggcccgggccgcgctcctct

SEQ ID NO: 626390 - DNA, 20 bp, mouse
gctgctagcgcgggtccgcg

SEQ ID NO: 626391 - DNA, 20 bp, mouse
ggggtccgcgcggtacgacg

SEQ ID NO: 626392 - DNA, 20 bp, mouse
ggatccgggcgaaggatagg

SEQ ID NO: 626393 - DNA, 20 bp, mouse
gtccgcgcggtacgacgcgg

SEQ ID NO: 626394 - DNA, 20 bp, mouse
gcggagtcggcggccctgga

SEQ ID NO: 626395 - DNA, 20 bp, mouse
gatgaggctgctgctagcgc

SEQ ID NO: 626396 - DNA, 20 bp, mouse
gggctctgaggagacctcgg

SEQ ID NO: 626397 - DNA, 20 bp, mouse
gtctgaggagacctcggcgg

SEQ ID NO: 626398 - DNA, 20 bp, mouse
gtggcgggagggcggctctg

SEQ ID NO: 626399 - DNA, 20 bp, mouse
gcagcgccggggcccatgtg

SEQ ID NO: 626400 - DNA, 20 bp, mouse
gcaggcggcggcgagaggaa

SEQ ID NO: 626401 - DNA, 20 bp, mouse
gagccccaggtacctcatac

SEQ ID NO: 626402 - DNA, 20 bp, mouse
gcgcgcacatcactcccgag

SEQ ID NO: 626403 - DNA, 20 bp, mouse
ggcccgggccggggagctca

SEQ ID NO: 626404 - DNA, 20 bp, mouse
gccgccgcggggagccactg

SEQ ID NO: 626405 - DNA, 20 bp, mouse
gcgccggggcccatgtgggg

SEQ ID NO: 626406 - DNA, 20 bp, mouse
ggtggacgcccgaccgtcca

SEQ ID NO: 626407 - DNA, 20 bp, mouse
gggcccccggagaaggttgg

SEQ ID NO: 626408 - DNA, 20 bp, mouse
ggctgctgcaggacacgacg

SEQ ID NO: 626409 - DNA, 20 bp, mouse
ggagcgcgcgcgccctgcac

SEQ ID NO: 626410 - DNA, 20 bp, mouse
gctcccccaaccttctccgg

SEQ ID NO: 626411 - DNA, 20 bp, mouse
gcgtggcggaggctgatctc

SEQ ID NO: 626412 - DNA, 20 bp, mouse
gaagaagggttgcagctccg

SEQ ID NO: 626413 - DNA, 20 bp, mouse
ggcgctcccccaaccttctc

SEQ ID NO: 626414 - DNA, 20 bp, mouse
ggggggcccccggagaaggt

SEQ ID NO: 626415 - DNA, 20 bp, mouse
gggagacaggggcttcctga

SEQ ID NO: 626416 - DNA, 20 bp, mouse
gaatggcgttgctggcgggt

SEQ ID NO: 626417 - DNA, 20 bp, mouse
gccagtgaaccggtcaggga

SEQ ID NO: 626418 - DNA, 20 bp, mouse
gggcgcccagggccaccgtg

SEQ ID NO: 626419 - DNA, 20 bp, mouse
gggagggccgcgcactacag

SEQ ID NO: 626420 - DNA, 20 bp, mouse
gaagggaggaccaccagttg

SEQ ID NO: 626421 - DNA, 20 bp, mouse
ggctaaatggcgttgctggc

SEQ ID NO: 626422 - DNA, 20 bp, mouse
gggcgggtaggttgaacccg

SEQ ID NO: 626423 - DNA, 20 bp, mouse
gtcggagccagagaagccga

SEQ ID NO: 626424 - DNA, 20 bp, mouse
ggccgccagtgaaccggtca

SEQ ID NO: 626425 - DNA, 20 bp, mouse
gagagcggaatccgggacag

SEQ ID NO: 626426 - DNA, 20 bp, mouse
gcgagtggccgaacatgggg

SEQ ID NO: 626427 - DNA, 20 bp, mouse
gtcgcgagtggccgaacatg

SEQ ID NO: 626428 - DNA, 20 bp, mouse
ggcggggtcgctgatccggg

SEQ ID NO: 626429 - DNA, 20 bp, mouse
gagcgcgcgggagacttgcg

SEQ ID NO: 626430 - DNA, 20 bp, mouse
gtctcccgccaccccatgtt

SEQ ID NO: 626431 - DNA, 20 bp, mouse
gtgagttagctgatcgcgag

SEQ ID NO: 626432 - DNA, 20 bp, mouse
ggtggccgaacatggggtgg

SEQ ID NO: 626433 - DNA, 20 bp, mouse
gatcagtgcgaggaaggctg

SEQ ID NO: 626434 - DNA, 20 bp, mouse
gcttgcggggtcgctgatcc

SEQ ID NO: 626435 - DNA, 20 bp, mouse
ggcagcgagtggtcacgctg

SEQ ID NO: 626436 - DNA, 20 bp, mouse
gatccaggacagggcagcct

SEQ ID NO: 626437 - DNA, 20 bp, mouse
gggccagtgatgccctccag

SEQ ID NO: 626438 - DNA, 20 bp, mouse
gcaggcgttgatgctgctca

SEQ ID NO: 626439 - DNA, 20 bp, mouse
gccaggaactgatccaggac

SEQ ID NO: 626440 - DNA, 20 bp, mouse
gtccacccaggaactgatcc

SEQ ID NO: 626441 - DNA, 20 bp, mouse
ggtggaggcctgcccctgga

SEQ ID NO: 626442 - DNA, 20 bp, mouse
gcaggggcaggcctccaccc

SEQ ID NO: 626443 - DNA, 20 bp, mouse
gtagccactggctcccagag

SEQ ID NO: 626444 - DNA, 20 bp, mouse
gaggcctagaggccggtaag

SEQ ID NO: 626445 - DNA, 20 bp, mouse
gctcccctcccttcaggaag

SEQ ID NO: 626446 - DNA, 20 bp, mouse
ggagaggtagggcccggaag

SEQ ID NO: 626447 - DNA, 20 bp, mouse
gcccaatgtgagcacctgtt

SEQ ID NO: 626448 - DNA, 20 bp, mouse
ggaggttgacatagaaaggg

SEQ ID NO: 626449 - DNA, 20 bp, mouse
gatttttagaagaccggaag

SEQ ID NO: 626450 - DNA, 20 bp, mouse
gcaggaggttgacatagaaa

SEQ ID NO: 626451 - DNA, 20 bp, mouse
ggacacagaaagagacactt

SEQ ID NO: 626452 - DNA, 20 bp, mouse
ggcccaacaggtgctcacat

SEQ ID NO: 626453 - DNA, 20 bp, mouse
gggctggtgggtcatcacac

SEQ ID NO: 626454 - DNA, 20 bp, mouse
gtccggtcttctaaaaattg

SEQ ID NO: 626455 - DNA, 20 bp, mouse
gacttaggaaggagcccaac

SEQ ID NO: 626456 - DNA, 20 bp, mouse
ggagatccccggcttaggaa

SEQ ID NO: 626457 - DNA, 20 bp, mouse
gtaagccggggatctctaga

SEQ ID NO: 626458 - DNA, 20 bp, mouse
gtccaccctctagagatccc

SEQ ID NO: 626459 - DNA, 20 bp, mouse
ggccggggatctctagaggg

SEQ ID NO: 626460 - DNA, 20 bp, mouse
gaggcaaaaggccctgctct

SEQ ID NO: 626461 - DNA, 20 bp, mouse
gatggcgtggtccggtaata

SEQ ID NO: 626462 - DNA, 20 bp, mouse
gtctagagggtggaagctgt

SEQ ID NO: 626463 - DNA, 20 bp, mouse
gcctgaggaccagcatggcg

SEQ ID NO: 626464 - DNA, 20 bp, mouse
ggcgggacgtctggatctgt

SEQ ID NO: 626465 - DNA, 20 bp, mouse
gctgaagcaacgagggagga

SEQ ID NO: 626466 - DNA, 20 bp, mouse
gcactgggacagcagaaggt

SEQ ID NO: 626467 - DNA, 20 bp, mouse
ggctgattgggcgagagaca

SEQ ID NO: 626468 - DNA, 20 bp, mouse
ggcccgcctgcggttaaggt

SEQ ID NO: 626469 - DNA, 20 bp, mouse
gcaaggagcccgcgtggacg

SEQ ID NO: 626470 - DNA, 20 bp, mouse
ggagagacaaggagcccgcg

SEQ ID NO: 626471 - DNA, 20 bp, mouse
gccagtggcttgcccgcctg

SEQ ID NO: 626472 - DNA, 20 bp, mouse
gacctaccttaaccgcaggc

SEQ ID NO: 626473 - DNA, 20 bp, mouse
gccagaaggcggaacaggac

SEQ ID NO: 626474 - DNA, 20 bp, mouse
gaggcctcatccaacacatg

SEQ ID NO: 626475 - DNA, 20 bp, mouse
ggcgaacctaccttaaccgc

SEQ ID NO: 626476 - DNA, 20 bp, mouse
gcggctgtcctaggtcgagc

SEQ ID NO: 626477 - DNA, 20 bp, mouse
gcctcctgcccgctcgacct

SEQ ID NO: 626478 - DNA, 20 bp, mouse
gtcatggcaggagctccggg

SEQ ID NO: 626479 - DNA, 20 bp, mouse
gtgcagtccgggatcagtgg

SEQ ID NO: 626480 - DNA, 20 bp, mouse
gcggcggaagcggctgtcct

SEQ ID NO: 626481 - DNA, 20 bp, mouse
gggccagcacgaaggagacg

SEQ ID NO: 626482 - DNA, 20 bp, mouse
gaggaggcttgcgggcctca

SEQ ID NO: 626483 - DNA, 20 bp, mouse
gtgtcctaggtcgagcgggc

SEQ ID NO: 626484 - DNA, 20 bp, mouse
gagtaagagccgcgacctgg

SEQ ID NO: 626485 - DNA, 20 bp, mouse
gcccacgggaagccccagca

SEQ ID NO: 626486 - DNA, 20 bp, mouse
ggggtagccgcaccaggtag

SEQ ID NO: 626487 - DNA, 20 bp, mouse
gtcctccgagcgacggccgg

SEQ ID NO: 626488 - DNA, 20 bp, mouse
gaggtcagcggccgaacggg

SEQ ID NO: 626489 - DNA, 20 bp, mouse
ggcctccggccgtcgctcgg

SEQ ID NO: 626490 - DNA, 20 bp, mouse
ggaaaccaaacaccccgccc

SEQ ID NO: 626491 - DNA, 20 bp, mouse
ggtggtgaaggagcatcagg

SEQ ID NO: 626492 - DNA, 20 bp, mouse
gttgcaaaggagcccttggt

SEQ ID NO: 626493 - DNA, 20 bp, mouse
gggtgggtgagctcaggccg

SEQ ID NO: 626494 - DNA, 20 bp, mouse
gtagtgtcgacggtcaaaat

SEQ ID NO: 626495 - DNA, 20 bp, mouse
gacctggtgcggctacccgg

SEQ ID NO: 626496 - DNA, 20 bp, mouse
gccaacgagactagcaggag

SEQ ID NO: 626497 - DNA, 20 bp, mouse
ggaaacagcagccgggccag

SEQ ID NO: 626498 - DNA, 20 bp, mouse
gcgggactcccatgaccagc

SEQ ID NO: 626499 - DNA, 20 bp, mouse
gcgagctgcccgctggtcat

SEQ ID NO: 626500 - DNA, 20 bp, mouse
gggcgggcgcccatccccga

SEQ ID NO: 626501 - DNA, 20 bp, mouse
ggtctaggccgaggccctcg

SEQ ID NO: 626502 - DNA, 20 bp, mouse
ggagccagcggaagaacgcc

SEQ ID NO: 626503 - DNA, 20 bp, mouse
ggccgctgaacgcacgtggg

SEQ ID NO: 626504 - DNA, 20 bp, mouse
gccggccgctgaacgcacgt

SEQ ID NO: 626505 - DNA, 20 bp, mouse
ggacccggcgtggcaggtct

SEQ ID NO: 626506 - DNA, 20 bp, mouse
gtctcggagtcgctccacgg

SEQ ID NO: 626507 - DNA, 20 bp, mouse
ggaatctcggagtcgctcca

SEQ ID NO: 626508 - DNA, 20 bp, mouse
ggcacgcctgcaagcctcac

SEQ ID NO: 626509 - DNA, 20 bp, mouse
gcggttactaaggagtgggt

SEQ ID NO: 626510 - DNA, 20 bp, mouse
gcggaggcgatgtccctgtc

SEQ ID NO: 626511 - DNA, 20 bp, mouse
ggcaagcctcacgggaatct

SEQ ID NO: 626512 - DNA, 20 bp, mouse
gctcgcggttactaaggagt

SEQ ID NO: 626513 - DNA, 20 bp, mouse
ggctgtggcaagcgccaccg

SEQ ID NO: 626514 - DNA, 20 bp, mouse
gcgactccgagattcccgtg

SEQ ID NO: 626515 - DNA, 20 bp, mouse
gtaccttcagggacagaaag

SEQ ID NO: 626516 - DNA, 20 bp, mouse
ggcatgggcctcctccgagg

SEQ ID NO: 626517 - DNA, 20 bp, mouse
gggcgcatgggcctcctccg

SEQ ID NO: 626518 - DNA, 20 bp, mouse
gctagagtgctgctctgagt

SEQ ID NO: 626519 - DNA, 20 bp, mouse
ggtgctgctctgagtgggcc

SEQ ID NO: 626520 - DNA, 20 bp, mouse
gccccaagccccgcagccgg

SEQ ID NO: 626521 - DNA, 20 bp, mouse
ggcccatgcgccggagccgg

SEQ ID NO: 626522 - DNA, 20 bp, mouse
gagccggcggcccagcagcc

SEQ ID NO: 626523 - DNA, 20 bp, mouse
ggaggcccatgcgccggagc

SEQ ID NO: 626524 - DNA, 20 bp, mouse
gcttctccagcgccaccaag

SEQ ID NO: 626525 - DNA, 20 bp, mouse
gcctgagcccaggtagtaga

SEQ ID NO: 626526 - DNA, 20 bp, mouse
ggacgcacggacgcacagac

SEQ ID NO: 626527 - DNA, 20 bp, mouse
ggcacggacgcacagacggg

SEQ ID NO: 626528 - DNA, 20 bp, mouse
ggtcccagcccaggcaacag

SEQ ID NO: 626529 - DNA, 20 bp, mouse
gcgggcggcgggaaccccca

SEQ ID NO: 626530 - DNA, 20 bp, mouse
gcccggagtacacgtagcgg

SEQ ID NO: 626531 - DNA, 20 bp, mouse
ggcgtccatgtgtactgcag

SEQ ID NO: 626532 - DNA, 20 bp, mouse
gctcgccgctgcagtacaca

SEQ ID NO: 626533 - DNA, 20 bp, mouse
ggaacccggagtacacgtag

SEQ ID NO: 626534 - DNA, 20 bp, mouse
gctctggcgtctctgagcga

SEQ ID NO: 626535 - DNA, 20 bp, mouse
gagactcgcgtggacccccg

SEQ ID NO: 626536 - DNA, 20 bp, mouse
gcggcgcggagttttcagac

SEQ ID NO: 626537 - DNA, 20 bp, mouse
gtgaaaactccgcgccgcgg

SEQ ID NO: 626538 - DNA, 20 bp, mouse
gcggacgtcaccaggaggag

SEQ ID NO: 626539 - DNA, 20 bp, mouse
ggcgccgccaccatcttccg

SEQ ID NO: 626540 - DNA, 20 bp, mouse
gggacccggacgtcaccagg

SEQ ID NO: 626541 - DNA, 20 bp, mouse
gcagcccgcggaggacctgg

SEQ ID NO: 626542 - DNA, 20 bp, mouse
gagcgcgcaccggggtgtcc

SEQ ID NO: 626543 - DNA, 20 bp, mouse
gcggcgagcccgggcgacgt

SEQ ID NO: 626544 - DNA, 20 bp, mouse
gcgtcaccaggaggagggga

SEQ ID NO: 626545 - DNA, 20 bp, mouse
gccgcgggctgcgggcagat

SEQ ID NO: 626546 - DNA, 20 bp, mouse
gcgcgtcccgggcaggaaga

SEQ ID NO: 626547 - DNA, 20 bp, mouse
gagcgcgcgggtgcagaagc

SEQ ID NO: 626548 - DNA, 20 bp, mouse
gcgcgtccggccctgcaaac

SEQ ID NO: 626549 - DNA, 20 bp, mouse
gaagatggtggcgagcgcgc

SEQ ID NO: 626550 - DNA, 20 bp, mouse
gaggcggccggcgaactggg

SEQ ID NO: 626551 - DNA, 20 bp, mouse
gcgcgccccgcgtcccgggc

SEQ ID NO: 626552 - DNA, 20 bp, mouse
gcgcccgcggccggtttgca

SEQ ID NO: 626553 - DNA, 20 bp, mouse
gggagtgaggagggactccg

SEQ ID NO: 626554 - DNA, 20 bp, mouse
gggagcggtgcgtgactcgg

SEQ ID NO: 626555 - DNA, 20 bp, mouse
gcatctgggcggagtgagga

SEQ ID NO: 626556 - DNA, 20 bp, mouse
gccggagccgccggaaaccc

SEQ ID NO: 626557 - DNA, 20 bp, mouse
gcacttgcccgggtttccgg

SEQ ID NO: 626558 - DNA, 20 bp, mouse
gggcacgcacgcagaagcct

SEQ ID NO: 626559 - DNA, 20 bp, mouse
gactcccaggcgggacccgg

SEQ ID NO: 626560 - DNA, 20 bp, mouse
gggtgttccgggcgatgtct

SEQ ID NO: 626561 - DNA, 20 bp, mouse
ggaaccggaagcacttgccc

SEQ ID NO: 626562 - DNA, 20 bp, mouse
gcaagtgcttccggttcggg

SEQ ID NO: 626563 - DNA, 20 bp, mouse
ggcgggagaaagggactccc

SEQ ID NO: 626564 - DNA, 20 bp, mouse
gggagaaagggactcccagg

SEQ ID NO: 626565 - DNA, 20 bp, mouse
gtgcgggccatcagcctagt

SEQ ID NO: 626566 - DNA, 20 bp, mouse
ggcgcgtcggcagcgagcat

SEQ ID NO: 626567 - DNA, 20 bp, mouse
ggcgggcgccctacctggtg

SEQ ID NO: 626568 - DNA, 20 bp, mouse
gctgacagaccggcgcgcgt

SEQ ID NO: 626569 - DNA, 20 bp, mouse
gcaccccggcgctgacagac

SEQ ID NO: 626570 - DNA, 20 bp, mouse
gctgtcagcgccggggtgag

SEQ ID NO: 626571 - DNA, 20 bp, mouse
gttccgccggcccctcaccc

SEQ ID NO: 626572 - DNA, 20 bp, mouse
gcgccatcgcggcccattgt

SEQ ID NO: 626573 - DNA, 20 bp, mouse
gcgccggtctgtcagcgccg

SEQ ID NO: 626574 - DNA, 20 bp, mouse
ggaggctgcgtgggatccgg

SEQ ID NO: 626575 - DNA, 20 bp, mouse
ggcgcgcggctgcccacaat

SEQ ID NO: 626576 - DNA, 20 bp, mouse
gtcccggccggagacacgga

SEQ ID NO: 626577 - DNA, 20 bp, mouse
gcgcggccgggggcaaagaa

SEQ ID NO: 626578 - DNA, 20 bp, mouse
gaaggaaggagctcgcggag

SEQ ID NO: 626579 - DNA, 20 bp, mouse
gaggagctcgcggaggggag

SEQ ID NO: 626580 - DNA, 20 bp, mouse
gcggccggagacacggacgg

SEQ ID NO: 626581 - DNA, 20 bp, mouse
gctcagttgggacgccgccg

SEQ ID NO: 626582 - DNA, 20 bp, mouse
gggggtcccggccggagaca

SEQ ID NO: 626583 - DNA, 20 bp, mouse
gacaggtaagggtatcccgg

SEQ ID NO: 626584 - DNA, 20 bp, mouse
gcaaggagtgcagggcgatg

SEQ ID NO: 626585 - DNA, 20 bp, mouse
gcactgcgctcaggttcggg

SEQ ID NO: 626586 - DNA, 20 bp, mouse
gtcccggcacgcggagacga

SEQ ID NO: 626587 - DNA, 20 bp, mouse
gacgacggcgaacgaggaaa

SEQ ID NO: 626588 - DNA, 20 bp, mouse
gggactagcgtgacagttcc

SEQ ID NO: 626589 - DNA, 20 bp, mouse
gtcagctgatgcaacccgac

SEQ ID NO: 626590 - DNA, 20 bp, mouse
ggcggagacgacggcgaacg

SEQ ID NO: 626591 - DNA, 20 bp, mouse
gctgtcacgctagtcccgtc

SEQ ID NO: 626592 - DNA, 20 bp, mouse
ggattggcatcgggaatcat

SEQ ID NO: 626593 - DNA, 20 bp, mouse
gtcccggcatggaataggat

SEQ ID NO: 626594 - DNA, 20 bp, mouse
ggtgcaagagaaactccagt

SEQ ID NO: 626595 - DNA, 20 bp, mouse
gcggcatggaataggatggg

SEQ ID NO: 626596 - DNA, 20 bp, mouse
ggaccctcgtagccagacca

SEQ ID NO: 626597 - DNA, 20 bp, mouse
gggcacaggcgcctcagcat

SEQ ID NO: 626598 - DNA, 20 bp, mouse
ggtagccagaccagggactg

SEQ ID NO: 626599 - DNA, 20 bp, mouse
gtgcgtgtcccgcaagatgg

SEQ ID NO: 626600 - DNA, 20 bp, mouse
gggactgcggaacgcggcac

SEQ ID NO: 626601 - DNA, 20 bp, mouse
ggaccagggactgcggaacg

SEQ ID NO: 626602 - DNA, 20 bp, mouse
ggatggcggcgcccatgctg

SEQ ID NO: 626603 - DNA, 20 bp, mouse
ggtccctggtctggctacga

SEQ ID NO: 626604 - DNA, 20 bp, mouse
gcgcgtctcaagagccccga

SEQ ID NO: 626605 - DNA, 20 bp, mouse
gccccccagacggtgtactg

SEQ ID NO: 626606 - DNA, 20 bp, mouse
gtccgaccgtgaagaaggtc

SEQ ID NO: 626607 - DNA, 20 bp, mouse
gaccaggtgaggatgagtgt

SEQ ID NO: 626608 - DNA, 20 bp, mouse
gatccggcttccgctctctg

SEQ ID NO: 626609 - DNA, 20 bp, mouse
gctgctgctgatcttccggc

SEQ ID NO: 626610 - DNA, 20 bp, mouse
gagaaggtcgggggtctggc

SEQ ID NO: 626611 - DNA, 20 bp, mouse
gccgaatccgaccgtgaaga

SEQ ID NO: 626612 - DNA, 20 bp, mouse
gtgtgctgctgctgatcttc

SEQ ID NO: 626613 - DNA, 20 bp, mouse
gctaataaacagggtagact

SEQ ID NO: 626614 - DNA, 20 bp, mouse
gggtctggcgggccgcctgc

SEQ ID NO: 626615 - DNA, 20 bp, mouse
ggcttccacgccgcacaatg

SEQ ID NO: 626616 - DNA, 20 bp, mouse
gtcgctagttcgatcggtag

SEQ ID NO: 626617 - DNA, 20 bp, mouse
gctagcgagaatggcgggac

SEQ ID NO: 626618 - DNA, 20 bp, mouse
gccattctcgctagttcgat

SEQ ID NO: 626619 - DNA, 20 bp, mouse
gtcatcggtgagcgccagaa

SEQ ID NO: 626620 - DNA, 20 bp, mouse
gcgagggcgggtctatcgcg

SEQ ID NO: 626621 - DNA, 20 bp, mouse
gccgggtggcctcacatcgg

SEQ ID NO: 626622 - DNA, 20 bp, mouse
ggcggggacaagaaggtcat

SEQ ID NO: 626623 - DNA, 20 bp, mouse
gtgagcgccagaagggaccg

SEQ ID NO: 626624 - DNA, 20 bp, mouse
ggcgagaatggcgggacggg

SEQ ID NO: 626625 - DNA, 20 bp, mouse
gcggcccgcggccccatccc

SEQ ID NO: 626626 - DNA, 20 bp, mouse
gagcgaggcggaggcgtcag

SEQ ID NO: 626627 - DNA, 20 bp, mouse
gccagcagcggggccagagg

SEQ ID NO: 626628 - DNA, 20 bp, mouse
gatcccgccgggtccagtac

SEQ ID NO: 626629 - DNA, 20 bp, mouse
ggggccggtactggacccgg

SEQ ID NO: 626630 - DNA, 20 bp, mouse
gggacccggcgggatgagcg

SEQ ID NO: 626631 - DNA, 20 bp, mouse
gcgggggccggtactggacc

SEQ ID NO: 626632 - DNA, 20 bp, mouse
ggcgtcagtggtggcgacag

SEQ ID NO: 626633 - DNA, 20 bp, mouse
gccgcctcgctcatcccgcc

SEQ ID NO: 626634 - DNA, 20 bp, mouse
gggccggtccgcgagccggg

SEQ ID NO: 626635 - DNA, 20 bp, mouse
gacccctggcaaccaggcga

SEQ ID NO: 626636 - DNA, 20 bp, mouse
gcccggagagagcggagagg

SEQ ID NO: 626637 - DNA, 20 bp, mouse
gaggcgggcgaggccaccac

SEQ ID NO: 626638 - DNA, 20 bp, mouse
gccgaggtgcccggagagag

SEQ ID NO: 626639 - DNA, 20 bp, mouse
gagaggcggcatgagcgagg

SEQ ID NO: 626640 - DNA, 20 bp, mouse
gagcgtggtgccgccggtgg

SEQ ID NO: 626641 - DNA, 20 bp, mouse
ggcggcgggcggcggctcga

SEQ ID NO: 626642 - DNA, 20 bp, mouse
gttgcgcggggccatcttcg

SEQ ID NO: 626643 - DNA, 20 bp, mouse
gtgcagcccgggagagacgg

SEQ ID NO: 626644 - DNA, 20 bp, mouse
gggcggcggctcgagggctg

SEQ ID NO: 626645 - DNA, 20 bp, mouse
ggttagcgcggtggcagtcg

SEQ ID NO: 626646 - DNA, 20 bp, mouse
gcaataaccaaagtcatcag

SEQ ID NO: 626647 - DNA, 20 bp, mouse
gagagcgcgagagcgatcac

SEQ ID NO: 626648 - DNA, 20 bp, mouse
ggagagcagagggaataggt

SEQ ID NO: 626649 - DNA, 20 bp, mouse
gagccagggtttggcagcca

SEQ ID NO: 626650 - DNA, 20 bp, mouse
gaaaccagccgggtcctgta

SEQ ID NO: 626651 - DNA, 20 bp, mouse
gtttaggggctcccacttgg

SEQ ID NO: 626652 - DNA, 20 bp, mouse
gggtgacaaccagccgcacg

SEQ ID NO: 626653 - DNA, 20 bp, mouse
ggtgggaatgctgtgcctac

SEQ ID NO: 626654 - DNA, 20 bp, mouse
gggcacagccgcagagagtg

SEQ ID NO: 626655 - DNA, 20 bp, mouse
gcgcgatgagggcatcgtag

SEQ ID NO: 626656 - DNA, 20 bp, mouse
gcctcgcacggcggttccac

SEQ ID NO: 626657 - DNA, 20 bp, mouse
gcgcacggcggttccacggg

SEQ ID NO: 626658 - DNA, 20 bp, mouse
gagcgaaaggtctcctcccg

SEQ ID NO: 626659 - DNA, 20 bp, mouse
ggggacccggaacccccacg

SEQ ID NO: 626660 - DNA, 20 bp, mouse
ggcgcgtcccgggcctcgca

SEQ ID NO: 626661 - DNA, 20 bp, mouse
gcgcggagagaaagagcgaa

SEQ ID NO: 626662 - DNA, 20 bp, mouse
ggaaccgccgtgcgaggccc

SEQ ID NO: 626663 - DNA, 20 bp, mouse
gcgtcccgggcctcgcacgg

SEQ ID NO: 626664 - DNA, 20 bp, mouse
gggccgcgcggacagctcag

SEQ ID NO: 626665 - DNA, 20 bp, mouse
ggcagctgggcgcgcaggaa

SEQ ID NO: 626666 - DNA, 20 bp, mouse
gtgaatggccgaccccgacg

SEQ ID NO: 626667 - DNA, 20 bp, mouse
gctgggagagccgagcggaa

SEQ ID NO: 626668 - DNA, 20 bp, mouse
gctcccagctcggggctgaa

SEQ ID NO: 626669 - DNA, 20 bp, mouse
gtgtggaggaggtggctgtc

SEQ ID NO: 626670 - DNA, 20 bp, mouse
gcccgacgcggcgcgtgtgg

SEQ ID NO: 626671 - DNA, 20 bp, mouse
gtcagtcgcagaccctggat

SEQ ID NO: 626672 - DNA, 20 bp, mouse
gcccctcacgagccggagga

SEQ ID NO: 626673 - DNA, 20 bp, mouse
ggactccggcgggagagtga

SEQ ID NO: 626674 - DNA, 20 bp, mouse
gtcacgagccggaggagggc

SEQ ID NO: 626675 - DNA, 20 bp, mouse
ggagagagctcaggccggcg

SEQ ID NO: 626676 - DNA, 20 bp, mouse
gcgccaggaggcagcgacgg

SEQ ID NO: 626677 - DNA, 20 bp, mouse
gcaggtcgcggggcgccagg

SEQ ID NO: 626678 - DNA, 20 bp, mouse
ggagaagcccgggagcagga

SEQ ID NO: 626679 - DNA, 20 bp, mouse
gtaggcagctgacccggacc

SEQ ID NO: 626680 - DNA, 20 bp, mouse
gcgcgacctggaggtggaga

SEQ ID NO: 626681 - DNA, 20 bp, mouse
gagactccgggaccagtagg

SEQ ID NO: 626682 - DNA, 20 bp, mouse
gtccagactccgggaccagt

SEQ ID NO: 626683 - DNA, 20 bp, mouse
ggagaagggagagggacccg

SEQ ID NO: 626684 - DNA, 20 bp, mouse
gacggcggcgcagccggccc

SEQ ID NO: 626685 - DNA, 20 bp, mouse
gcgggacgctttacttgagg

SEQ ID NO: 626686 - DNA, 20 bp, mouse
ggacggcccgacacgtccca

SEQ ID NO: 626687 - DNA, 20 bp, mouse
gtcgggccgtcgggtaactt

SEQ ID NO: 626688 - DNA, 20 bp, mouse
gaagtgtgacgccaaggaca

SEQ ID NO: 626689 - DNA, 20 bp, mouse
gggacagccctgggacgtgt

SEQ ID NO: 626690 - DNA, 20 bp, mouse
gcctgaccgaagttacccga

SEQ ID NO: 626691 - DNA, 20 bp, mouse
gtcccagggctgtccgatcg

SEQ ID NO: 626692 - DNA, 20 bp, mouse
gggtaacttcggtcaggacc

SEQ ID NO: 626693 - DNA, 20 bp, mouse
gtctcaggactggctagtaa

SEQ ID NO: 626694 - DNA, 20 bp, mouse
ggccgcgatcggacagccct

SEQ ID NO: 626695 - DNA, 20 bp, mouse
gatcgcggccgccatgtcct

SEQ ID NO: 626696 - DNA, 20 bp, mouse
ggcccagggatgccaagtcc

SEQ ID NO: 626697 - DNA, 20 bp, mouse
gagcatgcacgcgacaggtt

SEQ ID NO: 626698 - DNA, 20 bp, mouse
ggcgggcccattccaaactg

SEQ ID NO: 626699 - DNA, 20 bp, mouse
gagggatgccaagtccgggt

SEQ ID NO: 626700 - DNA, 20 bp, mouse
gatgcacgcgacaggtttgg

SEQ ID NO: 626701 - DNA, 20 bp, mouse
gtggcgaggtcactccaggt

SEQ ID NO: 626702 - DNA, 20 bp, mouse
gtagggggcgcatcgcgggt

SEQ ID NO: 626703 - DNA, 20 bp, mouse
ggggccgtactgtggagcgt

SEQ ID NO: 626704 - DNA, 20 bp, mouse
ggctgtggcgttctcggccg

SEQ ID NO: 626705 - DNA, 20 bp, mouse
ggtggctggctgaggagatc

SEQ ID NO: 626706 - DNA, 20 bp, mouse
gggcctgggatgctctgcac

SEQ ID NO: 626707 - DNA, 20 bp, mouse
gaggtccaactgtccaggaa

SEQ ID NO: 626708 - DNA, 20 bp, mouse
gcaactgtccaggaaaggtt

SEQ ID NO: 626709 - DNA, 20 bp, mouse
gctgagaggtgagggcgtca

SEQ ID NO: 626710 - DNA, 20 bp, mouse
gggaagaggtccaactgtcc

SEQ ID NO: 626711 - DNA, 20 bp, mouse
ggccctcacctctcaggaag

SEQ ID NO: 626712 - DNA, 20 bp, mouse
gagttggacctcttcctgag

SEQ ID NO: 626713 - DNA, 20 bp, mouse
gccctgcagtcagggatcta

SEQ ID NO: 626714 - DNA, 20 bp, mouse
gtagccggtcagtccaatcc

SEQ ID NO: 626715 - DNA, 20 bp, mouse
gcccggaagccggagatccg

SEQ ID NO: 626716 - DNA, 20 bp, mouse
gtagccacgccagcttaggt

SEQ ID NO: 626717 - DNA, 20 bp, mouse
ggcttaggtaggctcaggtg

SEQ ID NO: 626718 - DNA, 20 bp, mouse
ggcaatagccacgccagctt

SEQ ID NO: 626719 - DNA, 20 bp, mouse
gcgccagcttaggtaggctc

SEQ ID NO: 626720 - DNA, 20 bp, mouse
ggctctgaagggaagtcgag

SEQ ID NO: 626721 - DNA, 20 bp, mouse
gccgttgtgtggagaagggt

SEQ ID NO: 626722 - DNA, 20 bp, mouse
gctgcatggagcctaataca

SEQ ID NO: 626723 - DNA, 20 bp, mouse
gggtgagtggagcccggaag

SEQ ID NO: 626724 - DNA, 20 bp, mouse
gtctagcttaggactgaggt

SEQ ID NO: 626725 - DNA, 20 bp, mouse
gtggagcctaatacacggaa

SEQ ID NO: 626726 - DNA, 20 bp, mouse
gcgaccgcccgggcaaggtg

SEQ ID NO: 626727 - DNA, 20 bp, mouse
gtgcgacccgggtccgaggg

SEQ ID NO: 626728 - DNA, 20 bp, mouse
ggatccgccgggacgccgaa

SEQ ID NO: 626729 - DNA, 20 bp, mouse
gttcagaggggcgaccgccc

SEQ ID NO: 626730 - DNA, 20 bp, mouse
ggcgtgcgacccgggtccga

SEQ ID NO: 626731 - DNA, 20 bp, mouse
ggtgctggcccggaatgggg

SEQ ID NO: 626732 - DNA, 20 bp, mouse
ggcggatccccaccttgccc

SEQ ID NO: 626733 - DNA, 20 bp, mouse
ggacgccgaagggagaaacc

SEQ ID NO: 626734 - DNA, 20 bp, mouse
gcaagtggggccaaacatcc

SEQ ID NO: 626735 - DNA, 20 bp, mouse
gaggggcgaccgcccgggca

SEQ ID NO: 626736 - DNA, 20 bp, mouse
gcgcacccgaggccagccgg

SEQ ID NO: 626737 - DNA, 20 bp, mouse
ggcctcgggtgcgacctggt

SEQ ID NO: 626738 - DNA, 20 bp, mouse
gcgacctggtcggcagccag

SEQ ID NO: 626739 - DNA, 20 bp, mouse
ggaaggcccagggagcacag

SEQ ID NO: 626740 - DNA, 20 bp, mouse
ggcgtccgccgaagacacaa

SEQ ID NO: 626741 - DNA, 20 bp, mouse
ggtgcttgggtgctcgccac

SEQ ID NO: 626742 - DNA, 20 bp, mouse
ggccgaccaggtcgcacccg

SEQ ID NO: 626743 - DNA, 20 bp, mouse
gacaaaggtgaagtccccgt

SEQ ID NO: 626744 - DNA, 20 bp, mouse
gcagcctctggctgccgacc

SEQ ID NO: 626745 - DNA, 20 bp, mouse
gggtcgcacccgaggccagc

SEQ ID NO: 626746 - DNA, 20 bp, mouse
gaactcagctccagacccgg

SEQ ID NO: 626747 - DNA, 20 bp, mouse
gtagcaacagggctaccgcc

SEQ ID NO: 626748 - DNA, 20 bp, mouse
gtccaactcagctccagacc

SEQ ID NO: 626749 - DNA, 20 bp, mouse
gcctgtgacacgtagcaaca

SEQ ID NO: 626750 - DNA, 20 bp, mouse
gcagaggcgaggtcacgcgt

SEQ ID NO: 626751 - DNA, 20 bp, mouse
gacagggctaccgccgggtc

SEQ ID NO: 626752 - DNA, 20 bp, mouse
ggggtctggagagggagtag

SEQ ID NO: 626753 - DNA, 20 bp, mouse
gcgcagctccgggtctggag

SEQ ID NO: 626754 - DNA, 20 bp, mouse
gggccgcgcagctccgggtc

SEQ ID NO: 626755 - DNA, 20 bp, mouse
gtgcggactgcggttcccgg

SEQ ID NO: 626756 - DNA, 20 bp, mouse
ggactctccgggagaacagg

SEQ ID NO: 626757 - DNA, 20 bp, mouse
gcggaagcggaggactctcc

SEQ ID NO: 626758 - DNA, 20 bp, mouse
ggaggactctccgggagaac

SEQ ID NO: 626759 - DNA, 20 bp, mouse
gtgtcctcttaactcaccag

SEQ ID NO: 626760 - DNA, 20 bp, mouse
gtcgcagagacgcatgggag

SEQ ID NO: 626761 - DNA, 20 bp, mouse
gtggaggtttatcaagatgg

SEQ ID NO: 626762 - DNA, 20 bp, mouse
gaagcccctggtgagttaag

SEQ ID NO: 626763 - DNA, 20 bp, mouse
gccgctgcctcctgttctcc

SEQ ID NO: 626764 - DNA, 20 bp, mouse
gggcacagaaggccagcgaa

SEQ ID NO: 626765 - DNA, 20 bp, mouse
gatcaagatggcggaagcgg

SEQ ID NO: 626766 - DNA, 20 bp, mouse
gcttccctcatagcatacat

SEQ ID NO: 626767 - DNA, 20 bp, mouse
gatacctatgtatgctatga

SEQ ID NO: 626768 - DNA, 20 bp, mouse
gggaaatgaaagctaatcag

SEQ ID NO: 626769 - DNA, 20 bp, mouse
ggttcagctacgtttgttgg

SEQ ID NO: 626770 - DNA, 20 bp, mouse
gcaagttcagctacgtttgt

SEQ ID NO: 626771 - DNA, 20 bp, mouse
gttatgggctgagaaacata

SEQ ID NO: 626772 - DNA, 20 bp, mouse
gcagagagcctggctaaagt

SEQ ID NO: 626773 - DNA, 20 bp, mouse
ggggtgaaaagatgacgcac

SEQ ID NO: 626774 - DNA, 20 bp, mouse
gaatggagctcttagagtta

SEQ ID NO: 626775 - DNA, 20 bp, mouse
gcatgaagtagctacgagtt

SEQ ID NO: 626776 - DNA, 20 bp, mouse
gacctctgcggaaggagaca

SEQ ID NO: 626777 - DNA, 20 bp, mouse
gcggaaggagacacggctca

SEQ ID NO: 626778 - DNA, 20 bp, mouse
ggcgcggttcctaacctctg

SEQ ID NO: 626779 - DNA, 20 bp, mouse
ggccgtgtctccttccgcag

SEQ ID NO: 626780 - DNA, 20 bp, mouse
gccctcaggctgggatgcgg

SEQ ID NO: 626781 - DNA, 20 bp, mouse
ggaggctggcggagacgcaa

SEQ ID NO: 626782 - DNA, 20 bp, mouse
ggcagtggaaatggtgtagt

SEQ ID NO: 626783 - DNA, 20 bp, mouse
ggaacctgccggctacaaag

SEQ ID NO: 626784 - DNA, 20 bp, mouse
gggcggagacgcaaaggacg

SEQ ID NO: 626785 - DNA, 20 bp, mouse
gccgccctcaggctgggatg

SEQ ID NO: 626786 - DNA, 20 bp, mouse
ggccgggccccgtcaggagg

SEQ ID NO: 626787 - DNA, 20 bp, mouse
gcagtccctcagaacagcgg

SEQ ID NO: 626788 - DNA, 20 bp, mouse
gaagtgggccttactctagg

SEQ ID NO: 626789 - DNA, 20 bp, mouse
gcggaagtgggccttactct

SEQ ID NO: 626790 - DNA, 20 bp, mouse
gccggccgggccccgtcagg

SEQ ID NO: 626791 - DNA, 20 bp, mouse
gcggcggccgcctcctgacg

SEQ ID NO: 626792 - DNA, 20 bp, mouse
ggctcctgggagcgggtctg

SEQ ID NO: 626793 - DNA, 20 bp, mouse
ggcggccgccgctgttctga

SEQ ID NO: 626794 - DNA, 20 bp, mouse
ggggagtcgagtctctcgaa

SEQ ID NO: 626795 - DNA, 20 bp, mouse
gtggctggacccggagtcca

SEQ ID NO: 626796 - DNA, 20 bp, mouse
gaggccgcggagcgtgtgaa

SEQ ID NO: 626797 - DNA, 20 bp, mouse
gacacgctccgcggcctgta

SEQ ID NO: 626798 - DNA, 20 bp, mouse
gccaggagccgcggcggtga

SEQ ID NO: 626799 - DNA, 20 bp, mouse
gcggcgacagccggaactcg

SEQ ID NO: 626800 - DNA, 20 bp, mouse
gaaccgacctccaggagccg

SEQ ID NO: 626801 - DNA, 20 bp, mouse
gggtcggttgcgacgagtaa

SEQ ID NO: 626802 - DNA, 20 bp, mouse
gtgtaaggcaccgcgagttc

SEQ ID NO: 626803 - DNA, 20 bp, mouse
ggaaggcgcggggctcgtcc

SEQ ID NO: 626804 - DNA, 20 bp, mouse
gcgcggtgccttacaggccg

SEQ ID NO: 626805 - DNA, 20 bp, mouse
gcctcgggaagcgccaccgg

SEQ ID NO: 626806 - DNA, 20 bp, mouse
gtcgtttctgggaggagtaa

SEQ ID NO: 626807 - DNA, 20 bp, mouse
gtcgtagcagctgtcgggag

SEQ ID NO: 626808 - DNA, 20 bp, mouse
gggctgcacagtgctcgaca

SEQ ID NO: 626809 - DNA, 20 bp, mouse
gatctgccccggaagaccat

SEQ ID NO: 626810 - DNA, 20 bp, mouse
gctgtacctatggtcttccg

SEQ ID NO: 626811 - DNA, 20 bp, mouse
gtctagctcatgcggaggga

SEQ ID NO: 626812 - DNA, 20 bp, mouse
gtgtcgtcgtagcagctgtc

SEQ ID NO: 626813 - DNA, 20 bp, mouse
gcctcccagaaacgaaaaaa

SEQ ID NO: 626814 - DNA, 20 bp, mouse
gctggccggtaagatctcga

SEQ ID NO: 626815 - DNA, 20 bp, mouse
ggctacgacgacatctgccc

SEQ ID NO: 626816 - DNA, 20 bp, mouse
gacggcgcgggctcttaaag

SEQ ID NO: 626817 - DNA, 20 bp, mouse
gcaagggcggccgcgggtga

SEQ ID NO: 626818 - DNA, 20 bp, mouse
gtctcccgagcgctccggtg

SEQ ID NO: 626819 - DNA, 20 bp, mouse
gtcgcctcaccggagcgctc

SEQ ID NO: 626820 - DNA, 20 bp, mouse
gggtgaggcgagcttcgcgt

SEQ ID NO: 626821 - DNA, 20 bp, mouse
gtccgctgcaaggccaaggg

SEQ ID NO: 626822 - DNA, 20 bp, mouse
ggcctcggtccttccaaaaa

SEQ ID NO: 626823 - DNA, 20 bp, mouse
gggcggccgcgggtgagggt

SEQ ID NO: 626824 - DNA, 20 bp, mouse
gacagcgccggagtaaccag

SEQ ID NO: 626825 - DNA, 20 bp, mouse
gggcgctgtcccccagtctg

SEQ ID NO: 626826 - DNA, 20 bp, mouse
gcaggcggcccgcgaggcgg

SEQ ID NO: 626827 - DNA, 20 bp, mouse
ggctacgggtccaaaacaaa

SEQ ID NO: 626828 - DNA, 20 bp, mouse
ggatgcctcgcgcccggagt

SEQ ID NO: 626829 - DNA, 20 bp, mouse
gggccgttggcgcccactcc

SEQ ID NO: 626830 - DNA, 20 bp, mouse
ggcggagcggccgtgagtac

SEQ ID NO: 626831 - DNA, 20 bp, mouse
gcgggtccaaaacaaagggc

SEQ ID NO: 626832 - DNA, 20 bp, mouse
gaaagggcaggcggcccgcg

SEQ ID NO: 626833 - DNA, 20 bp, mouse
gcggggctcggacactgatt

SEQ ID NO: 626834 - DNA, 20 bp, mouse
gaggcggggaagcacctgtt

SEQ ID NO: 626835 - DNA, 20 bp, mouse
gggcgcagcggaccgcggag

SEQ ID NO: 626836 - DNA, 20 bp, mouse
ggattcggagggatgcggag

SEQ ID NO: 626837 - DNA, 20 bp, mouse
gggatgcggagcggcagtgg

SEQ ID NO: 626838 - DNA, 20 bp, mouse
ggcccggattcggagggatg

SEQ ID NO: 626839 - DNA, 20 bp, mouse
gaggagcccgaccgtcccca

SEQ ID NO: 626840 - DNA, 20 bp, mouse
gtgctgtcgcggtcccgagg

SEQ ID NO: 626841 - DNA, 20 bp, mouse
gttggcgatgaaggactgca

SEQ ID NO: 626842 - DNA, 20 bp, mouse
gcccccagcccggattcgga

SEQ ID NO: 626843 - DNA, 20 bp, mouse
gcgcacagcccgaactggag

SEQ ID NO: 626844 - DNA, 20 bp, mouse
gcagggcgcacagcccgaac

SEQ ID NO: 626845 - DNA, 20 bp, mouse
gggtgggtcacgccgaacaa

SEQ ID NO: 626846 - DNA, 20 bp, mouse
gtctcggtgtaaacaagtcg

SEQ ID NO: 626847 - DNA, 20 bp, mouse
gcggtgtaaacaagtcgagg

SEQ ID NO: 626848 - DNA, 20 bp, mouse
gagtggggggcgctcctgat

SEQ ID NO: 626849 - DNA, 20 bp, mouse
ggtcgaggcggctgtgaacc

SEQ ID NO: 626850 - DNA, 20 bp, mouse
gaagagggtcccctagagag

SEQ ID NO: 626851 - DNA, 20 bp, mouse
gaggcggctgtgaaccgggc

SEQ ID NO: 626852 - DNA, 20 bp, mouse
gggcgccgtcccccccggcc

SEQ ID NO: 626853 - DNA, 20 bp, mouse
gacctggggcgaggggatgg

SEQ ID NO: 626854 - DNA, 20 bp, mouse
gcccaggccaggccaccccg

SEQ ID NO: 626855 - DNA, 20 bp, mouse
gtcgccccaggtgagccccg

SEQ ID NO: 626856 - DNA, 20 bp, mouse
gaggctggacagctgctggg

SEQ ID NO: 626857 - DNA, 20 bp, mouse
gctcggtctgtgggtaaatg

SEQ ID NO: 626858 - DNA, 20 bp, mouse
ggcagacctcaaggtgaggg

SEQ ID NO: 626859 - DNA, 20 bp, mouse
ggctctgtacctcggtctgt

SEQ ID NO: 626860 - DNA, 20 bp, mouse
gtagttgaggggctgaggtc

SEQ ID NO: 626861 - DNA, 20 bp, mouse
gggctgaggtctgggactgc

SEQ ID NO: 626862 - DNA, 20 bp, mouse
gtgcctcttgctctgtacct

SEQ ID NO: 626863 - DNA, 20 bp, mouse
gatctctggagcagacctca

SEQ ID NO: 626864 - DNA, 20 bp, mouse
gagagatagacggagatctc

SEQ ID NO: 626865 - DNA, 20 bp, mouse
gggagcagacctcaaggtga

SEQ ID NO: 626866 - DNA, 20 bp, mouse
gccctggacgagtggagaag

SEQ ID NO: 626867 - DNA, 20 bp, mouse
ggtgggcttcgacccagctg

SEQ ID NO: 626868 - DNA, 20 bp, mouse
gccgaggcccgaccgaggag

SEQ ID NO: 626869 - DNA, 20 bp, mouse
gctgaggagcgaagagctgc

SEQ ID NO: 626870 - DNA, 20 bp, mouse
ggctgggtcgaagcccacct

SEQ ID NO: 626871 - DNA, 20 bp, mouse
gtgactaaacctgaagactt

SEQ ID NO: 626872 - DNA, 20 bp, mouse
gagctcttcgctcctcagct

SEQ ID NO: 626873 - DNA, 20 bp, mouse
gagcacgccggtgagtacgg

SEQ ID NO: 626874 - DNA, 20 bp, mouse
gtcaccggcgtgctgggaat

SEQ ID NO: 626875 - DNA, 20 bp, mouse
gcccagcacgccggtgagta

SEQ ID NO: 626876 - DNA, 20 bp, mouse
gctcaggagggcgtaggagg

SEQ ID NO: 626877 - DNA, 20 bp, mouse
gcccatgccggccgccacgg

SEQ ID NO: 626878 - DNA, 20 bp, mouse
gaaccccatgccggccgcca

SEQ ID NO: 626879 - DNA, 20 bp, mouse
gcgccggagcgggctcagga

SEQ ID NO: 626880 - DNA, 20 bp, mouse
gagccgcggccagaactagc

SEQ ID NO: 626881 - DNA, 20 bp, mouse
ggccaggccgtagagcgtgt

SEQ ID NO: 626882 - DNA, 20 bp, mouse
gtccgggaggaagtgacgca

SEQ ID NO: 626883 - DNA, 20 bp, mouse
gcgtccgtgcgcggggctga

SEQ ID NO: 626884 - DNA, 20 bp, mouse
gtcccggaagcggctcggca

SEQ ID NO: 626885 - DNA, 20 bp, mouse
gccgtcgctcaaccccatgc

SEQ ID NO: 626886 - DNA, 20 bp, mouse
gttcggccaccacagagaca

SEQ ID NO: 626887 - DNA, 20 bp, mouse
gcacagatggcgacgccggg

SEQ ID NO: 626888 - DNA, 20 bp, mouse
gagacacagatggcgacgcc

SEQ ID NO: 626889 - DNA, 20 bp, mouse
gacgccgggcggcgctaaaa

SEQ ID NO: 626890 - DNA, 20 bp, mouse
gctcccccttgtctctgtgg

SEQ ID NO: 626891 - DNA, 20 bp, mouse
gaaccagagcacgggaggaa

SEQ ID NO: 626892 - DNA, 20 bp, mouse
gaagctgagtggagcaggtc

SEQ ID NO: 626893 - DNA, 20 bp, mouse
gttgcgcgtaggaagctgag

SEQ ID NO: 626894 - DNA, 20 bp, mouse
gagccggagggcagccatgg

SEQ ID NO: 626895 - DNA, 20 bp, mouse
ggtggtggccgaaccccaac

SEQ ID NO: 626896 - DNA, 20 bp, mouse
gaaagcgccgctcacggcag

SEQ ID NO: 626897 - DNA, 20 bp, mouse
ggctcggaagacagcgccgg

SEQ ID NO: 626898 - DNA, 20 bp, mouse
ggcggtggaagcgaaagcgc

SEQ ID NO: 626899 - DNA, 20 bp, mouse
ggcccgcccgcagcttctct

SEQ ID NO: 626900 - DNA, 20 bp, mouse
gcagcttctctgggttagag

SEQ ID NO: 626901 - DNA, 20 bp, mouse
ggcgccgctcacggcagcgg

SEQ ID NO: 626902 - DNA, 20 bp, mouse
gcttccaccgctgccgtgag

SEQ ID NO: 626903 - DNA, 20 bp, mouse
gagacagcgccgggggcgac

SEQ ID NO: 626904 - DNA, 20 bp, mouse
gtccgctacggtgaccagag

SEQ ID NO: 626905 - DNA, 20 bp, mouse
gcgcgtccgccggctcctag

SEQ ID NO: 626906 - DNA, 20 bp, mouse
gaacagcgggaagcagcgga

SEQ ID NO: 626907 - DNA, 20 bp, mouse
ggcagcggaaggtagcggac

SEQ ID NO: 626908 - DNA, 20 bp, mouse
gggcacgcgggccggaacag

SEQ ID NO: 626909 - DNA, 20 bp, mouse
gccgcggccgccattggagt

SEQ ID NO: 626910 - DNA, 20 bp, mouse
gggggcgccgactccaatgg

SEQ ID NO: 626911 - DNA, 20 bp, mouse
gaggtagcggacaggctgag

SEQ ID NO: 626912 - DNA, 20 bp, mouse
ggagggggcgccgactccaa

SEQ ID NO: 626913 - DNA, 20 bp, mouse
gccgagacgcccctacctgg

SEQ ID NO: 626914 - DNA, 20 bp, mouse
gagcttcgtcccagccgccg

SEQ ID NO: 626915 - DNA, 20 bp, mouse
ggcggcagctgtaggcacgc

SEQ ID NO: 626916 - DNA, 20 bp, mouse
gacgggagcagagggtgcgg

SEQ ID NO: 626917 - DNA, 20 bp, mouse
ggacactcggagcctcgcct

SEQ ID NO: 626918 - DNA, 20 bp, mouse
ggtctctgctgcgtccgccg

SEQ ID NO: 626919 - DNA, 20 bp, mouse
gactcggagcctcgcctcgg

SEQ ID NO: 626920 - DNA, 20 bp, mouse
gtcctcacggggaacgacgg

SEQ ID NO: 626921 - DNA, 20 bp, mouse
ggccccgacgacgggagcag

SEQ ID NO: 626922 - DNA, 20 bp, mouse
gcccgtctcgcctcacacaa

SEQ ID NO: 626923 - DNA, 20 bp, mouse
ggagacacagcgcgcgactc

SEQ ID NO: 626924 - DNA, 20 bp, mouse
gccacccggcagccacacga

SEQ ID NO: 626925 - DNA, 20 bp, mouse
ggccgcggcccggccaggag

SEQ ID NO: 626926 - DNA, 20 bp, mouse
gacggcccggagcggaagtg

SEQ ID NO: 626927 - DNA, 20 bp, mouse
gttgtgggcccgaggatcgg

SEQ ID NO: 626928 - DNA, 20 bp, mouse
gccattgtgggcccgaggat

SEQ ID NO: 626929 - DNA, 20 bp, mouse
ggaggatcggaggacgagcg

SEQ ID NO: 626930 - DNA, 20 bp, mouse
gggcgcctgtccgccattgt

SEQ ID NO: 626931 - DNA, 20 bp, mouse
gcgggcccacaatggcggac

SEQ ID NO: 626932 - DNA, 20 bp, mouse
ggcggggacgagcagtgtgc

SEQ ID NO: 626933 - DNA, 20 bp, mouse
gacgctcgggagtcgcggaa

SEQ ID NO: 626934 - DNA, 20 bp, mouse
gactagcgtggatcaggtga

SEQ ID NO: 626935 - DNA, 20 bp, mouse
gtggacgtcagactggatag

SEQ ID NO: 626936 - DNA, 20 bp, mouse
gtacccggctccggaatcgg

SEQ ID NO: 626937 - DNA, 20 bp, mouse
gggctacccggctccggaat

SEQ ID NO: 626938 - DNA, 20 bp, mouse
gaccgccgccactgccccta

SEQ ID NO: 626939 - DNA, 20 bp, mouse
gccggctccggaatcggcgg

SEQ ID NO: 626940 - DNA, 20 bp, mouse
gcggcggtggcagcgaccgt

SEQ ID NO: 626941 - DNA, 20 bp, mouse
gctggccgcagcccgacaag

SEQ ID NO: 626942 - DNA, 20 bp, mouse
gcgcttccgggaagatcaga

SEQ ID NO: 626943 - DNA, 20 bp, mouse
gtgggctagagcggaagtgg

SEQ ID NO: 626944 - DNA, 20 bp, mouse
gctcaccgcggaggactgga

SEQ ID NO: 626945 - DNA, 20 bp, mouse
gagtgcggcgtggctcccag

SEQ ID NO: 626946 - DNA, 20 bp, mouse
gtctgcgcgacggatggaag

SEQ ID NO: 626947 - DNA, 20 bp, mouse
gtccggcagggtctgcgcga

SEQ ID NO: 626948 - DNA, 20 bp, mouse
ggcagggtctgcgcgacgga

SEQ ID NO: 626949 - DNA, 20 bp, mouse
gccgggaaccggagacaaaa

SEQ ID NO: 626950 - DNA, 20 bp, mouse
gagcaggccgagcgatacga

SEQ ID NO: 626951 - DNA, 20 bp, mouse
ggcccacagaggccgggaac

SEQ ID NO: 626952 - DNA, 20 bp, mouse
gtccattgcggcagcggctc

SEQ ID NO: 626953 - DNA, 20 bp, mouse
gtcctcccgatcatccattg

SEQ ID NO: 626954 - DNA, 20 bp, mouse
ggctgccgcaatggatgatc

SEQ ID NO: 626955 - DNA, 20 bp, mouse
gcgcgtccgagcaggaaaaa

SEQ ID NO: 626956 - DNA, 20 bp, mouse
ggaagcaagctactgagacg

SEQ ID NO: 626957 - DNA, 20 bp, mouse
ggcaagctactgagacgagg

SEQ ID NO: 626958 - DNA, 20 bp, mouse
gtactgagacgaggaggaga

SEQ ID NO: 626959 - DNA, 20 bp, mouse
gcgcgggacccggcgcaagg

SEQ ID NO: 626960 - DNA, 20 bp, mouse
ggagctgcgaccgcgggacc

SEQ ID NO: 626961 - DNA, 20 bp, mouse
gtcacagggctgaagaggat

SEQ ID NO: 626962 - DNA, 20 bp, mouse
gcgtggaaggcatgctccag

SEQ ID NO: 626963 - DNA, 20 bp, mouse
gcccagccccgaactcggag

SEQ ID NO: 626964 - DNA, 20 bp, mouse
ggtccgcccgcggcacgcat

SEQ ID NO: 626965 - DNA, 20 bp, mouse
ggcggtccaccatcttcaca

SEQ ID NO: 626966 - DNA, 20 bp, mouse
ggccagcgagaaggcgcgag

SEQ ID NO: 626967 - DNA, 20 bp, mouse
ggtgcagccagccagcgaga

SEQ ID NO: 626968 - DNA, 20 bp, mouse
ggccgctcgcgccttctcgc

SEQ ID NO: 626969 - DNA, 20 bp, mouse
ggccgccgagagaggatagg

SEQ ID NO: 626970 - DNA, 20 bp, mouse
gggagccgccgagagaggat

SEQ ID NO: 626971 - DNA, 20 bp, mouse
gccggccaggccgcaggaaa

SEQ ID NO: 626972 - DNA, 20 bp, mouse
gggcgccccctatcctctct

SEQ ID NO: 626973 - DNA, 20 bp, mouse
gcaggaaacggagagtccag

SEQ ID NO: 626974 - DNA, 20 bp, mouse
gggccgccgcgcccaaaagg

SEQ ID NO: 626975 - DNA, 20 bp, mouse
ggcactggctcgccggctgg

SEQ ID NO: 626976 - DNA, 20 bp, mouse
gagtggtgggactcgcgtcg

SEQ ID NO: 626977 - DNA, 20 bp, mouse
gcaaagcagatcaaagtggt

SEQ ID NO: 626978 - DNA, 20 bp, mouse
ggtgctaggctgagacggga

SEQ ID NO: 626979 - DNA, 20 bp, mouse
gagcccaaagcagatcaaag

SEQ ID NO: 626980 - DNA, 20 bp, mouse
ggggctgggacgggaaggtg

SEQ ID NO: 626981 - DNA, 20 bp, mouse
gacccggcctcggtacctcg

SEQ ID NO: 626982 - DNA, 20 bp, mouse
gcgggaaggtgcggcaccaa

SEQ ID NO: 626983 - DNA, 20 bp, mouse
gtggtcggtggcgagctcgt

SEQ ID NO: 626984 - DNA, 20 bp, mouse
gacccggcccaagatggaag

SEQ ID NO: 626985 - DNA, 20 bp, mouse
gtgagtgcggacacagctct

SEQ ID NO: 626986 - DNA, 20 bp, mouse
ggcccacgcgcgagacccag

SEQ ID NO: 626987 - DNA, 20 bp, mouse
gcgccgggccggagaactgt

SEQ ID NO: 626988 - DNA, 20 bp, mouse
gacagccgctccgcagacac

SEQ ID NO: 626989 - DNA, 20 bp, mouse
gcagccgcggggacaatggg

SEQ ID NO: 626990 - DNA, 20 bp, mouse
gcaccccggggaccagaacg

SEQ ID NO: 626991 - DNA, 20 bp, mouse
gtgctgccggggctagtgat

SEQ ID NO: 626992 - DNA, 20 bp, mouse
gagggaccggaggccgactc

SEQ ID NO: 626993 - DNA, 20 bp, mouse
gtgccggggctagtgattgg

SEQ ID NO: 626994 - DNA, 20 bp, mouse
gtcctgagaagacccctctc

SEQ ID NO: 626995 - DNA, 20 bp, mouse
gtgatcagaagccgagagta

SEQ ID NO: 626996 - DNA, 20 bp, mouse
gtcctgggctgcgggaggga

SEQ ID NO: 626997 - DNA, 20 bp, mouse
ggagccgaggccgcctgccg

SEQ ID NO: 626998 - DNA, 20 bp, mouse
ggagccggagcagagtgtgg

SEQ ID NO: 626999 - DNA, 20 bp, mouse
ggccgagccggagcagagtg

SEQ ID NO: 627000 - DNA, 20 bp, mouse
gagggtgtcgcccgaggcca

SEQ ID NO: 627001 - DNA, 20 bp, mouse
ggcggcggcggcgaccacgg

SEQ ID NO: 627002 - DNA, 20 bp, mouse
ggagctgcatgagatcgagg

SEQ ID NO: 627003 - DNA, 20 bp, mouse
ggaggtggagaccatcccgg

SEQ ID NO: 627004 - DNA, 20 bp, mouse
gggcggcggcggcgagatct

SEQ ID NO: 627005 - DNA, 20 bp, mouse
gtcgggtcgtccgtcaccag

SEQ ID NO: 627006 - DNA, 20 bp, mouse
ggtagtgcctcagacgacgg

SEQ ID NO: 627007 - DNA, 20 bp, mouse
gaccgtagtgcctcagacga

SEQ ID NO: 627008 - DNA, 20 bp, mouse
ggaaaagccgccgtcgtctg

SEQ ID NO: 627009 - DNA, 20 bp, mouse
ggaagcgcacggctttcgtc

SEQ ID NO: 627010 - DNA, 20 bp, mouse
gggctttcgtcaggctctct

SEQ ID NO: 627011 - DNA, 20 bp, mouse
ggtcctgggtagcaagcagg

SEQ ID NO: 627012 - DNA, 20 bp, mouse
gtggagtagagaaaaaatca

SEQ ID NO: 627013 - DNA, 20 bp, mouse
gtatcaccgatattatccgg

SEQ ID NO: 627014 - DNA, 20 bp, mouse
gtcaggctgctgcccacaag

SEQ ID NO: 627015 - DNA, 20 bp, mouse
gggcactacggtgtttccgg

SEQ ID NO: 627016 - DNA, 20 bp, mouse
ggcgggcgcacggctgactg

SEQ ID NO: 627017 - DNA, 20 bp, mouse
gcggcgcggagactccgaag

SEQ ID NO: 627018 - DNA, 20 bp, mouse
gtccggagcccgagcgtccc

SEQ ID NO: 627019 - DNA, 20 bp, mouse
gccccagccggcggagtcca

SEQ ID NO: 627020 - DNA, 20 bp, mouse
gtatgccggaaaaagcgcgc

SEQ ID NO: 627021 - DNA, 20 bp, mouse
ggaagctcgggtcgtccgtc

SEQ ID NO: 627022 - DNA, 20 bp, mouse
ggccaccggagcaaagaacc

SEQ ID NO: 627023 - DNA, 20 bp, mouse
gaccaagtcggccaggtaga

SEQ ID NO: 627024 - DNA, 20 bp, mouse
gcgcgcgggcttcttttcct

SEQ ID NO: 627025 - DNA, 20 bp, mouse
ggaagcccgcgcgctttttc

SEQ ID NO: 627026 - DNA, 20 bp, mouse
gatgtcagagatccaaacga

SEQ ID NO: 627027 - DNA, 20 bp, mouse
ggttgtgctgacctaggcta

SEQ ID NO: 627028 - DNA, 20 bp, mouse
gttaacttctccccagagtt

SEQ ID NO: 627029 - DNA, 20 bp, mouse
gctgggcttgttatgagaca

SEQ ID NO: 627030 - DNA, 20 bp, mouse
gtagatagaacacagagtat

SEQ ID NO: 627031 - DNA, 20 bp, mouse
gtccaaacgaaggtttcaac

SEQ ID NO: 627032 - DNA, 20 bp, mouse
gtgcggaagtttgatagcaa

SEQ ID NO: 627033 - DNA, 20 bp, mouse
gatagaacacagagtatagg

SEQ ID NO: 627034 - DNA, 20 bp, mouse
gtcctgttgaaaccttcgtt

SEQ ID NO: 627035 - DNA, 20 bp, mouse
gctgtgcagggtggcgtatc

SEQ ID NO: 627036 - DNA, 20 bp, mouse
gagcgggcggagctgatcgt

SEQ ID NO: 627037 - DNA, 20 bp, mouse
ggcgcgacccggcccagcgt

SEQ ID NO: 627038 - DNA, 20 bp, mouse
gcccagcgtaggcgcaggag

SEQ ID NO: 627039 - DNA, 20 bp, mouse
gacgatggctcgggccccgg

SEQ ID NO: 627040 - DNA, 20 bp, mouse
ggccgagcggagccaagcgg

SEQ ID NO: 627041 - DNA, 20 bp, mouse
ggcgtacgacatgtccacga

SEQ ID NO: 627042 - DNA, 20 bp, mouse
gggagggcggaggaaatcct

SEQ ID NO: 627043 - DNA, 20 bp, mouse
ggagccaagcggcggggact

SEQ ID NO: 627044 - DNA, 20 bp, mouse
ggagcggcactgggcagtcc

SEQ ID NO: 627045 - DNA, 20 bp, mouse
ggacatgtccacgatggctc

SEQ ID NO: 627046 - DNA, 20 bp, mouse
gtcattggcgccgcgcggag

SEQ ID NO: 627047 - DNA, 20 bp, mouse
gctgactccggcggaagcgt

SEQ ID NO: 627048 - DNA, 20 bp, mouse
ggccaatgaggaagacgtcg

SEQ ID NO: 627049 - DNA, 20 bp, mouse
ggccgcgacgtcttcctcat

SEQ ID NO: 627050 - DNA, 20 bp, mouse
gcgatccgggagccaggtaa

SEQ ID NO: 627051 - DNA, 20 bp, mouse
gaatgttcaactcctgactc

SEQ ID NO: 627052 - DNA, 20 bp, mouse
ggttcaactcctgactccgg

SEQ ID NO: 627053 - DNA, 20 bp, mouse
gcgggtctccagggcaccgg

SEQ ID NO: 627054 - DNA, 20 bp, mouse
gaggcgagggtgctcgggaa

SEQ ID NO: 627055 - DNA, 20 bp, mouse
ggcggctcccacgcttccgc

SEQ ID NO: 627056 - DNA, 20 bp, mouse
gtaaggaccggggatcctca

SEQ ID NO: 627057 - DNA, 20 bp, mouse
gtctcctcggtagcaaccat

SEQ ID NO: 627058 - DNA, 20 bp, mouse
gaggatcaagtcacatacta

SEQ ID NO: 627059 - DNA, 20 bp, mouse
gtagcaaccataggttctaa

SEQ ID NO: 627060 - DNA, 20 bp, mouse
gcaagtcacatactaaggac

SEQ ID NO: 627061 - DNA, 20 bp, mouse
ggaacctatggttgctaccg

SEQ ID NO: 627062 - DNA, 20 bp, mouse
gctgctgcctttagaaccta

SEQ ID NO: 627063 - DNA, 20 bp, mouse
gtcccagagctgagacactc

SEQ ID NO: 627064 - DNA, 20 bp, mouse
gcactaagcaagcactatcg

SEQ ID NO: 627065 - DNA, 20 bp, mouse
ggacccgagtgtctcagctc

SEQ ID NO: 627066 - DNA, 20 bp, mouse
gtgggtaggcccaagtggta

SEQ ID NO: 627067 - DNA, 20 bp, mouse
gagggcccagccggaaggcc

SEQ ID NO: 627068 - DNA, 20 bp, mouse
gacggcagggcccagccgga

SEQ ID NO: 627069 - DNA, 20 bp, mouse
gctggtgagaaaaagtgctc

SEQ ID NO: 627070 - DNA, 20 bp, mouse
gcgaggctatcacagctcac

SEQ ID NO: 627071 - DNA, 20 bp, mouse
ggtcttcgcatcaaggaaat

SEQ ID NO: 627072 - DNA, 20 bp, mouse
gactcacctggacaccctcg

SEQ ID NO: 627073 - DNA, 20 bp, mouse
gtggtggagggagtgtgact

SEQ ID NO: 627074 - DNA, 20 bp, mouse
gtctcaggtccctaccactt

SEQ ID NO: 627075 - DNA, 20 bp, mouse
gcacacagagatcagagtaa

SEQ ID NO: 627076 - DNA, 20 bp, mouse
gcctcccgcaacctccagtg

SEQ ID NO: 627077 - DNA, 20 bp, mouse
gagaaggtcacggacgagaa

SEQ ID NO: 627078 - DNA, 20 bp, mouse
gaacctccagtgaggaggag

SEQ ID NO: 627079 - DNA, 20 bp, mouse
ggagaggccacagaaggtca

SEQ ID NO: 627080 - DNA, 20 bp, mouse
gcccgcaacctccagtgagg

SEQ ID NO: 627081 - DNA, 20 bp, mouse
ggaggaggagaggccacaga

SEQ ID NO: 627082 - DNA, 20 bp, mouse
gggcctctcctcctcactgg

SEQ ID NO: 627083 - DNA, 20 bp, mouse
gtgtggcctctcctcctcac

SEQ ID NO: 627084 - DNA, 20 bp, mouse
ggcaggcagacacccacgaa

SEQ ID NO: 627085 - DNA, 20 bp, mouse
gggttgacaggaacccgatc

SEQ ID NO: 627086 - DNA, 20 bp, mouse
gacagtgtctccaggggcca

SEQ ID NO: 627087 - DNA, 20 bp, mouse
gctgttgacagtgtctccag

SEQ ID NO: 627088 - DNA, 20 bp, mouse
gggggccagggtaggtcaaa

SEQ ID NO: 627089 - DNA, 20 bp, mouse
ggggtaggtcaaagggtctg

SEQ ID NO: 627090 - DNA, 20 bp, mouse
gtctgtggtcccatagccac

SEQ ID NO: 627091 - DNA, 20 bp, mouse
gcgcagtgtccacaccacgg

SEQ ID NO: 627092 - DNA, 20 bp, mouse
gggaccccaacctgagtcta

SEQ ID NO: 627093 - DNA, 20 bp, mouse
gtgggagctcccatattctg

SEQ ID NO: 627094 - DNA, 20 bp, mouse
gctacgcagtgtccacacca

SEQ ID NO: 627095 - DNA, 20 bp, mouse
ggagctggttctgtccgaga

SEQ ID NO: 627096 - DNA, 20 bp, mouse
ggcagaggcagctgcaacaa

SEQ ID NO: 627097 - DNA, 20 bp, mouse
gagggtcgcaggtggtgagt

SEQ ID NO: 627098 - DNA, 20 bp, mouse
gctgcaacaagggtcgcagg

SEQ ID NO: 627099 - DNA, 20 bp, mouse
gtggtgagttggaggactaa

SEQ ID NO: 627100 - DNA, 20 bp, mouse
gcagctgcaacaagggtcgc

SEQ ID NO: 627101 - DNA, 20 bp, mouse
ggctgcctctgctctcacca

SEQ ID NO: 627102 - DNA, 20 bp, mouse
ggtaaccaaggagaccaagg

SEQ ID NO: 627103 - DNA, 20 bp, mouse
ggggtgcgtacagcaggtga

SEQ ID NO: 627104 - DNA, 20 bp, mouse
gcctgagccagagcctggtc

SEQ ID NO: 627105 - DNA, 20 bp, mouse
ggagtcctggcgggattggg

SEQ ID NO: 627106 - DNA, 20 bp, mouse
gatgtctgcgaggagcccgg

SEQ ID NO: 627107 - DNA, 20 bp, mouse
gcgaggagcccggaggcgag

SEQ ID NO: 627108 - DNA, 20 bp, mouse
gaggcgaggggcgaccatcg

SEQ ID NO: 627109 - DNA, 20 bp, mouse
ggctcacccggacgccgcga

SEQ ID NO: 627110 - DNA, 20 bp, mouse
gatggtcgcccctcgcctcc

SEQ ID NO: 627111 - DNA, 20 bp, mouse
ggagcgctgtgtctttaagg

SEQ ID NO: 627112 - DNA, 20 bp, mouse
gagcgaccgcagggacacca

SEQ ID NO: 627113 - DNA, 20 bp, mouse
ggacgccacgcaggacctcg

SEQ ID NO: 627114 - DNA, 20 bp, mouse
ggagaaaccgcggggtggag

SEQ ID NO: 627115 - DNA, 20 bp, mouse
ggcatcccctgcagaccccg

SEQ ID NO: 627116 - DNA, 20 bp, mouse
gtgcgcgcgggacgctccag

SEQ ID NO: 627117 - DNA, 20 bp, mouse
ggcccgccgcgcacggacaa

SEQ ID NO: 627118 - DNA, 20 bp, mouse
gcgcgaggcgcagctgtcag

SEQ ID NO: 627119 - DNA, 20 bp, mouse
gggcgcgcgtgtccaggaag

SEQ ID NO: 627120 - DNA, 20 bp, mouse
gccgggccgggcgcagtctc

SEQ ID NO: 627121 - DNA, 20 bp, mouse
gcggccgtcgaagacgccac

SEQ ID NO: 627122 - DNA, 20 bp, mouse
gccgcgcacggacaatggcg

SEQ ID NO: 627123 - DNA, 20 bp, mouse
ggcacggcggtgacacgggt

SEQ ID NO: 627124 - DNA, 20 bp, mouse
ggctccagtggcgtcttcga

SEQ ID NO: 627125 - DNA, 20 bp, mouse
ggcgggcccaggccgcggag

SEQ ID NO: 627126 - DNA, 20 bp, mouse
gcgggaacaccggatgtggg

SEQ ID NO: 627127 - DNA, 20 bp, mouse
gttcccgaaccgggattccc

SEQ ID NO: 627128 - DNA, 20 bp, mouse
gcggggctacccgggaatcc

SEQ ID NO: 627129 - DNA, 20 bp, mouse
ggtgtcagttccccctccgg

SEQ ID NO: 627130 - DNA, 20 bp, mouse
gaagtagtgggaccctagag

SEQ ID NO: 627131 - DNA, 20 bp, mouse
gggaagaggttggtaagtaa

SEQ ID NO: 627132 - DNA, 20 bp, mouse
gcgggagagtaatcagggta

SEQ ID NO: 627133 - DNA, 20 bp, mouse
gagtgggaccctagagagga

SEQ ID NO: 627134 - DNA, 20 bp, mouse
gaatcccggttcgggaacac

SEQ ID NO: 627135 - DNA, 20 bp, mouse
gcctagagaggaaggcgagg

SEQ ID NO: 627136 - DNA, 20 bp, mouse
gcctggggctctgaatccac

SEQ ID NO: 627137 - DNA, 20 bp, mouse
gtgggacccacgcgaggtga

SEQ ID NO: 627138 - DNA, 20 bp, mouse
gcagccttggggctccttta

SEQ ID NO: 627139 - DNA, 20 bp, mouse
gaatggctgcttggacctgc

SEQ ID NO: 627140 - DNA, 20 bp, mouse
gctgccctaaaggagcccca

SEQ ID NO: 627141 - DNA, 20 bp, mouse
gccacgcgaggtgaaggaag

SEQ ID NO: 627142 - DNA, 20 bp, mouse
ggtcccagctgatgtttcta

SEQ ID NO: 627143 - DNA, 20 bp, mouse
gagtttctggcactgtggtc

SEQ ID NO: 627144 - DNA, 20 bp, mouse
gaagcaagctgacttccctg

SEQ ID NO: 627145 - DNA, 20 bp, mouse
gatcagctgggacccacgcg

SEQ ID NO: 627146 - DNA, 20 bp, mouse
gggctgcgccgagacactcc

SEQ ID NO: 627147 - DNA, 20 bp, mouse
gggcagagcccggagtgtct

SEQ ID NO: 627148 - DNA, 20 bp, mouse
gggctgcgggctgcagttga

SEQ ID NO: 627149 - DNA, 20 bp, mouse
ggcggagccgctgggaaggc

SEQ ID NO: 627150 - DNA, 20 bp, mouse
gtttgttgcagcgcagtccc

SEQ ID NO: 627151 - DNA, 20 bp, mouse
gcctccgcccgccttcccag

SEQ ID NO: 627152 - DNA, 20 bp, mouse
gtgcggcaggcgcggctgtg

SEQ ID NO: 627153 - DNA, 20 bp, mouse
gggcagcggagccgctggga

SEQ ID NO: 627154 - DNA, 20 bp, mouse
gtggccgaggcggcgccgac

SEQ ID NO: 627155 - DNA, 20 bp, mouse
gtccggctccccgcaccggt

SEQ ID NO: 627156 - DNA, 20 bp, mouse
ggccgaggcgcggacgcgag

SEQ ID NO: 627157 - DNA, 20 bp, mouse
ggctatgtggcggagcctgg

SEQ ID NO: 627158 - DNA, 20 bp, mouse
gttgtcggctcgctatgtgg

SEQ ID NO: 627159 - DNA, 20 bp, mouse
gccgtccgaccaggccctgg

SEQ ID NO: 627160 - DNA, 20 bp, mouse
gtagcagtaaccgctggagg

SEQ ID NO: 627161 - DNA, 20 bp, mouse
ggagccgacaataaagccgg

SEQ ID NO: 627162 - DNA, 20 bp, mouse
gggccctggcggaggtcgaa

SEQ ID NO: 627163 - DNA, 20 bp, mouse
gttattgtcggctcgctatg

SEQ ID NO: 627164 - DNA, 20 bp, mouse
ggctccgccggctttattgt

SEQ ID NO: 627165 - DNA, 20 bp, mouse
gagcgagccgacaataaagc

SEQ ID NO: 627166 - DNA, 20 bp, mouse
ggctcgtgccgagtgttcca

SEQ ID NO: 627167 - DNA, 20 bp, mouse
gcagcgtcctcgcggactcg

SEQ ID NO: 627168 - DNA, 20 bp, mouse
gcgtcctcgcggactcgggg

SEQ ID NO: 627169 - DNA, 20 bp, mouse
gagcgacgccccccacacac

SEQ ID NO: 627170 - DNA, 20 bp, mouse
gcgcggggccttggaacact

SEQ ID NO: 627171 - DNA, 20 bp, mouse
gtgagaggcgcgtgcaccca

SEQ ID NO: 627172 - DNA, 20 bp, mouse
gggcccaggctagagcgagg

SEQ ID NO: 627173 - DNA, 20 bp, mouse
gaggcgcgccaagactaggg

SEQ ID NO: 627174 - DNA, 20 bp, mouse
gtcccacgcgcagatctccg

SEQ ID NO: 627175 - DNA, 20 bp, mouse
ggcgcagcgcagcgtcctcg

SEQ ID NO: 627176 - DNA, 20 bp, mouse
gagccagctgcaggatgtgg

SEQ ID NO: 627177 - DNA, 20 bp, mouse
ggcgttcccgccgagctccg

SEQ ID NO: 627178 - DNA, 20 bp, mouse
gcgcggtgcgagcgggatcg

SEQ ID NO: 627179 - DNA, 20 bp, mouse
gggccccccacgcccaaccg

SEQ ID NO: 627180 - DNA, 20 bp, mouse
gcccccaccgcggtgcactg

SEQ ID NO: 627181 - DNA, 20 bp, mouse
gggcgcagcgcggtgcgagc

SEQ ID NO: 627182 - DNA, 20 bp, mouse
gaggatgtggcggcgcagcg

SEQ ID NO: 627183 - DNA, 20 bp, mouse
ggggaaaccacagctgcgag

SEQ ID NO: 627184 - DNA, 20 bp, mouse
gtgcggcgcggagagccagg

SEQ ID NO: 627185 - DNA, 20 bp, mouse
gggccggggcggctgcgagg

SEQ ID NO: 627186 - DNA, 20 bp, mouse
ggttgctccggatctcacgg

SEQ ID NO: 627187 - DNA, 20 bp, mouse
ggagttaagggtgacgagag

SEQ ID NO: 627188 - DNA, 20 bp, mouse
ggaaccccgcacgagcccag

SEQ ID NO: 627189 - DNA, 20 bp, mouse
gactgttgctccggatctca

SEQ ID NO: 627190 - DNA, 20 bp, mouse
gcggcagcggcggcatcgcc

SEQ ID NO: 627191 - DNA, 20 bp, mouse
gtgctaacctagcggcagag

SEQ ID NO: 627192 - DNA, 20 bp, mouse
ggtccggtccgggtgagagg

SEQ ID NO: 627193 - DNA, 20 bp, mouse
gccgctgccgccgtgagatc

SEQ ID NO: 627194 - DNA, 20 bp, mouse
ggaccgtgcccggagaagaa

SEQ ID NO: 627195 - DNA, 20 bp, mouse
ggtgcccggagaagaaaggt

SEQ ID NO: 627196 - DNA, 20 bp, mouse
ggcgccgccatgttagaacc

SEQ ID NO: 627197 - DNA, 20 bp, mouse
gccgcccggttctaacatgg

SEQ ID NO: 627198 - DNA, 20 bp, mouse
gacggccgcgagaaggccgg

SEQ ID NO: 627199 - DNA, 20 bp, mouse
gcacagatggaggtgcatca

SEQ ID NO: 627200 - DNA, 20 bp, mouse
gagcgcttcacagcagacaa

SEQ ID NO: 627201 - DNA, 20 bp, mouse
ggttccgcccggttctaaca

SEQ ID NO: 627202 - DNA, 20 bp, mouse
gcccagccgggaagccagcg

SEQ ID NO: 627203 - DNA, 20 bp, mouse
gcgaaccccaccacagatgg

SEQ ID NO: 627204 - DNA, 20 bp, mouse
gcagcgaggtcggttccgcc

SEQ ID NO: 627205 - DNA, 20 bp, mouse
ggctgcccccggccttctcg

SEQ ID NO: 627206 - DNA, 20 bp, mouse
ggtgtctcagcatagtgtgg

SEQ ID NO: 627207 - DNA, 20 bp, mouse
gactgtgtctcagcatagtg

SEQ ID NO: 627208 - DNA, 20 bp, mouse
gcacttgcagaggtagatgt

SEQ ID NO: 627209 - DNA, 20 bp, mouse
gttcagaaggtatcggggtt

SEQ ID NO: 627210 - DNA, 20 bp, mouse
gttccccatcctgggaccaa

SEQ ID NO: 627211 - DNA, 20 bp, mouse
gtttctttcagaaggtatcg

SEQ ID NO: 627212 - DNA, 20 bp, mouse
gtgcctttggtcccaggatg

SEQ ID NO: 627213 - DNA, 20 bp, mouse
gagtcaaaattcatctgtag

SEQ ID NO: 627214 - DNA, 20 bp, mouse
gaaatcttggtttattctat

SEQ ID NO: 627215 - DNA, 20 bp, mouse
gattttctgttggatacctg

SEQ ID NO: 627216 - DNA, 20 bp, mouse
gagtgtgtgcggatctgtgg

SEQ ID NO: 627217 - DNA, 20 bp, mouse
gagtggagatgatgttggag

SEQ ID NO: 627218 - DNA, 20 bp, mouse
ggttagtgtgtgcggatctg

SEQ ID NO: 627219 - DNA, 20 bp, mouse
gtgcggatctgtggtggaga

SEQ ID NO: 627220 - DNA, 20 bp, mouse
gttattctaacacacagaca

SEQ ID NO: 627221 - DNA, 20 bp, mouse
ggcagccagcaagactccga

SEQ ID NO: 627222 - DNA, 20 bp, mouse
gccagcaagactccgaggga

SEQ ID NO: 627223 - DNA, 20 bp, mouse
ggacagggagttagtgtgtg

SEQ ID NO: 627224 - DNA, 20 bp, mouse
gaagagagacagatgcaaag

SEQ ID NO: 627225 - DNA, 20 bp, mouse
gtgcaggtctgttacatcgg

SEQ ID NO: 627226 - DNA, 20 bp, mouse
gccggagacaccgaccgcgg

SEQ ID NO: 627227 - DNA, 20 bp, mouse
ggcgccggagacaccgaccg

SEQ ID NO: 627228 - DNA, 20 bp, mouse
gccggcgcgggaccgctcac

SEQ ID NO: 627229 - DNA, 20 bp, mouse
gggcggcggcggggacagtt

SEQ ID NO: 627230 - DNA, 20 bp, mouse
ggaggggacggaagccgaga

SEQ ID NO: 627231 - DNA, 20 bp, mouse
gagacaccggcgactaggac

SEQ ID NO: 627232 - DNA, 20 bp, mouse
gagccgccggagctcgcaaa

SEQ ID NO: 627233 - DNA, 20 bp, mouse
gcggccaagggcgtccggag

SEQ ID NO: 627234 - DNA, 20 bp, mouse
ggctgggagacgcgccagag

SEQ ID NO: 627235 - DNA, 20 bp, mouse
gcaagggcgtccggagcggg

SEQ ID NO: 627236 - DNA, 20 bp, mouse
gacagcaggggggggtaata

SEQ ID NO: 627237 - DNA, 20 bp, mouse
gttgtagtgtggctttggat

SEQ ID NO: 627238 - DNA, 20 bp, mouse
gcaccgagagagggagcatt

SEQ ID NO: 627239 - DNA, 20 bp, mouse
gtatcgtgatttctaagaag

SEQ ID NO: 627240 - DNA, 20 bp, mouse
ggttgttcaacccatcaagg

SEQ ID NO: 627241 - DNA, 20 bp, mouse
ggcattaggtcacaaggtca

SEQ ID NO: 627242 - DNA, 20 bp, mouse
gcttatggtgcttaattcag

SEQ ID NO: 627243 - DNA, 20 bp, mouse
gttcctgtaccaccgagaga

SEQ ID NO: 627244 - DNA, 20 bp, mouse
gtgagttgttcaacccatca

SEQ ID NO: 627245 - DNA, 20 bp, mouse
ggacctaatgctccctctct

SEQ ID NO: 627246 - DNA, 20 bp, mouse
gaagatggatggaatcacag

SEQ ID NO: 627247 - DNA, 20 bp, mouse
ggacgcccgcaacccactgg

SEQ ID NO: 627248 - DNA, 20 bp, mouse
gtgcgcgagccgagtgtgag

SEQ ID NO: 627249 - DNA, 20 bp, mouse
gcccgacgcccgcaacccac

SEQ ID NO: 627250 - DNA, 20 bp, mouse
gtgagcatgcgtaggagcga

SEQ ID NO: 627251 - DNA, 20 bp, mouse
ggccgagtgtgagcggaaag

SEQ ID NO: 627252 - DNA, 20 bp, mouse
ggcccctttccgctcacact

SEQ ID NO: 627253 - DNA, 20 bp, mouse
gctgcagaggaagcactcaa

SEQ ID NO: 627254 - DNA, 20 bp, mouse
ggcaccccagacgcacaccg

SEQ ID NO: 627255 - DNA, 20 bp, mouse
gcgagggcgaggccaaatgc

SEQ ID NO: 627256 - DNA, 20 bp, mouse
gggagggagtcggcacaaga

SEQ ID NO: 627257 - DNA, 20 bp, mouse
ggggagtcggcacaagatgg

SEQ ID NO: 627258 - DNA, 20 bp, mouse
gcgcgcggccaggtaagcgg

SEQ ID NO: 627259 - DNA, 20 bp, mouse
gagccctggagggtcctgaa

SEQ ID NO: 627260 - DNA, 20 bp, mouse
gctctggtcgcggagtgagg

SEQ ID NO: 627261 - DNA, 20 bp, mouse
gcggggtcgggatcaactgg

SEQ ID NO: 627262 - DNA, 20 bp, mouse
gtaacgtccagagctcgggg

SEQ ID NO: 627263 - DNA, 20 bp, mouse
gaggcggggtcggggatcca

SEQ ID NO: 627264 - DNA, 20 bp, mouse
ggcacaagatggcggcggga

SEQ ID NO: 627265 - DNA, 20 bp, mouse
gatcaactgggggctctagg

SEQ ID NO: 627266 - DNA, 20 bp, mouse
gcggagctacagcgtagtgg

SEQ ID NO: 627267 - DNA, 20 bp, mouse
ggtccggagctacagcgtag

SEQ ID NO: 627268 - DNA, 20 bp, mouse
gtacagcgtagtggtggcgg

SEQ ID NO: 627269 - DNA, 20 bp, mouse
gcccacgcaagggagatcta

SEQ ID NO: 627270 - DNA, 20 bp, mouse
ggaggccccgctctgagcag

SEQ ID NO: 627271 - DNA, 20 bp, mouse
gaacccggaagcgcgcacaa

SEQ ID NO: 627272 - DNA, 20 bp, mouse
gagctacagcgtagtggtgg

SEQ ID NO: 627273 - DNA, 20 bp, mouse
gctcccggcgtctgtcaacc

SEQ ID NO: 627274 - DNA, 20 bp, mouse
gctgcccagagggcactaac

SEQ ID NO: 627275 - DNA, 20 bp, mouse
gttgacagacgccgggagtc

SEQ ID NO: 627276 - DNA, 20 bp, mouse
gaacgcggccctgcccctgt

SEQ ID NO: 627277 - DNA, 20 bp, mouse
gggagtctgggtaagcaacg

SEQ ID NO: 627278 - DNA, 20 bp, mouse
gggcggcccacggccagggg

SEQ ID NO: 627279 - DNA, 20 bp, mouse
gtgagcccggagcagcccac

SEQ ID NO: 627280 - DNA, 20 bp, mouse
gtgcaagtagccggggagag

SEQ ID NO: 627281 - DNA, 20 bp, mouse
gtgcccctgtgggctgctcc

SEQ ID NO: 627282 - DNA, 20 bp, mouse
gccaaggaggacattagcaa

SEQ ID NO: 627283 - DNA, 20 bp, mouse
gccctgactgacatctccaa

SEQ ID NO: 627284 - DNA, 20 bp, mouse
gcggcgggagggactgagcc

SEQ ID NO: 627285 - DNA, 20 bp, mouse
ggcttacccagactccgccg

SEQ ID NO: 627286 - DNA, 20 bp, mouse
gccgaacttacagacccggg

SEQ ID NO: 627287 - DNA, 20 bp, mouse
ggaaggtcgccatctacatc

SEQ ID NO: 627288 - DNA, 20 bp, mouse
gctggcaaaaccaggagctg

SEQ ID NO: 627289 - DNA, 20 bp, mouse
gagatggcgaccttcccccc

SEQ ID NO: 627290 - DNA, 20 bp, mouse
gccccttcccggagccccga

SEQ ID NO: 627291 - DNA, 20 bp, mouse
gggacccaacggaaccggaa

SEQ ID NO: 627292 - DNA, 20 bp, mouse
ggcagcatgggccagtccaa

SEQ ID NO: 627293 - DNA, 20 bp, mouse
gaggccggcagaaaactgaa

SEQ ID NO: 627294 - DNA, 20 bp, mouse
gccctagcccggctctcggg

SEQ ID NO: 627295 - DNA, 20 bp, mouse
gccaggagctgcggcccctc

SEQ ID NO: 627296 - DNA, 20 bp, mouse
gggctaaggactcccaacgt

SEQ ID NO: 627297 - DNA, 20 bp, mouse
ggctgctaggtcgtgggtga

SEQ ID NO: 627298 - DNA, 20 bp, mouse
gctagtagctgctaggtcgt

SEQ ID NO: 627299 - DNA, 20 bp, mouse
gaggcaccggctgagaatcg

SEQ ID NO: 627300 - DNA, 20 bp, mouse
gagttggaggactcattgta

SEQ ID NO: 627301 - DNA, 20 bp, mouse
gttagccttggagttcgaga

SEQ ID NO: 627302 - DNA, 20 bp, mouse
gctctgctagttcctacgtt

SEQ ID NO: 627303 - DNA, 20 bp, mouse
ggaagcacaggctgcttagg

SEQ ID NO: 627304 - DNA, 20 bp, mouse
ggccccctgagcctaacctt

SEQ ID NO: 627305 - DNA, 20 bp, mouse
gagctctcctagtagctgct

SEQ ID NO: 627306 - DNA, 20 bp, mouse
gaagtgggtgaggttgatgt

SEQ ID NO: 627307 - DNA, 20 bp, mouse
gcctgagcagtccttaaagt

SEQ ID NO: 627308 - DNA, 20 bp, mouse
gtgggtgaggttgatgtagg

SEQ ID NO: 627309 - DNA, 20 bp, mouse
ggacccaggttggtcaggag

SEQ ID NO: 627310 - DNA, 20 bp, mouse
ggcagtccttaaagtgggtg

SEQ ID NO: 627311 - DNA, 20 bp, mouse
gctgggctctggcaactgaa

SEQ ID NO: 627312 - DNA, 20 bp, mouse
gctctggcaactgaagggag

SEQ ID NO: 627313 - DNA, 20 bp, mouse
gcctaccctagagaatgcta

SEQ ID NO: 627314 - DNA, 20 bp, mouse
ggagtggccgttacaaaatg

SEQ ID NO: 627315 - DNA, 20 bp, mouse
gccgggaccataacaaaagt

SEQ ID NO: 627316 - DNA, 20 bp, mouse
gcctcctcggggccgaggca

SEQ ID NO: 627317 - DNA, 20 bp, mouse
gactggagcgacatttaaag

SEQ ID NO: 627318 - DNA, 20 bp, mouse
gggccgctttctcctcctcg

SEQ ID NO: 627319 - DNA, 20 bp, mouse
gcgcggagcaggtgaggagt

SEQ ID NO: 627320 - DNA, 20 bp, mouse
ggagtcctaccccaagcagc

SEQ ID NO: 627321 - DNA, 20 bp, mouse
gtgcggagtccggctgcttg

SEQ ID NO: 627322 - DNA, 20 bp, mouse
gtgaccctgcctcggccccg

SEQ ID NO: 627323 - DNA, 20 bp, mouse
ggccagggcatggaaggcgt

SEQ ID NO: 627324 - DNA, 20 bp, mouse
ggcgaggcggccgcaagcgt

SEQ ID NO: 627325 - DNA, 20 bp, mouse
gacatttaaagcggcagcag

SEQ ID NO: 627326 - DNA, 20 bp, mouse
gaagggcctggcgccggcgg

SEQ ID NO: 627327 - DNA, 20 bp, mouse
gcagcgggagcggcggggaa

SEQ ID NO: 627328 - DNA, 20 bp, mouse
gtgcaggccgaccagtagac

SEQ ID NO: 627329 - DNA, 20 bp, mouse
gcgttcacatcgcccgcccg

SEQ ID NO: 627330 - DNA, 20 bp, mouse
gggcctggaagcgcttccgg

SEQ ID NO: 627331 - DNA, 20 bp, mouse
ggccggccccgacactgacc

SEQ ID NO: 627332 - DNA, 20 bp, mouse
gcggcgatggccagaggcag

SEQ ID NO: 627333 - DNA, 20 bp, mouse
ggccagaggcagcggctcct

SEQ ID NO: 627334 - DNA, 20 bp, mouse
gaggccgaccagtagacggg

SEQ ID NO: 627335 - DNA, 20 bp, mouse
gtacccgcccgtctactggt

SEQ ID NO: 627336 - DNA, 20 bp, mouse
ggagcagcacctacctccgg

SEQ ID NO: 627337 - DNA, 20 bp, mouse
gcggggaacgagcccagtca

SEQ ID NO: 627338 - DNA, 20 bp, mouse
gaaggagcagcacctacctc

SEQ ID NO: 627339 - DNA, 20 bp, mouse
gggcccatttccacccccgg

SEQ ID NO: 627340 - DNA, 20 bp, mouse
gcgtcgggtatgagctaacg

SEQ ID NO: 627341 - DNA, 20 bp, mouse
gcgacagcccggagccaaag

SEQ ID NO: 627342 - DNA, 20 bp, mouse
gtacctccgggggtggaaat

SEQ ID NO: 627343 - DNA, 20 bp, mouse
gatgggccggaacaccgtcc

SEQ ID NO: 627344 - DNA, 20 bp, mouse
gtccggcccatttccacccc

SEQ ID NO: 627345 - DNA, 20 bp, mouse
gggtggaaatgggccggaat

SEQ ID NO: 627346 - DNA, 20 bp, mouse
gcggcagcaaatctcaaaac

SEQ ID NO: 627347 - DNA, 20 bp, mouse
ggcaggccgagacccagaga

SEQ ID NO: 627348 - DNA, 20 bp, mouse
ggagagagcaggcccctctg

SEQ ID NO: 627349 - DNA, 20 bp, mouse
gtgactgaggggctaagggt

SEQ ID NO: 627350 - DNA, 20 bp, mouse
ggaggccagtggcaagccgt

SEQ ID NO: 627351 - DNA, 20 bp, mouse
gcggtttgcagccaggaacc

SEQ ID NO: 627352 - DNA, 20 bp, mouse
gggaatccagaggacgaatg

SEQ ID NO: 627353 - DNA, 20 bp, mouse
gatgctgggccatgactgag

SEQ ID NO: 627354 - DNA, 20 bp, mouse
gcgagacccagagagggtgt

SEQ ID NO: 627355 - DNA, 20 bp, mouse
gcaagccgtgggtgacgtca

SEQ ID NO: 627356 - DNA, 20 bp, mouse
gccaaggctgcaacccctgg

SEQ ID NO: 627357 - DNA, 20 bp, mouse
gggcagggccctgcctccag

SEQ ID NO: 627358 - DNA, 20 bp, mouse
ggctgcagccgtctgtccgt

SEQ ID NO: 627359 - DNA, 20 bp, mouse
gtatcagctaacctgcaaag

SEQ ID NO: 627360 - DNA, 20 bp, mouse
gacagacggctgcagcaagc

SEQ ID NO: 627361 - DNA, 20 bp, mouse
gaattgaaccggatgttcaa

SEQ ID NO: 627362 - DNA, 20 bp, mouse
gttagaaccgatcattacaa

SEQ ID NO: 627363 - DNA, 20 bp, mouse
gcaaagcaggagttataaag

SEQ ID NO: 627364 - DNA, 20 bp, mouse
ggcacttgagcttcccaatt

SEQ ID NO: 627365 - DNA, 20 bp, mouse
gaaagggcattcacctaatt

SEQ ID NO: 627366 - DNA, 20 bp, mouse
ggcccggcccgacgaggagg

SEQ ID NO: 627367 - DNA, 20 bp, mouse
gcgtgcccggcccgacgagg

SEQ ID NO: 627368 - DNA, 20 bp, mouse
gccgccaccgcctcacacaa

SEQ ID NO: 627369 - DNA, 20 bp, mouse
gggcggcgccgcctcctcgt

SEQ ID NO: 627370 - DNA, 20 bp, mouse
ggtcgccgggagggaggaca

SEQ ID NO: 627371 - DNA, 20 bp, mouse
ggctcggcggatggagagtc

SEQ ID NO: 627372 - DNA, 20 bp, mouse
gaggagtacgccccaaccaa

SEQ ID NO: 627373 - DNA, 20 bp, mouse
gccggggcctttgtgtgagg

SEQ ID NO: 627374 - DNA, 20 bp, mouse
gagagtctggccgcggccgg

SEQ ID NO: 627375 - DNA, 20 bp, mouse
ggtctccccgcgatccgcca

SEQ ID NO: 627376 - DNA, 20 bp, mouse
ggaggagagcgaaacccaag

SEQ ID NO: 627377 - DNA, 20 bp, mouse
gcaggcccggctcatcaccg

SEQ ID NO: 627378 - DNA, 20 bp, mouse
gagcgaaacccaagcggccg

SEQ ID NO: 627379 - DNA, 20 bp, mouse
gtcatcaccgtggccagccc

SEQ ID NO: 627380 - DNA, 20 bp, mouse
ggagccgggcctggcagacg

SEQ ID NO: 627381 - DNA, 20 bp, mouse
gcagcgccgtgcacgtccgg

SEQ ID NO: 627382 - DNA, 20 bp, mouse
gctcgttggacaccatacca

SEQ ID NO: 627383 - DNA, 20 bp, mouse
gctggccacggtgatgagcc

SEQ ID NO: 627384 - DNA, 20 bp, mouse
gccccttccaggttgatcta

SEQ ID NO: 627385 - DNA, 20 bp, mouse
gaagcggccggggctggcca

SEQ ID NO: 627386 - DNA, 20 bp, mouse
gcagcgctggagacgccaaa

SEQ ID NO: 627387 - DNA, 20 bp, mouse
gcgtctccagcgctgttgaa

SEQ ID NO: 627388 - DNA, 20 bp, mouse
ggttttccccggccccaaga

SEQ ID NO: 627389 - DNA, 20 bp, mouse
ggccaaaaggcagccatctt

SEQ ID NO: 627390 - DNA, 20 bp, mouse
gctggggcgcccctcactca

SEQ ID NO: 627391 - DNA, 20 bp, mouse
gtgcgcggagacccctgtcg

SEQ ID NO: 627392 - DNA, 20 bp, mouse
gccctcactcagggagtctc

SEQ ID NO: 627393 - DNA, 20 bp, mouse
ggggccggggaaaacgccga

SEQ ID NO: 627394 - DNA, 20 bp, mouse
gacgaacactcctgcccgaa

SEQ ID NO: 627395 - DNA, 20 bp, mouse
ggcgtcccccaggggtcctg

SEQ ID NO: 627396 - DNA, 20 bp, mouse
ggtgcctgcctggcgagcgg

SEQ ID NO: 627397 - DNA, 20 bp, mouse
gcctgggagggaagggtcac

SEQ ID NO: 627398 - DNA, 20 bp, mouse
gcccacctcagccacctcgg

SEQ ID NO: 627399 - DNA, 20 bp, mouse
gggcacggcggccccaggag

SEQ ID NO: 627400 - DNA, 20 bp, mouse
gagcagagtggggtcagcac

SEQ ID NO: 627401 - DNA, 20 bp, mouse
ggcttctcgcggcggctggg

SEQ ID NO: 627402 - DNA, 20 bp, mouse
ggacgtgcctgcctggcgag

SEQ ID NO: 627403 - DNA, 20 bp, mouse
ggtcccacaggcccattacc

SEQ ID NO: 627404 - DNA, 20 bp, mouse
gcagccgccgcgagaagccg

SEQ ID NO: 627405 - DNA, 20 bp, mouse
ggcccattaccgggaagccc

SEQ ID NO: 627406 - DNA, 20 bp, mouse
ggagggcgcggggacccgga

SEQ ID NO: 627407 - DNA, 20 bp, mouse
gtcggaccgcaccgaactgg

SEQ ID NO: 627408 - DNA, 20 bp, mouse
ggaccgcaccgaactggggg

SEQ ID NO: 627409 - DNA, 20 bp, mouse
gatggggccgacggcagcgg

SEQ ID NO: 627410 - DNA, 20 bp, mouse
gagctcggaccgcaccgaac

SEQ ID NO: 627411 - DNA, 20 bp, mouse
gtaaatggggccgacggcag

SEQ ID NO: 627412 - DNA, 20 bp, mouse
gggccgcgctgccataaatg

SEQ ID NO: 627413 - DNA, 20 bp, mouse
gcctagccggccgttcccca

SEQ ID NO: 627414 - DNA, 20 bp, mouse
gggcggggcgcgcactaact

SEQ ID NO: 627415 - DNA, 20 bp, mouse
ggccccgcccggcgccgtcc

SEQ ID NO: 627416 - DNA, 20 bp, mouse
gggagaataaggccttggta

SEQ ID NO: 627417 - DNA, 20 bp, mouse
gtccgagggacgagaggctc

SEQ ID NO: 627418 - DNA, 20 bp, mouse
ggcggtggcggcggagaata

SEQ ID NO: 627419 - DNA, 20 bp, mouse
ggaagttgtccccgcggtgg

SEQ ID NO: 627420 - DNA, 20 bp, mouse
ggcaacggggacgctccggt

SEQ ID NO: 627421 - DNA, 20 bp, mouse
gagcgtatccgagggacgag

SEQ ID NO: 627422 - DNA, 20 bp, mouse
ggagggacgagaggctcggg

SEQ ID NO: 627423 - DNA, 20 bp, mouse
gtacggcaacggggacgctc

SEQ ID NO: 627424 - DNA, 20 bp, mouse
ggcggcggagaataaggcct

SEQ ID NO: 627425 - DNA, 20 bp, mouse
gcgggcggaagttgtccccg

SEQ ID NO: 627426 - DNA, 20 bp, mouse
gcaggctggagtgaaacgag

SEQ ID NO: 627427 - DNA, 20 bp, mouse
gggagtgaaacgagcggcta

SEQ ID NO: 627428 - DNA, 20 bp, mouse
ggtgaaacgagcggctacgg

SEQ ID NO: 627429 - DNA, 20 bp, mouse
gcgcccgtgggcctgagggg

SEQ ID NO: 627430 - DNA, 20 bp, mouse
gctgcacactggcctaggag

SEQ ID NO: 627431 - DNA, 20 bp, mouse
ggggcgcccgtgggcctgag

SEQ ID NO: 627432 - DNA, 20 bp, mouse
ggccatgcgcgcccagtccc

SEQ ID NO: 627433 - DNA, 20 bp, mouse
gggagcggcggcccgagata

SEQ ID NO: 627434 - DNA, 20 bp, mouse
gcagtgtgcagcctgggact

SEQ ID NO: 627435 - DNA, 20 bp, mouse
ggagagcgccgggcgcccgt

SEQ ID NO: 627436 - DNA, 20 bp, mouse
gctgctgcctgaggagtcgg

SEQ ID NO: 627437 - DNA, 20 bp, mouse
gtgcctgaggagtcggaggt

SEQ ID NO: 627438 - DNA, 20 bp, mouse
gactctggcatagatagggt

SEQ ID NO: 627439 - DNA, 20 bp, mouse
gcttcaagttgacaagcagg

SEQ ID NO: 627440 - DNA, 20 bp, mouse
ggcttcagcgcccggaagtg

SEQ ID NO: 627441 - DNA, 20 bp, mouse
gagagggcgctgcaggatcg

SEQ ID NO: 627442 - DNA, 20 bp, mouse
ggcgggcctgaaggggactc

SEQ ID NO: 627443 - DNA, 20 bp, mouse
gagatgtagcgggcctgaag

SEQ ID NO: 627444 - DNA, 20 bp, mouse
gggggactctggcatagata

SEQ ID NO: 627445 - DNA, 20 bp, mouse
ggtcggaggtggggtcgagc

SEQ ID NO: 627446 - DNA, 20 bp, mouse
gcgcgcgccggcctgacgga

SEQ ID NO: 627447 - DNA, 20 bp, mouse
ggcgagagctgcgtccggga

SEQ ID NO: 627448 - DNA, 20 bp, mouse
gactggcgagagctgcgtcc

SEQ ID NO: 627449 - DNA, 20 bp, mouse
gagctgcgcgctcgctcggg

SEQ ID NO: 627450 - DNA, 20 bp, mouse
ggcccggggcacagtaacca

SEQ ID NO: 627451 - DNA, 20 bp, mouse
gggacggacgaacggactgg

SEQ ID NO: 627452 - DNA, 20 bp, mouse
gcgcgcagctcggaccctcc

SEQ ID NO: 627453 - DNA, 20 bp, mouse
gggagccggaaccgagtccg

SEQ ID NO: 627454 - DNA, 20 bp, mouse
gaggctggcgcaccacgccg

SEQ ID NO: 627455 - DNA, 20 bp, mouse
ggctggggctgaagccctgg

SEQ ID NO: 627456 - DNA, 20 bp, mouse
gcagtagttagtcttgtggg

SEQ ID NO: 627457 - DNA, 20 bp, mouse
ggggcagtagttagtcttgt

SEQ ID NO: 627458 - DNA, 20 bp, mouse
gcggtcctcccggctcacac

SEQ ID NO: 627459 - DNA, 20 bp, mouse
gtgggcggtggaagtggtct

SEQ ID NO: 627460 - DNA, 20 bp, mouse
gtactgcccggcccacagcg

SEQ ID NO: 627461 - DNA, 20 bp, mouse
gacccaacggacagccagta

SEQ ID NO: 627462 - DNA, 20 bp, mouse
gcgtctccgcgctgtgggcc

SEQ ID NO: 627463 - DNA, 20 bp, mouse
gcgctcctgagagcccgagg

SEQ ID NO: 627464 - DNA, 20 bp, mouse
gtgatctgtagagcacccaa

SEQ ID NO: 627465 - DNA, 20 bp, mouse
gtagttagtcttgtgggcgg

SEQ ID NO: 627466 - DNA, 20 bp, mouse
gcgttgtcggaatggttccg

SEQ ID NO: 627467 - DNA, 20 bp, mouse
gccgagagtgcgacgagaaa

SEQ ID NO: 627468 - DNA, 20 bp, mouse
ggcgacgagaaagggtgtca

SEQ ID NO: 627469 - DNA, 20 bp, mouse
gcgtcgccccgagataggag

SEQ ID NO: 627470 - DNA, 20 bp, mouse
ggcggcgcagaccgcagcaa

SEQ ID NO: 627471 - DNA, 20 bp, mouse
gtcccagacggaagtgacgg

SEQ ID NO: 627472 - DNA, 20 bp, mouse
gggaatggttccgaggcggt

SEQ ID NO: 627473 - DNA, 20 bp, mouse
gccctcccagacggaagtga

SEQ ID NO: 627474 - DNA, 20 bp, mouse
gtgcaggactccaaccgcct

SEQ ID NO: 627475 - DNA, 20 bp, mouse
ggcgacgcagacaccaagag

SEQ ID NO: 627476 - DNA, 20 bp, mouse
gcctcctgcgaggagaaggg

SEQ ID NO: 627477 - DNA, 20 bp, mouse
gtcctcagggtcggtccgag

SEQ ID NO: 627478 - DNA, 20 bp, mouse
gtccgctcggaccgaccctg

SEQ ID NO: 627479 - DNA, 20 bp, mouse
gggtcggtccgagcggagga

SEQ ID NO: 627480 - DNA, 20 bp, mouse
ggccgggcgtcgggacacag

SEQ ID NO: 627481 - DNA, 20 bp, mouse
ggaggcgggaaggtccagac

SEQ ID NO: 627482 - DNA, 20 bp, mouse
gcaggccactctagctgata

SEQ ID NO: 627483 - DNA, 20 bp, mouse
gccgcctccttcctcagggt

SEQ ID NO: 627484 - DNA, 20 bp, mouse
gcatcgctcaggaggaccca

SEQ ID NO: 627485 - DNA, 20 bp, mouse
gttctcctcgcaggaggagg

SEQ ID NO: 627486 - DNA, 20 bp, mouse
gtccgcggcaatggcagccc

SEQ ID NO: 627487 - DNA, 20 bp, mouse
gcggcaatggcagcccaggc

SEQ ID NO: 627488 - DNA, 20 bp, mouse
gggcagcccaggccggaaga

SEQ ID NO: 627489 - DNA, 20 bp, mouse
gactggctttgaggcttccg

SEQ ID NO: 627490 - DNA, 20 bp, mouse
gctgccaactccctccaacg

SEQ ID NO: 627491 - DNA, 20 bp, mouse
gaagtgacggagacatgctg

SEQ ID NO: 627492 - DNA, 20 bp, mouse
gtttgaggcttccgcggcaa

SEQ ID NO: 627493 - DNA, 20 bp, mouse
gtaagtccatcttccggcct

SEQ ID NO: 627494 - DNA, 20 bp, mouse
gccaggctaagtccatcttc

SEQ ID NO: 627495 - DNA, 20 bp, mouse
gacttcggaaggctcgactt

SEQ ID NO: 627496 - DNA, 20 bp, mouse
gccgaacttacagacccggg

SEQ ID NO: 627497 - DNA, 20 bp, mouse
ggaaggtcgccatctacatc

SEQ ID NO: 627498 - DNA, 20 bp, mouse
gctggcaaaaccaggagctg

SEQ ID NO: 627499 - DNA, 20 bp, mouse
gccccttcccggagccccga

SEQ ID NO: 627500 - DNA, 20 bp, mouse
gggacccaacggaaccggaa

SEQ ID NO: 627501 - DNA, 20 bp, mouse
ggcagcatgggccagtccaa

SEQ ID NO: 627502 - DNA, 20 bp, mouse
gagatggcgaccttcccccc

SEQ ID NO: 627503 - DNA, 20 bp, mouse
gccaggagctgcggcccctc

SEQ ID NO: 627504 - DNA, 20 bp, mouse
gaggccggcagaaaactgaa

SEQ ID NO: 627505 - DNA, 20 bp, mouse
ggagccaaagggggacccaa

SEQ ID NO: 627506 - DNA, 20 bp, mouse
gtactgtacggctactgtag

SEQ ID NO: 627507 - DNA, 20 bp, mouse
gcgcggcgcggacctcgctc

SEQ ID NO: 627508 - DNA, 20 bp, mouse
gcccggaggacgcgcgatcg

SEQ ID NO: 627509 - DNA, 20 bp, mouse
gcgcggggacccgagcccgg

SEQ ID NO: 627510 - DNA, 20 bp, mouse
ggcgcgatcggggcagcccg

SEQ ID NO: 627511 - DNA, 20 bp, mouse
ggcgcggacctcgctcgggc

SEQ ID NO: 627512 - DNA, 20 bp, mouse
ggagtcgcgagcatcatacg

SEQ ID NO: 627513 - DNA, 20 bp, mouse
ggagcccgtacggagcggaa

SEQ ID NO: 627514 - DNA, 20 bp, mouse
gcccgagagcccgtacggag

SEQ ID NO: 627515 - DNA, 20 bp, mouse
gaggccgtgccgcccgagta

SEQ ID NO: 627516 - DNA, 20 bp, mouse
gcccgccgcagccatcgtca

SEQ ID NO: 627517 - DNA, 20 bp, mouse
ggcccgcgcgccgcccgcga

SEQ ID NO: 627518 - DNA, 20 bp, mouse
ggcgccggcgaccgtgacga

SEQ ID NO: 627519 - DNA, 20 bp, mouse
gcggctcctacctccttcgc

SEQ ID NO: 627520 - DNA, 20 bp, mouse
gcgatggccaccattaggaa

SEQ ID NO: 627521 - DNA, 20 bp, mouse
gaggggagaggacgaaacta

SEQ ID NO: 627522 - DNA, 20 bp, mouse
gctcctacctccttcgcggg

SEQ ID NO: 627523 - DNA, 20 bp, mouse
gaagtaggtctgcctgggag

SEQ ID NO: 627524 - DNA, 20 bp, mouse
ggcgaccgtgacgatggctg

SEQ ID NO: 627525 - DNA, 20 bp, mouse
gcagctgtggcaaggaaggg

SEQ ID NO: 627526 - DNA, 20 bp, mouse
gggtggaccggaggagatag

SEQ ID NO: 627527 - DNA, 20 bp, mouse
ggtcagaaggccgcggtcag

SEQ ID NO: 627528 - DNA, 20 bp, mouse
ggcggccttctgaccaggac

SEQ ID NO: 627529 - DNA, 20 bp, mouse
gagcagcgagccactgaccg

SEQ ID NO: 627530 - DNA, 20 bp, mouse
gctccagcgaacggacccaa

SEQ ID NO: 627531 - DNA, 20 bp, mouse
ggtgtgtacaggggtctcac

SEQ ID NO: 627532 - DNA, 20 bp, mouse
gatagtggtagaaagcagag

SEQ ID NO: 627533 - DNA, 20 bp, mouse
gtgctccggtcctggtcaga

SEQ ID NO: 627534 - DNA, 20 bp, mouse
gggtctcacaggacgcacga

SEQ ID NO: 627535 - DNA, 20 bp, mouse
gaagacccaggaaagctaca

SEQ ID NO: 627536 - DNA, 20 bp, mouse
gccgagggtgagcgtccacg

SEQ ID NO: 627537 - DNA, 20 bp, mouse
ggagcgccgccagggtccga

SEQ ID NO: 627538 - DNA, 20 bp, mouse
gaagatgcgggtccaacctg

SEQ ID NO: 627539 - DNA, 20 bp, mouse
gcacgcggcagcgctgctcc

SEQ ID NO: 627540 - DNA, 20 bp, mouse
ggctcaccctcggaccctgg

SEQ ID NO: 627541 - DNA, 20 bp, mouse
ggcgcccgccgagcttcccc

SEQ ID NO: 627542 - DNA, 20 bp, mouse
gggcgctcaggacacagccc

SEQ ID NO: 627543 - DNA, 20 bp, mouse
gcatccgcggtgccaggcag

SEQ ID NO: 627544 - DNA, 20 bp, mouse
gtgtgtcctgagcgccgcca

SEQ ID NO: 627545 - DNA, 20 bp, mouse
gggagggacggagccccgtt

SEQ ID NO: 627546 - DNA, 20 bp, mouse
gacagccgctggagcaaccc

SEQ ID NO: 627547 - DNA, 20 bp, mouse
ggccgctgtcaagagtctcg

SEQ ID NO: 627548 - DNA, 20 bp, mouse
ggtggcccgggttgctccag

SEQ ID NO: 627549 - DNA, 20 bp, mouse
gaggtcgcggggctccgaga

SEQ ID NO: 627550 - DNA, 20 bp, mouse
gggctgcggtggctattcag

SEQ ID NO: 627551 - DNA, 20 bp, mouse
gcgcctaggcagccgaggtg

SEQ ID NO: 627552 - DNA, 20 bp, mouse
gtccgcgcgcgggctgtcag

SEQ ID NO: 627553 - DNA, 20 bp, mouse
gagccgagcatcagtcgagc

SEQ ID NO: 627554 - DNA, 20 bp, mouse
ggtcaagagtctcgtggccc

SEQ ID NO: 627555 - DNA, 20 bp, mouse
gtgcccgctcgactgatgct

SEQ ID NO: 627556 - DNA, 20 bp, mouse
gaaacaagtagccccaacgt

SEQ ID NO: 627557 - DNA, 20 bp, mouse
gccaacgtgggagaaacaaa

SEQ ID NO: 627558 - DNA, 20 bp, mouse
ggattcccggttccgggtag

SEQ ID NO: 627559 - DNA, 20 bp, mouse
gcaaagcctcggcttcggaa

SEQ ID NO: 627560 - DNA, 20 bp, mouse
gtgggaaaggcgcctccgga

SEQ ID NO: 627561 - DNA, 20 bp, mouse
gcgcgctgcggagcgattcc

SEQ ID NO: 627562 - DNA, 20 bp, mouse
gcagcccctttccgaagccg

SEQ ID NO: 627563 - DNA, 20 bp, mouse
ggggtcggcgacggccacaa

SEQ ID NO: 627564 - DNA, 20 bp, mouse
ggttttagggcgcaaagcct

SEQ ID NO: 627565 - DNA, 20 bp, mouse
gagtgggcgaagctgctggt

SEQ ID NO: 627566 - DNA, 20 bp, mouse
gagtactctcagctcgctgg

SEQ ID NO: 627567 - DNA, 20 bp, mouse
ggccgcaggtgaatgaaagg

SEQ ID NO: 627568 - DNA, 20 bp, mouse
gactctcagctcgctggagg

SEQ ID NO: 627569 - DNA, 20 bp, mouse
ggctggaggtggctggaacc

SEQ ID NO: 627570 - DNA, 20 bp, mouse
gcccaaaaccaaaaaagccg

SEQ ID NO: 627571 - DNA, 20 bp, mouse
gtgcgcagagtcgctctcag

SEQ ID NO: 627572 - DNA, 20 bp, mouse
gtgagaacacaacatccgat

SEQ ID NO: 627573 - DNA, 20 bp, mouse
gaccccacgcaagaagaggg

SEQ ID NO: 627574 - DNA, 20 bp, mouse
gaaaaagccgcggcgccgat

SEQ ID NO: 627575 - DNA, 20 bp, mouse
gcccaccccacgcaagaaga

SEQ ID NO: 627576 - DNA, 20 bp, mouse
ggagggagttgtcagcataa

SEQ ID NO: 627577 - DNA, 20 bp, mouse
gtcagggtagcgaaagaatt

SEQ ID NO: 627578 - DNA, 20 bp, mouse
gtggctgcgcatgagcgtgt

SEQ ID NO: 627579 - DNA, 20 bp, mouse
gatggcgcggggccgaagtc

SEQ ID NO: 627580 - DNA, 20 bp, mouse
gggtctggttagcaactcgg

SEQ ID NO: 627581 - DNA, 20 bp, mouse
gacaggtgcctaattcaagg

SEQ ID NO: 627582 - DNA, 20 bp, mouse
ggcgcagccatcttcttagc

SEQ ID NO: 627583 - DNA, 20 bp, mouse
ggggtgtagagcggaagtta

SEQ ID NO: 627584 - DNA, 20 bp, mouse
gctaaattgggtccaaagag

SEQ ID NO: 627585 - DNA, 20 bp, mouse
gtttagacccgctgccaagg

SEQ ID NO: 627586 - DNA, 20 bp, mouse
gcggttgaggtgctccgacg

SEQ ID NO: 627587 - DNA, 20 bp, mouse
gggccggccaggcgcactgg

SEQ ID NO: 627588 - DNA, 20 bp, mouse
gtccggccggccaggcgcac

SEQ ID NO: 627589 - DNA, 20 bp, mouse
gttggcgtccggcggaactg

SEQ ID NO: 627590 - DNA, 20 bp, mouse
gaccgcacgcgcgaccgcgt

SEQ ID NO: 627591 - DNA, 20 bp, mouse
ggcggaagctaaggagggaa

SEQ ID NO: 627592 - DNA, 20 bp, mouse
gccaggcgcactggcggttg

SEQ ID NO: 627593 - DNA, 20 bp, mouse
gggcccagcggaagctaagg

SEQ ID NO: 627594 - DNA, 20 bp, mouse
gaactgcggtagcttccggc

SEQ ID NO: 627595 - DNA, 20 bp, mouse
gtagcttccgctgggcctgg

SEQ ID NO: 627596 - DNA, 20 bp, mouse
gtcggctacgcgataaaggg

SEQ ID NO: 627597 - DNA, 20 bp, mouse
gccgtcggctacgcgataaa

SEQ ID NO: 627598 - DNA, 20 bp, mouse
gcgcgctggtgtgaagatgc

SEQ ID NO: 627599 - DNA, 20 bp, mouse
ggtgtgaagatgctggccgt

SEQ ID NO: 627600 - DNA, 20 bp, mouse
gcgcaaggagtaagccagca

SEQ ID NO: 627601 - DNA, 20 bp, mouse
ggcctccctcgccaacacag

SEQ ID NO: 627602 - DNA, 20 bp, mouse
ggctacgcgataaagggagg

SEQ ID NO: 627603 - DNA, 20 bp, mouse
gtccctcgccaacacagggg

SEQ ID NO: 627604 - DNA, 20 bp, mouse
gacgacaccgcaaaagcgca

SEQ ID NO: 627605 - DNA, 20 bp, mouse
gaaactcccatcatgcctgg

SEQ ID NO: 627606 - DNA, 20 bp, mouse
gtacagcaggaactgggcgg

SEQ ID NO: 627607 - DNA, 20 bp, mouse
gagcctgaggcggcgcgtca

SEQ ID NO: 627608 - DNA, 20 bp, mouse
ggcgtcatggacggactgga

SEQ ID NO: 627609 - DNA, 20 bp, mouse
gtgaggcggcgcgtcatgga

SEQ ID NO: 627610 - DNA, 20 bp, mouse
gcggcgcgtcatggacggac

SEQ ID NO: 627611 - DNA, 20 bp, mouse
gtgcagaagtgaggacgcgg

SEQ ID NO: 627612 - DNA, 20 bp, mouse
gtggaaggtgagacgcgagg

SEQ ID NO: 627613 - DNA, 20 bp, mouse
gcgctcgccgacacccgggg

SEQ ID NO: 627614 - DNA, 20 bp, mouse
gcggccaccgctcccgtaag

SEQ ID NO: 627615 - DNA, 20 bp, mouse
gaccggggcctggagtctgg

SEQ ID NO: 627616 - DNA, 20 bp, mouse
gtggtgacacttctaaatgg

SEQ ID NO: 627617 - DNA, 20 bp, mouse
ggacatactaaactaacagg

SEQ ID NO: 627618 - DNA, 20 bp, mouse
gaggtggtgacacttctaaa

SEQ ID NO: 627619 - DNA, 20 bp, mouse
gactgttggttgaatggctg

SEQ ID NO: 627620 - DNA, 20 bp, mouse
ggctgaggcacagctgcttg

SEQ ID NO: 627621 - DNA, 20 bp, mouse
gtatctgcccctgaccagtg

SEQ ID NO: 627622 - DNA, 20 bp, mouse
gactaactctgcctctaggt

SEQ ID NO: 627623 - DNA, 20 bp, mouse
ggtcaggggcagataagcaa

SEQ ID NO: 627624 - DNA, 20 bp, mouse
gaaagacatactaaactaac

SEQ ID NO: 627625 - DNA, 20 bp, mouse
gtcttgtaatgccaacctag

SEQ ID NO: 627626 - DNA, 20 bp, mouse
ggcgtacctgaggcgctcgg

SEQ ID NO: 627627 - DNA, 20 bp, mouse
gagagcgcctgcgtggacgg

SEQ ID NO: 627628 - DNA, 20 bp, mouse
gccaggcaacgggataacag

SEQ ID NO: 627629 - DNA, 20 bp, mouse
ggcctgcgtggacggcggtt

SEQ ID NO: 627630 - DNA, 20 bp, mouse
gacggcggttgggtttagtc

SEQ ID NO: 627631 - DNA, 20 bp, mouse
gggcaacgggataacagagg

SEQ ID NO: 627632 - DNA, 20 bp, mouse
gggttgggtttagtcaggtg

SEQ ID NO: 627633 - DNA, 20 bp, mouse
gcagagagcgcctgcgtgga

SEQ ID NO: 627634 - DNA, 20 bp, mouse
gtagaggccgggtcccagta

SEQ ID NO: 627635 - DNA, 20 bp, mouse
ggatactgagacctcccgag

SEQ ID NO: 627636 - DNA, 20 bp, mouse
ggcggcagcagcaactacgg

SEQ ID NO: 627637 - DNA, 20 bp, mouse
gtgagggaggcgggagactt

SEQ ID NO: 627638 - DNA, 20 bp, mouse
gtttgtcgaagctagaggac

SEQ ID NO: 627639 - DNA, 20 bp, mouse
gagcggaagaaccgtagggt

SEQ ID NO: 627640 - DNA, 20 bp, mouse
ggggaggcgggagacttagg

SEQ ID NO: 627641 - DNA, 20 bp, mouse
gtgacatcaggcggagggat

SEQ ID NO: 627642 - DNA, 20 bp, mouse
gaggaagcggaagaaccgta

SEQ ID NO: 627643 - DNA, 20 bp, mouse
ggtggaggccgcgcccggag

SEQ ID NO: 627644 - DNA, 20 bp, mouse
ggcgaggtcagtgagaaaag

SEQ ID NO: 627645 - DNA, 20 bp, mouse
gggaagaaccgtagggtggg

SEQ ID NO: 627646 - DNA, 20 bp, mouse
gcggctgctgtgaggacggc

SEQ ID NO: 627647 - DNA, 20 bp, mouse
ggccgaacaagcagaaaccc

SEQ ID NO: 627648 - DNA, 20 bp, mouse
gctttgacgctggcagtcct

SEQ ID NO: 627649 - DNA, 20 bp, mouse
gtgcttgttcggctgctgtg

SEQ ID NO: 627650 - DNA, 20 bp, mouse
gccgggctaggccgaaagtc

SEQ ID NO: 627651 - DNA, 20 bp, mouse
gccgaaagtcgggcgagggg

SEQ ID NO: 627652 - DNA, 20 bp, mouse
gtgaaccgggcccatcagca

SEQ ID NO: 627653 - DNA, 20 bp, mouse
ggagtcggagacattgtcat

SEQ ID NO: 627654 - DNA, 20 bp, mouse
gcgggaacaccggatgtggg

SEQ ID NO: 627655 - DNA, 20 bp, mouse
gggaagaggttggtaagtaa

SEQ ID NO: 627656 - DNA, 20 bp, mouse
ggccgagtctcgggctctga

SEQ ID NO: 627657 - DNA, 20 bp, mouse
ggccgtcagagcccgagact

SEQ ID NO: 627658 - DNA, 20 bp, mouse
ggcgccggacgtcgtctgta

SEQ ID NO: 627659 - DNA, 20 bp, mouse
gaagtgcgcaggggacccag

SEQ ID NO: 627660 - DNA, 20 bp, mouse
ggtccatggagccgagtctc

SEQ ID NO: 627661 - DNA, 20 bp, mouse
ggacgacgtccggcgctcag

SEQ ID NO: 627662 - DNA, 20 bp, mouse
gagcccgagactcggctcca

SEQ ID NO: 627663 - DNA, 20 bp, mouse
ggtcgtctgtaaggtgtcca

SEQ ID NO: 627664 - DNA, 20 bp, mouse
gcggtgacgcgaggaggtcc

SEQ ID NO: 627665 - DNA, 20 bp, mouse
gtgagtgctaccgggtggaa

SEQ ID NO: 627666 - DNA, 20 bp, mouse
ggcagtggagacaccaaaaa

SEQ ID NO: 627667 - DNA, 20 bp, mouse
gatggagaagagtgcttcca

SEQ ID NO: 627668 - DNA, 20 bp, mouse
gggcagggtgaccgacagag

SEQ ID NO: 627669 - DNA, 20 bp, mouse
ggcggacgatgtggcttaga

SEQ ID NO: 627670 - DNA, 20 bp, mouse
gaccgacagagcggacgatg

SEQ ID NO: 627671 - DNA, 20 bp, mouse
gaagcaacagccaaagcagg

SEQ ID NO: 627672 - DNA, 20 bp, mouse
gtacccagtgaacgggatga

SEQ ID NO: 627673 - DNA, 20 bp, mouse
gctgtgctgtcctcctgctt

SEQ ID NO: 627674 - DNA, 20 bp, mouse
gggagaagcttggccggtcc

SEQ ID NO: 627675 - DNA, 20 bp, mouse
gagcttggccggtccaggca

SEQ ID NO: 627676 - DNA, 20 bp, mouse
gggaggaacgcggtacgcag

SEQ ID NO: 627677 - DNA, 20 bp, mouse
gaaggaagtcaagagagcgg

SEQ ID NO: 627678 - DNA, 20 bp, mouse
gtccgctccagtggcagcga

SEQ ID NO: 627679 - DNA, 20 bp, mouse
gtccttcgctgccactggag

SEQ ID NO: 627680 - DNA, 20 bp, mouse
gttgccaagctccgctccag

SEQ ID NO: 627681 - DNA, 20 bp, mouse
gcgctcggcccgagccctag

SEQ ID NO: 627682 - DNA, 20 bp, mouse
ggagcacaccgcactgaggg

SEQ ID NO: 627683 - DNA, 20 bp, mouse
gtcggcccgagccctagcgg

SEQ ID NO: 627684 - DNA, 20 bp, mouse
gccggcgctaaggcgagagg

SEQ ID NO: 627685 - DNA, 20 bp, mouse
gggcccggcgctaaggcgag

SEQ ID NO: 627686 - DNA, 20 bp, mouse
gcaggagttgctggagtcag

SEQ ID NO: 627687 - DNA, 20 bp, mouse
ggagttgctggagtcagagg

SEQ ID NO: 627688 - DNA, 20 bp, mouse
gcagtacagacttcagtcaa

SEQ ID NO: 627689 - DNA, 20 bp, mouse
gagggtgttgagggcagtcc

SEQ ID NO: 627690 - DNA, 20 bp, mouse
gctccctagctgaaaagaga

SEQ ID NO: 627691 - DNA, 20 bp, mouse
ggtctgctgtgagagcccga

SEQ ID NO: 627692 - DNA, 20 bp, mouse
gtacgaagcccgcagatggg

SEQ ID NO: 627693 - DNA, 20 bp, mouse
gtctcaggtgtgagaagcca

SEQ ID NO: 627694 - DNA, 20 bp, mouse
gtgagaagccagggtgttga

SEQ ID NO: 627695 - DNA, 20 bp, mouse
ggccgagccactgtctagac

SEQ ID NO: 627696 - DNA, 20 bp, mouse
gtagcggccaggcagagttg

SEQ ID NO: 627697 - DNA, 20 bp, mouse
gctctgcctggccgctacac

SEQ ID NO: 627698 - DNA, 20 bp, mouse
ggcaaactcgcgacttccgt

SEQ ID NO: 627699 - DNA, 20 bp, mouse
gttagatgctgccagtgtag

SEQ ID NO: 627700 - DNA, 20 bp, mouse
gtgctgccagtgtagcggcc

SEQ ID NO: 627701 - DNA, 20 bp, mouse
gccccgggaggacgaccaag

SEQ ID NO: 627702 - DNA, 20 bp, mouse
gtcttagcgttgctctgcag

SEQ ID NO: 627703 - DNA, 20 bp, mouse
gagctgggagaagatccggg

SEQ ID NO: 627704 - DNA, 20 bp, mouse
gagccggagctgaggcgtca

SEQ ID NO: 627705 - DNA, 20 bp, mouse
gcgccgggaacagggagcag

SEQ ID NO: 627706 - DNA, 20 bp, mouse
gcccgtgagaggcacctggg

SEQ ID NO: 627707 - DNA, 20 bp, mouse
ggcggttgccaggagtaacg

SEQ ID NO: 627708 - DNA, 20 bp, mouse
gggcgggctccaggtaaccg

SEQ ID NO: 627709 - DNA, 20 bp, mouse
gactccagcgggcccgtgag

SEQ ID NO: 627710 - DNA, 20 bp, mouse
ggcagcggcgtagggggccc

SEQ ID NO: 627711 - DNA, 20 bp, mouse
gtgcacgggggcgccagcag

SEQ ID NO: 627712 - DNA, 20 bp, mouse
gatccgggtgaggcccgcgt

SEQ ID NO: 627713 - DNA, 20 bp, mouse
ggccgccgagccatggaaat

SEQ ID NO: 627714 - DNA, 20 bp, mouse
gttggctcccacttgcacgg

SEQ ID NO: 627715 - DNA, 20 bp, mouse
gcaggagtaacggggcgggt

SEQ ID NO: 627716 - DNA, 20 bp, mouse
ggagctgccggacgccccga

SEQ ID NO: 627717 - DNA, 20 bp, mouse
gacgcagatggctaccgtcg

SEQ ID NO: 627718 - DNA, 20 bp, mouse
gcgcaaaggccacatccggg

SEQ ID NO: 627719 - DNA, 20 bp, mouse
ggcctcactacagcgatgag

SEQ ID NO: 627720 - DNA, 20 bp, mouse
gtcactacagcgatgagggg

SEQ ID NO: 627721 - DNA, 20 bp, mouse
gtggctaccgtcggggcgtc

SEQ ID NO: 627722 - DNA, 20 bp, mouse
gcagccgccgccgcagcgca

SEQ ID NO: 627723 - DNA, 20 bp, mouse
gagcccggcgagccccagcc

SEQ ID NO: 627724 - DNA, 20 bp, mouse
gtttccgtgcgctgcggcgg

SEQ ID NO: 627725 - DNA, 20 bp, mouse
gctgtcgcaaaggccacatc

SEQ ID NO: 627726 - DNA, 20 bp, mouse
gcgacgcgggcggaacaaac

SEQ ID NO: 627727 - DNA, 20 bp, mouse
ggagccagtgaggagcgaaa

SEQ ID NO: 627728 - DNA, 20 bp, mouse
gcccaaagccggagccagtg

SEQ ID NO: 627729 - DNA, 20 bp, mouse
gtccggctttgggcacgacg

SEQ ID NO: 627730 - DNA, 20 bp, mouse
ggagaaggccgccccagcgg

SEQ ID NO: 627731 - DNA, 20 bp, mouse
ggctttgggcacgacgcggg

SEQ ID NO: 627732 - DNA, 20 bp, mouse
gcgggctccactacccgcgg

SEQ ID NO: 627733 - DNA, 20 bp, mouse
ggcgcgcccgagagctcggg

SEQ ID NO: 627734 - DNA, 20 bp, mouse
ggcctgatgacgttgcacaa

SEQ ID NO: 627735 - DNA, 20 bp, mouse
gggccggcccccgcgggtag

SEQ ID NO: 627736 - DNA, 20 bp, mouse
ggcgtcgcggactccggaga

SEQ ID NO: 627737 - DNA, 20 bp, mouse
ggcgagggccgaacccgact

SEQ ID NO: 627738 - DNA, 20 bp, mouse
ggtcagccctgagtacgtgg

SEQ ID NO: 627739 - DNA, 20 bp, mouse
gtcatgggtgggcatcggag

SEQ ID NO: 627740 - DNA, 20 bp, mouse
gcgcggcgatgacgtcgagg

SEQ ID NO: 627741 - DNA, 20 bp, mouse
gacgtcgagggggtctggct

SEQ ID NO: 627742 - DNA, 20 bp, mouse
gggggtctggctaggcgtcg

SEQ ID NO: 627743 - DNA, 20 bp, mouse
gtcgcttcggagagggtcta

SEQ ID NO: 627744 - DNA, 20 bp, mouse
gcccgatggtcgtcatgggt

SEQ ID NO: 627745 - DNA, 20 bp, mouse
gccctcgccccgaagcctgg

SEQ ID NO: 627746 - DNA, 20 bp, mouse
gaggtacccgagtctaacgg

SEQ ID NO: 627747 - DNA, 20 bp, mouse
gcggccagctcccggagcag

SEQ ID NO: 627748 - DNA, 20 bp, mouse
gcatgcgttgccccccctcg

SEQ ID NO: 627749 - DNA, 20 bp, mouse
ggagcgggcgaacgccgcga

SEQ ID NO: 627750 - DNA, 20 bp, mouse
gtccgggagctggccgtcag

SEQ ID NO: 627751 - DNA, 20 bp, mouse
gcctcaccttcccctcagca

SEQ ID NO: 627752 - DNA, 20 bp, mouse
gccagctcccggagcagggg

SEQ ID NO: 627753 - DNA, 20 bp, mouse
ggataggtacccgagtctaa

SEQ ID NO: 627754 - DNA, 20 bp, mouse
gggcggccgaggaggctgat

SEQ ID NO: 627755 - DNA, 20 bp, mouse
gggacggaccgacagaccgg

SEQ ID NO: 627756 - DNA, 20 bp, mouse
gtggcggcacccgaaacagg

SEQ ID NO: 627757 - DNA, 20 bp, mouse
ggacgcggggatttggacag

SEQ ID NO: 627758 - DNA, 20 bp, mouse
gatttggacagtggccgtaa

SEQ ID NO: 627759 - DNA, 20 bp, mouse
gacatggcggcacccgaaac

SEQ ID NO: 627760 - DNA, 20 bp, mouse
gtgaggagaaatcaccgtta

SEQ ID NO: 627761 - DNA, 20 bp, mouse
ggtgcagcgacgcggggatt

SEQ ID NO: 627762 - DNA, 20 bp, mouse
gcaccttgcccgggactaaa

SEQ ID NO: 627763 - DNA, 20 bp, mouse
gctgaggcgtgggagccggc

SEQ ID NO: 627764 - DNA, 20 bp, mouse
gccgccgacaggtgacgaag

SEQ ID NO: 627765 - DNA, 20 bp, mouse
gggcggcgtgcagcgacgcg

SEQ ID NO: 627766 - DNA, 20 bp, mouse
gcggagtgcggaggcgacag

SEQ ID NO: 627767 - DNA, 20 bp, mouse
gcagcgggatgtgcgttcac

SEQ ID NO: 627768 - DNA, 20 bp, mouse
gggcggcacccaggagccga

SEQ ID NO: 627769 - DNA, 20 bp, mouse
gagctgcggtgggtcgccca

SEQ ID NO: 627770 - DNA, 20 bp, mouse
gggtgccgccccgcaggtga

SEQ ID NO: 627771 - DNA, 20 bp, mouse
gcaaggggcgaacccgacac

SEQ ID NO: 627772 - DNA, 20 bp, mouse
gtccgcgcccctcggctcct

SEQ ID NO: 627773 - DNA, 20 bp, mouse
gccttccctcacctgcgggg

SEQ ID NO: 627774 - DNA, 20 bp, mouse
gagccgaggggcgcggagtg

SEQ ID NO: 627775 - DNA, 20 bp, mouse
gactgtgagagctcttgagc

SEQ ID NO: 627776 - DNA, 20 bp, mouse
gccgaggagggagagctgca

SEQ ID NO: 627777 - DNA, 20 bp, mouse
gtcgcggcagcacccgctgg

SEQ ID NO: 627778 - DNA, 20 bp, mouse
ggctctctaggacccgagga

SEQ ID NO: 627779 - DNA, 20 bp, mouse
gcgctcgcggcagcacccgc

SEQ ID NO: 627780 - DNA, 20 bp, mouse
gccgcgagcggccggccgag

SEQ ID NO: 627781 - DNA, 20 bp, mouse
gccgggcagctcggtccatg

SEQ ID NO: 627782 - DNA, 20 bp, mouse
gctgcgccgagcccgataaa

SEQ ID NO: 627783 - DNA, 20 bp, mouse
gcatttccagccccctcggc

SEQ ID NO: 627784 - DNA, 20 bp, mouse
ggggtgctgccgcgagcggc

SEQ ID NO: 627785 - DNA, 20 bp, mouse
ggccaggccacctggaaagg

SEQ ID NO: 627786 - DNA, 20 bp, mouse
gtactgaacaaccagcgaag

SEQ ID NO: 627787 - DNA, 20 bp, mouse
gtgaacaaccagcgaagcgg

SEQ ID NO: 627788 - DNA, 20 bp, mouse
ggtacctgctcggcgtggag

SEQ ID NO: 627789 - DNA, 20 bp, mouse
ggaggctacagtcgcgccaa

SEQ ID NO: 627790 - DNA, 20 bp, mouse
gccggtttccaggagcgagg

SEQ ID NO: 627791 - DNA, 20 bp, mouse
gtggttgttcagtacctgct

SEQ ID NO: 627792 - DNA, 20 bp, mouse
ggttcagtacctgctcggcg

SEQ ID NO: 627793 - DNA, 20 bp, mouse
gaaaatccataactcagaca

SEQ ID NO: 627794 - DNA, 20 bp, mouse
gtgccgagggccggattggg

SEQ ID NO: 627795 - DNA, 20 bp, mouse
ggggagcagccggcccctgg

SEQ ID NO: 627796 - DNA, 20 bp, mouse
gacgtctagcctggaaccga

SEQ ID NO: 627797 - DNA, 20 bp, mouse
gcttgcagtcccgagctcgg

SEQ ID NO: 627798 - DNA, 20 bp, mouse
gcgtgaggtcccccgagctc

SEQ ID NO: 627799 - DNA, 20 bp, mouse
ggccgcgcgggagagcgaat

SEQ ID NO: 627800 - DNA, 20 bp, mouse
gaacttacgcgcggtcccag

SEQ ID NO: 627801 - DNA, 20 bp, mouse
gaatacctcgggatccgtca

SEQ ID NO: 627802 - DNA, 20 bp, mouse
gtgaccctggaggaactgct

SEQ ID NO: 627803 - DNA, 20 bp, mouse
gccgcggggcagcttcctag

SEQ ID NO: 627804 - DNA, 20 bp, mouse
gttacgcgcggtcccagggg

SEQ ID NO: 627805 - DNA, 20 bp, mouse
gaaggacgttcgtgaggctc

SEQ ID NO: 627806 - DNA, 20 bp, mouse
gcacagagtgaggtccgcca

SEQ ID NO: 627807 - DNA, 20 bp, mouse
gaccagcgcggggagtgtca

SEQ ID NO: 627808 - DNA, 20 bp, mouse
ggacggcccgtgggacgcag

SEQ ID NO: 627809 - DNA, 20 bp, mouse
gggccacgtggagctgtcgg

SEQ ID NO: 627810 - DNA, 20 bp, mouse
ggagctgcgcgacggcccgt

SEQ ID NO: 627811 - DNA, 20 bp, mouse
gccgtgggacgcagaggccg

SEQ ID NO: 627812 - DNA, 20 bp, mouse
gaggaggtggagctgcgcga

SEQ ID NO: 627813 - DNA, 20 bp, mouse
gcagaggcgcgcggaggaca

SEQ ID NO: 627814 - DNA, 20 bp, mouse
gcagctcgcaggctccggtc

SEQ ID NO: 627815 - DNA, 20 bp, mouse
gggagcctgcgagctgtagg

SEQ ID NO: 627816 - DNA, 20 bp, mouse
gtacggccggaccaagatgg

SEQ ID NO: 627817 - DNA, 20 bp, mouse
ggatggcggctaccagtgag

SEQ ID NO: 627818 - DNA, 20 bp, mouse
ggcaaacagcggcccctcac

SEQ ID NO: 627819 - DNA, 20 bp, mouse
gcaatactcgcagcaaacag

SEQ ID NO: 627820 - DNA, 20 bp, mouse
gttctggggtgtcccttcag

SEQ ID NO: 627821 - DNA, 20 bp, mouse
gacgcgaggggacccattta

SEQ ID NO: 627822 - DNA, 20 bp, mouse
gatttacggccggaccaaga

SEQ ID NO: 627823 - DNA, 20 bp, mouse
gtacctcgcccaccaagtca

SEQ ID NO: 627824 - DNA, 20 bp, mouse
ggagcaaccgcttggagcag

SEQ ID NO: 627825 - DNA, 20 bp, mouse
ggaattgtcccggaagaggg

SEQ ID NO: 627826 - DNA, 20 bp, mouse
ggccacaaaccagtaggagg

SEQ ID NO: 627827 - DNA, 20 bp, mouse
gaaagccacaaaccagtagg

SEQ ID NO: 627828 - DNA, 20 bp, mouse
gcaatacagccacctcctac

SEQ ID NO: 627829 - DNA, 20 bp, mouse
gctttgagcctgtgtggtaa

SEQ ID NO: 627830 - DNA, 20 bp, mouse
gttgtggctttgagcctgtg

SEQ ID NO: 627831 - DNA, 20 bp, mouse
gtcccttcccaggcatccct

SEQ ID NO: 627832 - DNA, 20 bp, mouse
gaaaaaaaatgcaccagcca

SEQ ID NO: 627833 - DNA, 20 bp, mouse
ggatgaggtgaagaatgaag

SEQ ID NO: 627834 - DNA, 20 bp, mouse
ggaggggtgatcgaggagag

SEQ ID NO: 627835 - DNA, 20 bp, mouse
ggggaagggaggggtgatcg

SEQ ID NO: 627836 - DNA, 20 bp, mouse
ggagctatgagccgatgcat

SEQ ID NO: 627837 - DNA, 20 bp, mouse
ggatggcgactcccatgcat

SEQ ID NO: 627838 - DNA, 20 bp, mouse
ggactccagccgctccaaga

SEQ ID NO: 627839 - DNA, 20 bp, mouse
ggcatcggctcatagctcga

SEQ ID NO: 627840 - DNA, 20 bp, mouse
gatcttgagagggaagatgt

SEQ ID NO: 627841 - DNA, 20 bp, mouse
gtgacatgtggaccggacag

SEQ ID NO: 627842 - DNA, 20 bp, mouse
ggcgtaagtgagatgcttgt

SEQ ID NO: 627843 - DNA, 20 bp, mouse
gcgctcactagctagcggac

SEQ ID NO: 627844 - DNA, 20 bp, mouse
ggcgcccgctcactagctag

SEQ ID NO: 627845 - DNA, 20 bp, mouse
gctacccttgacatgtggac

SEQ ID NO: 627846 - DNA, 20 bp, mouse
ggtgtcctggcctccatcgg

SEQ ID NO: 627847 - DNA, 20 bp, mouse
ggccaggacacgacgagctc

SEQ ID NO: 627848 - DNA, 20 bp, mouse
ggaagtgccaggccccgagg

SEQ ID NO: 627849 - DNA, 20 bp, mouse
gccgtcgccgccgccgatgg

SEQ ID NO: 627850 - DNA, 20 bp, mouse
ggcgaggcgccgcacctgaa

SEQ ID NO: 627851 - DNA, 20 bp, mouse
gggcgcggcggacatggcgg

SEQ ID NO: 627852 - DNA, 20 bp, mouse
gcggtcgcccggaaacaatg

SEQ ID NO: 627853 - DNA, 20 bp, mouse
gtgggaggagatagcctcgg

SEQ ID NO: 627854 - DNA, 20 bp, mouse
gtggctggagcgggcctgca

SEQ ID NO: 627855 - DNA, 20 bp, mouse
ggcacgccgacgccgggaag

SEQ ID NO: 627856 - DNA, 20 bp, mouse
gtacctgtgggtaagtagct

SEQ ID NO: 627857 - DNA, 20 bp, mouse
gttcgaatccggttacctgt

SEQ ID NO: 627858 - DNA, 20 bp, mouse
ggtcccggggagaaaagtgc

SEQ ID NO: 627859 - DNA, 20 bp, mouse
gtcgaatagcgcagtttcca

SEQ ID NO: 627860 - DNA, 20 bp, mouse
gaggggaagaggccaactgg

SEQ ID NO: 627861 - DNA, 20 bp, mouse
gctggctaccagtggatcac

SEQ ID NO: 627862 - DNA, 20 bp, mouse
ggtagcttcgagtcgcctag

SEQ ID NO: 627863 - DNA, 20 bp, mouse
gaggagcggcctatgcccga

SEQ ID NO: 627864 - DNA, 20 bp, mouse
ggatgggtgattccttggtg

SEQ ID NO: 627865 - DNA, 20 bp, mouse
ggatgggatgggtgattcct

SEQ ID NO: 627866 - DNA, 20 bp, mouse
gctcggggcccgtggcagtg

SEQ ID NO: 627867 - DNA, 20 bp, mouse
gtcctaggcaggtagcctcg

SEQ ID NO: 627868 - DNA, 20 bp, mouse
ggccccgaggctacctgcct

SEQ ID NO: 627869 - DNA, 20 bp, mouse
gtcctaagggaggaacccga

SEQ ID NO: 627870 - DNA, 20 bp, mouse
ggcccacaccccactgccac

SEQ ID NO: 627871 - DNA, 20 bp, mouse
gtttccatctaagccatcct

SEQ ID NO: 627872 - DNA, 20 bp, mouse
gtgggtacggtgagatcttc

SEQ ID NO: 627873 - DNA, 20 bp, mouse
gcttttactgctcatgggta

SEQ ID NO: 627874 - DNA, 20 bp, mouse
gcatctaagccatcctaggc

SEQ ID NO: 627875 - DNA, 20 bp, mouse
gcccgggagtgtcctaaggg

SEQ ID NO: 627876 - DNA, 20 bp, mouse
ggcgcggcggagggatccag

SEQ ID NO: 627877 - DNA, 20 bp, mouse
gagagcgcgctcgcgagcac

SEQ ID NO: 627878 - DNA, 20 bp, mouse
gagggatccagcgggacccg

SEQ ID NO: 627879 - DNA, 20 bp, mouse
gatccagcgggacccgcgga

SEQ ID NO: 627880 - DNA, 20 bp, mouse
gcagccgcggccagcggagt

SEQ ID NO: 627881 - DNA, 20 bp, mouse
gcccgcactgacagaccctg

SEQ ID NO: 627882 - DNA, 20 bp, mouse
gcgccgcgccaggcccgtcc

SEQ ID NO: 627883 - DNA, 20 bp, mouse
gccgggccgcgatccgtccg

SEQ ID NO: 627884 - DNA, 20 bp, mouse
ggggacccgcggacggatcg

SEQ ID NO: 627885 - DNA, 20 bp, mouse
gagtgcgggccgccccccga

SEQ ID NO: 627886 - DNA, 20 bp, mouse
ggagatgagacggtgggacg

SEQ ID NO: 627887 - DNA, 20 bp, mouse
ggtggtggcagagacccgag

SEQ ID NO: 627888 - DNA, 20 bp, mouse
ggctacagagcgggcaggag

SEQ ID NO: 627889 - DNA, 20 bp, mouse
ggtagctcagtggccagggg

SEQ ID NO: 627890 - DNA, 20 bp, mouse
ggggcagcgggggctgactt

SEQ ID NO: 627891 - DNA, 20 bp, mouse
gggccactgagctacagagc

SEQ ID NO: 627892 - DNA, 20 bp, mouse
ggggggagagatgagacggt

SEQ ID NO: 627893 - DNA, 20 bp, mouse
gcatctctcccccctcggta

SEQ ID NO: 627894 - DNA, 20 bp, mouse
gactatgtgggtcatcctgg

SEQ ID NO: 627895 - DNA, 20 bp, mouse
gcagagacccgaggggcgag

SEQ ID NO: 627896 - DNA, 20 bp, mouse
gggcgttcctagctatgaag

SEQ ID NO: 627897 - DNA, 20 bp, mouse
gcatcgtgggtgagaacgag

SEQ ID NO: 627898 - DNA, 20 bp, mouse
gggacagccgcttcatagct

SEQ ID NO: 627899 - DNA, 20 bp, mouse
gcgggcgcgcagtgcatcgt

SEQ ID NO: 627900 - DNA, 20 bp, mouse
gagaacgagcggagcaggtt

SEQ ID NO: 627901 - DNA, 20 bp, mouse
gatgaagcggctgtcctgct

SEQ ID NO: 627902 - DNA, 20 bp, mouse
ggcggctgtcctgctaggcg

SEQ ID NO: 627903 - DNA, 20 bp, mouse
ggaaagagaagtcccttggt

SEQ ID NO: 627904 - DNA, 20 bp, mouse
gcagccttagcagcatgggg

SEQ ID NO: 627905 - DNA, 20 bp, mouse
ggtcctgctaggcgcggacg

SEQ ID NO: 627906 - DNA, 20 bp, mouse
gctctgcaggctgaaattga

SEQ ID NO: 627907 - DNA, 20 bp, mouse
gtgcagggtcgcccagccag

SEQ ID NO: 627908 - DNA, 20 bp, mouse
gaggctgaaattgagggcgg

SEQ ID NO: 627909 - DNA, 20 bp, mouse
ggtcgcagccgcggtttcca

SEQ ID NO: 627910 - DNA, 20 bp, mouse
gatagctgccttggaaaccg

SEQ ID NO: 627911 - DNA, 20 bp, mouse
gggtagcagagtcgcagccg

SEQ ID NO: 627912 - DNA, 20 bp, mouse
gtgcataatgcggagatggg

SEQ ID NO: 627913 - DNA, 20 bp, mouse
gcatctacgaaggtaaaggg

SEQ ID NO: 627914 - DNA, 20 bp, mouse
ggaggtgcaactgcataatg

SEQ ID NO: 627915 - DNA, 20 bp, mouse
gcacctcgtaggccttgcag

SEQ ID NO: 627916 - DNA, 20 bp, mouse
ggcgccggctcgagagggaa

SEQ ID NO: 627917 - DNA, 20 bp, mouse
gtgccagcgccggctcgaga

SEQ ID NO: 627918 - DNA, 20 bp, mouse
ggagccgagcgcccgggcgg

SEQ ID NO: 627919 - DNA, 20 bp, mouse
gccgtgcggacgcggaaagg

SEQ ID NO: 627920 - DNA, 20 bp, mouse
ggagcggcttggcgaggagg

SEQ ID NO: 627921 - DNA, 20 bp, mouse
gtggggtgcgtcgacttcgg

SEQ ID NO: 627922 - DNA, 20 bp, mouse
ggccccgtgcggacgcggaa

SEQ ID NO: 627923 - DNA, 20 bp, mouse
ggacgcggaaaggcggaagg

SEQ ID NO: 627924 - DNA, 20 bp, mouse
gccgcgacggctcctcccct

SEQ ID NO: 627925 - DNA, 20 bp, mouse
gcgcacggggctggcggtga

SEQ ID NO: 627926 - DNA, 20 bp, mouse
gccactgctgcagttcgggg

SEQ ID NO: 627927 - DNA, 20 bp, mouse
gctgcagttcggggaggcgg

SEQ ID NO: 627928 - DNA, 20 bp, mouse
ggctggctggtacaccgagg

SEQ ID NO: 627929 - DNA, 20 bp, mouse
gtgcagcagtgggcgcgcac

SEQ ID NO: 627930 - DNA, 20 bp, mouse
gtgggctggctggtacaccg

SEQ ID NO: 627931 - DNA, 20 bp, mouse
ggaggcggcgctcgtgtcga

SEQ ID NO: 627932 - DNA, 20 bp, mouse
gggaggggccggcaccgcca

SEQ ID NO: 627933 - DNA, 20 bp, mouse
gcgcccactgctgcagttcg

SEQ ID NO: 627934 - DNA, 20 bp, mouse
gtcgggccggaaggcatcga

SEQ ID NO: 627935 - DNA, 20 bp, mouse
gccagcccagctactcaact

SEQ ID NO: 627936 - DNA, 20 bp, mouse
ggaggtaacatggccaccgg

SEQ ID NO: 627937 - DNA, 20 bp, mouse
gatggccaccggcggcggag

SEQ ID NO: 627938 - DNA, 20 bp, mouse
gcggaggaggagtcacagcg

SEQ ID NO: 627939 - DNA, 20 bp, mouse
gctcggaccgcgggaacgag

SEQ ID NO: 627940 - DNA, 20 bp, mouse
gggaccgcgggaacgagtgg

SEQ ID NO: 627941 - DNA, 20 bp, mouse
gcccgcgtcgaggaacccga

SEQ ID NO: 627942 - DNA, 20 bp, mouse
ggccgccgcagagaccctac

SEQ ID NO: 627943 - DNA, 20 bp, mouse
gtgctgggaaagaggtaaca

SEQ ID NO: 627944 - DNA, 20 bp, mouse
ggtaacatggccaccggcgg

SEQ ID NO: 627945 - DNA, 20 bp, mouse
gaaagaggtaacatggccac

SEQ ID NO: 627946 - DNA, 20 bp, mouse
ggggactcaagacagtccat

SEQ ID NO: 627947 - DNA, 20 bp, mouse
gactgtcttgagtccctgga

SEQ ID NO: 627948 - DNA, 20 bp, mouse
ggacttcggcagaaagatgg

SEQ ID NO: 627949 - DNA, 20 bp, mouse
gggaagcgccacctctaccc

SEQ ID NO: 627950 - DNA, 20 bp, mouse
gcgggacttcggcagaaaga

SEQ ID NO: 627951 - DNA, 20 bp, mouse
gacacaaggtaaggaagagg

SEQ ID NO: 627952 - DNA, 20 bp, mouse
ggcctctgtcccaaccaagg

SEQ ID NO: 627953 - DNA, 20 bp, mouse
gcgtagggcgtccggggtag

SEQ ID NO: 627954 - DNA, 20 bp, mouse
gcgcgtcgccatcaccctcc

SEQ ID NO: 627955 - DNA, 20 bp, mouse
ggcagccaggacctctctgg

SEQ ID NO: 627956 - DNA, 20 bp, mouse
ggtctgcatagccatcgctg

SEQ ID NO: 627957 - DNA, 20 bp, mouse
gattaccatttagagatgta

SEQ ID NO: 627958 - DNA, 20 bp, mouse
gagtgtgtgaatggctgcgg

SEQ ID NO: 627959 - DNA, 20 bp, mouse
gacacttctctcctcagcga

SEQ ID NO: 627960 - DNA, 20 bp, mouse
gccatttagagatgtagggc

SEQ ID NO: 627961 - DNA, 20 bp, mouse
gtgactagcataggaattgg

SEQ ID NO: 627962 - DNA, 20 bp, mouse
gaatgttacattgaaatatt

SEQ ID NO: 627963 - DNA, 20 bp, mouse
gtaaaaacgacttaaaacaa

SEQ ID NO: 627964 - DNA, 20 bp, mouse
gtcccgtgtctgattgtgtg

SEQ ID NO: 627965 - DNA, 20 bp, mouse
ggcgctctaaacatctgatt

SEQ ID NO: 627966 - DNA, 20 bp, mouse
gaagcggcgggggaccgcag

SEQ ID NO: 627967 - DNA, 20 bp, mouse
gccggagggacgcgacgaga

SEQ ID NO: 627968 - DNA, 20 bp, mouse
gccagcccggaggcgagtcc

SEQ ID NO: 627969 - DNA, 20 bp, mouse
gtgaggagccgggcccggac

SEQ ID NO: 627970 - DNA, 20 bp, mouse
ggggcccggacaggaagcgg

SEQ ID NO: 627971 - DNA, 20 bp, mouse
ggcccggaggcgagtcccgg

SEQ ID NO: 627972 - DNA, 20 bp, mouse
gacgcgacgagacggcgccc

SEQ ID NO: 627973 - DNA, 20 bp, mouse
gacccacgggcccagcccgg

SEQ ID NO: 627974 - DNA, 20 bp, mouse
gcgaggcggccggagaagga

SEQ ID NO: 627975 - DNA, 20 bp, mouse
ggcactcaccagcgccgctg

SEQ ID NO: 627976 - DNA, 20 bp, mouse
gcgaccaggaagcaccaacc

SEQ ID NO: 627977 - DNA, 20 bp, mouse
gcactgccgcggccgcgacc

SEQ ID NO: 627978 - DNA, 20 bp, mouse
gcaggaaccgaaacgcgtag

SEQ ID NO: 627979 - DNA, 20 bp, mouse
gccggccgcgggacagctcg

SEQ ID NO: 627980 - DNA, 20 bp, mouse
gggaggggcgaggacaaatg

SEQ ID NO: 627981 - DNA, 20 bp, mouse
gcgaaacgcgtagaggaacg

SEQ ID NO: 627982 - DNA, 20 bp, mouse
gaacgcgtagaggaacgggg

SEQ ID NO: 627983 - DNA, 20 bp, mouse
gtgcttcctggtcgcggccg

SEQ ID NO: 627984 - DNA, 20 bp, mouse
ggtcactgagccgcgtgggg

SEQ ID NO: 627985 - DNA, 20 bp, mouse
gacgcgtttcggttcctggt

SEQ ID NO: 627986 - DNA, 20 bp, mouse
gcggcgtcgactcctctggt

SEQ ID NO: 627987 - DNA, 20 bp, mouse
gggcgacctagagctcttcg

SEQ ID NO: 627988 - DNA, 20 bp, mouse
ggaggcgtttgacccaccag

SEQ ID NO: 627989 - DNA, 20 bp, mouse
gaaacgcctcgaagagctct

SEQ ID NO: 627990 - DNA, 20 bp, mouse
gcccaagatggcggccggtg

SEQ ID NO: 627991 - DNA, 20 bp, mouse
ggcttcggcgtcgactcctc

SEQ ID NO: 627992 - DNA, 20 bp, mouse
gtcggcgcggagctgctcga

SEQ ID NO: 627993 - DNA, 20 bp, mouse
gcgcgccggaaggatattct

SEQ ID NO: 627994 - DNA, 20 bp, mouse
ggcgcggagctgctcgatgg

SEQ ID NO: 627995 - DNA, 20 bp, mouse
gtggcggccggtgtggattt

SEQ ID NO: 627996 - DNA, 20 bp, mouse
gatggccgcgatctcatccg

SEQ ID NO: 627997 - DNA, 20 bp, mouse
ggctctggaggattcagacc

SEQ ID NO: 627998 - DNA, 20 bp, mouse
gctcctgcgggagatcgcga

SEQ ID NO: 627999 - DNA, 20 bp, mouse
gaaccagagaagcccggccc

SEQ ID NO: 628000 - DNA, 20 bp, mouse
gagatcgcggccatagagac

SEQ ID NO: 628001 - DNA, 20 bp, mouse
ggtcggccaaggtagcacag

SEQ ID NO: 628002 - DNA, 20 bp, mouse
gggaggattcagacccggta

SEQ ID NO: 628003 - DNA, 20 bp, mouse
ggcgcccacgccttaaccgg

SEQ ID NO: 628004 - DNA, 20 bp, mouse
gggagctacgcgggtaccac

SEQ ID NO: 628005 - DNA, 20 bp, mouse
gggtgcacttccggtctcta

SEQ ID NO: 628006 - DNA, 20 bp, mouse
gagaggatgcgagcccgcgg

SEQ ID NO: 628007 - DNA, 20 bp, mouse
ggcgcagaggcgaagcggag

SEQ ID NO: 628008 - DNA, 20 bp, mouse
gcggcgccgggcccaggaga

SEQ ID NO: 628009 - DNA, 20 bp, mouse
gcccgcggcggcttcacctc

SEQ ID NO: 628010 - DNA, 20 bp, mouse
gggcgtccgcgaacgcagcg

SEQ ID NO: 628011 - DNA, 20 bp, mouse
gccgcggcgcgcaaaagcgc

SEQ ID NO: 628012 - DNA, 20 bp, mouse
gcgccgaaggtaagctccca

SEQ ID NO: 628013 - DNA, 20 bp, mouse
gcttcggcgcagaggcgaag

SEQ ID NO: 628014 - DNA, 20 bp, mouse
gccccaggaacgtccagccg

SEQ ID NO: 628015 - DNA, 20 bp, mouse
gcggagaggatgcgagcccg

SEQ ID NO: 628016 - DNA, 20 bp, mouse
gtcctcgcgccttctcctgg

SEQ ID NO: 628017 - DNA, 20 bp, mouse
ggtggaagggatgtgcggaa

SEQ ID NO: 628018 - DNA, 20 bp, mouse
ggtgtcctcgcgccttctcc

SEQ ID NO: 628019 - DNA, 20 bp, mouse
gcgggaaaagttgctcgagg

SEQ ID NO: 628020 - DNA, 20 bp, mouse
gtggcgggaaaagttgctcg

SEQ ID NO: 628021 - DNA, 20 bp, mouse
gaaagttgctcgaggtggaa

SEQ ID NO: 628022 - DNA, 20 bp, mouse
gtggggcgacgaggacctaa

SEQ ID NO: 628023 - DNA, 20 bp, mouse
gtacttgacgctctgagggg

SEQ ID NO: 628024 - DNA, 20 bp, mouse
gttttcccgccaccaggaga

SEQ ID NO: 628025 - DNA, 20 bp, mouse
gcaggggctaaggtccgctg

SEQ ID NO: 628026 - DNA, 20 bp, mouse
ggagttcgtgcacagaacat

SEQ ID NO: 628027 - DNA, 20 bp, mouse
gggacagcagcctccatttc

SEQ ID NO: 628028 - DNA, 20 bp, mouse
gctccggggccgggcccatc

SEQ ID NO: 628029 - DNA, 20 bp, mouse
gtgatcagcatcagcctgat

SEQ ID NO: 628030 - DNA, 20 bp, mouse
gagctgctccgtctccgagg

SEQ ID NO: 628031 - DNA, 20 bp, mouse
ggcacgaactcgctgctctc

SEQ ID NO: 628032 - DNA, 20 bp, mouse
gagcagctgctccgtctccg

SEQ ID NO: 628033 - DNA, 20 bp, mouse
gccagtgtgagtgaggctat

SEQ ID NO: 628034 - DNA, 20 bp, mouse
gatctcagttccttgaaaac

SEQ ID NO: 628035 - DNA, 20 bp, mouse
gagtgaaccccagcgagccc

SEQ ID NO: 628036 - DNA, 20 bp, mouse
gcccgcccggaacggaggag

SEQ ID NO: 628037 - DNA, 20 bp, mouse
gccggaacggaggagcggag

SEQ ID NO: 628038 - DNA, 20 bp, mouse
ggggccacgcccgcccggaa

SEQ ID NO: 628039 - DNA, 20 bp, mouse
gccacgcccgcccggaacgg

SEQ ID NO: 628040 - DNA, 20 bp, mouse
ggagcaggaggcatccacgg

SEQ ID NO: 628041 - DNA, 20 bp, mouse
gggagagcaggaggcatcca

SEQ ID NO: 628042 - DNA, 20 bp, mouse
gggcccggaaggagagcagg

SEQ ID NO: 628043 - DNA, 20 bp, mouse
ggagcgcgtgtcgctcgacg

SEQ ID NO: 628044 - DNA, 20 bp, mouse
gaggccgcccgagtccgtcg

SEQ ID NO: 628045 - DNA, 20 bp, mouse
gcccgagcccagtcgcgact

SEQ ID NO: 628046 - DNA, 20 bp, mouse
gtgccagcgggtccttgcta

SEQ ID NO: 628047 - DNA, 20 bp, mouse
gctaaggcggaaggactctg

SEQ ID NO: 628048 - DNA, 20 bp, mouse
gtccatcccggacggaggtt

SEQ ID NO: 628049 - DNA, 20 bp, mouse
ggtgcagccgtgccaggcca

SEQ ID NO: 628050 - DNA, 20 bp, mouse
gcagcgggtccttgctaagg

SEQ ID NO: 628051 - DNA, 20 bp, mouse
gaccacgcgcaggtgaggag

SEQ ID NO: 628052 - DNA, 20 bp, mouse
ggcggctccatcccggacgg

SEQ ID NO: 628053 - DNA, 20 bp, mouse
gagcctgccttggcctggca

SEQ ID NO: 628054 - DNA, 20 bp, mouse
gtgaggcccaacctccgtcc

SEQ ID NO: 628055 - DNA, 20 bp, mouse
ggagtccttccgccttagca

SEQ ID NO: 628056 - DNA, 20 bp, mouse
ggtgctgacatgttaaacag

SEQ ID NO: 628057 - DNA, 20 bp, mouse
gcaacctgatgaaagaggta

SEQ ID NO: 628058 - DNA, 20 bp, mouse
gcagagtagacactagccaa

SEQ ID NO: 628059 - DNA, 20 bp, mouse
ggacatgttaaacagtggta

SEQ ID NO: 628060 - DNA, 20 bp, mouse
gggcgttcccacgaacaaag

SEQ ID NO: 628061 - DNA, 20 bp, mouse
gcattcagggagttatgagt

SEQ ID NO: 628062 - DNA, 20 bp, mouse
gctgttcaacctgatgaaag

SEQ ID NO: 628063 - DNA, 20 bp, mouse
ggatagctggggtctccagt

SEQ ID NO: 628064 - DNA, 20 bp, mouse
gccctgaatgagagcctcac

SEQ ID NO: 628065 - DNA, 20 bp, mouse
gcatccttacctctttcatc

SEQ ID NO: 628066 - DNA, 20 bp, mouse
ggcatcccagagttaagcgg

SEQ ID NO: 628067 - DNA, 20 bp, mouse
gagacgcttgaggaactggt

SEQ ID NO: 628068 - DNA, 20 bp, mouse
gctgcgcgcttcttccgggt

SEQ ID NO: 628069 - DNA, 20 bp, mouse
gtaactctgggatgctggtg

SEQ ID NO: 628070 - DNA, 20 bp, mouse
gtgggatgctggtgcggact

SEQ ID NO: 628071 - DNA, 20 bp, mouse
gggcacaccgtgctgacctg

SEQ ID NO: 628072 - DNA, 20 bp, mouse
gttggccgccgcttaactct

SEQ ID NO: 628073 - DNA, 20 bp, mouse
gacaggtagagcccagggat

SEQ ID NO: 628074 - DNA, 20 bp, mouse
gtcttccgggtgggctcggg

SEQ ID NO: 628075 - DNA, 20 bp, mouse
ggtgattccccaggtcagca

SEQ ID NO: 628076 - DNA, 20 bp, mouse
gcggctccagcgcaaagtgg

SEQ ID NO: 628077 - DNA, 20 bp, mouse
gaggcgtgcttggagagccg

SEQ ID NO: 628078 - DNA, 20 bp, mouse
ggccggaagtgggcgagagg

SEQ ID NO: 628079 - DNA, 20 bp, mouse
gccgcggctccagcgcaaag

SEQ ID NO: 628080 - DNA, 20 bp, mouse
gcggagcgcgagccggaagt

SEQ ID NO: 628081 - DNA, 20 bp, mouse
gacgcccagccgccgaatgg

SEQ ID NO: 628082 - DNA, 20 bp, mouse
gcagcgcaaagtggcggccg

SEQ ID NO: 628083 - DNA, 20 bp, mouse
ggagcgggcgcgggtcgtga

SEQ ID NO: 628084 - DNA, 20 bp, mouse
gcgagccggaagtgggcgag

SEQ ID NO: 628085 - DNA, 20 bp, mouse
gggtgagcgcggctggacgt

SEQ ID NO: 628086 - DNA, 20 bp, mouse
gcgcgacgagggccgccgga

SEQ ID NO: 628087 - DNA, 20 bp, mouse
ggacaaccctagcgcgacga

SEQ ID NO: 628088 - DNA, 20 bp, mouse
gcagtgtccccgcggccctc

SEQ ID NO: 628089 - DNA, 20 bp, mouse
gaccttacgccggctccctc

SEQ ID NO: 628090 - DNA, 20 bp, mouse
gacaccggcaacccctccca

SEQ ID NO: 628091 - DNA, 20 bp, mouse
ggaggcagcagaccttacgc

SEQ ID NO: 628092 - DNA, 20 bp, mouse
ggcgcagaagtggctccgga

SEQ ID NO: 628093 - DNA, 20 bp, mouse
gcctggtcgaggcgcagaag

SEQ ID NO: 628094 - DNA, 20 bp, mouse
gaccccccggctggaagcca

SEQ ID NO: 628095 - DNA, 20 bp, mouse
gagtagaaaccacctggtcg

SEQ ID NO: 628096 - DNA, 20 bp, mouse
gcacccaggacagtacccgg

SEQ ID NO: 628097 - DNA, 20 bp, mouse
gtcgagccgaagatgcggcg

SEQ ID NO: 628098 - DNA, 20 bp, mouse
ggatcttcgagccgaagatg

SEQ ID NO: 628099 - DNA, 20 bp, mouse
ggacatcggtatgaaggata

SEQ ID NO: 628100 - DNA, 20 bp, mouse
ggtaggaccagagaacgacg

SEQ ID NO: 628101 - DNA, 20 bp, mouse
gtccagccccgccgcatctt

SEQ ID NO: 628102 - DNA, 20 bp, mouse
gagagtcagggaattatcga

SEQ ID NO: 628103 - DNA, 20 bp, mouse
gtgccgccgggtactgtcct

SEQ ID NO: 628104 - DNA, 20 bp, mouse
gccaggccgcaggactcaca

SEQ ID NO: 628105 - DNA, 20 bp, mouse
ggggaaaagccgcagggtga

SEQ ID NO: 628106 - DNA, 20 bp, mouse
gcccaggccgggccgagcta

SEQ ID NO: 628107 - DNA, 20 bp, mouse
gtgtgggctgagggccatgg

SEQ ID NO: 628108 - DNA, 20 bp, mouse
gagctaaggctgacccacca

SEQ ID NO: 628109 - DNA, 20 bp, mouse
gagcccacagcgctagccag

SEQ ID NO: 628110 - DNA, 20 bp, mouse
gtggacaccgggactcggat

SEQ ID NO: 628111 - DNA, 20 bp, mouse
ggtccgctggctagcgctgt

SEQ ID NO: 628112 - DNA, 20 bp, mouse
gggcaggtcgtagagagatc

SEQ ID NO: 628113 - DNA, 20 bp, mouse
gtgcgcagctgggtggtgat

SEQ ID NO: 628114 - DNA, 20 bp, mouse
gcgctgtgggctgagggcca

SEQ ID NO: 628115 - DNA, 20 bp, mouse
gcggcagcggcacctacacc

SEQ ID NO: 628116 - DNA, 20 bp, mouse
gtcacctccgggtggagaag

SEQ ID NO: 628117 - DNA, 20 bp, mouse
gtccacccggaggtgaggga

SEQ ID NO: 628118 - DNA, 20 bp, mouse
ggccgtccctcacctccggg

SEQ ID NO: 628119 - DNA, 20 bp, mouse
ggcgagcgagcggataacgg

SEQ ID NO: 628120 - DNA, 20 bp, mouse
ggtgccccttctccacccgg

SEQ ID NO: 628121 - DNA, 20 bp, mouse
gacctgtggcgggaccccgg

SEQ ID NO: 628122 - DNA, 20 bp, mouse
gcggcgccgtccctcacctc

SEQ ID NO: 628123 - DNA, 20 bp, mouse
ggatgagtacgagaccgaaa

SEQ ID NO: 628124 - DNA, 20 bp, mouse
gaggcttggagcgagaccag

SEQ ID NO: 628125 - DNA, 20 bp, mouse
gggatttaacaccaagatgg

SEQ ID NO: 628126 - DNA, 20 bp, mouse
gccgggaccgggccgagcag

SEQ ID NO: 628127 - DNA, 20 bp, mouse
ggctcggcccggtcccggag

SEQ ID NO: 628128 - DNA, 20 bp, mouse
ggctccgcgcccggccgctc

SEQ ID NO: 628129 - DNA, 20 bp, mouse
gccggcctccgcagtagaag

SEQ ID NO: 628130 - DNA, 20 bp, mouse
gcggccccggcgtaagtggg

SEQ ID NO: 628131 - DNA, 20 bp, mouse
gccacctccgctgctcggcc

SEQ ID NO: 628132 - DNA, 20 bp, mouse
ggtactcgcagtccttcatg

SEQ ID NO: 628133 - DNA, 20 bp, mouse
gcccgcggccggccgcatga

SEQ ID NO: 628134 - DNA, 20 bp, mouse
gcaggcaggctcgctcgggt

SEQ ID NO: 628135 - DNA, 20 bp, mouse
gggctcatgctggccggcca

SEQ ID NO: 628136 - DNA, 20 bp, mouse
gacatgactcccatactcac

SEQ ID NO: 628137 - DNA, 20 bp, mouse
gataatttacctgtgagtat

SEQ ID NO: 628138 - DNA, 20 bp, mouse
ggaccacgtggaggtcgggg

SEQ ID NO: 628139 - DNA, 20 bp, mouse
ggctatggcaatgaaattct

SEQ ID NO: 628140 - DNA, 20 bp, mouse
gtataagacttcatactagc

SEQ ID NO: 628141 - DNA, 20 bp, mouse
ggagctataagaacatcctc

SEQ ID NO: 628142 - DNA, 20 bp, mouse
gctccccctacacccgccag

SEQ ID NO: 628143 - DNA, 20 bp, mouse
gatcctctggcgggtgtagg

SEQ ID NO: 628144 - DNA, 20 bp, mouse
gatgaaattctgggtcatta

SEQ ID NO: 628145 - DNA, 20 bp, mouse
gcccccccccgacctccacg

SEQ ID NO: 628146 - DNA, 20 bp, mouse
ggcgctagctccccatcccg

SEQ ID NO: 628147 - DNA, 20 bp, mouse
gtgaggcggcggctcagagt

SEQ ID NO: 628148 - DNA, 20 bp, mouse
gggactcccgctgctctgcc

SEQ ID NO: 628149 - DNA, 20 bp, mouse
gcccatcccgcggcagcgag

SEQ ID NO: 628150 - DNA, 20 bp, mouse
ggaggacgaaggcgacgagg

SEQ ID NO: 628151 - DNA, 20 bp, mouse
gtaggaggacgaaggcgacg

SEQ ID NO: 628152 - DNA, 20 bp, mouse
ggctcagagtaggaggacga

SEQ ID NO: 628153 - DNA, 20 bp, mouse
gacccagcggatgcacagag

SEQ ID NO: 628154 - DNA, 20 bp, mouse
gcccgacgggacaggcccgg

SEQ ID NO: 628155 - DNA, 20 bp, mouse
ggatccagtagagcacccgc

SEQ ID NO: 628156 - DNA, 20 bp, mouse
gtgtggtcctacagaatcgt

SEQ ID NO: 628157 - DNA, 20 bp, mouse
gggcggggaagctggcgaca

SEQ ID NO: 628158 - DNA, 20 bp, mouse
gccgctgcccacgattctgt

SEQ ID NO: 628159 - DNA, 20 bp, mouse
ggctccgccgccgcaagcag

SEQ ID NO: 628160 - DNA, 20 bp, mouse
ggctggcgacagggccgctg

SEQ ID NO: 628161 - DNA, 20 bp, mouse
gccttcgccactgcttgcgg

SEQ ID NO: 628162 - DNA, 20 bp, mouse
gagcagcgccagagtgtcca

SEQ ID NO: 628163 - DNA, 20 bp, mouse
ggggacccggcagtcagcag

SEQ ID NO: 628164 - DNA, 20 bp, mouse
ggccccgcggaatcagaacg

SEQ ID NO: 628165 - DNA, 20 bp, mouse
gaatcgtgggcagcgggacc

SEQ ID NO: 628166 - DNA, 20 bp, mouse
gggaccggccgagtgggtgt

SEQ ID NO: 628167 - DNA, 20 bp, mouse
ggcgccgggaccggccgagt

SEQ ID NO: 628168 - DNA, 20 bp, mouse
gggagaccgcggccctgaat

SEQ ID NO: 628169 - DNA, 20 bp, mouse
gagtcccggggagaactcgg

SEQ ID NO: 628170 - DNA, 20 bp, mouse
gcgcggagccgagtggaaag

SEQ ID NO: 628171 - DNA, 20 bp, mouse
gggccggccgagggagagga

SEQ ID NO: 628172 - DNA, 20 bp, mouse
gccggggcgcgaagcggaga

SEQ ID NO: 628173 - DNA, 20 bp, mouse
ggaagcggagagggcgacgg

SEQ ID NO: 628174 - DNA, 20 bp, mouse
ggggcatgccgacacccact

SEQ ID NO: 628175 - DNA, 20 bp, mouse
gtgcagggacgccagagtcc

SEQ ID NO: 628176 - DNA, 20 bp, mouse
gtgcagtacgaaggtcacca

SEQ ID NO: 628177 - DNA, 20 bp, mouse
ggccttgcggctgctcaacg

SEQ ID NO: 628178 - DNA, 20 bp, mouse
gatgcaaagaaagtaggcgg

SEQ ID NO: 628179 - DNA, 20 bp, mouse
gaggaagagctgcagtacga

SEQ ID NO: 628180 - DNA, 20 bp, mouse
gcctggatcacattcctaag

SEQ ID NO: 628181 - DNA, 20 bp, mouse
ggcaggcgagaagagcgggg

SEQ ID NO: 628182 - DNA, 20 bp, mouse
gcaggtgcccaggtcgtctg

SEQ ID NO: 628183 - DNA, 20 bp, mouse
gagaactccccagacgacct

SEQ ID NO: 628184 - DNA, 20 bp, mouse
gcgtgactcgggaacacact

SEQ ID NO: 628185 - DNA, 20 bp, mouse
gtccagccaccatggagtaa

SEQ ID NO: 628186 - DNA, 20 bp, mouse
gcctgcggagcggcgaccgg

SEQ ID NO: 628187 - DNA, 20 bp, mouse
gaccggcggtgctcacaggt

SEQ ID NO: 628188 - DNA, 20 bp, mouse
gcggcaggcgcgcgcaccgg

SEQ ID NO: 628189 - DNA, 20 bp, mouse
gcaggctcgggagtgccggg

SEQ ID NO: 628190 - DNA, 20 bp, mouse
ggcccgggacagcagagcta

SEQ ID NO: 628191 - DNA, 20 bp, mouse
gcgcgcgccgacctgcggag

SEQ ID NO: 628192 - DNA, 20 bp, mouse
gcggcaggctcgggagtgcc

SEQ ID NO: 628193 - DNA, 20 bp, mouse
gggaagcgcgcgccgacctg

SEQ ID NO: 628194 - DNA, 20 bp, mouse
ggcgcaccggcggtgctcac

SEQ ID NO: 628195 - DNA, 20 bp, mouse
ggaccccgcacggcaggctc

SEQ ID NO: 628196 - DNA, 20 bp, mouse
gcccccatggtcggacccac

SEQ ID NO: 628197 - DNA, 20 bp, mouse
gaagccggtgggtccgacca

SEQ ID NO: 628198 - DNA, 20 bp, mouse
gcagcgatcggaaagccggt

SEQ ID NO: 628199 - DNA, 20 bp, mouse
gcccaggactcccccatggt

SEQ ID NO: 628200 - DNA, 20 bp, mouse
gacagcgcggtgagtaccag

SEQ ID NO: 628201 - DNA, 20 bp, mouse
ggcagtgggatcccagcgat

SEQ ID NO: 628202 - DNA, 20 bp, mouse
gtgctaggccctccccaatg

SEQ ID NO: 628203 - DNA, 20 bp, mouse
gtccccaatgcggaagcagt

SEQ ID NO: 628204 - DNA, 20 bp, mouse
ggccagctccaggaccacga

SEQ ID NO: 628205 - DNA, 20 bp, mouse
gatcccagcgatcggaaagc

SEQ ID NO: 628206 - DNA, 20 bp, mouse
ggagaggatcctccagagag

SEQ ID NO: 628207 - DNA, 20 bp, mouse
gagcaggagaggaaggccaa

SEQ ID NO: 628208 - DNA, 20 bp, mouse
gccggaggaaccccctagag

SEQ ID NO: 628209 - DNA, 20 bp, mouse
gggaaccccctagagaggag

SEQ ID NO: 628210 - DNA, 20 bp, mouse
gcctggctccgggagacagg

SEQ ID NO: 628211 - DNA, 20 bp, mouse
ggcccgggcgggttacccag

SEQ ID NO: 628212 - DNA, 20 bp, mouse
gcgtgggcgctggtactgag

SEQ ID NO: 628213 - DNA, 20 bp, mouse
gggtagacccagggccccgg

SEQ ID NO: 628214 - DNA, 20 bp, mouse
gggatcctctcctctctagg

SEQ ID NO: 628215 - DNA, 20 bp, mouse
gcctcgtgggtccaaaacca

SEQ ID NO: 628216 - DNA, 20 bp, mouse
gccaccgcctggagctccat

SEQ ID NO: 628217 - DNA, 20 bp, mouse
ggactcggcctcacacgggg

SEQ ID NO: 628218 - DNA, 20 bp, mouse
gccggactcggcctcacacg

SEQ ID NO: 628219 - DNA, 20 bp, mouse
gctcacacggggcggtgcga

SEQ ID NO: 628220 - DNA, 20 bp, mouse
ggcactgaccgtcaatctgg

SEQ ID NO: 628221 - DNA, 20 bp, mouse
gctagggaccaactaggagg

SEQ ID NO: 628222 - DNA, 20 bp, mouse
ggccccagccgggactggat

SEQ ID NO: 628223 - DNA, 20 bp, mouse
gtgaggagatggtccctcat

SEQ ID NO: 628224 - DNA, 20 bp, mouse
gtggggaagccccagaagga

SEQ ID NO: 628225 - DNA, 20 bp, mouse
ggccatcctagggaccaact

SEQ ID NO: 628226 - DNA, 20 bp, mouse
gcgctgccggcggaccccag

SEQ ID NO: 628227 - DNA, 20 bp, mouse
gtcaggctcagaggagacaa

SEQ ID NO: 628228 - DNA, 20 bp, mouse
ggccggcagcggcggacggt

SEQ ID NO: 628229 - DNA, 20 bp, mouse
gctgcagctgcggggaacca

SEQ ID NO: 628230 - DNA, 20 bp, mouse
gagccgccttaccccaaacc

SEQ ID NO: 628231 - DNA, 20 bp, mouse
gccggacgcatcaggctcag

SEQ ID NO: 628232 - DNA, 20 bp, mouse
gccggagcccggacaacgac

SEQ ID NO: 628233 - DNA, 20 bp, mouse
gcagcggcggacggttggcc

SEQ ID NO: 628234 - DNA, 20 bp, mouse
gggggtgtcacagagccttc

SEQ ID NO: 628235 - DNA, 20 bp, mouse
ggagcgctccccaagacttc

SEQ ID NO: 628236 - DNA, 20 bp, mouse
ggaggcggcggcgacaacga

SEQ ID NO: 628237 - DNA, 20 bp, mouse
gacgacggcggtgacaacga

SEQ ID NO: 628238 - DNA, 20 bp, mouse
ggcccgtacagcccgaggag

SEQ ID NO: 628239 - DNA, 20 bp, mouse
ggccgcgcgctgcctctcag

SEQ ID NO: 628240 - DNA, 20 bp, mouse
ggaggccagacggcactgct

SEQ ID NO: 628241 - DNA, 20 bp, mouse
gcagtgggagtcatcaccgg

SEQ ID NO: 628242 - DNA, 20 bp, mouse
ggcggtgacaacgacggcgg

SEQ ID NO: 628243 - DNA, 20 bp, mouse
gacgtcgtgaggctacagac

SEQ ID NO: 628244 - DNA, 20 bp, mouse
gtcgtgaggctacagaccgg

SEQ ID NO: 628245 - DNA, 20 bp, mouse
gcgtccccggtactcacccc

SEQ ID NO: 628246 - DNA, 20 bp, mouse
gccgagcgggaggctcacgg

SEQ ID NO: 628247 - DNA, 20 bp, mouse
ggacccgagcgggaggctca

SEQ ID NO: 628248 - DNA, 20 bp, mouse
gcttgcgccgaggacccgag

SEQ ID NO: 628249 - DNA, 20 bp, mouse
gcgccgaggacccgagcggg

SEQ ID NO: 628250 - DNA, 20 bp, mouse
gagccgaatgcgaaccctga

SEQ ID NO: 628251 - DNA, 20 bp, mouse
gaagcgggttgcaccccctg

SEQ ID NO: 628252 - DNA, 20 bp, mouse
gctacatgggcgggaaactg

SEQ ID NO: 628253 - DNA, 20 bp, mouse
gactgaggcaggcaccgacc

SEQ ID NO: 628254 - DNA, 20 bp, mouse
ggaggtgggagtcaccgcag

SEQ ID NO: 628255 - DNA, 20 bp, mouse
gtggagatgctgggtcgact

SEQ ID NO: 628256 - DNA, 20 bp, mouse
gcgggagcccgacgccgaac

SEQ ID NO: 628257 - DNA, 20 bp, mouse
gggagaggcagcagcatcta

SEQ ID NO: 628258 - DNA, 20 bp, mouse
gtcgggccggccgggccggt

SEQ ID NO: 628259 - DNA, 20 bp, mouse
gggccgggccggtgggcgag

SEQ ID NO: 628260 - DNA, 20 bp, mouse
gcgcgctgcggtcccctcgg

SEQ ID NO: 628261 - DNA, 20 bp, mouse
gcgctccagagctaacgtca

SEQ ID NO: 628262 - DNA, 20 bp, mouse
gcggctcggctgtgccagtt

SEQ ID NO: 628263 - DNA, 20 bp, mouse
gagactggagagcccccgag

SEQ ID NO: 628264 - DNA, 20 bp, mouse
gcagccgagccgaacgaccc

SEQ ID NO: 628265 - DNA, 20 bp, mouse
gcgggcggcgacgcatcatg

SEQ ID NO: 628266 - DNA, 20 bp, mouse
gggcgcaggatccgccgcag

SEQ ID NO: 628267 - DNA, 20 bp, mouse
gggcctgctagaacgctcag

SEQ ID NO: 628268 - DNA, 20 bp, mouse
gcccggcccggggagggatg

SEQ ID NO: 628269 - DNA, 20 bp, mouse
gcagcccgcgcgcccgaccc

SEQ ID NO: 628270 - DNA, 20 bp, mouse
gggaggaaatcccaccccac

SEQ ID NO: 628271 - DNA, 20 bp, mouse
ggagcctggtagcagcgggt

SEQ ID NO: 628272 - DNA, 20 bp, mouse
gggaaatcccaccccacggg

SEQ ID NO: 628273 - DNA, 20 bp, mouse
ggtggccaccgggatgtact

SEQ ID NO: 628274 - DNA, 20 bp, mouse
ggcgccgccgcatccctccc

SEQ ID NO: 628275 - DNA, 20 bp, mouse
gaaagccccgagggaatgaa

SEQ ID NO: 628276 - DNA, 20 bp, mouse
ggacttctccctgacaggga

SEQ ID NO: 628277 - DNA, 20 bp, mouse
ggaactcggccggcaactgg

SEQ ID NO: 628278 - DNA, 20 bp, mouse
gtagcgacttctccctgaca

SEQ ID NO: 628279 - DNA, 20 bp, mouse
gcaaggggccccaatagtcg

SEQ ID NO: 628280 - DNA, 20 bp, mouse
gactattggggccccttgtc

SEQ ID NO: 628281 - DNA, 20 bp, mouse
ggagaagtcgctaccacctc

SEQ ID NO: 628282 - DNA, 20 bp, mouse
ggtcccggcggagctgaagg

SEQ ID NO: 628283 - DNA, 20 bp, mouse
gggggccccttgtcaggagg

SEQ ID NO: 628284 - DNA, 20 bp, mouse
gcggggccctaaaccagctg

SEQ ID NO: 628285 - DNA, 20 bp, mouse
gggtgcctcctcctgacaag

SEQ ID NO: 628286 - DNA, 20 bp, mouse
gacaagcgagaggatcatgg

SEQ ID NO: 628287 - DNA, 20 bp, mouse
ggacacaagcgagaggatca

SEQ ID NO: 628288 - DNA, 20 bp, mouse
gcagaaagcaggcgaacccg

SEQ ID NO: 628289 - DNA, 20 bp, mouse
gcgaacccgcggcgcaataa

SEQ ID NO: 628290 - DNA, 20 bp, mouse
ggggccgggccgagtagagt

SEQ ID NO: 628291 - DNA, 20 bp, mouse
gtccagtccagcagccgcgg

SEQ ID NO: 628292 - DNA, 20 bp, mouse
ggcgcaataacggtgagtgg

SEQ ID NO: 628293 - DNA, 20 bp, mouse
gccggagccgctaggcgcag

SEQ ID NO: 628294 - DNA, 20 bp, mouse
ggcatttagacacaagcgag

SEQ ID NO: 628295 - DNA, 20 bp, mouse
gagaggcaggtaagacataa

SEQ ID NO: 628296 - DNA, 20 bp, mouse
gtggtagcgtcattgtggag

SEQ ID NO: 628297 - DNA, 20 bp, mouse
gttcgaagggaaaggtgtgt

SEQ ID NO: 628298 - DNA, 20 bp, mouse
ggcaccggggattttaatgt

SEQ ID NO: 628299 - DNA, 20 bp, mouse
gttccaaagaggtttcttct

SEQ ID NO: 628300 - DNA, 20 bp, mouse
gaggtaagttggttaggaga

SEQ ID NO: 628301 - DNA, 20 bp, mouse
gctcgttctttcgaagggaa

SEQ ID NO: 628302 - DNA, 20 bp, mouse
ggcaattttagattttgtgt

SEQ ID NO: 628303 - DNA, 20 bp, mouse
gaatctaaaattgccaggaa

SEQ ID NO: 628304 - DNA, 20 bp, mouse
gtatgaaaggtaagttggtt

SEQ ID NO: 628305 - DNA, 20 bp, mouse
gtgtgttggtagcgtcattg

SEQ ID NO: 628306 - DNA, 20 bp, mouse
gcctcgccaagagtgtctgg

SEQ ID NO: 628307 - DNA, 20 bp, mouse
ggaggcgaagaaacagctcc

SEQ ID NO: 628308 - DNA, 20 bp, mouse
gagatcagttctaacctgct

SEQ ID NO: 628309 - DNA, 20 bp, mouse
gaaacctcgccaagagtgtc

SEQ ID NO: 628310 - DNA, 20 bp, mouse
ggaagaagccgcgaagtgtg

SEQ ID NO: 628311 - DNA, 20 bp, mouse
ggccaagagtgtctggaggc

SEQ ID NO: 628312 - DNA, 20 bp, mouse
gccctccccacaaagatagg

SEQ ID NO: 628313 - DNA, 20 bp, mouse
gtccaggaaacacaaacctg

SEQ ID NO: 628314 - DNA, 20 bp, mouse
ggtacagggcgaattactgg

SEQ ID NO: 628315 - DNA, 20 bp, mouse
gacctgaatggacaggtaca

SEQ ID NO: 628316 - DNA, 20 bp, mouse
gccttcggaacaggatcggg

SEQ ID NO: 628317 - DNA, 20 bp, mouse
gtaggacgtaccctaggagg

SEQ ID NO: 628318 - DNA, 20 bp, mouse
gcgaaggcttggagagcctg

SEQ ID NO: 628319 - DNA, 20 bp, mouse
gcggcccgagggcaagggaa

SEQ ID NO: 628320 - DNA, 20 bp, mouse
ggccggcggcccgagggcaa

SEQ ID NO: 628321 - DNA, 20 bp, mouse
gcccggagccaagcagccgg

SEQ ID NO: 628322 - DNA, 20 bp, mouse
gaagccttcggaacaggatc

SEQ ID NO: 628323 - DNA, 20 bp, mouse
gtgagggccgccccctccta

SEQ ID NO: 628324 - DNA, 20 bp, mouse
gtgcttcgcaggcttacaag

SEQ ID NO: 628325 - DNA, 20 bp, mouse
gatgcttagaccctgagaca

SEQ ID NO: 628326 - DNA, 20 bp, mouse
gccgccccctgcccttgcgg

SEQ ID NO: 628327 - DNA, 20 bp, mouse
gccaccgccgcaagggcagg

SEQ ID NO: 628328 - DNA, 20 bp, mouse
gggatctgcgtgcaaaccaa

SEQ ID NO: 628329 - DNA, 20 bp, mouse
gcatctttccaccgccgcaa

SEQ ID NO: 628330 - DNA, 20 bp, mouse
gccttccagggtgatactgg

SEQ ID NO: 628331 - DNA, 20 bp, mouse
gtctcccgcggatgaaaatg

SEQ ID NO: 628332 - DNA, 20 bp, mouse
ggggcgtgagcgaccttcca

SEQ ID NO: 628333 - DNA, 20 bp, mouse
ggaaagtggatgctccacgg

SEQ ID NO: 628334 - DNA, 20 bp, mouse
gaaagttcgcccctacaccg

SEQ ID NO: 628335 - DNA, 20 bp, mouse
gcggcgaagcgacttagatc

SEQ ID NO: 628336 - DNA, 20 bp, mouse
gtctgcaaggatcagagagc

SEQ ID NO: 628337 - DNA, 20 bp, mouse
gaacgggaatgagatgtagg

SEQ ID NO: 628338 - DNA, 20 bp, mouse
gtgaattatatacagctaag

SEQ ID NO: 628339 - DNA, 20 bp, mouse
ggcggtacacaaagcttgca

SEQ ID NO: 628340 - DNA, 20 bp, mouse
gatggttcagcgattacctc

SEQ ID NO: 628341 - DNA, 20 bp, mouse
ggagcaaagcctccataaac

SEQ ID NO: 628342 - DNA, 20 bp, mouse
gagcagccatggaagcctgt

SEQ ID NO: 628343 - DNA, 20 bp, mouse
gcattgtcggtgagtcccac

SEQ ID NO: 628344 - DNA, 20 bp, mouse
gaatgcaagttcttacactg

SEQ ID NO: 628345 - DNA, 20 bp, mouse
gtgttaagaggcctttccag

SEQ ID NO: 628346 - DNA, 20 bp, mouse
gatggcccaggctgctgcag

SEQ ID NO: 628347 - DNA, 20 bp, mouse
gaagcgcccgacttctctca

SEQ ID NO: 628348 - DNA, 20 bp, mouse
gcggggagctggtgaactag

SEQ ID NO: 628349 - DNA, 20 bp, mouse
gcagcggcccgcaaccacac

SEQ ID NO: 628350 - DNA, 20 bp, mouse
gttccggccttgagagaagt

SEQ ID NO: 628351 - DNA, 20 bp, mouse
gggcactcacgggtagtcag

SEQ ID NO: 628352 - DNA, 20 bp, mouse
gtctgtcggctggggataaa

SEQ ID NO: 628353 - DNA, 20 bp, mouse
gactcacgggtagtcagagg

SEQ ID NO: 628354 - DNA, 20 bp, mouse
gtgagtgccaggtaccggtg

SEQ ID NO: 628355 - DNA, 20 bp, mouse
gggctggggataaatggccc

SEQ ID NO: 628356 - DNA, 20 bp, mouse
ggagcgcgcgagccctcggg

SEQ ID NO: 628357 - DNA, 20 bp, mouse
gggtaacctgtgctgggcgg

SEQ ID NO: 628358 - DNA, 20 bp, mouse
gtgcgggccggcggacgctc

SEQ ID NO: 628359 - DNA, 20 bp, mouse
ggccctcgggaggaggagta

SEQ ID NO: 628360 - DNA, 20 bp, mouse
ggcaacacagcaactccggg

SEQ ID NO: 628361 - DNA, 20 bp, mouse
gcccctactcctcctcccga

SEQ ID NO: 628362 - DNA, 20 bp, mouse
gtcagagcgcgcgagccctc

SEQ ID NO: 628363 - DNA, 20 bp, mouse
gactgcaggtagggccagga

SEQ ID NO: 628364 - DNA, 20 bp, mouse
gcgcgcgagccctcgggagg

SEQ ID NO: 628365 - DNA, 20 bp, mouse
gctgtcagcgcttgggtgag

SEQ ID NO: 628366 - DNA, 20 bp, mouse
ggctgacccgcctggaatcc

SEQ ID NO: 628367 - DNA, 20 bp, mouse
ggaatcccggctcggagctc

SEQ ID NO: 628368 - DNA, 20 bp, mouse
gcgagtccggagctccgagc

SEQ ID NO: 628369 - DNA, 20 bp, mouse
gcccccctcggaggaagcgg

SEQ ID NO: 628370 - DNA, 20 bp, mouse
gtccgagccgggattccagg

SEQ ID NO: 628371 - DNA, 20 bp, mouse
gcttctgggggtaagtgtgg

SEQ ID NO: 628372 - DNA, 20 bp, mouse
gttccaggcgggtcagctgg

SEQ ID NO: 628373 - DNA, 20 bp, mouse
gctgtccctgcggcttctgg

SEQ ID NO: 628374 - DNA, 20 bp, mouse
ggagcccccctcggaggaag

SEQ ID NO: 628375 - DNA, 20 bp, mouse
gcggagctcggaggcgacgg

SEQ ID NO: 628376 - DNA, 20 bp, mouse
gggcggacgcgaccaccgga

SEQ ID NO: 628377 - DNA, 20 bp, mouse
gtcacccgctcgccctccgg

SEQ ID NO: 628378 - DNA, 20 bp, mouse
gagcgggcggacgcgaccac

SEQ ID NO: 628379 - DNA, 20 bp, mouse
gcgaccaccggagggcgagc

SEQ ID NO: 628380 - DNA, 20 bp, mouse
gcagcgtaggccggcgtctc

SEQ ID NO: 628381 - DNA, 20 bp, mouse
gtccgtaggcagagaagcac

SEQ ID NO: 628382 - DNA, 20 bp, mouse
gtcgctcgcctgcccgcagg

SEQ ID NO: 628383 - DNA, 20 bp, mouse
ggagcttcgcgggccagcgt

SEQ ID NO: 628384 - DNA, 20 bp, mouse
gcgcctgcccgcaggcggat

SEQ ID NO: 628385 - DNA, 20 bp, mouse
gctcctatccgcctgcgggc

SEQ ID NO: 628386 - DNA, 20 bp, mouse
gagtcgtcgggatcgctgag

SEQ ID NO: 628387 - DNA, 20 bp, mouse
gagagactctgcgcgactcc

SEQ ID NO: 628388 - DNA, 20 bp, mouse
ggagccagagcgtcagtcgt

SEQ ID NO: 628389 - DNA, 20 bp, mouse
gcgcgactccgggcagcgag

SEQ ID NO: 628390 - DNA, 20 bp, mouse
ggagcggtgtgcatctggtc

SEQ ID NO: 628391 - DNA, 20 bp, mouse
ggccccgccgcagctcgggt

SEQ ID NO: 628392 - DNA, 20 bp, mouse
ggcagagtctctggcgaacg

SEQ ID NO: 628393 - DNA, 20 bp, mouse
gaccggcgctcgggatctga

SEQ ID NO: 628394 - DNA, 20 bp, mouse
gcgggatctgagggaaaggg

SEQ ID NO: 628395 - DNA, 20 bp, mouse
gatcccgacgactgacgctc

SEQ ID NO: 628396 - DNA, 20 bp, mouse
ggcagggaagcagaacaaaa

SEQ ID NO: 628397 - DNA, 20 bp, mouse
gagcaaacagaaaattgtgg

SEQ ID NO: 628398 - DNA, 20 bp, mouse
gggagcttggtattcaggtt

SEQ ID NO: 628399 - DNA, 20 bp, mouse
gtattcaggtttggttgctt

SEQ ID NO: 628400 - DNA, 20 bp, mouse
gccactagaattgcgggagg

SEQ ID NO: 628401 - DNA, 20 bp, mouse
gaattgcgggaggtggagct

SEQ ID NO: 628402 - DNA, 20 bp, mouse
gagtatacacaaaagcataa

SEQ ID NO: 628403 - DNA, 20 bp, mouse
gtataaatgacattctaagg

SEQ ID NO: 628404 - DNA, 20 bp, mouse
gtgaacattaaaattaagca

SEQ ID NO: 628405 - DNA, 20 bp, mouse
gacaaaagggctgtttgaac

SEQ ID NO: 628406 - DNA, 20 bp, mouse
ggcagcaggtggcctcgcag

SEQ ID NO: 628407 - DNA, 20 bp, mouse
gctgtcctcactctcagcgg

SEQ ID NO: 628408 - DNA, 20 bp, mouse
gcggcgggccgggagcgagt

SEQ ID NO: 628409 - DNA, 20 bp, mouse
gctcgccgccgctgagagtg

SEQ ID NO: 628410 - DNA, 20 bp, mouse
gacagcggacggagggccgg

SEQ ID NO: 628411 - DNA, 20 bp, mouse
gtaaacagcggacggagggc

SEQ ID NO: 628412 - DNA, 20 bp, mouse
gcggagggcgcggtcccggt

SEQ ID NO: 628413 - DNA, 20 bp, mouse
gttaataaacagcggacgga

SEQ ID NO: 628414 - DNA, 20 bp, mouse
ggcggcctgggagccggaag

SEQ ID NO: 628415 - DNA, 20 bp, mouse
ggtcctcacgtccctttggt

SEQ ID NO: 628416 - DNA, 20 bp, mouse
ggaatctgcggcatccaaca

SEQ ID NO: 628417 - DNA, 20 bp, mouse
gagaggttatggcgaatctg

SEQ ID NO: 628418 - DNA, 20 bp, mouse
gtctgcggcatccaacatgg

SEQ ID NO: 628419 - DNA, 20 bp, mouse
gtttagggaaagagccggag

SEQ ID NO: 628420 - DNA, 20 bp, mouse
gcgtaggcgtcggatccccg

SEQ ID NO: 628421 - DNA, 20 bp, mouse
ggagaaagtcggacaccctg

SEQ ID NO: 628422 - DNA, 20 bp, mouse
ggcggtggagagcaagcgag

SEQ ID NO: 628423 - DNA, 20 bp, mouse
gcatggcaacgcccccacgg

SEQ ID NO: 628424 - DNA, 20 bp, mouse
gcggcatccaacatggcgga

SEQ ID NO: 628425 - DNA, 20 bp, mouse
gggaggccgcgcgcagactc

SEQ ID NO: 628426 - DNA, 20 bp, mouse
gagcgagagagagcgatctg

SEQ ID NO: 628427 - DNA, 20 bp, mouse
ggggcgctaggagagggaac

SEQ ID NO: 628428 - DNA, 20 bp, mouse
gagagggaactggcgagcga

SEQ ID NO: 628429 - DNA, 20 bp, mouse
ggcaagggggcgctaggaga

SEQ ID NO: 628430 - DNA, 20 bp, mouse
ggccggggtcgaaggatcgg

SEQ ID NO: 628431 - DNA, 20 bp, mouse
gtctggggtgcggggaagtt

SEQ ID NO: 628432 - DNA, 20 bp, mouse
ggagagagcgatctggggtg

SEQ ID NO: 628433 - DNA, 20 bp, mouse
gcctctcgccgaaggaagaa

SEQ ID NO: 628434 - DNA, 20 bp, mouse
gggtccgttaggacagaggg

SEQ ID NO: 628435 - DNA, 20 bp, mouse
ggaggccggggtcgaaggat

SEQ ID NO: 628436 - DNA, 20 bp, mouse
gtggctccagccagtgaatg

SEQ ID NO: 628437 - DNA, 20 bp, mouse
ggccaaggcgtcccacacaa

SEQ ID NO: 628438 - DNA, 20 bp, mouse
gactcctccgcctcattcac

SEQ ID NO: 628439 - DNA, 20 bp, mouse
gccccggagcgagcgctgaa

SEQ ID NO: 628440 - DNA, 20 bp, mouse
gcggagcgagcgctgaaggg

SEQ ID NO: 628441 - DNA, 20 bp, mouse
gtccattgtgtgggacgcct

SEQ ID NO: 628442 - DNA, 20 bp, mouse
ggggagcaagccagtgccca

SEQ ID NO: 628443 - DNA, 20 bp, mouse
gtcgagatcgagaagagagg

SEQ ID NO: 628444 - DNA, 20 bp, mouse
ggtttccattgattcaccct

SEQ ID NO: 628445 - DNA, 20 bp, mouse
gaaaataaataaattcacgg

SEQ ID NO: 628446 - DNA, 20 bp, mouse
gcgacaacgggagattccag

SEQ ID NO: 628447 - DNA, 20 bp, mouse
ggagggaggtcccccaggcg

SEQ ID NO: 628448 - DNA, 20 bp, mouse
gcggcggggattcacccacg

SEQ ID NO: 628449 - DNA, 20 bp, mouse
gacgcagcgccgcgccccgt

SEQ ID NO: 628450 - DNA, 20 bp, mouse
gcgccaccgccgagcccggg

SEQ ID NO: 628451 - DNA, 20 bp, mouse
gccggggagggaggtccccc

SEQ ID NO: 628452 - DNA, 20 bp, mouse
gggaggtcccccaggcgcgg

SEQ ID NO: 628453 - DNA, 20 bp, mouse
gggaggaaggaggcactcgg

SEQ ID NO: 628454 - DNA, 20 bp, mouse
gtccaggaggaacctacctg

SEQ ID NO: 628455 - DNA, 20 bp, mouse
gacgccgggcagcgcgacaa

SEQ ID NO: 628456 - DNA, 20 bp, mouse
gcaaacagcgagaccgcggt

SEQ ID NO: 628457 - DNA, 20 bp, mouse
gcaagcaaacagcgagaccg

SEQ ID NO: 628458 - DNA, 20 bp, mouse
ggagcacggagcggtcctcg

SEQ ID NO: 628459 - DNA, 20 bp, mouse
gaactcctcccggaaccccg

SEQ ID NO: 628460 - DNA, 20 bp, mouse
gaaagaggcgaagatcgagt

SEQ ID NO: 628461 - DNA, 20 bp, mouse
ggcggtagcaagcgatctag

SEQ ID NO: 628462 - DNA, 20 bp, mouse
gaaacgctggagcaaaaagt

SEQ ID NO: 628463 - DNA, 20 bp, mouse
gttaaagcatgtgccgaccg

SEQ ID NO: 628464 - DNA, 20 bp, mouse
gtaggggtagagaggcggag

SEQ ID NO: 628465 - DNA, 20 bp, mouse
gctcgctgtttgcttgtgaa

SEQ ID NO: 628466 - DNA, 20 bp, mouse
ggcgtgtagtcccatggagg

SEQ ID NO: 628467 - DNA, 20 bp, mouse
gcatgcgtgtagtcccatgg

SEQ ID NO: 628468 - DNA, 20 bp, mouse
ggcgcatgcgtgtagtccca

SEQ ID NO: 628469 - DNA, 20 bp, mouse
gaagcagctaccgcctccat

SEQ ID NO: 628470 - DNA, 20 bp, mouse
gggccgagtgctaaactgtg

SEQ ID NO: 628471 - DNA, 20 bp, mouse
ggagctgagggaccccgggt

SEQ ID NO: 628472 - DNA, 20 bp, mouse
gtagtcggtaggcataggta

SEQ ID NO: 628473 - DNA, 20 bp, mouse
gaactgtgtggggcacggat

SEQ ID NO: 628474 - DNA, 20 bp, mouse
ggccgctgcgtacaagatgg

SEQ ID NO: 628475 - DNA, 20 bp, mouse
gtcagagcagcagcatccgg

SEQ ID NO: 628476 - DNA, 20 bp, mouse
gcactcgcgactgcaggtgg

SEQ ID NO: 628477 - DNA, 20 bp, mouse
gcacgaggctcgcggagaag

SEQ ID NO: 628478 - DNA, 20 bp, mouse
ggcgactgcaggtgggggaa

SEQ ID NO: 628479 - DNA, 20 bp, mouse
ggacccggaaccgcgagtgg

SEQ ID NO: 628480 - DNA, 20 bp, mouse
gcgtgacccggaaccgcgag

SEQ ID NO: 628481 - DNA, 20 bp, mouse
ggccttgcagacatacctgg

SEQ ID NO: 628482 - DNA, 20 bp, mouse
gtctgagagtcggtccctat

SEQ ID NO: 628483 - DNA, 20 bp, mouse
gcgcgtctccccccaaaggg

SEQ ID NO: 628484 - DNA, 20 bp, mouse
gcgaccgcgaacagcccata

SEQ ID NO: 628485 - DNA, 20 bp, mouse
gacccactcgcgactgcagg

SEQ ID NO: 628486 - DNA, 20 bp, mouse
gagcctgccgacaaaatagg

SEQ ID NO: 628487 - DNA, 20 bp, mouse
ggattcaaaaatggagccag

SEQ ID NO: 628488 - DNA, 20 bp, mouse
gcgccagaggaacgtcgggt

SEQ ID NO: 628489 - DNA, 20 bp, mouse
gcggcggagccaggagtcgg

SEQ ID NO: 628490 - DNA, 20 bp, mouse
gaagagcctgccgacaaaat

SEQ ID NO: 628491 - DNA, 20 bp, mouse
gcacagcgccagaggaacgt

SEQ ID NO: 628492 - DNA, 20 bp, mouse
ggctgtgctgcagttcgagg

SEQ ID NO: 628493 - DNA, 20 bp, mouse
ggctacacgggattcaaaaa

SEQ ID NO: 628494 - DNA, 20 bp, mouse
gaggtggagcttggcaccgg

SEQ ID NO: 628495 - DNA, 20 bp, mouse
gcagaggaacgtcgggtcgg

SEQ ID NO: 628496 - DNA, 20 bp, mouse
ggagtctctcggcagcaacg

SEQ ID NO: 628497 - DNA, 20 bp, mouse
gtcgccacgaaggcccaacc

SEQ ID NO: 628498 - DNA, 20 bp, mouse
gcacgaaggcccaaccgggc

SEQ ID NO: 628499 - DNA, 20 bp, mouse
gtggagtctcatccgcgaag

SEQ ID NO: 628500 - DNA, 20 bp, mouse
ggtggtgagacgagtctcag

SEQ ID NO: 628501 - DNA, 20 bp, mouse
gaagcggcaccggcccggtt

SEQ ID NO: 628502 - DNA, 20 bp, mouse
gctgagaacaatgaccggac

SEQ ID NO: 628503 - DNA, 20 bp, mouse
gcggggctgagaacaatgac

SEQ ID NO: 628504 - DNA, 20 bp, mouse
gcagtctggccaggagactc

SEQ ID NO: 628505 - DNA, 20 bp, mouse
gctcatccgcgaagcggcac

SEQ ID NO: 628506 - DNA, 20 bp, mouse
ggcgatggtggtagtagcgg

SEQ ID NO: 628507 - DNA, 20 bp, mouse
ggccggaccggaggctaagg

SEQ ID NO: 628508 - DNA, 20 bp, mouse
gcggcggcgtcagtgcccgg

SEQ ID NO: 628509 - DNA, 20 bp, mouse
ggcccccttagcctccggtc

SEQ ID NO: 628510 - DNA, 20 bp, mouse
ggctccaccacctgtccagg

SEQ ID NO: 628511 - DNA, 20 bp, mouse
ggtcagtgcccggcggggag

SEQ ID NO: 628512 - DNA, 20 bp, mouse
gccgggacccgctccccgcc

SEQ ID NO: 628513 - DNA, 20 bp, mouse
gcccatgccgacagaggtca

SEQ ID NO: 628514 - DNA, 20 bp, mouse
gctgccccctggacaggtgg

SEQ ID NO: 628515 - DNA, 20 bp, mouse
gctgcgcgcttgcgcgatgg

SEQ ID NO: 628516 - DNA, 20 bp, mouse
gtccctgagaggacacaccg

SEQ ID NO: 628517 - DNA, 20 bp, mouse
gctccaagctctcacctcac

SEQ ID NO: 628518 - DNA, 20 bp, mouse
gaagctctcacctcactgga

SEQ ID NO: 628519 - DNA, 20 bp, mouse
gactggaaggaagcactgcc

SEQ ID NO: 628520 - DNA, 20 bp, mouse
gaatcagggcaggaggcctc

SEQ ID NO: 628521 - DNA, 20 bp, mouse
gacagcgcacagaaggcctg

SEQ ID NO: 628522 - DNA, 20 bp, mouse
gagagcttggagcatcccgc

SEQ ID NO: 628523 - DNA, 20 bp, mouse
gcagctgctggtggaacccc

SEQ ID NO: 628524 - DNA, 20 bp, mouse
ggccccggtgtgtcctctca

SEQ ID NO: 628525 - DNA, 20 bp, mouse
gccggggcacagcgcacaga

SEQ ID NO: 628526 - DNA, 20 bp, mouse
gctccgggtgtgccagggag

SEQ ID NO: 628527 - DNA, 20 bp, mouse
gggacactcagggaacacgg

SEQ ID NO: 628528 - DNA, 20 bp, mouse
ggaacacggcggcacctgaa

SEQ ID NO: 628529 - DNA, 20 bp, mouse
gccagggaggggagacgtgg

SEQ ID NO: 628530 - DNA, 20 bp, mouse
ggtaaccatgcctcccggag

SEQ ID NO: 628531 - DNA, 20 bp, mouse
ggttacctccgggtgtgcca

SEQ ID NO: 628532 - DNA, 20 bp, mouse
gcgggaggcatggttacctc

SEQ ID NO: 628533 - DNA, 20 bp, mouse
gggaagctagactctccccg

SEQ ID NO: 628534 - DNA, 20 bp, mouse
gccggcgcctgtgtaggtcg

SEQ ID NO: 628535 - DNA, 20 bp, mouse
ggtagttccggcgcctgtgt

SEQ ID NO: 628536 - DNA, 20 bp, mouse
gatcgggacaaggtgagtcc

SEQ ID NO: 628537 - DNA, 20 bp, mouse
gactctggaacgggacaccg

SEQ ID NO: 628538 - DNA, 20 bp, mouse
gccttgtcccgattccggaa

SEQ ID NO: 628539 - DNA, 20 bp, mouse
ggctcggcctccgagcaggg

SEQ ID NO: 628540 - DNA, 20 bp, mouse
gggtcgggtcgagttctcta

SEQ ID NO: 628541 - DNA, 20 bp, mouse
gccgcggaaaagatccgttc

SEQ ID NO: 628542 - DNA, 20 bp, mouse
ggacaaggtgagtccgggct

SEQ ID NO: 628543 - DNA, 20 bp, mouse
gcgcggcgagggcccaaggc

SEQ ID NO: 628544 - DNA, 20 bp, mouse
gccagctcagggcttttctc

SEQ ID NO: 628545 - DNA, 20 bp, mouse
gaaccggagaccagagaacc

SEQ ID NO: 628546 - DNA, 20 bp, mouse
gctgcgtgaaagcccgtcgg

SEQ ID NO: 628547 - DNA, 20 bp, mouse
gcgattgcggaaagacacaa

SEQ ID NO: 628548 - DNA, 20 bp, mouse
gagttcgggacaagaccgac

SEQ ID NO: 628549 - DNA, 20 bp, mouse
ggatgggtgctgcccccgac

SEQ ID NO: 628550 - DNA, 20 bp, mouse
gcctctgtggacagagaccg

SEQ ID NO: 628551 - DNA, 20 bp, mouse
gctcctgggagagaacatgg

SEQ ID NO: 628552 - DNA, 20 bp, mouse
gtcacgcagcgctacgattg

SEQ ID NO: 628553 - DNA, 20 bp, mouse
gctactcctgggagagaaca

SEQ ID NO: 628554 - DNA, 20 bp, mouse
gtgggtccgaacaaatccta

SEQ ID NO: 628555 - DNA, 20 bp, mouse
gacgtcgagcggcagcagtt

SEQ ID NO: 628556 - DNA, 20 bp, mouse
gccaggagcaagggcgtaca

SEQ ID NO: 628557 - DNA, 20 bp, mouse
gggcggcctggtggtacttc

SEQ ID NO: 628558 - DNA, 20 bp, mouse
ggcaaaccaaggcggcctgg

SEQ ID NO: 628559 - DNA, 20 bp, mouse
gccacttccgcaaaccaagg

SEQ ID NO: 628560 - DNA, 20 bp, mouse
ggaaagctagactctccctg

SEQ ID NO: 628561 - DNA, 20 bp, mouse
gcttccacttccgcaaacca

SEQ ID NO: 628562 - DNA, 20 bp, mouse
ggcggaagtggaagcgactt

SEQ ID NO: 628563 - DNA, 20 bp, mouse
gtccgcaaaccaaggcggcc

SEQ ID NO: 628564 - DNA, 20 bp, mouse
ggtccccgaggaggcatacc

SEQ ID NO: 628565 - DNA, 20 bp, mouse
gagcagcgccacttcaggaa

SEQ ID NO: 628566 - DNA, 20 bp, mouse
ggaggggtcagtaaagggga

SEQ ID NO: 628567 - DNA, 20 bp, mouse
gtcgggaggggtcagtaaag

SEQ ID NO: 628568 - DNA, 20 bp, mouse
ggatcgctcacactcgggag

SEQ ID NO: 628569 - DNA, 20 bp, mouse
gaggcctcacacacctgggg

SEQ ID NO: 628570 - DNA, 20 bp, mouse
ggagggctcacctttctgaa

SEQ ID NO: 628571 - DNA, 20 bp, mouse
gctcacctttctgaaaggaa

SEQ ID NO: 628572 - DNA, 20 bp, mouse
ggcctggtggctatcaccca

SEQ ID NO: 628573 - DNA, 20 bp, mouse
ggaagtgactcttcccgcat

SEQ ID NO: 628574 - DNA, 20 bp, mouse
ggtgcaatcgcagcacactc

SEQ ID NO: 628575 - DNA, 20 bp, mouse
gtagtcctggctgcctatgc

SEQ ID NO: 628576 - DNA, 20 bp, mouse
gctgttacagacccacacaa

SEQ ID NO: 628577 - DNA, 20 bp, mouse
gcagggacgtaagacttagg

SEQ ID NO: 628578 - DNA, 20 bp, mouse
ggacacgaaacaggtcctgt

SEQ ID NO: 628579 - DNA, 20 bp, mouse
gggacagggacgtaagactt

SEQ ID NO: 628580 - DNA, 20 bp, mouse
ggtctgtaacagggtccaac

SEQ ID NO: 628581 - DNA, 20 bp, mouse
gagggggccggacacgaaac

SEQ ID NO: 628582 - DNA, 20 bp, mouse
gcggagaacagaacaaagaa

SEQ ID NO: 628583 - DNA, 20 bp, mouse
gagatggccccactcaccct

SEQ ID NO: 628584 - DNA, 20 bp, mouse
gcccactcaccctggggaca

SEQ ID NO: 628585 - DNA, 20 bp, mouse
gccggaaacgatatggggag

SEQ ID NO: 628586 - DNA, 20 bp, mouse
gcagactcttctgcaagcgg

SEQ ID NO: 628587 - DNA, 20 bp, mouse
ggagtctgaccgcctggagt

SEQ ID NO: 628588 - DNA, 20 bp, mouse
gtagcacgagcacacacgaa

SEQ ID NO: 628589 - DNA, 20 bp, mouse
gactcttctgcaagcggagg

SEQ ID NO: 628590 - DNA, 20 bp, mouse
gaagcaggggaagtaggacc

SEQ ID NO: 628591 - DNA, 20 bp, mouse
gagcacacacgaagggccgc

SEQ ID NO: 628592 - DNA, 20 bp, mouse
gtctgcaagcggaggcgggc

SEQ ID NO: 628593 - DNA, 20 bp, mouse
gggtcagactcttctgcaag

SEQ ID NO: 628594 - DNA, 20 bp, mouse
gggcgggctggtagtgcttc

SEQ ID NO: 628595 - DNA, 20 bp, mouse
ggaattgtagttcccactcc

SEQ ID NO: 628596 - DNA, 20 bp, mouse
gaaccccacacagtctccca

SEQ ID NO: 628597 - DNA, 20 bp, mouse
gggagccttgggagactgtg

SEQ ID NO: 628598 - DNA, 20 bp, mouse
gccacgcggggaggagcctt

SEQ ID NO: 628599 - DNA, 20 bp, mouse
ggttctgcacttggcacctg

SEQ ID NO: 628600 - DNA, 20 bp, mouse
ggatcatacatcagaacctc

SEQ ID NO: 628601 - DNA, 20 bp, mouse
ggcacagaattaactgcgga

SEQ ID NO: 628602 - DNA, 20 bp, mouse
gaatgttgatgaaagaggcc

SEQ ID NO: 628603 - DNA, 20 bp, mouse
gatctgcacagaattaactg

SEQ ID NO: 628604 - DNA, 20 bp, mouse
gagacgtccggcttccgctc

SEQ ID NO: 628605 - DNA, 20 bp, mouse
gccggttcccgcaccccggg

SEQ ID NO: 628606 - DNA, 20 bp, mouse
ggcacagagctaactgcgga

SEQ ID NO: 628607 - DNA, 20 bp, mouse
gagccgcgggagactgtgtt

SEQ ID NO: 628608 - DNA, 20 bp, mouse
gagacgtcgcgcttccgctc

SEQ ID NO: 628609 - DNA, 20 bp, mouse
gatctgcacagagctaactg

SEQ ID NO: 628610 - DNA, 20 bp, mouse
gaacccaacacagtctcccg

SEQ ID NO: 628611 - DNA, 20 bp, mouse
ggcacttgatgttcaggagt

SEQ ID NO: 628612 - DNA, 20 bp, mouse
gcacttggcacttgatgttc

SEQ ID NO: 628613 - DNA, 20 bp, mouse
gcccgctgccgggagctgtg

SEQ ID NO: 628614 - DNA, 20 bp, mouse
gcggcagcgggtggcagacc

SEQ ID NO: 628615 - DNA, 20 bp, mouse
gggtccctgcacctccggag

SEQ ID NO: 628616 - DNA, 20 bp, mouse
gccgagggccgggctgacgg

SEQ ID NO: 628617 - DNA, 20 bp, mouse
gcagcgtgcgggatccggga

SEQ ID NO: 628618 - DNA, 20 bp, mouse
gggcctgagggtgcagatcg

SEQ ID NO: 628619 - DNA, 20 bp, mouse
ggcaccctcaggcctcacct

SEQ ID NO: 628620 - DNA, 20 bp, mouse
gcgcacgctgaggacaggag

SEQ ID NO: 628621 - DNA, 20 bp, mouse
ggcccgaggatgaggcgtgt

SEQ ID NO: 628622 - DNA, 20 bp, mouse
ggcgtagagacacagaccgc

SEQ ID NO: 628623 - DNA, 20 bp, mouse
gggacccagcctccctctca

SEQ ID NO: 628624 - DNA, 20 bp, mouse
gcggcgcggcctcctaggtg

SEQ ID NO: 628625 - DNA, 20 bp, mouse
ggatcgcggccgtgagaggg

SEQ ID NO: 628626 - DNA, 20 bp, mouse
gtcctgggtgcggggacctc

SEQ ID NO: 628627 - DNA, 20 bp, mouse
gaagcccagaagttccgaca

SEQ ID NO: 628628 - DNA, 20 bp, mouse
gggagtgctgggtcgtccca

SEQ ID NO: 628629 - DNA, 20 bp, mouse
ggccaggcggtctcccacaa

SEQ ID NO: 628630 - DNA, 20 bp, mouse
ggcggtctcccacaaagggg

SEQ ID NO: 628631 - DNA, 20 bp, mouse
gtctctctggacctggcggt

SEQ ID NO: 628632 - DNA, 20 bp, mouse
gcgactgccagctttaaaag

SEQ ID NO: 628633 - DNA, 20 bp, mouse
gcgacatggtaagtgccagg

SEQ ID NO: 628634 - DNA, 20 bp, mouse
gacaagtctcagcttctgtc

SEQ ID NO: 628635 - DNA, 20 bp, mouse
gcaagttcctcttttaaagc

SEQ ID NO: 628636 - DNA, 20 bp, mouse
ggtcataaaagaagacaaat

SEQ ID NO: 628637 - DNA, 20 bp, mouse
gagatgactgggtgttggaa

SEQ ID NO: 628638 - DNA, 20 bp, mouse
gcacatgaacataaccaatg

SEQ ID NO: 628639 - DNA, 20 bp, mouse
gagatgactgggacatgaaa

SEQ ID NO: 628640 - DNA, 20 bp, mouse
gattgaagatgactgggtgt

SEQ ID NO: 628641 - DNA, 20 bp, mouse
gattataaaagaacacgtac

SEQ ID NO: 628642 - DNA, 20 bp, mouse
gagttgactgcagtttttaa

SEQ ID NO: 628643 - DNA, 20 bp, mouse
gcttatgaatgtcgtcaatg

SEQ ID NO: 628644 - DNA, 20 bp, mouse
gatgtattcttttatgacgt

SEQ ID NO: 628645 - DNA, 20 bp, mouse
ggtcatcacagaacacatac

SEQ ID NO: 628646 - DNA, 20 bp, mouse
gtcgggtggtccccaggacg

SEQ ID NO: 628647 - DNA, 20 bp, mouse
ggcctcccgctggacaatgg

SEQ ID NO: 628648 - DNA, 20 bp, mouse
gcagcgggaggccagtcggg

SEQ ID NO: 628649 - DNA, 20 bp, mouse
gggttagccacagacgtcca

SEQ ID NO: 628650 - DNA, 20 bp, mouse
gctggcctcccgctggacaa

SEQ ID NO: 628651 - DNA, 20 bp, mouse
gcgctgccgccattgtccag

SEQ ID NO: 628652 - DNA, 20 bp, mouse
gtaaactcagccccgtcctg

SEQ ID NO: 628653 - DNA, 20 bp, mouse
ggccgccattgtccagcggg

SEQ ID NO: 628654 - DNA, 20 bp, mouse
gtgtcggggacagcaggact

SEQ ID NO: 628655 - DNA, 20 bp, mouse
gtgcgtgccatggggtggag

SEQ ID NO: 628656 - DNA, 20 bp, mouse
gggatggagaagcccggtgg

SEQ ID NO: 628657 - DNA, 20 bp, mouse
ggcagccagaacagaacgga

SEQ ID NO: 628658 - DNA, 20 bp, mouse
gggaaacaaaggagacccgg

SEQ ID NO: 628659 - DNA, 20 bp, mouse
gcctaatcccagcctccacc

SEQ ID NO: 628660 - DNA, 20 bp, mouse
gctggtttcactctagggag

SEQ ID NO: 628661 - DNA, 20 bp, mouse
gaacggatggagaagcccgg

SEQ ID NO: 628662 - DNA, 20 bp, mouse
gctggcaagcgataatgaag

SEQ ID NO: 628663 - DNA, 20 bp, mouse
gcagacactggtttcactct

SEQ ID NO: 628664 - DNA, 20 bp, mouse
gaggggctggacccaggatt

SEQ ID NO: 628665 - DNA, 20 bp, mouse
ggcagtcagcttgcagaagg

SEQ ID NO: 628666 - DNA, 20 bp, mouse
gcccggccggcactcactca

SEQ ID NO: 628667 - DNA, 20 bp, mouse
ggccggcactcactcaggga

SEQ ID NO: 628668 - DNA, 20 bp, mouse
gaggagggagaggcgccgga

SEQ ID NO: 628669 - DNA, 20 bp, mouse
ggaggccgagagcaaggctg

SEQ ID NO: 628670 - DNA, 20 bp, mouse
gcggagggagaggcgacccg

SEQ ID NO: 628671 - DNA, 20 bp, mouse
gagcctcggcggcctcccaa

SEQ ID NO: 628672 - DNA, 20 bp, mouse
ggggtgggcacagtgccggg

SEQ ID NO: 628673 - DNA, 20 bp, mouse
gagtgccggccgggtcgggg

SEQ ID NO: 628674 - DNA, 20 bp, mouse
gtccttccctgagtgagtgc

SEQ ID NO: 628675 - DNA, 20 bp, mouse
gagcgcaagtccggccgggg

SEQ ID NO: 628676 - DNA, 20 bp, mouse
gagcgccggtccgctctgag

SEQ ID NO: 628677 - DNA, 20 bp, mouse
gctcacctctcagagcggac

SEQ ID NO: 628678 - DNA, 20 bp, mouse
gctctgcagcgggaagacgg

SEQ ID NO: 628679 - DNA, 20 bp, mouse
gactgaggaaattgtcgcgg

SEQ ID NO: 628680 - DNA, 20 bp, mouse
ggtacaaagcagccctgcgg

SEQ ID NO: 628681 - DNA, 20 bp, mouse
gccggaaggatgctgcgcag

SEQ ID NO: 628682 - DNA, 20 bp, mouse
ggagttggtcccttgcactg

SEQ ID NO: 628683 - DNA, 20 bp, mouse
gtgcactgaggaaattgtcg

SEQ ID NO: 628684 - DNA, 20 bp, mouse
gatgctgcgcagaggcctgt

SEQ ID NO: 628685 - DNA, 20 bp, mouse
gcagcgcagctgccaccgca

SEQ ID NO: 628686 - DNA, 20 bp, mouse
ggcttggagtctggacagtt

SEQ ID NO: 628687 - DNA, 20 bp, mouse
gcaatgtgcggtgcttgtga

SEQ ID NO: 628688 - DNA, 20 bp, mouse
gcgagcctgcgatcaatgtg

SEQ ID NO: 628689 - DNA, 20 bp, mouse
gaccagctacgcaaacacaa

SEQ ID NO: 628690 - DNA, 20 bp, mouse
gcaggcaacacaaaccgcgg

SEQ ID NO: 628691 - DNA, 20 bp, mouse
gacaccgagctgtcccgccg

SEQ ID NO: 628692 - DNA, 20 bp, mouse
ggatactgcgtccccagttt

SEQ ID NO: 628693 - DNA, 20 bp, mouse
gaaaccgcggcgggacagct

SEQ ID NO: 628694 - DNA, 20 bp, mouse
gagcaccgcacattgatcgc

SEQ ID NO: 628695 - DNA, 20 bp, mouse
gtatgttttcgcccaaactg

SEQ ID NO: 628696 - DNA, 20 bp, mouse
gctcccgccagcccacgggt

SEQ ID NO: 628697 - DNA, 20 bp, mouse
ggaggtgagagagcggctgt

SEQ ID NO: 628698 - DNA, 20 bp, mouse
gcggctgtcggcgggaacca

SEQ ID NO: 628699 - DNA, 20 bp, mouse
gtctctcacctcctacccgt

SEQ ID NO: 628700 - DNA, 20 bp, mouse
gccgccagcccacgggtagg

SEQ ID NO: 628701 - DNA, 20 bp, mouse
gcgggaaccaggggaagtgc

SEQ ID NO: 628702 - DNA, 20 bp, mouse
ggccaagtcacgagatacag

SEQ ID NO: 628703 - DNA, 20 bp, mouse
gtgcagctcccgccagccca

SEQ ID NO: 628704 - DNA, 20 bp, mouse
gggagaggcagcggataccc

SEQ ID NO: 628705 - DNA, 20 bp, mouse
gggcgggagctgcatctcta

SEQ ID NO: 628706 - DNA, 20 bp, mouse
gcgaggccgccactctaggg

SEQ ID NO: 628707 - DNA, 20 bp, mouse
gttcctgtcctggtgcatgg

SEQ ID NO: 628708 - DNA, 20 bp, mouse
gggtcggacgaaggaattgt

SEQ ID NO: 628709 - DNA, 20 bp, mouse
gacccgaggccgccactcta

SEQ ID NO: 628710 - DNA, 20 bp, mouse
gagcgcagcccgggcagaat

SEQ ID NO: 628711 - DNA, 20 bp, mouse
ggaccaccatgcaccaggac

SEQ ID NO: 628712 - DNA, 20 bp, mouse
gctccgccgccctagagtgg

SEQ ID NO: 628713 - DNA, 20 bp, mouse
ggtgcatggtggtcggacga

SEQ ID NO: 628714 - DNA, 20 bp, mouse
ggtggcgtcctcagagggaa

SEQ ID NO: 628715 - DNA, 20 bp, mouse
gggcggagaataatgcacac

SEQ ID NO: 628716 - DNA, 20 bp, mouse
gtggcgccacgtggacacga

SEQ ID NO: 628717 - DNA, 20 bp, mouse
gcctgagtgcgcagacgcag

SEQ ID NO: 628718 - DNA, 20 bp, mouse
gcacgtggcgccaaagtagg

SEQ ID NO: 628719 - DNA, 20 bp, mouse
ggtccacgtggcgccaaagt

SEQ ID NO: 628720 - DNA, 20 bp, mouse
gcgacggccgtgctgacccg

SEQ ID NO: 628721 - DNA, 20 bp, mouse
gcacggccgtcgtgtccacg

SEQ ID NO: 628722 - DNA, 20 bp, mouse
gcagatcccacctcctactt

SEQ ID NO: 628723 - DNA, 20 bp, mouse
ggtggcgccaaagtaggagg

SEQ ID NO: 628724 - DNA, 20 bp, mouse
gctttgtccgcgggtcagca

SEQ ID NO: 628725 - DNA, 20 bp, mouse
gtggatcttggtgaaggcgg

SEQ ID NO: 628726 - DNA, 20 bp, mouse
ggaagaggagaaaggcgcag

SEQ ID NO: 628727 - DNA, 20 bp, mouse
gtctcgactgctctgggagg

SEQ ID NO: 628728 - DNA, 20 bp, mouse
gcccacgggcccgacgagga

SEQ ID NO: 628729 - DNA, 20 bp, mouse
gctggggacgcgaggatggt

SEQ ID NO: 628730 - DNA, 20 bp, mouse
gggtcactgactgcaggcgg

SEQ ID NO: 628731 - DNA, 20 bp, mouse
gggcaggcctgggcccggga

SEQ ID NO: 628732 - DNA, 20 bp, mouse
ggcggctccgaccttcccac

SEQ ID NO: 628733 - DNA, 20 bp, mouse
gtcgagaggcagacatggcg

SEQ ID NO: 628734 - DNA, 20 bp, mouse
gaagacggcggagaacccca

SEQ ID NO: 628735 - DNA, 20 bp, mouse
gggagaacggagaatgacgg

SEQ ID NO: 628736 - DNA, 20 bp, mouse
gcaggtaccagcgagtcaca

SEQ ID NO: 628737 - DNA, 20 bp, mouse
gtcacacggcgacagacact

SEQ ID NO: 628738 - DNA, 20 bp, mouse
ggagggcccagagaccaaga

SEQ ID NO: 628739 - DNA, 20 bp, mouse
ggttgctgaccccgccatct

SEQ ID NO: 628740 - DNA, 20 bp, mouse
gcccggtgtccccacctagg

SEQ ID NO: 628741 - DNA, 20 bp, mouse
gcgcctcgcgctgggtgtcc

SEQ ID NO: 628742 - DNA, 20 bp, mouse
gcacagatgccaagatggcg

SEQ ID NO: 628743 - DNA, 20 bp, mouse
gccatagcagccctggtcat

SEQ ID NO: 628744 - DNA, 20 bp, mouse
gccggctgcagaaaaatcct

SEQ ID NO: 628745 - DNA, 20 bp, mouse
gagtcccggtgtccccacct

SEQ ID NO: 628746 - DNA, 20 bp, mouse
gacacaagatggggactcca

SEQ ID NO: 628747 - DNA, 20 bp, mouse
gtggagccaggaaggagcgg

SEQ ID NO: 628748 - DNA, 20 bp, mouse
gcaaccggcctaaagaatct

SEQ ID NO: 628749 - DNA, 20 bp, mouse
gactgaggaagtaggaacgt

SEQ ID NO: 628750 - DNA, 20 bp, mouse
gggttctgagtgccagcaac

SEQ ID NO: 628751 - DNA, 20 bp, mouse
gctgcgcagcgacccggaag

SEQ ID NO: 628752 - DNA, 20 bp, mouse
ggatggggactccagggcag

SEQ ID NO: 628753 - DNA, 20 bp, mouse
gagctctccgcgtcaccgag

SEQ ID NO: 628754 - DNA, 20 bp, mouse
gagaacccggacctctgccc

SEQ ID NO: 628755 - DNA, 20 bp, mouse
ggagatggcagcggagccag

SEQ ID NO: 628756 - DNA, 20 bp, mouse
ggagggatctgcaagagccg

SEQ ID NO: 628757 - DNA, 20 bp, mouse
gcctgtggacgattctactg

SEQ ID NO: 628758 - DNA, 20 bp, mouse
ggcgaaagtgcagacgtcct

SEQ ID NO: 628759 - DNA, 20 bp, mouse
gctccaggcggggaagagtc

SEQ ID NO: 628760 - DNA, 20 bp, mouse
gtagaatcgtccacaggcac

SEQ ID NO: 628761 - DNA, 20 bp, mouse
gtggccccctccccatccca

SEQ ID NO: 628762 - DNA, 20 bp, mouse
gcgagaccctcctccgggat

SEQ ID NO: 628763 - DNA, 20 bp, mouse
gaggtgacgactgcaggatg

SEQ ID NO: 628764 - DNA, 20 bp, mouse
ggtcagggagattggacctg

SEQ ID NO: 628765 - DNA, 20 bp, mouse
gtcggtgaagaccctgggat

SEQ ID NO: 628766 - DNA, 20 bp, mouse
gaccctagagcacagtctag

SEQ ID NO: 628767 - DNA, 20 bp, mouse
gtcccctagactgtgctcta

SEQ ID NO: 628768 - DNA, 20 bp, mouse
gcttgccagagactggacac

SEQ ID NO: 628769 - DNA, 20 bp, mouse
ggttcccggtgtccagtctc

SEQ ID NO: 628770 - DNA, 20 bp, mouse
gcagaggtgctggatcaggt

SEQ ID NO: 628771 - DNA, 20 bp, mouse
gccgccacggagacgcccac

SEQ ID NO: 628772 - DNA, 20 bp, mouse
ggacccaccttgccagagac

SEQ ID NO: 628773 - DNA, 20 bp, mouse
ggtagctcgcaccaactctc

SEQ ID NO: 628774 - DNA, 20 bp, mouse
gggctccaagagctacccac

SEQ ID NO: 628775 - DNA, 20 bp, mouse
ggccggtagaggaatcccca

SEQ ID NO: 628776 - DNA, 20 bp, mouse
gtcaggatcggggcaggaag

SEQ ID NO: 628777 - DNA, 20 bp, mouse
gccgccccggtcctcaccac

SEQ ID NO: 628778 - DNA, 20 bp, mouse
ggagcccgtggtgaggaccg

SEQ ID NO: 628779 - DNA, 20 bp, mouse
ggaccctgagtcctattctg

SEQ ID NO: 628780 - DNA, 20 bp, mouse
gagatgtgggacgcttacag

SEQ ID NO: 628781 - DNA, 20 bp, mouse
gggctaaacccggaagtagg

SEQ ID NO: 628782 - DNA, 20 bp, mouse
gtaggactcagggtctcggg

SEQ ID NO: 628783 - DNA, 20 bp, mouse
gaccctgagggtaggtgcag

SEQ ID NO: 628784 - DNA, 20 bp, mouse
gctgcactgccggctaaacc

SEQ ID NO: 628785 - DNA, 20 bp, mouse
gacacccggcatgactcgag

SEQ ID NO: 628786 - DNA, 20 bp, mouse
gacagctagttggtccgatg

SEQ ID NO: 628787 - DNA, 20 bp, mouse
gttccaggccgtttacggaa

SEQ ID NO: 628788 - DNA, 20 bp, mouse
ggtctctgtcgcctaaactt

SEQ ID NO: 628789 - DNA, 20 bp, mouse
ggggtctgcggacttaatag

SEQ ID NO: 628790 - DNA, 20 bp, mouse
gacagctcgcaggaatcatg

SEQ ID NO: 628791 - DNA, 20 bp, mouse
ggggtcgcgagctgagtggt

SEQ ID NO: 628792 - DNA, 20 bp, mouse
gcaacaccctgcaaaaaatc

SEQ ID NO: 628793 - DNA, 20 bp, mouse
gtctaagtggagggaggttc

SEQ ID NO: 628794 - DNA, 20 bp, mouse
ggacctttccgtaaacggcc

SEQ ID NO: 628795 - DNA, 20 bp, mouse
ggagtagacctttccgtaaa

SEQ ID NO: 628796 - DNA, 20 bp, mouse
gctggcccggcccagaacaa

SEQ ID NO: 628797 - DNA, 20 bp, mouse
gagtcttgtgacgcactcca

SEQ ID NO: 628798 - DNA, 20 bp, mouse
gtcctggatccagatgacct

SEQ ID NO: 628799 - DNA, 20 bp, mouse
gcatctggatccaggatcct

SEQ ID NO: 628800 - DNA, 20 bp, mouse
gtgacgcactccaaggatcc

SEQ ID NO: 628801 - DNA, 20 bp, mouse
ggggatggtcatcaaaactc

SEQ ID NO: 628802 - DNA, 20 bp, mouse
gcgtcacaagactggagtcc

SEQ ID NO: 628803 - DNA, 20 bp, mouse
gtggagtccaggtatcacca

SEQ ID NO: 628804 - DNA, 20 bp, mouse
gagatcgcagaccctgtgga

SEQ ID NO: 628805 - DNA, 20 bp, mouse
ggttgcggggcacaccagaa

SEQ ID NO: 628806 - DNA, 20 bp, mouse
gagcgcgcggggcaacgaag

SEQ ID NO: 628807 - DNA, 20 bp, mouse
gtgcgcgggctccctcgggt

SEQ ID NO: 628808 - DNA, 20 bp, mouse
gcgcgggaagcggtacgcag

SEQ ID NO: 628809 - DNA, 20 bp, mouse
gcccagccgggccgcgtcag

SEQ ID NO: 628810 - DNA, 20 bp, mouse
gaagtggctcgaccaccggg

SEQ ID NO: 628811 - DNA, 20 bp, mouse
gcaacgaagaggcacggact

SEQ ID NO: 628812 - DNA, 20 bp, mouse
ggcggggcaacgaagaggca

SEQ ID NO: 628813 - DNA, 20 bp, mouse
ggtccaggaggacacgaact

SEQ ID NO: 628814 - DNA, 20 bp, mouse
gcgaccaccgggaggctaca

SEQ ID NO: 628815 - DNA, 20 bp, mouse
gcgggcacctgtaccaggta

SEQ ID NO: 628816 - DNA, 20 bp, mouse
gacagggagaccctaaggct

SEQ ID NO: 628817 - DNA, 20 bp, mouse
gacaaggaggagatattaca

SEQ ID NO: 628818 - DNA, 20 bp, mouse
ggtgcagcttgactttgagg

SEQ ID NO: 628819 - DNA, 20 bp, mouse
gggcggaggaattggcaaca

SEQ ID NO: 628820 - DNA, 20 bp, mouse
gatattacagggagacccta

SEQ ID NO: 628821 - DNA, 20 bp, mouse
ggtagtgcagcttgactttg

SEQ ID NO: 628822 - DNA, 20 bp, mouse
gcgaccacccccggaccaga

SEQ ID NO: 628823 - DNA, 20 bp, mouse
gggagcggtcaagttcctag

SEQ ID NO: 628824 - DNA, 20 bp, mouse
gtcggcgagaaggggctcac

SEQ ID NO: 628825 - DNA, 20 bp, mouse
gggctctgatgaggcctaga

SEQ ID NO: 628826 - DNA, 20 bp, mouse
ggcgtctgcccgggacgacg

SEQ ID NO: 628827 - DNA, 20 bp, mouse
ggccgcagcctcgtcgtccc

SEQ ID NO: 628828 - DNA, 20 bp, mouse
ggcccgggacgacgaggctg

SEQ ID NO: 628829 - DNA, 20 bp, mouse
gaggccccgccacactggac

SEQ ID NO: 628830 - DNA, 20 bp, mouse
gccggtcaaggtgaagacaa

SEQ ID NO: 628831 - DNA, 20 bp, mouse
ggtgcgcgccgggggcttgt

SEQ ID NO: 628832 - DNA, 20 bp, mouse
ggaacaaaaccggcccgtgg

SEQ ID NO: 628833 - DNA, 20 bp, mouse
ggcgtgcgcacagaaggccg

SEQ ID NO: 628834 - DNA, 20 bp, mouse
ggcggcctgctgcacttcgg

SEQ ID NO: 628835 - DNA, 20 bp, mouse
ggaggacggccgagttgctg

SEQ ID NO: 628836 - DNA, 20 bp, mouse
gagccagaggctggcggcac

SEQ ID NO: 628837 - DNA, 20 bp, mouse
gcccgtggaccacccgcccg

SEQ ID NO: 628838 - DNA, 20 bp, mouse
gtagtcccgcgcgcccagtg

SEQ ID NO: 628839 - DNA, 20 bp, mouse
ggtagagctggagagcagtc

SEQ ID NO: 628840 - DNA, 20 bp, mouse
ggtggtgagtgcgcttcctc

SEQ ID NO: 628841 - DNA, 20 bp, mouse
gtgagtgcgcttcctcgggc

SEQ ID NO: 628842 - DNA, 20 bp, mouse
gtcctcgggcgggtggtcca

SEQ ID NO: 628843 - DNA, 20 bp, mouse
gagagccccgggctcccagt

SEQ ID NO: 628844 - DNA, 20 bp, mouse
gccagcagcggtgcacacaa

SEQ ID NO: 628845 - DNA, 20 bp, mouse
gtcgggcgcgaatgaccccg

SEQ ID NO: 628846 - DNA, 20 bp, mouse
gccagcgggtcggaacacgt

SEQ ID NO: 628847 - DNA, 20 bp, mouse
gcccggccgaaagagccgag

SEQ ID NO: 628848 - DNA, 20 bp, mouse
gcgagtcgcgcggggcccag

SEQ ID NO: 628849 - DNA, 20 bp, mouse
gctttcggccgggagtgggt

SEQ ID NO: 628850 - DNA, 20 bp, mouse
gggacgtccggagacaaggg

SEQ ID NO: 628851 - DNA, 20 bp, mouse
gggtatggacgcaatccgag

SEQ ID NO: 628852 - DNA, 20 bp, mouse
ggaagggcaggagcattggg

SEQ ID NO: 628853 - DNA, 20 bp, mouse
gccgggacgtccggagacaa

SEQ ID NO: 628854 - DNA, 20 bp, mouse
gacgtctcccgcggctccgg

SEQ ID NO: 628855 - DNA, 20 bp, mouse
ggcgcgactcggatcccgct

SEQ ID NO: 628856 - DNA, 20 bp, mouse
gggaggtggagatagaacga

SEQ ID NO: 628857 - DNA, 20 bp, mouse
gctgcgggacgcgctggtgg

SEQ ID NO: 628858 - DNA, 20 bp, mouse
ggcgctggtggcggttggtg

SEQ ID NO: 628859 - DNA, 20 bp, mouse
gtgacgtggaggccgagcgt

SEQ ID NO: 628860 - DNA, 20 bp, mouse
gttcctgcgggacgcgctgg

SEQ ID NO: 628861 - DNA, 20 bp, mouse
gagaactctgcgagtctctt

SEQ ID NO: 628862 - DNA, 20 bp, mouse
gagaacaggcagaatagagg

SEQ ID NO: 628863 - DNA, 20 bp, mouse
gcggccgggccctaccaaac

SEQ ID NO: 628864 - DNA, 20 bp, mouse
ggggacgcgctggtggcggt

SEQ ID NO: 628865 - DNA, 20 bp, mouse
gtaactgcgccctacagaac

SEQ ID NO: 628866 - DNA, 20 bp, mouse
ggcggcggcggcttccagga

SEQ ID NO: 628867 - DNA, 20 bp, mouse
gccaggagggtgaggacgtc

SEQ ID NO: 628868 - DNA, 20 bp, mouse
gggagggtgaggacgtctgg

SEQ ID NO: 628869 - DNA, 20 bp, mouse
ggtgaggacgtctggcggag

SEQ ID NO: 628870 - DNA, 20 bp, mouse
gtgtatcaacacggcggcgg

SEQ ID NO: 628871 - DNA, 20 bp, mouse
ggagggcgagggtaccggga

SEQ ID NO: 628872 - DNA, 20 bp, mouse
ggcaccttgtatcaacacgg

SEQ ID NO: 628873 - DNA, 20 bp, mouse
gaatgcaccttgtatcaaca

SEQ ID NO: 628874 - DNA, 20 bp, mouse
gcggagcaccttacccgagt

SEQ ID NO: 628875 - DNA, 20 bp, mouse
gccttgtatcaacacggcgg

SEQ ID NO: 628876 - DNA, 20 bp, mouse
ggcagacccggagaacccgg

SEQ ID NO: 628877 - DNA, 20 bp, mouse
gcgggagaggacaagttcct

SEQ ID NO: 628878 - DNA, 20 bp, mouse
gttgcgcagaccggatcctg

SEQ ID NO: 628879 - DNA, 20 bp, mouse
gtatcctccagtgaccgagg

SEQ ID NO: 628880 - DNA, 20 bp, mouse
ggtggcagacccggagaacc

SEQ ID NO: 628881 - DNA, 20 bp, mouse
gctcgaggcgcctgcgggag

SEQ ID NO: 628882 - DNA, 20 bp, mouse
ggcgccgaatccgcaggatc

SEQ ID NO: 628883 - DNA, 20 bp, mouse
gggagggcccggactcacca

SEQ ID NO: 628884 - DNA, 20 bp, mouse
gaagttcctgggagcagcgc

SEQ ID NO: 628885 - DNA, 20 bp, mouse
gctccctgaggacacctcct

SEQ ID NO: 628886 - DNA, 20 bp, mouse
ggtccgcgcggggacagtgc

SEQ ID NO: 628887 - DNA, 20 bp, mouse
gtccggcggggggactgttg

SEQ ID NO: 628888 - DNA, 20 bp, mouse
ggccccaacagtccccccgc

SEQ ID NO: 628889 - DNA, 20 bp, mouse
gcgtctgccgctagccccga

SEQ ID NO: 628890 - DNA, 20 bp, mouse
gccccgcgcggacgagtagg

SEQ ID NO: 628891 - DNA, 20 bp, mouse
gtgtccccgcgcggacgagt

SEQ ID NO: 628892 - DNA, 20 bp, mouse
ggctagcggcagacgcacaa

SEQ ID NO: 628893 - DNA, 20 bp, mouse
gcagtccccccgccggacgc

SEQ ID NO: 628894 - DNA, 20 bp, mouse
gcccggtccccgcgccgtcg

SEQ ID NO: 628895 - DNA, 20 bp, mouse
ggcggggtccctgcgcgggc

SEQ ID NO: 628896 - DNA, 20 bp, mouse
gtggcgccactgcaatgtca

SEQ ID NO: 628897 - DNA, 20 bp, mouse
ggcaagcccaggtaccagtg

SEQ ID NO: 628898 - DNA, 20 bp, mouse
ggcttgccttgacattgcag

SEQ ID NO: 628899 - DNA, 20 bp, mouse
ggtgaggctagagcgcagcc

SEQ ID NO: 628900 - DNA, 20 bp, mouse
gtctagcctcactggtacct

SEQ ID NO: 628901 - DNA, 20 bp, mouse
gcagaggtcataagtggtgt

SEQ ID NO: 628902 - DNA, 20 bp, mouse
gagaaagcccaggaaaacgg

SEQ ID NO: 628903 - DNA, 20 bp, mouse
gaagctgtcccccctctccc

SEQ ID NO: 628904 - DNA, 20 bp, mouse
ggcgactattaccactccca

SEQ ID NO: 628905 - DNA, 20 bp, mouse
gccaatagcaccggggagag

SEQ ID NO: 628906 - DNA, 20 bp, mouse
gcaaggcccgcaccccctgg

SEQ ID NO: 628907 - DNA, 20 bp, mouse
gggccgggggacccccggag

SEQ ID NO: 628908 - DNA, 20 bp, mouse
gggcaagaggcggccgccag

SEQ ID NO: 628909 - DNA, 20 bp, mouse
gggacccccggagcggcaag

SEQ ID NO: 628910 - DNA, 20 bp, mouse
gccccaaggcccgcaccccc

SEQ ID NO: 628911 - DNA, 20 bp, mouse
gtccggggccgggggacccc

SEQ ID NO: 628912 - DNA, 20 bp, mouse
ggcagcgcgctcgggctccg

SEQ ID NO: 628913 - DNA, 20 bp, mouse
ggccgcctcttgccgctccg

SEQ ID NO: 628914 - DNA, 20 bp, mouse
ggacgccccgggccccccca

SEQ ID NO: 628915 - DNA, 20 bp, mouse
gcgggccattagcatgcggg

SEQ ID NO: 628916 - DNA, 20 bp, mouse
gtgtccccggaaatttctga

SEQ ID NO: 628917 - DNA, 20 bp, mouse
gtgagaggacacttaatagt

SEQ ID NO: 628918 - DNA, 20 bp, mouse
gccggaaatttctgagggaa

SEQ ID NO: 628919 - DNA, 20 bp, mouse
gcacgtctccgcaagaccct

SEQ ID NO: 628920 - DNA, 20 bp, mouse
gtattcccaaaagcgggaga

SEQ ID NO: 628921 - DNA, 20 bp, mouse
ggacacctagtgcagaatct

SEQ ID NO: 628922 - DNA, 20 bp, mouse
gggtagagtcagcagcgcgg

SEQ ID NO: 628923 - DNA, 20 bp, mouse
gaggtgggcgggattgggta

SEQ ID NO: 628924 - DNA, 20 bp, mouse
gaggacacttaatagtgggt

SEQ ID NO: 628925 - DNA, 20 bp, mouse
gggaaaggcgagttttgctg

SEQ ID NO: 628926 - DNA, 20 bp, mouse
gagacgggtccaggaatcct

SEQ ID NO: 628927 - DNA, 20 bp, mouse
gctcatcagaagtactgcca

SEQ ID NO: 628928 - DNA, 20 bp, mouse
ggtagttccagcgccagtga

SEQ ID NO: 628929 - DNA, 20 bp, mouse
gccagcacacagaagggtcg

SEQ ID NO: 628930 - DNA, 20 bp, mouse
gtcctctgacagactcccgt

SEQ ID NO: 628931 - DNA, 20 bp, mouse
gccagcgccagtgacggctg

SEQ ID NO: 628932 - DNA, 20 bp, mouse
gagctgggctctgcttgaga

SEQ ID NO: 628933 - DNA, 20 bp, mouse
ggcatctccggggagaagag

SEQ ID NO: 628934 - DNA, 20 bp, mouse
ggagcctggccttgcggcag

SEQ ID NO: 628935 - DNA, 20 bp, mouse
ggactctgaagcccacgtgg

SEQ ID NO: 628936 - DNA, 20 bp, mouse
gcggaccgcgcgggcctcgg

SEQ ID NO: 628937 - DNA, 20 bp, mouse
gcggccccgcggcatcgtcg

SEQ ID NO: 628938 - DNA, 20 bp, mouse
gcgagggagagcgcgagtga

SEQ ID NO: 628939 - DNA, 20 bp, mouse
gcgacggcgcccggacgcgc

SEQ ID NO: 628940 - DNA, 20 bp, mouse
ggaacccgccgaggcccgcg

SEQ ID NO: 628941 - DNA, 20 bp, mouse
gggccgccgagtccccggat

SEQ ID NO: 628942 - DNA, 20 bp, mouse
gagggagccgacaggaactc

SEQ ID NO: 628943 - DNA, 20 bp, mouse
gagcagcgctcggaccgcgc

SEQ ID NO: 628944 - DNA, 20 bp, mouse
gactccggtaaggcccgcgg

SEQ ID NO: 628945 - DNA, 20 bp, mouse
gcgggcctcggcgggttcca

SEQ ID NO: 628946 - DNA, 20 bp, mouse
gagctctgctcacctcttgt

SEQ ID NO: 628947 - DNA, 20 bp, mouse
ggtcctgcgttaccaggtgt

SEQ ID NO: 628948 - DNA, 20 bp, mouse
ggctgggctgccccaggggt

SEQ ID NO: 628949 - DNA, 20 bp, mouse
gggactcccgagcatcatcg

SEQ ID NO: 628950 - DNA, 20 bp, mouse
gtgtaggtagaacccacacc

SEQ ID NO: 628951 - DNA, 20 bp, mouse
gtgtgggttctacctacaag

SEQ ID NO: 628952 - DNA, 20 bp, mouse
gacgttcctggggaccatgt

SEQ ID NO: 628953 - DNA, 20 bp, mouse
ggtgcaccaggccaccctca

SEQ ID NO: 628954 - DNA, 20 bp, mouse
gaccaggccaccctcacgga

SEQ ID NO: 628955 - DNA, 20 bp, mouse
gtcgggagtcctgcgttacc

SEQ ID NO: 628956 - DNA, 20 bp, mouse
gaggtacgcgaggccacgga

SEQ ID NO: 628957 - DNA, 20 bp, mouse
gcggtgcactgcaggagcgg

SEQ ID NO: 628958 - DNA, 20 bp, mouse
ggtggcctcgcgtacctcct

SEQ ID NO: 628959 - DNA, 20 bp, mouse
ggcacggtgcactgcaggag

SEQ ID NO: 628960 - DNA, 20 bp, mouse
ggagccttagacagcatcaa

SEQ ID NO: 628961 - DNA, 20 bp, mouse
ggcgaggccacggatggacc

SEQ ID NO: 628962 - DNA, 20 bp, mouse
gccaggagttgtttcccagg

SEQ ID NO: 628963 - DNA, 20 bp, mouse
gcctgctcctggtccatccg

SEQ ID NO: 628964 - DNA, 20 bp, mouse
gggatcccgggtgtgtgagg

SEQ ID NO: 628965 - DNA, 20 bp, mouse
gaggccaggagttgtttccc

SEQ ID NO: 628966 - DNA, 20 bp, mouse
gggccaggctgggtgtaggt

SEQ ID NO: 628967 - DNA, 20 bp, mouse
gaggtgggtgcctggtccag

SEQ ID NO: 628968 - DNA, 20 bp, mouse
gagcctggcccgcgcagaag

SEQ ID NO: 628969 - DNA, 20 bp, mouse
gcgcgggccaggctgggtgt

SEQ ID NO: 628970 - DNA, 20 bp, mouse
gcagcagcgggagaacccgt

SEQ ID NO: 628971 - DNA, 20 bp, mouse
gtcgcctcagcctctggacc

SEQ ID NO: 628972 - DNA, 20 bp, mouse
ggaaggggcaagttgactgt

SEQ ID NO: 628973 - DNA, 20 bp, mouse
gtgcagagcgatgggaacgc

SEQ ID NO: 628974 - DNA, 20 bp, mouse
gggagcctcgcctcagcctc

SEQ ID NO: 628975 - DNA, 20 bp, mouse
gcacaagggccacccagcag

SEQ ID NO: 628976 - DNA, 20 bp, mouse
ggtgcagccgggacacccgg

SEQ ID NO: 628977 - DNA, 20 bp, mouse
gcgccgcgggagcaacgcgt

SEQ ID NO: 628978 - DNA, 20 bp, mouse
gtaagaaggggcgggaacag

SEQ ID NO: 628979 - DNA, 20 bp, mouse
gggaggaagtgaggtcgcag

SEQ ID NO: 628980 - DNA, 20 bp, mouse
ggaggcagctctggcgtaca

SEQ ID NO: 628981 - DNA, 20 bp, mouse
ggaagtcgcgtcgtgcccta

SEQ ID NO: 628982 - DNA, 20 bp, mouse
ggcagcgggcgagggcccga

SEQ ID NO: 628983 - DNA, 20 bp, mouse
ggctgtgcagccgggacacc

SEQ ID NO: 628984 - DNA, 20 bp, mouse
gcacggctgggtggttcccc

SEQ ID NO: 628985 - DNA, 20 bp, mouse
ggcgggcgagggcccgacgg

SEQ ID NO: 628986 - DNA, 20 bp, mouse
ggggccgcacgaagccacac

SEQ ID NO: 628987 - DNA, 20 bp, mouse
ggccacaccggaagagacgg

SEQ ID NO: 628988 - DNA, 20 bp, mouse
gggctgggcgggttctggtg

SEQ ID NO: 628989 - DNA, 20 bp, mouse
ggaagccacaccggaagaga

SEQ ID NO: 628990 - DNA, 20 bp, mouse
gcagcaagggctacattcga

SEQ ID NO: 628991 - DNA, 20 bp, mouse
gcggtagtagcaggccggct

SEQ ID NO: 628992 - DNA, 20 bp, mouse
gtagcctctgagaagcaacg

SEQ ID NO: 628993 - DNA, 20 bp, mouse
ggcgcgaagacagattccaa

SEQ ID NO: 628994 - DNA, 20 bp, mouse
gtagtagcaggccggctggg

SEQ ID NO: 628995 - DNA, 20 bp, mouse
gtcgccccgttgcttctcag

SEQ ID NO: 628996 - DNA, 20 bp, mouse
gacccagacaaaggcgacga

SEQ ID NO: 628997 - DNA, 20 bp, mouse
ggccatcgtcgcctttgtct

SEQ ID NO: 628998 - DNA, 20 bp, mouse
gatcaaactcacccagacaa

SEQ ID NO: 628999 - DNA, 20 bp, mouse
gactcagtctgggaaaatcc

SEQ ID NO: 629000 - DNA, 20 bp, mouse
ggctcactgaaggagtgcgc

SEQ ID NO: 629001 - DNA, 20 bp, mouse
gagtgagctagcactcccag

SEQ ID NO: 629002 - DNA, 20 bp, mouse
gctggggagatcagaaaccg

SEQ ID NO: 629003 - DNA, 20 bp, mouse
gctgggtgagtttgatttcg

SEQ ID NO: 629004 - DNA, 20 bp, mouse
gatggtggagctgagaactt

SEQ ID NO: 629005 - DNA, 20 bp, mouse
ggtttgatttcggggtctgt

SEQ ID NO: 629006 - DNA, 20 bp, mouse
gaacttaagtcgcagggccc

SEQ ID NO: 629007 - DNA, 20 bp, mouse
gggaagtccgtcctgactag

SEQ ID NO: 629008 - DNA, 20 bp, mouse
gcgggcctgagaagccggtc

SEQ ID NO: 629009 - DNA, 20 bp, mouse
gcccagggcgtctctcaagg

SEQ ID NO: 629010 - DNA, 20 bp, mouse
ggtgctgaggcttgcgaccc

SEQ ID NO: 629011 - DNA, 20 bp, mouse
gtctgtacagcagtaggcca

SEQ ID NO: 629012 - DNA, 20 bp, mouse
gtactgctgtacagaaccca

SEQ ID NO: 629013 - DNA, 20 bp, mouse
ggccacctgaccggcttctc

SEQ ID NO: 629014 - DNA, 20 bp, mouse
ggcctgagaagccggtcagg

SEQ ID NO: 629015 - DNA, 20 bp, mouse
gtggtgtcggggcatgacta

SEQ ID NO: 629016 - DNA, 20 bp, mouse
gctccacgcagcgctcggtg

SEQ ID NO: 629017 - DNA, 20 bp, mouse
ggcagcgctcggtgaggatt

SEQ ID NO: 629018 - DNA, 20 bp, mouse
ggctcggtgaggattcggtg

SEQ ID NO: 629019 - DNA, 20 bp, mouse
gggtgggtgcaaacagctca

SEQ ID NO: 629020 - DNA, 20 bp, mouse
gcttctcggcgtttgtccga

SEQ ID NO: 629021 - DNA, 20 bp, mouse
gagcttggagagctccaacg

SEQ ID NO: 629022 - DNA, 20 bp, mouse
gccgagctctgagtccttct

SEQ ID NO: 629023 - DNA, 20 bp, mouse
gctcagagctcggagaaaag

SEQ ID NO: 629024 - DNA, 20 bp, mouse
ggggagggcgaggactcggt

SEQ ID NO: 629025 - DNA, 20 bp, mouse
gccggctttagaagaaaggt

SEQ ID NO: 629026 - DNA, 20 bp, mouse
gctcaatggaagcagcacgg

SEQ ID NO: 629027 - DNA, 20 bp, mouse
gtgcggtgcaggggattcag

SEQ ID NO: 629028 - DNA, 20 bp, mouse
gggtcactaactcccaacat

SEQ ID NO: 629029 - DNA, 20 bp, mouse
gtcttgcccttaagactcaa

SEQ ID NO: 629030 - DNA, 20 bp, mouse
gtgcttccattgagtcttaa

SEQ ID NO: 629031 - DNA, 20 bp, mouse
gaaaccaaccggaatcatct

SEQ ID NO: 629032 - DNA, 20 bp, mouse
gcatccgagatgattccggt

SEQ ID NO: 629033 - DNA, 20 bp, mouse
gcggcctacgcggcatctct

SEQ ID NO: 629034 - DNA, 20 bp, mouse
ggagtggctgagggtctcgt

SEQ ID NO: 629035 - DNA, 20 bp, mouse
gtgttagggaatgtgatgag

SEQ ID NO: 629036 - DNA, 20 bp, mouse
ggcgtgcagggagccggtga

SEQ ID NO: 629037 - DNA, 20 bp, mouse
gctgcattgcacatccaagt

SEQ ID NO: 629038 - DNA, 20 bp, mouse
gcacaaatgcaaaatgaacc

SEQ ID NO: 629039 - DNA, 20 bp, mouse
gtggcctgctagtgcaagaa

SEQ ID NO: 629040 - DNA, 20 bp, mouse
gtcatgaggtttgcaagtct

SEQ ID NO: 629041 - DNA, 20 bp, mouse
gctagtgcaagaatggagat

SEQ ID NO: 629042 - DNA, 20 bp, mouse
gtagtgacgtcatgattaga

SEQ ID NO: 629043 - DNA, 20 bp, mouse
gcctcatgaactctgaggtt

SEQ ID NO: 629044 - DNA, 20 bp, mouse
gcatgaactctgaggttggg

SEQ ID NO: 629045 - DNA, 20 bp, mouse
gctaacagagcattcgctcc

SEQ ID NO: 629046 - DNA, 20 bp, mouse
gggcgtggcaggaagcgcca

SEQ ID NO: 629047 - DNA, 20 bp, mouse
gcggagccgccagtgcctgg

SEQ ID NO: 629048 - DNA, 20 bp, mouse
ggttgtaagcaggcccggcg

SEQ ID NO: 629049 - DNA, 20 bp, mouse
gccacggagccgccagtgcc

SEQ ID NO: 629050 - DNA, 20 bp, mouse
gtgtggccgagagagcgtgt

SEQ ID NO: 629051 - DNA, 20 bp, mouse
ggccgagagagcgtgtgggg

SEQ ID NO: 629052 - DNA, 20 bp, mouse
ggtgcgtgagcaaggatgtg

SEQ ID NO: 629053 - DNA, 20 bp, mouse
gaacgcgctgccgggcttct

SEQ ID NO: 629054 - DNA, 20 bp, mouse
gtcgatctcagtaccccagg

SEQ ID NO: 629055 - DNA, 20 bp, mouse
gtaagcaggcccggcgtggc

SEQ ID NO: 629056 - DNA, 20 bp, mouse
gtgggtttaggggaccggag

SEQ ID NO: 629057 - DNA, 20 bp, mouse
ggcagcaagttggccggagg

SEQ ID NO: 629058 - DNA, 20 bp, mouse
ggtccgcgctcgcagcaagt

SEQ ID NO: 629059 - DNA, 20 bp, mouse
gcaagagccactgacccctc

SEQ ID NO: 629060 - DNA, 20 bp, mouse
gctcgcagcaagttggccgg

SEQ ID NO: 629061 - DNA, 20 bp, mouse
ggcgctcgcagcaagttggc

SEQ ID NO: 629062 - DNA, 20 bp, mouse
ggcagcgcggcggagagtag

SEQ ID NO: 629063 - DNA, 20 bp, mouse
gcgacaggcccttaaaggag

SEQ ID NO: 629064 - DNA, 20 bp, mouse
gcgccccgccgcgcagactt

SEQ ID NO: 629065 - DNA, 20 bp, mouse
gtcggagccggaggaagcga

SEQ ID NO: 629066 - DNA, 20 bp, mouse
gggctgctagtgaggtccag

SEQ ID NO: 629067 - DNA, 20 bp, mouse
gctcactagcagccattacc

SEQ ID NO: 629068 - DNA, 20 bp, mouse
gcagcctcccgggggtccac

SEQ ID NO: 629069 - DNA, 20 bp, mouse
gcttcctgtggacccccggg

SEQ ID NO: 629070 - DNA, 20 bp, mouse
gtttctactgtgccaggtaa

SEQ ID NO: 629071 - DNA, 20 bp, mouse
ggcacctcgggcacagaaga

SEQ ID NO: 629072 - DNA, 20 bp, mouse
gaggaactccctcagtgagg

SEQ ID NO: 629073 - DNA, 20 bp, mouse
gccaaaccggaagacagcaa

SEQ ID NO: 629074 - DNA, 20 bp, mouse
gcggcacagcataggcgtgt

SEQ ID NO: 629075 - DNA, 20 bp, mouse
gagcaaaccggggagagcga

SEQ ID NO: 629076 - DNA, 20 bp, mouse
gtcgcgtgacatgcagggaa

SEQ ID NO: 629077 - DNA, 20 bp, mouse
gcctgagcagcggccttgaa

SEQ ID NO: 629078 - DNA, 20 bp, mouse
gaggctgcagacacccttca

SEQ ID NO: 629079 - DNA, 20 bp, mouse
gagggcgccacgccccagga

SEQ ID NO: 629080 - DNA, 20 bp, mouse
gggcgcacgctctcctagcc

SEQ ID NO: 629081 - DNA, 20 bp, mouse
gctcctgggagccccgaccg

SEQ ID NO: 629082 - DNA, 20 bp, mouse
gtggcctcccaggatcagca

SEQ ID NO: 629083 - DNA, 20 bp, mouse
gaggcctggtggaggtccgg

SEQ ID NO: 629084 - DNA, 20 bp, mouse
gcctcggggaccgcgcacaa

SEQ ID NO: 629085 - DNA, 20 bp, mouse
ggcaaggagcagtgacctcg

SEQ ID NO: 629086 - DNA, 20 bp, mouse
gccccgcaccacgacctcca

SEQ ID NO: 629087 - DNA, 20 bp, mouse
gggcggggccctggaggtcg

SEQ ID NO: 629088 - DNA, 20 bp, mouse
gtggagcggcggggccctgg

SEQ ID NO: 629089 - DNA, 20 bp, mouse
gcggggctttggtgttggag

SEQ ID NO: 629090 - DNA, 20 bp, mouse
gggcgtacctgagcctcccc

SEQ ID NO: 629091 - DNA, 20 bp, mouse
gagagggaggctgccaggaa

SEQ ID NO: 629092 - DNA, 20 bp, mouse
ggagcccagagaccccttcc

SEQ ID NO: 629093 - DNA, 20 bp, mouse
gggccctggaggtcgtggtg

SEQ ID NO: 629094 - DNA, 20 bp, mouse
ggccaatcacaggtcgccgt

SEQ ID NO: 629095 - DNA, 20 bp, mouse
ggccggcgcgcactagccca

SEQ ID NO: 629096 - DNA, 20 bp, mouse
gcaggacgtccggagctcag

SEQ ID NO: 629097 - DNA, 20 bp, mouse
gcagaccgctgcaggacgtc

SEQ ID NO: 629098 - DNA, 20 bp, mouse
ggcttcgaaggtgagcgaag

SEQ ID NO: 629099 - DNA, 20 bp, mouse
gttcgggtccctactatcca

SEQ ID NO: 629100 - DNA, 20 bp, mouse
gccttcgaagcggggagacg

SEQ ID NO: 629101 - DNA, 20 bp, mouse
gtcaggccccgggaagggaa

SEQ ID NO: 629102 - DNA, 20 bp, mouse
gaagggccgcaggagcccga

SEQ ID NO: 629103 - DNA, 20 bp, mouse
gtggcctccgaaggcctggg

SEQ ID NO: 629104 - DNA, 20 bp, mouse
ggccaccgccgccatttgag

SEQ ID NO: 629105 - DNA, 20 bp, mouse
gggccgcaggagcccgaggg

SEQ ID NO: 629106 - DNA, 20 bp, mouse
gcctgactggagccctgagg

SEQ ID NO: 629107 - DNA, 20 bp, mouse
gacgcttaccgtgagcggag

SEQ ID NO: 629108 - DNA, 20 bp, mouse
ggggggacgcttaccgtgag

SEQ ID NO: 629109 - DNA, 20 bp, mouse
gggccgagccgctccgctca

SEQ ID NO: 629110 - DNA, 20 bp, mouse
gagcccggctgtgctctcgg

SEQ ID NO: 629111 - DNA, 20 bp, mouse
gcgcggcggcccacagtaca

SEQ ID NO: 629112 - DNA, 20 bp, mouse
ggtcccccgagagcacagcc

SEQ ID NO: 629113 - DNA, 20 bp, mouse
gcggagcggctcggcctgac

SEQ ID NO: 629114 - DNA, 20 bp, mouse
ggatgggaggatctgcgcgg

SEQ ID NO: 629115 - DNA, 20 bp, mouse
gccggcgcgacgaggcgagg

SEQ ID NO: 629116 - DNA, 20 bp, mouse
gtattaactggaggcgacgg

SEQ ID NO: 629117 - DNA, 20 bp, mouse
gcggctgcgcagaagcgggg

SEQ ID NO: 629118 - DNA, 20 bp, mouse
gccgcggctgcgcagaagcg

SEQ ID NO: 629119 - DNA, 20 bp, mouse
ggcccgccggccacacttac

SEQ ID NO: 629120 - DNA, 20 bp, mouse
ggctccggcagcgccagcgg

SEQ ID NO: 629121 - DNA, 20 bp, mouse
gaggaggcctggctgcggag

SEQ ID NO: 629122 - DNA, 20 bp, mouse
gcggcgggtcccaaacgctg

SEQ ID NO: 629123 - DNA, 20 bp, mouse
gcccggcagacaccgcgccg

SEQ ID NO: 629124 - DNA, 20 bp, mouse
ggcggtcccagcagtagcgg

SEQ ID NO: 629125 - DNA, 20 bp, mouse
gtcggcagcgggttccttag

SEQ ID NO: 629126 - DNA, 20 bp, mouse
gagcggggaacagcactccc

SEQ ID NO: 629127 - DNA, 20 bp, mouse
gggtggcagacctcctccgg

SEQ ID NO: 629128 - DNA, 20 bp, mouse
ggcgtagcgccggctcctgg

SEQ ID NO: 629129 - DNA, 20 bp, mouse
gagggtttggggctggacag

SEQ ID NO: 629130 - DNA, 20 bp, mouse
gcgccccgcccccacggcag

SEQ ID NO: 629131 - DNA, 20 bp, mouse
gcctcagcagctgggcatcc

SEQ ID NO: 629132 - DNA, 20 bp, mouse
gtccctggccggcccgagcg

SEQ ID NO: 629133 - DNA, 20 bp, mouse
gagctgggcatccagggttt

SEQ ID NO: 629134 - DNA, 20 bp, mouse
gggccgcgccgctgccgtgg

SEQ ID NO: 629135 - DNA, 20 bp, mouse
ggcccaggctctgcccccgg

SEQ ID NO: 629136 - DNA, 20 bp, mouse
gcctttgtcaggcctgggat

SEQ ID NO: 629137 - DNA, 20 bp, mouse
gtgcgcgactcagagctaag

SEQ ID NO: 629138 - DNA, 20 bp, mouse
ggaagttcgtagcctttgtc

SEQ ID NO: 629139 - DNA, 20 bp, mouse
gagagctggacggagctgga

SEQ ID NO: 629140 - DNA, 20 bp, mouse
gtcgcgcagtcagcagtcca

SEQ ID NO: 629141 - DNA, 20 bp, mouse
gctcctggagctgtccccta

SEQ ID NO: 629142 - DNA, 20 bp, mouse
ggagaagagcaggaccttag

SEQ ID NO: 629143 - DNA, 20 bp, mouse
gctaggaccccggtgcatac

SEQ ID NO: 629144 - DNA, 20 bp, mouse
gcctggcagagagcaactac

SEQ ID NO: 629145 - DNA, 20 bp, mouse
gaactactggaccaccgccg

SEQ ID NO: 629146 - DNA, 20 bp, mouse
gtgcgaagcccgggagctag

SEQ ID NO: 629147 - DNA, 20 bp, mouse
gggcgcagcccgggcaacaa

SEQ ID NO: 629148 - DNA, 20 bp, mouse
gattccagccgggtccccag

SEQ ID NO: 629149 - DNA, 20 bp, mouse
ggcagcccgggcaacaatgg

SEQ ID NO: 629150 - DNA, 20 bp, mouse
gcgaggtcgctgcgaagccc

SEQ ID NO: 629151 - DNA, 20 bp, mouse
gcgactcagagctgcatcag

SEQ ID NO: 629152 - DNA, 20 bp, mouse
gcggctcccggctcctccca

SEQ ID NO: 629153 - DNA, 20 bp, mouse
ggcccgggagctaggggttc

SEQ ID NO: 629154 - DNA, 20 bp, mouse
gaggcgggcgcatctcctca

SEQ ID NO: 629155 - DNA, 20 bp, mouse
gggcgtggcgggagcctccg

SEQ ID NO: 629156 - DNA, 20 bp, mouse
ggagcgggctgcgaagatgg

SEQ ID NO: 629157 - DNA, 20 bp, mouse
gccgagcaggagcgcctgag

SEQ ID NO: 629158 - DNA, 20 bp, mouse
gagcaggagcgcctgagcgg

SEQ ID NO: 629159 - DNA, 20 bp, mouse
gacggagcgggctgcgaaga

SEQ ID NO: 629160 - DNA, 20 bp, mouse
gaggtgcgtacgcgacggag

SEQ ID NO: 629161 - DNA, 20 bp, mouse
gaggagcgcctgagcggtgg

SEQ ID NO: 629162 - DNA, 20 bp, mouse
ggacccaggtgcgtacgcga

SEQ ID NO: 629163 - DNA, 20 bp, mouse
gcgcgcagccgccaccgctc

SEQ ID NO: 629164 - DNA, 20 bp, mouse
gcacagctggcggcagtagg

SEQ ID NO: 629165 - DNA, 20 bp, mouse
ggccgcggaacacaaagacg

SEQ ID NO: 629166 - DNA, 20 bp, mouse
gggccttgcggcgggacatg

SEQ ID NO: 629167 - DNA, 20 bp, mouse
gaggcgctcaggtgagtgag

SEQ ID NO: 629168 - DNA, 20 bp, mouse
ggcgagggctagggactcac

SEQ ID NO: 629169 - DNA, 20 bp, mouse
ggcggcgggacatggggaga

SEQ ID NO: 629170 - DNA, 20 bp, mouse
gggggagagggcgcagatcc

SEQ ID NO: 629171 - DNA, 20 bp, mouse
gatccaggtaatccgcgcgg

SEQ ID NO: 629172 - DNA, 20 bp, mouse
gtgagcgcctggccaccgcg

SEQ ID NO: 629173 - DNA, 20 bp, mouse
gaaggtcccgatactagcag

SEQ ID NO: 629174 - DNA, 20 bp, mouse
gggccaccgcgcggattacc

SEQ ID NO: 629175 - DNA, 20 bp, mouse
gcagatccaggtaatccgcg

SEQ ID NO: 629176 - DNA, 20 bp, mouse
gggcccgaggcgctgcaccg

SEQ ID NO: 629177 - DNA, 20 bp, mouse
gtgcagcgcctcgggcccgg

SEQ ID NO: 629178 - DNA, 20 bp, mouse
gggcccggcggagggagcgt

SEQ ID NO: 629179 - DNA, 20 bp, mouse
gtaccggaagtggccggcgt

SEQ ID NO: 629180 - DNA, 20 bp, mouse
ggggcacgacggaaccagag

SEQ ID NO: 629181 - DNA, 20 bp, mouse
ggccgcagtgcgcccggtac

SEQ ID NO: 629182 - DNA, 20 bp, mouse
gagagaggcctcaccgctgg

SEQ ID NO: 629183 - DNA, 20 bp, mouse
ggtgcgcccggtaccggaag

SEQ ID NO: 629184 - DNA, 20 bp, mouse
gcacagcaaacccgagtcag

SEQ ID NO: 629185 - DNA, 20 bp, mouse
ggtccgaccgggcgaagatg

SEQ ID NO: 629186 - DNA, 20 bp, mouse
gggtccccggagaagagcgt

SEQ ID NO: 629187 - DNA, 20 bp, mouse
ggctcttggtcaggggaagg

SEQ ID NO: 629188 - DNA, 20 bp, mouse
ggagccaggcccctagctct

SEQ ID NO: 629189 - DNA, 20 bp, mouse
gggcccctagctcttggtca

SEQ ID NO: 629190 - DNA, 20 bp, mouse
gttcccctgaccaagagcta

SEQ ID NO: 629191 - DNA, 20 bp, mouse
gctggctcgcagcctccgcg

SEQ ID NO: 629192 - DNA, 20 bp, mouse
gcgtaggccgcacgagaccg

SEQ ID NO: 629193 - DNA, 20 bp, mouse
gcccagctgacgggtatccc

SEQ ID NO: 629194 - DNA, 20 bp, mouse
gacgggtatcccgggagggt

SEQ ID NO: 629195 - DNA, 20 bp, mouse
ggctgacgggtatcccggga

SEQ ID NO: 629196 - DNA, 20 bp, mouse
ggtgctcgcagtaactaagg

SEQ ID NO: 629197 - DNA, 20 bp, mouse
gttagtgctcgcagtaacta

SEQ ID NO: 629198 - DNA, 20 bp, mouse
gtcggtgagtacttggggag

SEQ ID NO: 629199 - DNA, 20 bp, mouse
gactaaaaagtggttatctc

SEQ ID NO: 629200 - DNA, 20 bp, mouse
gagtaactaaggcggggaaa

SEQ ID NO: 629201 - DNA, 20 bp, mouse
gcaggaagttatgactgata

SEQ ID NO: 629202 - DNA, 20 bp, mouse
ggctctatcagggtcctcat

SEQ ID NO: 629203 - DNA, 20 bp, mouse
ggagcgtgcagtagagtgat

SEQ ID NO: 629204 - DNA, 20 bp, mouse
ggtgcagagttcattcagag

SEQ ID NO: 629205 - DNA, 20 bp, mouse
gctgcaaacacgaatttact

SEQ ID NO: 629206 - DNA, 20 bp, mouse
gacggccgcgagctgcgcga

SEQ ID NO: 629207 - DNA, 20 bp, mouse
ggccgcgagctgcgcgacgg

SEQ ID NO: 629208 - DNA, 20 bp, mouse
gtagtgcgggggggagtccc

SEQ ID NO: 629209 - DNA, 20 bp, mouse
ggccaagccggagcgagaca

SEQ ID NO: 629210 - DNA, 20 bp, mouse
gcgagacacggactcgtggg

SEQ ID NO: 629211 - DNA, 20 bp, mouse
gtggggggctgtgaccaccg

SEQ ID NO: 629212 - DNA, 20 bp, mouse
ggcgagctgcgcgacggcgg

SEQ ID NO: 629213 - DNA, 20 bp, mouse
gcactttgtgtagtgcgggg

SEQ ID NO: 629214 - DNA, 20 bp, mouse
ggagcgagacacggactcgt

SEQ ID NO: 629215 - DNA, 20 bp, mouse
gcagtcccgcgatctcccca

SEQ ID NO: 629216 - DNA, 20 bp, mouse
gcgccaggatggggacctca

SEQ ID NO: 629217 - DNA, 20 bp, mouse
ggttagctccaggaagcgga

SEQ ID NO: 629218 - DNA, 20 bp, mouse
gcattgcttcggggagctag

SEQ ID NO: 629219 - DNA, 20 bp, mouse
gaacgcttcggggaacagga

SEQ ID NO: 629220 - DNA, 20 bp, mouse
gtgtagaccaggatgttcag

SEQ ID NO: 629221 - DNA, 20 bp, mouse
gatgtgcgaaaggatagttg

SEQ ID NO: 629222 - DNA, 20 bp, mouse
gcctcaaggcacgcctccta

SEQ ID NO: 629223 - DNA, 20 bp, mouse
gacaggagggtccaaacaca

SEQ ID NO: 629224 - DNA, 20 bp, mouse
gtccaggaagcggagggctg

SEQ ID NO: 629225 - DNA, 20 bp, mouse
ggggttaagtgacgaaccac

SEQ ID NO: 629226 - DNA, 20 bp, mouse
ggccgcagcgaggagcaaga

SEQ ID NO: 629227 - DNA, 20 bp, mouse
gggaggagcgggagccactg

SEQ ID NO: 629228 - DNA, 20 bp, mouse
ggtggcggcacgctcccgag

SEQ ID NO: 629229 - DNA, 20 bp, mouse
gcgcgctgcggtgtccgcgg

SEQ ID NO: 629230 - DNA, 20 bp, mouse
gatggctaccgggagcgccg

SEQ ID NO: 629231 - DNA, 20 bp, mouse
ggaccggtgcgaagagacgg

SEQ ID NO: 629232 - DNA, 20 bp, mouse
ggtgcgaagagacggaggag

SEQ ID NO: 629233 - DNA, 20 bp, mouse
gagcgtgccgccacagccgc

SEQ ID NO: 629234 - DNA, 20 bp, mouse
gtcaggagccgggagccgtg

SEQ ID NO: 629235 - DNA, 20 bp, mouse
gcggcgcgctgcggtgtccg

SEQ ID NO: 629236 - DNA, 20 bp, mouse
gaccggggcagcggacggac

SEQ ID NO: 629237 - DNA, 20 bp, mouse
gagaccggcggacagagggt

SEQ ID NO: 629238 - DNA, 20 bp, mouse
gggcgagcggacagaccgac

SEQ ID NO: 629239 - DNA, 20 bp, mouse
gcgacgggtcttgcagagac

SEQ ID NO: 629240 - DNA, 20 bp, mouse
gtggagccggaataaagagg

SEQ ID NO: 629241 - DNA, 20 bp, mouse
gcgggtcttgcagagaccgg

SEQ ID NO: 629242 - DNA, 20 bp, mouse
gactcgggttagcgggaccg

SEQ ID NO: 629243 - DNA, 20 bp, mouse
gtgcagagaccggcggacag

SEQ ID NO: 629244 - DNA, 20 bp, mouse
ggttagcgggaccggggcag

SEQ ID NO: 629245 - DNA, 20 bp, mouse
gggatggagccggaataaag

SEQ ID NO: 629246 - DNA, 20 bp, mouse
gcaaccgccggataccaacc

SEQ ID NO: 629247 - DNA, 20 bp, mouse
gggataccaacctggagaag

SEQ ID NO: 629248 - DNA, 20 bp, mouse
gagtgggccgagatgctgag

SEQ ID NO: 629249 - DNA, 20 bp, mouse
gggcttgagggtccagtcac

SEQ ID NO: 629250 - DNA, 20 bp, mouse
gctcacggccaaggacctcg

SEQ ID NO: 629251 - DNA, 20 bp, mouse
ggcggtccccgcacaccaca

SEQ ID NO: 629252 - DNA, 20 bp, mouse
gcttactccgccgcccaggg

SEQ ID NO: 629253 - DNA, 20 bp, mouse
gcggcggagtaagcgttcag

SEQ ID NO: 629254 - DNA, 20 bp, mouse
gctggcccggacccctctca

SEQ ID NO: 629255 - DNA, 20 bp, mouse
gaggtcggcaagccaaccgc

SEQ ID NO: 629256 - DNA, 20 bp, mouse
ggctgcagcggagaccgtta

SEQ ID NO: 629257 - DNA, 20 bp, mouse
gccacacgggtgatcccgat

SEQ ID NO: 629258 - DNA, 20 bp, mouse
ggccgactctgcaaatctcg

SEQ ID NO: 629259 - DNA, 20 bp, mouse
gcatgacgggcgagagacct

SEQ ID NO: 629260 - DNA, 20 bp, mouse
gcccccactgcagattccgg

SEQ ID NO: 629261 - DNA, 20 bp, mouse
gaccttggctcggtacacgt

SEQ ID NO: 629262 - DNA, 20 bp, mouse
gacgcccagaggactcctgg

SEQ ID NO: 629263 - DNA, 20 bp, mouse
gggcttcggcacaaccctaa

SEQ ID NO: 629264 - DNA, 20 bp, mouse
gatcccgattggtgcacgaa

SEQ ID NO: 629265 - DNA, 20 bp, mouse
gccgccgccggaatctgcag

SEQ ID NO: 629266 - DNA, 20 bp, mouse
ggcggcaagagcccgcgata

SEQ ID NO: 629267 - DNA, 20 bp, mouse
gacggcagtgtccacacgac

SEQ ID NO: 629268 - DNA, 20 bp, mouse
gccacacggccatcttgagg

SEQ ID NO: 629269 - DNA, 20 bp, mouse
gaagccacacggccatcttg

SEQ ID NO: 629270 - DNA, 20 bp, mouse
ggtcgcgcgggccggtcgtg

SEQ ID NO: 629271 - DNA, 20 bp, mouse
gccggccgcacccccacgtg

SEQ ID NO: 629272 - DNA, 20 bp, mouse
ggtccgggagccccacgtgg

SEQ ID NO: 629273 - DNA, 20 bp, mouse
ggaggcggtaaacagacccc

SEQ ID NO: 629274 - DNA, 20 bp, mouse
gcggctagtagcgccgctgt

SEQ ID NO: 629275 - DNA, 20 bp, mouse
gtccagagcccggggcgaca

SEQ ID NO: 629276 - DNA, 20 bp, mouse
ggcgcggaaggactcactac

SEQ ID NO: 629277 - DNA, 20 bp, mouse
ggggaagctaaggaacagaa

SEQ ID NO: 629278 - DNA, 20 bp, mouse
gacactcagaggggaagcta

SEQ ID NO: 629279 - DNA, 20 bp, mouse
gactcactacaggatgccgg

SEQ ID NO: 629280 - DNA, 20 bp, mouse
gaaggaacagaaaggcaccg

SEQ ID NO: 629281 - DNA, 20 bp, mouse
gcctcccgcaagacactcag

SEQ ID NO: 629282 - DNA, 20 bp, mouse
gacagaaaggcaccgaggcg

SEQ ID NO: 629283 - DNA, 20 bp, mouse
gggtcggaggggtccctgac

SEQ ID NO: 629284 - DNA, 20 bp, mouse
gaaaggcaccgaggcgcgga

SEQ ID NO: 629285 - DNA, 20 bp, mouse
gaggactcactacaggatgc

SEQ ID NO: 629286 - DNA, 20 bp, mouse
gggcgagccgcgggctagaa

SEQ ID NO: 629287 - DNA, 20 bp, mouse
gccggtctcgctcccaccgt

SEQ ID NO: 629288 - DNA, 20 bp, mouse
ggacgcgccactcaccgcag

SEQ ID NO: 629289 - DNA, 20 bp, mouse
gcgctcccaccgttggaaac

SEQ ID NO: 629290 - DNA, 20 bp, mouse
gagaagcagcccgtttccaa

SEQ ID NO: 629291 - DNA, 20 bp, mouse
gtccgcgtcctcggccactg

SEQ ID NO: 629292 - DNA, 20 bp, mouse
gcggaggagagggcgagccg

SEQ ID NO: 629293 - DNA, 20 bp, mouse
gcttctgccgttctagcccg

SEQ ID NO: 629294 - DNA, 20 bp, mouse
gagcagcccgtttccaacgg

SEQ ID NO: 629295 - DNA, 20 bp, mouse
gtgagtggcgcgtccccgtg

SEQ ID NO: 629296 - DNA, 20 bp, mouse
gcttccaggcgaggctcgag

SEQ ID NO: 629297 - DNA, 20 bp, mouse
gctggaagagccccacgaaa

SEQ ID NO: 629298 - DNA, 20 bp, mouse
gaggcaattgtggcgcacag

SEQ ID NO: 629299 - DNA, 20 bp, mouse
gcgcggtctcctaggctcta

SEQ ID NO: 629300 - DNA, 20 bp, mouse
ggcctccgcgggccccagga

SEQ ID NO: 629301 - DNA, 20 bp, mouse
gcaattgcctggggccttct

SEQ ID NO: 629302 - DNA, 20 bp, mouse
ggagccagaggaattccggg

SEQ ID NO: 629303 - DNA, 20 bp, mouse
gaggcccctcgagcctcgcc

SEQ ID NO: 629304 - DNA, 20 bp, mouse
ggtagctcccagaaggcccc

SEQ ID NO: 629305 - DNA, 20 bp, mouse
gcggaggcctgcagccccgg

SEQ ID NO: 629306 - DNA, 20 bp, mouse
gacctcgtcgatgccggagt

SEQ ID NO: 629307 - DNA, 20 bp, mouse
gagccagaggctcaggttag

SEQ ID NO: 629308 - DNA, 20 bp, mouse
gtgcacggcagtgtgcggag

SEQ ID NO: 629309 - DNA, 20 bp, mouse
gccgtcgcggaggaacccat

SEQ ID NO: 629310 - DNA, 20 bp, mouse
gtccgactccggcatcgacg

SEQ ID NO: 629311 - DNA, 20 bp, mouse
gtgccgctaacctgagcctc

SEQ ID NO: 629312 - DNA, 20 bp, mouse
gcccggtgcacggcagtgtg

SEQ ID NO: 629313 - DNA, 20 bp, mouse
gctgtgtcgctctccgactc

SEQ ID NO: 629314 - DNA, 20 bp, mouse
gcggaggggcagcccgcctc

SEQ ID NO: 629315 - DNA, 20 bp, mouse
gcgcgacgggggtgagagga

SEQ ID NO: 629316 - DNA, 20 bp, mouse
gcgatcttcgaggccctgga

SEQ ID NO: 629317 - DNA, 20 bp, mouse
gcccgctccgactccccggg

SEQ ID NO: 629318 - DNA, 20 bp, mouse
gccgacgcgctcaccctcca

SEQ ID NO: 629319 - DNA, 20 bp, mouse
gagccccgctccgactcccc

SEQ ID NO: 629320 - DNA, 20 bp, mouse
ggctccgactccccgggcgg

SEQ ID NO: 629321 - DNA, 20 bp, mouse
gccagcccggaggccaccgt

SEQ ID NO: 629322 - DNA, 20 bp, mouse
gatggcgcaggcgatcttcg

SEQ ID NO: 629323 - DNA, 20 bp, mouse
gctgccgccgcccggggagt

SEQ ID NO: 629324 - DNA, 20 bp, mouse
gcctgggcctggagagacgg

SEQ ID NO: 629325 - DNA, 20 bp, mouse
gaagatcgcctgcgccatct

SEQ ID NO: 629326 - DNA, 20 bp, mouse
gacagatatggccatgtgtg

SEQ ID NO: 629327 - DNA, 20 bp, mouse
gccacaaaggacctcacaca

SEQ ID NO: 629328 - DNA, 20 bp, mouse
ggcacccagcagaggcactc

SEQ ID NO: 629329 - DNA, 20 bp, mouse
gagagaaactgcggttctca

SEQ ID NO: 629330 - DNA, 20 bp, mouse
gagagaaaatagagaaactg

SEQ ID NO: 629331 - DNA, 20 bp, mouse
gctgaaagaaggtttctctg

SEQ ID NO: 629332 - DNA, 20 bp, mouse
ggattcagacaggaacttac

SEQ ID NO: 629333 - DNA, 20 bp, mouse
gggagagactagaaccacaa

SEQ ID NO: 629334 - DNA, 20 bp, mouse
gttcaggctcagattcagac

SEQ ID NO: 629335 - DNA, 20 bp, mouse
gtgtcctgagtgcctctgct

SEQ ID NO: 629336 - DNA, 20 bp, mouse
gcgcatgcgcagcttcttaa

SEQ ID NO: 629337 - DNA, 20 bp, mouse
ggcgccaggggagtgacagg

SEQ ID NO: 629338 - DNA, 20 bp, mouse
ggcgcgtcttgccggaaaga

SEQ ID NO: 629339 - DNA, 20 bp, mouse
ggtacggtccggcttctcca

SEQ ID NO: 629340 - DNA, 20 bp, mouse
ggagaagccggaccgtacaa

SEQ ID NO: 629341 - DNA, 20 bp, mouse
ggctaccacgagcagtgggt

SEQ ID NO: 629342 - DNA, 20 bp, mouse
gagggaggaaggtgagtcgg

SEQ ID NO: 629343 - DNA, 20 bp, mouse
gccgcagcatccgtagcatc

SEQ ID NO: 629344 - DNA, 20 bp, mouse
gtgtcctgcgcccgatgcta

SEQ ID NO: 629345 - DNA, 20 bp, mouse
ggctcctcggagcccttgta

SEQ ID NO: 629346 - DNA, 20 bp, mouse
gagagtaagggaggcttctt

SEQ ID NO: 629347 - DNA, 20 bp, mouse
gcttcatcgtcggagagtaa

SEQ ID NO: 629348 - DNA, 20 bp, mouse
gcatcgtcggagagtaaggg

SEQ ID NO: 629349 - DNA, 20 bp, mouse
gccggtagtttcttcatcgt

SEQ ID NO: 629350 - DNA, 20 bp, mouse
gaagggaggcttcttgggca

SEQ ID NO: 629351 - DNA, 20 bp, mouse
gcggatgttgaaggaattgt

SEQ ID NO: 629352 - DNA, 20 bp, mouse
gcttcttgggcatggagagc

SEQ ID NO: 629353 - DNA, 20 bp, mouse
gacctcctaggtgatcggta

SEQ ID NO: 629354 - DNA, 20 bp, mouse
ggtgggtggcggcgtttgac

SEQ ID NO: 629355 - DNA, 20 bp, mouse
gtggagagcaggtgggttct

SEQ ID NO: 629356 - DNA, 20 bp, mouse
gagctggctggactccacag

SEQ ID NO: 629357 - DNA, 20 bp, mouse
gggctggactccacagggga

SEQ ID NO: 629358 - DNA, 20 bp, mouse
gggcgctgttgagctgtgta

SEQ ID NO: 629359 - DNA, 20 bp, mouse
ggggaggaaggcatatctga

SEQ ID NO: 629360 - DNA, 20 bp, mouse
ggtgtatggtaaagacctgc

SEQ ID NO: 629361 - DNA, 20 bp, mouse
gtcacacatggctgtatttt

SEQ ID NO: 629362 - DNA, 20 bp, mouse
gaatacacagccttcccctg

SEQ ID NO: 629363 - DNA, 20 bp, mouse
gagaactcaacagcataccc

SEQ ID NO: 629364 - DNA, 20 bp, mouse
ggccatgtgtgagaatcaga

SEQ ID NO: 629365 - DNA, 20 bp, mouse
ggagctcagagatgcttacc

SEQ ID NO: 629366 - DNA, 20 bp, mouse
gtggtgagcgggacatgcat

SEQ ID NO: 629367 - DNA, 20 bp, mouse
ggagcgggacatgcatgggt

SEQ ID NO: 629368 - DNA, 20 bp, mouse
gagctacgacgacctgtctc

SEQ ID NO: 629369 - DNA, 20 bp, mouse
ggacatgcatgggttggtgt

SEQ ID NO: 629370 - DNA, 20 bp, mouse
gatcttcaggtagctactgt

SEQ ID NO: 629371 - DNA, 20 bp, mouse
gagttttgcagtcccgagac

SEQ ID NO: 629372 - DNA, 20 bp, mouse
gagggaaataaatgctaggg

SEQ ID NO: 629373 - DNA, 20 bp, mouse
gtactgaacttttcatcttc

SEQ ID NO: 629374 - DNA, 20 bp, mouse
gaaaagggaaataaatgcta

SEQ ID NO: 629375 - DNA, 20 bp, mouse
gtagctactgttggattatc

SEQ ID NO: 629376 - DNA, 20 bp, mouse
ggacccgcgaaggctcacgg

SEQ ID NO: 629377 - DNA, 20 bp, mouse
ggacgccctaagacccgcga

SEQ ID NO: 629378 - DNA, 20 bp, mouse
ggcgggtcttagggcgtctg

SEQ ID NO: 629379 - DNA, 20 bp, mouse
gtgagccttcgcgggtctta

SEQ ID NO: 629380 - DNA, 20 bp, mouse
gatgttcggacgtcagacag

SEQ ID NO: 629381 - DNA, 20 bp, mouse
gctccgcggccaccaccctc

SEQ ID NO: 629382 - DNA, 20 bp, mouse
ggcgtctgtggcgcggctcg

SEQ ID NO: 629383 - DNA, 20 bp, mouse
gtggcgcggctcgaggctag

SEQ ID NO: 629384 - DNA, 20 bp, mouse
gtcttagggcgtctgtggcg

SEQ ID NO: 629385 - DNA, 20 bp, mouse
ggcggctcagagcatatgtg

SEQ ID NO: 629386 - DNA, 20 bp, mouse
gacgcttggagactcagact

SEQ ID NO: 629387 - DNA, 20 bp, mouse
gcagactggggagctagatc

SEQ ID NO: 629388 - DNA, 20 bp, mouse
gtcgagccacagacacccgg

SEQ ID NO: 629389 - DNA, 20 bp, mouse
ggaatcgagccacagacacc

SEQ ID NO: 629390 - DNA, 20 bp, mouse
ggccaggctggaggacacgg

SEQ ID NO: 629391 - DNA, 20 bp, mouse
gggcctgatagatctcacag

SEQ ID NO: 629392 - DNA, 20 bp, mouse
ggcagctgcgagccttcatg

SEQ ID NO: 629393 - DNA, 20 bp, mouse
gctcccgccacgcctcatga

SEQ ID NO: 629394 - DNA, 20 bp, mouse
ggccagagtgcagccacagt

SEQ ID NO: 629395 - DNA, 20 bp, mouse
gggctcgcagctgccacgct

SEQ ID NO: 629396 - DNA, 20 bp, mouse
gtgctaggagagagcgtctg

SEQ ID NO: 629397 - DNA, 20 bp, mouse
gctgctcgcggcgttttggg

SEQ ID NO: 629398 - DNA, 20 bp, mouse
ggctctctcctagcacagtc

SEQ ID NO: 629399 - DNA, 20 bp, mouse
gaggtgatcctgactgtgct

SEQ ID NO: 629400 - DNA, 20 bp, mouse
gcgggagtagtagttctctg

SEQ ID NO: 629401 - DNA, 20 bp, mouse
gcgagcagtctcgaggatgt

SEQ ID NO: 629402 - DNA, 20 bp, mouse
gcggcctggcgactgctctg

SEQ ID NO: 629403 - DNA, 20 bp, mouse
gtctctggggcttctcccgg

SEQ ID NO: 629404 - DNA, 20 bp, mouse
gcgttttggggggctcctgg

SEQ ID NO: 629405 - DNA, 20 bp, mouse
gcgtggctgggaccaaactg

SEQ ID NO: 629406 - DNA, 20 bp, mouse
ggcctggggcggggagacac

SEQ ID NO: 629407 - DNA, 20 bp, mouse
ggcgggtctggcgatcggtg

SEQ ID NO: 629408 - DNA, 20 bp, mouse
gcgatcgccagacccgctgg

SEQ ID NO: 629409 - DNA, 20 bp, mouse
ggccccgccaggcactcccg

SEQ ID NO: 629410 - DNA, 20 bp, mouse
gcactcccggggagcgagag

SEQ ID NO: 629411 - DNA, 20 bp, mouse
gagggggccgccagcgggtc

SEQ ID NO: 629412 - DNA, 20 bp, mouse
ggtttcctgcaagcctgggg

SEQ ID NO: 629413 - DNA, 20 bp, mouse
ggggaaggctggacaaaagg

SEQ ID NO: 629414 - DNA, 20 bp, mouse
ggtgaatctgagatccggat

SEQ ID NO: 629415 - DNA, 20 bp, mouse
gtccccgggagtgcctggcg

SEQ ID NO: 629416 - DNA, 20 bp, mouse
gtagatggcagagagatcca

SEQ ID NO: 629417 - DNA, 20 bp, mouse
gatggcagagagatccatgg

SEQ ID NO: 629418 - DNA, 20 bp, mouse
gtggtgaagagaccgactgt

SEQ ID NO: 629419 - DNA, 20 bp, mouse
gcaggtactcacctcgtaga

SEQ ID NO: 629420 - DNA, 20 bp, mouse
gacttctgcgaaccgacagt

SEQ ID NO: 629421 - DNA, 20 bp, mouse
gagcgcctcggtccagatac

SEQ ID NO: 629422 - DNA, 20 bp, mouse
gagatccatggtggcgcgaa

SEQ ID NO: 629423 - DNA, 20 bp, mouse
gcactcgcgtagggcggaag

SEQ ID NO: 629424 - DNA, 20 bp, mouse
gaaggccattcgcgccacca

SEQ ID NO: 629425 - DNA, 20 bp, mouse
gctagtctgagaaggtacgg

SEQ ID NO: 629426 - DNA, 20 bp, mouse
gccccggggctccggcgagt

SEQ ID NO: 629427 - DNA, 20 bp, mouse
gtgcgcagccgagaggcggg

SEQ ID NO: 629428 - DNA, 20 bp, mouse
gcgtccggccccccgcctct

SEQ ID NO: 629429 - DNA, 20 bp, mouse
ggggctgcgcagccgagagg

SEQ ID NO: 629430 - DNA, 20 bp, mouse
ggagcccggcggcccgagta

SEQ ID NO: 629431 - DNA, 20 bp, mouse
ggggctcccggcttcggcgg

SEQ ID NO: 629432 - DNA, 20 bp, mouse
gccgggcgctgcccactcgc

SEQ ID NO: 629433 - DNA, 20 bp, mouse
ggctggggctcggtgcggag

SEQ ID NO: 629434 - DNA, 20 bp, mouse
gcagcgcccggcgctggcga

SEQ ID NO: 629435 - DNA, 20 bp, mouse
gagcggcgcgcaaaccttcc

SEQ ID NO: 629436 - DNA, 20 bp, mouse
gcgctagaggggccccgatg

SEQ ID NO: 629437 - DNA, 20 bp, mouse
gaatcctgagctggagtgaa

SEQ ID NO: 629438 - DNA, 20 bp, mouse
gccctgggtccaccccatcg

SEQ ID NO: 629439 - DNA, 20 bp, mouse
gtccctccccgtgatgtcag

SEQ ID NO: 629440 - DNA, 20 bp, mouse
gtcccgcgtgggagccgacc

SEQ ID NO: 629441 - DNA, 20 bp, mouse
gcccctctagcgggagatcc

SEQ ID NO: 629442 - DNA, 20 bp, mouse
gtccgcccagcggaaaccta

SEQ ID NO: 629443 - DNA, 20 bp, mouse
gcagtcaccagcgggagcgg

SEQ ID NO: 629444 - DNA, 20 bp, mouse
ggcccaggatctcccgctag

SEQ ID NO: 629445 - DNA, 20 bp, mouse
gaggattccgctgacatcac

SEQ ID NO: 629446 - DNA, 20 bp, mouse
gccgattgcagggaacttaa

SEQ ID NO: 629447 - DNA, 20 bp, mouse
gggaacttaaaggactcgca

SEQ ID NO: 629448 - DNA, 20 bp, mouse
gctcttgtgtaccgattgca

SEQ ID NO: 629449 - DNA, 20 bp, mouse
gccacagaaaccacctccct

SEQ ID NO: 629450 - DNA, 20 bp, mouse
gagcagtgacccctccagtg

SEQ ID NO: 629451 - DNA, 20 bp, mouse
gagaccaggtaaagcggtgg

SEQ ID NO: 629452 - DNA, 20 bp, mouse
ggtgacttaagaaggagaac

SEQ ID NO: 629453 - DNA, 20 bp, mouse
ggtcacttaccagctcctga

SEQ ID NO: 629454 - DNA, 20 bp, mouse
gagccagagaccaggtaaag

SEQ ID NO: 629455 - DNA, 20 bp, mouse
gcagagaccaggtaaagcgg

SEQ ID NO: 629456 - DNA, 20 bp, mouse
gcaggcggctccgggcgatc

SEQ ID NO: 629457 - DNA, 20 bp, mouse
gtacgcgcttcggggagtcg

SEQ ID NO: 629458 - DNA, 20 bp, mouse
gcgtggcagaagacgaccgg

SEQ ID NO: 629459 - DNA, 20 bp, mouse
gggcagaagacgaccggcgg

SEQ ID NO: 629460 - DNA, 20 bp, mouse
gagcgttgctgacaggaaaa

SEQ ID NO: 629461 - DNA, 20 bp, mouse
gagtcgtggcagaagacgac

SEQ ID NO: 629462 - DNA, 20 bp, mouse
gcgcggcgccccggcaccca

SEQ ID NO: 629463 - DNA, 20 bp, mouse
gccagacagcggccacctca

SEQ ID NO: 629464 - DNA, 20 bp, mouse
gagctagctagtgggagtgt

SEQ ID NO: 629465 - DNA, 20 bp, mouse
gcctcacagccgccggctca

SEQ ID NO: 629466 - DNA, 20 bp, mouse
ggataggagttgtccccgac

SEQ ID NO: 629467 - DNA, 20 bp, mouse
ggaccagcgagccgactcag

SEQ ID NO: 629468 - DNA, 20 bp, mouse
gagccgacactggactccgg

SEQ ID NO: 629469 - DNA, 20 bp, mouse
gcgaagccgacactggactc

SEQ ID NO: 629470 - DNA, 20 bp, mouse
ggtgcttgcgataaacacaa

SEQ ID NO: 629471 - DNA, 20 bp, mouse
gagcctccggagtccagtgt

SEQ ID NO: 629472 - DNA, 20 bp, mouse
gactcaggggctagaccgac

SEQ ID NO: 629473 - DNA, 20 bp, mouse
ggtgggtccggatcctgagg

SEQ ID NO: 629474 - DNA, 20 bp, mouse
ggtcggggagaggactcact

SEQ ID NO: 629475 - DNA, 20 bp, mouse
gcctgcagaggtcggaatat

SEQ ID NO: 629476 - DNA, 20 bp, mouse
gctcctgaccggagagccgg

SEQ ID NO: 629477 - DNA, 20 bp, mouse
gggagagtcagaaaggcgag

SEQ ID NO: 629478 - DNA, 20 bp, mouse
ggccatgcggtcaagaggga

SEQ ID NO: 629479 - DNA, 20 bp, mouse
gtggtgtgtcgtgaaggtcc

SEQ ID NO: 629480 - DNA, 20 bp, mouse
gtgtcgtgaaggtcccggtg

SEQ ID NO: 629481 - DNA, 20 bp, mouse
gggcgcagcctccggctctc

SEQ ID NO: 629482 - DNA, 20 bp, mouse
gcgagggtggtggtcatcgt

SEQ ID NO: 629483 - DNA, 20 bp, mouse
ggaggtgcggaagagtggtt

SEQ ID NO: 629484 - DNA, 20 bp, mouse
ggtaaagcagggcggagcgt

SEQ ID NO: 629485 - DNA, 20 bp, mouse
gtttgcggggcaaggaggtg

SEQ ID NO: 629486 - DNA, 20 bp, mouse
gttgggaggtgccctcggta

SEQ ID NO: 629487 - DNA, 20 bp, mouse
gtgtgcggccgaggaagcgg

SEQ ID NO: 629488 - DNA, 20 bp, mouse
gaggccgtggcgcggagtgg

SEQ ID NO: 629489 - DNA, 20 bp, mouse
gcgccccccgcccgagccgt

SEQ ID NO: 629490 - DNA, 20 bp, mouse
gaacgggcgagggccaagga

SEQ ID NO: 629491 - DNA, 20 bp, mouse
ggcttgtgcggccgaggaag

SEQ ID NO: 629492 - DNA, 20 bp, mouse
gtagaagggtgacagaagtg

SEQ ID NO: 629493 - DNA, 20 bp, mouse
gccagtccgcgagctgccga

SEQ ID NO: 629494 - DNA, 20 bp, mouse
ggagaagcgagagcgcagct

SEQ ID NO: 629495 - DNA, 20 bp, mouse
gcgcgagctgccgacggctc

SEQ ID NO: 629496 - DNA, 20 bp, mouse
ggtgcaagaccgagaaacta

SEQ ID NO: 629497 - DNA, 20 bp, mouse
gggacgagcagtcctcggtg

SEQ ID NO: 629498 - DNA, 20 bp, mouse
gtcaaaacggcgcaggacat

SEQ ID NO: 629499 - DNA, 20 bp, mouse
gggctggaggcactggaact

SEQ ID NO: 629500 - DNA, 20 bp, mouse
gccttacttaaagctcaaaa

SEQ ID NO: 629501 - DNA, 20 bp, mouse
gcacattagtgttgagcggg

SEQ ID NO: 629502 - DNA, 20 bp, mouse
gagtgcctccagcctcaccg

SEQ ID NO: 629503 - DNA, 20 bp, mouse
gccggagaaaccttcgaggg

SEQ ID NO: 629504 - DNA, 20 bp, mouse
ggagccctcagaggctaacg

SEQ ID NO: 629505 - DNA, 20 bp, mouse
gtagcctctgagggctcatg

SEQ ID NO: 629506 - DNA, 20 bp, mouse
gaggtcctcgatggagtcag

SEQ ID NO: 629507 - DNA, 20 bp, mouse
ggaggacctgacaaagccag

SEQ ID NO: 629508 - DNA, 20 bp, mouse
gtcggcctctgactccatcg

SEQ ID NO: 629509 - DNA, 20 bp, mouse
gtctgaagcggtgcccgggg

SEQ ID NO: 629510 - DNA, 20 bp, mouse
ggccagaggcgctggatcgg

SEQ ID NO: 629511 - DNA, 20 bp, mouse
gatggagtcagaggccgata

SEQ ID NO: 629512 - DNA, 20 bp, mouse
gagggtgactggagtcctag

SEQ ID NO: 629513 - DNA, 20 bp, mouse
ggagtcagaggccgatatgg

SEQ ID NO: 629514 - DNA, 20 bp, mouse
gccgatatggcggccacccc

SEQ ID NO: 629515 - DNA, 20 bp, mouse
ggcccccggaccctctgaag

SEQ ID NO: 629516 - DNA, 20 bp, mouse
ggagaggctgaggaccgcag

SEQ ID NO: 629517 - DNA, 20 bp, mouse
gagatccggagcatccactg

SEQ ID NO: 629518 - DNA, 20 bp, mouse
gcggttcgagacgttgggag

SEQ ID NO: 629519 - DNA, 20 bp, mouse
gtggatgctccggatctgga

SEQ ID NO: 629520 - DNA, 20 bp, mouse
ggcgggaccgggacactcaa

SEQ ID NO: 629521 - DNA, 20 bp, mouse
gcggggcggttcgagacgtt

SEQ ID NO: 629522 - DNA, 20 bp, mouse
gctcggtcgccctccagatc

SEQ ID NO: 629523 - DNA, 20 bp, mouse
ggtgagtgcgcaggcgtaga

SEQ ID NO: 629524 - DNA, 20 bp, mouse
gtgactgccggtgacccgaa

SEQ ID NO: 629525 - DNA, 20 bp, mouse
gaatccagatgggaagaccg

SEQ ID NO: 629526 - DNA, 20 bp, mouse
gccacacggaccctcgtcat

SEQ ID NO: 629527 - DNA, 20 bp, mouse
ggctcctgatacccatgacg

SEQ ID NO: 629528 - DNA, 20 bp, mouse
ggaccctcgtcatgggtatc

SEQ ID NO: 629529 - DNA, 20 bp, mouse
gcaaaagaggagctcagaca

SEQ ID NO: 629530 - DNA, 20 bp, mouse
gcttttcgcacatgtctatt

SEQ ID NO: 629531 - DNA, 20 bp, mouse
gaccaggacagcaaccagtg

SEQ ID NO: 629532 - DNA, 20 bp, mouse
gaggcaggtgagccatgtac

SEQ ID NO: 629533 - DNA, 20 bp, mouse
ggacgtctcagaataactcg

SEQ ID NO: 629534 - DNA, 20 bp, mouse
gcaacgccatgtccaaggtg

SEQ ID NO: 629535 - DNA, 20 bp, mouse
ggcagagacagagggacata

SEQ ID NO: 629536 - DNA, 20 bp, mouse
gcgggtgcctgtctagtggg

SEQ ID NO: 629537 - DNA, 20 bp, mouse
gggcgcgcgagacacccgca

SEQ ID NO: 629538 - DNA, 20 bp, mouse
gtccctggaggggtgaagga

SEQ ID NO: 629539 - DNA, 20 bp, mouse
gcggcgcgacactcaccagg

SEQ ID NO: 629540 - DNA, 20 bp, mouse
gcggcgcgcaccgactgcag

SEQ ID NO: 629541 - DNA, 20 bp, mouse
gcgagacacccgcagggcgg

SEQ ID NO: 629542 - DNA, 20 bp, mouse
gaccccgacgctcggccggg

SEQ ID NO: 629543 - DNA, 20 bp, mouse
ggcgcgagacacccgcaggg

SEQ ID NO: 629544 - DNA, 20 bp, mouse
gccgagcgtcggggtccgtc

SEQ ID NO: 629545 - DNA, 20 bp, mouse
ggccgcccggccgagcgtcg

SEQ ID NO: 629546 - DNA, 20 bp, mouse
gcccccgggacagaacgacg

SEQ ID NO: 629547 - DNA, 20 bp, mouse
gctcaccgaggatcatgctg

SEQ ID NO: 629548 - DNA, 20 bp, mouse
gcgcggaaccccgggagcca

SEQ ID NO: 629549 - DNA, 20 bp, mouse
gtcgtggagaccactcaccg

SEQ ID NO: 629550 - DNA, 20 bp, mouse
gcagaacgacgcggaacccc

SEQ ID NO: 629551 - DNA, 20 bp, mouse
gaccgcagctaggggaagag

SEQ ID NO: 629552 - DNA, 20 bp, mouse
gacccagtgagaaggaacca

SEQ ID NO: 629553 - DNA, 20 bp, mouse
gctcctggtaacatagggag

SEQ ID NO: 629554 - DNA, 20 bp, mouse
gtcggactcggggtacaggg

SEQ ID NO: 629555 - DNA, 20 bp, mouse
gctggggaccctggctcccg

SEQ ID NO: 629556 - DNA, 20 bp, mouse
ggcactgagccctggaccgg

SEQ ID NO: 629557 - DNA, 20 bp, mouse
gccggggctttgaagaaaag

SEQ ID NO: 629558 - DNA, 20 bp, mouse
gaacatggcaaccttcctcc

SEQ ID NO: 629559 - DNA, 20 bp, mouse
gccttgctgaactggtcccc

SEQ ID NO: 629560 - DNA, 20 bp, mouse
gcccgaacaccagcacaggt

SEQ ID NO: 629561 - DNA, 20 bp, mouse
gaaaggggttaaagaacgac

SEQ ID NO: 629562 - DNA, 20 bp, mouse
ggttaaagaacgacaggcct

SEQ ID NO: 629563 - DNA, 20 bp, mouse
gtcttcaaagccccggagga

SEQ ID NO: 629564 - DNA, 20 bp, mouse
gagagacaccctacgtgtag

SEQ ID NO: 629565 - DNA, 20 bp, mouse
gaggcccaggtccattatga

SEQ ID NO: 629566 - DNA, 20 bp, mouse
gacaggcgtgaggacctgcg

SEQ ID NO: 629567 - DNA, 20 bp, mouse
gcgctcggcgcgggatgctg

SEQ ID NO: 629568 - DNA, 20 bp, mouse
gccgcgcgggccacggggac

SEQ ID NO: 629569 - DNA, 20 bp, mouse
ggcgcgcagaggtaagcctg

SEQ ID NO: 629570 - DNA, 20 bp, mouse
gctggcctcgcccaggtgag

SEQ ID NO: 629571 - DNA, 20 bp, mouse
gcgagtccgcgcgggccacg

SEQ ID NO: 629572 - DNA, 20 bp, mouse
gggccacggggacaggcgtg

SEQ ID NO: 629573 - DNA, 20 bp, mouse
ggatgtggccggcgcctggg

SEQ ID NO: 629574 - DNA, 20 bp, mouse
gtgcgcgcctggcctcgccc

SEQ ID NO: 629575 - DNA, 20 bp, mouse
ggtcctcacgcctgtccccg

SEQ ID NO: 629576 - DNA, 20 bp, mouse
ggactcagaaatcaggaatc

SEQ ID NO: 629577 - DNA, 20 bp, mouse
gggagggactccagttaggc

SEQ ID NO: 629578 - DNA, 20 bp, mouse
gtagttgggactcagaaatc

SEQ ID NO: 629579 - DNA, 20 bp, mouse
gctaataagagggaaagagt

SEQ ID NO: 629580 - DNA, 20 bp, mouse
gtttctggcaaaggggaaca

SEQ ID NO: 629581 - DNA, 20 bp, mouse
gtgctcgtctccctctagtt

SEQ ID NO: 629582 - DNA, 20 bp, mouse
gagagggagacgagcagagt

SEQ ID NO: 629583 - DNA, 20 bp, mouse
gagtaggtagagtacgggag

SEQ ID NO: 629584 - DNA, 20 bp, mouse
gtcccctttgccagaaaaag

SEQ ID NO: 629585 - DNA, 20 bp, mouse
gctggagtgtctgccctcaa

SEQ ID NO: 629586 - DNA, 20 bp, mouse
ggatttcgtaagggccaccg

SEQ ID NO: 629587 - DNA, 20 bp, mouse
ggtggcccttacgaaatcac

SEQ ID NO: 629588 - DNA, 20 bp, mouse
ggctgcgcggagggttgagt

SEQ ID NO: 629589 - DNA, 20 bp, mouse
gcccgcaggaacctccgcca

SEQ ID NO: 629590 - DNA, 20 bp, mouse
gtggtcggctcggcctaggg

SEQ ID NO: 629591 - DNA, 20 bp, mouse
gccgtacgcgacctttgtgt

SEQ ID NO: 629592 - DNA, 20 bp, mouse
ggggagtctgcgctccgagg

SEQ ID NO: 629593 - DNA, 20 bp, mouse
gagcacccgtgatttcgtaa

SEQ ID NO: 629594 - DNA, 20 bp, mouse
gaaaggtcgcgtacgggatg

SEQ ID NO: 629595 - DNA, 20 bp, mouse
gcagcttttggaagccccgg

SEQ ID NO: 629596 - DNA, 20 bp, mouse
gtgatcggtcagttgagctg

SEQ ID NO: 629597 - DNA, 20 bp, mouse
gcaggccagtcagctgccgg

SEQ ID NO: 629598 - DNA, 20 bp, mouse
gtccgcctccggcagctgac

SEQ ID NO: 629599 - DNA, 20 bp, mouse
gtggcgcccccgtccgcctc

SEQ ID NO: 629600 - DNA, 20 bp, mouse
gacctagggagacagcctgt

SEQ ID NO: 629601 - DNA, 20 bp, mouse
gagctgccggaggcggacgg

SEQ ID NO: 629602 - DNA, 20 bp, mouse
ggctctgcgaggcctatgca

SEQ ID NO: 629603 - DNA, 20 bp, mouse
gtcagccacgtcaagaccta

SEQ ID NO: 629604 - DNA, 20 bp, mouse
gaagtgtccctgcagagtca

SEQ ID NO: 629605 - DNA, 20 bp, mouse
gcctcaggccagtcagctgc

SEQ ID NO: 629606 - DNA, 20 bp, mouse
gtcccgcgcgcagctcacct

SEQ ID NO: 629607 - DNA, 20 bp, mouse
ggcagtgtcccggagaggga

SEQ ID NO: 629608 - DNA, 20 bp, mouse
ggccgagctgtctgggtcag

SEQ ID NO: 629609 - DNA, 20 bp, mouse
gtgcgcgcgggacctcgcat

SEQ ID NO: 629610 - DNA, 20 bp, mouse
ggggaggcggcgcagtgcag

SEQ ID NO: 629611 - DNA, 20 bp, mouse
ggaaaggggccgcaagaagg

SEQ ID NO: 629612 - DNA, 20 bp, mouse
gtgcagggagccgagctgtc

SEQ ID NO: 629613 - DNA, 20 bp, mouse
gcggcgctggcggggtgact

SEQ ID NO: 629614 - DNA, 20 bp, mouse
gctcggcgcgctcccttccc

SEQ ID NO: 629615 - DNA, 20 bp, mouse
gcgcagtgcaggggccgcgc

SEQ ID NO: 629616 - DNA, 20 bp, mouse
gggagccccagctacagcgg

SEQ ID NO: 629617 - DNA, 20 bp, mouse
gggaggagcagcccgagtag

SEQ ID NO: 629618 - DNA, 20 bp, mouse
gctgtagctggggctccgtc

SEQ ID NO: 629619 - DNA, 20 bp, mouse
gagccccgtggagccccctc

SEQ ID NO: 629620 - DNA, 20 bp, mouse
gggacgcaggcgagcggaag

SEQ ID NO: 629621 - DNA, 20 bp, mouse
gcgcagggctccccgccgga

SEQ ID NO: 629622 - DNA, 20 bp, mouse
gcgtaggcgcgtgcccgagg

SEQ ID NO: 629623 - DNA, 20 bp, mouse
gctgccgcagggctccccgc

SEQ ID NO: 629624 - DNA, 20 bp, mouse
gtggctaatgtccgctactc

SEQ ID NO: 629625 - DNA, 20 bp, mouse
gtagctggggctccgtccgg

SEQ ID NO: 629626 - DNA, 20 bp, mouse
gcaaagcgccagctgagggg

SEQ ID NO: 629627 - DNA, 20 bp, mouse
gcgggggcgctgggacgcag

SEQ ID NO: 629628 - DNA, 20 bp, mouse
gcgagcagcctacgccgcac

SEQ ID NO: 629629 - DNA, 20 bp, mouse
gatcagcgcccttaccggag

SEQ ID NO: 629630 - DNA, 20 bp, mouse
ggcggcaatcgggcttccgg

SEQ ID NO: 629631 - DNA, 20 bp, mouse
ggctgcagccggtgcggcgt

SEQ ID NO: 629632 - DNA, 20 bp, mouse
gctctcgcggctgtacagaa

SEQ ID NO: 629633 - DNA, 20 bp, mouse
ggcgactcccgggacaggac

SEQ ID NO: 629634 - DNA, 20 bp, mouse
gctcggcagacggcgagaag

SEQ ID NO: 629635 - DNA, 20 bp, mouse
ggggcgacgccgcgggacca

SEQ ID NO: 629636 - DNA, 20 bp, mouse
gctgcgaggtccggaatccg

SEQ ID NO: 629637 - DNA, 20 bp, mouse
ggacacgggcttctctagga

SEQ ID NO: 629638 - DNA, 20 bp, mouse
gaatccggggtggaggacac

SEQ ID NO: 629639 - DNA, 20 bp, mouse
gggaggacacgggcttctct

SEQ ID NO: 629640 - DNA, 20 bp, mouse
gaagggtggaggctgctcaa

SEQ ID NO: 629641 - DNA, 20 bp, mouse
gaccattcactgagggaccg

SEQ ID NO: 629642 - DNA, 20 bp, mouse
gggtccggaatccggggtgg

SEQ ID NO: 629643 - DNA, 20 bp, mouse
gaggagggcgtgaaaattcc

SEQ ID NO: 629644 - DNA, 20 bp, mouse
gactcctctcgcggcacctg

SEQ ID NO: 629645 - DNA, 20 bp, mouse
gaaacgggcgggagcaaggg

SEQ ID NO: 629646 - DNA, 20 bp, mouse
ggccggaggagtcagtcaga

SEQ ID NO: 629647 - DNA, 20 bp, mouse
ggtcagtcagagggccgagc

SEQ ID NO: 629648 - DNA, 20 bp, mouse
gagggaagacggtgagccgg

SEQ ID NO: 629649 - DNA, 20 bp, mouse
gcccgcctcttcctcccaga

SEQ ID NO: 629650 - DNA, 20 bp, mouse
gggctcaccgtcttccctct

SEQ ID NO: 629651 - DNA, 20 bp, mouse
gtcaccgtcttccctctggg

SEQ ID NO: 629652 - DNA, 20 bp, mouse
ggtgcgcagccgacaggcga

SEQ ID NO: 629653 - DNA, 20 bp, mouse
gcggaagtggctcgacggag

SEQ ID NO: 629654 - DNA, 20 bp, mouse
gcgggacgtgcgcagccgac

SEQ ID NO: 629655 - DNA, 20 bp, mouse
gaaacaggtgagttattctc

SEQ ID NO: 629656 - DNA, 20 bp, mouse
gtgtcccacgatgaaggagg

SEQ ID NO: 629657 - DNA, 20 bp, mouse
gcccacgatgaaggaggtgg

SEQ ID NO: 629658 - DNA, 20 bp, mouse
gctctgtcccacgatgaagg

SEQ ID NO: 629659 - DNA, 20 bp, mouse
gtcgcaggtcactcacggtg

SEQ ID NO: 629660 - DNA, 20 bp, mouse
gcacttccggtagaggggag

SEQ ID NO: 629661 - DNA, 20 bp, mouse
ggctgtggccatctagtcca

SEQ ID NO: 629662 - DNA, 20 bp, mouse
gggtggaggaggtgatcttg

SEQ ID NO: 629663 - DNA, 20 bp, mouse
gtgagggtcgcagacatcgc

SEQ ID NO: 629664 - DNA, 20 bp, mouse
gagcaaggttctagttagta

SEQ ID NO: 629665 - DNA, 20 bp, mouse
gagttagtagggcccttgaa

SEQ ID NO: 629666 - DNA, 20 bp, mouse
ggggagtggcgggctcaagt

SEQ ID NO: 629667 - DNA, 20 bp, mouse
gccgtaagcaggctgaccgg

SEQ ID NO: 629668 - DNA, 20 bp, mouse
gtggccgtaagcaggctgac

SEQ ID NO: 629669 - DNA, 20 bp, mouse
gaggtagagcggcaccagag

SEQ ID NO: 629670 - DNA, 20 bp, mouse
gtagagcggcaccagagggg

SEQ ID NO: 629671 - DNA, 20 bp, mouse
gctcaagtgggcattgttaa

SEQ ID NO: 629672 - DNA, 20 bp, mouse
gcctttaggcgcgggagtgg

SEQ ID NO: 629673 - DNA, 20 bp, mouse
gtgccgagcacagacgccgg

SEQ ID NO: 629674 - DNA, 20 bp, mouse
ggtgttgcagaggtccttgg

SEQ ID NO: 629675 - DNA, 20 bp, mouse
gtgctggagccggcaggata

SEQ ID NO: 629676 - DNA, 20 bp, mouse
gacggctgcccgagactgga

SEQ ID NO: 629677 - DNA, 20 bp, mouse
gcgtgtgtggacgggattcg

SEQ ID NO: 629678 - DNA, 20 bp, mouse
gggaccacctacccgagcgg

SEQ ID NO: 629679 - DNA, 20 bp, mouse
gttcggggctgactgacgga

SEQ ID NO: 629680 - DNA, 20 bp, mouse
gacggacggctgcccgagac

SEQ ID NO: 629681 - DNA, 20 bp, mouse
gtagccacccccgctcgggt

SEQ ID NO: 629682 - DNA, 20 bp, mouse
gggcccgcccgcagacctaa

SEQ ID NO: 629683 - DNA, 20 bp, mouse
ggcgggaccacctacccgag

SEQ ID NO: 629684 - DNA, 20 bp, mouse
gcagccgccgggcttcggac

SEQ ID NO: 629685 - DNA, 20 bp, mouse
gagccggaagacgccgtgtg

SEQ ID NO: 629686 - DNA, 20 bp, mouse
gccgaaggcacgggaaccag

SEQ ID NO: 629687 - DNA, 20 bp, mouse
gcacggtctctcgctcacat

SEQ ID NO: 629688 - DNA, 20 bp, mouse
gaatgctggagggcctacag

SEQ ID NO: 629689 - DNA, 20 bp, mouse
gggcgtcttcctcggcgaca

SEQ ID NO: 629690 - DNA, 20 bp, mouse
ggaggtggcatctccagatg

SEQ ID NO: 629691 - DNA, 20 bp, mouse
gagcaagatacgggagataa

SEQ ID NO: 629692 - DNA, 20 bp, mouse
ggatctgagaagcgggaaaa

SEQ ID NO: 629693 - DNA, 20 bp, mouse
gaagagcagcgggactgaca

SEQ ID NO: 629694 - DNA, 20 bp, mouse
ggcgagagaccgtgtcgccg

SEQ ID NO: 629695 - DNA, 20 bp, mouse
gcccgtgccttcggaggctc

SEQ ID NO: 629696 - DNA, 20 bp, mouse
gagagggagcgcctagtatg

SEQ ID NO: 629697 - DNA, 20 bp, mouse
gtccatgggttggtatttgg

SEQ ID NO: 629698 - DNA, 20 bp, mouse
gctttggtttaactgtccat

SEQ ID NO: 629699 - DNA, 20 bp, mouse
gaaggtcgacagacattggg

SEQ ID NO: 629700 - DNA, 20 bp, mouse
gggctctgtagagtacgcag

SEQ ID NO: 629701 - DNA, 20 bp, mouse
gctaggactcaaagtatcta

SEQ ID NO: 629702 - DNA, 20 bp, mouse
gggtttaactgtccatgggt

SEQ ID NO: 629703 - DNA, 20 bp, mouse
gactcaaagtatctagggag

SEQ ID NO: 629704 - DNA, 20 bp, mouse
gctgtccatgggttggtatt

SEQ ID NO: 629705 - DNA, 20 bp, mouse
gtaaaggtacgagagcgaac

SEQ ID NO: 629706 - DNA, 20 bp, mouse
gcgtccatctaaaaagggag

SEQ ID NO: 629707 - DNA, 20 bp, mouse
gctaaaaagggaggggtcca

SEQ ID NO: 629708 - DNA, 20 bp, mouse
ggagttcgtccatctaaaaa

SEQ ID NO: 629709 - DNA, 20 bp, mouse
gagtggaaatctaggcggct

SEQ ID NO: 629710 - DNA, 20 bp, mouse
gtctcgttatgaggaaaggg

SEQ ID NO: 629711 - DNA, 20 bp, mouse
gtctgttccggccacactta

SEQ ID NO: 629712 - DNA, 20 bp, mouse
gagatggacgaactctgttc

SEQ ID NO: 629713 - DNA, 20 bp, mouse
gaactaactccgagctgggt

SEQ ID NO: 629714 - DNA, 20 bp, mouse
gcgttatgaggaaagggagg

SEQ ID NO: 629715 - DNA, 20 bp, mouse
gaggaaaccaaggaggaaat

SEQ ID NO: 629716 - DNA, 20 bp, mouse
gtagagcaggctgcctgtag

SEQ ID NO: 629717 - DNA, 20 bp, mouse
gtggagcccggcgcaggagg

SEQ ID NO: 629718 - DNA, 20 bp, mouse
gtcacctccgagggaagctc

SEQ ID NO: 629719 - DNA, 20 bp, mouse
gtagtggagcccggcgcagg

SEQ ID NO: 629720 - DNA, 20 bp, mouse
gctgtagtggagcccggcgc

SEQ ID NO: 629721 - DNA, 20 bp, mouse
gcctgctctatgggatgctt

SEQ ID NO: 629722 - DNA, 20 bp, mouse
gtcagcacgctcacctccga

SEQ ID NO: 629723 - DNA, 20 bp, mouse
ggtcacgagagggttgtgtc

SEQ ID NO: 629724 - DNA, 20 bp, mouse
ggggtacttgcgtcacgaga

SEQ ID NO: 629725 - DNA, 20 bp, mouse
ggaccctgagcttccctcgg

SEQ ID NO: 629726 - DNA, 20 bp, mouse
gctcaccgcgcaggccgcca

SEQ ID NO: 629727 - DNA, 20 bp, mouse
ggcccgacccgacccaacac

SEQ ID NO: 629728 - DNA, 20 bp, mouse
gtagcagcccgcacttccgg

SEQ ID NO: 629729 - DNA, 20 bp, mouse
gggcctgcgcggtgagtacg

SEQ ID NO: 629730 - DNA, 20 bp, mouse
gcccgacccaacaccggccc

SEQ ID NO: 629731 - DNA, 20 bp, mouse
gggcaccgtggcggcctgcg

SEQ ID NO: 629732 - DNA, 20 bp, mouse
gtgatcgaggtccccagtag

SEQ ID NO: 629733 - DNA, 20 bp, mouse
gccggcccaggcagacccgc

SEQ ID NO: 629734 - DNA, 20 bp, mouse
ggcgacttggagggaagcgg

SEQ ID NO: 629735 - DNA, 20 bp, mouse
gcggccgctctaggaagagg

SEQ ID NO: 629736 - DNA, 20 bp, mouse
gcgggggctccgggtcccag

SEQ ID NO: 629737 - DNA, 20 bp, mouse
gcccagcggcgcggggagtc

SEQ ID NO: 629738 - DNA, 20 bp, mouse
gtgggaccgccgctgggacc

SEQ ID NO: 629739 - DNA, 20 bp, mouse
gggtcggcggccgtaaggaa

SEQ ID NO: 629740 - DNA, 20 bp, mouse
gggagaagggctgcccggag

SEQ ID NO: 629741 - DNA, 20 bp, mouse
gggaggctgcccgggacctg

SEQ ID NO: 629742 - DNA, 20 bp, mouse
gggctcggccgagtggcctc

SEQ ID NO: 629743 - DNA, 20 bp, mouse
gagcggcggtcccagcggcg

SEQ ID NO: 629744 - DNA, 20 bp, mouse
gggggagtccggaggccact

SEQ ID NO: 629745 - DNA, 20 bp, mouse
gagggctgtcccctacaggg

SEQ ID NO: 629746 - DNA, 20 bp, mouse
gcggtacaaggactacctgg

SEQ ID NO: 629747 - DNA, 20 bp, mouse
ggataagagccggaagagac

SEQ ID NO: 629748 - DNA, 20 bp, mouse
ggactacctggaggcggagg

SEQ ID NO: 629749 - DNA, 20 bp, mouse
gctggcattcgtgagttctg

SEQ ID NO: 629750 - DNA, 20 bp, mouse
gtacaaggactacctggagg

SEQ ID NO: 629751 - DNA, 20 bp, mouse
gctgcggtacaaggactacc

SEQ ID NO: 629752 - DNA, 20 bp, mouse
ggaagagttgcggagttgcc

SEQ ID NO: 629753 - DNA, 20 bp, mouse
gtcgtgagttctgcggtaca

SEQ ID NO: 629754 - DNA, 20 bp, mouse
gcagagggcgggcctggcga

SEQ ID NO: 629755 - DNA, 20 bp, mouse
gtggggaagtgcccagaggg

SEQ ID NO: 629756 - DNA, 20 bp, mouse
gcccggatcaggctcggcgg

SEQ ID NO: 629757 - DNA, 20 bp, mouse
gggatcaggctcggcggtgg

SEQ ID NO: 629758 - DNA, 20 bp, mouse
gacgccggcggccccggatc

SEQ ID NO: 629759 - DNA, 20 bp, mouse
gggccccggatcaggctcgg

SEQ ID NO: 629760 - DNA, 20 bp, mouse
gaaacgcaggcgcagtgccc

SEQ ID NO: 629761 - DNA, 20 bp, mouse
gcggtggcggctgcacgccc

SEQ ID NO: 629762 - DNA, 20 bp, mouse
gactgcgcctgcgtttcggg

SEQ ID NO: 629763 - DNA, 20 bp, mouse
gttcgggaggctaggcgagc

SEQ ID NO: 629764 - DNA, 20 bp, mouse
gcgcgtgctggggaaagcaa

SEQ ID NO: 629765 - DNA, 20 bp, mouse
gagtctagcggggccgtgag

SEQ ID NO: 629766 - DNA, 20 bp, mouse
ggagcgcttctgggctgggt

SEQ ID NO: 629767 - DNA, 20 bp, mouse
gtggggtgggtgccagagca

SEQ ID NO: 629768 - DNA, 20 bp, mouse
gtcttggagggagcgcttct

SEQ ID NO: 629769 - DNA, 20 bp, mouse
gcaaggaagcagcatagact

SEQ ID NO: 629770 - DNA, 20 bp, mouse
gtgcggggtctgtgtcaggg

SEQ ID NO: 629771 - DNA, 20 bp, mouse
ggggtctgtgtcagggaggt

SEQ ID NO: 629772 - DNA, 20 bp, mouse
gcagtcagcagcgttgcttg

SEQ ID NO: 629773 - DNA, 20 bp, mouse
gtgtcagggaggttggttca

SEQ ID NO: 629774 - DNA, 20 bp, mouse
gtctgtgcggggtctgtgtc

SEQ ID NO: 629775 - DNA, 20 bp, mouse
gttgcttggggctctgtgcg

SEQ ID NO: 629776 - DNA, 20 bp, mouse
gaattttaagtcagaatctt

SEQ ID NO: 629777 - DNA, 20 bp, mouse
gaatttgtaacctaaaatac

SEQ ID NO: 629778 - DNA, 20 bp, mouse
gaagttatagaagacataga

SEQ ID NO: 629779 - DNA, 20 bp, mouse
gacaagcgtttcttggtcat

SEQ ID NO: 629780 - DNA, 20 bp, mouse
gatagtattcttcaacattg

SEQ ID NO: 629781 - DNA, 20 bp, mouse
ggcttttctttaaaacttaa

SEQ ID NO: 629782 - DNA, 20 bp, mouse
gcaagggaacaagcgtttct

SEQ ID NO: 629783 - DNA, 20 bp, mouse
gtgtggtgaataatcagaca

SEQ ID NO: 629784 - DNA, 20 bp, mouse
gtacacgtgtgggctatttt

SEQ ID NO: 629785 - DNA, 20 bp, mouse
ggaacttctctcatgaagag

SEQ ID NO: 629786 - DNA, 20 bp, mouse
gaggccccgcgagccctgca

SEQ ID NO: 629787 - DNA, 20 bp, mouse
ggcgagagcgagcagaacgt

SEQ ID NO: 629788 - DNA, 20 bp, mouse
gcacggcggggtgacgtcat

SEQ ID NO: 629789 - DNA, 20 bp, mouse
ggccgtgacgcgtacgcagt

SEQ ID NO: 629790 - DNA, 20 bp, mouse
gtcctactgcgtacgcgtca

SEQ ID NO: 629791 - DNA, 20 bp, mouse
gaggccagagggaaaggtgt

SEQ ID NO: 629792 - DNA, 20 bp, mouse
ggctggtagtcgccccaggt

SEQ ID NO: 629793 - DNA, 20 bp, mouse
gttctccgccggggtcatag

SEQ ID NO: 629794 - DNA, 20 bp, mouse
gaaaggtgtgggccaggcta

SEQ ID NO: 629795 - DNA, 20 bp, mouse
gagacagcgcaaaggaccat

SEQ ID NO: 629796 - DNA, 20 bp, mouse
gcttttccgggagctttcct

SEQ ID NO: 629797 - DNA, 20 bp, mouse
gaagctcccaggaaagctcc

SEQ ID NO: 629798 - DNA, 20 bp, mouse
gtagtttctctgatatcttc

SEQ ID NO: 629799 - DNA, 20 bp, mouse
gaccttgcaggaaagctccc

SEQ ID NO: 629800 - DNA, 20 bp, mouse
gacagaagcagcaacttgtg

SEQ ID NO: 629801 - DNA, 20 bp, mouse
gtatcacggagccccaggga

SEQ ID NO: 629802 - DNA, 20 bp, mouse
gtggagtcgtgggccgtccc

SEQ ID NO: 629803 - DNA, 20 bp, mouse
gtcagagaggaggaccttgc

SEQ ID NO: 629804 - DNA, 20 bp, mouse
gtacgcggtcctgtaatcgg

SEQ ID NO: 629805 - DNA, 20 bp, mouse
gcagagggaactggagtcgt

SEQ ID NO: 629806 - DNA, 20 bp, mouse
gtagctcacctcactctcct

SEQ ID NO: 629807 - DNA, 20 bp, mouse
ggagagtgaggtgagctaga

SEQ ID NO: 629808 - DNA, 20 bp, mouse
gcgggaaggggtctatccag

SEQ ID NO: 629809 - DNA, 20 bp, mouse
gtttgtgcgcatgtgcggga

SEQ ID NO: 629810 - DNA, 20 bp, mouse
gggaaggtgaggttgtttgg

SEQ ID NO: 629811 - DNA, 20 bp, mouse
gtgtttggggggcctcgccc

SEQ ID NO: 629812 - DNA, 20 bp, mouse
gcacctcactctcctgggcg

SEQ ID NO: 629813 - DNA, 20 bp, mouse
gacctgggtacccctccccg

SEQ ID NO: 629814 - DNA, 20 bp, mouse
ggcagacgcgggagagttgg

SEQ ID NO: 629815 - DNA, 20 bp, mouse
gggtacccaggtctggagga

SEQ ID NO: 629816 - DNA, 20 bp, mouse
gtgagtgctccggcgtgagt

SEQ ID NO: 629817 - DNA, 20 bp, mouse
gtccggcgtgagtcggtgag

SEQ ID NO: 629818 - DNA, 20 bp, mouse
gagaggcccgcggaggaagt

SEQ ID NO: 629819 - DNA, 20 bp, mouse
ggccgctcaccgactcacgc

SEQ ID NO: 629820 - DNA, 20 bp, mouse
gggaagaatgctgagtgctc

SEQ ID NO: 629821 - DNA, 20 bp, mouse
gctcgcagagaggcccgcgg

SEQ ID NO: 629822 - DNA, 20 bp, mouse
gggtgagcggctgggaggtc

SEQ ID NO: 629823 - DNA, 20 bp, mouse
ggagtcggtgagcggctggg

SEQ ID NO: 629824 - DNA, 20 bp, mouse
gcgcggaggaagtgggccct

SEQ ID NO: 629825 - DNA, 20 bp, mouse
gggtcgggtgcaggagcggg

SEQ ID NO: 629826 - DNA, 20 bp, mouse
ggcagccgtaggactcacgt

SEQ ID NO: 629827 - DNA, 20 bp, mouse
gccgtcctacgtgagtccta

SEQ ID NO: 629828 - DNA, 20 bp, mouse
ggtaggacggagccgactgt

SEQ ID NO: 629829 - DNA, 20 bp, mouse
gcggctgccaagtcaggagt

SEQ ID NO: 629830 - DNA, 20 bp, mouse
gaaggaggctaacccacagt

SEQ ID NO: 629831 - DNA, 20 bp, mouse
gctcttgcaaccgcagccgt

SEQ ID NO: 629832 - DNA, 20 bp, mouse
gttgctgcagagttccgggg

SEQ ID NO: 629833 - DNA, 20 bp, mouse
gcaggagtgggaaccccccc

SEQ ID NO: 629834 - DNA, 20 bp, mouse
gaggtgctctcggtgatccg

SEQ ID NO: 629835 - DNA, 20 bp, mouse
gaggcggggcgttctctgag

SEQ ID NO: 629836 - DNA, 20 bp, mouse
ggaggcggtgagtcccggag

SEQ ID NO: 629837 - DNA, 20 bp, mouse
ggcgcagaggcggtgagtcc

SEQ ID NO: 629838 - DNA, 20 bp, mouse
ggtgagcttgggagagccgt

SEQ ID NO: 629839 - DNA, 20 bp, mouse
gggcagttgccggtgagctt

SEQ ID NO: 629840 - DNA, 20 bp, mouse
gccggagcggacagagggcg

SEQ ID NO: 629841 - DNA, 20 bp, mouse
gccttgctgggagtccacga

SEQ ID NO: 629842 - DNA, 20 bp, mouse
gcctgtgagggtggattcag

SEQ ID NO: 629843 - DNA, 20 bp, mouse
gcagggagtgcccatctggg

SEQ ID NO: 629844 - DNA, 20 bp, mouse
ggctcaccggcaactgccca

SEQ ID NO: 629845 - DNA, 20 bp, mouse
gagagggcgtggctgtccct

SEQ ID NO: 629846 - DNA, 20 bp, mouse
gaagcggcgctggaagctag

SEQ ID NO: 629847 - DNA, 20 bp, mouse
gccgggcgagagggaagtcg

SEQ ID NO: 629848 - DNA, 20 bp, mouse
ggcggcgtcgggaacagcag

SEQ ID NO: 629849 - DNA, 20 bp, mouse
gacccagggccggaggtgag

SEQ ID NO: 629850 - DNA, 20 bp, mouse
gctggaagctagcggcagtg

SEQ ID NO: 629851 - DNA, 20 bp, mouse
gaggcggggagcgtacaaag

SEQ ID NO: 629852 - DNA, 20 bp, mouse
ggcgtcgggaacagcagcgg

SEQ ID NO: 629853 - DNA, 20 bp, mouse
gtgaggccgcgcttggggtc

SEQ ID NO: 629854 - DNA, 20 bp, mouse
gcggcagcttggcgtccccg

SEQ ID NO: 629855 - DNA, 20 bp, mouse
gcctgaggcgtcagctgcgt

SEQ ID NO: 629856 - DNA, 20 bp, mouse
ggacactgcagatcaccgtg

SEQ ID NO: 629857 - DNA, 20 bp, mouse
ggcagtggacaagcttctaa

SEQ ID NO: 629858 - DNA, 20 bp, mouse
gtagcctcgacagagtagtc

SEQ ID NO: 629859 - DNA, 20 bp, mouse
gtgtcctgactactctgtcg

SEQ ID NO: 629860 - DNA, 20 bp, mouse
ggcttctaagggaagcccca

SEQ ID NO: 629861 - DNA, 20 bp, mouse
ggggtacgtagactaagggt

SEQ ID NO: 629862 - DNA, 20 bp, mouse
gcagagggtacgtagactaa

SEQ ID NO: 629863 - DNA, 20 bp, mouse
gcggctccgcgtcaagcagc

SEQ ID NO: 629864 - DNA, 20 bp, mouse
gtggagcctgctgcttgacg

SEQ ID NO: 629865 - DNA, 20 bp, mouse
gctgcagcagagagatttgt

SEQ ID NO: 629866 - DNA, 20 bp, mouse
ggactctcgcaaaaactttg

SEQ ID NO: 629867 - DNA, 20 bp, mouse
ggagcggacctgggcttgga

SEQ ID NO: 629868 - DNA, 20 bp, mouse
gaggaacagactggtagcag

SEQ ID NO: 629869 - DNA, 20 bp, mouse
ggtggggactgagcggacct

SEQ ID NO: 629870 - DNA, 20 bp, mouse
gtacaaaacgaaagctaaag

SEQ ID NO: 629871 - DNA, 20 bp, mouse
gctatgtccaagacaccctg

SEQ ID NO: 629872 - DNA, 20 bp, mouse
gcagttctggaccaggaatg

SEQ ID NO: 629873 - DNA, 20 bp, mouse
gatcgggctgggaaaaggcg

SEQ ID NO: 629874 - DNA, 20 bp, mouse
gaagcaactgtgccatcacg

SEQ ID NO: 629875 - DNA, 20 bp, mouse
gctgaggtgagggttttcat

SEQ ID NO: 629876 - DNA, 20 bp, mouse
ggttgggcggaaatgatatt

SEQ ID NO: 629877 - DNA, 20 bp, mouse
gagcagggttctgtcttaga

SEQ ID NO: 629878 - DNA, 20 bp, mouse
ggagcgtttgtgggctaggt

SEQ ID NO: 629879 - DNA, 20 bp, mouse
gtcttagagggagcgtttgt

SEQ ID NO: 629880 - DNA, 20 bp, mouse
gcgtttgtgggctaggtggg

SEQ ID NO: 629881 - DNA, 20 bp, mouse
gcagaagggtatttcctaga

SEQ ID NO: 629882 - DNA, 20 bp, mouse
gttcaggaagaagtgtagac

SEQ ID NO: 629883 - DNA, 20 bp, mouse
gtggctgccccactctgacc

SEQ ID NO: 629884 - DNA, 20 bp, mouse
gctggggctctgtgtcaacg

SEQ ID NO: 629885 - DNA, 20 bp, mouse
gggcagcatccaggtcagag

SEQ ID NO: 629886 - DNA, 20 bp, mouse
gaggtcagcacagcacctca

SEQ ID NO: 629887 - DNA, 20 bp, mouse
gttccctgcaccaacctcca

SEQ ID NO: 629888 - DNA, 20 bp, mouse
gctgtctcacaagcccaagt

SEQ ID NO: 629889 - DNA, 20 bp, mouse
ggcacagagagtgccaactt

SEQ ID NO: 629890 - DNA, 20 bp, mouse
gacaggagaacccgtcagct

SEQ ID NO: 629891 - DNA, 20 bp, mouse
gcaggaagctgctgaccttg

SEQ ID NO: 629892 - DNA, 20 bp, mouse
gtgatgacgtcacaggcgat

SEQ ID NO: 629893 - DNA, 20 bp, mouse
gccaaaggtcctagtgtcta

SEQ ID NO: 629894 - DNA, 20 bp, mouse
gtctaggacataaagtatat

SEQ ID NO: 629895 - DNA, 20 bp, mouse
gagaatctgacaaccaccac

SEQ ID NO: 629896 - DNA, 20 bp, mouse
gcccgggaacaagattgaag

SEQ ID NO: 629897 - DNA, 20 bp, mouse
gcgaggtttaagaacgaacc

SEQ ID NO: 629898 - DNA, 20 bp, mouse
gctgtcagtattgaacttcc

SEQ ID NO: 629899 - DNA, 20 bp, mouse
gtaactttgggggagaagcg

SEQ ID NO: 629900 - DNA, 20 bp, mouse
gcaatactgacagccccttc

SEQ ID NO: 629901 - DNA, 20 bp, mouse
gatcttgttcccgggggcag

SEQ ID NO: 629902 - DNA, 20 bp, mouse
gctggtgatgtcataattgt

SEQ ID NO: 629903 - DNA, 20 bp, mouse
gcagggtggcgggtcgggcg

SEQ ID NO: 629904 - DNA, 20 bp, mouse
gatgttagttcctattccct

SEQ ID NO: 629905 - DNA, 20 bp, mouse
ggacagtcccctaactttgg

SEQ ID NO: 629906 - DNA, 20 bp, mouse
gatcttcccgaaagttggac

SEQ ID NO: 629907 - DNA, 20 bp, mouse
gcagcagccaggtgagaatg

SEQ ID NO: 629908 - DNA, 20 bp, mouse
ggtgcagcccgagtctacac

SEQ ID NO: 629909 - DNA, 20 bp, mouse
ggaacgggctgggacaggtg

SEQ ID NO: 629910 - DNA, 20 bp, mouse
gcctgctccggtgtagactc

SEQ ID NO: 629911 - DNA, 20 bp, mouse
gcaggtgaggttgcagggca

SEQ ID NO: 629912 - DNA, 20 bp, mouse
gtgttgaccaaaagccgggt

SEQ ID NO: 629913 - DNA, 20 bp, mouse
gcgtcaatcttcccgaaagt

SEQ ID NO: 629914 - DNA, 20 bp, mouse
gtgacttagaggttggtcgg

SEQ ID NO: 629915 - DNA, 20 bp, mouse
ggcgctgaacgggctgggac

SEQ ID NO: 629916 - DNA, 20 bp, mouse
gggatgaaggaattagacaa

SEQ ID NO: 629917 - DNA, 20 bp, mouse
gattagacaatggaaggcga

SEQ ID NO: 629918 - DNA, 20 bp, mouse
ggaaggaattagacaatgga

SEQ ID NO: 629919 - DNA, 20 bp, mouse
gcttgctgtagccttggaga

SEQ ID NO: 629920 - DNA, 20 bp, mouse
ggagccagcgaccacagacc

SEQ ID NO: 629921 - DNA, 20 bp, mouse
gctttccctagcggggatga

SEQ ID NO: 629922 - DNA, 20 bp, mouse
gccagcgaccacagaccagg

SEQ ID NO: 629923 - DNA, 20 bp, mouse
gagattaggacagaacggac

SEQ ID NO: 629924 - DNA, 20 bp, mouse
ggagactgttctatagctcc

SEQ ID NO: 629925 - DNA, 20 bp, mouse
gaattccttcatccccgcta

SEQ ID NO: 629926 - DNA, 20 bp, mouse
gtcaggccgatgcaattcaa

SEQ ID NO: 629927 - DNA, 20 bp, mouse
gcccggagatggcagagcag

SEQ ID NO: 629928 - DNA, 20 bp, mouse
gcagagcagaggcgttctat

SEQ ID NO: 629929 - DNA, 20 bp, mouse
gggccgatgcaattcaaggg

SEQ ID NO: 629930 - DNA, 20 bp, mouse
gaaaggtcccagcccggaga

SEQ ID NO: 629931 - DNA, 20 bp, mouse
gtccagccctagggagtagt

SEQ ID NO: 629932 - DNA, 20 bp, mouse
gccctgcccactactcccta

SEQ ID NO: 629933 - DNA, 20 bp, mouse
ggggtgccccctaggctggg

SEQ ID NO: 629934 - DNA, 20 bp, mouse
gggtaggagagggcaggcac

SEQ ID NO: 629935 - DNA, 20 bp, mouse
gtctggtcgcagggtatgag

SEQ ID NO: 629936 - DNA, 20 bp, mouse
ggagtctgaggagccgagga

SEQ ID NO: 629937 - DNA, 20 bp, mouse
gcagcgagtctgaggagccg

SEQ ID NO: 629938 - DNA, 20 bp, mouse
gtgccgggtctcagcaatgg

SEQ ID NO: 629939 - DNA, 20 bp, mouse
gtgcagctgcagcgagtctg

SEQ ID NO: 629940 - DNA, 20 bp, mouse
gagcactcagaccaccccag

SEQ ID NO: 629941 - DNA, 20 bp, mouse
gactcagaccaccccagagg

SEQ ID NO: 629942 - DNA, 20 bp, mouse
gatcctccattgctgagacc

SEQ ID NO: 629943 - DNA, 20 bp, mouse
gggagagagacggatatctc

SEQ ID NO: 629944 - DNA, 20 bp, mouse
gtggtctgagtgctccgggg

SEQ ID NO: 629945 - DNA, 20 bp, mouse
ggggtggtctgagtgctccg

SEQ ID NO: 629946 - DNA, 20 bp, mouse
gtccggagctctctcaatgt

SEQ ID NO: 629947 - DNA, 20 bp, mouse
gacgccacgggctaccaccc

SEQ ID NO: 629948 - DNA, 20 bp, mouse
gggcggagcaaggtcccctg

SEQ ID NO: 629949 - DNA, 20 bp, mouse
gcccaggcgcggagacgcag

SEQ ID NO: 629950 - DNA, 20 bp, mouse
gtggccagggtggtagcccg

SEQ ID NO: 629951 - DNA, 20 bp, mouse
gcggcacggcgcgacgccac

SEQ ID NO: 629952 - DNA, 20 bp, mouse
gtctcaatgtcggtcgctcg

SEQ ID NO: 629953 - DNA, 20 bp, mouse
gagcggcaaggaaggagcgg

SEQ ID NO: 629954 - DNA, 20 bp, mouse
gctcttctcctgggacgaga

SEQ ID NO: 629955 - DNA, 20 bp, mouse
gaccgacattgagagagctc

SEQ ID NO: 629956 - DNA, 20 bp, mouse
ggagtgtggagatggaaagt

SEQ ID NO: 629957 - DNA, 20 bp, mouse
gaagtgggagcttaggaccg

SEQ ID NO: 629958 - DNA, 20 bp, mouse
gaagcgggaacactgctccg

SEQ ID NO: 629959 - DNA, 20 bp, mouse
gagcgttgcgggtgatcggg

SEQ ID NO: 629960 - DNA, 20 bp, mouse
gtgatcggggggaggaaccc

SEQ ID NO: 629961 - DNA, 20 bp, mouse
gaggcccggtgggagcaggt

SEQ ID NO: 629962 - DNA, 20 bp, mouse
gaagggcactcgggctagaa

SEQ ID NO: 629963 - DNA, 20 bp, mouse
ggggagcttaggaccgagga

SEQ ID NO: 629964 - DNA, 20 bp, mouse
gcgcgggagggtgcactaat

SEQ ID NO: 629965 - DNA, 20 bp, mouse
ggggctgcccgaaagactcc

SEQ ID NO: 629966 - DNA, 20 bp, mouse
gtgagttccgggtagctgga

SEQ ID NO: 629967 - DNA, 20 bp, mouse
gcagtcggcagaacaggcac

SEQ ID NO: 629968 - DNA, 20 bp, mouse
ggttccgggtagctggaggg

SEQ ID NO: 629969 - DNA, 20 bp, mouse
ggctacccggaactcaaata

SEQ ID NO: 629970 - DNA, 20 bp, mouse
gcttcctactgagcggcagt

SEQ ID NO: 629971 - DNA, 20 bp, mouse
gacccggaactcaaatatgg

SEQ ID NO: 629972 - DNA, 20 bp, mouse
ggagttgtgcttgagcttcc

SEQ ID NO: 629973 - DNA, 20 bp, mouse
gctgccgactgccgctcagt

SEQ ID NO: 629974 - DNA, 20 bp, mouse
gaagaagcacggatagtgga

SEQ ID NO: 629975 - DNA, 20 bp, mouse
gcgcggcgcaggctcgtcat

SEQ ID NO: 629976 - DNA, 20 bp, mouse
gtccgggccgtgagaaaccc

SEQ ID NO: 629977 - DNA, 20 bp, mouse
ggtacttgtgaaaaagccgt

SEQ ID NO: 629978 - DNA, 20 bp, mouse
gcccagagaaggccgaataa

SEQ ID NO: 629979 - DNA, 20 bp, mouse
gtgagaaaccccggcgccca

SEQ ID NO: 629980 - DNA, 20 bp, mouse
gccggatcggagtgagagtc

SEQ ID NO: 629981 - DNA, 20 bp, mouse
gagtgacgtcacaggctgcc

SEQ ID NO: 629982 - DNA, 20 bp, mouse
gccgatccggagcagaaact

SEQ ID NO: 629983 - DNA, 20 bp, mouse
ggtcggcctccgccttcctc

SEQ ID NO: 629984 - DNA, 20 bp, mouse
gcactgcctgaggaaggcgg

SEQ ID NO: 629985 - DNA, 20 bp, mouse
ggggctccctcagagtacag

SEQ ID NO: 629986 - DNA, 20 bp, mouse
ggcaggagctgggaactcta

SEQ ID NO: 629987 - DNA, 20 bp, mouse
ggctcctgcgccatcctctg

SEQ ID NO: 629988 - DNA, 20 bp, mouse
gtcctctgtggctcctcaca

SEQ ID NO: 629989 - DNA, 20 bp, mouse
ggagccacagaggatggcgc

SEQ ID NO: 629990 - DNA, 20 bp, mouse
gagatctaggtaacaactga

SEQ ID NO: 629991 - DNA, 20 bp, mouse
gccacaccctccattcctgg

SEQ ID NO: 629992 - DNA, 20 bp, mouse
ggctaactccaagtccccgc

SEQ ID NO: 629993 - DNA, 20 bp, mouse
gtcattgccgcccccaggaa

SEQ ID NO: 629994 - DNA, 20 bp, mouse
gagctggggttccttttaca

SEQ ID NO: 629995 - DNA, 20 bp, mouse
gaaggccaagcatccagaag

SEQ ID NO: 629996 - DNA, 20 bp, mouse
gcgcggggcgcatctcacct

SEQ ID NO: 629997 - DNA, 20 bp, mouse
gctctctcgcagcatcagca

SEQ ID NO: 629998 - DNA, 20 bp, mouse
gtgatgctgcgagagagccc

SEQ ID NO: 629999 - DNA, 20 bp, mouse
gaggttgagtgtaccagctg

SEQ ID NO: 630000 - DNA, 20 bp, mouse
gctcgcagcatcagcaaggc

SEQ ID NO: 630001 - DNA, 20 bp, mouse
gtcctacgggacagactcac

SEQ ID NO: 630002 - DNA, 20 bp, mouse
gacgctgaaggacccgcagc

SEQ ID NO: 630003 - DNA, 20 bp, mouse
gtgaactggagaaaagatat

SEQ ID NO: 630004 - DNA, 20 bp, mouse
gatgcgccccgcggtcctac

SEQ ID NO: 630005 - DNA, 20 bp, mouse
gttgtgtgcggtgtgagagg

SEQ ID NO: 630006 - DNA, 20 bp, mouse
gtctgacctggatccaacgt

SEQ ID NO: 630007 - DNA, 20 bp, mouse
gtgggaagaagcggacttgg

SEQ ID NO: 630008 - DNA, 20 bp, mouse
ggtgatgggtccggaatgga

SEQ ID NO: 630009 - DNA, 20 bp, mouse
gggctggaccaaccccacgt

SEQ ID NO: 630010 - DNA, 20 bp, mouse
gtcacatggaggttcgtcca

SEQ ID NO: 630011 - DNA, 20 bp, mouse
gagaaacgtggtttcctgac

SEQ ID NO: 630012 - DNA, 20 bp, mouse
gaaaggtcttgctcagtact

SEQ ID NO: 630013 - DNA, 20 bp, mouse
ggctccttgtgacgtcatat

SEQ ID NO: 630014 - DNA, 20 bp, mouse
gaggtgggaagaagcggact

SEQ ID NO: 630015 - DNA, 20 bp, mouse
ggcagggcagcgttgcaccc

SEQ ID NO: 630016 - DNA, 20 bp, mouse
gcgctctcccggccccgagc

SEQ ID NO: 630017 - DNA, 20 bp, mouse
gcagcgcagggcgcagcccg

SEQ ID NO: 630018 - DNA, 20 bp, mouse
ggccagaagcgaataatcct

SEQ ID NO: 630019 - DNA, 20 bp, mouse
ggtcgctgcttgtccagccc

SEQ ID NO: 630020 - DNA, 20 bp, mouse
gtccagcccgggctctggcg

SEQ ID NO: 630021 - DNA, 20 bp, mouse
gacatcgcagagcgcagcgc

SEQ ID NO: 630022 - DNA, 20 bp, mouse
gccgcagcggagccgtgatg

SEQ ID NO: 630023 - DNA, 20 bp, mouse
ggcagagcgcagcgccggct

SEQ ID NO: 630024 - DNA, 20 bp, mouse
ggactgcgggagtgtccccg

SEQ ID NO: 630025 - DNA, 20 bp, mouse
gaatcctgggtggcccgcag

SEQ ID NO: 630026 - DNA, 20 bp, mouse
gtggagccacggccgaggaa

SEQ ID NO: 630027 - DNA, 20 bp, mouse
gccgaggaaggggcaaaaag

SEQ ID NO: 630028 - DNA, 20 bp, mouse
gtcgggagcgaggcggacga

SEQ ID NO: 630029 - DNA, 20 bp, mouse
gaaaggagtcgggagcgagg

SEQ ID NO: 630030 - DNA, 20 bp, mouse
gcatcttggagccacggccg

SEQ ID NO: 630031 - DNA, 20 bp, mouse
gacgagggcgagggtacggt

SEQ ID NO: 630032 - DNA, 20 bp, mouse
ggcagtgccgcgggcgtcac

SEQ ID NO: 630033 - DNA, 20 bp, mouse
gccgctcacgtgatctgtct

SEQ ID NO: 630034 - DNA, 20 bp, mouse
ggtctccacaggcccgacag

SEQ ID NO: 630035 - DNA, 20 bp, mouse
gcggcggcgctcaagcggag

SEQ ID NO: 630036 - DNA, 20 bp, mouse
ggttagaggagtgacgtgag

SEQ ID NO: 630037 - DNA, 20 bp, mouse
gagtgacgtgagcggaagct

SEQ ID NO: 630038 - DNA, 20 bp, mouse
gctttggttctcaacttacc

SEQ ID NO: 630039 - DNA, 20 bp, mouse
gggtgcagggccgtgagctc

SEQ ID NO: 630040 - DNA, 20 bp, mouse
ggacctgggatagcagaacg

SEQ ID NO: 630041 - DNA, 20 bp, mouse
gaaggggccggaagagagca

SEQ ID NO: 630042 - DNA, 20 bp, mouse
gccaagtcaaaggagctacg

SEQ ID NO: 630043 - DNA, 20 bp, mouse
gtacactacgcgattcccta

SEQ ID NO: 630044 - DNA, 20 bp, mouse
gaacaggtcgttaacacttt

SEQ ID NO: 630045 - DNA, 20 bp, mouse
gctcacggccctgcaccgta

SEQ ID NO: 630046 - DNA, 20 bp, mouse
gggcgggaatatagtgcagg

SEQ ID NO: 630047 - DNA, 20 bp, mouse
gcccgtggagaggaaccctg

SEQ ID NO: 630048 - DNA, 20 bp, mouse
gccaggcgggaatatagtgc

SEQ ID NO: 630049 - DNA, 20 bp, mouse
gtcgaggtgcgtgacaaccc

SEQ ID NO: 630050 - DNA, 20 bp, mouse
gtccgtcaccacccctccga

SEQ ID NO: 630051 - DNA, 20 bp, mouse
gaggtgcgtgacaacccggg

SEQ ID NO: 630052 - DNA, 20 bp, mouse
gtcggccaccgtcggagggg

SEQ ID NO: 630053 - DNA, 20 bp, mouse
gggcgtggctccgagctgta

SEQ ID NO: 630054 - DNA, 20 bp, mouse
ggacctgtggaccggatcaa

SEQ ID NO: 630055 - DNA, 20 bp, mouse
gcacgcggcgcgaatcggaa

SEQ ID NO: 630056 - DNA, 20 bp, mouse
gcgccgctgagaccacatcc

SEQ ID NO: 630057 - DNA, 20 bp, mouse
gaggagagcggaagtggcgt

SEQ ID NO: 630058 - DNA, 20 bp, mouse
ggaagtggcgttggtctgtc

SEQ ID NO: 630059 - DNA, 20 bp, mouse
gctcccggatgtggtctcag

SEQ ID NO: 630060 - DNA, 20 bp, mouse
ggcggtgactgcaccgagtc

SEQ ID NO: 630061 - DNA, 20 bp, mouse
ggtgaaattgttaggcgtgg

SEQ ID NO: 630062 - DNA, 20 bp, mouse
gtgggtgaaattgttaggcg

SEQ ID NO: 630063 - DNA, 20 bp, mouse
gtcctcgcctctcccggatg

SEQ ID NO: 630064 - DNA, 20 bp, mouse
ggaagtaggtgttcagaaca

SEQ ID NO: 630065 - DNA, 20 bp, mouse
gctgtcgagctgagaacacg

SEQ ID NO: 630066 - DNA, 20 bp, mouse
ggaagcggaagcgggtacgg

SEQ ID NO: 630067 - DNA, 20 bp, mouse
ggcggaagcggaagcgggta

SEQ ID NO: 630068 - DNA, 20 bp, mouse
gtaccagctggtcttcggag

SEQ ID NO: 630069 - DNA, 20 bp, mouse
gcttgagccgggaggaacag

SEQ ID NO: 630070 - DNA, 20 bp, mouse
ggctccatgaatggaagcgg

SEQ ID NO: 630071 - DNA, 20 bp, mouse
ggtagagtgggctcaggtca

SEQ ID NO: 630072 - DNA, 20 bp, mouse
gggcagggccgaactgggag

SEQ ID NO: 630073 - DNA, 20 bp, mouse
ggggtagggggctccatgaa

SEQ ID NO: 630074 - DNA, 20 bp, mouse
gagccgggaggaacaggggt

SEQ ID NO: 630075 - DNA, 20 bp, mouse
gtcctaagagcaaggaccga

SEQ ID NO: 630076 - DNA, 20 bp, mouse
gccaagaagtgaaagagacg

SEQ ID NO: 630077 - DNA, 20 bp, mouse
ggacccccaagcctttgtta

SEQ ID NO: 630078 - DNA, 20 bp, mouse
gcaacttcgcaccgtaacaa

SEQ ID NO: 630079 - DNA, 20 bp, mouse
gaggggcggcgaactcgtgg

SEQ ID NO: 630080 - DNA, 20 bp, mouse
gacttcttgggttacagtga

SEQ ID NO: 630081 - DNA, 20 bp, mouse
gcaccgtaacaaaggcttgg

SEQ ID NO: 630082 - DNA, 20 bp, mouse
gcagcggcgtgggcgagcgt

SEQ ID NO: 630083 - DNA, 20 bp, mouse
ggagacgcgccccctctggg

SEQ ID NO: 630084 - DNA, 20 bp, mouse
gcgcgggcaggccaagtaat

SEQ ID NO: 630085 - DNA, 20 bp, mouse
ggggtccgtgcgggccgtgg

SEQ ID NO: 630086 - DNA, 20 bp, mouse
ggcgtgcgcgtcctcctcct

SEQ ID NO: 630087 - DNA, 20 bp, mouse
ggcccgccgcctccccgcca

SEQ ID NO: 630088 - DNA, 20 bp, mouse
gcgccctacggcccctacct

SEQ ID NO: 630089 - DNA, 20 bp, mouse
gccctaccttggcggggagg

SEQ ID NO: 630090 - DNA, 20 bp, mouse
ggcgccagagaccttctaca

SEQ ID NO: 630091 - DNA, 20 bp, mouse
gcgccaaggtaggggccgta

SEQ ID NO: 630092 - DNA, 20 bp, mouse
gggcccctaccttggcgggg

SEQ ID NO: 630093 - DNA, 20 bp, mouse
gtaggggccgtagggcgggg

SEQ ID NO: 630094 - DNA, 20 bp, mouse
ggcgccctgtagaaggtctc

SEQ ID NO: 630095 - DNA, 20 bp, mouse
gggcttcctggctcagatgg

SEQ ID NO: 630096 - DNA, 20 bp, mouse
gccggcagtacccggatgga

SEQ ID NO: 630097 - DNA, 20 bp, mouse
ggcctgcgagtcccagatgg

SEQ ID NO: 630098 - DNA, 20 bp, mouse
gggccattacccctccatcc

SEQ ID NO: 630099 - DNA, 20 bp, mouse
gtacccggatggaggggtaa

SEQ ID NO: 630100 - DNA, 20 bp, mouse
gccggaagcgctgaatggac

SEQ ID NO: 630101 - DNA, 20 bp, mouse
gctgggactcgcaggcaatg

SEQ ID NO: 630102 - DNA, 20 bp, mouse
gctttccggcagtacccgga

SEQ ID NO: 630103 - DNA, 20 bp, mouse
gacacagggaatacctgccg

SEQ ID NO: 630104 - DNA, 20 bp, mouse
gagcttcctagcgcaagagg

SEQ ID NO: 630105 - DNA, 20 bp, mouse
gctaggctctgagaccgtgg

SEQ ID NO: 630106 - DNA, 20 bp, mouse
ggcacggtcccagatcccag

SEQ ID NO: 630107 - DNA, 20 bp, mouse
gcccgggtagggacctacag

SEQ ID NO: 630108 - DNA, 20 bp, mouse
gcagatcccagcggacggac

SEQ ID NO: 630109 - DNA, 20 bp, mouse
gggtcccagatcccagcgga

SEQ ID NO: 630110 - DNA, 20 bp, mouse
gggacaggcgtctagaccgc

SEQ ID NO: 630111 - DNA, 20 bp, mouse
gcgactccgcccccccgggt

SEQ ID NO: 630112 - DNA, 20 bp, mouse
gtagggacctacagcgggcg

SEQ ID NO: 630113 - DNA, 20 bp, mouse
gggcggcggcggtctgcggg

SEQ ID NO: 630114 - DNA, 20 bp, mouse
gcgggctaggcggatcgggt

SEQ ID NO: 630115 - DNA, 20 bp, mouse
gcgcggcggcggcggtctgc

SEQ ID NO: 630116 - DNA, 20 bp, mouse
gtagaggaagggtgtagtgt

SEQ ID NO: 630117 - DNA, 20 bp, mouse
ggggtgggattagaagactg

SEQ ID NO: 630118 - DNA, 20 bp, mouse
gggtgtgttagcttgggaag

SEQ ID NO: 630119 - DNA, 20 bp, mouse
gggtccgaggagctgaggcg

SEQ ID NO: 630120 - DNA, 20 bp, mouse
ggtctggagtgtcaagaatc

SEQ ID NO: 630121 - DNA, 20 bp, mouse
gggactaaaaagtcaaagtc

SEQ ID NO: 630122 - DNA, 20 bp, mouse
gggaagggtgtagtgtgggt

SEQ ID NO: 630123 - DNA, 20 bp, mouse
gccggtacaagactgagctg

SEQ ID NO: 630124 - DNA, 20 bp, mouse
gccttgcttcctagcttccc

SEQ ID NO: 630125 - DNA, 20 bp, mouse
gggattagaagactgaggcc

SEQ ID NO: 630126 - DNA, 20 bp, mouse
gcggcggcgagagcaggagg

SEQ ID NO: 630127 - DNA, 20 bp, mouse
gcatcaggatggctccagag

SEQ ID NO: 630128 - DNA, 20 bp, mouse
ggtacagagcgagtccctgc

SEQ ID NO: 630129 - DNA, 20 bp, mouse
ggctctgtacgtaatcactg

SEQ ID NO: 630130 - DNA, 20 bp, mouse
gagggggcccctaacccgca

SEQ ID NO: 630131 - DNA, 20 bp, mouse
gcagcggcggcgagagcagg

SEQ ID NO: 630132 - DNA, 20 bp, mouse
gcaccgggctctacagtcta

SEQ ID NO: 630133 - DNA, 20 bp, mouse
ggagcgagtccctgcgggtt

SEQ ID NO: 630134 - DNA, 20 bp, mouse
gtctagggctgcctcggcag

SEQ ID NO: 630135 - DNA, 20 bp, mouse
gcaaggcccccaaagccatc

SEQ ID NO: 630136 - DNA, 20 bp, mouse
ggccagcggagagaagagcg

SEQ ID NO: 630137 - DNA, 20 bp, mouse
gcaggccgccgagtctcctc

SEQ ID NO: 630138 - DNA, 20 bp, mouse
ggccagggaccgaggagggt

SEQ ID NO: 630139 - DNA, 20 bp, mouse
ggcgaggccgcgtcacccgg

SEQ ID NO: 630140 - DNA, 20 bp, mouse
gaggctcgcctgaggagact

SEQ ID NO: 630141 - DNA, 20 bp, mouse
gctcgcctgaggagactcgg

SEQ ID NO: 630142 - DNA, 20 bp, mouse
ggagctccgaggctcgcctg

SEQ ID NO: 630143 - DNA, 20 bp, mouse
gggccgcgccgggagcgaga

SEQ ID NO: 630144 - DNA, 20 bp, mouse
ggccaggccagggaccgagg

SEQ ID NO: 630145 - DNA, 20 bp, mouse
gctggcgaggccgcgtcacc

SEQ ID NO: 630146 - DNA, 20 bp, mouse
gagcggcgcggggacattgg

SEQ ID NO: 630147 - DNA, 20 bp, mouse
gacccgggccccccgcctct

SEQ ID NO: 630148 - DNA, 20 bp, mouse
gcgcgtacacacgcgagccc

SEQ ID NO: 630149 - DNA, 20 bp, mouse
ggggtacggtggccaatgag

SEQ ID NO: 630150 - DNA, 20 bp, mouse
gatgaggtacccagaggcgg

SEQ ID NO: 630151 - DNA, 20 bp, mouse
gcgggccgaagcgtgggaag

SEQ ID NO: 630152 - DNA, 20 bp, mouse
ggcgcgcgcagacccccttc

SEQ ID NO: 630153 - DNA, 20 bp, mouse
gcgcttcggcccgtcgcccc

SEQ ID NO: 630154 - DNA, 20 bp, mouse
gccgaagcgtgggaaggggc

SEQ ID NO: 630155 - DNA, 20 bp, mouse
ggcggggacattggtggcag

SEQ ID NO: 630156 - DNA, 20 bp, mouse
gtctgtgtcaagagcggcag

SEQ ID NO: 630157 - DNA, 20 bp, mouse
gcctacactactggagtgga

SEQ ID NO: 630158 - DNA, 20 bp, mouse
ggggaggcgtggatagtgaa

SEQ ID NO: 630159 - DNA, 20 bp, mouse
ggggtcctacactactggag

SEQ ID NO: 630160 - DNA, 20 bp, mouse
ggagagcaccgcccaatggg

SEQ ID NO: 630161 - DNA, 20 bp, mouse
gtgggcggtgctctcaggag

SEQ ID NO: 630162 - DNA, 20 bp, mouse
gggatccaacgacgcctcta

SEQ ID NO: 630163 - DNA, 20 bp, mouse
ggtgaagggtcctacactac

SEQ ID NO: 630164 - DNA, 20 bp, mouse
gagcggcaggggctgcttgg

SEQ ID NO: 630165 - DNA, 20 bp, mouse
gcgacgcctctagggcacac

SEQ ID NO: 630166 - DNA, 20 bp, mouse
ggtgtgagcctaaggaattg

SEQ ID NO: 630167 - DNA, 20 bp, mouse
gtatttagcctcaattcctt

SEQ ID NO: 630168 - DNA, 20 bp, mouse
ggctgcagaacgggcgggag

SEQ ID NO: 630169 - DNA, 20 bp, mouse
ggtgccaggcggggcgtcct

SEQ ID NO: 630170 - DNA, 20 bp, mouse
gtttagaggagtgaccagca

SEQ ID NO: 630171 - DNA, 20 bp, mouse
gaacgcgttcttaacacttt

SEQ ID NO: 630172 - DNA, 20 bp, mouse
gttcgtaggagaatatgtgg

SEQ ID NO: 630173 - DNA, 20 bp, mouse
gtgcactgtgtggagtcgcg

SEQ ID NO: 630174 - DNA, 20 bp, mouse
gcaggctgctgttcccgccg

SEQ ID NO: 630175 - DNA, 20 bp, mouse
gagaacgcgtttccggccta

SEQ ID NO: 630176 - DNA, 20 bp, mouse
gctcctcacccaggatgcgt

SEQ ID NO: 630177 - DNA, 20 bp, mouse
ggcctggcctcctagcagag

SEQ ID NO: 630178 - DNA, 20 bp, mouse
gcctgcagccgacgcatcct

SEQ ID NO: 630179 - DNA, 20 bp, mouse
gagccgacgcatcctgggtg

SEQ ID NO: 630180 - DNA, 20 bp, mouse
gccagcaccactctgctagg

SEQ ID NO: 630181 - DNA, 20 bp, mouse
gtctgcggtgggcttcgggg

SEQ ID NO: 630182 - DNA, 20 bp, mouse
gggtgggcttcggggtggag

SEQ ID NO: 630183 - DNA, 20 bp, mouse
ggtccctgagaatcagcaca

SEQ ID NO: 630184 - DNA, 20 bp, mouse
gctcctcaggaagccctaaa

SEQ ID NO: 630185 - DNA, 20 bp, mouse
ggtgtctgcggtgggcttcg

SEQ ID NO: 630186 - DNA, 20 bp, mouse
gaacgcgcgcctcccccggc

SEQ ID NO: 630187 - DNA, 20 bp, mouse
ggcactgcgccctcacctcg

SEQ ID NO: 630188 - DNA, 20 bp, mouse
gtccgcgcgccccgaggtga

SEQ ID NO: 630189 - DNA, 20 bp, mouse
gaatggactccggccggggg

SEQ ID NO: 630190 - DNA, 20 bp, mouse
gattcaacgcgcgcctcccc

SEQ ID NO: 630191 - DNA, 20 bp, mouse
gagcctgaagaggagatctt

SEQ ID NO: 630192 - DNA, 20 bp, mouse
ggcaaatggactccggccgg

SEQ ID NO: 630193 - DNA, 20 bp, mouse
gtatgcaaatggactccggc

SEQ ID NO: 630194 - DNA, 20 bp, mouse
gccggcgaggtgaggtgact

SEQ ID NO: 630195 - DNA, 20 bp, mouse
gtttcaaataagtttcaggg

SEQ ID NO: 630196 - DNA, 20 bp, mouse
gggtgaatctcggtggacag

SEQ ID NO: 630197 - DNA, 20 bp, mouse
gactcccgggtgaatctcgg

SEQ ID NO: 630198 - DNA, 20 bp, mouse
gctcggtggacagcgggacg

SEQ ID NO: 630199 - DNA, 20 bp, mouse
gtcacagcccgggcgtttaa

SEQ ID NO: 630200 - DNA, 20 bp, mouse
gaaaactcccgggtgaatct

SEQ ID NO: 630201 - DNA, 20 bp, mouse
gaggcagagagcgattgcca

SEQ ID NO: 630202 - DNA, 20 bp, mouse
gatgactcccttaaacgccc

SEQ ID NO: 630203 - DNA, 20 bp, mouse
gtggagaatcagtcacagcc

SEQ ID NO: 630204 - DNA, 20 bp, mouse
gaaagtagtgacaagcgaag

SEQ ID NO: 630205 - DNA, 20 bp, mouse
gacgccacaaggttacagcg

SEQ ID NO: 630206 - DNA, 20 bp, mouse
ggaggagtggcgtgatagct

SEQ ID NO: 630207 - DNA, 20 bp, mouse
gctcctcagtcaacttacct

SEQ ID NO: 630208 - DNA, 20 bp, mouse
gcaggcagcagcccaaccgg

SEQ ID NO: 630209 - DNA, 20 bp, mouse
ggaggagccaaacccaaaag

SEQ ID NO: 630210 - DNA, 20 bp, mouse
ggaggaagtgtgttgtgtgg

SEQ ID NO: 630211 - DNA, 20 bp, mouse
gcagcaggcagcagcccaac

SEQ ID NO: 630212 - DNA, 20 bp, mouse
ggagtcagaggatacaagaa

SEQ ID NO: 630213 - DNA, 20 bp, mouse
gactgttctttagtgaacct

SEQ ID NO: 630214 - DNA, 20 bp, mouse
gaacctaggtaagttgactg

SEQ ID NO: 630215 - DNA, 20 bp, mouse
ggtggaggaagtgtgttgtg

SEQ ID NO: 630216 - DNA, 20 bp, mouse
gatgggaggtgcccttctga

SEQ ID NO: 630217 - DNA, 20 bp, mouse
gatggagccatacagtcttg

SEQ ID NO: 630218 - DNA, 20 bp, mouse
ggacctgggccccagcacac

SEQ ID NO: 630219 - DNA, 20 bp, mouse
gtcactgggcatatcagatg

SEQ ID NO: 630220 - DNA, 20 bp, mouse
gttccccgagtatagggaca

SEQ ID NO: 630221 - DNA, 20 bp, mouse
gcctcttccccaagactgta

SEQ ID NO: 630222 - DNA, 20 bp, mouse
gcttgactttcagagaagga

SEQ ID NO: 630223 - DNA, 20 bp, mouse
gacaccctgtccctatactc

SEQ ID NO: 630224 - DNA, 20 bp, mouse
gagcacttgactttcagaga

SEQ ID NO: 630225 - DNA, 20 bp, mouse
gagccagggactgaatccgc

SEQ ID NO: 630226 - DNA, 20 bp, mouse
gatgccccgagccaggccta

SEQ ID NO: 630227 - DNA, 20 bp, mouse
gcagccattggattctgtag

SEQ ID NO: 630228 - DNA, 20 bp, mouse
gtgtagaggaagcaaggacc

SEQ ID NO: 630229 - DNA, 20 bp, mouse
gagcaaggaccaggtcgccg

SEQ ID NO: 630230 - DNA, 20 bp, mouse
gtcgccgaggtctcttccct

SEQ ID NO: 630231 - DNA, 20 bp, mouse
gggaagagacctcggcgacc

SEQ ID NO: 630232 - DNA, 20 bp, mouse
gggcctggctcggggcatgt

SEQ ID NO: 630233 - DNA, 20 bp, mouse
gaatggctgtggccatgcac

SEQ ID NO: 630234 - DNA, 20 bp, mouse
gcaagacgcagcacttacct

SEQ ID NO: 630235 - DNA, 20 bp, mouse
gctgagagctgtcacaccgg

SEQ ID NO: 630236 - DNA, 20 bp, mouse
gtccacgccacgccaggagg

SEQ ID NO: 630237 - DNA, 20 bp, mouse
gcagccagccgcacgggtac

SEQ ID NO: 630238 - DNA, 20 bp, mouse
gcgtggagcccgtacccgtg

SEQ ID NO: 630239 - DNA, 20 bp, mouse
gcgtgggccgagccccctcc

SEQ ID NO: 630240 - DNA, 20 bp, mouse
gccagcggcgcccgggacgt

SEQ ID NO: 630241 - DNA, 20 bp, mouse
ggagccatcggtacaggtga

SEQ ID NO: 630242 - DNA, 20 bp, mouse
ggcggccccggtgagtccga

SEQ ID NO: 630243 - DNA, 20 bp, mouse
gaagtcggacgtgggcgaag

SEQ ID NO: 630244 - DNA, 20 bp, mouse
gccatcggtacaggtgaggg

SEQ ID NO: 630245 - DNA, 20 bp, mouse
gaacccagcagccagccgca

SEQ ID NO: 630246 - DNA, 20 bp, mouse
gcgtcttcggcggctgggaa

SEQ ID NO: 630247 - DNA, 20 bp, mouse
ggcggctgggaagggcgact

SEQ ID NO: 630248 - DNA, 20 bp, mouse
ggcaggagtccagggccact

SEQ ID NO: 630249 - DNA, 20 bp, mouse
gatgtggtcgatcttggggt

SEQ ID NO: 630250 - DNA, 20 bp, mouse
gttggggtgggcgtcttcgg

SEQ ID NO: 630251 - DNA, 20 bp, mouse
gtggcaggcgagctgaggga

SEQ ID NO: 630252 - DNA, 20 bp, mouse
gggagtcagcgcagcggatg

SEQ ID NO: 630253 - DNA, 20 bp, mouse
gactaggcagagggcgctcc

SEQ ID NO: 630254 - DNA, 20 bp, mouse
ggaaggaggagtcagcgcag

SEQ ID NO: 630255 - DNA, 20 bp, mouse
gcgcggggcggaactgaagg

SEQ ID NO: 630256 - DNA, 20 bp, mouse
gcagagaaccaagcgcgcag

SEQ ID NO: 630257 - DNA, 20 bp, mouse
gaggaagtgcagccgccgag

SEQ ID NO: 630258 - DNA, 20 bp, mouse
gagaaccaagcgcgcagcgg

SEQ ID NO: 630259 - DNA, 20 bp, mouse
gggcggggtccgcccctcgg

SEQ ID NO: 630260 - DNA, 20 bp, mouse
gaagtgcagccgccgagggg

SEQ ID NO: 630261 - DNA, 20 bp, mouse
ggcgtgtgtcgtcagaaata

SEQ ID NO: 630262 - DNA, 20 bp, mouse
gcgggctgtgcgggccagcg

SEQ ID NO: 630263 - DNA, 20 bp, mouse
gagaggcggggtccgcccct

SEQ ID NO: 630264 - DNA, 20 bp, mouse
gcccaaatgtaactaagtgt

SEQ ID NO: 630265 - DNA, 20 bp, mouse
ggcggaggttccggccgcgc

SEQ ID NO: 630266 - DNA, 20 bp, mouse
gctgtcagctgagaaagtct

SEQ ID NO: 630267 - DNA, 20 bp, mouse
ggaggctccggacacagaca

SEQ ID NO: 630268 - DNA, 20 bp, mouse
gcaggatcgctgcactagta

SEQ ID NO: 630269 - DNA, 20 bp, mouse
ggagctgccgacaggaaacc

SEQ ID NO: 630270 - DNA, 20 bp, mouse
gccttcgacctcaggagcgg

SEQ ID NO: 630271 - DNA, 20 bp, mouse
gggcgcgccagtaagaaaga

SEQ ID NO: 630272 - DNA, 20 bp, mouse
ggtcgaaggtcttctggcca

SEQ ID NO: 630273 - DNA, 20 bp, mouse
gaggggacctggcatagcga

SEQ ID NO: 630274 - DNA, 20 bp, mouse
gagcctcacccccgctcctg

SEQ ID NO: 630275 - DNA, 20 bp, mouse
gagaccttcgacctcaggag

SEQ ID NO: 630276 - DNA, 20 bp, mouse
gtagtctggcaagtaagaga

SEQ ID NO: 630277 - DNA, 20 bp, mouse
gacacaacacggaccctgaa

SEQ ID NO: 630278 - DNA, 20 bp, mouse
gtgaagcggacgttcctcac

SEQ ID NO: 630279 - DNA, 20 bp, mouse
gaagtaagagaaggccggtg

SEQ ID NO: 630280 - DNA, 20 bp, mouse
gctctatcaccacaatagtc

SEQ ID NO: 630281 - DNA, 20 bp, mouse
gtgttggcagccacacaaca

SEQ ID NO: 630282 - DNA, 20 bp, mouse
ggagtcacaggtatccgttc

SEQ ID NO: 630283 - DNA, 20 bp, mouse
gcaggaacgccggcagaaag

SEQ ID NO: 630284 - DNA, 20 bp, mouse
gctccgggacagctgacctc

SEQ ID NO: 630285 - DNA, 20 bp, mouse
gggactgaggcatctacccg

SEQ ID NO: 630286 - DNA, 20 bp, mouse
gggtgcactgaaggattgca

SEQ ID NO: 630287 - DNA, 20 bp, mouse
gtgcggaacccgggaggagg

SEQ ID NO: 630288 - DNA, 20 bp, mouse
gctgaaggattgcagggctt

SEQ ID NO: 630289 - DNA, 20 bp, mouse
ggctccctcccactcaccaa

SEQ ID NO: 630290 - DNA, 20 bp, mouse
ggcaaggaaggcctttggtg

SEQ ID NO: 630291 - DNA, 20 bp, mouse
gcctcccactcaccaagggg

SEQ ID NO: 630292 - DNA, 20 bp, mouse
gggcctttggtgcggaaccc

SEQ ID NO: 630293 - DNA, 20 bp, mouse
gctcccgggttccgcaccaa

SEQ ID NO: 630294 - DNA, 20 bp, mouse
gagacaggactacctactag

SEQ ID NO: 630295 - DNA, 20 bp, mouse
gagcttgcaaggaaggcctt

SEQ ID NO: 630296 - DNA, 20 bp, mouse
ggccagcccctccactcggg

SEQ ID NO: 630297 - DNA, 20 bp, mouse
gacggccagcccctccactc

SEQ ID NO: 630298 - DNA, 20 bp, mouse
gagacgcaacctcagagacg

SEQ ID NO: 630299 - DNA, 20 bp, mouse
gctgtgctctgggacataac

SEQ ID NO: 630300 - DNA, 20 bp, mouse
ggcgctgccgcccgagtgga

SEQ ID NO: 630301 - DNA, 20 bp, mouse
gcgctgcggggacctctcca

SEQ ID NO: 630302 - DNA, 20 bp, mouse
ggccgcccgagtggaggggc

SEQ ID NO: 630303 - DNA, 20 bp, mouse
ggtggtaaggggttgagtaa

SEQ ID NO: 630304 - DNA, 20 bp, mouse
ggagctccgggccagaaggc

SEQ ID NO: 630305 - DNA, 20 bp, mouse
gcggagagctccgggccaga

SEQ ID NO: 630306 - DNA, 20 bp, mouse
gacctgcggacggagcagaa

SEQ ID NO: 630307 - DNA, 20 bp, mouse
gggagcagaacggaagcaga

SEQ ID NO: 630308 - DNA, 20 bp, mouse
ggactgccgagcctcaagta

SEQ ID NO: 630309 - DNA, 20 bp, mouse
ggagatgtgttacctgcgga

SEQ ID NO: 630310 - DNA, 20 bp, mouse
ggcggcgtgaaacccaggaa

SEQ ID NO: 630311 - DNA, 20 bp, mouse
gcgagggagcggctccaccc

SEQ ID NO: 630312 - DNA, 20 bp, mouse
gagaagccgagcgctgggaa

SEQ ID NO: 630313 - DNA, 20 bp, mouse
gagcctcgaccagaacgcag

SEQ ID NO: 630314 - DNA, 20 bp, mouse
gacgcagcggcgtgaaaccc

SEQ ID NO: 630315 - DNA, 20 bp, mouse
gggggcccttgccagaagtc

SEQ ID NO: 630316 - DNA, 20 bp, mouse
gacgggcgctagagaggacg

SEQ ID NO: 630317 - DNA, 20 bp, mouse
gagaggacgcggcgctagag

SEQ ID NO: 630318 - DNA, 20 bp, mouse
gtgcggagcaggcgagacga

SEQ ID NO: 630319 - DNA, 20 bp, mouse
gggacgcggcgctagagtgg

SEQ ID NO: 630320 - DNA, 20 bp, mouse
ggagacgacgggcgctagag

SEQ ID NO: 630321 - DNA, 20 bp, mouse
ggctagagtggcggtgcaaa

SEQ ID NO: 630322 - DNA, 20 bp, mouse
gagcggcccaggcggaaggt

SEQ ID NO: 630323 - DNA, 20 bp, mouse
gagtccccgccggagcgcag

SEQ ID NO: 630324 - DNA, 20 bp, mouse
gccggcgagacggccgaggc

SEQ ID NO: 630325 - DNA, 20 bp, mouse
ggcgtcccgggtgcggagag

SEQ ID NO: 630326 - DNA, 20 bp, mouse
gaggagattgccgagccgta

SEQ ID NO: 630327 - DNA, 20 bp, mouse
ggccccctccagccccggat

SEQ ID NO: 630328 - DNA, 20 bp, mouse
gggcgctgggacgccgttgg

SEQ ID NO: 630329 - DNA, 20 bp, mouse
gtcggacctgcacctcccag

SEQ ID NO: 630330 - DNA, 20 bp, mouse
ggcgggcgctgggacgccgt

SEQ ID NO: 630331 - DNA, 20 bp, mouse
ggaagctgggccctacggct

SEQ ID NO: 630332 - DNA, 20 bp, mouse
gtccagccccggatgggagg

SEQ ID NO: 630333 - DNA, 20 bp, mouse
gtctcctggagatggattgg

SEQ ID NO: 630334 - DNA, 20 bp, mouse
gtctccgcgaagggtagata

SEQ ID NO: 630335 - DNA, 20 bp, mouse
gcagggcggtccctccccgg

SEQ ID NO: 630336 - DNA, 20 bp, mouse
ggggcgatcgcggacagtgg

SEQ ID NO: 630337 - DNA, 20 bp, mouse
ggccgggcgatcgcggacag

SEQ ID NO: 630338 - DNA, 20 bp, mouse
gcaggaggtggaggtaagac

SEQ ID NO: 630339 - DNA, 20 bp, mouse
gaaaggagcgcaggaggtgg

SEQ ID NO: 630340 - DNA, 20 bp, mouse
gcgatcgcggacagtggtgg

SEQ ID NO: 630341 - DNA, 20 bp, mouse
gagaccggctccctgagact

SEQ ID NO: 630342 - DNA, 20 bp, mouse
gccctgcggccgggcgatcg

SEQ ID NO: 630343 - DNA, 20 bp, mouse
gcggacagtggtggcggaga

SEQ ID NO: 630344 - DNA, 20 bp, mouse
gacagtggtggcggagaggg

SEQ ID NO: 630345 - DNA, 20 bp, mouse
gttccttcacccggactcag

SEQ ID NO: 630346 - DNA, 20 bp, mouse
ggacacagcaccgctaactt

SEQ ID NO: 630347 - DNA, 20 bp, mouse
gcggagccgaggtggaccag

SEQ ID NO: 630348 - DNA, 20 bp, mouse
gccgatcgagagcgaggagc

SEQ ID NO: 630349 - DNA, 20 bp, mouse
gtgagcctggatgcaaatct

SEQ ID NO: 630350 - DNA, 20 bp, mouse
gagagatccgatcgagagcg

SEQ ID NO: 630351 - DNA, 20 bp, mouse
gaggcagggagaagccgagt

SEQ ID NO: 630352 - DNA, 20 bp, mouse
gctggatgcaaatctgggtg

SEQ ID NO: 630353 - DNA, 20 bp, mouse
gccgaggtggaccagaggca

SEQ ID NO: 630354 - DNA, 20 bp, mouse
gggaagtgcggttcgcagag

SEQ ID NO: 630355 - DNA, 20 bp, mouse
gaacgtctgcagacgggatg

SEQ ID NO: 630356 - DNA, 20 bp, mouse
gcagcactctcacccaactt

SEQ ID NO: 630357 - DNA, 20 bp, mouse
gtccataaagatactggtca

SEQ ID NO: 630358 - DNA, 20 bp, mouse
gcgaggtgcggggatccatc

SEQ ID NO: 630359 - DNA, 20 bp, mouse
gcacaacgcgagtctaccgt

SEQ ID NO: 630360 - DNA, 20 bp, mouse
gagttgcatcgctgacgtag

SEQ ID NO: 630361 - DNA, 20 bp, mouse
gttctgacaaacatcaatca

SEQ ID NO: 630362 - DNA, 20 bp, mouse
ggagtagagcagcgatgggt

SEQ ID NO: 630363 - DNA, 20 bp, mouse
gtcgtcacagggacctgctc

SEQ ID NO: 630364 - DNA, 20 bp, mouse
ggcacctcgaacaatgcctc

SEQ ID NO: 630365 - DNA, 20 bp, mouse
gcagcgagtagagcagcgat

SEQ ID NO: 630366 - DNA, 20 bp, mouse
ggcggtaggagcgagcttcc

SEQ ID NO: 630367 - DNA, 20 bp, mouse
gccctgacgagcgccgcggt

SEQ ID NO: 630368 - DNA, 20 bp, mouse
gctctgggtgtgggtcggag

SEQ ID NO: 630369 - DNA, 20 bp, mouse
ggcaggggcgcgaggggcga

SEQ ID NO: 630370 - DNA, 20 bp, mouse
gcttccgggcagctccgggc

SEQ ID NO: 630371 - DNA, 20 bp, mouse
gtgaacggtgctctttctca

SEQ ID NO: 630372 - DNA, 20 bp, mouse
gcgagcttccgggcagctcc

SEQ ID NO: 630373 - DNA, 20 bp, mouse
gcgccggggacgcgggtcgg

SEQ ID NO: 630374 - DNA, 20 bp, mouse
gtgtagcgggcgtttctgaa

SEQ ID NO: 630375 - DNA, 20 bp, mouse
gctagaggtccccagacgag

SEQ ID NO: 630376 - DNA, 20 bp, mouse
ggcgccggtagagctcacaa

SEQ ID NO: 630377 - DNA, 20 bp, mouse
gctcggcgccgaggcagatc

SEQ ID NO: 630378 - DNA, 20 bp, mouse
ggggccggggctcgatctcg

SEQ ID NO: 630379 - DNA, 20 bp, mouse
gggtagagctcacaaaggcg

SEQ ID NO: 630380 - DNA, 20 bp, mouse
gcgccgagtgagaggtgacg

SEQ ID NO: 630381 - DNA, 20 bp, mouse
ggccccggccagatctgcct

SEQ ID NO: 630382 - DNA, 20 bp, mouse
ggccgaggcagatctggccg

SEQ ID NO: 630383 - DNA, 20 bp, mouse
ggcgccgcgagatcgagccc

SEQ ID NO: 630384 - DNA, 20 bp, mouse
gtgagaggtgacgaggactg

SEQ ID NO: 630385 - DNA, 20 bp, mouse
gccgcgcaagggcctctggg

SEQ ID NO: 630386 - DNA, 20 bp, mouse
ggacgctccaggcttctcca

SEQ ID NO: 630387 - DNA, 20 bp, mouse
ggttgcacgccgggatctcc

SEQ ID NO: 630388 - DNA, 20 bp, mouse
gtggagcgtcccggagatcc

SEQ ID NO: 630389 - DNA, 20 bp, mouse
gagatcccggcgtgcaactc

SEQ ID NO: 630390 - DNA, 20 bp, mouse
ggcagctctgagaaagtcag

SEQ ID NO: 630391 - DNA, 20 bp, mouse
ggctggcccgagttgcacgc

SEQ ID NO: 630392 - DNA, 20 bp, mouse
gtggctccggtcttactctg

SEQ ID NO: 630393 - DNA, 20 bp, mouse
gctggactcggttttctgat

SEQ ID NO: 630394 - DNA, 20 bp, mouse
gcttgtgggagtgcccacgt

SEQ ID NO: 630395 - DNA, 20 bp, mouse
gtatctgagagcatgctcaa

SEQ ID NO: 630396 - DNA, 20 bp, mouse
gggctgcgggagccacaaca

SEQ ID NO: 630397 - DNA, 20 bp, mouse
gcagcgacaggccccgggct

SEQ ID NO: 630398 - DNA, 20 bp, mouse
ggcggggggcgcttacctgg

SEQ ID NO: 630399 - DNA, 20 bp, mouse
gccctgcccgccgccccagg

SEQ ID NO: 630400 - DNA, 20 bp, mouse
gcccgcctggcggcgatcgg

SEQ ID NO: 630401 - DNA, 20 bp, mouse
gagccacaacatggcgacgg

SEQ ID NO: 630402 - DNA, 20 bp, mouse
ggccccccgccgcctggacg

SEQ ID NO: 630403 - DNA, 20 bp, mouse
gtggcctcgccccgtccagg

SEQ ID NO: 630404 - DNA, 20 bp, mouse
gtggtggcctcgccccgtcc

SEQ ID NO: 630405 - DNA, 20 bp, mouse
gccggcccaggcagggataa

SEQ ID NO: 630406 - DNA, 20 bp, mouse
gcggaagcgccaacacgtgt

SEQ ID NO: 630407 - DNA, 20 bp, mouse
ggaccaagaaacagggagta

SEQ ID NO: 630408 - DNA, 20 bp, mouse
gggtctgaggtactagctag

SEQ ID NO: 630409 - DNA, 20 bp, mouse
ggatcatgggtcgctctcgg

SEQ ID NO: 630410 - DNA, 20 bp, mouse
gggaaaagacccacacgtgt

SEQ ID NO: 630411 - DNA, 20 bp, mouse
gcccaagccggagccggacg

SEQ ID NO: 630412 - DNA, 20 bp, mouse
gtcgcgagctgaggccgcag

SEQ ID NO: 630413 - DNA, 20 bp, mouse
gctctcgtgacgtcactggg

SEQ ID NO: 630414 - DNA, 20 bp, mouse
gcccctggcaggtccgggtc

SEQ ID NO: 630415 - DNA, 20 bp, mouse
gtaagtggcgggttgaccca

SEQ ID NO: 630416 - DNA, 20 bp, mouse
gatgtcagagatccaaacga

SEQ ID NO: 630417 - DNA, 20 bp, mouse
gttaacttctccccagagtt

SEQ ID NO: 630418 - DNA, 20 bp, mouse
ggttgtgctgacctaggcta

SEQ ID NO: 630419 - DNA, 20 bp, mouse
gtccaaacgaaggtttcaac

SEQ ID NO: 630420 - DNA, 20 bp, mouse
gctgggcttgttatgagaca

SEQ ID NO: 630421 - DNA, 20 bp, mouse
gtagatagaacacagagtat

SEQ ID NO: 630422 - DNA, 20 bp, mouse
gtcctgttgaaaccttcgtt

SEQ ID NO: 630423 - DNA, 20 bp, mouse
gatagaacacagagtatagg

SEQ ID NO: 630424 - DNA, 20 bp, mouse
gacagtccctcagatctgca

SEQ ID NO: 630425 - DNA, 20 bp, mouse
gctgtgcagggtggcgtatc

SEQ ID NO: 630426 - DNA, 20 bp, mouse
gtaagcttctccccaaagtt

SEQ ID NO: 630427 - DNA, 20 bp, mouse
gactacagctatgtaggcac

SEQ ID NO: 630428 - DNA, 20 bp, mouse
gtgagatcaaactggagtag

SEQ ID NO: 630429 - DNA, 20 bp, mouse
gtcctgttgagcactgcgtt

SEQ ID NO: 630430 - DNA, 20 bp, mouse
gatcaaactggagtagtgga

SEQ ID NO: 630431 - DNA, 20 bp, mouse
gcctggacatcaagaacttt

SEQ ID NO: 630432 - DNA, 20 bp, mouse
gaagatttgtgagatcaaac

SEQ ID NO: 630433 - DNA, 20 bp, mouse
gaagatgatttgagctgacc

SEQ ID NO: 630434 - DNA, 20 bp, mouse
gtgtgagggtgattgtttta

SEQ ID NO: 630435 - DNA, 20 bp, mouse
gaatctgactacagctatgt

SEQ ID NO: 630436 - DNA, 20 bp, mouse
ggcacgcaagggcagctggg

SEQ ID NO: 630437 - DNA, 20 bp, mouse
gtgtccacgcatgcacgcaa

SEQ ID NO: 630438 - DNA, 20 bp, mouse
ggtgcatgcgtggacaccgg

SEQ ID NO: 630439 - DNA, 20 bp, mouse
gaagcctcccgcactggcgg

SEQ ID NO: 630440 - DNA, 20 bp, mouse
gccgaagcctcccgcactgg

SEQ ID NO: 630441 - DNA, 20 bp, mouse
gctcccgaagcctcccgcac

SEQ ID NO: 630442 - DNA, 20 bp, mouse
gcatgcacgcaagggcagct

SEQ ID NO: 630443 - DNA, 20 bp, mouse
ggccgtgcgtctcaggacta

SEQ ID NO: 630444 - DNA, 20 bp, mouse
gcgcgctgacagccacagaa

SEQ ID NO: 630445 - DNA, 20 bp, mouse
gtaatactaacctccagtgg

SEQ ID NO: 630446 - DNA, 20 bp, mouse
gcggagcccggccatggcgg

SEQ ID NO: 630447 - DNA, 20 bp, mouse
gcacctggcgcagctcctcg

SEQ ID NO: 630448 - DNA, 20 bp, mouse
gggccggagcccggccatgg

SEQ ID NO: 630449 - DNA, 20 bp, mouse
gctgagggcagtgacgtcga

SEQ ID NO: 630450 - DNA, 20 bp, mouse
ggcagtgacgtcgacggaag

SEQ ID NO: 630451 - DNA, 20 bp, mouse
gagagccgcgcgccgcccct

SEQ ID NO: 630452 - DNA, 20 bp, mouse
gtagagcaccggtagcacac

SEQ ID NO: 630453 - DNA, 20 bp, mouse
gagcgcggcctggctcccgg

SEQ ID NO: 630454 - DNA, 20 bp, mouse
gccgcatcttggtagagcac

SEQ ID NO: 630455 - DNA, 20 bp, mouse
ggggggccggagcccggcca

SEQ ID NO: 630456 - DNA, 20 bp, mouse
gtccaacacggagaacatgt

SEQ ID NO: 630457 - DNA, 20 bp, mouse
gacctggacaggatccaaca

SEQ ID NO: 630458 - DNA, 20 bp, mouse
gccgcagcccggggacaaag

SEQ ID NO: 630459 - DNA, 20 bp, mouse
gctcgcccagaagtccggag

SEQ ID NO: 630460 - DNA, 20 bp, mouse
ggcggcaggcagaacctctc

SEQ ID NO: 630461 - DNA, 20 bp, mouse
gggagaacatgtgggacagt

SEQ ID NO: 630462 - DNA, 20 bp, mouse
gccgcgctcgcccagaagtc

SEQ ID NO: 630463 - DNA, 20 bp, mouse
gagaacctctccggacttct

SEQ ID NO: 630464 - DNA, 20 bp, mouse
gcccagggacaggatcgtct

SEQ ID NO: 630465 - DNA, 20 bp, mouse
gacatgtgggacagtggggc

SEQ ID NO: 630466 - DNA, 20 bp, mouse
gagagtaaggccgggagtcc

SEQ ID NO: 630467 - DNA, 20 bp, mouse
ggtctctgcagagtaaggcc

SEQ ID NO: 630468 - DNA, 20 bp, mouse
gctggcggcgctatagcgga

SEQ ID NO: 630469 - DNA, 20 bp, mouse
gaggccgggagtccgggtgt

SEQ ID NO: 630470 - DNA, 20 bp, mouse
gcttcggtctctgcagagta

SEQ ID NO: 630471 - DNA, 20 bp, mouse
gacacccacacccggactcc

SEQ ID NO: 630472 - DNA, 20 bp, mouse
ggccagtaggccaccctcgg

SEQ ID NO: 630473 - DNA, 20 bp, mouse
ggcttcactgaggagaggtg

SEQ ID NO: 630474 - DNA, 20 bp, mouse
gggcgctatagcggacggtc

SEQ ID NO: 630475 - DNA, 20 bp, mouse
gtgccctggcggcgctatag

SEQ ID NO: 630476 - DNA, 20 bp, mouse
gatatcaatgaagtcatggt

SEQ ID NO: 630477 - DNA, 20 bp, mouse
gcatcacagcacagcatggt

SEQ ID NO: 630478 - DNA, 20 bp, mouse
gagcatggtgggctgaacct

SEQ ID NO: 630479 - DNA, 20 bp, mouse
ggaagaggaggacagaagac

SEQ ID NO: 630480 - DNA, 20 bp, mouse
gggttggataggtactttct

SEQ ID NO: 630481 - DNA, 20 bp, mouse
gccaagcaatacagaagagg

SEQ ID NO: 630482 - DNA, 20 bp, mouse
gaaatcatcacagcacagca

SEQ ID NO: 630483 - DNA, 20 bp, mouse
gtacttactgaattactgtc

SEQ ID NO: 630484 - DNA, 20 bp, mouse
gtttccaagcaatacagaag

SEQ ID NO: 630485 - DNA, 20 bp, mouse
gataagtggaaatttttcta

SEQ ID NO: 630486 - DNA, 20 bp, mouse
gagtcggtgtggcccagtag

SEQ ID NO: 630487 - DNA, 20 bp, mouse
gtctgtcactagcttcacta

SEQ ID NO: 630488 - DNA, 20 bp, mouse
gaacagctgcagagtcggtg

SEQ ID NO: 630489 - DNA, 20 bp, mouse
ggacctaacagctgcagagt

SEQ ID NO: 630490 - DNA, 20 bp, mouse
gcagggtgcagcatcagtaa

SEQ ID NO: 630491 - DNA, 20 bp, mouse
ggtgcggagccattggagag

SEQ ID NO: 630492 - DNA, 20 bp, mouse
gcaccctgtcagggacaata

SEQ ID NO: 630493 - DNA, 20 bp, mouse
gttgcgcatgcgcagaatgg

SEQ ID NO: 630494 - DNA, 20 bp, mouse
ggggccctgagcactcttga

SEQ ID NO: 630495 - DNA, 20 bp, mouse
gtttggtaaggattaaggtg

SEQ ID NO: 630496 - DNA, 20 bp, mouse
gctctccgtgacaacgacat

SEQ ID NO: 630497 - DNA, 20 bp, mouse
gggccttattccggaccgaa

SEQ ID NO: 630498 - DNA, 20 bp, mouse
gccggaataaggccttactt

SEQ ID NO: 630499 - DNA, 20 bp, mouse
gagcccttcggtccggaata

SEQ ID NO: 630500 - DNA, 20 bp, mouse
gcatcggtagcccttcggtc

SEQ ID NO: 630501 - DNA, 20 bp, mouse
ggagtcggcgagagaagaga

SEQ ID NO: 630502 - DNA, 20 bp, mouse
gattgtccgcggccaaagta

SEQ ID NO: 630503 - DNA, 20 bp, mouse
ggtgcggccgccattgtccg

SEQ ID NO: 630504 - DNA, 20 bp, mouse
gggagggtcgagggcaatgg

SEQ ID NO: 630505 - DNA, 20 bp, mouse
gagtggccgcgagccaggta

SEQ ID NO: 630506 - DNA, 20 bp, mouse
gcggagatccgagaagccca

SEQ ID NO: 630507 - DNA, 20 bp, mouse
gctcggatctccggtagcga

SEQ ID NO: 630508 - DNA, 20 bp, mouse
gccaccatggcaagaagtag

SEQ ID NO: 630509 - DNA, 20 bp, mouse
gatggcaagaagtagtggat

SEQ ID NO: 630510 - DNA, 20 bp, mouse
gtgggtgtggatgtggaccg

SEQ ID NO: 630511 - DNA, 20 bp, mouse
ggaggcccagagttgagcat

SEQ ID NO: 630512 - DNA, 20 bp, mouse
gcaggccggaagagtctcca

SEQ ID NO: 630513 - DNA, 20 bp, mouse
ggaagtagtggataggctct

SEQ ID NO: 630514 - DNA, 20 bp, mouse
ggcgagggctgtagttttca

SEQ ID NO: 630515 - DNA, 20 bp, mouse
gaaactacagccctcgctac

SEQ ID NO: 630516 - DNA, 20 bp, mouse
gcaagcttgttctggaacag

SEQ ID NO: 630517 - DNA, 20 bp, mouse
gaacacaacacacgcacagg

SEQ ID NO: 630518 - DNA, 20 bp, mouse
gacagggggagtggagccaa

SEQ ID NO: 630519 - DNA, 20 bp, mouse
gacacacaccaagcttgttc

SEQ ID NO: 630520 - DNA, 20 bp, mouse
gtgaaacacaacacacgcac

SEQ ID NO: 630521 - DNA, 20 bp, mouse
gcaaaacacagaaatccccc

SEQ ID NO: 630522 - DNA, 20 bp, mouse
gccgtacttacggtctgtat

SEQ ID NO: 630523 - DNA, 20 bp, mouse
gtataaaaaaatacacggga

SEQ ID NO: 630524 - DNA, 20 bp, mouse
gtataatttccaaaataaag

SEQ ID NO: 630525 - DNA, 20 bp, mouse
gtcagcctgtatacctgaaa

SEQ ID NO: 630526 - DNA, 20 bp, mouse
gggcccgggacgcgtagcag

SEQ ID NO: 630527 - DNA, 20 bp, mouse
gccgcgatccgggacaacca

SEQ ID NO: 630528 - DNA, 20 bp, mouse
gcgcccggcggaggaagtgg

SEQ ID NO: 630529 - DNA, 20 bp, mouse
gggggccgcggcccagatgg

SEQ ID NO: 630530 - DNA, 20 bp, mouse
ggcgtcccgggccgccatct

SEQ ID NO: 630531 - DNA, 20 bp, mouse
gggaggggccgcggcccaga

SEQ ID NO: 630532 - DNA, 20 bp, mouse
gcagggcagcctggaagacc

SEQ ID NO: 630533 - DNA, 20 bp, mouse
gtcaccgcgcggccggtccc

SEQ ID NO: 630534 - DNA, 20 bp, mouse
gcaggccagagagttttcgg

SEQ ID NO: 630535 - DNA, 20 bp, mouse
gcaccactgctacgcgtccc

SEQ ID NO: 630536 - DNA, 20 bp, mouse
gcggaattctgggaactcgt

SEQ ID NO: 630537 - DNA, 20 bp, mouse
ggtctgagggcagggagagt

SEQ ID NO: 630538 - DNA, 20 bp, mouse
gatctagcgggtcattctgg

SEQ ID NO: 630539 - DNA, 20 bp, mouse
gaaaataactcaaatccagg

SEQ ID NO: 630540 - DNA, 20 bp, mouse
gcagggggacagatggctac

SEQ ID NO: 630541 - DNA, 20 bp, mouse
ggccggaagagggggtctga

SEQ ID NO: 630542 - DNA, 20 bp, mouse
gagcagcggcgagctccgga

SEQ ID NO: 630543 - DNA, 20 bp, mouse
gcggagagcgctactaactg

SEQ ID NO: 630544 - DNA, 20 bp, mouse
ggaccagagaaggagattga

SEQ ID NO: 630545 - DNA, 20 bp, mouse
gctgctgcgggccggaagag

SEQ ID NO: 630546 - DNA, 20 bp, mouse
ggacacaccgcgaaccgcaa

SEQ ID NO: 630547 - DNA, 20 bp, mouse
gcttggcggacagcacgcag

SEQ ID NO: 630548 - DNA, 20 bp, mouse
gggtgagtgcggacccattg

SEQ ID NO: 630549 - DNA, 20 bp, mouse
gcaagtctccgtgtccacag

SEQ ID NO: 630550 - DNA, 20 bp, mouse
ggctgtgtcacttcacagag

SEQ ID NO: 630551 - DNA, 20 bp, mouse
gggagacttggtggcccgcg

SEQ ID NO: 630552 - DNA, 20 bp, mouse
gagcgtcaccgctgtggaca

SEQ ID NO: 630553 - DNA, 20 bp, mouse
ggggctccaggcagggtgaa

SEQ ID NO: 630554 - DNA, 20 bp, mouse
ggctcccgcagccagcctcg

SEQ ID NO: 630555 - DNA, 20 bp, mouse
gcggctcgaggtgacatcgc

SEQ ID NO: 630556 - DNA, 20 bp, mouse
ggctattcctgagagaactc

SEQ ID NO: 630557 - DNA, 20 bp, mouse
gcacaagtatttggacttaa

SEQ ID NO: 630558 - DNA, 20 bp, mouse
gttatgaacaaaggagatat

SEQ ID NO: 630559 - DNA, 20 bp, mouse
gatgcaacaatgttctacac

SEQ ID NO: 630560 - DNA, 20 bp, mouse
gataaatgcttcagggaagt

SEQ ID NO: 630561 - DNA, 20 bp, mouse
gctacttgataaatgcttca

SEQ ID NO: 630562 - DNA, 20 bp, mouse
gagcatttatcaagtagtat

SEQ ID NO: 630563 - DNA, 20 bp, mouse
gacccaaatgtcactcttta

SEQ ID NO: 630564 - DNA, 20 bp, mouse
gaagaaataacacaagtatt

SEQ ID NO: 630565 - DNA, 20 bp, mouse
gactgagaatctactacaaa

SEQ ID NO: 630566 - DNA, 20 bp, mouse
gcgaccccaaactccctcag

SEQ ID NO: 630567 - DNA, 20 bp, mouse
gcagtccgctgagggagttt

SEQ ID NO: 630568 - DNA, 20 bp, mouse
gacctcaggccgctccaccc

SEQ ID NO: 630569 - DNA, 20 bp, mouse
gactgagagagcagtgacaa

SEQ ID NO: 630570 - DNA, 20 bp, mouse
ggcagcctcacgcggctcca

SEQ ID NO: 630571 - DNA, 20 bp, mouse
gtccaccctggagccgcgtg

SEQ ID NO: 630572 - DNA, 20 bp, mouse
ggacctcaagcagcctcacg

SEQ ID NO: 630573 - DNA, 20 bp, mouse
gtccctcggtacgggaacca

SEQ ID NO: 630574 - DNA, 20 bp, mouse
gtctcagtccagtccgctga

SEQ ID NO: 630575 - DNA, 20 bp, mouse
gggacgggcctgggaaccga

SEQ ID NO: 630576 - DNA, 20 bp, mouse
gtgctgcgccgggggacgaa

SEQ ID NO: 630577 - DNA, 20 bp, mouse
gtcccgccgcccgggaccaa

SEQ ID NO: 630578 - DNA, 20 bp, mouse
gaatcagcagcgccggcggg

SEQ ID NO: 630579 - DNA, 20 bp, mouse
gtagcaggcagcctagccac

SEQ ID NO: 630580 - DNA, 20 bp, mouse
ggcgcggcgcccttggtccc

SEQ ID NO: 630581 - DNA, 20 bp, mouse
gtgcgccgggggacgaaggg

SEQ ID NO: 630582 - DNA, 20 bp, mouse
ggaacttccgctcctcccgc

SEQ ID NO: 630583 - DNA, 20 bp, mouse
gacatggtgagccaggcgag

SEQ ID NO: 630584 - DNA, 20 bp, mouse
gggctgcgcactgtcgcctg

SEQ ID NO: 630585 - DNA, 20 bp, mouse
gcggcgcccttggtcccggg

SEQ ID NO: 630586 - DNA, 20 bp, mouse
gggaggagcaggacgcgccg

SEQ ID NO: 630587 - DNA, 20 bp, mouse
ggaccgatgagccagccgga

SEQ ID NO: 630588 - DNA, 20 bp, mouse
ggctcatcggtccgtgcggg

SEQ ID NO: 630589 - DNA, 20 bp, mouse
gctggctcatcggtccgtgc

SEQ ID NO: 630590 - DNA, 20 bp, mouse
gcgccgtccggctggctcat

SEQ ID NO: 630591 - DNA, 20 bp, mouse
ggcggcggccgaggctaatg

SEQ ID NO: 630592 - DNA, 20 bp, mouse
gcgccccgcagcgtcccggg

SEQ ID NO: 630593 - DNA, 20 bp, mouse
gcgcggcccccagctcggac

SEQ ID NO: 630594 - DNA, 20 bp, mouse
gccgcagcagccccgcggga

SEQ ID NO: 630595 - DNA, 20 bp, mouse
gggtgcgggagcggcccccc

SEQ ID NO: 630596 - DNA, 20 bp, mouse
gctcgcaagcgcggctcaag

SEQ ID NO: 630597 - DNA, 20 bp, mouse
ggcactctccccacaggtcc

SEQ ID NO: 630598 - DNA, 20 bp, mouse
gtacgcaagcgcggcccgag

SEQ ID NO: 630599 - DNA, 20 bp, mouse
gaggggaacccggagcatgg

SEQ ID NO: 630600 - DNA, 20 bp, mouse
ggggagagtgcagtcgagat

SEQ ID NO: 630601 - DNA, 20 bp, mouse
gtgctccgggttccccttta

SEQ ID NO: 630602 - DNA, 20 bp, mouse
ggtcctcagacggggaggag

SEQ ID NO: 630603 - DNA, 20 bp, mouse
ggcagcggagctcgcaagcg

SEQ ID NO: 630604 - DNA, 20 bp, mouse
ggcggagctgaccagagccg

SEQ ID NO: 630605 - DNA, 20 bp, mouse
gtcacccgaaaaggcgagag

SEQ ID NO: 630606 - DNA, 20 bp, mouse
gcagcccgggactcacgtac

SEQ ID NO: 630607 - DNA, 20 bp, mouse
gactcacgtactggctgtgg

SEQ ID NO: 630608 - DNA, 20 bp, mouse
ggcgcgccgggcccgaacca

SEQ ID NO: 630609 - DNA, 20 bp, mouse
gcagccagtacgtgagtccc

SEQ ID NO: 630610 - DNA, 20 bp, mouse
gtcctagaggacgctcccca

SEQ ID NO: 630611 - DNA, 20 bp, mouse
ggcgtcctctaggagtgaag

SEQ ID NO: 630612 - DNA, 20 bp, mouse
gggacccgcccgggaccgga

SEQ ID NO: 630613 - DNA, 20 bp, mouse
gcggggagaggcgggagcgt

SEQ ID NO: 630614 - DNA, 20 bp, mouse
gcaggccctgggccgaggaa

SEQ ID NO: 630615 - DNA, 20 bp, mouse
gggaaagacccgagccgcag

SEQ ID NO: 630616 - DNA, 20 bp, mouse
gtcctggctgtgggcgaagg

SEQ ID NO: 630617 - DNA, 20 bp, mouse
gcagcgggcgcactacaaga

SEQ ID NO: 630618 - DNA, 20 bp, mouse
ggcttccgggctctaagtga

SEQ ID NO: 630619 - DNA, 20 bp, mouse
gcgtttgtgggactagaagg

SEQ ID NO: 630620 - DNA, 20 bp, mouse
gggcgcactacaagacggac

SEQ ID NO: 630621 - DNA, 20 bp, mouse
gctggcaccgctacaacctg

SEQ ID NO: 630622 - DNA, 20 bp, mouse
gcttgcgccgcaggttgtag

SEQ ID NO: 630623 - DNA, 20 bp, mouse
ggactagaaggcggccggtc

SEQ ID NO: 630624 - DNA, 20 bp, mouse
ggaaccacctcggctcccgg

SEQ ID NO: 630625 - DNA, 20 bp, mouse
ggagccgaggtggttctcgt

SEQ ID NO: 630626 - DNA, 20 bp, mouse
gcatccaggcgggtaacccc

SEQ ID NO: 630627 - DNA, 20 bp, mouse
gaccaagccgagcagcatcc

SEQ ID NO: 630628 - DNA, 20 bp, mouse
gtcactcacccggagctcgg

SEQ ID NO: 630629 - DNA, 20 bp, mouse
gaagccgagcagcatccagg

SEQ ID NO: 630630 - DNA, 20 bp, mouse
gccgcccggaggacatccgt

SEQ ID NO: 630631 - DNA, 20 bp, mouse
gccaggcgggtaaccccggg

SEQ ID NO: 630632 - DNA, 20 bp, mouse
ggagctcggcggcgagagga

SEQ ID NO: 630633 - DNA, 20 bp, mouse
ggcaccgctgccgcacgccc

SEQ ID NO: 630634 - DNA, 20 bp, mouse
gcggccggggcgtgcggcag

SEQ ID NO: 630635 - DNA, 20 bp, mouse
gcgaaccaagcgaggagcta

SEQ ID NO: 630636 - DNA, 20 bp, mouse
gcctcccggccagctttcac

SEQ ID NO: 630637 - DNA, 20 bp, mouse
gtggcaaaggcagacccctt

SEQ ID NO: 630638 - DNA, 20 bp, mouse
gactggtgctaaaaccgtct

SEQ ID NO: 630639 - DNA, 20 bp, mouse
gacttgccagcaagcccaag

SEQ ID NO: 630640 - DNA, 20 bp, mouse
ggcaccagtgaaagctggcc

SEQ ID NO: 630641 - DNA, 20 bp, mouse
gccctgccaagctaggtagc

SEQ ID NO: 630642 - DNA, 20 bp, mouse
gttttagcaccagtgaaagc

SEQ ID NO: 630643 - DNA, 20 bp, mouse
gagggagctgaccctctcta

SEQ ID NO: 630644 - DNA, 20 bp, mouse
gccctgggctggagttatag

SEQ ID NO: 630645 - DNA, 20 bp, mouse
gaccctctctagggcctctt

SEQ ID NO: 630646 - DNA, 20 bp, mouse
gcgcgagaggccgccgataa

SEQ ID NO: 630647 - DNA, 20 bp, mouse
gggcactcaacctttatcgg

SEQ ID NO: 630648 - DNA, 20 bp, mouse
gccacaggtgagagaccgga

SEQ ID NO: 630649 - DNA, 20 bp, mouse
ggcgagcgggaaaccggaag

SEQ ID NO: 630650 - DNA, 20 bp, mouse
gggggcgcgctccctcccca

SEQ ID NO: 630651 - DNA, 20 bp, mouse
gcgaggcactcaacctttat

SEQ ID NO: 630652 - DNA, 20 bp, mouse
ggcgtcatgacgcacgaagg

SEQ ID NO: 630653 - DNA, 20 bp, mouse
gtgacgcacgaaggcggcgg

SEQ ID NO: 630654 - DNA, 20 bp, mouse
gtcatgacgcacgaaggcgg

SEQ ID NO: 630655 - DNA, 20 bp, mouse
ggctccctccccacggcccc

SEQ ID NO: 630656 - DNA, 20 bp, mouse
gctagatgccgggaactcta

SEQ ID NO: 630657 - DNA, 20 bp, mouse
gggacccggggaccagttca

SEQ ID NO: 630658 - DNA, 20 bp, mouse
gattccaggctgaggacccg

SEQ ID NO: 630659 - DNA, 20 bp, mouse
gagaaggaccctagagttcc

SEQ ID NO: 630660 - DNA, 20 bp, mouse
gggaccagttcagggtgact

SEQ ID NO: 630661 - DNA, 20 bp, mouse
gcagccgccggggaacaata

SEQ ID NO: 630662 - DNA, 20 bp, mouse
gcttctcaaggggtgattcc

SEQ ID NO: 630663 - DNA, 20 bp, mouse
ggcatctagcccgtcccccg

SEQ ID NO: 630664 - DNA, 20 bp, mouse
gcttaagtgccctgcctcgg

SEQ ID NO: 630665 - DNA, 20 bp, mouse
gtcaccctgaactggtcccc

SEQ ID NO: 630666 - DNA, 20 bp, mouse
gtcagcaacactcaccgcag

SEQ ID NO: 630667 - DNA, 20 bp, mouse
ggcccgcagacagacaaagc

SEQ ID NO: 630668 - DNA, 20 bp, mouse
gcgctggtcggagagcgggt

SEQ ID NO: 630669 - DNA, 20 bp, mouse
gctgcgggcgcgcgccgctg

SEQ ID NO: 630670 - DNA, 20 bp, mouse
ggtgagtgttgctgaggccg

SEQ ID NO: 630671 - DNA, 20 bp, mouse
gggctgtgcgcccgagagag

SEQ ID NO: 630672 - DNA, 20 bp, mouse
ggcagcggctgctacgggct

SEQ ID NO: 630673 - DNA, 20 bp, mouse
gacagacagggtgatctgta

SEQ ID NO: 630674 - DNA, 20 bp, mouse
gaatcgccaaccgcagacaa

SEQ ID NO: 630675 - DNA, 20 bp, mouse
ggccggctttgtctgtctgc

SEQ ID NO: 630676 - DNA, 20 bp, mouse
ggcgcatgcgcggggtgacg

SEQ ID NO: 630677 - DNA, 20 bp, mouse
gacacgcccggatgatggga

SEQ ID NO: 630678 - DNA, 20 bp, mouse
gcccggatgatgggacggag

SEQ ID NO: 630679 - DNA, 20 bp, mouse
ggccgctcgggtggactcgg

SEQ ID NO: 630680 - DNA, 20 bp, mouse
gcgagacacgcccggatgat

SEQ ID NO: 630681 - DNA, 20 bp, mouse
ggccgccgagtccacccgag

SEQ ID NO: 630682 - DNA, 20 bp, mouse
gacccggccctgagtcctca

SEQ ID NO: 630683 - DNA, 20 bp, mouse
ggggcctgcgtgccaagcga

SEQ ID NO: 630684 - DNA, 20 bp, mouse
gtagcctaggctagccggaa

SEQ ID NO: 630685 - DNA, 20 bp, mouse
gtgacggggtgagtgctgct

SEQ ID NO: 630686 - DNA, 20 bp, mouse
ggtccccgcctcacagagtt

SEQ ID NO: 630687 - DNA, 20 bp, mouse
ggctggtgcgggaaatatgc

SEQ ID NO: 630688 - DNA, 20 bp, mouse
ggccagcgccctctaggcag

SEQ ID NO: 630689 - DNA, 20 bp, mouse
gggaatgagcgtctccagga

SEQ ID NO: 630690 - DNA, 20 bp, mouse
ggccctctaggcagcggaag

SEQ ID NO: 630691 - DNA, 20 bp, mouse
gtaatgtagagcgagccgtg

SEQ ID NO: 630692 - DNA, 20 bp, mouse
gatcccggggtgctccccta

SEQ ID NO: 630693 - DNA, 20 bp, mouse
gtgctcccctagggcagatc

SEQ ID NO: 630694 - DNA, 20 bp, mouse
gcaaggggccagcgccctct

SEQ ID NO: 630695 - DNA, 20 bp, mouse
gccagtcggcgtgtcaggtc

SEQ ID NO: 630696 - DNA, 20 bp, mouse
gcagcaagcgacaagcgaca

SEQ ID NO: 630697 - DNA, 20 bp, mouse
gacgccaaggggccgagccg

SEQ ID NO: 630698 - DNA, 20 bp, mouse
ggctgtggcgacaggagtgt

SEQ ID NO: 630699 - DNA, 20 bp, mouse
gagcctggccgtgggaacag

SEQ ID NO: 630700 - DNA, 20 bp, mouse
gcaccacggagccccggaag

SEQ ID NO: 630701 - DNA, 20 bp, mouse
gaagcgacaagcgacagggc

SEQ ID NO: 630702 - DNA, 20 bp, mouse
gggcgggaggtaacgccaag

SEQ ID NO: 630703 - DNA, 20 bp, mouse
gactcgggaactggctaagt

SEQ ID NO: 630704 - DNA, 20 bp, mouse
gacgcccacgcaagtgacag

SEQ ID NO: 630705 - DNA, 20 bp, mouse
ggacaggagtgtgggtccag

SEQ ID NO: 630706 - DNA, 20 bp, mouse
gaccaaactgtgagtttcgg

SEQ ID NO: 630707 - DNA, 20 bp, mouse
ggccgcacaggctaagatgg

SEQ ID NO: 630708 - DNA, 20 bp, mouse
gtgccgtgtgcgtcaaaccg

SEQ ID NO: 630709 - DNA, 20 bp, mouse
gtggctcccaaccctcggaa

SEQ ID NO: 630710 - DNA, 20 bp, mouse
gtgccaatcagacccacggg

SEQ ID NO: 630711 - DNA, 20 bp, mouse
gagcccggacgtccgaaacg

SEQ ID NO: 630712 - DNA, 20 bp, mouse
gcgccccggtttgacgcaca

SEQ ID NO: 630713 - DNA, 20 bp, mouse
gagccgagtagcgtacagag

SEQ ID NO: 630714 - DNA, 20 bp, mouse
gacccccgaaactcacagtt

SEQ ID NO: 630715 - DNA, 20 bp, mouse
ggagtttcgggggtcttatt

SEQ ID NO: 630716 - DNA, 20 bp, mouse
ggcggaactgggctagactc

SEQ ID NO: 630717 - DNA, 20 bp, mouse
gggagtggtagctgagggaa

SEQ ID NO: 630718 - DNA, 20 bp, mouse
gcagccagggtacccgggag

SEQ ID NO: 630719 - DNA, 20 bp, mouse
gacccgggagtggtagctga

SEQ ID NO: 630720 - DNA, 20 bp, mouse
gtaacaataggaagtgtccg

SEQ ID NO: 630721 - DNA, 20 bp, mouse
ggccggcggcgggaaccaga

SEQ ID NO: 630722 - DNA, 20 bp, mouse
gtgcagccgcgagccataag

SEQ ID NO: 630723 - DNA, 20 bp, mouse
gtaggaagtgtccgcggaac

SEQ ID NO: 630724 - DNA, 20 bp, mouse
gtggctcgcggctgcagtta

SEQ ID NO: 630725 - DNA, 20 bp, mouse
ggtccgttggaggtcgtgaa

SEQ ID NO: 630726 - DNA, 20 bp, mouse
ggccacagggcgagaggttg

SEQ ID NO: 630727 - DNA, 20 bp, mouse
gagccgaagctgccgccaca

SEQ ID NO: 630728 - DNA, 20 bp, mouse
gggttgcggcagatggtgag

SEQ ID NO: 630729 - DNA, 20 bp, mouse
gatggtgagtggcgctctgt

SEQ ID NO: 630730 - DNA, 20 bp, mouse
ggctgccgccacagggcgag

SEQ ID NO: 630731 - DNA, 20 bp, mouse
ggccgcaacctctcgccctg

SEQ ID NO: 630732 - DNA, 20 bp, mouse
gttgggtgcggatgaaggag

SEQ ID NO: 630733 - DNA, 20 bp, mouse
gcgccctgtggcggcagctt

SEQ ID NO: 630734 - DNA, 20 bp, mouse
gggcgagaggttgcggcaga

SEQ ID NO: 630735 - DNA, 20 bp, mouse
ggagggttcgagggaccgga

SEQ ID NO: 630736 - DNA, 20 bp, mouse
gcttcagagaggggctcagg

SEQ ID NO: 630737 - DNA, 20 bp, mouse
ggagaggggctcaggaggtg

SEQ ID NO: 630738 - DNA, 20 bp, mouse
gcagcttcagagaggggctc

SEQ ID NO: 630739 - DNA, 20 bp, mouse
gcgtgtggagcaccttgtcc

SEQ ID NO: 630740 - DNA, 20 bp, mouse
gggcttaagcagaggaggag

SEQ ID NO: 630741 - DNA, 20 bp, mouse
gtgagacaaaagcctggaca

SEQ ID NO: 630742 - DNA, 20 bp, mouse
gaggcttctgaagcatgtct

SEQ ID NO: 630743 - DNA, 20 bp, mouse
gcaatgcagcagcttcagag

SEQ ID NO: 630744 - DNA, 20 bp, mouse
gagaggagatcagggagtct

SEQ ID NO: 630745 - DNA, 20 bp, mouse
ggtatagagtgggagaactg

SEQ ID NO: 630746 - DNA, 20 bp, mouse
ggcagggccgcggcaagtcc

SEQ ID NO: 630747 - DNA, 20 bp, mouse
gcccgcgaccatggccccgg

SEQ ID NO: 630748 - DNA, 20 bp, mouse
gatagggtcgaggaccccgg

SEQ ID NO: 630749 - DNA, 20 bp, mouse
gggccgtgcgctctgaaagg

SEQ ID NO: 630750 - DNA, 20 bp, mouse
ggaccccgaggctctcccga

SEQ ID NO: 630751 - DNA, 20 bp, mouse
gcctgcacaccggacagata

SEQ ID NO: 630752 - DNA, 20 bp, mouse
ggagggcagctgcatcgaga

SEQ ID NO: 630753 - DNA, 20 bp, mouse
gaggggccgtgcgctctgaa

SEQ ID NO: 630754 - DNA, 20 bp, mouse
gaccctgcaccgggtcccaa

SEQ ID NO: 630755 - DNA, 20 bp, mouse
gaaaggaggcgctcgcaggt

SEQ ID NO: 630756 - DNA, 20 bp, mouse
ggagtcgcgagacgtcggag

SEQ ID NO: 630757 - DNA, 20 bp, mouse
gggcccagagcgcagacgtt

SEQ ID NO: 630758 - DNA, 20 bp, mouse
gcgaggccgggtctgaggat

SEQ ID NO: 630759 - DNA, 20 bp, mouse
gctgggccgatcctcagacc

SEQ ID NO: 630760 - DNA, 20 bp, mouse
gcggcggccacgtagcgctg

SEQ ID NO: 630761 - DNA, 20 bp, mouse
gcggcctcgcgcgctcggaa

SEQ ID NO: 630762 - DNA, 20 bp, mouse
ggaagggagtcgcgagacgt

SEQ ID NO: 630763 - DNA, 20 bp, mouse
ggccgggcgcagaggaaacg

SEQ ID NO: 630764 - DNA, 20 bp, mouse
gcggccacgtagcgctgcgg

SEQ ID NO: 630765 - DNA, 20 bp, mouse
gccacgtagcgctgcggcgg

SEQ ID NO: 630766 - DNA, 20 bp, mouse
gcggtcgaggctcctaacaa

SEQ ID NO: 630767 - DNA, 20 bp, mouse
gtcgaggctcctaacaacgg

SEQ ID NO: 630768 - DNA, 20 bp, mouse
ggccggtaaccagggagggg

SEQ ID NO: 630769 - DNA, 20 bp, mouse
gcgggggaggccggtaacca

SEQ ID NO: 630770 - DNA, 20 bp, mouse
gtaggagcctcgaccggaag

SEQ ID NO: 630771 - DNA, 20 bp, mouse
gcctgtgagaaatctcccgg

SEQ ID NO: 630772 - DNA, 20 bp, mouse
ggcgtctcaggtccacccag

SEQ ID NO: 630773 - DNA, 20 bp, mouse
gaccggcctcccccgttgtt

SEQ ID NO: 630774 - DNA, 20 bp, mouse
gaggctcctaacaacggggg

SEQ ID NO: 630775 - DNA, 20 bp, mouse
gggcgcgccacttccggtcg

SEQ ID NO: 630776 - DNA, 20 bp, mouse
ggggacactatgatccactt

SEQ ID NO: 630777 - DNA, 20 bp, mouse
gcgtctgtagtgcaacctaa

SEQ ID NO: 630778 - DNA, 20 bp, mouse
gacactatgatccactttgg

SEQ ID NO: 630779 - DNA, 20 bp, mouse
ggtagtgcaacctaaaggac

SEQ ID NO: 630780 - DNA, 20 bp, mouse
ggctcttaacacctccaaag

SEQ ID NO: 630781 - DNA, 20 bp, mouse
gtaacatgcaccgatgtctt

SEQ ID NO: 630782 - DNA, 20 bp, mouse
gcggtgcatgttatgcaaca

SEQ ID NO: 630783 - DNA, 20 bp, mouse
ggaggtcatccgtgaacaca

SEQ ID NO: 630784 - DNA, 20 bp, mouse
gtatgcaacaaggaatttct

SEQ ID NO: 630785 - DNA, 20 bp, mouse
ggtaggaaatttaggaacag

SEQ ID NO: 630786 - DNA, 20 bp, mouse
gcctggagactgtcccgtca

SEQ ID NO: 630787 - DNA, 20 bp, mouse
ggcgaggagcgcctccgtga

SEQ ID NO: 630788 - DNA, 20 bp, mouse
gggagactgtcccgtcacgg

SEQ ID NO: 630789 - DNA, 20 bp, mouse
gagagtggccccggacaggc

SEQ ID NO: 630790 - DNA, 20 bp, mouse
ggggactcacccaggtggag

SEQ ID NO: 630791 - DNA, 20 bp, mouse
gcttctggcagtcgagagag

SEQ ID NO: 630792 - DNA, 20 bp, mouse
gactcacccaggtggagagg

SEQ ID NO: 630793 - DNA, 20 bp, mouse
gccgggaagaggggaaaaca

SEQ ID NO: 630794 - DNA, 20 bp, mouse
gggttccccgggactcaccc

SEQ ID NO: 630795 - DNA, 20 bp, mouse
gcgtcgccggaagtgacgta

SEQ ID NO: 630796 - DNA, 20 bp, mouse
gtctaacactgagggcccgg

SEQ ID NO: 630797 - DNA, 20 bp, mouse
gtagcctgcgagaagagaac

SEQ ID NO: 630798 - DNA, 20 bp, mouse
gccaaactctcctggagtgc

SEQ ID NO: 630799 - DNA, 20 bp, mouse
gatctgcgcggagatttaag

SEQ ID NO: 630800 - DNA, 20 bp, mouse
gggatgccctggttgagctg

SEQ ID NO: 630801 - DNA, 20 bp, mouse
ggctggggtgggaatcctat

SEQ ID NO: 630802 - DNA, 20 bp, mouse
gtgtgagaggtgagcggcag

SEQ ID NO: 630803 - DNA, 20 bp, mouse
ggccagctaccgcaagcctg

SEQ ID NO: 630804 - DNA, 20 bp, mouse
ggttagaatccaaactctcc

SEQ ID NO: 630805 - DNA, 20 bp, mouse
gttattgttgcccgcactcc

SEQ ID NO: 630806 - DNA, 20 bp, mouse
gctgccttcccgacacgagg

SEQ ID NO: 630807 - DNA, 20 bp, mouse
ggtactcttgccaaaggtga

SEQ ID NO: 630808 - DNA, 20 bp, mouse
gttcccagtactcttgccaa

SEQ ID NO: 630809 - DNA, 20 bp, mouse
gtcaccgcctcgtgtcggga

SEQ ID NO: 630810 - DNA, 20 bp, mouse
ggcactgccttcccgacacg

SEQ ID NO: 630811 - DNA, 20 bp, mouse
gcgaggcggtgagtgttcgc

SEQ ID NO: 630812 - DNA, 20 bp, mouse
gagaagccgagtggacgcgg

SEQ ID NO: 630813 - DNA, 20 bp, mouse
gaacactcaccgcctcgtgt

SEQ ID NO: 630814 - DNA, 20 bp, mouse
gaggtgagggttgcgggtct

SEQ ID NO: 630815 - DNA, 20 bp, mouse
ggcgcctgcgcgaagatctt

SEQ ID NO: 630816 - DNA, 20 bp, mouse
ggtagaccccgaggatctga

SEQ ID NO: 630817 - DNA, 20 bp, mouse
ggagcagcgcgtagaccccg

SEQ ID NO: 630818 - DNA, 20 bp, mouse
gggaaaccctcagatcctcg

SEQ ID NO: 630819 - DNA, 20 bp, mouse
ggagacccggtccccaggac

SEQ ID NO: 630820 - DNA, 20 bp, mouse
gcttaggcgcgcctgtcctg

SEQ ID NO: 630821 - DNA, 20 bp, mouse
ggcggcggtgggcttctcca

SEQ ID NO: 630822 - DNA, 20 bp, mouse
gtacgcgctgctcagagacc

SEQ ID NO: 630823 - DNA, 20 bp, mouse
gcctgcgcgaagcacactcg

SEQ ID NO: 630824 - DNA, 20 bp, mouse
ggcgcgcctgtcctggggac

SEQ ID NO: 630825 - DNA, 20 bp, mouse
ggtcgggacaaagtgagtta

SEQ ID NO: 630826 - DNA, 20 bp, mouse
gtccgagggagacacctcac

SEQ ID NO: 630827 - DNA, 20 bp, mouse
ggctcggagacgcacctgtg

SEQ ID NO: 630828 - DNA, 20 bp, mouse
gcctctctctctccttccga

SEQ ID NO: 630829 - DNA, 20 bp, mouse
gcatcctcccggaggcgtct

SEQ ID NO: 630830 - DNA, 20 bp, mouse
gacacccagacgcctccggg

SEQ ID NO: 630831 - DNA, 20 bp, mouse
gaccacccccatcctcccgg

SEQ ID NO: 630832 - DNA, 20 bp, mouse
gctccgcgcgcgcccacccc

SEQ ID NO: 630833 - DNA, 20 bp, mouse
gagagagggcggcccggggt

SEQ ID NO: 630834 - DNA, 20 bp, mouse
ggctagtcggccccacgccc

SEQ ID NO: 630835 - DNA, 20 bp, mouse
ggagtcccggggggaagcgg

SEQ ID NO: 630836 - DNA, 20 bp, mouse
gtctgttgctagcagttctg

SEQ ID NO: 630837 - DNA, 20 bp, mouse
gtgagacggaggacgcagca

SEQ ID NO: 630838 - DNA, 20 bp, mouse
gggagagggagagaccgact

SEQ ID NO: 630839 - DNA, 20 bp, mouse
gaatcattcccactgaagga

SEQ ID NO: 630840 - DNA, 20 bp, mouse
gcacacgtggagtctcctga

SEQ ID NO: 630841 - DNA, 20 bp, mouse
ggacagagacctgtttgcgt

SEQ ID NO: 630842 - DNA, 20 bp, mouse
gctgcgagccttccttcagt

SEQ ID NO: 630843 - DNA, 20 bp, mouse
gctcgcctcccagaccccca

SEQ ID NO: 630844 - DNA, 20 bp, mouse
ggtctgggaggcgagtgcgc

SEQ ID NO: 630845 - DNA, 20 bp, mouse
gaggggccgctagtggatgt

SEQ ID NO: 630846 - DNA, 20 bp, mouse
ggctcgggacagtcggagag

SEQ ID NO: 630847 - DNA, 20 bp, mouse
gcgacggagctcgggacagt

SEQ ID NO: 630848 - DNA, 20 bp, mouse
gggcaccgccgccaaagctg

SEQ ID NO: 630849 - DNA, 20 bp, mouse
gcctggcgccgacggagctc

SEQ ID NO: 630850 - DNA, 20 bp, mouse
gggctccgcagctttggcgg

SEQ ID NO: 630851 - DNA, 20 bp, mouse
ggcgctaggacccggaggga

SEQ ID NO: 630852 - DNA, 20 bp, mouse
ggaccaggcgcgagcatccc

SEQ ID NO: 630853 - DNA, 20 bp, mouse
gcccgccggcgtgtcctacc

SEQ ID NO: 630854 - DNA, 20 bp, mouse
gagcgtctgcaggagctagg

SEQ ID NO: 630855 - DNA, 20 bp, mouse
ggctaggaggtgggacgatg

SEQ ID NO: 630856 - DNA, 20 bp, mouse
gggagcggccctccgaagac

SEQ ID NO: 630857 - DNA, 20 bp, mouse
gcctctcaccagtcttcgga

SEQ ID NO: 630858 - DNA, 20 bp, mouse
gcagccctctcaccagtctt

SEQ ID NO: 630859 - DNA, 20 bp, mouse
gcaacgctttgaggtgaacg

SEQ ID NO: 630860 - DNA, 20 bp, mouse
ggcctcagggcgcggaggaa

SEQ ID NO: 630861 - DNA, 20 bp, mouse
ggagagggctgagggcctca

SEQ ID NO: 630862 - DNA, 20 bp, mouse
ggtcaggcgggcaacttccc

SEQ ID NO: 630863 - DNA, 20 bp, mouse
gcggtgggaaaggattcctg

SEQ ID NO: 630864 - DNA, 20 bp, mouse
gggctgagggcctcaaggca

SEQ ID NO: 630865 - DNA, 20 bp, mouse
ggctgtccagcctcacaccg

SEQ ID NO: 630866 - DNA, 20 bp, mouse
gtcctggagtcagcagtctg

SEQ ID NO: 630867 - DNA, 20 bp, mouse
ggcgagggcccattacctga

SEQ ID NO: 630868 - DNA, 20 bp, mouse
gaaagatggtacactgagtg

SEQ ID NO: 630869 - DNA, 20 bp, mouse
gttgcggaagtgtatagagt

SEQ ID NO: 630870 - DNA, 20 bp, mouse
gctgcggggctgggaaacta

SEQ ID NO: 630871 - DNA, 20 bp, mouse
gatagagtgggcgtggttag

SEQ ID NO: 630872 - DNA, 20 bp, mouse
gcagacaagttgagctgaaa

SEQ ID NO: 630873 - DNA, 20 bp, mouse
gacgtggcgcccacaaacat

SEQ ID NO: 630874 - DNA, 20 bp, mouse
ggccacagactgctgactcc

SEQ ID NO: 630875 - DNA, 20 bp, mouse
gggctaagtccaaatggcga

SEQ ID NO: 630876 - DNA, 20 bp, mouse
gaggaacaccgagcccaaga

SEQ ID NO: 630877 - DNA, 20 bp, mouse
ggtgggtgctggacgatggt

SEQ ID NO: 630878 - DNA, 20 bp, mouse
gcgctgtgggtgctggacga

SEQ ID NO: 630879 - DNA, 20 bp, mouse
ggcctcctgcgcagctttgt

SEQ ID NO: 630880 - DNA, 20 bp, mouse
gccggagggacaggacgccc

SEQ ID NO: 630881 - DNA, 20 bp, mouse
gcgctcgcgctggatccccg

SEQ ID NO: 630882 - DNA, 20 bp, mouse
gtgttggcgtagtgacgctg

SEQ ID NO: 630883 - DNA, 20 bp, mouse
gcggctcccagacaaaggac

SEQ ID NO: 630884 - DNA, 20 bp, mouse
ggccaacaaagctgcgcagg

SEQ ID NO: 630885 - DNA, 20 bp, mouse
ggtagtgacgctgtgggtgc

SEQ ID NO: 630886 - DNA, 20 bp, mouse
ggactctcttaaaccatcca

SEQ ID NO: 630887 - DNA, 20 bp, mouse
gcccccccatcaggtagtgg

SEQ ID NO: 630888 - DNA, 20 bp, mouse
gtcccccccccatcaggtag

SEQ ID NO: 630889 - DNA, 20 bp, mouse
gagagctggaagtccagact

SEQ ID NO: 630890 - DNA, 20 bp, mouse
gttgtagcaacaagccaact

SEQ ID NO: 630891 - DNA, 20 bp, mouse
ggcctccactacctgatggg

SEQ ID NO: 630892 - DNA, 20 bp, mouse
ggaagtccagactggggtac

SEQ ID NO: 630893 - DNA, 20 bp, mouse
gtgctacaagatgaaagccc

SEQ ID NO: 630894 - DNA, 20 bp, mouse
ggcagcctccactacctgat

SEQ ID NO: 630895 - DNA, 20 bp, mouse
gctcaactcccccccccatc

SEQ ID NO: 630896 - DNA, 20 bp, mouse
ggagaagcaggaagtagcgg

SEQ ID NO: 630897 - DNA, 20 bp, mouse
ggggagaggggaggccgaag

SEQ ID NO: 630898 - DNA, 20 bp, mouse
gtggtcctcgaagaagaagg

SEQ ID NO: 630899 - DNA, 20 bp, mouse
ggggcggcggcacggagaag

SEQ ID NO: 630900 - DNA, 20 bp, mouse
gggccgaagcggagagaagc

SEQ ID NO: 630901 - DNA, 20 bp, mouse
gtccgtgccgccgccccctg

SEQ ID NO: 630902 - DNA, 20 bp, mouse
gcggtggtcctcgaagaaga

SEQ ID NO: 630903 - DNA, 20 bp, mouse
ggtgccgccgccccctgggg

SEQ ID NO: 630904 - DNA, 20 bp, mouse
gggggtagttgaccaagtgg

SEQ ID NO: 630905 - DNA, 20 bp, mouse
gaggagcacggagggagctg

SEQ ID NO: 630906 - DNA, 20 bp, mouse
ggaaccagcagtgaggccgg

SEQ ID NO: 630907 - DNA, 20 bp, mouse
gggccggaagcggaaggcta

SEQ ID NO: 630908 - DNA, 20 bp, mouse
gggcatcggaaccagcagtg

SEQ ID NO: 630909 - DNA, 20 bp, mouse
gaaccgggccagatctcccc

SEQ ID NO: 630910 - DNA, 20 bp, mouse
ggccatcggggatcctgccc

SEQ ID NO: 630911 - DNA, 20 bp, mouse
gtccccgatggcgccacccc

SEQ ID NO: 630912 - DNA, 20 bp, mouse
gcagagaaccctgtatcggg

SEQ ID NO: 630913 - DNA, 20 bp, mouse
gggcagatagcatcccacta

SEQ ID NO: 630914 - DNA, 20 bp, mouse
gccgcgaagctcacaagctc

SEQ ID NO: 630915 - DNA, 20 bp, mouse
gccacccccggcctcactgc

SEQ ID NO: 630916 - DNA, 20 bp, mouse
gggcaaggaggttaagaagt

SEQ ID NO: 630917 - DNA, 20 bp, mouse
gccaccgctgcctagaacac

SEQ ID NO: 630918 - DNA, 20 bp, mouse
gatgccttcggggaagatgg

SEQ ID NO: 630919 - DNA, 20 bp, mouse
gcgactgcccgcaggagaag

SEQ ID NO: 630920 - DNA, 20 bp, mouse
gggaggttaagaagtcggca

SEQ ID NO: 630921 - DNA, 20 bp, mouse
gggagaagcggagccgaagg

SEQ ID NO: 630922 - DNA, 20 bp, mouse
gctcctgcgggcagtcggag

SEQ ID NO: 630923 - DNA, 20 bp, mouse
ggcccggaggaaatctgaat

SEQ ID NO: 630924 - DNA, 20 bp, mouse
ggagacctagaagctccgtc

SEQ ID NO: 630925 - DNA, 20 bp, mouse
ggcagcgccattacacttta

SEQ ID NO: 630926 - DNA, 20 bp, mouse
gagccggcgccgcaggtcct

SEQ ID NO: 630927 - DNA, 20 bp, mouse
gggtcctgggctgggacaga

SEQ ID NO: 630928 - DNA, 20 bp, mouse
gagcagagtcgcctactcac

SEQ ID NO: 630929 - DNA, 20 bp, mouse
gagagtcgcctactcaccgg

SEQ ID NO: 630930 - DNA, 20 bp, mouse
gagcggagctccgcgcgcac

SEQ ID NO: 630931 - DNA, 20 bp, mouse
ggacacgaaccgggctagag

SEQ ID NO: 630932 - DNA, 20 bp, mouse
gcggagctgcgagctcgacc

SEQ ID NO: 630933 - DNA, 20 bp, mouse
ggggtgaaacggcggagctc

SEQ ID NO: 630934 - DNA, 20 bp, mouse
ggaggggcggggtgaaacgg

SEQ ID NO: 630935 - DNA, 20 bp, mouse
gctactcaccggaggatctc

SEQ ID NO: 630936 - DNA, 20 bp, mouse
gcgagccgcgggagtgaagt

SEQ ID NO: 630937 - DNA, 20 bp, mouse
gcactcccgcggctcggtca

SEQ ID NO: 630938 - DNA, 20 bp, mouse
gtggagctggaagagtacaa

SEQ ID NO: 630939 - DNA, 20 bp, mouse
ggcgggagtgaagtgggtcg

SEQ ID NO: 630940 - DNA, 20 bp, mouse
gccggagccggaacccagag

SEQ ID NO: 630941 - DNA, 20 bp, mouse
gctgtgtagaggtgacgtgg

SEQ ID NO: 630942 - DNA, 20 bp, mouse
gatcgcagcggagggacaca

SEQ ID NO: 630943 - DNA, 20 bp, mouse
gagtaagactgggtcatccg

SEQ ID NO: 630944 - DNA, 20 bp, mouse
gtggtccaaggccaacagta

SEQ ID NO: 630945 - DNA, 20 bp, mouse
gcagggagggtagtaagact

SEQ ID NO: 630946 - DNA, 20 bp, mouse
gagcctcctgacgccgaggg

SEQ ID NO: 630947 - DNA, 20 bp, mouse
gagaagaaaccgtcccccct

SEQ ID NO: 630948 - DNA, 20 bp, mouse
gtgcaggtaagaccccacga

SEQ ID NO: 630949 - DNA, 20 bp, mouse
gcttaaaagagaaacagcgg

SEQ ID NO: 630950 - DNA, 20 bp, mouse
gcctccctggctctaagaag

SEQ ID NO: 630951 - DNA, 20 bp, mouse
ggcgtcaggaggctacggcc

SEQ ID NO: 630952 - DNA, 20 bp, mouse
ggaggacacttggaacacgg

SEQ ID NO: 630953 - DNA, 20 bp, mouse
gcgtagcctcctgacgccga

SEQ ID NO: 630954 - DNA, 20 bp, mouse
ggtcttcccgctgcaagtcc

SEQ ID NO: 630955 - DNA, 20 bp, mouse
gctacggcctggacttgcag

SEQ ID NO: 630956 - DNA, 20 bp, mouse
ggccccagcgaggaggtagt

SEQ ID NO: 630957 - DNA, 20 bp, mouse
gacaggaagccccagcgagg

SEQ ID NO: 630958 - DNA, 20 bp, mouse
gagcaccgggcgccaggctt

SEQ ID NO: 630959 - DNA, 20 bp, mouse
gtgcccggcgcatcacaggt

SEQ ID NO: 630960 - DNA, 20 bp, mouse
gcagcccgagtgccagcccg

SEQ ID NO: 630961 - DNA, 20 bp, mouse
gggttgcatagcctcagcac

SEQ ID NO: 630962 - DNA, 20 bp, mouse
ggctgaggctatgcaaccgc

SEQ ID NO: 630963 - DNA, 20 bp, mouse
gacctgagctgatcatctag

SEQ ID NO: 630964 - DNA, 20 bp, mouse
ggagctgcccggcgcatcac

SEQ ID NO: 630965 - DNA, 20 bp, mouse
gtcccacagaccaccgaagg

SEQ ID NO: 630966 - DNA, 20 bp, mouse
gtgggatccaccacgcgccg

SEQ ID NO: 630967 - DNA, 20 bp, mouse
gcacctgccccggcgcgtgg

SEQ ID NO: 630968 - DNA, 20 bp, mouse
ggccgaagacgtgatcccag

SEQ ID NO: 630969 - DNA, 20 bp, mouse
gagcggaagtcgcccgggtg

SEQ ID NO: 630970 - DNA, 20 bp, mouse
gtgcgcctactcacctgccc

SEQ ID NO: 630971 - DNA, 20 bp, mouse
ggctcttctagcctgctccc

SEQ ID NO: 630972 - DNA, 20 bp, mouse
ggtcccttgccctaaaaaca

SEQ ID NO: 630973 - DNA, 20 bp, mouse
gccttgctcaggttcaacac

SEQ ID NO: 630974 - DNA, 20 bp, mouse
gaggttcaacactggagccc

SEQ ID NO: 630975 - DNA, 20 bp, mouse
ggattactcacgaggaatga

SEQ ID NO: 630976 - DNA, 20 bp, mouse
gaggcggcacggaggcgcag

SEQ ID NO: 630977 - DNA, 20 bp, mouse
gtcgcctgggctagctgcgg

SEQ ID NO: 630978 - DNA, 20 bp, mouse
gtgcagctcgcggaaggcga

SEQ ID NO: 630979 - DNA, 20 bp, mouse
gaggaggcagtgccactggg

SEQ ID NO: 630980 - DNA, 20 bp, mouse
gttgacgtgcagctcgcgga

SEQ ID NO: 630981 - DNA, 20 bp, mouse
gcgaatcgctcatttggagg

SEQ ID NO: 630982 - DNA, 20 bp, mouse
ggcgaaccggctccctatca

SEQ ID NO: 630983 - DNA, 20 bp, mouse
ggtttttgtgttgctcgcct

SEQ ID NO: 630984 - DNA, 20 bp, mouse
ggtccttgggttagatccag

SEQ ID NO: 630985 - DNA, 20 bp, mouse
gagggaggggaagctccggg

SEQ ID NO: 630986 - DNA, 20 bp, mouse
ggctcgcgcccaggacaccg

SEQ ID NO: 630987 - DNA, 20 bp, mouse
ggcgcgctcagggcctaccg

SEQ ID NO: 630988 - DNA, 20 bp, mouse
ggcgcccaggacaccgcggt

SEQ ID NO: 630989 - DNA, 20 bp, mouse
ggggcctaccgcggtgtcct

SEQ ID NO: 630990 - DNA, 20 bp, mouse
gccctgcgcccgcgcgctca

SEQ ID NO: 630991 - DNA, 20 bp, mouse
ggcgggcgcagggcccggag

SEQ ID NO: 630992 - DNA, 20 bp, mouse
gcgggcccggccagcgaagg

SEQ ID NO: 630993 - DNA, 20 bp, mouse
gtggccaagcgccccagcct

SEQ ID NO: 630994 - DNA, 20 bp, mouse
gctgctggctggcagacgcg

SEQ ID NO: 630995 - DNA, 20 bp, mouse
gggctgcgctgcgctccatg

SEQ ID NO: 630996 - DNA, 20 bp, mouse
ggctctcaacagccattcgt

SEQ ID NO: 630997 - DNA, 20 bp, mouse
gaggaaggaccgagcagagc

SEQ ID NO: 630998 - DNA, 20 bp, mouse
gcccgccgcgcctgagcccg

SEQ ID NO: 630999 - DNA, 20 bp, mouse
ggcctcgggctcaggcgcgg

SEQ ID NO: 631000 - DNA, 20 bp, mouse
gccgcaggacgcgggagccg

SEQ ID NO: 631001 - DNA, 20 bp, mouse
ggcgctgcggcgggtgtgcg

SEQ ID NO: 631002 - DNA, 20 bp, mouse
ggtgggcagactcaacccca

SEQ ID NO: 631003 - DNA, 20 bp, mouse
gcctgcctcgggctcaggcg

SEQ ID NO: 631004 - DNA, 20 bp, mouse
gtaagcggcgccgcaggacg

SEQ ID NO: 631005 - DNA, 20 bp, mouse
gttgagaaggaggccctaag

SEQ ID NO: 631006 - DNA, 20 bp, mouse
ggagagcgctgcttccgacg

SEQ ID NO: 631007 - DNA, 20 bp, mouse
ggagggtccgagctcaccgg

SEQ ID NO: 631008 - DNA, 20 bp, mouse
ggtagagggtccgagctcac

SEQ ID NO: 631009 - DNA, 20 bp, mouse
ggtgccaaggggacccaggt

SEQ ID NO: 631010 - DNA, 20 bp, mouse
gcatcgccgttagctcgctc

SEQ ID NO: 631011 - DNA, 20 bp, mouse
ggggaagagcgctgccccgt

SEQ ID NO: 631012 - DNA, 20 bp, mouse
gagacccagactgagaccct

SEQ ID NO: 631013 - DNA, 20 bp, mouse
gagcagctgcagcaagacgc

SEQ ID NO: 631014 - DNA, 20 bp, mouse
ggctcgggaaacacaggtct

SEQ ID NO: 631015 - DNA, 20 bp, mouse
gcaggagctggggaatccga

SEQ ID NO: 631016 - DNA, 20 bp, mouse
gagcgctgcggagaggacgg

SEQ ID NO: 631017 - DNA, 20 bp, mouse
gctaactaccctgctggagt

SEQ ID NO: 631018 - DNA, 20 bp, mouse
ggaaaaggactcgctatgaa

SEQ ID NO: 631019 - DNA, 20 bp, mouse
gtgaggtgaaggctggttca

SEQ ID NO: 631020 - DNA, 20 bp, mouse
gggatctctgaggtgaaggc

SEQ ID NO: 631021 - DNA, 20 bp, mouse
gaaggactcgctatgaaggg

SEQ ID NO: 631022 - DNA, 20 bp, mouse
gagcagcccgccaggcccga

SEQ ID NO: 631023 - DNA, 20 bp, mouse
gggaaaagctcactttggag

SEQ ID NO: 631024 - DNA, 20 bp, mouse
gaacttgtttgagtccaaag

SEQ ID NO: 631025 - DNA, 20 bp, mouse
gggctgttctaaccaaggct

SEQ ID NO: 631026 - DNA, 20 bp, mouse
gccgcactgcaggaccacgt

SEQ ID NO: 631027 - DNA, 20 bp, mouse
gcgctccgcgctcgacatgg

SEQ ID NO: 631028 - DNA, 20 bp, mouse
gccgcgctcgacatggaggt

SEQ ID NO: 631029 - DNA, 20 bp, mouse
gaaatgaaccggaagcacag

SEQ ID NO: 631030 - DNA, 20 bp, mouse
gtcatgaggcctgcaaggct

SEQ ID NO: 631031 - DNA, 20 bp, mouse
gagactggaaagtctagggt

SEQ ID NO: 631032 - DNA, 20 bp, mouse
gttgcgctccgcgctcgaca

SEQ ID NO: 631033 - DNA, 20 bp, mouse
gtagggttggtagagcaggg

SEQ ID NO: 631034 - DNA, 20 bp, mouse
gcctcatgaactatacgggt

SEQ ID NO: 631035 - DNA, 20 bp, mouse
gcccggggtgcagggagccg

SEQ ID NO: 631036 - DNA, 20 bp, mouse
gccggtcagctgagaacccg

SEQ ID NO: 631037 - DNA, 20 bp, mouse
ggcaccgcgccggaagggag

SEQ ID NO: 631038 - DNA, 20 bp, mouse
gaggatcgatcagtcacctc

SEQ ID NO: 631039 - DNA, 20 bp, mouse
gggacagcaccgcgccggaa

SEQ ID NO: 631040 - DNA, 20 bp, mouse
gcgcgccggaagggagcggg

SEQ ID NO: 631041 - DNA, 20 bp, mouse
gcggccccgcggcggttcct

SEQ ID NO: 631042 - DNA, 20 bp, mouse
gtcctccgtggcccggagac

SEQ ID NO: 631043 - DNA, 20 bp, mouse
ggtccgcaggagcttctgaa

SEQ ID NO: 631044 - DNA, 20 bp, mouse
gccgccaccctaggagcagg

SEQ ID NO: 631045 - DNA, 20 bp, mouse
ggaagctcctgcggacaagg

SEQ ID NO: 631046 - DNA, 20 bp, mouse
ggaggcggaccgctgtgtct

SEQ ID NO: 631047 - DNA, 20 bp, mouse
gcggtcagcatagcacctcc

SEQ ID NO: 631048 - DNA, 20 bp, mouse
gaacccgtgcccagacacag

SEQ ID NO: 631049 - DNA, 20 bp, mouse
gtaaggaagcacgagtccga

SEQ ID NO: 631050 - DNA, 20 bp, mouse
ggaccgctgtgtctgggcac

SEQ ID NO: 631051 - DNA, 20 bp, mouse
gctgatgacgtcactgggga

SEQ ID NO: 631052 - DNA, 20 bp, mouse
gctctgcctgagatgctaac

SEQ ID NO: 631053 - DNA, 20 bp, mouse
gctttctgatgacgtcactg

SEQ ID NO: 631054 - DNA, 20 bp, mouse
ggccacttttcaggtataag

SEQ ID NO: 631055 - DNA, 20 bp, mouse
ggggagcagcgccacttttc

SEQ ID NO: 631056 - DNA, 20 bp, mouse
gtaatcgagtgtcttgggtt

SEQ ID NO: 631057 - DNA, 20 bp, mouse
gcggccaatcctgctcctag

SEQ ID NO: 631058 - DNA, 20 bp, mouse
gctgcaccaacctccatgtc

SEQ ID NO: 631059 - DNA, 20 bp, mouse
gtgggtttggatccctgaca

SEQ ID NO: 631060 - DNA, 20 bp, mouse
gcaagacactcgattaactt

SEQ ID NO: 631061 - DNA, 20 bp, mouse
gcaacacagtacctccaggt

SEQ ID NO: 631062 - DNA, 20 bp, mouse
gcctgtgcggagatgctgaa

SEQ ID NO: 631063 - DNA, 20 bp, mouse
ggtgcggtcgtacagatctg

SEQ ID NO: 631064 - DNA, 20 bp, mouse
ggagggggccgccgacctgg

SEQ ID NO: 631065 - DNA, 20 bp, mouse
gacatgagtaagggtcagct

SEQ ID NO: 631066 - DNA, 20 bp, mouse
gtccctggaagaagggaatg

SEQ ID NO: 631067 - DNA, 20 bp, mouse
ggaggcagggctgacgtgaa

SEQ ID NO: 631068 - DNA, 20 bp, mouse
gctctgcgagcaggcttagg

SEQ ID NO: 631069 - DNA, 20 bp, mouse
gttcctctgcgagcaggctt

SEQ ID NO: 631070 - DNA, 20 bp, mouse
gctctccctccctggaagaa

SEQ ID NO: 631071 - DNA, 20 bp, mouse
gcagctgcaacccgggcggt

SEQ ID NO: 631072 - DNA, 20 bp, mouse
gcgcgcagctgcaacccggg

SEQ ID NO: 631073 - DNA, 20 bp, mouse
ggagaaagagaggagccgga

SEQ ID NO: 631074 - DNA, 20 bp, mouse
gaagagaggagccggaggga

SEQ ID NO: 631075 - DNA, 20 bp, mouse
gacttgggccgaggagaggg

SEQ ID NO: 631076 - DNA, 20 bp, mouse
gcggcagccgtggacctgga

SEQ ID NO: 631077 - DNA, 20 bp, mouse
gacgcagagtagctcgtgat

SEQ ID NO: 631078 - DNA, 20 bp, mouse
gagtagctcgtgattggctc

SEQ ID NO: 631079 - DNA, 20 bp, mouse
gggctcgggctgcggaacct

SEQ ID NO: 631080 - DNA, 20 bp, mouse
ggcgttcgttcgggattccg

SEQ ID NO: 631081 - DNA, 20 bp, mouse
ggctataaagcgggacgagg

SEQ ID NO: 631082 - DNA, 20 bp, mouse
gcccgccgccaggcagtcgg

SEQ ID NO: 631083 - DNA, 20 bp, mouse
gcggaggcggtgacaggtaa

SEQ ID NO: 631084 - DNA, 20 bp, mouse
gcgctctcaactgccgcggg

SEQ ID NO: 631085 - DNA, 20 bp, mouse
gacgaacgccaggaccttcc

SEQ ID NO: 631086 - DNA, 20 bp, mouse
gcgcgcacaggacccgacac

SEQ ID NO: 631087 - DNA, 20 bp, mouse
gtgtgtgtctccctctctgg

SEQ ID NO: 631088 - DNA, 20 bp, mouse
gcacaggcgcagaagaaaca

SEQ ID NO: 631089 - DNA, 20 bp, mouse
gctgtgtgtgtctccctctc

SEQ ID NO: 631090 - DNA, 20 bp, mouse
gcgcgctctggtagcatctc

SEQ ID NO: 631091 - DNA, 20 bp, mouse
gttggagaagaccgccagag

SEQ ID NO: 631092 - DNA, 20 bp, mouse
gggcggtcttctccaaagtt

SEQ ID NO: 631093 - DNA, 20 bp, mouse
ggttaacgctggaggaggga

SEQ ID NO: 631094 - DNA, 20 bp, mouse
ggcgttaaccagcaccggaa

SEQ ID NO: 631095 - DNA, 20 bp, mouse
gaggcgggaagaagttgaat

SEQ ID NO: 631096 - DNA, 20 bp, mouse
gcacggaagccgaagagtcc

SEQ ID NO: 631097 - DNA, 20 bp, mouse
ggtcagctgaggccattagg

SEQ ID NO: 631098 - DNA, 20 bp, mouse
ggaagccgaagagtcccgga

SEQ ID NO: 631099 - DNA, 20 bp, mouse
gcgctggcgggtccgcgagg

SEQ ID NO: 631100 - DNA, 20 bp, mouse
gctctcggccgggcagtgtg

SEQ ID NO: 631101 - DNA, 20 bp, mouse
gacgcagcgggtccccgggt

SEQ ID NO: 631102 - DNA, 20 bp, mouse
gaaagacaccggaaatagag

SEQ ID NO: 631103 - DNA, 20 bp, mouse
ggcgggtccgcgaggtggtt

SEQ ID NO: 631104 - DNA, 20 bp, mouse
gaaagttccaaaccacctcg

SEQ ID NO: 631105 - DNA, 20 bp, mouse
gtgccggggctcgtcagatg

SEQ ID NO: 631106 - DNA, 20 bp, mouse
gcgtgtgcagagcttctcta

SEQ ID NO: 631107 - DNA, 20 bp, mouse
gaatgtgaggtgagtggatg

SEQ ID NO: 631108 - DNA, 20 bp, mouse
gaccctggcaacgacaggag

SEQ ID NO: 631109 - DNA, 20 bp, mouse
gggcggaagtctcgcagtcc

SEQ ID NO: 631110 - DNA, 20 bp, mouse
gcgacggtgggaaatcccac

SEQ ID NO: 631111 - DNA, 20 bp, mouse
gtaccatgtgagggcattcg

SEQ ID NO: 631112 - DNA, 20 bp, mouse
gaccatcactcagcacaaac

SEQ ID NO: 631113 - DNA, 20 bp, mouse
gtggaattgtgggtgtctgt

SEQ ID NO: 631114 - DNA, 20 bp, mouse
gtccacctcatccccccctg

SEQ ID NO: 631115 - DNA, 20 bp, mouse
gacgctaccctggcaacgac

SEQ ID NO: 631116 - DNA, 20 bp, mouse
gatcccactgagcagcgtcc

SEQ ID NO: 631117 - DNA, 20 bp, mouse
gtggttgtcattcagagatg

SEQ ID NO: 631118 - DNA, 20 bp, mouse
gttaattcattctattccag

SEQ ID NO: 631119 - DNA, 20 bp, mouse
gtgcctggacgctgctcagt

SEQ ID NO: 631120 - DNA, 20 bp, mouse
gtctgaatgacaaccacccc

SEQ ID NO: 631121 - DNA, 20 bp, mouse
gacgaattaaggattcaata

SEQ ID NO: 631122 - DNA, 20 bp, mouse
gattcattctattccagggg

SEQ ID NO: 631123 - DNA, 20 bp, mouse
gttgtatagcgatgtgatgt

SEQ ID NO: 631124 - DNA, 20 bp, mouse
gaaatgttaacaacgaatta

SEQ ID NO: 631125 - DNA, 20 bp, mouse
gataatatgtttatcagagt

SEQ ID NO: 631126 - DNA, 20 bp, mouse
gcgctcctcacagagaagga

SEQ ID NO: 631127 - DNA, 20 bp, mouse
gttatcaatggtaggaagga

SEQ ID NO: 631128 - DNA, 20 bp, mouse
gtcaacagcacatttatcaa

SEQ ID NO: 631129 - DNA, 20 bp, mouse
gaaatcaccttcagtaaatt

SEQ ID NO: 631130 - DNA, 20 bp, mouse
gaaagttaattcaaataaat

SEQ ID NO: 631131 - DNA, 20 bp, mouse
gtaatcacccaatttactga

SEQ ID NO: 631132 - DNA, 20 bp, mouse
gacatttatcaatggtagga

SEQ ID NO: 631133 - DNA, 20 bp, mouse
gcacccgctcctcacagaga

SEQ ID NO: 631134 - DNA, 20 bp, mouse
gcccaccttccttctctgtg

SEQ ID NO: 631135 - DNA, 20 bp, mouse
ggtcacctgggacatgatgg

SEQ ID NO: 631136 - DNA, 20 bp, mouse
gaaatccagatgtagtgctg

SEQ ID NO: 631137 - DNA, 20 bp, mouse
gtaaggaagctcgattccga

SEQ ID NO: 631138 - DNA, 20 bp, mouse
gcttgtgaggtcatcagaaa

SEQ ID NO: 631139 - DNA, 20 bp, mouse
gtgtagtcccgtcccttgtg

SEQ ID NO: 631140 - DNA, 20 bp, mouse
gatgtcttggacaccactcc

SEQ ID NO: 631141 - DNA, 20 bp, mouse
gccaagacataacgtataga

SEQ ID NO: 631142 - DNA, 20 bp, mouse
gtgatgacctcacaagggac

SEQ ID NO: 631143 - DNA, 20 bp, mouse
gcagcatctcaggaacaggc

SEQ ID NO: 631144 - DNA, 20 bp, mouse
gttgtcctcagcactacatc

SEQ ID NO: 631145 - DNA, 20 bp, mouse
gtttgagcacaaaccaggag

SEQ ID NO: 631146 - DNA, 20 bp, mouse
gtgtagcagcggctaccccg

SEQ ID NO: 631147 - DNA, 20 bp, mouse
ggcctggcattcacagcctg

SEQ ID NO: 631148 - DNA, 20 bp, mouse
gggaccggcttgagcctggg

SEQ ID NO: 631149 - DNA, 20 bp, mouse
gggctgtgaatgccaggccg

SEQ ID NO: 631150 - DNA, 20 bp, mouse
gagttgcaagttgcaccccc

SEQ ID NO: 631151 - DNA, 20 bp, mouse
gcagcggctaccccgcggcc

SEQ ID NO: 631152 - DNA, 20 bp, mouse
ggggggaccggcttgagcct

SEQ ID NO: 631153 - DNA, 20 bp, mouse
gtgggcgggttttgtagcag

SEQ ID NO: 631154 - DNA, 20 bp, mouse
ggcaccaggccgtagcccgg

SEQ ID NO: 631155 - DNA, 20 bp, mouse
gggcgctgcggcagggggac

SEQ ID NO: 631156 - DNA, 20 bp, mouse
ggtcccgacgcggggagcgg

SEQ ID NO: 631157 - DNA, 20 bp, mouse
ggcaccccgtgccaagcccg

SEQ ID NO: 631158 - DNA, 20 bp, mouse
gacttgcctcggtcccgacg

SEQ ID NO: 631159 - DNA, 20 bp, mouse
gggccgccgctccccgcgtc

SEQ ID NO: 631160 - DNA, 20 bp, mouse
gggacggagaagtgcttccg

SEQ ID NO: 631161 - DNA, 20 bp, mouse
gcagcagctcgcaggccgtg

SEQ ID NO: 631162 - DNA, 20 bp, mouse
ggaagtgcttccggggaaac

SEQ ID NO: 631163 - DNA, 20 bp, mouse
ggtttacaaacaccaacccg

SEQ ID NO: 631164 - DNA, 20 bp, mouse
gcgccgcgcggcggaggaga

SEQ ID NO: 631165 - DNA, 20 bp, mouse
ggaggccgcgccaggcaggt

SEQ ID NO: 631166 - DNA, 20 bp, mouse
gtgcctccaggaagcctcac

SEQ ID NO: 631167 - DNA, 20 bp, mouse
gaggccgacgaaggcccgtg

SEQ ID NO: 631168 - DNA, 20 bp, mouse
ggctccacctgcagctcgag

SEQ ID NO: 631169 - DNA, 20 bp, mouse
gctgcagctcgagcggcgaa

SEQ ID NO: 631170 - DNA, 20 bp, mouse
gaggcttcctggaggcagcg

SEQ ID NO: 631171 - DNA, 20 bp, mouse
ggccgcggccaggccgacga

SEQ ID NO: 631172 - DNA, 20 bp, mouse
ggtgccgccgcgctgcctcc

SEQ ID NO: 631173 - DNA, 20 bp, mouse
ggctgccggcggagaggacc

SEQ ID NO: 631174 - DNA, 20 bp, mouse
gtgtgccgcaggccccagga

SEQ ID NO: 631175 - DNA, 20 bp, mouse
gcggcctgcgaggagcgcgg

SEQ ID NO: 631176 - DNA, 20 bp, mouse
gactgtgcggggagtctaca

SEQ ID NO: 631177 - DNA, 20 bp, mouse
gcaggtgatggccccgggaa

SEQ ID NO: 631178 - DNA, 20 bp, mouse
gccgtgtgcaccttaacgta

SEQ ID NO: 631179 - DNA, 20 bp, mouse
ggtctacatggcgcaggtga

SEQ ID NO: 631180 - DNA, 20 bp, mouse
gtcaaaactacgctccctag

SEQ ID NO: 631181 - DNA, 20 bp, mouse
gcggtaccgaggcccttccc

SEQ ID NO: 631182 - DNA, 20 bp, mouse
gtggcgcaggtgatggcccc

SEQ ID NO: 631183 - DNA, 20 bp, mouse
gcagccctggtacccgaaaa

SEQ ID NO: 631184 - DNA, 20 bp, mouse
ggttaaggtgcacacggacc

SEQ ID NO: 631185 - DNA, 20 bp, mouse
gcaggcaatcccaggagtgc

SEQ ID NO: 631186 - DNA, 20 bp, mouse
gggaagtgccgtttccacaa

SEQ ID NO: 631187 - DNA, 20 bp, mouse
ggaggcgggaagaacagact

SEQ ID NO: 631188 - DNA, 20 bp, mouse
gcactagtgcagtcgcaatg

SEQ ID NO: 631189 - DNA, 20 bp, mouse
gtgcaggtcggagggaccga

SEQ ID NO: 631190 - DNA, 20 bp, mouse
gtccttgtgaagcgatccaa

SEQ ID NO: 631191 - DNA, 20 bp, mouse
gggtggagccctgctgacct

SEQ ID NO: 631192 - DNA, 20 bp, mouse
gagcgtctggaagcctgctg

SEQ ID NO: 631193 - DNA, 20 bp, mouse
ggcgggaagaacagacttgg

SEQ ID NO: 631194 - DNA, 20 bp, mouse
ggcttcacaaggagccattg

SEQ ID NO: 631195 - DNA, 20 bp, mouse
gtaggctgggccacagcgtc

SEQ ID NO: 631196 - DNA, 20 bp, mouse
gcagcaccttgcacagaaga

SEQ ID NO: 631197 - DNA, 20 bp, mouse
gacccggcaggtgcatctcg

SEQ ID NO: 631198 - DNA, 20 bp, mouse
gaatagtaagcacttaccaa

SEQ ID NO: 631199 - DNA, 20 bp, mouse
gctgctctcactattcccta

SEQ ID NO: 631200 - DNA, 20 bp, mouse
gtccctcccactggaacagc

SEQ ID NO: 631201 - DNA, 20 bp, mouse
gagtaagcacttaccaaagg

SEQ ID NO: 631202 - DNA, 20 bp, mouse
gggagtccttcttctgtgca

SEQ ID NO: 631203 - DNA, 20 bp, mouse
ggcaggatctgttctcacgc

SEQ ID NO: 631204 - DNA, 20 bp, mouse
gtggagccggctgttccagt

SEQ ID NO: 631205 - DNA, 20 bp, mouse
gtgttctcacgctggctcgc

SEQ ID NO: 631206 - DNA, 20 bp, mouse
gtcagcagcgcagccctgga

SEQ ID NO: 631207 - DNA, 20 bp, mouse
gagagtcagcagcgcagccc

SEQ ID NO: 631208 - DNA, 20 bp, mouse
gcgcagccctggaaggtccc

SEQ ID NO: 631209 - DNA, 20 bp, mouse
gctcctcagactctgttttg

SEQ ID NO: 631210 - DNA, 20 bp, mouse
ggactgaatattctgttaac

SEQ ID NO: 631211 - DNA, 20 bp, mouse
ggcgtccataaaaacagctg

SEQ ID NO: 631212 - DNA, 20 bp, mouse
gatgaacagttggtctatca

SEQ ID NO: 631213 - DNA, 20 bp, mouse
gtggatctcttacagttgtc

SEQ ID NO: 631214 - DNA, 20 bp, mouse
gttgagatcttatgaacagt

SEQ ID NO: 631215 - DNA, 20 bp, mouse
gcgctctcacagttctgatg

SEQ ID NO: 631216 - DNA, 20 bp, mouse
ggtagtcccggcccctgtga

SEQ ID NO: 631217 - DNA, 20 bp, mouse
gggtagggcacggagagtgc

SEQ ID NO: 631218 - DNA, 20 bp, mouse
gtggtcagcatcgcaggcac

SEQ ID NO: 631219 - DNA, 20 bp, mouse
ggacctttgacgaaagaata

SEQ ID NO: 631220 - DNA, 20 bp, mouse
gttccatattctttcgtcaa

SEQ ID NO: 631221 - DNA, 20 bp, mouse
gggacatgacgtataggggg

SEQ ID NO: 631222 - DNA, 20 bp, mouse
gtctccaggacatgacgtat

SEQ ID NO: 631223 - DNA, 20 bp, mouse
gccaggacatgacgtatagg

SEQ ID NO: 631224 - DNA, 20 bp, mouse
gaacgttagaaactacagga

SEQ ID NO: 631225 - DNA, 20 bp, mouse
gggagaacgttagaaactac

SEQ ID NO: 631226 - DNA, 20 bp, mouse
gccgttctacgaggctccag

SEQ ID NO: 631227 - DNA, 20 bp, mouse
gagggctggacggccgacac

SEQ ID NO: 631228 - DNA, 20 bp, mouse
ggagcctcgtagaacggtct

SEQ ID NO: 631229 - DNA, 20 bp, mouse
gtctcccagaccgttctacg

SEQ ID NO: 631230 - DNA, 20 bp, mouse
gtctttgtttaagggctgga

SEQ ID NO: 631231 - DNA, 20 bp, mouse
gtcgccggtccgcaccacag

SEQ ID NO: 631232 - DNA, 20 bp, mouse
gtacgaaacgggtagaccaa

SEQ ID NO: 631233 - DNA, 20 bp, mouse
gccgccactgtggtgcggac

SEQ ID NO: 631234 - DNA, 20 bp, mouse
gacgaggctccagtggctgc

SEQ ID NO: 631235 - DNA, 20 bp, mouse
gaacggtctgggagactcgc

SEQ ID NO: 631236 - DNA, 20 bp, mouse
gtcctaataggcctaaatac

SEQ ID NO: 631237 - DNA, 20 bp, mouse
gaaggtctgtggtggtgttg

SEQ ID NO: 631238 - DNA, 20 bp, mouse
gtccaggtgttcttcctaat

SEQ ID NO: 631239 - DNA, 20 bp, mouse
gtcctgtatttaggcctatt

SEQ ID NO: 631240 - DNA, 20 bp, mouse
ggtgcgcagagcaggcgacc

SEQ ID NO: 631241 - DNA, 20 bp, mouse
gctaggctgcacagcaccaa

SEQ ID NO: 631242 - DNA, 20 bp, mouse
gtccctaggacagaacagag

SEQ ID NO: 631243 - DNA, 20 bp, mouse
gttacgactccaggagccca

SEQ ID NO: 631244 - DNA, 20 bp, mouse
gtcccgctccaaggcacact

SEQ ID NO: 631245 - DNA, 20 bp, mouse
gagcctagtgtgccttggag

SEQ ID NO: 631246 - DNA, 20 bp, mouse
gtggcgcagaggatggcccg

SEQ ID NO: 631247 - DNA, 20 bp, mouse
gcctgcgtcctgtaaacccg

SEQ ID NO: 631248 - DNA, 20 bp, mouse
gtcacgtgaggcgcgaacac

SEQ ID NO: 631249 - DNA, 20 bp, mouse
ggtccccatggcgcagagga

SEQ ID NO: 631250 - DNA, 20 bp, mouse
ggcagaggatggcccgggga

SEQ ID NO: 631251 - DNA, 20 bp, mouse
gccgcgaagctcacagcctc

SEQ ID NO: 631252 - DNA, 20 bp, mouse
ggcgcctcacgtgacaccgt

SEQ ID NO: 631253 - DNA, 20 bp, mouse
gcgtgaggcgcgaacacagg

SEQ ID NO: 631254 - DNA, 20 bp, mouse
ggaactgagaaggcaatccc

SEQ ID NO: 631255 - DNA, 20 bp, mouse
gctcacagcctcgggtttac

SEQ ID NO: 631256 - DNA, 20 bp, mouse
gggccgcccggtctcctcgg

SEQ ID NO: 631257 - DNA, 20 bp, mouse
gagcctccgaggagaccggg

SEQ ID NO: 631258 - DNA, 20 bp, mouse
gctgaacgcgcgggtggcga

SEQ ID NO: 631259 - DNA, 20 bp, mouse
gggctccaggcactcgaact

SEQ ID NO: 631260 - DNA, 20 bp, mouse
ggaggctctgaacgcgcggg

SEQ ID NO: 631261 - DNA, 20 bp, mouse
ggccccgaagggtctctcaa

SEQ ID NO: 631262 - DNA, 20 bp, mouse
gcgcagtgggcagccccgaa

SEQ ID NO: 631263 - DNA, 20 bp, mouse
gtcggaggctctgaacgcgc

SEQ ID NO: 631264 - DNA, 20 bp, mouse
gggcccagggtcaagacgtc

SEQ ID NO: 631265 - DNA, 20 bp, mouse
gtttctggcacactcctaag

SEQ ID NO: 631266 - DNA, 20 bp, mouse
gagcctgggtttcgccaaga

SEQ ID NO: 631267 - DNA, 20 bp, mouse
gagtcgccgcgctgaccctg

SEQ ID NO: 631268 - DNA, 20 bp, mouse
gtgccgtcttggcgaaaccc

SEQ ID NO: 631269 - DNA, 20 bp, mouse
gcacgtccgcagggtcagcg

SEQ ID NO: 631270 - DNA, 20 bp, mouse
gcccggagctggcaaacgcc

SEQ ID NO: 631271 - DNA, 20 bp, mouse
gaggcaagctcacgtccgca

SEQ ID NO: 631272 - DNA, 20 bp, mouse
ggattcgaccccaggagatg

SEQ ID NO: 631273 - DNA, 20 bp, mouse
gagggacgcatctcagagcc

SEQ ID NO: 631274 - DNA, 20 bp, mouse
ggtgagcttgcctgccgtct

SEQ ID NO: 631275 - DNA, 20 bp, mouse
gagctggcaaacgccgggca

SEQ ID NO: 631276 - DNA, 20 bp, mouse
gcactcaccagcccgaggtt

SEQ ID NO: 631277 - DNA, 20 bp, mouse
gcgcacgagcaccgaacctc

SEQ ID NO: 631278 - DNA, 20 bp, mouse
ggcctgggcgaggggcggtt

SEQ ID NO: 631279 - DNA, 20 bp, mouse
gcgagcaccgaacctcgggc

SEQ ID NO: 631280 - DNA, 20 bp, mouse
ggagtgcgcactccaccccg

SEQ ID NO: 631281 - DNA, 20 bp, mouse
gggccccgggcctgggcgag

SEQ ID NO: 631282 - DNA, 20 bp, mouse
gccgctggagctgaggcccc

SEQ ID NO: 631283 - DNA, 20 bp, mouse
gctgaatgtcgggatgagtg

SEQ ID NO: 631284 - DNA, 20 bp, mouse
gggccccggcccagacaagg

SEQ ID NO: 631285 - DNA, 20 bp, mouse
gcggaggcccgctggagctg

SEQ ID NO: 631286 - DNA, 20 bp, mouse
gagaagggcgaaataaggaa

SEQ ID NO: 631287 - DNA, 20 bp, mouse
gtccgtgggctataacagaa

SEQ ID NO: 631288 - DNA, 20 bp, mouse
gaaaggagaagggcgaaata

SEQ ID NO: 631289 - DNA, 20 bp, mouse
gtggaaactggcgcttccgt

SEQ ID NO: 631290 - DNA, 20 bp, mouse
gggctataacagaaaggaga

SEQ ID NO: 631291 - DNA, 20 bp, mouse
gggcctgcaaccaaccacac

SEQ ID NO: 631292 - DNA, 20 bp, mouse
gcgcagaagagcttaaccaa

SEQ ID NO: 631293 - DNA, 20 bp, mouse
gagtctacgaggaccccgtg

SEQ ID NO: 631294 - DNA, 20 bp, mouse
gtcctttctgttatagccca

SEQ ID NO: 631295 - DNA, 20 bp, mouse
gggagagcattgggacttaa

SEQ ID NO: 631296 - DNA, 20 bp, mouse
gccagcactgatgcagtagg

SEQ ID NO: 631297 - DNA, 20 bp, mouse
gggatggagagtggcctggc

SEQ ID NO: 631298 - DNA, 20 bp, mouse
gtcaccagcactgatgcagt

SEQ ID NO: 631299 - DNA, 20 bp, mouse
ggggcagggggtctcagatg

SEQ ID NO: 631300 - DNA, 20 bp, mouse
gtcccatcttaccccccagg

SEQ ID NO: 631301 - DNA, 20 bp, mouse
gcagggggtctcagatgggg

SEQ ID NO: 631302 - DNA, 20 bp, mouse
gtcttaccccccaggtggca

SEQ ID NO: 631303 - DNA, 20 bp, mouse
ggtatgtagaatctcactgt

SEQ ID NO: 631304 - DNA, 20 bp, mouse
gaaacaaggacattaatgtt

SEQ ID NO: 631305 - DNA, 20 bp, mouse
ggactttgaaggtcacccaa

SEQ ID NO: 631306 - DNA, 20 bp, mouse
gtgctgaagaggcgccggga

SEQ ID NO: 631307 - DNA, 20 bp, mouse
gctacaaactgcatcctggg

SEQ ID NO: 631308 - DNA, 20 bp, mouse
gtgcagctcccctgctgaag

SEQ ID NO: 631309 - DNA, 20 bp, mouse
ggatgcagtttgtagcaaca

SEQ ID NO: 631310 - DNA, 20 bp, mouse
ggcgagctgcgcggccgtcc

SEQ ID NO: 631311 - DNA, 20 bp, mouse
gcagtgcagcccgggttcca

SEQ ID NO: 631312 - DNA, 20 bp, mouse
gcagctcgcagccgggaccc

SEQ ID NO: 631313 - DNA, 20 bp, mouse
ggcgctggtcacatgaactc

SEQ ID NO: 631314 - DNA, 20 bp, mouse
gcccctgctgaagaggcgcc

SEQ ID NO: 631315 - DNA, 20 bp, mouse
gtgagagggacatgcctccc

SEQ ID NO: 631316 - DNA, 20 bp, mouse
ggcgggcgcttgttagggag

SEQ ID NO: 631317 - DNA, 20 bp, mouse
gtctgggtaaggcagctagc

SEQ ID NO: 631318 - DNA, 20 bp, mouse
gtcctcggttgacagcgtct

SEQ ID NO: 631319 - DNA, 20 bp, mouse
gagctagcgggcgcttgtta

SEQ ID NO: 631320 - DNA, 20 bp, mouse
gacccagacgctgtcaaccg

SEQ ID NO: 631321 - DNA, 20 bp, mouse
gcggttgcgtggaatctagg

SEQ ID NO: 631322 - DNA, 20 bp, mouse
gctgtcaaccgaggaacgct

SEQ ID NO: 631323 - DNA, 20 bp, mouse
gagtgggagcccgagcgctg

SEQ ID NO: 631324 - DNA, 20 bp, mouse
gtcaaccgaggaacgctggg

SEQ ID NO: 631325 - DNA, 20 bp, mouse
ggaaacctcccagcgttcct

SEQ ID NO: 631326 - DNA, 20 bp, mouse
gaaagtcaggtttttctcgt

SEQ ID NO: 631327 - DNA, 20 bp, mouse
gggtggaagaaatcgctcta

SEQ ID NO: 631328 - DNA, 20 bp, mouse
gagggagcgatacacgacac

SEQ ID NO: 631329 - DNA, 20 bp, mouse
gtcttactctgtgaggacgt

SEQ ID NO: 631330 - DNA, 20 bp, mouse
gctttctcttgcaggcacag

SEQ ID NO: 631331 - DNA, 20 bp, mouse
ggtcaggtttttctcgtagg

SEQ ID NO: 631332 - DNA, 20 bp, mouse
gcgagtgttgcgggaaggga

SEQ ID NO: 631333 - DNA, 20 bp, mouse
ggctccgatcttactctgtg

SEQ ID NO: 631334 - DNA, 20 bp, mouse
gcctccgaggggcccctagg

SEQ ID NO: 631335 - DNA, 20 bp, mouse
ggctacaagcatagtgacac

SEQ ID NO: 631336 - DNA, 20 bp, mouse
gggtggtgggcatcaggggt

SEQ ID NO: 631337 - DNA, 20 bp, mouse
gcatggggtggtgggcatca

SEQ ID NO: 631338 - DNA, 20 bp, mouse
gcaatagaacatggggtggt

SEQ ID NO: 631339 - DNA, 20 bp, mouse
gtttagagtcaaaactagaa

SEQ ID NO: 631340 - DNA, 20 bp, mouse
ggggcatcaggggtgggcag

SEQ ID NO: 631341 - DNA, 20 bp, mouse
gttctgctgcatgttggaac

SEQ ID NO: 631342 - DNA, 20 bp, mouse
ggaagagacctgtatcactg

SEQ ID NO: 631343 - DNA, 20 bp, mouse
gaaaactagaagggactact

SEQ ID NO: 631344 - DNA, 20 bp, mouse
ggctgagttctgctgcatgt

SEQ ID NO: 631345 - DNA, 20 bp, mouse
gacaattgatgctggtgagc

SEQ ID NO: 631346 - DNA, 20 bp, mouse
ggggatggcgactcccgggt

SEQ ID NO: 631347 - DNA, 20 bp, mouse
gtcggtgagctcggaatcgg

SEQ ID NO: 631348 - DNA, 20 bp, mouse
gaccgggcttaggtacaaga

SEQ ID NO: 631349 - DNA, 20 bp, mouse
ggggtcggtgagctcggaat

SEQ ID NO: 631350 - DNA, 20 bp, mouse
gtcgcccgcaccaggtccgg

SEQ ID NO: 631351 - DNA, 20 bp, mouse
gggcggggcctagaacaatt

SEQ ID NO: 631352 - DNA, 20 bp, mouse
gtccggggatggcgactccc

SEQ ID NO: 631353 - DNA, 20 bp, mouse
gtcgtcgcccgcaccaggtc

SEQ ID NO: 631354 - DNA, 20 bp, mouse
ggggtccagggagaggacaa

SEQ ID NO: 631355 - DNA, 20 bp, mouse
ggccctcagggaccgggctt

SEQ ID NO: 631356 - DNA, 20 bp, mouse
ggagtgggagcggcgacctg

SEQ ID NO: 631357 - DNA, 20 bp, mouse
ggcgctgtgagacaggatga

SEQ ID NO: 631358 - DNA, 20 bp, mouse
gcggtggagttggggcgagt

SEQ ID NO: 631359 - DNA, 20 bp, mouse
gcggcgacctggggtcggtg

SEQ ID NO: 631360 - DNA, 20 bp, mouse
ggggagcggcgacctggggt

SEQ ID NO: 631361 - DNA, 20 bp, mouse
gctcactccgcaccgacccc

SEQ ID NO: 631362 - DNA, 20 bp, mouse
gtaagggccccgcgcggaca

SEQ ID NO: 631363 - DNA, 20 bp, mouse
gtatggagccgctgctgaca

SEQ ID NO: 631364 - DNA, 20 bp, mouse
ggagctctggagtcaagatg

SEQ ID NO: 631365 - DNA, 20 bp, mouse
gtgtcactgtagggaagagt

SEQ ID NO: 631366 - DNA, 20 bp, mouse
ggcccgtccccctgacccca

SEQ ID NO: 631367 - DNA, 20 bp, mouse
gtgcgcgtgcgctactccgg

SEQ ID NO: 631368 - DNA, 20 bp, mouse
gcgagcggaagcggccggga

SEQ ID NO: 631369 - DNA, 20 bp, mouse
gaggctgggctcgacccgtt

SEQ ID NO: 631370 - DNA, 20 bp, mouse
gcgtaccatagagccggagg

SEQ ID NO: 631371 - DNA, 20 bp, mouse
gcggccgggaaggtcacttc

SEQ ID NO: 631372 - DNA, 20 bp, mouse
gtatggcgcctcgctccgag

SEQ ID NO: 631373 - DNA, 20 bp, mouse
gaccctggggtcagggggac

SEQ ID NO: 631374 - DNA, 20 bp, mouse
ggcctagagtggcgaggtag

SEQ ID NO: 631375 - DNA, 20 bp, mouse
gtagagtggcgaggtagcgg

SEQ ID NO: 631376 - DNA, 20 bp, mouse
gaagactgaggtagtcgcgt

SEQ ID NO: 631377 - DNA, 20 bp, mouse
gccccccccaaggcccgcaa

SEQ ID NO: 631378 - DNA, 20 bp, mouse
gcaggattccccctccccgt

SEQ ID NO: 631379 - DNA, 20 bp, mouse
ggcctcataatttgtcacag

SEQ ID NO: 631380 - DNA, 20 bp, mouse
gccaatcgagtgccagcggg

SEQ ID NO: 631381 - DNA, 20 bp, mouse
gaccgctgtgacaaattatg

SEQ ID NO: 631382 - DNA, 20 bp, mouse
gaaggcccgcaagggcgtgg

SEQ ID NO: 631383 - DNA, 20 bp, mouse
ggagtaactctaaacccacg

SEQ ID NO: 631384 - DNA, 20 bp, mouse
gaaaaggcccgccccaaccc

SEQ ID NO: 631385 - DNA, 20 bp, mouse
ggagcctgcaagccgcgcta

SEQ ID NO: 631386 - DNA, 20 bp, mouse
ggctaagaccaacccagcat

SEQ ID NO: 631387 - DNA, 20 bp, mouse
gtggtcagactgccaatgct

SEQ ID NO: 631388 - DNA, 20 bp, mouse
gctcttgcacctacaggacg

SEQ ID NO: 631389 - DNA, 20 bp, mouse
ggggccacagaccggaatgt

SEQ ID NO: 631390 - DNA, 20 bp, mouse
gggaagttggggccacagac

SEQ ID NO: 631391 - DNA, 20 bp, mouse
gcagactgccaatgctgggt

SEQ ID NO: 631392 - DNA, 20 bp, mouse
gcattggcagtctgaccaag

SEQ ID NO: 631393 - DNA, 20 bp, mouse
gtgcgtactcttgcacctac

SEQ ID NO: 631394 - DNA, 20 bp, mouse
ggcgctggggtcctacattc

SEQ ID NO: 631395 - DNA, 20 bp, mouse
gatggatccctgtacaggag

SEQ ID NO: 631396 - DNA, 20 bp, mouse
gggggcagccgcactcacca

SEQ ID NO: 631397 - DNA, 20 bp, mouse
ggacaaggagaagcattgat

SEQ ID NO: 631398 - DNA, 20 bp, mouse
ggatcggtgaaggcctgcca

SEQ ID NO: 631399 - DNA, 20 bp, mouse
gctcccctatccccttgggt

SEQ ID NO: 631400 - DNA, 20 bp, mouse
gagtggtaccagtgaccctg

SEQ ID NO: 631401 - DNA, 20 bp, mouse
gcacccacccaaggggatag

SEQ ID NO: 631402 - DNA, 20 bp, mouse
gccccgcaggagcgcaggag

SEQ ID NO: 631403 - DNA, 20 bp, mouse
ggagaagcattgatcggtga

SEQ ID NO: 631404 - DNA, 20 bp, mouse
gcagccgcactcaccatggc

SEQ ID NO: 631405 - DNA, 20 bp, mouse
gctagaaagactagactaga

SEQ ID NO: 631406 - DNA, 20 bp, mouse
gaccgaggagagagacctgg

SEQ ID NO: 631407 - DNA, 20 bp, mouse
ggggccgcagtcaaagacac

SEQ ID NO: 631408 - DNA, 20 bp, mouse
gatatggcggggacacacaa

SEQ ID NO: 631409 - DNA, 20 bp, mouse
gaggggggacagagataccg

SEQ ID NO: 631410 - DNA, 20 bp, mouse
ggattcccgctgtcagtagg

SEQ ID NO: 631411 - DNA, 20 bp, mouse
gacacaggacgacaatatgg

SEQ ID NO: 631412 - DNA, 20 bp, mouse
ggcgtgcgcaggctgtaggg

SEQ ID NO: 631413 - DNA, 20 bp, mouse
gaggaggctactgtaagcgg

SEQ ID NO: 631414 - DNA, 20 bp, mouse
gaagacacaggacgacaata

SEQ ID NO: 631415 - DNA, 20 bp, mouse
ggggaggaggctactgtaag

SEQ ID NO: 631416 - DNA, 20 bp, mouse
gaccgccgtgcagagagggt

SEQ ID NO: 631417 - DNA, 20 bp, mouse
ggaagtctccggctgcgaca

SEQ ID NO: 631418 - DNA, 20 bp, mouse
gcgtgcagagagggtaggaa

SEQ ID NO: 631419 - DNA, 20 bp, mouse
gagcgaccgccgtgcagaga

SEQ ID NO: 631420 - DNA, 20 bp, mouse
gctgaccccggacggagatg

SEQ ID NO: 631421 - DNA, 20 bp, mouse
gactgaggcgcccctcgcca

SEQ ID NO: 631422 - DNA, 20 bp, mouse
ggggagcgactgactgaccc

SEQ ID NO: 631423 - DNA, 20 bp, mouse
gccggacggagatggggcga

SEQ ID NO: 631424 - DNA, 20 bp, mouse
gccacctgcaacggtccccc

SEQ ID NO: 631425 - DNA, 20 bp, mouse
gtacccgcaaggccccaggt

SEQ ID NO: 631426 - DNA, 20 bp, mouse
gggagccgcccgcgcggcag

SEQ ID NO: 631427 - DNA, 20 bp, mouse
gtaacactcatgcctgccag

SEQ ID NO: 631428 - DNA, 20 bp, mouse
gggtcagagcccgcgcggta

SEQ ID NO: 631429 - DNA, 20 bp, mouse
gcggcagcgactgcgagtgc

SEQ ID NO: 631430 - DNA, 20 bp, mouse
ggcagcgggagccgcccgcg

SEQ ID NO: 631431 - DNA, 20 bp, mouse
ggagcgcggccggcatgcgg

SEQ ID NO: 631432 - DNA, 20 bp, mouse
ggtggctgcatcctccccag

SEQ ID NO: 631433 - DNA, 20 bp, mouse
ggcagtgctcgcctggagat

SEQ ID NO: 631434 - DNA, 20 bp, mouse
ggaggatgcagccacaaggg

SEQ ID NO: 631435 - DNA, 20 bp, mouse
gtgatactgagagctgtcag

SEQ ID NO: 631436 - DNA, 20 bp, mouse
gaagtctacagcaaaatctc

SEQ ID NO: 631437 - DNA, 20 bp, mouse
gctgcaggtataaatctcag

SEQ ID NO: 631438 - DNA, 20 bp, mouse
ggagcagaactgcaaaggtt

SEQ ID NO: 631439 - DNA, 20 bp, mouse
gtcttagatgataataaaca

SEQ ID NO: 631440 - DNA, 20 bp, mouse
gtataaatctcagaggtgaa

SEQ ID NO: 631441 - DNA, 20 bp, mouse
gcttagaagcaccataaagt

SEQ ID NO: 631442 - DNA, 20 bp, mouse
ggtttactgttcaaatgtta

SEQ ID NO: 631443 - DNA, 20 bp, mouse
gtatgaccacgctcataagc

SEQ ID NO: 631444 - DNA, 20 bp, mouse
ggcttacctgcttatgagcg

SEQ ID NO: 631445 - DNA, 20 bp, mouse
ggaaaggacttttctcatgt

SEQ ID NO: 631446 - DNA, 20 bp, mouse
gggcccgccaacagaaggac

SEQ ID NO: 631447 - DNA, 20 bp, mouse
gatgccagcgatctacaagg

SEQ ID NO: 631448 - DNA, 20 bp, mouse
gggaccagcctggccgttct

SEQ ID NO: 631449 - DNA, 20 bp, mouse
gacagagagcaggggaaaca

SEQ ID NO: 631450 - DNA, 20 bp, mouse
gtctgctgccagggacccta

SEQ ID NO: 631451 - DNA, 20 bp, mouse
gggcattgccctagggtccc

SEQ ID NO: 631452 - DNA, 20 bp, mouse
gagatcgctggcattgccct

SEQ ID NO: 631453 - DNA, 20 bp, mouse
gaacacgcctgtccttctgt

SEQ ID NO: 631454 - DNA, 20 bp, mouse
ggaaccaagaacggccaggc

SEQ ID NO: 631455 - DNA, 20 bp, mouse
gaagagtatctcaatttcag

SEQ ID NO: 631456 - DNA, 20 bp, mouse
gggtctgagcctgccatctt

SEQ ID NO: 631457 - DNA, 20 bp, mouse
gccgttgcgggaagttgtgc

SEQ ID NO: 631458 - DNA, 20 bp, mouse
gcgggaagttgtgctggtgg

SEQ ID NO: 631459 - DNA, 20 bp, mouse
gctgggagcgtcctgtgact

SEQ ID NO: 631460 - DNA, 20 bp, mouse
gagggagctgggtctagtag

SEQ ID NO: 631461 - DNA, 20 bp, mouse
ggatttagaaagttcagagg

SEQ ID NO: 631462 - DNA, 20 bp, mouse
ggtgtcacactaggaactct

SEQ ID NO: 631463 - DNA, 20 bp, mouse
gccacccacaggcaagagac

SEQ ID NO: 631464 - DNA, 20 bp, mouse
gttcccgcaacggacgcctg

SEQ ID NO: 631465 - DNA, 20 bp, mouse
ggagtccccacgcatggtcg

SEQ ID NO: 631466 - DNA, 20 bp, mouse
ggtcctgtgtagctccaggg

SEQ ID NO: 631467 - DNA, 20 bp, mouse
gtgagtcctgtgtagctcca

SEQ ID NO: 631468 - DNA, 20 bp, mouse
gtgcctccctggagctacac

SEQ ID NO: 631469 - DNA, 20 bp, mouse
ggggcctacaatcagcagaa

SEQ ID NO: 631470 - DNA, 20 bp, mouse
ggcagaagggacagcgactc

SEQ ID NO: 631471 - DNA, 20 bp, mouse
gtcaaacagggcggcaatgg

SEQ ID NO: 631472 - DNA, 20 bp, mouse
gaagtcaccacctgcctccc

SEQ ID NO: 631473 - DNA, 20 bp, mouse
ggaggagcatggatagtcag

SEQ ID NO: 631474 - DNA, 20 bp, mouse
gagctacacaggactcaaac

SEQ ID NO: 631475 - DNA, 20 bp, mouse
gaccgacaggaccagacccc

SEQ ID NO: 631476 - DNA, 20 bp, mouse
ggacagagtcccccgaacct

SEQ ID NO: 631477 - DNA, 20 bp, mouse
ggccggtgtcccaggttcgg

SEQ ID NO: 631478 - DNA, 20 bp, mouse
ggctccagatcccaagatgg

SEQ ID NO: 631479 - DNA, 20 bp, mouse
gccggctccagatcccaaga

SEQ ID NO: 631480 - DNA, 20 bp, mouse
ggatctggagccggtgtccc

SEQ ID NO: 631481 - DNA, 20 bp, mouse
ggccagggagagcacagcgg

SEQ ID NO: 631482 - DNA, 20 bp, mouse
ggacagcataccaccatctt

SEQ ID NO: 631483 - DNA, 20 bp, mouse
gtcccccgaacctgggacac

SEQ ID NO: 631484 - DNA, 20 bp, mouse
gactctgtcggtaccggcac

SEQ ID NO: 631485 - DNA, 20 bp, mouse
ggacgcgacaggacactcgg

SEQ ID NO: 631486 - DNA, 20 bp, mouse
gtagttcctgcagtcagtgg

SEQ ID NO: 631487 - DNA, 20 bp, mouse
gctctcgcagtgccaggtct

SEQ ID NO: 631488 - DNA, 20 bp, mouse
ggattgttagcatctgtaca

SEQ ID NO: 631489 - DNA, 20 bp, mouse
gtgactgcaggaactacaag

SEQ ID NO: 631490 - DNA, 20 bp, mouse
gctggaccagctccacccgg

SEQ ID NO: 631491 - DNA, 20 bp, mouse
gcagagcgggatcctccggg

SEQ ID NO: 631492 - DNA, 20 bp, mouse
gcaggtctaggcagagtggg

SEQ ID NO: 631493 - DNA, 20 bp, mouse
gtgccaggtctaggcagagt

SEQ ID NO: 631494 - DNA, 20 bp, mouse
ggcctcagagcgggatcctc

SEQ ID NO: 631495 - DNA, 20 bp, mouse
gtccagatccccaaataagg

SEQ ID NO: 631496 - DNA, 20 bp, mouse
ggcacgccgggtggacgctg

SEQ ID NO: 631497 - DNA, 20 bp, mouse
gagccggctactgtgaacct

SEQ ID NO: 631498 - DNA, 20 bp, mouse
ggtcgggagagcagggtcga

SEQ ID NO: 631499 - DNA, 20 bp, mouse
gtggagtccggatcagacac

SEQ ID NO: 631500 - DNA, 20 bp, mouse
ggctactgtgaacctgggac

SEQ ID NO: 631501 - DNA, 20 bp, mouse
gggaatcctcagcgtccacc

SEQ ID NO: 631502 - DNA, 20 bp, mouse
ggcccaccccagctacgcac

SEQ ID NO: 631503 - DNA, 20 bp, mouse
ggtttggattctgaacactg

SEQ ID NO: 631504 - DNA, 20 bp, mouse
gagctctgcacgcggcacgc

SEQ ID NO: 631505 - DNA, 20 bp, mouse
gctctctgaagtggctgcgc

SEQ ID NO: 631506 - DNA, 20 bp, mouse
gggtgcactgaaggattgca

SEQ ID NO: 631507 - DNA, 20 bp, mouse
gtgcggaacccgggaggagg

SEQ ID NO: 631508 - DNA, 20 bp, mouse
gctgaaggattgcagggctt

SEQ ID NO: 631509 - DNA, 20 bp, mouse
ggctccctcccactcaccaa

SEQ ID NO: 631510 - DNA, 20 bp, mouse
ggcaaggaaggcctttggtg

SEQ ID NO: 631511 - DNA, 20 bp, mouse
gcctcccactcaccaagggg

SEQ ID NO: 631512 - DNA, 20 bp, mouse
gggcctttggtgcggaaccc

SEQ ID NO: 631513 - DNA, 20 bp, mouse
gctcccgggttccgcaccaa

SEQ ID NO: 631514 - DNA, 20 bp, mouse
gagacaggactacctactag

SEQ ID NO: 631515 - DNA, 20 bp, mouse
gagcttgcaaggaaggcctt

SEQ ID NO: 631516 - DNA, 20 bp, mouse
gctcccccggcccgtagcaa

SEQ ID NO: 631517 - DNA, 20 bp, mouse
ggccagagagcgctaggacg

SEQ ID NO: 631518 - DNA, 20 bp, mouse
gagcgcagcggcgggaaccg

SEQ ID NO: 631519 - DNA, 20 bp, mouse
gctgctgatcctgactcccc

SEQ ID NO: 631520 - DNA, 20 bp, mouse
ggaagcagttcctttgctac

SEQ ID NO: 631521 - DNA, 20 bp, mouse
gcagttcctttgctacgggc

SEQ ID NO: 631522 - DNA, 20 bp, mouse
ggctacgggccgggggagtc

SEQ ID NO: 631523 - DNA, 20 bp, mouse
gttcctttgctacgggccgg

SEQ ID NO: 631524 - DNA, 20 bp, mouse
gggcgggaaccgcggtccag

SEQ ID NO: 631525 - DNA, 20 bp, mouse
gtccgcgtcctagcgctctc

SEQ ID NO: 631526 - DNA, 20 bp, mouse
gccaacggcagacagacgga

SEQ ID NO: 631527 - DNA, 20 bp, mouse
gggcggacagacaaagccaa

SEQ ID NO: 631528 - DNA, 20 bp, mouse
gaaagccaacggcagacaga

SEQ ID NO: 631529 - DNA, 20 bp, mouse
gagatggcgacgcggacgac

SEQ ID NO: 631530 - DNA, 20 bp, mouse
ggaggcggagcccagggacg

SEQ ID NO: 631531 - DNA, 20 bp, mouse
gctggcggcggggaggcgag

SEQ ID NO: 631532 - DNA, 20 bp, mouse
gtctgggacccggccccggt

SEQ ID NO: 631533 - DNA, 20 bp, mouse
gccgcccgcccgctccagga

SEQ ID NO: 631534 - DNA, 20 bp, mouse
gctcggcgctccgcgtccct

SEQ ID NO: 631535 - DNA, 20 bp, mouse
gaaaaaaaaagatggcgacg

SEQ ID NO: 631536 - DNA, 20 bp, mouse
gaaaaaacaaacttccagta

SEQ ID NO: 631537 - DNA, 20 bp, mouse
gtttcttccggaagccttac

SEQ ID NO: 631538 - DNA, 20 bp, mouse
gtgccagtcacacaacgact

SEQ ID NO: 631539 - DNA, 20 bp, mouse
gacgggcaggatgccaaaca

SEQ ID NO: 631540 - DNA, 20 bp, mouse
gacaacgactcggtttcttc

SEQ ID NO: 631541 - DNA, 20 bp, mouse
gtgtgactggcagttccgcc

SEQ ID NO: 631542 - DNA, 20 bp, mouse
gaaccgagtcgttgtgtgac

SEQ ID NO: 631543 - DNA, 20 bp, mouse
gaactagggctttccatgtt

SEQ ID NO: 631544 - DNA, 20 bp, mouse
gcaagtgaggagcatcacaa

SEQ ID NO: 631545 - DNA, 20 bp, mouse
gcagtgggagctgaggtggt

SEQ ID NO: 631546 - DNA, 20 bp, mouse
gtgtgctcgcgtgtgatggg

SEQ ID NO: 631547 - DNA, 20 bp, mouse
ggccggtgcggcggtgtcta

SEQ ID NO: 631548 - DNA, 20 bp, mouse
ggccatagacaccgccgcac

SEQ ID NO: 631549 - DNA, 20 bp, mouse
gaaataaatgagcgccggtg

SEQ ID NO: 631550 - DNA, 20 bp, mouse
gtaaatgagcgccggtgcgg

SEQ ID NO: 631551 - DNA, 20 bp, mouse
gtcctgtgctcgcgtgtgat

SEQ ID NO: 631552 - DNA, 20 bp, mouse
gtgcacacaccggagagaag

SEQ ID NO: 631553 - DNA, 20 bp, mouse
gtttcctggagccagaagag

SEQ ID NO: 631554 - DNA, 20 bp, mouse
gggtataaataaatgagcgc

SEQ ID NO: 631555 - DNA, 20 bp, mouse
gatcccgacattagtgttag

SEQ ID NO: 631556 - DNA, 20 bp, mouse
gggagtccgagtagaggtgg

SEQ ID NO: 631557 - DNA, 20 bp, mouse
gccagccggagtccgagtag

SEQ ID NO: 631558 - DNA, 20 bp, mouse
ggccggagtccgagtagagg

SEQ ID NO: 631559 - DNA, 20 bp, mouse
gggcgtcctccacctctact

SEQ ID NO: 631560 - DNA, 20 bp, mouse
gcagcaccgggagagagtag

SEQ ID NO: 631561 - DNA, 20 bp, mouse
gactccggctgggaagcgag

SEQ ID NO: 631562 - DNA, 20 bp, mouse
gtgagtcctgggcgcaaaca

SEQ ID NO: 631563 - DNA, 20 bp, mouse
ggctagactcgcctgagtcc

SEQ ID NO: 631564 - DNA, 20 bp, mouse
gggtgaatcaggaagaactg

SEQ ID NO: 631565 - DNA, 20 bp, mouse
ggggaagcgagtggtgaatc

SEQ ID NO: 631566 - DNA, 20 bp, mouse
gcctggaatgccgggtacag

SEQ ID NO: 631567 - DNA, 20 bp, mouse
ggtccgtggccgatggggta

SEQ ID NO: 631568 - DNA, 20 bp, mouse
ggaatgccgggtacagaggc

SEQ ID NO: 631569 - DNA, 20 bp, mouse
gcgcagatgatgaggaatgg

SEQ ID NO: 631570 - DNA, 20 bp, mouse
gggctggtccgtggccgatg

SEQ ID NO: 631571 - DNA, 20 bp, mouse
ggataacaggacccagggtc

SEQ ID NO: 631572 - DNA, 20 bp, mouse
ggcagtcccggccacagtgg

SEQ ID NO: 631573 - DNA, 20 bp, mouse
gcccagggtcaggcgaggtg

SEQ ID NO: 631574 - DNA, 20 bp, mouse
gcaccctaccccatcggcca

SEQ ID NO: 631575 - DNA, 20 bp, mouse
gtccttcaggctgcagcaag

SEQ ID NO: 631576 - DNA, 20 bp, mouse
ggccatggcggcctatgggg

SEQ ID NO: 631577 - DNA, 20 bp, mouse
gaggcgcggaaccggagtcc

SEQ ID NO: 631578 - DNA, 20 bp, mouse
gccgggaatgtcggcgacag

SEQ ID NO: 631579 - DNA, 20 bp, mouse
gtaggccgccatggcaggcg

SEQ ID NO: 631580 - DNA, 20 bp, mouse
gccgcccctacagacgacac

SEQ ID NO: 631581 - DNA, 20 bp, mouse
gggttccgcgcctgccatgg

SEQ ID NO: 631582 - DNA, 20 bp, mouse
gagcagggctgtgagcgcag

SEQ ID NO: 631583 - DNA, 20 bp, mouse
gtccggttccgcgcctgcca

SEQ ID NO: 631584 - DNA, 20 bp, mouse
gagggctgtgagcgcagagg

SEQ ID NO: 631585 - DNA, 20 bp, mouse
gcgccgacattcccggactc

SEQ ID NO: 631586 - DNA, 20 bp, mouse
gtaccgggttaggtcgggta

SEQ ID NO: 631587 - DNA, 20 bp, mouse
ggacagtaccgggttaggtc

SEQ ID NO: 631588 - DNA, 20 bp, mouse
gaccaggacagtaccgggtt

SEQ ID NO: 631589 - DNA, 20 bp, mouse
gtaccgaccaggacagtacc

SEQ ID NO: 631590 - DNA, 20 bp, mouse
gtgccctacccgacctaacc

SEQ ID NO: 631591 - DNA, 20 bp, mouse
gcgaccagcgaataccgacc

SEQ ID NO: 631592 - DNA, 20 bp, mouse
ggatctcacggcttcgaact

SEQ ID NO: 631593 - DNA, 20 bp, mouse
ggcttaaagagggactaagg

SEQ ID NO: 631594 - DNA, 20 bp, mouse
gtgtcctggtcggtattcgc

SEQ ID NO: 631595 - DNA, 20 bp, mouse
gggcgggagtgtgactgcat

SEQ ID NO: 631596 - DNA, 20 bp, mouse
gctgtgctggaagaggaatc

SEQ ID NO: 631597 - DNA, 20 bp, mouse
gcagagggcgagcgagcaga

SEQ ID NO: 631598 - DNA, 20 bp, mouse
ggcagagagatggcccgtgg

SEQ ID NO: 631599 - DNA, 20 bp, mouse
gcgggcttctgtgctggaag

SEQ ID NO: 631600 - DNA, 20 bp, mouse
gtggaaggcggcttctgcag

SEQ ID NO: 631601 - DNA, 20 bp, mouse
gtcgccgaggcaaggatggg

SEQ ID NO: 631602 - DNA, 20 bp, mouse
gtaggcccgaagcctaggac

SEQ ID NO: 631603 - DNA, 20 bp, mouse
gctgggctgtgcagtggagg

SEQ ID NO: 631604 - DNA, 20 bp, mouse
gccgtggcgggcttctgtgc

SEQ ID NO: 631605 - DNA, 20 bp, mouse
ggagagcattcgccagaggg

SEQ ID NO: 631606 - DNA, 20 bp, mouse
ggcagatctaggcttagggg

SEQ ID NO: 631607 - DNA, 20 bp, mouse
gggctgaccatgccagagac

SEQ ID NO: 631608 - DNA, 20 bp, mouse
gtccggcgtgcagggagcgg

SEQ ID NO: 631609 - DNA, 20 bp, mouse
gcacaaacgtaaaaagaacc

SEQ ID NO: 631610 - DNA, 20 bp, mouse
gctgcactgcacatccaaat

SEQ ID NO: 631611 - DNA, 20 bp, mouse
gagtgcagatctaggcttag

SEQ ID NO: 631612 - DNA, 20 bp, mouse
gtctgcggtgttctcaaagt

SEQ ID NO: 631613 - DNA, 20 bp, mouse
gatccaggaactctgcgggt

SEQ ID NO: 631614 - DNA, 20 bp, mouse
gtctaggcttaggggtggct

SEQ ID NO: 631615 - DNA, 20 bp, mouse
gttcctggatttgcaagtct

SEQ ID NO: 631616 - DNA, 20 bp, mouse
gagagagttgaggtatcaga

SEQ ID NO: 631617 - DNA, 20 bp, mouse
gtgaggtgacctgcttgagg

SEQ ID NO: 631618 - DNA, 20 bp, mouse
gtggaggtgtcagtcccacg

SEQ ID NO: 631619 - DNA, 20 bp, mouse
gaaggcccctgtttccccgt

SEQ ID NO: 631620 - DNA, 20 bp, mouse
gatgtcttgagaattagagc

SEQ ID NO: 631621 - DNA, 20 bp, mouse
gatagggtgaccttcaggtt

SEQ ID NO: 631622 - DNA, 20 bp, mouse
ggtgccctgggaaacctgat

SEQ ID NO: 631623 - DNA, 20 bp, mouse
gttgacatagggtgaccttc

SEQ ID NO: 631624 - DNA, 20 bp, mouse
gtttaggagggagagagttg

SEQ ID NO: 631625 - DNA, 20 bp, mouse
gactgatgacccagtatgtg

SEQ ID NO: 631626 - DNA, 20 bp, mouse
gcatcctggcggtcacacca

SEQ ID NO: 631627 - DNA, 20 bp, mouse
gcatcgaagctccaacacaa

SEQ ID NO: 631628 - DNA, 20 bp, mouse
ggggcccagctccatcctgg

SEQ ID NO: 631629 - DNA, 20 bp, mouse
gggcacaacccagaccacca

SEQ ID NO: 631630 - DNA, 20 bp, mouse
gcggagcaggctgtgctaag

SEQ ID NO: 631631 - DNA, 20 bp, mouse
gaagctccaacacaaaggtc

SEQ ID NO: 631632 - DNA, 20 bp, mouse
gcaacccagaccaccacgga

SEQ ID NO: 631633 - DNA, 20 bp, mouse
gacatggggtccctccgtgg

SEQ ID NO: 631634 - DNA, 20 bp, mouse
gagaccctggtgtgaccgcc

SEQ ID NO: 631635 - DNA, 20 bp, mouse
gagttccaggtgggagatgg

SEQ ID NO: 631636 - DNA, 20 bp, mouse
gctcctcagcctcctcccgg

SEQ ID NO: 631637 - DNA, 20 bp, mouse
gccagcgccggtgagtgact

SEQ ID NO: 631638 - DNA, 20 bp, mouse
ggccatcccacggtattagg

SEQ ID NO: 631639 - DNA, 20 bp, mouse
gtggggtctccgccgggagg

SEQ ID NO: 631640 - DNA, 20 bp, mouse
gaggaggtgccgccgctccg

SEQ ID NO: 631641 - DNA, 20 bp, mouse
gccggcggagaccccagcgc

SEQ ID NO: 631642 - DNA, 20 bp, mouse
gggagacccgagggcccaac

SEQ ID NO: 631643 - DNA, 20 bp, mouse
gatctggagtgatcttgtag

SEQ ID NO: 631644 - DNA, 20 bp, mouse
gtggcaagcagaggatctcg

SEQ ID NO: 631645 - DNA, 20 bp, mouse
gcatctacgggtaagatatc

SEQ ID NO: 631646 - DNA, 20 bp, mouse
gtctgcggcacagggaggtg

SEQ ID NO: 631647 - DNA, 20 bp, mouse
ggcagagccgagccacaata

SEQ ID NO: 631648 - DNA, 20 bp, mouse
gtcggctctgcggcacaggg

SEQ ID NO: 631649 - DNA, 20 bp, mouse
ggagccgagccacaatatgg

SEQ ID NO: 631650 - DNA, 20 bp, mouse
ggctgctgccgggaccagtg

SEQ ID NO: 631651 - DNA, 20 bp, mouse
gggaccagtgaggagagcgc

SEQ ID NO: 631652 - DNA, 20 bp, mouse
gcttcacggccgccatattg

SEQ ID NO: 631653 - DNA, 20 bp, mouse
gggctcggctctgcggcaca

SEQ ID NO: 631654 - DNA, 20 bp, mouse
ggcaagaggcgggttcttca

SEQ ID NO: 631655 - DNA, 20 bp, mouse
gactggagagcggcaagagg

SEQ ID NO: 631656 - DNA, 20 bp, mouse
gcccacctaacggtttacct

SEQ ID NO: 631657 - DNA, 20 bp, mouse
gagcgcctaggtaaaccgtt

SEQ ID NO: 631658 - DNA, 20 bp, mouse
gtaaggtctgagcgccacct

SEQ ID NO: 631659 - DNA, 20 bp, mouse
gctaggcgcttcctattcca

SEQ ID NO: 631660 - DNA, 20 bp, mouse
gggcgcttcctattccaagg

SEQ ID NO: 631661 - DNA, 20 bp, mouse
ggcctaggtaaaccgttagg

SEQ ID NO: 631662 - DNA, 20 bp, mouse
gcggtctattacttccggta

SEQ ID NO: 631663 - DNA, 20 bp, mouse
gacttccggtctattacttc

SEQ ID NO: 631664 - DNA, 20 bp, mouse
gggcgccgccatgacaaaga

SEQ ID NO: 631665 - DNA, 20 bp, mouse
ggcggagctttcgcaaggta

SEQ ID NO: 631666 - DNA, 20 bp, mouse
gataaggacgctagctacag

SEQ ID NO: 631667 - DNA, 20 bp, mouse
gggctcacagttgtgtatgg

SEQ ID NO: 631668 - DNA, 20 bp, mouse
gtctggctcacagttgtgta

SEQ ID NO: 631669 - DNA, 20 bp, mouse
gtcgtcgtctgcacctcata

SEQ ID NO: 631670 - DNA, 20 bp, mouse
gagggcagatgggaagcgag

SEQ ID NO: 631671 - DNA, 20 bp, mouse
ggggccgcagacaccagcta

SEQ ID NO: 631672 - DNA, 20 bp, mouse
gggccgccgcgagggcagat

SEQ ID NO: 631673 - DNA, 20 bp, mouse
ggcgtcccaagtcctaaggt

SEQ ID NO: 631674 - DNA, 20 bp, mouse
gccaggacaccggacagcac

SEQ ID NO: 631675 - DNA, 20 bp, mouse
gggtgcagacgacgacgatg

SEQ ID NO: 631676 - DNA, 20 bp, mouse
ggctgacgccaagaggatca

SEQ ID NO: 631677 - DNA, 20 bp, mouse
gagtgcttggagctgtgtgg

SEQ ID NO: 631678 - DNA, 20 bp, mouse
ggacgccaagaggatcaggg

SEQ ID NO: 631679 - DNA, 20 bp, mouse
gaaggctgcttgctagacta

SEQ ID NO: 631680 - DNA, 20 bp, mouse
gaggttcttcaccgaaactg

SEQ ID NO: 631681 - DNA, 20 bp, mouse
gaactgaggaaagccgttgt

SEQ ID NO: 631682 - DNA, 20 bp, mouse
gcggccgccatgttagctaa

SEQ ID NO: 631683 - DNA, 20 bp, mouse
gagtgaacgcggggacgtcg

SEQ ID NO: 631684 - DNA, 20 bp, mouse
gatcagggcggaagtaccta

SEQ ID NO: 631685 - DNA, 20 bp, mouse
ggcctggcaatggtgagcga

SEQ ID NO: 631686 - DNA, 20 bp, mouse
gcgcgtggtcccgtgagctg

SEQ ID NO: 631687 - DNA, 20 bp, mouse
gcgatcacaccgcagctcac

SEQ ID NO: 631688 - DNA, 20 bp, mouse
ggaacaccagacgagacgag

SEQ ID NO: 631689 - DNA, 20 bp, mouse
gacagggcgccagcactggg

SEQ ID NO: 631690 - DNA, 20 bp, mouse
ggcgctccccctacagctcc

SEQ ID NO: 631691 - DNA, 20 bp, mouse
gccgctgccgggagctgtag

SEQ ID NO: 631692 - DNA, 20 bp, mouse
gaccagacgagacgagaggt

SEQ ID NO: 631693 - DNA, 20 bp, mouse
gaacagaatctgcagcatgg

SEQ ID NO: 631694 - DNA, 20 bp, mouse
ggaagactcctcctaatcag

SEQ ID NO: 631695 - DNA, 20 bp, mouse
gtcgcccagtggaacgcaca

SEQ ID NO: 631696 - DNA, 20 bp, mouse
ggacacagcaccgctaactt

SEQ ID NO: 631697 - DNA, 20 bp, mouse
gcggagccgaggtggaccag

SEQ ID NO: 631698 - DNA, 20 bp, mouse
gccgatcgagagcgaggagc

SEQ ID NO: 631699 - DNA, 20 bp, mouse
gtgagcctggatgcaaatct

SEQ ID NO: 631700 - DNA, 20 bp, mouse
gagagatccgatcgagagcg

SEQ ID NO: 631701 - DNA, 20 bp, mouse
gaggcagggagaagccgagt

SEQ ID NO: 631702 - DNA, 20 bp, mouse
gctggatgcaaatctgggtg

SEQ ID NO: 631703 - DNA, 20 bp, mouse
gccgaggtggaccagaggca

SEQ ID NO: 631704 - DNA, 20 bp, mouse
gggaagtgcggttcgcagag

SEQ ID NO: 631705 - DNA, 20 bp, mouse
gaacgtctgcagacgggatg

SEQ ID NO: 631706 - DNA, 20 bp, mouse
gccacccagcggaatcggag

SEQ ID NO: 631707 - DNA, 20 bp, mouse
gtcggagcggcaagacccag

SEQ ID NO: 631708 - DNA, 20 bp, mouse
gcggcctgtgacttagatgt

SEQ ID NO: 631709 - DNA, 20 bp, mouse
gcggctcctgctgtcagtga

SEQ ID NO: 631710 - DNA, 20 bp, mouse
gagcacaccaggacactccg

SEQ ID NO: 631711 - DNA, 20 bp, mouse
ggaggggctttgtctgaccg

SEQ ID NO: 631712 - DNA, 20 bp, mouse
gagcagacggagaccgcaat

SEQ ID NO: 631713 - DNA, 20 bp, mouse
gaggtctcgggaggatcctg

SEQ ID NO: 631714 - DNA, 20 bp, mouse
gagtacgcttcttgcatgag

SEQ ID NO: 631715 - DNA, 20 bp, mouse
gcgactctgatatctaggcc

SEQ ID NO: 631716 - DNA, 20 bp, mouse
gagctcttgcagtaagtgga

SEQ ID NO: 631717 - DNA, 20 bp, mouse
ggagagggcgggcacagaag

SEQ ID NO: 631718 - DNA, 20 bp, mouse
gcactggggaaaacaacctg

SEQ ID NO: 631719 - DNA, 20 bp, mouse
gcggcagctcttgcagtaag

SEQ ID NO: 631720 - DNA, 20 bp, mouse
ggcgctgcccgggtccctct

SEQ ID NO: 631721 - DNA, 20 bp, mouse
ggcgccgctagaagcggagg

SEQ ID NO: 631722 - DNA, 20 bp, mouse
gagggcgggcacagaagcgg

SEQ ID NO: 631723 - DNA, 20 bp, mouse
gagggcgccgctagaagcgg

SEQ ID NO: 631724 - DNA, 20 bp, mouse
ggggagggcgccgctagaag

SEQ ID NO: 631725 - DNA, 20 bp, mouse
gcagcgtcgcggtgagacac

SEQ ID NO: 631726 - DNA, 20 bp, mouse
gtctggggtgtcagccacgg

SEQ ID NO: 631727 - DNA, 20 bp, mouse
gtcccaggctcccgcctccg

SEQ ID NO: 631728 - DNA, 20 bp, mouse
ggccacggaggcgggagcct

SEQ ID NO: 631729 - DNA, 20 bp, mouse
gctctccagcgcagactcca

SEQ ID NO: 631730 - DNA, 20 bp, mouse
gtatttcaggcaggttctct

SEQ ID NO: 631731 - DNA, 20 bp, mouse
gacctgcctgaaatagagtc

SEQ ID NO: 631732 - DNA, 20 bp, mouse
ggctctcctgactctatttc

SEQ ID NO: 631733 - DNA, 20 bp, mouse
gggggtgtcagccacggagg

SEQ ID NO: 631734 - DNA, 20 bp, mouse
gagcgttgctggctcaggtt

SEQ ID NO: 631735 - DNA, 20 bp, mouse
gctgggaggacgcggggaaa

SEQ ID NO: 631736 - DNA, 20 bp, mouse
gggtttgactgtgagtctta

SEQ ID NO: 631737 - DNA, 20 bp, mouse
gagtcttagggaagctcttg

SEQ ID NO: 631738 - DNA, 20 bp, mouse
gtgtacgcaggcgcagagag

SEQ ID NO: 631739 - DNA, 20 bp, mouse
ggcctccgcctgggagatga

SEQ ID NO: 631740 - DNA, 20 bp, mouse
gtgaggtcccctcatctccc

SEQ ID NO: 631741 - DNA, 20 bp, mouse
gagtcaaacctgcagcatgg

SEQ ID NO: 631742 - DNA, 20 bp, mouse
ggatggagcccacacctgaa

SEQ ID NO: 631743 - DNA, 20 bp, mouse
gggtcccctcatctcccagg

SEQ ID NO: 631744 - DNA, 20 bp, mouse
gggggaactaagtcgatcag

SEQ ID NO: 631745 - DNA, 20 bp, mouse
gagaggtcccgcctccgcct

SEQ ID NO: 631746 - DNA, 20 bp, mouse
gaacagggaccggatggaat

SEQ ID NO: 631747 - DNA, 20 bp, mouse
ggttagactgacagaaatca

SEQ ID NO: 631748 - DNA, 20 bp, mouse
gcatagttccggaaggaaca

SEQ ID NO: 631749 - DNA, 20 bp, mouse
gttctgtcagtctaacgcag

SEQ ID NO: 631750 - DNA, 20 bp, mouse
gtgggtgaaggtctttgcct

SEQ ID NO: 631751 - DNA, 20 bp, mouse
ggaccggatggaatgggagc

SEQ ID NO: 631752 - DNA, 20 bp, mouse
ggtcagtaagtttagttaag

SEQ ID NO: 631753 - DNA, 20 bp, mouse
gaggattgcctgggcagtgt

SEQ ID NO: 631754 - DNA, 20 bp, mouse
gcacccagccaacactgccc

SEQ ID NO: 631755 - DNA, 20 bp, mouse
gatccggtccctgttccttc

SEQ ID NO: 631756 - DNA, 20 bp, mouse
ggcacggtgacgtcacagat

SEQ ID NO: 631757 - DNA, 20 bp, mouse
gacgtcacagatcggtactt

SEQ ID NO: 631758 - DNA, 20 bp, mouse
gattctgtcggtctaaacag

SEQ ID NO: 631759 - DNA, 20 bp, mouse
gcataggtccggagggaaca

SEQ ID NO: 631760 - DNA, 20 bp, mouse
gggagggaacagggaccggg

SEQ ID NO: 631761 - DNA, 20 bp, mouse
gtaaacaagagttcagcttt

SEQ ID NO: 631762 - DNA, 20 bp, mouse
ggggtctgtgcggggtgcat

SEQ ID NO: 631763 - DNA, 20 bp, mouse
gcacccagccaacattgcct

SEQ ID NO: 631764 - DNA, 20 bp, mouse
ggaccgggtggaatggaagc

SEQ ID NO: 631765 - DNA, 20 bp, mouse
gtttagaccgacagaattca

SEQ ID NO: 631766 - DNA, 20 bp, mouse
ggcccagagcgggtaagact

SEQ ID NO: 631767 - DNA, 20 bp, mouse
ggcctggcggaagcacgcag

SEQ ID NO: 631768 - DNA, 20 bp, mouse
gtggcagagctggaacggcc

SEQ ID NO: 631769 - DNA, 20 bp, mouse
ggcctagtcttacccgctct

SEQ ID NO: 631770 - DNA, 20 bp, mouse
gggaacggccgggaacctgc

SEQ ID NO: 631771 - DNA, 20 bp, mouse
ggaaagctcaatgcccagag

SEQ ID NO: 631772 - DNA, 20 bp, mouse
ggccctggcccgcaggttcc

SEQ ID NO: 631773 - DNA, 20 bp, mouse
ggccgggaacctgcgggcca

SEQ ID NO: 631774 - DNA, 20 bp, mouse
gttttctggcagagctggaa

SEQ ID NO: 631775 - DNA, 20 bp, mouse
ggcctctgcgtgcttccgcc

SEQ ID NO: 631776 - DNA, 20 bp, mouse
gcgaccccaaactccctcag

SEQ ID NO: 631777 - DNA, 20 bp, mouse
gcagtccgctgagggagttt

SEQ ID NO: 631778 - DNA, 20 bp, mouse
gacctcaggccgctccaccc

SEQ ID NO: 631779 - DNA, 20 bp, mouse
gactgagagagcagtgacaa

SEQ ID NO: 631780 - DNA, 20 bp, mouse
gtccctcggtacgggaacca

SEQ ID NO: 631781 - DNA, 20 bp, mouse
gtccaccctggagccgcgtg

SEQ ID NO: 631782 - DNA, 20 bp, mouse
ggcagcctcacgcggctcca

SEQ ID NO: 631783 - DNA, 20 bp, mouse
ggacctcaagcagcctcacg

SEQ ID NO: 631784 - DNA, 20 bp, mouse
gggacgggcctgggaaccga

SEQ ID NO: 631785 - DNA, 20 bp, mouse
gcccatggaccggaaagact

SEQ ID NO: 631786 - DNA, 20 bp, mouse
gcgctgcagatgcccgggga

SEQ ID NO: 631787 - DNA, 20 bp, mouse
gaagcgggaggacgccgacg

SEQ ID NO: 631788 - DNA, 20 bp, mouse
ggcgggaggacaaggcgagt

SEQ ID NO: 631789 - DNA, 20 bp, mouse
ggggatggctgagaagcggg

SEQ ID NO: 631790 - DNA, 20 bp, mouse
ggcctccgctgcagatgccc

SEQ ID NO: 631791 - DNA, 20 bp, mouse
gccgaggtgagaatcgctca

SEQ ID NO: 631792 - DNA, 20 bp, mouse
gcgggaggacgccgacgtgg

SEQ ID NO: 631793 - DNA, 20 bp, mouse
gtgcgtggaagagacaagcc

SEQ ID NO: 631794 - DNA, 20 bp, mouse
gattctcacctcggtgacag

SEQ ID NO: 631795 - DNA, 20 bp, mouse
gacactaagggatccagagg

SEQ ID NO: 631796 - DNA, 20 bp, mouse
ggtactgctctgcaacaaca

SEQ ID NO: 631797 - DNA, 20 bp, mouse
gactgcagcgggcgctagag

SEQ ID NO: 631798 - DNA, 20 bp, mouse
gtgctctgcaacaacagggt

SEQ ID NO: 631799 - DNA, 20 bp, mouse
gcgctagaggggcggacctg

SEQ ID NO: 631800 - DNA, 20 bp, mouse
gggaaggctcggctcacctg

SEQ ID NO: 631801 - DNA, 20 bp, mouse
gcagggtgggatgctccggg

SEQ ID NO: 631802 - DNA, 20 bp, mouse
gcgggaacaagaaactgcag

SEQ ID NO: 631803 - DNA, 20 bp, mouse
ggaactgtcccgaagctgtg

SEQ ID NO: 631804 - DNA, 20 bp, mouse
ggttgcagagcagtactgcc

SEQ ID NO: 631805 - DNA, 20 bp, mouse
gggcctcgccgaccatcctg

SEQ ID NO: 631806 - DNA, 20 bp, mouse
gcagctctcgaggggagaag

SEQ ID NO: 631807 - DNA, 20 bp, mouse
gggcgccgctgtcccctcaa

SEQ ID NO: 631808 - DNA, 20 bp, mouse
gagagactttcatccggcaa

SEQ ID NO: 631809 - DNA, 20 bp, mouse
gaaagtctctgaaaaaatgg

SEQ ID NO: 631810 - DNA, 20 bp, mouse
ggctagtaagaacccttgag

SEQ ID NO: 631811 - DNA, 20 bp, mouse
gcagcgccgccagctctcga

SEQ ID NO: 631812 - DNA, 20 bp, mouse
gtttttcagagactttcatc

SEQ ID NO: 631813 - DNA, 20 bp, mouse
gtttcatccggcaacggaca

SEQ ID NO: 631814 - DNA, 20 bp, mouse
ggtgcgcgcgcggctgagaa

SEQ ID NO: 631815 - DNA, 20 bp, mouse
gtggaggcgggataacgtcc

SEQ ID NO: 631816 - DNA, 20 bp, mouse
gcagcagaggacctggccaa

SEQ ID NO: 631817 - DNA, 20 bp, mouse
gggacgaacctcgtgaacaa

SEQ ID NO: 631818 - DNA, 20 bp, mouse
ggcctccaagaagctctcca

SEQ ID NO: 631819 - DNA, 20 bp, mouse
gcgtcctgcgtagagacctt

SEQ ID NO: 631820 - DNA, 20 bp, mouse
gttagcagcagcagaggacc

SEQ ID NO: 631821 - DNA, 20 bp, mouse
gagctgtatagcgtacaggt

SEQ ID NO: 631822 - DNA, 20 bp, mouse
gtggccaaaggtctctacgc

SEQ ID NO: 631823 - DNA, 20 bp, mouse
gaacctcgtgaacaaaggtg

SEQ ID NO: 631824 - DNA, 20 bp, mouse
ggctctccagggaggcgtcc

SEQ ID NO: 631825 - DNA, 20 bp, mouse
gccagggaggcgtcctggag

SEQ ID NO: 631826 - DNA, 20 bp, mouse
gcgcagatgcggtcactgag

SEQ ID NO: 631827 - DNA, 20 bp, mouse
gatcaggagcacaggcgcaa

SEQ ID NO: 631828 - DNA, 20 bp, mouse
gtgttcctgggccgcagatg

SEQ ID NO: 631829 - DNA, 20 bp, mouse
gccttgcagagccccaggag

SEQ ID NO: 631830 - DNA, 20 bp, mouse
gtcctgtgaggtgaaaacct

SEQ ID NO: 631831 - DNA, 20 bp, mouse
gcaaaggaaatgcagagcga

SEQ ID NO: 631832 - DNA, 20 bp, mouse
gtcccaggggagcctggcag

SEQ ID NO: 631833 - DNA, 20 bp, mouse
gtgtagggcagccccgcctc

SEQ ID NO: 631834 - DNA, 20 bp, mouse
gggatgccgggcttgttcct

SEQ ID NO: 631835 - DNA, 20 bp, mouse
gtgggaagctagcctctcct

SEQ ID NO: 631836 - DNA, 20 bp, mouse
gacagggtgaagttcttcag

SEQ ID NO: 631837 - DNA, 20 bp, mouse
ggagcttggaagccacgcta

SEQ ID NO: 631838 - DNA, 20 bp, mouse
gagtcggagcgtcatcgggg

SEQ ID NO: 631839 - DNA, 20 bp, mouse
ggaagctgggaaaatgcaag

SEQ ID NO: 631840 - DNA, 20 bp, mouse
gcattttcccagcttcggaa

SEQ ID NO: 631841 - DNA, 20 bp, mouse
gtgcagtcggagcgtcatcg

SEQ ID NO: 631842 - DNA, 20 bp, mouse
ggaagctagtgggccagatg

SEQ ID NO: 631843 - DNA, 20 bp, mouse
gggaactacagagaccgcat

SEQ ID NO: 631844 - DNA, 20 bp, mouse
ggcgtgtaacaggatctgtg

SEQ ID NO: 631845 - DNA, 20 bp, mouse
gtcttcagaggtcaccactt

SEQ ID NO: 631846 - DNA, 20 bp, mouse
ggggaatcagcggccatgtg

SEQ ID NO: 631847 - DNA, 20 bp, mouse
gcttggaagttgtgacatgg

SEQ ID NO: 631848 - DNA, 20 bp, mouse
ggggactcattgggaatcag

SEQ ID NO: 631849 - DNA, 20 bp, mouse
ggcgggttttccggatacct

SEQ ID NO: 631850 - DNA, 20 bp, mouse
ggaaaccggcccaaggtatc

SEQ ID NO: 631851 - DNA, 20 bp, mouse
ggtgacatggtggtgagtac

SEQ ID NO: 631852 - DNA, 20 bp, mouse
gactaagggaaaccggccca

SEQ ID NO: 631853 - DNA, 20 bp, mouse
gcaccctccacagcatccag

SEQ ID NO: 631854 - DNA, 20 bp, mouse
ggacagagagcacagcataa

SEQ ID NO: 631855 - DNA, 20 bp, mouse
ggtcctgccgctggatgctg

SEQ ID NO: 631856 - DNA, 20 bp, mouse
gagaaggggaagttagtagt

SEQ ID NO: 631857 - DNA, 20 bp, mouse
gaggggaagttagtagtggg

SEQ ID NO: 631858 - DNA, 20 bp, mouse
gcgtagttccggggcagagg

SEQ ID NO: 631859 - DNA, 20 bp, mouse
gtctccaccttgatttcagg

SEQ ID NO: 631860 - DNA, 20 bp, mouse
gttagtagtgggtggtctga

SEQ ID NO: 631861 - DNA, 20 bp, mouse
gctcgggactgggtggtaag

SEQ ID NO: 631862 - DNA, 20 bp, mouse
ggagcaggcggatgaacctg

SEQ ID NO: 631863 - DNA, 20 bp, mouse
gagggtcactgcccatatcg

SEQ ID NO: 631864 - DNA, 20 bp, mouse
gaggaacttacgtagttccg

SEQ ID NO: 631865 - DNA, 20 bp, mouse
gcattccctggacccggtag

SEQ ID NO: 631866 - DNA, 20 bp, mouse
gcagcctgctcgaaacggaa

SEQ ID NO: 631867 - DNA, 20 bp, mouse
ggctttcagcctgctcgaaa

SEQ ID NO: 631868 - DNA, 20 bp, mouse
gggaaaggaacacagagcac

SEQ ID NO: 631869 - DNA, 20 bp, mouse
ggttcctttccgtttcgagc

SEQ ID NO: 631870 - DNA, 20 bp, mouse
gaacacagagcaccggaaca

SEQ ID NO: 631871 - DNA, 20 bp, mouse
gaagctggagtcggggtgac

SEQ ID NO: 631872 - DNA, 20 bp, mouse
ggagcaggggtctaagaagc

SEQ ID NO: 631873 - DNA, 20 bp, mouse
gttgccagcgatctacgacg

SEQ ID NO: 631874 - DNA, 20 bp, mouse
gggctggacgctgcgatctc

SEQ ID NO: 631875 - DNA, 20 bp, mouse
gtcttccgtgtgccttgttc

SEQ ID NO: 631876 - DNA, 20 bp, mouse
gacagaagcagtgacttgtg

SEQ ID NO: 631877 - DNA, 20 bp, mouse
gtgtatcttcaggaagttct

SEQ ID NO: 631878 - DNA, 20 bp, mouse
gttggtgtcactataagttt

SEQ ID NO: 631879 - DNA, 20 bp, mouse
gctttaatatgtaggtttgt

SEQ ID NO: 631880 - DNA, 20 bp, mouse
gcagagggaactggagtcgt

SEQ ID NO: 631881 - DNA, 20 bp, mouse
gggccatgtcccacaaaagg

SEQ ID NO: 631882 - DNA, 20 bp, mouse
ggagtcgtgggtcgtccctg

SEQ ID NO: 631883 - DNA, 20 bp, mouse
gaagcttagaagtcccgaca

SEQ ID NO: 631884 - DNA, 20 bp, mouse
gtatttatcacggagcccca

SEQ ID NO: 631885 - DNA, 20 bp, mouse
ggcggatgagcagagggaac

SEQ ID NO: 631886 - DNA, 20 bp, mouse
gtctgttgccgggagctggg

SEQ ID NO: 631887 - DNA, 20 bp, mouse
ggtccgccatactgcagtct

SEQ ID NO: 631888 - DNA, 20 bp, mouse
gtcaaggaggtcattcaggg

SEQ ID NO: 631889 - DNA, 20 bp, mouse
gggaccgagcagttagaatg

SEQ ID NO: 631890 - DNA, 20 bp, mouse
gcctggtgcagaactttaga

SEQ ID NO: 631891 - DNA, 20 bp, mouse
gcagatcacatcaaagcaca

SEQ ID NO: 631892 - DNA, 20 bp, mouse
ggctccgagctccccatagt

SEQ ID NO: 631893 - DNA, 20 bp, mouse
gacagcgatccagctcacca

SEQ ID NO: 631894 - DNA, 20 bp, mouse
gcagggggtggaactcaagg

SEQ ID NO: 631895 - DNA, 20 bp, mouse
gtccccatagtcggagcagg

SEQ ID NO: 631896 - DNA, 20 bp, mouse
gtacccacccaccaccatcg

SEQ ID NO: 631897 - DNA, 20 bp, mouse
gcagatcccaaccccgatgg

SEQ ID NO: 631898 - DNA, 20 bp, mouse
gatcggggttgggatctgtc

SEQ ID NO: 631899 - DNA, 20 bp, mouse
gaaccccgatggtggtgggt

SEQ ID NO: 631900 - DNA, 20 bp, mouse
gtcccaaccccgatggtggt

SEQ ID NO: 631901 - DNA, 20 bp, mouse
gagcttcccccagcagcgat

SEQ ID NO: 631902 - DNA, 20 bp, mouse
gtctgtcaggcgcttctgct

SEQ ID NO: 631903 - DNA, 20 bp, mouse
ggagggcgggcattgaacga

SEQ ID NO: 631904 - DNA, 20 bp, mouse
gcgcgagtccgggaacgcac

SEQ ID NO: 631905 - DNA, 20 bp, mouse
ggtgggtagtggtaagtggg

SEQ ID NO: 631906 - DNA, 20 bp, mouse
gcatcagtcgaggaaggtgt

SEQ ID NO: 631907 - DNA, 20 bp, mouse
ggagactcaagggaggacaa

SEQ ID NO: 631908 - DNA, 20 bp, mouse
ggtgggagagaggagactca

SEQ ID NO: 631909 - DNA, 20 bp, mouse
gcagatccaggcatcagtcg

SEQ ID NO: 631910 - DNA, 20 bp, mouse
gtccaggcatcagtcgagga

SEQ ID NO: 631911 - DNA, 20 bp, mouse
gcgcaacacaccggatgctg

SEQ ID NO: 631912 - DNA, 20 bp, mouse
ggatgctaacagaaaccacc

SEQ ID NO: 631913 - DNA, 20 bp, mouse
gcctggagccgactccccta

SEQ ID NO: 631914 - DNA, 20 bp, mouse
ggggctgatgcgaagcattc

SEQ ID NO: 631915 - DNA, 20 bp, mouse
gtcagtgcgatgatatctgt

SEQ ID NO: 631916 - DNA, 20 bp, mouse
gccctgggcagtctgatgag

SEQ ID NO: 631917 - DNA, 20 bp, mouse
gcatgcagacggcttctaac

SEQ ID NO: 631918 - DNA, 20 bp, mouse
ggcgctcccagccagcaagc

SEQ ID NO: 631919 - DNA, 20 bp, mouse
ggggtctcgcggtggaccct

SEQ ID NO: 631920 - DNA, 20 bp, mouse
ggccgcctgcctagtcccgt

SEQ ID NO: 631921 - DNA, 20 bp, mouse
gggagcgcacgaagctgtgg

SEQ ID NO: 631922 - DNA, 20 bp, mouse
gtggccagcgccgggtctcg

SEQ ID NO: 631923 - DNA, 20 bp, mouse
gccagcgccgggtctcgcgg

SEQ ID NO: 631924 - DNA, 20 bp, mouse
gcactggtacccacgggact

SEQ ID NO: 631925 - DNA, 20 bp, mouse
gcacacaccaggtctcatca

SEQ ID NO: 631926 - DNA, 20 bp, mouse
ggcctctgggaccagatcac

SEQ ID NO: 631927 - DNA, 20 bp, mouse
gtcctgtgatctggtcccag

SEQ ID NO: 631928 - DNA, 20 bp, mouse
gcagaggcactgacgttgtt

SEQ ID NO: 631929 - DNA, 20 bp, mouse
gcgctggagctggccatctt

SEQ ID NO: 631930 - DNA, 20 bp, mouse
ggcacagccccgccccaaaa

SEQ ID NO: 631931 - DNA, 20 bp, mouse
gtggaacccccgctaccctg

SEQ ID NO: 631932 - DNA, 20 bp, mouse
gcagccccgccccaaaacgg

SEQ ID NO: 631933 - DNA, 20 bp, mouse
gctccctggaggctgcccca

SEQ ID NO: 631934 - DNA, 20 bp, mouse
gggcggggctgtgcagacag

SEQ ID NO: 631935 - DNA, 20 bp, mouse
gtgagcacactacgcagggt

SEQ ID NO: 631936 - DNA, 20 bp, mouse
gtggacaggacactgacctt

SEQ ID NO: 631937 - DNA, 20 bp, mouse
gtccctggtaaatgctccca

SEQ ID NO: 631938 - DNA, 20 bp, mouse
gaggaaagtaaagtttcgaa

SEQ ID NO: 631939 - DNA, 20 bp, mouse
gactacaggtcatcgatcct

SEQ ID NO: 631940 - DNA, 20 bp, mouse
ggatgttactgagcaatgta

SEQ ID NO: 631941 - DNA, 20 bp, mouse
gtcctgaaatgcagtttatg

SEQ ID NO: 631942 - DNA, 20 bp, mouse
gttaatcttacctatagtgt

SEQ ID NO: 631943 - DNA, 20 bp, mouse
ggtttaatttctatattcgt

SEQ ID NO: 631944 - DNA, 20 bp, mouse
gatattcacaaggttatttc

SEQ ID NO: 631945 - DNA, 20 bp, mouse
gttgcagatctatattcaca

SEQ ID NO: 631946 - DNA, 20 bp, mouse
gcgcatctgaggagagttta

SEQ ID NO: 631947 - DNA, 20 bp, mouse
gtatcttatggttaccagaa

SEQ ID NO: 631948 - DNA, 20 bp, mouse
gctatgaactgggtgtatcg

SEQ ID NO: 631949 - DNA, 20 bp, mouse
gggcggccctggaaccttgc

SEQ ID NO: 631950 - DNA, 20 bp, mouse
gccatcagccgcgcagccgc

SEQ ID NO: 631951 - DNA, 20 bp, mouse
ggtttgtttcatttatctta

SEQ ID NO: 631952 - DNA, 20 bp, mouse
gctattttcggaaaccattc

SEQ ID NO: 631953 - DNA, 20 bp, mouse
gagtgggagtagagacaact

SEQ ID NO: 631954 - DNA, 20 bp, mouse
gagggtaagtcgcccgcagt

SEQ ID NO: 631955 - DNA, 20 bp, mouse
ggctccaacaggtacctaag

SEQ ID NO: 631956 - DNA, 20 bp, mouse
ggggaccttccggggccacc

SEQ ID NO: 631957 - DNA, 20 bp, mouse
gctcctcagacgcagtttcc

SEQ ID NO: 631958 - DNA, 20 bp, mouse
gagccaggaaactgcgtctg

SEQ ID NO: 631959 - DNA, 20 bp, mouse
gtgatagacccccagttcac

SEQ ID NO: 631960 - DNA, 20 bp, mouse
ggatctcaatttcccgacaa

SEQ ID NO: 631961 - DNA, 20 bp, mouse
gaactgaatattctgataac

SEQ ID NO: 631962 - DNA, 20 bp, mouse
gtctgtactggttcttcata

SEQ ID NO: 631963 - DNA, 20 bp, mouse
gctgttatcttaccgttgtc

SEQ ID NO: 631964 - DNA, 20 bp, mouse
gttctatttagcgaagtaaa

SEQ ID NO: 631965 - DNA, 20 bp, mouse
gtgaggagctttccggtttc

SEQ ID NO: 631966 - DNA, 20 bp, mouse
gtcagcagcgcagccctgga

SEQ ID NO: 631967 - DNA, 20 bp, mouse
gagagtcagcagcgcagccc

SEQ ID NO: 631968 - DNA, 20 bp, mouse
gcgcagccctggaaggtccc

SEQ ID NO: 631969 - DNA, 20 bp, mouse
gccgcatctgaggagagtta

SEQ ID NO: 631970 - DNA, 20 bp, mouse
gctcctcagactctgttttg

SEQ ID NO: 631971 - DNA, 20 bp, mouse
gcagccatcagccgcgcagc

SEQ ID NO: 631972 - DNA, 20 bp, mouse
gagccacaaaacagagtctg

SEQ ID NO: 631973 - DNA, 20 bp, mouse
gcaggtagcaaggggagtgg

SEQ ID NO: 631974 - DNA, 20 bp, mouse
gtgttttgtggctgcggacc

SEQ ID NO: 631975 - DNA, 20 bp, mouse
gccatcagccgcgcagccgg

SEQ ID NO: 631976 - DNA, 20 bp, mouse
ggccgcacggtctggaagtg

SEQ ID NO: 631977 - DNA, 20 bp, mouse
gctcagggagccgcacggtc

SEQ ID NO: 631978 - DNA, 20 bp, mouse
gaagaactcagggagccgca

SEQ ID NO: 631979 - DNA, 20 bp, mouse
gtttcgggtaccctaataca

SEQ ID NO: 631980 - DNA, 20 bp, mouse
gggtaccctaatacacggcc

SEQ ID NO: 631981 - DNA, 20 bp, mouse
ggacaacgctaagataacca

SEQ ID NO: 631982 - DNA, 20 bp, mouse
gaccccacttccagaccgtg

SEQ ID NO: 631983 - DNA, 20 bp, mouse
gagaacccggccgtgtatta

SEQ ID NO: 631984 - DNA, 20 bp, mouse
gcctttccctgaagaactca

SEQ ID NO: 631985 - DNA, 20 bp, mouse
gcagaggcacctgagtctta

SEQ ID NO: 631986 - DNA, 20 bp, mouse
gtgttcacttaagtacctaa

SEQ ID NO: 631987 - DNA, 20 bp, mouse
gacttaagtacctaagggaa

SEQ ID NO: 631988 - DNA, 20 bp, mouse
ggaaaattcaccattccctt

SEQ ID NO: 631989 - DNA, 20 bp, mouse
gcaacttgttctctaaccgg

SEQ ID NO: 631990 - DNA, 20 bp, mouse
gccggaaccggggccgtagt

SEQ ID NO: 631991 - DNA, 20 bp, mouse
gtcctatctgacttgatctt

SEQ ID NO: 631992 - DNA, 20 bp, mouse
gctcctagacccgcccacta

SEQ ID NO: 631993 - DNA, 20 bp, mouse
ggaaccggggccgtagtggg

SEQ ID NO: 631994 - DNA, 20 bp, mouse
gctggacctagggaaaactc

SEQ ID NO: 631995 - DNA, 20 bp, mouse
gaacgggcgggagccgaggt

SEQ ID NO: 631996 - DNA, 20 bp, mouse
ggctcctaagatccagtcct

SEQ ID NO: 631997 - DNA, 20 bp, mouse
gaacgggagggagcagagca

SEQ ID NO: 631998 - DNA, 20 bp, mouse
gagatccagtcctgggtgac

SEQ ID NO: 631999 - DNA, 20 bp, mouse
gagccaagaaaatgcttcgg

SEQ ID NO: 632000 - DNA, 20 bp, mouse
gtgccagcactgcagctcgg

SEQ ID NO: 632001 - DNA, 20 bp, mouse
gatctcaaacttctaatcag

SEQ ID NO: 632002 - DNA, 20 bp, mouse
gaaggtagaaagacaatcgg

SEQ ID NO: 632003 - DNA, 20 bp, mouse
gcggaaggtagaaagacaat

SEQ ID NO: 632004 - DNA, 20 bp, mouse
gagttcctgtcacccaggac

SEQ ID NO: 632005 - DNA, 20 bp, mouse
gtctgcattctagctctctc

SEQ ID NO: 632006 - DNA, 20 bp, mouse
gtgtgggaggctggaaacgt

SEQ ID NO: 632007 - DNA, 20 bp, mouse
ggaagtgtcaaggacctgtc

SEQ ID NO: 632008 - DNA, 20 bp, mouse
gcgcgagctctggacctgac

SEQ ID NO: 632009 - DNA, 20 bp, mouse
ggttagggcagtgacgtgaa

SEQ ID NO: 632010 - DNA, 20 bp, mouse
gaaccacgcgattccccacg

SEQ ID NO: 632011 - DNA, 20 bp, mouse
gaggacacagaggacttcgt

SEQ ID NO: 632012 - DNA, 20 bp, mouse
gctcgcggccctgccccgtg

SEQ ID NO: 632013 - DNA, 20 bp, mouse
gtgccccgtggggaatcgcg

SEQ ID NO: 632014 - DNA, 20 bp, mouse
gggttggaaaagggcgggaa

SEQ ID NO: 632015 - DNA, 20 bp, mouse
gaatcgcgtggttcagacct

SEQ ID NO: 632016 - DNA, 20 bp, mouse
ggtagctgccaagagagcgc

SEQ ID NO: 632017 - DNA, 20 bp, mouse
gctggatgcgactttctatg

SEQ ID NO: 632018 - DNA, 20 bp, mouse
gggccctcccacacaggagc

SEQ ID NO: 632019 - DNA, 20 bp, mouse
gggactgagtcgcagttcga

SEQ ID NO: 632020 - DNA, 20 bp, mouse
gtctgtgtcctgcgctctct

SEQ ID NO: 632021 - DNA, 20 bp, mouse
gaccgcagcggctcagggga

SEQ ID NO: 632022 - DNA, 20 bp, mouse
gggtaaacagctctgacatt

SEQ ID NO: 632023 - DNA, 20 bp, mouse
ggcggaccgcagcggctcag

SEQ ID NO: 632024 - DNA, 20 bp, mouse
ggggagggccttgtatgtta

SEQ ID NO: 632025 - DNA, 20 bp, mouse
gaacagctctgacatttggc

SEQ ID NO: 632026 - DNA, 20 bp, mouse
gttgtggtgggtcctactca

SEQ ID NO: 632027 - DNA, 20 bp, mouse
ggtcctactcagggttaggc

SEQ ID NO: 632028 - DNA, 20 bp, mouse
gtgtcactggcatactgtca

SEQ ID NO: 632029 - DNA, 20 bp, mouse
gcagtatgccagtgacagac

SEQ ID NO: 632030 - DNA, 20 bp, mouse
gagtcacccaacagatggga

SEQ ID NO: 632031 - DNA, 20 bp, mouse
gcttgatatagccacgtgtg

SEQ ID NO: 632032 - DNA, 20 bp, mouse
gcaaggatgtttatatacac

SEQ ID NO: 632033 - DNA, 20 bp, mouse
gagatgccactgctgggttc

SEQ ID NO: 632034 - DNA, 20 bp, mouse
gggagctggagacattgtgg

SEQ ID NO: 632035 - DNA, 20 bp, mouse
gtgaggagctggagacattg

SEQ ID NO: 632036 - DNA, 20 bp, mouse
gagtcgtgtcaactcttctt

SEQ ID NO: 632037 - DNA, 20 bp, mouse
gagctgcaccggcttcaaga

SEQ ID NO: 632038 - DNA, 20 bp, mouse
gggcatggacccacactgaa

SEQ ID NO: 632039 - DNA, 20 bp, mouse
gtgacactgccaggagacca

SEQ ID NO: 632040 - DNA, 20 bp, mouse
gaatttcaggctccttggag

SEQ ID NO: 632041 - DNA, 20 bp, mouse
gttgaagccggtgcagctgc

SEQ ID NO: 632042 - DNA, 20 bp, mouse
gctgcagaggtgtaagttcg

SEQ ID NO: 632043 - DNA, 20 bp, mouse
gagaatggtgagtgtgtcac

SEQ ID NO: 632044 - DNA, 20 bp, mouse
gagggcaaacgaaagtgcaa

SEQ ID NO: 632045 - DNA, 20 bp, mouse
gcgtagtgaagggacagaac

SEQ ID NO: 632046 - DNA, 20 bp, mouse
gatgtcagagatccaaacga

SEQ ID NO: 632047 - DNA, 20 bp, mouse
ggttgtgctgacctaggcta

SEQ ID NO: 632048 - DNA, 20 bp, mouse
gttaacttctccccagagtt

SEQ ID NO: 632049 - DNA, 20 bp, mouse
gctgggcttgttatgagaca

SEQ ID NO: 632050 - DNA, 20 bp, mouse
gtagatagaacacagagtat

SEQ ID NO: 632051 - DNA, 20 bp, mouse
gtccaaacgaaggtttcaac

SEQ ID NO: 632052 - DNA, 20 bp, mouse
gtgcggaagtttgatagcaa

SEQ ID NO: 632053 - DNA, 20 bp, mouse
gatagaacacagagtatagg

SEQ ID NO: 632054 - DNA, 20 bp, mouse
gtcctgttgaaaccttcgtt

SEQ ID NO: 632055 - DNA, 20 bp, mouse
gctgtgcagggtggcgtatc

SEQ ID NO: 632056 - DNA, 20 bp, mouse
gcttcctggacccgtcagta

SEQ ID NO: 632057 - DNA, 20 bp, mouse
gttctgtgagccatactgac

SEQ ID NO: 632058 - DNA, 20 bp, mouse
ggtgtcatctgctttggcca

SEQ ID NO: 632059 - DNA, 20 bp, mouse
gcgggctccagaggatggtg

SEQ ID NO: 632060 - DNA, 20 bp, mouse
gcgtcacagagacggatctg

SEQ ID NO: 632061 - DNA, 20 bp, mouse
gaccatcgggctccagagga

SEQ ID NO: 632062 - DNA, 20 bp, mouse
gtgtccccgactgtagggta

SEQ ID NO: 632063 - DNA, 20 bp, mouse
gcccgcccacaagccttggg

SEQ ID NO: 632064 - DNA, 20 bp, mouse
ggctcggagacagagccctg

SEQ ID NO: 632065 - DNA, 20 bp, mouse
gcatctgctttggccatggc

SEQ ID NO: 632066 - DNA, 20 bp, mouse
gggaggacacctggatgcat

SEQ ID NO: 632067 - DNA, 20 bp, mouse
gccgcgccagggtaacgtca

SEQ ID NO: 632068 - DNA, 20 bp, mouse
gatgcatcggaagcagaaga

SEQ ID NO: 632069 - DNA, 20 bp, mouse
gtgagtgtgcgctgggcccc

SEQ ID NO: 632070 - DNA, 20 bp, mouse
gtgtagaccgggtcttgtca

SEQ ID NO: 632071 - DNA, 20 bp, mouse
ggaacccagaaggatcacag

SEQ ID NO: 632072 - DNA, 20 bp, mouse
ggggccccgggaatcgtttg

SEQ ID NO: 632073 - DNA, 20 bp, mouse
gcgccagggtaacgtcaggg

SEQ ID NO: 632074 - DNA, 20 bp, mouse
ggactcaccctgacaagacc

SEQ ID NO: 632075 - DNA, 20 bp, mouse
gtcgccacaaacgattcccg

SEQ ID NO: 632076 - DNA, 20 bp, mouse
gggtcccagaagccttgaga

SEQ ID NO: 632077 - DNA, 20 bp, mouse
gggcttctgggacccaaaca

SEQ ID NO: 632078 - DNA, 20 bp, mouse
gcacttggagcaccctctca

SEQ ID NO: 632079 - DNA, 20 bp, mouse
gccgcgccagggtaacgtca

SEQ ID NO: 632080 - DNA, 20 bp, mouse
ggcacggtcaacaaggtcga

SEQ ID NO: 632081 - DNA, 20 bp, mouse
gagtgaaagcacggtcaaca

SEQ ID NO: 632082 - DNA, 20 bp, mouse
gggaggacacctggatgcat

SEQ ID NO: 632083 - DNA, 20 bp, mouse
gacaaggtcgatggagcact

SEQ ID NO: 632084 - DNA, 20 bp, mouse
gaagcatggatattccgaag

SEQ ID NO: 632085 - DNA, 20 bp, mouse
gggtagttgctgccatgttt

SEQ ID NO: 632086 - DNA, 20 bp, mouse
ggggagcagcgaggacgtct

SEQ ID NO: 632087 - DNA, 20 bp, mouse
gtgtatcgtgaggccaggaa

SEQ ID NO: 632088 - DNA, 20 bp, mouse
gagaatcaggatggtcgtct

SEQ ID NO: 632089 - DNA, 20 bp, mouse
gggcctcacgatacagaatc

SEQ ID NO: 632090 - DNA, 20 bp, mouse
gtcacgatacagaatcagga

SEQ ID NO: 632091 - DNA, 20 bp, mouse
gccctacaggcggcccttcc

SEQ ID NO: 632092 - DNA, 20 bp, mouse
gtggtcgtcttggacgcagt

SEQ ID NO: 632093 - DNA, 20 bp, mouse
gtagccgctgtgtcccctac

SEQ ID NO: 632094 - DNA, 20 bp, mouse
gccgctgtgtcccctacagg

SEQ ID NO: 632095 - DNA, 20 bp, mouse
gggccacaccctccacaagg

SEQ ID NO: 632096 - DNA, 20 bp, mouse
gtgtgggctccaccaaccct

SEQ ID NO: 632097 - DNA, 20 bp, mouse
gggttggtggagcccacagt

SEQ ID NO: 632098 - DNA, 20 bp, mouse
gtctctctactggtccaccc

SEQ ID NO: 632099 - DNA, 20 bp, mouse
ggatggacctgaccatgcgg

SEQ ID NO: 632100 - DNA, 20 bp, mouse
gacagaggaattctctctac

SEQ ID NO: 632101 - DNA, 20 bp, mouse
gaccacctgcctagggttgg

SEQ ID NO: 632102 - DNA, 20 bp, mouse
gatgcctagagcttatggag

SEQ ID NO: 632103 - DNA, 20 bp, mouse
ggtgtgcaccagcaccgcac

SEQ ID NO: 632104 - DNA, 20 bp, mouse
gcaaccactccataagctct

SEQ ID NO: 632105 - DNA, 20 bp, mouse
gttcttatcacagcgatgga

SEQ ID NO: 632106 - DNA, 20 bp, mouse
gggtgcggctaggagagctc

SEQ ID NO: 632107 - DNA, 20 bp, mouse
gaaccgttcgagcttctcag

SEQ ID NO: 632108 - DNA, 20 bp, mouse
gcgccgctgagaagctcgaa

SEQ ID NO: 632109 - DNA, 20 bp, mouse
ggtacacagagcacgtcaca

SEQ ID NO: 632110 - DNA, 20 bp, mouse
ggagcagggtcacttcccca

SEQ ID NO: 632111 - DNA, 20 bp, mouse
ggagcgtgctgaagtgtcca

SEQ ID NO: 632112 - DNA, 20 bp, mouse
gcggagctggacttgcagta

SEQ ID NO: 632113 - DNA, 20 bp, mouse
gcacgctccaaccctaacgg

SEQ ID NO: 632114 - DNA, 20 bp, mouse
gtgtgtactgctgtttggtg

SEQ ID NO: 632115 - DNA, 20 bp, mouse
gcagccggagtgagagtggt

SEQ ID NO: 632116 - DNA, 20 bp, mouse
gagccgcgggagtctgtgtg

SEQ ID NO: 632117 - DNA, 20 bp, mouse
gtcacgccgggcggcgagtc

SEQ ID NO: 632118 - DNA, 20 bp, mouse
ggcacagagttaactgtgga

SEQ ID NO: 632119 - DNA, 20 bp, mouse
gaaccccacacagactcccg

SEQ ID NO: 632120 - DNA, 20 bp, mouse
ggggcggcgagtctggccgc

SEQ ID NO: 632121 - DNA, 20 bp, mouse
gagacgtccggcttccgctc

SEQ ID NO: 632122 - DNA, 20 bp, mouse
ggcacttgatgttcaggagt

SEQ ID NO: 632123 - DNA, 20 bp, mouse
gcacttggcacttgatgttc

SEQ ID NO: 632124 - DNA, 20 bp, mouse
gcgggtggcagaccaggaca

SEQ ID NO: 632125 - DNA, 20 bp, mouse
gcccgctgccgggagctgtg

SEQ ID NO: 632126 - DNA, 20 bp, mouse
ggaaccagcgaaaagaattc

SEQ ID NO: 632127 - DNA, 20 bp, mouse
gttaagcctgcttaattaca

SEQ ID NO: 632128 - DNA, 20 bp, mouse
gcattgagctctgtacaagg

SEQ ID NO: 632129 - DNA, 20 bp, mouse
gctgtacaaggaggtaagaa

SEQ ID NO: 632130 - DNA, 20 bp, mouse
gacagtacccagcagcacac

SEQ ID NO: 632131 - DNA, 20 bp, mouse
gccgcttctggacccaacgg

SEQ ID NO: 632132 - DNA, 20 bp, mouse
gggtactgtgaaggaaactc

SEQ ID NO: 632133 - DNA, 20 bp, mouse
ggccagtcataagaggaggg

SEQ ID NO: 632134 - DNA, 20 bp, mouse
gggaaccagcagctacatgc

SEQ ID NO: 632135 - DNA, 20 bp, mouse
gtggttccctgtaattaagc

SEQ ID NO: 632136 - DNA, 20 bp, mouse
ggcaagacgagagtgcacca

SEQ ID NO: 632137 - DNA, 20 bp, mouse
gtcttgcctgagctgcgctg

SEQ ID NO: 632138 - DNA, 20 bp, mouse
gtagcaatgcgcaaggtacg

SEQ ID NO: 632139 - DNA, 20 bp, mouse
gacccgccacagcgcagctc

SEQ ID NO: 632140 - DNA, 20 bp, mouse
gtgcctgagctgcgctgtgg

SEQ ID NO: 632141 - DNA, 20 bp, mouse
gtcagagacgcgggtgggag

SEQ ID NO: 632142 - DNA, 20 bp, mouse
gggctgcgggctctggaaaa

SEQ ID NO: 632143 - DNA, 20 bp, mouse
gttttcggcgctgtccttgg

SEQ ID NO: 632144 - DNA, 20 bp, mouse
gtgagtgcatctcagagacg

SEQ ID NO: 632145 - DNA, 20 bp, mouse
ggcatctcagagacgcgggt

SEQ ID NO: 632146 - DNA, 20 bp, mouse
gtctgcggcacagggaggtg

SEQ ID NO: 632147 - DNA, 20 bp, mouse
ggcagagccgagccacaata

SEQ ID NO: 632148 - DNA, 20 bp, mouse
gtcggctctgcggcacaggg

SEQ ID NO: 632149 - DNA, 20 bp, mouse
ggagccgagccacaatatgg

SEQ ID NO: 632150 - DNA, 20 bp, mouse
ggctgctgccgggaccagtg

SEQ ID NO: 632151 - DNA, 20 bp, mouse
gggaccagtgaggagagcgc

SEQ ID NO: 632152 - DNA, 20 bp, mouse
gcttcacggccgccatattg

SEQ ID NO: 632153 - DNA, 20 bp, mouse
gggctcggctctgcggcaca

SEQ ID NO: 632154 - DNA, 20 bp, mouse
ggcaagaggcgggttcttca

SEQ ID NO: 632155 - DNA, 20 bp, mouse
gactggagagcggcaagagg

SEQ ID NO: 632156 - DNA, 20 bp, mouse
ggcccgtgctcccctcacag

SEQ ID NO: 632157 - DNA, 20 bp, mouse
gtgttgtagactgaactccg

SEQ ID NO: 632158 - DNA, 20 bp, mouse
gacggggcctccctgagcca

SEQ ID NO: 632159 - DNA, 20 bp, mouse
ggcgcagcacacgcacccac

SEQ ID NO: 632160 - DNA, 20 bp, mouse
gagttcagtctacaacacgg

SEQ ID NO: 632161 - DNA, 20 bp, mouse
gctcaatcaagagcgaggta

SEQ ID NO: 632162 - DNA, 20 bp, mouse
ggccgctgtgaggggagcac

SEQ ID NO: 632163 - DNA, 20 bp, mouse
ggactgaactccgtggctca

SEQ ID NO: 632164 - DNA, 20 bp, mouse
gtgaactccgtggctcaggg

SEQ ID NO: 632165 - DNA, 20 bp, mouse
gaagagcgaggtagggcagt

SEQ ID NO: 632166 - DNA, 20 bp, mouse
ggcagtggccacagcgaagg

SEQ ID NO: 632167 - DNA, 20 bp, mouse
gccttagctacgggccgcag

SEQ ID NO: 632168 - DNA, 20 bp, mouse
gggttcggcccccttcgctg

SEQ ID NO: 632169 - DNA, 20 bp, mouse
ggccgcagtggccacagcga

SEQ ID NO: 632170 - DNA, 20 bp, mouse
gggctggcccggagagacga

SEQ ID NO: 632171 - DNA, 20 bp, mouse
ggccgcgctccccttagcta

SEQ ID NO: 632172 - DNA, 20 bp, mouse
gcgccttctccgcttcccag

SEQ ID NO: 632173 - DNA, 20 bp, mouse
gttcccagcggaatgcacag

SEQ ID NO: 632174 - DNA, 20 bp, mouse
gggagaaggcgcagcgggtt

SEQ ID NO: 632175 - DNA, 20 bp, mouse
ggcgccgtcgaaggagctgt

SEQ ID NO: 632176 - DNA, 20 bp, mouse
gttacaggaaaccagcgaaa

SEQ ID NO: 632177 - DNA, 20 bp, mouse
gaaaccagcgaaaaggattc

SEQ ID NO: 632178 - DNA, 20 bp, mouse
gggtactgtgaaggaagctc

SEQ ID NO: 632179 - DNA, 20 bp, mouse
gccgcttctggacccaacgg

SEQ ID NO: 632180 - DNA, 20 bp, mouse
gacagtacccagcagcacac

SEQ ID NO: 632181 - DNA, 20 bp, mouse
ggttatgcaagagccaccgt

SEQ ID NO: 632182 - DNA, 20 bp, mouse
gtcccgctcctcacctctgt

SEQ ID NO: 632183 - DNA, 20 bp, mouse
gttcccacagaggtgaggag

SEQ ID NO: 632184 - DNA, 20 bp, mouse
gagaagcggctaaaaccacg

SEQ ID NO: 632185 - DNA, 20 bp, mouse
gatattgtcacttcccacag

SEQ ID NO: 632186 - DNA, 20 bp, mouse
gtaatcaggccggacctgaa

SEQ ID NO: 632187 - DNA, 20 bp, mouse
ggagctgcagctaccggagt

SEQ ID NO: 632188 - DNA, 20 bp, mouse
gggactgagctcaccaactc

SEQ ID NO: 632189 - DNA, 20 bp, mouse
ggccgcacccggaagagacg

SEQ ID NO: 632190 - DNA, 20 bp, mouse
gtggcagcggagggataatc

SEQ ID NO: 632191 - DNA, 20 bp, mouse
gcccggaagagacgtggcag

SEQ ID NO: 632192 - DNA, 20 bp, mouse
gtgaaaagcgcggaaggccg

SEQ ID NO: 632193 - DNA, 20 bp, mouse
ggctccgctcccttcaggtc

SEQ ID NO: 632194 - DNA, 20 bp, mouse
gagcggagggataatcaggc

SEQ ID NO: 632195 - DNA, 20 bp, mouse
gttggagctgtgcagagatc

SEQ ID NO: 632196 - DNA, 20 bp, mouse
ggccgcgagcggcgaaccgg

SEQ ID NO: 632197 - DNA, 20 bp, mouse
gcgagccgcgagcggcgaac

SEQ ID NO: 632198 - DNA, 20 bp, mouse
gggaacctgcgagccgcgag

SEQ ID NO: 632199 - DNA, 20 bp, mouse
gccccggcccgcgggctcca

SEQ ID NO: 632200 - DNA, 20 bp, mouse
gcagcctgcggggagcgccc

SEQ ID NO: 632201 - DNA, 20 bp, mouse
ggaggaaacagagcaatccc

SEQ ID NO: 632202 - DNA, 20 bp, mouse
gggtggcggcttctctgctc

SEQ ID NO: 632203 - DNA, 20 bp, mouse
gcctgcggggagcgccctgg

SEQ ID NO: 632204 - DNA, 20 bp, mouse
gcggcgccggagacatgtcc

SEQ ID NO: 632205 - DNA, 20 bp, mouse
gtggcctcgggcctccgcgg

SEQ ID NO: 632206 - DNA, 20 bp, mouse
gggcgacggatagagcgatg

SEQ ID NO: 632207 - DNA, 20 bp, mouse
gcagaggcggcgacaaccca

SEQ ID NO: 632208 - DNA, 20 bp, mouse
gaatctaggagcgatcggcc

SEQ ID NO: 632209 - DNA, 20 bp, mouse
gtagagcgatggggctgtgg

SEQ ID NO: 632210 - DNA, 20 bp, mouse
ggcggcccgagcctgcccag

SEQ ID NO: 632211 - DNA, 20 bp, mouse
gctccgtgtccccggctgcc

SEQ ID NO: 632212 - DNA, 20 bp, mouse
ggcacctggagtccgaccgg

SEQ ID NO: 632213 - DNA, 20 bp, mouse
gcggccaggcagagagaaaa

SEQ ID NO: 632214 - DNA, 20 bp, mouse
gggagcacctggagtccgac

SEQ ID NO: 632215 - DNA, 20 bp, mouse
gcgagcctgcccagaggcag

SEQ ID NO: 632216 - DNA, 20 bp, mouse
gcagggcatatgggaatcat

SEQ ID NO: 632217 - DNA, 20 bp, mouse
gataggtgaaagaaactaca

SEQ ID NO: 632218 - DNA, 20 bp, mouse
gatatgggaatcatgggctc

SEQ ID NO: 632219 - DNA, 20 bp, mouse
gctgccccactcctcctcag

SEQ ID NO: 632220 - DNA, 20 bp, mouse
ggggtgccgagggatggcaa

SEQ ID NO: 632221 - DNA, 20 bp, mouse
gttctccgctgaggaggagt

SEQ ID NO: 632222 - DNA, 20 bp, mouse
gcggtccccgccggccaggg

SEQ ID NO: 632223 - DNA, 20 bp, mouse
gcctatggtgagtctaaatg

SEQ ID NO: 632224 - DNA, 20 bp, mouse
gtgcggcccagtataggtaa

SEQ ID NO: 632225 - DNA, 20 bp, mouse
ggtcaggtcccatggcggga

SEQ ID NO: 632226 - DNA, 20 bp, mouse
ggccctgacgtcactcccgt

SEQ ID NO: 632227 - DNA, 20 bp, mouse
gcgttacctggacgacgggt

SEQ ID NO: 632228 - DNA, 20 bp, mouse
gacgtcctcccggagcccac

SEQ ID NO: 632229 - DNA, 20 bp, mouse
ggctcttccggcctcgcgca

SEQ ID NO: 632230 - DNA, 20 bp, mouse
gtccaggtaacgagccccgt

SEQ ID NO: 632231 - DNA, 20 bp, mouse
gggctcgttacctggacgac

SEQ ID NO: 632232 - DNA, 20 bp, mouse
gaggtaacgagccccgtggg

SEQ ID NO: 632233 - DNA, 20 bp, mouse
gatccaggtcggtccctcct

SEQ ID NO: 632234 - DNA, 20 bp, mouse
ggcccacgggagtgacgtca

SEQ ID NO: 632235 - DNA, 20 bp, mouse
ggggcaccaacccgtcgtcc

SEQ ID NO: 632236 - DNA, 20 bp, mouse
gggcccagtgctccagagaa

SEQ ID NO: 632237 - DNA, 20 bp, mouse
gagtggcgccccggactcac

SEQ ID NO: 632238 - DNA, 20 bp, mouse
ggtcgtgcggcggtcggcga

SEQ ID NO: 632239 - DNA, 20 bp, mouse
ggcgcgcgcaccaggcccta

SEQ ID NO: 632240 - DNA, 20 bp, mouse
ggcgccccggactcaccgga

SEQ ID NO: 632241 - DNA, 20 bp, mouse
ggactcaccggacggtcgtg

SEQ ID NO: 632242 - DNA, 20 bp, mouse
gcgccgagcaggccccgagg

SEQ ID NO: 632243 - DNA, 20 bp, mouse
gcggcggtcggcgacggtgg

SEQ ID NO: 632244 - DNA, 20 bp, mouse
gcgaccgtccggtgagtccg

SEQ ID NO: 632245 - DNA, 20 bp, mouse
ggtgcggcggtcggcgacgg

SEQ ID NO: 632246 - DNA, 20 bp, mouse
gaatgcctgaaattgagtaa

SEQ ID NO: 632247 - DNA, 20 bp, mouse
gattctgggaacggaaagac

SEQ ID NO: 632248 - DNA, 20 bp, mouse
gcagaccagtgtagaggggt

SEQ ID NO: 632249 - DNA, 20 bp, mouse
gacaattaagaggcctagta

SEQ ID NO: 632250 - DNA, 20 bp, mouse
gactcaatttcaggcattct

SEQ ID NO: 632251 - DNA, 20 bp, mouse
gtcaccagaccagtgtagag

SEQ ID NO: 632252 - DNA, 20 bp, mouse
gctggctaatggaagaaaga

SEQ ID NO: 632253 - DNA, 20 bp, mouse
gagagtactgggccggtctc

SEQ ID NO: 632254 - DNA, 20 bp, mouse
gcaacaccactctcaagagt

SEQ ID NO: 632255 - DNA, 20 bp, mouse
ggctgcggcgctgttcccta

SEQ ID NO: 632256 - DNA, 20 bp, mouse
gcagggtggtcagaactatg

SEQ ID NO: 632257 - DNA, 20 bp, mouse
gactggtctagagcagcaac

SEQ ID NO: 632258 - DNA, 20 bp, mouse
gagctctgctattgctccag

SEQ ID NO: 632259 - DNA, 20 bp, mouse
gcaacaacaggaacgagaac

SEQ ID NO: 632260 - DNA, 20 bp, mouse
gaagagggacaagatctctt

SEQ ID NO: 632261 - DNA, 20 bp, mouse
gtcttgggaagctaaatcta

SEQ ID NO: 632262 - DNA, 20 bp, mouse
gcttttggctttggtggcgg

SEQ ID NO: 632263 - DNA, 20 bp, mouse
ggatcttttggctttggtgg

SEQ ID NO: 632264 - DNA, 20 bp, mouse
gaactggaacgaattaaaga

SEQ ID NO: 632265 - DNA, 20 bp, mouse
gcctggtttggggaaaagat

SEQ ID NO: 632266 - DNA, 20 bp, mouse
gcaactgacaacaagagagg

SEQ ID NO: 632267 - DNA, 20 bp, mouse
gtcgctcctaggaggaaggg

SEQ ID NO: 632268 - DNA, 20 bp, mouse
gttccaactgacaacaagag

SEQ ID NO: 632269 - DNA, 20 bp, mouse
gtggccgaactgctccgggt

SEQ ID NO: 632270 - DNA, 20 bp, mouse
gccaaggcaaggcggtgtgg

SEQ ID NO: 632271 - DNA, 20 bp, mouse
gtggccgctcctccctagct

SEQ ID NO: 632272 - DNA, 20 bp, mouse
gagagcagcccgggtcctgt

SEQ ID NO: 632273 - DNA, 20 bp, mouse
gcagttcggccaaggcaagg

SEQ ID NO: 632274 - DNA, 20 bp, mouse
gcagtcgctcctaggaggaa

SEQ ID NO: 632275 - DNA, 20 bp, mouse
gtggtgtccgggagcaaggt

SEQ ID NO: 632276 - DNA, 20 bp, mouse
gcagccgacctagcagagaa

SEQ ID NO: 632277 - DNA, 20 bp, mouse
gtgaggcgtgaagagtaacc

SEQ ID NO: 632278 - DNA, 20 bp, mouse
gtcggctggggacgagctct

SEQ ID NO: 632279 - DNA, 20 bp, mouse
gtaacccggccacgacaccc

SEQ ID NO: 632280 - DNA, 20 bp, mouse
ggctggcgtcgcgctgtcct

SEQ ID NO: 632281 - DNA, 20 bp, mouse
gcccgcagtacgctgaggag

SEQ ID NO: 632282 - DNA, 20 bp, mouse
gtcgacgcgacgccgcagtg

SEQ ID NO: 632283 - DNA, 20 bp, mouse
gcagcgtactgcgggcggag

SEQ ID NO: 632284 - DNA, 20 bp, mouse
gagacagcgagcgaacactg

SEQ ID NO: 632285 - DNA, 20 bp, mouse
gtactcttcacgcctcactg

SEQ ID NO: 632286 - DNA, 20 bp, mouse
gccgatgggcgtgtgggact

SEQ ID NO: 632287 - DNA, 20 bp, mouse
gacagcgccgatgggcgtgt

SEQ ID NO: 632288 - DNA, 20 bp, mouse
gcacaacctgagggtctgag

SEQ ID NO: 632289 - DNA, 20 bp, mouse
ggcccctggacagcgccgat

SEQ ID NO: 632290 - DNA, 20 bp, mouse
gtcgctccgggtccaggata

SEQ ID NO: 632291 - DNA, 20 bp, mouse
ggtaggcctctcagaccctc

SEQ ID NO: 632292 - DNA, 20 bp, mouse
gtcggcgctgcagaattggt

SEQ ID NO: 632293 - DNA, 20 bp, mouse
gcctctcaccagcgcagggt

SEQ ID NO: 632294 - DNA, 20 bp, mouse
gaaagccgaagggccaaggg

SEQ ID NO: 632295 - DNA, 20 bp, mouse
gggacgcggggcgaagggaa

SEQ ID NO: 632296 - DNA, 20 bp, mouse
gtggcagccatcgccatcag

SEQ ID NO: 632297 - DNA, 20 bp, mouse
gggtctctgaggaacctcgt

SEQ ID NO: 632298 - DNA, 20 bp, mouse
ggtcagaacccgaggtggaa

SEQ ID NO: 632299 - DNA, 20 bp, mouse
gcggcagtcagaacccgagg

SEQ ID NO: 632300 - DNA, 20 bp, mouse
ggccgagccactgatggcga

SEQ ID NO: 632301 - DNA, 20 bp, mouse
gggccggcagtcagaacccg

SEQ ID NO: 632302 - DNA, 20 bp, mouse
gtcgagcgccgagccactga

SEQ ID NO: 632303 - DNA, 20 bp, mouse
gaggcgcgccgggcagaaac

SEQ ID NO: 632304 - DNA, 20 bp, mouse
gttctgactgccggcctacg

SEQ ID NO: 632305 - DNA, 20 bp, mouse
gtctgaggaacctcgtaggc

SEQ ID NO: 632306 - DNA, 20 bp, mouse
gggcggagacatgtcctcgg

SEQ ID NO: 632307 - DNA, 20 bp, mouse
gcgacgcgcggccacccccg

SEQ ID NO: 632308 - DNA, 20 bp, mouse
gcggccgagcgtccctagga

SEQ ID NO: 632309 - DNA, 20 bp, mouse
ggcgcgggcggtggcgtgag

SEQ ID NO: 632310 - DNA, 20 bp, mouse
ggtggcgtgaggggctcagg

SEQ ID NO: 632311 - DNA, 20 bp, mouse
gtcaggcggagacatgtcct

SEQ ID NO: 632312 - DNA, 20 bp, mouse
ggcggtggcgtgaggggctc

SEQ ID NO: 632313 - DNA, 20 bp, mouse
ggtctcccgcctccgtccta

SEQ ID NO: 632314 - DNA, 20 bp, mouse
gccttgtccggaacccactg

SEQ ID NO: 632315 - DNA, 20 bp, mouse
ggcggggtggcgccttgtgt

SEQ ID NO: 632316 - DNA, 20 bp, mouse
gcccggagcaggtgagtgta

SEQ ID NO: 632317 - DNA, 20 bp, mouse
gacctgaccgggatcaaaca

SEQ ID NO: 632318 - DNA, 20 bp, mouse
gaacagaaggctctaaccaa

SEQ ID NO: 632319 - DNA, 20 bp, mouse
gaaacatggctgctctggac

SEQ ID NO: 632320 - DNA, 20 bp, mouse
gtgggacttgtcacctgacc

SEQ ID NO: 632321 - DNA, 20 bp, mouse
gggcgcagggaagattgcga

SEQ ID NO: 632322 - DNA, 20 bp, mouse
gaggtctgcggtagaagatg

SEQ ID NO: 632323 - DNA, 20 bp, mouse
ggccatgtttgatcccggtc

SEQ ID NO: 632324 - DNA, 20 bp, mouse
gtgcattcgactcccggagc

SEQ ID NO: 632325 - DNA, 20 bp, mouse
ggagcagccatgtttgatcc

SEQ ID NO: 632326 - DNA, 20 bp, mouse
gcgaagtcgcaggtccaccc

SEQ ID NO: 632327 - DNA, 20 bp, mouse
gcgcgtcccggaagcgacgg

SEQ ID NO: 632328 - DNA, 20 bp, mouse
gagtcgcgtcccggaagcga

SEQ ID NO: 632329 - DNA, 20 bp, mouse
gggaggggcagacggttccc

SEQ ID NO: 632330 - DNA, 20 bp, mouse
gcgggacgcgactcactctg

SEQ ID NO: 632331 - DNA, 20 bp, mouse
gcggaagcgacggcggtgga

SEQ ID NO: 632332 - DNA, 20 bp, mouse
ggacgcgactcactctgcgg

SEQ ID NO: 632333 - DNA, 20 bp, mouse
gacctgcgacttcggagcgt

SEQ ID NO: 632334 - DNA, 20 bp, mouse
gaccgacgctccgaagtcgc

SEQ ID NO: 632335 - DNA, 20 bp, mouse
gacttcggagcgtcggtggg

SEQ ID NO: 632336 - DNA, 20 bp, mouse
gcgggcgcgcggaaaggcgc

SEQ ID NO: 632337 - DNA, 20 bp, mouse
gagcgggcgggcgcgcggaa

SEQ ID NO: 632338 - DNA, 20 bp, mouse
ggcggaaaggcgcgggcaca

SEQ ID NO: 632339 - DNA, 20 bp, mouse
gcatgtgcggtcgtgaccgg

SEQ ID NO: 632340 - DNA, 20 bp, mouse
ggcgcatgtgcggtcgtgac

SEQ ID NO: 632341 - DNA, 20 bp, mouse
gcccaaacccgcgagcgggc

SEQ ID NO: 632342 - DNA, 20 bp, mouse
ggccgacccaaacccgcgag

SEQ ID NO: 632343 - DNA, 20 bp, mouse
ggcagcgctgcgcccgggtc

SEQ ID NO: 632344 - DNA, 20 bp, mouse
gcggcgcggggtggacacgc

SEQ ID NO: 632345 - DNA, 20 bp, mouse
gccagctgcggaccatgtcc

SEQ ID NO: 632346 - DNA, 20 bp, mouse
ggcttacggcgggacaaccg

SEQ ID NO: 632347 - DNA, 20 bp, mouse
gcgaggcgatgcaggcagac

SEQ ID NO: 632348 - DNA, 20 bp, mouse
gaagcctcgcactcctgagg

SEQ ID NO: 632349 - DNA, 20 bp, mouse
gcgatgcaggcagacgggct

SEQ ID NO: 632350 - DNA, 20 bp, mouse
gcccccgggccatggagagg

SEQ ID NO: 632351 - DNA, 20 bp, mouse
gcggccgcaccgggcacgag

SEQ ID NO: 632352 - DNA, 20 bp, mouse
gccgggggcgcagcttacgg

SEQ ID NO: 632353 - DNA, 20 bp, mouse
gcggccgggggcgcagctta

SEQ ID NO: 632354 - DNA, 20 bp, mouse
ggggacaaccgaggcgatgc

SEQ ID NO: 632355 - DNA, 20 bp, mouse
gtcgcggcggagccccgctg

SEQ ID NO: 632356 - DNA, 20 bp, mouse
gctggccagcggcagtacac

SEQ ID NO: 632357 - DNA, 20 bp, mouse
gaatgccacagggagatcat

SEQ ID NO: 632358 - DNA, 20 bp, mouse
gccactgtaagaggatgtcc

SEQ ID NO: 632359 - DNA, 20 bp, mouse
gcttacagtggagagtatgg

SEQ ID NO: 632360 - DNA, 20 bp, mouse
gctctgacaatcctggccag

SEQ ID NO: 632361 - DNA, 20 bp, mouse
gaacattctgaggctgcggt

SEQ ID NO: 632362 - DNA, 20 bp, mouse
gagaaggactaagagggcga

SEQ ID NO: 632363 - DNA, 20 bp, mouse
gcctcttacagtggagagta

SEQ ID NO: 632364 - DNA, 20 bp, mouse
ggtcctggactgaactagag

SEQ ID NO: 632365 - DNA, 20 bp, mouse
gccagtaagtgaaatgccac

SEQ ID NO: 632366 - DNA, 20 bp, mouse
gactcggtgtccagacaagg

SEQ ID NO: 632367 - DNA, 20 bp, mouse
ggtgggcatggaggcggcac

SEQ ID NO: 632368 - DNA, 20 bp, mouse
gtggcgccagaagttcctgc

SEQ ID NO: 632369 - DNA, 20 bp, mouse
gccgcctccatgcccactgt

SEQ ID NO: 632370 - DNA, 20 bp, mouse
gacgtccgcgtacctaacag

SEQ ID NO: 632371 - DNA, 20 bp, mouse
gacgcgccggcaggaacttc

SEQ ID NO: 632372 - DNA, 20 bp, mouse
ggcgactcggtgtccagaca

SEQ ID NO: 632373 - DNA, 20 bp, mouse
gggctggagacttgacgcgc

SEQ ID NO: 632374 - DNA, 20 bp, mouse
gcccacggatgagccctcag

SEQ ID NO: 632375 - DNA, 20 bp, mouse
gcccactgtgggcccagctg

SEQ ID NO: 632376 - DNA, 20 bp, mouse
gcggcgctcgcaggctagaa

SEQ ID NO: 632377 - DNA, 20 bp, mouse
gctccggcggaagtgcccgg

SEQ ID NO: 632378 - DNA, 20 bp, mouse
gtgagcttggctggcgaggg

SEQ ID NO: 632379 - DNA, 20 bp, mouse
ggcgtgagcttggctggcga

SEQ ID NO: 632380 - DNA, 20 bp, mouse
gggcggaagtgcccggcgga

SEQ ID NO: 632381 - DNA, 20 bp, mouse
ggagcagtaagaacaactca

SEQ ID NO: 632382 - DNA, 20 bp, mouse
ggctctccggcggaagtgcc

SEQ ID NO: 632383 - DNA, 20 bp, mouse
gcgacccagcaggcaggatt

SEQ ID NO: 632384 - DNA, 20 bp, mouse
gcgagcgccggccggaggtg

SEQ ID NO: 632385 - DNA, 20 bp, mouse
gtagccttctgccctccgcc

SEQ ID NO: 632386 - DNA, 20 bp, mouse
ggctctgaaatgcaagatgg

SEQ ID NO: 632387 - DNA, 20 bp, mouse
gctgaaatgcaagatggcgg

SEQ ID NO: 632388 - DNA, 20 bp, mouse
ggtcgctctgaaatgcaaga

SEQ ID NO: 632389 - DNA, 20 bp, mouse
ggcgaggcgctgaggcgagg

SEQ ID NO: 632390 - DNA, 20 bp, mouse
ggcggcgaggcgctgaggcg

SEQ ID NO: 632391 - DNA, 20 bp, mouse
ggctgggtcccgaagagggg

SEQ ID NO: 632392 - DNA, 20 bp, mouse
gtccctgacagagggcgggg

SEQ ID NO: 632393 - DNA, 20 bp, mouse
gacgcaagatcggacccggg

SEQ ID NO: 632394 - DNA, 20 bp, mouse
gggcaggcccagttcccccc

SEQ ID NO: 632395 - DNA, 20 bp, mouse
gcgcgaggaggagccagccg

SEQ ID NO: 632396 - DNA, 20 bp, mouse
ggaacgcggagacgaggcac

SEQ ID NO: 632397 - DNA, 20 bp, mouse
ggctgcgaacgcggggaccc

SEQ ID NO: 632398 - DNA, 20 bp, mouse
gaatggaagccagaccgagg

SEQ ID NO: 632399 - DNA, 20 bp, mouse
ggggacccgggctgggaacg

SEQ ID NO: 632400 - DNA, 20 bp, mouse
gaggcacgggcgttccaaaa

SEQ ID NO: 632401 - DNA, 20 bp, mouse
gaagtttcttacctgcgccg

SEQ ID NO: 632402 - DNA, 20 bp, mouse
gcaggtaagaaacttcgccc

SEQ ID NO: 632403 - DNA, 20 bp, mouse
ggtccccgcgttcgcagccc

SEQ ID NO: 632404 - DNA, 20 bp, mouse
ggagggtgggaggaaatccg

SEQ ID NO: 632405 - DNA, 20 bp, mouse
gctgcgggtgctccgcgccg

SEQ ID NO: 632406 - DNA, 20 bp, mouse
gggtggcgacgccagatcca

SEQ ID NO: 632407 - DNA, 20 bp, mouse
ggatccacggactgcttctg

SEQ ID NO: 632408 - DNA, 20 bp, mouse
ggccgctcggccgagctcgg

SEQ ID NO: 632409 - DNA, 20 bp, mouse
gcgagctcggtggcactcgg

SEQ ID NO: 632410 - DNA, 20 bp, mouse
gtcgccccagaagcagtccg

SEQ ID NO: 632411 - DNA, 20 bp, mouse
ggccggcacaggccccgcgg

SEQ ID NO: 632412 - DNA, 20 bp, mouse
gcccgggactgacagctctg

SEQ ID NO: 632413 - DNA, 20 bp, mouse
ggccgcccaccaaggaagga

SEQ ID NO: 632414 - DNA, 20 bp, mouse
gaggcgctcgcagacacaca

SEQ ID NO: 632415 - DNA, 20 bp, mouse
ggccggccgcccaccaagga

SEQ ID NO: 632416 - DNA, 20 bp, mouse
gcgcgctgcgcgaggagaca

SEQ ID NO: 632417 - DNA, 20 bp, mouse
gtttgcggtttatcttcctg

SEQ ID NO: 632418 - DNA, 20 bp, mouse
gcgcgctcaccgcccggctg

SEQ ID NO: 632419 - DNA, 20 bp, mouse
gctagtggagaagtgaggag

SEQ ID NO: 632420 - DNA, 20 bp, mouse
ggaggtgaaagtttctcccc

SEQ ID NO: 632421 - DNA, 20 bp, mouse
gcagtctcgcgctcaccgcc

SEQ ID NO: 632422 - DNA, 20 bp, mouse
gtttcacctcctcagccggg

SEQ ID NO: 632423 - DNA, 20 bp, mouse
gcctctcggcagagactgag

SEQ ID NO: 632424 - DNA, 20 bp, mouse
gccgagagggcctcgaatca

SEQ ID NO: 632425 - DNA, 20 bp, mouse
gagggagagttgaaggatcg

SEQ ID NO: 632426 - DNA, 20 bp, mouse
gcgaaggcgcggagaggaag

SEQ ID NO: 632427 - DNA, 20 bp, mouse
gaccgagcgaaggcgcggag

SEQ ID NO: 632428 - DNA, 20 bp, mouse
ggcggccgggcaccgagcga

SEQ ID NO: 632429 - DNA, 20 bp, mouse
gcgggcaccgagcgaaggcg

SEQ ID NO: 632430 - DNA, 20 bp, mouse
gggccgcctgaggcagatac

SEQ ID NO: 632431 - DNA, 20 bp, mouse
gtccaggcggcggggttcac

SEQ ID NO: 632432 - DNA, 20 bp, mouse
gcacggagccgggcgtccag

SEQ ID NO: 632433 - DNA, 20 bp, mouse
gcgatccgaagaggaaatcc

SEQ ID NO: 632434 - DNA, 20 bp, mouse
gctgaggcagatacaggcgg

SEQ ID NO: 632435 - DNA, 20 bp, mouse
gaggagaagagtccaaagcc

SEQ ID NO: 632436 - DNA, 20 bp, mouse
gctcctgcagagggacggga

SEQ ID NO: 632437 - DNA, 20 bp, mouse
gcagtccaaggacattactc

SEQ ID NO: 632438 - DNA, 20 bp, mouse
gctctggaggtgaagaggct

SEQ ID NO: 632439 - DNA, 20 bp, mouse
ggcgctcttgagtagaggag

SEQ ID NO: 632440 - DNA, 20 bp, mouse
gactcgcgaagcgagcagtg

SEQ ID NO: 632441 - DNA, 20 bp, mouse
gcggaacgtggccagagggc

SEQ ID NO: 632442 - DNA, 20 bp, mouse
gcaggcagcctgcagtaagc

SEQ ID NO: 632443 - DNA, 20 bp, mouse
gggccgtagtcggaaaggga

SEQ ID NO: 632444 - DNA, 20 bp, mouse
gcgtagtcggaaagggatgg

SEQ ID NO: 632445 - DNA, 20 bp, mouse
gccggagctgcaactttcct

SEQ ID NO: 632446 - DNA, 20 bp, mouse
ggctttcggggaagcagtta

SEQ ID NO: 632447 - DNA, 20 bp, mouse
gcttccccgaaagctggaga

SEQ ID NO: 632448 - DNA, 20 bp, mouse
gtgaaggatgaccgcctcgg

SEQ ID NO: 632449 - DNA, 20 bp, mouse
gaaatgaaggatgaccgcct

SEQ ID NO: 632450 - DNA, 20 bp, mouse
gggaaggcctgtacccccag

SEQ ID NO: 632451 - DNA, 20 bp, mouse
gtctccttctccagctttcg

SEQ ID NO: 632452 - DNA, 20 bp, mouse
gctcggtggaaccacaaaag

SEQ ID NO: 632453 - DNA, 20 bp, mouse
gaggtgatccgggcaacagg

SEQ ID NO: 632454 - DNA, 20 bp, mouse
gaaaccaggggggtcaactg

SEQ ID NO: 632455 - DNA, 20 bp, mouse
gtaagtgcttgaaaccaggg

SEQ ID NO: 632456 - DNA, 20 bp, mouse
gaatcgctggaggatagagt

SEQ ID NO: 632457 - DNA, 20 bp, mouse
gacaagaataagcagctagg

SEQ ID NO: 632458 - DNA, 20 bp, mouse
gaataagcagctaggaggcc

SEQ ID NO: 632459 - DNA, 20 bp, mouse
gtcactctgccaatcgctgg

SEQ ID NO: 632460 - DNA, 20 bp, mouse
gggcccatggaccctcactg

SEQ ID NO: 632461 - DNA, 20 bp, mouse
gccactgtgcagctcaaatg

SEQ ID NO: 632462 - DNA, 20 bp, mouse
gaaaaacatgtatatattag

SEQ ID NO: 632463 - DNA, 20 bp, mouse
ggggcgggccgaccagcacc

SEQ ID NO: 632464 - DNA, 20 bp, mouse
gtgttcactctgccaatcgc

SEQ ID NO: 632465 - DNA, 20 bp, mouse
gagtccctgaggccacggag

SEQ ID NO: 632466 - DNA, 20 bp, mouse
gaagcctggtgcatgagcgt

SEQ ID NO: 632467 - DNA, 20 bp, mouse
gcgtacacctctggacaaag

SEQ ID NO: 632468 - DNA, 20 bp, mouse
ggcaagacccctttgtccag

SEQ ID NO: 632469 - DNA, 20 bp, mouse
gaggggtcttgcacacgatc

SEQ ID NO: 632470 - DNA, 20 bp, mouse
gagataagtggcgaggacaa

SEQ ID NO: 632471 - DNA, 20 bp, mouse
gctcaaaggagcggttctaa

SEQ ID NO: 632472 - DNA, 20 bp, mouse
gcgcagacaacggggaaacg

SEQ ID NO: 632473 - DNA, 20 bp, mouse
gtggggagtagcgacttaag

SEQ ID NO: 632474 - DNA, 20 bp, mouse
gtctgtggcgctcattttag

SEQ ID NO: 632475 - DNA, 20 bp, mouse
gctactaatacagggatctg

SEQ ID NO: 632476 - DNA, 20 bp, mouse
gaaccaagcgcgaggacgag

SEQ ID NO: 632477 - DNA, 20 bp, mouse
gggacgagaggcaagaacac

SEQ ID NO: 632478 - DNA, 20 bp, mouse
gcggtgcctggaggcgagtg

SEQ ID NO: 632479 - DNA, 20 bp, mouse
ggcctggaggcgagtgcgga

SEQ ID NO: 632480 - DNA, 20 bp, mouse
gggtgtgcgagggaatagtg

SEQ ID NO: 632481 - DNA, 20 bp, mouse
gacacgggagaggactgaga

SEQ ID NO: 632482 - DNA, 20 bp, mouse
gcgcaggctgcggtgcctgg

SEQ ID NO: 632483 - DNA, 20 bp, mouse
gagcctgcggccacccggag

SEQ ID NO: 632484 - DNA, 20 bp, mouse
gagaggcaagaacacgggag

SEQ ID NO: 632485 - DNA, 20 bp, mouse
gggaggcgagtgcggacgga

SEQ ID NO: 632486 - DNA, 20 bp, mouse
gtgggttcaacccgaccgaa

SEQ ID NO: 632487 - DNA, 20 bp, mouse
ggggcactgcacaccgacat

SEQ ID NO: 632488 - DNA, 20 bp, mouse
gctgtggcgaggtattggga

SEQ ID NO: 632489 - DNA, 20 bp, mouse
ggtattgggagggcctatgt

SEQ ID NO: 632490 - DNA, 20 bp, mouse
gtgtgcagtgcccttcggtc

SEQ ID NO: 632491 - DNA, 20 bp, mouse
ggtcggtgtgcagtgccctt

SEQ ID NO: 632492 - DNA, 20 bp, mouse
gaggccgctccggagactca

SEQ ID NO: 632493 - DNA, 20 bp, mouse
gtcaccgtgagtctccggag

SEQ ID NO: 632494 - DNA, 20 bp, mouse
gggcggtgctcgaatctctg

SEQ ID NO: 632495 - DNA, 20 bp, mouse
ggtgcctgtggcgaggtatt

SEQ ID NO: 632496 - DNA, 20 bp, mouse
ggtgtgtgctgtgtccgtag

SEQ ID NO: 632497 - DNA, 20 bp, mouse
gtacaaagcccagcaccgag

SEQ ID NO: 632498 - DNA, 20 bp, mouse
gggtggaggaggactctccg

SEQ ID NO: 632499 - DNA, 20 bp, mouse
ggaagtggccggccctgagg

SEQ ID NO: 632500 - DNA, 20 bp, mouse
ggcccagcaccgagaggtgg

SEQ ID NO: 632501 - DNA, 20 bp, mouse
gccaatggctgcaggctctg

SEQ ID NO: 632502 - DNA, 20 bp, mouse
gcacagcacacacgcgaacc

SEQ ID NO: 632503 - DNA, 20 bp, mouse
ggggtcgtcccgccacctct

SEQ ID NO: 632504 - DNA, 20 bp, mouse
gctttgtacggtgaaggtgg

SEQ ID NO: 632505 - DNA, 20 bp, mouse
gctaccctcttccaaaaacg

SEQ ID NO: 632506 - DNA, 20 bp, mouse
gcgcgcagccccgaaccgaa

SEQ ID NO: 632507 - DNA, 20 bp, mouse
ggcagccccgaaccgaacgg

SEQ ID NO: 632508 - DNA, 20 bp, mouse
gcggatgctggtgcaggtat

SEQ ID NO: 632509 - DNA, 20 bp, mouse
ggtggtatggaaggacggga

SEQ ID NO: 632510 - DNA, 20 bp, mouse
gaggttctgaacgcttattg

SEQ ID NO: 632511 - DNA, 20 bp, mouse
gtcaagacttgagcacaggg

SEQ ID NO: 632512 - DNA, 20 bp, mouse
ggcgcagctgctgcgggaca

SEQ ID NO: 632513 - DNA, 20 bp, mouse
gacttgagcacagggtggta

SEQ ID NO: 632514 - DNA, 20 bp, mouse
gcagggtggtatggaaggac

SEQ ID NO: 632515 - DNA, 20 bp, mouse
ggacacaccaaagaattata

SEQ ID NO: 632516 - DNA, 20 bp, mouse
gcaaccgggacgctgcgcag

SEQ ID NO: 632517 - DNA, 20 bp, mouse
gcgcagcggtgagtatactg

SEQ ID NO: 632518 - DNA, 20 bp, mouse
gcctacgcggcccgccaacc

SEQ ID NO: 632519 - DNA, 20 bp, mouse
gatccccgagggcacctatg

SEQ ID NO: 632520 - DNA, 20 bp, mouse
gaggccgggccgccgcggaa

SEQ ID NO: 632521 - DNA, 20 bp, mouse
ggagggcacctatgaggacg

SEQ ID NO: 632522 - DNA, 20 bp, mouse
gcccagagccgcgtcctcat

SEQ ID NO: 632523 - DNA, 20 bp, mouse
gctccggcctttcctttccg

SEQ ID NO: 632524 - DNA, 20 bp, mouse
gcgcggcggcccggcctacg

SEQ ID NO: 632525 - DNA, 20 bp, mouse
gtcaccgctgcgcagcgtcc

SEQ ID NO: 632526 - DNA, 20 bp, mouse
gtgcgctggcggagctgaca

SEQ ID NO: 632527 - DNA, 20 bp, mouse
ggccagaggggaagaagctg

SEQ ID NO: 632528 - DNA, 20 bp, mouse
gatgaggctaggcctcgcgg

SEQ ID NO: 632529 - DNA, 20 bp, mouse
ggacctggaccaggacccca

SEQ ID NO: 632530 - DNA, 20 bp, mouse
ggaagctgcgggatgaggct

SEQ ID NO: 632531 - DNA, 20 bp, mouse
gccgagaacctcggccagag

SEQ ID NO: 632532 - DNA, 20 bp, mouse
gctgcgctcgcgcccctggt

SEQ ID NO: 632533 - DNA, 20 bp, mouse
ggggaagaagctgcgggatg

SEQ ID NO: 632534 - DNA, 20 bp, mouse
gcgctgcaggtgcccaccag

SEQ ID NO: 632535 - DNA, 20 bp, mouse
gggaatgtccggactcgcag

SEQ ID NO: 632536 - DNA, 20 bp, mouse
gcgggaggacggtaacagga

SEQ ID NO: 632537 - DNA, 20 bp, mouse
ggtgactgcggggtgctacg

SEQ ID NO: 632538 - DNA, 20 bp, mouse
gagcagccgacccctgcggg

SEQ ID NO: 632539 - DNA, 20 bp, mouse
gaggtgctgcgttcgcgggt

SEQ ID NO: 632540 - DNA, 20 bp, mouse
gcctgcgggaggacggtaac

SEQ ID NO: 632541 - DNA, 20 bp, mouse
gtcgaaagtccgaccccggg

SEQ ID NO: 632542 - DNA, 20 bp, mouse
gtacgaggtgctgcgttcgc

SEQ ID NO: 632543 - DNA, 20 bp, mouse
gaggcgcccgaggccctgtc

SEQ ID NO: 632544 - DNA, 20 bp, mouse
gacaagcagccgacccctgc

SEQ ID NO: 632545 - DNA, 20 bp, mouse
gaccgtcctcccgcaggggt

SEQ ID NO: 632546 - DNA, 20 bp, mouse
gtattctcaagggatgctcg

SEQ ID NO: 632547 - DNA, 20 bp, mouse
gacgctcggtctgcagaaga

SEQ ID NO: 632548 - DNA, 20 bp, mouse
gtcctagagggcgccggaag

SEQ ID NO: 632549 - DNA, 20 bp, mouse
gtgcagaagactaggattgt

SEQ ID NO: 632550 - DNA, 20 bp, mouse
gtcgtgctctgggtcaccaa

SEQ ID NO: 632551 - DNA, 20 bp, mouse
ggaatattgtgggtttaggg

SEQ ID NO: 632552 - DNA, 20 bp, mouse
gcaatgcttccaccagagtc

SEQ ID NO: 632553 - DNA, 20 bp, mouse
ggccattctgtgccaactcc

SEQ ID NO: 632554 - DNA, 20 bp, mouse
gtgacccagagcacgagggg

SEQ ID NO: 632555 - DNA, 20 bp, mouse
gccagagcacgaggggaggg

SEQ ID NO: 632556 - DNA, 20 bp, mouse
gatgaactgttggaaagtgt

SEQ ID NO: 632557 - DNA, 20 bp, mouse
gacttccggcgatgaactgt

SEQ ID NO: 632558 - DNA, 20 bp, mouse
ggtccccgggacttaaagac

SEQ ID NO: 632559 - DNA, 20 bp, mouse
ggtcggacttgcctctctct

SEQ ID NO: 632560 - DNA, 20 bp, mouse
gaccagccgggtcaaggtta

SEQ ID NO: 632561 - DNA, 20 bp, mouse
ggccaaactgaagtcagtat

SEQ ID NO: 632562 - DNA, 20 bp, mouse
gatcttccaagcctgggctg

SEQ ID NO: 632563 - DNA, 20 bp, mouse
gatcaaactccccgcagccc

SEQ ID NO: 632564 - DNA, 20 bp, mouse
gccgggtcaaggttagggac

SEQ ID NO: 632565 - DNA, 20 bp, mouse
ggagctattacaaagaatcc

SEQ ID NO: 632566 - DNA, 20 bp, mouse
ggcctcggtgagggtggtta

SEQ ID NO: 632567 - DNA, 20 bp, mouse
ggccctaaccaccctcaccg

SEQ ID NO: 632568 - DNA, 20 bp, mouse
gtccggaagtgcctcggtga

SEQ ID NO: 632569 - DNA, 20 bp, mouse
gtcaagcccaggaagagcta

SEQ ID NO: 632570 - DNA, 20 bp, mouse
ggtagtttgggcggatcgga

SEQ ID NO: 632571 - DNA, 20 bp, mouse
gggtaagcgcgtagtttggg

SEQ ID NO: 632572 - DNA, 20 bp, mouse
gaccctcaccgaggcacttc

SEQ ID NO: 632573 - DNA, 20 bp, mouse
gggcacttccggaagctgga

SEQ ID NO: 632574 - DNA, 20 bp, mouse
gtctcctgggacgagcaacc

SEQ ID NO: 632575 - DNA, 20 bp, mouse
ggcgcgtagtttgggcggat

SEQ ID NO: 632576 - DNA, 20 bp, mouse
gctctggcatcagccaccag

SEQ ID NO: 632577 - DNA, 20 bp, mouse
ggtgctaccatgagatgtct

SEQ ID NO: 632578 - DNA, 20 bp, mouse
gagctccctgagccggctca

SEQ ID NO: 632579 - DNA, 20 bp, mouse
gagctggttccagctacagc

SEQ ID NO: 632580 - DNA, 20 bp, mouse
gtcagtgtgcctgctgtagc

SEQ ID NO: 632581 - DNA, 20 bp, mouse
gtctctgcttcaaactgcgg

SEQ ID NO: 632582 - DNA, 20 bp, mouse
gcatgtatcagaagcaggag

SEQ ID NO: 632583 - DNA, 20 bp, mouse
gcaagccctgagccggctca

SEQ ID NO: 632584 - DNA, 20 bp, mouse
gatgccagaggtccacacca

SEQ ID NO: 632585 - DNA, 20 bp, mouse
gctggaaccagcttctcttt

SEQ ID NO: 632586 - DNA, 20 bp, mouse
gagcgcgcgaggagacgcga

SEQ ID NO: 632587 - DNA, 20 bp, mouse
gaggcggcacagcgcggaca

SEQ ID NO: 632588 - DNA, 20 bp, mouse
gggctgcaggggtcccgctc

SEQ ID NO: 632589 - DNA, 20 bp, mouse
ggacggacaccgaacccgag

SEQ ID NO: 632590 - DNA, 20 bp, mouse
gcccggctctgcggctccaa

SEQ ID NO: 632591 - DNA, 20 bp, mouse
gtggaacttagcggctgcag

SEQ ID NO: 632592 - DNA, 20 bp, mouse
gatgaggagagccatcccgt

SEQ ID NO: 632593 - DNA, 20 bp, mouse
gcaggggtcccgctcgggtt

SEQ ID NO: 632594 - DNA, 20 bp, mouse
ggcggacagggaagcgcgcg

SEQ ID NO: 632595 - DNA, 20 bp, mouse
gcgggtgtcggcctgctcag

SEQ ID NO: 632596 - DNA, 20 bp, mouse
gtagggaacttcccgagggt

SEQ ID NO: 632597 - DNA, 20 bp, mouse
gtgtgcgcgccaggctgcga

SEQ ID NO: 632598 - DNA, 20 bp, mouse
gagcttagggaacttcccga

SEQ ID NO: 632599 - DNA, 20 bp, mouse
gctggcgcgcacaattgcac

SEQ ID NO: 632600 - DNA, 20 bp, mouse
gccggcaagtgagcaggcag

SEQ ID NO: 632601 - DNA, 20 bp, mouse
gggctttggcggctccacta

SEQ ID NO: 632602 - DNA, 20 bp, mouse
ggcgaggtcttcccaccctc

SEQ ID NO: 632603 - DNA, 20 bp, mouse
gcggcggaggcgacagctta

SEQ ID NO: 632604 - DNA, 20 bp, mouse
gcgggccagctgctgactgg

SEQ ID NO: 632605 - DNA, 20 bp, mouse
gctggagtccggattccgtt

SEQ ID NO: 632606 - DNA, 20 bp, mouse
gctggcagcggggtaggtgt

SEQ ID NO: 632607 - DNA, 20 bp, mouse
gtggtgtgacgaggtttgag

SEQ ID NO: 632608 - DNA, 20 bp, mouse
gcgaggtttgaggggtctgg

SEQ ID NO: 632609 - DNA, 20 bp, mouse
gggtaggtgttggtgtgacg

SEQ ID NO: 632610 - DNA, 20 bp, mouse
gctgcgccaaggccttacgg

SEQ ID NO: 632611 - DNA, 20 bp, mouse
ggtctctctggaacgcccag

SEQ ID NO: 632612 - DNA, 20 bp, mouse
gcgcagggacagtggaatct

SEQ ID NO: 632613 - DNA, 20 bp, mouse
gttcggaagagaagtctctc

SEQ ID NO: 632614 - DNA, 20 bp, mouse
gaagatggcgtctggcagcg

SEQ ID NO: 632615 - DNA, 20 bp, mouse
gccgagtccaccagacccct

SEQ ID NO: 632616 - DNA, 20 bp, mouse
ggaggctgattgtcaaaagt

SEQ ID NO: 632617 - DNA, 20 bp, mouse
gtcagcctccagcagcggag

SEQ ID NO: 632618 - DNA, 20 bp, mouse
gtgtcaaaagtcggtcggag

SEQ ID NO: 632619 - DNA, 20 bp, mouse
gcggtcggagcggagccacc

SEQ ID NO: 632620 - DNA, 20 bp, mouse
gcagcggagcggccggtcgg

SEQ ID NO: 632621 - DNA, 20 bp, mouse
gccggccgctccgctgctgg

SEQ ID NO: 632622 - DNA, 20 bp, mouse
gcggcggcgagcgcagaaag

SEQ ID NO: 632623 - DNA, 20 bp, mouse
ggagcaccgagtcgccgagg

SEQ ID NO: 632624 - DNA, 20 bp, mouse
gctgattgtcaaaagtcggt

SEQ ID NO: 632625 - DNA, 20 bp, mouse
gatggctgcgggatcgggat

SEQ ID NO: 632626 - DNA, 20 bp, mouse
ggccgggatggagcacgctg

SEQ ID NO: 632627 - DNA, 20 bp, mouse
gtcctcagcgtgctccatcc

SEQ ID NO: 632628 - DNA, 20 bp, mouse
gaaggtctggtcgcagagac

SEQ ID NO: 632629 - DNA, 20 bp, mouse
ggttggtccgagctgctgaa

SEQ ID NO: 632630 - DNA, 20 bp, mouse
gcaggaagacactgccggga

SEQ ID NO: 632631 - DNA, 20 bp, mouse
gagcgcaggaagacactgcc

SEQ ID NO: 632632 - DNA, 20 bp, mouse
gttgcagttagcacaggtgg

SEQ ID NO: 632633 - DNA, 20 bp, mouse
gagcccgagcgaaaacagag

SEQ ID NO: 632634 - DNA, 20 bp, mouse
gtctcccgggacacagataa

SEQ ID NO: 632635 - DNA, 20 bp, mouse
gatctgtgtcccgggagagg

SEQ ID NO: 632636 - DNA, 20 bp, mouse
gcgcaacgcgaggactcaag

SEQ ID NO: 632637 - DNA, 20 bp, mouse
ggcgagcagagcgcaacgcg

SEQ ID NO: 632638 - DNA, 20 bp, mouse
gagtaggttcaaaggacgtt

SEQ ID NO: 632639 - DNA, 20 bp, mouse
ggcatggggagtgaatacag

SEQ ID NO: 632640 - DNA, 20 bp, mouse
ggggaaaagagcctaaaact

SEQ ID NO: 632641 - DNA, 20 bp, mouse
gccgagaaggcggaatacga

SEQ ID NO: 632642 - DNA, 20 bp, mouse
gagagcctaaaacttggacg

SEQ ID NO: 632643 - DNA, 20 bp, mouse
gaccaaagatacctggttcc

SEQ ID NO: 632644 - DNA, 20 bp, mouse
gcagggaacctgagtttctg

SEQ ID NO: 632645 - DNA, 20 bp, mouse
gacatctggagtaggttcaa

SEQ ID NO: 632646 - DNA, 20 bp, mouse
gaaaggaactcggcgttagg

SEQ ID NO: 632647 - DNA, 20 bp, mouse
gacattaaaaaagcgagcgg

SEQ ID NO: 632648 - DNA, 20 bp, mouse
gtggacattaaaaaagcgag

SEQ ID NO: 632649 - DNA, 20 bp, mouse
gggccgggcgagcagcgatc

SEQ ID NO: 632650 - DNA, 20 bp, mouse
gagcgccgtgtactatacta

SEQ ID NO: 632651 - DNA, 20 bp, mouse
gggctccagcctgccctaca

SEQ ID NO: 632652 - DNA, 20 bp, mouse
ggagagcgcggaaatccact

SEQ ID NO: 632653 - DNA, 20 bp, mouse
gccgccgccaccgccgtgta

SEQ ID NO: 632654 - DNA, 20 bp, mouse
ggcggcggcgcgtcctccag

SEQ ID NO: 632655 - DNA, 20 bp, mouse
gcgctcccggcggatcatcg

SEQ ID NO: 632656 - DNA, 20 bp, mouse
gcattgtgccctccgagcgg

SEQ ID NO: 632657 - DNA, 20 bp, mouse
gatatgcatgagcagcgcgg

SEQ ID NO: 632658 - DNA, 20 bp, mouse
gctccattgtgccctccgag

SEQ ID NO: 632659 - DNA, 20 bp, mouse
gacaggtacccgaaggtggg

SEQ ID NO: 632660 - DNA, 20 bp, mouse
ggagctggaacgacaggctg

SEQ ID NO: 632661 - DNA, 20 bp, mouse
gcctgggccaaccccaacaa

SEQ ID NO: 632662 - DNA, 20 bp, mouse
ggcaggtgcggcaggtgcgg

SEQ ID NO: 632663 - DNA, 20 bp, mouse
gaccggggcggggccgactg

SEQ ID NO: 632664 - DNA, 20 bp, mouse
gcggtcgcaaaggtgcggag

SEQ ID NO: 632665 - DNA, 20 bp, mouse
ggcaggtgcggtggcaggtg

SEQ ID NO: 632666 - DNA, 20 bp, mouse
gtaaaggagcgggtgagata

SEQ ID NO: 632667 - DNA, 20 bp, mouse
gagggtgacgatggggatgt

SEQ ID NO: 632668 - DNA, 20 bp, mouse
gccggtgcacgctaaaggag

SEQ ID NO: 632669 - DNA, 20 bp, mouse
gctggcctaaggctgtccag

SEQ ID NO: 632670 - DNA, 20 bp, mouse
ggctatgtgggacttccctg

SEQ ID NO: 632671 - DNA, 20 bp, mouse
ggtgagatagggtgacgatg

SEQ ID NO: 632672 - DNA, 20 bp, mouse
gcaccgctggcactctccga

SEQ ID NO: 632673 - DNA, 20 bp, mouse
gcgagggacgcgtgtcgctg

SEQ ID NO: 632674 - DNA, 20 bp, mouse
gaggcaccggtgcacgctaa

SEQ ID NO: 632675 - DNA, 20 bp, mouse
ggcatcggtggacgctatgt

SEQ ID NO: 632676 - DNA, 20 bp, mouse
gctggaaaagcgggcctgag

SEQ ID NO: 632677 - DNA, 20 bp, mouse
ggacagatcagccatcctcg

SEQ ID NO: 632678 - DNA, 20 bp, mouse
gtgatctgtctccaactcag

SEQ ID NO: 632679 - DNA, 20 bp, mouse
ggagccacaggtgtaacgga

SEQ ID NO: 632680 - DNA, 20 bp, mouse
gaagagagccacaggtgtaa

SEQ ID NO: 632681 - DNA, 20 bp, mouse
ggcgcttcccgccgctgagt

SEQ ID NO: 632682 - DNA, 20 bp, mouse
gggcccgcttttccagagag

SEQ ID NO: 632683 - DNA, 20 bp, mouse
gcatcctcgtggagccgctc

SEQ ID NO: 632684 - DNA, 20 bp, mouse
gtgcacggcaaaatgcgagt

SEQ ID NO: 632685 - DNA, 20 bp, mouse
ggagaaatgccgcctctctc

SEQ ID NO: 632686 - DNA, 20 bp, mouse
gtgggtgaggcggtcgccgg

SEQ ID NO: 632687 - DNA, 20 bp, mouse
gggcagcggccggaggtcgt

SEQ ID NO: 632688 - DNA, 20 bp, mouse
ggaaaacaccccacgacctc

SEQ ID NO: 632689 - DNA, 20 bp, mouse
ggggggcctcgaggtgcggg

SEQ ID NO: 632690 - DNA, 20 bp, mouse
ggcgcgggggcctcgaggtg

SEQ ID NO: 632691 - DNA, 20 bp, mouse
ggtgaggcggtcgccggggg

SEQ ID NO: 632692 - DNA, 20 bp, mouse
gttctgtgctgcgggcggcc

SEQ ID NO: 632693 - DNA, 20 bp, mouse
ggcttcgcgtgcggcccgag

SEQ ID NO: 632694 - DNA, 20 bp, mouse
gcgctgccgcccgcacctcg

SEQ ID NO: 632695 - DNA, 20 bp, mouse
gaggcggtcgccgggggcgg

SEQ ID NO: 632696 - DNA, 20 bp, mouse
ggccaaagatgcaccagata

SEQ ID NO: 632697 - DNA, 20 bp, mouse
gaccctatctggtgcatctt

SEQ ID NO: 632698 - DNA, 20 bp, mouse
gactccagtgatgcctggtg

SEQ ID NO: 632699 - DNA, 20 bp, mouse
gggaggagccttctcttggg

SEQ ID NO: 632700 - DNA, 20 bp, mouse
ggcagaagcgatgtctgcag

SEQ ID NO: 632701 - DNA, 20 bp, mouse
ggcagctgccacccaagaga

SEQ ID NO: 632702 - DNA, 20 bp, mouse
gaatttcgttcaaccctatc

SEQ ID NO: 632703 - DNA, 20 bp, mouse
gggacgtggttggattatag

SEQ ID NO: 632704 - DNA, 20 bp, mouse
gcccactctgtaactctaga

SEQ ID NO: 632705 - DNA, 20 bp, mouse
gaggggaggagccttctctt

SEQ ID NO: 632706 - DNA, 20 bp, mouse
gctgtcccggctgctaggga

SEQ ID NO: 632707 - DNA, 20 bp, mouse
gtcccggctgctagggaggg

SEQ ID NO: 632708 - DNA, 20 bp, mouse
gacccctgtcccggctgcta

SEQ ID NO: 632709 - DNA, 20 bp, mouse
ggggtcgcggcccctttaaa

SEQ ID NO: 632710 - DNA, 20 bp, mouse
gctagaactgcagacagcaa

SEQ ID NO: 632711 - DNA, 20 bp, mouse
gggggccgcgacccctgtcc

SEQ ID NO: 632712 - DNA, 20 bp, mouse
gaagcggcgctgccatttaa

SEQ ID NO: 632713 - DNA, 20 bp, mouse
gcagacccgacccctacctg

SEQ ID NO: 632714 - DNA, 20 bp, mouse
gcgctggggctggagaggat

SEQ ID NO: 632715 - DNA, 20 bp, mouse
gctcgcagtagccgggaggg

SEQ ID NO: 632716 - DNA, 20 bp, mouse
gtgggcgcaagggcctgccg

SEQ ID NO: 632717 - DNA, 20 bp, mouse
ggtcccacgggcgggcgcgt

SEQ ID NO: 632718 - DNA, 20 bp, mouse
gcgcccgcccgtgggacccc

SEQ ID NO: 632719 - DNA, 20 bp, mouse
gggcgcgggagtgacgaggg

SEQ ID NO: 632720 - DNA, 20 bp, mouse
gcctggcgcgggagtgacga

SEQ ID NO: 632721 - DNA, 20 bp, mouse
gcgagcggggcccaacatgg

SEQ ID NO: 632722 - DNA, 20 bp, mouse
gcgcccacgcgcccgcccgt

SEQ ID NO: 632723 - DNA, 20 bp, mouse
gccggcccccgaaagagggt

SEQ ID NO: 632724 - DNA, 20 bp, mouse
gttccgagcggggcccaaca

SEQ ID NO: 632725 - DNA, 20 bp, mouse
gggcgggcgcgtgggcgcaa

SEQ ID NO: 632726 - DNA, 20 bp, mouse
gcggtggcacggcggggccc

SEQ ID NO: 632727 - DNA, 20 bp, mouse
ggagagcctccgggtgcggg

SEQ ID NO: 632728 - DNA, 20 bp, mouse
ggcgcgagagcctccgggtg

SEQ ID NO: 632729 - DNA, 20 bp, mouse
gcggggagcgcgagagcctc

SEQ ID NO: 632730 - DNA, 20 bp, mouse
ggcttcgcgtgcggccggag

SEQ ID NO: 632731 - DNA, 20 bp, mouse
gcgctgccgcccgcacccgg

SEQ ID NO: 632732 - DNA, 20 bp, mouse
gtctcgcgctccccgccccg

SEQ ID NO: 632733 - DNA, 20 bp, mouse
gtggctgggtgaggcggccg

SEQ ID NO: 632734 - DNA, 20 bp, mouse
ggtgaggcggccgcggggcg

SEQ ID NO: 632735 - DNA, 20 bp, mouse
gtttagcgctggtgaggagg

SEQ ID NO: 632736 - DNA, 20 bp, mouse
gagcgagcctgaggatgcta

SEQ ID NO: 632737 - DNA, 20 bp, mouse
gggaggaactcagtctccaa

SEQ ID NO: 632738 - DNA, 20 bp, mouse
ggtggtgccgtagcatcctc

SEQ ID NO: 632739 - DNA, 20 bp, mouse
gggatgctacggcaccaccg

SEQ ID NO: 632740 - DNA, 20 bp, mouse
gtcaggctcgctgcagttgg

SEQ ID NO: 632741 - DNA, 20 bp, mouse
gcctgtcccccaaaggccag

SEQ ID NO: 632742 - DNA, 20 bp, mouse
gcagctcatcacgtgaccgg

SEQ ID NO: 632743 - DNA, 20 bp, mouse
gtcctcaggctcgctgcagt

SEQ ID NO: 632744 - DNA, 20 bp, mouse
gtggaggcgggtgtcctacc

SEQ ID NO: 632745 - DNA, 20 bp, mouse
gtggcagctcatcacgtgac

SEQ ID NO: 632746 - DNA, 20 bp, mouse
gttgggaagcaacccgaata

SEQ ID NO: 632747 - DNA, 20 bp, mouse
gagggaaaactgaaacactt

SEQ ID NO: 632748 - DNA, 20 bp, mouse
gagcggtaggaccaaagtct

SEQ ID NO: 632749 - DNA, 20 bp, mouse
gtcgggagatgggctctgaa

SEQ ID NO: 632750 - DNA, 20 bp, mouse
gtccaggtcacccatgccag

SEQ ID NO: 632751 - DNA, 20 bp, mouse
ggacgactcaagcgcttcaa

SEQ ID NO: 632752 - DNA, 20 bp, mouse
gctgccctgtcccaagactt

SEQ ID NO: 632753 - DNA, 20 bp, mouse
gagaccagtgactccacctg

SEQ ID NO: 632754 - DNA, 20 bp, mouse
gagggtgaggcagccgccac

SEQ ID NO: 632755 - DNA, 20 bp, mouse
gcctggaggcccctccacac

SEQ ID NO: 632756 - DNA, 20 bp, mouse
gggcagcgcggcctgagctg

SEQ ID NO: 632757 - DNA, 20 bp, mouse
gggcgagcaccgagacacga

SEQ ID NO: 632758 - DNA, 20 bp, mouse
gccgtcgggctgaggagacg

SEQ ID NO: 632759 - DNA, 20 bp, mouse
gaggagctcacaagactccg

SEQ ID NO: 632760 - DNA, 20 bp, mouse
gagacaggtcgagggaaggt

SEQ ID NO: 632761 - DNA, 20 bp, mouse
ggctgaggcccgagaggcgc

SEQ ID NO: 632762 - DNA, 20 bp, mouse
gggtacaaggtgctggacag

SEQ ID NO: 632763 - DNA, 20 bp, mouse
ggctgcagaggacgcctggg

SEQ ID NO: 632764 - DNA, 20 bp, mouse
ggggccgtgcctgacgccac

SEQ ID NO: 632765 - DNA, 20 bp, mouse
ggcgcacacaatgaactccg

SEQ ID NO: 632766 - DNA, 20 bp, mouse
gaggagagccggcgcccctt

SEQ ID NO: 632767 - DNA, 20 bp, mouse
gacccgctggcggtgcccaa

SEQ ID NO: 632768 - DNA, 20 bp, mouse
ggcggcgtcggtctccagga

SEQ ID NO: 632769 - DNA, 20 bp, mouse
gagcgggtagatcacgttca

SEQ ID NO: 632770 - DNA, 20 bp, mouse
ggctagccaggcaaccgtcc

SEQ ID NO: 632771 - DNA, 20 bp, mouse
gagagccggagaagacgcag

SEQ ID NO: 632772 - DNA, 20 bp, mouse
ggggcgccggctctcctgtg

SEQ ID NO: 632773 - DNA, 20 bp, mouse
gaacgtgatctacccgctgg

SEQ ID NO: 632774 - DNA, 20 bp, mouse
gctggcaggaaaggccacaa

SEQ ID NO: 632775 - DNA, 20 bp, mouse
ggtagatcacgttcatggtg

SEQ ID NO: 632776 - DNA, 20 bp, mouse
ggcgcccagctcccagtcgg

SEQ ID NO: 632777 - DNA, 20 bp, mouse
gccggtaccgaccagacggt

SEQ ID NO: 632778 - DNA, 20 bp, mouse
ggtgtgtgtgtcccccgact

SEQ ID NO: 632779 - DNA, 20 bp, mouse
gcccgaagaatgactcggtt

SEQ ID NO: 632780 - DNA, 20 bp, mouse
gccggaaccgaccgtctggt

SEQ ID NO: 632781 - DNA, 20 bp, mouse
gagccagaggaaggatctag

SEQ ID NO: 632782 - DNA, 20 bp, mouse
ggacagatgacttctcaaga

SEQ ID NO: 632783 - DNA, 20 bp, mouse
gtggttcccgaagaatgact

SEQ ID NO: 632784 - DNA, 20 bp, mouse
gctccccggtaccgaccaga

SEQ ID NO: 632785 - DNA, 20 bp, mouse
gtgggagctgggcgcaaagc

SEQ ID NO: 632786 - DNA, 20 bp, mouse
gcggcggcgcgtggcaggtc

SEQ ID NO: 632787 - DNA, 20 bp, mouse
gcagcgagcgaagcagaggg

SEQ ID NO: 632788 - DNA, 20 bp, mouse
gggcgcgtggcaggtccggc

SEQ ID NO: 632789 - DNA, 20 bp, mouse
gccggtccggagcctcccga

SEQ ID NO: 632790 - DNA, 20 bp, mouse
ggctggggtgcgcacggtgg

SEQ ID NO: 632791 - DNA, 20 bp, mouse
ggagcacagacgaggagcca

SEQ ID NO: 632792 - DNA, 20 bp, mouse
gccccagcgagcgaagcaga

SEQ ID NO: 632793 - DNA, 20 bp, mouse
ggaggagtacctgagagtct

SEQ ID NO: 632794 - DNA, 20 bp, mouse
gaggaacagacagaaagtag

SEQ ID NO: 632795 - DNA, 20 bp, mouse
gaggcacaggatgaacccca

SEQ ID NO: 632796 - DNA, 20 bp, mouse
ggttaacaatgcatccacag

SEQ ID NO: 632797 - DNA, 20 bp, mouse
gcacgactcgatgactcgga

SEQ ID NO: 632798 - DNA, 20 bp, mouse
gaaagccgagcttacctctg

SEQ ID NO: 632799 - DNA, 20 bp, mouse
gactcgatgactcggaggga

SEQ ID NO: 632800 - DNA, 20 bp, mouse
gagagcacttagggtaactt

SEQ ID NO: 632801 - DNA, 20 bp, mouse
gagtctgtaaaatcaagcta

SEQ ID NO: 632802 - DNA, 20 bp, mouse
gacagcggccgacagtgcag

SEQ ID NO: 632803 - DNA, 20 bp, mouse
gtgctctggggggggaagtg

SEQ ID NO: 632804 - DNA, 20 bp, mouse
gcggccgacagtgcaggggg

SEQ ID NO: 632805 - DNA, 20 bp, mouse
gttctcacagaaaaagggtt

SEQ ID NO: 632806 - DNA, 20 bp, mouse
ggacagtagcaagctcccgg

SEQ ID NO: 632807 - DNA, 20 bp, mouse
ggaggacagtagcaagctcc

SEQ ID NO: 632808 - DNA, 20 bp, mouse
ggaggccgccgagcagccgc

SEQ ID NO: 632809 - DNA, 20 bp, mouse
ggctcggcggcctctcccag

SEQ ID NO: 632810 - DNA, 20 bp, mouse
gaggatcagatggctcaggg

SEQ ID NO: 632811 - DNA, 20 bp, mouse
gagcaggaatgtctgccgcc

SEQ ID NO: 632812 - DNA, 20 bp, mouse
gaggagccaggctctctaag

SEQ ID NO: 632813 - DNA, 20 bp, mouse
ggagaggtcacactcagctt

SEQ ID NO: 632814 - DNA, 20 bp, mouse
ggggcacttacccgccatag

SEQ ID NO: 632815 - DNA, 20 bp, mouse
gcttggccgcttagagagcc

SEQ ID NO: 632816 - DNA, 20 bp, mouse
gtcctccctggaggctacaa

SEQ ID NO: 632817 - DNA, 20 bp, mouse
gctgcagcgcccaaggggtg

SEQ ID NO: 632818 - DNA, 20 bp, mouse
gcgaaggcagtgaaccaaaa

SEQ ID NO: 632819 - DNA, 20 bp, mouse
gggaagcgccgaccgcgggg

SEQ ID NO: 632820 - DNA, 20 bp, mouse
gccggcctcaggtgacaggt

SEQ ID NO: 632821 - DNA, 20 bp, mouse
gagatcgcagggaccccagg

SEQ ID NO: 632822 - DNA, 20 bp, mouse
gagccaagaggcgcacctgg

SEQ ID NO: 632823 - DNA, 20 bp, mouse
gtcccttgtagcctccaggg

SEQ ID NO: 632824 - DNA, 20 bp, mouse
ggcttacctgcagcgcccaa

SEQ ID NO: 632825 - DNA, 20 bp, mouse
gtgtcacctgaggccggacg

SEQ ID NO: 632826 - DNA, 20 bp, mouse
gtagggcggaggccactcac

SEQ ID NO: 632827 - DNA, 20 bp, mouse
gaagcaggtgcgtgataggg

SEQ ID NO: 632828 - DNA, 20 bp, mouse
gcagaagcaggtgcgtgata

SEQ ID NO: 632829 - DNA, 20 bp, mouse
gccgcgacctgccagggccg

SEQ ID NO: 632830 - DNA, 20 bp, mouse
gacttcggggactatagggg

SEQ ID NO: 632831 - DNA, 20 bp, mouse
gctcgggcgcgtcctccgca

SEQ ID NO: 632832 - DNA, 20 bp, mouse
gaggcagagcgggacgccgg

SEQ ID NO: 632833 - DNA, 20 bp, mouse
ggcccaggggctgcagggac

SEQ ID NO: 632834 - DNA, 20 bp, mouse
gtaacctgacacccggccgg

SEQ ID NO: 632835 - DNA, 20 bp, mouse
gacgcgcccgagccggtgag

SEQ ID NO: 632836 - DNA, 20 bp, mouse
gagatgcagacggcgagaca

SEQ ID NO: 632837 - DNA, 20 bp, mouse
gcagacggcgagacaaggca

SEQ ID NO: 632838 - DNA, 20 bp, mouse
ggtctgacccggaggaacac

SEQ ID NO: 632839 - DNA, 20 bp, mouse
gcgaaaacccgagatgcaga

SEQ ID NO: 632840 - DNA, 20 bp, mouse
gggactccgccctggaaaaa

SEQ ID NO: 632841 - DNA, 20 bp, mouse
gaaccgagcccgctgagagg

SEQ ID NO: 632842 - DNA, 20 bp, mouse
gagctaggcggggagatgtt

SEQ ID NO: 632843 - DNA, 20 bp, mouse
gaggggtgtgctcagagcaa

SEQ ID NO: 632844 - DNA, 20 bp, mouse
gcaaggcaaggattgtcccg

SEQ ID NO: 632845 - DNA, 20 bp, mouse
ggagggtccaggcgacgcgg

SEQ ID NO: 632846 - DNA, 20 bp, mouse
gggagctgatacgggacagg

SEQ ID NO: 632847 - DNA, 20 bp, mouse
ggaagtggcggagctgatac

SEQ ID NO: 632848 - DNA, 20 bp, mouse
gggcggagctgatacgggac

SEQ ID NO: 632849 - DNA, 20 bp, mouse
gcagcgggctccatggaaac

SEQ ID NO: 632850 - DNA, 20 bp, mouse
gtggagcccgctgggctctg

SEQ ID NO: 632851 - DNA, 20 bp, mouse
gaccaccagggccgccacgg

SEQ ID NO: 632852 - DNA, 20 bp, mouse
gaccaaagaagcgccggaag

SEQ ID NO: 632853 - DNA, 20 bp, mouse
gaaagaagcgccggaagtgg

SEQ ID NO: 632854 - DNA, 20 bp, mouse
gacgcgcccgccagacggct

SEQ ID NO: 632855 - DNA, 20 bp, mouse
ggcgggcaggtgtagcgcgc

SEQ ID NO: 632856 - DNA, 20 bp, mouse
gtacccgctctggctcacta

SEQ ID NO: 632857 - DNA, 20 bp, mouse
gctagggcacgcggcaagtc

SEQ ID NO: 632858 - DNA, 20 bp, mouse
gtgtaggactgcggtctgtg

SEQ ID NO: 632859 - DNA, 20 bp, mouse
gcacgcggcaagtcgggcaa

SEQ ID NO: 632860 - DNA, 20 bp, mouse
gtcgctgaattgtaggactg

SEQ ID NO: 632861 - DNA, 20 bp, mouse
gcatggcgtcgctgaattgt

SEQ ID NO: 632862 - DNA, 20 bp, mouse
gcagctgtaatgagacagac

SEQ ID NO: 632863 - DNA, 20 bp, mouse
gcggtacaaagaaggagcaa

SEQ ID NO: 632864 - DNA, 20 bp, mouse
ggtgccctagtgagccagag

SEQ ID NO: 632865 - DNA, 20 bp, mouse
gaagtcgggcaacggtattt

SEQ ID NO: 632866 - DNA, 20 bp, mouse
gaggcgtgcagagcttgccg

SEQ ID NO: 632867 - DNA, 20 bp, mouse
gacgtgcagcaaagcagccg

SEQ ID NO: 632868 - DNA, 20 bp, mouse
ggcacgtgtggcgctgtcgg

SEQ ID NO: 632869 - DNA, 20 bp, mouse
gggagaggagaggaacggac

SEQ ID NO: 632870 - DNA, 20 bp, mouse
ggctgcacgtgtggcgctgt

SEQ ID NO: 632871 - DNA, 20 bp, mouse
gtccgggaggaggttcccag

SEQ ID NO: 632872 - DNA, 20 bp, mouse
ggccactccgttcttcacgg

SEQ ID NO: 632873 - DNA, 20 bp, mouse
gctgagaaggaagggactcc

SEQ ID NO: 632874 - DNA, 20 bp, mouse
ggtggtgccaccgtgaagaa

SEQ ID NO: 632875 - DNA, 20 bp, mouse
gagggagccagggacttaga

SEQ ID NO: 632876 - DNA, 20 bp, mouse
gtcctctgacagcaagagtt

SEQ ID NO: 632877 - DNA, 20 bp, mouse
gacctcattaggtccgacgt

SEQ ID NO: 632878 - DNA, 20 bp, mouse
ggcctacgtcggacctaatg

SEQ ID NO: 632879 - DNA, 20 bp, mouse
gagagtttggagtgctaggt

SEQ ID NO: 632880 - DNA, 20 bp, mouse
gcaggactgagccacaatct

SEQ ID NO: 632881 - DNA, 20 bp, mouse
ggctgctggggaacctcatt

SEQ ID NO: 632882 - DNA, 20 bp, mouse
gtgtcctgaattccaggcag

SEQ ID NO: 632883 - DNA, 20 bp, mouse
gggtggaagggtctacggtg

SEQ ID NO: 632884 - DNA, 20 bp, mouse
gacctgagtcttcttcccac

SEQ ID NO: 632885 - DNA, 20 bp, mouse
ggcgaggtgagactgagaac

SEQ ID NO: 632886 - DNA, 20 bp, mouse
gtcaatggcgcacatattgg

SEQ ID NO: 632887 - DNA, 20 bp, mouse
ggtgcggagcgggaaagtag

SEQ ID NO: 632888 - DNA, 20 bp, mouse
ggtttaagccgaacctctgg

SEQ ID NO: 632889 - DNA, 20 bp, mouse
gagccgaacctctggcggaa

SEQ ID NO: 632890 - DNA, 20 bp, mouse
gttcccttccgccagaggtt

SEQ ID NO: 632891 - DNA, 20 bp, mouse
gtaatcaatggcgcacatat

SEQ ID NO: 632892 - DNA, 20 bp, mouse
gtacacatagcagggtaagg

SEQ ID NO: 632893 - DNA, 20 bp, mouse
ggggagccctacacatagca

SEQ ID NO: 632894 - DNA, 20 bp, mouse
gcgggaaccggcaagagttg

SEQ ID NO: 632895 - DNA, 20 bp, mouse
gaaggcgagtagccagagtt

SEQ ID NO: 632896 - DNA, 20 bp, mouse
gagcgcagcccgggacggag

SEQ ID NO: 632897 - DNA, 20 bp, mouse
gccctccattgtctccacgg

SEQ ID NO: 632898 - DNA, 20 bp, mouse
ggcaccgccccgctccgtcc

SEQ ID NO: 632899 - DNA, 20 bp, mouse
gcgcccgcagcaggaagcgg

SEQ ID NO: 632900 - DNA, 20 bp, mouse
gcgccgggcgtctgcgacag

SEQ ID NO: 632901 - DNA, 20 bp, mouse
ggtcacaaaagagccccgag

SEQ ID NO: 632902 - DNA, 20 bp, mouse
gcacagctctgctggagtcg

SEQ ID NO: 632903 - DNA, 20 bp, mouse
gcggggcgcaggcggtaggt

SEQ ID NO: 632904 - DNA, 20 bp, mouse
ggcgggcgagcggcctcctc

SEQ ID NO: 632905 - DNA, 20 bp, mouse
ggtcgcgtggcgtcgcgctc

SEQ ID NO: 632906 - DNA, 20 bp, mouse
gaacgggaaagaggaacggg

SEQ ID NO: 632907 - DNA, 20 bp, mouse
gtgcaacgggaaagaggaac

SEQ ID NO: 632908 - DNA, 20 bp, mouse
gcgcgaggcgacggttgccg

SEQ ID NO: 632909 - DNA, 20 bp, mouse
gggcaggtccgagcccgagt

SEQ ID NO: 632910 - DNA, 20 bp, mouse
ggcctcgcggccggcactgg

SEQ ID NO: 632911 - DNA, 20 bp, mouse
ggtccgcacggctacctgag

SEQ ID NO: 632912 - DNA, 20 bp, mouse
gaggagcggcggccgaatcg

SEQ ID NO: 632913 - DNA, 20 bp, mouse
gagtgccggccgcgaggcga

SEQ ID NO: 632914 - DNA, 20 bp, mouse
ggccgcttgcaacgggaaag

SEQ ID NO: 632915 - DNA, 20 bp, mouse
ggcgcgccagccgcttgcaa

SEQ ID NO: 632916 - DNA, 20 bp, mouse
gtcttgctctgcactggtcc

SEQ ID NO: 632917 - DNA, 20 bp, mouse
gatagccccatgcagggtca

SEQ ID NO: 632918 - DNA, 20 bp, mouse
gagtgcccatccagaaggga

SEQ ID NO: 632919 - DNA, 20 bp, mouse
gatagagtgcccatccagaa

SEQ ID NO: 632920 - DNA, 20 bp, mouse
ggcgagctgctggaatgctt

SEQ ID NO: 632921 - DNA, 20 bp, mouse
ggatgttgttgtacttacat

SEQ ID NO: 632922 - DNA, 20 bp, mouse
gctgcattcctgggggacaa

SEQ ID NO: 632923 - DNA, 20 bp, mouse
gagccagatagccccatgca

SEQ ID NO: 632924 - DNA, 20 bp, mouse
ggtggccctcccttctggat

SEQ ID NO: 632925 - DNA, 20 bp, mouse
gacacacagtcacttgtctc

SEQ ID NO: 632926 - DNA, 20 bp, mouse
gctactgtggccgaactcgg

SEQ ID NO: 632927 - DNA, 20 bp, mouse
gtcccgtggccgggtgggag

SEQ ID NO: 632928 - DNA, 20 bp, mouse
gcgaactcgggggcctcaag

SEQ ID NO: 632929 - DNA, 20 bp, mouse
gctcaagcggaagaggctcc

SEQ ID NO: 632930 - DNA, 20 bp, mouse
ggtgggagcggcgcctactg

SEQ ID NO: 632931 - DNA, 20 bp, mouse
gcgggggcctcaagcggaag

SEQ ID NO: 632932 - DNA, 20 bp, mouse
ggttcctgtggaccccaaga

SEQ ID NO: 632933 - DNA, 20 bp, mouse
gcgcctactgtggccgaact

SEQ ID NO: 632934 - DNA, 20 bp, mouse
gtgtgggctgaactgtcgcc

SEQ ID NO: 632935 - DNA, 20 bp, mouse
ggagccacgcggggatcccg

SEQ ID NO: 632936 - DNA, 20 bp, mouse
gcagacagggacctccatca

SEQ ID NO: 632937 - DNA, 20 bp, mouse
gggcgctgacccaatctcag

SEQ ID NO: 632938 - DNA, 20 bp, mouse
ggagctgcacctcttcccgg

SEQ ID NO: 632939 - DNA, 20 bp, mouse
gaaacaaccccaggccatga

SEQ ID NO: 632940 - DNA, 20 bp, mouse
ggccccccaagtaggatgat

SEQ ID NO: 632941 - DNA, 20 bp, mouse
gcaaggtgctgggtgagtgc

SEQ ID NO: 632942 - DNA, 20 bp, mouse
gaaatcatagagactgttgt

SEQ ID NO: 632943 - DNA, 20 bp, mouse
gggacctccatcatggcctg

SEQ ID NO: 632944 - DNA, 20 bp, mouse
gcggcagctcccctgagatt

SEQ ID NO: 632945 - DNA, 20 bp, mouse
gagctgccgccagcagaagc

SEQ ID NO: 632946 - DNA, 20 bp, mouse
gaccttccaacatggcgagg

SEQ ID NO: 632947 - DNA, 20 bp, mouse
gctccgtgcggcaggaggtg

SEQ ID NO: 632948 - DNA, 20 bp, mouse
gctgctgcacggcctcacct

SEQ ID NO: 632949 - DNA, 20 bp, mouse
gcatctgtaagctctccgtg

SEQ ID NO: 632950 - DNA, 20 bp, mouse
gttggtggtaccttccaaca

SEQ ID NO: 632951 - DNA, 20 bp, mouse
gtgaggcattctgggaatga

SEQ ID NO: 632952 - DNA, 20 bp, mouse
ggccacctcgccatgttgga

SEQ ID NO: 632953 - DNA, 20 bp, mouse
gaggtaccaccaaagcgccg

SEQ ID NO: 632954 - DNA, 20 bp, mouse
gggtaccttccaacatggcg

SEQ ID NO: 632955 - DNA, 20 bp, mouse
gaagctctccgtgcggcagg

SEQ ID NO: 632956 - DNA, 20 bp, mouse
gtccacacagcaggagacaa

SEQ ID NO: 632957 - DNA, 20 bp, mouse
gcagctgggctcagaatgag

SEQ ID NO: 632958 - DNA, 20 bp, mouse
gtgtactccaggcgggacca

SEQ ID NO: 632959 - DNA, 20 bp, mouse
gtcccgcctggagtacagct

SEQ ID NO: 632960 - DNA, 20 bp, mouse
gggtgatgaggaccccactg

SEQ ID NO: 632961 - DNA, 20 bp, mouse
gctgggaattgcacagctcg

SEQ ID NO: 632962 - DNA, 20 bp, mouse
gagcccggggacctcaccct

SEQ ID NO: 632963 - DNA, 20 bp, mouse
gctcggggcctccacacagc

SEQ ID NO: 632964 - DNA, 20 bp, mouse
gtgtctggaagctgaactag

SEQ ID NO: 632965 - DNA, 20 bp, mouse
ggcgttgaacctgaccacgt

SEQ ID NO: 632966 - DNA, 20 bp, mouse
gaggtatctgaataagacgt

SEQ ID NO: 632967 - DNA, 20 bp, mouse
ggagaggggcgaaaaaccca

SEQ ID NO: 632968 - DNA, 20 bp, mouse
ggtcttattcagatacctac

SEQ ID NO: 632969 - DNA, 20 bp, mouse
gaaacactcagactacctca

SEQ ID NO: 632970 - DNA, 20 bp, mouse
gcactcatttctaatctact

SEQ ID NO: 632971 - DNA, 20 bp, mouse
gtcagactacctcagggaaa

SEQ ID NO: 632972 - DNA, 20 bp, mouse
gaagactctagtgttgcctt

SEQ ID NO: 632973 - DNA, 20 bp, mouse
ggccaattctagaaaagtaa

SEQ ID NO: 632974 - DNA, 20 bp, mouse
gtctcagaatgaagtatctt

SEQ ID NO: 632975 - DNA, 20 bp, mouse
ggctacccaatgaggcaaaa

SEQ ID NO: 632976 - DNA, 20 bp, mouse
gaagtcaagggagcccctag

SEQ ID NO: 632977 - DNA, 20 bp, mouse
gacccagcttgggtacacat

SEQ ID NO: 632978 - DNA, 20 bp, mouse
gcagcttgggtacacatggg

SEQ ID NO: 632979 - DNA, 20 bp, mouse
gtgcggggcctcgaagtcaa

SEQ ID NO: 632980 - DNA, 20 bp, mouse
gcaagaggtcgatcccctag

SEQ ID NO: 632981 - DNA, 20 bp, mouse
gtcgaggccccgcaccacta

SEQ ID NO: 632982 - DNA, 20 bp, mouse
gggacggcggccagcgacag

SEQ ID NO: 632983 - DNA, 20 bp, mouse
gagaccagccaggttctgga

SEQ ID NO: 632984 - DNA, 20 bp, mouse
ggcgggaggtgtgctagctt

SEQ ID NO: 632985 - DNA, 20 bp, mouse
gttctggagggtttccttag

SEQ ID NO: 632986 - DNA, 20 bp, mouse
gtgatagcctgggaccggta

SEQ ID NO: 632987 - DNA, 20 bp, mouse
ggagcgaagcaaaccgccaa

SEQ ID NO: 632988 - DNA, 20 bp, mouse
gccccgtgatagcctgggac

SEQ ID NO: 632989 - DNA, 20 bp, mouse
ggctctgtagaggagcgatg

SEQ ID NO: 632990 - DNA, 20 bp, mouse
ggtagggaagatgcccttgg

SEQ ID NO: 632991 - DNA, 20 bp, mouse
gctgtagaggagcgatgggg

SEQ ID NO: 632992 - DNA, 20 bp, mouse
ggggcggaggcgaagaagga

SEQ ID NO: 632993 - DNA, 20 bp, mouse
ggccgcccccgtgatagcct

SEQ ID NO: 632994 - DNA, 20 bp, mouse
gggaacacgcaggcgctctc

SEQ ID NO: 632995 - DNA, 20 bp, mouse
gaggcgaagaaggagggacg

SEQ ID NO: 632996 - DNA, 20 bp, mouse
gtccctcatgaagctgacca

SEQ ID NO: 632997 - DNA, 20 bp, mouse
ggtcttgcctgcttactcaa

SEQ ID NO: 632998 - DNA, 20 bp, mouse
gagccttggtcagcttcatg

SEQ ID NO: 632999 - DNA, 20 bp, mouse
gccttagcagccactctgag

SEQ ID NO: 633000 - DNA, 20 bp, mouse
gagctgactctacagaacca

SEQ ID NO: 633001 - DNA, 20 bp, mouse
gaaaagcaggtatggaaaat

SEQ ID NO: 633002 - DNA, 20 bp, mouse
gggaagatcaaaagcaggta

SEQ ID NO: 633003 - DNA, 20 bp, mouse
gatgcagtgaaccaggcaca

SEQ ID NO: 633004 - DNA, 20 bp, mouse
gaaataggagcatgcaagtg

SEQ ID NO: 633005 - DNA, 20 bp, mouse
gttttttcttctagacctgc

SEQ ID NO: 633006 - DNA, 20 bp, mouse
gcgcagaggactccgaatgg

SEQ ID NO: 633007 - DNA, 20 bp, mouse
ggggcgcagaggactccgaa

SEQ ID NO: 633008 - DNA, 20 bp, mouse
gctcccagcggcccgagggg

SEQ ID NO: 633009 - DNA, 20 bp, mouse
ggggacagcctcgggcgcag

SEQ ID NO: 633010 - DNA, 20 bp, mouse
ggacaggggcggagcggtct

SEQ ID NO: 633011 - DNA, 20 bp, mouse
gggtcctgaccgccgccatt

SEQ ID NO: 633012 - DNA, 20 bp, mouse
gcgccgcgcgtcagacgggg

SEQ ID NO: 633013 - DNA, 20 bp, mouse
ggggcgccgcgcgtcagacg

SEQ ID NO: 633014 - DNA, 20 bp, mouse
gagaggactccgaatggcgg

SEQ ID NO: 633015 - DNA, 20 bp, mouse
gcagcgcggggacaacccgg

SEQ ID NO: 633016 - DNA, 20 bp, mouse
gtcactgactcggaaattct

SEQ ID NO: 633017 - DNA, 20 bp, mouse
gaggcccccgcggctccggt

SEQ ID NO: 633018 - DNA, 20 bp, mouse
gcgaagcagagcctcaggac

SEQ ID NO: 633019 - DNA, 20 bp, mouse
ggccgaaggaccctagagaa

SEQ ID NO: 633020 - DNA, 20 bp, mouse
gcccgcagcgacgtccccac

SEQ ID NO: 633021 - DNA, 20 bp, mouse
gtccggtggggacgtcgctg

SEQ ID NO: 633022 - DNA, 20 bp, mouse
gcctgctcaggagctcggta

SEQ ID NO: 633023 - DNA, 20 bp, mouse
gggtcgctgccggccttgag

SEQ ID NO: 633024 - DNA, 20 bp, mouse
ggagcgtggcgggataccgt

SEQ ID NO: 633025 - DNA, 20 bp, mouse
gaaattcttggtcgacatct

SEQ ID NO: 633026 - DNA, 20 bp, mouse
gacgagtagaatcctgaggt

SEQ ID NO: 633027 - DNA, 20 bp, mouse
gactgtatagggcaagagat

SEQ ID NO: 633028 - DNA, 20 bp, mouse
gcattttggcggactgtata

SEQ ID NO: 633029 - DNA, 20 bp, mouse
gagctagtgctgcattttgg

SEQ ID NO: 633030 - DNA, 20 bp, mouse
gacgcttgcaaaaagtttgg

SEQ ID NO: 633031 - DNA, 20 bp, mouse
gtcccacgagtagaatcctg

SEQ ID NO: 633032 - DNA, 20 bp, mouse
gacccgttaccgctaagggg

SEQ ID NO: 633033 - DNA, 20 bp, mouse
gagcccaggctatgaactcg

SEQ ID NO: 633034 - DNA, 20 bp, mouse
gaaggaaggagaatataaca

SEQ ID NO: 633035 - DNA, 20 bp, mouse
gtgaagctagtgctgcattt

SEQ ID NO: 633036 - DNA, 20 bp, mouse
gtccgcctgcgcagtcatcc

SEQ ID NO: 633037 - DNA, 20 bp, mouse
ggcgcagatcagacatactg

SEQ ID NO: 633038 - DNA, 20 bp, mouse
ggacgtaactgcagattaca

SEQ ID NO: 633039 - DNA, 20 bp, mouse
ggatacctggatgactgcgc

SEQ ID NO: 633040 - DNA, 20 bp, mouse
gcgggtggttatctgcagta

SEQ ID NO: 633041 - DNA, 20 bp, mouse
ggataaccgggtaactacgt

SEQ ID NO: 633042 - DNA, 20 bp, mouse
gctgcgcaggccggtcggta

SEQ ID NO: 633043 - DNA, 20 bp, mouse
gcaggccggccatgccacgg

SEQ ID NO: 633044 - DNA, 20 bp, mouse
ggctttaaggccagcctccg

SEQ ID NO: 633045 - DNA, 20 bp, mouse
ggcgcaggccggccatgcca

SEQ ID NO: 633046 - DNA, 20 bp, mouse
gctggggcacgagtttccgg

SEQ ID NO: 633047 - DNA, 20 bp, mouse
gggggtggaagatctccggg

SEQ ID NO: 633048 - DNA, 20 bp, mouse
gccagtcagccaggcatcgc

SEQ ID NO: 633049 - DNA, 20 bp, mouse
gtcccacggcaaggtctcag

SEQ ID NO: 633050 - DNA, 20 bp, mouse
gtccgggggtggaagatctc

SEQ ID NO: 633051 - DNA, 20 bp, mouse
gtgcccaagacggaaggaga

SEQ ID NO: 633052 - DNA, 20 bp, mouse
gggtacctgcccaagacgga

SEQ ID NO: 633053 - DNA, 20 bp, mouse
gagtgggcgaccgaggacct

SEQ ID NO: 633054 - DNA, 20 bp, mouse
gggccgcccgaggagatggg

SEQ ID NO: 633055 - DNA, 20 bp, mouse
gaggcccccgcgaggccccg

SEQ ID NO: 633056 - DNA, 20 bp, mouse
gaggcagcgtagcctagttt

SEQ ID NO: 633057 - DNA, 20 bp, mouse
ggagatgtttggggatcctt

SEQ ID NO: 633058 - DNA, 20 bp, mouse
gcaggcgtcggtacctggag

SEQ ID NO: 633059 - DNA, 20 bp, mouse
gcctggagtggtgagttgga

SEQ ID NO: 633060 - DNA, 20 bp, mouse
gcgcctgaggccgagatgtt

SEQ ID NO: 633061 - DNA, 20 bp, mouse
ggcgtagcctagtttgggaa

SEQ ID NO: 633062 - DNA, 20 bp, mouse
gactcgtgctggagactcca

SEQ ID NO: 633063 - DNA, 20 bp, mouse
gtgtggccttggagacatga

SEQ ID NO: 633064 - DNA, 20 bp, mouse
gtagctctcagcctaccagt

SEQ ID NO: 633065 - DNA, 20 bp, mouse
ggaatcccgggaaatggaac

SEQ ID NO: 633066 - DNA, 20 bp, mouse
gtccctgcgcaggagcgacg

SEQ ID NO: 633067 - DNA, 20 bp, mouse
ggccgagagtctaggtagca

SEQ ID NO: 633068 - DNA, 20 bp, mouse
gtttctaaggccgagagtct

SEQ ID NO: 633069 - DNA, 20 bp, mouse
gagctcgtgctccaggcggg

SEQ ID NO: 633070 - DNA, 20 bp, mouse
gagcgagctcgtgctccagg

SEQ ID NO: 633071 - DNA, 20 bp, mouse
gcgtgctccaggcgggggga

SEQ ID NO: 633072 - DNA, 20 bp, mouse
ggtgagcgagctcgtgctcc

SEQ ID NO: 633073 - DNA, 20 bp, mouse
gggttccaagcatctttcta

SEQ ID NO: 633074 - DNA, 20 bp, mouse
gtccctgctacctagactct

SEQ ID NO: 633075 - DNA, 20 bp, mouse
gaagggaatccagccctccc

SEQ ID NO: 633076 - DNA, 20 bp, mouse
ggaaaggtcagcagtacctg

SEQ ID NO: 633077 - DNA, 20 bp, mouse
gccaaaggcagcatcttcac

SEQ ID NO: 633078 - DNA, 20 bp, mouse
gcaaagataacagggtaacc

SEQ ID NO: 633079 - DNA, 20 bp, mouse
gcttggcagttatatttctg

SEQ ID NO: 633080 - DNA, 20 bp, mouse
gagtacctgaggaaaagcaa

SEQ ID NO: 633081 - DNA, 20 bp, mouse
gcaaagacagcaaagataac

SEQ ID NO: 633082 - DNA, 20 bp, mouse
gaggaacccatccagcagga

SEQ ID NO: 633083 - DNA, 20 bp, mouse
gcaggatgagcccagtcaag

SEQ ID NO: 633084 - DNA, 20 bp, mouse
gtagatggttctggttgggg

SEQ ID NO: 633085 - DNA, 20 bp, mouse
ggctgctggaaactagtcag

SEQ ID NO: 633086 - DNA, 20 bp, mouse
gtgagctgaggtgaatccag

SEQ ID NO: 633087 - DNA, 20 bp, mouse
gccgggccgggccagaccgt

SEQ ID NO: 633088 - DNA, 20 bp, mouse
gcacctcagctcaagcccaa

SEQ ID NO: 633089 - DNA, 20 bp, mouse
ggcaaaagcaccccacggtc

SEQ ID NO: 633090 - DNA, 20 bp, mouse
gtcgagggctccgaagaacc

SEQ ID NO: 633091 - DNA, 20 bp, mouse
gaatccagaggggccgggcc

SEQ ID NO: 633092 - DNA, 20 bp, mouse
gggtgtgagcggagcctcga

SEQ ID NO: 633093 - DNA, 20 bp, mouse
gagagaacaatggacgggag

SEQ ID NO: 633094 - DNA, 20 bp, mouse
gccccacctggtcaaggagg

SEQ ID NO: 633095 - DNA, 20 bp, mouse
gcgagcgggagaggcaggtc

SEQ ID NO: 633096 - DNA, 20 bp, mouse
gtgagaagtgggtgtctctg

SEQ ID NO: 633097 - DNA, 20 bp, mouse
gtgagtctgggtggcggatg

SEQ ID NO: 633098 - DNA, 20 bp, mouse
gttccggcctgttgagaagt

SEQ ID NO: 633099 - DNA, 20 bp, mouse
gacaggccggaagtgctccc

SEQ ID NO: 633100 - DNA, 20 bp, mouse
gggctgcagcgtgtggagat

SEQ ID NO: 633101 - DNA, 20 bp, mouse
gtggggtgcagttgagaatc

SEQ ID NO: 633102 - DNA, 20 bp, mouse
gaagagcccgggagcacttc

SEQ ID NO: 633103 - DNA, 20 bp, mouse
ggcatcccctgcaagagccc

SEQ ID NO: 633104 - DNA, 20 bp, mouse
gagatgggcagggtcaccga

SEQ ID NO: 633105 - DNA, 20 bp, mouse
gcagcgtgtggagatgggca

SEQ ID NO: 633106 - DNA, 20 bp, mouse
gccaaagcggttctgagtca

SEQ ID NO: 633107 - DNA, 20 bp, mouse
gtgttccagggagccctcgg

SEQ ID NO: 633108 - DNA, 20 bp, mouse
gccgaccgctaggctaacct

SEQ ID NO: 633109 - DNA, 20 bp, mouse
gaggctaacctgggactcgc

SEQ ID NO: 633110 - DNA, 20 bp, mouse
gcggcgcccgctctaaggaa

SEQ ID NO: 633111 - DNA, 20 bp, mouse
gcggtgagcctgcgagtccc

SEQ ID NO: 633112 - DNA, 20 bp, mouse
ggtcaggtaacagacaataa

SEQ ID NO: 633113 - DNA, 20 bp, mouse
gcctagcggtcggggagcgt

SEQ ID NO: 633114 - DNA, 20 bp, mouse
gggctgaacgacagcaccac

SEQ ID NO: 633115 - DNA, 20 bp, mouse
gggctctgacgcgcttccgg

SEQ ID NO: 633116 - DNA, 20 bp, mouse
ggggtctccagaactcccag

SEQ ID NO: 633117 - DNA, 20 bp, mouse
gcgggaaccctggcatggag

SEQ ID NO: 633118 - DNA, 20 bp, mouse
gtcccagcggacacttccaa

SEQ ID NO: 633119 - DNA, 20 bp, mouse
gccggtgagcgcgggaaccc

SEQ ID NO: 633120 - DNA, 20 bp, mouse
gccctcacccctccatgcca

SEQ ID NO: 633121 - DNA, 20 bp, mouse
gaagtgtccgctgggagttc

SEQ ID NO: 633122 - DNA, 20 bp, mouse
ggagcgcgggaaccctggca

SEQ ID NO: 633123 - DNA, 20 bp, mouse
gctggagacccggtgagcgc

SEQ ID NO: 633124 - DNA, 20 bp, mouse
gtgagggctgcgaacgccca

SEQ ID NO: 633125 - DNA, 20 bp, mouse
gtacaggacagagtgtgtca

SEQ ID NO: 633126 - DNA, 20 bp, mouse
gaggctgaggatgacaacaa

SEQ ID NO: 633127 - DNA, 20 bp, mouse
gtcaagctccggcaaggctg

SEQ ID NO: 633128 - DNA, 20 bp, mouse
ggcatcttcaagctccggca

SEQ ID NO: 633129 - DNA, 20 bp, mouse
ggggaacacagcccagacag

SEQ ID NO: 633130 - DNA, 20 bp, mouse
ggagatcctcagcagcagat

SEQ ID NO: 633131 - DNA, 20 bp, mouse
gaccagcagcctcttggtag

SEQ ID NO: 633132 - DNA, 20 bp, mouse
gagctcttggagctccctga

SEQ ID NO: 633133 - DNA, 20 bp, mouse
gcggcagttccgctaccaag

SEQ ID NO: 633134 - DNA, 20 bp, mouse
gccaccggcgacagagctct

SEQ ID NO: 633135 - DNA, 20 bp, mouse
ggggagcacggaggccaagg

SEQ ID NO: 633136 - DNA, 20 bp, mouse
gtacggtgatcgggttccag

SEQ ID NO: 633137 - DNA, 20 bp, mouse
gccagggcgagggggacgta

SEQ ID NO: 633138 - DNA, 20 bp, mouse
gaccctgcgaccagggcgag

SEQ ID NO: 633139 - DNA, 20 bp, mouse
ggtgactgaccctgcgacca

SEQ ID NO: 633140 - DNA, 20 bp, mouse
gagcggagccggaaactact

SEQ ID NO: 633141 - DNA, 20 bp, mouse
gagggagctcaggacgtagt

SEQ ID NO: 633142 - DNA, 20 bp, mouse
gaagctgcggggcatgggag

SEQ ID NO: 633143 - DNA, 20 bp, mouse
gagggggacgtacggtgatc

SEQ ID NO: 633144 - DNA, 20 bp, mouse
gagagagaacccgcaaactt

SEQ ID NO: 633145 - DNA, 20 bp, mouse
gaccagaagctggtgcgtga

SEQ ID NO: 633146 - DNA, 20 bp, mouse
gggactgaggctagcccagg

SEQ ID NO: 633147 - DNA, 20 bp, mouse
gcggcttgagagcgggactg

SEQ ID NO: 633148 - DNA, 20 bp, mouse
ggcgggactgaggctagccc

SEQ ID NO: 633149 - DNA, 20 bp, mouse
gaagctggttgagagagacg

SEQ ID NO: 633150 - DNA, 20 bp, mouse
ggccggtgctgcgagtccgt

SEQ ID NO: 633151 - DNA, 20 bp, mouse
gttcgagcacagctccacag

SEQ ID NO: 633152 - DNA, 20 bp, mouse
ggagcacagctccacagcgg

SEQ ID NO: 633153 - DNA, 20 bp, mouse
gactcccgccggcccacccc

SEQ ID NO: 633154 - DNA, 20 bp, mouse
ggagagacgcggcctggggt

SEQ ID NO: 633155 - DNA, 20 bp, mouse
gggacttccggcttgagagc

SEQ ID NO: 633156 - DNA, 20 bp, mouse
gcggctgtgcgggtaatctg

SEQ ID NO: 633157 - DNA, 20 bp, mouse
gcggagcgaggtgagtgcga

SEQ ID NO: 633158 - DNA, 20 bp, mouse
ggaggacgcgcagcgagcag

SEQ ID NO: 633159 - DNA, 20 bp, mouse
gggaaggcatcgaagcccaa

SEQ ID NO: 633160 - DNA, 20 bp, mouse
ggagcagaggcacccttaga

SEQ ID NO: 633161 - DNA, 20 bp, mouse
gttccggcacgcgagcacca

SEQ ID NO: 633162 - DNA, 20 bp, mouse
gggattgcgccccatcagag

SEQ ID NO: 633163 - DNA, 20 bp, mouse
ggtgctcgcgtgccggaagt

SEQ ID NO: 633164 - DNA, 20 bp, mouse
ggccagcaccaacacacagg

SEQ ID NO: 633165 - DNA, 20 bp, mouse
ggggtcgcttgtccctctaa

SEQ ID NO: 633166 - DNA, 20 bp, mouse
ggtagttcaatattgccgtt

SEQ ID NO: 633167 - DNA, 20 bp, mouse
gagaggtgatgtggagaagt

SEQ ID NO: 633168 - DNA, 20 bp, mouse
gcattcaagaccacaagaaa

SEQ ID NO: 633169 - DNA, 20 bp, mouse
gactttagaatgagacggaa

SEQ ID NO: 633170 - DNA, 20 bp, mouse
gggtaaacttccctttcttg

SEQ ID NO: 633171 - DNA, 20 bp, mouse
gatgttgtcagttcccctct

SEQ ID NO: 633172 - DNA, 20 bp, mouse
gttcccatcttttccaagag

SEQ ID NO: 633173 - DNA, 20 bp, mouse
gactggagaaagaggtgatg

SEQ ID NO: 633174 - DNA, 20 bp, mouse
ggttcccctcttggaaaaga

SEQ ID NO: 633175 - DNA, 20 bp, mouse
gtctgtgaatttaatattcc

SEQ ID NO: 633176 - DNA, 20 bp, mouse
gttcaccggagaaagcagtg

SEQ ID NO: 633177 - DNA, 20 bp, mouse
gaccggagaaagcagtgagg

SEQ ID NO: 633178 - DNA, 20 bp, mouse
gtccacctcactgctttctc

SEQ ID NO: 633179 - DNA, 20 bp, mouse
gaagattcatcacaattatg

SEQ ID NO: 633180 - DNA, 20 bp, mouse
ggctttagaatgagacagaa

SEQ ID NO: 633181 - DNA, 20 bp, mouse
gaaaaatcaacctcttgatc

SEQ ID NO: 633182 - DNA, 20 bp, mouse
gatgttgtctgttccccctt

SEQ ID NO: 633183 - DNA, 20 bp, mouse
gagcagtgaggtggaggaat

SEQ ID NO: 633184 - DNA, 20 bp, mouse
gacattcaagaccactagga

SEQ ID NO: 633185 - DNA, 20 bp, mouse
gttacacattcaagaccact

SEQ ID NO: 633186 - DNA, 20 bp, mouse
gatgttgtattttcccccct

SEQ ID NO: 633187 - DNA, 20 bp, mouse
gcattcacgaccactaggaa

SEQ ID NO: 633188 - DNA, 20 bp, mouse
gactttagaatgacacagaa

SEQ ID NO: 633189 - DNA, 20 bp, mouse
gaaacttaaaatttaaggaa

SEQ ID NO: 633190 - DNA, 20 bp, mouse
gtgaagttcactggacaaag

SEQ ID NO: 633191 - DNA, 20 bp, mouse
ggatcagtaaagcatccaaa

SEQ ID NO: 633192 - DNA, 20 bp, mouse
gtttccccccttggaaaaga

SEQ ID NO: 633193 - DNA, 20 bp, mouse
ggggtgaaacttaaaattta

SEQ ID NO: 633194 - DNA, 20 bp, mouse
gctcccatcttttccaaggg

SEQ ID NO: 633195 - DNA, 20 bp, mouse
gggacaaagaggtgaggtgg

SEQ ID NO: 633196 - DNA, 20 bp, mouse
gggagaaagaggtgaggtgg

SEQ ID NO: 633197 - DNA, 20 bp, mouse
ggctttagaatgagacagaa

SEQ ID NO: 633198 - DNA, 20 bp, mouse
gaaaaatcaacctcttgatc

SEQ ID NO: 633199 - DNA, 20 bp, mouse
gttccccctttggaaaagtt

SEQ ID NO: 633200 - DNA, 20 bp, mouse
gctcccaacttttccaaagg

SEQ ID NO: 633201 - DNA, 20 bp, mouse
gatgttgtctgttccccctt

SEQ ID NO: 633202 - DNA, 20 bp, mouse
gacattcaagaccactagga

SEQ ID NO: 633203 - DNA, 20 bp, mouse
gttacacattcaagaccact

SEQ ID NO: 633204 - DNA, 20 bp, mouse
gggtaaactttccttcctag

SEQ ID NO: 633205 - DNA, 20 bp, mouse
gtaactcccaacttttccaa

SEQ ID NO: 633206 - DNA, 20 bp, mouse
gctgggaagacacgagactg

SEQ ID NO: 633207 - DNA, 20 bp, mouse
gaaagtgcttggagcgacag

SEQ ID NO: 633208 - DNA, 20 bp, mouse
gcaaggtaaattaaccaggg

SEQ ID NO: 633209 - DNA, 20 bp, mouse
gcgggctagcaggactagca

SEQ ID NO: 633210 - DNA, 20 bp, mouse
ggtaaattaaccagggagga

SEQ ID NO: 633211 - DNA, 20 bp, mouse
ggtaaggcacgttggacctg

SEQ ID NO: 633212 - DNA, 20 bp, mouse
gaaagccgcatggcgtggtg

SEQ ID NO: 633213 - DNA, 20 bp, mouse
gcacgagactgcgggctagc

SEQ ID NO: 633214 - DNA, 20 bp, mouse
gcaggcaaagccgcatggcg

SEQ ID NO: 633215 - DNA, 20 bp, mouse
gtcagccaggcaaagccgca

SEQ ID NO: 633216 - DNA, 20 bp, mouse
gacctgacagggctatctgg

SEQ ID NO: 633217 - DNA, 20 bp, mouse
gagatagccctgtcaggtca

SEQ ID NO: 633218 - DNA, 20 bp, mouse
ggccgccagatagccctgtc

SEQ ID NO: 633219 - DNA, 20 bp, mouse
gtgattgccctgacctgaca

SEQ ID NO: 633220 - DNA, 20 bp, mouse
gtcagtatcactgatatccc

SEQ ID NO: 633221 - DNA, 20 bp, mouse
gctctgagctctgctatcag

SEQ ID NO: 633222 - DNA, 20 bp, mouse
ggacaggaaacgccacaact

SEQ ID NO: 633223 - DNA, 20 bp, mouse
gctgtgggaaatatccccct

SEQ ID NO: 633224 - DNA, 20 bp, mouse
gccgggagcagaacctgtag

SEQ ID NO: 633225 - DNA, 20 bp, mouse
gtccagttggacccttcaga

SEQ ID NO: 633226 - DNA, 20 bp, mouse
gattcgcgcaccggcagacg

SEQ ID NO: 633227 - DNA, 20 bp, mouse
gacccggcttcacgcctcca

SEQ ID NO: 633228 - DNA, 20 bp, mouse
gagtcggaggcgggcccagt

SEQ ID NO: 633229 - DNA, 20 bp, mouse
gctggacgtcagtcagtcgg

SEQ ID NO: 633230 - DNA, 20 bp, mouse
ggccgagaccattcgcgcac

SEQ ID NO: 633231 - DNA, 20 bp, mouse
gcgaatggtctcggccgtgg

SEQ ID NO: 633232 - DNA, 20 bp, mouse
gtgcactagtcgctgagacc

SEQ ID NO: 633233 - DNA, 20 bp, mouse
gaggctggacgtcagtcagt

SEQ ID NO: 633234 - DNA, 20 bp, mouse
ggccggtgcgcgaatggtct

SEQ ID NO: 633235 - DNA, 20 bp, mouse
ggacgtcagtcagtcggagg

SEQ ID NO: 633236 - DNA, 20 bp, mouse
gcgccagggatgcttcgcgg

SEQ ID NO: 633237 - DNA, 20 bp, mouse
gaggcgcctcagaaagctag

SEQ ID NO: 633238 - DNA, 20 bp, mouse
gggccgccagggatgcttcg

SEQ ID NO: 633239 - DNA, 20 bp, mouse
gagaggctccacggccgcca

SEQ ID NO: 633240 - DNA, 20 bp, mouse
gagcctccgcgaagcatccc

SEQ ID NO: 633241 - DNA, 20 bp, mouse
gcagaaagctagaggctcca

SEQ ID NO: 633242 - DNA, 20 bp, mouse
ggaggcgccttgggtctcta

SEQ ID NO: 633243 - DNA, 20 bp, mouse
gaatccccaagggagcttgg

SEQ ID NO: 633244 - DNA, 20 bp, mouse
gcagtaggagaagggcggga

SEQ ID NO: 633245 - DNA, 20 bp, mouse
gaagctcccttggggattgg

SEQ ID NO: 633246 - DNA, 20 bp, mouse
gcttgggaggagcccagaac

SEQ ID NO: 633247 - DNA, 20 bp, mouse
gaccggtaacagcaacctag

SEQ ID NO: 633248 - DNA, 20 bp, mouse
gcccgagtgagtggcttaca

SEQ ID NO: 633249 - DNA, 20 bp, mouse
gagtggcttacagggcgctt

SEQ ID NO: 633250 - DNA, 20 bp, mouse
gactgagcaaagtcgcccct

SEQ ID NO: 633251 - DNA, 20 bp, mouse
gaccggtctcctcctgttct

SEQ ID NO: 633252 - DNA, 20 bp, mouse
gagctgcggtcccgagtgag

SEQ ID NO: 633253 - DNA, 20 bp, mouse
ggcccctaggttgctgttac

SEQ ID NO: 633254 - DNA, 20 bp, mouse
gcactccttgaagtcctcgt

SEQ ID NO: 633255 - DNA, 20 bp, mouse
gagtccccggccatggagct

SEQ ID NO: 633256 - DNA, 20 bp, mouse
gccgagccggccggacgacg

SEQ ID NO: 633257 - DNA, 20 bp, mouse
gggccggatggagcccccgg

SEQ ID NO: 633258 - DNA, 20 bp, mouse
gctcggccggatggagcccc

SEQ ID NO: 633259 - DNA, 20 bp, mouse
ggtgggacagggaaacccta

SEQ ID NO: 633260 - DNA, 20 bp, mouse
gggctgcgcttggccgccgg

SEQ ID NO: 633261 - DNA, 20 bp, mouse
gtggcgctaaggtccaacaa

SEQ ID NO: 633262 - DNA, 20 bp, mouse
gtgttgtgaagagtcttaaa

SEQ ID NO: 633263 - DNA, 20 bp, mouse
gtcgcgggcagagaggctcg

SEQ ID NO: 633264 - DNA, 20 bp, mouse
gtccatccggccgagccggc

SEQ ID NO: 633265 - DNA, 20 bp, mouse
ggtcccccgcggggcagccc

SEQ ID NO: 633266 - DNA, 20 bp, mouse
gtcttggccggagagatcgg

SEQ ID NO: 633267 - DNA, 20 bp, mouse
ggtcagtcagtccccagcaa

SEQ ID NO: 633268 - DNA, 20 bp, mouse
gtggccggagagatcggcgg

SEQ ID NO: 633269 - DNA, 20 bp, mouse
gccccagcaatggcggaagg

SEQ ID NO: 633270 - DNA, 20 bp, mouse
ggactgcgccgccaagacgg

SEQ ID NO: 633271 - DNA, 20 bp, mouse
ggcctcttggccggagagat

SEQ ID NO: 633272 - DNA, 20 bp, mouse
gggactccggctgcaggtgg

SEQ ID NO: 633273 - DNA, 20 bp, mouse
gactgactgactgattgagg

SEQ ID NO: 633274 - DNA, 20 bp, mouse
gcaaccagcgccggcccgag

SEQ ID NO: 633275 - DNA, 20 bp, mouse
gcgcagtccagcaaggactc

SEQ ID NO: 633276 - DNA, 20 bp, mouse
gtccgctgtcgggttagaag

SEQ ID NO: 633277 - DNA, 20 bp, mouse
gagaagcggcgcggtcatgg

SEQ ID NO: 633278 - DNA, 20 bp, mouse
gagagccgtttcgcgggagg

SEQ ID NO: 633279 - DNA, 20 bp, mouse
ggttagaagcggcgcggtca

SEQ ID NO: 633280 - DNA, 20 bp, mouse
ggcagcctcctcccgcgaaa

SEQ ID NO: 633281 - DNA, 20 bp, mouse
gagcagagccgtttcgcggg

SEQ ID NO: 633282 - DNA, 20 bp, mouse
gagtgccgggaccctataaa

SEQ ID NO: 633283 - DNA, 20 bp, mouse
gcggcagcagagccgtttcg

SEQ ID NO: 633284 - DNA, 20 bp, mouse
ggccgcttctaacccgacag

SEQ ID NO: 633285 - DNA, 20 bp, mouse
ggacatcgcagcgcgcaggg

SEQ ID NO: 633286 - DNA, 20 bp, mouse
gtccgggagcgcgaccgcca

SEQ ID NO: 633287 - DNA, 20 bp, mouse
ggaagttcgcagcgcccggg

SEQ ID NO: 633288 - DNA, 20 bp, mouse
ggacgggcggcgtgccatgg

SEQ ID NO: 633289 - DNA, 20 bp, mouse
ggagctcttccaccacctcc

SEQ ID NO: 633290 - DNA, 20 bp, mouse
ggtcgcgctcccggaggtgg

SEQ ID NO: 633291 - DNA, 20 bp, mouse
gcgtgaagttcgcagcgccc

SEQ ID NO: 633292 - DNA, 20 bp, mouse
gcgagggctgggatgcggaa

SEQ ID NO: 633293 - DNA, 20 bp, mouse
ggaagacgggcggcgtgcca

SEQ ID NO: 633294 - DNA, 20 bp, mouse
gactccttggatgtacccag

SEQ ID NO: 633295 - DNA, 20 bp, mouse
ggccccgcccccggcctgca

SEQ ID NO: 633296 - DNA, 20 bp, mouse
gggcggccagggcctctagg

SEQ ID NO: 633297 - DNA, 20 bp, mouse
gggccagcctgcgagactcg

SEQ ID NO: 633298 - DNA, 20 bp, mouse
gtcccggcctcgagtctcgc

SEQ ID NO: 633299 - DNA, 20 bp, mouse
ggccgcccagcgcttcgtcc

SEQ ID NO: 633300 - DNA, 20 bp, mouse
gcgggcctcacccaacagcg

SEQ ID NO: 633301 - DNA, 20 bp, mouse
gagcctgcgagactcgaggc

SEQ ID NO: 633302 - DNA, 20 bp, mouse
gacgaagcgctgggcggcca

SEQ ID NO: 633303 - DNA, 20 bp, mouse
ggaggccgggacgaagcgct

SEQ ID NO: 633304 - DNA, 20 bp, mouse
gcgcagccgcctagaggccc

SEQ ID NO: 633305 - DNA, 20 bp, mouse
gcaacagcgaggtgcgagcg

SEQ ID NO: 633306 - DNA, 20 bp, mouse
gcttcctcactggccagaga

SEQ ID NO: 633307 - DNA, 20 bp, mouse
gaggtctgttgtgactgcgg

SEQ ID NO: 633308 - DNA, 20 bp, mouse
gctgggatctctaccctctc

SEQ ID NO: 633309 - DNA, 20 bp, mouse
gcacaacagaccttcctcac

SEQ ID NO: 633310 - DNA, 20 bp, mouse
gtgtgactgcggaggactct

SEQ ID NO: 633311 - DNA, 20 bp, mouse
gagccaacgtcgcaccggtg

SEQ ID NO: 633312 - DNA, 20 bp, mouse
ggcctgcagacccggaccca

SEQ ID NO: 633313 - DNA, 20 bp, mouse
ggcggcgcggcagtctcggg

SEQ ID NO: 633314 - DNA, 20 bp, mouse
gctgcggtggggaggagcgg

SEQ ID NO: 633315 - DNA, 20 bp, mouse
gctcagacggatctgcagcg

SEQ ID NO: 633316 - DNA, 20 bp, mouse
ggtacccacacaaacaggat

SEQ ID NO: 633317 - DNA, 20 bp, mouse
gcgcacccggctctccccag

SEQ ID NO: 633318 - DNA, 20 bp, mouse
ggaagcgtacccacacaaac

SEQ ID NO: 633319 - DNA, 20 bp, mouse
ggcctggagaaggaggatct

SEQ ID NO: 633320 - DNA, 20 bp, mouse
ggcagctccggtcccgccag

SEQ ID NO: 633321 - DNA, 20 bp, mouse
gcccggcaggccctgcggtg

SEQ ID NO: 633322 - DNA, 20 bp, mouse
ggaggctcagaagtgttggg

SEQ ID NO: 633323 - DNA, 20 bp, mouse
gagtttcccggcaggccctg

SEQ ID NO: 633324 - DNA, 20 bp, mouse
ggtggaggagatcaaggtga

SEQ ID NO: 633325 - DNA, 20 bp, mouse
gtgggtagagatgacagata

SEQ ID NO: 633326 - DNA, 20 bp, mouse
gcaatggacggaggccacgg

SEQ ID NO: 633327 - DNA, 20 bp, mouse
gtggtcgcgaatgaaccgcg

SEQ ID NO: 633328 - DNA, 20 bp, mouse
gtagcaatggacggaggcca

SEQ ID NO: 633329 - DNA, 20 bp, mouse
gtcgcgaatgaaccgcgcgg

SEQ ID NO: 633330 - DNA, 20 bp, mouse
gacttcttagcaatggacgg

SEQ ID NO: 633331 - DNA, 20 bp, mouse
gcgtctccggcagtgagttg

SEQ ID NO: 633332 - DNA, 20 bp, mouse
gttaacttcttagcaatgga

SEQ ID NO: 633333 - DNA, 20 bp, mouse
gcagctgtggcaaacaccac

SEQ ID NO: 633334 - DNA, 20 bp, mouse
gcgggcctcaagctcagaaa

SEQ ID NO: 633335 - DNA, 20 bp, mouse
gacccgagcttacccaaggg

SEQ ID NO: 633336 - DNA, 20 bp, mouse
ggtggtgagcgacagaacga

SEQ ID NO: 633337 - DNA, 20 bp, mouse
ggtgagcgacagaacgatgg

SEQ ID NO: 633338 - DNA, 20 bp, mouse
ggacagaacgatggcggacg

SEQ ID NO: 633339 - DNA, 20 bp, mouse
gccaggagaatccaaaggcg

SEQ ID NO: 633340 - DNA, 20 bp, mouse
gcgacctaggcgggcagtcc

SEQ ID NO: 633341 - DNA, 20 bp, mouse
gtctcctggactgcccgcct

SEQ ID NO: 633342 - DNA, 20 bp, mouse
gaagtcgcactcctgaacta

SEQ ID NO: 633343 - DNA, 20 bp, mouse
gggcctacactccagaatcc

SEQ ID NO: 633344 - DNA, 20 bp, mouse
ggagtgagtgtggaaggcga

SEQ ID NO: 633345 - DNA, 20 bp, mouse
gttctggagtgtaggccccg

SEQ ID NO: 633346 - DNA, 20 bp, mouse
ggctggaaccagagccgagg

SEQ ID NO: 633347 - DNA, 20 bp, mouse
gtcggctggaaccagagccg

SEQ ID NO: 633348 - DNA, 20 bp, mouse
gggccccccggagcagtagg

SEQ ID NO: 633349 - DNA, 20 bp, mouse
ggcccgaacacgttcctgaa

SEQ ID NO: 633350 - DNA, 20 bp, mouse
gtgttcgggcccgcggcagg

SEQ ID NO: 633351 - DNA, 20 bp, mouse
gaggaacgtgttcgggcccg

SEQ ID NO: 633352 - DNA, 20 bp, mouse
gtgacaagccagagaggccg

SEQ ID NO: 633353 - DNA, 20 bp, mouse
gagtaggaggcggcgcgtgg

SEQ ID NO: 633354 - DNA, 20 bp, mouse
gtctcggcgtcggtgaggct

SEQ ID NO: 633355 - DNA, 20 bp, mouse
gcggggtcgcgcctccgcct

SEQ ID NO: 633356 - DNA, 20 bp, mouse
gccacgcgcggagaccaaca

SEQ ID NO: 633357 - DNA, 20 bp, mouse
gcgcgcggagaccaacatgg

SEQ ID NO: 633358 - DNA, 20 bp, mouse
gggcatgcgcgcgacaccta

SEQ ID NO: 633359 - DNA, 20 bp, mouse
gcctaagatggacctcccgg

SEQ ID NO: 633360 - DNA, 20 bp, mouse
gcagctcgagatgcgactct

SEQ ID NO: 633361 - DNA, 20 bp, mouse
gctttgacagaggctcccgg

SEQ ID NO: 633362 - DNA, 20 bp, mouse
gtagtcacgaggaagcccag

SEQ ID NO: 633363 - DNA, 20 bp, mouse
gcgccgcccccggaggacgg

SEQ ID NO: 633364 - DNA, 20 bp, mouse
gaggcgacggcgcccgggac

SEQ ID NO: 633365 - DNA, 20 bp, mouse
gagtcgccgccgtcctccgg

SEQ ID NO: 633366 - DNA, 20 bp, mouse
gtcgcgccccggcgccccgg

SEQ ID NO: 633367 - DNA, 20 bp, mouse
gcaggaaggtcgcccggcac

SEQ ID NO: 633368 - DNA, 20 bp, mouse
ggaaggtcgcccggcacggg

SEQ ID NO: 633369 - DNA, 20 bp, mouse
gagagcgcaggaaggtcgcc

SEQ ID NO: 633370 - DNA, 20 bp, mouse
gacgggaggagagctcagga

SEQ ID NO: 633371 - DNA, 20 bp, mouse
gtcggcggccgggctcgcgt

SEQ ID NO: 633372 - DNA, 20 bp, mouse
ggggcccgcggccacagcaa

SEQ ID NO: 633373 - DNA, 20 bp, mouse
gcgccggggcgcgacgtcgg

SEQ ID NO: 633374 - DNA, 20 bp, mouse
ggcgaacaggaaccccgcga

SEQ ID NO: 633375 - DNA, 20 bp, mouse
gagagctcaggaaggtcggc

SEQ ID NO: 633376 - DNA, 20 bp, mouse
ggctccaggaggctcgggtc

SEQ ID NO: 633377 - DNA, 20 bp, mouse
ggctgtagttcagaagagcg

SEQ ID NO: 633378 - DNA, 20 bp, mouse
ggttcagaagagcgaggccg

SEQ ID NO: 633379 - DNA, 20 bp, mouse
gttcggtcaggttgcggcag

SEQ ID NO: 633380 - DNA, 20 bp, mouse
ggcaggcgcggcgagcgagg

SEQ ID NO: 633381 - DNA, 20 bp, mouse
gaggccgcgctagctcacca

SEQ ID NO: 633382 - DNA, 20 bp, mouse
gccgaggcctgggcccagcc

SEQ ID NO: 633383 - DNA, 20 bp, mouse
gccggctcgggggctccagg

SEQ ID NO: 633384 - DNA, 20 bp, mouse
gtcaggcagcggctccgggc

SEQ ID NO: 633385 - DNA, 20 bp, mouse
gaagagcgaggccgaggcct

SEQ ID NO: 633386 - DNA, 20 bp, mouse
ggctagaagcggctccggac

SEQ ID NO: 633387 - DNA, 20 bp, mouse
ggaccgggacgcagagtccg

SEQ ID NO: 633388 - DNA, 20 bp, mouse
gccgcgcgcaggagcgtgag

SEQ ID NO: 633389 - DNA, 20 bp, mouse
ggcgtctcggatgaccgcct

SEQ ID NO: 633390 - DNA, 20 bp, mouse
ggagcgcagatgggtcgggt

SEQ ID NO: 633391 - DNA, 20 bp, mouse
gcgcctcggcgccgagtccg

SEQ ID NO: 633392 - DNA, 20 bp, mouse
gagacggagacggagatcgc

SEQ ID NO: 633393 - DNA, 20 bp, mouse
gctgcgcgcggtgaggagcg

SEQ ID NO: 633394 - DNA, 20 bp, mouse
gccgcgtccccttcccgggg

SEQ ID NO: 633395 - DNA, 20 bp, mouse
ggtccgcggactcggcgccg

SEQ ID NO: 633396 - DNA, 20 bp, mouse
ggcccgccaggagctgtcgg

SEQ ID NO: 633397 - DNA, 20 bp, mouse
gggagctgtcggaggttgac

SEQ ID NO: 633398 - DNA, 20 bp, mouse
gcccgcccgccaggagctgt

SEQ ID NO: 633399 - DNA, 20 bp, mouse
ggtcggaggttgacaggtcg

SEQ ID NO: 633400 - DNA, 20 bp, mouse
gctccgtcttgggtgctcgg

SEQ ID NO: 633401 - DNA, 20 bp, mouse
gtactcggagcgttccccat

SEQ ID NO: 633402 - DNA, 20 bp, mouse
ggcgggttccaggagtgcag

SEQ ID NO: 633403 - DNA, 20 bp, mouse
gcccatggggtctccgtctt

SEQ ID NO: 633404 - DNA, 20 bp, mouse
gggttccaggagtgcagcgg

SEQ ID NO: 633405 - DNA, 20 bp, mouse
gccgggggtcgtgccagagt

SEQ ID NO: 633406 - DNA, 20 bp, mouse
ggccgctgtggcgcttcctg

SEQ ID NO: 633407 - DNA, 20 bp, mouse
ggccgcaggaagcgccacag

SEQ ID NO: 633408 - DNA, 20 bp, mouse
gccagtgcggcggccgacgg

SEQ ID NO: 633409 - DNA, 20 bp, mouse
ggactctcgcgggacctggt

SEQ ID NO: 633410 - DNA, 20 bp, mouse
ggcgcgcccggcccacgtgg

SEQ ID NO: 633411 - DNA, 20 bp, mouse
gcgggaggcggggacccacc

SEQ ID NO: 633412 - DNA, 20 bp, mouse
gcgcgggcaaacgggaggag

SEQ ID NO: 633413 - DNA, 20 bp, mouse
gggcgctcgctcgctctgaa

SEQ ID NO: 633414 - DNA, 20 bp, mouse
gccgacggcggccacgcggg

SEQ ID NO: 633415 - DNA, 20 bp, mouse
ggaggccgcgggcaaacggg

SEQ ID NO: 633416 - DNA, 20 bp, mouse
gagctcccctaagggaagcc

SEQ ID NO: 633417 - DNA, 20 bp, mouse
gctccgcatcagctccccta

SEQ ID NO: 633418 - DNA, 20 bp, mouse
gcaggaaagacattctggcc

SEQ ID NO: 633419 - DNA, 20 bp, mouse
gagtcacttgtgctgtaagt

SEQ ID NO: 633420 - DNA, 20 bp, mouse
gccacagtacagttcaagtt

SEQ ID NO: 633421 - DNA, 20 bp, mouse
gagtaaaggccatctaacca

SEQ ID NO: 633422 - DNA, 20 bp, mouse
ggcagcccaggctacctgaa

SEQ ID NO: 633423 - DNA, 20 bp, mouse
ggccaggtctcccgcagccc

SEQ ID NO: 633424 - DNA, 20 bp, mouse
ggttccctttcaggtagcct

SEQ ID NO: 633425 - DNA, 20 bp, mouse
gtctatctcctccttctgta

SEQ ID NO: 633426 - DNA, 20 bp, mouse
gtaccttctgggacccccgg

SEQ ID NO: 633427 - DNA, 20 bp, mouse
gaacctccaggaaccaccgg

SEQ ID NO: 633428 - DNA, 20 bp, mouse
gctgaggctgcaggggctca

SEQ ID NO: 633429 - DNA, 20 bp, mouse
ggatgggctccctcgagcac

SEQ ID NO: 633430 - DNA, 20 bp, mouse
ggcccctgcagcctcagaag

SEQ ID NO: 633431 - DNA, 20 bp, mouse
gccctcttctgaggctgcag

SEQ ID NO: 633432 - DNA, 20 bp, mouse
ggacccccggtggttcctgg

SEQ ID NO: 633433 - DNA, 20 bp, mouse
gggggctcaaggactcagac

SEQ ID NO: 633434 - DNA, 20 bp, mouse
ggtcatcagctgaaacctcc

SEQ ID NO: 633435 - DNA, 20 bp, mouse
gctcaaggactcagactggt

SEQ ID NO: 633436 - DNA, 20 bp, mouse
gctggtgaggatggcccggg

SEQ ID NO: 633437 - DNA, 20 bp, mouse
ggcccgggcggtggcaggaa

SEQ ID NO: 633438 - DNA, 20 bp, mouse
gctccactacataacaacac

SEQ ID NO: 633439 - DNA, 20 bp, mouse
gaaggttcttgagttcaatt

SEQ ID NO: 633440 - DNA, 20 bp, mouse
ggtgcccgctggcctagcag

SEQ ID NO: 633441 - DNA, 20 bp, mouse
gccgagggcgctgccatgtt

SEQ ID NO: 633442 - DNA, 20 bp, mouse
gcagcactcaacccagcagg

SEQ ID NO: 633443 - DNA, 20 bp, mouse
ggacccggaagtactcgttc

SEQ ID NO: 633444 - DNA, 20 bp, mouse
gtcaattaggacagtggctg

SEQ ID NO: 633445 - DNA, 20 bp, mouse
gggcctagcagaggcgccga

SEQ ID NO: 633446 - DNA, 20 bp, mouse
gtgagcggcgtagcaggaag

SEQ ID NO: 633447 - DNA, 20 bp, mouse
gcaggaagaggctcaggcgg

SEQ ID NO: 633448 - DNA, 20 bp, mouse
gtcagttcgagcaggcgata

SEQ ID NO: 633449 - DNA, 20 bp, mouse
gaacccaggctgtcaccaga

SEQ ID NO: 633450 - DNA, 20 bp, mouse
gaccgcgtgagcggcgtagc

SEQ ID NO: 633451 - DNA, 20 bp, mouse
gaagtggcccaggtggactt

SEQ ID NO: 633452 - DNA, 20 bp, mouse
gcagacaccagagccaaccc

SEQ ID NO: 633453 - DNA, 20 bp, mouse
gtccgccacgctcgacagaa

SEQ ID NO: 633454 - DNA, 20 bp, mouse
gtaaacccttctgtcgagcg

SEQ ID NO: 633455 - DNA, 20 bp, mouse
gggcggcggcaactgctgat

SEQ ID NO: 633456 - DNA, 20 bp, mouse
gaggccttgacccaagatgg

SEQ ID NO: 633457 - DNA, 20 bp, mouse
gtacgcgtgcggtgaaggca

SEQ ID NO: 633458 - DNA, 20 bp, mouse
ggggaccccgacgtcccatg

SEQ ID NO: 633459 - DNA, 20 bp, mouse
ggccgacctgacgcaagtga

SEQ ID NO: 633460 - DNA, 20 bp, mouse
gcagggcagctcagtcgacc

SEQ ID NO: 633461 - DNA, 20 bp, mouse
gcaggccgctcagtccttcc

SEQ ID NO: 633462 - DNA, 20 bp, mouse
gccaagatggcggccggacc

SEQ ID NO: 633463 - DNA, 20 bp, mouse
gctctccgggaaggactgag

SEQ ID NO: 633464 - DNA, 20 bp, mouse
gggtccccgcgggcctcctc

SEQ ID NO: 633465 - DNA, 20 bp, mouse
gagacgcatgtgcgcatgcc

SEQ ID NO: 633466 - DNA, 20 bp, mouse
gaggcccagggccccgggat

SEQ ID NO: 633467 - DNA, 20 bp, mouse
ggggccgcgggaaccgggtg

SEQ ID NO: 633468 - DNA, 20 bp, mouse
gcctgggcgcgctaaatcgc

SEQ ID NO: 633469 - DNA, 20 bp, mouse
gggggcgaatgccaagggaa

SEQ ID NO: 633470 - DNA, 20 bp, mouse
gaccgggtgagggagttcga

SEQ ID NO: 633471 - DNA, 20 bp, mouse
ggtgtggcttaaggagcgag

SEQ ID NO: 633472 - DNA, 20 bp, mouse
gcaggtctcggagaggaacc

SEQ ID NO: 633473 - DNA, 20 bp, mouse
gcgcgctaaatcgcaggctc

SEQ ID NO: 633474 - DNA, 20 bp, mouse
gaggggcggggcgaatgcca

SEQ ID NO: 633475 - DNA, 20 bp, mouse
gtcgccagcgcttccaacag

SEQ ID NO: 633476 - DNA, 20 bp, mouse
gcctgcctgccgcaccgctg

SEQ ID NO: 633477 - DNA, 20 bp, mouse
gcccgctcccgcttaaatag

SEQ ID NO: 633478 - DNA, 20 bp, mouse
ggcagcgccccgttccgccg

SEQ ID NO: 633479 - DNA, 20 bp, mouse
gtcgccgccgcgtccttcgc

SEQ ID NO: 633480 - DNA, 20 bp, mouse
gccggggagcggcagcttac

SEQ ID NO: 633481 - DNA, 20 bp, mouse
gccccgggcggcgtaaccgt

SEQ ID NO: 633482 - DNA, 20 bp, mouse
ggcgcctgacgggtgggcct

SEQ ID NO: 633483 - DNA, 20 bp, mouse
gcagggccgagccaccccgg

SEQ ID NO: 633484 - DNA, 20 bp, mouse
ggagggctgcgctaattccg

SEQ ID NO: 633485 - DNA, 20 bp, mouse
gcggagtgtgagaccgaccg

SEQ ID NO: 633486 - DNA, 20 bp, mouse
gggtgcgcgaatccgaatgg

SEQ ID NO: 633487 - DNA, 20 bp, mouse
gaatccgaatggtggctgat

SEQ ID NO: 633488 - DNA, 20 bp, mouse
gaggaagtggccatcggata

SEQ ID NO: 633489 - DNA, 20 bp, mouse
gagcaaggagccctgccgga

SEQ ID NO: 633490 - DNA, 20 bp, mouse
gccaagcccgccctatccga

SEQ ID NO: 633491 - DNA, 20 bp, mouse
ggctcctgcaatggcgacag

SEQ ID NO: 633492 - DNA, 20 bp, mouse
gaccctcgcagctcctgcaa

SEQ ID NO: 633493 - DNA, 20 bp, mouse
gacagaggacaccttggccg

SEQ ID NO: 633494 - DNA, 20 bp, mouse
ggagctagaacctggggcaa

SEQ ID NO: 633495 - DNA, 20 bp, mouse
ggccattgcaggagctgcga

SEQ ID NO: 633496 - DNA, 20 bp, mouse
gagagaggacgagccagaga

SEQ ID NO: 633497 - DNA, 20 bp, mouse
gagcaggctctgtgcagcgg

SEQ ID NO: 633498 - DNA, 20 bp, mouse
gagcgacgagatcctgcggg

SEQ ID NO: 633499 - DNA, 20 bp, mouse
ggggcctgatcgacgcgccc

SEQ ID NO: 633500 - DNA, 20 bp, mouse
gagacatgacgctaagagag

SEQ ID NO: 633501 - DNA, 20 bp, mouse
gggggacgctgcactgcgac

SEQ ID NO: 633502 - DNA, 20 bp, mouse
gacgagatcctgcgggtggg

SEQ ID NO: 633503 - DNA, 20 bp, mouse
gaatgagcgacgagatcctg

SEQ ID NO: 633504 - DNA, 20 bp, mouse
gtggcccgggcgcgtcgatc

SEQ ID NO: 633505 - DNA, 20 bp, mouse
ggcagcggtgggctgcactc

SEQ ID NO: 633506 - DNA, 20 bp, mouse
gcgggcgccgaccactctga

SEQ ID NO: 633507 - DNA, 20 bp, mouse
ggcgtggtgggccaagcttg

SEQ ID NO: 633508 - DNA, 20 bp, mouse
ggagtggcagaagtgttgag

SEQ ID NO: 633509 - DNA, 20 bp, mouse
gttgagtggtgcagacgcta

SEQ ID NO: 633510 - DNA, 20 bp, mouse
gtaacgctgtgacgcgtggt

SEQ ID NO: 633511 - DNA, 20 bp, mouse
gtaccccggcttggaatgga

SEQ ID NO: 633512 - DNA, 20 bp, mouse
ggcgacaagtgataacactc

SEQ ID NO: 633513 - DNA, 20 bp, mouse
gaagtcttgcttgaaccgag

SEQ ID NO: 633514 - DNA, 20 bp, mouse
gtcatgtgatccaacaaagt

SEQ ID NO: 633515 - DNA, 20 bp, mouse
gcggcgcagagcgacggggg

SEQ ID NO: 633516 - DNA, 20 bp, mouse
gggcgggcccgggctggaag

SEQ ID NO: 633517 - DNA, 20 bp, mouse
gaaggggcctcgccgcgcgg

SEQ ID NO: 633518 - DNA, 20 bp, mouse
ggggtccggactcctcgatg

SEQ ID NO: 633519 - DNA, 20 bp, mouse
gccggaccctccgacggaag

SEQ ID NO: 633520 - DNA, 20 bp, mouse
gaggagtccggaccctccga

SEQ ID NO: 633521 - DNA, 20 bp, mouse
gcaaaactgcgcccagcctc

SEQ ID NO: 633522 - DNA, 20 bp, mouse
gcctctccccagtcactcaa

SEQ ID NO: 633523 - DNA, 20 bp, mouse
ggaagtggaatgaagctagc

SEQ ID NO: 633524 - DNA, 20 bp, mouse
gagcctctggaggagaccga

SEQ ID NO: 633525 - DNA, 20 bp, mouse
gaacggggcgcggtcaccct

SEQ ID NO: 633526 - DNA, 20 bp, mouse
gaatgcgcgcggggcaccac

SEQ ID NO: 633527 - DNA, 20 bp, mouse
gtgcgggaaactgattccgg

SEQ ID NO: 633528 - DNA, 20 bp, mouse
gggcctctcaactcctaaaa

SEQ ID NO: 633529 - DNA, 20 bp, mouse
gaaggctcgagtagaggcta

SEQ ID NO: 633530 - DNA, 20 bp, mouse
gctcctgcgcggggcactac

SEQ ID NO: 633531 - DNA, 20 bp, mouse
gcccgcgcgcattctggctg

SEQ ID NO: 633532 - DNA, 20 bp, mouse
gtccggcggccgggatttag

SEQ ID NO: 633533 - DNA, 20 bp, mouse
gaacccttttaggagttgag

SEQ ID NO: 633534 - DNA, 20 bp, mouse
gtacgggagttgtggtcgaa

SEQ ID NO: 633535 - DNA, 20 bp, mouse
gcaacagtataactgttagg

SEQ ID NO: 633536 - DNA, 20 bp, mouse
gagaaaaacaagggctatca

SEQ ID NO: 633537 - DNA, 20 bp, mouse
gcaagggctatcagggtaga

SEQ ID NO: 633538 - DNA, 20 bp, mouse
gacagcgggccaaaaagatc

SEQ ID NO: 633539 - DNA, 20 bp, mouse
gaggcagggcaaggccgccc

SEQ ID NO: 633540 - DNA, 20 bp, mouse
gcccagtgaggtcaggttgc

SEQ ID NO: 633541 - DNA, 20 bp, mouse
ggcccgctgtctttttactg

SEQ ID NO: 633542 - DNA, 20 bp, mouse
gatagcccttgtttttctaa

SEQ ID NO: 633543 - DNA, 20 bp, mouse
gaacctgacctcactgggtc

SEQ ID NO: 633544 - DNA, 20 bp, mouse
gtcactagacacaggcatag

SEQ ID NO: 633545 - DNA, 20 bp, mouse
ggacaatagaattcacccga

SEQ ID NO: 633546 - DNA, 20 bp, mouse
gtacgggcgctcacagatga

SEQ ID NO: 633547 - DNA, 20 bp, mouse
gtgagcgcccgtagagctgg

SEQ ID NO: 633548 - DNA, 20 bp, mouse
gtgcgtagggccaggcgcag

SEQ ID NO: 633549 - DNA, 20 bp, mouse
ggcgcctggccctacgcaac

SEQ ID NO: 633550 - DNA, 20 bp, mouse
gagaggacctccagctctac

SEQ ID NO: 633551 - DNA, 20 bp, mouse
gaaggggagagaactatagg

SEQ ID NO: 633552 - DNA, 20 bp, mouse
gggaaaaagggcatcggagc

SEQ ID NO: 633553 - DNA, 20 bp, mouse
gagccggaagccgaggtcgg

SEQ ID NO: 633554 - DNA, 20 bp, mouse
gtggaggtcctcttactttg

SEQ ID NO: 633555 - DNA, 20 bp, mouse
ggaattagggccttcggctg

SEQ ID NO: 633556 - DNA, 20 bp, mouse
gagggtgtctgcagtaaggt

SEQ ID NO: 633557 - DNA, 20 bp, mouse
gcaccagaggtgatgtaggt

SEQ ID NO: 633558 - DNA, 20 bp, mouse
ggatgtaggtggggccggta

SEQ ID NO: 633559 - DNA, 20 bp, mouse
ggccccacctacatcacctc

SEQ ID NO: 633560 - DNA, 20 bp, mouse
gggccaacaaagttcttaaa

SEQ ID NO: 633561 - DNA, 20 bp, mouse
gaaggagtcatgtgactctg

SEQ ID NO: 633562 - DNA, 20 bp, mouse
ggcccctttaagaactttgt

SEQ ID NO: 633563 - DNA, 20 bp, mouse
gatagcctcccgaaagctca

SEQ ID NO: 633564 - DNA, 20 bp, mouse
gtgctagaaagatatagaga

SEQ ID NO: 633565 - DNA, 20 bp, mouse
gcttactgcagacaccctac

SEQ ID NO: 633566 - DNA, 20 bp, mouse
ggggctcggctgttttcggt

SEQ ID NO: 633567 - DNA, 20 bp, mouse
ggagcccggcaggttaagga

SEQ ID NO: 633568 - DNA, 20 bp, mouse
gtcgccgcgcagcctcagtg

SEQ ID NO: 633569 - DNA, 20 bp, mouse
gggagcggggcgttagtgag

SEQ ID NO: 633570 - DNA, 20 bp, mouse
gtaaacgcaaatgccagaga

SEQ ID NO: 633571 - DNA, 20 bp, mouse
gtccccgcccacccgcactg

SEQ ID NO: 633572 - DNA, 20 bp, mouse
ggcgcagcctcagtgcgggt

SEQ ID NO: 633573 - DNA, 20 bp, mouse
ggaaaacagccgagcccggc

SEQ ID NO: 633574 - DNA, 20 bp, mouse
gcagctatgggggtaaggag

SEQ ID NO: 633575 - DNA, 20 bp, mouse
gcgacgccggccttttacga

SEQ ID NO: 633576 - DNA, 20 bp, mouse
gtgcgcaggcgacagggaca

SEQ ID NO: 633577 - DNA, 20 bp, mouse
ggggccaaggcgcaggtaaa

SEQ ID NO: 633578 - DNA, 20 bp, mouse
gcccgcgtgcgcaggcgaca

SEQ ID NO: 633579 - DNA, 20 bp, mouse
gacagggacaaggggacgtc

SEQ ID NO: 633580 - DNA, 20 bp, mouse
gggccgccgcgtcacgtgga

SEQ ID NO: 633581 - DNA, 20 bp, mouse
ggcgtcacgtggacggggag

SEQ ID NO: 633582 - DNA, 20 bp, mouse
gtgccccaaaggctattagt

SEQ ID NO: 633583 - DNA, 20 bp, mouse
gcgggcgagcctcccaggca

SEQ ID NO: 633584 - DNA, 20 bp, mouse
gcgcacgcgggccaaggcgc

SEQ ID NO: 633585 - DNA, 20 bp, mouse
gtaaagggttacccttgcct

SEQ ID NO: 633586 - DNA, 20 bp, mouse
gtggaacagagggtgttctg

SEQ ID NO: 633587 - DNA, 20 bp, mouse
gacacacactatgtatgtcc

SEQ ID NO: 633588 - DNA, 20 bp, mouse
gaaggcagagggaacgacgc

SEQ ID NO: 633589 - DNA, 20 bp, mouse
gagctaggcagcaaggctag

SEQ ID NO: 633590 - DNA, 20 bp, mouse
ggagcttggcttgagtaaga

SEQ ID NO: 633591 - DNA, 20 bp, mouse
gtgttctgtggcacggagct

SEQ ID NO: 633592 - DNA, 20 bp, mouse
gccagctttccaactttagg

SEQ ID NO: 633593 - DNA, 20 bp, mouse
gtgtgtgtccctggcaatgc

SEQ ID NO: 633594 - DNA, 20 bp, mouse
gagaccgtgggagagccagt

SEQ ID NO: 633595 - DNA, 20 bp, mouse
gccttgctgcctagctcagt

SEQ ID NO: 633596 - DNA, 20 bp, mouse
gagagagtggccagaaaagt

SEQ ID NO: 633597 - DNA, 20 bp, mouse
gctaactagctgtgggaagc

SEQ ID NO: 633598 - DNA, 20 bp, mouse
gtcccgttctgatacatttt

SEQ ID NO: 633599 - DNA, 20 bp, mouse
gtgcccaatagtcaagaaga

SEQ ID NO: 633600 - DNA, 20 bp, mouse
gtgggaagctggtatcgttt

SEQ ID NO: 633601 - DNA, 20 bp, mouse
gacaacccatcgccagagag

SEQ ID NO: 633602 - DNA, 20 bp, mouse
gcaagaagagggctgaccta

SEQ ID NO: 633603 - DNA, 20 bp, mouse
gaaaagtgggaccctaaatt

SEQ ID NO: 633604 - DNA, 20 bp, mouse
gtcccacagctagttaggtc

SEQ ID NO: 633605 - DNA, 20 bp, mouse
gagtttggagatggtgtcct

SEQ ID NO: 633606 - DNA, 20 bp, mouse
gcaaagggacgcagtcagaa

SEQ ID NO: 633607 - DNA, 20 bp, mouse
ggatggccgccgagtctctg

SEQ ID NO: 633608 - DNA, 20 bp, mouse
gtgtctggcaggagagtatg

SEQ ID NO: 633609 - DNA, 20 bp, mouse
gcagaagggccgagaggatt

SEQ ID NO: 633610 - DNA, 20 bp, mouse
gggaaggtgccgaatcctct

SEQ ID NO: 633611 - DNA, 20 bp, mouse
ggctgcggggaccataaagt

SEQ ID NO: 633612 - DNA, 20 bp, mouse
gtccaagggtggtcggtaga

SEQ ID NO: 633613 - DNA, 20 bp, mouse
gccgccgagtctctgaggaa

SEQ ID NO: 633614 - DNA, 20 bp, mouse
gtatgtggatgtctggacat

SEQ ID NO: 633615 - DNA, 20 bp, mouse
gacaggcacctcaggggacc

SEQ ID NO: 633616 - DNA, 20 bp, mouse
ggccaaggatgtattagaat

SEQ ID NO: 633617 - DNA, 20 bp, mouse
gccccattctaatacatcct

SEQ ID NO: 633618 - DNA, 20 bp, mouse
gaatgaggtagggtctacaa

SEQ ID NO: 633619 - DNA, 20 bp, mouse
gcccaaagtggttttgtcta

SEQ ID NO: 633620 - DNA, 20 bp, mouse
gaggctgcctcccgagtgcg

SEQ ID NO: 633621 - DNA, 20 bp, mouse
gagcgagttcccggacctcc

SEQ ID NO: 633622 - DNA, 20 bp, mouse
gagcggccggagctagacga

SEQ ID NO: 633623 - DNA, 20 bp, mouse
ggaggccatttccgcagcca

SEQ ID NO: 633624 - DNA, 20 bp, mouse
gcctactatagtagaaatta

SEQ ID NO: 633625 - DNA, 20 bp, mouse
gtggtcgttaggtggcgttt

SEQ ID NO: 633626 - DNA, 20 bp, mouse
ggaaagatggcagccagcga

SEQ ID NO: 633627 - DNA, 20 bp, mouse
gaaaaagaagagatgcggag

SEQ ID NO: 633628 - DNA, 20 bp, mouse
ggcgcacaattacccttcgc

SEQ ID NO: 633629 - DNA, 20 bp, mouse
gaagaagagatgcggagagg

SEQ ID NO: 633630 - DNA, 20 bp, mouse
ggggaaagacaatgcaaatg

SEQ ID NO: 633631 - DNA, 20 bp, mouse
gacagattacaatgaacatt

SEQ ID NO: 633632 - DNA, 20 bp, mouse
gtgtagtttcgatatgacta

SEQ ID NO: 633633 - DNA, 20 bp, mouse
gggagagcaaaatcagatga

SEQ ID NO: 633634 - DNA, 20 bp, mouse
gcatatcgaaactacacttg

SEQ ID NO: 633635 - DNA, 20 bp, mouse
gagagtataagtctggccaa

SEQ ID NO: 633636 - DNA, 20 bp, mouse
gctaccgccgctgccatatt

SEQ ID NO: 633637 - DNA, 20 bp, mouse
gactgtacaagcagcttctg

SEQ ID NO: 633638 - DNA, 20 bp, mouse
gcggagacaccggaagtgca

SEQ ID NO: 633639 - DNA, 20 bp, mouse
gcgtgcgcaagggctcgatg

SEQ ID NO: 633640 - DNA, 20 bp, mouse
gcccagcctcggcgtcggac

SEQ ID NO: 633641 - DNA, 20 bp, mouse
gagcccttgcgcacgacgga

SEQ ID NO: 633642 - DNA, 20 bp, mouse
gagggcggcccatggtctgt

SEQ ID NO: 633643 - DNA, 20 bp, mouse
gcgccctccgtcgtgcgcaa

SEQ ID NO: 633644 - DNA, 20 bp, mouse
gaatctgctcctttcgggaa

SEQ ID NO: 633645 - DNA, 20 bp, mouse
ggaaaagggccgtaggaaga

SEQ ID NO: 633646 - DNA, 20 bp, mouse
gagcgagcgctgggcactat

SEQ ID NO: 633647 - DNA, 20 bp, mouse
gcgctgaagaacaggttgtg

SEQ ID NO: 633648 - DNA, 20 bp, mouse
gctcgcgcctggaaggccgg

SEQ ID NO: 633649 - DNA, 20 bp, mouse
gcggagcagcggttaatctc

SEQ ID NO: 633650 - DNA, 20 bp, mouse
gcaacagctacttccgggag

SEQ ID NO: 633651 - DNA, 20 bp, mouse
ggtccccggaccgtccgcac

SEQ ID NO: 633652 - DNA, 20 bp, mouse
ggctcacgcttcagcccgga

SEQ ID NO: 633653 - DNA, 20 bp, mouse
gcggaagtggctgttgccag

SEQ ID NO: 633654 - DNA, 20 bp, mouse
gtccaggcgcgagttctaac

SEQ ID NO: 633655 - DNA, 20 bp, mouse
gcggacatctcccgagtccc

SEQ ID NO: 633656 - DNA, 20 bp, mouse
ggtggcgggagagccctcgg

SEQ ID NO: 633657 - DNA, 20 bp, mouse
gtgggtatggtggtgatcgt

SEQ ID NO: 633658 - DNA, 20 bp, mouse
gccgagcgaagcatctcgcg

SEQ ID NO: 633659 - DNA, 20 bp, mouse
gcccactctaggtctgtctg

SEQ ID NO: 633660 - DNA, 20 bp, mouse
gctgcggccgctcgtcaccc

SEQ ID NO: 633661 - DNA, 20 bp, mouse
gcaactcccggtgtgctcca

SEQ ID NO: 633662 - DNA, 20 bp, mouse
gtgtagagggagctttcccg

SEQ ID NO: 633663 - DNA, 20 bp, mouse
gagggagctttcccgtggat

SEQ ID NO: 633664 - DNA, 20 bp, mouse
ggaagaaagcgtagcctccg

SEQ ID NO: 633665 - DNA, 20 bp, mouse
gcaccaccatacccatccac

SEQ ID NO: 633666 - DNA, 20 bp, mouse
gtacaggagaagctcctcag

SEQ ID NO: 633667 - DNA, 20 bp, mouse
gaaggggcgtggctaatcgg

SEQ ID NO: 633668 - DNA, 20 bp, mouse
ggacccgcgcccacctgtca

SEQ ID NO: 633669 - DNA, 20 bp, mouse
gccagtgcgaagtacagaaa

SEQ ID NO: 633670 - DNA, 20 bp, mouse
gtggagacgcgtcagccgtg

SEQ ID NO: 633671 - DNA, 20 bp, mouse
gtcgctgggcgggacctata

SEQ ID NO: 633672 - DNA, 20 bp, mouse
gtgtccgccgcccggcgcga

SEQ ID NO: 633673 - DNA, 20 bp, mouse
gacccgggtagctattggag

SEQ ID NO: 633674 - DNA, 20 bp, mouse
gacagccgaggacgacgggg

SEQ ID NO: 633675 - DNA, 20 bp, mouse
gtagagcccgagccgcccca

SEQ ID NO: 633676 - DNA, 20 bp, mouse
gaggggacggtgagcgagaa

SEQ ID NO: 633677 - DNA, 20 bp, mouse
gtcgaggcgtcgccgagctt

SEQ ID NO: 633678 - DNA, 20 bp, mouse
gcgcgagcgtcccctccggt

SEQ ID NO: 633679 - DNA, 20 bp, mouse
gtgcgcacgcagccaatcgg

SEQ ID NO: 633680 - DNA, 20 bp, mouse
gccaatcggcggccacgcgg

SEQ ID NO: 633681 - DNA, 20 bp, mouse
gagaagggacaagtgcggcc

SEQ ID NO: 633682 - DNA, 20 bp, mouse
gtcacttccgcccaccggag

SEQ ID NO: 633683 - DNA, 20 bp, mouse
gggaggggacgctcgcgtcg

SEQ ID NO: 633684 - DNA, 20 bp, mouse
gaggcgatctgtgcgcgagg

SEQ ID NO: 633685 - DNA, 20 bp, mouse
gaagcttccggcggacgcca

SEQ ID NO: 633686 - DNA, 20 bp, mouse
gaactggaacatgggtgtga

SEQ ID NO: 633687 - DNA, 20 bp, mouse
gcctgcggcctcagagctta

SEQ ID NO: 633688 - DNA, 20 bp, mouse
gcagaactcctgcattgatc

SEQ ID NO: 633689 - DNA, 20 bp, mouse
gaatcgacgaggaagaatat

SEQ ID NO: 633690 - DNA, 20 bp, mouse
gcgtgggagctcaccaaaga

SEQ ID NO: 633691 - DNA, 20 bp, mouse
gagagcttacggtttgtgtt

SEQ ID NO: 633692 - DNA, 20 bp, mouse
ggattctgcctgatcaatgc

SEQ ID NO: 633693 - DNA, 20 bp, mouse
gtgggtaagtctatccagag

SEQ ID NO: 633694 - DNA, 20 bp, mouse
gagtcatcccctgcctgggc

SEQ ID NO: 633695 - DNA, 20 bp, mouse
gggggcctctgatagttatt

SEQ ID NO: 633696 - DNA, 20 bp, mouse
gagcgcgagggcggggtata

SEQ ID NO: 633697 - DNA, 20 bp, mouse
ggggacataccaactggtgg

SEQ ID NO: 633698 - DNA, 20 bp, mouse
gtaggccccgccccttggta

SEQ ID NO: 633699 - DNA, 20 bp, mouse
ggaacgtgtggacaaactcg

SEQ ID NO: 633700 - DNA, 20 bp, mouse
ggggacgtaccagtgcgcag

SEQ ID NO: 633701 - DNA, 20 bp, mouse
gcctaatggatgtacagatg

SEQ ID NO: 633702 - DNA, 20 bp, mouse
gagggtcaaccttgcgtggt

SEQ ID NO: 633703 - DNA, 20 bp, mouse
gcaaggttgaccctaccaag

SEQ ID NO: 633704 - DNA, 20 bp, mouse
gagcctgtgagacgcaagag

SEQ ID NO: 633705 - DNA, 20 bp, mouse
gttgaccctaccaaggggcg

SEQ ID NO: 633706 - DNA, 20 bp, mouse
gctggggcgggctatctaga

SEQ ID NO: 633707 - DNA, 20 bp, mouse
gcgccccaggctagaagtgg

SEQ ID NO: 633708 - DNA, 20 bp, mouse
ggggcgggctatctagaggg

SEQ ID NO: 633709 - DNA, 20 bp, mouse
gtctgagcgggagtcaacca

SEQ ID NO: 633710 - DNA, 20 bp, mouse
gaggctagaagtggcggaca

SEQ ID NO: 633711 - DNA, 20 bp, mouse
ggcccgccccaggctagaag

SEQ ID NO: 633712 - DNA, 20 bp, mouse
ggaaagacgtgcttcgccgg

SEQ ID NO: 633713 - DNA, 20 bp, mouse
gccaaagagtgagtttgaga

SEQ ID NO: 633714 - DNA, 20 bp, mouse
ggcggacagggtggataggg

SEQ ID NO: 633715 - DNA, 20 bp, mouse
gtcactctttggatccgtgt

SEQ ID NO: 633716 - DNA, 20 bp, mouse
ggagcgcccaagcaaggagg

SEQ ID NO: 633717 - DNA, 20 bp, mouse
ggctcggaagcgagaggagg

SEQ ID NO: 633718 - DNA, 20 bp, mouse
gatagagcgcccaagcaagg

SEQ ID NO: 633719 - DNA, 20 bp, mouse
gtaagggcgtggttgcgcgg

SEQ ID NO: 633720 - DNA, 20 bp, mouse
gggcggggctcggaagcgag

SEQ ID NO: 633721 - DNA, 20 bp, mouse
gctccgccccgtcccctctc

SEQ ID NO: 633722 - DNA, 20 bp, mouse
gcgcccaagcaaggaggggg

SEQ ID NO: 633723 - DNA, 20 bp, mouse
gccctggcccgctagtgctt

SEQ ID NO: 633724 - DNA, 20 bp, mouse
ggaggaggaggagcccgaga

SEQ ID NO: 633725 - DNA, 20 bp, mouse
ggctgtcagcggagcaaggt

SEQ ID NO: 633726 - DNA, 20 bp, mouse
gttgcaaataaagtgggtca

SEQ ID NO: 633727 - DNA, 20 bp, mouse
gctacccggataggaaggta

SEQ ID NO: 633728 - DNA, 20 bp, mouse
gggcactatgctacccggat

SEQ ID NO: 633729 - DNA, 20 bp, mouse
gggcgggattggggatgtga

SEQ ID NO: 633730 - DNA, 20 bp, mouse
gggtcagggtctgtaatagg

SEQ ID NO: 633731 - DNA, 20 bp, mouse
gaggttgcactgcagcagga

SEQ ID NO: 633732 - DNA, 20 bp, mouse
gagggtctgtaataggcggt

SEQ ID NO: 633733 - DNA, 20 bp, mouse
gtgtaataggcggttgggga

SEQ ID NO: 633734 - DNA, 20 bp, mouse
gaaggagtgagtgatttagt

SEQ ID NO: 633735 - DNA, 20 bp, mouse
gagcaggaggggcgggattg

SEQ ID NO: 633736 - DNA, 20 bp, mouse
gcacgtctctaatgtgggga

SEQ ID NO: 633737 - DNA, 20 bp, mouse
gacttgagggaacttaggag

SEQ ID NO: 633738 - DNA, 20 bp, mouse
ggcctacgcgggcaaggtga

SEQ ID NO: 633739 - DNA, 20 bp, mouse
gggtgaggatactagaaccg

SEQ ID NO: 633740 - DNA, 20 bp, mouse
ggacgtgacaaatgacatat

SEQ ID NO: 633741 - DNA, 20 bp, mouse
gaaaaagttctgtttcagag

SEQ ID NO: 633742 - DNA, 20 bp, mouse
gttgtcacgtctctaatgtg

SEQ ID NO: 633743 - DNA, 20 bp, mouse
gaaccgcggcagggtggtag

SEQ ID NO: 633744 - DNA, 20 bp, mouse
gagaaaggcttgggcctcac

SEQ ID NO: 633745 - DNA, 20 bp, mouse
gtataggtaaatgctaaagt

SEQ ID NO: 633746 - DNA, 20 bp, mouse
gtggagggacatgtgtatcc

SEQ ID NO: 633747 - DNA, 20 bp, mouse
gcctaggtgagtcacaacct

SEQ ID NO: 633748 - DNA, 20 bp, mouse
gaggccttctgtgcagggat

SEQ ID NO: 633749 - DNA, 20 bp, mouse
gtggaacttggatactttga

SEQ ID NO: 633750 - DNA, 20 bp, mouse
ggggtgtgggccacgcaagg

SEQ ID NO: 633751 - DNA, 20 bp, mouse
gcagactcactagtgaagag

SEQ ID NO: 633752 - DNA, 20 bp, mouse
gggtcccatccctgcacaga

SEQ ID NO: 633753 - DNA, 20 bp, mouse
gcctaaaagggaagttgggt

SEQ ID NO: 633754 - DNA, 20 bp, mouse
gggttctgattcacagtccg

SEQ ID NO: 633755 - DNA, 20 bp, mouse
ggtggcccacaccccaggta

SEQ ID NO: 633756 - DNA, 20 bp, mouse
gtgtgggtgggactaaccac

SEQ ID NO: 633757 - DNA, 20 bp, mouse
gtccctaagagcatgtaaga

SEQ ID NO: 633758 - DNA, 20 bp, mouse
gaaccctcttacatgctctt

SEQ ID NO: 633759 - DNA, 20 bp, mouse
gaaccacaggcttgtgtcac

SEQ ID NO: 633760 - DNA, 20 bp, mouse
gttcacattaaggactcagg

SEQ ID NO: 633761 - DNA, 20 bp, mouse
gggcaccatggaaggatgta

SEQ ID NO: 633762 - DNA, 20 bp, mouse
ggagcatgtaagagggtttg

SEQ ID NO: 633763 - DNA, 20 bp, mouse
gtgtttcagacaatcaaaat

SEQ ID NO: 633764 - DNA, 20 bp, mouse
gtgtatcaaggtcttatagc

SEQ ID NO: 633765 - DNA, 20 bp, mouse
gagattattgttttgtatca

SEQ ID NO: 633766 - DNA, 20 bp, mouse
gagagcgccggcaggtaagc

SEQ ID NO: 633767 - DNA, 20 bp, mouse
gtacctgccggcgctctccg

SEQ ID NO: 633768 - DNA, 20 bp, mouse
gcttccccggcgcctcctgt

SEQ ID NO: 633769 - DNA, 20 bp, mouse
ggggcccgcccggagcgtaa

SEQ ID NO: 633770 - DNA, 20 bp, mouse
gtcgccgcttctctgatcga

SEQ ID NO: 633771 - DNA, 20 bp, mouse
gaggaggcgccggggaagca

SEQ ID NO: 633772 - DNA, 20 bp, mouse
ggctcgcgcggggaactcga

SEQ ID NO: 633773 - DNA, 20 bp, mouse
gggagacgaggcccacgcga

SEQ ID NO: 633774 - DNA, 20 bp, mouse
gaggccgtcgatcagagaag

SEQ ID NO: 633775 - DNA, 20 bp, mouse
ggcgccggcaggtaagccgg

SEQ ID NO: 633776 - DNA, 20 bp, mouse
gttatcagggacagaaaaat

SEQ ID NO: 633777 - DNA, 20 bp, mouse
ggacaaggaaacctgataaa

SEQ ID NO: 633778 - DNA, 20 bp, mouse
ggacatccactcagttatca

SEQ ID NO: 633779 - DNA, 20 bp, mouse
gtctaaacactaggcctgtt

SEQ ID NO: 633780 - DNA, 20 bp, mouse
gcacaaaggtagatgatgtg

SEQ ID NO: 633781 - DNA, 20 bp, mouse
gaaggctgcctgcagtacaa

SEQ ID NO: 633782 - DNA, 20 bp, mouse
gtagtgtttagaggtgatac

SEQ ID NO: 633783 - DNA, 20 bp, mouse
ggactgattcagaaatcagc

SEQ ID NO: 633784 - DNA, 20 bp, mouse
ggtcaccaaacagcatgact

SEQ ID NO: 633785 - DNA, 20 bp, mouse
gacagcatgacttgggtatg

SEQ ID NO: 633786 - DNA, 20 bp, mouse
ggctcccgaggcggcgacag

SEQ ID NO: 633787 - DNA, 20 bp, mouse
gctggcgaggaagagcgcgc

SEQ ID NO: 633788 - DNA, 20 bp, mouse
ggtaccccgcggcgctggaa

SEQ ID NO: 633789 - DNA, 20 bp, mouse
gccgcggggtacccaggtgc

SEQ ID NO: 633790 - DNA, 20 bp, mouse
gcgcgctctctcactagcgt

SEQ ID NO: 633791 - DNA, 20 bp, mouse
ggggctgcactggccattaa

SEQ ID NO: 633792 - DNA, 20 bp, mouse
gcttcctcgccagacgggcg

SEQ ID NO: 633793 - DNA, 20 bp, mouse
gccagcgccgcggggtaccc

SEQ ID NO: 633794 - DNA, 20 bp, mouse
ggcgccccgcccgtctggcg

SEQ ID NO: 633795 - DNA, 20 bp, mouse
gcgcggcgctggaagggtta

SEQ ID NO: 633796 - DNA, 20 bp, mouse
gcgtcctgctgcaggagttc

SEQ ID NO: 633797 - DNA, 20 bp, mouse
gctgaggcgagaaaaggtca

SEQ ID NO: 633798 - DNA, 20 bp, mouse
gggttcagactgtacttcca

SEQ ID NO: 633799 - DNA, 20 bp, mouse
ggccttgggaggacgttgtg

SEQ ID NO: 633800 - DNA, 20 bp, mouse
gaacgtcctcccaaggcctc

SEQ ID NO: 633801 - DNA, 20 bp, mouse
gtgtccgactccaaagaaac

SEQ ID NO: 633802 - DNA, 20 bp, mouse
gctgcagcaggacggtcatc

SEQ ID NO: 633803 - DNA, 20 bp, mouse
gaacagtttcccagtttctt

SEQ ID NO: 633804 - DNA, 20 bp, mouse
ggggaaaagcagagtttaaa

SEQ ID NO: 633805 - DNA, 20 bp, mouse
gcaagacgatcaggagcttt

SEQ ID NO: 633806 - DNA, 20 bp, mouse
gaaggcgccctccgccgcgc

SEQ ID NO: 633807 - DNA, 20 bp, mouse
gtctgcgagcccaaaggggc

SEQ ID NO: 633808 - DNA, 20 bp, mouse
gcaagctgcgatgggattgg

SEQ ID NO: 633809 - DNA, 20 bp, mouse
ggccttctgcgagcccaaag

SEQ ID NO: 633810 - DNA, 20 bp, mouse
ggggaaaactgcagtacttc

SEQ ID NO: 633811 - DNA, 20 bp, mouse
gcagcaagctgcgatgggat

SEQ ID NO: 633812 - DNA, 20 bp, mouse
ggcgccctccgccgcgctgg

SEQ ID NO: 633813 - DNA, 20 bp, mouse
gcccgcctcctccagcgcgg

SEQ ID NO: 633814 - DNA, 20 bp, mouse
gcctcctccagcgcggcgga

SEQ ID NO: 633815 - DNA, 20 bp, mouse
gagaactcatcgcctctcgc

SEQ ID NO: 633816 - DNA, 20 bp, mouse
gtgggtggatggagcgcctc

SEQ ID NO: 633817 - DNA, 20 bp, mouse
gtgcacggggatgaacttaa

SEQ ID NO: 633818 - DNA, 20 bp, mouse
gttaggagacagagtgcacg

SEQ ID NO: 633819 - DNA, 20 bp, mouse
ggggcgcaggcgttgacaga

SEQ ID NO: 633820 - DNA, 20 bp, mouse
gcggacagaaagcacttggg

SEQ ID NO: 633821 - DNA, 20 bp, mouse
gcacagggtctccccaccta

SEQ ID NO: 633822 - DNA, 20 bp, mouse
gcgccggacagaaagcactt

SEQ ID NO: 633823 - DNA, 20 bp, mouse
gcggccgctccgactaatgg

SEQ ID NO: 633824 - DNA, 20 bp, mouse
gcggcggccgctccgactaa

SEQ ID NO: 633825 - DNA, 20 bp, mouse
gcagaggagtgagttcgctg

SEQ ID NO: 633826 - DNA, 20 bp, mouse
gcggccagaggagaactaga

SEQ ID NO: 633827 - DNA, 20 bp, mouse
ggagaactagaaggctgaga

SEQ ID NO: 633828 - DNA, 20 bp, mouse
gcttccggaacttgtgtgat

SEQ ID NO: 633829 - DNA, 20 bp, mouse
gcagccttctagttctcctc

SEQ ID NO: 633830 - DNA, 20 bp, mouse
ggctgaagaattactatcag

SEQ ID NO: 633831 - DNA, 20 bp, mouse
ggagcctatcacacaagttc

SEQ ID NO: 633832 - DNA, 20 bp, mouse
gaaaaccaaatcccaaaaat

SEQ ID NO: 633833 - DNA, 20 bp, mouse
gcacgtaaacagtctccgac

SEQ ID NO: 633834 - DNA, 20 bp, mouse
gatggcacccaggcggccag

SEQ ID NO: 633835 - DNA, 20 bp, mouse
gcaatccaagggaccccatg

SEQ ID NO: 633836 - DNA, 20 bp, mouse
gagagcgggtaaaattcagg

SEQ ID NO: 633837 - DNA, 20 bp, mouse
ggaaaagtgggcagatgggg

SEQ ID NO: 633838 - DNA, 20 bp, mouse
ggcaactggtggtggaagaa

SEQ ID NO: 633839 - DNA, 20 bp, mouse
gcgcgccggtcccggaagtc

SEQ ID NO: 633840 - DNA, 20 bp, mouse
gagtttgggtggcagcttga

SEQ ID NO: 633841 - DNA, 20 bp, mouse
gcagagagcgggtaaaattc

SEQ ID NO: 633842 - DNA, 20 bp, mouse
gtcccgtgtgagagtttggg

SEQ ID NO: 633843 - DNA, 20 bp, mouse
ggatctcccgtgtgagagtt

SEQ ID NO: 633844 - DNA, 20 bp, mouse
ggccacccaaactctcacac

SEQ ID NO: 633845 - DNA, 20 bp, mouse
ggctgtgacgtcagtacagg

SEQ ID NO: 633846 - DNA, 20 bp, mouse
gagcacagtacaaagatgtg

SEQ ID NO: 633847 - DNA, 20 bp, mouse
gacactgaatttccttcatt

SEQ ID NO: 633848 - DNA, 20 bp, mouse
gacatagttttcaggtttct

SEQ ID NO: 633849 - DNA, 20 bp, mouse
gagatgacagttatctacca

SEQ ID NO: 633850 - DNA, 20 bp, mouse
gttgaggactatgtttattg

SEQ ID NO: 633851 - DNA, 20 bp, mouse
gtcagttgattttaaaatca

SEQ ID NO: 633852 - DNA, 20 bp, mouse
gattttcattaccccaatga

SEQ ID NO: 633853 - DNA, 20 bp, mouse
ggaccatgagatcctgaagc

SEQ ID NO: 633854 - DNA, 20 bp, mouse
gaggagctgacatagttttc

SEQ ID NO: 633855 - DNA, 20 bp, mouse
gcacgagtattgagagttac

SEQ ID NO: 633856 - DNA, 20 bp, mouse
gtctgcgcaggcgtcaacga

SEQ ID NO: 633857 - DNA, 20 bp, mouse
gaggtactgcgcaggaccaa

SEQ ID NO: 633858 - DNA, 20 bp, mouse
gctcaactgctcaactgcct

SEQ ID NO: 633859 - DNA, 20 bp, mouse
gccaagggcgaggacttgtg

SEQ ID NO: 633860 - DNA, 20 bp, mouse
gcgctgcccaggtactgcgc

SEQ ID NO: 633861 - DNA, 20 bp, mouse
gtgggaggggcgctccacag

SEQ ID NO: 633862 - DNA, 20 bp, mouse
ggcgaggacttgtgaggaca

SEQ ID NO: 633863 - DNA, 20 bp, mouse
gtgtgaggacaaggcactgc

SEQ ID NO: 633864 - DNA, 20 bp, mouse
ggagcagttgaggatttcca

SEQ ID NO: 633865 - DNA, 20 bp, mouse
gctgcgcaggaccaagggcg

SEQ ID NO: 633866 - DNA, 20 bp, mouse
gagtcacgtgggccgacctg

SEQ ID NO: 633867 - DNA, 20 bp, mouse
gcggcccacgtgactcatta

SEQ ID NO: 633868 - DNA, 20 bp, mouse
gcggacccaaggtgcaagtc

SEQ ID NO: 633869 - DNA, 20 bp, mouse
gcggcaggaggcggggattg

SEQ ID NO: 633870 - DNA, 20 bp, mouse
gaaagccttcctcggaccca

SEQ ID NO: 633871 - DNA, 20 bp, mouse
gtgcaccttgggtccgagga

SEQ ID NO: 633872 - DNA, 20 bp, mouse
gtcccccattggctcgaacg

SEQ ID NO: 633873 - DNA, 20 bp, mouse
ggccgcacatcctcgactac

SEQ ID NO: 633874 - DNA, 20 bp, mouse
gcgaacgcggctgtccatca

SEQ ID NO: 633875 - DNA, 20 bp, mouse
gaaagccggacttgcacctt

SEQ ID NO: 633876 - DNA, 20 bp, mouse
gcgtaagcgaatctcggacg

SEQ ID NO: 633877 - DNA, 20 bp, mouse
gaatctgcggccatcttgaa

SEQ ID NO: 633878 - DNA, 20 bp, mouse
gccaacggaccacgcctcct

SEQ ID NO: 633879 - DNA, 20 bp, mouse
gacggggtcgccatggcccc

SEQ ID NO: 633880 - DNA, 20 bp, mouse
gctcttagggcgccccgcga

SEQ ID NO: 633881 - DNA, 20 bp, mouse
gaggtgacgccccgtagcac

SEQ ID NO: 633882 - DNA, 20 bp, mouse
gagaagagcgctcgggtgta

SEQ ID NO: 633883 - DNA, 20 bp, mouse
gcatcttgaagggaggattc

SEQ ID NO: 633884 - DNA, 20 bp, mouse
gggcagatgccggtgctacg

SEQ ID NO: 633885 - DNA, 20 bp, mouse
gctgcggccatcttgaaggg

SEQ ID NO: 633886 - DNA, 20 bp, mouse
ggttgctaggcaaaggagtg

SEQ ID NO: 633887 - DNA, 20 bp, mouse
gctaggcaaaggagtgagga

SEQ ID NO: 633888 - DNA, 20 bp, mouse
gaactctgctacagactagt

SEQ ID NO: 633889 - DNA, 20 bp, mouse
gcagttgccaaacctctctg

SEQ ID NO: 633890 - DNA, 20 bp, mouse
ggttccacatttagctttga

SEQ ID NO: 633891 - DNA, 20 bp, mouse
gtctgtagcagagttgattt

SEQ ID NO: 633892 - DNA, 20 bp, mouse
gagtgaagtcatcagttgct

SEQ ID NO: 633893 - DNA, 20 bp, mouse
gggtttggcaactggaatga

SEQ ID NO: 633894 - DNA, 20 bp, mouse
gactccttcaaagctaaatg

SEQ ID NO: 633895 - DNA, 20 bp, mouse
gactaatagaactctgagta

SEQ ID NO: 633896 - DNA, 20 bp, mouse
gactgcggaggggtggtgag

SEQ ID NO: 633897 - DNA, 20 bp, mouse
gcggacgccgcggtctcccg

SEQ ID NO: 633898 - DNA, 20 bp, mouse
gacctcgcgccgcctagcgc

SEQ ID NO: 633899 - DNA, 20 bp, mouse
ggaagagggagtagagagtc

SEQ ID NO: 633900 - DNA, 20 bp, mouse
gtaaagggaccgcgaccccc

SEQ ID NO: 633901 - DNA, 20 bp, mouse
ggcgacttgaaggagaacgg

SEQ ID NO: 633902 - DNA, 20 bp, mouse
gcgggtggcacgggcggcga

SEQ ID NO: 633903 - DNA, 20 bp, mouse
gtggagtggggtcccggcgc

SEQ ID NO: 633904 - DNA, 20 bp, mouse
gctgacgccgtctctctccc

SEQ ID NO: 633905 - DNA, 20 bp, mouse
gcggaggggtggtgagcggg

SEQ ID NO: 633906 - DNA, 20 bp, mouse
gcgcacgcgcactcccgccc

SEQ ID NO: 633907 - DNA, 20 bp, mouse
gcgggcacgcccgagagcga

SEQ ID NO: 633908 - DNA, 20 bp, mouse
gcccgcgcgcgctgctcgcc

SEQ ID NO: 633909 - DNA, 20 bp, mouse
gaggcgcagctcaagcgtcc

SEQ ID NO: 633910 - DNA, 20 bp, mouse
ggaagctacggtgcgaggag

SEQ ID NO: 633911 - DNA, 20 bp, mouse
ggctcgcccgggacccagca

SEQ ID NO: 633912 - DNA, 20 bp, mouse
gctgcgccttgctgggtccc

SEQ ID NO: 633913 - DNA, 20 bp, mouse
gcggcggggcccccacgcgc

SEQ ID NO: 633914 - DNA, 20 bp, mouse
ggcagctcaagcgtcccggg

SEQ ID NO: 633915 - DNA, 20 bp, mouse
gggccccgcccctcgctctc

SEQ ID NO: 633916 - DNA, 20 bp, mouse
ggaaccatctctcaccgtga

SEQ ID NO: 633917 - DNA, 20 bp, mouse
gtggctccaatgaccttgaa

SEQ ID NO: 633918 - DNA, 20 bp, mouse
gagcaggcaagcttctgttt

SEQ ID NO: 633919 - DNA, 20 bp, mouse
gcaaaggggactggaatggt

SEQ ID NO: 633920 - DNA, 20 bp, mouse
gtgtgcaaaggggactggaa

SEQ ID NO: 633921 - DNA, 20 bp, mouse
gcttccctcacggtgagaga

SEQ ID NO: 633922 - DNA, 20 bp, mouse
gacttggccagaacctagag

SEQ ID NO: 633923 - DNA, 20 bp, mouse
gtgccccttagtgtgcaaag

SEQ ID NO: 633924 - DNA, 20 bp, mouse
gaaactacctctctaggttc

SEQ ID NO: 633925 - DNA, 20 bp, mouse
gcacactaaggggcagagaa

SEQ ID NO: 633926 - DNA, 20 bp, mouse
gccgccccgcagcccgccca

SEQ ID NO: 633927 - DNA, 20 bp, mouse
gcccccgcccggcacctgga

SEQ ID NO: 633928 - DNA, 20 bp, mouse
gggcatcggccggctgtccc

SEQ ID NO: 633929 - DNA, 20 bp, mouse
gtacctctgcgtctctgcac

SEQ ID NO: 633930 - DNA, 20 bp, mouse
gccgggcaaagtttgggcat

SEQ ID NO: 633931 - DNA, 20 bp, mouse
ggacgcagaggtaacgcccc

SEQ ID NO: 633932 - DNA, 20 bp, mouse
gcagccgcgctcccggcacc

SEQ ID NO: 633933 - DNA, 20 bp, mouse
gccgccctccaggtgccggg

SEQ ID NO: 633934 - DNA, 20 bp, mouse
gccggctgtccccggttctg

SEQ ID NO: 633935 - DNA, 20 bp, mouse
gcggttctgtggaaggaaat

SEQ ID NO: 633936 - DNA, 20 bp, mouse
gtggggctggaattgggcgg

SEQ ID NO: 633937 - DNA, 20 bp, mouse
gaaccaggagctaggattcc

SEQ ID NO: 633938 - DNA, 20 bp, mouse
gtaggattccaggctggcta

SEQ ID NO: 633939 - DNA, 20 bp, mouse
ggcggaggcaatactcgcgc

SEQ ID NO: 633940 - DNA, 20 bp, mouse
ggattgtttctgacggactt

SEQ ID NO: 633941 - DNA, 20 bp, mouse
ggcacgtgtcccacgtggtt

SEQ ID NO: 633942 - DNA, 20 bp, mouse
gcgcactcgattgtttctga

SEQ ID NO: 633943 - DNA, 20 bp, mouse
gtgccaggaatggcaaacgc

SEQ ID NO: 633944 - DNA, 20 bp, mouse
gatagacgactcccagaaag

SEQ ID NO: 633945 - DNA, 20 bp, mouse
gcctgcaaatcggacacctt

SEQ ID NO: 633946 - DNA, 20 bp, mouse
gcgggacgaagcagtgatgg

SEQ ID NO: 633947 - DNA, 20 bp, mouse
ggggcgggacgaagcagtga

SEQ ID NO: 633948 - DNA, 20 bp, mouse
gaagccggccccaggttcct

SEQ ID NO: 633949 - DNA, 20 bp, mouse
ggcttggggcgggacttcgc

SEQ ID NO: 633950 - DNA, 20 bp, mouse
gcaagggggcgccagagata

SEQ ID NO: 633951 - DNA, 20 bp, mouse
ggcgggacttcgcggggtag

SEQ ID NO: 633952 - DNA, 20 bp, mouse
gggaggtggagcgtcgtctg

SEQ ID NO: 633953 - DNA, 20 bp, mouse
ggcgacggcgctctaggcgg

SEQ ID NO: 633954 - DNA, 20 bp, mouse
gcctctgtggtcatcggcga

SEQ ID NO: 633955 - DNA, 20 bp, mouse
gtaaactagggcccagtgta

SEQ ID NO: 633956 - DNA, 20 bp, mouse
gcaaagccggcagacagctg

SEQ ID NO: 633957 - DNA, 20 bp, mouse
ggaatagcagcaaggccaag

SEQ ID NO: 633958 - DNA, 20 bp, mouse
gcaggcagcagccctcttcc

SEQ ID NO: 633959 - DNA, 20 bp, mouse
gcctggtttcacaacacttt

SEQ ID NO: 633960 - DNA, 20 bp, mouse
gagccagccgtcctggttta

SEQ ID NO: 633961 - DNA, 20 bp, mouse
gattctcaatccacaagcgg

SEQ ID NO: 633962 - DNA, 20 bp, mouse
gtggggggttgctgtgtgaa

SEQ ID NO: 633963 - DNA, 20 bp, mouse
gtgtgaaaggaatagcagca

SEQ ID NO: 633964 - DNA, 20 bp, mouse
gacccagtgaaacatttact

SEQ ID NO: 633965 - DNA, 20 bp, mouse
gggctggctgccagtgtcca

SEQ ID NO: 633966 - DNA, 20 bp, mouse
gtccacccagggaccgaacc

SEQ ID NO: 633967 - DNA, 20 bp, mouse
gtggcgaccagcccggactg

SEQ ID NO: 633968 - DNA, 20 bp, mouse
gagaagagatagctccactg

SEQ ID NO: 633969 - DNA, 20 bp, mouse
gtgtccccggttcggtccct

SEQ ID NO: 633970 - DNA, 20 bp, mouse
gggtgcttctccgggaaagc

SEQ ID NO: 633971 - DNA, 20 bp, mouse
ggaagcaccgtttccaccca

SEQ ID NO: 633972 - DNA, 20 bp, mouse
gtctggccaagcagatactc

SEQ ID NO: 633973 - DNA, 20 bp, mouse
gccccggttcggtccctggg

SEQ ID NO: 633974 - DNA, 20 bp, mouse
ggggtaaagtgcacctaggc

SEQ ID NO: 633975 - DNA, 20 bp, mouse
ggagatagaggagaaactat

SEQ ID NO: 633976 - DNA, 20 bp, mouse
gcggcgaagtccctccccgg

SEQ ID NO: 633977 - DNA, 20 bp, mouse
ggggcgcagggagcaccgga

SEQ ID NO: 633978 - DNA, 20 bp, mouse
gacaggcagccgagatgtgg

SEQ ID NO: 633979 - DNA, 20 bp, mouse
gggccgccgcgcagaccgca

SEQ ID NO: 633980 - DNA, 20 bp, mouse
gcgcagggagcaccggaggg

SEQ ID NO: 633981 - DNA, 20 bp, mouse
gccctgcgcccggctccctg

SEQ ID NO: 633982 - DNA, 20 bp, mouse
gcgggctgcgtcacagggac

SEQ ID NO: 633983 - DNA, 20 bp, mouse
ggccccgcgccagcatccag

SEQ ID NO: 633984 - DNA, 20 bp, mouse
gctccctgcggtctgcgcgg

SEQ ID NO: 633985 - DNA, 20 bp, mouse
gcacgtcagcccccacatct

SEQ ID NO: 633986 - DNA, 20 bp, mouse
ggtaccacgtgtacagtaga

SEQ ID NO: 633987 - DNA, 20 bp, mouse
gactaggtcccaaggatggt

SEQ ID NO: 633988 - DNA, 20 bp, mouse
gaggagacccagggctgagt

SEQ ID NO: 633989 - DNA, 20 bp, mouse
gtcccaaggatggtaggcag

SEQ ID NO: 633990 - DNA, 20 bp, mouse
gtactgtacacgtggtacga

SEQ ID NO: 633991 - DNA, 20 bp, mouse
ggacagggagggcaaaattc

SEQ ID NO: 633992 - DNA, 20 bp, mouse
gcgtggtacgatggatgaca

SEQ ID NO: 633993 - DNA, 20 bp, mouse
ggggagggcaaaattcaggc

SEQ ID NO: 633994 - DNA, 20 bp, mouse
gaaaagaaagctggttgcca

SEQ ID NO: 633995 - DNA, 20 bp, mouse
gtagcagggactaggtccca

SEQ ID NO: 633996 - DNA, 20 bp, mouse
gagagcgaaggtgaacaaga

SEQ ID NO: 633997 - DNA, 20 bp, mouse
gcctccctgtccccaggatg

SEQ ID NO: 633998 - DNA, 20 bp, mouse
gcagaaggctgcgcattggt

SEQ ID NO: 633999 - DNA, 20 bp, mouse
gcattggtggcggttgaaag

SEQ ID NO: 634000 - DNA, 20 bp, mouse
ggtgacgggtgggttcgtgg

SEQ ID NO: 634001 - DNA, 20 bp, mouse
gtggcccaggaacgcgcaga

SEQ ID NO: 634002 - DNA, 20 bp, mouse
gctgggccaagcattggtgg

SEQ ID NO: 634003 - DNA, 20 bp, mouse
gggagtttaaagtagggttt

SEQ ID NO: 634004 - DNA, 20 bp, mouse
gccacgaagaaagagagcga

SEQ ID NO: 634005 - DNA, 20 bp, mouse
gcagccttctgcgcgttcct

SEQ ID NO: 634006 - DNA, 20 bp, mouse
gccatcccgaccaacttcgg

SEQ ID NO: 634007 - DNA, 20 bp, mouse
gccgaccaacttcgggggtg

SEQ ID NO: 634008 - DNA, 20 bp, mouse
gtgggcggacctcggaaaaa

SEQ ID NO: 634009 - DNA, 20 bp, mouse
gaccaccccacccccgaagt

SEQ ID NO: 634010 - DNA, 20 bp, mouse
ggccacggaaacagggcggg

SEQ ID NO: 634011 - DNA, 20 bp, mouse
gagttgccacggaaacaggg

SEQ ID NO: 634012 - DNA, 20 bp, mouse
gcccacccgccctgtttccg

SEQ ID NO: 634013 - DNA, 20 bp, mouse
gaattatggttctgcgcaga

SEQ ID NO: 634014 - DNA, 20 bp, mouse
ggcagagggttccaaagctg

SEQ ID NO: 634015 - DNA, 20 bp, mouse
gagacgttgccgtttttccg

SEQ ID NO: 634016 - DNA, 20 bp, mouse
gggcccagtgagcacgggga

SEQ ID NO: 634017 - DNA, 20 bp, mouse
ggaaggggacatggactctg

SEQ ID NO: 634018 - DNA, 20 bp, mouse
gcggaggcccagtgagcacg

SEQ ID NO: 634019 - DNA, 20 bp, mouse
ggggcgagtagcctagtggg

SEQ ID NO: 634020 - DNA, 20 bp, mouse
gccgcgacctgccagggccg

SEQ ID NO: 634021 - DNA, 20 bp, mouse
gcccggaagcgacgcgccat

SEQ ID NO: 634022 - DNA, 20 bp, mouse
gggcgagcccggcctctcgc

SEQ ID NO: 634023 - DNA, 20 bp, mouse
ggcccctccccgtgctcact

SEQ ID NO: 634024 - DNA, 20 bp, mouse
gaagcaggtgcgtgataggg

SEQ ID NO: 634025 - DNA, 20 bp, mouse
ggacgccaagcggtcgcgcc

SEQ ID NO: 634026 - DNA, 20 bp, mouse
gaagggccgcgtggccaaag

SEQ ID NO: 634027 - DNA, 20 bp, mouse
gggcctgggttgctagggga

SEQ ID NO: 634028 - DNA, 20 bp, mouse
ggggttgtgctgcagaggaa

SEQ ID NO: 634029 - DNA, 20 bp, mouse
ggctctgggcgggacccaca

SEQ ID NO: 634030 - DNA, 20 bp, mouse
ggcagaggaacggctcaggg

SEQ ID NO: 634031 - DNA, 20 bp, mouse
gccgaggcacactgccctgc

SEQ ID NO: 634032 - DNA, 20 bp, mouse
gagcctgacgccaagggcct

SEQ ID NO: 634033 - DNA, 20 bp, mouse
gggcctgagcctgacgccaa

SEQ ID NO: 634034 - DNA, 20 bp, mouse
gagagggcaagactgatgcc

SEQ ID NO: 634035 - DNA, 20 bp, mouse
gaacggctcaggggggcgtg

SEQ ID NO: 634036 - DNA, 20 bp, mouse
gcatcagcgcataactggat

SEQ ID NO: 634037 - DNA, 20 bp, mouse
gcagttatgcgctgatgcag

SEQ ID NO: 634038 - DNA, 20 bp, mouse
ggtagaaagaacaggatgga

SEQ ID NO: 634039 - DNA, 20 bp, mouse
ggcgcataactggatgggaa

SEQ ID NO: 634040 - DNA, 20 bp, mouse
gtatgcgctgatgcagcggc

SEQ ID NO: 634041 - DNA, 20 bp, mouse
gacagctgaggcctctacat

SEQ ID NO: 634042 - DNA, 20 bp, mouse
gagtgtcctcagaactgctg

SEQ ID NO: 634043 - DNA, 20 bp, mouse
gtcaggggttgctatagcaa

SEQ ID NO: 634044 - DNA, 20 bp, mouse
gtacaaacccagtgccgctc

SEQ ID NO: 634045 - DNA, 20 bp, mouse
ggtgtagctggtgtaagtca

SEQ ID NO: 634046 - DNA, 20 bp, mouse
gctcccacgggaggacgcaa

SEQ ID NO: 634047 - DNA, 20 bp, mouse
ggggcggagtctgggatgat

SEQ ID NO: 634048 - DNA, 20 bp, mouse
gcctcccgtgggaggggtta

SEQ ID NO: 634049 - DNA, 20 bp, mouse
ggggtagcctacccggaagt

SEQ ID NO: 634050 - DNA, 20 bp, mouse
ggaggacgcaaaggctctgt

SEQ ID NO: 634051 - DNA, 20 bp, mouse
gagcctttgcgtcctcccgt

SEQ ID NO: 634052 - DNA, 20 bp, mouse
gaggccgcccacttccgggt

SEQ ID NO: 634053 - DNA, 20 bp, mouse
gtccgccctaacccctccca

SEQ ID NO: 634054 - DNA, 20 bp, mouse
gcggaaggcgcgggactcct

SEQ ID NO: 634055 - DNA, 20 bp, mouse
ggcaagctgtgctcaagatt

SEQ ID NO: 634056 - DNA, 20 bp, mouse
gacccaagccacagagtcgg

SEQ ID NO: 634057 - DNA, 20 bp, mouse
gaacccccgactctgtggct

SEQ ID NO: 634058 - DNA, 20 bp, mouse
ggttgggttgcctgaataaa

SEQ ID NO: 634059 - DNA, 20 bp, mouse
gtgggcgatgcaggcttctg

SEQ ID NO: 634060 - DNA, 20 bp, mouse
gcagacccaagccacagagt

SEQ ID NO: 634061 - DNA, 20 bp, mouse
ggtggcttgggtctgagacg

SEQ ID NO: 634062 - DNA, 20 bp, mouse
ggacactccgggtgctcaga

SEQ ID NO: 634063 - DNA, 20 bp, mouse
gtgagacgtggcagggatag

SEQ ID NO: 634064 - DNA, 20 bp, mouse
gtcgctgggacagaatgttg

SEQ ID NO: 634065 - DNA, 20 bp, mouse
gggcagggataggggtgact

SEQ ID NO: 634066 - DNA, 20 bp, mouse
gcacgccagccgcgtcgcta

SEQ ID NO: 634067 - DNA, 20 bp, mouse
ggcgacgcggctggcgtggt

SEQ ID NO: 634068 - DNA, 20 bp, mouse
gggaaagtgggctggacggt

SEQ ID NO: 634069 - DNA, 20 bp, mouse
gtgcgacaagctcccttgag

SEQ ID NO: 634070 - DNA, 20 bp, mouse
gggtgagttccggggaaagt

SEQ ID NO: 634071 - DNA, 20 bp, mouse
gcgcgtcgctatggttacgg

SEQ ID NO: 634072 - DNA, 20 bp, mouse
gggcgtggtcggtgagttcc

SEQ ID NO: 634073 - DNA, 20 bp, mouse
ggtgggctggacggtcggtg

SEQ ID NO: 634074 - DNA, 20 bp, mouse
gagttccggggaaagtgggc

SEQ ID NO: 634075 - DNA, 20 bp, mouse
gcctgctcccggatggcgga

SEQ ID NO: 634076 - DNA, 20 bp, mouse
gtggaggaggaatacagcca

SEQ ID NO: 634077 - DNA, 20 bp, mouse
gcatgctctgaggcacaggt

SEQ ID NO: 634078 - DNA, 20 bp, mouse
gtgacagagggtggatctgt

SEQ ID NO: 634079 - DNA, 20 bp, mouse
gcccttgtgccttgtgacag

SEQ ID NO: 634080 - DNA, 20 bp, mouse
gatggctgtctgcacgtccc

SEQ ID NO: 634081 - DNA, 20 bp, mouse
gtgtgctgtgtggccctagg

SEQ ID NO: 634082 - DNA, 20 bp, mouse
gtgggctgtgtgatggtagg

SEQ ID NO: 634083 - DNA, 20 bp, mouse
gggctgggctgtgtgatggt

SEQ ID NO: 634084 - DNA, 20 bp, mouse
gcttggtgcaggcaggaaat

SEQ ID NO: 634085 - DNA, 20 bp, mouse
gtcatacagaacaccaccta

SEQ ID NO: 634086 - DNA, 20 bp, mouse
gcagacgctggggcgcggaa

SEQ ID NO: 634087 - DNA, 20 bp, mouse
gcttgaggacccagactcat

SEQ ID NO: 634088 - DNA, 20 bp, mouse
ggcctggggaaagatcttga

SEQ ID NO: 634089 - DNA, 20 bp, mouse
gtctgggtccccatgagtct

SEQ ID NO: 634090 - DNA, 20 bp, mouse
gtcaatcagacgctggggcg

SEQ ID NO: 634091 - DNA, 20 bp, mouse
ggagtctgggtcctcaagat

SEQ ID NO: 634092 - DNA, 20 bp, mouse
ggacctgggagatgatagag

SEQ ID NO: 634093 - DNA, 20 bp, mouse
gccagcgcaaagggcgatcg

SEQ ID NO: 634094 - DNA, 20 bp, mouse
gtggggaaagatcttgatgg

SEQ ID NO: 634095 - DNA, 20 bp, mouse
gggccaggcggagaggaagt

SEQ ID NO: 634096 - DNA, 20 bp, mouse
gaccccctggggcctggtta

SEQ ID NO: 634097 - DNA, 20 bp, mouse
ggccgaggacacaccccctg

SEQ ID NO: 634098 - DNA, 20 bp, mouse
gacgcgggcaggcagcgtgg

SEQ ID NO: 634099 - DNA, 20 bp, mouse
gggcagcgtggcggggactc

SEQ ID NO: 634100 - DNA, 20 bp, mouse
gtggccgacagcctcccgcg

SEQ ID NO: 634101 - DNA, 20 bp, mouse
ggtgcggcgcggcatgtcgc

SEQ ID NO: 634102 - DNA, 20 bp, mouse
ggccacaacgcgacgcgggc

SEQ ID NO: 634103 - DNA, 20 bp, mouse
gcccacagctccctgtctcc

SEQ ID NO: 634104 - DNA, 20 bp, mouse
gcagctgctccggaccgcgc

SEQ ID NO: 634105 - DNA, 20 bp, mouse
gggaccgcgcgggaggctgt

SEQ ID NO: 634106 - DNA, 20 bp, mouse
ggctaggccccctgagaagt

SEQ ID NO: 634107 - DNA, 20 bp, mouse
gaacccaccccacttctcag

SEQ ID NO: 634108 - DNA, 20 bp, mouse
gatctcagttatgggatgta

SEQ ID NO: 634109 - DNA, 20 bp, mouse
gtcactacattgatatggaa

SEQ ID NO: 634110 - DNA, 20 bp, mouse
gaagcagaatgaggtgcaca

SEQ ID NO: 634111 - DNA, 20 bp, mouse
ggattccactcacaatagga

SEQ ID NO: 634112 - DNA, 20 bp, mouse
gttatagaacatagaaccca

SEQ ID NO: 634113 - DNA, 20 bp, mouse
ggtctttttaatctcagtta

SEQ ID NO: 634114 - DNA, 20 bp, mouse
gtaatgttcggtgtttgaaa

SEQ ID NO: 634115 - DNA, 20 bp, mouse
gaattatcactacattgata

SEQ ID NO: 634116 - DNA, 20 bp, mouse
ggggctacttgtgtccttct

SEQ ID NO: 634117 - DNA, 20 bp, mouse
ggaggggactaagtcttgtg

SEQ ID NO: 634118 - DNA, 20 bp, mouse
gtagagtcctctgacccaga

SEQ ID NO: 634119 - DNA, 20 bp, mouse
gttgtgtccttctgggtcag

SEQ ID NO: 634120 - DNA, 20 bp, mouse
gccagggcataaggtccaaa

SEQ ID NO: 634121 - DNA, 20 bp, mouse
gaggacacaagtagcccgag

SEQ ID NO: 634122 - DNA, 20 bp, mouse
gctaaaggtgattttgttct

SEQ ID NO: 634123 - DNA, 20 bp, mouse
gttcaatgttgtaacatccc

SEQ ID NO: 634124 - DNA, 20 bp, mouse
gctgactgcatttgagtcct

SEQ ID NO: 634125 - DNA, 20 bp, mouse
gggtcctgactgcatcactg

SEQ ID NO: 634126 - DNA, 20 bp, mouse
ggtccctagccagtggtgat

SEQ ID NO: 634127 - DNA, 20 bp, mouse
gagtgcattctgtaccaata

SEQ ID NO: 634128 - DNA, 20 bp, mouse
gagtggtgataggctggtac

SEQ ID NO: 634129 - DNA, 20 bp, mouse
ggtcctgggccgggtctccc

SEQ ID NO: 634130 - DNA, 20 bp, mouse
gtagggacaggtagttccct

SEQ ID NO: 634131 - DNA, 20 bp, mouse
gagctgggtgggtaggaatc

SEQ ID NO: 634132 - DNA, 20 bp, mouse
gggctggtactggaaaacaa

SEQ ID NO: 634133 - DNA, 20 bp, mouse
gttacagatccagaccatat

SEQ ID NO: 634134 - DNA, 20 bp, mouse
gccacactgaatttactcat

SEQ ID NO: 634135 - DNA, 20 bp, mouse
ggtacagaaatccatggcaa

SEQ ID NO: 634136 - DNA, 20 bp, mouse
gtcgttggtcacaaaagtgg

SEQ ID NO: 634137 - DNA, 20 bp, mouse
gggaattggtagaggatcgt

SEQ ID NO: 634138 - DNA, 20 bp, mouse
gatagcaggtgctgagacgg

SEQ ID NO: 634139 - DNA, 20 bp, mouse
gggatcgttggtcacaaaag

SEQ ID NO: 634140 - DNA, 20 bp, mouse
ggggtccgtgtcaaataatt

SEQ ID NO: 634141 - DNA, 20 bp, mouse
ggcaaaactggaattggtag

SEQ ID NO: 634142 - DNA, 20 bp, mouse
ggaggctgggtgattcatcc

SEQ ID NO: 634143 - DNA, 20 bp, mouse
gagccccagagcatataaac

SEQ ID NO: 634144 - DNA, 20 bp, mouse
gcacctgctatctgaagaag

SEQ ID NO: 634145 - DNA, 20 bp, mouse
gctaggctagtcatgagatg

SEQ ID NO: 634146 - DNA, 20 bp, mouse
gaggactgcaaagtacttta

SEQ ID NO: 634147 - DNA, 20 bp, mouse
gttagacgctcttgtccctt

SEQ ID NO: 634148 - DNA, 20 bp, mouse
ggctcactgggtcatagagc

SEQ ID NO: 634149 - DNA, 20 bp, mouse
ggtaccaaatccacgggcct

SEQ ID NO: 634150 - DNA, 20 bp, mouse
gggcagatggctcagacctt

SEQ ID NO: 634151 - DNA, 20 bp, mouse
gaactgaacggaaacggagg

SEQ ID NO: 634152 - DNA, 20 bp, mouse
gagagccatggtcagacaac

SEQ ID NO: 634153 - DNA, 20 bp, mouse
gaagccaaggcccgtggatt

SEQ ID NO: 634154 - DNA, 20 bp, mouse
ggtggggtaggatcccatgt

SEQ ID NO: 634155 - DNA, 20 bp, mouse
gagggacttgacccattagc

SEQ ID NO: 634156 - DNA, 20 bp, mouse
gttactgtgtggctccccca

SEQ ID NO: 634157 - DNA, 20 bp, mouse
gtggctcccccaagggtccc

SEQ ID NO: 634158 - DNA, 20 bp, mouse
gacgccgccccatcctcaca

SEQ ID NO: 634159 - DNA, 20 bp, mouse
ggatggggcggcgtcttctc

SEQ ID NO: 634160 - DNA, 20 bp, mouse
gggtccctggcatccagttt

SEQ ID NO: 634161 - DNA, 20 bp, mouse
ggaaccctcgtgatccaaat

SEQ ID NO: 634162 - DNA, 20 bp, mouse
gaacacctaaactggatgcc

SEQ ID NO: 634163 - DNA, 20 bp, mouse
gcccacggaactcggggaag

SEQ ID NO: 634164 - DNA, 20 bp, mouse
gggaacccacacatgaagtg

SEQ ID NO: 634165 - DNA, 20 bp, mouse
gtggcaacccgagttcgttc

SEQ ID NO: 634166 - DNA, 20 bp, mouse
gacccctaggaccctcccag

SEQ ID NO: 634167 - DNA, 20 bp, mouse
gctaggggtcacactgtaga

SEQ ID NO: 634168 - DNA, 20 bp, mouse
gcccactgggagggtcctag

SEQ ID NO: 634169 - DNA, 20 bp, mouse
gaatacctcaccccactggg

SEQ ID NO: 634170 - DNA, 20 bp, mouse
ggcaaggggccctggtgttg

SEQ ID NO: 634171 - DNA, 20 bp, mouse
gcagacacagactcagggtc

SEQ ID NO: 634172 - DNA, 20 bp, mouse
gtgcctggaggtacccaagt

SEQ ID NO: 634173 - DNA, 20 bp, mouse
gagaaatacctcaccccact

SEQ ID NO: 634174 - DNA, 20 bp, mouse
gatgtgtcatatgaaatcac

SEQ ID NO: 634175 - DNA, 20 bp, mouse
gggcctacttgggtacctcc

SEQ ID NO: 634176 - DNA, 20 bp, mouse
ggaaggcgctggggccggaa

SEQ ID NO: 634177 - DNA, 20 bp, mouse
gaccgagtgacaggtggtgt

SEQ ID NO: 634178 - DNA, 20 bp, mouse
gtcgggtcggagggaggctc

SEQ ID NO: 634179 - DNA, 20 bp, mouse
gacaggtggtgtcgggtcgg

SEQ ID NO: 634180 - DNA, 20 bp, mouse
gccgggtgggatggcgggga

SEQ ID NO: 634181 - DNA, 20 bp, mouse
ggcggcccgggaaggcgctg

SEQ ID NO: 634182 - DNA, 20 bp, mouse
gccggccccagcgccttccc

SEQ ID NO: 634183 - DNA, 20 bp, mouse
gggggccggaagggaagtta

SEQ ID NO: 634184 - DNA, 20 bp, mouse
gggtgggaccgagtgacagg

SEQ ID NO: 634185 - DNA, 20 bp, mouse
gaggctccgggtgggatggc

SEQ ID NO: 634186 - DNA, 20 bp, mouse
gggcaagggtccgtggtggg

SEQ ID NO: 634187 - DNA, 20 bp, mouse
gctgggcaagggtccgtggt

SEQ ID NO: 634188 - DNA, 20 bp, mouse
gttcttgggcccccccacca

SEQ ID NO: 634189 - DNA, 20 bp, mouse
gtgggcagtactggcttctt

SEQ ID NO: 634190 - DNA, 20 bp, mouse
gagagccttttatacaaaag

SEQ ID NO: 634191 - DNA, 20 bp, mouse
gctttccccttttgtataaa

SEQ ID NO: 634192 - DNA, 20 bp, mouse
gatcccgtgaaagtcagata

SEQ ID NO: 634193 - DNA, 20 bp, mouse
gggaactgggcaagggtccg

SEQ ID NO: 634194 - DNA, 20 bp, mouse
gggccctatctgactttcac

SEQ ID NO: 634195 - DNA, 20 bp, mouse
gtctgactttcacgggatta

SEQ ID NO: 634196 - DNA, 20 bp, mouse
gggaactgagggggggaact

SEQ ID NO: 634197 - DNA, 20 bp, mouse
gaactgggaactgtggttta

SEQ ID NO: 634198 - DNA, 20 bp, mouse
gcggggcacagggaactgag

SEQ ID NO: 634199 - DNA, 20 bp, mouse
ggcagcagaactcggggcac

SEQ ID NO: 634200 - DNA, 20 bp, mouse
gtacccatgctgtgtgaagc

SEQ ID NO: 634201 - DNA, 20 bp, mouse
ggagctgtgggcaactggaa

SEQ ID NO: 634202 - DNA, 20 bp, mouse
gtggcagggtgggacaaaac

SEQ ID NO: 634203 - DNA, 20 bp, mouse
gaggagccccgtggctgttg

SEQ ID NO: 634204 - DNA, 20 bp, mouse
gggcctgtatgcacaggata

SEQ ID NO: 634205 - DNA, 20 bp, mouse
gtaggcctgcatgatgtcac

SEQ ID NO: 634206 - DNA, 20 bp, mouse
gtgctgggaatcagatgtag

SEQ ID NO: 634207 - DNA, 20 bp, mouse
gccccctggcagttcctacc

SEQ ID NO: 634208 - DNA, 20 bp, mouse
gttccaggtaggaactgcca

SEQ ID NO: 634209 - DNA, 20 bp, mouse
ggaatcagatgtagaggact

SEQ ID NO: 634210 - DNA, 20 bp, mouse
ggaaagccaggtctctttca

SEQ ID NO: 634211 - DNA, 20 bp, mouse
gacccagggctgtttgtttc

SEQ ID NO: 634212 - DNA, 20 bp, mouse
ggtaagctccctgtgaccca

SEQ ID NO: 634213 - DNA, 20 bp, mouse
gaacctagaaggaggcgtca

SEQ ID NO: 634214 - DNA, 20 bp, mouse
ggtggtgaaaagaacctaga

SEQ ID NO: 634215 - DNA, 20 bp, mouse
gtaagtggatgctgagacca

SEQ ID NO: 634216 - DNA, 20 bp, mouse
gcccaagtgtgctaagtgat

SEQ ID NO: 634217 - DNA, 20 bp, mouse
gtgcaagaaactgagcgtgg

SEQ ID NO: 634218 - DNA, 20 bp, mouse
ggaccttgaggctagaagag

SEQ ID NO: 634219 - DNA, 20 bp, mouse
ggtgtgctaagtgataggaa

SEQ ID NO: 634220 - DNA, 20 bp, mouse
gtgataggaaaggcggtctt

SEQ ID NO: 634221 - DNA, 20 bp, mouse
gcttgaggctagaagagtgg

SEQ ID NO: 634222 - DNA, 20 bp, mouse
ggaagagtggcggataactt

SEQ ID NO: 634223 - DNA, 20 bp, mouse
gaaggcggtcttaggccagc

SEQ ID NO: 634224 - DNA, 20 bp, mouse
gtgctaagtgataggaaagg

SEQ ID NO: 634225 - DNA, 20 bp, mouse
gtgacatgagctagagcacg

SEQ ID NO: 634226 - DNA, 20 bp, mouse
gagtgcaggtgtgcccgagt

SEQ ID NO: 634227 - DNA, 20 bp, mouse
gcaggcataaagccttcctt

SEQ ID NO: 634228 - DNA, 20 bp, mouse
gctggaacttaacccaagga

SEQ ID NO: 634229 - DNA, 20 bp, mouse
gtgcccgagtgggagttgtg

SEQ ID NO: 634230 - DNA, 20 bp, mouse
gcatcacgataagatgggcg

SEQ ID NO: 634231 - DNA, 20 bp, mouse
gtccagcatcacgataagat

SEQ ID NO: 634232 - DNA, 20 bp, mouse
ggatgctggaacttaaccca

SEQ ID NO: 634233 - DNA, 20 bp, mouse
gtgaccctgaaataacaata

SEQ ID NO: 634234 - DNA, 20 bp, mouse
ggcagcgtcccaagacaacc

SEQ ID NO: 634235 - DNA, 20 bp, mouse
gtgggacgctgccactacgc

SEQ ID NO: 634236 - DNA, 20 bp, mouse
gcgtcggtgcgtcgtctcta

SEQ ID NO: 634237 - DNA, 20 bp, mouse
gtcaggcaaggcacacttga

SEQ ID NO: 634238 - DNA, 20 bp, mouse
gacgcccagaggccgtgcgt

SEQ ID NO: 634239 - DNA, 20 bp, mouse
gtggtggcggcggatttgga

SEQ ID NO: 634240 - DNA, 20 bp, mouse
gtggagggaccttaggatcg

SEQ ID NO: 634241 - DNA, 20 bp, mouse
gaggccccgctgagggtccc

SEQ ID NO: 634242 - DNA, 20 bp, mouse
ggcctgacgccgcgatccta

SEQ ID NO: 634243 - DNA, 20 bp, mouse
ggggctctctccagctccgt

SEQ ID NO: 634244 - DNA, 20 bp, mouse
gagtcacggcacgacaaata

SEQ ID NO: 634245 - DNA, 20 bp, mouse
gtacctgaaggcccacgcca

SEQ ID NO: 634246 - DNA, 20 bp, mouse
gactcccctaccccattcaa

SEQ ID NO: 634247 - DNA, 20 bp, mouse
gaatgatacttaagtaatta

SEQ ID NO: 634248 - DNA, 20 bp, mouse
gaagtaattatggaagaatg

SEQ ID NO: 634249 - DNA, 20 bp, mouse
gcattcaaaactgacatttt

SEQ ID NO: 634250 - DNA, 20 bp, mouse
gtgacatttttggttacatg

SEQ ID NO: 634251 - DNA, 20 bp, mouse
gatttttggttacatgtgga

SEQ ID NO: 634252 - DNA, 20 bp, mouse
gtgaaccattgaatggggta

SEQ ID NO: 634253 - DNA, 20 bp, mouse
ggtgggagcaggcattaggg

SEQ ID NO: 634254 - DNA, 20 bp, mouse
gaatgctaaattcaccagat

SEQ ID NO: 634255 - DNA, 20 bp, mouse
ggaatgaatatcttcctatc

SEQ ID NO: 634256 - DNA, 20 bp, mouse
gcagaagaggtcatagacag

SEQ ID NO: 634257 - DNA, 20 bp, mouse
gcccctgggagttacagggg

SEQ ID NO: 634258 - DNA, 20 bp, mouse
ggaggagcagagttttggtg

SEQ ID NO: 634259 - DNA, 20 bp, mouse
gctcctcccctgtaactccc

SEQ ID NO: 634260 - DNA, 20 bp, mouse
ggagtagagggggacttcta

SEQ ID NO: 634261 - DNA, 20 bp, mouse
gcggccctgccctctaacca

SEQ ID NO: 634262 - DNA, 20 bp, mouse
ggtgcttaagggtgagtaga

SEQ ID NO: 634263 - DNA, 20 bp, mouse
gtgtaactcccaggggaatc

SEQ ID NO: 634264 - DNA, 20 bp, mouse
gactggggcccctggttaga

SEQ ID NO: 634265 - DNA, 20 bp, mouse
gagtcctgctctaagtctgt

SEQ ID NO: 634266 - DNA, 20 bp, mouse
ggttagcttggtaaaaacca

SEQ ID NO: 634267 - DNA, 20 bp, mouse
gactataaacatttggagat

SEQ ID NO: 634268 - DNA, 20 bp, mouse
gacacactatgatctgtacc

SEQ ID NO: 634269 - DNA, 20 bp, mouse
gacactggagtttggggata

SEQ ID NO: 634270 - DNA, 20 bp, mouse
gacaagaagccaggctgagt

SEQ ID NO: 634271 - DNA, 20 bp, mouse
gtgagagcacactggagttt

SEQ ID NO: 634272 - DNA, 20 bp, mouse
gccagtgtgctctcatagcc

SEQ ID NO: 634273 - DNA, 20 bp, mouse
gtgagcctctgaatggaata

SEQ ID NO: 634274 - DNA, 20 bp, mouse
gttggatgagacaagaagcc

SEQ ID NO: 634275 - DNA, 20 bp, mouse
gtatactgtcgtcatagaat

SEQ ID NO: 634276 - DNA, 20 bp, mouse
gcgggaagggcggctggaat

SEQ ID NO: 634277 - DNA, 20 bp, mouse
gaccttgagaagaggggtgt

SEQ ID NO: 634278 - DNA, 20 bp, mouse
gcctctgggaccttgagaag

SEQ ID NO: 634279 - DNA, 20 bp, mouse
gcagagggcggggcggacag

SEQ ID NO: 634280 - DNA, 20 bp, mouse
ggcggctggaatgggtcctc

SEQ ID NO: 634281 - DNA, 20 bp, mouse
gttggggcggggtctggcta

SEQ ID NO: 634282 - DNA, 20 bp, mouse
gacttgagttcttgtctctt

SEQ ID NO: 634283 - DNA, 20 bp, mouse
gagacaagaactcaagtccc

SEQ ID NO: 634284 - DNA, 20 bp, mouse
gtgagttcttgtctcttggg

SEQ ID NO: 634285 - DNA, 20 bp, mouse
gaacgcgacgccagaggctt

SEQ ID NO: 634286 - DNA, 20 bp, mouse
gccagcgtgaaggggggcgg

SEQ ID NO: 634287 - DNA, 20 bp, mouse
gaggaagccagcgtgaaggg

SEQ ID NO: 634288 - DNA, 20 bp, mouse
ggagaggaagccagcgtgaa

SEQ ID NO: 634289 - DNA, 20 bp, mouse
gagtacactagaatttgggc

SEQ ID NO: 634290 - DNA, 20 bp, mouse
ggaagattctgtggtagtct

SEQ ID NO: 634291 - DNA, 20 bp, mouse
gataaagcccatgtgtcatt

SEQ ID NO: 634292 - DNA, 20 bp, mouse
gattgtaagggcattatgag

SEQ ID NO: 634293 - DNA, 20 bp, mouse
ggaaaataacattctctatc

SEQ ID NO: 634294 - DNA, 20 bp, mouse
gaagccagcgtgaagggggg

SEQ ID NO: 634295 - DNA, 20 bp, mouse
gaaggactaaaaagagtacc

SEQ ID NO: 634296 - DNA, 20 bp, mouse
gcagggacaagtctcagcgg

SEQ ID NO: 634297 - DNA, 20 bp, mouse
ggatggggtgcgggacaatc

SEQ ID NO: 634298 - DNA, 20 bp, mouse
gagcatgtttagttgtctct

SEQ ID NO: 634299 - DNA, 20 bp, mouse
gttacccagttatgacatca

SEQ ID NO: 634300 - DNA, 20 bp, mouse
gtaacccagagcagtgccac

SEQ ID NO: 634301 - DNA, 20 bp, mouse
gcaggaccatgtcaggagga

SEQ ID NO: 634302 - DNA, 20 bp, mouse
gaggctcacaaagggaggtt

SEQ ID NO: 634303 - DNA, 20 bp, mouse
gcgagcctgtggcactgctc

SEQ ID NO: 634304 - DNA, 20 bp, mouse
gcaagtctcagcggaggaag

SEQ ID NO: 634305 - DNA, 20 bp, mouse
gggcagaggctcacaaaggg

SEQ ID NO: 634306 - DNA, 20 bp, mouse
ggggccaaactgtacagaga

SEQ ID NO: 634307 - DNA, 20 bp, mouse
gctactctggttgcattcca

SEQ ID NO: 634308 - DNA, 20 bp, mouse
gagaatgggagattctactc

SEQ ID NO: 634309 - DNA, 20 bp, mouse
ggagggcgctcccgctctga

SEQ ID NO: 634310 - DNA, 20 bp, mouse
ggcgccctctctgtacagtt

SEQ ID NO: 634311 - DNA, 20 bp, mouse
gcagcacagtgagcctagaa

SEQ ID NO: 634312 - DNA, 20 bp, mouse
gcaaggagttctactgagaa

SEQ ID NO: 634313 - DNA, 20 bp, mouse
gaacgtcacagggatatcca

SEQ ID NO: 634314 - DNA, 20 bp, mouse
gcatagaaggtccttcagag

SEQ ID NO: 634315 - DNA, 20 bp, mouse
gagatgctcctcaacgtcac

SEQ ID NO: 634316 - DNA, 20 bp, mouse
gccccagccggatccctggg

SEQ ID NO: 634317 - DNA, 20 bp, mouse
ggggagcggtcagccctgca

SEQ ID NO: 634318 - DNA, 20 bp, mouse
gagggcaaacccaacttttt

SEQ ID NO: 634319 - DNA, 20 bp, mouse
gagagtatcccggaaatcta

SEQ ID NO: 634320 - DNA, 20 bp, mouse
gtagaagccgcccagggatc

SEQ ID NO: 634321 - DNA, 20 bp, mouse
ggcaccttcggactttgcta

SEQ ID NO: 634322 - DNA, 20 bp, mouse
gcagggctgaccgctcccag

SEQ ID NO: 634323 - DNA, 20 bp, mouse
gtgggcggcttctaacccct

SEQ ID NO: 634324 - DNA, 20 bp, mouse
gctgccccagccggatccct

SEQ ID NO: 634325 - DNA, 20 bp, mouse
gctaggggaaatagtcttgc

SEQ ID NO: 634326 - DNA, 20 bp, mouse
gacaacttgcccaaacacat

SEQ ID NO: 634327 - DNA, 20 bp, mouse
gcacttgttcccatgtgttt

SEQ ID NO: 634328 - DNA, 20 bp, mouse
ggaggctaaaagggagaatt

SEQ ID NO: 634329 - DNA, 20 bp, mouse
gctagccagtcttctattaa

SEQ ID NO: 634330 - DNA, 20 bp, mouse
gaactcaatcataaacctat

SEQ ID NO: 634331 - DNA, 20 bp, mouse
gggcatcatatcatacttta

SEQ ID NO: 634332 - DNA, 20 bp, mouse
gaaggtattccaaaccagaa

SEQ ID NO: 634333 - DNA, 20 bp, mouse
gaatttctccagaggctaaa

SEQ ID NO: 634334 - DNA, 20 bp, mouse
gaaagccattaatagaagac

SEQ ID NO: 634335 - DNA, 20 bp, mouse
ggcatttcttatgcctggaa

SEQ ID NO: 634336 - DNA, 20 bp, mouse
gaagtctagaatcttcccga

SEQ ID NO: 634337 - DNA, 20 bp, mouse
gtcccgagggcgaataacaa

SEQ ID NO: 634338 - DNA, 20 bp, mouse
gaggtggggcggtcttttgt

SEQ ID NO: 634339 - DNA, 20 bp, mouse
gagtcccagaaaaaggtcag

SEQ ID NO: 634340 - DNA, 20 bp, mouse
gctgcctcctagtgcatttt

SEQ ID NO: 634341 - DNA, 20 bp, mouse
gttggctagcagctagctgt

SEQ ID NO: 634342 - DNA, 20 bp, mouse
gcttccacacgctgctcctc

SEQ ID NO: 634343 - DNA, 20 bp, mouse
gctccctgaggagcagcgtg

SEQ ID NO: 634344 - DNA, 20 bp, mouse
gaagtcacctgatcaggagg

SEQ ID NO: 634345 - DNA, 20 bp, mouse
ggacagacttgtacttgctc

SEQ ID NO: 634346 - DNA, 20 bp, mouse
gcacacacgtagtgagcatt

SEQ ID NO: 634347 - DNA, 20 bp, mouse
ggcttgatgacacggagtgg

SEQ ID NO: 634348 - DNA, 20 bp, mouse
gcttgcttgatgacacggag

SEQ ID NO: 634349 - DNA, 20 bp, mouse
gggttaaatctcagagtggt

SEQ ID NO: 634350 - DNA, 20 bp, mouse
gaatctatggagactatgat

SEQ ID NO: 634351 - DNA, 20 bp, mouse
gtcatgcttgcttgatgaca

SEQ ID NO: 634352 - DNA, 20 bp, mouse
gctatgataggttcccaccc

SEQ ID NO: 634353 - DNA, 20 bp, mouse
gaatgactacattttcagtt

SEQ ID NO: 634354 - DNA, 20 bp, mouse
ggtgtgtttatgagagacac

SEQ ID NO: 634355 - DNA, 20 bp, mouse
gtgataggttcccacccagg

SEQ ID NO: 634356 - DNA, 20 bp, mouse
gtcagtaagcctttgttata

SEQ ID NO: 634357 - DNA, 20 bp, mouse
gcagaactaccttataacaa

SEQ ID NO: 634358 - DNA, 20 bp, mouse
gggagatatagtctagctga

SEQ ID NO: 634359 - DNA, 20 bp, mouse
gatttcacactaatgtttga

SEQ ID NO: 634360 - DNA, 20 bp, mouse
gagcaagcatatggagggtg

SEQ ID NO: 634361 - DNA, 20 bp, mouse
gaaaatgttaaggcattcaa

SEQ ID NO: 634362 - DNA, 20 bp, mouse
gaatacaagcagttctgtac

SEQ ID NO: 634363 - DNA, 20 bp, mouse
gggtggggctgatcacactc

SEQ ID NO: 634364 - DNA, 20 bp, mouse
gtggcattatgtttttcttt

SEQ ID NO: 634365 - DNA, 20 bp, mouse
gtagtctagctgaaggaagt

SEQ ID NO: 634366 - DNA, 20 bp, mouse
gtggactcttgatctgtagg

SEQ ID NO: 634367 - DNA, 20 bp, mouse
ggtgggccccataatttcaa

SEQ ID NO: 634368 - DNA, 20 bp, mouse
ggtggacttcctggggaaca

SEQ ID NO: 634369 - DNA, 20 bp, mouse
gcccctctccctggctgcta

SEQ ID NO: 634370 - DNA, 20 bp, mouse
gaaattatggggcccacatg

SEQ ID NO: 634371 - DNA, 20 bp, mouse
gggagagggggatatcagca

SEQ ID NO: 634372 - DNA, 20 bp, mouse
gacttcctggggaacaaggt

SEQ ID NO: 634373 - DNA, 20 bp, mouse
gaaaggatagtggacttcct

SEQ ID NO: 634374 - DNA, 20 bp, mouse
gagggggatatcagcaggga

SEQ ID NO: 634375 - DNA, 20 bp, mouse
gaactcccaccttgttcccc

SEQ ID NO: 634376 - DNA, 20 bp, mouse
gaacgtgagaaaagtgtcat

SEQ ID NO: 634377 - DNA, 20 bp, mouse
gagggtgacaagattggtga

SEQ ID NO: 634378 - DNA, 20 bp, mouse
gcaagggcctgcctggataa

SEQ ID NO: 634379 - DNA, 20 bp, mouse
gcacaggtccgaactcacaa

SEQ ID NO: 634380 - DNA, 20 bp, mouse
gcatagacgagacagctaaa

SEQ ID NO: 634381 - DNA, 20 bp, mouse
gaggaatgggcctgggagaa

SEQ ID NO: 634382 - DNA, 20 bp, mouse
gcaatgtgagagcaaggctg

SEQ ID NO: 634383 - DNA, 20 bp, mouse
ggggactctattgtcagaag

SEQ ID NO: 634384 - DNA, 20 bp, mouse
ggagacggaagtagagttgc

SEQ ID NO: 634385 - DNA, 20 bp, mouse
gaggggaacgggaaataggg

SEQ ID NO: 634386 - DNA, 20 bp, mouse
gttaccgtacgcacagacac

SEQ ID NO: 634387 - DNA, 20 bp, mouse
gggcattcagacatagggtg

SEQ ID NO: 634388 - DNA, 20 bp, mouse
gtcactaagtgataggtgaa

SEQ ID NO: 634389 - DNA, 20 bp, mouse
ggggataggagtctcaaagc

SEQ ID NO: 634390 - DNA, 20 bp, mouse
gagggtgtttgcttcataat

SEQ ID NO: 634391 - DNA, 20 bp, mouse
gtaaacagttgtcctgggat

SEQ ID NO: 634392 - DNA, 20 bp, mouse
ggtcacctgcagatacaacc

SEQ ID NO: 634393 - DNA, 20 bp, mouse
gccaatagaaggaaaaccgc

SEQ ID NO: 634394 - DNA, 20 bp, mouse
gaggtttaaacagttgtcct

SEQ ID NO: 634395 - DNA, 20 bp, mouse
ggaataccgagcaaaaatga

SEQ ID NO: 634396 - DNA, 20 bp, mouse
ggcacgagagggtagacggg

SEQ ID NO: 634397 - DNA, 20 bp, mouse
gagggcacgagagggtagac

SEQ ID NO: 634398 - DNA, 20 bp, mouse
gcagcccgacgaaggagaat

SEQ ID NO: 634399 - DNA, 20 bp, mouse
ggagagaggcagcccgacga

SEQ ID NO: 634400 - DNA, 20 bp, mouse
gaagccatcccccagtcaag

SEQ ID NO: 634401 - DNA, 20 bp, mouse
gccagtgggagggcacgaga

SEQ ID NO: 634402 - DNA, 20 bp, mouse
gcatggatcctcttgactgg

SEQ ID NO: 634403 - DNA, 20 bp, mouse
gttgctgtctgtccttcgac

SEQ ID NO: 634404 - DNA, 20 bp, mouse
gggctctcagataacctgca

SEQ ID NO: 634405 - DNA, 20 bp, mouse
gggtctgtgtgtccagtggg

SEQ ID NO: 634406 - DNA, 20 bp, mouse
gcccacccctatacgaagaa

SEQ ID NO: 634407 - DNA, 20 bp, mouse
gtactaaaaggatacacaaa

SEQ ID NO: 634408 - DNA, 20 bp, mouse
gatcagccattcttcgtata

SEQ ID NO: 634409 - DNA, 20 bp, mouse
gtctggagatgtgtgctcga

SEQ ID NO: 634410 - DNA, 20 bp, mouse
gacacaccgtaggagtaaca

SEQ ID NO: 634411 - DNA, 20 bp, mouse
gaatctggagtgaatgatag

SEQ ID NO: 634412 - DNA, 20 bp, mouse
gatagtggcagtgactgagc

SEQ ID NO: 634413 - DNA, 20 bp, mouse
gcttttagtaatatgaagga

SEQ ID NO: 634414 - DNA, 20 bp, mouse
gtatccttttagtaatatga

SEQ ID NO: 634415 - DNA, 20 bp, mouse
gtcttgcttctggccataaa

SEQ ID NO: 634416 - DNA, 20 bp, mouse
gcaggaggacggggtgttca

SEQ ID NO: 634417 - DNA, 20 bp, mouse
ggtaactgaggcaaatgcag

SEQ ID NO: 634418 - DNA, 20 bp, mouse
gcctctgcttccaaaatccc

SEQ ID NO: 634419 - DNA, 20 bp, mouse
gggggtgttcaaggtatcca

SEQ ID NO: 634420 - DNA, 20 bp, mouse
gaccgggagtaactcccaga

SEQ ID NO: 634421 - DNA, 20 bp, mouse
gactcccggtcagcaggggt

SEQ ID NO: 634422 - DNA, 20 bp, mouse
gggggttgggctacattctg

SEQ ID NO: 634423 - DNA, 20 bp, mouse
gcggtcctgctcagtggtcc

SEQ ID NO: 634424 - DNA, 20 bp, mouse
gagttactcccggtcagcag

SEQ ID NO: 634425 - DNA, 20 bp, mouse
gctcagtggtcctgggattt

SEQ ID NO: 634426 - DNA, 20 bp, mouse
gctaaccagcccatcggaga

SEQ ID NO: 634427 - DNA, 20 bp, mouse
gaccccgctccccttcctgt

SEQ ID NO: 634428 - DNA, 20 bp, mouse
gctccccagccctctccgat

SEQ ID NO: 634429 - DNA, 20 bp, mouse
gtgggacgcatgcagctcag

SEQ ID NO: 634430 - DNA, 20 bp, mouse
gcagcccatcggagagggct

SEQ ID NO: 634431 - DNA, 20 bp, mouse
gatgcgtgcaagaggacttg

SEQ ID NO: 634432 - DNA, 20 bp, mouse
gcatacacaacaataaagag

SEQ ID NO: 634433 - DNA, 20 bp, mouse
ggatgggctggttagctatg

SEQ ID NO: 634434 - DNA, 20 bp, mouse
gcgtttagcatgcgtgcaag

SEQ ID NO: 634435 - DNA, 20 bp, mouse
gtcccacaggaaggggagcg

SEQ ID NO: 634436 - DNA, 20 bp, mouse
gctcctccacccctattcaa

SEQ ID NO: 634437 - DNA, 20 bp, mouse
gtagaatgaaccattgaata

SEQ ID NO: 634438 - DNA, 20 bp, mouse
gcatgaaaatatcttcctac

SEQ ID NO: 634439 - DNA, 20 bp, mouse
gttcctactggtttaatata

SEQ ID NO: 634440 - DNA, 20 bp, mouse
gtctttttgttttcatctac

SEQ ID NO: 634441 - DNA, 20 bp, mouse
gttccgtatattaaaccagt

SEQ ID NO: 634442 - DNA, 20 bp, mouse
gatgaaccattgaatagggg

SEQ ID NO: 634443 - DNA, 20 bp, mouse
gataggggtggaggagtttc

SEQ ID NO: 634444 - DNA, 20 bp, mouse
gaaccattgaataggggtgg

SEQ ID NO: 634445 - DNA, 20 bp, mouse
gcacaaagcaccttgctgcc

SEQ ID NO: 634446 - DNA, 20 bp, mouse
gaaaccctactcagtcagag

SEQ ID NO: 634447 - DNA, 20 bp, mouse
ggggacctgcatctcaataa

SEQ ID NO: 634448 - DNA, 20 bp, mouse
gagagtggagcagggggtcg

SEQ ID NO: 634449 - DNA, 20 bp, mouse
ggctccactctgactgagta

SEQ ID NO: 634450 - DNA, 20 bp, mouse
gtggtccttgagaagagagc

SEQ ID NO: 634451 - DNA, 20 bp, mouse
gacctgcatctcaataaagg

SEQ ID NO: 634452 - DNA, 20 bp, mouse
gtgcatctcaataaaggtgg

SEQ ID NO: 634453 - DNA, 20 bp, mouse
gtaaaacgtaggtagctaaa

SEQ ID NO: 634454 - DNA, 20 bp, mouse
gcatatgatgtggagcagtt

SEQ ID NO: 634455 - DNA, 20 bp, mouse
gtctggatttgaggtaggag

SEQ ID NO: 634456 - DNA, 20 bp, mouse
gcctccagggctcccagacc

SEQ ID NO: 634457 - DNA, 20 bp, mouse
gctggcgcccggccacaggg

SEQ ID NO: 634458 - DNA, 20 bp, mouse
gggcgccagagttacactga

SEQ ID NO: 634459 - DNA, 20 bp, mouse
ggcagcgggggcacattcac

SEQ ID NO: 634460 - DNA, 20 bp, mouse
gcacgggatgctaaagagga

SEQ ID NO: 634461 - DNA, 20 bp, mouse
gagcacacgggatgctaaag

SEQ ID NO: 634462 - DNA, 20 bp, mouse
gagggctcccagacctggct

SEQ ID NO: 634463 - DNA, 20 bp, mouse
gaactctggcgcccggccac

SEQ ID NO: 634464 - DNA, 20 bp, mouse
gggggaaggtggcagactcc

SEQ ID NO: 634465 - DNA, 20 bp, mouse
gctccccctcagtgtaactc

SEQ ID NO: 634466 - DNA, 20 bp, mouse
gggaagctgcagtatgcaaa

SEQ ID NO: 634467 - DNA, 20 bp, mouse
gcagggcttagtggtatcca

SEQ ID NO: 634468 - DNA, 20 bp, mouse
gtgggacctattagtgctgt

SEQ ID NO: 634469 - DNA, 20 bp, mouse
gcaagggatcgattgctttg

SEQ ID NO: 634470 - DNA, 20 bp, mouse
gtctgctttgggctcactta

SEQ ID NO: 634471 - DNA, 20 bp, mouse
gctgcaagtgtgtataccca

SEQ ID NO: 634472 - DNA, 20 bp, mouse
ggacgcacatccaattcatc

SEQ ID NO: 634473 - DNA, 20 bp, mouse
gaaaccgcatcaaaggtaaa

SEQ ID NO: 634474 - DNA, 20 bp, mouse
gggaatagcagcttaaggta

SEQ ID NO: 634475 - DNA, 20 bp, mouse
ggagggaaccaaaaggagag

SEQ ID NO: 634476 - DNA, 20 bp, mouse
gacacacagcacagtcaact

SEQ ID NO: 634477 - DNA, 20 bp, mouse
gagtcaactgggtcctaagg

SEQ ID NO: 634478 - DNA, 20 bp, mouse
gacaaagatggcacatgcat

SEQ ID NO: 634479 - DNA, 20 bp, mouse
gtgcccatgtatacagttag

SEQ ID NO: 634480 - DNA, 20 bp, mouse
gtacccctaactgtatacat

SEQ ID NO: 634481 - DNA, 20 bp, mouse
gctcacttggttacaattgc

SEQ ID NO: 634482 - DNA, 20 bp, mouse
ggcccacagacatgtgccct

SEQ ID NO: 634483 - DNA, 20 bp, mouse
gtaggggtagagtgacaaga

SEQ ID NO: 634484 - DNA, 20 bp, mouse
gtcacaaaatcctcatctct

SEQ ID NO: 634485 - DNA, 20 bp, mouse
gtgtctctaaaaattccaat

SEQ ID NO: 634486 - DNA, 20 bp, mouse
gtgaagttgcccgagttctt

SEQ ID NO: 634487 - DNA, 20 bp, mouse
ggggaagcgaggcacgaggc

SEQ ID NO: 634488 - DNA, 20 bp, mouse
gtccctgtccccaccactgg

SEQ ID NO: 634489 - DNA, 20 bp, mouse
gtggtggggacagggaagcg

SEQ ID NO: 634490 - DNA, 20 bp, mouse
gtatacacaccgaagaactc

SEQ ID NO: 634491 - DNA, 20 bp, mouse
ggcgaagctgactcagtaga

SEQ ID NO: 634492 - DNA, 20 bp, mouse
gcagtagacggtctttgaga

SEQ ID NO: 634493 - DNA, 20 bp, mouse
ggaaggtcacctccagtggt

SEQ ID NO: 634494 - DNA, 20 bp, mouse
gttcttcggtgtgtatagac

SEQ ID NO: 634495 - DNA, 20 bp, mouse
ggcgcaggcttggaatcaat

SEQ ID NO: 634496 - DNA, 20 bp, mouse
gtcttgtaatggcctggggt

SEQ ID NO: 634497 - DNA, 20 bp, mouse
ggtgtgtcttgtaatggcct

SEQ ID NO: 634498 - DNA, 20 bp, mouse
gagggttgtagagaagtctt

SEQ ID NO: 634499 - DNA, 20 bp, mouse
gtaaacaattatccaacccc

SEQ ID NO: 634500 - DNA, 20 bp, mouse
gtgacttgagctaccttcga

SEQ ID NO: 634501 - DNA, 20 bp, mouse
gccctgcttcttctcctaac

SEQ ID NO: 634502 - DNA, 20 bp, mouse
gtctgaaaaactcagttaca

SEQ ID NO: 634503 - DNA, 20 bp, mouse
gtctaacaatttagctcttc

SEQ ID NO: 634504 - DNA, 20 bp, mouse
gaaggaaatgaatacattgc

SEQ ID NO: 634505 - DNA, 20 bp, mouse
gccaacatgtttactatgaa

SEQ ID NO: 634506 - DNA, 20 bp, mouse
gcatctcacaagtcagatgc

SEQ ID NO: 634507 - DNA, 20 bp, mouse
ggaagcctgtggctctgtaa

SEQ ID NO: 634508 - DNA, 20 bp, mouse
gaattgactcaacacgtaag

SEQ ID NO: 634509 - DNA, 20 bp, mouse
gcggttgtccccctgctgtc

SEQ ID NO: 634510 - DNA, 20 bp, mouse
gcaacacgtaagaggagcac

SEQ ID NO: 634511 - DNA, 20 bp, mouse
gcaagcctgtgttagggagc

SEQ ID NO: 634512 - DNA, 20 bp, mouse
gagtcaatttccagaaatga

SEQ ID NO: 634513 - DNA, 20 bp, mouse
gaaacccaggtctaatgcca

SEQ ID NO: 634514 - DNA, 20 bp, mouse
ggaatccgttacagagccac

SEQ ID NO: 634515 - DNA, 20 bp, mouse
gatcctctgccagacagcag

SEQ ID NO: 634516 - DNA, 20 bp, mouse
gagagaatcagagtggtcgt

SEQ ID NO: 634517 - DNA, 20 bp, mouse
gagtgagcatccttcatctc

SEQ ID NO: 634518 - DNA, 20 bp, mouse
gtagcgaaaatccgtgtcct

SEQ ID NO: 634519 - DNA, 20 bp, mouse
ggtgtccttggagcagacat

SEQ ID NO: 634520 - DNA, 20 bp, mouse
gttaccagccttcagagcct

SEQ ID NO: 634521 - DNA, 20 bp, mouse
ggcacggtaaagaactgcca

SEQ ID NO: 634522 - DNA, 20 bp, mouse
gggagcagacataggctttg

SEQ ID NO: 634523 - DNA, 20 bp, mouse
ggcctaagccaccatcctta

SEQ ID NO: 634524 - DNA, 20 bp, mouse
gtggtataccttaaggatgg

SEQ ID NO: 634525 - DNA, 20 bp, mouse
gatattatgtcaataccaat

SEQ ID NO: 634526 - DNA, 20 bp, mouse
gggagctgagagctatggag

SEQ ID NO: 634527 - DNA, 20 bp, mouse
ggctctcagctccaatcgcc

SEQ ID NO: 634528 - DNA, 20 bp, mouse
gtgagagctatggagggggt

SEQ ID NO: 634529 - DNA, 20 bp, mouse
gcagggaggaaccaggcgat

SEQ ID NO: 634530 - DNA, 20 bp, mouse
gtcttcgggttcccggtgag

SEQ ID NO: 634531 - DNA, 20 bp, mouse
gagtaataagacagttcgga

SEQ ID NO: 634532 - DNA, 20 bp, mouse
gggactaggctgaaacaggg

SEQ ID NO: 634533 - DNA, 20 bp, mouse
gggtgagtggcccttctgag

SEQ ID NO: 634534 - DNA, 20 bp, mouse
ggctggactaggctgaaaca

SEQ ID NO: 634535 - DNA, 20 bp, mouse
ggtccagcgtgctcaaccag

SEQ ID NO: 634536 - DNA, 20 bp, mouse
gcaaagagaactacagaggg

SEQ ID NO: 634537 - DNA, 20 bp, mouse
gttgggctggggacaagcag

SEQ ID NO: 634538 - DNA, 20 bp, mouse
gatagcacagatgtgtcagt

SEQ ID NO: 634539 - DNA, 20 bp, mouse
gggaactgcctgtacccaag

SEQ ID NO: 634540 - DNA, 20 bp, mouse
gataactaaatccttttgtg

SEQ ID NO: 634541 - DNA, 20 bp, mouse
gcaaaaacccagagttgggc

SEQ ID NO: 634542 - DNA, 20 bp, mouse
gcaactctgggtttttgcat

SEQ ID NO: 634543 - DNA, 20 bp, mouse
ggcgctaatgagatgcagag

SEQ ID NO: 634544 - DNA, 20 bp, mouse
gacagggcaattcatcttca

SEQ ID NO: 634545 - DNA, 20 bp, mouse
gtgatggaaacttgcacaca

SEQ ID NO: 634546 - DNA, 20 bp, mouse
gggacctccccccctctcag

SEQ ID NO: 634547 - DNA, 20 bp, mouse
ggtcggctgaagaatgggtg

SEQ ID NO: 634548 - DNA, 20 bp, mouse
gtcctctagtgcctgttctt

SEQ ID NO: 634549 - DNA, 20 bp, mouse
ggttctctgcacatcttccc

SEQ ID NO: 634550 - DNA, 20 bp, mouse
gccattcttcagccgaccaa

SEQ ID NO: 634551 - DNA, 20 bp, mouse
ggttggcaatgtcatcccta

SEQ ID NO: 634552 - DNA, 20 bp, mouse
gtgtccacctctgagagggg

SEQ ID NO: 634553 - DNA, 20 bp, mouse
gcctgttcttcggaacccta

SEQ ID NO: 634554 - DNA, 20 bp, mouse
gtccgaagaacaggcactag

SEQ ID NO: 634555 - DNA, 20 bp, mouse
gcatttccctcaagtgtcat

SEQ ID NO: 634556 - DNA, 20 bp, mouse
ggtatagctgagagtcacaa

SEQ ID NO: 634557 - DNA, 20 bp, mouse
gctggaacgcaaggcgtctg

SEQ ID NO: 634558 - DNA, 20 bp, mouse
gaagctggggcctttccgtg

SEQ ID NO: 634559 - DNA, 20 bp, mouse
gtggaggcccggagcatctg

SEQ ID NO: 634560 - DNA, 20 bp, mouse
gcaacagcctacctgctagc

SEQ ID NO: 634561 - DNA, 20 bp, mouse
gtccgggtgagtgttagggt

SEQ ID NO: 634562 - DNA, 20 bp, mouse
gtccgtggggtctgtagcta

SEQ ID NO: 634563 - DNA, 20 bp, mouse
gaaggctcctgctagcaggt

SEQ ID NO: 634564 - DNA, 20 bp, mouse
gcccagggcctgtgggaaat

SEQ ID NO: 634565 - DNA, 20 bp, mouse
gtccttagctacagacccca

SEQ ID NO: 634566 - DNA, 20 bp, mouse
gagatttttacaatctgaca

SEQ ID NO: 634567 - DNA, 20 bp, mouse
gctaggttttagaatctaat

SEQ ID NO: 634568 - DNA, 20 bp, mouse
gttttagaatctaataggat

SEQ ID NO: 634569 - DNA, 20 bp, mouse
gggataggtaacatttatca

SEQ ID NO: 634570 - DNA, 20 bp, mouse
ggccacacatatgattccta

SEQ ID NO: 634571 - DNA, 20 bp, mouse
gattcctaaggcctgaagtt

SEQ ID NO: 634572 - DNA, 20 bp, mouse
ggccttaggaatcatatgtg

SEQ ID NO: 634573 - DNA, 20 bp, mouse
ggttcccaacttcaggcctt

SEQ ID NO: 634574 - DNA, 20 bp, mouse
ggatatgatgaaatgtttct

SEQ ID NO: 634575 - DNA, 20 bp, mouse
ggagtctagttcccaacttc

SEQ ID NO: 634576 - DNA, 20 bp, mouse
gagaaggggaatgctagtgc

SEQ ID NO: 634577 - DNA, 20 bp, mouse
ggggaatgctagtgcgggtg

SEQ ID NO: 634578 - DNA, 20 bp, mouse
gggggggtgggtggctggtt

SEQ ID NO: 634579 - DNA, 20 bp, mouse
gcagaagcagttggttctgg

SEQ ID NO: 634580 - DNA, 20 bp, mouse
gaaaacagtagtgaaagttc

SEQ ID NO: 634581 - DNA, 20 bp, mouse
gaaatgggagagtagatgca

SEQ ID NO: 634582 - DNA, 20 bp, mouse
gaatgctagtgcgggtgagg

SEQ ID NO: 634583 - DNA, 20 bp, mouse
gtgggagagtagatgcaggg

SEQ ID NO: 634584 - DNA, 20 bp, mouse
ggactctgggcagaagcagt

SEQ ID NO: 634585 - DNA, 20 bp, mouse
gaagatttcagcaagagtgg

SEQ ID NO: 634586 - DNA, 20 bp, mouse
gagagacaatgggtgagatg

SEQ ID NO: 634587 - DNA, 20 bp, mouse
ggtgagatgaggatctgatt

SEQ ID NO: 634588 - DNA, 20 bp, mouse
gatgaggatctgattgggat

SEQ ID NO: 634589 - DNA, 20 bp, mouse
gttcatcctgtctatgacaa

SEQ ID NO: 634590 - DNA, 20 bp, mouse
gggcatcagtctacctgata

SEQ ID NO: 634591 - DNA, 20 bp, mouse
gaaagctgtatgagaggtat

SEQ ID NO: 634592 - DNA, 20 bp, mouse
gcatgtaaaagctgtatgag

SEQ ID NO: 634593 - DNA, 20 bp, mouse
gatcatagcttcagagacaa

SEQ ID NO: 634594 - DNA, 20 bp, mouse
gactatcccttgtcatagac

SEQ ID NO: 634595 - DNA, 20 bp, mouse
ggtcatagctatggtcactt

SEQ ID NO: 634596 - DNA, 20 bp, mouse
gaagaaggctccttgagagg

SEQ ID NO: 634597 - DNA, 20 bp, mouse
gaggaggctgctgtgaatgg

SEQ ID NO: 634598 - DNA, 20 bp, mouse
ggagaggaggctgctgtgaa

SEQ ID NO: 634599 - DNA, 20 bp, mouse
gcctggcggttcaactaaga

SEQ ID NO: 634600 - DNA, 20 bp, mouse
ggcgacctggatacgcactc

SEQ ID NO: 634601 - DNA, 20 bp, mouse
gcgcagaaatcccatgcctt

SEQ ID NO: 634602 - DNA, 20 bp, mouse
gcactctaggagaccatccc

SEQ ID NO: 634603 - DNA, 20 bp, mouse
gggctccagagtgcgtatcc

SEQ ID NO: 634604 - DNA, 20 bp, mouse
gcgctggcttcccaaggcat

SEQ ID NO: 634605 - DNA, 20 bp, mouse
gatcccgggtcccaattgtt

SEQ ID NO: 634606 - DNA, 20 bp, mouse
gttggggaacccattctcgg

SEQ ID NO: 634607 - DNA, 20 bp, mouse
ggcaacctgccagaacagat

SEQ ID NO: 634608 - DNA, 20 bp, mouse
gccgaccaggccccagcctc

SEQ ID NO: 634609 - DNA, 20 bp, mouse
ggtctggagcggcagaaaga

SEQ ID NO: 634610 - DNA, 20 bp, mouse
ggccagccagaagtgtgttt

SEQ ID NO: 634611 - DNA, 20 bp, mouse
ggctagcccaaacacacttc

SEQ ID NO: 634612 - DNA, 20 bp, mouse
ggggaagcagctctctgtag

SEQ ID NO: 634613 - DNA, 20 bp, mouse
ggcctggtcggaatgacccc

SEQ ID NO: 634614 - DNA, 20 bp, mouse
gaggacgtgggctgcttgtt

SEQ ID NO: 634615 - DNA, 20 bp, mouse
gctagtagttcctgcccctg

SEQ ID NO: 634616 - DNA, 20 bp, mouse
gtgggtggggcaccccgtgg

SEQ ID NO: 634617 - DNA, 20 bp, mouse
gagaaggcgcaaatccaaca

SEQ ID NO: 634618 - DNA, 20 bp, mouse
gggccccatcgacaaggaga

SEQ ID NO: 634619 - DNA, 20 bp, mouse
gatgtggatggtagcgacac

SEQ ID NO: 634620 - DNA, 20 bp, mouse
ggggtcatgtaggttggtat

SEQ ID NO: 634621 - DNA, 20 bp, mouse
ggcaaggatcagggctttgt

SEQ ID NO: 634622 - DNA, 20 bp, mouse
gtcaaggagcagcccaccac

SEQ ID NO: 634623 - DNA, 20 bp, mouse
gaatgccgcgcatgcgtgtg

SEQ ID NO: 634624 - DNA, 20 bp, mouse
ggcgacacaggcaaggatca

SEQ ID NO: 634625 - DNA, 20 bp, mouse
ggtagcagaaatctgagtgt

SEQ ID NO: 634626 - DNA, 20 bp, mouse
gtgactccccctctgtctca

SEQ ID NO: 634627 - DNA, 20 bp, mouse
gaagactatccctgagacag

SEQ ID NO: 634628 - DNA, 20 bp, mouse
ggacccggggacggagacat

SEQ ID NO: 634629 - DNA, 20 bp, mouse
gtgtcactcaaggactagct

SEQ ID NO: 634630 - DNA, 20 bp, mouse
gaatggagaactaagtcact

SEQ ID NO: 634631 - DNA, 20 bp, mouse
gtcggagagttattgcgtga

SEQ ID NO: 634632 - DNA, 20 bp, mouse
ggtctaatgggcatttccct

SEQ ID NO: 634633 - DNA, 20 bp, mouse
gtgcacagctcgaagcacga

SEQ ID NO: 634634 - DNA, 20 bp, mouse
gcaggatgttgtatactgaa

SEQ ID NO: 634635 - DNA, 20 bp, mouse
ggaagcacgagggtgaggtt

SEQ ID NO: 634636 - DNA, 20 bp, mouse
gacaacccggccaacctctc

SEQ ID NO: 634637 - DNA, 20 bp, mouse
gaactggctaatggaatcat

SEQ ID NO: 634638 - DNA, 20 bp, mouse
gtcacacgcccgctcctgag

SEQ ID NO: 634639 - DNA, 20 bp, mouse
gcggccaacctctcaggagc

SEQ ID NO: 634640 - DNA, 20 bp, mouse
gcatggaagcagaaagataa

SEQ ID NO: 634641 - DNA, 20 bp, mouse
gtggggaggttagagtgtag

SEQ ID NO: 634642 - DNA, 20 bp, mouse
gacgcccgctcctgagaggt

SEQ ID NO: 634643 - DNA, 20 bp, mouse
gaaaaaggacacatatgaca

SEQ ID NO: 634644 - DNA, 20 bp, mouse
ggttagagtgtagtggagat

SEQ ID NO: 634645 - DNA, 20 bp, mouse
gtcctaacctaactggctaa

SEQ ID NO: 634646 - DNA, 20 bp, mouse
gaaactgcacgtggtattca

SEQ ID NO: 634647 - DNA, 20 bp, mouse
gtgtccgctggacttgatca

SEQ ID NO: 634648 - DNA, 20 bp, mouse
gcaaaccaagtaggctttga

SEQ ID NO: 634649 - DNA, 20 bp, mouse
gaacttcaagatcacactcc

SEQ ID NO: 634650 - DNA, 20 bp, mouse
gccacgtgcagtttgtccgc

SEQ ID NO: 634651 - DNA, 20 bp, mouse
gagggcccagcgcccagggc

SEQ ID NO: 634652 - DNA, 20 bp, mouse
gacaggagggcccagcgccc

SEQ ID NO: 634653 - DNA, 20 bp, mouse
gggcatgaaagggtcagaac

SEQ ID NO: 634654 - DNA, 20 bp, mouse
gtgaggcatgctatcctgaa

SEQ ID NO: 634655 - DNA, 20 bp, mouse
gcttgagactagtgcacacc

SEQ ID NO: 634656 - DNA, 20 bp, mouse
gcctcctgaacactggtgtt

SEQ ID NO: 634657 - DNA, 20 bp, mouse
gcaggaggctgagacatagc

SEQ ID NO: 634658 - DNA, 20 bp, mouse
ggaacactggtgttagggaa

SEQ ID NO: 634659 - DNA, 20 bp, mouse
gctacaaaacatggaggtgg

SEQ ID NO: 634660 - DNA, 20 bp, mouse
ggagttagatgcactaatca

SEQ ID NO: 634661 - DNA, 20 bp, mouse
ggctccgctacaaaacatgg

SEQ ID NO: 634662 - DNA, 20 bp, mouse
gtccaactggaaatcatgat

SEQ ID NO: 634663 - DNA, 20 bp, mouse
gaaaataaagagaattgtga

SEQ ID NO: 634664 - DNA, 20 bp, mouse
gtgtgatggcaaggagggtc

SEQ ID NO: 634665 - DNA, 20 bp, mouse
gccgctacaaaacatggagg

SEQ ID NO: 634666 - DNA, 20 bp, mouse
gagaacgtaagggcagaaat

SEQ ID NO: 634667 - DNA, 20 bp, mouse
gtagctgcgcatagaacgta

SEQ ID NO: 634668 - DNA, 20 bp, mouse
gagggcagaaattggtgtca

SEQ ID NO: 634669 - DNA, 20 bp, mouse
gaggggattatgatgcacgg

SEQ ID NO: 634670 - DNA, 20 bp, mouse
gtcaaggggaacgtaaggtc

SEQ ID NO: 634671 - DNA, 20 bp, mouse
gtgtcagggagaaaccatac

SEQ ID NO: 634672 - DNA, 20 bp, mouse
gcaaaggggattatgatgca

SEQ ID NO: 634673 - DNA, 20 bp, mouse
gaactgagaagggctgtcac

SEQ ID NO: 634674 - DNA, 20 bp, mouse
gttgcaagttggaactgaga

SEQ ID NO: 634675 - DNA, 20 bp, mouse
ggtgcaacagtgatggttgg

SEQ ID NO: 634676 - DNA, 20 bp, mouse
ggccttacctcaaaggtctt

SEQ ID NO: 634677 - DNA, 20 bp, mouse
ggactgatgccttacctcaa

SEQ ID NO: 634678 - DNA, 20 bp, mouse
gcatgaacggacgtcctgga

SEQ ID NO: 634679 - DNA, 20 bp, mouse
gtcatggaaggagatatgat

SEQ ID NO: 634680 - DNA, 20 bp, mouse
ggattgtagcagacacgggc

SEQ ID NO: 634681 - DNA, 20 bp, mouse
ggcagtacaaagcagcagag

SEQ ID NO: 634682 - DNA, 20 bp, mouse
gggaggacttgatgaactgc

SEQ ID NO: 634683 - DNA, 20 bp, mouse
gcaccactaggaagtgatca

SEQ ID NO: 634684 - DNA, 20 bp, mouse
gttgggattgtagcagacac

SEQ ID NO: 634685 - DNA, 20 bp, mouse
gtcccaagacctttgaggta

SEQ ID NO: 634686 - DNA, 20 bp, mouse
gggaaagttcggtccgtcac

SEQ ID NO: 634687 - DNA, 20 bp, mouse
gtaaacattcagttcttcag

SEQ ID NO: 634688 - DNA, 20 bp, mouse
gcaggcaggccgtgggtccc

SEQ ID NO: 634689 - DNA, 20 bp, mouse
gcacgtgtagctagaacact

SEQ ID NO: 634690 - DNA, 20 bp, mouse
ggtaaagccgaggaagtggc

SEQ ID NO: 634691 - DNA, 20 bp, mouse
gtctaatgcggctgcaaatg

SEQ ID NO: 634692 - DNA, 20 bp, mouse
gtgggtccctgggccagcca

SEQ ID NO: 634693 - DNA, 20 bp, mouse
gtagaaaggtcttgcggaaa

SEQ ID NO: 634694 - DNA, 20 bp, mouse
gcagagccgtgggcccaggc

SEQ ID NO: 634695 - DNA, 20 bp, mouse
gtcagcccctggctggccca

SEQ ID NO: 634696 - DNA, 20 bp, mouse
ggatcctcgagagtgggcgt

SEQ ID NO: 634697 - DNA, 20 bp, mouse
gtcgctggatcctcgagagt

SEQ ID NO: 634698 - DNA, 20 bp, mouse
gtgtcccacgcccactctcg

SEQ ID NO: 634699 - DNA, 20 bp, mouse
ggggagtcacttcgccccag

SEQ ID NO: 634700 - DNA, 20 bp, mouse
gaggaacacggagctgtcgc

SEQ ID NO: 634701 - DNA, 20 bp, mouse
gacaatgactgtcacccact

SEQ ID NO: 634702 - DNA, 20 bp, mouse
gcagatccagcctgcctaat

SEQ ID NO: 634703 - DNA, 20 bp, mouse
ggcaaaccgtggcactatgc

SEQ ID NO: 634704 - DNA, 20 bp, mouse
gcacccggtgcctcaataaa

SEQ ID NO: 634705 - DNA, 20 bp, mouse
gaggctcgacggagggacac

SEQ ID NO: 634706 - DNA, 20 bp, mouse
gcatttgtacactctcccaa

SEQ ID NO: 634707 - DNA, 20 bp, mouse
gtgatggggcgcgaggtgca

SEQ ID NO: 634708 - DNA, 20 bp, mouse
ggggcgcgaggtgcagggtg

SEQ ID NO: 634709 - DNA, 20 bp, mouse
gaactaggaagttgccgcaa

SEQ ID NO: 634710 - DNA, 20 bp, mouse
gtgatcacgcattagtggat

SEQ ID NO: 634711 - DNA, 20 bp, mouse
gtgccgcaaggggcaccata

SEQ ID NO: 634712 - DNA, 20 bp, mouse
gaggcaacttaagtggtgag

SEQ ID NO: 634713 - DNA, 20 bp, mouse
gtggcgtggagcggtcgcca

SEQ ID NO: 634714 - DNA, 20 bp, mouse
gccacgccacgcgcacaact

SEQ ID NO: 634715 - DNA, 20 bp, mouse
gggcatgagctattgatgtc

SEQ ID NO: 634716 - DNA, 20 bp, mouse
gtaacggaatgactgaatga

SEQ ID NO: 634717 - DNA, 20 bp, mouse
gaagccagaggccgggtcgc

SEQ ID NO: 634718 - DNA, 20 bp, mouse
gggaggacccaggggagcgc

SEQ ID NO: 634719 - DNA, 20 bp, mouse
ggcggggcgggccgttgagt

SEQ ID NO: 634720 - DNA, 20 bp, mouse
gtcggcacgggaggacccag

SEQ ID NO: 634721 - DNA, 20 bp, mouse
gccactcaggccttcggcac

SEQ ID NO: 634722 - DNA, 20 bp, mouse
gagggcttacgatcgccctc

SEQ ID NO: 634723 - DNA, 20 bp, mouse
gccccgctcgggaccacaaa

SEQ ID NO: 634724 - DNA, 20 bp, mouse
gtgggagcctgcgctcccct

SEQ ID NO: 634725 - DNA, 20 bp, mouse
gtcctcaaacctctgccccg

SEQ ID NO: 634726 - DNA, 20 bp, mouse
gagagaccacgtgggcactg

SEQ ID NO: 634727 - DNA, 20 bp, mouse
gactgagtgagagaccacgt

SEQ ID NO: 634728 - DNA, 20 bp, mouse
gggatctaaagctgcggttg

SEQ ID NO: 634729 - DNA, 20 bp, mouse
ggagaattgtgggatcagca

SEQ ID NO: 634730 - DNA, 20 bp, mouse
ggcggttgtggtcaagaacg

SEQ ID NO: 634731 - DNA, 20 bp, mouse
gtcaagaacgtggttaccaa

SEQ ID NO: 634732 - DNA, 20 bp, mouse
gactatccccagtgcccacg

SEQ ID NO: 634733 - DNA, 20 bp, mouse
ggtctctcactcagtaccct

SEQ ID NO: 634734 - DNA, 20 bp, mouse
gattatcctcagagaattgt

SEQ ID NO: 634735 - DNA, 20 bp, mouse
gctgatcccacaattctctg

SEQ ID NO: 634736 - DNA, 20 bp, mouse
gtgacctcatatgcaactgt

SEQ ID NO: 634737 - DNA, 20 bp, mouse
ggtaggctactccacctaag

SEQ ID NO: 634738 - DNA, 20 bp, mouse
ggggaaataatccacttagg

SEQ ID NO: 634739 - DNA, 20 bp, mouse
gtaggggaaataatccactt

SEQ ID NO: 634740 - DNA, 20 bp, mouse
gtagcctacagttgcatatg

SEQ ID NO: 634741 - DNA, 20 bp, mouse
gataaagccaccggatgaat

SEQ ID NO: 634742 - DNA, 20 bp, mouse
ggaaataaagcatttgctat

SEQ ID NO: 634743 - DNA, 20 bp, mouse
gtggtgccatacactgactt

SEQ ID NO: 634744 - DNA, 20 bp, mouse
gatttctttaatcagaacac

SEQ ID NO: 634745 - DNA, 20 bp, mouse
gacgaattctcttttcagga

SEQ ID NO: 634746 - DNA, 20 bp, mouse
ggggccacgcggcgaggaac

SEQ ID NO: 634747 - DNA, 20 bp, mouse
gcaggcggagactggggcgg

SEQ ID NO: 634748 - DNA, 20 bp, mouse
gaagcagccaggcggagact

SEQ ID NO: 634749 - DNA, 20 bp, mouse
ggcaggcgaaaccacgggcg

SEQ ID NO: 634750 - DNA, 20 bp, mouse
gagccaggcggagactgggg

SEQ ID NO: 634751 - DNA, 20 bp, mouse
ggggagccgcgaatgacgcc

SEQ ID NO: 634752 - DNA, 20 bp, mouse
gtgcagctggacaagcagcc

SEQ ID NO: 634753 - DNA, 20 bp, mouse
gggccctagcagggtcgtgt

SEQ ID NO: 634754 - DNA, 20 bp, mouse
gggcagccgggcgtcattcg

SEQ ID NO: 634755 - DNA, 20 bp, mouse
gggagactggggcggtggcg

SEQ ID NO: 634756 - DNA, 20 bp, mouse
gctcccgattggctgatcga

SEQ ID NO: 634757 - DNA, 20 bp, mouse
gaggtggctcatgggagcag

SEQ ID NO: 634758 - DNA, 20 bp, mouse
gctactcgcaggtggctcat

SEQ ID NO: 634759 - DNA, 20 bp, mouse
gggccctcgatcagccaatc

SEQ ID NO: 634760 - DNA, 20 bp, mouse
ggaaaatggtgagtgtcttc

SEQ ID NO: 634761 - DNA, 20 bp, mouse
gcccaggcgacgagaggata

SEQ ID NO: 634762 - DNA, 20 bp, mouse
gagacagagggaggtaggac

SEQ ID NO: 634763 - DNA, 20 bp, mouse
gtcccctgtaaagagacaga

SEQ ID NO: 634764 - DNA, 20 bp, mouse
gggaggtaggaccggaccaa

SEQ ID NO: 634765 - DNA, 20 bp, mouse
gcagatccatccacagaaaa

SEQ ID NO: 634766 - DNA, 20 bp, mouse
gaacacggctgattatgcaa

SEQ ID NO: 634767 - DNA, 20 bp, mouse
gttacagagacgtctctcaa

SEQ ID NO: 634768 - DNA, 20 bp, mouse
gcaagtctcgcgagagttgg

SEQ ID NO: 634769 - DNA, 20 bp, mouse
gctgggcgcacgtactgctc

SEQ ID NO: 634770 - DNA, 20 bp, mouse
gtaatggttgtgcagaaaca

SEQ ID NO: 634771 - DNA, 20 bp, mouse
gctactgtgcaaagaatgtg

SEQ ID NO: 634772 - DNA, 20 bp, mouse
ggaactgcgcatgcacccgg

SEQ ID NO: 634773 - DNA, 20 bp, mouse
gaggtgcgtctcgttgttaa

SEQ ID NO: 634774 - DNA, 20 bp, mouse
gaagaggcacgtgcaaatgt

SEQ ID NO: 634775 - DNA, 20 bp, mouse
gtctctgtaaggaaacatat

SEQ ID NO: 634776 - DNA, 20 bp, mouse
gtgagggtgtcaggccagaa

SEQ ID NO: 634777 - DNA, 20 bp, mouse
gctctgagggacagcaatgg

SEQ ID NO: 634778 - DNA, 20 bp, mouse
gcagaaagatggatcatgat

SEQ ID NO: 634779 - DNA, 20 bp, mouse
gtatctggctattaacctca

SEQ ID NO: 634780 - DNA, 20 bp, mouse
ggcactacacgagaaagcat

SEQ ID NO: 634781 - DNA, 20 bp, mouse
gccaagttcttctgtctgtg

SEQ ID NO: 634782 - DNA, 20 bp, mouse
gtggactagaccataaggcg

SEQ ID NO: 634783 - DNA, 20 bp, mouse
gagatggatcatgataggaa

SEQ ID NO: 634784 - DNA, 20 bp, mouse
gacagcaatggtggacagct

SEQ ID NO: 634785 - DNA, 20 bp, mouse
gacatcagagttgtaagcac

SEQ ID NO: 634786 - DNA, 20 bp, mouse
gagagcaagtcaggactgta

SEQ ID NO: 634787 - DNA, 20 bp, mouse
gcctgccttctcaaaaatga

SEQ ID NO: 634788 - DNA, 20 bp, mouse
gactgtaaggataccctaag

SEQ ID NO: 634789 - DNA, 20 bp, mouse
gcacctctggtaacactatt

SEQ ID NO: 634790 - DNA, 20 bp, mouse
gaagtttccacatgcatccc

SEQ ID NO: 634791 - DNA, 20 bp, mouse
gaaatcaagaagccttaaga

SEQ ID NO: 634792 - DNA, 20 bp, mouse
gctcctaatagtgttaccag

SEQ ID NO: 634793 - DNA, 20 bp, mouse
gagctatgtgccttcacctc

SEQ ID NO: 634794 - DNA, 20 bp, mouse
gcactattaggaggttttca

SEQ ID NO: 634795 - DNA, 20 bp, mouse
gctttttcctgggatgcatg

SEQ ID NO: 634796 - DNA, 20 bp, mouse
ggagctgcctgctgttctca

SEQ ID NO: 634797 - DNA, 20 bp, mouse
gggacaaattgaggggtaac

SEQ ID NO: 634798 - DNA, 20 bp, mouse
gctttggagcagtagggtat

SEQ ID NO: 634799 - DNA, 20 bp, mouse
gtgttctcatggttgtagtt

SEQ ID NO: 634800 - DNA, 20 bp, mouse
gcttctagaggaaatgaact

SEQ ID NO: 634801 - DNA, 20 bp, mouse
gaagagccggtaacaaaact

SEQ ID NO: 634802 - DNA, 20 bp, mouse
gtgggtctaaaggggcctca

SEQ ID NO: 634803 - DNA, 20 bp, mouse
ggaaaccactgtagtaggta

SEQ ID NO: 634804 - DNA, 20 bp, mouse
ggaggggggaggggccttct

SEQ ID NO: 634805 - DNA, 20 bp, mouse
gagccaacagagtcaagagc

SEQ ID NO: 634806 - DNA, 20 bp, mouse
gacctgggccagaccatctt

SEQ ID NO: 634807 - DNA, 20 bp, mouse
gtcctcaaggctgcccccag

SEQ ID NO: 634808 - DNA, 20 bp, mouse
gttcccagattacaaaactg

SEQ ID NO: 634809 - DNA, 20 bp, mouse
gactctagaatgacaagaag

SEQ ID NO: 634810 - DNA, 20 bp, mouse
gccagataatgctgtcacat

SEQ ID NO: 634811 - DNA, 20 bp, mouse
gtgtaatctgggaaatggta

SEQ ID NO: 634812 - DNA, 20 bp, mouse
ggagcctcagttttgtaatc

SEQ ID NO: 634813 - DNA, 20 bp, mouse
gaggcctgtttctgtctctt

SEQ ID NO: 634814 - DNA, 20 bp, mouse
gcataggtgtgactacctct

SEQ ID NO: 634815 - DNA, 20 bp, mouse
gtagaagtagatgtgtatgt

SEQ ID NO: 634816 - DNA, 20 bp, mouse
gtacccctgcccaacagcat

SEQ ID NO: 634817 - DNA, 20 bp, mouse
gctggcggtgccaacactga

SEQ ID NO: 634818 - DNA, 20 bp, mouse
ggccaagggacccgcggcta

SEQ ID NO: 634819 - DNA, 20 bp, mouse
gtccctgaaagtggagccaa

SEQ ID NO: 634820 - DNA, 20 bp, mouse
gggagcacaaccctcagtgt

SEQ ID NO: 634821 - DNA, 20 bp, mouse
ggaacccaatgctgttgggc

SEQ ID NO: 634822 - DNA, 20 bp, mouse
gcaggtggctctggggatgt

SEQ ID NO: 634823 - DNA, 20 bp, mouse
ggtcccttggctccactttc

SEQ ID NO: 634824 - DNA, 20 bp, mouse
gccagcacttcggatccctt

SEQ ID NO: 634825 - DNA, 20 bp, mouse
gggttccaagcacaaccaaa

SEQ ID NO: 634826 - DNA, 20 bp, mouse
gagaagaggtcacaaagaca

SEQ ID NO: 634827 - DNA, 20 bp, mouse
gtcctagaggaagctggatc

SEQ ID NO: 634828 - DNA, 20 bp, mouse
gtaagaggttatgacacgaa

SEQ ID NO: 634829 - DNA, 20 bp, mouse
gtgagggcaagcaagttcta

SEQ ID NO: 634830 - DNA, 20 bp, mouse
ggcccaagagataatagata

SEQ ID NO: 634831 - DNA, 20 bp, mouse
gggcacatgcctcctagaag

SEQ ID NO: 634832 - DNA, 20 bp, mouse
gatctagcctggcacttcat

SEQ ID NO: 634833 - DNA, 20 bp, mouse
gaaagtacactgggtgtaag

SEQ ID NO: 634834 - DNA, 20 bp, mouse
gctccacagtattatcctag

SEQ ID NO: 634835 - DNA, 20 bp, mouse
gccaatgccactgactaggc

SEQ ID NO: 634836 - DNA, 20 bp, mouse
gtctcccgagaccccagcat

SEQ ID NO: 634837 - DNA, 20 bp, mouse
gcagaggcacacactagcct

SEQ ID NO: 634838 - DNA, 20 bp, mouse
gccggacacaggatcctgtc

SEQ ID NO: 634839 - DNA, 20 bp, mouse
gggcaggttggtctaggcag

SEQ ID NO: 634840 - DNA, 20 bp, mouse
gagtgaggctgggttttaaa

SEQ ID NO: 634841 - DNA, 20 bp, mouse
gctaggcctaggccggacac

SEQ ID NO: 634842 - DNA, 20 bp, mouse
gggctcttgagtacaagttt

SEQ ID NO: 634843 - DNA, 20 bp, mouse
ggcctccaatacaaaatgtg

SEQ ID NO: 634844 - DNA, 20 bp, mouse
gtccatacatagcaacagtg

SEQ ID NO: 634845 - DNA, 20 bp, mouse
gtttttcagagcaggatacc

SEQ ID NO: 634846 - DNA, 20 bp, mouse
ggtgaagatcactctggtga

SEQ ID NO: 634847 - DNA, 20 bp, mouse
gtgtctggatacagactgga

SEQ ID NO: 634848 - DNA, 20 bp, mouse
ggcctcccattgtgcaaggt

SEQ ID NO: 634849 - DNA, 20 bp, mouse
gtgcaaggtgggttcataag

SEQ ID NO: 634850 - DNA, 20 bp, mouse
gatggtggtggggtaatttc

SEQ ID NO: 634851 - DNA, 20 bp, mouse
gaacgccaaatttacctggt

SEQ ID NO: 634852 - DNA, 20 bp, mouse
gacccaccttgcacaatggg

SEQ ID NO: 634853 - DNA, 20 bp, mouse
gtcttcctaccaggtaaatt

SEQ ID NO: 634854 - DNA, 20 bp, mouse
gacgagaatcaccccataaa

SEQ ID NO: 634855 - DNA, 20 bp, mouse
ggttattaatacttagattt

SEQ ID NO: 634856 - DNA, 20 bp, mouse
gctggctgctgagagattag

SEQ ID NO: 634857 - DNA, 20 bp, mouse
gcaaacatctggacttccgc

SEQ ID NO: 634858 - DNA, 20 bp, mouse
gtacatgaaaaccaggggtc

SEQ ID NO: 634859 - DNA, 20 bp, mouse
gcccacccccggtgggaatg

SEQ ID NO: 634860 - DNA, 20 bp, mouse
gagccagggtgatctcacaa

SEQ ID NO: 634861 - DNA, 20 bp, mouse
gaccactgtcccaactttga

SEQ ID NO: 634862 - DNA, 20 bp, mouse
gtcaagctacagcttgttag

SEQ ID NO: 634863 - DNA, 20 bp, mouse
gtgagctcctcattcccacc

SEQ ID NO: 634864 - DNA, 20 bp, mouse
gggcagatgctggattcata

SEQ ID NO: 634865 - DNA, 20 bp, mouse
ggccccttacatgaaaacca

SEQ ID NO: 634866 - DNA, 20 bp, mouse
ggttgcatagccagagtagt

SEQ ID NO: 634867 - DNA, 20 bp, mouse
gctggcgagctgactatagg

SEQ ID NO: 634868 - DNA, 20 bp, mouse
ggtcctggcgagctgactat

SEQ ID NO: 634869 - DNA, 20 bp, mouse
gaagatggagatacgtaggt

SEQ ID NO: 634870 - DNA, 20 bp, mouse
gatgtcctgagtctgctgag

SEQ ID NO: 634871 - DNA, 20 bp, mouse
gtcctctgtacccactactc

SEQ ID NO: 634872 - DNA, 20 bp, mouse
gtaggtgcagatgcagccgc

SEQ ID NO: 634873 - DNA, 20 bp, mouse
gacaggtacttgtagagcaa

SEQ ID NO: 634874 - DNA, 20 bp, mouse
ggaaaccactcacagccctg

SEQ ID NO: 634875 - DNA, 20 bp, mouse
ggtactttggggcatgatac

SEQ ID NO: 634876 - DNA, 20 bp, mouse
gccctggtgcagagaattac

SEQ ID NO: 634877 - DNA, 20 bp, mouse
ggtgcagagaattactggca

SEQ ID NO: 634878 - DNA, 20 bp, mouse
gagccctcaccccactttca

SEQ ID NO: 634879 - DNA, 20 bp, mouse
gaggaccttgaattaaggac

SEQ ID NO: 634880 - DNA, 20 bp, mouse
gaagcactggtggcctaggt

SEQ ID NO: 634881 - DNA, 20 bp, mouse
gctgacatcccaagactggt

SEQ ID NO: 634882 - DNA, 20 bp, mouse
gacatcctaaacacagagtc

SEQ ID NO: 634883 - DNA, 20 bp, mouse
gtaggccaccagtgcttatg

SEQ ID NO: 634884 - DNA, 20 bp, mouse
gcaaggtcctccctgataat

SEQ ID NO: 634885 - DNA, 20 bp, mouse
gagggacttcccaccagtct

SEQ ID NO: 634886 - DNA, 20 bp, mouse
gttccctggggtaaggtagg

SEQ ID NO: 634887 - DNA, 20 bp, mouse
gctcactgaaatcttccctg

SEQ ID NO: 634888 - DNA, 20 bp, mouse
gtgccccctaccttacccca

SEQ ID NO: 634889 - DNA, 20 bp, mouse
gactccaggtgcccacatct

SEQ ID NO: 634890 - DNA, 20 bp, mouse
gtgaaatcttccctggggta

SEQ ID NO: 634891 - DNA, 20 bp, mouse
gaaaccatgtggagttctat

SEQ ID NO: 634892 - DNA, 20 bp, mouse
gggtctctaagcagagccta

SEQ ID NO: 634893 - DNA, 20 bp, mouse
ggggggtgacacctagatgt

SEQ ID NO: 634894 - DNA, 20 bp, mouse
gtaggtgtcacccccagcaa

SEQ ID NO: 634895 - DNA, 20 bp, mouse
ggctttggccccagtaggct

SEQ ID NO: 634896 - DNA, 20 bp, mouse
ggggaggggcgggacttcca

SEQ ID NO: 634897 - DNA, 20 bp, mouse
gacacactgcggcaggggag

SEQ ID NO: 634898 - DNA, 20 bp, mouse
gaaacatggctgatactccg

SEQ ID NO: 634899 - DNA, 20 bp, mouse
gctagccaagggtctagcca

SEQ ID NO: 634900 - DNA, 20 bp, mouse
gttgaagctgagacttctct

SEQ ID NO: 634901 - DNA, 20 bp, mouse
gaggggcgggacttccaggg

SEQ ID NO: 634902 - DNA, 20 bp, mouse
gcaactagtatggacatgac

SEQ ID NO: 634903 - DNA, 20 bp, mouse
gagataaccaacaactagta

SEQ ID NO: 634904 - DNA, 20 bp, mouse
gacttccagggcggaatttt

SEQ ID NO: 634905 - DNA, 20 bp, mouse
gcggggtttacaacacactg

SEQ ID NO: 634906 - DNA, 20 bp, mouse
ggggctaggtggtctgctta

SEQ ID NO: 634907 - DNA, 20 bp, mouse
gggccctgtagggagagtgt

SEQ ID NO: 634908 - DNA, 20 bp, mouse
gagcccacactctccctaca

SEQ ID NO: 634909 - DNA, 20 bp, mouse
ggcattaccttagcctccta

SEQ ID NO: 634910 - DNA, 20 bp, mouse
gtggtctgcttagggaagag

SEQ ID NO: 634911 - DNA, 20 bp, mouse
gagagagaatgtcaaggaaa

SEQ ID NO: 634912 - DNA, 20 bp, mouse
gctaggacaaagcaaagcga

SEQ ID NO: 634913 - DNA, 20 bp, mouse
gtaaccaagacgtgaggcaa

SEQ ID NO: 634914 - DNA, 20 bp, mouse
gtactccagagagaatgtca

SEQ ID NO: 634915 - DNA, 20 bp, mouse
gagtggttaaccaagacgtg

SEQ ID NO: 634916 - DNA, 20 bp, mouse
gacaggtatggcaccaagtc

SEQ ID NO: 634917 - DNA, 20 bp, mouse
gagtgtgtaggtgacaggta

SEQ ID NO: 634918 - DNA, 20 bp, mouse
gtattcaagtcttgcccttc

SEQ ID NO: 634919 - DNA, 20 bp, mouse
gatgtcagtgtgtaggtgac

SEQ ID NO: 634920 - DNA, 20 bp, mouse
gacggcccgaagaccatgcg

SEQ ID NO: 634921 - DNA, 20 bp, mouse
gtaaagaggttgaactttgg

SEQ ID NO: 634922 - DNA, 20 bp, mouse
ggtgactctgggggttatca

SEQ ID NO: 634923 - DNA, 20 bp, mouse
gcattcttgtgccttgctat

SEQ ID NO: 634924 - DNA, 20 bp, mouse
gagagtttgggaacagcaat

SEQ ID NO: 634925 - DNA, 20 bp, mouse
gccgtggctcacacagtgtt

SEQ ID NO: 634926 - DNA, 20 bp, mouse
gaaggcgccgcgtccagcag

SEQ ID NO: 634927 - DNA, 20 bp, mouse
gtcaacagcgtggtcctcca

SEQ ID NO: 634928 - DNA, 20 bp, mouse
ggggggagaggggacgtggg

SEQ ID NO: 634929 - DNA, 20 bp, mouse
ggaccacgctgttgaggtcg

SEQ ID NO: 634930 - DNA, 20 bp, mouse
ggctggacgcggcgccttgg

SEQ ID NO: 634931 - DNA, 20 bp, mouse
gtaggcgcatctgagcacgg

SEQ ID NO: 634932 - DNA, 20 bp, mouse
gagccagttccagaagaatt

SEQ ID NO: 634933 - DNA, 20 bp, mouse
ggctgttgaggtcggggtgt

SEQ ID NO: 634934 - DNA, 20 bp, mouse
ggcgcatctgagcacggtgg

SEQ ID NO: 634935 - DNA, 20 bp, mouse
gggcggggcaggtgcggagg

SEQ ID NO: 634936 - DNA, 20 bp, mouse
gagagcaccgcacacctgaa

SEQ ID NO: 634937 - DNA, 20 bp, mouse
ggcacacctgaaggggatga

SEQ ID NO: 634938 - DNA, 20 bp, mouse
ggaggccaggggcaagctcc

SEQ ID NO: 634939 - DNA, 20 bp, mouse
gggtgcctggagcttgcccc

SEQ ID NO: 634940 - DNA, 20 bp, mouse
gcatgggacaggatgaccac

SEQ ID NO: 634941 - DNA, 20 bp, mouse
gaggcaccctcatccccttc

SEQ ID NO: 634942 - DNA, 20 bp, mouse
gtgccaggtcacacgtgaca

SEQ ID NO: 634943 - DNA, 20 bp, mouse
gaggctgggaatgtaggtcc

SEQ ID NO: 634944 - DNA, 20 bp, mouse
ggggaattgctcgcagggct

SEQ ID NO: 634945 - DNA, 20 bp, mouse
gatgaccactgggtgctcag

SEQ ID NO: 634946 - DNA, 20 bp, mouse
gacccaggttaggggagcct

SEQ ID NO: 634947 - DNA, 20 bp, mouse
gacgacagtcaggaattcga

SEQ ID NO: 634948 - DNA, 20 bp, mouse
gcactgccccatccaatccc

SEQ ID NO: 634949 - DNA, 20 bp, mouse
ggtgctaggcgagtttccct

SEQ ID NO: 634950 - DNA, 20 bp, mouse
gatcacgtgtacccaggtta

SEQ ID NO: 634951 - DNA, 20 bp, mouse
gtgggtacacgtgatgtgct

SEQ ID NO: 634952 - DNA, 20 bp, mouse
gaatcaaggttccctgccca

SEQ ID NO: 634953 - DNA, 20 bp, mouse
ggagaaggatggccttcgaa

SEQ ID NO: 634954 - DNA, 20 bp, mouse
gtcccaggctcccctaacct

SEQ ID NO: 634955 - DNA, 20 bp, mouse
gggaaatcagactctgtcgg

SEQ ID NO: 634956 - DNA, 20 bp, mouse
gaggtgctgcacagctacaa

SEQ ID NO: 634957 - DNA, 20 bp, mouse
gagagtgaggggaacgccca

SEQ ID NO: 634958 - DNA, 20 bp, mouse
ggcctgtggaggggcactcc

SEQ ID NO: 634959 - DNA, 20 bp, mouse
gaggggaacgcccagggcga

SEQ ID NO: 634960 - DNA, 20 bp, mouse
ggccaggagtgcccctccac

SEQ ID NO: 634961 - DNA, 20 bp, mouse
gtttgggtagagtagattgg

SEQ ID NO: 634962 - DNA, 20 bp, mouse
gggaaggaaaccattacaat

SEQ ID NO: 634963 - DNA, 20 bp, mouse
gtaccacatgaaaaggtgga

SEQ ID NO: 634964 - DNA, 20 bp, mouse
ggatagattgactgagaaag

SEQ ID NO: 634965 - DNA, 20 bp, mouse
gggcgagagagctacgtcct

SEQ ID NO: 634966 - DNA, 20 bp, mouse
gtaggctattggattcacgt

SEQ ID NO: 634967 - DNA, 20 bp, mouse
gtcagacagctcatcccaga

SEQ ID NO: 634968 - DNA, 20 bp, mouse
gcactcagatttcaccatct

SEQ ID NO: 634969 - DNA, 20 bp, mouse
ggaatccaatagcctactcc

SEQ ID NO: 634970 - DNA, 20 bp, mouse
gagctccaggagtaggctat

SEQ ID NO: 634971 - DNA, 20 bp, mouse
gggctctaagctccaggagt

SEQ ID NO: 634972 - DNA, 20 bp, mouse
gggaggtgaaaactagagtc

SEQ ID NO: 634973 - DNA, 20 bp, mouse
gaccagaactatgaatgttt

SEQ ID NO: 634974 - DNA, 20 bp, mouse
ggtctggatagcatagttca

SEQ ID NO: 634975 - DNA, 20 bp, mouse
gacattcatagttctggtct

SEQ ID NO: 634976 - DNA, 20 bp, mouse
gctaggaggtaagaggtctc

SEQ ID NO: 634977 - DNA, 20 bp, mouse
gtagaaccctggttaacaga

SEQ ID NO: 634978 - DNA, 20 bp, mouse
gtcgtccgtgcaaggccacc

SEQ ID NO: 634979 - DNA, 20 bp, mouse
gaagtcataaggcagataat

SEQ ID NO: 634980 - DNA, 20 bp, mouse
gcaccaggctaggaggtaag

SEQ ID NO: 634981 - DNA, 20 bp, mouse
gcaggagttgggattacata

SEQ ID NO: 634982 - DNA, 20 bp, mouse
gaggtcaagtcgtccgtgca

SEQ ID NO: 634983 - DNA, 20 bp, mouse
gctagcctggtggccttgca

SEQ ID NO: 634984 - DNA, 20 bp, mouse
gggactccctctgttaacca

SEQ ID NO: 634985 - DNA, 20 bp, mouse
gttaaattgcagtgagtgga

SEQ ID NO: 634986 - DNA, 20 bp, mouse
ggagacgtgacgctctccta

SEQ ID NO: 634987 - DNA, 20 bp, mouse
gaggaagcatatgtgtaccg

SEQ ID NO: 634988 - DNA, 20 bp, mouse
gctcccgcttccggtgtgaa

SEQ ID NO: 634989 - DNA, 20 bp, mouse
gacaccgcaccgtgagacag

SEQ ID NO: 634990 - DNA, 20 bp, mouse
ggagacaactcaaccacccg

SEQ ID NO: 634991 - DNA, 20 bp, mouse
gtggccccgccccgccggtc

SEQ ID NO: 634992 - DNA, 20 bp, mouse
gccgcctctgtctcacggtg

SEQ ID NO: 634993 - DNA, 20 bp, mouse
gtctcccttcacaccggaag

SEQ ID NO: 634994 - DNA, 20 bp, mouse
gtacacatatgcttcctaac

SEQ ID NO: 634995 - DNA, 20 bp, mouse
gagcatatgtgtaccgcggg

SEQ ID NO: 634996 - DNA, 20 bp, mouse
gggcaccccacgcccacttc

SEQ ID NO: 634997 - DNA, 20 bp, mouse
gtcccctggtggtacctagc

SEQ ID NO: 634998 - DNA, 20 bp, mouse
gtcccagctaggtaccacca

SEQ ID NO: 634999 - DNA, 20 bp, mouse
gagtgtgtacatgcctaacg

SEQ ID NO: 635000 - DNA, 20 bp, mouse
gacgaggccagaagtgggcg

SEQ ID NO: 635001 - DNA, 20 bp, mouse
ggacacctttaagatctcat

SEQ ID NO: 635002 - DNA, 20 bp, mouse
gcacctcacgagtaacttct

SEQ ID NO: 635003 - DNA, 20 bp, mouse
gaagtgagttgagaacctgc

SEQ ID NO: 635004 - DNA, 20 bp, mouse
ggttctcaactcacttgctc

SEQ ID NO: 635005 - DNA, 20 bp, mouse
gattaaagtactgttgacca

SEQ ID NO: 635006 - DNA, 20 bp, mouse
ggggacctcactagcctgtg

SEQ ID NO: 635007 - DNA, 20 bp, mouse
gccacccccacaggctagtg

SEQ ID NO: 635008 - DNA, 20 bp, mouse
ggctagtgaggtccccccca

SEQ ID NO: 635009 - DNA, 20 bp, mouse
gaggggatgcgattggtgtc

SEQ ID NO: 635010 - DNA, 20 bp, mouse
ggcagtagactgcaggggga

SEQ ID NO: 635011 - DNA, 20 bp, mouse
ggtagcctgggcaaacttga

SEQ ID NO: 635012 - DNA, 20 bp, mouse
gtatcaagcagtagactgca

SEQ ID NO: 635013 - DNA, 20 bp, mouse
ggaagctgaggggatgcgat

SEQ ID NO: 635014 - DNA, 20 bp, mouse
gaagacagctaccatccaag

SEQ ID NO: 635015 - DNA, 20 bp, mouse
ggctcacaaatcttggactc

SEQ ID NO: 635016 - DNA, 20 bp, mouse
gtcactaacctctttttggc

SEQ ID NO: 635017 - DNA, 20 bp, mouse
gctcacattttcccgtttcc

SEQ ID NO: 635018 - DNA, 20 bp, mouse
gtcgggcccaatacactcct

SEQ ID NO: 635019 - DNA, 20 bp, mouse
gcagcaaagggttgcagtgt

SEQ ID NO: 635020 - DNA, 20 bp, mouse
gtctcagagcagagcttctc

SEQ ID NO: 635021 - DNA, 20 bp, mouse
gagcaaaacaacatcagcaa

SEQ ID NO: 635022 - DNA, 20 bp, mouse
gtctgtcctaggagtgtatt

SEQ ID NO: 635023 - DNA, 20 bp, mouse
gaatctaatgagtgtcttac

SEQ ID NO: 635024 - DNA, 20 bp, mouse
gactctgcaaaacaatgaga

SEQ ID NO: 635025 - DNA, 20 bp, mouse
gcttagtgcaatgaaggcaa

SEQ ID NO: 635026 - DNA, 20 bp, mouse
ggccccgcccacctctctga

SEQ ID NO: 635027 - DNA, 20 bp, mouse
gagtccagccttcagagagg

SEQ ID NO: 635028 - DNA, 20 bp, mouse
gccttggccccgcccagcag

SEQ ID NO: 635029 - DNA, 20 bp, mouse
gaggtgggcggggccactgc

SEQ ID NO: 635030 - DNA, 20 bp, mouse
gaacacttaaccacagcagg

SEQ ID NO: 635031 - DNA, 20 bp, mouse
gaatgcaggctgcaactgga

SEQ ID NO: 635032 - DNA, 20 bp, mouse
gagaaaatgcaggctgcaac

SEQ ID NO: 635033 - DNA, 20 bp, mouse
gtgctgtggttaagtgttag

SEQ ID NO: 635034 - DNA, 20 bp, mouse
gacttgggacaggaaagcct

SEQ ID NO: 635035 - DNA, 20 bp, mouse
ggaaattgagttagtttaag

SEQ ID NO: 635036 - DNA, 20 bp, mouse
ggggctctcctcagagtggg

SEQ ID NO: 635037 - DNA, 20 bp, mouse
gagagtgggagggtagtaca

SEQ ID NO: 635038 - DNA, 20 bp, mouse
gcactctgaggagagcccaa

SEQ ID NO: 635039 - DNA, 20 bp, mouse
gctcctcagcaacaggtcgg

SEQ ID NO: 635040 - DNA, 20 bp, mouse
ggagggtagtacaaggactg

SEQ ID NO: 635041 - DNA, 20 bp, mouse
gagcctccgacctgttgctg

SEQ ID NO: 635042 - DNA, 20 bp, mouse
gaaaagcttgccaaagtcgg

SEQ ID NO: 635043 - DNA, 20 bp, mouse
ggctgagaaggagagtgttc

SEQ ID NO: 635044 - DNA, 20 bp, mouse
gggagaaagtggctcccctt

SEQ ID NO: 635045 - DNA, 20 bp, mouse
gggccaacctcaagctgaga

SEQ ID NO: 635046 - DNA, 20 bp, mouse
gggacctgctgcataggggt

SEQ ID NO: 635047 - DNA, 20 bp, mouse
gcaggggcggagttgggtga

SEQ ID NO: 635048 - DNA, 20 bp, mouse
gctcagaaactcccccagat

SEQ ID NO: 635049 - DNA, 20 bp, mouse
gcaaggaagcccgggaccag

SEQ ID NO: 635050 - DNA, 20 bp, mouse
gggcagaaggccactggtcc

SEQ ID NO: 635051 - DNA, 20 bp, mouse
gtcccccagatgggatgtga

SEQ ID NO: 635052 - DNA, 20 bp, mouse
gtgtgtgggcagaaggccac

SEQ ID NO: 635053 - DNA, 20 bp, mouse
ggctgcataggggtaggggc

SEQ ID NO: 635054 - DNA, 20 bp, mouse
gatgggagaggacccgactc

SEQ ID NO: 635055 - DNA, 20 bp, mouse
gccagccggacctgctgcat

SEQ ID NO: 635056 - DNA, 20 bp, mouse
gaaagcagtgacataaacca

SEQ ID NO: 635057 - DNA, 20 bp, mouse
gacagagcctccctggccta

SEQ ID NO: 635058 - DNA, 20 bp, mouse
gtctcagacagtgagtgagc

SEQ ID NO: 635059 - DNA, 20 bp, mouse
gtaatgccttgggtgattcc

SEQ ID NO: 635060 - DNA, 20 bp, mouse
gagcctccctggcctaggga

SEQ ID NO: 635061 - DNA, 20 bp, mouse
gaatcacccaaggcattaca

SEQ ID NO: 635062 - DNA, 20 bp, mouse
gtgacataaaccatggcttc

SEQ ID NO: 635063 - DNA, 20 bp, mouse
gataaagagtcctcctcaga

SEQ ID NO: 635064 - DNA, 20 bp, mouse
ggagtgtcatggctggtccc

SEQ ID NO: 635065 - DNA, 20 bp, mouse
gtgaggaggactctttatta

SEQ ID NO: 635066 - DNA, 20 bp, mouse
gcagtccttgagcccagcta

SEQ ID NO: 635067 - DNA, 20 bp, mouse
gtgcttggtggggaagtcta

SEQ ID NO: 635068 - DNA, 20 bp, mouse
gtggggaagtctatggagca

SEQ ID NO: 635069 - DNA, 20 bp, mouse
gagcaggaggagctctagtg

SEQ ID NO: 635070 - DNA, 20 bp, mouse
gtgcccgcgagaggtagatg

SEQ ID NO: 635071 - DNA, 20 bp, mouse
gcagccttcatgcccgcgag

SEQ ID NO: 635072 - DNA, 20 bp, mouse
gcgagaggtagatgcggtta

SEQ ID NO: 635073 - DNA, 20 bp, mouse
gcagggaatcagccatagct

SEQ ID NO: 635074 - DNA, 20 bp, mouse
gtagatgcggttagggtttg

SEQ ID NO: 635075 - DNA, 20 bp, mouse
gctagaaggaaggatgttgt

SEQ ID NO: 635076 - DNA, 20 bp, mouse
ggcgcggcgctcggggaaga

SEQ ID NO: 635077 - DNA, 20 bp, mouse
gcgctcggggaagaggggct

SEQ ID NO: 635078 - DNA, 20 bp, mouse
gggaacggccccccgggagt

SEQ ID NO: 635079 - DNA, 20 bp, mouse
gcggcccgctctcctccccc

SEQ ID NO: 635080 - DNA, 20 bp, mouse
gcgcccaggcgctcactcga

SEQ ID NO: 635081 - DNA, 20 bp, mouse
ggcgctcactcgaggggcgg

SEQ ID NO: 635082 - DNA, 20 bp, mouse
gggcagactcggagcgagga

SEQ ID NO: 635083 - DNA, 20 bp, mouse
gcgcgcccggcggcctccgc

SEQ ID NO: 635084 - DNA, 20 bp, mouse
gcaggcgctcactcgagggg

SEQ ID NO: 635085 - DNA, 20 bp, mouse
gactcggagcgaggagggag

SEQ ID NO: 635086 - DNA, 20 bp, mouse
gtctccgcctagggaacatt

SEQ ID NO: 635087 - DNA, 20 bp, mouse
gtcatctgagacagtggcag

SEQ ID NO: 635088 - DNA, 20 bp, mouse
ggaacagtgtcccccgtcag

SEQ ID NO: 635089 - DNA, 20 bp, mouse
ggaggggcagggcgagctgg

SEQ ID NO: 635090 - DNA, 20 bp, mouse
gatctgggaaacccctgacg

SEQ ID NO: 635091 - DNA, 20 bp, mouse
gggagatcttcttgactcac

SEQ ID NO: 635092 - DNA, 20 bp, mouse
gtgctagtcatctgagacag

SEQ ID NO: 635093 - DNA, 20 bp, mouse
gtcaaaaatttctccgccta

SEQ ID NO: 635094 - DNA, 20 bp, mouse
gctagcactcaaagcagatc

SEQ ID NO: 635095 - DNA, 20 bp, mouse
gcaaagagatcttgaccaac

SEQ ID NO: 635096 - DNA, 20 bp, mouse
ggcaacccggtcacatgact

SEQ ID NO: 635097 - DNA, 20 bp, mouse
gccccacccccatatgatct

SEQ ID NO: 635098 - DNA, 20 bp, mouse
gaaagacgctggggcagacg

SEQ ID NO: 635099 - DNA, 20 bp, mouse
gtcggccggccgcccaaacc

SEQ ID NO: 635100 - DNA, 20 bp, mouse
ggctggggcagacgtgggac

SEQ ID NO: 635101 - DNA, 20 bp, mouse
gtatgcgcccagatcatatg

SEQ ID NO: 635102 - DNA, 20 bp, mouse
gccggccgagtcatgtgacc

SEQ ID NO: 635103 - DNA, 20 bp, mouse
gggaaactgggcgggtctcc

SEQ ID NO: 635104 - DNA, 20 bp, mouse
gcccctcaggaaatgggcgt

SEQ ID NO: 635105 - DNA, 20 bp, mouse
gtagctccacaggcgttctg

SEQ ID NO: 635106 - DNA, 20 bp, mouse
gtgcttccaggcactcccaa

SEQ ID NO: 635107 - DNA, 20 bp, mouse
gcagactgacaggttaatcc

SEQ ID NO: 635108 - DNA, 20 bp, mouse
gaagctggagccacagatag

SEQ ID NO: 635109 - DNA, 20 bp, mouse
gtccacacctatgccccgaa

SEQ ID NO: 635110 - DNA, 20 bp, mouse
gctggaggtcagaggagttc

SEQ ID NO: 635111 - DNA, 20 bp, mouse
gagctgctgtctctttgctc

SEQ ID NO: 635112 - DNA, 20 bp, mouse
gcccatcctgctcttcaaca

SEQ ID NO: 635113 - DNA, 20 bp, mouse
gaccttgggtggcatctagg

SEQ ID NO: 635114 - DNA, 20 bp, mouse
ggttaatccaggaagccatt

SEQ ID NO: 635115 - DNA, 20 bp, mouse
ggtgttctatgacagttgga

SEQ ID NO: 635116 - DNA, 20 bp, mouse
ggaggggggttcattgacta

SEQ ID NO: 635117 - DNA, 20 bp, mouse
ggaaaggaaagcagggcgtg

SEQ ID NO: 635118 - DNA, 20 bp, mouse
ggggttcattgactaaggaa

SEQ ID NO: 635119 - DNA, 20 bp, mouse
gccctcccgcacaaccttct

SEQ ID NO: 635120 - DNA, 20 bp, mouse
gctgcctctgctgcaactga

SEQ ID NO: 635121 - DNA, 20 bp, mouse
gttaaccaagaaggttgtgc

SEQ ID NO: 635122 - DNA, 20 bp, mouse
gttgccttcagttgcagcag

SEQ ID NO: 635123 - DNA, 20 bp, mouse
gtgttgttgctactaatcta

SEQ ID NO: 635124 - DNA, 20 bp, mouse
gtgggtgcccattggattag

SEQ ID NO: 635125 - DNA, 20 bp, mouse
gagactgctgttaaccaaga

SEQ ID NO: 635126 - DNA, 20 bp, mouse
gtgtggaggtaatagaagat

SEQ ID NO: 635127 - DNA, 20 bp, mouse
ggggcggggtcagtggaggt

SEQ ID NO: 635128 - DNA, 20 bp, mouse
gaggttaggctggtgagccc

SEQ ID NO: 635129 - DNA, 20 bp, mouse
gttaactgtgaggggaggtg

SEQ ID NO: 635130 - DNA, 20 bp, mouse
ggcaggcaatcaggatagta

SEQ ID NO: 635131 - DNA, 20 bp, mouse
gtgaaagaggaccacatgct

SEQ ID NO: 635132 - DNA, 20 bp, mouse
gccctccgttgacccctcct

SEQ ID NO: 635133 - DNA, 20 bp, mouse
gtactgccccaagtctagat

SEQ ID NO: 635134 - DNA, 20 bp, mouse
ggacccctcctcggttgcta

SEQ ID NO: 635135 - DNA, 20 bp, mouse
gactcaaaaggcaggcaatc

SEQ ID NO: 635136 - DNA, 20 bp, mouse
gtaactgcagttcaaaagca

SEQ ID NO: 635137 - DNA, 20 bp, mouse
gtgtctctttgaggttttga

SEQ ID NO: 635138 - DNA, 20 bp, mouse
gccagagcatgccagaactt

SEQ ID NO: 635139 - DNA, 20 bp, mouse
gtgctgtcttagaatgaccc

SEQ ID NO: 635140 - DNA, 20 bp, mouse
gttggagagactggattgtt

SEQ ID NO: 635141 - DNA, 20 bp, mouse
ggaactgcagttagcaagcc

SEQ ID NO: 635142 - DNA, 20 bp, mouse
gtaaactgccagtgttccat

SEQ ID NO: 635143 - DNA, 20 bp, mouse
gcaaaactgtggttgtactc

SEQ ID NO: 635144 - DNA, 20 bp, mouse
gacctccatgctacaaagtt

SEQ ID NO: 635145 - DNA, 20 bp, mouse
gtgtgtttgtgtgcaggaat

SEQ ID NO: 635146 - DNA, 20 bp, mouse
gagagctggatggttgttga

SEQ ID NO: 635147 - DNA, 20 bp, mouse
gacagcgaggggcttctaga

SEQ ID NO: 635148 - DNA, 20 bp, mouse
ggccctggggcagtgtgatc

SEQ ID NO: 635149 - DNA, 20 bp, mouse
gaaacaggaagattctcaaa

SEQ ID NO: 635150 - DNA, 20 bp, mouse
gataccgaagtacaggaaag

SEQ ID NO: 635151 - DNA, 20 bp, mouse
gtcctcacgcccatagaaac

SEQ ID NO: 635152 - DNA, 20 bp, mouse
gtgacatcacaagatagagc

SEQ ID NO: 635153 - DNA, 20 bp, mouse
gttaaagaataccgaagtac

SEQ ID NO: 635154 - DNA, 20 bp, mouse
gacagtgagtgagatcgcgc

SEQ ID NO: 635155 - DNA, 20 bp, mouse
gtagagccagcatgacctct

SEQ ID NO: 635156 - DNA, 20 bp, mouse
ggaccatggggactccatgt

SEQ ID NO: 635157 - DNA, 20 bp, mouse
ggagttggatagtatggaat

SEQ ID NO: 635158 - DNA, 20 bp, mouse
gtagtctagagtgatggaca

SEQ ID NO: 635159 - DNA, 20 bp, mouse
gtacccacatggagtcccca

SEQ ID NO: 635160 - DNA, 20 bp, mouse
ggtgaggtggccctgagaac

SEQ ID NO: 635161 - DNA, 20 bp, mouse
ggcaggtccctagaactaaa

SEQ ID NO: 635162 - DNA, 20 bp, mouse
ggagtccccatggtctgctg

SEQ ID NO: 635163 - DNA, 20 bp, mouse
gaactggcaccaggttctgt

SEQ ID NO: 635164 - DNA, 20 bp, mouse
ggaggctcgaccaaggcact

SEQ ID NO: 635165 - DNA, 20 bp, mouse
gcccaccaacccatttacca

SEQ ID NO: 635166 - DNA, 20 bp, mouse
gccgatggcggggaaacaga

SEQ ID NO: 635167 - DNA, 20 bp, mouse
ggtcacgcccgccgactgcg

SEQ ID NO: 635168 - DNA, 20 bp, mouse
gccgactgcggggctccgac

SEQ ID NO: 635169 - DNA, 20 bp, mouse
gtcggcgaatagtttccctg

SEQ ID NO: 635170 - DNA, 20 bp, mouse
ggggagttgtagtcacctgt

SEQ ID NO: 635171 - DNA, 20 bp, mouse
gcctgtggtacgctccgtga

SEQ ID NO: 635172 - DNA, 20 bp, mouse
gggtgcttggtaagtgattc

SEQ ID NO: 635173 - DNA, 20 bp, mouse
gcaggagcagctccttttag

SEQ ID NO: 635174 - DNA, 20 bp, mouse
gcacggcgcgtccacgaaaa

SEQ ID NO: 635175 - DNA, 20 bp, mouse
gggaaactattcgccgatgg

SEQ ID NO: 635176 - DNA, 20 bp, mouse
gaatgctcccataatctcgg

SEQ ID NO: 635177 - DNA, 20 bp, mouse
gggcggggcatgtatttcgg

SEQ ID NO: 635178 - DNA, 20 bp, mouse
gagatgtaagagatggaagt

SEQ ID NO: 635179 - DNA, 20 bp, mouse
gtgacatcctccgagattat

SEQ ID NO: 635180 - DNA, 20 bp, mouse
gctgaagaggagctggactg

SEQ ID NO: 635181 - DNA, 20 bp, mouse
ggctctgtagatatcagtta

SEQ ID NO: 635182 - DNA, 20 bp, mouse
gcatgtatttcggtggtgtg

SEQ ID NO: 635183 - DNA, 20 bp, mouse
ggggggcggggcatgtattt

SEQ ID NO: 635184 - DNA, 20 bp, mouse
gacagtccctgtgtccaagg

SEQ ID NO: 635185 - DNA, 20 bp, mouse
gctggttgactgtcagcatt

SEQ ID NO: 635186 - DNA, 20 bp, mouse
gaagtcagagaacaatgcgg

SEQ ID NO: 635187 - DNA, 20 bp, mouse
ggggcactgtatcccgggag

SEQ ID NO: 635188 - DNA, 20 bp, mouse
ggtggcccacaggcgctgac

SEQ ID NO: 635189 - DNA, 20 bp, mouse
gggagcggggcactgtatcc

SEQ ID NO: 635190 - DNA, 20 bp, mouse
ggaacaatgcggtggcccac

SEQ ID NO: 635191 - DNA, 20 bp, mouse
gccggcctgtcagcgcctgt

SEQ ID NO: 635192 - DNA, 20 bp, mouse
gtggaggtgctgtggttcca

SEQ ID NO: 635193 - DNA, 20 bp, mouse
ggttctggaggggaattcaa

SEQ ID NO: 635194 - DNA, 20 bp, mouse
gggagggcgacgtgcactcc

SEQ ID NO: 635195 - DNA, 20 bp, mouse
gtacccaggggggcgtggag

SEQ ID NO: 635196 - DNA, 20 bp, mouse
gtcaacacgggatcccaaga

SEQ ID NO: 635197 - DNA, 20 bp, mouse
gaggcactggcgacgttggg

SEQ ID NO: 635198 - DNA, 20 bp, mouse
gccgcaacaaaccagctcaa

SEQ ID NO: 635199 - DNA, 20 bp, mouse
gagggcggagtcccctctga

SEQ ID NO: 635200 - DNA, 20 bp, mouse
ggcggagtcccctctgaggg

SEQ ID NO: 635201 - DNA, 20 bp, mouse
gaggccacacaaacagtgtc

SEQ ID NO: 635202 - DNA, 20 bp, mouse
ggacgcttcgagagcttcgc

SEQ ID NO: 635203 - DNA, 20 bp, mouse
gccgacgcggccgtaaccta

SEQ ID NO: 635204 - DNA, 20 bp, mouse
gcggaggcgggcctaggtgc

SEQ ID NO: 635205 - DNA, 20 bp, mouse
gcgcaggcactggcgacgtt

SEQ ID NO: 635206 - DNA, 20 bp, mouse
gatgacctggggacgctaat

SEQ ID NO: 635207 - DNA, 20 bp, mouse
ggccacgcgcagcacacaga

SEQ ID NO: 635208 - DNA, 20 bp, mouse
gtccccaggtcataatccca

SEQ ID NO: 635209 - DNA, 20 bp, mouse
gtccaggaggagtttctaga

SEQ ID NO: 635210 - DNA, 20 bp, mouse
gtcacaatcccgggcgtcac

SEQ ID NO: 635211 - DNA, 20 bp, mouse
gcaactcaggtcacaatccc

SEQ ID NO: 635212 - DNA, 20 bp, mouse
gtactggtcccgtgacgccc

SEQ ID NO: 635213 - DNA, 20 bp, mouse
gtcctcctggaagtacacag

SEQ ID NO: 635214 - DNA, 20 bp, mouse
gttgcgcccgtcaagcggta

SEQ ID NO: 635215 - DNA, 20 bp, mouse
gtgcccaaactgggagtcat

SEQ ID NO: 635216 - DNA, 20 bp, mouse
gtcagcagattgttgttctc

SEQ ID NO: 635217 - DNA, 20 bp, mouse
ggaacaacaatctgctgagt

SEQ ID NO: 635218 - DNA, 20 bp, mouse
gctatctcctggctagaaca

SEQ ID NO: 635219 - DNA, 20 bp, mouse
gctatctcctagctatctcc

SEQ ID NO: 635220 - DNA, 20 bp, mouse
gctcctggctagaacaagga

SEQ ID NO: 635221 - DNA, 20 bp, mouse
gtctcctcatgacttgaaca

SEQ ID NO: 635222 - DNA, 20 bp, mouse
gaaagaacttaaaggacttg

SEQ ID NO: 635223 - DNA, 20 bp, mouse
gtctctctggtctggagagg

SEQ ID NO: 635224 - DNA, 20 bp, mouse
ggaacttaaaggacttgcgg

SEQ ID NO: 635225 - DNA, 20 bp, mouse
gtgagccaacatagagttgt

SEQ ID NO: 635226 - DNA, 20 bp, mouse
ggatcgccggtgcacagaaa

SEQ ID NO: 635227 - DNA, 20 bp, mouse
gcacagaaagggctaattgt

SEQ ID NO: 635228 - DNA, 20 bp, mouse
gaggagtcccatgtcactct

SEQ ID NO: 635229 - DNA, 20 bp, mouse
ggactaagtgcgagaaccac

SEQ ID NO: 635230 - DNA, 20 bp, mouse
gcattcagctcatgagaatg

SEQ ID NO: 635231 - DNA, 20 bp, mouse
gtgataggtcacacattaag

SEQ ID NO: 635232 - DNA, 20 bp, mouse
ggtgacctatcatctccaaa

SEQ ID NO: 635233 - DNA, 20 bp, mouse
gcgcacttagtcatcttcag

SEQ ID NO: 635234 - DNA, 20 bp, mouse
gcaccaggacttaggatcgc

SEQ ID NO: 635235 - DNA, 20 bp, mouse
ggttcctgaaatcaagacta

SEQ ID NO: 635236 - DNA, 20 bp, mouse
gcggggcgtggcacccaccg

SEQ ID NO: 635237 - DNA, 20 bp, mouse
gcgccccctggcgaccgcgg

SEQ ID NO: 635238 - DNA, 20 bp, mouse
ggtgtgtgggccctggttaa

SEQ ID NO: 635239 - DNA, 20 bp, mouse
gaaaggcggcctttgtgaac

SEQ ID NO: 635240 - DNA, 20 bp, mouse
gtgtgggccctggttaaagg

SEQ ID NO: 635241 - DNA, 20 bp, mouse
gtgccaacccgaggaggtga

SEQ ID NO: 635242 - DNA, 20 bp, mouse
gcaaaggccgcctttaacca

SEQ ID NO: 635243 - DNA, 20 bp, mouse
gcacacactcccgttcacaa

SEQ ID NO: 635244 - DNA, 20 bp, mouse
gcaccctcacctcctcgggt

SEQ ID NO: 635245 - DNA, 20 bp, mouse
gggtgagcgccacagtgttc

SEQ ID NO: 635246 - DNA, 20 bp, mouse
gaagtgcaaactattcccga

SEQ ID NO: 635247 - DNA, 20 bp, mouse
gtagctctggagaatgctct

SEQ ID NO: 635248 - DNA, 20 bp, mouse
ggtctggtacgtagtctagt

SEQ ID NO: 635249 - DNA, 20 bp, mouse
gtcatcttgttcagcgacag

SEQ ID NO: 635250 - DNA, 20 bp, mouse
gccagactgtggactgacag

SEQ ID NO: 635251 - DNA, 20 bp, mouse
gtcttgttcagcgacagagg

SEQ ID NO: 635252 - DNA, 20 bp, mouse
gtaagctcttagaccaccag

SEQ ID NO: 635253 - DNA, 20 bp, mouse
gagaatgctctgggttgaag

SEQ ID NO: 635254 - DNA, 20 bp, mouse
gtcgtcagttatgcaccctc

SEQ ID NO: 635255 - DNA, 20 bp, mouse
gggggaggctggcccagagc

SEQ ID NO: 635256 - DNA, 20 bp, mouse
gttgggggatggaaatcttg

SEQ ID NO: 635257 - DNA, 20 bp, mouse
gtacagacctagcatggcag

SEQ ID NO: 635258 - DNA, 20 bp, mouse
gtaggtctgtagattacagg

SEQ ID NO: 635259 - DNA, 20 bp, mouse
gtctgagcacatacaatagt

SEQ ID NO: 635260 - DNA, 20 bp, mouse
ggactaatgtgcaatcttgg

SEQ ID NO: 635261 - DNA, 20 bp, mouse
gatggtcagaattatgtaaa

SEQ ID NO: 635262 - DNA, 20 bp, mouse
gcagaatactctgaaactga

SEQ ID NO: 635263 - DNA, 20 bp, mouse
gtctgctacatgtcatactt

SEQ ID NO: 635264 - DNA, 20 bp, mouse
gaaatgtgagaaagatctca

SEQ ID NO: 635265 - DNA, 20 bp, mouse
gcaacaaaggaaccaagtta

SEQ ID NO: 635266 - DNA, 20 bp, mouse
ggcatctgagatggtcataa

SEQ ID NO: 635267 - DNA, 20 bp, mouse
gatggcagaggcatctgaga

SEQ ID NO: 635268 - DNA, 20 bp, mouse
gccacccttctgtctggcaa

SEQ ID NO: 635269 - DNA, 20 bp, mouse
ggatgcctgtcatcttgtgt

SEQ ID NO: 635270 - DNA, 20 bp, mouse
ggccatggcagcgatgtcat

SEQ ID NO: 635271 - DNA, 20 bp, mouse
gttggaacccttttaggttg

SEQ ID NO: 635272 - DNA, 20 bp, mouse
gcaacttttggaaccctttt

SEQ ID NO: 635273 - DNA, 20 bp, mouse
gtacttagatgagaagtcac

SEQ ID NO: 635274 - DNA, 20 bp, mouse
gatagacaggtgtcagatct

SEQ ID NO: 635275 - DNA, 20 bp, mouse
gataggacacatagaatcag

SEQ ID NO: 635276 - DNA, 20 bp, mouse
gcacctcctaggaagagaca

SEQ ID NO: 635277 - DNA, 20 bp, mouse
gattgacagggcccggggga

SEQ ID NO: 635278 - DNA, 20 bp, mouse
gatgagagggatatggtgtg

SEQ ID NO: 635279 - DNA, 20 bp, mouse
gcaccctgtctcttcctagg

SEQ ID NO: 635280 - DNA, 20 bp, mouse
gagggatatggtgtggggca

SEQ ID NO: 635281 - DNA, 20 bp, mouse
gcacccttccagactgagta

SEQ ID NO: 635282 - DNA, 20 bp, mouse
gtagccttactcagtctgga

SEQ ID NO: 635283 - DNA, 20 bp, mouse
gcccaccagccatcagttgg

SEQ ID NO: 635284 - DNA, 20 bp, mouse
gtgtctataagggcaagatt

SEQ ID NO: 635285 - DNA, 20 bp, mouse
gagatgctggacaaactaat

SEQ ID NO: 635286 - DNA, 20 bp, mouse
ggcgccccagtggactcttg

SEQ ID NO: 635287 - DNA, 20 bp, mouse
gggagagtatggtatgtcag

SEQ ID NO: 635288 - DNA, 20 bp, mouse
gatgtcaggggcaaggaggg

SEQ ID NO: 635289 - DNA, 20 bp, mouse
gcaggacaggaagcgaagag

SEQ ID NO: 635290 - DNA, 20 bp, mouse
gggaagagaccagaaaccta

SEQ ID NO: 635291 - DNA, 20 bp, mouse
gcgtgcggaccaggccaaac

SEQ ID NO: 635292 - DNA, 20 bp, mouse
ggacaggaagcgaagagggg

SEQ ID NO: 635293 - DNA, 20 bp, mouse
gaggggagtctcgagatcct

SEQ ID NO: 635294 - DNA, 20 bp, mouse
ggctctggcaggggtccggc

SEQ ID NO: 635295 - DNA, 20 bp, mouse
gaggtaatgagagttccaac

SEQ ID NO: 635296 - DNA, 20 bp, mouse
gcctccgcgcacacgtgatg

SEQ ID NO: 635297 - DNA, 20 bp, mouse
gtggggtgacgtcgactcgt

SEQ ID NO: 635298 - DNA, 20 bp, mouse
gacccaagctcgtgccgctg

SEQ ID NO: 635299 - DNA, 20 bp, mouse
gcgagcttgggtgatgaagc

SEQ ID NO: 635300 - DNA, 20 bp, mouse
gaccccagcggcacgagctt

SEQ ID NO: 635301 - DNA, 20 bp, mouse
gtggggaaggtcgctctggt

SEQ ID NO: 635302 - DNA, 20 bp, mouse
gcccctcaagccaatgaagg

SEQ ID NO: 635303 - DNA, 20 bp, mouse
gctcatggggaaggtcgctc

SEQ ID NO: 635304 - DNA, 20 bp, mouse
gacgccctctcctccttcat

SEQ ID NO: 635305 - DNA, 20 bp, mouse
gaaggcacgcggcgtaggaa

SEQ ID NO: 635306 - DNA, 20 bp, mouse
gatgcagagagggatgaagt

SEQ ID NO: 635307 - DNA, 20 bp, mouse
gagccccggccttacctcta

SEQ ID NO: 635308 - DNA, 20 bp, mouse
ggtcaccaggcgccagaggc

SEQ ID NO: 635309 - DNA, 20 bp, mouse
ggaccatagaggtaaggccg

SEQ ID NO: 635310 - DNA, 20 bp, mouse
gacgctgccgttcaggaaga

SEQ ID NO: 635311 - DNA, 20 bp, mouse
gtgcaggaaggcagtgtctg

SEQ ID NO: 635312 - DNA, 20 bp, mouse
gacagagaacgcattagcaa

SEQ ID NO: 635313 - DNA, 20 bp, mouse
gggccctcacgctgccgttc

SEQ ID NO: 635314 - DNA, 20 bp, mouse
gcctggtgaccatagaggta

SEQ ID NO: 635315 - DNA, 20 bp, mouse
ggagtggtttcttgggtgaa

SEQ ID NO: 635316 - DNA, 20 bp, mouse
ggagacgataagcgatttgg

SEQ ID NO: 635317 - DNA, 20 bp, mouse
gcagaaagctaactctaaaa

SEQ ID NO: 635318 - DNA, 20 bp, mouse
gtgggggctctggctcttaa

SEQ ID NO: 635319 - DNA, 20 bp, mouse
ggagcagcaggtggcctcac

SEQ ID NO: 635320 - DNA, 20 bp, mouse
gccactcacgggagcccgtg

SEQ ID NO: 635321 - DNA, 20 bp, mouse
gagggagacgataagcgatt

SEQ ID NO: 635322 - DNA, 20 bp, mouse
gtaaaattgcggaagaggtg

SEQ ID NO: 635323 - DNA, 20 bp, mouse
gcggggcctgagcttcggtt

SEQ ID NO: 635324 - DNA, 20 bp, mouse
gtcagcctgggctaccaagg

SEQ ID NO: 635325 - DNA, 20 bp, mouse
gctcaggccccgcccactca

SEQ ID NO: 635326 - DNA, 20 bp, mouse
gcagctgcggggagtcggga

SEQ ID NO: 635327 - DNA, 20 bp, mouse
gcgactccccgcagctgcgt

SEQ ID NO: 635328 - DNA, 20 bp, mouse
ggcggggagtcgggagggta

SEQ ID NO: 635329 - DNA, 20 bp, mouse
gcacccccgggaattcactg

SEQ ID NO: 635330 - DNA, 20 bp, mouse
gaggcggaggatggttgcca

SEQ ID NO: 635331 - DNA, 20 bp, mouse
gtctctggacccaaccatcc

SEQ ID NO: 635332 - DNA, 20 bp, mouse
gcaaaggcgggaaataaagc

SEQ ID NO: 635333 - DNA, 20 bp, mouse
gggtctcgccggagtcactc

SEQ ID NO: 635334 - DNA, 20 bp, mouse
ggaggcgccgctttgtccgc

SEQ ID NO: 635335 - DNA, 20 bp, mouse
gcccgcagctgcgtgggtgg

SEQ ID NO: 635336 - DNA, 20 bp, mouse
gcctctgctacatatccaag

SEQ ID NO: 635337 - DNA, 20 bp, mouse
gtattaaatactcaaaagga

SEQ ID NO: 635338 - DNA, 20 bp, mouse
gggagtgtatagggggattt

SEQ ID NO: 635339 - DNA, 20 bp, mouse
gaaatactcaaaaggaagga

SEQ ID NO: 635340 - DNA, 20 bp, mouse
gtgtatagggggatttgggg

SEQ ID NO: 635341 - DNA, 20 bp, mouse
gttggggggggaccaggaaa

SEQ ID NO: 635342 - DNA, 20 bp, mouse
gctaatattaaatactcaaa

SEQ ID NO: 635343 - DNA, 20 bp, mouse
gggggatttggggggggacc

SEQ ID NO: 635344 - DNA, 20 bp, mouse
gttggtgagcaagggggagg

SEQ ID NO: 635345 - DNA, 20 bp, mouse
gcaggacagtgatgtcagtg

SEQ ID NO: 635346 - DNA, 20 bp, mouse
gtcaccaagggatcttgctg

SEQ ID NO: 635347 - DNA, 20 bp, mouse
gcaaccacagcaagatccct

SEQ ID NO: 635348 - DNA, 20 bp, mouse
gaggaagtctgagctatggt

SEQ ID NO: 635349 - DNA, 20 bp, mouse
gagtctgagctatggttggg

SEQ ID NO: 635350 - DNA, 20 bp, mouse
ggcttcttgaactgattgtg

SEQ ID NO: 635351 - DNA, 20 bp, mouse
gtgaaaggaactttggcaga

SEQ ID NO: 635352 - DNA, 20 bp, mouse
gccaaagttcctttcaccaa

SEQ ID NO: 635353 - DNA, 20 bp, mouse
gacatatgaagcctgcctaa

SEQ ID NO: 635354 - DNA, 20 bp, mouse
gaacaaagagcaccaccctt

SEQ ID NO: 635355 - DNA, 20 bp, mouse
gctctgcataggtctgtcgt

SEQ ID NO: 635356 - DNA, 20 bp, mouse
gacacagttaactctggggg

SEQ ID NO: 635357 - DNA, 20 bp, mouse
gaatgacacagttaactctg

SEQ ID NO: 635358 - DNA, 20 bp, mouse
gcagtttagttcatcctgcc

SEQ ID NO: 635359 - DNA, 20 bp, mouse
gaagtgtcattgcaacctaa

SEQ ID NO: 635360 - DNA, 20 bp, mouse
gctgtgtcatttcggccttt

SEQ ID NO: 635361 - DNA, 20 bp, mouse
gaaggggctggtgcagatat

SEQ ID NO: 635362 - DNA, 20 bp, mouse
ggtgaggcacgtggtgaaaa

SEQ ID NO: 635363 - DNA, 20 bp, mouse
gtgaggcacggtttgagtga

SEQ ID NO: 635364 - DNA, 20 bp, mouse
ggtaaggtagaccacactca

SEQ ID NO: 635365 - DNA, 20 bp, mouse
gggagtgtgaccagaggtga

SEQ ID NO: 635366 - DNA, 20 bp, mouse
gtaagtaaaggatgtgtgct

SEQ ID NO: 635367 - DNA, 20 bp, mouse
gtcaaaaactccctaagtaa

SEQ ID NO: 635368 - DNA, 20 bp, mouse
gtgctagctggagcacttcc

SEQ ID NO: 635369 - DNA, 20 bp, mouse
gtaatagctcagtgtcgttg

SEQ ID NO: 635370 - DNA, 20 bp, mouse
gacttcgacattatgctagc

SEQ ID NO: 635371 - DNA, 20 bp, mouse
ggctgcgcagggcccagtct

SEQ ID NO: 635372 - DNA, 20 bp, mouse
ggaagctgagatggaggcac

SEQ ID NO: 635373 - DNA, 20 bp, mouse
gttgtcggaagctgagatgg

SEQ ID NO: 635374 - DNA, 20 bp, mouse
gggtaccgccctacctgcgc

SEQ ID NO: 635375 - DNA, 20 bp, mouse
gatggaggcacgggctctaa

SEQ ID NO: 635376 - DNA, 20 bp, mouse
gagcagagatttcccggatg

SEQ ID NO: 635377 - DNA, 20 bp, mouse
gatgagagagtcacgatagg

SEQ ID NO: 635378 - DNA, 20 bp, mouse
gccaagaagcaataaaaaga

SEQ ID NO: 635379 - DNA, 20 bp, mouse
gggatgaatccagacatggc

SEQ ID NO: 635380 - DNA, 20 bp, mouse
gaatctcaccaatcctcatc

SEQ ID NO: 635381 - DNA, 20 bp, mouse
gtcctatcggccgtgtctca

SEQ ID NO: 635382 - DNA, 20 bp, mouse
gctgatgagagagtcacgat

SEQ ID NO: 635383 - DNA, 20 bp, mouse
gcatgaaagagatttattca

SEQ ID NO: 635384 - DNA, 20 bp, mouse
ggagcagggctaccttcccc

SEQ ID NO: 635385 - DNA, 20 bp, mouse
gtcctgggcttccaaggccc

SEQ ID NO: 635386 - DNA, 20 bp, mouse
gctgtctaacagacacagta

SEQ ID NO: 635387 - DNA, 20 bp, mouse
gttctcgcccttaaaaaggc

SEQ ID NO: 635388 - DNA, 20 bp, mouse
gggtctaaaagctaaagtac

SEQ ID NO: 635389 - DNA, 20 bp, mouse
ggagcatccctgccttttta

SEQ ID NO: 635390 - DNA, 20 bp, mouse
gggtttgtgggagttcccac

SEQ ID NO: 635391 - DNA, 20 bp, mouse
gtggctgggcgtggtagcaa

SEQ ID NO: 635392 - DNA, 20 bp, mouse
gacggttgttgcatagcatg

SEQ ID NO: 635393 - DNA, 20 bp, mouse
ggattttctcgcccttaaaa

SEQ ID NO: 635394 - DNA, 20 bp, mouse
gtctgaagttaacagatagc

SEQ ID NO: 635395 - DNA, 20 bp, mouse
ggcattgaaagtactgtaat

SEQ ID NO: 635396 - DNA, 20 bp, mouse
gggccggcccgggaccagaa

SEQ ID NO: 635397 - DNA, 20 bp, mouse
gtcgctccccgccacctggg

SEQ ID NO: 635398 - DNA, 20 bp, mouse
gcgaacaaagccatgcgggg

SEQ ID NO: 635399 - DNA, 20 bp, mouse
gctgtcgctccccgccacct

SEQ ID NO: 635400 - DNA, 20 bp, mouse
ggggcctgggagcggggacc

SEQ ID NO: 635401 - DNA, 20 bp, mouse
gaacacggttcgaataaagt

SEQ ID NO: 635402 - DNA, 20 bp, mouse
gcatggctttgttcgcggtt

SEQ ID NO: 635403 - DNA, 20 bp, mouse
gggaccagaaggggcagcgc

SEQ ID NO: 635404 - DNA, 20 bp, mouse
gaaagccatgcggggcggca

SEQ ID NO: 635405 - DNA, 20 bp, mouse
ggacccggcgctgccccttc

SEQ ID NO: 635406 - DNA, 20 bp, mouse
ggtagcccgccgagcggaag

SEQ ID NO: 635407 - DNA, 20 bp, mouse
gagcggaagccctggaggac

SEQ ID NO: 635408 - DNA, 20 bp, mouse
ggagcggtcacgtgttcgga

SEQ ID NO: 635409 - DNA, 20 bp, mouse
gcccgccgcaggaacctctg

SEQ ID NO: 635410 - DNA, 20 bp, mouse
gtaccgcctccggtcctcca

SEQ ID NO: 635411 - DNA, 20 bp, mouse
gacgcgagcggaagccctgg

SEQ ID NO: 635412 - DNA, 20 bp, mouse
ggctacgcgagcggaagccc

SEQ ID NO: 635413 - DNA, 20 bp, mouse
ggtcccagcttgccggcctg

SEQ ID NO: 635414 - DNA, 20 bp, mouse
gtggccagggtcagaacatg

SEQ ID NO: 635415 - DNA, 20 bp, mouse
gcgcactgcaagccccaggc

SEQ ID NO: 635416 - DNA, 20 bp, mouse
gttggtgcctggtgggttat

SEQ ID NO: 635417 - DNA, 20 bp, mouse
ggctacctttatgacatctt

SEQ ID NO: 635418 - DNA, 20 bp, mouse
gaggtagctcctgaccaatg

SEQ ID NO: 635419 - DNA, 20 bp, mouse
gtttcctcaaaatcgaggta

SEQ ID NO: 635420 - DNA, 20 bp, mouse
gttaattcaagtgtaaactg

SEQ ID NO: 635421 - DNA, 20 bp, mouse
gtgggttatgggttctgact

SEQ ID NO: 635422 - DNA, 20 bp, mouse
gcaatgaggtgcagaagctg

SEQ ID NO: 635423 - DNA, 20 bp, mouse
gcctcaaaatcgaggtaggg

SEQ ID NO: 635424 - DNA, 20 bp, mouse
gttaggctttgagatgtcat

SEQ ID NO: 635425 - DNA, 20 bp, mouse
gtacagtttcctcaaaatcg

SEQ ID NO: 635426 - DNA, 20 bp, mouse
gcgagccaatggagggactc

SEQ ID NO: 635427 - DNA, 20 bp, mouse
gcacttagcaacaccaggtt

SEQ ID NO: 635428 - DNA, 20 bp, mouse
gtaaacacagccggggtcct

SEQ ID NO: 635429 - DNA, 20 bp, mouse
gagtcagcgcgagccaatgg

SEQ ID NO: 635430 - DNA, 20 bp, mouse
gtgttctcaaagatctttga

SEQ ID NO: 635431 - DNA, 20 bp, mouse
gttcatgctgagttctgatt

SEQ ID NO: 635432 - DNA, 20 bp, mouse
ggaggcgggaaggtccagac

SEQ ID NO: 635433 - DNA, 20 bp, mouse
gtggcagtagtcattgcgat

SEQ ID NO: 635434 - DNA, 20 bp, mouse
gctgaaggagccgggagcga

SEQ ID NO: 635435 - DNA, 20 bp, mouse
gctgaccaatccgccatccc

SEQ ID NO: 635436 - DNA, 20 bp, mouse
gggaactggattgacaggat

SEQ ID NO: 635437 - DNA, 20 bp, mouse
gcaggcttccaaggcatgga

SEQ ID NO: 635438 - DNA, 20 bp, mouse
gcaggatgggcaggcttcca

SEQ ID NO: 635439 - DNA, 20 bp, mouse
gcttccctgactccactgaa

SEQ ID NO: 635440 - DNA, 20 bp, mouse
gtcctccagaaagcccccac

SEQ ID NO: 635441 - DNA, 20 bp, mouse
ggttcccttcagtggagtca

SEQ ID NO: 635442 - DNA, 20 bp, mouse
gtgaagggaactggattgac

SEQ ID NO: 635443 - DNA, 20 bp, mouse
gttggcagaggaagggcgtg

SEQ ID NO: 635444 - DNA, 20 bp, mouse
gctcctacacccacacctaa

SEQ ID NO: 635445 - DNA, 20 bp, mouse
gctggaggagataggattgc

SEQ ID NO: 635446 - DNA, 20 bp, mouse
gaccaataagaagccgagga

SEQ ID NO: 635447 - DNA, 20 bp, mouse
ggcagcctctgggtcttcat

SEQ ID NO: 635448 - DNA, 20 bp, mouse
ggccgcccgctacatcacag

SEQ ID NO: 635449 - DNA, 20 bp, mouse
gtacgccaatgaagacccag

SEQ ID NO: 635450 - DNA, 20 bp, mouse
gaccactgtgatgtagcggg

SEQ ID NO: 635451 - DNA, 20 bp, mouse
ggcgaggcctcgccttggga

SEQ ID NO: 635452 - DNA, 20 bp, mouse
gaaggggcgaggcctcgcct

SEQ ID NO: 635453 - DNA, 20 bp, mouse
ggtagcgggcggcagcctct

SEQ ID NO: 635454 - DNA, 20 bp, mouse
gcccactagcgggtccgagc

SEQ ID NO: 635455 - DNA, 20 bp, mouse
ggagggcggagaaaggggcg

SEQ ID NO: 635456 - DNA, 20 bp, mouse
gtgagcttctaggttcggaa

SEQ ID NO: 635457 - DNA, 20 bp, mouse
gactagtgagcttctaggtt

SEQ ID NO: 635458 - DNA, 20 bp, mouse
gtgtacacacttgcagaagg

SEQ ID NO: 635459 - DNA, 20 bp, mouse
gaagtcgaccatgctctagt

SEQ ID NO: 635460 - DNA, 20 bp, mouse
gttaggaaaggtccagaatg

SEQ ID NO: 635461 - DNA, 20 bp, mouse
gtacccaaatagtcttgatg

SEQ ID NO: 635462 - DNA, 20 bp, mouse
gatagaactagtgagcttct

SEQ ID NO: 635463 - DNA, 20 bp, mouse
gtggcagttattatcttctg

SEQ ID NO: 635464 - DNA, 20 bp, mouse
gtatcttctggggcgaaaaa

SEQ ID NO: 635465 - DNA, 20 bp, mouse
gtgtatcagagtgtagcctc

SEQ ID NO: 635466 - DNA, 20 bp, mouse
gaggactgatggctgcagaa

SEQ ID NO: 635467 - DNA, 20 bp, mouse
ggaaaatgggagtgtctcag

SEQ ID NO: 635468 - DNA, 20 bp, mouse
gcaaggtcaggtcaccccca

SEQ ID NO: 635469 - DNA, 20 bp, mouse
gtcctcacacaccccaaatg

SEQ ID NO: 635470 - DNA, 20 bp, mouse
gaggataactgcaataccat

SEQ ID NO: 635471 - DNA, 20 bp, mouse
gcaaagctttgccccttcac

SEQ ID NO: 635472 - DNA, 20 bp, mouse
gtgcagaaaggaaaggtgct

SEQ ID NO: 635473 - DNA, 20 bp, mouse
gagggcagatatctgtgaaa

SEQ ID NO: 635474 - DNA, 20 bp, mouse
gcagccatcagtcctgtgaa

SEQ ID NO: 635475 - DNA, 20 bp, mouse
gccacactgctcagatatgt

SEQ ID NO: 635476 - DNA, 20 bp, mouse
gcgtggctactgtgtggata

SEQ ID NO: 635477 - DNA, 20 bp, mouse
gaagaagcgtggctactgtg

SEQ ID NO: 635478 - DNA, 20 bp, mouse
ggggcctgcaagtgcgaccc

SEQ ID NO: 635479 - DNA, 20 bp, mouse
gagctcatggtcactgacag

SEQ ID NO: 635480 - DNA, 20 bp, mouse
ggggagtgagcactgaattg

SEQ ID NO: 635481 - DNA, 20 bp, mouse
gttggcatgggcatcttttc

SEQ ID NO: 635482 - DNA, 20 bp, mouse
gacgatggcaacatgaccca

SEQ ID NO: 635483 - DNA, 20 bp, mouse
ggaccatgagctaagaagcg

SEQ ID NO: 635484 - DNA, 20 bp, mouse
gggggcagagcttcagactg

SEQ ID NO: 635485 - DNA, 20 bp, mouse
ggacgagggcacatacccca

SEQ ID NO: 635486 - DNA, 20 bp, mouse
gagcagagaacgcagtgccc

SEQ ID NO: 635487 - DNA, 20 bp, mouse
gttgtcaatcatggcacagg

SEQ ID NO: 635488 - DNA, 20 bp, mouse
ggacaaagctgtgaggtggt

SEQ ID NO: 635489 - DNA, 20 bp, mouse
gggaaggctcctactcaagt

SEQ ID NO: 635490 - DNA, 20 bp, mouse
gtgaggtggttggtttcatt

SEQ ID NO: 635491 - DNA, 20 bp, mouse
gactcggtgtttcttcaaat

SEQ ID NO: 635492 - DNA, 20 bp, mouse
gtactcaagttggtcttatt

SEQ ID NO: 635493 - DNA, 20 bp, mouse
gcgatgagacaagatgcatt

SEQ ID NO: 635494 - DNA, 20 bp, mouse
gatgttgtcaatcatggcac

SEQ ID NO: 635495 - DNA, 20 bp, mouse
gtaaaaagagaaacagtgag

SEQ ID NO: 635496 - DNA, 20 bp, mouse
gtggggaagcgagggctgat

SEQ ID NO: 635497 - DNA, 20 bp, mouse
gagaaaggataacgggaggt

SEQ ID NO: 635498 - DNA, 20 bp, mouse
gtgtcaagctggggaagcga

SEQ ID NO: 635499 - DNA, 20 bp, mouse
gtgggatgagaaaggataac

SEQ ID NO: 635500 - DNA, 20 bp, mouse
gaagtagagcgtttggttag

SEQ ID NO: 635501 - DNA, 20 bp, mouse
gaagtggagcatgacagcac

SEQ ID NO: 635502 - DNA, 20 bp, mouse
gataaaaatgtagtcatgta

SEQ ID NO: 635503 - DNA, 20 bp, mouse
ggatgagaaaggataacggg

SEQ ID NO: 635504 - DNA, 20 bp, mouse
ggatgggctgggaagccggc

SEQ ID NO: 635505 - DNA, 20 bp, mouse
gaatctggccatgagtctac

SEQ ID NO: 635506 - DNA, 20 bp, mouse
gggcaagccggttgacggaa

SEQ ID NO: 635507 - DNA, 20 bp, mouse
ggagcagtgacgtggcgtta

SEQ ID NO: 635508 - DNA, 20 bp, mouse
gggagcggcaagccggttga

SEQ ID NO: 635509 - DNA, 20 bp, mouse
gagcccgcgttccacgcacg

SEQ ID NO: 635510 - DNA, 20 bp, mouse
ggcggaggactgtaggcttg

SEQ ID NO: 635511 - DNA, 20 bp, mouse
ggcccccgtgcgtggaacgc

SEQ ID NO: 635512 - DNA, 20 bp, mouse
gtgagctaatccccctccac

SEQ ID NO: 635513 - DNA, 20 bp, mouse
gtgcgctcctcctcctctag

SEQ ID NO: 635514 - DNA, 20 bp, mouse
gggaggaggagcgcactgcg

SEQ ID NO: 635515 - DNA, 20 bp, mouse
gcctctaggggagcacataa

SEQ ID NO: 635516 - DNA, 20 bp, mouse
gagacccggcgactcgaagc

SEQ ID NO: 635517 - DNA, 20 bp, mouse
gggagagggcggagcgtcga

SEQ ID NO: 635518 - DNA, 20 bp, mouse
gccgccctctccaccggagg

SEQ ID NO: 635519 - DNA, 20 bp, mouse
gtacctggccaactcccgca

SEQ ID NO: 635520 - DNA, 20 bp, mouse
gcgcccatggtgacaccgag

SEQ ID NO: 635521 - DNA, 20 bp, mouse
gtcccgcagggcggggatca

SEQ ID NO: 635522 - DNA, 20 bp, mouse
ggccactgtgagggagggaa

SEQ ID NO: 635523 - DNA, 20 bp, mouse
gggcgaccacgggctggagc

SEQ ID NO: 635524 - DNA, 20 bp, mouse
gatccccgccctgcgggagt

SEQ ID NO: 635525 - DNA, 20 bp, mouse
gcggccaactgccactgtga

SEQ ID NO: 635526 - DNA, 20 bp, mouse
gtgacaaaggaaagctacgt

SEQ ID NO: 635527 - DNA, 20 bp, mouse
ggcaaccctcaggagctaag

SEQ ID NO: 635528 - DNA, 20 bp, mouse
gctacgtgggcccagagcct

SEQ ID NO: 635529 - DNA, 20 bp, mouse
gttggtgtgtacagtgttaa

SEQ ID NO: 635530 - DNA, 20 bp, mouse
ggcccagagcctggggatgg

SEQ ID NO: 635531 - DNA, 20 bp, mouse
gtaactccacagcaaccctc

SEQ ID NO: 635532 - DNA, 20 bp, mouse
gctgtgtgtatgtctcttca

SEQ ID NO: 635533 - DNA, 20 bp, mouse
gcggaacctagagttcagtc

SEQ ID NO: 635534 - DNA, 20 bp, mouse
gcgtgccattggtttgtcaa

SEQ ID NO: 635535 - DNA, 20 bp, mouse
gggttgctgtggagttaaca

SEQ ID NO: 635536 - DNA, 20 bp, mouse
gaatgggcaagtcctaggga

SEQ ID NO: 635537 - DNA, 20 bp, mouse
gtaggtgtctagtatctgca

SEQ ID NO: 635538 - DNA, 20 bp, mouse
gcaagtcctagggagggatt

SEQ ID NO: 635539 - DNA, 20 bp, mouse
gaaagtgctctcagagtaga

SEQ ID NO: 635540 - DNA, 20 bp, mouse
gttcccggaactacaagcgc

SEQ ID NO: 635541 - DNA, 20 bp, mouse
ggtctagtatctgcagggag

SEQ ID NO: 635542 - DNA, 20 bp, mouse
gttcccgcgcttgtagttcc

SEQ ID NO: 635543 - DNA, 20 bp, mouse
gcagtgagggtgtgtgcaga

SEQ ID NO: 635544 - DNA, 20 bp, mouse
gtgtagttccgggaacatct

SEQ ID NO: 635545 - DNA, 20 bp, mouse
gagacacctaatccctccct

SEQ ID NO: 635546 - DNA, 20 bp, mouse
ggctggaggaaggacgtttg

SEQ ID NO: 635547 - DNA, 20 bp, mouse
gcgggaagttcgaacggacg

SEQ ID NO: 635548 - DNA, 20 bp, mouse
gcgttcgaacttcccggccg

SEQ ID NO: 635549 - DNA, 20 bp, mouse
gcgcgtgcgtccggagggag

SEQ ID NO: 635550 - DNA, 20 bp, mouse
gcggacgtggaagagcccgc

SEQ ID NO: 635551 - DNA, 20 bp, mouse
ggccgctcacccggcagcga

SEQ ID NO: 635552 - DNA, 20 bp, mouse
gcggggcctcggctgcccaa

SEQ ID NO: 635553 - DNA, 20 bp, mouse
gctcggctgcccaacggctt

SEQ ID NO: 635554 - DNA, 20 bp, mouse
gcacgccgcgtgcgtccgga

SEQ ID NO: 635555 - DNA, 20 bp, mouse
gtcagcacgccgcgtgcgtc

SEQ ID NO: 635556 - DNA, 20 bp, mouse
gccagtccagtcaattgcct

SEQ ID NO: 635557 - DNA, 20 bp, mouse
gcaaacacgaggcaggtctg

SEQ ID NO: 635558 - DNA, 20 bp, mouse
gctaaggcctagtgatacag

SEQ ID NO: 635559 - DNA, 20 bp, mouse
gctcttcccaggcaattgac

SEQ ID NO: 635560 - DNA, 20 bp, mouse
ggcgcgcggggtgctgccaa

SEQ ID NO: 635561 - DNA, 20 bp, mouse
gcgcaccgcaaacacgaggc

SEQ ID NO: 635562 - DNA, 20 bp, mouse
ggctgcgcaccgcaaacacg

SEQ ID NO: 635563 - DNA, 20 bp, mouse
gcaattgactggactggatg

SEQ ID NO: 635564 - DNA, 20 bp, mouse
ggcctaggctacaccccagc

SEQ ID NO: 635565 - DNA, 20 bp, mouse
gcactgcgcacggagctcgg

SEQ ID NO: 635566 - DNA, 20 bp, mouse
ggggttccctaacttctctc

SEQ ID NO: 635567 - DNA, 20 bp, mouse
ggggactggcttgcctcctg

SEQ ID NO: 635568 - DNA, 20 bp, mouse
gtggttgtgttcattgcaca

SEQ ID NO: 635569 - DNA, 20 bp, mouse
gggactccagagagaagtta

SEQ ID NO: 635570 - DNA, 20 bp, mouse
ggaacccagcgatgtaacac

SEQ ID NO: 635571 - DNA, 20 bp, mouse
gcaggagaagcaggaccttg

SEQ ID NO: 635572 - DNA, 20 bp, mouse
gcacaggtgatgtcacagat

SEQ ID NO: 635573 - DNA, 20 bp, mouse
gggaggcaagccagtcccac

SEQ ID NO: 635574 - DNA, 20 bp, mouse
gtgtgagaggaacagattta

SEQ ID NO: 635575 - DNA, 20 bp, mouse
gggctgatggcctgtgggac

SEQ ID NO: 635576 - DNA, 20 bp, mouse
gtgggcgcggaggccggccc

SEQ ID NO: 635577 - DNA, 20 bp, mouse
ggcgccctcgtcgccgtcgt

SEQ ID NO: 635578 - DNA, 20 bp, mouse
gcggtccggggcggcgccct

SEQ ID NO: 635579 - DNA, 20 bp, mouse
gggacagcgtcttgaggacg

SEQ ID NO: 635580 - DNA, 20 bp, mouse
gggcggcgccctcggagctg

SEQ ID NO: 635581 - DNA, 20 bp, mouse
gcggaggccgccgcggtccg

SEQ ID NO: 635582 - DNA, 20 bp, mouse
ggagctgaggtgcgagagcg

SEQ ID NO: 635583 - DNA, 20 bp, mouse
gtctcgcacctcagctccga

SEQ ID NO: 635584 - DNA, 20 bp, mouse
gcggtcggcccgcccggtac

SEQ ID NO: 635585 - DNA, 20 bp, mouse
gccaccgagcgcgccgacga

SEQ ID NO: 635586 - DNA, 20 bp, mouse
ggatgacgacatcttgagat

SEQ ID NO: 635587 - DNA, 20 bp, mouse
gcgtcatcgatgtgtcgaac

SEQ ID NO: 635588 - DNA, 20 bp, mouse
gattaaaaagaccatgaacg

SEQ ID NO: 635589 - DNA, 20 bp, mouse
gtctcaccagtccccgttca

SEQ ID NO: 635590 - DNA, 20 bp, mouse
gatcttgagatagggttttc

SEQ ID NO: 635591 - DNA, 20 bp, mouse
gaagttgactgtgttgtgta

SEQ ID NO: 635592 - DNA, 20 bp, mouse
gcactgcacagttttctcag

SEQ ID NO: 635593 - DNA, 20 bp, mouse
gagaaaactgtgcagtgctc

SEQ ID NO: 635594 - DNA, 20 bp, mouse
gctcaatgactgttaatgag

SEQ ID NO: 635595 - DNA, 20 bp, mouse
gaaagaccatgaacggggac

SEQ ID NO: 635596 - DNA, 20 bp, mouse
ggcaccagaggctacttcaa

SEQ ID NO: 635597 - DNA, 20 bp, mouse
ggatgggtacgggcagtatg

SEQ ID NO: 635598 - DNA, 20 bp, mouse
gccaagagaggtgataattt

SEQ ID NO: 635599 - DNA, 20 bp, mouse
gggatgacctaaggcaccag

SEQ ID NO: 635600 - DNA, 20 bp, mouse
gactagtatcgcgatgggta

SEQ ID NO: 635601 - DNA, 20 bp, mouse
gatcccaaggactcatatct

SEQ ID NO: 635602 - DNA, 20 bp, mouse
gtagagggcctttcttgtct

SEQ ID NO: 635603 - DNA, 20 bp, mouse
gattcagactagtatcgcga

SEQ ID NO: 635604 - DNA, 20 bp, mouse
gggtgccttaggtcatccca

SEQ ID NO: 635605 - DNA, 20 bp, mouse
gcctgggagaccataatctc

SEQ ID NO: 635606 - DNA, 20 bp, mouse
gctctctttgccatcttcag

SEQ ID NO: 635607 - DNA, 20 bp, mouse
gaaaaatcatgtcacaaaga

SEQ ID NO: 635608 - DNA, 20 bp, mouse
gttctaagagcctctgaaga

SEQ ID NO: 635609 - DNA, 20 bp, mouse
gaagacagagatacccaggg

SEQ ID NO: 635610 - DNA, 20 bp, mouse
gaggcctgacccaaatctta

SEQ ID NO: 635611 - DNA, 20 bp, mouse
gttctcagttccaaaatggg

SEQ ID NO: 635612 - DNA, 20 bp, mouse
ggtaaagacagagataccca

SEQ ID NO: 635613 - DNA, 20 bp, mouse
gcaaaatcagggaccaggga

SEQ ID NO: 635614 - DNA, 20 bp, mouse
gagacttctcagttccaaaa

SEQ ID NO: 635615 - DNA, 20 bp, mouse
gaagcataaggacttgttgt

SEQ ID NO: 635616 - DNA, 20 bp, mouse
gccagagtcctgaaagtgga

SEQ ID NO: 635617 - DNA, 20 bp, mouse
gcagtccaaaccccgagtag

SEQ ID NO: 635618 - DNA, 20 bp, mouse
gggagctgaatgtaggaaaa

SEQ ID NO: 635619 - DNA, 20 bp, mouse
ggaatgtaggaaaaaggagt

SEQ ID NO: 635620 - DNA, 20 bp, mouse
gcatgtgagggggaaatagg

SEQ ID NO: 635621 - DNA, 20 bp, mouse
gagccacgccctagtccgat

SEQ ID NO: 635622 - DNA, 20 bp, mouse
gtaaagagagagccactact

SEQ ID NO: 635623 - DNA, 20 bp, mouse
ggtcctaagtcatagttagg

SEQ ID NO: 635624 - DNA, 20 bp, mouse
gattaccagagtcctgaaag

SEQ ID NO: 635625 - DNA, 20 bp, mouse
gtagggcgtggctaaaggtg

SEQ ID NO: 635626 - DNA, 20 bp, mouse
gtccaaggcccccaagttcc

SEQ ID NO: 635627 - DNA, 20 bp, mouse
gttcccggatgcaggaagag

SEQ ID NO: 635628 - DNA, 20 bp, mouse
gactctagacttgtgtgctt

SEQ ID NO: 635629 - DNA, 20 bp, mouse
gtctgcttcaccatctacaa

SEQ ID NO: 635630 - DNA, 20 bp, mouse
gtccacggggtctatcttag

SEQ ID NO: 635631 - DNA, 20 bp, mouse
gaggggacaaatgactttct

SEQ ID NO: 635632 - DNA, 20 bp, mouse
gggaccgcttacgtcacaaa

SEQ ID NO: 635633 - DNA, 20 bp, mouse
gacttcccaaaatggctcca

SEQ ID NO: 635634 - DNA, 20 bp, mouse
ggcaaagttgagtgtgaatg

SEQ ID NO: 635635 - DNA, 20 bp, mouse
ggagtgtgaatgtgggacta

SEQ ID NO: 635636 - DNA, 20 bp, mouse
gcctcctgcgacccctggtt

SEQ ID NO: 635637 - DNA, 20 bp, mouse
gccaaggctcgaggagtcga

SEQ ID NO: 635638 - DNA, 20 bp, mouse
gcaagagcaaatgggaccca

SEQ ID NO: 635639 - DNA, 20 bp, mouse
gtcgacggcattcctaacca

SEQ ID NO: 635640 - DNA, 20 bp, mouse
gcctgtgtaaaggggggtga

SEQ ID NO: 635641 - DNA, 20 bp, mouse
gtgtgagcctgtgtaaaggg

SEQ ID NO: 635642 - DNA, 20 bp, mouse
ggctcctaggccgtgtccat

SEQ ID NO: 635643 - DNA, 20 bp, mouse
gaccgcaggcctccctgggg

SEQ ID NO: 635644 - DNA, 20 bp, mouse
gaaatgggacccaaggctcg

SEQ ID NO: 635645 - DNA, 20 bp, mouse
gagactggttacaaacagtg

SEQ ID NO: 635646 - DNA, 20 bp, mouse
ggcagcctgagattccttag

SEQ ID NO: 635647 - DNA, 20 bp, mouse
gacggccactaaggaatctc

SEQ ID NO: 635648 - DNA, 20 bp, mouse
gagaaatggtcttgctagtc

SEQ ID NO: 635649 - DNA, 20 bp, mouse
gaggctatagaaaacttaga

SEQ ID NO: 635650 - DNA, 20 bp, mouse
ggccgtgagcatctgagaaa

SEQ ID NO: 635651 - DNA, 20 bp, mouse
gaaacttagaagggatgcaa

SEQ ID NO: 635652 - DNA, 20 bp, mouse
gaaactctcgctcacactgg

SEQ ID NO: 635653 - DNA, 20 bp, mouse
gatcaaagagacatagaggc

SEQ ID NO: 635654 - DNA, 20 bp, mouse
gacgaaactctcgctcacac

SEQ ID NO: 635655 - DNA, 20 bp, mouse
gcgctcacactggaggactc

SEQ ID NO: 635656 - DNA, 20 bp, mouse
gtctatcacacttgaagatg

SEQ ID NO: 635657 - DNA, 20 bp, mouse
ggtcagaatgaatcaatgaa

SEQ ID NO: 635658 - DNA, 20 bp, mouse
gtttaggctacatagtgtga

SEQ ID NO: 635659 - DNA, 20 bp, mouse
gcattcaaaactgacatttt

SEQ ID NO: 635660 - DNA, 20 bp, mouse
gtgaatcaatgaatggggat

SEQ ID NO: 635661 - DNA, 20 bp, mouse
gtcaagtgtgatagaacatg

SEQ ID NO: 635662 - DNA, 20 bp, mouse
ggtttcaggaagagttcata

SEQ ID NO: 635663 - DNA, 20 bp, mouse
gcaataattttggtagaatg

SEQ ID NO: 635664 - DNA, 20 bp, mouse
ggaatgaatatcttactacc

SEQ ID NO: 635665 - DNA, 20 bp, mouse
gtttgaatgctaaattcacc

SEQ ID NO: 635666 - DNA, 20 bp, mouse
gcagtgatgggaatgaaagg

SEQ ID NO: 635667 - DNA, 20 bp, mouse
ggatcaccctcgcatgccaa

SEQ ID NO: 635668 - DNA, 20 bp, mouse
gggcccctttcccaatgcac

SEQ ID NO: 635669 - DNA, 20 bp, mouse
gaatgaaaggaggtagcgtg

SEQ ID NO: 635670 - DNA, 20 bp, mouse
gtttacttctggccagtgat

SEQ ID NO: 635671 - DNA, 20 bp, mouse
gtcaacctgtgcattgggaa

SEQ ID NO: 635672 - DNA, 20 bp, mouse
gcagagcagtgccttgtaga

SEQ ID NO: 635673 - DNA, 20 bp, mouse
ggcagtgccttgtagacggt

SEQ ID NO: 635674 - DNA, 20 bp, mouse
ggctcatagtgctggaagtc

SEQ ID NO: 635675 - DNA, 20 bp, mouse
gctgtgcccttggcatgcga

SEQ ID NO: 635676 - DNA, 20 bp, mouse
gactgggagctctaccggga

SEQ ID NO: 635677 - DNA, 20 bp, mouse
gagaacgaggggtccagcca

SEQ ID NO: 635678 - DNA, 20 bp, mouse
gagagctggcgacacgggag

SEQ ID NO: 635679 - DNA, 20 bp, mouse
ggggctactgagagccagac

SEQ ID NO: 635680 - DNA, 20 bp, mouse
gaccaagtcagtgtgacccg

SEQ ID NO: 635681 - DNA, 20 bp, mouse
gaccttcaggaaagttgctt

SEQ ID NO: 635682 - DNA, 20 bp, mouse
gaaggaaggctgagaacgag

SEQ ID NO: 635683 - DNA, 20 bp, mouse
gtgctaggagcgttgctagg

SEQ ID NO: 635684 - DNA, 20 bp, mouse
gcccgaagcaactttcctga

SEQ ID NO: 635685 - DNA, 20 bp, mouse
gtctggcgcccgagaccttc

SEQ ID NO: 635686 - DNA, 20 bp, mouse
gaacgaggacaagtgagcac

SEQ ID NO: 635687 - DNA, 20 bp, mouse
gactacgcgtggtgcggcga

SEQ ID NO: 635688 - DNA, 20 bp, mouse
ggtggtgcggcgaggggcaa

SEQ ID NO: 635689 - DNA, 20 bp, mouse
gcgcaagcgcaaactacgcg

SEQ ID NO: 635690 - DNA, 20 bp, mouse
gggaggtcgtggtgcgagca

SEQ ID NO: 635691 - DNA, 20 bp, mouse
gagcacgggccacggaagga

SEQ ID NO: 635692 - DNA, 20 bp, mouse
ggacaagtgagcacgggcca

SEQ ID NO: 635693 - DNA, 20 bp, mouse
gtgcgcttgcgccgtgaccc

SEQ ID NO: 635694 - DNA, 20 bp, mouse
gagtaactgcgcctgggtca

SEQ ID NO: 635695 - DNA, 20 bp, mouse
ggcgcaaactacgcgtggtg

SEQ ID NO: 635696 - DNA, 20 bp, mouse
gccaacgcgcgtactgatcc

SEQ ID NO: 635697 - DNA, 20 bp, mouse
gaaggggcttcaaggactgg

SEQ ID NO: 635698 - DNA, 20 bp, mouse
gggaacccctcccacctaca

SEQ ID NO: 635699 - DNA, 20 bp, mouse
gggagaaacgccttgtaggt

SEQ ID NO: 635700 - DNA, 20 bp, mouse
gtctctgtggagagaacagg

SEQ ID NO: 635701 - DNA, 20 bp, mouse
gtcttctgagggtacttggt

SEQ ID NO: 635702 - DNA, 20 bp, mouse
ggtctcccgcagctaggtga

SEQ ID NO: 635703 - DNA, 20 bp, mouse
gtgggctcttgaggttcttg

SEQ ID NO: 635704 - DNA, 20 bp, mouse
gacatgagcaaggggcttca

SEQ ID NO: 635705 - DNA, 20 bp, mouse
ggatcctggaccttttgtga

SEQ ID NO: 635706 - DNA, 20 bp, mouse
gggaaggccaccaacttctc

SEQ ID NO: 635707 - DNA, 20 bp, mouse
gtctctggggctgtggacta

SEQ ID NO: 635708 - DNA, 20 bp, mouse
ggtggaaaggatgatcaatg

SEQ ID NO: 635709 - DNA, 20 bp, mouse
gctgccctcaggccacggtc

SEQ ID NO: 635710 - DNA, 20 bp, mouse
gggtcagttaatctcacctg

SEQ ID NO: 635711 - DNA, 20 bp, mouse
ggctggatgagggtatctaa

SEQ ID NO: 635712 - DNA, 20 bp, mouse
gacctcgatcagctggatga

SEQ ID NO: 635713 - DNA, 20 bp, mouse
gactatggccattctcttgt

SEQ ID NO: 635714 - DNA, 20 bp, mouse
gagctccagaccgtggcctg

SEQ ID NO: 635715 - DNA, 20 bp, mouse
gtatctaagggcttctctcc

SEQ ID NO: 635716 - DNA, 20 bp, mouse
ggagaatcaggattcccttc

SEQ ID NO: 635717 - DNA, 20 bp, mouse
gaatagaaagctggagaatc

SEQ ID NO: 635718 - DNA, 20 bp, mouse
gggtagttgactggttactt

SEQ ID NO: 635719 - DNA, 20 bp, mouse
gcctagtcctggtagttgac

SEQ ID NO: 635720 - DNA, 20 bp, mouse
gtcctaaaatagggactgtg

SEQ ID NO: 635721 - DNA, 20 bp, mouse
gccttacaggacatagggtg

SEQ ID NO: 635722 - DNA, 20 bp, mouse
gacagaagaaatcctaaaat

SEQ ID NO: 635723 - DNA, 20 bp, mouse
gacacaatccaatcagtttc

SEQ ID NO: 635724 - DNA, 20 bp, mouse
ggccacacagtccctatttt

SEQ ID NO: 635725 - DNA, 20 bp, mouse
gccaggactagggtcattgt

SEQ ID NO: 635726 - DNA, 20 bp, mouse
gctcgcagcagactgagaga

SEQ ID NO: 635727 - DNA, 20 bp, mouse
gttaaaccccgccagttctt

SEQ ID NO: 635728 - DNA, 20 bp, mouse
gagcagagcgcgcccacctg

SEQ ID NO: 635729 - DNA, 20 bp, mouse
gccggagcgcgcgctcgctc

SEQ ID NO: 635730 - DNA, 20 bp, mouse
gctcgcggcaaggcaggctc

SEQ ID NO: 635731 - DNA, 20 bp, mouse
gttgccgcgaggtgcacccc

SEQ ID NO: 635732 - DNA, 20 bp, mouse
gcagttcttcggagtgattt

SEQ ID NO: 635733 - DNA, 20 bp, mouse
ggggaactgtaactagagta

SEQ ID NO: 635734 - DNA, 20 bp, mouse
gcaggtctaaaaggtctctg

SEQ ID NO: 635735 - DNA, 20 bp, mouse
ggggtttaagctttggacag

SEQ ID NO: 635736 - DNA, 20 bp, mouse
gtggacggcatgatcatctg

SEQ ID NO: 635737 - DNA, 20 bp, mouse
gaagctgatctgagtgtaca

SEQ ID NO: 635738 - DNA, 20 bp, mouse
gaactgtgacagacactgga

SEQ ID NO: 635739 - DNA, 20 bp, mouse
gggtgaactgtgacagacac

SEQ ID NO: 635740 - DNA, 20 bp, mouse
ggccggaatgccctggagat

SEQ ID NO: 635741 - DNA, 20 bp, mouse
gtggcgttgtggtgctgggg

SEQ ID NO: 635742 - DNA, 20 bp, mouse
ggcttggcgttgtggtgctg

SEQ ID NO: 635743 - DNA, 20 bp, mouse
gtggcgcaaaccgatctcca

SEQ ID NO: 635744 - DNA, 20 bp, mouse
gctgactggccggaatgccc

SEQ ID NO: 635745 - DNA, 20 bp, mouse
gtggcaaattgttaaactct

SEQ ID NO: 635746 - DNA, 20 bp, mouse
ggggaccaacgcagcctctc

SEQ ID NO: 635747 - DNA, 20 bp, mouse
gaggccccgagaggctgcgt

SEQ ID NO: 635748 - DNA, 20 bp, mouse
gaagtggctgaggccccgag

SEQ ID NO: 635749 - DNA, 20 bp, mouse
gccccggcggtaagtggctg

SEQ ID NO: 635750 - DNA, 20 bp, mouse
ggggcactgcctccactccg

SEQ ID NO: 635751 - DNA, 20 bp, mouse
gctcccgatgaggaccagcg

SEQ ID NO: 635752 - DNA, 20 bp, mouse
gtggtcctcatcgggagcta

SEQ ID NO: 635753 - DNA, 20 bp, mouse
gggggctggggagtgtcgca

SEQ ID NO: 635754 - DNA, 20 bp, mouse
gcgacactccccagccccgg

SEQ ID NO: 635755 - DNA, 20 bp, mouse
ggcgcccagagaggatgcgc

SEQ ID NO: 635756 - DNA, 20 bp, mouse
gcactaggggagtaagggaa

SEQ ID NO: 635757 - DNA, 20 bp, mouse
ggcaaagccggcaacctaac

SEQ ID NO: 635758 - DNA, 20 bp, mouse
gggaacaaaggccctagagc

SEQ ID NO: 635759 - DNA, 20 bp, mouse
gtttgccactaggggagtaa

SEQ ID NO: 635760 - DNA, 20 bp, mouse
gaagagaatccggtctggag

SEQ ID NO: 635761 - DNA, 20 bp, mouse
gtaaggaagagaatccggtc

SEQ ID NO: 635762 - DNA, 20 bp, mouse
gcccccacctactaggttaa

SEQ ID NO: 635763 - DNA, 20 bp, mouse
gatgaccccaatgggaacaa

SEQ ID NO: 635764 - DNA, 20 bp, mouse
gtaaaactgggtgcagtgtg

SEQ ID NO: 635765 - DNA, 20 bp, mouse
gcctactaggttaaaggtcg

SEQ ID NO: 635766 - DNA, 20 bp, mouse
gccgccgcaccaggaagtgg

SEQ ID NO: 635767 - DNA, 20 bp, mouse
gcccaacacggacctgccaa

SEQ ID NO: 635768 - DNA, 20 bp, mouse
gggctgcgggcgctgaggta

SEQ ID NO: 635769 - DNA, 20 bp, mouse
ggcggcgcgcacgcccaaca

SEQ ID NO: 635770 - DNA, 20 bp, mouse
ggaagcgggcccgcggtggg

SEQ ID NO: 635771 - DNA, 20 bp, mouse
gctgcggcggcgggcgaagg

SEQ ID NO: 635772 - DNA, 20 bp, mouse
gtagccgccgcaccaggaag

SEQ ID NO: 635773 - DNA, 20 bp, mouse
gccaccaccacggccgcctc

SEQ ID NO: 635774 - DNA, 20 bp, mouse
ggtcgccaacgccaccacca

SEQ ID NO: 635775 - DNA, 20 bp, mouse
gaagggggtcgaacccgagg

SEQ ID NO: 635776 - DNA, 20 bp, mouse
gcaagccaggtcaggttcac

SEQ ID NO: 635777 - DNA, 20 bp, mouse
gaccccgagggcaaatctga

SEQ ID NO: 635778 - DNA, 20 bp, mouse
gggaagcgcagtaaatctgt

SEQ ID NO: 635779 - DNA, 20 bp, mouse
ggcagcctgtgaacctgacc

SEQ ID NO: 635780 - DNA, 20 bp, mouse
gttgaacgccagttctgact

SEQ ID NO: 635781 - DNA, 20 bp, mouse
ggtaggagactgctcggtct

SEQ ID NO: 635782 - DNA, 20 bp, mouse
ggatttgccctcggggttaa

SEQ ID NO: 635783 - DNA, 20 bp, mouse
gaatcagctgtgctccttat

SEQ ID NO: 635784 - DNA, 20 bp, mouse
gccgaggaagcccagacacc

SEQ ID NO: 635785 - DNA, 20 bp, mouse
gcttcctcgggctcaccaat

SEQ ID NO: 635786 - DNA, 20 bp, mouse
gacacccgtgctagctgttg

SEQ ID NO: 635787 - DNA, 20 bp, mouse
gcaaacctgccccttttctt

SEQ ID NO: 635788 - DNA, 20 bp, mouse
ggctagctgttgtggtcact

SEQ ID NO: 635789 - DNA, 20 bp, mouse
gatactggataaagtctctt

SEQ ID NO: 635790 - DNA, 20 bp, mouse
gggtcaccaagcaccatgag

SEQ ID NO: 635791 - DNA, 20 bp, mouse
gatcacccaagaaaaggggc

SEQ ID NO: 635792 - DNA, 20 bp, mouse
gtctcagaatgttctcagtc

SEQ ID NO: 635793 - DNA, 20 bp, mouse
ggacataaggtggatatgta

SEQ ID NO: 635794 - DNA, 20 bp, mouse
gtgagaacattctgagaaca

SEQ ID NO: 635795 - DNA, 20 bp, mouse
gcctgccattcagtacatac

SEQ ID NO: 635796 - DNA, 20 bp, mouse
gagggcagagtaagatttgt

SEQ ID NO: 635797 - DNA, 20 bp, mouse
gcatcactctccaggaggca

SEQ ID NO: 635798 - DNA, 20 bp, mouse
gggtgctggggtcggagtac

SEQ ID NO: 635799 - DNA, 20 bp, mouse
gtcattggctcgctgtctga

SEQ ID NO: 635800 - DNA, 20 bp, mouse
gtgcatgtgcccttgaagtc

SEQ ID NO: 635801 - DNA, 20 bp, mouse
gttactaaaacagtctttgc

SEQ ID NO: 635802 - DNA, 20 bp, mouse
gttgaagtccggaagagggt

SEQ ID NO: 635803 - DNA, 20 bp, mouse
gttgctcgataatgggtgct

SEQ ID NO: 635804 - DNA, 20 bp, mouse
gttgtgagttgctcgataat

SEQ ID NO: 635805 - DNA, 20 bp, mouse
gagagcatttgctgctgata

SEQ ID NO: 635806 - DNA, 20 bp, mouse
gtggaaactgccttcttgac

SEQ ID NO: 635807 - DNA, 20 bp, mouse
ggggcgggaggagagtatac

SEQ ID NO: 635808 - DNA, 20 bp, mouse
ggcgtcttgtcttgatgctt

SEQ ID NO: 635809 - DNA, 20 bp, mouse
gacactgagactttttccac

SEQ ID NO: 635810 - DNA, 20 bp, mouse
gagctaaaaatatagagcta

SEQ ID NO: 635811 - DNA, 20 bp, mouse
gctatggctgtattgttgcc

SEQ ID NO: 635812 - DNA, 20 bp, mouse
ggttctataaagcatccatt

SEQ ID NO: 635813 - DNA, 20 bp, mouse
ggatgacttagtgtgttcta

SEQ ID NO: 635814 - DNA, 20 bp, mouse
gaaaggaacttagagctttg

SEQ ID NO: 635815 - DNA, 20 bp, mouse
ggctatggagcctgtcaaga

SEQ ID NO: 635816 - DNA, 20 bp, mouse
gggccgtagaggaaccggac

SEQ ID NO: 635817 - DNA, 20 bp, mouse
ggcgagctgcccggaggtgc

SEQ ID NO: 635818 - DNA, 20 bp, mouse
gagagaggagtagtcgcgtg

SEQ ID NO: 635819 - DNA, 20 bp, mouse
gggaagccctagactccggt

SEQ ID NO: 635820 - DNA, 20 bp, mouse
ggcacgtgaacctgcacctc

SEQ ID NO: 635821 - DNA, 20 bp, mouse
ggcggcgctgcacccagcgt

SEQ ID NO: 635822 - DNA, 20 bp, mouse
ggggttgagccagccagcgg

SEQ ID NO: 635823 - DNA, 20 bp, mouse
gggtggccgaccggagtcta

SEQ ID NO: 635824 - DNA, 20 bp, mouse
gacggcccccgctccccaaa

SEQ ID NO: 635825 - DNA, 20 bp, mouse
gcccgctgcgagctgcccgg

SEQ ID NO: 635826 - DNA, 20 bp, mouse
gtaagctgaaggcttgtcca

SEQ ID NO: 635827 - DNA, 20 bp, mouse
gtggttgccgggagactgag

SEQ ID NO: 635828 - DNA, 20 bp, mouse
gcggaggtgtccataagggt

SEQ ID NO: 635829 - DNA, 20 bp, mouse
gcacaaaggaggtagttcta

SEQ ID NO: 635830 - DNA, 20 bp, mouse
gtgcccggaggtgtccataa

SEQ ID NO: 635831 - DNA, 20 bp, mouse
ggagaggcctagattggtag

SEQ ID NO: 635832 - DNA, 20 bp, mouse
gagtgtggggccaactcgtt

SEQ ID NO: 635833 - DNA, 20 bp, mouse
gagtctcccggcaaccacaa

SEQ ID NO: 635834 - DNA, 20 bp, mouse
gccacactgccccaccctta

SEQ ID NO: 635835 - DNA, 20 bp, mouse
gctctcggaacggtgcccgg

SEQ ID NO: 635836 - DNA, 20 bp, mouse
gccacccggcagattactca

SEQ ID NO: 635837 - DNA, 20 bp, mouse
gaggccctccagggcagtaa

SEQ ID NO: 635838 - DNA, 20 bp, mouse
gcactggccgaagcatccgc

SEQ ID NO: 635839 - DNA, 20 bp, mouse
gccgggtggagcagagtgga

SEQ ID NO: 635840 - DNA, 20 bp, mouse
gcggccagtgcgtacccgag

SEQ ID NO: 635841 - DNA, 20 bp, mouse
gaatgtggccattactgccc

SEQ ID NO: 635842 - DNA, 20 bp, mouse
gctgccctggagggcctgaa

SEQ ID NO: 635843 - DNA, 20 bp, mouse
gtcgcccttcaggccctcca

SEQ ID NO: 635844 - DNA, 20 bp, mouse
gcttgcctggggcatctcaa

SEQ ID NO: 635845 - DNA, 20 bp, mouse
gtggccattactgccctgga

SEQ ID NO: 635846 - DNA, 20 bp, mouse
gctcggggaaagggtctccc

SEQ ID NO: 635847 - DNA, 20 bp, mouse
gtccctggggccgaggccgt

SEQ ID NO: 635848 - DNA, 20 bp, mouse
gaactcccgcagctacctat

SEQ ID NO: 635849 - DNA, 20 bp, mouse
gtgcaccgccctcggggaaa

SEQ ID NO: 635850 - DNA, 20 bp, mouse
ggccgcgggagctgatcgtg

SEQ ID NO: 635851 - DNA, 20 bp, mouse
gggagagggttcaccccacc

SEQ ID NO: 635852 - DNA, 20 bp, mouse
ggctacctatgggcgagccg

SEQ ID NO: 635853 - DNA, 20 bp, mouse
gctctccccggctcgcccat

SEQ ID NO: 635854 - DNA, 20 bp, mouse
gtttggctggccggcccgtg

SEQ ID NO: 635855 - DNA, 20 bp, mouse
ggagtggtgcaccgccctcg

SEQ ID NO: 635856 - DNA, 20 bp, mouse
ggggtccccagctgaactgt

SEQ ID NO: 635857 - DNA, 20 bp, mouse
ggaccctaaggagctagatt

SEQ ID NO: 635858 - DNA, 20 bp, mouse
gagcaccagcaatgcctgac

SEQ ID NO: 635859 - DNA, 20 bp, mouse
gcggaagtagcagactaact

SEQ ID NO: 635860 - DNA, 20 bp, mouse
gttaccaaatctagctcctt

SEQ ID NO: 635861 - DNA, 20 bp, mouse
gctagctccttagggtctct

SEQ ID NO: 635862 - DNA, 20 bp, mouse
gtaacatcccagagacccta

SEQ ID NO: 635863 - DNA, 20 bp, mouse
gcccacatactaatctttga

SEQ ID NO: 635864 - DNA, 20 bp, mouse
gtgaagagtcaggtgctgct

SEQ ID NO: 635865 - DNA, 20 bp, mouse
ggatggctcctttggactta

SEQ ID NO: 635866 - DNA, 20 bp, mouse
gcacgcgcagatttgaggca

SEQ ID NO: 635867 - DNA, 20 bp, mouse
gatcatgcccggcgcgagaa

SEQ ID NO: 635868 - DNA, 20 bp, mouse
gcgcgtgacgctcagaagtt

SEQ ID NO: 635869 - DNA, 20 bp, mouse
gcgtgcgcggaggatttggc

SEQ ID NO: 635870 - DNA, 20 bp, mouse
gtgcgcgtgcgcggaggatt

SEQ ID NO: 635871 - DNA, 20 bp, mouse
gagttaagggataggtcatg

SEQ ID NO: 635872 - DNA, 20 bp, mouse
gaagttaggtgttcttgcgc

SEQ ID NO: 635873 - DNA, 20 bp, mouse
gaaacaataatagtagttaa

SEQ ID NO: 635874 - DNA, 20 bp, mouse
gcgcagatttgaggcagggc

SEQ ID NO: 635875 - DNA, 20 bp, mouse
gataatagtagttaagggat

SEQ ID NO: 635876 - DNA, 20 bp, mouse
gcacacaggtccaggcccag

SEQ ID NO: 635877 - DNA, 20 bp, mouse
gctgaggagaaggccaacat

SEQ ID NO: 635878 - DNA, 20 bp, mouse
gtaggaggttttcaggtcta

SEQ ID NO: 635879 - DNA, 20 bp, mouse
gatagagttacctgaggaga

SEQ ID NO: 635880 - DNA, 20 bp, mouse
gcacacatacacacaggtcc

SEQ ID NO: 635881 - DNA, 20 bp, mouse
ggctccggctggagcacctc

SEQ ID NO: 635882 - DNA, 20 bp, mouse
gtatgaggaggggctccggc

SEQ ID NO: 635883 - DNA, 20 bp, mouse
gactctattaggaggttttc

SEQ ID NO: 635884 - DNA, 20 bp, mouse
gcctcatatgctttctctag

SEQ ID NO: 635885 - DNA, 20 bp, mouse
gctcctaatagagttacctg

SEQ ID NO: 635886 - DNA, 20 bp, mouse
gagcctggaacctatttcct

SEQ ID NO: 635887 - DNA, 20 bp, mouse
gcgctccagcttggaatctc

SEQ ID NO: 635888 - DNA, 20 bp, mouse
gggacaacaatgtttaagga

SEQ ID NO: 635889 - DNA, 20 bp, mouse
gaaggtagaagagtgttaga

SEQ ID NO: 635890 - DNA, 20 bp, mouse
gacaatgtttaaggaaggcg

SEQ ID NO: 635891 - DNA, 20 bp, mouse
gttctcagatatgtagacca

SEQ ID NO: 635892 - DNA, 20 bp, mouse
gagtacagctcgctccagct

SEQ ID NO: 635893 - DNA, 20 bp, mouse
gccgttcgccaagtggtatc

SEQ ID NO: 635894 - DNA, 20 bp, mouse
gtccgctttaccaaggaaat

SEQ ID NO: 635895 - DNA, 20 bp, mouse
gcgatgatatctacagttgc

SEQ ID NO: 635896 - DNA, 20 bp, mouse
gccctctacaaccaccggtg

SEQ ID NO: 635897 - DNA, 20 bp, mouse
gcagggctgggtccgagtta

SEQ ID NO: 635898 - DNA, 20 bp, mouse
gggtgtggctggccttaagg

SEQ ID NO: 635899 - DNA, 20 bp, mouse
gccgagttagggatacagtt

SEQ ID NO: 635900 - DNA, 20 bp, mouse
gttaaggccagccacaccgg

SEQ ID NO: 635901 - DNA, 20 bp, mouse
gggccttaagggggcgagca

SEQ ID NO: 635902 - DNA, 20 bp, mouse
gttaagggggcgagcagggc

SEQ ID NO: 635903 - DNA, 20 bp, mouse
ggggatacagttgggcggat

SEQ ID NO: 635904 - DNA, 20 bp, mouse
ggacggctgtctaatttata

SEQ ID NO: 635905 - DNA, 20 bp, mouse
gtaaatccctctacaaccac

SEQ ID NO: 635906 - DNA, 20 bp, mouse
gcccccaaaaaaaagtgggg

SEQ ID NO: 635907 - DNA, 20 bp, mouse
gcccagctgaaggagatagt

SEQ ID NO: 635908 - DNA, 20 bp, mouse
gtaagcctccggaataactg

SEQ ID NO: 635909 - DNA, 20 bp, mouse
gcctgaggcatgagtgaaca

SEQ ID NO: 635910 - DNA, 20 bp, mouse
gcactccgcagttattccgg

SEQ ID NO: 635911 - DNA, 20 bp, mouse
gtcagtgcttacagctgact

SEQ ID NO: 635912 - DNA, 20 bp, mouse
gggaccaaatggcacacctc

SEQ ID NO: 635913 - DNA, 20 bp, mouse
gcaccactccgcagttattc

SEQ ID NO: 635914 - DNA, 20 bp, mouse
gtgcggagtggtgtccatcc

SEQ ID NO: 635915 - DNA, 20 bp, mouse
gtggccagaggtgtgccatt

SEQ ID NO: 635916 - DNA, 20 bp, mouse
gcacgccggcagttcctcct

SEQ ID NO: 635917 - DNA, 20 bp, mouse
ggcagtggaggccgagcagt

SEQ ID NO: 635918 - DNA, 20 bp, mouse
gcctctgccagacttcaaca

SEQ ID NO: 635919 - DNA, 20 bp, mouse
ggcttggtggggtgccactt

SEQ ID NO: 635920 - DNA, 20 bp, mouse
gttccagctatgcctgaaca

SEQ ID NO: 635921 - DNA, 20 bp, mouse
gctgatgccatgttgaagtc

SEQ ID NO: 635922 - DNA, 20 bp, mouse
gggggtgtgggacagtatta

SEQ ID NO: 635923 - DNA, 20 bp, mouse
gtatgatcaacaggcttggt

SEQ ID NO: 635924 - DNA, 20 bp, mouse
gagtgacgccgaggaagccc

SEQ ID NO: 635925 - DNA, 20 bp, mouse
gcatcagccacatgccaaag

SEQ ID NO: 635926 - DNA, 20 bp, mouse
ggcaaatggcactgaacatc

SEQ ID NO: 635927 - DNA, 20 bp, mouse
gaggggtgtgcctgggttac

SEQ ID NO: 635928 - DNA, 20 bp, mouse
gtctccagttcctaattcta

SEQ ID NO: 635929 - DNA, 20 bp, mouse
gttctctgaggggtgtgcct

SEQ ID NO: 635930 - DNA, 20 bp, mouse
gctaggtgtaagagtgacca

SEQ ID NO: 635931 - DNA, 20 bp, mouse
ggggcagcagccctagaatt

SEQ ID NO: 635932 - DNA, 20 bp, mouse
gcagccctagaattaggaac

SEQ ID NO: 635933 - DNA, 20 bp, mouse
gtagagcccatttctctgag

SEQ ID NO: 635934 - DNA, 20 bp, mouse
gtcattgcattgacggagag

SEQ ID NO: 635935 - DNA, 20 bp, mouse
gacagatgtgatgcacagag

SEQ ID NO: 635936 - DNA, 20 bp, mouse
gcgggcaccaggggtatata

SEQ ID NO: 635937 - DNA, 20 bp, mouse
ggcgttgcggggcctttcca

SEQ ID NO: 635938 - DNA, 20 bp, mouse
ggcttggaggcgggcaccag

SEQ ID NO: 635939 - DNA, 20 bp, mouse
gcccgcctccaagctgcgat

SEQ ID NO: 635940 - DNA, 20 bp, mouse
gaggttgttccgcgcgttgc

SEQ ID NO: 635941 - DNA, 20 bp, mouse
gctcacgtgaaaaccaccct

SEQ ID NO: 635942 - DNA, 20 bp, mouse
gcaagctgcgattggttcgg

SEQ ID NO: 635943 - DNA, 20 bp, mouse
gtgcggggcctttccaaggg

SEQ ID NO: 635944 - DNA, 20 bp, mouse
gagcgaacacagggtcctta

SEQ ID NO: 635945 - DNA, 20 bp, mouse
gaggtcccgcagtcccctct

SEQ ID NO: 635946 - DNA, 20 bp, mouse
gttaaaggacactgctggtg

SEQ ID NO: 635947 - DNA, 20 bp, mouse
gaaagattaaaggacactgc

SEQ ID NO: 635948 - DNA, 20 bp, mouse
gaatggatacaaaaaaaatg

SEQ ID NO: 635949 - DNA, 20 bp, mouse
gaatggtgaaaaacaaaaaa

SEQ ID NO: 635950 - DNA, 20 bp, mouse
gaacctttagagaataccgg

SEQ ID NO: 635951 - DNA, 20 bp, mouse
gaaggtataaatagctgtaa

SEQ ID NO: 635952 - DNA, 20 bp, mouse
gaccgggggaaacaatgatg

SEQ ID NO: 635953 - DNA, 20 bp, mouse
gaattctgttctgtgattgg

SEQ ID NO: 635954 - DNA, 20 bp, mouse
gaaacaatgatgtggaaact

SEQ ID NO: 635955 - DNA, 20 bp, mouse
gtctctaaaggttatgggaa

SEQ ID NO: 635956 - DNA, 20 bp, mouse
ggcccaggagggtgtaccac

SEQ ID NO: 635957 - DNA, 20 bp, mouse
gtccagtggtacaccctcct

SEQ ID NO: 635958 - DNA, 20 bp, mouse
ggatctggggagagagccag

SEQ ID NO: 635959 - DNA, 20 bp, mouse
gcccacgtgactgacaagga

SEQ ID NO: 635960 - DNA, 20 bp, mouse
gagagagttcatgtgtgccc

SEQ ID NO: 635961 - DNA, 20 bp, mouse
gtaggcagagcccaaataac

SEQ ID NO: 635962 - DNA, 20 bp, mouse
ggctctgcctagtggcgagt

SEQ ID NO: 635963 - DNA, 20 bp, mouse
gaacccacagtctttggctg

SEQ ID NO: 635964 - DNA, 20 bp, mouse
gaagctcgcaagtcctcctc

SEQ ID NO: 635965 - DNA, 20 bp, mouse
gaaagactgtgggttcttct

SEQ ID NO: 635966 - DNA, 20 bp, mouse
gtgccgtctgaggtgtaaag

SEQ ID NO: 635967 - DNA, 20 bp, mouse
gtaaggcacaatgccgtctg

SEQ ID NO: 635968 - DNA, 20 bp, mouse
ggcaaaaggcacacagacct

SEQ ID NO: 635969 - DNA, 20 bp, mouse
gtaaagggtgaacaaagctc

SEQ ID NO: 635970 - DNA, 20 bp, mouse
gtgcctctttacacctcaga

SEQ ID NO: 635971 - DNA, 20 bp, mouse
gaactccttgtttcaatcgt

SEQ ID NO: 635972 - DNA, 20 bp, mouse
gccttccagaagccgaaatc

SEQ ID NO: 635973 - DNA, 20 bp, mouse
ggcatccggagccagatctt

SEQ ID NO: 635974 - DNA, 20 bp, mouse
ggacctaggctgccagggtc

SEQ ID NO: 635975 - DNA, 20 bp, mouse
gccctcaccctgatagggac

SEQ ID NO: 635976 - DNA, 20 bp, mouse
gaatggggaaggtcgacggt

SEQ ID NO: 635977 - DNA, 20 bp, mouse
gccgttgcggcgggccaatg

SEQ ID NO: 635978 - DNA, 20 bp, mouse
ggaagcgccgctggccaagt

SEQ ID NO: 635979 - DNA, 20 bp, mouse
gttggccagcggcgcttccc

SEQ ID NO: 635980 - DNA, 20 bp, mouse
gcacgcggaacccgttgcgg

SEQ ID NO: 635981 - DNA, 20 bp, mouse
gtccccggcaggaggcggtt

SEQ ID NO: 635982 - DNA, 20 bp, mouse
gtgatgtcatcaatgggcgg

SEQ ID NO: 635983 - DNA, 20 bp, mouse
gaatcagaacgctgcgttca

SEQ ID NO: 635984 - DNA, 20 bp, mouse
ggggggaaggagtaaatgtc

SEQ ID NO: 635985 - DNA, 20 bp, mouse
ggcgttcaggggccagcacg

SEQ ID NO: 635986 - DNA, 20 bp, mouse
ggacagagctagggactcag

SEQ ID NO: 635987 - DNA, 20 bp, mouse
ggcccggacggcttcccagg

SEQ ID NO: 635988 - DNA, 20 bp, mouse
gaagtatcggagagcccatg

SEQ ID NO: 635989 - DNA, 20 bp, mouse
gcctgagaggggccatcatc

SEQ ID NO: 635990 - DNA, 20 bp, mouse
gagcccatggggcgcctacc

SEQ ID NO: 635991 - DNA, 20 bp, mouse
gagggactcaggggcccgga

SEQ ID NO: 635992 - DNA, 20 bp, mouse
gggcccggtaggcgccccat

SEQ ID NO: 635993 - DNA, 20 bp, mouse
gcgcaaagctcctacttaaa

SEQ ID NO: 635994 - DNA, 20 bp, mouse
gtggactatagagcagagag

SEQ ID NO: 635995 - DNA, 20 bp, mouse
gagtccctagctctgtcatg

SEQ ID NO: 635996 - DNA, 20 bp, mouse
gcggaaggagccgccttcga

SEQ ID NO: 635997 - DNA, 20 bp, mouse
gcgagtgggcggggtcacgg

SEQ ID NO: 635998 - DNA, 20 bp, mouse
gaaggcggctccttccgagt

SEQ ID NO: 635999 - DNA, 20 bp, mouse
gcaggctactgtgaagggcc

SEQ ID NO: 636000 - DNA, 20 bp, mouse
ggggtcacggcggacacgcc

SEQ ID NO: 636001 - DNA, 20 bp, mouse
gaggcaccagagggagctga

SEQ ID NO: 636002 - DNA, 20 bp, mouse
gcccgcccaggctactgtga

SEQ ID NO: 636003 - DNA, 20 bp, mouse
ggactcctcctccccttcga

SEQ ID NO: 636004 - DNA, 20 bp, mouse
ggtaaccccacccaccgaac

SEQ ID NO: 636005 - DNA, 20 bp, mouse
gtcctcctccccttcgaagg

SEQ ID NO: 636006 - DNA, 20 bp, mouse
gacaacgcaggacgaacgta

SEQ ID NO: 636007 - DNA, 20 bp, mouse
ggcggtgcgtgtggtctcga

SEQ ID NO: 636008 - DNA, 20 bp, mouse
gcgaaccgccctggcacaac

SEQ ID NO: 636009 - DNA, 20 bp, mouse
gttagcgggcgtcccggaag

SEQ ID NO: 636010 - DNA, 20 bp, mouse
gccagggcggttcgctgaag

SEQ ID NO: 636011 - DNA, 20 bp, mouse
ggcaggacgaacgtaaggga

SEQ ID NO: 636012 - DNA, 20 bp, mouse
gagaagcagtggttagtaac

SEQ ID NO: 636013 - DNA, 20 bp, mouse
gttcggagcgtgaagaagag

SEQ ID NO: 636014 - DNA, 20 bp, mouse
gggcacaacaggtacaacgc

SEQ ID NO: 636015 - DNA, 20 bp, mouse
gcgaaggaccggtgcagaca

SEQ ID NO: 636016 - DNA, 20 bp, mouse
gccgttgtgtggagaagggt

SEQ ID NO: 636017 - DNA, 20 bp, mouse
ggctctgaagggaagtcgag

SEQ ID NO: 636018 - DNA, 20 bp, mouse
gacaggaagtagtttcccac

SEQ ID NO: 636019 - DNA, 20 bp, mouse
gcacctgagcctacctaagc

SEQ ID NO: 636020 - DNA, 20 bp, mouse
gaataggaaacggacctaaa

SEQ ID NO: 636021 - DNA, 20 bp, mouse
gctgcctggggttctagctt

SEQ ID NO: 636022 - DNA, 20 bp, mouse
gtagccacgccagcttaggt

SEQ ID NO: 636023 - DNA, 20 bp, mouse
gctgcgcaagcgcaagatac

SEQ ID NO: 636024 - DNA, 20 bp, mouse
gctgcatggagcctaataca

SEQ ID NO: 636025 - DNA, 20 bp, mouse
gacaacggcaacatccgttt

SEQ ID NO: 636026 - DNA, 20 bp, mouse
ggggtggagctgccacttcc

SEQ ID NO: 636027 - DNA, 20 bp, mouse
gcatcaggaggggatcaggt

SEQ ID NO: 636028 - DNA, 20 bp, mouse
gaggggatcaggttggttag

SEQ ID NO: 636029 - DNA, 20 bp, mouse
gtaagcacgcgcagcaccct

SEQ ID NO: 636030 - DNA, 20 bp, mouse
gtgtgcggtgtacacttcag

SEQ ID NO: 636031 - DNA, 20 bp, mouse
ggagctgccacttcctggag

SEQ ID NO: 636032 - DNA, 20 bp, mouse
gtaaacgtctggacgttttg

SEQ ID NO: 636033 - DNA, 20 bp, mouse
gcaaagcggttcctttaagc

SEQ ID NO: 636034 - DNA, 20 bp, mouse
gttgctgttcagtgggttta

SEQ ID NO: 636035 - DNA, 20 bp, mouse
ggctgcgtgggagcatccca

SEQ ID NO: 636036 - DNA, 20 bp, mouse
gaggggcagcagagggttcg

SEQ ID NO: 636037 - DNA, 20 bp, mouse
gaaccctctgctgcccctgg

SEQ ID NO: 636038 - DNA, 20 bp, mouse
gcggtcccccgctaagtctg

SEQ ID NO: 636039 - DNA, 20 bp, mouse
ggggaggtggagaatgttcg

SEQ ID NO: 636040 - DNA, 20 bp, mouse
gactctcgcgatgtcgagaa

SEQ ID NO: 636041 - DNA, 20 bp, mouse
gaggtgagacgacccattct

SEQ ID NO: 636042 - DNA, 20 bp, mouse
gaagatggtggcagccacca

SEQ ID NO: 636043 - DNA, 20 bp, mouse
ggggcactcgagagctgcag

SEQ ID NO: 636044 - DNA, 20 bp, mouse
gaagtccagggagagtccca

SEQ ID NO: 636045 - DNA, 20 bp, mouse
gtccacctccccagacttag

SEQ ID NO: 636046 - DNA, 20 bp, mouse
ggcctccagggcgagagatc

SEQ ID NO: 636047 - DNA, 20 bp, mouse
ggtagctgaagatgcctcca

SEQ ID NO: 636048 - DNA, 20 bp, mouse
gcagggcgagagatctggtg

SEQ ID NO: 636049 - DNA, 20 bp, mouse
gtcttctgtcatcacatcta

SEQ ID NO: 636050 - DNA, 20 bp, mouse
ggggaaatctcattttggag

SEQ ID NO: 636051 - DNA, 20 bp, mouse
gtggggatgtgtggacactt

SEQ ID NO: 636052 - DNA, 20 bp, mouse
gctatctgacatcttccggt

SEQ ID NO: 636053 - DNA, 20 bp, mouse
gggaagatgtcagatagatg

SEQ ID NO: 636054 - DNA, 20 bp, mouse
gtccacacatccccacctac

SEQ ID NO: 636055 - DNA, 20 bp, mouse
gtccggtaggtggggatgtg

SEQ ID NO: 636056 - DNA, 20 bp, mouse
gacaccttcgccaagttcgg

SEQ ID NO: 636057 - DNA, 20 bp, mouse
ggacgcctgcgcagtccgga

SEQ ID NO: 636058 - DNA, 20 bp, mouse
gttcccgggaatgccgaaga

SEQ ID NO: 636059 - DNA, 20 bp, mouse
gggaacgcgcagactccgct

SEQ ID NO: 636060 - DNA, 20 bp, mouse
gcgcatgcgtgcggtcgggg

SEQ ID NO: 636061 - DNA, 20 bp, mouse
gcgccccccgaacttggcga

SEQ ID NO: 636062 - DNA, 20 bp, mouse
gcctcctcgccccccgaact

SEQ ID NO: 636063 - DNA, 20 bp, mouse
ggcgtgcggtcggggaggcg

SEQ ID NO: 636064 - DNA, 20 bp, mouse
gagagcgcatgcgtgcggtc

SEQ ID NO: 636065 - DNA, 20 bp, mouse
gcccttgcggtgttcagagg

SEQ ID NO: 636066 - DNA, 20 bp, mouse
gagaagcgactgggacgcgc

SEQ ID NO: 636067 - DNA, 20 bp, mouse
gaggtgggggagacggagtg

SEQ ID NO: 636068 - DNA, 20 bp, mouse
gaggcggagcaaaagcaagg

SEQ ID NO: 636069 - DNA, 20 bp, mouse
ggaggagaaccctctggtgg

SEQ ID NO: 636070 - DNA, 20 bp, mouse
gcagagctggggagatgcac

SEQ ID NO: 636071 - DNA, 20 bp, mouse
ggggtggggcagagtgtcgc

SEQ ID NO: 636072 - DNA, 20 bp, mouse
ggaaccctctggtggaggtt

SEQ ID NO: 636073 - DNA, 20 bp, mouse
gggtggagaagagaagcgac

SEQ ID NO: 636074 - DNA, 20 bp, mouse
ggaagaaagtgaaggatgag

SEQ ID NO: 636075 - DNA, 20 bp, mouse
ggtggaggttgggaagcggg

SEQ ID NO: 636076 - DNA, 20 bp, mouse
gcggcgggccgccaaagggg

SEQ ID NO: 636077 - DNA, 20 bp, mouse
gggaccggcgggccgccaaa

SEQ ID NO: 636078 - DNA, 20 bp, mouse
gtgactgccaatgggacctc

SEQ ID NO: 636079 - DNA, 20 bp, mouse
gtcgggccgtcccgcttcgc

SEQ ID NO: 636080 - DNA, 20 bp, mouse
gaggacagaaaaggtcgagt

SEQ ID NO: 636081 - DNA, 20 bp, mouse
ggcggggcccgcgtttctag

SEQ ID NO: 636082 - DNA, 20 bp, mouse
gcggaagcgcgccggcgaag

SEQ ID NO: 636083 - DNA, 20 bp, mouse
gcttcccgcgcacgcaaaca

SEQ ID NO: 636084 - DNA, 20 bp, mouse
gagaaaaggtcgagtcggga

SEQ ID NO: 636085 - DNA, 20 bp, mouse
gcgtgcatgcgcaggaccgg

SEQ ID NO: 636086 - DNA, 20 bp, mouse
gaaggggcgggcacgaaggc

SEQ ID NO: 636087 - DNA, 20 bp, mouse
gccttgcgagcgattggtcg

SEQ ID NO: 636088 - DNA, 20 bp, mouse
gagcaagagacggacaagaa

SEQ ID NO: 636089 - DNA, 20 bp, mouse
gaccaatcgctcgcaagggg

SEQ ID NO: 636090 - DNA, 20 bp, mouse
gagaggagcgcgacgattgg

SEQ ID NO: 636091 - DNA, 20 bp, mouse
gtcgcaaggggcgggcacga

SEQ ID NO: 636092 - DNA, 20 bp, mouse
gtggcggaagcggggcagtt

SEQ ID NO: 636093 - DNA, 20 bp, mouse
gaagcctggggagagccgat

SEQ ID NO: 636094 - DNA, 20 bp, mouse
gtcaagcggtcccgcagggg

SEQ ID NO: 636095 - DNA, 20 bp, mouse
ggcgagaggagcgcgacgat

SEQ ID NO: 636096 - DNA, 20 bp, mouse
gctgcattggggatgcaaat

SEQ ID NO: 636097 - DNA, 20 bp, mouse
gtgactgcagaagcatcact

SEQ ID NO: 636098 - DNA, 20 bp, mouse
ggtaacaacgagtttccatt

SEQ ID NO: 636099 - DNA, 20 bp, mouse
gcatctcttaaattagggtt

SEQ ID NO: 636100 - DNA, 20 bp, mouse
gctctcttaaatgtttgtta

SEQ ID NO: 636101 - DNA, 20 bp, mouse
gcagtagcaactgggcaata

SEQ ID NO: 636102 - DNA, 20 bp, mouse
ggtacttttccctctctcta

SEQ ID NO: 636103 - DNA, 20 bp, mouse
ggtttgttatggaaacaagg

SEQ ID NO: 636104 - DNA, 20 bp, mouse
gttcatatataatctgcatt

SEQ ID NO: 636105 - DNA, 20 bp, mouse
gtacttggtagagacttttt

SEQ ID NO: 636106 - DNA, 20 bp, mouse
ggctgactcccacactcctt

SEQ ID NO: 636107 - DNA, 20 bp, mouse
ggcgcggggctccggaagca

SEQ ID NO: 636108 - DNA, 20 bp, mouse
gagagggcgctcaggggcgc

SEQ ID NO: 636109 - DNA, 20 bp, mouse
gctcggagcgcagccggaga

SEQ ID NO: 636110 - DNA, 20 bp, mouse
ggacccgggtggctccaggt

SEQ ID NO: 636111 - DNA, 20 bp, mouse
gtgtgggagtcagccctctc

SEQ ID NO: 636112 - DNA, 20 bp, mouse
gcaagcgagcacttggtacc

SEQ ID NO: 636113 - DNA, 20 bp, mouse
gggtggcagcgggacccggg

SEQ ID NO: 636114 - DNA, 20 bp, mouse
ggccccacctggagccaccc

SEQ ID NO: 636115 - DNA, 20 bp, mouse
gtgggacgagagggcgctca

SEQ ID NO: 636116 - DNA, 20 bp, mouse
ggggaccaataggctgtcgc

SEQ ID NO: 636117 - DNA, 20 bp, mouse
gggccaaggcgggaccaagt

SEQ ID NO: 636118 - DNA, 20 bp, mouse
gaaggcgggaccaagttgga

SEQ ID NO: 636119 - DNA, 20 bp, mouse
gggaaggcagctcctgaagc

SEQ ID NO: 636120 - DNA, 20 bp, mouse
gcggccgcgtgcggtgggcg

SEQ ID NO: 636121 - DNA, 20 bp, mouse
gaggctgtcgctggcacgcg

SEQ ID NO: 636122 - DNA, 20 bp, mouse
gggagaagaggggtcagatc

SEQ ID NO: 636123 - DNA, 20 bp, mouse
gaggtgagcgcagatgtact

SEQ ID NO: 636124 - DNA, 20 bp, mouse
gcgtgccagcgacagcctat

SEQ ID NO: 636125 - DNA, 20 bp, mouse
gcgcagatgtactcggacga

SEQ ID NO: 636126 - DNA, 20 bp, mouse
ggggaggtggccatggtagg

SEQ ID NO: 636127 - DNA, 20 bp, mouse
gccgggctgggacctaatta

SEQ ID NO: 636128 - DNA, 20 bp, mouse
gcgcaggcgcaggagcatag

SEQ ID NO: 636129 - DNA, 20 bp, mouse
ggcagggcgtgtcctgatgg

SEQ ID NO: 636130 - DNA, 20 bp, mouse
gcccgggccgcgcccccatc

SEQ ID NO: 636131 - DNA, 20 bp, mouse
ggaggaaagtaccgtatcca

SEQ ID NO: 636132 - DNA, 20 bp, mouse
gagggatgtggcagctgcct

SEQ ID NO: 636133 - DNA, 20 bp, mouse
gggctgggacctaattaggg

SEQ ID NO: 636134 - DNA, 20 bp, mouse
gggcggggccaggtcgggct

SEQ ID NO: 636135 - DNA, 20 bp, mouse
gaaaagccccacgcaggcgc

SEQ ID NO: 636136 - DNA, 20 bp, mouse
gtgtagagcaaggtcaacgt

SEQ ID NO: 636137 - DNA, 20 bp, mouse
gtattagaagaaatggtctc

SEQ ID NO: 636138 - DNA, 20 bp, mouse
gcccacatatgaaattgtta

SEQ ID NO: 636139 - DNA, 20 bp, mouse
gagaaatggtctctgggttt

SEQ ID NO: 636140 - DNA, 20 bp, mouse
gtttggcattagtgtgatgt

SEQ ID NO: 636141 - DNA, 20 bp, mouse
gtaataattggaacaaaaca

SEQ ID NO: 636142 - DNA, 20 bp, mouse
gtccagctgaagaagggggt

SEQ ID NO: 636143 - DNA, 20 bp, mouse
gaagacaaatgtctctgtcc

SEQ ID NO: 636144 - DNA, 20 bp, mouse
gttgtcttggctgcagttgt

SEQ ID NO: 636145 - DNA, 20 bp, mouse
gaggctggaaatgaaggggg

SEQ ID NO: 636146 - DNA, 20 bp, mouse
gacctctgcctgctggggat

SEQ ID NO: 636147 - DNA, 20 bp, mouse
gccaggaccctcgtgactcc

SEQ ID NO: 636148 - DNA, 20 bp, mouse
gaggaagtgtagtgcacttt

SEQ ID NO: 636149 - DNA, 20 bp, mouse
gaggaaacgtgtgttgggag

SEQ ID NO: 636150 - DNA, 20 bp, mouse
gatctcctatagctcaatgg

SEQ ID NO: 636151 - DNA, 20 bp, mouse
gagtatagaatcatgacctg

SEQ ID NO: 636152 - DNA, 20 bp, mouse
gaatcatgacctgtggcatg

SEQ ID NO: 636153 - DNA, 20 bp, mouse
ggtccattgcctggcaatta

SEQ ID NO: 636154 - DNA, 20 bp, mouse
gaatctctctctagaagacc

SEQ ID NO: 636155 - DNA, 20 bp, mouse
gaaacgtgtgttgggagggg

SEQ ID NO: 636156 - DNA, 20 bp, mouse
gtgacccgggagaccagtag

SEQ ID NO: 636157 - DNA, 20 bp, mouse
gctcccgggtcaccgcacaa

SEQ ID NO: 636158 - DNA, 20 bp, mouse
gcgagcaccgcgtggaccgg

SEQ ID NO: 636159 - DNA, 20 bp, mouse
gcgtggggagaggctcggtg

SEQ ID NO: 636160 - DNA, 20 bp, mouse
ggcggtgctcgcacctctac

SEQ ID NO: 636161 - DNA, 20 bp, mouse
gggcgcagcagagtcttctg

SEQ ID NO: 636162 - DNA, 20 bp, mouse
gggaccggtggcttgcgagg

SEQ ID NO: 636163 - DNA, 20 bp, mouse
gtccccggcgactaagatct

SEQ ID NO: 636164 - DNA, 20 bp, mouse
ggactccctcaatctctccc

SEQ ID NO: 636165 - DNA, 20 bp, mouse
ggtcgccggggagagattga

SEQ ID NO: 636166 - DNA, 20 bp, mouse
gttcctaagtgaagctggca

SEQ ID NO: 636167 - DNA, 20 bp, mouse
ggtccttgccagcttcactt

SEQ ID NO: 636168 - DNA, 20 bp, mouse
gagagaggattattattctt

SEQ ID NO: 636169 - DNA, 20 bp, mouse
gggaagaatgatgctgttac

SEQ ID NO: 636170 - DNA, 20 bp, mouse
gaagggattggttacttatc

SEQ ID NO: 636171 - DNA, 20 bp, mouse
gtggattatgagttatgaaa

SEQ ID NO: 636172 - DNA, 20 bp, mouse
gttggcagaaccctcatgaa

SEQ ID NO: 636173 - DNA, 20 bp, mouse
gatggatgaaaccattcatg

SEQ ID NO: 636174 - DNA, 20 bp, mouse
gtttaacgctgctatataat

SEQ ID NO: 636175 - DNA, 20 bp, mouse
gttaaagtctctaatgtaat

SEQ ID NO: 636176 - DNA, 20 bp, mouse
gctgcgctgtatagtcccac

SEQ ID NO: 636177 - DNA, 20 bp, mouse
gccacagggtgagaagtcaa

SEQ ID NO: 636178 - DNA, 20 bp, mouse
gaaccagcctagcattcaga

SEQ ID NO: 636179 - DNA, 20 bp, mouse
gccaaggccaaggccagagg

SEQ ID NO: 636180 - DNA, 20 bp, mouse
gagggaggagggaagacaat

SEQ ID NO: 636181 - DNA, 20 bp, mouse
ggggactatacagcgcaggc

SEQ ID NO: 636182 - DNA, 20 bp, mouse
ggagaaggctgtctggaggg

SEQ ID NO: 636183 - DNA, 20 bp, mouse
ggtcagagaaggctgtctgg

SEQ ID NO: 636184 - DNA, 20 bp, mouse
gagaccttgccggcctcctc

SEQ ID NO: 636185 - DNA, 20 bp, mouse
gagaatgactcagagatatt

SEQ ID NO: 636186 - DNA, 20 bp, mouse
gaattcagactttttcaggc

SEQ ID NO: 636187 - DNA, 20 bp, mouse
gaaggttcatagtgagcccc

SEQ ID NO: 636188 - DNA, 20 bp, mouse
gctggaattcagactttttc

SEQ ID NO: 636189 - DNA, 20 bp, mouse
ggcttggtggtgtttcacag

SEQ ID NO: 636190 - DNA, 20 bp, mouse
gcaggagacccagaagctca

SEQ ID NO: 636191 - DNA, 20 bp, mouse
gaagaaacttcgtgtagccc

SEQ ID NO: 636192 - DNA, 20 bp, mouse
gtcctgcatctgcctgcaga

SEQ ID NO: 636193 - DNA, 20 bp, mouse
gactatgaaccttgagcttc

SEQ ID NO: 636194 - DNA, 20 bp, mouse
gtggttttgttgtatttgtt

SEQ ID NO: 636195 - DNA, 20 bp, mouse
gatgtaatcaatggtcatgg

SEQ ID NO: 636196 - DNA, 20 bp, mouse
gtggctgtccaacctggttc

SEQ ID NO: 636197 - DNA, 20 bp, mouse
gggacaagagagattcaatg

SEQ ID NO: 636198 - DNA, 20 bp, mouse
gggaacagcctaggtcagtg

SEQ ID NO: 636199 - DNA, 20 bp, mouse
gtgacctaggctgttccctg

SEQ ID NO: 636200 - DNA, 20 bp, mouse
gtcaatgtggctgtccaacc

SEQ ID NO: 636201 - DNA, 20 bp, mouse
gggtccacagggaacagcct

SEQ ID NO: 636202 - DNA, 20 bp, mouse
gcaggctgcaggtcagagga

SEQ ID NO: 636203 - DNA, 20 bp, mouse
gttccccttaaaatggagag

SEQ ID NO: 636204 - DNA, 20 bp, mouse
gctggttcaggtggtccaca

SEQ ID NO: 636205 - DNA, 20 bp, mouse
gaggttttggggaatgaaca

SEQ ID NO: 636206 - DNA, 20 bp, mouse
gtaggcaggctaccctggag

SEQ ID NO: 636207 - DNA, 20 bp, mouse
gttcagttgatggacatgga

SEQ ID NO: 636208 - DNA, 20 bp, mouse
gaggggatagaatataattt

SEQ ID NO: 636209 - DNA, 20 bp, mouse
gtgtagccacatcactcctt

SEQ ID NO: 636210 - DNA, 20 bp, mouse
gccagggtagcctgcctaaa

SEQ ID NO: 636211 - DNA, 20 bp, mouse
gtggaaggaggataccgttt

SEQ ID NO: 636212 - DNA, 20 bp, mouse
gagcatcccaaggagtgatg

SEQ ID NO: 636213 - DNA, 20 bp, mouse
gaggaggataccgtttaggc

SEQ ID NO: 636214 - DNA, 20 bp, mouse
gcagataacagaagacacag

SEQ ID NO: 636215 - DNA, 20 bp, mouse
gttatattctatcccctcca

SEQ ID NO: 636216 - DNA, 20 bp, mouse
gaggcgtagtgcaacagcgg

SEQ ID NO: 636217 - DNA, 20 bp, mouse
ggtgggacgagcatcgcgga

SEQ ID NO: 636218 - DNA, 20 bp, mouse
gcgcaggcgtagtgcaacag

SEQ ID NO: 636219 - DNA, 20 bp, mouse
ggcaacggaaggctgctttg

SEQ ID NO: 636220 - DNA, 20 bp, mouse
ggcaacagcgggggtaaagt

SEQ ID NO: 636221 - DNA, 20 bp, mouse
gtaaagtgggacgagcatcg

SEQ ID NO: 636222 - DNA, 20 bp, mouse
ggtctccaggagaatcgtct

SEQ ID NO: 636223 - DNA, 20 bp, mouse
ggcggggctgaggctgcgga

SEQ ID NO: 636224 - DNA, 20 bp, mouse
gcaggaggtgggctcaacag

SEQ ID NO: 636225 - DNA, 20 bp, mouse
gggagggagagcttgtgcgc

SEQ ID NO: 636226 - DNA, 20 bp, mouse
ggccacacgctgtctcccaa

SEQ ID NO: 636227 - DNA, 20 bp, mouse
gtgagcaagaaggatgtgaa

SEQ ID NO: 636228 - DNA, 20 bp, mouse
gccacgaggcagcttagtgt

SEQ ID NO: 636229 - DNA, 20 bp, mouse
gacttcgagcaggtcagaac

SEQ ID NO: 636230 - DNA, 20 bp, mouse
gaggggtaggccgaaccctc

SEQ ID NO: 636231 - DNA, 20 bp, mouse
gcatccttcttgctcaatta

SEQ ID NO: 636232 - DNA, 20 bp, mouse
gactccgtaattgagcaaga

SEQ ID NO: 636233 - DNA, 20 bp, mouse
ggctcaattacggagtacac

SEQ ID NO: 636234 - DNA, 20 bp, mouse
gaagttgtgattggagacca

SEQ ID NO: 636235 - DNA, 20 bp, mouse
gaattacggagtacacagga

SEQ ID NO: 636236 - DNA, 20 bp, mouse
gcacttgtattctgagaagt

SEQ ID NO: 636237 - DNA, 20 bp, mouse
gccaaagaagagtctttact

SEQ ID NO: 636238 - DNA, 20 bp, mouse
ggacaaacagttttaggaaa

SEQ ID NO: 636239 - DNA, 20 bp, mouse
gataaaggcagaagcagata

SEQ ID NO: 636240 - DNA, 20 bp, mouse
ggacctcttactctaagcag

SEQ ID NO: 636241 - DNA, 20 bp, mouse
ggcagataaggagagctgcg

SEQ ID NO: 636242 - DNA, 20 bp, mouse
ggaagaggaaagtattaccc

SEQ ID NO: 636243 - DNA, 20 bp, mouse
gtataggagacatctgaaga

SEQ ID NO: 636244 - DNA, 20 bp, mouse
gcaccactgcttagagtaag

SEQ ID NO: 636245 - DNA, 20 bp, mouse
gaactgtttgtctttctact

SEQ ID NO: 636246 - DNA, 20 bp, mouse
gaacacccgggcgaccactg

SEQ ID NO: 636247 - DNA, 20 bp, mouse
gagtccaaaccaggaggagc

SEQ ID NO: 636248 - DNA, 20 bp, mouse
ggcccgggtgttacaagctt

SEQ ID NO: 636249 - DNA, 20 bp, mouse
gagcacgcaggcgccgcgca

SEQ ID NO: 636250 - DNA, 20 bp, mouse
ggaagggattagtccaaacc

SEQ ID NO: 636251 - DNA, 20 bp, mouse
gggtgttacaagcttcggaa

SEQ ID NO: 636252 - DNA, 20 bp, mouse
gggcctgctgggaaagcgga

SEQ ID NO: 636253 - DNA, 20 bp, mouse
ggagcggagacaccagacgc

SEQ ID NO: 636254 - DNA, 20 bp, mouse
gcgcaccacagcgcccccag

SEQ ID NO: 636255 - DNA, 20 bp, mouse
gagcgcccccagtggtcgcc

SEQ ID NO: 636256 - DNA, 20 bp, mouse
gggtggagctgcgtggggga

SEQ ID NO: 636257 - DNA, 20 bp, mouse
gaacatgccgccaatcacgg

SEQ ID NO: 636258 - DNA, 20 bp, mouse
gcagtgccgcccaccctgag

SEQ ID NO: 636259 - DNA, 20 bp, mouse
gagctgcgtgggggagggac

SEQ ID NO: 636260 - DNA, 20 bp, mouse
gtcctggggtggagctgcgt

SEQ ID NO: 636261 - DNA, 20 bp, mouse
gagcatggtgatgtggacta

SEQ ID NO: 636262 - DNA, 20 bp, mouse
gaccacgccctcctctccct

SEQ ID NO: 636263 - DNA, 20 bp, mouse
ggccgccaatcacgggggta

SEQ ID NO: 636264 - DNA, 20 bp, mouse
gccgacctgcacacccagag

SEQ ID NO: 636265 - DNA, 20 bp, mouse
ggatgatcccgaacatgaca

SEQ ID NO: 636266 - DNA, 20 bp, mouse
gctatcgggaagagatgagg

SEQ ID NO: 636267 - DNA, 20 bp, mouse
gacaaggagcagctagattg

SEQ ID NO: 636268 - DNA, 20 bp, mouse
gtgcagctgcgcatcgggac

SEQ ID NO: 636269 - DNA, 20 bp, mouse
gttggggaggaaggactatc

SEQ ID NO: 636270 - DNA, 20 bp, mouse
ggtaactgcagctgcgcatc

SEQ ID NO: 636271 - DNA, 20 bp, mouse
gggaacaggcagagttagct

SEQ ID NO: 636272 - DNA, 20 bp, mouse
gaatgtgggtgaatacatga

SEQ ID NO: 636273 - DNA, 20 bp, mouse
gtaccccggcagccggcaga

SEQ ID NO: 636274 - DNA, 20 bp, mouse
ggacccgggatgcctgggtt

SEQ ID NO: 636275 - DNA, 20 bp, mouse
ggcggtgcgcgcttcctgtg

SEQ ID NO: 636276 - DNA, 20 bp, mouse
gggccgaaatcagtccgcga

SEQ ID NO: 636277 - DNA, 20 bp, mouse
gcctcggaggcgtttccctc

SEQ ID NO: 636278 - DNA, 20 bp, mouse
gggagcgtacgaaaaagcgc

SEQ ID NO: 636279 - DNA, 20 bp, mouse
gcgccctcgcggactgattt

SEQ ID NO: 636280 - DNA, 20 bp, mouse
gaggatcatgaggtggtaac

SEQ ID NO: 636281 - DNA, 20 bp, mouse
gagcggggcgcgcgggacca

SEQ ID NO: 636282 - DNA, 20 bp, mouse
gatcctcggcgcgcggcagc

SEQ ID NO: 636283 - DNA, 20 bp, mouse
gtgaggtggtaacgggcccc

SEQ ID NO: 636284 - DNA, 20 bp, mouse
gaggggaaatggtggaaggg

SEQ ID NO: 636285 - DNA, 20 bp, mouse
gcggctctgcccctgcccga

SEQ ID NO: 636286 - DNA, 20 bp, mouse
ggtgcagctgactggagtca

SEQ ID NO: 636287 - DNA, 20 bp, mouse
gtacctacatgtgtcatctc

SEQ ID NO: 636288 - DNA, 20 bp, mouse
ggccccacccacagagcaag

SEQ ID NO: 636289 - DNA, 20 bp, mouse
gcagggttgggggctttgta

SEQ ID NO: 636290 - DNA, 20 bp, mouse
gtgagaggatgcccccttat

SEQ ID NO: 636291 - DNA, 20 bp, mouse
gtctaaccaggccttcactg

SEQ ID NO: 636292 - DNA, 20 bp, mouse
gatgacacatgtaggtagtc

SEQ ID NO: 636293 - DNA, 20 bp, mouse
ggcaagagggatataaagac

SEQ ID NO: 636294 - DNA, 20 bp, mouse
ggggggctttgtagggagca

SEQ ID NO: 636295 - DNA, 20 bp, mouse
gagacaccatggagaatcat

SEQ ID NO: 636296 - DNA, 20 bp, mouse
gctgctcagggaaaaaaaga

SEQ ID NO: 636297 - DNA, 20 bp, mouse
gctgcaggatctgcaactgc

SEQ ID NO: 636298 - DNA, 20 bp, mouse
ggcaactgcagggacattta

SEQ ID NO: 636299 - DNA, 20 bp, mouse
gagtagctcagaatcacaaa

SEQ ID NO: 636300 - DNA, 20 bp, mouse
gtccacaactttcaattccc

SEQ ID NO: 636301 - DNA, 20 bp, mouse
gccaaggtggcagctgctca

SEQ ID NO: 636302 - DNA, 20 bp, mouse
gccagtgggtgcttcttatt

SEQ ID NO: 636303 - DNA, 20 bp, mouse
gtatctagcaatccccaagg

SEQ ID NO: 636304 - DNA, 20 bp, mouse
gaaagataacgagtgccagt

SEQ ID NO: 636305 - DNA, 20 bp, mouse
gtgtgattctgagctactac

SEQ ID NO: 636306 - DNA, 20 bp, mouse
gtctccatgagcaatctcaa

SEQ ID NO: 636307 - DNA, 20 bp, mouse
gactgacttctaagcggcta

SEQ ID NO: 636308 - DNA, 20 bp, mouse
gctgggtaatagctttcttg

SEQ ID NO: 636309 - DNA, 20 bp, mouse
gcacattactgacttctaag

SEQ ID NO: 636310 - DNA, 20 bp, mouse
gagcacttccagtaaattac

SEQ ID NO: 636311 - DNA, 20 bp, mouse
gtgaaaagtgcattaatccc

SEQ ID NO: 636312 - DNA, 20 bp, mouse
gtccgcacaatataactcca

SEQ ID NO: 636313 - DNA, 20 bp, mouse
gaatacttagaatgcactcc

SEQ ID NO: 636314 - DNA, 20 bp, mouse
ggaaaatgagccaatttacc

SEQ ID NO: 636315 - DNA, 20 bp, mouse
ggctcatctttctgactgac

SEQ ID NO: 636316 - DNA, 20 bp, mouse
gggaccctggccaccccacg

SEQ ID NO: 636317 - DNA, 20 bp, mouse
ggggccgcgcgcagccgagt

SEQ ID NO: 636318 - DNA, 20 bp, mouse
gccgccacgtggggtggcca

SEQ ID NO: 636319 - DNA, 20 bp, mouse
gcccgggcgcccactctccg

SEQ ID NO: 636320 - DNA, 20 bp, mouse
ggcagcgccgccacgtgggg

SEQ ID NO: 636321 - DNA, 20 bp, mouse
gagtgggcgcccgggtggca

SEQ ID NO: 636322 - DNA, 20 bp, mouse
gacgaggacgctcacgatcg

SEQ ID NO: 636323 - DNA, 20 bp, mouse
gtcacccgagcctcggagag

SEQ ID NO: 636324 - DNA, 20 bp, mouse
gccgctcccgccgggcacgc

SEQ ID NO: 636325 - DNA, 20 bp, mouse
gtctgcagcgccgccacgtg

SEQ ID NO: 636326 - DNA, 20 bp, mouse
gagaaccagacacacaaata

SEQ ID NO: 636327 - DNA, 20 bp, mouse
gtgaacaagtatcagttatt

SEQ ID NO: 636328 - DNA, 20 bp, mouse
gactagaataaatctaaatg

SEQ ID NO: 636329 - DNA, 20 bp, mouse
gatccagattcagagagtat

SEQ ID NO: 636330 - DNA, 20 bp, mouse
gtacctatactctctgaatc

SEQ ID NO: 636331 - DNA, 20 bp, mouse
gtaagaaggtgaccttagtt

SEQ ID NO: 636332 - DNA, 20 bp, mouse
gcataccatatttgtgtgtc

SEQ ID NO: 636333 - DNA, 20 bp, mouse
gatgccctgcttggctataa

SEQ ID NO: 636334 - DNA, 20 bp, mouse
gggagaaatatctacaatta

SEQ ID NO: 636335 - DNA, 20 bp, mouse
gctacaattagggggcattt

SEQ ID NO: 636336 - DNA, 20 bp, mouse
gctggtgaataaatcatgcc

SEQ ID NO: 636337 - DNA, 20 bp, mouse
gagagttgtttcctttgtta

SEQ ID NO: 636338 - DNA, 20 bp, mouse
gaactaggattgatgatgaa

SEQ ID NO: 636339 - DNA, 20 bp, mouse
gtaagggcagaacttgtaga

SEQ ID NO: 636340 - DNA, 20 bp, mouse
gctaagaagcttttcagaga

SEQ ID NO: 636341 - DNA, 20 bp, mouse
gtttcagagagggcattaca

SEQ ID NO: 636342 - DNA, 20 bp, mouse
gtggtttggtgacaaaagtc

SEQ ID NO: 636343 - DNA, 20 bp, mouse
gtgccaaacttggaaagccc

SEQ ID NO: 636344 - DNA, 20 bp, mouse
gtacgcaaagcatttagaac

SEQ ID NO: 636345 - DNA, 20 bp, mouse
gtacatccacagattaatat

SEQ ID NO: 636346 - DNA, 20 bp, mouse
gagcgccagtgcagtgagtc

SEQ ID NO: 636347 - DNA, 20 bp, mouse
gctaaccccacttcccactt

SEQ ID NO: 636348 - DNA, 20 bp, mouse
gttcccacttaggaaagtct

SEQ ID NO: 636349 - DNA, 20 bp, mouse
gtggccctgactcactgcac

SEQ ID NO: 636350 - DNA, 20 bp, mouse
gagaagtggctgtaggtgtc

SEQ ID NO: 636351 - DNA, 20 bp, mouse
ggacaaaggtccggagggtg

SEQ ID NO: 636352 - DNA, 20 bp, mouse
gcacccagactttcctaagt

SEQ ID NO: 636353 - DNA, 20 bp, mouse
gctgagggacaaaggtccgg

SEQ ID NO: 636354 - DNA, 20 bp, mouse
gccgccagggcgcactagtc

SEQ ID NO: 636355 - DNA, 20 bp, mouse
gactacttatctcagctcgg

SEQ ID NO: 636356 - DNA, 20 bp, mouse
gcagcctgggcgtacatctc

SEQ ID NO: 636357 - DNA, 20 bp, mouse
ggggccatcagctgtaagcc

SEQ ID NO: 636358 - DNA, 20 bp, mouse
gggtgtgacggtaacaaaaa

SEQ ID NO: 636359 - DNA, 20 bp, mouse
ggcactggaggcacacccac

SEQ ID NO: 636360 - DNA, 20 bp, mouse
gtggccaatcataatgaagt

SEQ ID NO: 636361 - DNA, 20 bp, mouse
ggggagagccagggtcttgt

SEQ ID NO: 636362 - DNA, 20 bp, mouse
gtccagtgcttaaatctgat

SEQ ID NO: 636363 - DNA, 20 bp, mouse
gctgctttgagcccggagcc

SEQ ID NO: 636364 - DNA, 20 bp, mouse
ggagttcgctgctttgagcc

SEQ ID NO: 636365 - DNA, 20 bp, mouse
gagtgagttagttcatgtgc

SEQ ID NO: 636366 - DNA, 20 bp, mouse
ggggatgtagagtactagaa

SEQ ID NO: 636367 - DNA, 20 bp, mouse
gagaaacaaactcacctggt

SEQ ID NO: 636368 - DNA, 20 bp, mouse
gaattcaaatcagtgaaaga

SEQ ID NO: 636369 - DNA, 20 bp, mouse
gacaaaaatctaaagggtgt

SEQ ID NO: 636370 - DNA, 20 bp, mouse
ggaaagatggaagataatgc

SEQ ID NO: 636371 - DNA, 20 bp, mouse
gggcaaaacttcaggttttc

SEQ ID NO: 636372 - DNA, 20 bp, mouse
gactggggacagaaggtggg

SEQ ID NO: 636373 - DNA, 20 bp, mouse
ggccagaaaagttctttcat

SEQ ID NO: 636374 - DNA, 20 bp, mouse
gttaatgaaagcagtcactg

SEQ ID NO: 636375 - DNA, 20 bp, mouse
gtaaaagaccttctctttca

SEQ ID NO: 636376 - DNA, 20 bp, mouse
ggcgaccgggactcagaccc

SEQ ID NO: 636377 - DNA, 20 bp, mouse
gagccgggccgactgagcac

SEQ ID NO: 636378 - DNA, 20 bp, mouse
gaaagcctgcgccggagccg

SEQ ID NO: 636379 - DNA, 20 bp, mouse
gcccgcccgagcgcgctcca

SEQ ID NO: 636380 - DNA, 20 bp, mouse
ggcgcgcggcagcggagtac

SEQ ID NO: 636381 - DNA, 20 bp, mouse
ggtctgagtcccggtcgcgc

SEQ ID NO: 636382 - DNA, 20 bp, mouse
gagttcctcgcccgcgcgac

SEQ ID NO: 636383 - DNA, 20 bp, mouse
gagtcccggtcgcgcgggcg

SEQ ID NO: 636384 - DNA, 20 bp, mouse
gggcgggcgcgaagatgcaa

SEQ ID NO: 636385 - DNA, 20 bp, mouse
ggggactcagaccccggctc

SEQ ID NO: 636386 - DNA, 20 bp, mouse
ggcgcggggcgtggggactc

SEQ ID NO: 636387 - DNA, 20 bp, mouse
ggctgcccggcgccaccccg

SEQ ID NO: 636388 - DNA, 20 bp, mouse
gcctccgaggcacctagcct

SEQ ID NO: 636389 - DNA, 20 bp, mouse
gagcacaccccacacttcag

SEQ ID NO: 636390 - DNA, 20 bp, mouse
gttgggatcgcgcggggcgt

SEQ ID NO: 636391 - DNA, 20 bp, mouse
gaggaaggcttgggatcgcg

SEQ ID NO: 636392 - DNA, 20 bp, mouse
gtggaacattgactgcatga

SEQ ID NO: 636393 - DNA, 20 bp, mouse
gcggccggaagcttcccgca

SEQ ID NO: 636394 - DNA, 20 bp, mouse
gccggcgccaccccgaggct

SEQ ID NO: 636395 - DNA, 20 bp, mouse
gcaaagacgggagtgcgacg

SEQ ID NO: 636396 - DNA, 20 bp, mouse
gatcacaaggagagacgggg

SEQ ID NO: 636397 - DNA, 20 bp, mouse
gggtacagaaaaatgagctc

SEQ ID NO: 636398 - DNA, 20 bp, mouse
gggagaaggtggtggtctcc

SEQ ID NO: 636399 - DNA, 20 bp, mouse
gaaaagattggagaaggtgg

SEQ ID NO: 636400 - DNA, 20 bp, mouse
gatgagctccggaaggatcc

SEQ ID NO: 636401 - DNA, 20 bp, mouse
gccacctgtcagagcatcat

SEQ ID NO: 636402 - DNA, 20 bp, mouse
ggttcccagaccaccattgg

SEQ ID NO: 636403 - DNA, 20 bp, mouse
gggggatcacaaggagagac

SEQ ID NO: 636404 - DNA, 20 bp, mouse
gtcgccgccaatggtggtct

SEQ ID NO: 636405 - DNA, 20 bp, mouse
gtaccgttcgccgccaatgg

SEQ ID NO: 636406 - DNA, 20 bp, mouse
gggacaacgcgggtcctagt

SEQ ID NO: 636407 - DNA, 20 bp, mouse
gcacatgcgcaaggaagtct

SEQ ID NO: 636408 - DNA, 20 bp, mouse
gtcaagatggcgtctgtaat

SEQ ID NO: 636409 - DNA, 20 bp, mouse
gagccgaaagagcagctgat

SEQ ID NO: 636410 - DNA, 20 bp, mouse
gagagaaagaggagcgaggt

SEQ ID NO: 636411 - DNA, 20 bp, mouse
gctgggaaagaccggaggat

SEQ ID NO: 636412 - DNA, 20 bp, mouse
ggactactcccaagcgtcta

SEQ ID NO: 636413 - DNA, 20 bp, mouse
gtcggactacaactcccact

SEQ ID NO: 636414 - DNA, 20 bp, mouse
gtcacacgtagcggtcaaga

SEQ ID NO: 636415 - DNA, 20 bp, mouse
gattggctgggaaagaccgg

SEQ ID NO: 636416 - DNA, 20 bp, mouse
ggggctgctggtctccaggg

SEQ ID NO: 636417 - DNA, 20 bp, mouse
ggcccagcagggtaggacta

SEQ ID NO: 636418 - DNA, 20 bp, mouse
gggaggggtgcaaggtgcgg

SEQ ID NO: 636419 - DNA, 20 bp, mouse
ggcgggggaagggacagtct

SEQ ID NO: 636420 - DNA, 20 bp, mouse
gcacacctgcagctgaacgt

SEQ ID NO: 636421 - DNA, 20 bp, mouse
gcagggaggggtgcaaggtg

SEQ ID NO: 636422 - DNA, 20 bp, mouse
ggaaagaggcgggtcttgga

SEQ ID NO: 636423 - DNA, 20 bp, mouse
gagagaggggaagacgttaa

SEQ ID NO: 636424 - DNA, 20 bp, mouse
gagcctgcccaaggtgtcca

SEQ ID NO: 636425 - DNA, 20 bp, mouse
gtggggttaagacagtgatt

SEQ ID NO: 636426 - DNA, 20 bp, mouse
gtctcccttgaaccctgagg

SEQ ID NO: 636427 - DNA, 20 bp, mouse
gtctctctagctcctcctca

SEQ ID NO: 636428 - DNA, 20 bp, mouse
gggagtgagacacttgcaca

SEQ ID NO: 636429 - DNA, 20 bp, mouse
gtcgaagagactccaatatt

SEQ ID NO: 636430 - DNA, 20 bp, mouse
gagctgttgttttttactct

SEQ ID NO: 636431 - DNA, 20 bp, mouse
gtctgagcctacatgcttag

SEQ ID NO: 636432 - DNA, 20 bp, mouse
gcattctcccttgaaccctg

SEQ ID NO: 636433 - DNA, 20 bp, mouse
gagctcctcctcagggttca

SEQ ID NO: 636434 - DNA, 20 bp, mouse
gaccctgcaaacagggcttt

SEQ ID NO: 636435 - DNA, 20 bp, mouse
gtaaaaaaggataaacatga

SEQ ID NO: 636436 - DNA, 20 bp, mouse
gacttctggttggtagggaa

SEQ ID NO: 636437 - DNA, 20 bp, mouse
gagtactctaaactgttctg

SEQ ID NO: 636438 - DNA, 20 bp, mouse
ggatttgccccaagcaacaa

SEQ ID NO: 636439 - DNA, 20 bp, mouse
gccctaccaaccagaagttc

SEQ ID NO: 636440 - DNA, 20 bp, mouse
gctgttctgcggcttacttc

SEQ ID NO: 636441 - DNA, 20 bp, mouse
ggagaagttaatagactcta

SEQ ID NO: 636442 - DNA, 20 bp, mouse
ggatggtagctacacactac

SEQ ID NO: 636443 - DNA, 20 bp, mouse
gagcctaaaaataaatagac

SEQ ID NO: 636444 - DNA, 20 bp, mouse
gttgccaggcattggtcctc

SEQ ID NO: 636445 - DNA, 20 bp, mouse
gtaagctatgccctaagaag

SEQ ID NO: 636446 - DNA, 20 bp, mouse
gaggacggccgggaagtcag

SEQ ID NO: 636447 - DNA, 20 bp, mouse
gagggcccggccatcggcac

SEQ ID NO: 636448 - DNA, 20 bp, mouse
gggagcagggagtcctacgg

SEQ ID NO: 636449 - DNA, 20 bp, mouse
gcgagcgccaagcgcctccg

SEQ ID NO: 636450 - DNA, 20 bp, mouse
gtggccgggccctccgatct

SEQ ID NO: 636451 - DNA, 20 bp, mouse
gcagcccagaagcttcggcc

SEQ ID NO: 636452 - DNA, 20 bp, mouse
gggaatccctgccaccttca

SEQ ID NO: 636453 - DNA, 20 bp, mouse
gcggcccagagaggacggcc

SEQ ID NO: 636454 - DNA, 20 bp, mouse
gacttcccggccgtcctctc

SEQ ID NO: 636455 - DNA, 20 bp, mouse
ggaggcgctgcctgagaacg

SEQ ID NO: 636456 - DNA, 20 bp, mouse
gggagtaccaggaagtagcc

SEQ ID NO: 636457 - DNA, 20 bp, mouse
gaccgaatcaagaatgaggg

SEQ ID NO: 636458 - DNA, 20 bp, mouse
gcagaccgaatcaagaatga

SEQ ID NO: 636459 - DNA, 20 bp, mouse
gtccaccctcattcttgatt

SEQ ID NO: 636460 - DNA, 20 bp, mouse
ggcacccgggtgctctataa

SEQ ID NO: 636461 - DNA, 20 bp, mouse
gtgtcacttgaaagttcctg

SEQ ID NO: 636462 - DNA, 20 bp, mouse
ggaggaacacccagttcctc

SEQ ID NO: 636463 - DNA, 20 bp, mouse
gcacccgaccaacaggataa

SEQ ID NO: 636464 - DNA, 20 bp, mouse
gacctgggtgaggaaggggc

SEQ ID NO: 636465 - DNA, 20 bp, mouse
gagaaacagtctgggaacag

SEQ ID NO: 636466 - DNA, 20 bp, mouse
gagataagccttaatccaga

SEQ ID NO: 636467 - DNA, 20 bp, mouse
gagcacaatcatcatggttc

SEQ ID NO: 636468 - DNA, 20 bp, mouse
gttcacagacccatcctcta

SEQ ID NO: 636469 - DNA, 20 bp, mouse
gttgttttccctctggatta

SEQ ID NO: 636470 - DNA, 20 bp, mouse
gacacttagcacaatcatca

SEQ ID NO: 636471 - DNA, 20 bp, mouse
gttcaggaggaaagagtgga

SEQ ID NO: 636472 - DNA, 20 bp, mouse
gtcagggtagagcaacaccc

SEQ ID NO: 636473 - DNA, 20 bp, mouse
gcagacccatcctctaaggg

SEQ ID NO: 636474 - DNA, 20 bp, mouse
gcagctcctcccttagagga

SEQ ID NO: 636475 - DNA, 20 bp, mouse
gtaaggaaaagagactgagt

SEQ ID NO: 636476 - DNA, 20 bp, mouse
gttccctcctccatggagta

SEQ ID NO: 636477 - DNA, 20 bp, mouse
gccaggttgcaagtgactca

SEQ ID NO: 636478 - DNA, 20 bp, mouse
gggcccagggctctcaaggg

SEQ ID NO: 636479 - DNA, 20 bp, mouse
ggctggggccaggtgatact

SEQ ID NO: 636480 - DNA, 20 bp, mouse
ggtgccaaacatcaggccca

SEQ ID NO: 636481 - DNA, 20 bp, mouse
gcacaagcaggtataagggg

SEQ ID NO: 636482 - DNA, 20 bp, mouse
gggcagagcttgttgctatg

SEQ ID NO: 636483 - DNA, 20 bp, mouse
gcatccagaaggtgctgccg

SEQ ID NO: 636484 - DNA, 20 bp, mouse
gctcaagggaggtcttgtgc

SEQ ID NO: 636485 - DNA, 20 bp, mouse
gagacctcccttgagagccc

SEQ ID NO: 636486 - DNA, 20 bp, mouse
gcgtgcgcacaggacgggac

SEQ ID NO: 636487 - DNA, 20 bp, mouse
gcggagcgactgcgcagatc

SEQ ID NO: 636488 - DNA, 20 bp, mouse
gacacccagcgggcagcgcg

SEQ ID NO: 636489 - DNA, 20 bp, mouse
gcggcgcgtgcgcacaggac

SEQ ID NO: 636490 - DNA, 20 bp, mouse
ggtgagagcgccttgaggtg

SEQ ID NO: 636491 - DNA, 20 bp, mouse
gtgtcccccgccctggccta

SEQ ID NO: 636492 - DNA, 20 bp, mouse
ggcgcacaggacgggacggg

SEQ ID NO: 636493 - DNA, 20 bp, mouse
gcacccgcgcgctgcccgct

SEQ ID NO: 636494 - DNA, 20 bp, mouse
gcacagcgacaaacccggtc

SEQ ID NO: 636495 - DNA, 20 bp, mouse
ggcgcacgcgccgcacctca

SEQ ID NO: 636496 - DNA, 20 bp, mouse
gggcaagcgcctaactctgg

SEQ ID NO: 636497 - DNA, 20 bp, mouse
ggtgggttataagtgacagt

SEQ ID NO: 636498 - DNA, 20 bp, mouse
gtgactagccggcaagagga

SEQ ID NO: 636499 - DNA, 20 bp, mouse
gaggggcaagcgcctaactc

SEQ ID NO: 636500 - DNA, 20 bp, mouse
gaggaggatcgagtcggtga

SEQ ID NO: 636501 - DNA, 20 bp, mouse
gcaaaagctcttggggtggt

SEQ ID NO: 636502 - DNA, 20 bp, mouse
gcttgcccctgtcctgttca

SEQ ID NO: 636503 - DNA, 20 bp, mouse
gatggcaaaagctcttgggg

SEQ ID NO: 636504 - DNA, 20 bp, mouse
ggggtggtgggtgggtctag

SEQ ID NO: 636505 - DNA, 20 bp, mouse
gaggtgacatctccctgaac

SEQ ID NO: 636506 - DNA, 20 bp, mouse
gtcacccctcattcccagat

SEQ ID NO: 636507 - DNA, 20 bp, mouse
ggccatgacccaaggaggta

SEQ ID NO: 636508 - DNA, 20 bp, mouse
ggccccacccctctctagga

SEQ ID NO: 636509 - DNA, 20 bp, mouse
gaaggaggagctcagaacgg

SEQ ID NO: 636510 - DNA, 20 bp, mouse
gccaaggtttggactttaag

SEQ ID NO: 636511 - DNA, 20 bp, mouse
ggcagaaaagatgtaagtca

SEQ ID NO: 636512 - DNA, 20 bp, mouse
gcccctcattcccagatggg

SEQ ID NO: 636513 - DNA, 20 bp, mouse
gtgattgagtcaccccagat

SEQ ID NO: 636514 - DNA, 20 bp, mouse
gtttctggggccatgaccca

SEQ ID NO: 636515 - DNA, 20 bp, mouse
gcctgcctctacttcctttc

SEQ ID NO: 636516 - DNA, 20 bp, mouse
ggcaagggcgagagtgaggt

SEQ ID NO: 636517 - DNA, 20 bp, mouse
gctcggagagtatactgggg

SEQ ID NO: 636518 - DNA, 20 bp, mouse
gctcatccgtgggatctcca

SEQ ID NO: 636519 - DNA, 20 bp, mouse
gtgaccctgacctcatccgt

SEQ ID NO: 636520 - DNA, 20 bp, mouse
gcggtctcggagagtatact

SEQ ID NO: 636521 - DNA, 20 bp, mouse
gagatcccacggatgaggtc

SEQ ID NO: 636522 - DNA, 20 bp, mouse
gcgggtgagagacagcgtga

SEQ ID NO: 636523 - DNA, 20 bp, mouse
gcgagaccggactcactgtc

SEQ ID NO: 636524 - DNA, 20 bp, mouse
ggagttccgtggagatccca

SEQ ID NO: 636525 - DNA, 20 bp, mouse
gtgaggtcagggtcagaggt

SEQ ID NO: 636526 - DNA, 20 bp, mouse
gagacattgggcaacgagga

SEQ ID NO: 636527 - DNA, 20 bp, mouse
ggatctagaaaaactaagtg

SEQ ID NO: 636528 - DNA, 20 bp, mouse
gtggggcaagcatgctggac

SEQ ID NO: 636529 - DNA, 20 bp, mouse
gggtaatgagcagtcacttg

SEQ ID NO: 636530 - DNA, 20 bp, mouse
gattgggcaacgaggaggga

SEQ ID NO: 636531 - DNA, 20 bp, mouse
gtcacttggggcaagcatgc

SEQ ID NO: 636532 - DNA, 20 bp, mouse
gctcatgatgaacagacatt

SEQ ID NO: 636533 - DNA, 20 bp, mouse
gttattgttcatcagaggag

SEQ ID NO: 636534 - DNA, 20 bp, mouse
ggtatggcttcaacatgcag

SEQ ID NO: 636535 - DNA, 20 bp, mouse
gggacgagcaacactgctga

SEQ ID NO: 636536 - DNA, 20 bp, mouse
gggcggggacagttgctcta

SEQ ID NO: 636537 - DNA, 20 bp, mouse
gggaacgcccccaaacaccg

SEQ ID NO: 636538 - DNA, 20 bp, mouse
gcagtcctgcaagttcactg

SEQ ID NO: 636539 - DNA, 20 bp, mouse
ggaagcgcccgccatcctgc

SEQ ID NO: 636540 - DNA, 20 bp, mouse
gcggccgtaaagcctggagg

SEQ ID NO: 636541 - DNA, 20 bp, mouse
gccggcgcccgcaggatggc

SEQ ID NO: 636542 - DNA, 20 bp, mouse
gcgggccccagtgaacttgc

SEQ ID NO: 636543 - DNA, 20 bp, mouse
gcgaggcaagggccctgacg

SEQ ID NO: 636544 - DNA, 20 bp, mouse
gggtaggtgatccgaggcaa

SEQ ID NO: 636545 - DNA, 20 bp, mouse
gtcaacaggtaggtgatccg

SEQ ID NO: 636546 - DNA, 20 bp, mouse
gattgggcagccagagtggg

SEQ ID NO: 636547 - DNA, 20 bp, mouse
ggacaagcttcattctgcct

SEQ ID NO: 636548 - DNA, 20 bp, mouse
gacatcgtaaaatgccactt

SEQ ID NO: 636549 - DNA, 20 bp, mouse
gtttcagttgcatctttcca

SEQ ID NO: 636550 - DNA, 20 bp, mouse
gtattattgggcagccagag

SEQ ID NO: 636551 - DNA, 20 bp, mouse
gcttgtctctaaatttaaag

SEQ ID NO: 636552 - DNA, 20 bp, mouse
gttaaggacaggattgtgat

SEQ ID NO: 636553 - DNA, 20 bp, mouse
gcctctcctttcttttgtct

SEQ ID NO: 636554 - DNA, 20 bp, mouse
ggtggcattttacgatgtta

SEQ ID NO: 636555 - DNA, 20 bp, mouse
gtaaaacatatccaagagat

SEQ ID NO: 636556 - DNA, 20 bp, mouse
gacactctagacagcagagt

SEQ ID NO: 636557 - DNA, 20 bp, mouse
gcagaagtaaggttttggga

SEQ ID NO: 636558 - DNA, 20 bp, mouse
gtaagactctgttgcagagt

SEQ ID NO: 636559 - DNA, 20 bp, mouse
ggtgacagaagtaaggtttt

SEQ ID NO: 636560 - DNA, 20 bp, mouse
gggatgcttaggcaacaggt

SEQ ID NO: 636561 - DNA, 20 bp, mouse
ggcggagttaaaacctccag

SEQ ID NO: 636562 - DNA, 20 bp, mouse
gcccaagctacaaaaagtcc

SEQ ID NO: 636563 - DNA, 20 bp, mouse
ggtgtggatgcttaggcaac

SEQ ID NO: 636564 - DNA, 20 bp, mouse
gaagccagcatccacaactg

SEQ ID NO: 636565 - DNA, 20 bp, mouse
ggacaaacaggtattttcac

SEQ ID NO: 636566 - DNA, 20 bp, mouse
gtaggggccaagggtcgata

SEQ ID NO: 636567 - DNA, 20 bp, mouse
gcccactggcaggtatggag

SEQ ID NO: 636568 - DNA, 20 bp, mouse
gctctgcagccacactgcga

SEQ ID NO: 636569 - DNA, 20 bp, mouse
ggacccttggcccctagagg

SEQ ID NO: 636570 - DNA, 20 bp, mouse
ggatggggatgcccagaata

SEQ ID NO: 636571 - DNA, 20 bp, mouse
gtctcactgggcctcctcta

SEQ ID NO: 636572 - DNA, 20 bp, mouse
gtgctaggctgtcaacctgt

SEQ ID NO: 636573 - DNA, 20 bp, mouse
ggaaaactgccctgcttaga

SEQ ID NO: 636574 - DNA, 20 bp, mouse
gacagcctagcaagcgtcat

SEQ ID NO: 636575 - DNA, 20 bp, mouse
gggccaagggtcgatagggg

SEQ ID NO: 636576 - DNA, 20 bp, mouse
gaagccggaagaagagacta

SEQ ID NO: 636577 - DNA, 20 bp, mouse
gaccaggtgcaggaggggta

SEQ ID NO: 636578 - DNA, 20 bp, mouse
gaacaaaagtgggtcaccca

SEQ ID NO: 636579 - DNA, 20 bp, mouse
gcgtgggaggcccctgtatg

SEQ ID NO: 636580 - DNA, 20 bp, mouse
gcgtctggggcctaggaaac

SEQ ID NO: 636581 - DNA, 20 bp, mouse
gccgcccagcccaggacgtc

SEQ ID NO: 636582 - DNA, 20 bp, mouse
gagtctgggaaaccccatac

SEQ ID NO: 636583 - DNA, 20 bp, mouse
gcctaggccccagacgtcct

SEQ ID NO: 636584 - DNA, 20 bp, mouse
gtcttcttccggcttgtggg

SEQ ID NO: 636585 - DNA, 20 bp, mouse
ggccagcaccaggtgcagga

SEQ ID NO: 636586 - DNA, 20 bp, mouse
ggggaggcggggtcggtcta

SEQ ID NO: 636587 - DNA, 20 bp, mouse
gtcttcagctccctccatct

SEQ ID NO: 636588 - DNA, 20 bp, mouse
ggcactgttcagtgtagact

SEQ ID NO: 636589 - DNA, 20 bp, mouse
ggcgactttaagagtaaaga

SEQ ID NO: 636590 - DNA, 20 bp, mouse
ggcggggtcggtctaggggc

SEQ ID NO: 636591 - DNA, 20 bp, mouse
gaaattatgcatatgaagac

SEQ ID NO: 636592 - DNA, 20 bp, mouse
gccttcagcccatatagaaa

SEQ ID NO: 636593 - DNA, 20 bp, mouse
gtacgcagccttttctatat

SEQ ID NO: 636594 - DNA, 20 bp, mouse
ggaatacgatctagcttgat

SEQ ID NO: 636595 - DNA, 20 bp, mouse
ggaaaaggctgcgtatttgc

SEQ ID NO: 636596 - DNA, 20 bp, mouse
gcaccacacgcggtgaagga

SEQ ID NO: 636597 - DNA, 20 bp, mouse
gcgcgtgtggtgggaggaaa

SEQ ID NO: 636598 - DNA, 20 bp, mouse
gctcccaccacacgcggtga

SEQ ID NO: 636599 - DNA, 20 bp, mouse
gtgccctccttcaccgcgtg

SEQ ID NO: 636600 - DNA, 20 bp, mouse
gcggaagtgccggaacgtag

SEQ ID NO: 636601 - DNA, 20 bp, mouse
gactaggagcatctaggctt

SEQ ID NO: 636602 - DNA, 20 bp, mouse
ggagttccttctgatcttac

SEQ ID NO: 636603 - DNA, 20 bp, mouse
gggcttagggctctttaaga

SEQ ID NO: 636604 - DNA, 20 bp, mouse
gtggagtggaccggaagtgc

SEQ ID NO: 636605 - DNA, 20 bp, mouse
gaacgtagtggcgttcaagc

SEQ ID NO: 636606 - DNA, 20 bp, mouse
ggaagacccaacaagtattg

SEQ ID NO: 636607 - DNA, 20 bp, mouse
ggaccttaggccaaccctct

SEQ ID NO: 636608 - DNA, 20 bp, mouse
gaacctagagggttggccta

SEQ ID NO: 636609 - DNA, 20 bp, mouse
gcaggcttcaagtgccccta

SEQ ID NO: 636610 - DNA, 20 bp, mouse
ggcggggcgagtggctagac

SEQ ID NO: 636611 - DNA, 20 bp, mouse
gctatggagaccagtactaa

SEQ ID NO: 636612 - DNA, 20 bp, mouse
gtgtacacaaaccacactat

SEQ ID NO: 636613 - DNA, 20 bp, mouse
gactattcatgctagtagga

SEQ ID NO: 636614 - DNA, 20 bp, mouse
gctgatctataacagatgct

SEQ ID NO: 636615 - DNA, 20 bp, mouse
gggagcacttagctacctag

SEQ ID NO: 636616 - DNA, 20 bp, mouse
gttaaggcatccccgcctag

SEQ ID NO: 636617 - DNA, 20 bp, mouse
gaggggctatgttctcacag

SEQ ID NO: 636618 - DNA, 20 bp, mouse
ggaaactgacagacacaggt

SEQ ID NO: 636619 - DNA, 20 bp, mouse
ggggatgccttaagtcccca

SEQ ID NO: 636620 - DNA, 20 bp, mouse
gccagaatgtcatggggagg

SEQ ID NO: 636621 - DNA, 20 bp, mouse
ggtgtcaggggtgtttaagg

SEQ ID NO: 636622 - DNA, 20 bp, mouse
ggagggcaataaggaatatc

SEQ ID NO: 636623 - DNA, 20 bp, mouse
ggagccagaatgtcatgggg

SEQ ID NO: 636624 - DNA, 20 bp, mouse
gtcaagcaagccgctaggcg

SEQ ID NO: 636625 - DNA, 20 bp, mouse
gacctgagccagaatgtcat

SEQ ID NO: 636626 - DNA, 20 bp, mouse
gccaactctctctggtcctg

SEQ ID NO: 636627 - DNA, 20 bp, mouse
gggcagcctcctgtggttca

SEQ ID NO: 636628 - DNA, 20 bp, mouse
gtaaatgttctccaaggcaa

SEQ ID NO: 636629 - DNA, 20 bp, mouse
gttctggtccatgtgactct

SEQ ID NO: 636630 - DNA, 20 bp, mouse
gtgcctgtaaatgttctcca

SEQ ID NO: 636631 - DNA, 20 bp, mouse
ggagagttggcagcctcctg

SEQ ID NO: 636632 - DNA, 20 bp, mouse
gctgggctggaagtagcccc

SEQ ID NO: 636633 - DNA, 20 bp, mouse
gaagctcaccccttgctctc

SEQ ID NO: 636634 - DNA, 20 bp, mouse
gcttccagcccagagtcaca

SEQ ID NO: 636635 - DNA, 20 bp, mouse
gccacttgtccctgaaccac

SEQ ID NO: 636636 - DNA, 20 bp, mouse
gggaaggcggggctaggttc

SEQ ID NO: 636637 - DNA, 20 bp, mouse
gcaaccagcaagagagtgtg

SEQ ID NO: 636638 - DNA, 20 bp, mouse
gctagactgcgggcagggtg

SEQ ID NO: 636639 - DNA, 20 bp, mouse
gagaacgccgccaatcagaa

SEQ ID NO: 636640 - DNA, 20 bp, mouse
gttcccgcccacctgtgcgc

SEQ ID NO: 636641 - DNA, 20 bp, mouse
gagggcacctaagtgggcca

SEQ ID NO: 636642 - DNA, 20 bp, mouse
gtagacgagagggtgacaca

SEQ ID NO: 636643 - DNA, 20 bp, mouse
ggctctgtgttgtcatgtga

SEQ ID NO: 636644 - DNA, 20 bp, mouse
gactgcgcctgcgcacaggt

SEQ ID NO: 636645 - DNA, 20 bp, mouse
gacatgacaacacagagcct

SEQ ID NO: 636646 - DNA, 20 bp, mouse
ggctgcttcgggctattctt

SEQ ID NO: 636647 - DNA, 20 bp, mouse
gggcaggccgtggtgagcct

SEQ ID NO: 636648 - DNA, 20 bp, mouse
gcctggttagaactcagaga

SEQ ID NO: 636649 - DNA, 20 bp, mouse
gctagagaaaagggaagtca

SEQ ID NO: 636650 - DNA, 20 bp, mouse
gtgtgatggcagcccttccc

SEQ ID NO: 636651 - DNA, 20 bp, mouse
ggcaactggggaaatagagt

SEQ ID NO: 636652 - DNA, 20 bp, mouse
gagcagcagctggcaggccg

SEQ ID NO: 636653 - DNA, 20 bp, mouse
gggtgctagcaggtgcaact

SEQ ID NO: 636654 - DNA, 20 bp, mouse
gcatgctgttataaggaagc

SEQ ID NO: 636655 - DNA, 20 bp, mouse
gggtcctgaccccctagttc

SEQ ID NO: 636656 - DNA, 20 bp, mouse
gcgggctcagggacgattag

SEQ ID NO: 636657 - DNA, 20 bp, mouse
ggtaccagatggggcgtagg

SEQ ID NO: 636658 - DNA, 20 bp, mouse
gcgtaggcggcccgtacgaa

SEQ ID NO: 636659 - DNA, 20 bp, mouse
gggaccctagggcatctctg

SEQ ID NO: 636660 - DNA, 20 bp, mouse
gtacgaagggtgtcccggga

SEQ ID NO: 636661 - DNA, 20 bp, mouse
ggaccacaggggttaactca

SEQ ID NO: 636662 - DNA, 20 bp, mouse
ggccccatctggtaccggtc

SEQ ID NO: 636663 - DNA, 20 bp, mouse
ggtgtcccgggaaggtctgg

SEQ ID NO: 636664 - DNA, 20 bp, mouse
gcataacaggaggagctcgg

SEQ ID NO: 636665 - DNA, 20 bp, mouse
gccggtaccagatggggcgt

SEQ ID NO: 636666 - DNA, 20 bp, mouse
gtggctgcgaacagtcactt

SEQ ID NO: 636667 - DNA, 20 bp, mouse
gtgtggtagggcaaacgtag

SEQ ID NO: 636668 - DNA, 20 bp, mouse
gcgtgtgtcttcctgccctt

SEQ ID NO: 636669 - DNA, 20 bp, mouse
gtgagagttatctcacctta

SEQ ID NO: 636670 - DNA, 20 bp, mouse
gggctcccaggaagtctgtc

SEQ ID NO: 636671 - DNA, 20 bp, mouse
gcagagagacacatttccta

SEQ ID NO: 636672 - DNA, 20 bp, mouse
gtgaaatagaccctccataa

SEQ ID NO: 636673 - DNA, 20 bp, mouse
gaagggctctgagtttccat

SEQ ID NO: 636674 - DNA, 20 bp, mouse
gttccaaggtccaacctact

SEQ ID NO: 636675 - DNA, 20 bp, mouse
ggtgactgttcgcagccaaa

SEQ ID NO: 636676 - DNA, 20 bp, mouse
ggcacgtggcactaggatga

SEQ ID NO: 636677 - DNA, 20 bp, mouse
gcctgcgcactgcgtatccg

SEQ ID NO: 636678 - DNA, 20 bp, mouse
gcgcaggcgcacgtggcact

SEQ ID NO: 636679 - DNA, 20 bp, mouse
gtctttctaaagggcgttca

SEQ ID NO: 636680 - DNA, 20 bp, mouse
gtgaaggaatctcggtggaa

SEQ ID NO: 636681 - DNA, 20 bp, mouse
gggcacgttagcgagagcgc

SEQ ID NO: 636682 - DNA, 20 bp, mouse
gagggcgttcagggcttctc

SEQ ID NO: 636683 - DNA, 20 bp, mouse
gcaatagctcctcaaaaagg

SEQ ID NO: 636684 - DNA, 20 bp, mouse
gtcgtgtgaaggaatctcgg

SEQ ID NO: 636685 - DNA, 20 bp, mouse
ggggccggccccttgctttc

SEQ ID NO: 636686 - DNA, 20 bp, mouse
gcccacaagctctcgaggat

SEQ ID NO: 636687 - DNA, 20 bp, mouse
ggtcgctgaggggtacgatt

SEQ ID NO: 636688 - DNA, 20 bp, mouse
gtgctctcgcgataactctc

SEQ ID NO: 636689 - DNA, 20 bp, mouse
gtagaggtggaggtcgctga

SEQ ID NO: 636690 - DNA, 20 bp, mouse
gcgagagcagcgaaggcctg

SEQ ID NO: 636691 - DNA, 20 bp, mouse
gccagggcggtgaaagatgt

SEQ ID NO: 636692 - DNA, 20 bp, mouse
gttccctggagcagtagagg

SEQ ID NO: 636693 - DNA, 20 bp, mouse
gcttggagtggcaagatcga

SEQ ID NO: 636694 - DNA, 20 bp, mouse
gcgaaggcctggggcaggtt

SEQ ID NO: 636695 - DNA, 20 bp, mouse
gccccgcccacaagctctcg

SEQ ID NO: 636696 - DNA, 20 bp, mouse
gtgacctggccaccaggcga

SEQ ID NO: 636697 - DNA, 20 bp, mouse
gtggccaggtcagaaccctt

SEQ ID NO: 636698 - DNA, 20 bp, mouse
ggggccacacaagttcccaa

SEQ ID NO: 636699 - DNA, 20 bp, mouse
gagagtgggcggagcttagg

SEQ ID NO: 636700 - DNA, 20 bp, mouse
gtagcaggattagggaaccg

SEQ ID NO: 636701 - DNA, 20 bp, mouse
gaggaaagggaccggcttct

SEQ ID NO: 636702 - DNA, 20 bp, mouse
gaagccggtccctttccttc

SEQ ID NO: 636703 - DNA, 20 bp, mouse
gtagctaactcgtatctagc

SEQ ID NO: 636704 - DNA, 20 bp, mouse
ggggcctgggtcccaaacga

SEQ ID NO: 636705 - DNA, 20 bp, mouse
ggcatgctgggaagagaggt

SEQ ID NO: 636706 - DNA, 20 bp, mouse
ggagagctggaggttaaccc

SEQ ID NO: 636707 - DNA, 20 bp, mouse
gtgtgcagaagctgcagcct

SEQ ID NO: 636708 - DNA, 20 bp, mouse
gcacaacatgagatgtgctg

SEQ ID NO: 636709 - DNA, 20 bp, mouse
ggacgcaggctgcgcgctca

SEQ ID NO: 636710 - DNA, 20 bp, mouse
gagatgtgctgcggtgggtg

SEQ ID NO: 636711 - DNA, 20 bp, mouse
gacatgagatgtgctgcggt

SEQ ID NO: 636712 - DNA, 20 bp, mouse
gactaccaagacgaccctcc

SEQ ID NO: 636713 - DNA, 20 bp, mouse
gcagtgagacaagtgtgagg

SEQ ID NO: 636714 - DNA, 20 bp, mouse
gcaggctgcgcgctcagggc

SEQ ID NO: 636715 - DNA, 20 bp, mouse
gacccagtgagacaagtgtg

SEQ ID NO: 636716 - DNA, 20 bp, mouse
ggaagtatgggtttcttctt

SEQ ID NO: 636717 - DNA, 20 bp, mouse
gtcggggttggcattagcta

SEQ ID NO: 636718 - DNA, 20 bp, mouse
gggtatggggccagcactcg

SEQ ID NO: 636719 - DNA, 20 bp, mouse
gcctgcctagtgttaatcat

SEQ ID NO: 636720 - DNA, 20 bp, mouse
ggcattagctaaggtcacac

SEQ ID NO: 636721 - DNA, 20 bp, mouse
gaggacattttcctggtatg

SEQ ID NO: 636722 - DNA, 20 bp, mouse
gtggggccagcactcggggt

SEQ ID NO: 636723 - DNA, 20 bp, mouse
ggtcttctctagttggaatc

SEQ ID NO: 636724 - DNA, 20 bp, mouse
gtccaaaaatagcctgtccc

SEQ ID NO: 636725 - DNA, 20 bp, mouse
gcatagtgagctggaagtat

SEQ ID NO: 636726 - DNA, 20 bp, mouse
gtagagcggcgaggtgaggc

SEQ ID NO: 636727 - DNA, 20 bp, mouse
gggcctccaagtgcccttct

SEQ ID NO: 636728 - DNA, 20 bp, mouse
gccgcggagcaccgaggaga

SEQ ID NO: 636729 - DNA, 20 bp, mouse
gcgcggccttcccgctagag

SEQ ID NO: 636730 - DNA, 20 bp, mouse
gcggctgcggcgtccggcat

SEQ ID NO: 636731 - DNA, 20 bp, mouse
gccgctagagcggcgaggtg

SEQ ID NO: 636732 - DNA, 20 bp, mouse
gaagctgtcgtggaggcgga

SEQ ID NO: 636733 - DNA, 20 bp, mouse
gctcctagaagggcacttgg

SEQ ID NO: 636734 - DNA, 20 bp, mouse
gtgactggcgaaagctgtcg

SEQ ID NO: 636735 - DNA, 20 bp, mouse
gatcgagaggagcatcgctg

SEQ ID NO: 636736 - DNA, 20 bp, mouse
gtagcagggagtccttgacg

SEQ ID NO: 636737 - DNA, 20 bp, mouse
gacacgagatagacggaagg

SEQ ID NO: 636738 - DNA, 20 bp, mouse
gcagacacgagatagacgga

SEQ ID NO: 636739 - DNA, 20 bp, mouse
gccacggggcggagacacat

SEQ ID NO: 636740 - DNA, 20 bp, mouse
gcgattggggcagacaggag

SEQ ID NO: 636741 - DNA, 20 bp, mouse
gagtcctatgcgagcgtgtc

SEQ ID NO: 636742 - DNA, 20 bp, mouse
gtccgccctcccaccgtctg

SEQ ID NO: 636743 - DNA, 20 bp, mouse
gcctcccgacacgctcgcat

SEQ ID NO: 636744 - DNA, 20 bp, mouse
gtccacagacggtgggaggg

SEQ ID NO: 636745 - DNA, 20 bp, mouse
gcatgcgccactgtacccat

SEQ ID NO: 636746 - DNA, 20 bp, mouse
gctcctcccggaacttcctg

SEQ ID NO: 636747 - DNA, 20 bp, mouse
gcaccccaggaagttccggg

SEQ ID NO: 636748 - DNA, 20 bp, mouse
gtcccaccggggcggagctt

SEQ ID NO: 636749 - DNA, 20 bp, mouse
gcagccggatgataatggtc

SEQ ID NO: 636750 - DNA, 20 bp, mouse
gcccggagctgccacccgac

SEQ ID NO: 636751 - DNA, 20 bp, mouse
ggagcccggcggacgactcg

SEQ ID NO: 636752 - DNA, 20 bp, mouse
gaacacaagtgaaagccagt

SEQ ID NO: 636753 - DNA, 20 bp, mouse
gtgtccggaccattatcatc

SEQ ID NO: 636754 - DNA, 20 bp, mouse
gcgccccttcggaaagttga

SEQ ID NO: 636755 - DNA, 20 bp, mouse
gaggcgcgccgattggcagc

SEQ ID NO: 636756 - DNA, 20 bp, mouse
gacaagagctgatattgcat

SEQ ID NO: 636757 - DNA, 20 bp, mouse
gagtgaacagtcaggcatac

SEQ ID NO: 636758 - DNA, 20 bp, mouse
ggactgttcactcagaggca

SEQ ID NO: 636759 - DNA, 20 bp, mouse
gtgcctgactgttcactcag

SEQ ID NO: 636760 - DNA, 20 bp, mouse
gcgtggcttctaggatgaga

SEQ ID NO: 636761 - DNA, 20 bp, mouse
ggcaatctgaccctgatgta

SEQ ID NO: 636762 - DNA, 20 bp, mouse
gctagaagccacgtgttatc

SEQ ID NO: 636763 - DNA, 20 bp, mouse
gactaaacgcccctacatca

SEQ ID NO: 636764 - DNA, 20 bp, mouse
gtcctgctggggatttcttg

SEQ ID NO: 636765 - DNA, 20 bp, mouse
ggtctctggctcagtatagt

SEQ ID NO: 636766 - DNA, 20 bp, mouse
gagatcagactctgaactca

SEQ ID NO: 636767 - DNA, 20 bp, mouse
ggtctgatctcatgtacttt

SEQ ID NO: 636768 - DNA, 20 bp, mouse
gcgtgcgaccatgcttttat

SEQ ID NO: 636769 - DNA, 20 bp, mouse
gaaaagcatggtcgcacgct

SEQ ID NO: 636770 - DNA, 20 bp, mouse
gagcacaaattacttacaag

SEQ ID NO: 636771 - DNA, 20 bp, mouse
gtcatgtacttttggtggaa

SEQ ID NO: 636772 - DNA, 20 bp, mouse
gtctttactggcattctgcc

SEQ ID NO: 636773 - DNA, 20 bp, mouse
gtgcttttattggagaagaa

SEQ ID NO: 636774 - DNA, 20 bp, mouse
gatcggcatttccaccaatg

SEQ ID NO: 636775 - DNA, 20 bp, mouse
gtgaataatttccacattgg

SEQ ID NO: 636776 - DNA, 20 bp, mouse
gtctgcgcgcgggaacccag

SEQ ID NO: 636777 - DNA, 20 bp, mouse
gcatgcgcacgtgtggtggt

SEQ ID NO: 636778 - DNA, 20 bp, mouse
gtgcgcgcggcacctgcccc

SEQ ID NO: 636779 - DNA, 20 bp, mouse
gaacccctggctcttttccg

SEQ ID NO: 636780 - DNA, 20 bp, mouse
gtctccgcggaaaagagcca

SEQ ID NO: 636781 - DNA, 20 bp, mouse
gcacgcatgcgcacgtgtgg

SEQ ID NO: 636782 - DNA, 20 bp, mouse
gccgcgcacgagccaacccc

SEQ ID NO: 636783 - DNA, 20 bp, mouse
ggcggcacctgccccaggag

SEQ ID NO: 636784 - DNA, 20 bp, mouse
gggtggttgggtcccgggat

SEQ ID NO: 636785 - DNA, 20 bp, mouse
gagttggtttaaaatctccg

SEQ ID NO: 636786 - DNA, 20 bp, mouse
gcagtcatggcatccgtgac

SEQ ID NO: 636787 - DNA, 20 bp, mouse
gtatgacaatgagccagtca

SEQ ID NO: 636788 - DNA, 20 bp, mouse
gatacctattcactgtgtcc

SEQ ID NO: 636789 - DNA, 20 bp, mouse
gctagtgcaggtaaagaaca

SEQ ID NO: 636790 - DNA, 20 bp, mouse
ggaatgagactgaacctaaa

SEQ ID NO: 636791 - DNA, 20 bp, mouse
gacagagattaaagctgtgg

SEQ ID NO: 636792 - DNA, 20 bp, mouse
gcaccaagggtgatgctatt

SEQ ID NO: 636793 - DNA, 20 bp, mouse
gtgtttgtccaaatgttctg

SEQ ID NO: 636794 - DNA, 20 bp, mouse
gccaacaagtaatctttcaa

SEQ ID NO: 636795 - DNA, 20 bp, mouse
gaacacagagattaaagctg

SEQ ID NO: 636796 - DNA, 20 bp, mouse
ggggcagcgcgccccggagc

SEQ ID NO: 636797 - DNA, 20 bp, mouse
ggtcaggcctagcaaaatga

SEQ ID NO: 636798 - DNA, 20 bp, mouse
gccggagccggcttcgtgaa

SEQ ID NO: 636799 - DNA, 20 bp, mouse
gcaagcgcactcccgcgtag

SEQ ID NO: 636800 - DNA, 20 bp, mouse
gctcccgcgtagcggcgcct

SEQ ID NO: 636801 - DNA, 20 bp, mouse
gcccggcgaggagacggaga

SEQ ID NO: 636802 - DNA, 20 bp, mouse
gggcctagcaaaatgagggg

SEQ ID NO: 636803 - DNA, 20 bp, mouse
gggagtgcgcttgcgcacag

SEQ ID NO: 636804 - DNA, 20 bp, mouse
gagcccaggcgccgctacgc

SEQ ID NO: 636805 - DNA, 20 bp, mouse
gccccccagtcctggacggt

SEQ ID NO: 636806 - DNA, 20 bp, mouse
gcaaacctcagcaaactcca

SEQ ID NO: 636807 - DNA, 20 bp, mouse
gagaatgtggacacacccag

SEQ ID NO: 636808 - DNA, 20 bp, mouse
gtagttcaacgtgtatgggg

SEQ ID NO: 636809 - DNA, 20 bp, mouse
gggaggtattttcgtgtgaa

SEQ ID NO: 636810 - DNA, 20 bp, mouse
gcacacgaaaatacctccct

SEQ ID NO: 636811 - DNA, 20 bp, mouse
gaattgcagtttaatcactg

SEQ ID NO: 636812 - DNA, 20 bp, mouse
ggggtgtgtccacattctag

SEQ ID NO: 636813 - DNA, 20 bp, mouse
gtattttcgtgtgaagggtg

SEQ ID NO: 636814 - DNA, 20 bp, mouse
gtgacactaaaagtactcag

SEQ ID NO: 636815 - DNA, 20 bp, mouse
gtttcgtgtgaagggtgagg

SEQ ID NO: 636816 - DNA, 20 bp, mouse
ggtaacctccaccgcccctc

SEQ ID NO: 636817 - DNA, 20 bp, mouse
gcgtgccggagataggaccc

SEQ ID NO: 636818 - DNA, 20 bp, mouse
gcgcccctccgggagcctgg

SEQ ID NO: 636819 - DNA, 20 bp, mouse
gaattccgccaggctcccgg

SEQ ID NO: 636820 - DNA, 20 bp, mouse
ggaagcctgggtcctatctc

SEQ ID NO: 636821 - DNA, 20 bp, mouse
gggttgaaattcgaggtagg

SEQ ID NO: 636822 - DNA, 20 bp, mouse
gtccgttgtgggcaactctg

SEQ ID NO: 636823 - DNA, 20 bp, mouse
ggataggacccaggcttccc

SEQ ID NO: 636824 - DNA, 20 bp, mouse
ggttgtgggcaactctgagg

SEQ ID NO: 636825 - DNA, 20 bp, mouse
gggagcttcgtgccggagat

SEQ ID NO: 636826 - DNA, 20 bp, mouse
gtgaatacgaaggaccagat

SEQ ID NO: 636827 - DNA, 20 bp, mouse
gtagtgacatgcaaggaggg

SEQ ID NO: 636828 - DNA, 20 bp, mouse
gaatgagaacttgaatacga

SEQ ID NO: 636829 - DNA, 20 bp, mouse
ggtctagtgacatgcaagga

SEQ ID NO: 636830 - DNA, 20 bp, mouse
gaaactgttaagactgttaa

SEQ ID NO: 636831 - DNA, 20 bp, mouse
gggactgcttagtaagcaac

SEQ ID NO: 636832 - DNA, 20 bp, mouse
gggcagtctagtgacatgca

SEQ ID NO: 636833 - DNA, 20 bp, mouse
gaggaacacactccactttt

SEQ ID NO: 636834 - DNA, 20 bp, mouse
ggaaccaacacccagcaccg

SEQ ID NO: 636835 - DNA, 20 bp, mouse
gatacctcggtgctgggtgt

SEQ ID NO: 636836 - DNA, 20 bp, mouse
gaccgtgaaagcaggatccc

SEQ ID NO: 636837 - DNA, 20 bp, mouse
gccggctcaggcgtaagtgt

SEQ ID NO: 636838 - DNA, 20 bp, mouse
ggcagcgcgcgctataaatg

SEQ ID NO: 636839 - DNA, 20 bp, mouse
gggcgatcgcgtgtgaggtg

SEQ ID NO: 636840 - DNA, 20 bp, mouse
gaaagccccccatggggtgg

SEQ ID NO: 636841 - DNA, 20 bp, mouse
gtataaatggggacacgcgg

SEQ ID NO: 636842 - DNA, 20 bp, mouse
ggcccggagcggggacgcta

SEQ ID NO: 636843 - DNA, 20 bp, mouse
gcttgcgagcgcgatgggtg

SEQ ID NO: 636844 - DNA, 20 bp, mouse
gcagctcccaaggagagggc

SEQ ID NO: 636845 - DNA, 20 bp, mouse
ggcccaagagccgctggagg

SEQ ID NO: 636846 - DNA, 20 bp, mouse
ggagccgcgctcctactcat

SEQ ID NO: 636847 - DNA, 20 bp, mouse
gtcccgcggccgcccgtcgt

SEQ ID NO: 636848 - DNA, 20 bp, mouse
ggagccttaggatacccgga

SEQ ID NO: 636849 - DNA, 20 bp, mouse
gctcatgggcggagattgga

SEQ ID NO: 636850 - DNA, 20 bp, mouse
gaaaaagcagcgggagcctt

SEQ ID NO: 636851 - DNA, 20 bp, mouse
gatacccggagggaaatcag

SEQ ID NO: 636852 - DNA, 20 bp, mouse
gagcagcagctccgactcgt

SEQ ID NO: 636853 - DNA, 20 bp, mouse
gtcaaagggaaggggtctcg

SEQ ID NO: 636854 - DNA, 20 bp, mouse
gcctactcatgggcggagat

SEQ ID NO: 636855 - DNA, 20 bp, mouse
ggacccgttgagctacttcg

SEQ ID NO: 636856 - DNA, 20 bp, mouse
gacttcggagccactcggtg

SEQ ID NO: 636857 - DNA, 20 bp, mouse
gacgaagggacgagagacca

SEQ ID NO: 636858 - DNA, 20 bp, mouse
gactcagggtcccagacgaa

SEQ ID NO: 636859 - DNA, 20 bp, mouse
gaccctgagttctccaccag

SEQ ID NO: 636860 - DNA, 20 bp, mouse
gtggctccgaagtctttgga

SEQ ID NO: 636861 - DNA, 20 bp, mouse
ggccccctggtggagaactc

SEQ ID NO: 636862 - DNA, 20 bp, mouse
ggtgcgccctccaaagactt

SEQ ID NO: 636863 - DNA, 20 bp, mouse
gccactcggtggggtgcaga

SEQ ID NO: 636864 - DNA, 20 bp, mouse
gcccaagtgcgcatgcggaa

SEQ ID NO: 636865 - DNA, 20 bp, mouse
gtgtcccgctctcccgccca

SEQ ID NO: 636866 - DNA, 20 bp, mouse
gggccagcctgacactcctg

SEQ ID NO: 636867 - DNA, 20 bp, mouse
gttaacggagtgtggtttgg

SEQ ID NO: 636868 - DNA, 20 bp, mouse
gccggaatagaatttcaaga

SEQ ID NO: 636869 - DNA, 20 bp, mouse
gggttactaggtagtccggg

SEQ ID NO: 636870 - DNA, 20 bp, mouse
ggctccgccccaggagtgtc

SEQ ID NO: 636871 - DNA, 20 bp, mouse
gttagcgcggtttagagaat

SEQ ID NO: 636872 - DNA, 20 bp, mouse
gtaggctgcacctctggaag

SEQ ID NO: 636873 - DNA, 20 bp, mouse
ggaacccgggatttatgagt

SEQ ID NO: 636874 - DNA, 20 bp, mouse
gtccgtctgaacttgggttc

SEQ ID NO: 636875 - DNA, 20 bp, mouse
gcctctggaagcgggagtcc

SEQ ID NO: 636876 - DNA, 20 bp, mouse
gggaagaccaaagaagggct

SEQ ID NO: 636877 - DNA, 20 bp, mouse
gttaggcggaagaccaaaga

SEQ ID NO: 636878 - DNA, 20 bp, mouse
gacgagccctcggaagacac

SEQ ID NO: 636879 - DNA, 20 bp, mouse
gtcgcggcctagcccttctt

SEQ ID NO: 636880 - DNA, 20 bp, mouse
ggccgtggtaaccatcactt

SEQ ID NO: 636881 - DNA, 20 bp, mouse
gcaagagtctaactccattg

SEQ ID NO: 636882 - DNA, 20 bp, mouse
ggctaggccgcgaaggctcc

SEQ ID NO: 636883 - DNA, 20 bp, mouse
gtcttgtaggtcgaggtccg

SEQ ID NO: 636884 - DNA, 20 bp, mouse
gggctgccgcaattctttct

SEQ ID NO: 636885 - DNA, 20 bp, mouse
gggttaccacggcaacgcga

SEQ ID NO: 636886 - DNA, 20 bp, mouse
gtaggacccaggaagacggt

SEQ ID NO: 636887 - DNA, 20 bp, mouse
gcttacacggagtctttatc

SEQ ID NO: 636888 - DNA, 20 bp, mouse
gggcgggtcccacgcttccg

SEQ ID NO: 636889 - DNA, 20 bp, mouse
gggctcacctaataagttct

SEQ ID NO: 636890 - DNA, 20 bp, mouse
gaaaccgcggtagtatgcac

SEQ ID NO: 636891 - DNA, 20 bp, mouse
gtcctggtagaatggaatga

SEQ ID NO: 636892 - DNA, 20 bp, mouse
gcctacccagggaatgccga

SEQ ID NO: 636893 - DNA, 20 bp, mouse
ggccaagcctaccgtcttcc

SEQ ID NO: 636894 - DNA, 20 bp, mouse
ggacaaaccgggctagctgt

SEQ ID NO: 636895 - DNA, 20 bp, mouse
gccagaaagcaccacggccg

SEQ ID NO: 636896 - DNA, 20 bp, mouse
gagaagggagagtgtgtccc

SEQ ID NO: 636897 - DNA, 20 bp, mouse
gagtgcagtcactgtgacaa

SEQ ID NO: 636898 - DNA, 20 bp, mouse
gtggctgacagaggctatag

SEQ ID NO: 636899 - DNA, 20 bp, mouse
gcaagggatcaagagaccca

SEQ ID NO: 636900 - DNA, 20 bp, mouse
gactctcccttctgggacag

SEQ ID NO: 636901 - DNA, 20 bp, mouse
gacgcactcgccctctaggt

SEQ ID NO: 636902 - DNA, 20 bp, mouse
gctccacgcactcgccctct

SEQ ID NO: 636903 - DNA, 20 bp, mouse
gggcaaccagcctagtgttg

SEQ ID NO: 636904 - DNA, 20 bp, mouse
gacatggactccccaacact

SEQ ID NO: 636905 - DNA, 20 bp, mouse
gtgatgcccctgtcccagaa

SEQ ID NO: 636906 - DNA, 20 bp, mouse
gtcgtcgccaagcaacttcc

SEQ ID NO: 636907 - DNA, 20 bp, mouse
gtggcagtggaggaatccag

SEQ ID NO: 636908 - DNA, 20 bp, mouse
gcacgggcgtccagcaagga

SEQ ID NO: 636909 - DNA, 20 bp, mouse
gaccacgccgggaagttgct

SEQ ID NO: 636910 - DNA, 20 bp, mouse
gcacgatcgctgaaagttat

SEQ ID NO: 636911 - DNA, 20 bp, mouse
gacgaggcgctgtagctaat

SEQ ID NO: 636912 - DNA, 20 bp, mouse
ggtgccactgcgtaccacgc

SEQ ID NO: 636913 - DNA, 20 bp, mouse
ggggcgtccagcaaggaggg

SEQ ID NO: 636914 - DNA, 20 bp, mouse
ggcttctcctgggctctaat

SEQ ID NO: 636915 - DNA, 20 bp, mouse
gttcccggcgtggtacgcag

SEQ ID NO: 636916 - DNA, 20 bp, mouse
gctcgtgacgtcacgaactc

SEQ ID NO: 636917 - DNA, 20 bp, mouse
gagcccggtgacgtcagggt

SEQ ID NO: 636918 - DNA, 20 bp, mouse
gctccgggcggcgccgagta

SEQ ID NO: 636919 - DNA, 20 bp, mouse
gcgcccgtctctgcaggtgg

SEQ ID NO: 636920 - DNA, 20 bp, mouse
gcccggagcccggtgacgtc

SEQ ID NO: 636921 - DNA, 20 bp, mouse
gccgcccaccctgacgtcac

SEQ ID NO: 636922 - DNA, 20 bp, mouse
ggcggcgccgagtagggctc

SEQ ID NO: 636923 - DNA, 20 bp, mouse
gacgaactctggccaatccc

SEQ ID NO: 636924 - DNA, 20 bp, mouse
gccaaactggctccaaacca

SEQ ID NO: 636925 - DNA, 20 bp, mouse
gggggctggctccggacccc

SEQ ID NO: 636926 - DNA, 20 bp, mouse
ggaagcagaggattccacta

SEQ ID NO: 636927 - DNA, 20 bp, mouse
gaatgtgaagactcccatga

SEQ ID NO: 636928 - DNA, 20 bp, mouse
gggactagaccggctctcta

SEQ ID NO: 636929 - DNA, 20 bp, mouse
ggagcgccgtgcttcctgat

SEQ ID NO: 636930 - DNA, 20 bp, mouse
gggcagatgaacgcttgcgt

SEQ ID NO: 636931 - DNA, 20 bp, mouse
ggaagaccacacttccgtag

SEQ ID NO: 636932 - DNA, 20 bp, mouse
gttctccaaaacggaagcag

SEQ ID NO: 636933 - DNA, 20 bp, mouse
gaggagaatgttctggggta

SEQ ID NO: 636934 - DNA, 20 bp, mouse
gacggaagtgtggtcttcgc

SEQ ID NO: 636935 - DNA, 20 bp, mouse
ggagtggagacaatctctct

SEQ ID NO: 636936 - DNA, 20 bp, mouse
gcaggagggcaggacagact

SEQ ID NO: 636937 - DNA, 20 bp, mouse
gggaggtaacccactctggc

SEQ ID NO: 636938 - DNA, 20 bp, mouse
gcaggtgcccgcccacggag

SEQ ID NO: 636939 - DNA, 20 bp, mouse
ggggcgggcggggatccgtc

SEQ ID NO: 636940 - DNA, 20 bp, mouse
gcttgcacgaggggaagcca

SEQ ID NO: 636941 - DNA, 20 bp, mouse
gagaaaggactaccgagctg

SEQ ID NO: 636942 - DNA, 20 bp, mouse
gcccacgcgtcgcctggaca

SEQ ID NO: 636943 - DNA, 20 bp, mouse
gggcaggacagactcggtgg

SEQ ID NO: 636944 - DNA, 20 bp, mouse
gttactcagggttatgtcgt

SEQ ID NO: 636945 - DNA, 20 bp, mouse
gctccatgccgctccgtggg

SEQ ID NO: 636946 - DNA, 20 bp, mouse
gctggtacaggactccagag

SEQ ID NO: 636947 - DNA, 20 bp, mouse
gtccccgggtcagaacaaaa

SEQ ID NO: 636948 - DNA, 20 bp, mouse
gacggcgagcgataaacctc

SEQ ID NO: 636949 - DNA, 20 bp, mouse
gcctgtaccagcaaattgca

SEQ ID NO: 636950 - DNA, 20 bp, mouse
gcactccccctagtgatgaa

SEQ ID NO: 636951 - DNA, 20 bp, mouse
gcaggtgtgtagatggattc

SEQ ID NO: 636952 - DNA, 20 bp, mouse
ggagaaaaggccacaattcg

SEQ ID NO: 636953 - DNA, 20 bp, mouse
gtctgccgttcatcactagg

SEQ ID NO: 636954 - DNA, 20 bp, mouse
gtgcctcttcgggatcaatc

SEQ ID NO: 636955 - DNA, 20 bp, mouse
ggcagctcttgtttgctccc

SEQ ID NO: 636956 - DNA, 20 bp, mouse
gtggcccgctggagtgggac

SEQ ID NO: 636957 - DNA, 20 bp, mouse
gtggagtgggacgggctctg

SEQ ID NO: 636958 - DNA, 20 bp, mouse
ggcttagagggcggggtcta

SEQ ID NO: 636959 - DNA, 20 bp, mouse
gcccgcccactggctctcat

SEQ ID NO: 636960 - DNA, 20 bp, mouse
gaccaatgagagccagtggg

SEQ ID NO: 636961 - DNA, 20 bp, mouse
gtccgaatacgcttagaggg

SEQ ID NO: 636962 - DNA, 20 bp, mouse
gggcaccaatgagagccagt

SEQ ID NO: 636963 - DNA, 20 bp, mouse
gacgtccgaatacgcttaga

SEQ ID NO: 636964 - DNA, 20 bp, mouse
gggaggaggagctcctttgc

SEQ ID NO: 636965 - DNA, 20 bp, mouse
gcccggcagcgaatgaacgc

SEQ ID NO: 636966 - DNA, 20 bp, mouse
gtggctgaatgtgacggcag

SEQ ID NO: 636967 - DNA, 20 bp, mouse
gggcgctaggaccctcgcac

SEQ ID NO: 636968 - DNA, 20 bp, mouse
ggtgccaccgagaacgcgat

SEQ ID NO: 636969 - DNA, 20 bp, mouse
gtggcgccctggccacgcca

SEQ ID NO: 636970 - DNA, 20 bp, mouse
gcgcgcccaagcgtcctgta

SEQ ID NO: 636971 - DNA, 20 bp, mouse
gaggctgcacggtcccctac

SEQ ID NO: 636972 - DNA, 20 bp, mouse
ggcgccgatcgcgttctcgg

SEQ ID NO: 636973 - DNA, 20 bp, mouse
ggaggctccggcagaaccaa

SEQ ID NO: 636974 - DNA, 20 bp, mouse
gcggagcctcggctctccat

SEQ ID NO: 636975 - DNA, 20 bp, mouse
ggccacgccagggattggct

SEQ ID NO: 636976 - DNA, 20 bp, mouse
ggtggtgcgggggtcaaccc

SEQ ID NO: 636977 - DNA, 20 bp, mouse
gtgacccccgcaccacccct

SEQ ID NO: 636978 - DNA, 20 bp, mouse
ggagcctaggggtggtgcgg

SEQ ID NO: 636979 - DNA, 20 bp, mouse
gctggcagagggtgtgtagt

SEQ ID NO: 636980 - DNA, 20 bp, mouse
gggtggtggtgaaataccgc

SEQ ID NO: 636981 - DNA, 20 bp, mouse
ggggaggagaactagcacac

SEQ ID NO: 636982 - DNA, 20 bp, mouse
ggtgcgggggtcaacccagg

SEQ ID NO: 636983 - DNA, 20 bp, mouse
gcagggctccagacacggat

SEQ ID NO: 636984 - DNA, 20 bp, mouse
gagggaacgctaagtctcag

SEQ ID NO: 636985 - DNA, 20 bp, mouse
gggagacaagcggacttgct

SEQ ID NO: 636986 - DNA, 20 bp, mouse
ggaccaattaaaatactagt

SEQ ID NO: 636987 - DNA, 20 bp, mouse
ggcacccaaggaaacagaaa

SEQ ID NO: 636988 - DNA, 20 bp, mouse
gatcctactagtattttaat

SEQ ID NO: 636989 - DNA, 20 bp, mouse
gatttttaaagagttacaaa

SEQ ID NO: 636990 - DNA, 20 bp, mouse
gaaggtgtatttccccaagc

SEQ ID NO: 636991 - DNA, 20 bp, mouse
gatgatgcaggcctccagct

SEQ ID NO: 636992 - DNA, 20 bp, mouse
gtatttgcagggggagtgag

SEQ ID NO: 636993 - DNA, 20 bp, mouse
gtgctcatgactttaatcag

SEQ ID NO: 636994 - DNA, 20 bp, mouse
gcatctatgcaaccaattcc

SEQ ID NO: 636995 - DNA, 20 bp, mouse
gattgagagggagattgcaa

SEQ ID NO: 636996 - DNA, 20 bp, mouse
gctacctggtgtctagccga

SEQ ID NO: 636997 - DNA, 20 bp, mouse
ggagaggaggaaggcagtgc

SEQ ID NO: 636998 - DNA, 20 bp, mouse
gaactcttgagtaacccacc

SEQ ID NO: 636999 - DNA, 20 bp, mouse
gagtcagaggccacactacc

SEQ ID NO: 637000 - DNA, 20 bp, mouse
gagtgtaggtgagcttgatt

SEQ ID NO: 637001 - DNA, 20 bp, mouse
gtcggaaaaaacaggagttc

SEQ ID NO: 637002 - DNA, 20 bp, mouse
gggcagtgcaggatgactaa

SEQ ID NO: 637003 - DNA, 20 bp, mouse
gaagccatcggctagacacc

SEQ ID NO: 637004 - DNA, 20 bp, mouse
gtcaaaaactgaaccacata

SEQ ID NO: 637005 - DNA, 20 bp, mouse
gaagcaaacgcgcactaaac

SEQ ID NO: 637006 - DNA, 20 bp, mouse
gacgctcggcagcagccaat

SEQ ID NO: 637007 - DNA, 20 bp, mouse
ggggaggcggccgtcagctc

SEQ ID NO: 637008 - DNA, 20 bp, mouse
ggagcgccgaccaatgaagt

SEQ ID NO: 637009 - DNA, 20 bp, mouse
gcaaggaaacgaagctgtca

SEQ ID NO: 637010 - DNA, 20 bp, mouse
ggaccaatgaagtcggtaga

SEQ ID NO: 637011 - DNA, 20 bp, mouse
gagccaatgggaggatgttc

SEQ ID NO: 637012 - DNA, 20 bp, mouse
ggagaagccatactgctcaa

SEQ ID NO: 637013 - DNA, 20 bp, mouse
ggaggggagcgctagacgct

SEQ ID NO: 637014 - DNA, 20 bp, mouse
ggcaacgcggaggcctccag

SEQ ID NO: 637015 - DNA, 20 bp, mouse
ggccacaacagccgtcgtca

SEQ ID NO: 637016 - DNA, 20 bp, mouse
gaacgccaccgcgaggggat

SEQ ID NO: 637017 - DNA, 20 bp, mouse
gaggggatgggctcgcagag

SEQ ID NO: 637018 - DNA, 20 bp, mouse
ggcgcgcaacgccaccgcga

SEQ ID NO: 637019 - DNA, 20 bp, mouse
gcctcccaacccgagggcgt

SEQ ID NO: 637020 - DNA, 20 bp, mouse
ggtacgccctcccaacccga

SEQ ID NO: 637021 - DNA, 20 bp, mouse
gcgacggggagggagtgcta

SEQ ID NO: 637022 - DNA, 20 bp, mouse
gcgtgcgcgtgcaggcgtgg

SEQ ID NO: 637023 - DNA, 20 bp, mouse
gcgccacggcgcgacgggga

SEQ ID NO: 637024 - DNA, 20 bp, mouse
gcaggcgtggcggcccgagt

SEQ ID NO: 637025 - DNA, 20 bp, mouse
gaccctgtgcctaaaggctg

SEQ ID NO: 637026 - DNA, 20 bp, mouse
gcaggggcgggatttggaga

SEQ ID NO: 637027 - DNA, 20 bp, mouse
ggcgcagcacatgttgggtt

SEQ ID NO: 637028 - DNA, 20 bp, mouse
gacgaggcgcagcacatgtt

SEQ ID NO: 637029 - DNA, 20 bp, mouse
gccaccccgcccctcagtcc

SEQ ID NO: 637030 - DNA, 20 bp, mouse
gagcggccaggggcgggatt

SEQ ID NO: 637031 - DNA, 20 bp, mouse
gaaggtggaaaagcggccag

SEQ ID NO: 637032 - DNA, 20 bp, mouse
gaaaccatcagcagcaaacg

SEQ ID NO: 637033 - DNA, 20 bp, mouse
gtcaaacgccaccggccgta

SEQ ID NO: 637034 - DNA, 20 bp, mouse
gggcggggtctccttggggg

SEQ ID NO: 637035 - DNA, 20 bp, mouse
ggtggaaaagcggccagggg

SEQ ID NO: 637036 - DNA, 20 bp, mouse
gcacgcgccctggacgggaa

SEQ ID NO: 637037 - DNA, 20 bp, mouse
gcagcactcgggattggggg

SEQ ID NO: 637038 - DNA, 20 bp, mouse
gggggcggggctgtgggagc

SEQ ID NO: 637039 - DNA, 20 bp, mouse
ggcgccctacctctctgaag

SEQ ID NO: 637040 - DNA, 20 bp, mouse
gtgaagaggtgggaagcggc

SEQ ID NO: 637041 - DNA, 20 bp, mouse
ggcttcccacctcttcagag

SEQ ID NO: 637042 - DNA, 20 bp, mouse
ggccctggacgggaaggggg

SEQ ID NO: 637043 - DNA, 20 bp, mouse
ggcgatctcacggccaggtt

SEQ ID NO: 637044 - DNA, 20 bp, mouse
gagctggctagtctagatgc

SEQ ID NO: 637045 - DNA, 20 bp, mouse
gtgtgggagccggcgccctg

SEQ ID NO: 637046 - DNA, 20 bp, mouse
gaaggggagacgggctgcat

SEQ ID NO: 637047 - DNA, 20 bp, mouse
gctgctggctaggggagaga

SEQ ID NO: 637048 - DNA, 20 bp, mouse
gagggctttagaggataagt

SEQ ID NO: 637049 - DNA, 20 bp, mouse
gacgggctgcatgggaaagc

SEQ ID NO: 637050 - DNA, 20 bp, mouse
ggggctcagagttcatcaga

SEQ ID NO: 637051 - DNA, 20 bp, mouse
gtttagaggataagtaggag

SEQ ID NO: 637052 - DNA, 20 bp, mouse
gtatcataaggagaggctga

SEQ ID NO: 637053 - DNA, 20 bp, mouse
gtctgatttcagactggggt

SEQ ID NO: 637054 - DNA, 20 bp, mouse
ggcaggggcagcctggttac

SEQ ID NO: 637055 - DNA, 20 bp, mouse
gccagcagagcagcgggcac

SEQ ID NO: 637056 - DNA, 20 bp, mouse
ggcacaccaaagttgggctg

SEQ ID NO: 637057 - DNA, 20 bp, mouse
gcctcacagcacaccaaagt

SEQ ID NO: 637058 - DNA, 20 bp, mouse
gtacgtgtcaagtcttacag

SEQ ID NO: 637059 - DNA, 20 bp, mouse
gcatgggacgctgggatcag

SEQ ID NO: 637060 - DNA, 20 bp, mouse
gggggctctagtaatggagg

SEQ ID NO: 637061 - DNA, 20 bp, mouse
gggggagggggctctagtaa

SEQ ID NO: 637062 - DNA, 20 bp, mouse
gactaactccccaagtgtgg

SEQ ID NO: 637063 - DNA, 20 bp, mouse
ggtgtcaagtcttacagggg

SEQ ID NO: 637064 - DNA, 20 bp, mouse
gaacacttctcaggggttgt

SEQ ID NO: 637065 - DNA, 20 bp, mouse
ggagggggctctagtaatgg

SEQ ID NO: 637066 - DNA, 20 bp, mouse
gctctgggatccctgactga

SEQ ID NO: 637067 - DNA, 20 bp, mouse
ggaaataaggaagtaaccgt

SEQ ID NO: 637068 - DNA, 20 bp, mouse
gcgtgggagagggtagctga

SEQ ID NO: 637069 - DNA, 20 bp, mouse
gtgactgagggatagaccac

SEQ ID NO: 637070 - DNA, 20 bp, mouse
gtgagggaagccatctgttt

SEQ ID NO: 637071 - DNA, 20 bp, mouse
gagagcgcgctgtgcatgac

SEQ ID NO: 637072 - DNA, 20 bp, mouse
gccacaggctgcttgttgtt

SEQ ID NO: 637073 - DNA, 20 bp, mouse
gaaggaagtaaccgtgggag

SEQ ID NO: 637074 - DNA, 20 bp, mouse
gcggaaaagatctgtgtata

SEQ ID NO: 637075 - DNA, 20 bp, mouse
gatgacgggagtaggcagca

SEQ ID NO: 637076 - DNA, 20 bp, mouse
gctgtcccgcctctccctca

SEQ ID NO: 637077 - DNA, 20 bp, mouse
gttgtggcgctggaaatcta

SEQ ID NO: 637078 - DNA, 20 bp, mouse
gcgcacccctgcaaactgga

SEQ ID NO: 637079 - DNA, 20 bp, mouse
gggagcggatcccggtcgga

SEQ ID NO: 637080 - DNA, 20 bp, mouse
gcgccgagatcccaaccgtt

SEQ ID NO: 637081 - DNA, 20 bp, mouse
gggcagcctcgtgttcccaa

SEQ ID NO: 637082 - DNA, 20 bp, mouse
gcctcgtgttcccaacggtt

SEQ ID NO: 637083 - DNA, 20 bp, mouse
gtcccgcctctccctcaagg

SEQ ID NO: 637084 - DNA, 20 bp, mouse
ggggacagagcggaagggtg

SEQ ID NO: 637085 - DNA, 20 bp, mouse
gcgaccgggatccgctccgg

SEQ ID NO: 637086 - DNA, 20 bp, mouse
gtggctgcagtgagtcgctt

SEQ ID NO: 637087 - DNA, 20 bp, mouse
gcgcacgtgaagcatctaag

SEQ ID NO: 637088 - DNA, 20 bp, mouse
ggcagtgagtcgcttcggtt

SEQ ID NO: 637089 - DNA, 20 bp, mouse
gaggatggctctggtcgctt

SEQ ID NO: 637090 - DNA, 20 bp, mouse
gggacctaagcttcagctct

SEQ ID NO: 637091 - DNA, 20 bp, mouse
gtcccgcctctctagctcgt

SEQ ID NO: 637092 - DNA, 20 bp, mouse
gcgtgaagcatctaagtggg

SEQ ID NO: 637093 - DNA, 20 bp, mouse
ggcttcggttaggatggctc

SEQ ID NO: 637094 - DNA, 20 bp, mouse
gcgactcactgcagccatgt

SEQ ID NO: 637095 - DNA, 20 bp, mouse
ggactgggacgacgccaaca

SEQ ID NO: 637096 - DNA, 20 bp, mouse
gcacagagagcgagcatgga

SEQ ID NO: 637097 - DNA, 20 bp, mouse
ggccctggatatagagctaa

SEQ ID NO: 637098 - DNA, 20 bp, mouse
gtccgattggatagcatttc

SEQ ID NO: 637099 - DNA, 20 bp, mouse
gctcacagatgttgtcaggc

SEQ ID NO: 637100 - DNA, 20 bp, mouse
gcagggcaattgttcagtac

SEQ ID NO: 637101 - DNA, 20 bp, mouse
gtgggctctgttctctcacg

SEQ ID NO: 637102 - DNA, 20 bp, mouse
gctctgttctctcacggggt

SEQ ID NO: 637103 - DNA, 20 bp, mouse
gtcagtctagtgcatccgat

SEQ ID NO: 637104 - DNA, 20 bp, mouse
ggcccgaaatgctatccaat

SEQ ID NO: 637105 - DNA, 20 bp, mouse
gatgtccgatacaagcaaca

SEQ ID NO: 637106 - DNA, 20 bp, mouse
gttcccgcgcaacgcctcct

SEQ ID NO: 637107 - DNA, 20 bp, mouse
gggtgatgacgcagaaattc

SEQ ID NO: 637108 - DNA, 20 bp, mouse
gagacaggggtcagacattc

SEQ ID NO: 637109 - DNA, 20 bp, mouse
ggttactatggcatcggcgg

SEQ ID NO: 637110 - DNA, 20 bp, mouse
gcacgctgttactatggcat

SEQ ID NO: 637111 - DNA, 20 bp, mouse
gaaattccggattggctctg

SEQ ID NO: 637112 - DNA, 20 bp, mouse
gtggcatcggcggaggtcac

SEQ ID NO: 637113 - DNA, 20 bp, mouse
gactcccaggaggcgttgcg

SEQ ID NO: 637114 - DNA, 20 bp, mouse
gccacctagcagctagacag

SEQ ID NO: 637115 - DNA, 20 bp, mouse
gaagcgccagaattacgcaa

SEQ ID NO: 637116 - DNA, 20 bp, mouse
gagacgctcggggctctcag

SEQ ID NO: 637117 - DNA, 20 bp, mouse
ggcaacccgcccgaacgctt

SEQ ID NO: 637118 - DNA, 20 bp, mouse
gagggcaacccggatgaatg

SEQ ID NO: 637119 - DNA, 20 bp, mouse
gaggcttcaggctgcaaagg

SEQ ID NO: 637120 - DNA, 20 bp, mouse
gccagagttggagacgctcg

SEQ ID NO: 637121 - DNA, 20 bp, mouse
gccgctgccgggcggtgtca

SEQ ID NO: 637122 - DNA, 20 bp, mouse
gggcggtgtcaggggagctg

SEQ ID NO: 637123 - DNA, 20 bp, mouse
gcggagagcagcagaaaggc

SEQ ID NO: 637124 - DNA, 20 bp, mouse
gttcaggctgcaaagggggt

SEQ ID NO: 637125 - DNA, 20 bp, mouse
ggcagcagaaaggcgggatc

SEQ ID NO: 637126 - DNA, 20 bp, mouse
ggaagcgggcgcttgtagag

SEQ ID NO: 637127 - DNA, 20 bp, mouse
gccacggtagggaggacccg

SEQ ID NO: 637128 - DNA, 20 bp, mouse
ggtggggcccgagaagacca

SEQ ID NO: 637129 - DNA, 20 bp, mouse
gagactggcgcggtacgtta

SEQ ID NO: 637130 - DNA, 20 bp, mouse
ggggatggcgaccaagagac

SEQ ID NO: 637131 - DNA, 20 bp, mouse
ggaacaccgcccaccctaag

SEQ ID NO: 637132 - DNA, 20 bp, mouse
gttgtcgcgaatggcgacgt

SEQ ID NO: 637133 - DNA, 20 bp, mouse
ggacccgggggcgtggacag

SEQ ID NO: 637134 - DNA, 20 bp, mouse
gggcgcttgtagagcggcgg

SEQ ID NO: 637135 - DNA, 20 bp, mouse
gagtcggacgcccccacttc

SEQ ID NO: 637136 - DNA, 20 bp, mouse
gtgcgcgctaccactggcag

SEQ ID NO: 637137 - DNA, 20 bp, mouse
gcgcgcgccgtcccccaagt

SEQ ID NO: 637138 - DNA, 20 bp, mouse
gcggccctggtactttctga

SEQ ID NO: 637139 - DNA, 20 bp, mouse
gaactgaggcactttgatga

SEQ ID NO: 637140 - DNA, 20 bp, mouse
gaccactaggcatgcacggg

SEQ ID NO: 637141 - DNA, 20 bp, mouse
gtgcctcagttccttacaac

SEQ ID NO: 637142 - DNA, 20 bp, mouse
gccagtcttgcccggttgta

SEQ ID NO: 637143 - DNA, 20 bp, mouse
gaagaaagggtaggaccccc

SEQ ID NO: 637144 - DNA, 20 bp, mouse
gtagaaaaggtatttttatg

SEQ ID NO: 637145 - DNA, 20 bp, mouse
ggcatgcctagtggttgtgg

SEQ ID NO: 637146 - DNA, 20 bp, mouse
gtggctctgtgtccccaaat

SEQ ID NO: 637147 - DNA, 20 bp, mouse
gagtggggaggtaaaaggcc

SEQ ID NO: 637148 - DNA, 20 bp, mouse
ggaccagaatggtgtggtgt

SEQ ID NO: 637149 - DNA, 20 bp, mouse
ggttgccaggcacggatcag

SEQ ID NO: 637150 - DNA, 20 bp, mouse
gcaggacctcccttcctcac

SEQ ID NO: 637151 - DNA, 20 bp, mouse
gaaggacaagagtgtcctag

SEQ ID NO: 637152 - DNA, 20 bp, mouse
gatggtgtggtgtaggtcta

SEQ ID NO: 637153 - DNA, 20 bp, mouse
gctgactcacgggtgttgcc

SEQ ID NO: 637154 - DNA, 20 bp, mouse
ggccaagaaaggactctcag

SEQ ID NO: 637155 - DNA, 20 bp, mouse
gtgtaggtctaggggcaatg

SEQ ID NO: 637156 - DNA, 20 bp, mouse
gggtctggctgtcaggaatg

SEQ ID NO: 637157 - DNA, 20 bp, mouse
gagacctcgtgcagtaacag

SEQ ID NO: 637158 - DNA, 20 bp, mouse
ggatccgggaagctagtccg

SEQ ID NO: 637159 - DNA, 20 bp, mouse
gttcccagttgggacttaaa

SEQ ID NO: 637160 - DNA, 20 bp, mouse
gagtccgaggcgttcccagt

SEQ ID NO: 637161 - DNA, 20 bp, mouse
gaccacggggaggtccaaaa

SEQ ID NO: 637162 - DNA, 20 bp, mouse
gttcccgggttaacagatcc

SEQ ID NO: 637163 - DNA, 20 bp, mouse
gtctctgtatagtacagatg

SEQ ID NO: 637164 - DNA, 20 bp, mouse
gcgtagggcggggcacctcg

SEQ ID NO: 637165 - DNA, 20 bp, mouse
gggcccctttaagtcccaac

SEQ ID NO: 637166 - DNA, 20 bp, mouse
gctaataatagactgattaa

SEQ ID NO: 637167 - DNA, 20 bp, mouse
gggaggtgtatgagaaacat

SEQ ID NO: 637168 - DNA, 20 bp, mouse
gcattggcgtggtattcaca

SEQ ID NO: 637169 - DNA, 20 bp, mouse
gccaaagcaaaatctccctc

SEQ ID NO: 637170 - DNA, 20 bp, mouse
gtattattagccgtcttaat

SEQ ID NO: 637171 - DNA, 20 bp, mouse
gagtatataatgatgcattg

SEQ ID NO: 637172 - DNA, 20 bp, mouse
ggactcgtcttgttctattt

SEQ ID NO: 637173 - DNA, 20 bp, mouse
gtaaatatgctaatcagatt

SEQ ID NO: 637174 - DNA, 20 bp, mouse
gtgggctagttaataagaga

SEQ ID NO: 637175 - DNA, 20 bp, mouse
gaacttcacgttgctgttct

SEQ ID NO: 637176 - DNA, 20 bp, mouse
gtatgtgaatatattgtcaa

SEQ ID NO: 637177 - DNA, 20 bp, mouse
gaagggttcagaagtgatac

SEQ ID NO: 637178 - DNA, 20 bp, mouse
gacaaaaatgatggcaagct

SEQ ID NO: 637179 - DNA, 20 bp, mouse
gtgagtaacctaggctggta

SEQ ID NO: 637180 - DNA, 20 bp, mouse
gacaaattacaattgataga

SEQ ID NO: 637181 - DNA, 20 bp, mouse
gacttctgaaccctttgaat

SEQ ID NO: 637182 - DNA, 20 bp, mouse
gggaactcattgagtaacct

SEQ ID NO: 637183 - DNA, 20 bp, mouse
gtacacctgtctgtgcctct

SEQ ID NO: 637184 - DNA, 20 bp, mouse
gtagattataactttgtgtc

SEQ ID NO: 637185 - DNA, 20 bp, mouse
gagctgggtatgtttgctca

SEQ ID NO: 637186 - DNA, 20 bp, mouse
ggcccaaggaggagtgtaaa

SEQ ID NO: 637187 - DNA, 20 bp, mouse
ggccttttacactcctcctt

SEQ ID NO: 637188 - DNA, 20 bp, mouse
gcatgctcttccttaggaga

SEQ ID NO: 637189 - DNA, 20 bp, mouse
gtcctagcctctgaatcctc

SEQ ID NO: 637190 - DNA, 20 bp, mouse
gtggaggatcacatgagctg

SEQ ID NO: 637191 - DNA, 20 bp, mouse
gtgcttacctgctgagtaat

SEQ ID NO: 637192 - DNA, 20 bp, mouse
gctttaacctgaggattcag

SEQ ID NO: 637193 - DNA, 20 bp, mouse
ggagagtaagtagccagaac

SEQ ID NO: 637194 - DNA, 20 bp, mouse
gcagtccactgaacccagag

SEQ ID NO: 637195 - DNA, 20 bp, mouse
gcagctgcagagcagtctgc

SEQ ID NO: 637196 - DNA, 20 bp, mouse
ggacgggcgcgcactcgcgg

SEQ ID NO: 637197 - DNA, 20 bp, mouse
ggacccaccgacaacatccg

SEQ ID NO: 637198 - DNA, 20 bp, mouse
gggcccacaggctgcgtgga

SEQ ID NO: 637199 - DNA, 20 bp, mouse
ggaggcccggggacccgctg

SEQ ID NO: 637200 - DNA, 20 bp, mouse
gcggccgccgcggatgttgt

SEQ ID NO: 637201 - DNA, 20 bp, mouse
gcaaacctccgggcgactcg

SEQ ID NO: 637202 - DNA, 20 bp, mouse
gcgccccccgagtcgcccgg

SEQ ID NO: 637203 - DNA, 20 bp, mouse
gccggcctcagcgggtcccc

SEQ ID NO: 637204 - DNA, 20 bp, mouse
gccaccgacaacatccgcgg

SEQ ID NO: 637205 - DNA, 20 bp, mouse
gtgcgcgcccgtcagcgccg

SEQ ID NO: 637206 - DNA, 20 bp, mouse
gacaaaaggtcccctctccc

SEQ ID NO: 637207 - DNA, 20 bp, mouse
ggcgtccagcattgatactc

SEQ ID NO: 637208 - DNA, 20 bp, mouse
gctacagaggcactgctcct

SEQ ID NO: 637209 - DNA, 20 bp, mouse
gtagggaagggagcagatct

SEQ ID NO: 637210 - DNA, 20 bp, mouse
gtgagcaaagaattcactca

SEQ ID NO: 637211 - DNA, 20 bp, mouse
gaggctctccagctgccaca

SEQ ID NO: 637212 - DNA, 20 bp, mouse
gaggtcttgttggtcccatg

SEQ ID NO: 637213 - DNA, 20 bp, mouse
ggtgtcaggaattggaaggt

SEQ ID NO: 637214 - DNA, 20 bp, mouse
gctacattggcttcctacag

SEQ ID NO: 637215 - DNA, 20 bp, mouse
gaagcccacgtgtcaggaat

SEQ ID NO: 637216 - DNA, 20 bp, mouse
gtggccaggcgcccgagttt

SEQ ID NO: 637217 - DNA, 20 bp, mouse
gagcgagggctctgagatcc

SEQ ID NO: 637218 - DNA, 20 bp, mouse
gggcacagcgccagcctcat

SEQ ID NO: 637219 - DNA, 20 bp, mouse
gaggaggcaaagcttggtgt

SEQ ID NO: 637220 - DNA, 20 bp, mouse
gcagccaataggtgcgcagg

SEQ ID NO: 637221 - DNA, 20 bp, mouse
gagggcgccacgaggtgctg

SEQ ID NO: 637222 - DNA, 20 bp, mouse
gagtcccgagggccgagccc

SEQ ID NO: 637223 - DNA, 20 bp, mouse
gggccctcgggactgtcaga

SEQ ID NO: 637224 - DNA, 20 bp, mouse
gactgtcagatggttaaaga

SEQ ID NO: 637225 - DNA, 20 bp, mouse
gagagaaatgagctgggaaa

SEQ ID NO: 637226 - DNA, 20 bp, mouse
gagccctgagggccgaccag

SEQ ID NO: 637227 - DNA, 20 bp, mouse
gggtcggggcgggtcgtgga

SEQ ID NO: 637228 - DNA, 20 bp, mouse
gcgcgcgtgcgcgagccctg

SEQ ID NO: 637229 - DNA, 20 bp, mouse
ggctccgcggcgtgccgcgc

SEQ ID NO: 637230 - DNA, 20 bp, mouse
gcgcagacagggaccctcta

SEQ ID NO: 637231 - DNA, 20 bp, mouse
gtggaggcgtggctctggag

SEQ ID NO: 637232 - DNA, 20 bp, mouse
gtcagggcccggcatggcgg

SEQ ID NO: 637233 - DNA, 20 bp, mouse
gcggagtggaggcgtggctc

SEQ ID NO: 637234 - DNA, 20 bp, mouse
gggctcgtggaccagccggc

SEQ ID NO: 637235 - DNA, 20 bp, mouse
gaccgcccggcgagctcgtg

SEQ ID NO: 637236 - DNA, 20 bp, mouse
gaggaccggtaagggggcga

SEQ ID NO: 637237 - DNA, 20 bp, mouse
gagccatcctgaccaacttt

SEQ ID NO: 637238 - DNA, 20 bp, mouse
gggaaacaggaccggtaagg

SEQ ID NO: 637239 - DNA, 20 bp, mouse
gcacggaaacaggaccggta

SEQ ID NO: 637240 - DNA, 20 bp, mouse
ggcggagggttccaaaactg

SEQ ID NO: 637241 - DNA, 20 bp, mouse
gggagtgggcggacctgggg

SEQ ID NO: 637242 - DNA, 20 bp, mouse
gagcggagtgggcggacctg

SEQ ID NO: 637243 - DNA, 20 bp, mouse
gcccccaaagttggtcagga

SEQ ID NO: 637244 - DNA, 20 bp, mouse
gaattatggttgcgcgcgga

SEQ ID NO: 637245 - DNA, 20 bp, mouse
gaccatcccacccccaaagt

SEQ ID NO: 637246 - DNA, 20 bp, mouse
gtgcacttatgcgacttcta

SEQ ID NO: 637247 - DNA, 20 bp, mouse
ggcagagggcccctcccaac

SEQ ID NO: 637248 - DNA, 20 bp, mouse
ggtgtagcgaaaagggttaa

SEQ ID NO: 637249 - DNA, 20 bp, mouse
gcaggaagatctgcattcgg

SEQ ID NO: 637250 - DNA, 20 bp, mouse
gccccagccacatttacaag

SEQ ID NO: 637251 - DNA, 20 bp, mouse
gaactcttgtgtagcgaaaa

SEQ ID NO: 637252 - DNA, 20 bp, mouse
ggaaagaggcgtttccccat

SEQ ID NO: 637253 - DNA, 20 bp, mouse
ggaagtcgcataagtgcaga

SEQ ID NO: 637254 - DNA, 20 bp, mouse
gcagggggagccaaatggcc

SEQ ID NO: 637255 - DNA, 20 bp, mouse
ggcaaaggcaaaggctcagg

SEQ ID NO: 637256 - DNA, 20 bp, mouse
gactcactctaacacattga

SEQ ID NO: 637257 - DNA, 20 bp, mouse
gaagccagatggtaccatga

SEQ ID NO: 637258 - DNA, 20 bp, mouse
ggcactaatccgcagctgtg

SEQ ID NO: 637259 - DNA, 20 bp, mouse
gagtgcaactggaatgcaga

SEQ ID NO: 637260 - DNA, 20 bp, mouse
gggaaggcggggcaccagcc

SEQ ID NO: 637261 - DNA, 20 bp, mouse
gggtctggcaagtcaagtca

SEQ ID NO: 637262 - DNA, 20 bp, mouse
gaagtcaagtcaaggggacc

SEQ ID NO: 637263 - DNA, 20 bp, mouse
gagcaggcgcttgactcacc

SEQ ID NO: 637264 - DNA, 20 bp, mouse
gatttgcagcgtcctcagca

SEQ ID NO: 637265 - DNA, 20 bp, mouse
gaacacattgagggggcagt

SEQ ID NO: 637266 - DNA, 20 bp, mouse
ggctccgccccctgagacgg

SEQ ID NO: 637267 - DNA, 20 bp, mouse
gcggggccaccccaggtctg

SEQ ID NO: 637268 - DNA, 20 bp, mouse
gaggcccggtccgcagacct

SEQ ID NO: 637269 - DNA, 20 bp, mouse
ggggcggtgcttgcgttcgg

SEQ ID NO: 637270 - DNA, 20 bp, mouse
gccggtccgcagacctgggg

SEQ ID NO: 637271 - DNA, 20 bp, mouse
gccgccccctgagacggagg

SEQ ID NO: 637272 - DNA, 20 bp, mouse
gcacgctggcgctaggcaat

SEQ ID NO: 637273 - DNA, 20 bp, mouse
gtggcgctaggcaatgggcg

SEQ ID NO: 637274 - DNA, 20 bp, mouse
gcaggctccgccccctgaga

SEQ ID NO: 637275 - DNA, 20 bp, mouse
gcgtcctcctccgtctcagg

SEQ ID NO: 637276 - DNA, 20 bp, mouse
gccaaaaggaggatcagcct

SEQ ID NO: 637277 - DNA, 20 bp, mouse
gacgccctctccagggatca

SEQ ID NO: 637278 - DNA, 20 bp, mouse
gccccagcacttctggtaaa

SEQ ID NO: 637279 - DNA, 20 bp, mouse
gctccagggatcagggacac

SEQ ID NO: 637280 - DNA, 20 bp, mouse
gagagctctcctccaaaagg

SEQ ID NO: 637281 - DNA, 20 bp, mouse
gagggcagatactggagcaa

SEQ ID NO: 637282 - DNA, 20 bp, mouse
gtgcctgtgtccctgatccc

SEQ ID NO: 637283 - DNA, 20 bp, mouse
gcaagggattactgatacag

SEQ ID NO: 637284 - DNA, 20 bp, mouse
gcagagagctctcctccaaa

SEQ ID NO: 637285 - DNA, 20 bp, mouse
ggcaaactgccgtatgtccc

SEQ ID NO: 637286 - DNA, 20 bp, mouse
gcatgcgtgctgacgctcaa

SEQ ID NO: 637287 - DNA, 20 bp, mouse
ggaccggaacgggagtgctc

SEQ ID NO: 637288 - DNA, 20 bp, mouse
ggagaattcgccattcctct

SEQ ID NO: 637289 - DNA, 20 bp, mouse
gcaccagagcactcccgttc

SEQ ID NO: 637290 - DNA, 20 bp, mouse
gccccccccccgaccggaac

SEQ ID NO: 637291 - DNA, 20 bp, mouse
ggaaagctgagaacacgtgg

SEQ ID NO: 637292 - DNA, 20 bp, mouse
ggtgctcttccattcgtgtc

SEQ ID NO: 637293 - DNA, 20 bp, mouse
gcgtgctgacgctcaagggc

SEQ ID NO: 637294 - DNA, 20 bp, mouse
gctaagtattcctagaggaa

SEQ ID NO: 637295 - DNA, 20 bp, mouse
gcactcccgttccggtcggg

SEQ ID NO: 637296 - DNA, 20 bp, mouse
gaaagaccggccacgagcga

SEQ ID NO: 637297 - DNA, 20 bp, mouse
ggctcctgcccggaccgcga

SEQ ID NO: 637298 - DNA, 20 bp, mouse
gccagcccgtcctccggctc

SEQ ID NO: 637299 - DNA, 20 bp, mouse
gcctgcccggaccgcgaagg

SEQ ID NO: 637300 - DNA, 20 bp, mouse
gggctctggctcctccttcg

SEQ ID NO: 637301 - DNA, 20 bp, mouse
gctcgcgatacacgcctccc

SEQ ID NO: 637302 - DNA, 20 bp, mouse
ggcaggcggccgctctcttg

SEQ ID NO: 637303 - DNA, 20 bp, mouse
gtccgccctaatggtgtgac

SEQ ID NO: 637304 - DNA, 20 bp, mouse
gcagcggctcgcacttccgg

SEQ ID NO: 637305 - DNA, 20 bp, mouse
gcacgcgcggggacctccgt

SEQ ID NO: 637306 - DNA, 20 bp, mouse
ggcgacgcggcgaaggggcg

SEQ ID NO: 637307 - DNA, 20 bp, mouse
gttaggaggcggggccacgt

SEQ ID NO: 637308 - DNA, 20 bp, mouse
gggctccgtccgccgtccgt

SEQ ID NO: 637309 - DNA, 20 bp, mouse
gccgccgtccgtcggagcgt

SEQ ID NO: 637310 - DNA, 20 bp, mouse
gtgaccgacgctccgacgga

SEQ ID NO: 637311 - DNA, 20 bp, mouse
gggtctgaagctgcgattcg

SEQ ID NO: 637312 - DNA, 20 bp, mouse
gcaccggcgacgcggcgaag

SEQ ID NO: 637313 - DNA, 20 bp, mouse
gccaatcatcgctgctgctt

SEQ ID NO: 637314 - DNA, 20 bp, mouse
gcagcttcctagttgtacaa

SEQ ID NO: 637315 - DNA, 20 bp, mouse
gtgtacaatggaccgaaagc

SEQ ID NO: 637316 - DNA, 20 bp, mouse
gaactccatacacgacacgg

SEQ ID NO: 637317 - DNA, 20 bp, mouse
gtcgaactccatacacgaca

SEQ ID NO: 637318 - DNA, 20 bp, mouse
gtcggagcctgtcaccattc

SEQ ID NO: 637319 - DNA, 20 bp, mouse
gtgacaggctccgaagccca

SEQ ID NO: 637320 - DNA, 20 bp, mouse
gttgtacccagaatggtgac

SEQ ID NO: 637321 - DNA, 20 bp, mouse
ggggtacaagaacttcgctc

SEQ ID NO: 637322 - DNA, 20 bp, mouse
gtgtaatggtgttggggaca

SEQ ID NO: 637323 - DNA, 20 bp, mouse
gattcgcgacacaggagttc

SEQ ID NO: 637324 - DNA, 20 bp, mouse
ggggtcttgtcgtcttaccc

SEQ ID NO: 637325 - DNA, 20 bp, mouse
ggtcatctagcttatgactt

SEQ ID NO: 637326 - DNA, 20 bp, mouse
ggcaataggccgaccagtac

SEQ ID NO: 637327 - DNA, 20 bp, mouse
ggctctggcaggttcttccg

SEQ ID NO: 637328 - DNA, 20 bp, mouse
gactgcgttccagtactggt

SEQ ID NO: 637329 - DNA, 20 bp, mouse
ggagtgatggagatgaggaa

SEQ ID NO: 637330 - DNA, 20 bp, mouse
gcgcggcagcgagtgagtga

SEQ ID NO: 637331 - DNA, 20 bp, mouse
gggaggctgccatgttaaaa

SEQ ID NO: 637332 - DNA, 20 bp, mouse
gcgtccctgagcaaggcgta

SEQ ID NO: 637333 - DNA, 20 bp, mouse
gttccggggtcacgactcca

SEQ ID NO: 637334 - DNA, 20 bp, mouse
gggcagcctccgccataaag

SEQ ID NO: 637335 - DNA, 20 bp, mouse
gcactcgctgccgcggtcca

SEQ ID NO: 637336 - DNA, 20 bp, mouse
gcggcagggcggacccacga

SEQ ID NO: 637337 - DNA, 20 bp, mouse
gtggctgaagcgcgtcgcag

SEQ ID NO: 637338 - DNA, 20 bp, mouse
gggaggtggcaagtccgcaa

SEQ ID NO: 637339 - DNA, 20 bp, mouse
gcggtcctcagcgccctcgt

SEQ ID NO: 637340 - DNA, 20 bp, mouse
gcctcctgccagctcgcggg

SEQ ID NO: 637341 - DNA, 20 bp, mouse
ggaagcgcgtcgcagcggac

SEQ ID NO: 637342 - DNA, 20 bp, mouse
gggagctgcagctgcggacg

SEQ ID NO: 637343 - DNA, 20 bp, mouse
gcgggcgcttgttacggacg

SEQ ID NO: 637344 - DNA, 20 bp, mouse
gcgggcgcccctggtcacct

SEQ ID NO: 637345 - DNA, 20 bp, mouse
gctcgcggggggctggtgcg

SEQ ID NO: 637346 - DNA, 20 bp, mouse
gttgcaaggatcaaaggtcg

SEQ ID NO: 637347 - DNA, 20 bp, mouse
gggcagttatgtaactgcta

SEQ ID NO: 637348 - DNA, 20 bp, mouse
gtcagcttcccgaggaaggt

SEQ ID NO: 637349 - DNA, 20 bp, mouse
gtcgggaagctgacaggaag

SEQ ID NO: 637350 - DNA, 20 bp, mouse
gcgtgccgctgtccctttaa

SEQ ID NO: 637351 - DNA, 20 bp, mouse
gcctgtcagcttcccgagga

SEQ ID NO: 637352 - DNA, 20 bp, mouse
gacggtgacgttttcagtta

SEQ ID NO: 637353 - DNA, 20 bp, mouse
gccagcagccaaccttcctc

SEQ ID NO: 637354 - DNA, 20 bp, mouse
gacggagctctgccctttaa

SEQ ID NO: 637355 - DNA, 20 bp, mouse
ggctaaattacatcagctca

SEQ ID NO: 637356 - DNA, 20 bp, mouse
gcactgagggggtctgtctt

SEQ ID NO: 637357 - DNA, 20 bp, mouse
gtacaaacgccctggaaatg

SEQ ID NO: 637358 - DNA, 20 bp, mouse
gggtctgtcttgggcggaga

SEQ ID NO: 637359 - DNA, 20 bp, mouse
gggtctggggatccttgggt

SEQ ID NO: 637360 - DNA, 20 bp, mouse
gcggtgaaacaaaaacggac

SEQ ID NO: 637361 - DNA, 20 bp, mouse
ggaaaacccccagccaaagg

SEQ ID NO: 637362 - DNA, 20 bp, mouse
gtacgctatcaaaagggagt

SEQ ID NO: 637363 - DNA, 20 bp, mouse
ggagtcttgaaagcctcctt

SEQ ID NO: 637364 - DNA, 20 bp, mouse
gggatccccagaccaatctc

SEQ ID NO: 637365 - DNA, 20 bp, mouse
gcctcagtgctgtacaatgt

SEQ ID NO: 637366 - DNA, 20 bp, mouse
ggcacaaagccccgcgtcta

SEQ ID NO: 637367 - DNA, 20 bp, mouse
ggggtcgcagcgcgcgtgtc

SEQ ID NO: 637368 - DNA, 20 bp, mouse
ggctcccccgaaaggataga

SEQ ID NO: 637369 - DNA, 20 bp, mouse
gcctaggccgcgcgcccttg

SEQ ID NO: 637370 - DNA, 20 bp, mouse
gcggcgtggggcctcgctaa

SEQ ID NO: 637371 - DNA, 20 bp, mouse
gcgtctacggctcccccgaa

SEQ ID NO: 637372 - DNA, 20 bp, mouse
gagagtgcagaactccgcaa

SEQ ID NO: 637373 - DNA, 20 bp, mouse
gaccccttctatcctttcgg

SEQ ID NO: 637374 - DNA, 20 bp, mouse
ggcgggaggcggggtcccgg

SEQ ID NO: 637375 - DNA, 20 bp, mouse
gcgggggagccgtagacgcg

SEQ ID NO: 637376 - DNA, 20 bp, mouse
ggcgcggctgccgtccctgg

SEQ ID NO: 637377 - DNA, 20 bp, mouse
ggtcccgtgcagtggccgta

SEQ ID NO: 637378 - DNA, 20 bp, mouse
ggccgtccctggcggggcct

SEQ ID NO: 637379 - DNA, 20 bp, mouse
ggcgaaagaaccgcccccag

SEQ ID NO: 637380 - DNA, 20 bp, mouse
gaccagcccaggccccgcca

SEQ ID NO: 637381 - DNA, 20 bp, mouse
ggggcggctcccgtctgccc

SEQ ID NO: 637382 - DNA, 20 bp, mouse
ggggacatagggatcgggga

SEQ ID NO: 637383 - DNA, 20 bp, mouse
ggaggagctaggaacgtcca

SEQ ID NO: 637384 - DNA, 20 bp, mouse
ggcctcgggcctggttaaga

SEQ ID NO: 637385 - DNA, 20 bp, mouse
ggggggcggttctttcgcac

SEQ ID NO: 637386 - DNA, 20 bp, mouse
gcgcgcgtcaggggaaacta

SEQ ID NO: 637387 - DNA, 20 bp, mouse
gcgtcaggggaaactagggg

SEQ ID NO: 637388 - DNA, 20 bp, mouse
gggccaagacctctgctgat

SEQ ID NO: 637389 - DNA, 20 bp, mouse
ggggagctgcgtggccgcaa

SEQ ID NO: 637390 - DNA, 20 bp, mouse
ggagggcagggcgacgccgg

SEQ ID NO: 637391 - DNA, 20 bp, mouse
gagagagggcagggcgacgc

SEQ ID NO: 637392 - DNA, 20 bp, mouse
ggtaggctgggagaagccgt

SEQ ID NO: 637393 - DNA, 20 bp, mouse
gattggctgctcggaagaga

SEQ ID NO: 637394 - DNA, 20 bp, mouse
gtcttccgagcagccaatcg

SEQ ID NO: 637395 - DNA, 20 bp, mouse
gtctccgggtacccgatcta

SEQ ID NO: 637396 - DNA, 20 bp, mouse
gttacacatggtggcttgta

SEQ ID NO: 637397 - DNA, 20 bp, mouse
gaaatcaataggcaaagtta

SEQ ID NO: 637398 - DNA, 20 bp, mouse
gaagttagggatgtaggtca

SEQ ID NO: 637399 - DNA, 20 bp, mouse
gctcccctaggatggtaaag

SEQ ID NO: 637400 - DNA, 20 bp, mouse
gtcagaggcatataaatagt

SEQ ID NO: 637401 - DNA, 20 bp, mouse
gaaaaacagcttgtgaaaga

SEQ ID NO: 637402 - DNA, 20 bp, mouse
ggacatgtaatatagaacta

SEQ ID NO: 637403 - DNA, 20 bp, mouse
gcatttgatcaattctggtt

SEQ ID NO: 637404 - DNA, 20 bp, mouse
gggtctgctcaatagtttaa

SEQ ID NO: 637405 - DNA, 20 bp, mouse
gaacatgacatgaaatcaat

SEQ ID NO: 637406 - DNA, 20 bp, mouse
ggcccccaaggcggtttcac

SEQ ID NO: 637407 - DNA, 20 bp, mouse
gcacaaccagcacccactta

SEQ ID NO: 637408 - DNA, 20 bp, mouse
gacctgtgaaaccgccttgg

SEQ ID NO: 637409 - DNA, 20 bp, mouse
ggatgtcactaacgagtgac

SEQ ID NO: 637410 - DNA, 20 bp, mouse
gagaacctgtgaaaccgcct

SEQ ID NO: 637411 - DNA, 20 bp, mouse
gggcgacgccggaaatagac

SEQ ID NO: 637412 - DNA, 20 bp, mouse
ggcataaagcagttgtttct

SEQ ID NO: 637413 - DNA, 20 bp, mouse
gacaggttctgaactccgga

SEQ ID NO: 637414 - DNA, 20 bp, mouse
ggaaatagaccggaagttcg

SEQ ID NO: 637415 - DNA, 20 bp, mouse
gcttgcttccggtttccgag

SEQ ID NO: 637416 - DNA, 20 bp, mouse
gcggcggcaggcggcatccc

SEQ ID NO: 637417 - DNA, 20 bp, mouse
gcgcccgcgggggttgagca

SEQ ID NO: 637418 - DNA, 20 bp, mouse
gggcggcatcccagggtgat

SEQ ID NO: 637419 - DNA, 20 bp, mouse
gggccggcccgctaactctc

SEQ ID NO: 637420 - DNA, 20 bp, mouse
gcagccctgctcaacccccg

SEQ ID NO: 637421 - DNA, 20 bp, mouse
gaggggccgccccctctgac

SEQ ID NO: 637422 - DNA, 20 bp, mouse
ggggttgagcagggctgcgt

SEQ ID NO: 637423 - DNA, 20 bp, mouse
ggggcttgtgggtttctcag

SEQ ID NO: 637424 - DNA, 20 bp, mouse
gggagcaagccgacgccagg

SEQ ID NO: 637425 - DNA, 20 bp, mouse
gctcaggtgcgggtccggag

SEQ ID NO: 637426 - DNA, 20 bp, mouse
gcaggcagcaggtgtataag

SEQ ID NO: 637427 - DNA, 20 bp, mouse
gcagcagagcaggtcagacg

SEQ ID NO: 637428 - DNA, 20 bp, mouse
ggacctgctctgctgcagat

SEQ ID NO: 637429 - DNA, 20 bp, mouse
gacctgctgcctgtgttgag

SEQ ID NO: 637430 - DNA, 20 bp, mouse
gcctagcagccactcaacac

SEQ ID NO: 637431 - DNA, 20 bp, mouse
gcatcttcctgaagcttctg

SEQ ID NO: 637432 - DNA, 20 bp, mouse
gcaagaaccagtgcgggagg

SEQ ID NO: 637433 - DNA, 20 bp, mouse
gcccgcactggttcttggtc

SEQ ID NO: 637434 - DNA, 20 bp, mouse
gttctgtggagtgctgtggg

SEQ ID NO: 637435 - DNA, 20 bp, mouse
gtcaactgaatggagggtgg

SEQ ID NO: 637436 - DNA, 20 bp, mouse
gcggggaccatgctcccttc

SEQ ID NO: 637437 - DNA, 20 bp, mouse
gtcggcgcgcagccagggac

SEQ ID NO: 637438 - DNA, 20 bp, mouse
ggctgctgctagatcggcgg

SEQ ID NO: 637439 - DNA, 20 bp, mouse
gagagctgctgctagatcgg

SEQ ID NO: 637440 - DNA, 20 bp, mouse
gcgtccgcagcccaggtcat

SEQ ID NO: 637441 - DNA, 20 bp, mouse
gagctaaagcagacggtacc

SEQ ID NO: 637442 - DNA, 20 bp, mouse
gctactcgggcgtctgtgat

SEQ ID NO: 637443 - DNA, 20 bp, mouse
gaagcagacggtacccggag

SEQ ID NO: 637444 - DNA, 20 bp, mouse
ggcaccgcgcatagccgcgc

SEQ ID NO: 637445 - DNA, 20 bp, mouse
gggcggcgcggggattggcg

SEQ ID NO: 637446 - DNA, 20 bp, mouse
gagcaagccggagagtcgac

SEQ ID NO: 637447 - DNA, 20 bp, mouse
gtgcctgcctgtcgactctc

SEQ ID NO: 637448 - DNA, 20 bp, mouse
gaggtaaggcgggtccggtg

SEQ ID NO: 637449 - DNA, 20 bp, mouse
gcgtctggcgtctcagtgac

SEQ ID NO: 637450 - DNA, 20 bp, mouse
gcggaatcaagagtcctcac

SEQ ID NO: 637451 - DNA, 20 bp, mouse
ggaggactcttgattccgat

SEQ ID NO: 637452 - DNA, 20 bp, mouse
gtagcggaggagaaccctgc

SEQ ID NO: 637453 - DNA, 20 bp, mouse
gtccggccgtgaggtaaggc

SEQ ID NO: 637454 - DNA, 20 bp, mouse
gcgcttgcccacaataaaaa

SEQ ID NO: 637455 - DNA, 20 bp, mouse
gagccggagagtcgacaggc

SEQ ID NO: 637456 - DNA, 20 bp, mouse
gccaacggagaagtgcccag

SEQ ID NO: 637457 - DNA, 20 bp, mouse
gtcccagagctcacattcca

SEQ ID NO: 637458 - DNA, 20 bp, mouse
ggaagtgcccagcggtttct

SEQ ID NO: 637459 - DNA, 20 bp, mouse
ggtacagccaagaaaccgct

SEQ ID NO: 637460 - DNA, 20 bp, mouse
gtggaaatctagcaggtgaa

SEQ ID NO: 637461 - DNA, 20 bp, mouse
gagccctggaatgtgagctc

SEQ ID NO: 637462 - DNA, 20 bp, mouse
gcctcacttggaaatctagc

SEQ ID NO: 637463 - DNA, 20 bp, mouse
gacaaagacagcggccgttg

SEQ ID NO: 637464 - DNA, 20 bp, mouse
gagtgtctgagcctgtcctc

SEQ ID NO: 637465 - DNA, 20 bp, mouse
gtataactcgctgttccttg

SEQ ID NO: 637466 - DNA, 20 bp, mouse
gtcacagccccgcaacacca

SEQ ID NO: 637467 - DNA, 20 bp, mouse
gaccagggagagcctgagta

SEQ ID NO: 637468 - DNA, 20 bp, mouse
gcaggccccttgactgtgat

SEQ ID NO: 637469 - DNA, 20 bp, mouse
gaggtgtgatgcaaagtctg

SEQ ID NO: 637470 - DNA, 20 bp, mouse
gccggcctcggcactgtgaa

SEQ ID NO: 637471 - DNA, 20 bp, mouse
gtcccgttgggtaatctcaa

SEQ ID NO: 637472 - DNA, 20 bp, mouse
ggcggggctgtgacatcaca

SEQ ID NO: 637473 - DNA, 20 bp, mouse
gagaagggcggtgatggaga

SEQ ID NO: 637474 - DNA, 20 bp, mouse
gggctctccctggtgttgcg

SEQ ID NO: 637475 - DNA, 20 bp, mouse
gtcttggggtgtaacaataa

SEQ ID NO: 637476 - DNA, 20 bp, mouse
gaggctgcctggttctgcta

SEQ ID NO: 637477 - DNA, 20 bp, mouse
gtcacgaagacagacaggga

SEQ ID NO: 637478 - DNA, 20 bp, mouse
gtacgcggtgccggtggaca

SEQ ID NO: 637479 - DNA, 20 bp, mouse
gagggcttatcagaattaag

SEQ ID NO: 637480 - DNA, 20 bp, mouse
gtgtggggcggtgttaatgg

SEQ ID NO: 637481 - DNA, 20 bp, mouse
gcttcatcacggtgatgctc

SEQ ID NO: 637482 - DNA, 20 bp, mouse
gctaggcgaagctttctatc

SEQ ID NO: 637483 - DNA, 20 bp, mouse
gtgaagataccggatctgag

SEQ ID NO: 637484 - DNA, 20 bp, mouse
gcctggttctgctagggtga

SEQ ID NO: 637485 - DNA, 20 bp, mouse
gcgtgtcccacttcagtcta

SEQ ID NO: 637486 - DNA, 20 bp, mouse
ggtaggcggtgctaggactc

SEQ ID NO: 637487 - DNA, 20 bp, mouse
gcggtgctaggactctgggt

SEQ ID NO: 637488 - DNA, 20 bp, mouse
ggtacaaatcacgaccactg

SEQ ID NO: 637489 - DNA, 20 bp, mouse
gggcacgaagtatggaggtg

SEQ ID NO: 637490 - DNA, 20 bp, mouse
ggactctgggtgggggaaga

SEQ ID NO: 637491 - DNA, 20 bp, mouse
gctagcaccgcctaccaggg

SEQ ID NO: 637492 - DNA, 20 bp, mouse
gaggggggcacgaagtatgg

SEQ ID NO: 637493 - DNA, 20 bp, mouse
gctggggctgatggactgac

SEQ ID NO: 637494 - DNA, 20 bp, mouse
gactgctggacgctgtcaat

SEQ ID NO: 637495 - DNA, 20 bp, mouse
ggtcgtgatttgtacctccc

SEQ ID NO: 637496 - DNA, 20 bp, mouse
ggcagccaacacctctgtgg

SEQ ID NO: 637497 - DNA, 20 bp, mouse
ggatcggggcgtctctctat

SEQ ID NO: 637498 - DNA, 20 bp, mouse
gaacaagcggggctcgaata

SEQ ID NO: 637499 - DNA, 20 bp, mouse
ggcagcagccaacacctctg

SEQ ID NO: 637500 - DNA, 20 bp, mouse
ggggtctgcggagtccgcgt

SEQ ID NO: 637501 - DNA, 20 bp, mouse
gggtgagcccggttgcgggt

SEQ ID NO: 637502 - DNA, 20 bp, mouse
gcactggtctagacggcgga

SEQ ID NO: 637503 - DNA, 20 bp, mouse
ggggtgtggggccatgaagc

SEQ ID NO: 637504 - DNA, 20 bp, mouse
gcccgcttgttgcaaggatc

SEQ ID NO: 637505 - DNA, 20 bp, mouse
gtggtggtggacctcccggc

SEQ ID NO: 637506 - DNA, 20 bp, mouse
gtcggccgacacgcccccga

SEQ ID NO: 637507 - DNA, 20 bp, mouse
gtagaaagtacaggctcttg

SEQ ID NO: 637508 - DNA, 20 bp, mouse
ggagccacccttccaggcgt

SEQ ID NO: 637509 - DNA, 20 bp, mouse
gcggcgggacaggagtgcgc

SEQ ID NO: 637510 - DNA, 20 bp, mouse
gcgggacaggagtgcgcagg

SEQ ID NO: 637511 - DNA, 20 bp, mouse
gcgctgctgagggacttcgc

SEQ ID NO: 637512 - DNA, 20 bp, mouse
gggagctcccagctcggcgc

SEQ ID NO: 637513 - DNA, 20 bp, mouse
ggcctccaccaacgcctgga

SEQ ID NO: 637514 - DNA, 20 bp, mouse
gggcgtgtcggccgaggcag

SEQ ID NO: 637515 - DNA, 20 bp, mouse
gtccggcgggaacacggcac

SEQ ID NO: 637516 - DNA, 20 bp, mouse
ggtgccttctacagtctgag

SEQ ID NO: 637517 - DNA, 20 bp, mouse
gccctggtgcaagcgctcgg

SEQ ID NO: 637518 - DNA, 20 bp, mouse
gggtcagctaccaatgtcgc

SEQ ID NO: 637519 - DNA, 20 bp, mouse
ggggccgcggtcctagtgcc

SEQ ID NO: 637520 - DNA, 20 bp, mouse
gtctcccctcagactgtaga

SEQ ID NO: 637521 - DNA, 20 bp, mouse
gctgcccggcactaggaccg

SEQ ID NO: 637522 - DNA, 20 bp, mouse
ggctggacccgccccaacga

SEQ ID NO: 637523 - DNA, 20 bp, mouse
gccaagcgcagagcgcgcag

SEQ ID NO: 637524 - DNA, 20 bp, mouse
gttctggagtgaaacgtcaa

SEQ ID NO: 637525 - DNA, 20 bp, mouse
gagcgcttgcaccagggccg

SEQ ID NO: 637526 - DNA, 20 bp, mouse
gtgactggggatctgttaga

SEQ ID NO: 637527 - DNA, 20 bp, mouse
gcacactgaaaccagtagat

SEQ ID NO: 637528 - DNA, 20 bp, mouse
gaaagcagcggtccatactt

SEQ ID NO: 637529 - DNA, 20 bp, mouse
gtggatggatctagcattgt

SEQ ID NO: 637530 - DNA, 20 bp, mouse
gccaactggtacccaggatg

SEQ ID NO: 637531 - DNA, 20 bp, mouse
ggatctgttagagggctggt

SEQ ID NO: 637532 - DNA, 20 bp, mouse
gccagtagataggctttctg

SEQ ID NO: 637533 - DNA, 20 bp, mouse
gggtaggtttcaagcgtgat

SEQ ID NO: 637534 - DNA, 20 bp, mouse
gatgcataacacatgcgcaa

SEQ ID NO: 637535 - DNA, 20 bp, mouse
gacatctacagatactgttc

SEQ ID NO: 637536 - DNA, 20 bp, mouse
gtgggcaggggacaaggttg

SEQ ID NO: 637537 - DNA, 20 bp, mouse
gcacccctaacccaggtcac

SEQ ID NO: 637538 - DNA, 20 bp, mouse
ggaggggcgggacaaaggtt

SEQ ID NO: 637539 - DNA, 20 bp, mouse
gccaggtcacaggtctccct

SEQ ID NO: 637540 - DNA, 20 bp, mouse
gcctgtgtcagcatcccggg

SEQ ID NO: 637541 - DNA, 20 bp, mouse
gcgggacaaaggttgggtag

SEQ ID NO: 637542 - DNA, 20 bp, mouse
gaccaggaggggcgggacaa

SEQ ID NO: 637543 - DNA, 20 bp, mouse
ggttggaggtacagagttga

SEQ ID NO: 637544 - DNA, 20 bp, mouse
gggccacatgggcgctgtgg

SEQ ID NO: 637545 - DNA, 20 bp, mouse
ggggttggtggggtgcgcag

SEQ ID NO: 637546 - DNA, 20 bp, mouse
ggggacgttgcacggtacag

SEQ ID NO: 637547 - DNA, 20 bp, mouse
gtacaggggcccccagcctg

SEQ ID NO: 637548 - DNA, 20 bp, mouse
gggcgctggctgctgacaca

SEQ ID NO: 637549 - DNA, 20 bp, mouse
ggggcccccagcctgtggtc

SEQ ID NO: 637550 - DNA, 20 bp, mouse
gtgtcagcagccagcgcctc

SEQ ID NO: 637551 - DNA, 20 bp, mouse
gggcacgggaccagaggcgc

SEQ ID NO: 637552 - DNA, 20 bp, mouse
gcagctcggagtcacgtcct

SEQ ID NO: 637553 - DNA, 20 bp, mouse
ggcggtgggcacgggaccag

SEQ ID NO: 637554 - DNA, 20 bp, mouse
gctggctgctgacacagggc

SEQ ID NO: 637555 - DNA, 20 bp, mouse
gcgcacgtccccgtcagtgc

SEQ ID NO: 637556 - DNA, 20 bp, mouse
gcctccggccccgcccagaa

SEQ ID NO: 637557 - DNA, 20 bp, mouse
gcaaagaagcacagcgtcag

SEQ ID NO: 637558 - DNA, 20 bp, mouse
gttgtgacgcgcggccttct

SEQ ID NO: 637559 - DNA, 20 bp, mouse
gtggggtaggcctcctgcgg

SEQ ID NO: 637560 - DNA, 20 bp, mouse
gctaagtccgggtttggttg

SEQ ID NO: 637561 - DNA, 20 bp, mouse
gcgcaactcaaggagagggc

SEQ ID NO: 637562 - DNA, 20 bp, mouse
gcagaaagggtattcgacgt

SEQ ID NO: 637563 - DNA, 20 bp, mouse
gaggcttcagaaagcccctt

SEQ ID NO: 637564 - DNA, 20 bp, mouse
gcgtcagcggtgcagtggga

SEQ ID NO: 637565 - DNA, 20 bp, mouse
gaagactgagctggctggtc

SEQ ID NO: 637566 - DNA, 20 bp, mouse
gttcagggaaaatgcagatt

SEQ ID NO: 637567 - DNA, 20 bp, mouse
ggtgaggagaaagtgacaga

SEQ ID NO: 637568 - DNA, 20 bp, mouse
ggaatcccttcacagaactt

SEQ ID NO: 637569 - DNA, 20 bp, mouse
gaaccaggtgtccttctgtg

SEQ ID NO: 637570 - DNA, 20 bp, mouse
gcaggaatcttgattcagtg

SEQ ID NO: 637571 - DNA, 20 bp, mouse
gtgcctcacagaaggacacc

SEQ ID NO: 637572 - DNA, 20 bp, mouse
gagagcaggtttcagccttc

SEQ ID NO: 637573 - DNA, 20 bp, mouse
ggattagggagaaggcagac

SEQ ID NO: 637574 - DNA, 20 bp, mouse
gaaggtgactgaaacaaacc

SEQ ID NO: 637575 - DNA, 20 bp, mouse
gagggattccagggtagtta

SEQ ID NO: 637576 - DNA, 20 bp, mouse
ggtggacagaaactgtgaga

SEQ ID NO: 637577 - DNA, 20 bp, mouse
ggtagagactagaaggccaa

SEQ ID NO: 637578 - DNA, 20 bp, mouse
gttccccaactgcaaggttc

SEQ ID NO: 637579 - DNA, 20 bp, mouse
gggccggaaccttgcagttg

SEQ ID NO: 637580 - DNA, 20 bp, mouse
ggtgagaggggtgatgtggg

SEQ ID NO: 637581 - DNA, 20 bp, mouse
gaggttccggccgggagcgg

SEQ ID NO: 637582 - DNA, 20 bp, mouse
ggcaaggttccggccgggag

SEQ ID NO: 637583 - DNA, 20 bp, mouse
ggagactagtgtagtacttc

SEQ ID NO: 637584 - DNA, 20 bp, mouse
gtggggaaacgttagctctc

SEQ ID NO: 637585 - DNA, 20 bp, mouse
gattataggcaaacgcctaa

SEQ ID NO: 637586 - DNA, 20 bp, mouse
gtcaagagctctcaggggcg

SEQ ID NO: 637587 - DNA, 20 bp, mouse
gccgctctagcccactgtct

SEQ ID NO: 637588 - DNA, 20 bp, mouse
gcgcaccagggcatgcgagg

SEQ ID NO: 637589 - DNA, 20 bp, mouse
gctctagcccactgtctcgg

SEQ ID NO: 637590 - DNA, 20 bp, mouse
gtggtcactgttcgcctctc

SEQ ID NO: 637591 - DNA, 20 bp, mouse
ggggctctgcaatcccgccc

SEQ ID NO: 637592 - DNA, 20 bp, mouse
gttgtcaggggatggaggcg

SEQ ID NO: 637593 - DNA, 20 bp, mouse
gacagtgaccaccgagacag

SEQ ID NO: 637594 - DNA, 20 bp, mouse
gagaacggagagacgcacca

SEQ ID NO: 637595 - DNA, 20 bp, mouse
gagacgcaccagggcatgcg

SEQ ID NO: 637596 - DNA, 20 bp, mouse
gcagagcagtgctgacatga

SEQ ID NO: 637597 - DNA, 20 bp, mouse
gtgggatctgacaagcacgg

SEQ ID NO: 637598 - DNA, 20 bp, mouse
gtatgaggcgtcaatcccat

SEQ ID NO: 637599 - DNA, 20 bp, mouse
gttgactggcaattggaatg

SEQ ID NO: 637600 - DNA, 20 bp, mouse
gcagaaagaaggaagccgaa

SEQ ID NO: 637601 - DNA, 20 bp, mouse
gttgtttaatccatgctctt

SEQ ID NO: 637602 - DNA, 20 bp, mouse
gattgacgcctcataggaag

SEQ ID NO: 637603 - DNA, 20 bp, mouse
gcactgctctgagctacctg

SEQ ID NO: 637604 - DNA, 20 bp, mouse
ggagctggtccctgaaccta

SEQ ID NO: 637605 - DNA, 20 bp, mouse
ggcgtcaatcccataggttc

SEQ ID NO: 637606 - DNA, 20 bp, mouse
gtggctcggacgaaaaggaa

SEQ ID NO: 637607 - DNA, 20 bp, mouse
gaggaaggggcgggtcgcgt

SEQ ID NO: 637608 - DNA, 20 bp, mouse
gggaacctccagacctgggg

SEQ ID NO: 637609 - DNA, 20 bp, mouse
gcagctggaacctccagacc

SEQ ID NO: 637610 - DNA, 20 bp, mouse
gagggcacgtacatgtgaat

SEQ ID NO: 637611 - DNA, 20 bp, mouse
gcccctagagcagccgctct

SEQ ID NO: 637612 - DNA, 20 bp, mouse
gaggcagccggaggtcgcac

SEQ ID NO: 637613 - DNA, 20 bp, mouse
gggctgctctaggggcatgc

SEQ ID NO: 637614 - DNA, 20 bp, mouse
gtcggacgaaaaggaagggg

SEQ ID NO: 637615 - DNA, 20 bp, mouse
ggtgcttggctcggacgaaa

SEQ ID NO: 637616 - DNA, 20 bp, mouse
gaagcctgccagctgctggg

SEQ ID NO: 637617 - DNA, 20 bp, mouse
gcagaagacacgcccctttc

SEQ ID NO: 637618 - DNA, 20 bp, mouse
gcagcagctggcaggcttct

SEQ ID NO: 637619 - DNA, 20 bp, mouse
gaaggggcgtgtcttctggt

SEQ ID NO: 637620 - DNA, 20 bp, mouse
gcggacagaggaagggaccc

SEQ ID NO: 637621 - DNA, 20 bp, mouse
gccgtccgcgcatcagtggg

SEQ ID NO: 637622 - DNA, 20 bp, mouse
gcggccgtccgcgcatcagt

SEQ ID NO: 637623 - DNA, 20 bp, mouse
gtcgccctcccctcctgaaa

SEQ ID NO: 637624 - DNA, 20 bp, mouse
gtccgcgcatcagtgggcgg

SEQ ID NO: 637625 - DNA, 20 bp, mouse
ggacacgcccctttcaggag

SEQ ID NO: 637626 - DNA, 20 bp, mouse
gcaagcccagccattatctt

SEQ ID NO: 637627 - DNA, 20 bp, mouse
gcccgccaggggatcagcgg

SEQ ID NO: 637628 - DNA, 20 bp, mouse
gccgccaggcactacagcta

SEQ ID NO: 637629 - DNA, 20 bp, mouse
gagcagggacccgaagataa

SEQ ID NO: 637630 - DNA, 20 bp, mouse
gcggtgcgacagaagcgcgt

SEQ ID NO: 637631 - DNA, 20 bp, mouse
gggacccgaagataatggct

SEQ ID NO: 637632 - DNA, 20 bp, mouse
gggaaccgccacagacttag

SEQ ID NO: 637633 - DNA, 20 bp, mouse
gggtcccgccaggggatcag

SEQ ID NO: 637634 - DNA, 20 bp, mouse
gagagcgcgggacacagtga

SEQ ID NO: 637635 - DNA, 20 bp, mouse
ggctctgacaacagcgcagg

SEQ ID NO: 637636 - DNA, 20 bp, mouse
ggtactgcgtgtgccccgcc

SEQ ID NO: 637637 - DNA, 20 bp, mouse
gaggagccgcggggcacgtt

SEQ ID NO: 637638 - DNA, 20 bp, mouse
gaagagctgcgggatatctg

SEQ ID NO: 637639 - DNA, 20 bp, mouse
gtccctcttgggtccgggaa

SEQ ID NO: 637640 - DNA, 20 bp, mouse
gtacctgagacatactggtg

SEQ ID NO: 637641 - DNA, 20 bp, mouse
ggagcccagctcatagcctg

SEQ ID NO: 637642 - DNA, 20 bp, mouse
gtcggatcccagaagagctg

SEQ ID NO: 637643 - DNA, 20 bp, mouse
gaagtcggatctgctttcgg

SEQ ID NO: 637644 - DNA, 20 bp, mouse
ggagctcagttggaacgccg

SEQ ID NO: 637645 - DNA, 20 bp, mouse
gccgctcgcccgagctcagt

SEQ ID NO: 637646 - DNA, 20 bp, mouse
gcggctctgcccaactggat

SEQ ID NO: 637647 - DNA, 20 bp, mouse
gcagggccaaaaggaatgct

SEQ ID NO: 637648 - DNA, 20 bp, mouse
gaactcctgcccttgttgtc

SEQ ID NO: 637649 - DNA, 20 bp, mouse
gaattcatcagaagtccagt

SEQ ID NO: 637650 - DNA, 20 bp, mouse
gagagccgagatagcagcag

SEQ ID NO: 637651 - DNA, 20 bp, mouse
ggccaccactgctgctatct

SEQ ID NO: 637652 - DNA, 20 bp, mouse
gaatctgtagttcagttcag

SEQ ID NO: 637653 - DNA, 20 bp, mouse
gtatctcggctctgcccaac

SEQ ID NO: 637654 - DNA, 20 bp, mouse
gagagccgagatagcagcag

SEQ ID NO: 637655 - DNA, 20 bp, mouse
gtgtgcaacacttatcggtc

SEQ ID NO: 637656 - DNA, 20 bp, mouse
ggcggctgtggtagtgtcgg

SEQ ID NO: 637657 - DNA, 20 bp, mouse
gggccctgaggagagtaagg

SEQ ID NO: 637658 - DNA, 20 bp, mouse
gggcgccggtcgtgctgtgg

SEQ ID NO: 637659 - DNA, 20 bp, mouse
gcgggagcgccgagccgggt

SEQ ID NO: 637660 - DNA, 20 bp, mouse
ggccaccgccacagcacgac

SEQ ID NO: 637661 - DNA, 20 bp, mouse
ggcgcgggcgacagggggtg

SEQ ID NO: 637662 - DNA, 20 bp, mouse
gcggcagcggctcgctcgtc

SEQ ID NO: 637663 - DNA, 20 bp, mouse
gaaggcggccgcgtcggcag

SEQ ID NO: 637664 - DNA, 20 bp, mouse
ggcggggcgtggtgacgtcg

SEQ ID NO: 637665 - DNA, 20 bp, mouse
gggaacctcgatctgcccag

SEQ ID NO: 637666 - DNA, 20 bp, mouse
gctcgtctggcagacaagtg

SEQ ID NO: 637667 - DNA, 20 bp, mouse
gttctcctctcccacttcaa

SEQ ID NO: 637668 - DNA, 20 bp, mouse
gagtgccgttgaagtgggag

SEQ ID NO: 637669 - DNA, 20 bp, mouse
gaatttagtgccgttgaagt

SEQ ID NO: 637670 - DNA, 20 bp, mouse
gccagaacattcttctcgtc

SEQ ID NO: 637671 - DNA, 20 bp, mouse
gaattcttttagttgttcac

SEQ ID NO: 637672 - DNA, 20 bp, mouse
gtgaaggacggtgagaatgt

SEQ ID NO: 637673 - DNA, 20 bp, mouse
gtccagagactgacaccatg

SEQ ID NO: 637674 - DNA, 20 bp, mouse
gacattgcaaagcgatttgc

SEQ ID NO: 637675 - DNA, 20 bp, mouse
gtctgtgaatcatctctgtg

SEQ ID NO: 637676 - DNA, 20 bp, mouse
ggaagatcctgttcccctgg

SEQ ID NO: 637677 - DNA, 20 bp, mouse
gcccgggtctcattccagaa

SEQ ID NO: 637678 - DNA, 20 bp, mouse
gtctcctcctccaggggaac

SEQ ID NO: 637679 - DNA, 20 bp, mouse
ggatcctgttcccctggagg

SEQ ID NO: 637680 - DNA, 20 bp, mouse
gagaaaaagcccttcctttc

SEQ ID NO: 637681 - DNA, 20 bp, mouse
ggtaagccttgttgtcaaag

SEQ ID NO: 637682 - DNA, 20 bp, mouse
gcgtgactatgcatacctgt

SEQ ID NO: 637683 - DNA, 20 bp, mouse
gaatgaagatcctgttcccc

SEQ ID NO: 637684 - DNA, 20 bp, mouse
gctggaggatttcacagaag

SEQ ID NO: 637685 - DNA, 20 bp, mouse
gcaccaagggacccgtttat

SEQ ID NO: 637686 - DNA, 20 bp, mouse
gtgacggtgaagatcattgc

SEQ ID NO: 637687 - DNA, 20 bp, mouse
gaaaagcctgttggagaatt

SEQ ID NO: 637688 - DNA, 20 bp, mouse
gtcattgcaggtttcagtgc

SEQ ID NO: 637689 - DNA, 20 bp, mouse
gtgctgaagtaggaatgtac

SEQ ID NO: 637690 - DNA, 20 bp, mouse
gggagaattaggttaacaaa

SEQ ID NO: 637691 - DNA, 20 bp, mouse
gtggctgagatgggttgctg

SEQ ID NO: 637692 - DNA, 20 bp, mouse
gcagggttatctgctgaagt

SEQ ID NO: 637693 - DNA, 20 bp, mouse
gtgtgagtagctaatatagt

SEQ ID NO: 637694 - DNA, 20 bp, mouse
gttgtgtaactgtgtctaga

SEQ ID NO: 637695 - DNA, 20 bp, mouse
gagtcttcccgtgtcttcta

SEQ ID NO: 637696 - DNA, 20 bp, mouse
ggctgctcttgccaacccta

SEQ ID NO: 637697 - DNA, 20 bp, mouse
gtgaggctggcaggttgcaa

SEQ ID NO: 637698 - DNA, 20 bp, mouse
gggcaggcgagcaccgaggc

SEQ ID NO: 637699 - DNA, 20 bp, mouse
gaggtggcactcttaggtgc

SEQ ID NO: 637700 - DNA, 20 bp, mouse
gcgcctgcgcaagtcatggg

SEQ ID NO: 637701 - DNA, 20 bp, mouse
ggtgccacctcgccccgaga

SEQ ID NO: 637702 - DNA, 20 bp, mouse
gggtgctcgcctgcccaacg

SEQ ID NO: 637703 - DNA, 20 bp, mouse
ggcggaagcggcaggcgcgt

SEQ ID NO: 637704 - DNA, 20 bp, mouse
ggcaccatggcaattcgcac

SEQ ID NO: 637705 - DNA, 20 bp, mouse
gaccaatggatcacaccctg

SEQ ID NO: 637706 - DNA, 20 bp, mouse
gggggagccctgcagattct

SEQ ID NO: 637707 - DNA, 20 bp, mouse
gaacttacggagtcccacga

SEQ ID NO: 637708 - DNA, 20 bp, mouse
gctccctcgcacaccctccc

SEQ ID NO: 637709 - DNA, 20 bp, mouse
ggccaggcggaggctgtcat

SEQ ID NO: 637710 - DNA, 20 bp, mouse
gtctgcagggctccccggtg

SEQ ID NO: 637711 - DNA, 20 bp, mouse
gagccgctcaggaaaagcat

SEQ ID NO: 637712 - DNA, 20 bp, mouse
gcaaacgccatctttcacgt

SEQ ID NO: 637713 - DNA, 20 bp, mouse
ggtccagggagggtgtgcga

SEQ ID NO: 637714 - DNA, 20 bp, mouse
gacgcgccgcggttccctcg

SEQ ID NO: 637715 - DNA, 20 bp, mouse
ggtggtgtctagacagtcca

SEQ ID NO: 637716 - DNA, 20 bp, mouse
gtgggcgcgcaggaaccagg

SEQ ID NO: 637717 - DNA, 20 bp, mouse
gttcctgcgcgcccacagga

SEQ ID NO: 637718 - DNA, 20 bp, mouse
ggggagccccacgcagtagt

SEQ ID NO: 637719 - DNA, 20 bp, mouse
gtggctgttcgccctcctgt

SEQ ID NO: 637720 - DNA, 20 bp, mouse
ggagggcgaacagccaggaa

SEQ ID NO: 637721 - DNA, 20 bp, mouse
gctcacacccactactgcgt

SEQ ID NO: 637722 - DNA, 20 bp, mouse
gaggaaccaggcggcttcca

SEQ ID NO: 637723 - DNA, 20 bp, mouse
gaggctccctggtcctttaa

SEQ ID NO: 637724 - DNA, 20 bp, mouse
gcttctcagcgggagcaggg

SEQ ID NO: 637725 - DNA, 20 bp, mouse
gtgagctctggctcaaggga

SEQ ID NO: 637726 - DNA, 20 bp, mouse
gagttagggggtgacgtaaa

SEQ ID NO: 637727 - DNA, 20 bp, mouse
gaggatgtggcctgttgagg

SEQ ID NO: 637728 - DNA, 20 bp, mouse
gggagggagctatctccgta

SEQ ID NO: 637729 - DNA, 20 bp, mouse
ggggagctatctccgtaagg

SEQ ID NO: 637730 - DNA, 20 bp, mouse
gggtaagtggccccgcctta

SEQ ID NO: 637731 - DNA, 20 bp, mouse
gtgtagaaaagtgttcagag

SEQ ID NO: 637732 - DNA, 20 bp, mouse
gcaggtccacttctcacttc

SEQ ID NO: 637733 - DNA, 20 bp, mouse
gatcacacacccgcctcaac

SEQ ID NO: 637734 - DNA, 20 bp, mouse
gtccaggtgtcaggctatct

SEQ ID NO: 637735 - DNA, 20 bp, mouse
ggttcataccaaacagcaac

SEQ ID NO: 637736 - DNA, 20 bp, mouse
gggcgcgcacgcgcactcat

SEQ ID NO: 637737 - DNA, 20 bp, mouse
gcccgggatcaccggaaagc

SEQ ID NO: 637738 - DNA, 20 bp, mouse
ggcagtgtctgctgtaaaag

SEQ ID NO: 637739 - DNA, 20 bp, mouse
ggtacctaacaaagctgggc

SEQ ID NO: 637740 - DNA, 20 bp, mouse
gagtgcgcgtgcgcgccgcg

SEQ ID NO: 637741 - DNA, 20 bp, mouse
gacctgctttccggtgatcc

SEQ ID NO: 637742 - DNA, 20 bp, mouse
ggaaaaagaaattctcaagg

SEQ ID NO: 637743 - DNA, 20 bp, mouse
gcttgtgtacctaacaaagc

SEQ ID NO: 637744 - DNA, 20 bp, mouse
gccccctgcccagctttgtt

SEQ ID NO: 637745 - DNA, 20 bp, mouse
gaagaaattctcaaggagga

SEQ ID NO: 637746 - DNA, 20 bp, mouse
gagcctgcggatgtgacccg

SEQ ID NO: 637747 - DNA, 20 bp, mouse
gcggccagagtcagtaacta

SEQ ID NO: 637748 - DNA, 20 bp, mouse
gggtgccccctgcagaccgc

SEQ ID NO: 637749 - DNA, 20 bp, mouse
ggtgacccgcggtctgcagg

SEQ ID NO: 637750 - DNA, 20 bp, mouse
ggccagccagcgcccgggtc

SEQ ID NO: 637751 - DNA, 20 bp, mouse
gagcgcgcaggagccggaag

SEQ ID NO: 637752 - DNA, 20 bp, mouse
ggggcgctggctggccgcta

SEQ ID NO: 637753 - DNA, 20 bp, mouse
gcacaacagctgacagaaac

SEQ ID NO: 637754 - DNA, 20 bp, mouse
ggaccgcgggtcacatccgc

SEQ ID NO: 637755 - DNA, 20 bp, mouse
gggtctgcagggggcacccg

SEQ ID NO: 637756 - DNA, 20 bp, mouse
gggaccgcgctgcgtccaga

SEQ ID NO: 637757 - DNA, 20 bp, mouse
gaggcggaggatcgagtccc

SEQ ID NO: 637758 - DNA, 20 bp, mouse
ggcggcgtcgacggggtcgg

SEQ ID NO: 637759 - DNA, 20 bp, mouse
gtaccgcgaggcgcgccggg

SEQ ID NO: 637760 - DNA, 20 bp, mouse
gcgcgcgcgtctctatggtg

SEQ ID NO: 637761 - DNA, 20 bp, mouse
gaggatcgagtcccgggccg

SEQ ID NO: 637762 - DNA, 20 bp, mouse
ggcgcctcgcggtaggcggg

SEQ ID NO: 637763 - DNA, 20 bp, mouse
ggagaagagcggcgtcgacg

SEQ ID NO: 637764 - DNA, 20 bp, mouse
gagagcggcgtcgacggggt

SEQ ID NO: 637765 - DNA, 20 bp, mouse
gctccccgcccggcgagccg

SEQ ID NO: 637766 - DNA, 20 bp, mouse
gggctcaggcagcgggaaag

SEQ ID NO: 637767 - DNA, 20 bp, mouse
gaaacagccccaccctggag

SEQ ID NO: 637768 - DNA, 20 bp, mouse
gtggggctgtttggtagttc

SEQ ID NO: 637769 - DNA, 20 bp, mouse
gctaccaaacagccccaccc

SEQ ID NO: 637770 - DNA, 20 bp, mouse
gcatgtgtgaggggcgggca

SEQ ID NO: 637771 - DNA, 20 bp, mouse
gggactaggcggctgggctc

SEQ ID NO: 637772 - DNA, 20 bp, mouse
gggggcgggcacggtgtccc

SEQ ID NO: 637773 - DNA, 20 bp, mouse
ggcgggcacggtgtcccagg

SEQ ID NO: 637774 - DNA, 20 bp, mouse
gtttggtagttcaggactgc

SEQ ID NO: 637775 - DNA, 20 bp, mouse
gatgcaaactctgtcctcct

SEQ ID NO: 637776 - DNA, 20 bp, mouse
gagagcgcagtcagttgcca

SEQ ID NO: 637777 - DNA, 20 bp, mouse
gggcacgtgcggccgaattc

SEQ ID NO: 637778 - DNA, 20 bp, mouse
gcagccctggcgcaggatat

SEQ ID NO: 637779 - DNA, 20 bp, mouse
ggggcaacacctggtggcgt

SEQ ID NO: 637780 - DNA, 20 bp, mouse
gacgccaatatcctgcgcca

SEQ ID NO: 637781 - DNA, 20 bp, mouse
gagggctgcgccctcccatg

SEQ ID NO: 637782 - DNA, 20 bp, mouse
gcagccaatggccgccgcat

SEQ ID NO: 637783 - DNA, 20 bp, mouse
gcagttgccagggcaacacc

SEQ ID NO: 637784 - DNA, 20 bp, mouse
gctgttcagcccagcaccag

SEQ ID NO: 637785 - DNA, 20 bp, mouse
ggaagctaggaagaaggatt

SEQ ID NO: 637786 - DNA, 20 bp, mouse
gccccccatcaacggggaca

SEQ ID NO: 637787 - DNA, 20 bp, mouse
gcaggtacccggtgtctaga

SEQ ID NO: 637788 - DNA, 20 bp, mouse
gtctagaggggagacggagg

SEQ ID NO: 637789 - DNA, 20 bp, mouse
gtaaccctgtggggggtcgg

SEQ ID NO: 637790 - DNA, 20 bp, mouse
gcccccacagggttagtaac

SEQ ID NO: 637791 - DNA, 20 bp, mouse
gaaccggagcccccaagtct

SEQ ID NO: 637792 - DNA, 20 bp, mouse
gcccatcaacggggacaggg

SEQ ID NO: 637793 - DNA, 20 bp, mouse
ggggctgctcctggcacaac

SEQ ID NO: 637794 - DNA, 20 bp, mouse
gcggaggatgcgaaaagtcg

SEQ ID NO: 637795 - DNA, 20 bp, mouse
gccctccctgtccccgttga

SEQ ID NO: 637796 - DNA, 20 bp, mouse
gtaagcggaaagcaggagat

SEQ ID NO: 637797 - DNA, 20 bp, mouse
gaaagctgggagtagctgca

SEQ ID NO: 637798 - DNA, 20 bp, mouse
ggccacggactggacgacag

SEQ ID NO: 637799 - DNA, 20 bp, mouse
ggggccgggccgtgcatttt

SEQ ID NO: 637800 - DNA, 20 bp, mouse
gggtcagaatggccacggac

SEQ ID NO: 637801 - DNA, 20 bp, mouse
gctgacccagtgatctctgc

SEQ ID NO: 637802 - DNA, 20 bp, mouse
ggagcaggcgcgttgagcgc

SEQ ID NO: 637803 - DNA, 20 bp, mouse
gctcaacgcgcctgctccgt

SEQ ID NO: 637804 - DNA, 20 bp, mouse
gaggaagtagcccacggagc

SEQ ID NO: 637805 - DNA, 20 bp, mouse
gcacggcccggccctgcact

SEQ ID NO: 637806 - DNA, 20 bp, mouse
gcacaactccagcttccggt

SEQ ID NO: 637807 - DNA, 20 bp, mouse
ggacacagtggattagtcct

SEQ ID NO: 637808 - DNA, 20 bp, mouse
ggggaaagcaggtagccgac

SEQ ID NO: 637809 - DNA, 20 bp, mouse
gatcctccccggacctaggt

SEQ ID NO: 637810 - DNA, 20 bp, mouse
gtgcccacaaaggggaaagc

SEQ ID NO: 637811 - DNA, 20 bp, mouse
gttcccacctaggtccgggg

SEQ ID NO: 637812 - DNA, 20 bp, mouse
gcaggtagccgaccggaagc

SEQ ID NO: 637813 - DNA, 20 bp, mouse
gagaagaaggcgggctttac

SEQ ID NO: 637814 - DNA, 20 bp, mouse
ggtggatcctccccggacct

SEQ ID NO: 637815 - DNA, 20 bp, mouse
gtgcactctaaccctaattg

SEQ ID NO: 637816 - DNA, 20 bp, mouse
ggaggctggaatcgtggtga

SEQ ID NO: 637817 - DNA, 20 bp, mouse
gtgagctgaggctggaatcg

SEQ ID NO: 637818 - DNA, 20 bp, mouse
ggatgtaaaaatagcctctg

SEQ ID NO: 637819 - DNA, 20 bp, mouse
gcacgagtaatagataactt

SEQ ID NO: 637820 - DNA, 20 bp, mouse
gaaacaggctatttctgctc

SEQ ID NO: 637821 - DNA, 20 bp, mouse
ggcctccggcactggctcca

SEQ ID NO: 637822 - DNA, 20 bp, mouse
ggccttggagccagtgccgg

SEQ ID NO: 637823 - DNA, 20 bp, mouse
gaaaatatctcaagatggga

SEQ ID NO: 637824 - DNA, 20 bp, mouse
gtaggttctgggatagcctt

SEQ ID NO: 637825 - DNA, 20 bp, mouse
gcagctcagaatgattccta

SEQ ID NO: 637826 - DNA, 20 bp, mouse
gcacagggctggattagagt

SEQ ID NO: 637827 - DNA, 20 bp, mouse
gaagactgcagctaaggcta

SEQ ID NO: 637828 - DNA, 20 bp, mouse
gggagtccacaaaactgtag

SEQ ID NO: 637829 - DNA, 20 bp, mouse
gacagccaagggagtgtagg

SEQ ID NO: 637830 - DNA, 20 bp, mouse
gtggactccgctaacgcaca

SEQ ID NO: 637831 - DNA, 20 bp, mouse
ggatgcagagtggtccctgt

SEQ ID NO: 637832 - DNA, 20 bp, mouse
gatgtgaagagggacagttg

SEQ ID NO: 637833 - DNA, 20 bp, mouse
gatccagccctgtgcgttag

SEQ ID NO: 637834 - DNA, 20 bp, mouse
gtgcagctaaggctagggat

SEQ ID NO: 637835 - DNA, 20 bp, mouse
gtagcatcccagacagccaa

SEQ ID NO: 637836 - DNA, 20 bp, mouse
gaacaggattgggacagcgg

SEQ ID NO: 637837 - DNA, 20 bp, mouse
gggattgggacagcgggggg

SEQ ID NO: 637838 - DNA, 20 bp, mouse
ggcataccttaaacacacac

SEQ ID NO: 637839 - DNA, 20 bp, mouse
gcaggacagggatggaaaga

SEQ ID NO: 637840 - DNA, 20 bp, mouse
gcctgtcctgtgtgtgttta

SEQ ID NO: 637841 - DNA, 20 bp, mouse
gtacaacacatgcatgactg

SEQ ID NO: 637842 - DNA, 20 bp, mouse
gaagaggatgccaaatcccc

SEQ ID NO: 637843 - DNA, 20 bp, mouse
gtggatcaatttctcttgat

SEQ ID NO: 637844 - DNA, 20 bp, mouse
gtttatttatttaactaacg

SEQ ID NO: 637845 - DNA, 20 bp, mouse
gtgtcatcgaagcagtaaaa

SEQ ID NO: 637846 - DNA, 20 bp, mouse
gcctcagggagatgagactg

SEQ ID NO: 637847 - DNA, 20 bp, mouse
ggcgcgggttcgagcacctc

SEQ ID NO: 637848 - DNA, 20 bp, mouse
gtgggactctgactgacgtc

SEQ ID NO: 637849 - DNA, 20 bp, mouse
gccccactggaacattccaa

SEQ ID NO: 637850 - DNA, 20 bp, mouse
ggggaaggcgtgagtgttgt

SEQ ID NO: 637851 - DNA, 20 bp, mouse
gagtcttcggggagtacagt

SEQ ID NO: 637852 - DNA, 20 bp, mouse
gagcgtaaagtacgcaaaca

SEQ ID NO: 637853 - DNA, 20 bp, mouse
ggcttggcttggctctggcg

SEQ ID NO: 637854 - DNA, 20 bp, mouse
gcttgcgcaggcgtcgtcca

SEQ ID NO: 637855 - DNA, 20 bp, mouse
gcaaaggaggaatatgttac

SEQ ID NO: 637856 - DNA, 20 bp, mouse
ggggcgtccgggtgaagcga

SEQ ID NO: 637857 - DNA, 20 bp, mouse
gagagcggcggcggacgagc

SEQ ID NO: 637858 - DNA, 20 bp, mouse
ggacgagcgggctgaagccc

SEQ ID NO: 637859 - DNA, 20 bp, mouse
gaggcagcgtggacgcgagc

SEQ ID NO: 637860 - DNA, 20 bp, mouse
ggagggccgcagccgtgagg

SEQ ID NO: 637861 - DNA, 20 bp, mouse
gtccacgctgcctcccggac

SEQ ID NO: 637862 - DNA, 20 bp, mouse
gcgggcgaaacaggcgggga

SEQ ID NO: 637863 - DNA, 20 bp, mouse
gcctacggacgctggagagg

SEQ ID NO: 637864 - DNA, 20 bp, mouse
gggcgcgcacgccgggcgtc

SEQ ID NO: 637865 - DNA, 20 bp, mouse
gcttcccccgcgccgcctca

SEQ ID NO: 637866 - DNA, 20 bp, mouse
gagggtctcacataaagtcg

SEQ ID NO: 637867 - DNA, 20 bp, mouse
ggatgttgatgcggaagttt

SEQ ID NO: 637868 - DNA, 20 bp, mouse
gaagtccctggatgttgatg

SEQ ID NO: 637869 - DNA, 20 bp, mouse
gcctccagggacatcactaa

SEQ ID NO: 637870 - DNA, 20 bp, mouse
ggtctcacataaagtcgggg

SEQ ID NO: 637871 - DNA, 20 bp, mouse
gcgtgagcaccccaagtccc

SEQ ID NO: 637872 - DNA, 20 bp, mouse
gctacttctggggacttcag

SEQ ID NO: 637873 - DNA, 20 bp, mouse
gcgacctttagtgatgtccc

SEQ ID NO: 637874 - DNA, 20 bp, mouse
gtctgagtgcagacagaagc

SEQ ID NO: 637875 - DNA, 20 bp, mouse
gttccgagagcttcacaaaa

SEQ ID NO: 637876 - DNA, 20 bp, mouse
gtcggcagcttgaatcccgt

SEQ ID NO: 637877 - DNA, 20 bp, mouse
gggagccagagacttccaga

SEQ ID NO: 637878 - DNA, 20 bp, mouse
gcctgccttctggaagtctc

SEQ ID NO: 637879 - DNA, 20 bp, mouse
gactacaatcaaatgttctg

SEQ ID NO: 637880 - DNA, 20 bp, mouse
gcattgggataagacctcaa

SEQ ID NO: 637881 - DNA, 20 bp, mouse
gcggaacgagctgtttcatt

SEQ ID NO: 637882 - DNA, 20 bp, mouse
ggccaacttggtcaacatct

SEQ ID NO: 637883 - DNA, 20 bp, mouse
gcgtcccagggtgtgcacgt

SEQ ID NO: 637884 - DNA, 20 bp, mouse
gtcggtccgagccctgatga

SEQ ID NO: 637885 - DNA, 20 bp, mouse
gtggaagtctctggctccac

SEQ ID NO: 637886 - DNA, 20 bp, mouse
gggccaggctaccaccaggg

SEQ ID NO: 637887 - DNA, 20 bp, mouse
gtggcccagtgactgtctaa

SEQ ID NO: 637888 - DNA, 20 bp, mouse
ggggagggtgagaagacgta

SEQ ID NO: 637889 - DNA, 20 bp, mouse
gtggggccacagtgtgtcca

SEQ ID NO: 637890 - DNA, 20 bp, mouse
gactgggccaggctaccacc

SEQ ID NO: 637891 - DNA, 20 bp, mouse
gggaacctgtccacggatgt

SEQ ID NO: 637892 - DNA, 20 bp, mouse
ggtcttctcaccctccctgg

SEQ ID NO: 637893 - DNA, 20 bp, mouse
gctcctctggaactcctgcg

SEQ ID NO: 637894 - DNA, 20 bp, mouse
gcggacccttagacagtcac

SEQ ID NO: 637895 - DNA, 20 bp, mouse
gtcctgcgaggctgagacgc

SEQ ID NO: 637896 - DNA, 20 bp, mouse
ggcagcccggcccacggcgg

SEQ ID NO: 637897 - DNA, 20 bp, mouse
gagcccccggaggaccatcg

SEQ ID NO: 637898 - DNA, 20 bp, mouse
gtccctcgatggtcctccgg

SEQ ID NO: 637899 - DNA, 20 bp, mouse
gcccagcggccgtccctcga

SEQ ID NO: 637900 - DNA, 20 bp, mouse
gcgcgatgccgagcccccgg

SEQ ID NO: 637901 - DNA, 20 bp, mouse
gcgggatggcagtgcggaag

SEQ ID NO: 637902 - DNA, 20 bp, mouse
ggacggccgctgggctcctc

SEQ ID NO: 637903 - DNA, 20 bp, mouse
ggggggctcggcatcgcgga

SEQ ID NO: 637904 - DNA, 20 bp, mouse
ggggacgctgcttccgcccg

SEQ ID NO: 637905 - DNA, 20 bp, mouse
gccgccgctgccaccgccgt

SEQ ID NO: 637906 - DNA, 20 bp, mouse
gggcctagggtcacatgtgg

SEQ ID NO: 637907 - DNA, 20 bp, mouse
ggcttcgagcagcgaggcga

SEQ ID NO: 637908 - DNA, 20 bp, mouse
gcccctgggaacacaggcac

SEQ ID NO: 637909 - DNA, 20 bp, mouse
ggcagcgaggcgagggccta

SEQ ID NO: 637910 - DNA, 20 bp, mouse
ggagggcctagggtcacatg

SEQ ID NO: 637911 - DNA, 20 bp, mouse
ggtgacaggcgcgggccggg

SEQ ID NO: 637912 - DNA, 20 bp, mouse
ggcttccggcggccgtgggg

SEQ ID NO: 637913 - DNA, 20 bp, mouse
gcgccggcccacccccccca

SEQ ID NO: 637914 - DNA, 20 bp, mouse
gcacgacgcacgtacacgca

SEQ ID NO: 637915 - DNA, 20 bp, mouse
gggggggcgggaaagacgcg

SEQ ID NO: 637916 - DNA, 20 bp, mouse
gcaaccgaatgtggccttac

SEQ ID NO: 637917 - DNA, 20 bp, mouse
gtcactgtatgaagactaaa

SEQ ID NO: 637918 - DNA, 20 bp, mouse
ggcgcctgtaaggccacatt

SEQ ID NO: 637919 - DNA, 20 bp, mouse
ggtggccttacaggcgctga

SEQ ID NO: 637920 - DNA, 20 bp, mouse
ggcggggcggggagtggtcg

SEQ ID NO: 637921 - DNA, 20 bp, mouse
gtgaaccctcagcgcctgta

SEQ ID NO: 637922 - DNA, 20 bp, mouse
gtcccagagtgcagcggggc

SEQ ID NO: 637923 - DNA, 20 bp, mouse
gggagagctgatgtgcttag

SEQ ID NO: 637924 - DNA, 20 bp, mouse
gctagcagccccagaagttt

SEQ ID NO: 637925 - DNA, 20 bp, mouse
gtggtcgcggtaggacgcgc

SEQ ID NO: 637926 - DNA, 20 bp, mouse
gggcaagctgggttagacta

SEQ ID NO: 637927 - DNA, 20 bp, mouse
gctggagttgctgatagaag

SEQ ID NO: 637928 - DNA, 20 bp, mouse
gacggcgtctccagagccca

SEQ ID NO: 637929 - DNA, 20 bp, mouse
gaccgcccgccgcccctcgg

SEQ ID NO: 637930 - DNA, 20 bp, mouse
gtctccagagcccagggatg

SEQ ID NO: 637931 - DNA, 20 bp, mouse
gacagggggaagtggctggt

SEQ ID NO: 637932 - DNA, 20 bp, mouse
gcgggtaggtggataagtaa

SEQ ID NO: 637933 - DNA, 20 bp, mouse
gaagcaccgggacttacagg

SEQ ID NO: 637934 - DNA, 20 bp, mouse
gacttacagggggaagtggc

SEQ ID NO: 637935 - DNA, 20 bp, mouse
gtcccccagggctttatcta

SEQ ID NO: 637936 - DNA, 20 bp, mouse
gggaaaatgggcattatgac

SEQ ID NO: 637937 - DNA, 20 bp, mouse
gagaagagggcagtgcggtt

SEQ ID NO: 637938 - DNA, 20 bp, mouse
gctagtacacatggtgtcct

SEQ ID NO: 637939 - DNA, 20 bp, mouse
gagtgcttttctagtacaca

SEQ ID NO: 637940 - DNA, 20 bp, mouse
gaatgtcccacctgtctctt

SEQ ID NO: 637941 - DNA, 20 bp, mouse
gcaaatcattgagaagtggg

SEQ ID NO: 637942 - DNA, 20 bp, mouse
ggtcgaaagtctgtagtctc

SEQ ID NO: 637943 - DNA, 20 bp, mouse
gagggataagagcatagtgg

SEQ ID NO: 637944 - DNA, 20 bp, mouse
gctcctgtttccatatacaa

SEQ ID NO: 637945 - DNA, 20 bp, mouse
gtggggggactgaaagctaa

SEQ ID NO: 637946 - DNA, 20 bp, mouse
ggacccttcttgtaaagcta

SEQ ID NO: 637947 - DNA, 20 bp, mouse
gacccctagctttacaagaa

SEQ ID NO: 637948 - DNA, 20 bp, mouse
ggggtagctgtgggtttcga

SEQ ID NO: 637949 - DNA, 20 bp, mouse
ggggaagccgggaaggctcg

SEQ ID NO: 637950 - DNA, 20 bp, mouse
ggaaggctcgaggcgtggga

SEQ ID NO: 637951 - DNA, 20 bp, mouse
gaagaagggtcgcttgcccg

SEQ ID NO: 637952 - DNA, 20 bp, mouse
ggacgccgagggcgtgggag

SEQ ID NO: 637953 - DNA, 20 bp, mouse
gagtgcgagggaagccggga

SEQ ID NO: 637954 - DNA, 20 bp, mouse
gctcgaggcgtgggaaggag

SEQ ID NO: 637955 - DNA, 20 bp, mouse
gttctctcggcgaagtgcga

SEQ ID NO: 637956 - DNA, 20 bp, mouse
gtgacccagctactcactgt

SEQ ID NO: 637957 - DNA, 20 bp, mouse
gaaaataggcgctggaggga

SEQ ID NO: 637958 - DNA, 20 bp, mouse
gcatgactgcttcaggtcca

SEQ ID NO: 637959 - DNA, 20 bp, mouse
gcctgaaaataggcgctgga

SEQ ID NO: 637960 - DNA, 20 bp, mouse
gtagcagaagtcagacgtgt

SEQ ID NO: 637961 - DNA, 20 bp, mouse
gactgtgggatttcaaataa

SEQ ID NO: 637962 - DNA, 20 bp, mouse
gcacacctgaaaataggcgc

SEQ ID NO: 637963 - DNA, 20 bp, mouse
gctgctaaacaaaccccaca

SEQ ID NO: 637964 - DNA, 20 bp, mouse
gcaggggatgcgatcccagc

SEQ ID NO: 637965 - DNA, 20 bp, mouse
gcatgttaaaagtaaatttt

SEQ ID NO: 637966 - DNA, 20 bp, mouse
gttaaagactcatgacggaa

SEQ ID NO: 637967 - DNA, 20 bp, mouse
gcagagtggtggatgtgcta

SEQ ID NO: 637968 - DNA, 20 bp, mouse
gtcgccccgcagatggattt

SEQ ID NO: 637969 - DNA, 20 bp, mouse
gcaagacattcagttgggtg

SEQ ID NO: 637970 - DNA, 20 bp, mouse
ggtgctatggtgactgttta

SEQ ID NO: 637971 - DNA, 20 bp, mouse
gtgagtccacgagtgttccg

SEQ ID NO: 637972 - DNA, 20 bp, mouse
gagtcctatgtaccagttca

SEQ ID NO: 637973 - DNA, 20 bp, mouse
gcccaccccaaatccatctg

SEQ ID NO: 637974 - DNA, 20 bp, mouse
ggactcatgacggaagggac

SEQ ID NO: 637975 - DNA, 20 bp, mouse
gcagtactttctctacagag

SEQ ID NO: 637976 - DNA, 20 bp, mouse
ggcctcaggctggacttccc

SEQ ID NO: 637977 - DNA, 20 bp, mouse
gagtggagagctctggaccc

SEQ ID NO: 637978 - DNA, 20 bp, mouse
gggtggggaacaccctaccc

SEQ ID NO: 637979 - DNA, 20 bp, mouse
gcaggcaagctagactccga

SEQ ID NO: 637980 - DNA, 20 bp, mouse
gcccaggcctggtcctgccc

SEQ ID NO: 637981 - DNA, 20 bp, mouse
gctgcctgctaatcacggtg

SEQ ID NO: 637982 - DNA, 20 bp, mouse
gtccagcctgaggcacacct

SEQ ID NO: 637983 - DNA, 20 bp, mouse
ggccaagcccagttcttgaa

SEQ ID NO: 637984 - DNA, 20 bp, mouse
gtgggtctgggagttagctg

SEQ ID NO: 637985 - DNA, 20 bp, mouse
ggttccccaccgtgattagc

SEQ ID NO: 637986 - DNA, 20 bp, mouse
gcttcaggggtgttcatgat

SEQ ID NO: 637987 - DNA, 20 bp, mouse
ggagcatgctcgattaagac

SEQ ID NO: 637988 - DNA, 20 bp, mouse
gggtgttcatgattggttca

SEQ ID NO: 637989 - DNA, 20 bp, mouse
gtttggaagagggcagcttc

SEQ ID NO: 637990 - DNA, 20 bp, mouse
gtgttgatcatttttaacct

SEQ ID NO: 637991 - DNA, 20 bp, mouse
gctagccagtacactcactt

SEQ ID NO: 637992 - DNA, 20 bp, mouse
gtcatcctaagtgagtgtac

SEQ ID NO: 637993 - DNA, 20 bp, mouse
gaaattcttcagcaaatgaa

SEQ ID NO: 637994 - DNA, 20 bp, mouse
gaacccagctatacctctac

SEQ ID NO: 637995 - DNA, 20 bp, mouse
gtaaccttggctttggaaga

SEQ ID NO: 637996 - DNA, 20 bp, mouse
gagcctatcgctgtcctaca

SEQ ID NO: 637997 - DNA, 20 bp, mouse
ggctgaaggcgtggtcggaa

SEQ ID NO: 637998 - DNA, 20 bp, mouse
ggggcaggtttcttgtctat

SEQ ID NO: 637999 - DNA, 20 bp, mouse
gccagtctgtgcaactaaaa

SEQ ID NO: 638000 - DNA, 20 bp, mouse
gaggcaaggtctctactacc

SEQ ID NO: 638001 - DNA, 20 bp, mouse
gaggacctgacatttcttag

SEQ ID NO: 638002 - DNA, 20 bp, mouse
gaaacctgccccatagggat

SEQ ID NO: 638003 - DNA, 20 bp, mouse
gggccggctgaaggcgtggt

SEQ ID NO: 638004 - DNA, 20 bp, mouse
gactcaagggctgttgggaa

SEQ ID NO: 638005 - DNA, 20 bp, mouse
gctcaatactggaaaaagag

SEQ ID NO: 638006 - DNA, 20 bp, mouse
gcccatctggatgtcctcga

SEQ ID NO: 638007 - DNA, 20 bp, mouse
gcctccccgcgaggaccaaa

SEQ ID NO: 638008 - DNA, 20 bp, mouse
ggggactgactgagtaagaa

SEQ ID NO: 638009 - DNA, 20 bp, mouse
gaccagggagcactcccctt

SEQ ID NO: 638010 - DNA, 20 bp, mouse
gcgggtaggtaggcaggatc

SEQ ID NO: 638011 - DNA, 20 bp, mouse
gccgcgccccagcagacttt

SEQ ID NO: 638012 - DNA, 20 bp, mouse
gagtctgctggggcgcgggt

SEQ ID NO: 638013 - DNA, 20 bp, mouse
ggggagcgatacctagtgta

SEQ ID NO: 638014 - DNA, 20 bp, mouse
ggggtcaggttcctgtggga

SEQ ID NO: 638015 - DNA, 20 bp, mouse
ggaagggcggacccctcacc

SEQ ID NO: 638016 - DNA, 20 bp, mouse
gggaggctatcccattatgt

SEQ ID NO: 638017 - DNA, 20 bp, mouse
gtgggatctacccacataat

SEQ ID NO: 638018 - DNA, 20 bp, mouse
gtccagccttcaaaaaggaa

SEQ ID NO: 638019 - DNA, 20 bp, mouse
ggcccagagggctttaagaa

SEQ ID NO: 638020 - DNA, 20 bp, mouse
gcctatacttggtatatcct

SEQ ID NO: 638021 - DNA, 20 bp, mouse
gcagccttggggcatttggg

SEQ ID NO: 638022 - DNA, 20 bp, mouse
gggggctggagagctagcgt

SEQ ID NO: 638023 - DNA, 20 bp, mouse
gaggaagggactcctatact

SEQ ID NO: 638024 - DNA, 20 bp, mouse
ggatggatgaattagcacat

SEQ ID NO: 638025 - DNA, 20 bp, mouse
gcaggatagcgccagctcca

SEQ ID NO: 638026 - DNA, 20 bp, mouse
ggaagcgccgagtttccgtg

SEQ ID NO: 638027 - DNA, 20 bp, mouse
gtaccaggcgacactgtcac

SEQ ID NO: 638028 - DNA, 20 bp, mouse
gacactgagcacccgatacg

SEQ ID NO: 638029 - DNA, 20 bp, mouse
gactctggtctccacgtatc

SEQ ID NO: 638030 - DNA, 20 bp, mouse
gccgagtttccgtggggatt

SEQ ID NO: 638031 - DNA, 20 bp, mouse
gcgggtgctcagtgtcggca

SEQ ID NO: 638032 - DNA, 20 bp, mouse
gtggggattggagaatgact

SEQ ID NO: 638033 - DNA, 20 bp, mouse
gacgtcagcaaaatacgctg

SEQ ID NO: 638034 - DNA, 20 bp, mouse
gtggagaccagagtccaacc

SEQ ID NO: 638035 - DNA, 20 bp, mouse
gccggaaaaccggtcttttc

SEQ ID NO: 638036 - DNA, 20 bp, mouse
gctcccatggcgcaaggggt

SEQ ID NO: 638037 - DNA, 20 bp, mouse
gccttgcgccatgggaggag

SEQ ID NO: 638038 - DNA, 20 bp, mouse
gcccccaccccttgcgccat

SEQ ID NO: 638039 - DNA, 20 bp, mouse
gccagagagggtgtggaggg

SEQ ID NO: 638040 - DNA, 20 bp, mouse
ggggggggcgggcttgggta

SEQ ID NO: 638041 - DNA, 20 bp, mouse
gtggctcaggctctgtactc

SEQ ID NO: 638042 - DNA, 20 bp, mouse
gccaccaccatgaagtcact

SEQ ID NO: 638043 - DNA, 20 bp, mouse
ggacttcatggtggtgggtt

SEQ ID NO: 638044 - DNA, 20 bp, mouse
ggagccaatcacagtctgga

SEQ ID NO: 638045 - DNA, 20 bp, mouse
gcaacagactccagtcatcc

SEQ ID NO: 638046 - DNA, 20 bp, mouse
gttgcctcgggccggtccga

SEQ ID NO: 638047 - DNA, 20 bp, mouse
ggggagcatccgcgacaccg

SEQ ID NO: 638048 - DNA, 20 bp, mouse
gccgaggcaagcggcgtcgg

SEQ ID NO: 638049 - DNA, 20 bp, mouse
gggcacctcgtcccctcgga

SEQ ID NO: 638050 - DNA, 20 bp, mouse
gggcccgaggcaagcggcgt

SEQ ID NO: 638051 - DNA, 20 bp, mouse
ggcggggtcgcgcgcaaggg

SEQ ID NO: 638052 - DNA, 20 bp, mouse
ggccgcggggtcgcgcgcaa

SEQ ID NO: 638053 - DNA, 20 bp, mouse
gcagaggaggaggctacccc

SEQ ID NO: 638054 - DNA, 20 bp, mouse
gcatccgcccgccctccgag

SEQ ID NO: 638055 - DNA, 20 bp, mouse
ggatgctcccgagctggggc

SEQ ID NO: 638056 - DNA, 20 bp, mouse
gtagatctggggttcctcga

SEQ ID NO: 638057 - DNA, 20 bp, mouse
gtacctctggggaaattctc

SEQ ID NO: 638058 - DNA, 20 bp, mouse
gcagcagctggcttctgtcg

SEQ ID NO: 638059 - DNA, 20 bp, mouse
gctgggggaggaggagacgc

SEQ ID NO: 638060 - DNA, 20 bp, mouse
ggaactgggccgagaagtac

SEQ ID NO: 638061 - DNA, 20 bp, mouse
ggggcgggacgccagagcta

SEQ ID NO: 638062 - DNA, 20 bp, mouse
ggatgggccacaagccctcg

SEQ ID NO: 638063 - DNA, 20 bp, mouse
ggaactcagcccacttaacc

SEQ ID NO: 638064 - DNA, 20 bp, mouse
gaaagcgctaatctagaact

SEQ ID NO: 638065 - DNA, 20 bp, mouse
gtttactcttaaggcttgac

SEQ ID NO: 638066 - DNA, 20 bp, mouse
gcaccggaacacctccctgt

SEQ ID NO: 638067 - DNA, 20 bp, mouse
gcacggggttcccagaaagg

SEQ ID NO: 638068 - DNA, 20 bp, mouse
ggggctgaggatgagaaggg

SEQ ID NO: 638069 - DNA, 20 bp, mouse
ggaggtgttccggtggtggt

SEQ ID NO: 638070 - DNA, 20 bp, mouse
gtctaaaagggaattccacg

SEQ ID NO: 638071 - DNA, 20 bp, mouse
gcggaggcacgctcagatct

SEQ ID NO: 638072 - DNA, 20 bp, mouse
gccggtggtggtgggtacgg

SEQ ID NO: 638073 - DNA, 20 bp, mouse
gacctgcgacagtctcgggg

SEQ ID NO: 638074 - DNA, 20 bp, mouse
gaacctacagggaggtgttc

SEQ ID NO: 638075 - DNA, 20 bp, mouse
gaaacaggtgacctcctttc

SEQ ID NO: 638076 - DNA, 20 bp, mouse
ggaccccaactccaggactg

SEQ ID NO: 638077 - DNA, 20 bp, mouse
gacagcctaaagaatgaagg

SEQ ID NO: 638078 - DNA, 20 bp, mouse
gaagagaccaaaaattagga

SEQ ID NO: 638079 - DNA, 20 bp, mouse
gggacaaggcaaacaagact

SEQ ID NO: 638080 - DNA, 20 bp, mouse
gggctctcaagccacagtcc

SEQ ID NO: 638081 - DNA, 20 bp, mouse
ggatgaaagtcacaaaattg

SEQ ID NO: 638082 - DNA, 20 bp, mouse
gtgctggcctctcgcatctt

SEQ ID NO: 638083 - DNA, 20 bp, mouse
gctaataacctgaccagaag

SEQ ID NO: 638084 - DNA, 20 bp, mouse
gtggaaagagaccaaaaatt

SEQ ID NO: 638085 - DNA, 20 bp, mouse
gcattactgaccccaactcc

SEQ ID NO: 638086 - DNA, 20 bp, mouse
gagaaaccggagaccggggt

SEQ ID NO: 638087 - DNA, 20 bp, mouse
ggtggagtgggtgaggtgta

SEQ ID NO: 638088 - DNA, 20 bp, mouse
gaggtggcctggcgagacag

SEQ ID NO: 638089 - DNA, 20 bp, mouse
ggcaaggcttatgtctggtg

SEQ ID NO: 638090 - DNA, 20 bp, mouse
ggggcggggcggagagcggg

SEQ ID NO: 638091 - DNA, 20 bp, mouse
gggcttgtgggcgtccgaga

SEQ ID NO: 638092 - DNA, 20 bp, mouse
gagtgctcctctgtctcgcc

SEQ ID NO: 638093 - DNA, 20 bp, mouse
gagtgggtgaggtgtagggc

SEQ ID NO: 638094 - DNA, 20 bp, mouse
gttgtcgcaaggcttatgtc

SEQ ID NO: 638095 - DNA, 20 bp, mouse
gtaggaacgggttggcttgt

SEQ ID NO: 638096 - DNA, 20 bp, mouse
ggtggcggggagcccttcag

SEQ ID NO: 638097 - DNA, 20 bp, mouse
gtggggcgctggccgacgtg

SEQ ID NO: 638098 - DNA, 20 bp, mouse
ggatcttagaccaccagaat

SEQ ID NO: 638099 - DNA, 20 bp, mouse
gcggccagcgccccaccctc

SEQ ID NO: 638100 - DNA, 20 bp, mouse
gccggagcggggcctaggac

SEQ ID NO: 638101 - DNA, 20 bp, mouse
gaggcgctcaactacagact

SEQ ID NO: 638102 - DNA, 20 bp, mouse
gaccgcgaagagaggcgggt

SEQ ID NO: 638103 - DNA, 20 bp, mouse
gccccagggaccgcgaagag

SEQ ID NO: 638104 - DNA, 20 bp, mouse
gctgcctcacgccccgccat

SEQ ID NO: 638105 - DNA, 20 bp, mouse
gagggctccccgccacacgt

SEQ ID NO: 638106 - DNA, 20 bp, mouse
ggctaactggccaattcaga

SEQ ID NO: 638107 - DNA, 20 bp, mouse
gtggctggtacacatttctt

SEQ ID NO: 638108 - DNA, 20 bp, mouse
ggttaagcctacaaaacgtg

SEQ ID NO: 638109 - DNA, 20 bp, mouse
gtacttcccaagctcattag

SEQ ID NO: 638110 - DNA, 20 bp, mouse
ggtgtaccagccaaaatccc

SEQ ID NO: 638111 - DNA, 20 bp, mouse
gcaagaacctcacgttttgt

SEQ ID NO: 638112 - DNA, 20 bp, mouse
gggtttggttcggctgtttt

SEQ ID NO: 638113 - DNA, 20 bp, mouse
ggtagcaagagagaagtcac

SEQ ID NO: 638114 - DNA, 20 bp, mouse
ggaagtaaacatagttaagt

SEQ ID NO: 638115 - DNA, 20 bp, mouse
gctcttgctacatgaccttg

SEQ ID NO: 638116 - DNA, 20 bp, mouse
gcaaacctctatgctttaat

SEQ ID NO: 638117 - DNA, 20 bp, mouse
gctttaatgggtatagactc

SEQ ID NO: 638118 - DNA, 20 bp, mouse
ggggtatagactctggttgc

SEQ ID NO: 638119 - DNA, 20 bp, mouse
gtatacccattaaagcatag

SEQ ID NO: 638120 - DNA, 20 bp, mouse
gcattctgttgcttctgctt

SEQ ID NO: 638121 - DNA, 20 bp, mouse
gctgacctggcattggacat

SEQ ID NO: 638122 - DNA, 20 bp, mouse
ggcaaaacatggaccaatga

SEQ ID NO: 638123 - DNA, 20 bp, mouse
ggggaaagcatgatgtagag

SEQ ID NO: 638124 - DNA, 20 bp, mouse
gtagctggtaatactgtgaa

SEQ ID NO: 638125 - DNA, 20 bp, mouse
ggcaacagaatggttcattt

SEQ ID NO: 638126 - DNA, 20 bp, mouse
gcgttcagacaatattgaaa

SEQ ID NO: 638127 - DNA, 20 bp, mouse
gtcttcaaaaagttgttatt

SEQ ID NO: 638128 - DNA, 20 bp, mouse
gttgtgaattagctcgacgt

SEQ ID NO: 638129 - DNA, 20 bp, mouse
gcatttgattgacacaatca

SEQ ID NO: 638130 - DNA, 20 bp, mouse
gacagctatagaaaaattct

SEQ ID NO: 638131 - DNA, 20 bp, mouse
gtgcttctttggattgataa

SEQ ID NO: 638132 - DNA, 20 bp, mouse
gaatctatcaaattctaatt

SEQ ID NO: 638133 - DNA, 20 bp, mouse
ggggatttatataaactaga

SEQ ID NO: 638134 - DNA, 20 bp, mouse
gggtttcttacaatgcaaaa

SEQ ID NO: 638135 - DNA, 20 bp, mouse
ggcattcatgcttgaattta

SEQ ID NO: 638136 - DNA, 20 bp, mouse
gaaaggggatagaatattcc

SEQ ID NO: 638137 - DNA, 20 bp, mouse
gccacaatggatcttgtcct

SEQ ID NO: 638138 - DNA, 20 bp, mouse
gacaaaccacagcactgttg

SEQ ID NO: 638139 - DNA, 20 bp, mouse
gaaaaacctcaacagtgctg

SEQ ID NO: 638140 - DNA, 20 bp, mouse
gacagtgctgtggtttgtgg

SEQ ID NO: 638141 - DNA, 20 bp, mouse
ggactatggtaatagaactc

SEQ ID NO: 638142 - DNA, 20 bp, mouse
gctctggagaggacagttga

SEQ ID NO: 638143 - DNA, 20 bp, mouse
gatctcatgaaatcagacct

SEQ ID NO: 638144 - DNA, 20 bp, mouse
gctacttgtctgatatacaa

SEQ ID NO: 638145 - DNA, 20 bp, mouse
gtggcaccaaagagccacaa

SEQ ID NO: 638146 - DNA, 20 bp, mouse
gtgaacagctgcaagctctg

SEQ ID NO: 638147 - DNA, 20 bp, mouse
ggttaagtgaaggagatcgt

SEQ ID NO: 638148 - DNA, 20 bp, mouse
ggtagaagatggctggagag

SEQ ID NO: 638149 - DNA, 20 bp, mouse
gtcactggatataaaggcat

SEQ ID NO: 638150 - DNA, 20 bp, mouse
gagcttgcagctgttcagga

SEQ ID NO: 638151 - DNA, 20 bp, mouse
gaagggaggattaggagacc

SEQ ID NO: 638152 - DNA, 20 bp, mouse
gtattctagagcaacgtcag

SEQ ID NO: 638153 - DNA, 20 bp, mouse
ggctgtcccgaggaaagaac

SEQ ID NO: 638154 - DNA, 20 bp, mouse
gcaggaatgtagaagatggc

SEQ ID NO: 638155 - DNA, 20 bp, mouse
gagtggaagaagggaggatt

SEQ ID NO: 638156 - DNA, 20 bp, mouse
gggctcacaggcatggtagt

SEQ ID NO: 638157 - DNA, 20 bp, mouse
gagcagtgggcgtggctcac

SEQ ID NO: 638158 - DNA, 20 bp, mouse
gtgggcgtggctcacaggca

SEQ ID NO: 638159 - DNA, 20 bp, mouse
gagggaatgacggagctcag

SEQ ID NO: 638160 - DNA, 20 bp, mouse
ggaaagcatcgcgatgggag

SEQ ID NO: 638161 - DNA, 20 bp, mouse
gggtagtgggagtggctagc

SEQ ID NO: 638162 - DNA, 20 bp, mouse
gatctcagcggaccaggaaa

SEQ ID NO: 638163 - DNA, 20 bp, mouse
gaagtccgcagtgcatggga

SEQ ID NO: 638164 - DNA, 20 bp, mouse
gaagggaaccaggtgaccat

SEQ ID NO: 638165 - DNA, 20 bp, mouse
gctagagaggaatgactaag

SEQ ID NO: 638166 - DNA, 20 bp, mouse
gagggaaagggtggggacta

SEQ ID NO: 638167 - DNA, 20 bp, mouse
ggtgattggcatgttgacaa

SEQ ID NO: 638168 - DNA, 20 bp, mouse
gggcgacatgcacttggggt

SEQ ID NO: 638169 - DNA, 20 bp, mouse
gtctactctgagtccttggt

SEQ ID NO: 638170 - DNA, 20 bp, mouse
gctgtcccaagtcaatagaa

SEQ ID NO: 638171 - DNA, 20 bp, mouse
gagtgccacttggccacttg

SEQ ID NO: 638172 - DNA, 20 bp, mouse
gcacagtgggcggagcaagg

SEQ ID NO: 638173 - DNA, 20 bp, mouse
gtcacagtgcatggggttca

SEQ ID NO: 638174 - DNA, 20 bp, mouse
gcatgccaatcacagtggga

SEQ ID NO: 638175 - DNA, 20 bp, mouse
gaaggtcagacagtgccact

SEQ ID NO: 638176 - DNA, 20 bp, mouse
gtgacagtaagggcggggtt

SEQ ID NO: 638177 - DNA, 20 bp, mouse
gtggggtaaagtctaaagtg

SEQ ID NO: 638178 - DNA, 20 bp, mouse
gtcttgctgtcaacatgcaa

SEQ ID NO: 638179 - DNA, 20 bp, mouse
gatgttgacagcaagagctg

SEQ ID NO: 638180 - DNA, 20 bp, mouse
gcttggtagagagtgaaagg

SEQ ID NO: 638181 - DNA, 20 bp, mouse
gaagtgactgtttgacagta

SEQ ID NO: 638182 - DNA, 20 bp, mouse
ggactgtttgacagtaaggg

SEQ ID NO: 638183 - DNA, 20 bp, mouse
gcaacatgcaaaggagacac

SEQ ID NO: 638184 - DNA, 20 bp, mouse
ggagttgtatagccctgttc

SEQ ID NO: 638185 - DNA, 20 bp, mouse
gggccagtggttccctgggg

SEQ ID NO: 638186 - DNA, 20 bp, mouse
gagggatccgccaagtacca

SEQ ID NO: 638187 - DNA, 20 bp, mouse
ggcgccatacgcgcgagggg

SEQ ID NO: 638188 - DNA, 20 bp, mouse
ggcccagcggggctcgtcct

SEQ ID NO: 638189 - DNA, 20 bp, mouse
gcctctgagccattaactga

SEQ ID NO: 638190 - DNA, 20 bp, mouse
gcgtatggcgccctggtact

SEQ ID NO: 638191 - DNA, 20 bp, mouse
gtgggtctcggggtcgggaa

SEQ ID NO: 638192 - DNA, 20 bp, mouse
ggtgccagaatcaagttaga

SEQ ID NO: 638193 - DNA, 20 bp, mouse
gtctcgccctatcctagcga

SEQ ID NO: 638194 - DNA, 20 bp, mouse
ggtctcggggtcgggaaggg

SEQ ID NO: 638195 - DNA, 20 bp, mouse
gcatacgcgcgaggggcggc

SEQ ID NO: 638196 - DNA, 20 bp, mouse
ggctcggcccacctgtgcgt

SEQ ID NO: 638197 - DNA, 20 bp, mouse
gaaggcggtggaccgctcgg

SEQ ID NO: 638198 - DNA, 20 bp, mouse
ggccacgccctctaaggcgg

SEQ ID NO: 638199 - DNA, 20 bp, mouse
ggctgggcacgccccctcgt

SEQ ID NO: 638200 - DNA, 20 bp, mouse
gtgggccgagccctggtgct

SEQ ID NO: 638201 - DNA, 20 bp, mouse
gggcccacctgtgcgttggt

SEQ ID NO: 638202 - DNA, 20 bp, mouse
gccacctgtgcgttggttgg

SEQ ID NO: 638203 - DNA, 20 bp, mouse
ggcacaggtgggccgagccc

SEQ ID NO: 638204 - DNA, 20 bp, mouse
gttggttggtggagtctcgt

SEQ ID NO: 638205 - DNA, 20 bp, mouse
gactccaccaaccaacgcac

SEQ ID NO: 638206 - DNA, 20 bp, mouse
gttaagctgggacttgaatg

SEQ ID NO: 638207 - DNA, 20 bp, mouse
gaatccagactcttgaggta

SEQ ID NO: 638208 - DNA, 20 bp, mouse
gtctctgagaggagagtagt

SEQ ID NO: 638209 - DNA, 20 bp, mouse
gaaaggagtgggagtcaaac

SEQ ID NO: 638210 - DNA, 20 bp, mouse
gtgggagtcaaacaggcaaa

SEQ ID NO: 638211 - DNA, 20 bp, mouse
gaggctaatcccacagaagc

SEQ ID NO: 638212 - DNA, 20 bp, mouse
gaaaagcttgcttgctgcaa

SEQ ID NO: 638213 - DNA, 20 bp, mouse
gaaggaagatcgtttaattc

SEQ ID NO: 638214 - DNA, 20 bp, mouse
gtttttctttagttcaaagt

SEQ ID NO: 638215 - DNA, 20 bp, mouse
ggctctaataatgccagtaa

SEQ ID NO: 638216 - DNA, 20 bp, mouse
gcaaggtcaggacgacagtg

SEQ ID NO: 638217 - DNA, 20 bp, mouse
gagaaaactaactttgtagt

SEQ ID NO: 638218 - DNA, 20 bp, mouse
gcttagaattttaagtttca

SEQ ID NO: 638219 - DNA, 20 bp, mouse
gagtctgctcatacaaggtc

SEQ ID NO: 638220 - DNA, 20 bp, mouse
gaggcaagtctgctcataca

SEQ ID NO: 638221 - DNA, 20 bp, mouse
gcagacaggcaaaaattcac

SEQ ID NO: 638222 - DNA, 20 bp, mouse
gcagatagacacatggttag

SEQ ID NO: 638223 - DNA, 20 bp, mouse
gttaaggacagatagacaca

SEQ ID NO: 638224 - DNA, 20 bp, mouse
gtaaaatgcctacttcacaa

SEQ ID NO: 638225 - DNA, 20 bp, mouse
gttaatgtagaaagattaat

SEQ ID NO: 638226 - DNA, 20 bp, mouse
ggggaggtaccgggtgagta

SEQ ID NO: 638227 - DNA, 20 bp, mouse
gcaaggatatggggaggtac

SEQ ID NO: 638228 - DNA, 20 bp, mouse
gagggaaatgagtcttgaga

SEQ ID NO: 638229 - DNA, 20 bp, mouse
gactagagccctcttgacag

SEQ ID NO: 638230 - DNA, 20 bp, mouse
gctaagggacagtacagtgt

SEQ ID NO: 638231 - DNA, 20 bp, mouse
ggcctactgccatactcacc

SEQ ID NO: 638232 - DNA, 20 bp, mouse
gcctcagccccctggatctc

SEQ ID NO: 638233 - DNA, 20 bp, mouse
gtggagagaaaggtcttacc

SEQ ID NO: 638234 - DNA, 20 bp, mouse
gaccgggtgagtatggcagt

SEQ ID NO: 638235 - DNA, 20 bp, mouse
gccattcttagggtcatctc

SEQ ID NO: 638236 - DNA, 20 bp, mouse
gggtaactttagtgacacat

SEQ ID NO: 638237 - DNA, 20 bp, mouse
gatgcagtctggttttttta

SEQ ID NO: 638238 - DNA, 20 bp, mouse
gatgggctacatatgcagtc

SEQ ID NO: 638239 - DNA, 20 bp, mouse
gtagtcaagtattttatttt

SEQ ID NO: 638240 - DNA, 20 bp, mouse
gtaataatttataaataagt

SEQ ID NO: 638241 - DNA, 20 bp, mouse
gatctacagtgatgtcactt

SEQ ID NO: 638242 - DNA, 20 bp, mouse
gatttaatttaacaatattg

SEQ ID NO: 638243 - DNA, 20 bp, mouse
ggtttacaagattacttagc

SEQ ID NO: 638244 - DNA, 20 bp, mouse
gtttttaaggcatgtgtctt

SEQ ID NO: 638245 - DNA, 20 bp, mouse
gtaatttataaataagttgg

SEQ ID NO: 638246 - DNA, 20 bp, mouse
gcggaacaatgggcagttcg

SEQ ID NO: 638247 - DNA, 20 bp, mouse
ggtgttgcctaggagacgaa

SEQ ID NO: 638248 - DNA, 20 bp, mouse
gctgccctgaaagatttcgg

SEQ ID NO: 638249 - DNA, 20 bp, mouse
ggggcagttcggggcttagg

SEQ ID NO: 638250 - DNA, 20 bp, mouse
gtaggagacgaagggtgagt

SEQ ID NO: 638251 - DNA, 20 bp, mouse
ggaggtacagaatcagtcgc

SEQ ID NO: 638252 - DNA, 20 bp, mouse
ggactgattctgtacctcga

SEQ ID NO: 638253 - DNA, 20 bp, mouse
gggcggggcgtgcaggcggt

SEQ ID NO: 638254 - DNA, 20 bp, mouse
ggctctgccctgaaagattt

SEQ ID NO: 638255 - DNA, 20 bp, mouse
gaatgcgccaagtagccaga

SEQ ID NO: 638256 - DNA, 20 bp, mouse
gtgagaggtaggtagatcca

SEQ ID NO: 638257 - DNA, 20 bp, mouse
ggacaatgggttcaaagaaa

SEQ ID NO: 638258 - DNA, 20 bp, mouse
gggtaggtagatccagggtt

SEQ ID NO: 638259 - DNA, 20 bp, mouse
gctgaagggctagaggacaa

SEQ ID NO: 638260 - DNA, 20 bp, mouse
gttcaaagaaagggtgaaag

SEQ ID NO: 638261 - DNA, 20 bp, mouse
gggagcaagccatggctcgt

SEQ ID NO: 638262 - DNA, 20 bp, mouse
gaactctagcccacgagcca

SEQ ID NO: 638263 - DNA, 20 bp, mouse
ggggggctgtgctttcacac

SEQ ID NO: 638264 - DNA, 20 bp, mouse
gaaagctactcccaaagcag

SEQ ID NO: 638265 - DNA, 20 bp, mouse
gagggcccattctgcagata

SEQ ID NO: 638266 - DNA, 20 bp, mouse
gaagagcagctcgctgcgga

SEQ ID NO: 638267 - DNA, 20 bp, mouse
ggcggaaggacgagcacaaa

SEQ ID NO: 638268 - DNA, 20 bp, mouse
gtagccggccgggaagaccc

SEQ ID NO: 638269 - DNA, 20 bp, mouse
ggccgcgcccacgtccctta

SEQ ID NO: 638270 - DNA, 20 bp, mouse
gcagtagccttcaaatgaaa

SEQ ID NO: 638271 - DNA, 20 bp, mouse
gctgcctgccacgtgaccca

SEQ ID NO: 638272 - DNA, 20 bp, mouse
gggaaccttcacggctctgc

SEQ ID NO: 638273 - DNA, 20 bp, mouse
gtggcggccgtaagggacgt

SEQ ID NO: 638274 - DNA, 20 bp, mouse
gcaggatgtggcggccgtaa

SEQ ID NO: 638275 - DNA, 20 bp, mouse
gctcccagaaagccacgcgc

SEQ ID NO: 638276 - DNA, 20 bp, mouse
gagatctagggtacagttga

SEQ ID NO: 638277 - DNA, 20 bp, mouse
gctcctgggtcttagatcta

SEQ ID NO: 638278 - DNA, 20 bp, mouse
gaggcagactcacaatgaga

SEQ ID NO: 638279 - DNA, 20 bp, mouse
gtgaccatagaatcagaatg

SEQ ID NO: 638280 - DNA, 20 bp, mouse
gagaatggggctgtgactca

SEQ ID NO: 638281 - DNA, 20 bp, mouse
gccgggagactacctgagta

SEQ ID NO: 638282 - DNA, 20 bp, mouse
gagggcatgtgtcagagcga

SEQ ID NO: 638283 - DNA, 20 bp, mouse
ggccctgcatgcagacgaag

SEQ ID NO: 638284 - DNA, 20 bp, mouse
gtgaagtgaggcaggctcct

SEQ ID NO: 638285 - DNA, 20 bp, mouse
gtgactcaaggcagtattcc

SEQ ID NO: 638286 - DNA, 20 bp, mouse
gctgaaggggttgtctagtt

SEQ ID NO: 638287 - DNA, 20 bp, mouse
ggggttgtctagttgggaag

SEQ ID NO: 638288 - DNA, 20 bp, mouse
gatagaagcggtcttgggag

SEQ ID NO: 638289 - DNA, 20 bp, mouse
gctctcgaagaacttctgaa

SEQ ID NO: 638290 - DNA, 20 bp, mouse
gcaaaactagcaactgctga

SEQ ID NO: 638291 - DNA, 20 bp, mouse
gggaggatagaagcggtctt

SEQ ID NO: 638292 - DNA, 20 bp, mouse
gcctcatcctgtacagtata

SEQ ID NO: 638293 - DNA, 20 bp, mouse
gatggctccatatactgtac

SEQ ID NO: 638294 - DNA, 20 bp, mouse
gtacttgtgctgtgtagggt

SEQ ID NO: 638295 - DNA, 20 bp, mouse
gagagcgatagaagtcagcg

SEQ ID NO: 638296 - DNA, 20 bp, mouse
gagacactatacaaagacca

SEQ ID NO: 638297 - DNA, 20 bp, mouse
gaagggagaggatgctaatc

SEQ ID NO: 638298 - DNA, 20 bp, mouse
gtcttgactggatagctgaa

SEQ ID NO: 638299 - DNA, 20 bp, mouse
gtctcgctagctgccctgat

SEQ ID NO: 638300 - DNA, 20 bp, mouse
gcagctagcgagacacccgt

SEQ ID NO: 638301 - DNA, 20 bp, mouse
gaacggtagcacgctccaac

SEQ ID NO: 638302 - DNA, 20 bp, mouse
gtggcgaccagcagccaatc

SEQ ID NO: 638303 - DNA, 20 bp, mouse
gtggagcgtgctaccgttag

SEQ ID NO: 638304 - DNA, 20 bp, mouse
gtgctaatcaggcttcccca

SEQ ID NO: 638305 - DNA, 20 bp, mouse
gttggctgctggtcgccatg

SEQ ID NO: 638306 - DNA, 20 bp, mouse
gagtcccagggatcgaatgt

SEQ ID NO: 638307 - DNA, 20 bp, mouse
ggaagtggcaggagcgtcac

SEQ ID NO: 638308 - DNA, 20 bp, mouse
gcacaggccacatggatcac

SEQ ID NO: 638309 - DNA, 20 bp, mouse
gatgagctggctggaagtct

SEQ ID NO: 638310 - DNA, 20 bp, mouse
gctggaagtctaggaaacaa

SEQ ID NO: 638311 - DNA, 20 bp, mouse
ggacatgtagaagccatgac

SEQ ID NO: 638312 - DNA, 20 bp, mouse
gagcttccacaatccactaa

SEQ ID NO: 638313 - DNA, 20 bp, mouse
gcacctggcctttgatgagc

SEQ ID NO: 638314 - DNA, 20 bp, mouse
gcaaagtgtagtgttgagga

SEQ ID NO: 638315 - DNA, 20 bp, mouse
gtaagccttctgtgcatgta

SEQ ID NO: 638316 - DNA, 20 bp, mouse
ggagctgtcgctctggagat

SEQ ID NO: 638317 - DNA, 20 bp, mouse
gcaagggtgctactgtttgt

SEQ ID NO: 638318 - DNA, 20 bp, mouse
gctaacacagcactatccac

SEQ ID NO: 638319 - DNA, 20 bp, mouse
gctgtgttaggcattgacta

SEQ ID NO: 638320 - DNA, 20 bp, mouse
gccccgtggagttcacactg

SEQ ID NO: 638321 - DNA, 20 bp, mouse
gccccctggtgtccacgaga

SEQ ID NO: 638322 - DNA, 20 bp, mouse
ggtgtggtatggttgagatg

SEQ ID NO: 638323 - DNA, 20 bp, mouse
gaggcataagggaagtagga

SEQ ID NO: 638324 - DNA, 20 bp, mouse
ggagatgggcttctgtgaca

SEQ ID NO: 638325 - DNA, 20 bp, mouse
gtccctctcgtggacaccag

SEQ ID NO: 638326 - DNA, 20 bp, mouse
gccagcgccgcaccgtgctg

SEQ ID NO: 638327 - DNA, 20 bp, mouse
ggaggagccagacggacttg

SEQ ID NO: 638328 - DNA, 20 bp, mouse
gctccgggacaccacacctc

SEQ ID NO: 638329 - DNA, 20 bp, mouse
gaagcctagcccggccctcg

SEQ ID NO: 638330 - DNA, 20 bp, mouse
gcccgcaccccaagtccgtc

SEQ ID NO: 638331 - DNA, 20 bp, mouse
gaggtctctcagtgcggtga

SEQ ID NO: 638332 - DNA, 20 bp, mouse
ggagagaccttagggcccgg

SEQ ID NO: 638333 - DNA, 20 bp, mouse
ggctcctccgcagcacggtg

SEQ ID NO: 638334 - DNA, 20 bp, mouse
gaccttagggcccggaggtg

SEQ ID NO: 638335 - DNA, 20 bp, mouse
ggccctaaggtctctcagtg

SEQ ID NO: 638336 - DNA, 20 bp, mouse
gcatactacggagaacagaa

SEQ ID NO: 638337 - DNA, 20 bp, mouse
gaatggaggagactgctggt

SEQ ID NO: 638338 - DNA, 20 bp, mouse
gtgtgtgtgttaagtcaact

SEQ ID NO: 638339 - DNA, 20 bp, mouse
gacagaatggaggagactgc

SEQ ID NO: 638340 - DNA, 20 bp, mouse
gttactacagtcttttttga

SEQ ID NO: 638341 - DNA, 20 bp, mouse
gattctactatgacaagcaa

SEQ ID NO: 638342 - DNA, 20 bp, mouse
gcttgtcatagtagaatcca

SEQ ID NO: 638343 - DNA, 20 bp, mouse
gaatgatagattgccagaag

SEQ ID NO: 638344 - DNA, 20 bp, mouse
ggtgtcatcacaatagcaaa

SEQ ID NO: 638345 - DNA, 20 bp, mouse
gagatctcctagcaactgag

SEQ ID NO: 638346 - DNA, 20 bp, mouse
gagccaaggccctacttgac

SEQ ID NO: 638347 - DNA, 20 bp, mouse
ggggcttctgggaagatggt

SEQ ID NO: 638348 - DNA, 20 bp, mouse
gtggctatgtgggtttccta

SEQ ID NO: 638349 - DNA, 20 bp, mouse
ggcaataatgagagagacag

SEQ ID NO: 638350 - DNA, 20 bp, mouse
gaacctaaactctatggcta

SEQ ID NO: 638351 - DNA, 20 bp, mouse
gggaagatggtgggccgttc

SEQ ID NO: 638352 - DNA, 20 bp, mouse
gaactcagggggtaaaggtg

SEQ ID NO: 638353 - DNA, 20 bp, mouse
ggttctgggcctgtcaagta

SEQ ID NO: 638354 - DNA, 20 bp, mouse
ggggagtgagtaccaggtgt

SEQ ID NO: 638355 - DNA, 20 bp, mouse
gaaaaccacctaaggagctt

SEQ ID NO: 638356 - DNA, 20 bp, mouse
gcccgcccgcggggctcgtt

SEQ ID NO: 638357 - DNA, 20 bp, mouse
gcgtgcgcccccggagggac

SEQ ID NO: 638358 - DNA, 20 bp, mouse
gcaccccgggccgcccgctt

SEQ ID NO: 638359 - DNA, 20 bp, mouse
gcggggtgcgctaacgagca

SEQ ID NO: 638360 - DNA, 20 bp, mouse
ggggccctccgaacccgggc

SEQ ID NO: 638361 - DNA, 20 bp, mouse
gccgcccgcttcggtccgga

SEQ ID NO: 638362 - DNA, 20 bp, mouse
gccgctgacagctgccaggg

SEQ ID NO: 638363 - DNA, 20 bp, mouse
gggccccccagcccggggtg

SEQ ID NO: 638364 - DNA, 20 bp, mouse
gcgtgccggcccgggttcgg

SEQ ID NO: 638365 - DNA, 20 bp, mouse
gggtccccattcccagtcct

SEQ ID NO: 638366 - DNA, 20 bp, mouse
gttacccaggacactgctgt

SEQ ID NO: 638367 - DNA, 20 bp, mouse
ggcccaacggggcccctcca

SEQ ID NO: 638368 - DNA, 20 bp, mouse
gcgcctatacagactgtaaa

SEQ ID NO: 638369 - DNA, 20 bp, mouse
gtataggcggcgctccactt

SEQ ID NO: 638370 - DNA, 20 bp, mouse
gaccaagggcaggaacccac

SEQ ID NO: 638371 - DNA, 20 bp, mouse
gtgggaccagcaggacgccc

SEQ ID NO: 638372 - DNA, 20 bp, mouse
gaagctgaggtcttagactg

SEQ ID NO: 638373 - DNA, 20 bp, mouse
gggtcctggccaacttaccc

SEQ ID NO: 638374 - DNA, 20 bp, mouse
gtccctggaggggccccgtt

SEQ ID NO: 638375 - DNA, 20 bp, mouse
gagtggctcaaggctgaggc

SEQ ID NO: 638376 - DNA, 20 bp, mouse
gtcttccaggagctccaacc

SEQ ID NO: 638377 - DNA, 20 bp, mouse
gaggtcagggcaagctgaac

SEQ ID NO: 638378 - DNA, 20 bp, mouse
ggtagctggctcagtaagtt

SEQ ID NO: 638379 - DNA, 20 bp, mouse
gttggctcaaacttactccc

SEQ ID NO: 638380 - DNA, 20 bp, mouse
gcacaccaggttggagctcc

SEQ ID NO: 638381 - DNA, 20 bp, mouse
gagacttccctcactgtcct

SEQ ID NO: 638382 - DNA, 20 bp, mouse
gtagccatttgaccacatgg

SEQ ID NO: 638383 - DNA, 20 bp, mouse
gtgttcttcgatttcttgag

SEQ ID NO: 638384 - DNA, 20 bp, mouse
ggagctgcaagggcaacatc

SEQ ID NO: 638385 - DNA, 20 bp, mouse
gacagaggcattatgaagta

SEQ ID NO: 638386 - DNA, 20 bp, mouse
gcgcgctcactgcccggcgg

SEQ ID NO: 638387 - DNA, 20 bp, mouse
gctagcgcggggctggtggg

SEQ ID NO: 638388 - DNA, 20 bp, mouse
ggggctggtgggcgggcgaa

SEQ ID NO: 638389 - DNA, 20 bp, mouse
gcaacacccaccctgcgggt

SEQ ID NO: 638390 - DNA, 20 bp, mouse
gccggcgcgcgctcactgcc

SEQ ID NO: 638391 - DNA, 20 bp, mouse
gagaggtgggcggctagcgc

SEQ ID NO: 638392 - DNA, 20 bp, mouse
gcgaagggccggccccgccg

SEQ ID NO: 638393 - DNA, 20 bp, mouse
gtgggcggctagcgcggggc

SEQ ID NO: 638394 - DNA, 20 bp, mouse
gggcgggaggagccggcctc

SEQ ID NO: 638395 - DNA, 20 bp, mouse
gcggccccgccgcgggcgga

SEQ ID NO: 638396 - DNA, 20 bp, mouse
gaagagacaggggagagcta

SEQ ID NO: 638397 - DNA, 20 bp, mouse
gaggggtcatgagttcacaa

SEQ ID NO: 638398 - DNA, 20 bp, mouse
gaaagggaagggagagccat

SEQ ID NO: 638399 - DNA, 20 bp, mouse
gggaagataaagcgtagagt

SEQ ID NO: 638400 - DNA, 20 bp, mouse
gaatgtgatgatgtaagaaa

SEQ ID NO: 638401 - DNA, 20 bp, mouse
gtggagacatggaaagggaa

SEQ ID NO: 638402 - DNA, 20 bp, mouse
gcaaggtggagacatggaaa

SEQ ID NO: 638403 - DNA, 20 bp, mouse
gctagagaaagcatgtgaga

SEQ ID NO: 638404 - DNA, 20 bp, mouse
ggggaaggaaattgagaggg

SEQ ID NO: 638405 - DNA, 20 bp, mouse
gccatggggaagaaagagac

SEQ ID NO: 638406 - DNA, 20 bp, mouse
ggcactggatccagcctgta

SEQ ID NO: 638407 - DNA, 20 bp, mouse
gagggttggcagagaggggt

SEQ ID NO: 638408 - DNA, 20 bp, mouse
gaggctggatccagtgcccg

SEQ ID NO: 638409 - DNA, 20 bp, mouse
gtccgggaacaggggcggac

SEQ ID NO: 638410 - DNA, 20 bp, mouse
ggcccggggcgcctagcctc

SEQ ID NO: 638411 - DNA, 20 bp, mouse
ggtctgaggtagtttagggt

SEQ ID NO: 638412 - DNA, 20 bp, mouse
gccaggtctgaggtagttta

SEQ ID NO: 638413 - DNA, 20 bp, mouse
ggtcagtccgggaacagggg

SEQ ID NO: 638414 - DNA, 20 bp, mouse
gcctgttcccggactgacag

SEQ ID NO: 638415 - DNA, 20 bp, mouse
gggcctgaggctaggcgccc

SEQ ID NO: 638416 - DNA, 20 bp, mouse
gtacacaaggacaccctctc

SEQ ID NO: 638417 - DNA, 20 bp, mouse
ggggctgtccctgccagaga

SEQ ID NO: 638418 - DNA, 20 bp, mouse
gtgcatagaaaagacctctg

SEQ ID NO: 638419 - DNA, 20 bp, mouse
gctcctcacgagaattgcgt

SEQ ID NO: 638420 - DNA, 20 bp, mouse
gagagggcgctgcactatca

SEQ ID NO: 638421 - DNA, 20 bp, mouse
gcaaggacaccctctctggc

SEQ ID NO: 638422 - DNA, 20 bp, mouse
gggccaacgcaattctcgtg

SEQ ID NO: 638423 - DNA, 20 bp, mouse
gtacacaaaactaggctcac

SEQ ID NO: 638424 - DNA, 20 bp, mouse
gcgccgcatggcgggagctc

SEQ ID NO: 638425 - DNA, 20 bp, mouse
gagactcgctctgaaacaca

SEQ ID NO: 638426 - DNA, 20 bp, mouse
gcatcagaagtatggaactt

SEQ ID NO: 638427 - DNA, 20 bp, mouse
ggtagccttggccaaaacat

SEQ ID NO: 638428 - DNA, 20 bp, mouse
gcattgacagatagtgtaaa

SEQ ID NO: 638429 - DNA, 20 bp, mouse
ggaaccgggtcaaagaggaa

SEQ ID NO: 638430 - DNA, 20 bp, mouse
gctgaagtgtcagcttccag

SEQ ID NO: 638431 - DNA, 20 bp, mouse
gcaggtccctttaagagtat

SEQ ID NO: 638432 - DNA, 20 bp, mouse
gatagagaaccgggtcaaag

SEQ ID NO: 638433 - DNA, 20 bp, mouse
gattacctatgttttggcca

SEQ ID NO: 638434 - DNA, 20 bp, mouse
gtgtaaccgatactcttaaa

SEQ ID NO: 638435 - DNA, 20 bp, mouse
gtaccatcaaaatagtaact

SEQ ID NO: 638436 - DNA, 20 bp, mouse
ggcgtgagctaaataattcc

SEQ ID NO: 638437 - DNA, 20 bp, mouse
ggttctagtaaccatggtaa

SEQ ID NO: 638438 - DNA, 20 bp, mouse
gcctgtgctctactggacaa

SEQ ID NO: 638439 - DNA, 20 bp, mouse
gctccaggttctagtaacca

SEQ ID NO: 638440 - DNA, 20 bp, mouse
gtcgataagcccggctgtgc

SEQ ID NO: 638441 - DNA, 20 bp, mouse
gaggatttgtgggttctcca

SEQ ID NO: 638442 - DNA, 20 bp, mouse
gtcacgcagttgcagctcca

SEQ ID NO: 638443 - DNA, 20 bp, mouse
gaagtgtgagctaacactga

SEQ ID NO: 638444 - DNA, 20 bp, mouse
gcttgatacctcaagcttcc

SEQ ID NO: 638445 - DNA, 20 bp, mouse
gcttggagcgttaccgtaac

SEQ ID NO: 638446 - DNA, 20 bp, mouse
gcataggcggagcatctcgg

SEQ ID NO: 638447 - DNA, 20 bp, mouse
gggttcgttgctgacgtcat

SEQ ID NO: 638448 - DNA, 20 bp, mouse
ggtcgggagaaggaaagcgt

SEQ ID NO: 638449 - DNA, 20 bp, mouse
gtccgccgaccgcaggggtc

SEQ ID NO: 638450 - DNA, 20 bp, mouse
gaaagacgggtccgaggccc

SEQ ID NO: 638451 - DNA, 20 bp, mouse
gtcagcccgctacggaaaga

SEQ ID NO: 638452 - DNA, 20 bp, mouse
gggacccgtctttccgtagc

SEQ ID NO: 638453 - DNA, 20 bp, mouse
ggacgtcagcaacgaaccct

SEQ ID NO: 638454 - DNA, 20 bp, mouse
gagccacgcggtgactgcgc

SEQ ID NO: 638455 - DNA, 20 bp, mouse
gagcgctgaccgtggatctg

SEQ ID NO: 638456 - DNA, 20 bp, mouse
gtccgcccgcgctcagtcct

SEQ ID NO: 638457 - DNA, 20 bp, mouse
gagcgcagctgcagcctaag

SEQ ID NO: 638458 - DNA, 20 bp, mouse
gtccgcgcgctcggccgctt

SEQ ID NO: 638459 - DNA, 20 bp, mouse
ggaggcagctgcatcccccg

SEQ ID NO: 638460 - DNA, 20 bp, mouse
ggctgtgcgccgagccgcga

SEQ ID NO: 638461 - DNA, 20 bp, mouse
gcctacacgccagcccgggg

SEQ ID NO: 638462 - DNA, 20 bp, mouse
gccgggctggcgtgtaggga

SEQ ID NO: 638463 - DNA, 20 bp, mouse
ggggaccgagactgcgacca

SEQ ID NO: 638464 - DNA, 20 bp, mouse
gtcggcggcgcggcggtgga

SEQ ID NO: 638465 - DNA, 20 bp, mouse
ggggatgcagctgcctcccc

SEQ ID NO: 638466 - DNA, 20 bp, mouse
gtagcccggggttgctaagg

SEQ ID NO: 638467 - DNA, 20 bp, mouse
gcaggcacttccggggtcgg

SEQ ID NO: 638468 - DNA, 20 bp, mouse
gtggtgagttccaacggagt

SEQ ID NO: 638469 - DNA, 20 bp, mouse
gcccggaagtgcctgcctac

SEQ ID NO: 638470 - DNA, 20 bp, mouse
ggataagtcgaggtgctgat

SEQ ID NO: 638471 - DNA, 20 bp, mouse
ggtcccgagcgggcaatccg

SEQ ID NO: 638472 - DNA, 20 bp, mouse
ggggctggctgtacatgaga

SEQ ID NO: 638473 - DNA, 20 bp, mouse
gagggaagcgcgaggctgga

SEQ ID NO: 638474 - DNA, 20 bp, mouse
gttggaggtgccaactccgt

SEQ ID NO: 638475 - DNA, 20 bp, mouse
gtggctccacccagccacga

SEQ ID NO: 638476 - DNA, 20 bp, mouse
gcatactaaaagctcggaaa

SEQ ID NO: 638477 - DNA, 20 bp, mouse
gttgacacttgatgctgtgg

SEQ ID NO: 638478 - DNA, 20 bp, mouse
gacacagcatactaaaagct

SEQ ID NO: 638479 - DNA, 20 bp, mouse
gtaacgccacctccattgac

SEQ ID NO: 638480 - DNA, 20 bp, mouse
gaacgctgatgacagaacac

SEQ ID NO: 638481 - DNA, 20 bp, mouse
gtagcaactgcatctataca

SEQ ID NO: 638482 - DNA, 20 bp, mouse
ggctcatacttcaagtgttg

SEQ ID NO: 638483 - DNA, 20 bp, mouse
gatcttgacacttgatgctg

SEQ ID NO: 638484 - DNA, 20 bp, mouse
gatgcagttgctaaaagagg

SEQ ID NO: 638485 - DNA, 20 bp, mouse
ggagatccaagcatatgtta

SEQ ID NO: 638486 - DNA, 20 bp, mouse
gctggcgtccgggtaaagta

SEQ ID NO: 638487 - DNA, 20 bp, mouse
ggcagaaaaacagccctggc

SEQ ID NO: 638488 - DNA, 20 bp, mouse
gtcttctccggaatacccag

SEQ ID NO: 638489 - DNA, 20 bp, mouse
gccaccatgtaccggtctga

SEQ ID NO: 638490 - DNA, 20 bp, mouse
gacagaagaaagcttagaag

SEQ ID NO: 638491 - DNA, 20 bp, mouse
ggctggggcctactcctcac

SEQ ID NO: 638492 - DNA, 20 bp, mouse
gcccccgcgtgtgccattcc

SEQ ID NO: 638493 - DNA, 20 bp, mouse
ggatgtaaaacagcctgcca

SEQ ID NO: 638494 - DNA, 20 bp, mouse
gctcagaggtcaccaaaacg

SEQ ID NO: 638495 - DNA, 20 bp, mouse
ggtaggccccagcccaaccg

SEQ ID NO: 638496 - DNA, 20 bp, mouse
gcaacagcaaggcttgagta

SEQ ID NO: 638497 - DNA, 20 bp, mouse
gggtggtactaggagaggaa

SEQ ID NO: 638498 - DNA, 20 bp, mouse
gacagtgagttggacagaag

SEQ ID NO: 638499 - DNA, 20 bp, mouse
gcaagcatgaagtcagtcgg

SEQ ID NO: 638500 - DNA, 20 bp, mouse
gaggaccatttctacaatga

SEQ ID NO: 638501 - DNA, 20 bp, mouse
gttggcaggtaaggggggat

SEQ ID NO: 638502 - DNA, 20 bp, mouse
ggaacgcccttaaatctcaa

SEQ ID NO: 638503 - DNA, 20 bp, mouse
gggtgcttcttggcaggtaa

SEQ ID NO: 638504 - DNA, 20 bp, mouse
gaagcgacgctggtaaacat

SEQ ID NO: 638505 - DNA, 20 bp, mouse
ggtgcgcatgcacaacagca

SEQ ID NO: 638506 - DNA, 20 bp, mouse
ggggaaggtgatgatgcctc

SEQ ID NO: 638507 - DNA, 20 bp, mouse
gtgatggaaagattgacagg

SEQ ID NO: 638508 - DNA, 20 bp, mouse
gtgtctatgcaggtgatcac

SEQ ID NO: 638509 - DNA, 20 bp, mouse
gcacattgctagcttgcctg

SEQ ID NO: 638510 - DNA, 20 bp, mouse
gaatatctgtgtgctattct

SEQ ID NO: 638511 - DNA, 20 bp, mouse
gctaccagctcagtctttag

SEQ ID NO: 638512 - DNA, 20 bp, mouse
gatacctctaaagactgagc

SEQ ID NO: 638513 - DNA, 20 bp, mouse
gtcaagaagcatgtctatgc

SEQ ID NO: 638514 - DNA, 20 bp, mouse
gtaatcagtcatgctgggga

SEQ ID NO: 638515 - DNA, 20 bp, mouse
gtgtgtaatcagtcatgctg

SEQ ID NO: 638516 - DNA, 20 bp, mouse
gagaggcggggactcactac

SEQ ID NO: 638517 - DNA, 20 bp, mouse
gaggggaatcacgcatgtgg

SEQ ID NO: 638518 - DNA, 20 bp, mouse
gggaagcgaccgcctagtcg

SEQ ID NO: 638519 - DNA, 20 bp, mouse
gtccccgcctctctccggag

SEQ ID NO: 638520 - DNA, 20 bp, mouse
ggtggccaagtatacaacat

SEQ ID NO: 638521 - DNA, 20 bp, mouse
gttacccgatgttgtatact

SEQ ID NO: 638522 - DNA, 20 bp, mouse
gcacaggggaatcacgcatg

SEQ ID NO: 638523 - DNA, 20 bp, mouse
gtctctgtcgagtttttctt

SEQ ID NO: 638524 - DNA, 20 bp, mouse
gcgcatgctctgtagcctcg

SEQ ID NO: 638525 - DNA, 20 bp, mouse
gcctagtcgcggtgcattct

SEQ ID NO: 638526 - DNA, 20 bp, mouse
gaataggctgccagggagcg

SEQ ID NO: 638527 - DNA, 20 bp, mouse
gggacagccgggaatgccaa

SEQ ID NO: 638528 - DNA, 20 bp, mouse
ggcggggcccttggcattcc

SEQ ID NO: 638529 - DNA, 20 bp, mouse
gtgggagccgccaagttcgg

SEQ ID NO: 638530 - DNA, 20 bp, mouse
ggcggcccctcgatccgggc

SEQ ID NO: 638531 - DNA, 20 bp, mouse
gcgtggcggcccctcgatcc

SEQ ID NO: 638532 - DNA, 20 bp, mouse
gccccaggagaagccgtcag

SEQ ID NO: 638533 - DNA, 20 bp, mouse
gccaccccgcccggatcgag

SEQ ID NO: 638534 - DNA, 20 bp, mouse
gtaggcccgaacaaaagacg

SEQ ID NO: 638535 - DNA, 20 bp, mouse
gcgaggggccgccacggagg

SEQ ID NO: 638536 - DNA, 20 bp, mouse
gggctgaaggctgacaagaa

SEQ ID NO: 638537 - DNA, 20 bp, mouse
ggtactcggtactggattta

SEQ ID NO: 638538 - DNA, 20 bp, mouse
gtcattcttaagtaggctga

SEQ ID NO: 638539 - DNA, 20 bp, mouse
gatggagcaaagcatctccc

SEQ ID NO: 638540 - DNA, 20 bp, mouse
ggtaaaacagtcactaatct

SEQ ID NO: 638541 - DNA, 20 bp, mouse
gacaatattcattcttaagt

SEQ ID NO: 638542 - DNA, 20 bp, mouse
gtcactaatctaggtcaatc

SEQ ID NO: 638543 - DNA, 20 bp, mouse
gttaggggtttcatagtact

SEQ ID NO: 638544 - DNA, 20 bp, mouse
gcaagaaaggtcttgaatcc

SEQ ID NO: 638545 - DNA, 20 bp, mouse
gctcccgggattgtgctgta

SEQ ID NO: 638546 - DNA, 20 bp, mouse
ggtgttgccaaggcagatta

SEQ ID NO: 638547 - DNA, 20 bp, mouse
gcaaggcagattatggttga

SEQ ID NO: 638548 - DNA, 20 bp, mouse
ggactgaactatggtaggag

SEQ ID NO: 638549 - DNA, 20 bp, mouse
gctgaatctttgtactatac

SEQ ID NO: 638550 - DNA, 20 bp, mouse
gtcagcagtttttctgtaaa

SEQ ID NO: 638551 - DNA, 20 bp, mouse
gaaaggacagggatcattta

SEQ ID NO: 638552 - DNA, 20 bp, mouse
gtgatagactgaactatggt

SEQ ID NO: 638553 - DNA, 20 bp, mouse
gaggaatggaaggttctaag

SEQ ID NO: 638554 - DNA, 20 bp, mouse
gggaatgaaatctgcatggt

SEQ ID NO: 638555 - DNA, 20 bp, mouse
gcagattgctaaggaatgga

SEQ ID NO: 638556 - DNA, 20 bp, mouse
gctaacagaacgatgtgcgg

SEQ ID NO: 638557 - DNA, 20 bp, mouse
gagaaggcggagcatgcgta

SEQ ID NO: 638558 - DNA, 20 bp, mouse
gggaccgcgtggcaaactgg

SEQ ID NO: 638559 - DNA, 20 bp, mouse
gcgcggcagtgtgacgtctg

SEQ ID NO: 638560 - DNA, 20 bp, mouse
gcatgcgtaaggtgtgtagt

SEQ ID NO: 638561 - DNA, 20 bp, mouse
gtccccgcgagtgtgaggaa

SEQ ID NO: 638562 - DNA, 20 bp, mouse
ggctcctgctctcccgtctg

SEQ ID NO: 638563 - DNA, 20 bp, mouse
gcaaactggcggtgggagac

SEQ ID NO: 638564 - DNA, 20 bp, mouse
ggcgcggcggctggattcgt

SEQ ID NO: 638565 - DNA, 20 bp, mouse
gggcgcggaggagggactca

SEQ ID NO: 638566 - DNA, 20 bp, mouse
ggtgccacctaccttctggg

SEQ ID NO: 638567 - DNA, 20 bp, mouse
gcccgtgttggtgagactca

SEQ ID NO: 638568 - DNA, 20 bp, mouse
gggcaccattccaacggttg

SEQ ID NO: 638569 - DNA, 20 bp, mouse
ggtgggaagacccacccaga

SEQ ID NO: 638570 - DNA, 20 bp, mouse
ggatgcaggggaaagtgttc

SEQ ID NO: 638571 - DNA, 20 bp, mouse
gccaacccatcactgtctaa

SEQ ID NO: 638572 - DNA, 20 bp, mouse
gccaaacagtaaaaaagcta

SEQ ID NO: 638573 - DNA, 20 bp, mouse
gggtccctcaaccgttggaa

SEQ ID NO: 638574 - DNA, 20 bp, mouse
gcattctgtagaggatgcag

SEQ ID NO: 638575 - DNA, 20 bp, mouse
gagccagaggttgacacact

SEQ ID NO: 638576 - DNA, 20 bp, mouse
gtgaagggtaagatgttagc

SEQ ID NO: 638577 - DNA, 20 bp, mouse
gtctgaggtaaagacaagat

SEQ ID NO: 638578 - DNA, 20 bp, mouse
gattgggtagaagctatgaa

SEQ ID NO: 638579 - DNA, 20 bp, mouse
gcagccctgcagacgattcc

SEQ ID NO: 638580 - DNA, 20 bp, mouse
ggggtaaatgtcatgggaag

SEQ ID NO: 638581 - DNA, 20 bp, mouse
gtaagatgttagctggttaa

SEQ ID NO: 638582 - DNA, 20 bp, mouse
gatgagaaagtaagattctg

SEQ ID NO: 638583 - DNA, 20 bp, mouse
gctgacagcgctggtttctt

SEQ ID NO: 638584 - DNA, 20 bp, mouse
gataaacatgtcctgggcac

SEQ ID NO: 638585 - DNA, 20 bp, mouse
gggagctacctgtaaacaac

SEQ ID NO: 638586 - DNA, 20 bp, mouse
gccggacagtcgtgataacc

SEQ ID NO: 638587 - DNA, 20 bp, mouse
ggctggtcgcatgaaacttg

SEQ ID NO: 638588 - DNA, 20 bp, mouse
gcacgactgtccggagccac

SEQ ID NO: 638589 - DNA, 20 bp, mouse
gagagggcagatcccggaag

SEQ ID NO: 638590 - DNA, 20 bp, mouse
gctcctctcctagagctcac

SEQ ID NO: 638591 - DNA, 20 bp, mouse
gggtacaggatgatcggcag

SEQ ID NO: 638592 - DNA, 20 bp, mouse
gcccctgaaggatcgaacag

SEQ ID NO: 638593 - DNA, 20 bp, mouse
gtgccttcctgagcccgaca

SEQ ID NO: 638594 - DNA, 20 bp, mouse
gacccctgttcgatccttca

SEQ ID NO: 638595 - DNA, 20 bp, mouse
gcaggggttgtccactaaat

SEQ ID NO: 638596 - DNA, 20 bp, mouse
gcaaagtaggtggatgaatc

SEQ ID NO: 638597 - DNA, 20 bp, mouse
ggacaagaggtgaatcccat

SEQ ID NO: 638598 - DNA, 20 bp, mouse
gtgctgtggcagcccaaagt

SEQ ID NO: 638599 - DNA, 20 bp, mouse
gagagctgggattctgtctc

SEQ ID NO: 638600 - DNA, 20 bp, mouse
gaagaggtgaatcccatagg

SEQ ID NO: 638601 - DNA, 20 bp, mouse
gccaaagtacctggcaactg

SEQ ID NO: 638602 - DNA, 20 bp, mouse
gaggccccacccaaagtacc

SEQ ID NO: 638603 - DNA, 20 bp, mouse
gcacaaaggaagactgccaa

SEQ ID NO: 638604 - DNA, 20 bp, mouse
gggcaccagtgaaaaccatg

SEQ ID NO: 638605 - DNA, 20 bp, mouse
gttgccaggtactttgggtg

SEQ ID NO: 638606 - DNA, 20 bp, mouse
gaaggaagccaggatcctat

SEQ ID NO: 638607 - DNA, 20 bp, mouse
ggaagccaggatcctatggg

SEQ ID NO: 638608 - DNA, 20 bp, mouse
gtaactcgtcagggacatgt

SEQ ID NO: 638609 - DNA, 20 bp, mouse
ggcaaagttggcatctgaga

SEQ ID NO: 638610 - DNA, 20 bp, mouse
gatgagaagctaactcgtca

SEQ ID NO: 638611 - DNA, 20 bp, mouse
gttatcctcccataggatcc

SEQ ID NO: 638612 - DNA, 20 bp, mouse
gctgagaatggagactgtgc

SEQ ID NO: 638613 - DNA, 20 bp, mouse
gaacaggttgttttcaggta

SEQ ID NO: 638614 - DNA, 20 bp, mouse
ggagtcccgaggaaaacaca

SEQ ID NO: 638615 - DNA, 20 bp, mouse
gcaccaggaagtagtaataa

SEQ ID NO: 638616 - DNA, 20 bp, mouse
gcaggagctgggcttcatga

SEQ ID NO: 638617 - DNA, 20 bp, mouse
gacctggcacctctgggtgg

SEQ ID NO: 638618 - DNA, 20 bp, mouse
gtgggagatggggcaattgg

SEQ ID NO: 638619 - DNA, 20 bp, mouse
gaggacctggcacctctggg

SEQ ID NO: 638620 - DNA, 20 bp, mouse
gccacccagcatgcactctc

SEQ ID NO: 638621 - DNA, 20 bp, mouse
gggcagcccacagtcacaca

SEQ ID NO: 638622 - DNA, 20 bp, mouse
gaggcagagctctgggagat

SEQ ID NO: 638623 - DNA, 20 bp, mouse
gtgtgtcttcatgtcctaca

SEQ ID NO: 638624 - DNA, 20 bp, mouse
gagaagaggcatggtgcaag

SEQ ID NO: 638625 - DNA, 20 bp, mouse
gacatgaagacacagagccc

SEQ ID NO: 638626 - DNA, 20 bp, mouse
gtgcctgaatgtggacatgg

SEQ ID NO: 638627 - DNA, 20 bp, mouse
gttgaggaccattatgagat

SEQ ID NO: 638628 - DNA, 20 bp, mouse
gctcctctcccatctcataa

SEQ ID NO: 638629 - DNA, 20 bp, mouse
gtggccttctgaaggattct

SEQ ID NO: 638630 - DNA, 20 bp, mouse
ggaagcctcttgggagaagt

SEQ ID NO: 638631 - DNA, 20 bp, mouse
gtgaatgtggacatggcggc

SEQ ID NO: 638632 - DNA, 20 bp, mouse
ggggaacctgaagtctggcg

SEQ ID NO: 638633 - DNA, 20 bp, mouse
gcatctgggaacctgaagtc

SEQ ID NO: 638634 - DNA, 20 bp, mouse
ggtaccaccagaaaactctg

SEQ ID NO: 638635 - DNA, 20 bp, mouse
gtgctccgaggcactgtccc

SEQ ID NO: 638636 - DNA, 20 bp, mouse
ggactatgctgggaggactt

SEQ ID NO: 638637 - DNA, 20 bp, mouse
gactagtactatgactatgc

SEQ ID NO: 638638 - DNA, 20 bp, mouse
gggttcatcaagtatgatgg

SEQ ID NO: 638639 - DNA, 20 bp, mouse
ggtactatgactatgctggg

SEQ ID NO: 638640 - DNA, 20 bp, mouse
gagtcatagtactagtcagc

SEQ ID NO: 638641 - DNA, 20 bp, mouse
gtcctggattgcttatgcag

SEQ ID NO: 638642 - DNA, 20 bp, mouse
gtcaagtatgatggtggtat

SEQ ID NO: 638643 - DNA, 20 bp, mouse
ggggttacatataggaatat

SEQ ID NO: 638644 - DNA, 20 bp, mouse
gtcctctgcataagcaatcc

SEQ ID NO: 638645 - DNA, 20 bp, mouse
gatcggttcatcaagtatga

SEQ ID NO: 638646 - DNA, 20 bp, mouse
gcaaaggccggcatccaccc

SEQ ID NO: 638647 - DNA, 20 bp, mouse
ggcagggaaggactcccagt

SEQ ID NO: 638648 - DNA, 20 bp, mouse
ggaggtgctggtccaaggta

SEQ ID NO: 638649 - DNA, 20 bp, mouse
gcgcactggcaccactctca

SEQ ID NO: 638650 - DNA, 20 bp, mouse
gcgcttgcccggtacaccgt

SEQ ID NO: 638651 - DNA, 20 bp, mouse
gctacccttggaagagtatt

SEQ ID NO: 638652 - DNA, 20 bp, mouse
gacagcagcctcaggatagt

SEQ ID NO: 638653 - DNA, 20 bp, mouse
gaccctggcttcataccgac

SEQ ID NO: 638654 - DNA, 20 bp, mouse
gcctctcagaagtgacccaa

SEQ ID NO: 638655 - DNA, 20 bp, mouse
gtcaggatagtgggccaagg

SEQ ID NO: 638656 - DNA, 20 bp, mouse
gtggagaccgggattgagtg

SEQ ID NO: 638657 - DNA, 20 bp, mouse
gggcacagaggctcagtttg

SEQ ID NO: 638658 - DNA, 20 bp, mouse
gcctctgtgcccataaagta

SEQ ID NO: 638659 - DNA, 20 bp, mouse
gtggggtctccatactttat

SEQ ID NO: 638660 - DNA, 20 bp, mouse
gaagcagtgggatgctgtca

SEQ ID NO: 638661 - DNA, 20 bp, mouse
gtcaccgagcgcctggagac

SEQ ID NO: 638662 - DNA, 20 bp, mouse
gtggagaccccactcaatcc

SEQ ID NO: 638663 - DNA, 20 bp, mouse
gtatgtgtatgagatgaagg

SEQ ID NO: 638664 - DNA, 20 bp, mouse
gtcacctgcagcacctacag

SEQ ID NO: 638665 - DNA, 20 bp, mouse
ggaagtgcaccgaaaaaagg

SEQ ID NO: 638666 - DNA, 20 bp, mouse
gaaagcggtgccagaagaaa

SEQ ID NO: 638667 - DNA, 20 bp, mouse
gaccccgcgcaccacgtggt

SEQ ID NO: 638668 - DNA, 20 bp, mouse
ggggtgctggatgcagaaag

SEQ ID NO: 638669 - DNA, 20 bp, mouse
gggcgctcccccaggtggag

SEQ ID NO: 638670 - DNA, 20 bp, mouse
gagtctaagccctttggctg

SEQ ID NO: 638671 - DNA, 20 bp, mouse
ggatcacattgacgcggggt

SEQ ID NO: 638672 - DNA, 20 bp, mouse
ggtcaaaaaaatcccaaaat

SEQ ID NO: 638673 - DNA, 20 bp, mouse
gtctcaaggccccagccaaa

SEQ ID NO: 638674 - DNA, 20 bp, mouse
ggggggggcgctcccccagg

SEQ ID NO: 638675 - DNA, 20 bp, mouse
gggggggggggcgctccccc

SEQ ID NO: 638676 - DNA, 20 bp, mouse
gggaactctagagttgaacc

SEQ ID NO: 638677 - DNA, 20 bp, mouse
ggaatcttcaaaaggtgtca

SEQ ID NO: 638678 - DNA, 20 bp, mouse
gctggagagataaagagagt

SEQ ID NO: 638679 - DNA, 20 bp, mouse
gcatcacaaagcactacttc

SEQ ID NO: 638680 - DNA, 20 bp, mouse
gaaggaaaaggtactattag

SEQ ID NO: 638681 - DNA, 20 bp, mouse
gtgatgtcaaagactcataa

SEQ ID NO: 638682 - DNA, 20 bp, mouse
ggtgatgtcaacggttccct

SEQ ID NO: 638683 - DNA, 20 bp, mouse
ggttctgagaatgagtatat

SEQ ID NO: 638684 - DNA, 20 bp, mouse
gacttgttcactctagccta

SEQ ID NO: 638685 - DNA, 20 bp, mouse
gtttccatagagaatcttaa

SEQ ID NO: 638686 - DNA, 20 bp, mouse
gaccagatgtgtttggacga

SEQ ID NO: 638687 - DNA, 20 bp, mouse
gtgaaaaggagtgttaatcc

SEQ ID NO: 638688 - DNA, 20 bp, mouse
gtgggcacaacaggaactac

SEQ ID NO: 638689 - DNA, 20 bp, mouse
gggcctagccaatgagcaga

SEQ ID NO: 638690 - DNA, 20 bp, mouse
gcatagacacatgtaagaga

SEQ ID NO: 638691 - DNA, 20 bp, mouse
ggggttaacacatactgctt

SEQ ID NO: 638692 - DNA, 20 bp, mouse
ggatgatatctctcttcatt

SEQ ID NO: 638693 - DNA, 20 bp, mouse
gccttgagtctctcaaacgc

SEQ ID NO: 638694 - DNA, 20 bp, mouse
ggggtgcaggagctttgaaa

SEQ ID NO: 638695 - DNA, 20 bp, mouse
gctggggaacaattatcatg

SEQ ID NO: 638696 - DNA, 20 bp, mouse
gagcaggcactgcacactta

SEQ ID NO: 638697 - DNA, 20 bp, mouse
gttaggggagcgctgctctc

SEQ ID NO: 638698 - DNA, 20 bp, mouse
gagggtctctgtactaccta

SEQ ID NO: 638699 - DNA, 20 bp, mouse
gtccccggtaagacaggaga

SEQ ID NO: 638700 - DNA, 20 bp, mouse
gtgtcatagcatatggaggg

SEQ ID NO: 638701 - DNA, 20 bp, mouse
gaattctatgcccatcttga

SEQ ID NO: 638702 - DNA, 20 bp, mouse
gcatcttgagggcatagact

SEQ ID NO: 638703 - DNA, 20 bp, mouse
gtcctgtcttaccggggagg

SEQ ID NO: 638704 - DNA, 20 bp, mouse
ggtgcctgctcacataccat

SEQ ID NO: 638705 - DNA, 20 bp, mouse
gaatgtcccccgaggtggga

SEQ ID NO: 638706 - DNA, 20 bp, mouse
gggacaacaggtggtctctg

SEQ ID NO: 638707 - DNA, 20 bp, mouse
gcccaccccgccgtcgtcct

SEQ ID NO: 638708 - DNA, 20 bp, mouse
gtggtctctggggccagtaa

SEQ ID NO: 638709 - DNA, 20 bp, mouse
gtggcagcggtagtcagccc

SEQ ID NO: 638710 - DNA, 20 bp, mouse
gctacccccgtgcatggcag

SEQ ID NO: 638711 - DNA, 20 bp, mouse
gaccaatcgaatctgatcta

SEQ ID NO: 638712 - DNA, 20 bp, mouse
gtcccaggacgacggcgggg

SEQ ID NO: 638713 - DNA, 20 bp, mouse
gggagggcgggcaccgttac

SEQ ID NO: 638714 - DNA, 20 bp, mouse
gccgccgtcgtcctgggaac

SEQ ID NO: 638715 - DNA, 20 bp, mouse
gcaaacaagacccggttccc

SEQ ID NO: 638716 - DNA, 20 bp, mouse
ggaagcctgtctaaccccag

SEQ ID NO: 638717 - DNA, 20 bp, mouse
ggacacagcaggaccagcca

SEQ ID NO: 638718 - DNA, 20 bp, mouse
gcaaaatggggcccatgaaa

SEQ ID NO: 638719 - DNA, 20 bp, mouse
ggaatggatggtaagatcaa

SEQ ID NO: 638720 - DNA, 20 bp, mouse
gatctcccaggaatcagaag

SEQ ID NO: 638721 - DNA, 20 bp, mouse
gaagagcagcccagtccttg

SEQ ID NO: 638722 - DNA, 20 bp, mouse
gtccccaaaagtatgtctgc

SEQ ID NO: 638723 - DNA, 20 bp, mouse
gtcaaaggacttggcccatc

SEQ ID NO: 638724 - DNA, 20 bp, mouse
ggggtctcttctttcctgat

SEQ ID NO: 638725 - DNA, 20 bp, mouse
ggggctgctcttgacacagc

SEQ ID NO: 638726 - DNA, 20 bp, mouse
gacagtggtgaggggtcttg

SEQ ID NO: 638727 - DNA, 20 bp, mouse
gcataaccgctctactgggg

SEQ ID NO: 638728 - DNA, 20 bp, mouse
ggggtcttggggtgtaggcc

SEQ ID NO: 638729 - DNA, 20 bp, mouse
ggtgaggggtcttggggtgt

SEQ ID NO: 638730 - DNA, 20 bp, mouse
ggggctagcggaatggctct

SEQ ID NO: 638731 - DNA, 20 bp, mouse
gcatccttggggctcaatgg

SEQ ID NO: 638732 - DNA, 20 bp, mouse
gctgaccataacagcaacag

SEQ ID NO: 638733 - DNA, 20 bp, mouse
gtctactggggaggtgagga

SEQ ID NO: 638734 - DNA, 20 bp, mouse
gaggcccaaaccagtgtgca

SEQ ID NO: 638735 - DNA, 20 bp, mouse
gatggtcagtgtcatccttg

SEQ ID NO: 638736 - DNA, 20 bp, mouse
gaacccaagtatgggaggat

SEQ ID NO: 638737 - DNA, 20 bp, mouse
ggcgcccattggctccccgg

SEQ ID NO: 638738 - DNA, 20 bp, mouse
gggaaccgcgcagcccgctc

SEQ ID NO: 638739 - DNA, 20 bp, mouse
gccgttgcccaggcaactga

SEQ ID NO: 638740 - DNA, 20 bp, mouse
gtaaggaaccctacaccttt

SEQ ID NO: 638741 - DNA, 20 bp, mouse
ggtgagttaccagctgttac

SEQ ID NO: 638742 - DNA, 20 bp, mouse
gacaagcccctcagttgcct

SEQ ID NO: 638743 - DNA, 20 bp, mouse
ggcgcctccggggagccaat

SEQ ID NO: 638744 - DNA, 20 bp, mouse
gaaccctacaccttttgggc

SEQ ID NO: 638745 - DNA, 20 bp, mouse
gtctcaaagaacccaagtat

SEQ ID NO: 638746 - DNA, 20 bp, mouse
gggaaggtggatagatgctc

SEQ ID NO: 638747 - DNA, 20 bp, mouse
ggaaggggcgacttaaagtg

SEQ ID NO: 638748 - DNA, 20 bp, mouse
gtagcccagcctcgagtgga

SEQ ID NO: 638749 - DNA, 20 bp, mouse
ggggctagaaacgaacctgg

SEQ ID NO: 638750 - DNA, 20 bp, mouse
gaggaaatgtggttccgact

SEQ ID NO: 638751 - DNA, 20 bp, mouse
gtggttccgacttggggctc

SEQ ID NO: 638752 - DNA, 20 bp, mouse
gcgtgcctgatggtggaggc

SEQ ID NO: 638753 - DNA, 20 bp, mouse
gcgcgcgtgcctgatggtgg

SEQ ID NO: 638754 - DNA, 20 bp, mouse
gacccttccggcgcttgcga

SEQ ID NO: 638755 - DNA, 20 bp, mouse
gcatgcgcgcgcgtgcctga

SEQ ID NO: 638756 - DNA, 20 bp, mouse
gaaactctcctcaccttctg

SEQ ID NO: 638757 - DNA, 20 bp, mouse
gagaacatttgtccgataga

SEQ ID NO: 638758 - DNA, 20 bp, mouse
gaacttcagatatccacaga

SEQ ID NO: 638759 - DNA, 20 bp, mouse
gtgtggatatctgaagttta

SEQ ID NO: 638760 - DNA, 20 bp, mouse
gcattctaaacgataatcaa

SEQ ID NO: 638761 - DNA, 20 bp, mouse
ggttcttatagatgcctaac

SEQ ID NO: 638762 - DNA, 20 bp, mouse
gaacagaagaaaagtagcga

SEQ ID NO: 638763 - DNA, 20 bp, mouse
ggacagacatagtccgaata

SEQ ID NO: 638764 - DNA, 20 bp, mouse
gacacttgatgtttgttctg

SEQ ID NO: 638765 - DNA, 20 bp, mouse
gtatgtctgtccttctgtac

SEQ ID NO: 638766 - DNA, 20 bp, mouse
gtaggagtgcaatgacactt

SEQ ID NO: 638767 - DNA, 20 bp, mouse
ggagtgcaatgacactttgg

SEQ ID NO: 638768 - DNA, 20 bp, mouse
gataggacttgactatgagc

SEQ ID NO: 638769 - DNA, 20 bp, mouse
gggtctcagaaccctcaata

SEQ ID NO: 638770 - DNA, 20 bp, mouse
gtacactaatggctaaagct

SEQ ID NO: 638771 - DNA, 20 bp, mouse
gaacacactgggataaatct

SEQ ID NO: 638772 - DNA, 20 bp, mouse
ggaagtggaatcaacacact

SEQ ID NO: 638773 - DNA, 20 bp, mouse
gcattgcactcctacactaa

SEQ ID NO: 638774 - DNA, 20 bp, mouse
gcagcacctggatatataca

SEQ ID NO: 638775 - DNA, 20 bp, mouse
gtaacagtcaataagatagc

SEQ ID NO: 638776 - DNA, 20 bp, mouse
ggggatgaactcttatgctc

SEQ ID NO: 638777 - DNA, 20 bp, mouse
gtaagagttcatcccagata

SEQ ID NO: 638778 - DNA, 20 bp, mouse
gttgctgcatcctccctatc

SEQ ID NO: 638779 - DNA, 20 bp, mouse
gatgcagcaagatgcagtca

SEQ ID NO: 638780 - DNA, 20 bp, mouse
gaagatgcagtcatggcagg

SEQ ID NO: 638781 - DNA, 20 bp, mouse
gtggggacagagtgtccaat

SEQ ID NO: 638782 - DNA, 20 bp, mouse
gcaggaccaaggttacttat

SEQ ID NO: 638783 - DNA, 20 bp, mouse
gatgggcgaaaaggtcacgc

SEQ ID NO: 638784 - DNA, 20 bp, mouse
ggagttcatcccagataggg

SEQ ID NO: 638785 - DNA, 20 bp, mouse
ggtctggggaagaagccgtg

SEQ ID NO: 638786 - DNA, 20 bp, mouse
gcaaacaaccctgtgagcaa

SEQ ID NO: 638787 - DNA, 20 bp, mouse
gaccctgtgagcaatggaac

SEQ ID NO: 638788 - DNA, 20 bp, mouse
gtattcctgggaggttgaag

SEQ ID NO: 638789 - DNA, 20 bp, mouse
gcaaatagatacagttacat

SEQ ID NO: 638790 - DNA, 20 bp, mouse
gcagggctggtgcctgacat

SEQ ID NO: 638791 - DNA, 20 bp, mouse
gggattcttaatacgatctt

SEQ ID NO: 638792 - DNA, 20 bp, mouse
gttcctgttccattgctcac

SEQ ID NO: 638793 - DNA, 20 bp, mouse
ggtttaggaagtagggttac

SEQ ID NO: 638794 - DNA, 20 bp, mouse
gcagagagctgcaaacatct

SEQ ID NO: 638795 - DNA, 20 bp, mouse
gtatgtagggcttcattatg

SEQ ID NO: 638796 - DNA, 20 bp, mouse
gttaaacccaccagaagatt

SEQ ID NO: 638797 - DNA, 20 bp, mouse
gtctgaccatacctcatgtt

SEQ ID NO: 638798 - DNA, 20 bp, mouse
ggaacacatggtaaaccagt

SEQ ID NO: 638799 - DNA, 20 bp, mouse
gtctggtgggtttaaaaggt

SEQ ID NO: 638800 - DNA, 20 bp, mouse
gtgaagttctcctaatcttc

SEQ ID NO: 638801 - DNA, 20 bp, mouse
ggttctcctaatcttctggt

SEQ ID NO: 638802 - DNA, 20 bp, mouse
gatggtcagacctttcaact

SEQ ID NO: 638803 - DNA, 20 bp, mouse
gactgggaatattctaatgt

SEQ ID NO: 638804 - DNA, 20 bp, mouse
gtagaatattcccagttgaa

SEQ ID NO: 638805 - DNA, 20 bp, mouse
gaatgagaagacaaatgatg

SEQ ID NO: 638806 - DNA, 20 bp, mouse
gcgcgcagagcaagagagaa

SEQ ID NO: 638807 - DNA, 20 bp, mouse
gccagtcaaggttacatgtt

SEQ ID NO: 638808 - DNA, 20 bp, mouse
gctctgcgcgcccggcgctc

SEQ ID NO: 638809 - DNA, 20 bp, mouse
ggctcctaaagatgtaagat

SEQ ID NO: 638810 - DNA, 20 bp, mouse
gtaaagatgtaagattgggg

SEQ ID NO: 638811 - DNA, 20 bp, mouse
gcatgtaaccttgactggac

SEQ ID NO: 638812 - DNA, 20 bp, mouse
gacaaacataaaaaaggagg

SEQ ID NO: 638813 - DNA, 20 bp, mouse
gctttaggagccagagcgcc

SEQ ID NO: 638814 - DNA, 20 bp, mouse
gaaaacaaacataaaaaagg

SEQ ID NO: 638815 - DNA, 20 bp, mouse
gaaaaaaacaaacataaaaa

SEQ ID NO: 638816 - DNA, 20 bp, mouse
gatagagtggggcaattcat

SEQ ID NO: 638817 - DNA, 20 bp, mouse
ggacaagatgggatcagttg

SEQ ID NO: 638818 - DNA, 20 bp, mouse
gccccactctatgacaagat

SEQ ID NO: 638819 - DNA, 20 bp, mouse
ggatgtgtcagagagtaaac

SEQ ID NO: 638820 - DNA, 20 bp, mouse
gactcagatgtcaaggtcta

SEQ ID NO: 638821 - DNA, 20 bp, mouse
gagtcccctcctattgtgac

SEQ ID NO: 638822 - DNA, 20 bp, mouse
gcacaataggaggggactca

SEQ ID NO: 638823 - DNA, 20 bp, mouse
gacatccagtcacaatagga

SEQ ID NO: 638824 - DNA, 20 bp, mouse
gctaaaggaaaagtggtgct

SEQ ID NO: 638825 - DNA, 20 bp, mouse
gatcccatcttgtcatagag

SEQ ID NO: 638826 - DNA, 20 bp, mouse
gccaaatggaaaatattcta

SEQ ID NO: 638827 - DNA, 20 bp, mouse
gtgaaaggcatgagtttgcc

SEQ ID NO: 638828 - DNA, 20 bp, mouse
gccggtagttagaaagtgaa

SEQ ID NO: 638829 - DNA, 20 bp, mouse
gtgtacgtggattagcaacg

SEQ ID NO: 638830 - DNA, 20 bp, mouse
gcactcaagacatgacaacc

SEQ ID NO: 638831 - DNA, 20 bp, mouse
gatacctcagacagctgcaa

SEQ ID NO: 638832 - DNA, 20 bp, mouse
gttgatgtcaatgatggcac

SEQ ID NO: 638833 - DNA, 20 bp, mouse
gagctgtctgaggtatacgg

SEQ ID NO: 638834 - DNA, 20 bp, mouse
gaaagaagcgtcatagatct

SEQ ID NO: 638835 - DNA, 20 bp, mouse
gtttcctttgcagctgtctg

SEQ ID NO: 638836 - DNA, 20 bp, mouse
gctatgtgatgggacaaaca

SEQ ID NO: 638837 - DNA, 20 bp, mouse
ggggtggaggtcattttacg

SEQ ID NO: 638838 - DNA, 20 bp, mouse
gtccacccatacacttttat

SEQ ID NO: 638839 - DNA, 20 bp, mouse
gacctataaaagtgtatggg

SEQ ID NO: 638840 - DNA, 20 bp, mouse
ggatttcagcgctatgtgat

SEQ ID NO: 638841 - DNA, 20 bp, mouse
gtgacatgtagcaaatagga

SEQ ID NO: 638842 - DNA, 20 bp, mouse
gtaccctggcactccacacg

SEQ ID NO: 638843 - DNA, 20 bp, mouse
gccactgacatgtagcaaat

SEQ ID NO: 638844 - DNA, 20 bp, mouse
gcatacacttttataggttc

SEQ ID NO: 638845 - DNA, 20 bp, mouse
ggagtaaactactctcctat

SEQ ID NO: 638846 - DNA, 20 bp, mouse
gcatagtggtggggaatcgg

SEQ ID NO: 638847 - DNA, 20 bp, mouse
gtctcccagactctcagctg

SEQ ID NO: 638848 - DNA, 20 bp, mouse
ggtaacccaaactggatgtt

SEQ ID NO: 638849 - DNA, 20 bp, mouse
gaggtggccactataaaaac

SEQ ID NO: 638850 - DNA, 20 bp, mouse
gtcctgcctttggtcactgt

SEQ ID NO: 638851 - DNA, 20 bp, mouse
ggtcccagtgacacagaaga

SEQ ID NO: 638852 - DNA, 20 bp, mouse
gctctgcagcggctacaaga

SEQ ID NO: 638853 - DNA, 20 bp, mouse
ggccttgtttccatagtggt

SEQ ID NO: 638854 - DNA, 20 bp, mouse
gtggctgttaaaaacaaaca

SEQ ID NO: 638855 - DNA, 20 bp, mouse
gatccagtttgggttactaa

SEQ ID NO: 638856 - DNA, 20 bp, mouse
gaccaggcgccgggagggat

SEQ ID NO: 638857 - DNA, 20 bp, mouse
gagcccggcgaagagttcag

SEQ ID NO: 638858 - DNA, 20 bp, mouse
gcgggcgtccggccttcctg

SEQ ID NO: 638859 - DNA, 20 bp, mouse
gagggcgcatgtgtagtacc

SEQ ID NO: 638860 - DNA, 20 bp, mouse
ggtagtaccaggcgccggga

SEQ ID NO: 638861 - DNA, 20 bp, mouse
ggggtggggaactgtgcgat

SEQ ID NO: 638862 - DNA, 20 bp, mouse
gagaggtcaaagggcgttga

SEQ ID NO: 638863 - DNA, 20 bp, mouse
ggcccggcgccatgttgggt

SEQ ID NO: 638864 - DNA, 20 bp, mouse
gtgggcaggctgggcttccc

SEQ ID NO: 638865 - DNA, 20 bp, mouse
ggataagggcccggcatctg

SEQ ID NO: 638866 - DNA, 20 bp, mouse
gagaggcagtgaaatctcat

SEQ ID NO: 638867 - DNA, 20 bp, mouse
gaaccagctgtagtatgggg

SEQ ID NO: 638868 - DNA, 20 bp, mouse
gtgcgtgtggtgcggaggtg

SEQ ID NO: 638869 - DNA, 20 bp, mouse
gtacactcttcctgccttct

SEQ ID NO: 638870 - DNA, 20 bp, mouse
gccctccagtgagcgaggca

SEQ ID NO: 638871 - DNA, 20 bp, mouse
gcaacgccctccagtgagcg

SEQ ID NO: 638872 - DNA, 20 bp, mouse
gggttaaagctgtcttcttg

SEQ ID NO: 638873 - DNA, 20 bp, mouse
gctctccatgcctcgctcac

SEQ ID NO: 638874 - DNA, 20 bp, mouse
gtttaaccagctgtagtatg

SEQ ID NO: 638875 - DNA, 20 bp, mouse
gcatgggtacttctcgtcaa

SEQ ID NO: 638876 - DNA, 20 bp, mouse
gggtgtggcttgcttcaatc

SEQ ID NO: 638877 - DNA, 20 bp, mouse
ggctaggcgactgagagctc

SEQ ID NO: 638878 - DNA, 20 bp, mouse
gtggctccccactaggtttt

SEQ ID NO: 638879 - DNA, 20 bp, mouse
gagaaaaacacaagcgactg

SEQ ID NO: 638880 - DNA, 20 bp, mouse
gtggcttgcttcaatccggg

SEQ ID NO: 638881 - DNA, 20 bp, mouse
ggcagtaagtgtgctctgtt

SEQ ID NO: 638882 - DNA, 20 bp, mouse
ggggctttcgcagctgggtg

SEQ ID NO: 638883 - DNA, 20 bp, mouse
gagcaacgctggagtcacag

SEQ ID NO: 638884 - DNA, 20 bp, mouse
ggtagagccctaaacctagt

SEQ ID NO: 638885 - DNA, 20 bp, mouse
gtcctcaaacccaacagggc

SEQ ID NO: 638886 - DNA, 20 bp, mouse
gggcccgcgagtaggtgcgt

SEQ ID NO: 638887 - DNA, 20 bp, mouse
ggaaccgcatacagccacct

SEQ ID NO: 638888 - DNA, 20 bp, mouse
ggggcgcctgcgatcctccc

SEQ ID NO: 638889 - DNA, 20 bp, mouse
gggcgtgggccgctggaggc

SEQ ID NO: 638890 - DNA, 20 bp, mouse
gtgggcgcctggcccggtag

SEQ ID NO: 638891 - DNA, 20 bp, mouse
gcctcccaggtggctgtatg

SEQ ID NO: 638892 - DNA, 20 bp, mouse
gggaggcgggtgaagtgtca

SEQ ID NO: 638893 - DNA, 20 bp, mouse
gcgcctgcgatcctcccagg

SEQ ID NO: 638894 - DNA, 20 bp, mouse
gaacccgggtcgagtctcca

SEQ ID NO: 638895 - DNA, 20 bp, mouse
ggaggatcgcaggcgcccca

SEQ ID NO: 638896 - DNA, 20 bp, mouse
gaggactctaggagcacaag

SEQ ID NO: 638897 - DNA, 20 bp, mouse
gggtgagcttgacaatggga

SEQ ID NO: 638898 - DNA, 20 bp, mouse
gaaattcaggtctgtctcgt

SEQ ID NO: 638899 - DNA, 20 bp, mouse
gcacaagcggcgcaccactt

SEQ ID NO: 638900 - DNA, 20 bp, mouse
gacttaggctcgggtgctaa

SEQ ID NO: 638901 - DNA, 20 bp, mouse
gctcctagagtcctcatgga

SEQ ID NO: 638902 - DNA, 20 bp, mouse
gtgacattgaccgttctctt

SEQ ID NO: 638903 - DNA, 20 bp, mouse
gtgtgctcctagagtcctca

SEQ ID NO: 638904 - DNA, 20 bp, mouse
ggcctcccggcagagcggca

SEQ ID NO: 638905 - DNA, 20 bp, mouse
gaccctgccgctctgccggg

SEQ ID NO: 638906 - DNA, 20 bp, mouse
gtcgaggtagataatagaga

SEQ ID NO: 638907 - DNA, 20 bp, mouse
ggtaactatacggtggaagt

SEQ ID NO: 638908 - DNA, 20 bp, mouse
gagggctggtaactatacgg

SEQ ID NO: 638909 - DNA, 20 bp, mouse
gcagtcaagaatcctggtcg

SEQ ID NO: 638910 - DNA, 20 bp, mouse
gatacatgagagctatgagg

SEQ ID NO: 638911 - DNA, 20 bp, mouse
gaccagggctggtaactata

SEQ ID NO: 638912 - DNA, 20 bp, mouse
gacagtctatccaacattca

SEQ ID NO: 638913 - DNA, 20 bp, mouse
gttcttgactgtaagagccc

SEQ ID NO: 638914 - DNA, 20 bp, mouse
ggctctcatgtatattctgt

SEQ ID NO: 638915 - DNA, 20 bp, mouse
gcttggttcaccttgaatgt

SEQ ID NO: 638916 - DNA, 20 bp, mouse
gggagtggcagttgggacac

SEQ ID NO: 638917 - DNA, 20 bp, mouse
gtgaacgacagttaagggag

SEQ ID NO: 638918 - DNA, 20 bp, mouse
gagttaagggagtggcagtt

SEQ ID NO: 638919 - DNA, 20 bp, mouse
ggtgagtgatctttcttctc

SEQ ID NO: 638920 - DNA, 20 bp, mouse
gttcttctcaggaagagaga

SEQ ID NO: 638921 - DNA, 20 bp, mouse
ggaaggggtcagcaacccta

SEQ ID NO: 638922 - DNA, 20 bp, mouse
ggctagagacacagctctgt

SEQ ID NO: 638923 - DNA, 20 bp, mouse
ggggggtgggggagcgtata

SEQ ID NO: 638924 - DNA, 20 bp, mouse
ggggtcagcaaccctatggg

SEQ ID NO: 638925 - DNA, 20 bp, mouse
gaaaacagggcccctaatga

SEQ ID NO: 638926 - DNA, 20 bp, mouse
gcccaagaaaacaggacaat

SEQ ID NO: 638927 - DNA, 20 bp, mouse
gggaaaatggttgaagaaga

SEQ ID NO: 638928 - DNA, 20 bp, mouse
gctctccaggatctagtact

SEQ ID NO: 638929 - DNA, 20 bp, mouse
gactgtatccatatacaagg

SEQ ID NO: 638930 - DNA, 20 bp, mouse
gactagatcctggagagcac

SEQ ID NO: 638931 - DNA, 20 bp, mouse
ggatggctagtgttaacctt

SEQ ID NO: 638932 - DNA, 20 bp, mouse
gatatatagcccaagaaaac

SEQ ID NO: 638933 - DNA, 20 bp, mouse
gcaatcccagtactagatcc

SEQ ID NO: 638934 - DNA, 20 bp, mouse
gagcttaggtccttggacaa

SEQ ID NO: 638935 - DNA, 20 bp, mouse
gcacaataaatgctgcccga

SEQ ID NO: 638936 - DNA, 20 bp, mouse
gaaagaaagtggggtcagta

SEQ ID NO: 638937 - DNA, 20 bp, mouse
gaagggagtagggaactatc

SEQ ID NO: 638938 - DNA, 20 bp, mouse
gggtggtgtagaaaagaaag

SEQ ID NO: 638939 - DNA, 20 bp, mouse
gacctcaagaactaccttaa

SEQ ID NO: 638940 - DNA, 20 bp, mouse
ggggacaatttgttaatcaa

SEQ ID NO: 638941 - DNA, 20 bp, mouse
gtatacctagaaagtgacag

SEQ ID NO: 638942 - DNA, 20 bp, mouse
gaacaccagattgagcacta

SEQ ID NO: 638943 - DNA, 20 bp, mouse
gttagcctctgtcactttct

SEQ ID NO: 638944 - DNA, 20 bp, mouse
gaaaaccctagtgctcaatc

SEQ ID NO: 638945 - DNA, 20 bp, mouse
ggctacatatagtttatgga

SEQ ID NO: 638946 - DNA, 20 bp, mouse
ggccacaccgttacctataa

SEQ ID NO: 638947 - DNA, 20 bp, mouse
ggtgcagccattataggtaa

SEQ ID NO: 638948 - DNA, 20 bp, mouse
ggccattataggtaacggtg

SEQ ID NO: 638949 - DNA, 20 bp, mouse
gactgctataataaacacag

SEQ ID NO: 638950 - DNA, 20 bp, mouse
gagcgccatggcgatgtacc

SEQ ID NO: 638951 - DNA, 20 bp, mouse
ggaaagcactcctcacaact

SEQ ID NO: 638952 - DNA, 20 bp, mouse
gatagcagggctttacaaca

SEQ ID NO: 638953 - DNA, 20 bp, mouse
gatatcgagttcaattcctt

SEQ ID NO: 638954 - DNA, 20 bp, mouse
gtcatggcacatgtgagcct

SEQ ID NO: 638955 - DNA, 20 bp, mouse
gaaagcttaagtcaatagca

SEQ ID NO: 638956 - DNA, 20 bp, mouse
gcggaagtgccctgattttg

SEQ ID NO: 638957 - DNA, 20 bp, mouse
gctggtaggtggcaagtctc

SEQ ID NO: 638958 - DNA, 20 bp, mouse
gacagacaggtggagtgacc

SEQ ID NO: 638959 - DNA, 20 bp, mouse
ggttaagattgggagtctgg

SEQ ID NO: 638960 - DNA, 20 bp, mouse
ggagtgacctggagatgatg

SEQ ID NO: 638961 - DNA, 20 bp, mouse
gagctgacttgtagtgtccc

SEQ ID NO: 638962 - DNA, 20 bp, mouse
ggacttgtagtgtccctggt

SEQ ID NO: 638963 - DNA, 20 bp, mouse
gaggaaggtgaccctcagga

SEQ ID NO: 638964 - DNA, 20 bp, mouse
ggcacttccgcatcatctcc

SEQ ID NO: 638965 - DNA, 20 bp, mouse
gaagaaaaaaggtctcgggt

SEQ ID NO: 638966 - DNA, 20 bp, mouse
gtccaagtgtgctgcatgag

SEQ ID NO: 638967 - DNA, 20 bp, mouse
gtctaataagtgcaggtctg

SEQ ID NO: 638968 - DNA, 20 bp, mouse
gagcccggtctaataagtgc

SEQ ID NO: 638969 - DNA, 20 bp, mouse
gcctacagcagcatccccat

SEQ ID NO: 638970 - DNA, 20 bp, mouse
gggaccaggggactgcttgc

SEQ ID NO: 638971 - DNA, 20 bp, mouse
ggacctgcacttattagacc

SEQ ID NO: 638972 - DNA, 20 bp, mouse
gatggtatttccaccatcaa

SEQ ID NO: 638973 - DNA, 20 bp, mouse
gcatgcagcacacttggaca

SEQ ID NO: 638974 - DNA, 20 bp, mouse
ggggaggaaacgcatagaag

SEQ ID NO: 638975 - DNA, 20 bp, mouse
gtgcgcataggcaactgctg

SEQ ID NO: 638976 - DNA, 20 bp, mouse
gcagttgggcgacaccaagg

SEQ ID NO: 638977 - DNA, 20 bp, mouse
gaccaaggtggtcacctgac

SEQ ID NO: 638978 - DNA, 20 bp, mouse
gagccagttgggcgacacca

SEQ ID NO: 638979 - DNA, 20 bp, mouse
gagatgctaagacattctaa

SEQ ID NO: 638980 - DNA, 20 bp, mouse
gaagcagcctggacacaggg

SEQ ID NO: 638981 - DNA, 20 bp, mouse
ggctggggcggggtcattca

SEQ ID NO: 638982 - DNA, 20 bp, mouse
gcagcacaggagctcctccc

SEQ ID NO: 638983 - DNA, 20 bp, mouse
gggaaagcagcctggacaca

SEQ ID NO: 638984 - DNA, 20 bp, mouse
gctgaactggggtagacagt

SEQ ID NO: 638985 - DNA, 20 bp, mouse
gctgaactggccagagctag

SEQ ID NO: 638986 - DNA, 20 bp, mouse
gagcgccggctctgcgggga

SEQ ID NO: 638987 - DNA, 20 bp, mouse
ggagagacggcggtgcggga

SEQ ID NO: 638988 - DNA, 20 bp, mouse
gtccgggccggaacagccgc

SEQ ID NO: 638989 - DNA, 20 bp, mouse
gccgcagagccggcgctccc

SEQ ID NO: 638990 - DNA, 20 bp, mouse
ggcggagggcggagggcgtc

SEQ ID NO: 638991 - DNA, 20 bp, mouse
gtcccgccccgcggctgttc

SEQ ID NO: 638992 - DNA, 20 bp, mouse
gccagcccggaggccaccgt

SEQ ID NO: 638993 - DNA, 20 bp, mouse
gggccccctccccgcagagc

SEQ ID NO: 638994 - DNA, 20 bp, mouse
gaggcccccggctgtttcct

SEQ ID NO: 638995 - DNA, 20 bp, mouse
gcggaacagcgcggcagtcg

SEQ ID NO: 638996 - DNA, 20 bp, mouse
gtaagggtgcggtctacagt

SEQ ID NO: 638997 - DNA, 20 bp, mouse
gatagaagattcagcctcac

SEQ ID NO: 638998 - DNA, 20 bp, mouse
ggggataagggtgatcccca

SEQ ID NO: 638999 - DNA, 20 bp, mouse
ggcactcacattctttgtaa

SEQ ID NO: 639000 - DNA, 20 bp, mouse
gtcttctggactgtggaggg

SEQ ID NO: 639001 - DNA, 20 bp, mouse
ggacttccacagtttccatg

SEQ ID NO: 639002 - DNA, 20 bp, mouse
gctttcttctggactgtgga

SEQ ID NO: 639003 - DNA, 20 bp, mouse
ggactgtggaggggggataa

SEQ ID NO: 639004 - DNA, 20 bp, mouse
gaccatgcaagcaatactcg

SEQ ID NO: 639005 - DNA, 20 bp, mouse
gtccatgagttgcttcgaaa

SEQ ID NO: 639006 - DNA, 20 bp, mouse
ggattcagacccaggatcag

SEQ ID NO: 639007 - DNA, 20 bp, mouse
gcacctgccttgagcaaact

SEQ ID NO: 639008 - DNA, 20 bp, mouse
gttgaggtgcaggttctcat

SEQ ID NO: 639009 - DNA, 20 bp, mouse
gcaacatactgcagctgaag

SEQ ID NO: 639010 - DNA, 20 bp, mouse
gaacccagtttgctcaaggc

SEQ ID NO: 639011 - DNA, 20 bp, mouse
gtgcagctgaagagggggat

SEQ ID NO: 639012 - DNA, 20 bp, mouse
gacaggaactggaaatgaat

SEQ ID NO: 639013 - DNA, 20 bp, mouse
gcatactgcagctgaagagg

SEQ ID NO: 639014 - DNA, 20 bp, mouse
ggataaacccagtttgctca

SEQ ID NO: 639015 - DNA, 20 bp, mouse
gtgtagagcaatgtcagtgc

SEQ ID NO: 639016 - DNA, 20 bp, mouse
gaagggctggggtgtctaaa

SEQ ID NO: 639017 - DNA, 20 bp, mouse
gccagtgttcccagagacgt

SEQ ID NO: 639018 - DNA, 20 bp, mouse
gggctctggcgtcctgaagg

SEQ ID NO: 639019 - DNA, 20 bp, mouse
gcccaaatgtaaaggtgggg

SEQ ID NO: 639020 - DNA, 20 bp, mouse
ggcaaaagaacgtcacagtg

SEQ ID NO: 639021 - DNA, 20 bp, mouse
ggcgcgtctgtgagcaaagt

SEQ ID NO: 639022 - DNA, 20 bp, mouse
gggagttacctggagatgtt

SEQ ID NO: 639023 - DNA, 20 bp, mouse
gccccgagcacgcctccttc

SEQ ID NO: 639024 - DNA, 20 bp, mouse
ggggtgtaaactcccaaccc

SEQ ID NO: 639025 - DNA, 20 bp, mouse
ggtcctgaaggaggcgtgct

SEQ ID NO: 639026 - DNA, 20 bp, mouse
gggagggtggagaaccgttg

SEQ ID NO: 639027 - DNA, 20 bp, mouse
gactgaagagagatggagtg

SEQ ID NO: 639028 - DNA, 20 bp, mouse
ggagcctgggtaggaagttg

SEQ ID NO: 639029 - DNA, 20 bp, mouse
gttggggccagacctgtgtg

SEQ ID NO: 639030 - DNA, 20 bp, mouse
gacacctcaacttcctaccc

SEQ ID NO: 639031 - DNA, 20 bp, mouse
ggccagacctgtgtgaggcg

SEQ ID NO: 639032 - DNA, 20 bp, mouse
gcacttgcgcatgcgggctg

SEQ ID NO: 639033 - DNA, 20 bp, mouse
gtcccgtcctcgcctcacac

SEQ ID NO: 639034 - DNA, 20 bp, mouse
gcagtgaagttggggcctct

SEQ ID NO: 639035 - DNA, 20 bp, mouse
gtccagaacaccaggagcct

SEQ ID NO: 639036 - DNA, 20 bp, mouse
gaggatgaagggtgagtaag

SEQ ID NO: 639037 - DNA, 20 bp, mouse
gggagcccgaggtacaagag

SEQ ID NO: 639038 - DNA, 20 bp, mouse
gcgggagcgaggcctaatgg

SEQ ID NO: 639039 - DNA, 20 bp, mouse
gtcgcgggagcgaggcctaa

SEQ ID NO: 639040 - DNA, 20 bp, mouse
gcgaggcctaatggcgggga

SEQ ID NO: 639041 - DNA, 20 bp, mouse
ggtacaagaggggcggccga

SEQ ID NO: 639042 - DNA, 20 bp, mouse
gggggagggggcctggcgag

SEQ ID NO: 639043 - DNA, 20 bp, mouse
gatgaagggtgagtaagggg

SEQ ID NO: 639044 - DNA, 20 bp, mouse
gctgcggccggaggcaccga

SEQ ID NO: 639045 - DNA, 20 bp, mouse
gcgagggggcgactgcactg

SEQ ID NO: 639046 - DNA, 20 bp, mouse
ggcaatgaccaaattcaaat

SEQ ID NO: 639047 - DNA, 20 bp, mouse
gaccaagaataatcttcact

SEQ ID NO: 639048 - DNA, 20 bp, mouse
ggcatcatgtataaagatcc

SEQ ID NO: 639049 - DNA, 20 bp, mouse
ggaaaaatctagcttgttca

SEQ ID NO: 639050 - DNA, 20 bp, mouse
gatgcgcttataatttcatt

SEQ ID NO: 639051 - DNA, 20 bp, mouse
gatgtgtgcccatttgaatt

SEQ ID NO: 639052 - DNA, 20 bp, mouse
gtttaatcctactattggaa

SEQ ID NO: 639053 - DNA, 20 bp, mouse
ggcttacttcttattgattc

SEQ ID NO: 639054 - DNA, 20 bp, mouse
gtcatatccattccaatagt

SEQ ID NO: 639055 - DNA, 20 bp, mouse
gtgagagcatgcagaaaaga

SEQ ID NO: 639056 - DNA, 20 bp, mouse
ggtactcctccagactgagc

SEQ ID NO: 639057 - DNA, 20 bp, mouse
gtctgactaccagctcagtc

SEQ ID NO: 639058 - DNA, 20 bp, mouse
gtctagtcacattgctagct

SEQ ID NO: 639059 - DNA, 20 bp, mouse
gtgcaagtcaaggcaccgta

SEQ ID NO: 639060 - DNA, 20 bp, mouse
ggactaccagctcagtctgg

SEQ ID NO: 639061 - DNA, 20 bp, mouse
gcactgtgaagtgcaagtca

SEQ ID NO: 639062 - DNA, 20 bp, mouse
gtcaagaagcatgtctatgc

SEQ ID NO: 639063 - DNA, 20 bp, mouse
gtaatcagtcatgctgggga

SEQ ID NO: 639064 - DNA, 20 bp, mouse
gtgtgtaatcagtcatgctg

SEQ ID NO: 639065 - DNA, 20 bp, mouse
gcttgccatgaattcttcaa

SEQ ID NO: 639066 - DNA, 20 bp, mouse
ggcccaccgtaagcccttgt

SEQ ID NO: 639067 - DNA, 20 bp, mouse
ggggttctgagttcctacaa

SEQ ID NO: 639068 - DNA, 20 bp, mouse
ggtcacctcaaaggaaacat

SEQ ID NO: 639069 - DNA, 20 bp, mouse
gttactccagagttgatgaa

SEQ ID NO: 639070 - DNA, 20 bp, mouse
gagccccaatgcaagcatta

SEQ ID NO: 639071 - DNA, 20 bp, mouse
gtgggatctcaggggtctag

SEQ ID NO: 639072 - DNA, 20 bp, mouse
gttggggcttattggggtga

SEQ ID NO: 639073 - DNA, 20 bp, mouse
gagccacaaaggtattttgt

SEQ ID NO: 639074 - DNA, 20 bp, mouse
gattcactgtcccgattttg

SEQ ID NO: 639075 - DNA, 20 bp, mouse
gcttgcattggggcttattg

SEQ ID NO: 639076 - DNA, 20 bp, mouse
gagcccccgaacagcatctg

SEQ ID NO: 639077 - DNA, 20 bp, mouse
ggcagtcatggcagcctcca

SEQ ID NO: 639078 - DNA, 20 bp, mouse
gcgtggaactcgagcgatcc

SEQ ID NO: 639079 - DNA, 20 bp, mouse
gaaacagcgcattcctaaag

SEQ ID NO: 639080 - DNA, 20 bp, mouse
ggtcatggcagcctccacgg

SEQ ID NO: 639081 - DNA, 20 bp, mouse
gcacctgtcttcttggaccg

SEQ ID NO: 639082 - DNA, 20 bp, mouse
gtgagaaaagcacttcgaac

SEQ ID NO: 639083 - DNA, 20 bp, mouse
gcaccgcagatgctgttcgg

SEQ ID NO: 639084 - DNA, 20 bp, mouse
ggaagtgcttttctcaagtc

SEQ ID NO: 639085 - DNA, 20 bp, mouse
gagcgatcctggccgacaac

SEQ ID NO: 639086 - DNA, 20 bp, mouse
gtccacaggaggttttacaa

SEQ ID NO: 639087 - DNA, 20 bp, mouse
gcactgaaccgcttgatgat

SEQ ID NO: 639088 - DNA, 20 bp, mouse
gaagtcacaaggactcttca

SEQ ID NO: 639089 - DNA, 20 bp, mouse
ggacatggacccaacagcca

SEQ ID NO: 639090 - DNA, 20 bp, mouse
gtctgcaggttctagagata

SEQ ID NO: 639091 - DNA, 20 bp, mouse
gacctgcagacaggttagtg

SEQ ID NO: 639092 - DNA, 20 bp, mouse
ggtccctgataagctcaggt

SEQ ID NO: 639093 - DNA, 20 bp, mouse
gagtgttcctgcatgatgtc

SEQ ID NO: 639094 - DNA, 20 bp, mouse
gaatgcattcagatacaccc

SEQ ID NO: 639095 - DNA, 20 bp, mouse
gccccttgtaaaacctcctg

SEQ ID NO: 639096 - DNA, 20 bp, mouse
gggtttgagaccctccttgc

SEQ ID NO: 639097 - DNA, 20 bp, mouse
gtgcttgcaagaggttctat

SEQ ID NO: 639098 - DNA, 20 bp, mouse
gatactatgaactgtatccc

SEQ ID NO: 639099 - DNA, 20 bp, mouse
gagtaggctatgcttgcaag

SEQ ID NO: 639100 - DNA, 20 bp, mouse
gtggtgcctacactctctaa

SEQ ID NO: 639101 - DNA, 20 bp, mouse
gtacactctctaaaggaaat

SEQ ID NO: 639102 - DNA, 20 bp, mouse
gagcatagcctacttctgtc

SEQ ID NO: 639103 - DNA, 20 bp, mouse
gaacagcaacacctaagttt

SEQ ID NO: 639104 - DNA, 20 bp, mouse
gaaaaagacctgcctgtccg

SEQ ID NO: 639105 - DNA, 20 bp, mouse
gttctgtctgccagcaagga

SEQ ID NO: 639106 - DNA, 20 bp, mouse
ggcggcgcctgaaagtgttg

SEQ ID NO: 639107 - DNA, 20 bp, mouse
gagaaccggggacgacgggt

SEQ ID NO: 639108 - DNA, 20 bp, mouse
ggaaaccgacccgtcgtccc

SEQ ID NO: 639109 - DNA, 20 bp, mouse
ggtcccgccgcatctcactt

SEQ ID NO: 639110 - DNA, 20 bp, mouse
gacaagggcagcgaccagaa

SEQ ID NO: 639111 - DNA, 20 bp, mouse
gaggcgccgctacggtccag

SEQ ID NO: 639112 - DNA, 20 bp, mouse
gccgctacggtccagaggct

SEQ ID NO: 639113 - DNA, 20 bp, mouse
ggaagggaggagttctaggg

SEQ ID NO: 639114 - DNA, 20 bp, mouse
gcgtgagaaccggggacgac

SEQ ID NO: 639115 - DNA, 20 bp, mouse
gtcacctaagtgagatgcgg

SEQ ID NO: 639116 - DNA, 20 bp, mouse
ggctctatccaggtccaagt

SEQ ID NO: 639117 - DNA, 20 bp, mouse
ggagcatggaggattcttag

SEQ ID NO: 639118 - DNA, 20 bp, mouse
gggaggggctgcagagtctt

SEQ ID NO: 639119 - DNA, 20 bp, mouse
gtggaggattcttaggggag

SEQ ID NO: 639120 - DNA, 20 bp, mouse
gcgcaagagctgtcaattga

SEQ ID NO: 639121 - DNA, 20 bp, mouse
gcaatccagaggacagggga

SEQ ID NO: 639122 - DNA, 20 bp, mouse
ggccaccctgggctcaccgc

SEQ ID NO: 639123 - DNA, 20 bp, mouse
gggcggcaagaggcggagca

SEQ ID NO: 639124 - DNA, 20 bp, mouse
gctatccaggtccaagtggg

SEQ ID NO: 639125 - DNA, 20 bp, mouse
gtaagatggaggctatatca

SEQ ID NO: 639126 - DNA, 20 bp, mouse
gcacaggtagccaaccagag

SEQ ID NO: 639127 - DNA, 20 bp, mouse
gggtagccaaccagagagga

SEQ ID NO: 639128 - DNA, 20 bp, mouse
gcgcgggccagacatgaagc

SEQ ID NO: 639129 - DNA, 20 bp, mouse
gaggttgcttcccgctcctc

SEQ ID NO: 639130 - DNA, 20 bp, mouse
gacctgggcgggaagcaacc

SEQ ID NO: 639131 - DNA, 20 bp, mouse
gagcgggaagcaacctgggc

SEQ ID NO: 639132 - DNA, 20 bp, mouse
gccaatagccaacttcttag

SEQ ID NO: 639133 - DNA, 20 bp, mouse
gccccaaaaaaaagctctgg

SEQ ID NO: 639134 - DNA, 20 bp, mouse
ggtttcgttcaggtacaata

SEQ ID NO: 639135 - DNA, 20 bp, mouse
ggaagctggtttctaagcgc

SEQ ID NO: 639136 - DNA, 20 bp, mouse
gcctggcagagacgaagctg

SEQ ID NO: 639137 - DNA, 20 bp, mouse
gtgccaggaggtttaacttg

SEQ ID NO: 639138 - DNA, 20 bp, mouse
ggccgcgcgagtcttccagg

SEQ ID NO: 639139 - DNA, 20 bp, mouse
gggtgcagccatcaccctct

SEQ ID NO: 639140 - DNA, 20 bp, mouse
gactgcggagagcagtacgc

SEQ ID NO: 639141 - DNA, 20 bp, mouse
gggccagcagctcagtgcgg

SEQ ID NO: 639142 - DNA, 20 bp, mouse
gaagactcgcgcggcatccg

SEQ ID NO: 639143 - DNA, 20 bp, mouse
gggtgtgaaaacgacctaga

SEQ ID NO: 639144 - DNA, 20 bp, mouse
ggatgccgcgcgagtcttcc

SEQ ID NO: 639145 - DNA, 20 bp, mouse
gtgggcttcttgttcagatt

SEQ ID NO: 639146 - DNA, 20 bp, mouse
ggggatgtagcatgagtcgt

SEQ ID NO: 639147 - DNA, 20 bp, mouse
ggactcatgctacatcccct

SEQ ID NO: 639148 - DNA, 20 bp, mouse
gcgtgctcaacgtatctttg

SEQ ID NO: 639149 - DNA, 20 bp, mouse
ggcagttcggggatcctctg

SEQ ID NO: 639150 - DNA, 20 bp, mouse
gggctcgagcccaggagacg

SEQ ID NO: 639151 - DNA, 20 bp, mouse
gaacgccaccagctgtgcgg

SEQ ID NO: 639152 - DNA, 20 bp, mouse
gcttacctggcgcagccgag

SEQ ID NO: 639153 - DNA, 20 bp, mouse
gctaataaaatctgcagccg

SEQ ID NO: 639154 - DNA, 20 bp, mouse
ggttggagaaagtactgccc

SEQ ID NO: 639155 - DNA, 20 bp, mouse
ggcgccaggtaagcgctggt

SEQ ID NO: 639156 - DNA, 20 bp, mouse
gtcacctacgtaggcgtgat

SEQ ID NO: 639157 - DNA, 20 bp, mouse
ggcaatcatctcacctacgt

SEQ ID NO: 639158 - DNA, 20 bp, mouse
gcaacaaggttgcgcgtgag

SEQ ID NO: 639159 - DNA, 20 bp, mouse
gcaccaaggggcttgatgga

SEQ ID NO: 639160 - DNA, 20 bp, mouse
gattcccatcacgcctacgt

SEQ ID NO: 639161 - DNA, 20 bp, mouse
ggcttaagtacctttctttc

SEQ ID NO: 639162 - DNA, 20 bp, mouse
gtgtccaccaaggggcttga

SEQ ID NO: 639163 - DNA, 20 bp, mouse
gcgagccaagctgggcattc

SEQ ID NO: 639164 - DNA, 20 bp, mouse
gttccaaagagcagctgggg

SEQ ID NO: 639165 - DNA, 20 bp, mouse
gaaggacggttcaataaatg

SEQ ID NO: 639166 - DNA, 20 bp, mouse
gtgagcgaacaggtgctcat

SEQ ID NO: 639167 - DNA, 20 bp, mouse
gagagctacaacttgttgat

SEQ ID NO: 639168 - DNA, 20 bp, mouse
gacagggaagacataagtgc

SEQ ID NO: 639169 - DNA, 20 bp, mouse
gcaacaagttgtagctctga

SEQ ID NO: 639170 - DNA, 20 bp, mouse
ggggctacgggttgaataaa

SEQ ID NO: 639171 - DNA, 20 bp, mouse
gtcaaagcttctgagggcta

SEQ ID NO: 639172 - DNA, 20 bp, mouse
gaagagaacctgtactcatc

SEQ ID NO: 639173 - DNA, 20 bp, mouse
gaagagtacatgcagcctcc

SEQ ID NO: 639174 - DNA, 20 bp, mouse
gtgagaaatgtagccgtcca

SEQ ID NO: 639175 - DNA, 20 bp, mouse
ggatggcagatgcctgcaaa

SEQ ID NO: 639176 - DNA, 20 bp, mouse
gcagtgggaaagcatccttc

SEQ ID NO: 639177 - DNA, 20 bp, mouse
gacctacaacagtaatggat

SEQ ID NO: 639178 - DNA, 20 bp, mouse
gggaagtgcaagaatgctgt

SEQ ID NO: 639179 - DNA, 20 bp, mouse
gcgtgagttcagagttaatc

SEQ ID NO: 639180 - DNA, 20 bp, mouse
gctggcacctacaacagtaa

SEQ ID NO: 639181 - DNA, 20 bp, mouse
ggcacttagcactacactga

SEQ ID NO: 639182 - DNA, 20 bp, mouse
gaagtcctgggtccagtatc

SEQ ID NO: 639183 - DNA, 20 bp, mouse
gagtggcccctgagcaggtg

SEQ ID NO: 639184 - DNA, 20 bp, mouse
gtgaagaaaatccatccagt

SEQ ID NO: 639185 - DNA, 20 bp, mouse
gcaccaaggaaagcaaggtt

SEQ ID NO: 639186 - DNA, 20 bp, mouse
gttccccagaggtgggaacg

SEQ ID NO: 639187 - DNA, 20 bp, mouse
ggccggcagtgtagctatgg

SEQ ID NO: 639188 - DNA, 20 bp, mouse
gtaacctgtgaggacgtcca

SEQ ID NO: 639189 - DNA, 20 bp, mouse
gttccccgttcccacctctg

SEQ ID NO: 639190 - DNA, 20 bp, mouse
gggccctggttcaggaagga

SEQ ID NO: 639191 - DNA, 20 bp, mouse
gtggcccagccacaaattta

SEQ ID NO: 639192 - DNA, 20 bp, mouse
gacacggaggcgttcctcat

SEQ ID NO: 639193 - DNA, 20 bp, mouse
ggaggccggcagtgtagcta

SEQ ID NO: 639194 - DNA, 20 bp, mouse
gggtcacaggtgaggttctt

SEQ ID NO: 639195 - DNA, 20 bp, mouse
gtgaccctggacgtcctcac

SEQ ID NO: 639196 - DNA, 20 bp, mouse
gacaagtacactggagactc

SEQ ID NO: 639197 - DNA, 20 bp, mouse
gaacctcagaagagagggca

SEQ ID NO: 639198 - DNA, 20 bp, mouse
gacgcttcactcatgaaagg

SEQ ID NO: 639199 - DNA, 20 bp, mouse
gtactaatgacattggagag

SEQ ID NO: 639200 - DNA, 20 bp, mouse
gtacaggttactaatgacat

SEQ ID NO: 639201 - DNA, 20 bp, mouse
gaaatctataacaagtacac

SEQ ID NO: 639202 - DNA, 20 bp, mouse
gcagttgtggtttgctctga

SEQ ID NO: 639203 - DNA, 20 bp, mouse
gttagagggatcttttttaa

SEQ ID NO: 639204 - DNA, 20 bp, mouse
gatgacgcttcactcatgaa

SEQ ID NO: 639205 - DNA, 20 bp, mouse
ggttatagatttattagttg

SEQ ID NO: 639206 - DNA, 20 bp, mouse
gagagaactgacatagaatg

SEQ ID NO: 639207 - DNA, 20 bp, mouse
ggaccatgtggagttcacag

SEQ ID NO: 639208 - DNA, 20 bp, mouse
gttcacaaaataagtcagtt

SEQ ID NO: 639209 - DNA, 20 bp, mouse
ggtcagttaggctgtgtcta

SEQ ID NO: 639210 - DNA, 20 bp, mouse
gagatgatgatagcagtcat

SEQ ID NO: 639211 - DNA, 20 bp, mouse
ggagaaaaatatacgtctct

SEQ ID NO: 639212 - DNA, 20 bp, mouse
gtctacagtaatattcagtt

SEQ ID NO: 639213 - DNA, 20 bp, mouse
gagcctctgtgaactccaca

SEQ ID NO: 639214 - DNA, 20 bp, mouse
gatctgagaaaatgacacta

SEQ ID NO: 639215 - DNA, 20 bp, mouse
gattttgtgaactggccagt

SEQ ID NO: 639216 - DNA, 20 bp, mouse
gtagtgacttggtgtctcta

SEQ ID NO: 639217 - DNA, 20 bp, mouse
gaccttgaggagatgtggta

SEQ ID NO: 639218 - DNA, 20 bp, mouse
gtctagagaggtggttcttc

SEQ ID NO: 639219 - DNA, 20 bp, mouse
gttggtgtctctatggtgag

SEQ ID NO: 639220 - DNA, 20 bp, mouse
gggctagactgcagtttttg

SEQ ID NO: 639221 - DNA, 20 bp, mouse
ggaaagggcttccggaatgg

SEQ ID NO: 639222 - DNA, 20 bp, mouse
gaataccaacagacacacag

SEQ ID NO: 639223 - DNA, 20 bp, mouse
gtccctgcacaatggcctca

SEQ ID NO: 639224 - DNA, 20 bp, mouse
gtagaccactgtgtgtctgt

SEQ ID NO: 639225 - DNA, 20 bp, mouse
ggtgtcaagagactgcctgt

SEQ ID NO: 639226 - DNA, 20 bp, mouse
gcatgggagaggtacccctg

SEQ ID NO: 639227 - DNA, 20 bp, mouse
gccacatggcagccacatga

SEQ ID NO: 639228 - DNA, 20 bp, mouse
gcctgaggacctccttcatg

SEQ ID NO: 639229 - DNA, 20 bp, mouse
ggagaagcgttccatgggag

SEQ ID NO: 639230 - DNA, 20 bp, mouse
gcctccctcatcatgagagc

SEQ ID NO: 639231 - DNA, 20 bp, mouse
gcactgtgtgtcagtctctc

SEQ ID NO: 639232 - DNA, 20 bp, mouse
gtgtcagtctctctggcagg

SEQ ID NO: 639233 - DNA, 20 bp, mouse
gtgcttatgaatcagaggag

SEQ ID NO: 639234 - DNA, 20 bp, mouse
gcagtgggcccttaaggcat

SEQ ID NO: 639235 - DNA, 20 bp, mouse
ggtgtgtcagtctctctggc

SEQ ID NO: 639236 - DNA, 20 bp, mouse
ggggcctaagaaggttgcta

SEQ ID NO: 639237 - DNA, 20 bp, mouse
gctcaagtcctctgcctcta

SEQ ID NO: 639238 - DNA, 20 bp, mouse
gtccagtctcagtgccatag

SEQ ID NO: 639239 - DNA, 20 bp, mouse
gtaaaacccgtgtcaggcta

SEQ ID NO: 639240 - DNA, 20 bp, mouse
ggagatctcgggcatgtgac

SEQ ID NO: 639241 - DNA, 20 bp, mouse
gtgaaggcctaagtaacatg

SEQ ID NO: 639242 - DNA, 20 bp, mouse
gctaagaaggttgctaggga

SEQ ID NO: 639243 - DNA, 20 bp, mouse
gtctgacattgaggtaatgt

SEQ ID NO: 639244 - DNA, 20 bp, mouse
gaaggaactcagagagatct

SEQ ID NO: 639245 - DNA, 20 bp, mouse
gctgagacctcatgttactt

SEQ ID NO: 639246 - DNA, 20 bp, mouse
gactaaggaggggcccacga

SEQ ID NO: 639247 - DNA, 20 bp, mouse
ggagagggaggatcgataga

SEQ ID NO: 639248 - DNA, 20 bp, mouse
gtacctcacatctggaacta

SEQ ID NO: 639249 - DNA, 20 bp, mouse
gctcacatctggaactaagg

SEQ ID NO: 639250 - DNA, 20 bp, mouse
gcgaaacggaagtcactata

SEQ ID NO: 639251 - DNA, 20 bp, mouse
gcagtgtaggaatggagggt

SEQ ID NO: 639252 - DNA, 20 bp, mouse
ggcaccagtgtaggaatgga

SEQ ID NO: 639253 - DNA, 20 bp, mouse
gggaggatcgatagagggtt

SEQ ID NO: 639254 - DNA, 20 bp, mouse
gacctcttccaatactaggg

SEQ ID NO: 639255 - DNA, 20 bp, mouse
gctaactgcctccctagtat

SEQ ID NO: 639256 - DNA, 20 bp, mouse
gtcagccctatcctatatgt

SEQ ID NO: 639257 - DNA, 20 bp, mouse
gtctctacacagtatattta

SEQ ID NO: 639258 - DNA, 20 bp, mouse
gaggatagggctgacaatct

SEQ ID NO: 639259 - DNA, 20 bp, mouse
gatactctcaagaggaggtg

SEQ ID NO: 639260 - DNA, 20 bp, mouse
gtaaaggacagcccacatat

SEQ ID NO: 639261 - DNA, 20 bp, mouse
ggacagcccacatataggat

SEQ ID NO: 639262 - DNA, 20 bp, mouse
gaattgggaaacatactttt

SEQ ID NO: 639263 - DNA, 20 bp, mouse
gaacacacaaaaagtatgtc

SEQ ID NO: 639264 - DNA, 20 bp, mouse
gggaggaaaaaggatctttc

SEQ ID NO: 639265 - DNA, 20 bp, mouse
gctcctatgtcagaaatgcc

SEQ ID NO: 639266 - DNA, 20 bp, mouse
gtgggcaatgagcagctgta

SEQ ID NO: 639267 - DNA, 20 bp, mouse
ggcacagaggactatctggt

SEQ ID NO: 639268 - DNA, 20 bp, mouse
gggcagcacagaggactatc

SEQ ID NO: 639269 - DNA, 20 bp, mouse
gtgggatgaggataacgggg

SEQ ID NO: 639270 - DNA, 20 bp, mouse
gcacgcacgtatggtgcata

SEQ ID NO: 639271 - DNA, 20 bp, mouse
gaccacccttaactacactg

SEQ ID NO: 639272 - DNA, 20 bp, mouse
gtggctccaaaaggcacagg

SEQ ID NO: 639273 - DNA, 20 bp, mouse
gggctggctccaaaaggcac

SEQ ID NO: 639274 - DNA, 20 bp, mouse
gttctgggatgaggataacg

SEQ ID NO: 639275 - DNA, 20 bp, mouse
gagaggactatctggttggc

SEQ ID NO: 639276 - DNA, 20 bp, mouse
gacacccgaaggttttcaaa

SEQ ID NO: 639277 - DNA, 20 bp, mouse
gtgaaaagaaacgcttctgt

SEQ ID NO: 639278 - DNA, 20 bp, mouse
gtctcaaaataacacccaag

SEQ ID NO: 639279 - DNA, 20 bp, mouse
gttttcacgaggctaaagtt

SEQ ID NO: 639280 - DNA, 20 bp, mouse
gagaagcgtttcttttcacg

SEQ ID NO: 639281 - DNA, 20 bp, mouse
gtcttgtttaagacacccga

SEQ ID NO: 639282 - DNA, 20 bp, mouse
gcagatggaacctcttctgc

SEQ ID NO: 639283 - DNA, 20 bp, mouse
ggtcatctaaaattacatca

SEQ ID NO: 639284 - DNA, 20 bp, mouse
gttgtggaatcaagttttag

SEQ ID NO: 639285 - DNA, 20 bp, mouse
gtaatatgcgccagcagaag

SEQ ID NO: 639286 - DNA, 20 bp, mouse
gtcccctacaaggcacacga

SEQ ID NO: 639287 - DNA, 20 bp, mouse
gactgtatcaccaagaccta

SEQ ID NO: 639288 - DNA, 20 bp, mouse
gtcacaagggaataaccaga

SEQ ID NO: 639289 - DNA, 20 bp, mouse
gccccggccggtcaacaatc

SEQ ID NO: 639290 - DNA, 20 bp, mouse
gagccaaagaaatgtcacaa

SEQ ID NO: 639291 - DNA, 20 bp, mouse
gttcccttgtgacatttctt

SEQ ID NO: 639292 - DNA, 20 bp, mouse
gaggggaggttgtgtgccct

SEQ ID NO: 639293 - DNA, 20 bp, mouse
gaggccctcgtgtgccttgt

SEQ ID NO: 639294 - DNA, 20 bp, mouse
gcagaggcaggggcacccag

SEQ ID NO: 639295 - DNA, 20 bp, mouse
gggtgggcagttgtatggac

SEQ ID NO: 639296 - DNA, 20 bp, mouse
ggtgaacagtttcctagcat

SEQ ID NO: 639297 - DNA, 20 bp, mouse
gtgccctgaaattgattcag

SEQ ID NO: 639298 - DNA, 20 bp, mouse
gatgggctcttgtagactga

SEQ ID NO: 639299 - DNA, 20 bp, mouse
ggtctacaagagcccatgct

SEQ ID NO: 639300 - DNA, 20 bp, mouse
gtaatcctagaagatggaat

SEQ ID NO: 639301 - DNA, 20 bp, mouse
ggcatcccattccatcttct

SEQ ID NO: 639302 - DNA, 20 bp, mouse
gagatcttttctgaccaagg

SEQ ID NO: 639303 - DNA, 20 bp, mouse
gaggcaaatcgctaatgtca

SEQ ID NO: 639304 - DNA, 20 bp, mouse
gttcaaacggttattgtcag

SEQ ID NO: 639305 - DNA, 20 bp, mouse
ggagcagtgatgacacttac

SEQ ID NO: 639306 - DNA, 20 bp, mouse
gggaacaaatggattaatgc

SEQ ID NO: 639307 - DNA, 20 bp, mouse
gtagaacattaggtcaaggt

SEQ ID NO: 639308 - DNA, 20 bp, mouse
ggaaagctagagatggttga

SEQ ID NO: 639309 - DNA, 20 bp, mouse
gcttctagaacattaggtca

SEQ ID NO: 639310 - DNA, 20 bp, mouse
gcatcctccatgtgtgacag

SEQ ID NO: 639311 - DNA, 20 bp, mouse
gaaggtttggtcatcttcct

SEQ ID NO: 639312 - DNA, 20 bp, mouse
gcctcctctgtcacacatgg

SEQ ID NO: 639313 - DNA, 20 bp, mouse
gcaattgtgacttcggacaa

SEQ ID NO: 639314 - DNA, 20 bp, mouse
gataactcaggatagtcaag

SEQ ID NO: 639315 - DNA, 20 bp, mouse
ggactatgcaaggaatagtg

SEQ ID NO: 639316 - DNA, 20 bp, mouse
ggggtggggtgggtgttcat

SEQ ID NO: 639317 - DNA, 20 bp, mouse
gtgggtgttcataggtgagc

SEQ ID NO: 639318 - DNA, 20 bp, mouse
gatcagagggcttgaatgaa

SEQ ID NO: 639319 - DNA, 20 bp, mouse
gcaagccctctgattacata

SEQ ID NO: 639320 - DNA, 20 bp, mouse
ggcttccgagaacccagggt

SEQ ID NO: 639321 - DNA, 20 bp, mouse
ggcctctaagtgacacagag

SEQ ID NO: 639322 - DNA, 20 bp, mouse
gaggatgccagagaacatgg

SEQ ID NO: 639323 - DNA, 20 bp, mouse
gtaggtgagctggctagagg

SEQ ID NO: 639324 - DNA, 20 bp, mouse
gtaagccttatgtaatcaga

SEQ ID NO: 639325 - DNA, 20 bp, mouse
gccaccccaccctgggttct

SEQ ID NO: 639326 - DNA, 20 bp, mouse
gtaccctaggactgtatccg

SEQ ID NO: 639327 - DNA, 20 bp, mouse
ggtcccaagcaccttaccct

SEQ ID NO: 639328 - DNA, 20 bp, mouse
gttgccacggatacagtcct

SEQ ID NO: 639329 - DNA, 20 bp, mouse
gcagccccctggggcctctt

SEQ ID NO: 639330 - DNA, 20 bp, mouse
gtgcctacctgatccatctg

SEQ ID NO: 639331 - DNA, 20 bp, mouse
gactgtatccgtggcaactc

SEQ ID NO: 639332 - DNA, 20 bp, mouse
ggcaactctggaatagacca

SEQ ID NO: 639333 - DNA, 20 bp, mouse
ggtccccagatggatcaggt

SEQ ID NO: 639334 - DNA, 20 bp, mouse
gcagaagtccagtgtgggtg

SEQ ID NO: 639335 - DNA, 20 bp, mouse
gtactgtccccagatggatc

SEQ ID NO: 639336 - DNA, 20 bp, mouse
gagaaccgatctttttatgg

SEQ ID NO: 639337 - DNA, 20 bp, mouse
gtgcccctgacacgtagcta

SEQ ID NO: 639338 - DNA, 20 bp, mouse
gcggttctaggagtgacact

SEQ ID NO: 639339 - DNA, 20 bp, mouse
gctgaccaccataaaaagat

SEQ ID NO: 639340 - DNA, 20 bp, mouse
gtcaggggcagaacagcatg

SEQ ID NO: 639341 - DNA, 20 bp, mouse
gacaatgtctgattcacgga

SEQ ID NO: 639342 - DNA, 20 bp, mouse
gtaccatagctacgtgtcag

SEQ ID NO: 639343 - DNA, 20 bp, mouse
gctgcacaatgtctgattca

SEQ ID NO: 639344 - DNA, 20 bp, mouse
gagaaggatgacctcacaaa

SEQ ID NO: 639345 - DNA, 20 bp, mouse
gcctagaaccgatcttttta

SEQ ID NO: 639346 - DNA, 20 bp, mouse
gtggcagcccagagcgagat

SEQ ID NO: 639347 - DNA, 20 bp, mouse
gcaaggacaaggcgtggcct

SEQ ID NO: 639348 - DNA, 20 bp, mouse
ggggatggagctggctgcac

SEQ ID NO: 639349 - DNA, 20 bp, mouse
gcgtggcctcggctaagtgg

SEQ ID NO: 639350 - DNA, 20 bp, mouse
gggttccgagtgcaaggaca

SEQ ID NO: 639351 - DNA, 20 bp, mouse
gccggcctcctgaaggtcca

SEQ ID NO: 639352 - DNA, 20 bp, mouse
gtagcctcctctccaatctc

SEQ ID NO: 639353 - DNA, 20 bp, mouse
gcactggggtcgggcaagat

SEQ ID NO: 639354 - DNA, 20 bp, mouse
gcaggttggcccaggggcaa

SEQ ID NO: 639355 - DNA, 20 bp, mouse
ggcccagagcgagatgggga

SEQ ID NO: 639356 - DNA, 20 bp, mouse
gagctgatggtgacacccag

SEQ ID NO: 639357 - DNA, 20 bp, mouse
gcctcccagggcatcccgtg

SEQ ID NO: 639358 - DNA, 20 bp, mouse
gtcccagccaaaggaggaga

SEQ ID NO: 639359 - DNA, 20 bp, mouse
ggaagggagtctggcttcta

SEQ ID NO: 639360 - DNA, 20 bp, mouse
gggtgtcaccatcagctcat

SEQ ID NO: 639361 - DNA, 20 bp, mouse
gagcgcaggtgagtccacac

SEQ ID NO: 639362 - DNA, 20 bp, mouse
gcccaggggcttagagatgt

SEQ ID NO: 639363 - DNA, 20 bp, mouse
gagtccacacgggatgccct

SEQ ID NO: 639364 - DNA, 20 bp, mouse
gggcttagagatgttggtcc

SEQ ID NO: 639365 - DNA, 20 bp, mouse
gatggtaggagtgcctccca

SEQ ID NO: 639366 - DNA, 20 bp, mouse
gaggacttagtgagctgcta

SEQ ID NO: 639367 - DNA, 20 bp, mouse
gagaaaagacggcacttaca

SEQ ID NO: 639368 - DNA, 20 bp, mouse
gtgtgtcctagagacactct

SEQ ID NO: 639369 - DNA, 20 bp, mouse
gagctgctatggttggcact

SEQ ID NO: 639370 - DNA, 20 bp, mouse
gctctggtcacgtggttcat

SEQ ID NO: 639371 - DNA, 20 bp, mouse
gtggtttacgacaggatcgt

SEQ ID NO: 639372 - DNA, 20 bp, mouse
ggtcagaagtggtttacgac

SEQ ID NO: 639373 - DNA, 20 bp, mouse
gacaggatcgtgggaaagtt

SEQ ID NO: 639374 - DNA, 20 bp, mouse
gagcatcctagagtgtctct

SEQ ID NO: 639375 - DNA, 20 bp, mouse
ggttcataggccgtcagaag

SEQ ID NO: 639376 - DNA, 20 bp, mouse
gggagtctctgattgaggac

SEQ ID NO: 639377 - DNA, 20 bp, mouse
gacactggagtctctgattg

SEQ ID NO: 639378 - DNA, 20 bp, mouse
gtggaaagcaaatccaagat

SEQ ID NO: 639379 - DNA, 20 bp, mouse
gacagatgccctttccattg

SEQ ID NO: 639380 - DNA, 20 bp, mouse
ggattcagagaaggagaatt

SEQ ID NO: 639381 - DNA, 20 bp, mouse
gccagcctgccctgttccca

SEQ ID NO: 639382 - DNA, 20 bp, mouse
gcaaatccaagattggacac

SEQ ID NO: 639383 - DNA, 20 bp, mouse
gcaggaggaaccatgggaac

SEQ ID NO: 639384 - DNA, 20 bp, mouse
gagtccctagacaaagccat

SEQ ID NO: 639385 - DNA, 20 bp, mouse
ggaatctgcccttcccctct

SEQ ID NO: 639386 - DNA, 20 bp, mouse
gctagaggactctaccttcc

SEQ ID NO: 639387 - DNA, 20 bp, mouse
gtggctgtgtctgttcacat

SEQ ID NO: 639388 - DNA, 20 bp, mouse
gtccaactgctcctgctggc

SEQ ID NO: 639389 - DNA, 20 bp, mouse
ggccagccagcaggagcagt

SEQ ID NO: 639390 - DNA, 20 bp, mouse
ggttcacataggtcctagta

SEQ ID NO: 639391 - DNA, 20 bp, mouse
gcataggtcctagtaaggaa

SEQ ID NO: 639392 - DNA, 20 bp, mouse
ggtgaaaaccattccttact

SEQ ID NO: 639393 - DNA, 20 bp, mouse
gacagacacagccagccagc

SEQ ID NO: 639394 - DNA, 20 bp, mouse
gctagaccatgtgacctgga

SEQ ID NO: 639395 - DNA, 20 bp, mouse
gaaggctagaccatgtgacc

SEQ ID NO: 639396 - DNA, 20 bp, mouse
gactgtggcagcagcttcta

SEQ ID NO: 639397 - DNA, 20 bp, mouse
gagaacaaggtgttacctct

SEQ ID NO: 639398 - DNA, 20 bp, mouse
ggacctccccaccaaaagga

SEQ ID NO: 639399 - DNA, 20 bp, mouse
ggccacaagtccaatctgta

SEQ ID NO: 639400 - DNA, 20 bp, mouse
ggctgccacagtgaccccag

SEQ ID NO: 639401 - DNA, 20 bp, mouse
ggatgtgtagctccccacaa

SEQ ID NO: 639402 - DNA, 20 bp, mouse
gctccccaccaaaaggaagg

SEQ ID NO: 639403 - DNA, 20 bp, mouse
gggcttctggcgtgggttgt

SEQ ID NO: 639404 - DNA, 20 bp, mouse
gaggtataagccatacagat

SEQ ID NO: 639405 - DNA, 20 bp, mouse
gcacgccagaagcccttgtg

SEQ ID NO: 639406 - DNA, 20 bp, mouse
ggggctgtggaatagcttag

SEQ ID NO: 639407 - DNA, 20 bp, mouse
gtaggagtggcagtctcaga

SEQ ID NO: 639408 - DNA, 20 bp, mouse
gtagatggtgtcaagcgctg

SEQ ID NO: 639409 - DNA, 20 bp, mouse
gtctcagagggtctgttgtc

SEQ ID NO: 639410 - DNA, 20 bp, mouse
gcactggggtctagggttca

SEQ ID NO: 639411 - DNA, 20 bp, mouse
gtagaagctgctcaccaggg

SEQ ID NO: 639412 - DNA, 20 bp, mouse
gttctagagtaagcatcaag

SEQ ID NO: 639413 - DNA, 20 bp, mouse
gggtctgtgtgggacatgac

SEQ ID NO: 639414 - DNA, 20 bp, mouse
gtggtcacacggaagctcta

SEQ ID NO: 639415 - DNA, 20 bp, mouse
gccactcctatgcaagagcc

SEQ ID NO: 639416 - DNA, 20 bp, mouse
gacctgctaggcgtctggtg

SEQ ID NO: 639417 - DNA, 20 bp, mouse
gcggcgcggcgttaagtgtt

SEQ ID NO: 639418 - DNA, 20 bp, mouse
gggacaggacgtagcgggac

SEQ ID NO: 639419 - DNA, 20 bp, mouse
gccgcgggacaggacgtagc

SEQ ID NO: 639420 - DNA, 20 bp, mouse
gttccggctcacaaccgagt

SEQ ID NO: 639421 - DNA, 20 bp, mouse
gcggcccgcccgctccaacg

SEQ ID NO: 639422 - DNA, 20 bp, mouse
ggcggcgcctgcaacgcagg

SEQ ID NO: 639423 - DNA, 20 bp, mouse
ggctgtgccacgtcacacgg

SEQ ID NO: 639424 - DNA, 20 bp, mouse
gggagtgtcggcgaagccgc

SEQ ID NO: 639425 - DNA, 20 bp, mouse
gcctcgggccttcacggttc

SEQ ID NO: 639426 - DNA, 20 bp, mouse
ggtcagcctgggcagaaaaa

SEQ ID NO: 639427 - DNA, 20 bp, mouse
gcagtgacagtggtcagcct

SEQ ID NO: 639428 - DNA, 20 bp, mouse
gtgactaactggtatcaggg

SEQ ID NO: 639429 - DNA, 20 bp, mouse
gaagtgactaactggtatca

SEQ ID NO: 639430 - DNA, 20 bp, mouse
gacaactagaactcccgcta

SEQ ID NO: 639431 - DNA, 20 bp, mouse
gggtgatggtacctgtgagg

SEQ ID NO: 639432 - DNA, 20 bp, mouse
ggggaggacatctgagctgt

SEQ ID NO: 639433 - DNA, 20 bp, mouse
ggggagttctagttgttgta

SEQ ID NO: 639434 - DNA, 20 bp, mouse
ggggacgatgctgacagtga

SEQ ID NO: 639435 - DNA, 20 bp, mouse
gcgtgtactgagtgtcatgg

SEQ ID NO: 639436 - DNA, 20 bp, mouse
gcaggaggtgaggaagtcca

SEQ ID NO: 639437 - DNA, 20 bp, mouse
ggaggagctagcagctaatg

SEQ ID NO: 639438 - DNA, 20 bp, mouse
gagctagcagctaatggggc

SEQ ID NO: 639439 - DNA, 20 bp, mouse
gcctctgaggtttctgtctg

SEQ ID NO: 639440 - DNA, 20 bp, mouse
gtggggcggctgcctctgtc

SEQ ID NO: 639441 - DNA, 20 bp, mouse
gtcggaaagaacaatggtta

SEQ ID NO: 639442 - DNA, 20 bp, mouse
gtgtgcccctccccagacag

SEQ ID NO: 639443 - DNA, 20 bp, mouse
gaggttcaacacacatcctg

SEQ ID NO: 639444 - DNA, 20 bp, mouse
gaggttaggcctgaccagaa

SEQ ID NO: 639445 - DNA, 20 bp, mouse
ggtacccagaatgaaaacag

SEQ ID NO: 639446 - DNA, 20 bp, mouse
gcagctgaggctgacaataa

SEQ ID NO: 639447 - DNA, 20 bp, mouse
gcacggacatccaaaggacc

SEQ ID NO: 639448 - DNA, 20 bp, mouse
ggctgacaataagggagaag

SEQ ID NO: 639449 - DNA, 20 bp, mouse
gaacccagtaagtcccagtg

SEQ ID NO: 639450 - DNA, 20 bp, mouse
gatcaagtgtgacctgtaga

SEQ ID NO: 639451 - DNA, 20 bp, mouse
ggtatcttgtgtatctgttc

SEQ ID NO: 639452 - DNA, 20 bp, mouse
gaagatacacggacatccaa

SEQ ID NO: 639453 - DNA, 20 bp, mouse
gtagaaggacaggaagacct

SEQ ID NO: 639454 - DNA, 20 bp, mouse
ggacctcactgggacttact

SEQ ID NO: 639455 - DNA, 20 bp, mouse
ggaaccctggcaaagaaggc

SEQ ID NO: 639456 - DNA, 20 bp, mouse
gcctgctgggtggttagtga

SEQ ID NO: 639457 - DNA, 20 bp, mouse
gcaaatgggtatggggttga

SEQ ID NO: 639458 - DNA, 20 bp, mouse
ggacccacatgtcctatcaa

SEQ ID NO: 639459 - DNA, 20 bp, mouse
ggaaaagcatggctttgatt

SEQ ID NO: 639460 - DNA, 20 bp, mouse
gaccacccagcaggacaagt

SEQ ID NO: 639461 - DNA, 20 bp, mouse
ggggtctggactgctctgga

SEQ ID NO: 639462 - DNA, 20 bp, mouse
gttagtgagggccaggattg

SEQ ID NO: 639463 - DNA, 20 bp, mouse
gcatgtgggtcaaatgggta

SEQ ID NO: 639464 - DNA, 20 bp, mouse
gaggattggggtgaaaagca

SEQ ID NO: 639465 - DNA, 20 bp, mouse
ggcaggacaagtgggacctt

SEQ ID NO: 639466 - DNA, 20 bp, mouse
gagtctgctcagacaagatc

SEQ ID NO: 639467 - DNA, 20 bp, mouse
gcaagatcaggactacagtg

SEQ ID NO: 639468 - DNA, 20 bp, mouse
ggtgaagtaggcatttaaac

SEQ ID NO: 639469 - DNA, 20 bp, mouse
gagacaggcaaaaatggccc

SEQ ID NO: 639470 - DNA, 20 bp, mouse
gggcagcagacaggcaaaaa

SEQ ID NO: 639471 - DNA, 20 bp, mouse
ggacaaacatgactggttag

SEQ ID NO: 639472 - DNA, 20 bp, mouse
gttaaatgcctacttcacag

SEQ ID NO: 639473 - DNA, 20 bp, mouse
gagctgtcagctactgctcc

SEQ ID NO: 639474 - DNA, 20 bp, mouse
gttcagggagttagaatcca

SEQ ID NO: 639475 - DNA, 20 bp, mouse
gttaatgtagaaaaattaat

SEQ ID NO: 639476 - DNA, 20 bp, mouse
ggtatggcagggatactcat

SEQ ID NO: 639477 - DNA, 20 bp, mouse
ggagccagctcttgatggaa

SEQ ID NO: 639478 - DNA, 20 bp, mouse
gcatccagaaactgagtaga

SEQ ID NO: 639479 - DNA, 20 bp, mouse
ggatactcatggggcttaac

SEQ ID NO: 639480 - DNA, 20 bp, mouse
gaggctggagaagatgttca

SEQ ID NO: 639481 - DNA, 20 bp, mouse
gtgggaggtgaagggaacgg

SEQ ID NO: 639482 - DNA, 20 bp, mouse
gtcatggggcttaacaggac

SEQ ID NO: 639483 - DNA, 20 bp, mouse
ggaaaggataggagagacta

SEQ ID NO: 639484 - DNA, 20 bp, mouse
gtcccctttccatcaagagc

SEQ ID NO: 639485 - DNA, 20 bp, mouse
gggcaggcatgcccttactg

SEQ ID NO: 639486 - DNA, 20 bp, mouse
ggagacgtacttggggtcca

SEQ ID NO: 639487 - DNA, 20 bp, mouse
gcagcctcgctatgcttcta

SEQ ID NO: 639488 - DNA, 20 bp, mouse
ggcgccctagaagcatagcg

SEQ ID NO: 639489 - DNA, 20 bp, mouse
gatggggcgggactccgtgt

SEQ ID NO: 639490 - DNA, 20 bp, mouse
ggggcgggactccgtgtggg

SEQ ID NO: 639491 - DNA, 20 bp, mouse
gccggcgcaaagcagaagag

SEQ ID NO: 639492 - DNA, 20 bp, mouse
gcgcacacgcgagagcttgt

SEQ ID NO: 639493 - DNA, 20 bp, mouse
gcacactaggttcctggctg

SEQ ID NO: 639494 - DNA, 20 bp, mouse
ggtacgccgcgaagcaaggg

SEQ ID NO: 639495 - DNA, 20 bp, mouse
gggaacctagtgtgcagaag

SEQ ID NO: 639496 - DNA, 20 bp, mouse
gcccggaagttccacgtcag

SEQ ID NO: 639497 - DNA, 20 bp, mouse
gaacccaccgacccgtggac

SEQ ID NO: 639498 - DNA, 20 bp, mouse
gggaacccgccgcagccggt

SEQ ID NO: 639499 - DNA, 20 bp, mouse
gtggccggtccacgggtcgg

SEQ ID NO: 639500 - DNA, 20 bp, mouse
gcggctgcggcgggttcccg

SEQ ID NO: 639501 - DNA, 20 bp, mouse
gcctgcgcacaccctccgta

SEQ ID NO: 639502 - DNA, 20 bp, mouse
gggttggccggtccacgggt

SEQ ID NO: 639503 - DNA, 20 bp, mouse
ggggacaggaggaccccgtc

SEQ ID NO: 639504 - DNA, 20 bp, mouse
gtaccgcgagagtcgcttcc

SEQ ID NO: 639505 - DNA, 20 bp, mouse
gagtcggagccatggtaagt

SEQ ID NO: 639506 - DNA, 20 bp, mouse
gtaagaaagcagcccggcta

SEQ ID NO: 639507 - DNA, 20 bp, mouse
ggctgaatcatgccctagcc

SEQ ID NO: 639508 - DNA, 20 bp, mouse
gataaatccccaaatagaga

SEQ ID NO: 639509 - DNA, 20 bp, mouse
gtaaaatcacttgcagtaat

SEQ ID NO: 639510 - DNA, 20 bp, mouse
ggctgcttactaactgttaa

SEQ ID NO: 639511 - DNA, 20 bp, mouse
gctgctttcttataaacaat

SEQ ID NO: 639512 - DNA, 20 bp, mouse
gtatctactgcgcactaatg

SEQ ID NO: 639513 - DNA, 20 bp, mouse
gggaaaattacagtgtgcta

SEQ ID NO: 639514 - DNA, 20 bp, mouse
ggacgtctgttagatgtgca

SEQ ID NO: 639515 - DNA, 20 bp, mouse
gtgtttataagaaagcagcc

SEQ ID NO: 639516 - DNA, 20 bp, mouse
gccaatgctaagtgcttctt

SEQ ID NO: 639517 - DNA, 20 bp, mouse
gcaacagcaacgaaccataa

SEQ ID NO: 639518 - DNA, 20 bp, mouse
gctgggagataactgaagcc

SEQ ID NO: 639519 - DNA, 20 bp, mouse
gtattggcttaggtgggttg

SEQ ID NO: 639520 - DNA, 20 bp, mouse
gaacaaaggtagaccaagct

SEQ ID NO: 639521 - DNA, 20 bp, mouse
gtactatcaaagctgagaag

SEQ ID NO: 639522 - DNA, 20 bp, mouse
gagagtatgaggttcagaca

SEQ ID NO: 639523 - DNA, 20 bp, mouse
gagagggacacagatgataa

SEQ ID NO: 639524 - DNA, 20 bp, mouse
ggttgctattggagccagaa

SEQ ID NO: 639525 - DNA, 20 bp, mouse
gctcacttctaagaatcatg

SEQ ID NO: 639526 - DNA, 20 bp, mouse
gaagagtggaacgtgttggg

SEQ ID NO: 639527 - DNA, 20 bp, mouse
gatgaagagtggaacgtgtt

SEQ ID NO: 639528 - DNA, 20 bp, mouse
ggggaggaatacaagggagt

SEQ ID NO: 639529 - DNA, 20 bp, mouse
ggagcgcaggcgatgaagag

SEQ ID NO: 639530 - DNA, 20 bp, mouse
ggcgtcagaaggcagcacga

SEQ ID NO: 639531 - DNA, 20 bp, mouse
ggaggggggtgcacgagcga

SEQ ID NO: 639532 - DNA, 20 bp, mouse
gagagaggagtgggcgatgg

SEQ ID NO: 639533 - DNA, 20 bp, mouse
gcctgcgccgacatcactag

SEQ ID NO: 639534 - DNA, 20 bp, mouse
ggaggctcgtagggaggagt

SEQ ID NO: 639535 - DNA, 20 bp, mouse
gcgtgttgggaggaatacaa

SEQ ID NO: 639536 - DNA, 20 bp, mouse
gaggcgtggctaattcccct

SEQ ID NO: 639537 - DNA, 20 bp, mouse
gaccagctgaagagcaaccc

SEQ ID NO: 639538 - DNA, 20 bp, mouse
gttagaatccggaacagggg

SEQ ID NO: 639539 - DNA, 20 bp, mouse
gaatgggaagacaaagtaca

SEQ ID NO: 639540 - DNA, 20 bp, mouse
gaactgcgccaaaacacaca

SEQ ID NO: 639541 - DNA, 20 bp, mouse
gttagctatacatttgccag

SEQ ID NO: 639542 - DNA, 20 bp, mouse
ggtgtactgaatcattctgc

SEQ ID NO: 639543 - DNA, 20 bp, mouse
gagcaggcacctcatgtata

SEQ ID NO: 639544 - DNA, 20 bp, mouse
gtctcctttgggcattctac

SEQ ID NO: 639545 - DNA, 20 bp, mouse
gccagtctttggtcattaat

SEQ ID NO: 639546 - DNA, 20 bp, mouse
ggagtcaagccaggtctggt

SEQ ID NO: 639547 - DNA, 20 bp, mouse
gaaacctcggagatagagag

SEQ ID NO: 639548 - DNA, 20 bp, mouse
gaagccaggtctggtagggt

SEQ ID NO: 639549 - DNA, 20 bp, mouse
gtgtggctgccactgttctt

SEQ ID NO: 639550 - DNA, 20 bp, mouse
ggcagcttgcaccagggttt

SEQ ID NO: 639551 - DNA, 20 bp, mouse
gaggagacatgtcatggtca

SEQ ID NO: 639552 - DNA, 20 bp, mouse
ggctggagtcaagccaggtc

SEQ ID NO: 639553 - DNA, 20 bp, mouse
gtggtgctactcagtccagt

SEQ ID NO: 639554 - DNA, 20 bp, mouse
gctaaactacacccgagact

SEQ ID NO: 639555 - DNA, 20 bp, mouse
gaagctgctggagtcaagcc

SEQ ID NO: 639556 - DNA, 20 bp, mouse
gaggaggcaatgtgtacata

SEQ ID NO: 639557 - DNA, 20 bp, mouse
gaattccagtaatgacacgg

SEQ ID NO: 639558 - DNA, 20 bp, mouse
gatagccccactgagtcata

SEQ ID NO: 639559 - DNA, 20 bp, mouse
gttaaattccagtaatgaca

SEQ ID NO: 639560 - DNA, 20 bp, mouse
gtcagccttatgactcagtg

SEQ ID NO: 639561 - DNA, 20 bp, mouse
gactattttcataccagagg

SEQ ID NO: 639562 - DNA, 20 bp, mouse
gatagggattactgaatgaa

SEQ ID NO: 639563 - DNA, 20 bp, mouse
gaagaaatatttttctagag

SEQ ID NO: 639564 - DNA, 20 bp, mouse
gagcaacaatatgaaagaag

SEQ ID NO: 639565 - DNA, 20 bp, mouse
gttgactattttcataccag

SEQ ID NO: 639566 - DNA, 20 bp, mouse
gtgagtgggcaacacctgtg

SEQ ID NO: 639567 - DNA, 20 bp, mouse
gcctctgggagcaattgagt

SEQ ID NO: 639568 - DNA, 20 bp, mouse
gaagcaaggaaacatagcta

SEQ ID NO: 639569 - DNA, 20 bp, mouse
gtggtccactggagtaatta

SEQ ID NO: 639570 - DNA, 20 bp, mouse
ggtggtggaaactgattctg

SEQ ID NO: 639571 - DNA, 20 bp, mouse
gttgtcatctataacttccc

SEQ ID NO: 639572 - DNA, 20 bp, mouse
gctgataaagggacagtaat

SEQ ID NO: 639573 - DNA, 20 bp, mouse
gaattgctcccagaggtgtt

SEQ ID NO: 639574 - DNA, 20 bp, mouse
gtcaaccctaattactccag

SEQ ID NO: 639575 - DNA, 20 bp, mouse
ggcaggaacactgacattgt

SEQ ID NO: 639576 - DNA, 20 bp, mouse
gtggcagcgggctggagcta

SEQ ID NO: 639577 - DNA, 20 bp, mouse
gctctcgcgtctgtgggccc

SEQ ID NO: 639578 - DNA, 20 bp, mouse
gaggccgagcgaggcagcta

SEQ ID NO: 639579 - DNA, 20 bp, mouse
gtgggccgcggaaggggagt

SEQ ID NO: 639580 - DNA, 20 bp, mouse
gagcccgcgggacccacagg

SEQ ID NO: 639581 - DNA, 20 bp, mouse
gggaggaggggcgtgcgtgg

SEQ ID NO: 639582 - DNA, 20 bp, mouse
gaaaagccgccaggtcgcgg

SEQ ID NO: 639583 - DNA, 20 bp, mouse
ggcgctctgggccgcggaag

SEQ ID NO: 639584 - DNA, 20 bp, mouse
ggggtcccgcgggctggcag

SEQ ID NO: 639585 - DNA, 20 bp, mouse
gcgtctagagatcggaggag

SEQ ID NO: 639586 - DNA, 20 bp, mouse
gcttcagccaatgacatgtc

SEQ ID NO: 639587 - DNA, 20 bp, mouse
gagtggcagaagcaccggac

SEQ ID NO: 639588 - DNA, 20 bp, mouse
gctcaccatgaatagttccc

SEQ ID NO: 639589 - DNA, 20 bp, mouse
ggccaatgacatgtcaggaa

SEQ ID NO: 639590 - DNA, 20 bp, mouse
gttaaaggatctggtttaaa

SEQ ID NO: 639591 - DNA, 20 bp, mouse
gcacttagtggcagaagcac

SEQ ID NO: 639592 - DNA, 20 bp, mouse
ggaattcaagttaaaggatc

SEQ ID NO: 639593 - DNA, 20 bp, mouse
gatgacggaattcaagttaa

SEQ ID NO: 639594 - DNA, 20 bp, mouse
gttagctaattggcacttag

SEQ ID NO: 639595 - DNA, 20 bp, mouse
gtctaccagggaactattca

SEQ ID NO: 639596 - DNA, 20 bp, mouse
gtgggagtctatggagggcg

SEQ ID NO: 639597 - DNA, 20 bp, mouse
gccaagtgggagtctatgga

SEQ ID NO: 639598 - DNA, 20 bp, mouse
gagagtctgaggtgccaagt

SEQ ID NO: 639599 - DNA, 20 bp, mouse
gtaaggctctgcaagagctt

SEQ ID NO: 639600 - DNA, 20 bp, mouse
gtaagggacccgctctgagg

SEQ ID NO: 639601 - DNA, 20 bp, mouse
gcagaacaaatcagagtctg

SEQ ID NO: 639602 - DNA, 20 bp, mouse
gacctcgtacaagtaagtga

SEQ ID NO: 639603 - DNA, 20 bp, mouse
gaatcaatcaatctcttaac

SEQ ID NO: 639604 - DNA, 20 bp, mouse
gtgctcgttggtatctatgt

SEQ ID NO: 639605 - DNA, 20 bp, mouse
ggagggaaatcgctgcttct

SEQ ID NO: 639606 - DNA, 20 bp, mouse
gcggaaacggcgctcttgta

SEQ ID NO: 639607 - DNA, 20 bp, mouse
gtggccgctcaggtctgctg

SEQ ID NO: 639608 - DNA, 20 bp, mouse
gccgcagggcggggttcttt

SEQ ID NO: 639609 - DNA, 20 bp, mouse
ggggagcgctcttttcgacg

SEQ ID NO: 639610 - DNA, 20 bp, mouse
gcgcaggccgcacgaggctc

SEQ ID NO: 639611 - DNA, 20 bp, mouse
gagcgctcttttcgacgcgg

SEQ ID NO: 639612 - DNA, 20 bp, mouse
gggtaagcggttgttcactg

SEQ ID NO: 639613 - DNA, 20 bp, mouse
gacgcggcggaagaggtaag

SEQ ID NO: 639614 - DNA, 20 bp, mouse
gcaggtctgctgcgggcgac

SEQ ID NO: 639615 - DNA, 20 bp, mouse
gcagcagccggactaggaca

SEQ ID NO: 639616 - DNA, 20 bp, mouse
gcctcagcagggttccgact

SEQ ID NO: 639617 - DNA, 20 bp, mouse
ggcaaccgagcccctcagca

SEQ ID NO: 639618 - DNA, 20 bp, mouse
ggcccatccagcacgagggg

SEQ ID NO: 639619 - DNA, 20 bp, mouse
ggctcacgaagcaatccctg

SEQ ID NO: 639620 - DNA, 20 bp, mouse
gctaggtctggaaacaggga

SEQ ID NO: 639621 - DNA, 20 bp, mouse
ggccgcccatccagcacgag

SEQ ID NO: 639622 - DNA, 20 bp, mouse
gtccgactaggtctggaaac

SEQ ID NO: 639623 - DNA, 20 bp, mouse
gacaccggaagtgacgtcgg

SEQ ID NO: 639624 - DNA, 20 bp, mouse
gaaaccgcagcgaccgcctg

SEQ ID NO: 639625 - DNA, 20 bp, mouse
gctgacagacgatgtaggag

SEQ ID NO: 639626 - DNA, 20 bp, mouse
gagggctataagcagaaggg

SEQ ID NO: 639627 - DNA, 20 bp, mouse
ggtggactcaagcagacaga

SEQ ID NO: 639628 - DNA, 20 bp, mouse
ggcagaagggagggttgcac

SEQ ID NO: 639629 - DNA, 20 bp, mouse
gagcagcaagatttcaaagg

SEQ ID NO: 639630 - DNA, 20 bp, mouse
ggatttcaaaggagggagta

SEQ ID NO: 639631 - DNA, 20 bp, mouse
gttcagcagcaagatttcaa

SEQ ID NO: 639632 - DNA, 20 bp, mouse
gacactcttagagggaaagt

SEQ ID NO: 639633 - DNA, 20 bp, mouse
gtcaacaaataagatcctag

SEQ ID NO: 639634 - DNA, 20 bp, mouse
gtaggcttttttatggaact

SEQ ID NO: 639635 - DNA, 20 bp, mouse
gtgtggtggttgtttaattg

SEQ ID NO: 639636 - DNA, 20 bp, mouse
ggtctaggaagacatctctg

SEQ ID NO: 639637 - DNA, 20 bp, mouse
gaggttggggacacttgtct

SEQ ID NO: 639638 - DNA, 20 bp, mouse
ggtccacaggcagttgctat

SEQ ID NO: 639639 - DNA, 20 bp, mouse
ggcagagtgtgagacaactc

SEQ ID NO: 639640 - DNA, 20 bp, mouse
gcgttcttaaactgaggggt

SEQ ID NO: 639641 - DNA, 20 bp, mouse
gagttgctataggaatgtta

SEQ ID NO: 639642 - DNA, 20 bp, mouse
gtaggaaatgtcaggggtca

SEQ ID NO: 639643 - DNA, 20 bp, mouse
gcctacgttcttaaactgag

SEQ ID NO: 639644 - DNA, 20 bp, mouse
gagcaagaggcggaacagtt

SEQ ID NO: 639645 - DNA, 20 bp, mouse
gctgcacactcaaagtccac

SEQ ID NO: 639646 - DNA, 20 bp, mouse
gcggggagggagaacgagac

SEQ ID NO: 639647 - DNA, 20 bp, mouse
gcacccgaggcgcccgtccg

SEQ ID NO: 639648 - DNA, 20 bp, mouse
gggccgcgagctcccggacc

SEQ ID NO: 639649 - DNA, 20 bp, mouse
gtgggcgcatcggccaggtc

SEQ ID NO: 639650 - DNA, 20 bp, mouse
gccgtccggggggcccccga

SEQ ID NO: 639651 - DNA, 20 bp, mouse
gagcggacagcgaggagaaa

SEQ ID NO: 639652 - DNA, 20 bp, mouse
gagcgaacttgggacctctt

SEQ ID NO: 639653 - DNA, 20 bp, mouse
ggggcggcggccaatccggg

SEQ ID NO: 639654 - DNA, 20 bp, mouse
ggggcggggcttgtgagctc

SEQ ID NO: 639655 - DNA, 20 bp, mouse
gtcagagggcgctcactcac

SEQ ID NO: 639656 - DNA, 20 bp, mouse
gtctttgcttagactcccag

SEQ ID NO: 639657 - DNA, 20 bp, mouse
ggctccatccggagagtgta

SEQ ID NO: 639658 - DNA, 20 bp, mouse
gccccgcccctgctccacca

SEQ ID NO: 639659 - DNA, 20 bp, mouse
ggaccctggtggagcagggg

SEQ ID NO: 639660 - DNA, 20 bp, mouse
ggctggtcttagcacgagag

SEQ ID NO: 639661 - DNA, 20 bp, mouse
gctgtttcctggtctaatta

SEQ ID NO: 639662 - DNA, 20 bp, mouse
gggcacacagcagaagatac

SEQ ID NO: 639663 - DNA, 20 bp, mouse
gcaggaaacagatcacccct

SEQ ID NO: 639664 - DNA, 20 bp, mouse
gccatccggagagtgtaggg

SEQ ID NO: 639665 - DNA, 20 bp, mouse
gagggcctgtgttagttctt

SEQ ID NO: 639666 - DNA, 20 bp, mouse
gcaaccacccaccataaaaa

SEQ ID NO: 639667 - DNA, 20 bp, mouse
ggtaaggcctcaccggaagt

SEQ ID NO: 639668 - DNA, 20 bp, mouse
ggtcacctgtaaggcctcac

SEQ ID NO: 639669 - DNA, 20 bp, mouse
ggcgcgacagggatgcgcgt

SEQ ID NO: 639670 - DNA, 20 bp, mouse
ggtaactgcagtcacctgta

SEQ ID NO: 639671 - DNA, 20 bp, mouse
gagggaccccaggcgcgaca

SEQ ID NO: 639672 - DNA, 20 bp, mouse
ggcgttctacctgcccacga

SEQ ID NO: 639673 - DNA, 20 bp, mouse
gcttgtgtcggcgacttttt

SEQ ID NO: 639674 - DNA, 20 bp, mouse
gaatcctgacacagggggtg

SEQ ID NO: 639675 - DNA, 20 bp, mouse
ggaccagagccctcgtgggc

SEQ ID NO: 639676 - DNA, 20 bp, mouse
gaaggcgcctctgcgagtat

SEQ ID NO: 639677 - DNA, 20 bp, mouse
gttccagcgcccaccatagc

SEQ ID NO: 639678 - DNA, 20 bp, mouse
gactgtaagccagctatggt

SEQ ID NO: 639679 - DNA, 20 bp, mouse
gtggcactgtaagccagcta

SEQ ID NO: 639680 - DNA, 20 bp, mouse
gtacaaggactgctttccca

SEQ ID NO: 639681 - DNA, 20 bp, mouse
gcaggcacctatactcgcag

SEQ ID NO: 639682 - DNA, 20 bp, mouse
gggaaagcagtccttgtaca

SEQ ID NO: 639683 - DNA, 20 bp, mouse
gacctttggtcgtttgttcg

SEQ ID NO: 639684 - DNA, 20 bp, mouse
gagccagctatggtgggcgc

SEQ ID NO: 639685 - DNA, 20 bp, mouse
gcatgcgcattaacctttat

SEQ ID NO: 639686 - DNA, 20 bp, mouse
gcaaacgtgcgaagaggggc

SEQ ID NO: 639687 - DNA, 20 bp, mouse
gggagccaaacgtgcgaaga

SEQ ID NO: 639688 - DNA, 20 bp, mouse
gaagcgcggaagtttgaaga

SEQ ID NO: 639689 - DNA, 20 bp, mouse
gagcttaagcacgcccccta

SEQ ID NO: 639690 - DNA, 20 bp, mouse
gcttctaaagcgactggcga

SEQ ID NO: 639691 - DNA, 20 bp, mouse
gcacgggagcccagggttcg

SEQ ID NO: 639692 - DNA, 20 bp, mouse
ggcgtgcttaagctcgctgt

SEQ ID NO: 639693 - DNA, 20 bp, mouse
gagacgcggtccaggggcgc

SEQ ID NO: 639694 - DNA, 20 bp, mouse
gaggaccagacgcggtccag

SEQ ID NO: 639695 - DNA, 20 bp, mouse
gcagacatctgctctctttg

SEQ ID NO: 639696 - DNA, 20 bp, mouse
ggcgagtggcagtttatttt

SEQ ID NO: 639697 - DNA, 20 bp, mouse
gtcgtcccgttcagggtcta

SEQ ID NO: 639698 - DNA, 20 bp, mouse
gaccctgaacgggacgagct

SEQ ID NO: 639699 - DNA, 20 bp, mouse
gagataagagtgtacctcaa

SEQ ID NO: 639700 - DNA, 20 bp, mouse
gagagtcaagcaggaactag

SEQ ID NO: 639701 - DNA, 20 bp, mouse
ggactctgctagccaatcac

SEQ ID NO: 639702 - DNA, 20 bp, mouse
gagcaagcactctacccttg

SEQ ID NO: 639703 - DNA, 20 bp, mouse
ggtcaagcaggaactagagg

SEQ ID NO: 639704 - DNA, 20 bp, mouse
ggaacgggacgagctgggat

SEQ ID NO: 639705 - DNA, 20 bp, mouse
gagactggatagtgcttgaa

SEQ ID NO: 639706 - DNA, 20 bp, mouse
ggctgagtcactaggaacta

SEQ ID NO: 639707 - DNA, 20 bp, mouse
gcaagtgtataaaagacata

SEQ ID NO: 639708 - DNA, 20 bp, mouse
gcataaggatgaaggactct

SEQ ID NO: 639709 - DNA, 20 bp, mouse
gtcagagccaaaacacccgt

SEQ ID NO: 639710 - DNA, 20 bp, mouse
gaccctggatcactggaaag

SEQ ID NO: 639711 - DNA, 20 bp, mouse
gagaaacacgcctgctccaa

SEQ ID NO: 639712 - DNA, 20 bp, mouse
gcaaaggccaggcctagctt

SEQ ID NO: 639713 - DNA, 20 bp, mouse
gaagaggagaactcagcaat

SEQ ID NO: 639714 - DNA, 20 bp, mouse
gataaaagacataaggatga

SEQ ID NO: 639715 - DNA, 20 bp, mouse
gaaggcatggccaagtctaa

SEQ ID NO: 639716 - DNA, 20 bp, mouse
gcccaagttgggtgcctcac

SEQ ID NO: 639717 - DNA, 20 bp, mouse
gcacgtgtcccctaagttag

SEQ ID NO: 639718 - DNA, 20 bp, mouse
gaggcacccaacttgggcag

SEQ ID NO: 639719 - DNA, 20 bp, mouse
gccacagctgcctctaactt

SEQ ID NO: 639720 - DNA, 20 bp, mouse
gtagactaggttaactgtga

SEQ ID NO: 639721 - DNA, 20 bp, mouse
gaagggatttccaccgacaa

SEQ ID NO: 639722 - DNA, 20 bp, mouse
gcagaggacctgttggtgtg

SEQ ID NO: 639723 - DNA, 20 bp, mouse
gtagtctaactggggatcaa

SEQ ID NO: 639724 - DNA, 20 bp, mouse
gaacacgaaaggcaatccaa

SEQ ID NO: 639725 - DNA, 20 bp, mouse
gcgtgcaagacaattttctg

SEQ ID NO: 639726 - DNA, 20 bp, mouse
gtatggaagcagatgaactc

SEQ ID NO: 639727 - DNA, 20 bp, mouse
gaagagctctctgctcatgc

SEQ ID NO: 639728 - DNA, 20 bp, mouse
gaagtggcctcagatgccct

SEQ ID NO: 639729 - DNA, 20 bp, mouse
ggagagaccagctggagagc

SEQ ID NO: 639730 - DNA, 20 bp, mouse
gtctgctcatgcagggaacc

SEQ ID NO: 639731 - DNA, 20 bp, mouse
gctcctagctcagataccgg

SEQ ID NO: 639732 - DNA, 20 bp, mouse
gtaagatggtgtctgagagg

SEQ ID NO: 639733 - DNA, 20 bp, mouse
gggcaaagtgtcacaaccaa

SEQ ID NO: 639734 - DNA, 20 bp, mouse
gtgccgccggtatctgagct

SEQ ID NO: 639735 - DNA, 20 bp, mouse
ggcagagcagacccgcctgg

SEQ ID NO: 639736 - DNA, 20 bp, mouse
gtccggccccgcccccaatt

SEQ ID NO: 639737 - DNA, 20 bp, mouse
gctgccacctgcctgaggtt

SEQ ID NO: 639738 - DNA, 20 bp, mouse
gttgaaaggtacatctgaat

SEQ ID NO: 639739 - DNA, 20 bp, mouse
gaaggtctgagaattagcta

SEQ ID NO: 639740 - DNA, 20 bp, mouse
gtgatgaggtcacagttgaa

SEQ ID NO: 639741 - DNA, 20 bp, mouse
gaaacccaacctcaggcagg

SEQ ID NO: 639742 - DNA, 20 bp, mouse
gagaacatacagtaatttag

SEQ ID NO: 639743 - DNA, 20 bp, mouse
gggagatgggtggtactagg

SEQ ID NO: 639744 - DNA, 20 bp, mouse
gggtttaagcaccaaattgg

SEQ ID NO: 639745 - DNA, 20 bp, mouse
ggtgcttaaaccaaatcatg

SEQ ID NO: 639746 - DNA, 20 bp, mouse
gagaagggatgcctctacat

SEQ ID NO: 639747 - DNA, 20 bp, mouse
gcccctgggaccatagagat

SEQ ID NO: 639748 - DNA, 20 bp, mouse
gtctcagccggcccatgtag

SEQ ID NO: 639749 - DNA, 20 bp, mouse
gaatataaggatatgcccta

SEQ ID NO: 639750 - DNA, 20 bp, mouse
gtgggggcttaccagatctt

SEQ ID NO: 639751 - DNA, 20 bp, mouse
ggcaggttgtaaatgaggga

SEQ ID NO: 639752 - DNA, 20 bp, mouse
gaggggagagttcttgagat

SEQ ID NO: 639753 - DNA, 20 bp, mouse
gcgtctgagaacttcaggct

SEQ ID NO: 639754 - DNA, 20 bp, mouse
gctggctcactataaaatgg

SEQ ID NO: 639755 - DNA, 20 bp, mouse
gcttaccagatcttgggcta

SEQ ID NO: 639756 - DNA, 20 bp, mouse
ggggcaggaaggaaccctga

SEQ ID NO: 639757 - DNA, 20 bp, mouse
gtgccctaaaaaagcagcag

SEQ ID NO: 639758 - DNA, 20 bp, mouse
gtgtgatggggcaggcgtgg

SEQ ID NO: 639759 - DNA, 20 bp, mouse
gggaaggaaccctgagggac

SEQ ID NO: 639760 - DNA, 20 bp, mouse
gggcaaaggcccagtagaga

SEQ ID NO: 639761 - DNA, 20 bp, mouse
gccggaatggatgtgtgatg

SEQ ID NO: 639762 - DNA, 20 bp, mouse
gggtgagaggaagtagaagt

SEQ ID NO: 639763 - DNA, 20 bp, mouse
gatgcagagaccaccttgca

SEQ ID NO: 639764 - DNA, 20 bp, mouse
ggaccaccttgcagggaaac

SEQ ID NO: 639765 - DNA, 20 bp, mouse
gcctctgatgctatgagtca

SEQ ID NO: 639766 - DNA, 20 bp, mouse
gggagcctcgagagcagttg

SEQ ID NO: 639767 - DNA, 20 bp, mouse
gggtgtctaggggtcgtggg

SEQ ID NO: 639768 - DNA, 20 bp, mouse
gcggcgcgcgggccattccg

SEQ ID NO: 639769 - DNA, 20 bp, mouse
gagacaccggccctcgtcct

SEQ ID NO: 639770 - DNA, 20 bp, mouse
ggccggctcgtcttcgggga

SEQ ID NO: 639771 - DNA, 20 bp, mouse
gcgaagacgagccggcccgg

SEQ ID NO: 639772 - DNA, 20 bp, mouse
gaggagcttcggggccgaga

SEQ ID NO: 639773 - DNA, 20 bp, mouse
gcggtccgagccgaggacga

SEQ ID NO: 639774 - DNA, 20 bp, mouse
ggacgagggccggtgtctag

SEQ ID NO: 639775 - DNA, 20 bp, mouse
gggccggtgtctaggggtcg

SEQ ID NO: 639776 - DNA, 20 bp, mouse
gtagagaaacggtatgatcc

SEQ ID NO: 639777 - DNA, 20 bp, mouse
gattcccacaggatagataa

SEQ ID NO: 639778 - DNA, 20 bp, mouse
gagagtgaaggtctattaac

SEQ ID NO: 639779 - DNA, 20 bp, mouse
gtcaaatgtctgtgactcac

SEQ ID NO: 639780 - DNA, 20 bp, mouse
gcgtggaacaatcaatgatt

SEQ ID NO: 639781 - DNA, 20 bp, mouse
gtgactcacaggatcctagc

SEQ ID NO: 639782 - DNA, 20 bp, mouse
gctaaggtgagaaaatatgg

SEQ ID NO: 639783 - DNA, 20 bp, mouse
gagggcatcaataagagtga

SEQ ID NO: 639784 - DNA, 20 bp, mouse
gctgtcttagaggcagaggt

SEQ ID NO: 639785 - DNA, 20 bp, mouse
gcgtttctctaattaattat

SEQ ID NO: 639786 - DNA, 20 bp, mouse
ggctttaaagagtaattaaa

SEQ ID NO: 639787 - DNA, 20 bp, mouse
gtaaatcatttgctgaagaa

SEQ ID NO: 639788 - DNA, 20 bp, mouse
gaaaacaaaaccttgtagtc

SEQ ID NO: 639789 - DNA, 20 bp, mouse
gattctgaacattgatatag

SEQ ID NO: 639790 - DNA, 20 bp, mouse
gaacatatgtgcacacttaa

SEQ ID NO: 639791 - DNA, 20 bp, mouse
gtattgttacttccataaaa

SEQ ID NO: 639792 - DNA, 20 bp, mouse
gttatggaagtaacaatatg

SEQ ID NO: 639793 - DNA, 20 bp, mouse
gacaaatgccaaaattgaaa

SEQ ID NO: 639794 - DNA, 20 bp, mouse
gaggtaaatttcagaattca

SEQ ID NO: 639795 - DNA, 20 bp, mouse
gtttctgaccatttcaattt

SEQ ID NO: 639796 - DNA, 20 bp, mouse
gtaccaggaccatatgtcta

SEQ ID NO: 639797 - DNA, 20 bp, mouse
ggagtactggctattcttgt

SEQ ID NO: 639798 - DNA, 20 bp, mouse
ggctacctcttctgcatacc

SEQ ID NO: 639799 - DNA, 20 bp, mouse
gtagccatcttgtgcagaag

SEQ ID NO: 639800 - DNA, 20 bp, mouse
gctacctcttctgcacaaga

SEQ ID NO: 639801 - DNA, 20 bp, mouse
gtgtaccaatataactgcaa

SEQ ID NO: 639802 - DNA, 20 bp, mouse
gtattccattgcagttatat

SEQ ID NO: 639803 - DNA, 20 bp, mouse
ggtataaagcttatgagaaa

SEQ ID NO: 639804 - DNA, 20 bp, mouse
ggtctcacgaccatctgaat

SEQ ID NO: 639805 - DNA, 20 bp, mouse
gaagaggtagccatcttgtt

SEQ ID NO: 639806 - DNA, 20 bp, mouse
ggcacctgggaatgtggtgg

SEQ ID NO: 639807 - DNA, 20 bp, mouse
gtaacttggttagtgttaga

SEQ ID NO: 639808 - DNA, 20 bp, mouse
ggtaaagttctgtatgccac

SEQ ID NO: 639809 - DNA, 20 bp, mouse
gcaaaatgaaatgcagcacc

SEQ ID NO: 639810 - DNA, 20 bp, mouse
ggagccttatccactgaatg

SEQ ID NO: 639811 - DNA, 20 bp, mouse
gaaacaatgtcctcattcag

SEQ ID NO: 639812 - DNA, 20 bp, mouse
gtgtcctcattcagtggata

SEQ ID NO: 639813 - DNA, 20 bp, mouse
gaggacattgtttgttgtac

SEQ ID NO: 639814 - DNA, 20 bp, mouse
gtttgttgtaccgggattcc

SEQ ID NO: 639815 - DNA, 20 bp, mouse
gacatttgtagagagtggat

SEQ ID NO: 639816 - DNA, 20 bp, mouse
gctgaattagggcaacttca

SEQ ID NO: 639817 - DNA, 20 bp, mouse
gtgacaaaacaactgaatta

SEQ ID NO: 639818 - DNA, 20 bp, mouse
ggtttcaagaactttcggta

SEQ ID NO: 639819 - DNA, 20 bp, mouse
gcctatggagttaactccaa

SEQ ID NO: 639820 - DNA, 20 bp, mouse
gctgaagtttcaagaacttt

SEQ ID NO: 639821 - DNA, 20 bp, mouse
ggtcttgaagatggggtctt

SEQ ID NO: 639822 - DNA, 20 bp, mouse
gtaactccataggttttacc

SEQ ID NO: 639823 - DNA, 20 bp, mouse
ggctcatgaattaacactgt

SEQ ID NO: 639824 - DNA, 20 bp, mouse
gcaagacctggtaaaaccta

SEQ ID NO: 639825 - DNA, 20 bp, mouse
gtttaccaggtcttgaagat

SEQ ID NO: 639826 - DNA, 20 bp, mouse
gttctggaagtcgatatgat

SEQ ID NO: 639827 - DNA, 20 bp, mouse
gcacacccaacagagacttc

SEQ ID NO: 639828 - DNA, 20 bp, mouse
ggtgctccctagagtgtcag

SEQ ID NO: 639829 - DNA, 20 bp, mouse
ggacttccagaagtctctgt

SEQ ID NO: 639830 - DNA, 20 bp, mouse
ggctagctagagccatgagt

SEQ ID NO: 639831 - DNA, 20 bp, mouse
gcaagacagcagagggttta

SEQ ID NO: 639832 - DNA, 20 bp, mouse
gcagctctaatcccagtcta

SEQ ID NO: 639833 - DNA, 20 bp, mouse
gggtgggagagaattccagg

SEQ ID NO: 639834 - DNA, 20 bp, mouse
ggtgtggtctctcctgtcca

SEQ ID NO: 639835 - DNA, 20 bp, mouse
ggtcactgagtgttagcctg

SEQ ID NO: 639836 - DNA, 20 bp, mouse
gagaaatggtcaaaaaggag

SEQ ID NO: 639837 - DNA, 20 bp, mouse
gaaggctcgtcattgagaaa

SEQ ID NO: 639838 - DNA, 20 bp, mouse
ggagagccaggtaaccacga

SEQ ID NO: 639839 - DNA, 20 bp, mouse
gcgggaccacgcagccttcg

SEQ ID NO: 639840 - DNA, 20 bp, mouse
gttcagtaaaggtgatcgga

SEQ ID NO: 639841 - DNA, 20 bp, mouse
gaaaggtgatcggagggagg

SEQ ID NO: 639842 - DNA, 20 bp, mouse
gtggttgcaaaggtgtgtgc

SEQ ID NO: 639843 - DNA, 20 bp, mouse
gtgtcgcagcctctcctctt

SEQ ID NO: 639844 - DNA, 20 bp, mouse
gcaacagtacgccctcacac

SEQ ID NO: 639845 - DNA, 20 bp, mouse
gcattgagaaatggtcaaaa

SEQ ID NO: 639846 - DNA, 20 bp, mouse
ggcctcccttactttaaaaa

SEQ ID NO: 639847 - DNA, 20 bp, mouse
gatgtgccccaacttttcat

SEQ ID NO: 639848 - DNA, 20 bp, mouse
gaaaagaaatatcaatgttt

SEQ ID NO: 639849 - DNA, 20 bp, mouse
ggtatgccaatgaaaagttg

SEQ ID NO: 639850 - DNA, 20 bp, mouse
gaacttcaggctgaaaagaa

SEQ ID NO: 639851 - DNA, 20 bp, mouse
gtgtgatacagagtaaaaga

SEQ ID NO: 639852 - DNA, 20 bp, mouse
gtcattggcatacagggtaa

SEQ ID NO: 639853 - DNA, 20 bp, mouse
gaaaacttcccataatatgt

SEQ ID NO: 639854 - DNA, 20 bp, mouse
gtcttcactcattagaaatg

SEQ ID NO: 639855 - DNA, 20 bp, mouse
ggctgaaaagaatggattgc

SEQ ID NO: 639856 - DNA, 20 bp, mouse
gggagagcgcgcgtgcgcga

SEQ ID NO: 639857 - DNA, 20 bp, mouse
gcgcccctccccaggctcgc

SEQ ID NO: 639858 - DNA, 20 bp, mouse
ggagcctgcgagcctgggga

SEQ ID NO: 639859 - DNA, 20 bp, mouse
ggggggacccccaaccatcc

SEQ ID NO: 639860 - DNA, 20 bp, mouse
gcgactcagccctggatggt

SEQ ID NO: 639861 - DNA, 20 bp, mouse
gtctccggccgactcagccc

SEQ ID NO: 639862 - DNA, 20 bp, mouse
gccccgaggggtgtgaggca

SEQ ID NO: 639863 - DNA, 20 bp, mouse
ggctccgcccagcgctgaag

SEQ ID NO: 639864 - DNA, 20 bp, mouse
gctgaagggggtctagcgca

SEQ ID NO: 639865 - DNA, 20 bp, mouse
gcccggtccgccttcttcct

SEQ ID NO: 639866 - DNA, 20 bp, mouse
ggacctagatctcatcccta

SEQ ID NO: 639867 - DNA, 20 bp, mouse
gggccctagggatgagatct

SEQ ID NO: 639868 - DNA, 20 bp, mouse
gggacagggcttaggcccta

SEQ ID NO: 639869 - DNA, 20 bp, mouse
gcgggcctggtgccagtgag

SEQ ID NO: 639870 - DNA, 20 bp, mouse
ggcggggccttggaaggccg

SEQ ID NO: 639871 - DNA, 20 bp, mouse
ggccccgcccccggcccaag

SEQ ID NO: 639872 - DNA, 20 bp, mouse
gagaagcgccgcttgggccg

SEQ ID NO: 639873 - DNA, 20 bp, mouse
gaagcggcgcttctccgttc

SEQ ID NO: 639874 - DNA, 20 bp, mouse
gcggggctaactcggttctt

SEQ ID NO: 639875 - DNA, 20 bp, mouse
ggccagagtggcgtacacgg

SEQ ID NO: 639876 - DNA, 20 bp, mouse
gaggagagaacctgtctctt

SEQ ID NO: 639877 - DNA, 20 bp, mouse
gcacaaaggagaggcgtaaa

SEQ ID NO: 639878 - DNA, 20 bp, mouse
ggagacaggttctctcctac

SEQ ID NO: 639879 - DNA, 20 bp, mouse
gtagactgaccacaaaggag

SEQ ID NO: 639880 - DNA, 20 bp, mouse
gcgagaccacgcattccacc

SEQ ID NO: 639881 - DNA, 20 bp, mouse
gtggtggcttagtctatttg

SEQ ID NO: 639882 - DNA, 20 bp, mouse
ggcaagccgggtggaatgcg

SEQ ID NO: 639883 - DNA, 20 bp, mouse
gtgctgtagactgaccacaa

SEQ ID NO: 639884 - DNA, 20 bp, mouse
gctctttggggctgttaagc

SEQ ID NO: 639885 - DNA, 20 bp, mouse
gtcatgagaggggagagact

SEQ ID NO: 639886 - DNA, 20 bp, mouse
gtcctcaaggtcatcgggaa

SEQ ID NO: 639887 - DNA, 20 bp, mouse
gcaggtgccccatgatcacg

SEQ ID NO: 639888 - DNA, 20 bp, mouse
gcacctgcacgtacgatccc

SEQ ID NO: 639889 - DNA, 20 bp, mouse
gcatcgggaaggggagcttt

SEQ ID NO: 639890 - DNA, 20 bp, mouse
gcagcacgtggccctgaaga

SEQ ID NO: 639891 - DNA, 20 bp, mouse
gccggtggacccaacaatgg

SEQ ID NO: 639892 - DNA, 20 bp, mouse
gcgtggccctgaagatggtg

SEQ ID NO: 639893 - DNA, 20 bp, mouse
gtcgttccgcaccatcttca

SEQ ID NO: 639894 - DNA, 20 bp, mouse
gaacgccaaggcatgaccgg

SEQ ID NO: 639895 - DNA, 20 bp, mouse
gtacaggtacgaggtcctca

SEQ ID NO: 639896 - DNA, 20 bp, mouse
gagcgcttcggtaagaagtt

SEQ ID NO: 639897 - DNA, 20 bp, mouse
gtggaagaagccctgtgggc

SEQ ID NO: 639898 - DNA, 20 bp, mouse
gaacccccctaatttcctta

SEQ ID NO: 639899 - DNA, 20 bp, mouse
ggggacaagctggagcgctt

SEQ ID NO: 639900 - DNA, 20 bp, mouse
gtgtcacggccgagcgtcca

SEQ ID NO: 639901 - DNA, 20 bp, mouse
gtagcctcagggaacactag

SEQ ID NO: 639902 - DNA, 20 bp, mouse
gaaaaggcgcgccgcgcgtc

SEQ ID NO: 639903 - DNA, 20 bp, mouse
gccagcttgtcccagacgcg

SEQ ID NO: 639904 - DNA, 20 bp, mouse
gtctatgggcacaattgtca

SEQ ID NO: 639905 - DNA, 20 bp, mouse
ggtgtgtcccaatcagtctc

SEQ ID NO: 639906 - DNA, 20 bp, mouse
ggggagagcccagttcagtc

SEQ ID NO: 639907 - DNA, 20 bp, mouse
gagactcaagacaaccactg

SEQ ID NO: 639908 - DNA, 20 bp, mouse
gctcaagacaaccactgggg

SEQ ID NO: 639909 - DNA, 20 bp, mouse
gctgaactgggctctcccca

SEQ ID NO: 639910 - DNA, 20 bp, mouse
gaaaggaagagagtggcagg

SEQ ID NO: 639911 - DNA, 20 bp, mouse
gtgtttgtggggtcatgtga

SEQ ID NO: 639912 - DNA, 20 bp, mouse
gggttcattctagtctgttc

SEQ ID NO: 639913 - DNA, 20 bp, mouse
gctgggctctccccaaggcc

SEQ ID NO: 639914 - DNA, 20 bp, mouse
gttcttcttcggttgacttg

SEQ ID NO: 639915 - DNA, 20 bp, mouse
gtcaggaagagaaacacttt

SEQ ID NO: 639916 - DNA, 20 bp, mouse
ggggaatgggtagaagctca

SEQ ID NO: 639917 - DNA, 20 bp, mouse
ggctaagagaggcctagtga

SEQ ID NO: 639918 - DNA, 20 bp, mouse
gttagtcaggtgatctaaga

SEQ ID NO: 639919 - DNA, 20 bp, mouse
gatcacaatgatgctaagag

SEQ ID NO: 639920 - DNA, 20 bp, mouse
gtctagcctctggacagagg

SEQ ID NO: 639921 - DNA, 20 bp, mouse
gttagccatgtaggccatgc

SEQ ID NO: 639922 - DNA, 20 bp, mouse
gctgtccagaggctagactt

SEQ ID NO: 639923 - DNA, 20 bp, mouse
gggactttgtcagcctcagg

SEQ ID NO: 639924 - DNA, 20 bp, mouse
gggaacaagatattcaggga

SEQ ID NO: 639925 - DNA, 20 bp, mouse
ggaggccaaagtctagcctc

SEQ ID NO: 639926 - DNA, 20 bp, mouse
gcagttctctccaattggag

SEQ ID NO: 639927 - DNA, 20 bp, mouse
gagaaggtgacatgatactg

SEQ ID NO: 639928 - DNA, 20 bp, mouse
gtttcggtgtcgtctgtaca

SEQ ID NO: 639929 - DNA, 20 bp, mouse
gggtgacatgatactgtggg

SEQ ID NO: 639930 - DNA, 20 bp, mouse
gtgaacgaggcaaatatcag

SEQ ID NO: 639931 - DNA, 20 bp, mouse
gaaccctctgaaatgaatgt

SEQ ID NO: 639932 - DNA, 20 bp, mouse
ggcagcattgtgagaagatg

SEQ ID NO: 639933 - DNA, 20 bp, mouse
ggtaggaacaaaaatatgaa

SEQ ID NO: 639934 - DNA, 20 bp, mouse
gattctctgagtctagtacc

SEQ ID NO: 639935 - DNA, 20 bp, mouse
gttagtgttctactgaccat

SEQ ID NO: 639936 - DNA, 20 bp, mouse
gtggacaggaggaccttgaa

SEQ ID NO: 639937 - DNA, 20 bp, mouse
gctagtccgaaaccagtttt

SEQ ID NO: 639938 - DNA, 20 bp, mouse
gtggccacacctcttttcgt

SEQ ID NO: 639939 - DNA, 20 bp, mouse
gctctagaagagcctaaaac

SEQ ID NO: 639940 - DNA, 20 bp, mouse
gtggggacaggacagaactc

SEQ ID NO: 639941 - DNA, 20 bp, mouse
gttgaggctcctcccactca

SEQ ID NO: 639942 - DNA, 20 bp, mouse
gtgtggctctgggaatatct

SEQ ID NO: 639943 - DNA, 20 bp, mouse
gaagtctgagcgagcgagtt

SEQ ID NO: 639944 - DNA, 20 bp, mouse
gaggttcatccttgagtggg

SEQ ID NO: 639945 - DNA, 20 bp, mouse
gagccacaatctggtcaaag

SEQ ID NO: 639946 - DNA, 20 bp, mouse
gagagagaccatagaacgta

SEQ ID NO: 639947 - DNA, 20 bp, mouse
gcaactggcctctaggtcag

SEQ ID NO: 639948 - DNA, 20 bp, mouse
gcacaaccgtgtgcagaggt

SEQ ID NO: 639949 - DNA, 20 bp, mouse
ggggttgagcggaagctccc

SEQ ID NO: 639950 - DNA, 20 bp, mouse
gtcactgctgacttagcaac

SEQ ID NO: 639951 - DNA, 20 bp, mouse
gggcctgtcaacaacctgcc

SEQ ID NO: 639952 - DNA, 20 bp, mouse
gctagccaatgagtttatgt

SEQ ID NO: 639953 - DNA, 20 bp, mouse
gactctgacctctgacctag

SEQ ID NO: 639954 - DNA, 20 bp, mouse
gtgggtgaggctttcctaac

SEQ ID NO: 639955 - DNA, 20 bp, mouse
gcaacctgccaggggttgag

SEQ ID NO: 639956 - DNA, 20 bp, mouse
ggaagagactgggcagagtg

SEQ ID NO: 639957 - DNA, 20 bp, mouse
gtgtacagctgctcagttat

SEQ ID NO: 639958 - DNA, 20 bp, mouse
gtgaaggtggggtttttagg

SEQ ID NO: 639959 - DNA, 20 bp, mouse
gctaagggttagatgaccct

SEQ ID NO: 639960 - DNA, 20 bp, mouse
gatgacccttggagtgaaac

SEQ ID NO: 639961 - DNA, 20 bp, mouse
gagtgaaacaggcagcagac

SEQ ID NO: 639962 - DNA, 20 bp, mouse
gtattgaaggtggggttttt

SEQ ID NO: 639963 - DNA, 20 bp, mouse
gttgcactggtacctattga

SEQ ID NO: 639964 - DNA, 20 bp, mouse
gttgtgaagtctgcacctaa

SEQ ID NO: 639965 - DNA, 20 bp, mouse
gcactggtacctattgaagg

SEQ ID NO: 639966 - DNA, 20 bp, mouse
gagggccatggtctatcaaa

SEQ ID NO: 639967 - DNA, 20 bp, mouse
gcgagagccaggtcataatg

SEQ ID NO: 639968 - DNA, 20 bp, mouse
gcaagatatggggttaaaca

SEQ ID NO: 639969 - DNA, 20 bp, mouse
gctaaccaggagcaagatat

SEQ ID NO: 639970 - DNA, 20 bp, mouse
gcacgggcgctggtgctaga

SEQ ID NO: 639971 - DNA, 20 bp, mouse
gactgtactcaagtacccga

SEQ ID NO: 639972 - DNA, 20 bp, mouse
ggagacacggcctgctttga

SEQ ID NO: 639973 - DNA, 20 bp, mouse
gggtcagcgtgcagaagaca

SEQ ID NO: 639974 - DNA, 20 bp, mouse
gctcaagtacccgagggcca

SEQ ID NO: 639975 - DNA, 20 bp, mouse
gtaaccccatatcttgctcc

SEQ ID NO: 639976 - DNA, 20 bp, mouse
gctgtgggggatggtcactt

SEQ ID NO: 639977 - DNA, 20 bp, mouse
gctagaagttgtgtacacaa

SEQ ID NO: 639978 - DNA, 20 bp, mouse
gagagctaagagagtgaggt

SEQ ID NO: 639979 - DNA, 20 bp, mouse
gtactgtggctaggtaacta

SEQ ID NO: 639980 - DNA, 20 bp, mouse
gaggagaagacaaagagaaa

SEQ ID NO: 639981 - DNA, 20 bp, mouse
gtgtggctaggtaactaggg

SEQ ID NO: 639982 - DNA, 20 bp, mouse
gaagagagggggtaaggaga

SEQ ID NO: 639983 - DNA, 20 bp, mouse
gagagagagctaagagagtg

SEQ ID NO: 639984 - DNA, 20 bp, mouse
ggaggagtgagagaaatgag

SEQ ID NO: 639985 - DNA, 20 bp, mouse
ggggggatggtcacttaggc

SEQ ID NO: 639986 - DNA, 20 bp, mouse
gggacaggataatactaacg

SEQ ID NO: 639987 - DNA, 20 bp, mouse
gacacaaccctaatgaactg

SEQ ID NO: 639988 - DNA, 20 bp, mouse
gaataggcactgtgcaacta

SEQ ID NO: 639989 - DNA, 20 bp, mouse
ggataacagagtttttgatt

SEQ ID NO: 639990 - DNA, 20 bp, mouse
gtaagaagtagcaaccctga

SEQ ID NO: 639991 - DNA, 20 bp, mouse
gtgaaagtactgacccatca

SEQ ID NO: 639992 - DNA, 20 bp, mouse
gagaagtatggactatagct

SEQ ID NO: 639993 - DNA, 20 bp, mouse
gtctaatcaccttagtctct

SEQ ID NO: 639994 - DNA, 20 bp, mouse
gtaatgaacctcagttcatt

SEQ ID NO: 639995 - DNA, 20 bp, mouse
gcatcttttattataaggac

SEQ ID NO: 639996 - DNA, 20 bp, mouse
gccccgccaagccccagcga

SEQ ID NO: 639997 - DNA, 20 bp, mouse
gccccagcgagggctctcac

SEQ ID NO: 639998 - DNA, 20 bp, mouse
ggaggggcggcgaacccctc

SEQ ID NO: 639999 - DNA, 20 bp, mouse
gtgggcagtgggctagtcgc

SEQ ID NO: 640000 - DNA, 20 bp, mouse
ggggcggtcgtcgaggggtg

SEQ ID NO: 640001 - DNA, 20 bp, mouse
gagagacgggcggtcgtcga

SEQ ID NO: 640002 - DNA, 20 bp, mouse
gagggtggaagcacccgaca

SEQ ID NO: 640003 - DNA, 20 bp, mouse
gcacccgacagggattagag

SEQ ID NO: 640004 - DNA, 20 bp, mouse
ggccctgcaacagtgcacca

SEQ ID NO: 640005 - DNA, 20 bp, mouse
ggatgcagggctcgggtgga

SEQ ID NO: 640006 - DNA, 20 bp, mouse
gcgtgtaagcatgctagata

SEQ ID NO: 640007 - DNA, 20 bp, mouse
gaagtttgggaagttggact

SEQ ID NO: 640008 - DNA, 20 bp, mouse
gtgctagatatggaacaata

SEQ ID NO: 640009 - DNA, 20 bp, mouse
gcagaggagtagatctgggt

SEQ ID NO: 640010 - DNA, 20 bp, mouse
gggtaataattcatgtttat

SEQ ID NO: 640011 - DNA, 20 bp, mouse
gagtttgctttggagttctg

SEQ ID NO: 640012 - DNA, 20 bp, mouse
gagagaattgtgactcaaga

SEQ ID NO: 640013 - DNA, 20 bp, mouse
gctattgtgctgaggggcac

SEQ ID NO: 640014 - DNA, 20 bp, mouse
gggaaggaagtttgggaagt

SEQ ID NO: 640015 - DNA, 20 bp, mouse
ggactcagtctattgtgctg

SEQ ID NO: 640016 - DNA, 20 bp, mouse
gcctgaggcaaatctggggt

SEQ ID NO: 640017 - DNA, 20 bp, mouse
gctgggcggggcttaagatg

SEQ ID NO: 640018 - DNA, 20 bp, mouse
gactgaaagaatagctgtgg

SEQ ID NO: 640019 - DNA, 20 bp, mouse
gcaaggggaaagggcgggaa

SEQ ID NO: 640020 - DNA, 20 bp, mouse
gcaggtggcgccatgttcca

SEQ ID NO: 640021 - DNA, 20 bp, mouse
gatggcgccacctgactcct

SEQ ID NO: 640022 - DNA, 20 bp, mouse
ggaaccaaccacgctgcccc

SEQ ID NO: 640023 - DNA, 20 bp, mouse
gagggcctgccctgaaattc

SEQ ID NO: 640024 - DNA, 20 bp, mouse
gggcagcgtggttggttctg

SEQ ID NO: 640025 - DNA, 20 bp, mouse
gttctgcggcagtgtcagtc

SEQ ID NO: 640026 - DNA, 20 bp, mouse
gcaaggaggtgtttgatgta

SEQ ID NO: 640027 - DNA, 20 bp, mouse
ggaacaatggttgtcaggtg

SEQ ID NO: 640028 - DNA, 20 bp, mouse
gttgtcaggtggggcttcct

SEQ ID NO: 640029 - DNA, 20 bp, mouse
gtttcaagtagcaagactga

SEQ ID NO: 640030 - DNA, 20 bp, mouse
gaaccattgttcagcttgaa

SEQ ID NO: 640031 - DNA, 20 bp, mouse
gtgtaaggctggttgacaca

SEQ ID NO: 640032 - DNA, 20 bp, mouse
gccccattcaagctgaacaa

SEQ ID NO: 640033 - DNA, 20 bp, mouse
gcctcctcacctcatcaagg

SEQ ID NO: 640034 - DNA, 20 bp, mouse
gggggacttcagaaggccac

SEQ ID NO: 640035 - DNA, 20 bp, mouse
gtgcgccctttgataaaaaa

SEQ ID NO: 640036 - DNA, 20 bp, mouse
gggaaggccacgccccaagt

SEQ ID NO: 640037 - DNA, 20 bp, mouse
gggcctgcctagcgatttag

SEQ ID NO: 640038 - DNA, 20 bp, mouse
gcgcgcctgggcgggacggt

SEQ ID NO: 640039 - DNA, 20 bp, mouse
gaggcgcgactggcgaaccg

SEQ ID NO: 640040 - DNA, 20 bp, mouse
gcctgggcgggacggtggga

SEQ ID NO: 640041 - DNA, 20 bp, mouse
gttcgccagtcgcgcctggg

SEQ ID NO: 640042 - DNA, 20 bp, mouse
ggggtggggcgggccctgaa

SEQ ID NO: 640043 - DNA, 20 bp, mouse
gcagtcgcgcctgggcggga

SEQ ID NO: 640044 - DNA, 20 bp, mouse
gagacttcccagaaagcctt

SEQ ID NO: 640045 - DNA, 20 bp, mouse
ggagaggaagaccatagagg

SEQ ID NO: 640046 - DNA, 20 bp, mouse
gggaaagagctggggccata

SEQ ID NO: 640047 - DNA, 20 bp, mouse
gaactaggggctcctcctgg

SEQ ID NO: 640048 - DNA, 20 bp, mouse
gagctggggccatagggcat

SEQ ID NO: 640049 - DNA, 20 bp, mouse
ggagctaaatcaagtaacta

SEQ ID NO: 640050 - DNA, 20 bp, mouse
gcagaggcagtaagcagtac

SEQ ID NO: 640051 - DNA, 20 bp, mouse
gagaatggctacgaaaaaag

SEQ ID NO: 640052 - DNA, 20 bp, mouse
gcctgcaataggaatctact

SEQ ID NO: 640053 - DNA, 20 bp, mouse
ggacatttcgatggtgagaa

SEQ ID NO: 640054 - DNA, 20 bp, mouse
gagtaactaggggctcctcc

SEQ ID NO: 640055 - DNA, 20 bp, mouse
gcacaaaaccccagaatgac

SEQ ID NO: 640056 - DNA, 20 bp, mouse
gtggtgggagctaaaaagct

SEQ ID NO: 640057 - DNA, 20 bp, mouse
ggcaagtgagtctataggca

SEQ ID NO: 640058 - DNA, 20 bp, mouse
gcaaggttggggcaaaaata

SEQ ID NO: 640059 - DNA, 20 bp, mouse
gcaacggcaagtgagtctat

SEQ ID NO: 640060 - DNA, 20 bp, mouse
gcagactagctagggttgca

SEQ ID NO: 640061 - DNA, 20 bp, mouse
gtaaaggatagattttcagg

SEQ ID NO: 640062 - DNA, 20 bp, mouse
ggatatgagcttaccaaggt

SEQ ID NO: 640063 - DNA, 20 bp, mouse
gggcaaggcatcctggccca

SEQ ID NO: 640064 - DNA, 20 bp, mouse
gtgtggatataatacattaa

SEQ ID NO: 640065 - DNA, 20 bp, mouse
ggctagtctgaaacttccct

SEQ ID NO: 640066 - DNA, 20 bp, mouse
ggtcaacagcaaggaataaa

SEQ ID NO: 640067 - DNA, 20 bp, mouse
gaaaggtggctggggatctc

SEQ ID NO: 640068 - DNA, 20 bp, mouse
ggcgcactgcggagcgtgct

SEQ ID NO: 640069 - DNA, 20 bp, mouse
gggagcgtgctaggtagaaa

SEQ ID NO: 640070 - DNA, 20 bp, mouse
gagtttgggctcacagggta

SEQ ID NO: 640071 - DNA, 20 bp, mouse
gccaaactaggctacacctc

SEQ ID NO: 640072 - DNA, 20 bp, mouse
ggtggctggggatctcgggg

SEQ ID NO: 640073 - DNA, 20 bp, mouse
gagaaatggaaaactcgctt

SEQ ID NO: 640074 - DNA, 20 bp, mouse
gaggaataaatggcgcactg

SEQ ID NO: 640075 - DNA, 20 bp, mouse
gaacacgcggaaaggtggct

SEQ ID NO: 640076 - DNA, 20 bp, mouse
gcccagtgatgctgcagaag

SEQ ID NO: 640077 - DNA, 20 bp, mouse
gcggccctacactgaaatga

SEQ ID NO: 640078 - DNA, 20 bp, mouse
ggatggaagctcatacatct

SEQ ID NO: 640079 - DNA, 20 bp, mouse
gatacatcttggaacaacct

SEQ ID NO: 640080 - DNA, 20 bp, mouse
gcttccatcatttcagtgta

SEQ ID NO: 640081 - DNA, 20 bp, mouse
gtggaagcgtcacctcagtc

SEQ ID NO: 640082 - DNA, 20 bp, mouse
gatgaagctgacccagactg

SEQ ID NO: 640083 - DNA, 20 bp, mouse
gtcagaagagtaattagagc

SEQ ID NO: 640084 - DNA, 20 bp, mouse
gaccacttctgcagcatcac

SEQ ID NO: 640085 - DNA, 20 bp, mouse
gttagagccgggggagttaa

SEQ ID NO: 640086 - DNA, 20 bp, mouse
gtggggagtccggtggtagc

SEQ ID NO: 640087 - DNA, 20 bp, mouse
gagcaagctctcctctctta

SEQ ID NO: 640088 - DNA, 20 bp, mouse
ggcctgtgtgggttgagatg

SEQ ID NO: 640089 - DNA, 20 bp, mouse
gccggtggtagcaggtacgc

SEQ ID NO: 640090 - DNA, 20 bp, mouse
gctcaacccacacaggcaga

SEQ ID NO: 640091 - DNA, 20 bp, mouse
gaaaaccatagtggggagtc

SEQ ID NO: 640092 - DNA, 20 bp, mouse
gcccacatctcaacccacac

SEQ ID NO: 640093 - DNA, 20 bp, mouse
gaccaccggactccccacta

SEQ ID NO: 640094 - DNA, 20 bp, mouse
gagagctccctctgcctgtg

SEQ ID NO: 640095 - DNA, 20 bp, mouse
ggtcacttccgggttccaga

SEQ ID NO: 640096 - DNA, 20 bp, mouse
ggggcggcagcgaacagact

SEQ ID NO: 640097 - DNA, 20 bp, mouse
gttagcgaacgcaaaggctg

SEQ ID NO: 640098 - DNA, 20 bp, mouse
ggcaaaggctgcgggaggga

SEQ ID NO: 640099 - DNA, 20 bp, mouse
gtcgcgcgccactgcatcta

SEQ ID NO: 640100 - DNA, 20 bp, mouse
gcgagggcgcagagcgatcg

SEQ ID NO: 640101 - DNA, 20 bp, mouse
gcggaggctgacaggggcag

SEQ ID NO: 640102 - DNA, 20 bp, mouse
gcagtggcccagcgcaagcg

SEQ ID NO: 640103 - DNA, 20 bp, mouse
gagtttctgtgcaattcttg

SEQ ID NO: 640104 - DNA, 20 bp, mouse
gcgaacgcaaaggctgcggg

SEQ ID NO: 640105 - DNA, 20 bp, mouse
ggtggcgcgcgaaggcgtct

SEQ ID NO: 640106 - DNA, 20 bp, mouse
gagactaggtctgagtgatg

SEQ ID NO: 640107 - DNA, 20 bp, mouse
gagggaaagggtccgggaag

SEQ ID NO: 640108 - DNA, 20 bp, mouse
gctgtggcggccactagatc

SEQ ID NO: 640109 - DNA, 20 bp, mouse
ggacagcagagatgggtcgt

SEQ ID NO: 640110 - DNA, 20 bp, mouse
gacaggaagcttgccagact

SEQ ID NO: 640111 - DNA, 20 bp, mouse
ggacaagacctgatccttac

SEQ ID NO: 640112 - DNA, 20 bp, mouse
gagtggccgccacaggatag

SEQ ID NO: 640113 - DNA, 20 bp, mouse
gcaagcttcctgtaaggatc

SEQ ID NO: 640114 - DNA, 20 bp, mouse
gctaggtctgagtgatgagg

SEQ ID NO: 640115 - DNA, 20 bp, mouse
ggatgctatctttctttcta

SEQ ID NO: 640116 - DNA, 20 bp, mouse
gtctctgccggcgagggtga

SEQ ID NO: 640117 - DNA, 20 bp, mouse
ggcgcagccctcaccctcgc

SEQ ID NO: 640118 - DNA, 20 bp, mouse
gggactcagcggaaggggaa

SEQ ID NO: 640119 - DNA, 20 bp, mouse
gaccgggtctcccggaacta

SEQ ID NO: 640120 - DNA, 20 bp, mouse
gggacctcgcgaggtctcgg

SEQ ID NO: 640121 - DNA, 20 bp, mouse
gaccctcgccggcagagact

SEQ ID NO: 640122 - DNA, 20 bp, mouse
gaaggcctccctgttgtcca

SEQ ID NO: 640123 - DNA, 20 bp, mouse
gtgagcgcgggcggaagctc

SEQ ID NO: 640124 - DNA, 20 bp, mouse
gagacccggtcaaagtgatc

SEQ ID NO: 640125 - DNA, 20 bp, mouse
gccggcgcacgcctgagcgc

SEQ ID NO: 640126 - DNA, 20 bp, mouse
gccgaagcccgcggaagact

SEQ ID NO: 640127 - DNA, 20 bp, mouse
gaccaactgcacttcaacat

SEQ ID NO: 640128 - DNA, 20 bp, mouse
ggatggatctctctgtgcag

SEQ ID NO: 640129 - DNA, 20 bp, mouse
gtcaacatcggagacccgcc

SEQ ID NO: 640130 - DNA, 20 bp, mouse
gtggtcacgcgcgccgtttt

SEQ ID NO: 640131 - DNA, 20 bp, mouse
gcagagagatccatccaggc

SEQ ID NO: 640132 - DNA, 20 bp, mouse
ggctgtaagcggatttttct

SEQ ID NO: 640133 - DNA, 20 bp, mouse
gcgcagaccccggggggctc

SEQ ID NO: 640134 - DNA, 20 bp, mouse
gtgagtgagctccctcggac

SEQ ID NO: 640135 - DNA, 20 bp, mouse
gctccggccgggtggccctc

SEQ ID NO: 640136 - DNA, 20 bp, mouse
gtatcacattaattgtaaga

SEQ ID NO: 640137 - DNA, 20 bp, mouse
gaaggtgcaggaaatcctca

SEQ ID NO: 640138 - DNA, 20 bp, mouse
gactctctgtcctatcacca

SEQ ID NO: 640139 - DNA, 20 bp, mouse
gatacaaatgtgataaaatt

SEQ ID NO: 640140 - DNA, 20 bp, mouse
gacgtaaggtgcaagtctca

SEQ ID NO: 640141 - DNA, 20 bp, mouse
gcacattaattgtaagaggg

SEQ ID NO: 640142 - DNA, 20 bp, mouse
gaccgaggatatagcccatt

SEQ ID NO: 640143 - DNA, 20 bp, mouse
gttatcacatttgtatgaac

SEQ ID NO: 640144 - DNA, 20 bp, mouse
gggggtttctactacgactc

SEQ ID NO: 640145 - DNA, 20 bp, mouse
gcctagtagcaactaagaga

SEQ ID NO: 640146 - DNA, 20 bp, mouse
gagcctcccaggacaggcaa

SEQ ID NO: 640147 - DNA, 20 bp, mouse
gactgacagcgaaaagcatc

SEQ ID NO: 640148 - DNA, 20 bp, mouse
gagtctggtcccatggaaca

SEQ ID NO: 640149 - DNA, 20 bp, mouse
gtgaaagccgaaactgttgt

SEQ ID NO: 640150 - DNA, 20 bp, mouse
ggagacacctacaacagttt

SEQ ID NO: 640151 - DNA, 20 bp, mouse
ggtcccatggaacaaggtct

SEQ ID NO: 640152 - DNA, 20 bp, mouse
gtggttacaaacttggtaac

SEQ ID NO: 640153 - DNA, 20 bp, mouse
gcttcctgactggtgctgct

SEQ ID NO: 640154 - DNA, 20 bp, mouse
gaccccagaccttgttccat

SEQ ID NO: 640155 - DNA, 20 bp, mouse
ggtctggggtggcaaggaag

SEQ ID NO: 640156 - DNA, 20 bp, mouse
gaacgcagctctgaccctca

SEQ ID NO: 640157 - DNA, 20 bp, mouse
gctgaccctcagggttctca

SEQ ID NO: 640158 - DNA, 20 bp, mouse
gcaaccgtgggcatcaagga

SEQ ID NO: 640159 - DNA, 20 bp, mouse
gcttccggggagtccgttaa

SEQ ID NO: 640160 - DNA, 20 bp, mouse
ggccctacctgggtcaaatg

SEQ ID NO: 640161 - DNA, 20 bp, mouse
gttgcggcagatgaagaaaa

SEQ ID NO: 640162 - DNA, 20 bp, mouse
gaggcacttcgttttcgttg

SEQ ID NO: 640163 - DNA, 20 bp, mouse
gatgaagaaaatgggcgcgc

SEQ ID NO: 640164 - DNA, 20 bp, mouse
ggccccatttgacccaggta

SEQ ID NO: 640165 - DNA, 20 bp, mouse
gtagccgttaacggactccc

SEQ ID NO: 640166 - DNA, 20 bp, mouse
gtctgggatttgcagtgcga

SEQ ID NO: 640167 - DNA, 20 bp, mouse
gtgtgcttaagatgttcttg

SEQ ID NO: 640168 - DNA, 20 bp, mouse
gcctcccttccaattctgat

SEQ ID NO: 640169 - DNA, 20 bp, mouse
ggctgttcacccatcagaat

SEQ ID NO: 640170 - DNA, 20 bp, mouse
gctaaagggtagtcatactg

SEQ ID NO: 640171 - DNA, 20 bp, mouse
gttcacccatcagaattgga

SEQ ID NO: 640172 - DNA, 20 bp, mouse
gggggaggaagggactaacg

SEQ ID NO: 640173 - DNA, 20 bp, mouse
gatttgcagtgcgagggctc

SEQ ID NO: 640174 - DNA, 20 bp, mouse
gcactgcaaatcccagacat

SEQ ID NO: 640175 - DNA, 20 bp, mouse
gagagcaaaagcccatgtct

SEQ ID NO: 640176 - DNA, 20 bp, mouse
ggggagcagctgccctagtg

SEQ ID NO: 640177 - DNA, 20 bp, mouse
gagccagtggtcagccgggg

SEQ ID NO: 640178 - DNA, 20 bp, mouse
gctcctccccggctgaccac

SEQ ID NO: 640179 - DNA, 20 bp, mouse
ggttcatgatgttccctact

SEQ ID NO: 640180 - DNA, 20 bp, mouse
gaacatcatgaaccacacta

SEQ ID NO: 640181 - DNA, 20 bp, mouse
gtaaaagcatcaaaaactaa

SEQ ID NO: 640182 - DNA, 20 bp, mouse
gcatgatgttccctactagg

SEQ ID NO: 640183 - DNA, 20 bp, mouse
ggcttcaagctctggccctg

SEQ ID NO: 640184 - DNA, 20 bp, mouse
ggctgaccactggctcaggt

SEQ ID NO: 640185 - DNA, 20 bp, mouse
gactggctcaggttggctcg

SEQ ID NO: 640186 - DNA, 20 bp, mouse
ggagaccgcgaggcctgagg

SEQ ID NO: 640187 - DNA, 20 bp, mouse
gcacctcaggacaccacctc

SEQ ID NO: 640188 - DNA, 20 bp, mouse
ggaggtacgtggagaccgcg

SEQ ID NO: 640189 - DNA, 20 bp, mouse
ggggctagggacgactgagg

SEQ ID NO: 640190 - DNA, 20 bp, mouse
ggaggcccgaggaggtgtag

SEQ ID NO: 640191 - DNA, 20 bp, mouse
gctcaccgctggccgttaag

SEQ ID NO: 640192 - DNA, 20 bp, mouse
gactgtggaggagtacatag

SEQ ID NO: 640193 - DNA, 20 bp, mouse
gggaccaggaacgaccgagg

SEQ ID NO: 640194 - DNA, 20 bp, mouse
gggactagggaggcccgagg

SEQ ID NO: 640195 - DNA, 20 bp, mouse
gggcctcaggacgccacctc

SEQ ID NO: 640196 - DNA, 20 bp, mouse
gtggatgtggatgaattctg

SEQ ID NO: 640197 - DNA, 20 bp, mouse
ggaaactccagtttcttgac

SEQ ID NO: 640198 - DNA, 20 bp, mouse
gttcctgaaaggaaggagat

SEQ ID NO: 640199 - DNA, 20 bp, mouse
gggtttgagacctctaggaa

SEQ ID NO: 640200 - DNA, 20 bp, mouse
gaacaagttctcagggttcc

SEQ ID NO: 640201 - DNA, 20 bp, mouse
gcactgatgtaaccactctt

SEQ ID NO: 640202 - DNA, 20 bp, mouse
ggatgaattctgaggcaaaa

SEQ ID NO: 640203 - DNA, 20 bp, mouse
ggctgccccctgtagatccg

SEQ ID NO: 640204 - DNA, 20 bp, mouse
gttggcaggataccttccat

SEQ ID NO: 640205 - DNA, 20 bp, mouse
gcgcttcctcggatctacag

SEQ ID NO: 640206 - DNA, 20 bp, mouse
gggacagcaatgggcaatac

SEQ ID NO: 640207 - DNA, 20 bp, mouse
gggctctggctggagacctc

SEQ ID NO: 640208 - DNA, 20 bp, mouse
ggtgtagaggcatgaactta

SEQ ID NO: 640209 - DNA, 20 bp, mouse
gatcacgcatgccctatatc

SEQ ID NO: 640210 - DNA, 20 bp, mouse
gtacacacaggcccagtccc

SEQ ID NO: 640211 - DNA, 20 bp, mouse
gtgtgtacaacaggacacag

SEQ ID NO: 640212 - DNA, 20 bp, mouse
gcacgtgtgtgaatgggcac

SEQ ID NO: 640213 - DNA, 20 bp, mouse
gttaggaggtttccagatat

SEQ ID NO: 640214 - DNA, 20 bp, mouse
gtcatgtacacgtgtgtgaa

SEQ ID NO: 640215 - DNA, 20 bp, mouse
ggagggtctccctgaagcca

SEQ ID NO: 640216 - DNA, 20 bp, mouse
gggtgagaacccatacatgg

SEQ ID NO: 640217 - DNA, 20 bp, mouse
gccagcatctatgtctctcg

SEQ ID NO: 640218 - DNA, 20 bp, mouse
gggaggtgagaacccataca

SEQ ID NO: 640219 - DNA, 20 bp, mouse
ggcactgtagtctgccccat

SEQ ID NO: 640220 - DNA, 20 bp, mouse
gacatcacaggcaggatgca

SEQ ID NO: 640221 - DNA, 20 bp, mouse
gaaaacggccaatgagcagc

SEQ ID NO: 640222 - DNA, 20 bp, mouse
gactctactcctccatgtat

SEQ ID NO: 640223 - DNA, 20 bp, mouse
gcaggacacaggtgtcccat

SEQ ID NO: 640224 - DNA, 20 bp, mouse
gtgtgtcctgatgacatcac

SEQ ID NO: 640225 - DNA, 20 bp, mouse
gaaaacttgccttatcctca

SEQ ID NO: 640226 - DNA, 20 bp, mouse
gagcatgcgcagcacttgca

SEQ ID NO: 640227 - DNA, 20 bp, mouse
ggggcctggtccatgggttg

SEQ ID NO: 640228 - DNA, 20 bp, mouse
gtaacagagggaacatgcgc

SEQ ID NO: 640229 - DNA, 20 bp, mouse
ggtttccgttggggtctcaa

SEQ ID NO: 640230 - DNA, 20 bp, mouse
gaagcagaggcctcaaccca

SEQ ID NO: 640231 - DNA, 20 bp, mouse
gacttgcagggcctggtcca

SEQ ID NO: 640232 - DNA, 20 bp, mouse
gaggcctcaacccatggacc

SEQ ID NO: 640233 - DNA, 20 bp, mouse
gctgtcctgcgcatgcgaac

SEQ ID NO: 640234 - DNA, 20 bp, mouse
gacagccgttgagaccccaa

SEQ ID NO: 640235 - DNA, 20 bp, mouse
ggagcatcagggtttccgtt

SEQ ID NO: 640236 - DNA, 20 bp, mouse
ggccaggggcgtgtcagaca

SEQ ID NO: 640237 - DNA, 20 bp, mouse
ggcgtgtcagacaaggtcag

SEQ ID NO: 640238 - DNA, 20 bp, mouse
ggcgcgtgcgcgtgactcct

SEQ ID NO: 640239 - DNA, 20 bp, mouse
gtgcgcgtgactcctcgggg

SEQ ID NO: 640240 - DNA, 20 bp, mouse
gacagtcactcgaactgctc

SEQ ID NO: 640241 - DNA, 20 bp, mouse
gggagggccctctaggaagg

SEQ ID NO: 640242 - DNA, 20 bp, mouse
gtctgacacgcccctggcgg

SEQ ID NO: 640243 - DNA, 20 bp, mouse
gtggcccagctgtacgacgc

SEQ ID NO: 640244 - DNA, 20 bp, mouse
ggcccctggcggcgggggga

SEQ ID NO: 640245 - DNA, 20 bp, mouse
gaccttgtctgacacgcccc

SEQ ID NO: 640246 - DNA, 20 bp, mouse
gccgcggcaacattgaggtg

SEQ ID NO: 640247 - DNA, 20 bp, mouse
gaaaatggtggacctaattg

SEQ ID NO: 640248 - DNA, 20 bp, mouse
gagcgcccattgactgtgat

SEQ ID NO: 640249 - DNA, 20 bp, mouse
gacgcagagggtcttctcat

SEQ ID NO: 640250 - DNA, 20 bp, mouse
gagggtcttctcatgggttc

SEQ ID NO: 640251 - DNA, 20 bp, mouse
gaggctgcttcgaattccgt

SEQ ID NO: 640252 - DNA, 20 bp, mouse
ggccctggagtcatggctgt

SEQ ID NO: 640253 - DNA, 20 bp, mouse
gcaactccgcggcaacattg

SEQ ID NO: 640254 - DNA, 20 bp, mouse
gcgggctccaggtgcccacc

SEQ ID NO: 640255 - DNA, 20 bp, mouse
gagcccacagccatgactcc

SEQ ID NO: 640256 - DNA, 20 bp, mouse
gccaaggcggggcccaagta

SEQ ID NO: 640257 - DNA, 20 bp, mouse
gcaggcgtctagttgtctga

SEQ ID NO: 640258 - DNA, 20 bp, mouse
ggtggggaccagaccaggtc

SEQ ID NO: 640259 - DNA, 20 bp, mouse
gcgtggacaaggttccgggt

SEQ ID NO: 640260 - DNA, 20 bp, mouse
gaaggcgtggacaaggttcc

SEQ ID NO: 640261 - DNA, 20 bp, mouse
gacagtgcggagaggagcac

SEQ ID NO: 640262 - DNA, 20 bp, mouse
gccgcagcagagtggtgcta

SEQ ID NO: 640263 - DNA, 20 bp, mouse
ggcggggcccaagtaaggcg

SEQ ID NO: 640264 - DNA, 20 bp, mouse
gcgcctgttgccatgacgac

SEQ ID NO: 640265 - DNA, 20 bp, mouse
gggccatgggtacaacagtg

SEQ ID NO: 640266 - DNA, 20 bp, mouse
gcctccgccgactgacttgg

SEQ ID NO: 640267 - DNA, 20 bp, mouse
ggagcctccaagtcagtcgg

SEQ ID NO: 640268 - DNA, 20 bp, mouse
gagtggggctgggccgtgcg

SEQ ID NO: 640269 - DNA, 20 bp, mouse
gtccgcaggtgagtggggct

SEQ ID NO: 640270 - DNA, 20 bp, mouse
gaaggccgagaagagcgggc

SEQ ID NO: 640271 - DNA, 20 bp, mouse
gaccgagcttgcccggtctg

SEQ ID NO: 640272 - DNA, 20 bp, mouse
ggaccccgtgccgccgctac

SEQ ID NO: 640273 - DNA, 20 bp, mouse
gcgggaatcgagtcgcattc

SEQ ID NO: 640274 - DNA, 20 bp, mouse
ggcggcggcacggggtccgc

SEQ ID NO: 640275 - DNA, 20 bp, mouse
gagaaacaacgatgatcgtc

SEQ ID NO: 640276 - DNA, 20 bp, mouse
gaggcggggaaagacgaaga

SEQ ID NO: 640277 - DNA, 20 bp, mouse
ggagacgattcaaacccggg

SEQ ID NO: 640278 - DNA, 20 bp, mouse
gacccggggcgcgctcgcta

SEQ ID NO: 640279 - DNA, 20 bp, mouse
ggggacctccagcaaggtga

SEQ ID NO: 640280 - DNA, 20 bp, mouse
gtaggcggctcattcgtgat

SEQ ID NO: 640281 - DNA, 20 bp, mouse
gcggggagacgattcaaacc

SEQ ID NO: 640282 - DNA, 20 bp, mouse
ggggaaagacgaagagggtg

SEQ ID NO: 640283 - DNA, 20 bp, mouse
gaaaaaaggtcgcgggtccg

SEQ ID NO: 640284 - DNA, 20 bp, mouse
ggacgcagacaaaagaggag

SEQ ID NO: 640285 - DNA, 20 bp, mouse
gcagaaccctcccaaagccg

SEQ ID NO: 640286 - DNA, 20 bp, mouse
gggactgacctgcatataag

SEQ ID NO: 640287 - DNA, 20 bp, mouse
ggttaagaagtcattatcta

SEQ ID NO: 640288 - DNA, 20 bp, mouse
ggatcactaggcgcacagga

SEQ ID NO: 640289 - DNA, 20 bp, mouse
gaaggcttccacttatatgc

SEQ ID NO: 640290 - DNA, 20 bp, mouse
gtagttaagagccagtgaaa

SEQ ID NO: 640291 - DNA, 20 bp, mouse
gtcttaacaccaacagacac

SEQ ID NO: 640292 - DNA, 20 bp, mouse
gtcatctgacctccctatgg

SEQ ID NO: 640293 - DNA, 20 bp, mouse
gcaggttgttatcccccata

SEQ ID NO: 640294 - DNA, 20 bp, mouse
gcttctgtcatcaaattgtg

SEQ ID NO: 640295 - DNA, 20 bp, mouse
ggttgttatcccccataggg

SEQ ID NO: 640296 - DNA, 20 bp, mouse
gggtgcccgagcacacgcta

SEQ ID NO: 640297 - DNA, 20 bp, mouse
gcggaccctcggcctccgcg

SEQ ID NO: 640298 - DNA, 20 bp, mouse
gacgtggagacggacacgga

SEQ ID NO: 640299 - DNA, 20 bp, mouse
gggaccgcggggacacgccc

SEQ ID NO: 640300 - DNA, 20 bp, mouse
gaggccgagggtccgggcgc

SEQ ID NO: 640301 - DNA, 20 bp, mouse
gagccacgtggagacggaca

SEQ ID NO: 640302 - DNA, 20 bp, mouse
gctgtctcgcagccgcgcgg

SEQ ID NO: 640303 - DNA, 20 bp, mouse
ggatggtgtgagctgaagga

SEQ ID NO: 640304 - DNA, 20 bp, mouse
ggaaggatggccggcgcgac

SEQ ID NO: 640305 - DNA, 20 bp, mouse
gagtgtcgcatggcatgaga

SEQ ID NO: 640306 - DNA, 20 bp, mouse
gtaaaggtccttatgttcta

SEQ ID NO: 640307 - DNA, 20 bp, mouse
ggctctagtgacgtatgaaa

SEQ ID NO: 640308 - DNA, 20 bp, mouse
gcaaagtgatagacatgcat

SEQ ID NO: 640309 - DNA, 20 bp, mouse
ggagcaatccctagaacata

SEQ ID NO: 640310 - DNA, 20 bp, mouse
gtatcttgggatacctttaa

SEQ ID NO: 640311 - DNA, 20 bp, mouse
gattgtggcattactatctt

SEQ ID NO: 640312 - DNA, 20 bp, mouse
gacgagtgggcggagccttg

SEQ ID NO: 640313 - DNA, 20 bp, mouse
ggtagctcagatttcagcag

SEQ ID NO: 640314 - DNA, 20 bp, mouse
gggagcattattactcctca

SEQ ID NO: 640315 - DNA, 20 bp, mouse
ggcaggaacacaagatcccc

SEQ ID NO: 640316 - DNA, 20 bp, mouse
gctaccgtggccttaatatc

SEQ ID NO: 640317 - DNA, 20 bp, mouse
gtggaaggagggctgacctg

SEQ ID NO: 640318 - DNA, 20 bp, mouse
gggacgccagggagacacgg

SEQ ID NO: 640319 - DNA, 20 bp, mouse
gccctccgccgcaggaacgc

SEQ ID NO: 640320 - DNA, 20 bp, mouse
gtcgggacgccagggagaca

SEQ ID NO: 640321 - DNA, 20 bp, mouse
gcggccccgcgttcctgcgg

SEQ ID NO: 640322 - DNA, 20 bp, mouse
gcgccagggagacacggagg

SEQ ID NO: 640323 - DNA, 20 bp, mouse
gcgccgggatggtctcgagg

SEQ ID NO: 640324 - DNA, 20 bp, mouse
gcgtcccgatattaaggcca

SEQ ID NO: 640325 - DNA, 20 bp, mouse
ggggctctgtggtgcgtccg

SEQ ID NO: 640326 - DNA, 20 bp, mouse
ggggctggcgaatgggtcga

SEQ ID NO: 640327 - DNA, 20 bp, mouse
gctggcgaatgggtcgaggg

SEQ ID NO: 640328 - DNA, 20 bp, mouse
gacactggggacttgtggcg

SEQ ID NO: 640329 - DNA, 20 bp, mouse
ggggtcgagggcggacgtgt

SEQ ID NO: 640330 - DNA, 20 bp, mouse
ggggctacactggggacttg

SEQ ID NO: 640331 - DNA, 20 bp, mouse
gtgtgggacactggcaacgt

SEQ ID NO: 640332 - DNA, 20 bp, mouse
gaggaggcggtgagccgctc

SEQ ID NO: 640333 - DNA, 20 bp, mouse
gatcctggtgatgacggcgt

SEQ ID NO: 640334 - DNA, 20 bp, mouse
ggtcctaaaccattgcgaca

SEQ ID NO: 640335 - DNA, 20 bp, mouse
gtgtagtagagaaacaagcc

SEQ ID NO: 640336 - DNA, 20 bp, mouse
gctcccagcaacagagggga

SEQ ID NO: 640337 - DNA, 20 bp, mouse
ggggagagcccctcctgatc

SEQ ID NO: 640338 - DNA, 20 bp, mouse
gcctgctgagactgtcaccc

SEQ ID NO: 640339 - DNA, 20 bp, mouse
gacagtctcagcaggtaagg

SEQ ID NO: 640340 - DNA, 20 bp, mouse
ggtctcagcaggtaaggagg

SEQ ID NO: 640341 - DNA, 20 bp, mouse
gagtaaagggaaaaggggtt

SEQ ID NO: 640342 - DNA, 20 bp, mouse
gggagctcccagcaacagag

SEQ ID NO: 640343 - DNA, 20 bp, mouse
gaaggagggggtactaagga

SEQ ID NO: 640344 - DNA, 20 bp, mouse
gttagaacctgttctgacca

SEQ ID NO: 640345 - DNA, 20 bp, mouse
ggaacattgtccagatcagg

SEQ ID NO: 640346 - DNA, 20 bp, mouse
ggaggcggatccgtgcgggg

SEQ ID NO: 640347 - DNA, 20 bp, mouse
gtactggagtcacgtgatgg

SEQ ID NO: 640348 - DNA, 20 bp, mouse
ggatggaggcggatccgtgc

SEQ ID NO: 640349 - DNA, 20 bp, mouse
gagcgagcgcgagagggaaa

SEQ ID NO: 640350 - DNA, 20 bp, mouse
gctaccgcgggacaggaata

SEQ ID NO: 640351 - DNA, 20 bp, mouse
gacctgggagtgcggagacg

SEQ ID NO: 640352 - DNA, 20 bp, mouse
gcaagagcagtgtttcgtgg

SEQ ID NO: 640353 - DNA, 20 bp, mouse
gcgcgggacaggaatacgga

SEQ ID NO: 640354 - DNA, 20 bp, mouse
gccttactggagtcacgtga

SEQ ID NO: 640355 - DNA, 20 bp, mouse
ggcagtgtttcgtggcgggg

SEQ ID NO: 640356 - DNA, 20 bp, mouse
gtgcctgggagaaagtgttg

SEQ ID NO: 640357 - DNA, 20 bp, mouse
gcacgcggggtcaaggacgc

SEQ ID NO: 640358 - DNA, 20 bp, mouse
gaccaaatgggaaacatgaa

SEQ ID NO: 640359 - DNA, 20 bp, mouse
gtgcttgctcgccctcccaa

SEQ ID NO: 640360 - DNA, 20 bp, mouse
ggtccccaacactttctccc

SEQ ID NO: 640361 - DNA, 20 bp, mouse
gaggggaccacgatgtgcct

SEQ ID NO: 640362 - DNA, 20 bp, mouse
gggtcatggccaggcagcgc

SEQ ID NO: 640363 - DNA, 20 bp, mouse
ggcaaggctgtgaaaaactg

SEQ ID NO: 640364 - DNA, 20 bp, mouse
gtgggaaatggggcggaaga

SEQ ID NO: 640365 - DNA, 20 bp, mouse
gaccgtagcaacggcccctt

SEQ ID NO: 640366 - DNA, 20 bp, mouse
ggttacccaccattcaccaa

SEQ ID NO: 640367 - DNA, 20 bp, mouse
ggtgaatggtgggtaactcc

SEQ ID NO: 640368 - DNA, 20 bp, mouse
gtgtctggtaactctaggtc

SEQ ID NO: 640369 - DNA, 20 bp, mouse
gcctctgagcccttggtgaa

SEQ ID NO: 640370 - DNA, 20 bp, mouse
gtgggtaactccagggtgtc

SEQ ID NO: 640371 - DNA, 20 bp, mouse
ggaggcatggaagtactctt

SEQ ID NO: 640372 - DNA, 20 bp, mouse
gcagggtgtctggtaactct

SEQ ID NO: 640373 - DNA, 20 bp, mouse
gagccaatcatggcaacctt

SEQ ID NO: 640374 - DNA, 20 bp, mouse
ggaattaaggagatgttggg

SEQ ID NO: 640375 - DNA, 20 bp, mouse
gactgaacataagtgtatag

SEQ ID NO: 640376 - DNA, 20 bp, mouse
gtggggaatctctaatcaag

SEQ ID NO: 640377 - DNA, 20 bp, mouse
gagagcaaccagaagcatga

SEQ ID NO: 640378 - DNA, 20 bp, mouse
gtaatgaggcaagacagggg

SEQ ID NO: 640379 - DNA, 20 bp, mouse
gaacccagagcctcttaggt

SEQ ID NO: 640380 - DNA, 20 bp, mouse
gcaagacaggggagggcccc

SEQ ID NO: 640381 - DNA, 20 bp, mouse
gaattggggacccacctaag

SEQ ID NO: 640382 - DNA, 20 bp, mouse
gtaggtgggtccccaatttg

SEQ ID NO: 640383 - DNA, 20 bp, mouse
ggacccacctaagaggctct

SEQ ID NO: 640384 - DNA, 20 bp, mouse
gggactgggccctttaagca

SEQ ID NO: 640385 - DNA, 20 bp, mouse
ggatcctaatgaggcaagac

SEQ ID NO: 640386 - DNA, 20 bp, mouse
gtacctctgggggacgggac

SEQ ID NO: 640387 - DNA, 20 bp, mouse
gcgacccggcgggatcggag

SEQ ID NO: 640388 - DNA, 20 bp, mouse
gaaggccgactaacccacct

SEQ ID NO: 640389 - DNA, 20 bp, mouse
gctcccgggccgccacgagg

SEQ ID NO: 640390 - DNA, 20 bp, mouse
gcgccggtcccgtcccccag

SEQ ID NO: 640391 - DNA, 20 bp, mouse
ggtctgggaaaagttgaggt

SEQ ID NO: 640392 - DNA, 20 bp, mouse
ggtgctcgtaactgcggcta

SEQ ID NO: 640393 - DNA, 20 bp, mouse
gtcgctgggtgggagtctta

SEQ ID NO: 640394 - DNA, 20 bp, mouse
ggggagtcttagggcacatg

SEQ ID NO: 640395 - DNA, 20 bp, mouse
gtaggagcaccggtctgcgc

SEQ ID NO: 640396 - DNA, 20 bp, mouse
ggagccctgtaggcgaagca

SEQ ID NO: 640397 - DNA, 20 bp, mouse
ggatccctgcttcgcctaca

SEQ ID NO: 640398 - DNA, 20 bp, mouse
gagcaccgtgcgccacctag

SEQ ID NO: 640399 - DNA, 20 bp, mouse
ggtggcgcacggtgctcttt

SEQ ID NO: 640400 - DNA, 20 bp, mouse
gcgtcaaaagcgatggaagt

SEQ ID NO: 640401 - DNA, 20 bp, mouse
ggctctttggggaaagaact

SEQ ID NO: 640402 - DNA, 20 bp, mouse
gaaaccggccacacgggaag

SEQ ID NO: 640403 - DNA, 20 bp, mouse
gaagggaccgtcaaaagcga

SEQ ID NO: 640404 - DNA, 20 bp, mouse
gtccctggggcatcctagtt

SEQ ID NO: 640405 - DNA, 20 bp, mouse
gagctcctctaggtggcgca

SEQ ID NO: 640406 - DNA, 20 bp, mouse
gggccacggcaggaatgacg

SEQ ID NO: 640407 - DNA, 20 bp, mouse
gagaagcagtgacactgagc

SEQ ID NO: 640408 - DNA, 20 bp, mouse
gtctcgctctgggaaaatgg

SEQ ID NO: 640409 - DNA, 20 bp, mouse
ggacactgagcgggcgcagg

SEQ ID NO: 640410 - DNA, 20 bp, mouse
gagcgcgcagcgtcttcagt

SEQ ID NO: 640411 - DNA, 20 bp, mouse
ggcaggctcgatctccgact

SEQ ID NO: 640412 - DNA, 20 bp, mouse
gtgctgccgctcccgaacgc

SEQ ID NO: 640413 - DNA, 20 bp, mouse
gacgctgcgcgctgctgctt

SEQ ID NO: 640414 - DNA, 20 bp, mouse
gccgcagtggctgtcgtcgg

SEQ ID NO: 640415 - DNA, 20 bp, mouse
gtgtcactgcttctcgctct

SEQ ID NO: 640416 - DNA, 20 bp, mouse
gggtgcggagatcactcatc

SEQ ID NO: 640417 - DNA, 20 bp, mouse
gtacctggtatggggattat

SEQ ID NO: 640418 - DNA, 20 bp, mouse
gaaaccatgggctctgtgga

SEQ ID NO: 640419 - DNA, 20 bp, mouse
gaaattgctctgttcgttga

SEQ ID NO: 640420 - DNA, 20 bp, mouse
gtaggctacttggaaagttg

SEQ ID NO: 640421 - DNA, 20 bp, mouse
gtttttgcctacctggtatg

SEQ ID NO: 640422 - DNA, 20 bp, mouse
gattactgaccagttagcct

SEQ ID NO: 640423 - DNA, 20 bp, mouse
gtggtttttgtaaaaaccat

SEQ ID NO: 640424 - DNA, 20 bp, mouse
gcagtgtggtattgaaagct

SEQ ID NO: 640425 - DNA, 20 bp, mouse
gactggtcagtaatctccag

SEQ ID NO: 640426 - DNA, 20 bp, mouse
gcaaggcggtgagtcgtccc

SEQ ID NO: 640427 - DNA, 20 bp, mouse
gccgccttgcccagagatct

SEQ ID NO: 640428 - DNA, 20 bp, mouse
ggcgggagaaagtggactca

SEQ ID NO: 640429 - DNA, 20 bp, mouse
gcagctggtcgcaaggaagt

SEQ ID NO: 640430 - DNA, 20 bp, mouse
gtggtcgcaaggaagtaggc

SEQ ID NO: 640431 - DNA, 20 bp, mouse
gaaactccgcccagatctct

SEQ ID NO: 640432 - DNA, 20 bp, mouse
gagaacgtcacgcgacaggt

SEQ ID NO: 640433 - DNA, 20 bp, mouse
gaaggtcagcaggccaagga

SEQ ID NO: 640434 - DNA, 20 bp, mouse
gagtaggcggggccaggacc

SEQ ID NO: 640435 - DNA, 20 bp, mouse
gaggcagggcctttgcgtgt

SEQ ID NO: 640436 - DNA, 20 bp, mouse
gtcaggctgcggcaattcca

SEQ ID NO: 640437 - DNA, 20 bp, mouse
gaaggagaacctgacttaaa

SEQ ID NO: 640438 - DNA, 20 bp, mouse
gaatcaagtgggagtcaacc

SEQ ID NO: 640439 - DNA, 20 bp, mouse
gaaagtctggagtaatcaag

SEQ ID NO: 640440 - DNA, 20 bp, mouse
gagcctgagggggagggcta

SEQ ID NO: 640441 - DNA, 20 bp, mouse
gttaggagaccgctggggaa

SEQ ID NO: 640442 - DNA, 20 bp, mouse
ggaattgccgcagcctgagg

SEQ ID NO: 640443 - DNA, 20 bp, mouse
gaagatgaatggctcccagc

SEQ ID NO: 640444 - DNA, 20 bp, mouse
gaggctctggccattccagc

SEQ ID NO: 640445 - DNA, 20 bp, mouse
gggttgtgacccaccgatta

SEQ ID NO: 640446 - DNA, 20 bp, mouse
gcggaagcggagggcgtggt

SEQ ID NO: 640447 - DNA, 20 bp, mouse
ggggccgagtgagactgagg

SEQ ID NO: 640448 - DNA, 20 bp, mouse
gtgggcggggaagagtgcga

SEQ ID NO: 640449 - DNA, 20 bp, mouse
ggcggggccgagtgagactg

SEQ ID NO: 640450 - DNA, 20 bp, mouse
gaagcggagggcgtggtggg

SEQ ID NO: 640451 - DNA, 20 bp, mouse
ggcgagagactcggttgaac

SEQ ID NO: 640452 - DNA, 20 bp, mouse
gtgaacaggatcgtccaagg

SEQ ID NO: 640453 - DNA, 20 bp, mouse
ggaagagtgcgagggcgacc

SEQ ID NO: 640454 - DNA, 20 bp, mouse
gagggcggatcagaggggta

SEQ ID NO: 640455 - DNA, 20 bp, mouse
ggggtgtgaggcgagagact

SEQ ID NO: 640456 - DNA, 20 bp, mouse
gagcgcgagagagagcgcga

SEQ ID NO: 640457 - DNA, 20 bp, mouse
gaagtcggatccttgagctg

SEQ ID NO: 640458 - DNA, 20 bp, mouse
ggtagtagaaatgatgtctg

SEQ ID NO: 640459 - DNA, 20 bp, mouse
gctcaaggatccgacttcat

SEQ ID NO: 640460 - DNA, 20 bp, mouse
gcagtgaaacaggtcctgta

SEQ ID NO: 640461 - DNA, 20 bp, mouse
gcagccaactgctccatatt

SEQ ID NO: 640462 - DNA, 20 bp, mouse
ggatccttgagctgcggcgg

SEQ ID NO: 640463 - DNA, 20 bp, mouse
ggatccccctgcagtgaaac

SEQ ID NO: 640464 - DNA, 20 bp, mouse
ggcgctcgccgtgctctgtg

SEQ ID NO: 640465 - DNA, 20 bp, mouse
gcggcgagccgcacagagca

SEQ ID NO: 640466 - DNA, 20 bp, mouse
gtcaaggcgacatggatagg

SEQ ID NO: 640467 - DNA, 20 bp, mouse
gaggaggaggagaggaccga

SEQ ID NO: 640468 - DNA, 20 bp, mouse
gttgtcaaggcgacatggat

SEQ ID NO: 640469 - DNA, 20 bp, mouse
gacacagggggaggatgcaa

SEQ ID NO: 640470 - DNA, 20 bp, mouse
gaggcgacatggataggagg

SEQ ID NO: 640471 - DNA, 20 bp, mouse
ggggaccacgcgcgcctgtg

SEQ ID NO: 640472 - DNA, 20 bp, mouse
gcgcttcagtcacctccctg

SEQ ID NO: 640473 - DNA, 20 bp, mouse
ggctcacctgccggtctcca

SEQ ID NO: 640474 - DNA, 20 bp, mouse
gcactctaggagaccatccc

SEQ ID NO: 640475 - DNA, 20 bp, mouse
gtgcggttgtcaaggcgaca

SEQ ID NO: 640476 - DNA, 20 bp, mouse
gtgtgctcagaaccccttaa

SEQ ID NO: 640477 - DNA, 20 bp, mouse
gaggaagaatgtgaattcta

SEQ ID NO: 640478 - DNA, 20 bp, mouse
ggggttcctgtcttaggagt

SEQ ID NO: 640479 - DNA, 20 bp, mouse
gtcctgtcttaggagtggga

SEQ ID NO: 640480 - DNA, 20 bp, mouse
gtaagacaggaacccattaa

SEQ ID NO: 640481 - DNA, 20 bp, mouse
gcactggcagggcatagcag

SEQ ID NO: 640482 - DNA, 20 bp, mouse
gtccttcccactcctaagac

SEQ ID NO: 640483 - DNA, 20 bp, mouse
ggaaagctgtgtggtatggc

SEQ ID NO: 640484 - DNA, 20 bp, mouse
ggagcacacagtgacatgat

SEQ ID NO: 640485 - DNA, 20 bp, mouse
gaatagttcataacttccct

SEQ ID NO: 640486 - DNA, 20 bp, mouse
gtagaagcgcggcctgggtg

SEQ ID NO: 640487 - DNA, 20 bp, mouse
gtcgccgctggtgctgtggg

SEQ ID NO: 640488 - DNA, 20 bp, mouse
gggtgcttgagaaaccccga

SEQ ID NO: 640489 - DNA, 20 bp, mouse
gcagtcgccgctggtgctgt

SEQ ID NO: 640490 - DNA, 20 bp, mouse
gacccgtggtggtagagatt

SEQ ID NO: 640491 - DNA, 20 bp, mouse
ggctaggaaccagtcgccgc

SEQ ID NO: 640492 - DNA, 20 bp, mouse
gagaatcagggagataagag

SEQ ID NO: 640493 - DNA, 20 bp, mouse
gcatactagacctgtgtaag

SEQ ID NO: 640494 - DNA, 20 bp, mouse
gagaaactaggttgaagcac

SEQ ID NO: 640495 - DNA, 20 bp, mouse
gacccagagactagaaatcg

SEQ ID NO: 640496 - DNA, 20 bp, mouse
gtgtggaaaagaccttcaaa

SEQ ID NO: 640497 - DNA, 20 bp, mouse
ggcggaaaatatgctcatgg

SEQ ID NO: 640498 - DNA, 20 bp, mouse
gcacacatgcaaggtaatga

SEQ ID NO: 640499 - DNA, 20 bp, mouse
gaggttgcaaggccgcctgg

SEQ ID NO: 640500 - DNA, 20 bp, mouse
gactatccaggggcaggtgg

SEQ ID NO: 640501 - DNA, 20 bp, mouse
ggaggagtgcaggagtactt

SEQ ID NO: 640502 - DNA, 20 bp, mouse
gcggacattccagagagtga

SEQ ID NO: 640503 - DNA, 20 bp, mouse
gagtgatggctatttacaaa

SEQ ID NO: 640504 - DNA, 20 bp, mouse
ggtcacgtgtccacaggggg

SEQ ID NO: 640505 - DNA, 20 bp, mouse
gattctgggtaaaggctagc

SEQ ID NO: 640506 - DNA, 20 bp, mouse
gagagaagcacagttataag

SEQ ID NO: 640507 - DNA, 20 bp, mouse
gaaggtgatattgtttgcct

SEQ ID NO: 640508 - DNA, 20 bp, mouse
gttctgttggctcattttat

SEQ ID NO: 640509 - DNA, 20 bp, mouse
gacgagatgtgttcttcaaa

SEQ ID NO: 640510 - DNA, 20 bp, mouse
gcaagtcacaaattagataa

SEQ ID NO: 640511 - DNA, 20 bp, mouse
gggtggaagtgcccatccca

SEQ ID NO: 640512 - DNA, 20 bp, mouse
gaaaacaaaaacaaaatcat

SEQ ID NO: 640513 - DNA, 20 bp, mouse
gtacaagttctttgaaacaa

SEQ ID NO: 640514 - DNA, 20 bp, mouse
gcaccttgaagaccatggga

SEQ ID NO: 640515 - DNA, 20 bp, mouse
ggtcacaaattagataaggg

SEQ ID NO: 640516 - DNA, 20 bp, mouse
gtaagttatcttatacaagt

SEQ ID NO: 640517 - DNA, 20 bp, mouse
gctacaagtttttgaaacaa

SEQ ID NO: 640518 - DNA, 20 bp, mouse
gttctgttggcccattctgt

SEQ ID NO: 640519 - DNA, 20 bp, mouse
gagacactttcctacagaat

SEQ ID NO: 640520 - DNA, 20 bp, mouse
gttctttaattcatcttgtc

SEQ ID NO: 640521 - DNA, 20 bp, mouse
gtaattctaagtattactaa

SEQ ID NO: 640522 - DNA, 20 bp, mouse
gagagaaacacagttatatg

SEQ ID NO: 640523 - DNA, 20 bp, mouse
gcaagtcacaaattagataa

SEQ ID NO: 640524 - DNA, 20 bp, mouse
gggtggaagtgcccatccca

SEQ ID NO: 640525 - DNA, 20 bp, mouse
gcaccttgaagaccatggga

SEQ ID NO: 640526 - DNA, 20 bp, mouse
gtgcaaattcctgcccagaa

SEQ ID NO: 640527 - DNA, 20 bp, mouse
gatagtacacttcttcacaa

SEQ ID NO: 640528 - DNA, 20 bp, mouse
gagtgtactattttcctttc

SEQ ID NO: 640529 - DNA, 20 bp, mouse
gactattttcctttctgggc

SEQ ID NO: 640530 - DNA, 20 bp, mouse
ggatcaaagggtctgattga

SEQ ID NO: 640531 - DNA, 20 bp, mouse
gaagtccacagaagtctaaa

SEQ ID NO: 640532 - DNA, 20 bp, mouse
gggcaatccatgccaatctc

SEQ ID NO: 640533 - DNA, 20 bp, mouse
gaatcagaccctttgatcac

SEQ ID NO: 640534 - DNA, 20 bp, mouse
gacggtaacctgtgatcaaa

SEQ ID NO: 640535 - DNA, 20 bp, mouse
ggattggcatggattgcctg

SEQ ID NO: 640536 - DNA, 20 bp, mouse
ggggactgatggttcctcca

SEQ ID NO: 640537 - DNA, 20 bp, mouse
gggagccagcggcagagtag

SEQ ID NO: 640538 - DNA, 20 bp, mouse
gagcggcagagtagtggcag

SEQ ID NO: 640539 - DNA, 20 bp, mouse
gttcctccatggggctgcgc

SEQ ID NO: 640540 - DNA, 20 bp, mouse
gagtagtggcaggggactga

SEQ ID NO: 640541 - DNA, 20 bp, mouse
gcgccttccttttgatttgc

SEQ ID NO: 640542 - DNA, 20 bp, mouse
gtccccgcgcagccccatgg

SEQ ID NO: 640543 - DNA, 20 bp, mouse
gagtaaccctgtgatcgcca

SEQ ID NO: 640544 - DNA, 20 bp, mouse
gatcaggccctggcgatcac

SEQ ID NO: 640545 - DNA, 20 bp, mouse
gacagggttactgcctacct

SEQ ID NO: 640546 - DNA, 20 bp, mouse
gaaagagtgtgctggtggct

SEQ ID NO: 640547 - DNA, 20 bp, mouse
gagagaggtaggttggatgt

SEQ ID NO: 640548 - DNA, 20 bp, mouse
ggatgccaaggcaaacgcat

SEQ ID NO: 640549 - DNA, 20 bp, mouse
ggacttccaggtcttctaat

SEQ ID NO: 640550 - DNA, 20 bp, mouse
gacagccaatgcgtttgcct

SEQ ID NO: 640551 - DNA, 20 bp, mouse
gttggcaagcgtccggagca

SEQ ID NO: 640552 - DNA, 20 bp, mouse
gctaatgggatgtatctaat

SEQ ID NO: 640553 - DNA, 20 bp, mouse
gaggctaaagagtgtgctgg

SEQ ID NO: 640554 - DNA, 20 bp, mouse
gggtagcttctcttcgaaga

SEQ ID NO: 640555 - DNA, 20 bp, mouse
ggacgcttgccaattcgagc

SEQ ID NO: 640556 - DNA, 20 bp, mouse
gtaagctccaactcctagtg

SEQ ID NO: 640557 - DNA, 20 bp, mouse
gcaagggaggggcagagacc

SEQ ID NO: 640558 - DNA, 20 bp, mouse
gctaggagttggagcttaag

SEQ ID NO: 640559 - DNA, 20 bp, mouse
gctctaccagagaccaaggg

SEQ ID NO: 640560 - DNA, 20 bp, mouse
gtagggacatactccctcac

SEQ ID NO: 640561 - DNA, 20 bp, mouse
gctctggtagagaagggcaa

SEQ ID NO: 640562 - DNA, 20 bp, mouse
ggaccagggcaagcttgtaa

SEQ ID NO: 640563 - DNA, 20 bp, mouse
gacacagccacactaggagt

SEQ ID NO: 640564 - DNA, 20 bp, mouse
gccttctctaccagagacca

SEQ ID NO: 640565 - DNA, 20 bp, mouse
gaaagccaggccagatagcc

SEQ ID NO: 640566 - DNA, 20 bp, mouse
gcatctggccactgagtggc

SEQ ID NO: 640567 - DNA, 20 bp, mouse
gcctctctgcaaaccccaac

SEQ ID NO: 640568 - DNA, 20 bp, mouse
ggaggcatctggccactgag

SEQ ID NO: 640569 - DNA, 20 bp, mouse
gcacagtccacatcctgttg

SEQ ID NO: 640570 - DNA, 20 bp, mouse
gttcccagcctgccactcag

SEQ ID NO: 640571 - DNA, 20 bp, mouse
gcatgacactagctctctct

SEQ ID NO: 640572 - DNA, 20 bp, mouse
ggagcagcctgaagcctctt

SEQ ID NO: 640573 - DNA, 20 bp, mouse
gctgaggagaatgtatgatg

SEQ ID NO: 640574 - DNA, 20 bp, mouse
gcctcaggaagtcggtctct

SEQ ID NO: 640575 - DNA, 20 bp, mouse
gccagtgtgctcacaggcct

SEQ ID NO: 640576 - DNA, 20 bp, mouse
gaggaagaaacaccattctg

SEQ ID NO: 640577 - DNA, 20 bp, mouse
gctgccgaaaaaggagtaaa

SEQ ID NO: 640578 - DNA, 20 bp, mouse
gtatgcatgttgctctcatg

SEQ ID NO: 640579 - DNA, 20 bp, mouse
gacaagacagtttcacagat

SEQ ID NO: 640580 - DNA, 20 bp, mouse
gttaatccaagtccatgagt

SEQ ID NO: 640581 - DNA, 20 bp, mouse
gccttgcctcagcccactca

SEQ ID NO: 640582 - DNA, 20 bp, mouse
gcagccctttactccttttt

SEQ ID NO: 640583 - DNA, 20 bp, mouse
gcattacactagtaaaactt

SEQ ID NO: 640584 - DNA, 20 bp, mouse
gggaacttcataaggagata

SEQ ID NO: 640585 - DNA, 20 bp, mouse
gttacctcctgcccatttcc

SEQ ID NO: 640586 - DNA, 20 bp, mouse
gctgccgtccctcatcccct

SEQ ID NO: 640587 - DNA, 20 bp, mouse
gagggacggcaggtttgagt

SEQ ID NO: 640588 - DNA, 20 bp, mouse
gtggaggaggcggagtgcac

SEQ ID NO: 640589 - DNA, 20 bp, mouse
gaccagtgacccagtgaggt

SEQ ID NO: 640590 - DNA, 20 bp, mouse
gctgagactcccatggacag

SEQ ID NO: 640591 - DNA, 20 bp, mouse
gttctgatcccaggggatga

SEQ ID NO: 640592 - DNA, 20 bp, mouse
gctgatgaactgaatatgcc

SEQ ID NO: 640593 - DNA, 20 bp, mouse
gatcaggattctgatcccag

SEQ ID NO: 640594 - DNA, 20 bp, mouse
gtggggaacttttggacaca

SEQ ID NO: 640595 - DNA, 20 bp, mouse
ggaccatcttccaacctcac

SEQ ID NO: 640596 - DNA, 20 bp, mouse
gcacccacactccaccacac

SEQ ID NO: 640597 - DNA, 20 bp, mouse
gtggataatagccagtgtgg

SEQ ID NO: 640598 - DNA, 20 bp, mouse
gctttggataatagccagtg

SEQ ID NO: 640599 - DNA, 20 bp, mouse
gatacttgtcagaatagtga

SEQ ID NO: 640600 - DNA, 20 bp, mouse
gatagtgaaggttaagaaaa

SEQ ID NO: 640601 - DNA, 20 bp, mouse
gttttgtggggaagggaact

SEQ ID NO: 640602 - DNA, 20 bp, mouse
ggaatatttgagtgtcagtt

SEQ ID NO: 640603 - DNA, 20 bp, mouse
gcctgactggattaagaatg

SEQ ID NO: 640604 - DNA, 20 bp, mouse
gaatgtggtgatgatgttaa

SEQ ID NO: 640605 - DNA, 20 bp, mouse
gataggagcaacacctaatg

SEQ ID NO: 640606 - DNA, 20 bp, mouse
gtgcgagcagagactgtagt

SEQ ID NO: 640607 - DNA, 20 bp, mouse
gtccctcctgcatgcacaga

SEQ ID NO: 640608 - DNA, 20 bp, mouse
gtccagacactggacagccc

SEQ ID NO: 640609 - DNA, 20 bp, mouse
gtccatctgtgcatgcagga

SEQ ID NO: 640610 - DNA, 20 bp, mouse
gagactgtagtaggctcctt

SEQ ID NO: 640611 - DNA, 20 bp, mouse
ggcaattaatgaggcagaaa

SEQ ID NO: 640612 - DNA, 20 bp, mouse
gcctcattaattgctaactg

SEQ ID NO: 640613 - DNA, 20 bp, mouse
gtgaggtaatccagtaagcc

SEQ ID NO: 640614 - DNA, 20 bp, mouse
gcagaagcagctccagacac

SEQ ID NO: 640615 - DNA, 20 bp, mouse
gagggctgacctagtattta

SEQ ID NO: 640616 - DNA, 20 bp, mouse
ggatccgtggcgcctcgcca

SEQ ID NO: 640617 - DNA, 20 bp, mouse
gcctgcgcggagaaccgaac

SEQ ID NO: 640618 - DNA, 20 bp, mouse
ggcgcctcgccagggtggtt

SEQ ID NO: 640619 - DNA, 20 bp, mouse
gaggagaaccaatggatccg

SEQ ID NO: 640620 - DNA, 20 bp, mouse
gccaccctggcgaggcgcca

SEQ ID NO: 640621 - DNA, 20 bp, mouse
ggagtccagcagcgtctgcg

SEQ ID NO: 640622 - DNA, 20 bp, mouse
ggaaccgaaccggcccacgt

SEQ ID NO: 640623 - DNA, 20 bp, mouse
gggaggaggcagttcctgcg

SEQ ID NO: 640624 - DNA, 20 bp, mouse
gcttgacccgagagccttgt

SEQ ID NO: 640625 - DNA, 20 bp, mouse
gcgaggcgccacggatccat

SEQ ID NO: 640626 - DNA, 20 bp, mouse
ggcggaactcagatgtgcga

SEQ ID NO: 640627 - DNA, 20 bp, mouse
gggcggggaggaagtcgagc

SEQ ID NO: 640628 - DNA, 20 bp, mouse
ggcctcccgaatcctggact

SEQ ID NO: 640629 - DNA, 20 bp, mouse
ggaactcagatgtgcgaggg

SEQ ID NO: 640630 - DNA, 20 bp, mouse
ggaaacctgttcttctgggg

SEQ ID NO: 640631 - DNA, 20 bp, mouse
gggctccttgatgcgttaac

SEQ ID NO: 640632 - DNA, 20 bp, mouse
gtccaagtccaggattcggg

SEQ ID NO: 640633 - DNA, 20 bp, mouse
gaagtcgagccggcgcacaa

SEQ ID NO: 640634 - DNA, 20 bp, mouse
gggagacaaagtcagttaaa

SEQ ID NO: 640635 - DNA, 20 bp, mouse
gaaggacagcccggccgcgg

SEQ ID NO: 640636 - DNA, 20 bp, mouse
ggcaggaactgaacatgggg

SEQ ID NO: 640637 - DNA, 20 bp, mouse
ggggagagccccaggtttag

SEQ ID NO: 640638 - DNA, 20 bp, mouse
gcccgtgacaatagccagtc

SEQ ID NO: 640639 - DNA, 20 bp, mouse
gctggctattgtcacggggt

SEQ ID NO: 640640 - DNA, 20 bp, mouse
ggggggaacaactgacaatc

SEQ ID NO: 640641 - DNA, 20 bp, mouse
gaaaacactaacgtgctgga

SEQ ID NO: 640642 - DNA, 20 bp, mouse
gcctgcagcagtgggtcaga

SEQ ID NO: 640643 - DNA, 20 bp, mouse
gggacagtgagagtccctgc

SEQ ID NO: 640644 - DNA, 20 bp, mouse
gcatttctgatgtaatcggc

SEQ ID NO: 640645 - DNA, 20 bp, mouse
gagaatccggatgacctgta

SEQ ID NO: 640646 - DNA, 20 bp, mouse
ggaaccccagcaagtcccaa

SEQ ID NO: 640647 - DNA, 20 bp, mouse
gtaaaggggagggcccggat

SEQ ID NO: 640648 - DNA, 20 bp, mouse
gacgcctcccgctaaagggg

SEQ ID NO: 640649 - DNA, 20 bp, mouse
gcggacgcctcccgctaaag

SEQ ID NO: 640650 - DNA, 20 bp, mouse
gcagagtgaaccggggatac

SEQ ID NO: 640651 - DNA, 20 bp, mouse
gcccgctaaaggggagggcc

SEQ ID NO: 640652 - DNA, 20 bp, mouse
gttaagaagccaggagtaaa

SEQ ID NO: 640653 - DNA, 20 bp, mouse
gagttggggatgcaataata

SEQ ID NO: 640654 - DNA, 20 bp, mouse
gcattgctcagagtgaaccg

SEQ ID NO: 640655 - DNA, 20 bp, mouse
ggtctgcctttgggacttgc

SEQ ID NO: 640656 - DNA, 20 bp, mouse
ggaccgcggcccaatgaagg

SEQ ID NO: 640657 - DNA, 20 bp, mouse
ggcggaccgcggcccaatga

SEQ ID NO: 640658 - DNA, 20 bp, mouse
ggcccaatgaaggcgggacc

SEQ ID NO: 640659 - DNA, 20 bp, mouse
gcagggaggggcggaaccaa

SEQ ID NO: 640660 - DNA, 20 bp, mouse
gaatgaaggcgggacctggt

SEQ ID NO: 640661 - DNA, 20 bp, mouse
gaaactatgaatgaggccat

SEQ ID NO: 640662 - DNA, 20 bp, mouse
gttgggcagggtactgggag

SEQ ID NO: 640663 - DNA, 20 bp, mouse
ggggttccgcccccgagctg

SEQ ID NO: 640664 - DNA, 20 bp, mouse
gtcccgccttcattgggccg

SEQ ID NO: 640665 - DNA, 20 bp, mouse
ggtgggttgggcagggtact

SEQ ID NO: 640666 - DNA, 20 bp, mouse
ggtgcggggaacgcggtggt

SEQ ID NO: 640667 - DNA, 20 bp, mouse
ggatccccaaatctcggctg

SEQ ID NO: 640668 - DNA, 20 bp, mouse
gaagttgcgggtgcacggtg

SEQ ID NO: 640669 - DNA, 20 bp, mouse
gctactctcctgcgtggggg

SEQ ID NO: 640670 - DNA, 20 bp, mouse
ggctgtggaaggcgaagttg

SEQ ID NO: 640671 - DNA, 20 bp, mouse
gtgaggcgatccccaaatct

SEQ ID NO: 640672 - DNA, 20 bp, mouse
gcagagccgaacagaccgag

SEQ ID NO: 640673 - DNA, 20 bp, mouse
ggctctgctgcggctagctg

SEQ ID NO: 640674 - DNA, 20 bp, mouse
gcggctgaggtgtacttgct

SEQ ID NO: 640675 - DNA, 20 bp, mouse
ggaggctactctcctgcgtg

SEQ ID NO: 640676 - DNA, 20 bp, mouse
gcctctgcacttccgggcgg

SEQ ID NO: 640677 - DNA, 20 bp, mouse
gcctaggcctctgcacttcc

SEQ ID NO: 640678 - DNA, 20 bp, mouse
gccagcagccggattagttc

SEQ ID NO: 640679 - DNA, 20 bp, mouse
gatgacttgagtcagagggg

SEQ ID NO: 640680 - DNA, 20 bp, mouse
gagccggattagttcaggga

SEQ ID NO: 640681 - DNA, 20 bp, mouse
gctcccaggcggccgggcca

SEQ ID NO: 640682 - DNA, 20 bp, mouse
gcaggcgggacctgatgaga

SEQ ID NO: 640683 - DNA, 20 bp, mouse
ggccgcctgggagggacaac

SEQ ID NO: 640684 - DNA, 20 bp, mouse
ggtccttccctgaactaatc

SEQ ID NO: 640685 - DNA, 20 bp, mouse
ggctgctggcagttgccggc

SEQ ID NO: 640686 - DNA, 20 bp, mouse
gacggggcggggcctcacgt

SEQ ID NO: 640687 - DNA, 20 bp, mouse
gagaggggaagatgctagaa

SEQ ID NO: 640688 - DNA, 20 bp, mouse
gcacgaggctgcgtgaatgc

SEQ ID NO: 640689 - DNA, 20 bp, mouse
gtgcgtgaatgcgggagaca

SEQ ID NO: 640690 - DNA, 20 bp, mouse
gtgcggcagcaacagcgcga

SEQ ID NO: 640691 - DNA, 20 bp, mouse
ggtcccctggggcataccaa

SEQ ID NO: 640692 - DNA, 20 bp, mouse
gcccagccgggccagagaga

SEQ ID NO: 640693 - DNA, 20 bp, mouse
gtagggggtgtcacaccacg

SEQ ID NO: 640694 - DNA, 20 bp, mouse
gcggggcctcacgttgggtt

SEQ ID NO: 640695 - DNA, 20 bp, mouse
gagcccaagtgtgcatcctg

SEQ ID NO: 640696 - DNA, 20 bp, mouse
gtgcagcggcgcaacttgaa

SEQ ID NO: 640697 - DNA, 20 bp, mouse
gggtatgcatgaggccaccc

SEQ ID NO: 640698 - DNA, 20 bp, mouse
gcaacgagggtccctctcaa

SEQ ID NO: 640699 - DNA, 20 bp, mouse
gggaagagcccgggacgtgt

SEQ ID NO: 640700 - DNA, 20 bp, mouse
gacgtgtaggaggtgagagc

SEQ ID NO: 640701 - DNA, 20 bp, mouse
gcggaagcaggtagtccatg

SEQ ID NO: 640702 - DNA, 20 bp, mouse
gttgctctaaggtgacactt

SEQ ID NO: 640703 - DNA, 20 bp, mouse
gcccgccggtactgtgcaat

SEQ ID NO: 640704 - DNA, 20 bp, mouse
ggggaagctgaacggggcat

SEQ ID NO: 640705 - DNA, 20 bp, mouse
gctcacctcctacacgtccc

SEQ ID NO: 640706 - DNA, 20 bp, mouse
gagacaggggcccaggttat

SEQ ID NO: 640707 - DNA, 20 bp, mouse
ggatacccaagcattgtgtt

SEQ ID NO: 640708 - DNA, 20 bp, mouse
ggaaacccaaacttagggtg

SEQ ID NO: 640709 - DNA, 20 bp, mouse
gtggaggaaacccaaactta

SEQ ID NO: 640710 - DNA, 20 bp, mouse
gctagaagatccagtatctg

SEQ ID NO: 640711 - DNA, 20 bp, mouse
gtgcagaagggaaatggttt

SEQ ID NO: 640712 - DNA, 20 bp, mouse
gcccaaacttagggtggggt

SEQ ID NO: 640713 - DNA, 20 bp, mouse
gaccctgaatagaccaagac

SEQ ID NO: 640714 - DNA, 20 bp, mouse
gcgatttcgttgtttgtcaa

SEQ ID NO: 640715 - DNA, 20 bp, mouse
ggcagcaagcctgctctctg

SEQ ID NO: 640716 - DNA, 20 bp, mouse
gcaaagcagtaccagctgtg

SEQ ID NO: 640717 - DNA, 20 bp, mouse
gtgtctgggctctggctcgg

SEQ ID NO: 640718 - DNA, 20 bp, mouse
gtagatggctgtagctgtga

SEQ ID NO: 640719 - DNA, 20 bp, mouse
ggcaggaagcttcactgtgc

SEQ ID NO: 640720 - DNA, 20 bp, mouse
gggtgggtgagtgcttgctt

SEQ ID NO: 640721 - DNA, 20 bp, mouse
gtcactgtgctggcactgtc

SEQ ID NO: 640722 - DNA, 20 bp, mouse
gcagccatctaggcctttct

SEQ ID NO: 640723 - DNA, 20 bp, mouse
gaggagcctatggtgctgaa

SEQ ID NO: 640724 - DNA, 20 bp, mouse
gagagatgacggctctcata

SEQ ID NO: 640725 - DNA, 20 bp, mouse
ggacggctctcatatggggg

SEQ ID NO: 640726 - DNA, 20 bp, mouse
ggagctgccgcgtggagggt

SEQ ID NO: 640727 - DNA, 20 bp, mouse
gcacatgtcccaccttcgga

SEQ ID NO: 640728 - DNA, 20 bp, mouse
ggccgccatcgccgcgtggt

SEQ ID NO: 640729 - DNA, 20 bp, mouse
gggccgagctgccgcgtgga

SEQ ID NO: 640730 - DNA, 20 bp, mouse
gtggagaacgcgctcaatgg

SEQ ID NO: 640731 - DNA, 20 bp, mouse
gcgcgtggtgggtgaatgat

SEQ ID NO: 640732 - DNA, 20 bp, mouse
ggggcgcgcggacgactcag

SEQ ID NO: 640733 - DNA, 20 bp, mouse
ggggtgaatgatgggcctca

SEQ ID NO: 640734 - DNA, 20 bp, mouse
gacccaccacgcggcgatgg

SEQ ID NO: 640735 - DNA, 20 bp, mouse
gcggaagcggaaatcagcgt

SEQ ID NO: 640736 - DNA, 20 bp, mouse
gcgtgcgccgagctggaggt

SEQ ID NO: 640737 - DNA, 20 bp, mouse
gtccgcaggggccgcccgga

SEQ ID NO: 640738 - DNA, 20 bp, mouse
gtgcgtgcgtgcacgtgggc

SEQ ID NO: 640739 - DNA, 20 bp, mouse
gggacggcgggaaccagctt

SEQ ID NO: 640740 - DNA, 20 bp, mouse
gcaaacggcccgccaatggc

SEQ ID NO: 640741 - DNA, 20 bp, mouse
gggcccgccaatggcgggat

SEQ ID NO: 640742 - DNA, 20 bp, mouse
ggtcgccggcagtcaatcct

SEQ ID NO: 640743 - DNA, 20 bp, mouse
ggccttccgggcggcccctg

SEQ ID NO: 640744 - DNA, 20 bp, mouse
gcaatggcgggatcggacgg

SEQ ID NO: 640745 - DNA, 20 bp, mouse
ggcacgcgcagcttgcgcaa

SEQ ID NO: 640746 - DNA, 20 bp, mouse
gggagtctgcgcaagtgcgc

SEQ ID NO: 640747 - DNA, 20 bp, mouse
gcggtccagcggagtaggag

SEQ ID NO: 640748 - DNA, 20 bp, mouse
ggagtaggaggggtttgatg

SEQ ID NO: 640749 - DNA, 20 bp, mouse
gccgctggaccgacaagtgg

SEQ ID NO: 640750 - DNA, 20 bp, mouse
gcggaagcgcgagcgcactc

SEQ ID NO: 640751 - DNA, 20 bp, mouse
gatcttcagagcagatgcgc

SEQ ID NO: 640752 - DNA, 20 bp, mouse
gaggtgcgctttgagacgtt

SEQ ID NO: 640753 - DNA, 20 bp, mouse
ggaggggtttgatgtggctc

SEQ ID NO: 640754 - DNA, 20 bp, mouse
gcaaacccctcctactccgc

SEQ ID NO: 640755 - DNA, 20 bp, mouse
gtgcgcatctgggcagcagg

SEQ ID NO: 640756 - DNA, 20 bp, mouse
gcctcagagcccaaagccaa

SEQ ID NO: 640757 - DNA, 20 bp, mouse
gccctagagtctgtgatgga

SEQ ID NO: 640758 - DNA, 20 bp, mouse
gaacagacaacctgtggagc

SEQ ID NO: 640759 - DNA, 20 bp, mouse
gcacgtcctgccgagcccga

SEQ ID NO: 640760 - DNA, 20 bp, mouse
ggccagtccctctaagagtg

SEQ ID NO: 640761 - DNA, 20 bp, mouse
gtgcagaagcccttggcttt

SEQ ID NO: 640762 - DNA, 20 bp, mouse
gcttagagggactggcaggg

SEQ ID NO: 640763 - DNA, 20 bp, mouse
ggacacagatcgagtaagtg

SEQ ID NO: 640764 - DNA, 20 bp, mouse
gtcaagccatcgggctcggc

SEQ ID NO: 640765 - DNA, 20 bp, mouse
ggatatcagacccaaggcct

SEQ ID NO: 640766 - DNA, 20 bp, mouse
ggcgactggagctactgagg

SEQ ID NO: 640767 - DNA, 20 bp, mouse
ggagaagtccatgaagtgtc

SEQ ID NO: 640768 - DNA, 20 bp, mouse
gtacctgtatgcatgctctc

SEQ ID NO: 640769 - DNA, 20 bp, mouse
gagcctgagagcatgcatac

SEQ ID NO: 640770 - DNA, 20 bp, mouse
gacaataaaaggctagcgac

SEQ ID NO: 640771 - DNA, 20 bp, mouse
gtgaggtggctcggaggcta

SEQ ID NO: 640772 - DNA, 20 bp, mouse
gcttctctccagacacttca

SEQ ID NO: 640773 - DNA, 20 bp, mouse
gaactgagtcaagctggcag

SEQ ID NO: 640774 - DNA, 20 bp, mouse
gttttaacgcgagggttctg

SEQ ID NO: 640775 - DNA, 20 bp, mouse
gaacagtcacagcaaataac

SEQ ID NO: 640776 - DNA, 20 bp, mouse
gcatgtgcaaagttctaaag

SEQ ID NO: 640777 - DNA, 20 bp, mouse
ggactcctatccctgagtgc

SEQ ID NO: 640778 - DNA, 20 bp, mouse
ggggcaagtggactggactc

SEQ ID NO: 640779 - DNA, 20 bp, mouse
ggcaatctcaaacatatcat

SEQ ID NO: 640780 - DNA, 20 bp, mouse
gagtccacttgcccagtcaa

SEQ ID NO: 640781 - DNA, 20 bp, mouse
ggattgacaaccagcactca

SEQ ID NO: 640782 - DNA, 20 bp, mouse
gactggcattgccaagaccc

SEQ ID NO: 640783 - DNA, 20 bp, mouse
gagcaaacgatgcacctgtt

SEQ ID NO: 640784 - DNA, 20 bp, mouse
ggaaacgagatactgtagac

SEQ ID NO: 640785 - DNA, 20 bp, mouse
gaggagtcctttgtgtttgc

SEQ ID NO: 640786 - DNA, 20 bp, mouse
gggagggggtacttatggat

SEQ ID NO: 640787 - DNA, 20 bp, mouse
gaaacacacgggaaagatgg

SEQ ID NO: 640788 - DNA, 20 bp, mouse
gcccaagtgcacagatgaat

SEQ ID NO: 640789 - DNA, 20 bp, mouse
gagtgttaaagacaatgggt

SEQ ID NO: 640790 - DNA, 20 bp, mouse
ggacagacgcggatatagac

SEQ ID NO: 640791 - DNA, 20 bp, mouse
gaaacccttatggagtgcgg

SEQ ID NO: 640792 - DNA, 20 bp, mouse
ggtgaaacccttatggagtg

SEQ ID NO: 640793 - DNA, 20 bp, mouse
gcatctgtgcacttgggcgt

SEQ ID NO: 640794 - DNA, 20 bp, mouse
gttccctccgcactccataa

SEQ ID NO: 640795 - DNA, 20 bp, mouse
gcgtaaacacacgggaaaga

SEQ ID NO: 640796 - DNA, 20 bp, mouse
ggggactgggactaagcact

SEQ ID NO: 640797 - DNA, 20 bp, mouse
gtgtacctagaggaggaatc

SEQ ID NO: 640798 - DNA, 20 bp, mouse
gcgtacggatgtgtacctag

SEQ ID NO: 640799 - DNA, 20 bp, mouse
gtagtcacagttgctcaatg

SEQ ID NO: 640800 - DNA, 20 bp, mouse
gacagtggattatagttgat

SEQ ID NO: 640801 - DNA, 20 bp, mouse
ggaaaccataagacacatga

SEQ ID NO: 640802 - DNA, 20 bp, mouse
gacctccagattcctcctct

SEQ ID NO: 640803 - DNA, 20 bp, mouse
gacggatgtgtacctagagg

SEQ ID NO: 640804 - DNA, 20 bp, mouse
gttggagcttgtagtgatgg

SEQ ID NO: 640805 - DNA, 20 bp, mouse
gagcgcatgacagataaggc

SEQ ID NO: 640806 - DNA, 20 bp, mouse
gtggaggagtctgtctagga

SEQ ID NO: 640807 - DNA, 20 bp, mouse
gaaggacctcgaggccactc

SEQ ID NO: 640808 - DNA, 20 bp, mouse
gcgctgctctgcacgcactt

SEQ ID NO: 640809 - DNA, 20 bp, mouse
gtctgacaggctggatcctt

SEQ ID NO: 640810 - DNA, 20 bp, mouse
gtgcgtgcagagcagcgctc

SEQ ID NO: 640811 - DNA, 20 bp, mouse
gtagacagactcctccagag

SEQ ID NO: 640812 - DNA, 20 bp, mouse
gaggtccttctctgacaggc

SEQ ID NO: 640813 - DNA, 20 bp, mouse
gctgtcagagaaggacctcg

SEQ ID NO: 640814 - DNA, 20 bp, mouse
ggacctcgaggccactctgg

SEQ ID NO: 640815 - DNA, 20 bp, mouse
gctaaggggcgggcctccca

SEQ ID NO: 640816 - DNA, 20 bp, mouse
gcagtccaacccgctcccta

SEQ ID NO: 640817 - DNA, 20 bp, mouse
gcgggacgcaccaccgtgag

SEQ ID NO: 640818 - DNA, 20 bp, mouse
gcaccaccgtgaggggagga

SEQ ID NO: 640819 - DNA, 20 bp, mouse
gtctgtgcgcccagggcagc

SEQ ID NO: 640820 - DNA, 20 bp, mouse
ggacgcaccaccgtgagggg

SEQ ID NO: 640821 - DNA, 20 bp, mouse
ggactgggcgccagcggacc

SEQ ID NO: 640822 - DNA, 20 bp, mouse
gccagagcgtggcacacaat

SEQ ID NO: 640823 - DNA, 20 bp, mouse
gctgggcctctgtgcgccca

SEQ ID NO: 640824 - DNA, 20 bp, mouse
gcgtcccggggttccccttc

SEQ ID NO: 640825 - DNA, 20 bp, mouse
gcgtgaggggaggagggtca

SEQ ID NO: 640826 - DNA, 20 bp, mouse
ggaggctgacggacggacga

SEQ ID NO: 640827 - DNA, 20 bp, mouse
gccttcggatgagaatagtg

SEQ ID NO: 640828 - DNA, 20 bp, mouse
gagaccctataaattgtcct

SEQ ID NO: 640829 - DNA, 20 bp, mouse
ggagcaccgggttgcggacg

SEQ ID NO: 640830 - DNA, 20 bp, mouse
gcaatgaatggatcggcctg

SEQ ID NO: 640831 - DNA, 20 bp, mouse
gaatggatcggcctgaggtc

SEQ ID NO: 640832 - DNA, 20 bp, mouse
gaggccacacacttatccca

SEQ ID NO: 640833 - DNA, 20 bp, mouse
gttaacaggctgacatcagg

SEQ ID NO: 640834 - DNA, 20 bp, mouse
gatgagaatagtgaggctga

SEQ ID NO: 640835 - DNA, 20 bp, mouse
gggttgcggacgaggatccg

SEQ ID NO: 640836 - DNA, 20 bp, mouse
gcccccagaacccagttatg

SEQ ID NO: 640837 - DNA, 20 bp, mouse
ggggagatctcaaagaccac

SEQ ID NO: 640838 - DNA, 20 bp, mouse
gtctgggcatgatccaccct

SEQ ID NO: 640839 - DNA, 20 bp, mouse
gaggaagcggccttaaaact

SEQ ID NO: 640840 - DNA, 20 bp, mouse
gtgaagcagagctgacttca

SEQ ID NO: 640841 - DNA, 20 bp, mouse
gttctgggggagtagagcgc

SEQ ID NO: 640842 - DNA, 20 bp, mouse
gggaggctcccaggaaattc

SEQ ID NO: 640843 - DNA, 20 bp, mouse
gttgagatctccccataact

SEQ ID NO: 640844 - DNA, 20 bp, mouse
gtggttcaaggttaaactct

SEQ ID NO: 640845 - DNA, 20 bp, mouse
gactgggtgaagccgtttct

SEQ ID NO: 640846 - DNA, 20 bp, mouse
gcgcccccaaggcacgatcg

SEQ ID NO: 640847 - DNA, 20 bp, mouse
gagaaatccggacctgggga

SEQ ID NO: 640848 - DNA, 20 bp, mouse
gactctctgtaggtagacgg

SEQ ID NO: 640849 - DNA, 20 bp, mouse
gtggaggacgacacggtgga

SEQ ID NO: 640850 - DNA, 20 bp, mouse
gccacccacgcctccggaac

SEQ ID NO: 640851 - DNA, 20 bp, mouse
gggcggatcagcgagagtga

SEQ ID NO: 640852 - DNA, 20 bp, mouse
ggcaccttttgcaccgtgat

SEQ ID NO: 640853 - DNA, 20 bp, mouse
gccaactcccaggatcgttt

SEQ ID NO: 640854 - DNA, 20 bp, mouse
gcctccggaacaggaagccc

SEQ ID NO: 640855 - DNA, 20 bp, mouse
gctcgctgatccgccaatca

SEQ ID NO: 640856 - DNA, 20 bp, mouse
gtatcctggggcactggcgt

SEQ ID NO: 640857 - DNA, 20 bp, mouse
gggggccccaataccttaca

SEQ ID NO: 640858 - DNA, 20 bp, mouse
gccttacagggctggttcca

SEQ ID NO: 640859 - DNA, 20 bp, mouse
gagccccacgccagtgcccc

SEQ ID NO: 640860 - DNA, 20 bp, mouse
gaccagccctgtaaggtatt

SEQ ID NO: 640861 - DNA, 20 bp, mouse
gtgaaggttgtggctctcca

SEQ ID NO: 640862 - DNA, 20 bp, mouse
gcgcgtgtgtctactgagtt

SEQ ID NO: 640863 - DNA, 20 bp, mouse
gttctccccctgttacctgc

SEQ ID NO: 640864 - DNA, 20 bp, mouse
ggggatgtgtgattatcctg

SEQ ID NO: 640865 - DNA, 20 bp, mouse
ggccacccgaggagcatcca

SEQ ID NO: 640866 - DNA, 20 bp, mouse
gtgcacccatcaagacaaaa

SEQ ID NO: 640867 - DNA, 20 bp, mouse
gagtgaagcagagtcctgta

SEQ ID NO: 640868 - DNA, 20 bp, mouse
gggactgtagggaatttaga

SEQ ID NO: 640869 - DNA, 20 bp, mouse
gtcactctgtgacaaggccc

SEQ ID NO: 640870 - DNA, 20 bp, mouse
gagggctggcctgatgtctc

SEQ ID NO: 640871 - DNA, 20 bp, mouse
gtccacccttttgtcttgat

SEQ ID NO: 640872 - DNA, 20 bp, mouse
ggtagtgttttccaaacatg

SEQ ID NO: 640873 - DNA, 20 bp, mouse
gtgacctctcagagccagta

SEQ ID NO: 640874 - DNA, 20 bp, mouse
gctgccatactggctctgag

SEQ ID NO: 640875 - DNA, 20 bp, mouse
ggggcctctccagggactgt

SEQ ID NO: 640876 - DNA, 20 bp, mouse
gcaaaagggcaaggcagcaa

SEQ ID NO: 640877 - DNA, 20 bp, mouse
gtcctgacaagcccacttgt

SEQ ID NO: 640878 - DNA, 20 bp, mouse
gagtatgctgggaacggaaa

SEQ ID NO: 640879 - DNA, 20 bp, mouse
gccctcgctttcaggatttc

SEQ ID NO: 640880 - DNA, 20 bp, mouse
ggcaagggagatcatgtcct

SEQ ID NO: 640881 - DNA, 20 bp, mouse
gcgacagaatcaagtatgct

SEQ ID NO: 640882 - DNA, 20 bp, mouse
ggcagaaggttgatttactc

SEQ ID NO: 640883 - DNA, 20 bp, mouse
ggaatcaagtatgctgggaa

SEQ ID NO: 640884 - DNA, 20 bp, mouse
ggaagtagccatcaatgtca

SEQ ID NO: 640885 - DNA, 20 bp, mouse
gatgttgttctccgtgtcag

SEQ ID NO: 640886 - DNA, 20 bp, mouse
gggtggtctaggtacccaga

SEQ ID NO: 640887 - DNA, 20 bp, mouse
ggaggcacatccatccctct

SEQ ID NO: 640888 - DNA, 20 bp, mouse
gaaccaagggctttgcagag

SEQ ID NO: 640889 - DNA, 20 bp, mouse
gcacctgtgctaggagggtg

SEQ ID NO: 640890 - DNA, 20 bp, mouse
gaaggagagcgcaaggatgc

SEQ ID NO: 640891 - DNA, 20 bp, mouse
gaaagcgcaaggagagcgca

SEQ ID NO: 640892 - DNA, 20 bp, mouse
gtccacgcccccactccggg

SEQ ID NO: 640893 - DNA, 20 bp, mouse
ggctttgcagagaggtgtgg

SEQ ID NO: 640894 - DNA, 20 bp, mouse
gagaacctcactcaaggtcc

SEQ ID NO: 640895 - DNA, 20 bp, mouse
gccgccctccgcccggagtg

SEQ ID NO: 640896 - DNA, 20 bp, mouse
gcgctccagccgggctcctg

SEQ ID NO: 640897 - DNA, 20 bp, mouse
gcgcgccgagcgcgctccgc

SEQ ID NO: 640898 - DNA, 20 bp, mouse
gtcccgaggcgctggaagct

SEQ ID NO: 640899 - DNA, 20 bp, mouse
gaggcgctggaagctcggca

SEQ ID NO: 640900 - DNA, 20 bp, mouse
ggggagcgcggcccggagga

SEQ ID NO: 640901 - DNA, 20 bp, mouse
gggccgcgctccctgaggga

SEQ ID NO: 640902 - DNA, 20 bp, mouse
ggagggtggcgcggagagca

SEQ ID NO: 640903 - DNA, 20 bp, mouse
gctccgggccgcgctccctg

SEQ ID NO: 640904 - DNA, 20 bp, mouse
gtgcgccgagggagccgaga

SEQ ID NO: 640905 - DNA, 20 bp, mouse
gtctccgcgccaccctcctc

SEQ ID NO: 640906 - DNA, 20 bp, mouse
gcggagacgagcaagggcgg

SEQ ID NO: 640907 - DNA, 20 bp, mouse
gaggtcgtaagggtgacagt

SEQ ID NO: 640908 - DNA, 20 bp, mouse
gtgagcctgcgaggtcgtaa

SEQ ID NO: 640909 - DNA, 20 bp, mouse
ggggcggagacgagcaaggg

SEQ ID NO: 640910 - DNA, 20 bp, mouse
gcggggcatcccgggagcaa

SEQ ID NO: 640911 - DNA, 20 bp, mouse
gtgcggcacgcgctactcgc

SEQ ID NO: 640912 - DNA, 20 bp, mouse
gataccgcgcggggcatccc

SEQ ID NO: 640913 - DNA, 20 bp, mouse
gcgcgcactttggcgggagg

SEQ ID NO: 640914 - DNA, 20 bp, mouse
gccaccttgccaggcactag

SEQ ID NO: 640915 - DNA, 20 bp, mouse
gtgccgcaactatcgcccgg

SEQ ID NO: 640916 - DNA, 20 bp, mouse
ggaccgaccgggctgggcac

SEQ ID NO: 640917 - DNA, 20 bp, mouse
gcaggggcgcggggaccgac

SEQ ID NO: 640918 - DNA, 20 bp, mouse
ggcaacgctcggtcatggtg

SEQ ID NO: 640919 - DNA, 20 bp, mouse
ggtgacggccgaaggggcag

SEQ ID NO: 640920 - DNA, 20 bp, mouse
ggggtcccccgagcgtacca

SEQ ID NO: 640921 - DNA, 20 bp, mouse
gtacctcatcgcctggtcgg

SEQ ID NO: 640922 - DNA, 20 bp, mouse
gtaccaggggtgacggccga

SEQ ID NO: 640923 - DNA, 20 bp, mouse
ggcgccccgccgctgagatg

SEQ ID NO: 640924 - DNA, 20 bp, mouse
gccgagcgtaccaggggtga

SEQ ID NO: 640925 - DNA, 20 bp, mouse
gcggcggggcgcagtgaccc

SEQ ID NO: 640926 - DNA, 20 bp, mouse
gggacgccgcggcgtacaag

SEQ ID NO: 640927 - DNA, 20 bp, mouse
gtacggcaggagcgtctctc

SEQ ID NO: 640928 - DNA, 20 bp, mouse
gccgcggcgtacaaggggca

SEQ ID NO: 640929 - DNA, 20 bp, mouse
ggggcgacgcgccccaaaaa

SEQ ID NO: 640930 - DNA, 20 bp, mouse
gcgtccctgcagtgaaggag

SEQ ID NO: 640931 - DNA, 20 bp, mouse
gtcccccagggcgccggtag

SEQ ID NO: 640932 - DNA, 20 bp, mouse
ggggaccagaagtttcttcc

SEQ ID NO: 640933 - DNA, 20 bp, mouse
gctgccgtagggcgactcgg

SEQ ID NO: 640934 - DNA, 20 bp, mouse
gtctccgccgagtcgcccta

SEQ ID NO: 640935 - DNA, 20 bp, mouse
gcaaaaagggcgcgcgggga

SEQ ID NO: 640936 - DNA, 20 bp, mouse
gcggagagctacaaaggcgg

SEQ ID NO: 640937 - DNA, 20 bp, mouse
gcggggttgcggacagagtg

SEQ ID NO: 640938 - DNA, 20 bp, mouse
gtgtccgcaaccccgcccaa

SEQ ID NO: 640939 - DNA, 20 bp, mouse
gcagcggcaggtctggagag

SEQ ID NO: 640940 - DNA, 20 bp, mouse
gccagcctgcattgaggggg

SEQ ID NO: 640941 - DNA, 20 bp, mouse
gcacaatggctgtagggcta

SEQ ID NO: 640942 - DNA, 20 bp, mouse
gcctccagcctgcattgagg

SEQ ID NO: 640943 - DNA, 20 bp, mouse
gtacaaaggcggcggtgctg

SEQ ID NO: 640944 - DNA, 20 bp, mouse
ggacccggagcccttgggcg

SEQ ID NO: 640945 - DNA, 20 bp, mouse
gtacctgcggaactagcaga

SEQ ID NO: 640946 - DNA, 20 bp, mouse
gccaaggaaagattgaggtt

SEQ ID NO: 640947 - DNA, 20 bp, mouse
gtactggagaaaaccccgag

SEQ ID NO: 640948 - DNA, 20 bp, mouse
ggaaagaaagccaccagtta

SEQ ID NO: 640949 - DNA, 20 bp, mouse
gaagccaccagttaaggagc

SEQ ID NO: 640950 - DNA, 20 bp, mouse
gaggacaagcgtggggtaat

SEQ ID NO: 640951 - DNA, 20 bp, mouse
gagagaggaaattatccagt

SEQ ID NO: 640952 - DNA, 20 bp, mouse
gcagcctgctccttaactgg

SEQ ID NO: 640953 - DNA, 20 bp, mouse
gaattgggaagcaaatgttg

SEQ ID NO: 640954 - DNA, 20 bp, mouse
ggctctaaacatgccagcca

SEQ ID NO: 640955 - DNA, 20 bp, mouse
gggggccaaggacaagcgtg

SEQ ID NO: 640956 - DNA, 20 bp, mouse
gggaaacccaggagaggaat

SEQ ID NO: 640957 - DNA, 20 bp, mouse
gccgcagagcagaaagtgga

SEQ ID NO: 640958 - DNA, 20 bp, mouse
gggaggggggtggtcctcag

SEQ ID NO: 640959 - DNA, 20 bp, mouse
gctgcgggcggtctagagaa

SEQ ID NO: 640960 - DNA, 20 bp, mouse
gccagcccccagtttcctag

SEQ ID NO: 640961 - DNA, 20 bp, mouse
ggcgaaagagctggaaaccc

SEQ ID NO: 640962 - DNA, 20 bp, mouse
gaaaggcggccggagggggg

SEQ ID NO: 640963 - DNA, 20 bp, mouse
ggcccccagtttcctagcgg

SEQ ID NO: 640964 - DNA, 20 bp, mouse
gtgcggctctagcagtggca

SEQ ID NO: 640965 - DNA, 20 bp, mouse
gagagctggaaacccaggag

SEQ ID NO: 640966 - DNA, 20 bp, mouse
gagatcgggctgaatcaagg

SEQ ID NO: 640967 - DNA, 20 bp, mouse
gcagagatcgggctgaatca

SEQ ID NO: 640968 - DNA, 20 bp, mouse
gcgggctgaatcaaggtgga

SEQ ID NO: 640969 - DNA, 20 bp, mouse
gagacgcggcacagccggaa

SEQ ID NO: 640970 - DNA, 20 bp, mouse
gccttcctgggatcgaggga

SEQ ID NO: 640971 - DNA, 20 bp, mouse
ggtgccgcgtctcccagcaa

SEQ ID NO: 640972 - DNA, 20 bp, mouse
ggttaaaaaacgaagggaga

SEQ ID NO: 640973 - DNA, 20 bp, mouse
gggccagtgcagaagttgct

SEQ ID NO: 640974 - DNA, 20 bp, mouse
gctcctgcacgcccagagat

SEQ ID NO: 640975 - DNA, 20 bp, mouse
gccactcgtgtatgagactt

SEQ ID NO: 640976 - DNA, 20 bp, mouse
gaacccgcgcggctgtcggg

SEQ ID NO: 640977 - DNA, 20 bp, mouse
gcagccgcgcgggttcgctc

SEQ ID NO: 640978 - DNA, 20 bp, mouse
gcgcgagtcacgtggtgctc

SEQ ID NO: 640979 - DNA, 20 bp, mouse
gtcacgcgggggaggagggt

SEQ ID NO: 640980 - DNA, 20 bp, mouse
ggagtcacgtggtgctctgg

SEQ ID NO: 640981 - DNA, 20 bp, mouse
ggaactcgtacgtcacgcgg

SEQ ID NO: 640982 - DNA, 20 bp, mouse
gagagagttgtcagtcaaca

SEQ ID NO: 640983 - DNA, 20 bp, mouse
ggctctggaggcgtggctcc

SEQ ID NO: 640984 - DNA, 20 bp, mouse
gtcgggaggcgcagggacta

SEQ ID NO: 640985 - DNA, 20 bp, mouse
gcgcctcccgacagccgcgc

SEQ ID NO: 640986 - DNA, 20 bp, mouse
gcgcctgcgcaagacagcga

SEQ ID NO: 640987 - DNA, 20 bp, mouse
gacagcgaggggcgtgaccc

SEQ ID NO: 640988 - DNA, 20 bp, mouse
gccctccagcctcccgcttc

SEQ ID NO: 640989 - DNA, 20 bp, mouse
gggtccaggccggaagcggg

SEQ ID NO: 640990 - DNA, 20 bp, mouse
gccagcgcctccatggggac

SEQ ID NO: 640991 - DNA, 20 bp, mouse
gcccgggtccaggccggaag

SEQ ID NO: 640992 - DNA, 20 bp, mouse
gcctttgaggaggcaggtga

SEQ ID NO: 640993 - DNA, 20 bp, mouse
gcgtgaccccgggtccaggc

SEQ ID NO: 640994 - DNA, 20 bp, mouse
gcatggggaccggccggaaa

SEQ ID NO: 640995 - DNA, 20 bp, mouse
gctgtcttgcgcaggcgtag

SEQ ID NO: 640996 - DNA, 20 bp, mouse
gtaggcgaagcagccaatca

SEQ ID NO: 640997 - DNA, 20 bp, mouse
gagcgcctccggaccctgat

SEQ ID NO: 640998 - DNA, 20 bp, mouse
gcctaaagctcgatcagcat

SEQ ID NO: 640999 - DNA, 20 bp, mouse
gggcaggaggcaaggcactc

SEQ ID NO: 641000 - DNA, 20 bp, mouse
gagggtccggaggcgctggg

SEQ ID NO: 641001 - DNA, 20 bp, mouse
gaagttaggcagaggaccgt

SEQ ID NO: 641002 - DNA, 20 bp, mouse
ggggagcttggacctgaaac

SEQ ID NO: 641003 - DNA, 20 bp, mouse
gggctcctggggatcccccg

SEQ ID NO: 641004 - DNA, 20 bp, mouse
gagaatacctctgaccctga

SEQ ID NO: 641005 - DNA, 20 bp, mouse
gctgggatgagcagcctcgg

SEQ ID NO: 641006 - DNA, 20 bp, mouse
ggccgcgcgcattcaggctc

SEQ ID NO: 641007 - DNA, 20 bp, mouse
gcgcggctccgtagagaagt

SEQ ID NO: 641008 - DNA, 20 bp, mouse
gccgcgccgagccgactcgg

SEQ ID NO: 641009 - DNA, 20 bp, mouse
gctgccgagctgcaccgctt

SEQ ID NO: 641010 - DNA, 20 bp, mouse
gctcggcaggaggtccccac

SEQ ID NO: 641011 - DNA, 20 bp, mouse
gtggggactccgctgggtgg

SEQ ID NO: 641012 - DNA, 20 bp, mouse
gggcttgcggttgtagcctg

SEQ ID NO: 641013 - DNA, 20 bp, mouse
ggcgcgcccgggctagagcg

SEQ ID NO: 641014 - DNA, 20 bp, mouse
gcggcgtagcccaagccgtg

SEQ ID NO: 641015 - DNA, 20 bp, mouse
gcccggacgcgccagaggct

SEQ ID NO: 641016 - DNA, 20 bp, mouse
gagcgtccccggggtgagac

SEQ ID NO: 641017 - DNA, 20 bp, mouse
gtacactgaagagcgtcccc

SEQ ID NO: 641018 - DNA, 20 bp, mouse
gacgtcgtgacgtaagacgt

SEQ ID NO: 641019 - DNA, 20 bp, mouse
gggcgccatggcggttctct

SEQ ID NO: 641020 - DNA, 20 bp, mouse
gttctcttggagaccactct

SEQ ID NO: 641021 - DNA, 20 bp, mouse
gccagaaacagcgaagaaaa

SEQ ID NO: 641022 - DNA, 20 bp, mouse
gggcctccagtctcaccccg

SEQ ID NO: 641023 - DNA, 20 bp, mouse
ggtctccaagagaaccgcca

SEQ ID NO: 641024 - DNA, 20 bp, mouse
gtccgcaggaacaaacaccc

SEQ ID NO: 641025 - DNA, 20 bp, mouse
gggaggccttcgcgacctgg

SEQ ID NO: 641026 - DNA, 20 bp, mouse
ggacctgggcgcccgaggta

SEQ ID NO: 641027 - DNA, 20 bp, mouse
gggagcgcgcggcggcgtca

SEQ ID NO: 641028 - DNA, 20 bp, mouse
ggcgcggcggcgtcacgggg

SEQ ID NO: 641029 - DNA, 20 bp, mouse
gcccaggtcgtctgcatcca

SEQ ID NO: 641030 - DNA, 20 bp, mouse
ggccgtggatgcagacgacc

SEQ ID NO: 641031 - DNA, 20 bp, mouse
ggcctcggcgtcgtcgtcgc

SEQ ID NO: 641032 - DNA, 20 bp, mouse
ggcgtcccgcgtggcagagc

SEQ ID NO: 641033 - DNA, 20 bp, mouse
gcagacgacctgggcgcccg

SEQ ID NO: 641034 - DNA, 20 bp, mouse
gagcagcggggggcgagctg

SEQ ID NO: 641035 - DNA, 20 bp, mouse
ggcgcgcaccgccgtacctc

SEQ ID NO: 641036 - DNA, 20 bp, mouse
gtgaggaggaggaaaaccgg

SEQ ID NO: 641037 - DNA, 20 bp, mouse
gtggaggatgggacagagtg

SEQ ID NO: 641038 - DNA, 20 bp, mouse
gtccgaataggcccgccaat

SEQ ID NO: 641039 - DNA, 20 bp, mouse
gtctgtcccatcctccacca

SEQ ID NO: 641040 - DNA, 20 bp, mouse
gggaggaggaaaaccggcgg

SEQ ID NO: 641041 - DNA, 20 bp, mouse
gtcctattggcgggcctatt

SEQ ID NO: 641042 - DNA, 20 bp, mouse
gaggatgggacagagtgagg

SEQ ID NO: 641043 - DNA, 20 bp, mouse
gggatggatgccaatcacta

SEQ ID NO: 641044 - DNA, 20 bp, mouse
gaacagtgctccatagtgat

SEQ ID NO: 641045 - DNA, 20 bp, mouse
ggcactgttgttagccagca

SEQ ID NO: 641046 - DNA, 20 bp, mouse
gtatgtgggagagtcggggt

SEQ ID NO: 641047 - DNA, 20 bp, mouse
gagaaacaagtgatggaagt

SEQ ID NO: 641048 - DNA, 20 bp, mouse
gcaagtgtatgtgggagagt

SEQ ID NO: 641049 - DNA, 20 bp, mouse
gtagccaggcaagactgcag

SEQ ID NO: 641050 - DNA, 20 bp, mouse
gcggtgatacaagtgtatgt

SEQ ID NO: 641051 - DNA, 20 bp, mouse
ggatggaagttggatgaaag

SEQ ID NO: 641052 - DNA, 20 bp, mouse
ggcaatccatgatggaaagt

SEQ ID NO: 641053 - DNA, 20 bp, mouse
gtggcagcgtctggtctcca

SEQ ID NO: 641054 - DNA, 20 bp, mouse
gaaaatatgttggaactccg

SEQ ID NO: 641055 - DNA, 20 bp, mouse
gcatggatcaatcaccaccc

SEQ ID NO: 641056 - DNA, 20 bp, mouse
gtagcctttgaatgtcctta

SEQ ID NO: 641057 - DNA, 20 bp, mouse
ggccctcagaggctgtggca

SEQ ID NO: 641058 - DNA, 20 bp, mouse
ggttcatgacaacccggcag

SEQ ID NO: 641059 - DNA, 20 bp, mouse
gaagctccacctaggtaagg

SEQ ID NO: 641060 - DNA, 20 bp, mouse
gaaggcggagcctagaaatc

SEQ ID NO: 641061 - DNA, 20 bp, mouse
gctagaaatcaggccctcag

SEQ ID NO: 641062 - DNA, 20 bp, mouse
gtctaggctccgccttacct

SEQ ID NO: 641063 - DNA, 20 bp, mouse
gttccaaggaagctccacct

SEQ ID NO: 641064 - DNA, 20 bp, mouse
ggaggattgttgggaacatc

SEQ ID NO: 641065 - DNA, 20 bp, mouse
gaaaggcaatgcacaccata

SEQ ID NO: 641066 - DNA, 20 bp, mouse
gtgcaactggtagactccat

SEQ ID NO: 641067 - DNA, 20 bp, mouse
gagaccatggggaactggcc

SEQ ID NO: 641068 - DNA, 20 bp, mouse
gaaggcaccagcttagacca

SEQ ID NO: 641069 - DNA, 20 bp, mouse
gacagtgtccttctctgtgc

SEQ ID NO: 641070 - DNA, 20 bp, mouse
gtggccaggccagttcccca

SEQ ID NO: 641071 - DNA, 20 bp, mouse
gagcttagaccatggggaac

SEQ ID NO: 641072 - DNA, 20 bp, mouse
gctgggttcctgcacagaga

SEQ ID NO: 641073 - DNA, 20 bp, mouse
ggttacttgggcattaggga

SEQ ID NO: 641074 - DNA, 20 bp, mouse
gctggggtgccaggtgcttt

SEQ ID NO: 641075 - DNA, 20 bp, mouse
gccatttttgcttcagagag

SEQ ID NO: 641076 - DNA, 20 bp, mouse
ggaacaaaagccatgagcag

SEQ ID NO: 641077 - DNA, 20 bp, mouse
gccacctgggaatggctctt

SEQ ID NO: 641078 - DNA, 20 bp, mouse
gcgcaatgctcagtcactga

SEQ ID NO: 641079 - DNA, 20 bp, mouse
gtgtgggccctgatcaggga

SEQ ID NO: 641080 - DNA, 20 bp, mouse
ggatcaggcccctcccaggt

SEQ ID NO: 641081 - DNA, 20 bp, mouse
ggccatggcaggccccattc

SEQ ID NO: 641082 - DNA, 20 bp, mouse
gctgccccttccagatgcat

SEQ ID NO: 641083 - DNA, 20 bp, mouse
gtgaggatcaggcccctccc

SEQ ID NO: 641084 - DNA, 20 bp, mouse
ggaatctaattctgctgact

SEQ ID NO: 641085 - DNA, 20 bp, mouse
gcaaacacattagagggctt

SEQ ID NO: 641086 - DNA, 20 bp, mouse
ggctggggacacaagggtaa

SEQ ID NO: 641087 - DNA, 20 bp, mouse
gtcaaggccaacagttgggg

SEQ ID NO: 641088 - DNA, 20 bp, mouse
ggggacgtctccttctgttt

SEQ ID NO: 641089 - DNA, 20 bp, mouse
gccctctgcatgcacatctc

SEQ ID NO: 641090 - DNA, 20 bp, mouse
gctgtttggggtggagagaa

SEQ ID NO: 641091 - DNA, 20 bp, mouse
gataaagcccttttaggctc

SEQ ID NO: 641092 - DNA, 20 bp, mouse
ggggacagtacagtgcctct

SEQ ID NO: 641093 - DNA, 20 bp, mouse
gtggaatcctgagcctaaaa

SEQ ID NO: 641094 - DNA, 20 bp, mouse
gtttgtgtcaccacagggtc

SEQ ID NO: 641095 - DNA, 20 bp, mouse
gctgtctaggcaaagcttag

SEQ ID NO: 641096 - DNA, 20 bp, mouse
ggagatgcgactaggttgcc

SEQ ID NO: 641097 - DNA, 20 bp, mouse
gggggcatagagatgcgact

SEQ ID NO: 641098 - DNA, 20 bp, mouse
ggtattcactgtcttatcaa

SEQ ID NO: 641099 - DNA, 20 bp, mouse
gagcaacccaagcattagag

SEQ ID NO: 641100 - DNA, 20 bp, mouse
gacaaaagaagaggagtgta

SEQ ID NO: 641101 - DNA, 20 bp, mouse
gaaggaagggcagatctatg

SEQ ID NO: 641102 - DNA, 20 bp, mouse
gcaaggccagctagaaaaag

SEQ ID NO: 641103 - DNA, 20 bp, mouse
gtgtctaagttgctgaagtt

SEQ ID NO: 641104 - DNA, 20 bp, mouse
ggacatcagaaaacatttga

SEQ ID NO: 641105 - DNA, 20 bp, mouse
gcctggtttattaggttcta

SEQ ID NO: 641106 - DNA, 20 bp, mouse
ggcgcagcgccatctggcgg

SEQ ID NO: 641107 - DNA, 20 bp, mouse
ggggaacctaagctagctgg

SEQ ID NO: 641108 - DNA, 20 bp, mouse
gcgcgcgcgcgcgaaagccc

SEQ ID NO: 641109 - DNA, 20 bp, mouse
gcgctggagcccgcgctcag

SEQ ID NO: 641110 - DNA, 20 bp, mouse
gcggtctcggagggccgaga

SEQ ID NO: 641111 - DNA, 20 bp, mouse
ggcgcgaaagcccgggaagc

SEQ ID NO: 641112 - DNA, 20 bp, mouse
gcgagcggcgcagcgccatc

SEQ ID NO: 641113 - DNA, 20 bp, mouse
ggccggccgccagctagctt

SEQ ID NO: 641114 - DNA, 20 bp, mouse
ggcgcgccctccgttcgatc

SEQ ID NO: 641115 - DNA, 20 bp, mouse
gggcgggaacctaagctagc

SEQ ID NO: 641116 - DNA, 20 bp, mouse
ggcgagactaggccctgggg

SEQ ID NO: 641117 - DNA, 20 bp, mouse
ggcgctgtctgtctgtccga

SEQ ID NO: 641118 - DNA, 20 bp, mouse
gcgaggaacggcccaacaat

SEQ ID NO: 641119 - DNA, 20 bp, mouse
gaacggcgagactaggccct

SEQ ID NO: 641120 - DNA, 20 bp, mouse
ggcaaccgtcacctccgccg

SEQ ID NO: 641121 - DNA, 20 bp, mouse
ggcagtgcggtgaacggcgg

SEQ ID NO: 641122 - DNA, 20 bp, mouse
gcaacaataggcgccctggt

SEQ ID NO: 641123 - DNA, 20 bp, mouse
gcgccctggttggtggctag

SEQ ID NO: 641124 - DNA, 20 bp, mouse
gccagcagtgcggtgaacgg

SEQ ID NO: 641125 - DNA, 20 bp, mouse
gaccacgagtcgtactgggg

SEQ ID NO: 641126 - DNA, 20 bp, mouse
gacctccataggacccccat

SEQ ID NO: 641127 - DNA, 20 bp, mouse
gtacactgtagggtgaggtg

SEQ ID NO: 641128 - DNA, 20 bp, mouse
ggggaaatatttacactgta

SEQ ID NO: 641129 - DNA, 20 bp, mouse
gacaggggtggaagcccatg

SEQ ID NO: 641130 - DNA, 20 bp, mouse
gaggcacatacacaaattcc

SEQ ID NO: 641131 - DNA, 20 bp, mouse
gcacaaggctggcgtgtcac

SEQ ID NO: 641132 - DNA, 20 bp, mouse
gtcacaggatcacaggtcct

SEQ ID NO: 641133 - DNA, 20 bp, mouse
ggtgctataccagacagggg

SEQ ID NO: 641134 - DNA, 20 bp, mouse
gacttagacagctttactat

SEQ ID NO: 641135 - DNA, 20 bp, mouse
gatactgtgctataccagac

SEQ ID NO: 641136 - DNA, 20 bp, mouse
gaggaggcgcccactgtcgc

SEQ ID NO: 641137 - DNA, 20 bp, mouse
gcgggctgtgaagttcgcgt

SEQ ID NO: 641138 - DNA, 20 bp, mouse
gctgtcgcaggtcactggtg

SEQ ID NO: 641139 - DNA, 20 bp, mouse
gcgaaccgcgcgtggggctg

SEQ ID NO: 641140 - DNA, 20 bp, mouse
gtgggcgcctcctcctagct

SEQ ID NO: 641141 - DNA, 20 bp, mouse
ggcccactgtcgcaggtcac

SEQ ID NO: 641142 - DNA, 20 bp, mouse
gtgcgcctcagcagccggta

SEQ ID NO: 641143 - DNA, 20 bp, mouse
gggcgcaagcgactcaacct

SEQ ID NO: 641144 - DNA, 20 bp, mouse
gtcgctgcgaaccgcgcgtg

SEQ ID NO: 641145 - DNA, 20 bp, mouse
ggggaaaggtgtgacctgcc

SEQ ID NO: 641146 - DNA, 20 bp, mouse
ggggcaagccctgcctgcgg

SEQ ID NO: 641147 - DNA, 20 bp, mouse
gcgacagctgtaagtggttg

SEQ ID NO: 641148 - DNA, 20 bp, mouse
gctcaagcaaccaggctaag

SEQ ID NO: 641149 - DNA, 20 bp, mouse
gggaggcagcaccctaccat

SEQ ID NO: 641150 - DNA, 20 bp, mouse
gcaggctaagaggcagcgaa

SEQ ID NO: 641151 - DNA, 20 bp, mouse
ggggttctcaacttagaaca

SEQ ID NO: 641152 - DNA, 20 bp, mouse
gagccaagaaactgtgtgat

SEQ ID NO: 641153 - DNA, 20 bp, mouse
gaaaacacgacagctgtaag

SEQ ID NO: 641154 - DNA, 20 bp, mouse
ggcagggcttgccccatggt

SEQ ID NO: 641155 - DNA, 20 bp, mouse
gtgtgatgggcctgaagcta

SEQ ID NO: 641156 - DNA, 20 bp, mouse
gcccgcctccaccacgccgc

SEQ ID NO: 641157 - DNA, 20 bp, mouse
gtctaacaggtgggatcccg

SEQ ID NO: 641158 - DNA, 20 bp, mouse
ggcgtggtggaggcgggcgc

SEQ ID NO: 641159 - DNA, 20 bp, mouse
gtaagacgacccaatcgggg

SEQ ID NO: 641160 - DNA, 20 bp, mouse
gcgggcccggaggtgcagag

SEQ ID NO: 641161 - DNA, 20 bp, mouse
gcggtggctgtcagcttgcg

SEQ ID NO: 641162 - DNA, 20 bp, mouse
gcagcctgcgccgctctaac

SEQ ID NO: 641163 - DNA, 20 bp, mouse
gccacctgttagagcggcgc

SEQ ID NO: 641164 - DNA, 20 bp, mouse
gggatcccgcggcgtggtgg

SEQ ID NO: 641165 - DNA, 20 bp, mouse
gcccggaggtgcagaggggg

SEQ ID NO: 641166 - DNA, 20 bp, mouse
gctacgcgggtgagaagcga

SEQ ID NO: 641167 - DNA, 20 bp, mouse
ggcgggtgagaagcgagggg

SEQ ID NO: 641168 - DNA, 20 bp, mouse
gggagcggcgggtgcgcgat

SEQ ID NO: 641169 - DNA, 20 bp, mouse
gcgggacggctgcgctacgc

SEQ ID NO: 641170 - DNA, 20 bp, mouse
gaggtgcagcggagcgggag

SEQ ID NO: 641171 - DNA, 20 bp, mouse
gcgcgcaggtgcagcggagc

SEQ ID NO: 641172 - DNA, 20 bp, mouse
gcggcccacgtgacgggaag

SEQ ID NO: 641173 - DNA, 20 bp, mouse
gggcgcccgcgcaggtgcag

SEQ ID NO: 641174 - DNA, 20 bp, mouse
gggcgggtgcctgcatgact

SEQ ID NO: 641175 - DNA, 20 bp, mouse
gtgacgggaagcggctgcgg

SEQ ID NO: 641176 - DNA, 20 bp, mouse
ggggccgttgggcagttaca

SEQ ID NO: 641177 - DNA, 20 bp, mouse
gtgagccgatcaagatggag

SEQ ID NO: 641178 - DNA, 20 bp, mouse
gtgggcagttacacggcgga

SEQ ID NO: 641179 - DNA, 20 bp, mouse
gccgttgggcagttacacgg

SEQ ID NO: 641180 - DNA, 20 bp, mouse
gcggccctgctcagatgccg

SEQ ID NO: 641181 - DNA, 20 bp, mouse
gttacacggcggagggcgga

SEQ ID NO: 641182 - DNA, 20 bp, mouse
gatggagcggcgaggccgaa

SEQ ID NO: 641183 - DNA, 20 bp, mouse
gtgctccgcggcatctgagc

SEQ ID NO: 641184 - DNA, 20 bp, mouse
gcccggtgagccgatcaaga

SEQ ID NO: 641185 - DNA, 20 bp, mouse
gctcgccgctccatcttgat

SEQ ID NO: 641186 - DNA, 20 bp, mouse
gcgggagagcgcgccagccc

SEQ ID NO: 641187 - DNA, 20 bp, mouse
gtgagcggggaggggtccga

SEQ ID NO: 641188 - DNA, 20 bp, mouse
gacggcggagacagctgctc

SEQ ID NO: 641189 - DNA, 20 bp, mouse
ggggagggactgagcgggga

SEQ ID NO: 641190 - DNA, 20 bp, mouse
ggaggggtccgagggagggg

SEQ ID NO: 641191 - DNA, 20 bp, mouse
ggagccgagccgcgggcgga

SEQ ID NO: 641192 - DNA, 20 bp, mouse
gcggagggagggactgagcg

SEQ ID NO: 641193 - DNA, 20 bp, mouse
gctcccgcgagccgagccgc

SEQ ID NO: 641194 - DNA, 20 bp, mouse
gcgggaggcgctgggcgccg

SEQ ID NO: 641195 - DNA, 20 bp, mouse
gcagtccctccctccgcccg

SEQ ID NO: 641196 - DNA, 20 bp, mouse
gaaagggaagtaaccttaga

SEQ ID NO: 641197 - DNA, 20 bp, mouse
ggctctcaaggcctgtactg

SEQ ID NO: 641198 - DNA, 20 bp, mouse
gaaggcatggccatgatgat

SEQ ID NO: 641199 - DNA, 20 bp, mouse
gctcaaggcctgtactgggg

SEQ ID NO: 641200 - DNA, 20 bp, mouse
gaaagtcacagagccctcta

SEQ ID NO: 641201 - DNA, 20 bp, mouse
gagggcttacgtgagttcct

SEQ ID NO: 641202 - DNA, 20 bp, mouse
gaagcaagaaactcccgcaa

SEQ ID NO: 641203 - DNA, 20 bp, mouse
gcctgcagccaatgctctca

SEQ ID NO: 641204 - DNA, 20 bp, mouse
ggtagttgtgaaactcctca

SEQ ID NO: 641205 - DNA, 20 bp, mouse
ggaagcatgacacaaaggca

SEQ ID NO: 641206 - DNA, 20 bp, mouse
gggtggcaagccattgggga

SEQ ID NO: 641207 - DNA, 20 bp, mouse
gtggtacaagaggactaata

SEQ ID NO: 641208 - DNA, 20 bp, mouse
gtaccatggtccctccccaa

SEQ ID NO: 641209 - DNA, 20 bp, mouse
gtaaagtacaagccaatgat

SEQ ID NO: 641210 - DNA, 20 bp, mouse
gggagggaccatggtacaag

SEQ ID NO: 641211 - DNA, 20 bp, mouse
gtgttggtggcaagccattg

SEQ ID NO: 641212 - DNA, 20 bp, mouse
gaagaggactaatagggcag

SEQ ID NO: 641213 - DNA, 20 bp, mouse
gcagaagcagtagcagcggg

SEQ ID NO: 641214 - DNA, 20 bp, mouse
gacaaacaactgacacatac

SEQ ID NO: 641215 - DNA, 20 bp, mouse
gctgacacatactgggagac

SEQ ID NO: 641216 - DNA, 20 bp, mouse
ggaaccccagtacttccgga

SEQ ID NO: 641217 - DNA, 20 bp, mouse
gcctcgaaccccagtacttc

SEQ ID NO: 641218 - DNA, 20 bp, mouse
gtctgccttccggaagtact

SEQ ID NO: 641219 - DNA, 20 bp, mouse
gtgggcatcgcagctcagga

SEQ ID NO: 641220 - DNA, 20 bp, mouse
ggagctgggcatcgcagctc

SEQ ID NO: 641221 - DNA, 20 bp, mouse
gggaagcggaggcctcagcc

SEQ ID NO: 641222 - DNA, 20 bp, mouse
gtgagcgctcatagccctcc

SEQ ID NO: 641223 - DNA, 20 bp, mouse
gctcatagccctcctggctg

SEQ ID NO: 641224 - DNA, 20 bp, mouse
gagccgggaagcagtatcct

SEQ ID NO: 641225 - DNA, 20 bp, mouse
gagttggggatgcaatgata

SEQ ID NO: 641226 - DNA, 20 bp, mouse
gccattgcccgatacaactg

SEQ ID NO: 641227 - DNA, 20 bp, mouse
gttgcccgatacaactgcgg

SEQ ID NO: 641228 - DNA, 20 bp, mouse
gactgcggaggatcggaatc

SEQ ID NO: 641229 - DNA, 20 bp, mouse
ggagcccgggatcttcagag

SEQ ID NO: 641230 - DNA, 20 bp, mouse
gttgcccctcacaatcatgg

SEQ ID NO: 641231 - DNA, 20 bp, mouse
gaaaacccaagctccgtcat

SEQ ID NO: 641232 - DNA, 20 bp, mouse
ggggcggggccgagcttccc

SEQ ID NO: 641233 - DNA, 20 bp, mouse
ggtaaggggtaagacgccac

SEQ ID NO: 641234 - DNA, 20 bp, mouse
ggcggaggatcggaatccgg

SEQ ID NO: 641235 - DNA, 20 bp, mouse
gtccctggatgtgagaaaag

SEQ ID NO: 641236 - DNA, 20 bp, mouse
ggcggctaagtcctagggat

SEQ ID NO: 641237 - DNA, 20 bp, mouse
ggaatcgcggctaagtccta

SEQ ID NO: 641238 - DNA, 20 bp, mouse
gctaagactgtgtttgaagt

SEQ ID NO: 641239 - DNA, 20 bp, mouse
gaagtgggtggagatcaata

SEQ ID NO: 641240 - DNA, 20 bp, mouse
gtgagcgaggcactgactag

SEQ ID NO: 641241 - DNA, 20 bp, mouse
ggagacctcactaggcagtt

SEQ ID NO: 641242 - DNA, 20 bp, mouse
gagactgtgtttgaagtggg

SEQ ID NO: 641243 - DNA, 20 bp, mouse
gcagcccaaactgcctagtg

SEQ ID NO: 641244 - DNA, 20 bp, mouse
gactgggtgtggcttgagcg

SEQ ID NO: 641245 - DNA, 20 bp, mouse
gggagggcggtgcaagcact

SEQ ID NO: 641246 - DNA, 20 bp, mouse
gtgaacccgcttcaggaaga

SEQ ID NO: 641247 - DNA, 20 bp, mouse
gttctctcgcggtgtctgtt

SEQ ID NO: 641248 - DNA, 20 bp, mouse
gtgaagggctagttctctcg

SEQ ID NO: 641249 - DNA, 20 bp, mouse
ggggaaaagtgtcgggaggt

SEQ ID NO: 641250 - DNA, 20 bp, mouse
gcacgccctcttcctgaagc

SEQ ID NO: 641251 - DNA, 20 bp, mouse
ggggaacgcgcccgtgattc

SEQ ID NO: 641252 - DNA, 20 bp, mouse
gaaagaacctgaagagcgga

SEQ ID NO: 641253 - DNA, 20 bp, mouse
gcgtgaaagaacctgaagag

SEQ ID NO: 641254 - DNA, 20 bp, mouse
ggccactgctccggaatcac

SEQ ID NO: 641255 - DNA, 20 bp, mouse
gggcctgggggaaaagtgtc

SEQ ID NO: 641256 - DNA, 20 bp, mouse
gcaggcagggtgtctcacgt

SEQ ID NO: 641257 - DNA, 20 bp, mouse
ggaggaccacatgcagttga

SEQ ID NO: 641258 - DNA, 20 bp, mouse
gaagtcacgtggtgcaaccc

SEQ ID NO: 641259 - DNA, 20 bp, mouse
gtcacaggccgcttccacct

SEQ ID NO: 641260 - DNA, 20 bp, mouse
gcgtctcagggtcctgccca

SEQ ID NO: 641261 - DNA, 20 bp, mouse
ggatgagggcatgaagacat

SEQ ID NO: 641262 - DNA, 20 bp, mouse
gcatgtggtcctcacaggca

SEQ ID NO: 641263 - DNA, 20 bp, mouse
gctggtggaaccaccccaac

SEQ ID NO: 641264 - DNA, 20 bp, mouse
gtaaaaccctcaactgcatg

SEQ ID NO: 641265 - DNA, 20 bp, mouse
ggtggaaccaccccaactgg

SEQ ID NO: 641266 - DNA, 20 bp, mouse
gcggcccaggggtgtctcgt

SEQ ID NO: 641267 - DNA, 20 bp, mouse
gagagagcggaactggaaga

SEQ ID NO: 641268 - DNA, 20 bp, mouse
gcggcggagcagggcgagaa

SEQ ID NO: 641269 - DNA, 20 bp, mouse
gctcgcgcagctcacggcgg

SEQ ID NO: 641270 - DNA, 20 bp, mouse
gcctgaggcccgggccaaga

SEQ ID NO: 641271 - DNA, 20 bp, mouse
gaacgagagcgagtccgtaa

SEQ ID NO: 641272 - DNA, 20 bp, mouse
gtgcctcgcgcagctcacgg

SEQ ID NO: 641273 - DNA, 20 bp, mouse
ggcccgcagcagccgttcgg

SEQ ID NO: 641274 - DNA, 20 bp, mouse
gctaccaacgagacacccct

SEQ ID NO: 641275 - DNA, 20 bp, mouse
gcccctctgccgccttgatg

SEQ ID NO: 641276 - DNA, 20 bp, mouse
gaagaaaaggggtgtgaaat

SEQ ID NO: 641277 - DNA, 20 bp, mouse
gaccctgccaagtctacaat

SEQ ID NO: 641278 - DNA, 20 bp, mouse
gctgagtcacattgataacg

SEQ ID NO: 641279 - DNA, 20 bp, mouse
gagaagatgtaccatgaatt

SEQ ID NO: 641280 - DNA, 20 bp, mouse
ggaatcttaaacctgctatt

SEQ ID NO: 641281 - DNA, 20 bp, mouse
gtttgtcccaattgtagact

SEQ ID NO: 641282 - DNA, 20 bp, mouse
gagttatagtttttcatctc

SEQ ID NO: 641283 - DNA, 20 bp, mouse
gcatttcctaccctaatagc

SEQ ID NO: 641284 - DNA, 20 bp, mouse
gattcttgattaaccaagat

SEQ ID NO: 641285 - DNA, 20 bp, mouse
gatgatttgtataccaatct

SEQ ID NO: 641286 - DNA, 20 bp, mouse
gtcagcgcgcgggtgagatg

SEQ ID NO: 641287 - DNA, 20 bp, mouse
ggtctccaaaacgcgggcgg

SEQ ID NO: 641288 - DNA, 20 bp, mouse
ggcgcgccggcgcccctcac

SEQ ID NO: 641289 - DNA, 20 bp, mouse
gggcggcagcagtccggtga

SEQ ID NO: 641290 - DNA, 20 bp, mouse
gcgagaggagcagtgggatg

SEQ ID NO: 641291 - DNA, 20 bp, mouse
ggcgccccgtcttgtctgta

SEQ ID NO: 641292 - DNA, 20 bp, mouse
gagacaagacggggcgccca

SEQ ID NO: 641293 - DNA, 20 bp, mouse
gcccggcgcgagaggagcag

SEQ ID NO: 641294 - DNA, 20 bp, mouse
ggtgggagtgacggggcctt

SEQ ID NO: 641295 - DNA, 20 bp, mouse
gggccaaggtctccaaaacg

SEQ ID NO: 641296 - DNA, 20 bp, mouse
ggggaagggaagacgagaga

SEQ ID NO: 641297 - DNA, 20 bp, mouse
gctggggggggcaagttgaa

SEQ ID NO: 641298 - DNA, 20 bp, mouse
ggggaagacgagagatgggc

SEQ ID NO: 641299 - DNA, 20 bp, mouse
gaggggaccaagggggtaga

SEQ ID NO: 641300 - DNA, 20 bp, mouse
ggacgagagatgggctgggc

SEQ ID NO: 641301 - DNA, 20 bp, mouse
ggttctatttacaagggacc

SEQ ID NO: 641302 - DNA, 20 bp, mouse
ggagtgaggggttcagggtt

SEQ ID NO: 641303 - DNA, 20 bp, mouse
gtaacaatctatttacaccc

SEQ ID NO: 641304 - DNA, 20 bp, mouse
gagacacaggcagccagaca

SEQ ID NO: 641305 - DNA, 20 bp, mouse
gaatcagttccacttgaagc

SEQ ID NO: 641306 - DNA, 20 bp, mouse
gttgggacggaagatctcag

SEQ ID NO: 641307 - DNA, 20 bp, mouse
gaataacagaaggctagaac

SEQ ID NO: 641308 - DNA, 20 bp, mouse
gtgaactgggttcaagggga

SEQ ID NO: 641309 - DNA, 20 bp, mouse
gggacggaagatctcagagg

SEQ ID NO: 641310 - DNA, 20 bp, mouse
ggaacccagttcaaagctgt

SEQ ID NO: 641311 - DNA, 20 bp, mouse
gagctttgaactgggttcaa

SEQ ID NO: 641312 - DNA, 20 bp, mouse
gctccccgcaacaatcttgc

SEQ ID NO: 641313 - DNA, 20 bp, mouse
gcaggtagctaagagtatgt

SEQ ID NO: 641314 - DNA, 20 bp, mouse
ggagccttctcagctgtcaa

SEQ ID NO: 641315 - DNA, 20 bp, mouse
gtaagttgcaggtattaaac

SEQ ID NO: 641316 - DNA, 20 bp, mouse
gactattcgaggtactcagg

SEQ ID NO: 641317 - DNA, 20 bp, mouse
ggtagagtgtagagcggcac

SEQ ID NO: 641318 - DNA, 20 bp, mouse
gcgcgccgcccacacggaag

SEQ ID NO: 641319 - DNA, 20 bp, mouse
gacgactattcgaggtactc

SEQ ID NO: 641320 - DNA, 20 bp, mouse
gccgcccacacggaagcggt

SEQ ID NO: 641321 - DNA, 20 bp, mouse
gcagagaccacgactattcg

SEQ ID NO: 641322 - DNA, 20 bp, mouse
gctgctgtcgcgcgctttgg

SEQ ID NO: 641323 - DNA, 20 bp, mouse
gcggctggggatttccgtgg

SEQ ID NO: 641324 - DNA, 20 bp, mouse
ggggctcttctcacagttat

SEQ ID NO: 641325 - DNA, 20 bp, mouse
gcaacccaccgcttccgtgt

SEQ ID NO: 641326 - DNA, 20 bp, mouse
gatacccatagactgcagga

SEQ ID NO: 641327 - DNA, 20 bp, mouse
gaatggctgcagccgtgcta

SEQ ID NO: 641328 - DNA, 20 bp, mouse
gtctgcaggctgtgcctcca

SEQ ID NO: 641329 - DNA, 20 bp, mouse
ggtaccctcctgcagtctat

SEQ ID NO: 641330 - DNA, 20 bp, mouse
gaggcctggcctttacgtgc

SEQ ID NO: 641331 - DNA, 20 bp, mouse
gcctgcagagtcagctgacc

SEQ ID NO: 641332 - DNA, 20 bp, mouse
gacactatgaaaaagttggc

SEQ ID NO: 641333 - DNA, 20 bp, mouse
gtccaaacctcagaccctgg

SEQ ID NO: 641334 - DNA, 20 bp, mouse
gaggctgagtaatacctttg

SEQ ID NO: 641335 - DNA, 20 bp, mouse
gaccaggccgggctggtgac

SEQ ID NO: 641336 - DNA, 20 bp, mouse
gacaaactgggtacaccaag

SEQ ID NO: 641337 - DNA, 20 bp, mouse
ggaacctggtccctcccact

SEQ ID NO: 641338 - DNA, 20 bp, mouse
gacaccaagtgggagggacc

SEQ ID NO: 641339 - DNA, 20 bp, mouse
gttatgaggacacttcgcta

SEQ ID NO: 641340 - DNA, 20 bp, mouse
gcaaaggtcctcaccctcgc

SEQ ID NO: 641341 - DNA, 20 bp, mouse
gacgcctcctaatcctccaa

SEQ ID NO: 641342 - DNA, 20 bp, mouse
gagcgccagaagaagagctc

SEQ ID NO: 641343 - DNA, 20 bp, mouse
gactgggtacaccaagtggg

SEQ ID NO: 641344 - DNA, 20 bp, mouse
ggaagtgtcctcataaaata

SEQ ID NO: 641345 - DNA, 20 bp, mouse
gtctagagcaggtacaaggc

SEQ ID NO: 641346 - DNA, 20 bp, mouse
gagggatggagcaagactag

SEQ ID NO: 641347 - DNA, 20 bp, mouse
gggaaggcctccaggtactc

SEQ ID NO: 641348 - DNA, 20 bp, mouse
gtcaggggatcctagaggga

SEQ ID NO: 641349 - DNA, 20 bp, mouse
gatagggaaggggcaaatga

SEQ ID NO: 641350 - DNA, 20 bp, mouse
gagctgcctgggggtctcag

SEQ ID NO: 641351 - DNA, 20 bp, mouse
ggggaaggggcaaatgatgg

SEQ ID NO: 641352 - DNA, 20 bp, mouse
ggtacctggaggccttcctg

SEQ ID NO: 641353 - DNA, 20 bp, mouse
gagtcttgctccatccctct

SEQ ID NO: 641354 - DNA, 20 bp, mouse
gtgagggggtgatagggaag

SEQ ID NO: 641355 - DNA, 20 bp, mouse
gaggatcccctgagaccccc

SEQ ID NO: 641356 - DNA, 20 bp, mouse
gcagtcgcgcgtaaggagga

SEQ ID NO: 641357 - DNA, 20 bp, mouse
gccgctgggtgcaggggatt

SEQ ID NO: 641358 - DNA, 20 bp, mouse
gggccggcagagcagacccg

SEQ ID NO: 641359 - DNA, 20 bp, mouse
ggacagcagggaccttaaag

SEQ ID NO: 641360 - DNA, 20 bp, mouse
ggggcacatgcgtgcctctc

SEQ ID NO: 641361 - DNA, 20 bp, mouse
ggcgagggagctttagtaag

SEQ ID NO: 641362 - DNA, 20 bp, mouse
ggggacagaaggtgctcgcg

SEQ ID NO: 641363 - DNA, 20 bp, mouse
gtcaactgttgtagtcacgt

SEQ ID NO: 641364 - DNA, 20 bp, mouse
gggggacaagaagcattgaa

SEQ ID NO: 641365 - DNA, 20 bp, mouse
gcttacgcgcgactggatgg

SEQ ID NO: 641366 - DNA, 20 bp, mouse
gactgagggaggtggtacca

SEQ ID NO: 641367 - DNA, 20 bp, mouse
gaagagaacgccccatggtc

SEQ ID NO: 641368 - DNA, 20 bp, mouse
gtaaaggaacagggctgtaa

SEQ ID NO: 641369 - DNA, 20 bp, mouse
ggagtcacaggtagtgagtg

SEQ ID NO: 641370 - DNA, 20 bp, mouse
ggatggagcaaagagcaccc

SEQ ID NO: 641371 - DNA, 20 bp, mouse
ggtgctgaaagattgataac

SEQ ID NO: 641372 - DNA, 20 bp, mouse
ggatcaagagaatccccaga

SEQ ID NO: 641373 - DNA, 20 bp, mouse
gcacaggtagtgagtgtggt

SEQ ID NO: 641374 - DNA, 20 bp, mouse
gcttctatccagtgagtcac

SEQ ID NO: 641375 - DNA, 20 bp, mouse
gaatgaacagctttgactga

SEQ ID NO: 641376 - DNA, 20 bp, mouse
ggcgactgggcagagaattg

SEQ ID NO: 641377 - DNA, 20 bp, mouse
gctagagactcgacattcaa

SEQ ID NO: 641378 - DNA, 20 bp, mouse
ggataaggactcaggcgact

SEQ ID NO: 641379 - DNA, 20 bp, mouse
gacaggtgtcattgccctaa

SEQ ID NO: 641380 - DNA, 20 bp, mouse
ggcacggctttcaggctcgc

SEQ ID NO: 641381 - DNA, 20 bp, mouse
ggactcgacattcaacggtt

SEQ ID NO: 641382 - DNA, 20 bp, mouse
gtcccgaaatctgacaggca

SEQ ID NO: 641383 - DNA, 20 bp, mouse
ggaaagaaaaggcgacaaat

SEQ ID NO: 641384 - DNA, 20 bp, mouse
gctgggcagagaattgaggc

SEQ ID NO: 641385 - DNA, 20 bp, mouse
gctgggtcccgaaatctgac

SEQ ID NO: 641386 - DNA, 20 bp, mouse
gcctgcccctgaggcattgt

SEQ ID NO: 641387 - DNA, 20 bp, mouse
ggcccctgaggcattgtggg

SEQ ID NO: 641388 - DNA, 20 bp, mouse
gacctcccacaatgcctcag

SEQ ID NO: 641389 - DNA, 20 bp, mouse
gtccaagtcaagagttaggc

SEQ ID NO: 641390 - DNA, 20 bp, mouse
ggaaacaattcctgcccctg

SEQ ID NO: 641391 - DNA, 20 bp, mouse
gccctgcctaactcttgact

SEQ ID NO: 641392 - DNA, 20 bp, mouse
gaagctgtgtctgtaagcaa

SEQ ID NO: 641393 - DNA, 20 bp, mouse
gcattgtgggaggtaaaacc

SEQ ID NO: 641394 - DNA, 20 bp, mouse
gcataccccgcttttcaagg

SEQ ID NO: 641395 - DNA, 20 bp, mouse
gaggcccaccttgaaaagcg

SEQ ID NO: 641396 - DNA, 20 bp, mouse
gtaaggccacgcccacgtcc

SEQ ID NO: 641397 - DNA, 20 bp, mouse
gaaggaagagtcctaccgta

SEQ ID NO: 641398 - DNA, 20 bp, mouse
ggcagtttaagacttctcca

SEQ ID NO: 641399 - DNA, 20 bp, mouse
gtcagaacttgtattgactg

SEQ ID NO: 641400 - DNA, 20 bp, mouse
ggtgggcgtggccttacggt

SEQ ID NO: 641401 - DNA, 20 bp, mouse
gaagttctgatccaggacgt

SEQ ID NO: 641402 - DNA, 20 bp, mouse
gggagtgcaggcactaaccg

SEQ ID NO: 641403 - DNA, 20 bp, mouse
ggatcagatttatgtaggtc

SEQ ID NO: 641404 - DNA, 20 bp, mouse
ggtcactgattaattgatat

SEQ ID NO: 641405 - DNA, 20 bp, mouse
gtcaatacaagttctgatcc

SEQ ID NO: 641406 - DNA, 20 bp, mouse
gggtccctgcctttacactg

SEQ ID NO: 641407 - DNA, 20 bp, mouse
gctaagagtcctcagtgtaa

SEQ ID NO: 641408 - DNA, 20 bp, mouse
gtagcctggctgttaggaaa

SEQ ID NO: 641409 - DNA, 20 bp, mouse
ggggaggggcgccgctcaga

SEQ ID NO: 641410 - DNA, 20 bp, mouse
ggcagggacccaaaatgcca

SEQ ID NO: 641411 - DNA, 20 bp, mouse
gctggctgttaggaaatgga

SEQ ID NO: 641412 - DNA, 20 bp, mouse
ggggcgccgctcagagggcg

SEQ ID NO: 641413 - DNA, 20 bp, mouse
ggacctgccaccacgttcag

SEQ ID NO: 641414 - DNA, 20 bp, mouse
gacactgaggactcttagcc

SEQ ID NO: 641415 - DNA, 20 bp, mouse
ggctcagtacgcatgcgcca

SEQ ID NO: 641416 - DNA, 20 bp, mouse
gatgaagtgcataaggagga

SEQ ID NO: 641417 - DNA, 20 bp, mouse
gtaggaaaactcacagactt

SEQ ID NO: 641418 - DNA, 20 bp, mouse
ggtaaatcatgaagtgcata

SEQ ID NO: 641419 - DNA, 20 bp, mouse
gagcaaggagttatgtataa

SEQ ID NO: 641420 - DNA, 20 bp, mouse
ggatagagtggtacagcaca

SEQ ID NO: 641421 - DNA, 20 bp, mouse
gaccccattctaaccatcct

SEQ ID NO: 641422 - DNA, 20 bp, mouse
gcttcatctctttcctagga

SEQ ID NO: 641423 - DNA, 20 bp, mouse
gttaggcactatcttagtgt

SEQ ID NO: 641424 - DNA, 20 bp, mouse
gaatcatgaagtgcataagg

SEQ ID NO: 641425 - DNA, 20 bp, mouse
gggttagaatggggtaataa

SEQ ID NO: 641426 - DNA, 20 bp, mouse
gttgagagttggaacgtagt

SEQ ID NO: 641427 - DNA, 20 bp, mouse
ggtgaaggaactttgagagt

SEQ ID NO: 641428 - DNA, 20 bp, mouse
gatggcgctgctgtctccca

SEQ ID NO: 641429 - DNA, 20 bp, mouse
gcaacccgagggaacacaga

SEQ ID NO: 641430 - DNA, 20 bp, mouse
gcagttctagacgagcgtga

SEQ ID NO: 641431 - DNA, 20 bp, mouse
gacgtagtgggctaaagccc

SEQ ID NO: 641432 - DNA, 20 bp, mouse
ggggcttgagaacacaggta

SEQ ID NO: 641433 - DNA, 20 bp, mouse
gtgagaacacaggtaggggg

SEQ ID NO: 641434 - DNA, 20 bp, mouse
ggagaaggcacggtgggcca

SEQ ID NO: 641435 - DNA, 20 bp, mouse
gaaagagagcaactggaatc

SEQ ID NO: 641436 - DNA, 20 bp, mouse
gacagtaggggatactaaca

SEQ ID NO: 641437 - DNA, 20 bp, mouse
ggaccacagcctgacagtag

SEQ ID NO: 641438 - DNA, 20 bp, mouse
ggacgtggatctcagagcgt

SEQ ID NO: 641439 - DNA, 20 bp, mouse
gcaggctgtggtcaggaggg

SEQ ID NO: 641440 - DNA, 20 bp, mouse
ggatctcagagcgtggggat

SEQ ID NO: 641441 - DNA, 20 bp, mouse
gctgtcaggctgtggtcagg

SEQ ID NO: 641442 - DNA, 20 bp, mouse
gagggaggtgagcaggctcc

SEQ ID NO: 641443 - DNA, 20 bp, mouse
gtgacccatgcaggctggaa

SEQ ID NO: 641444 - DNA, 20 bp, mouse
gtgggagtaacaatttaagt

SEQ ID NO: 641445 - DNA, 20 bp, mouse
gtacagggaaagcagaaccg

SEQ ID NO: 641446 - DNA, 20 bp, mouse
gacaccttgtaatcttttat

SEQ ID NO: 641447 - DNA, 20 bp, mouse
gcaattgacaggattttttg

SEQ ID NO: 641448 - DNA, 20 bp, mouse
ggacaggattttttgaggtg

SEQ ID NO: 641449 - DNA, 20 bp, mouse
ggattggatacaggcaatat

SEQ ID NO: 641450 - DNA, 20 bp, mouse
gaggtgtggagagagtgaat

SEQ ID NO: 641451 - DNA, 20 bp, mouse
gctattactacgtggttgat

SEQ ID NO: 641452 - DNA, 20 bp, mouse
gtgtaaattctattactacg

SEQ ID NO: 641453 - DNA, 20 bp, mouse
gtttaggatagaaagacaaa

SEQ ID NO: 641454 - DNA, 20 bp, mouse
gattttgtaagcttagaagt

SEQ ID NO: 641455 - DNA, 20 bp, mouse
ggattacaaggtgtctgtgt

SEQ ID NO: 641456 - DNA, 20 bp, mouse
gaactgatggacaccgagtg

SEQ ID NO: 641457 - DNA, 20 bp, mouse
gcctaccagagcaggaaggt

SEQ ID NO: 641458 - DNA, 20 bp, mouse
gcggggcggggctacacttg

SEQ ID NO: 641459 - DNA, 20 bp, mouse
ggaaaggggcacgctttctg

SEQ ID NO: 641460 - DNA, 20 bp, mouse
gatggacaccgagtgaggcc

SEQ ID NO: 641461 - DNA, 20 bp, mouse
gaaggaaagtgaagacagca

SEQ ID NO: 641462 - DNA, 20 bp, mouse
gtccctgctccggtaagcgc

SEQ ID NO: 641463 - DNA, 20 bp, mouse
gggggaagtagacaagaagc

SEQ ID NO: 641464 - DNA, 20 bp, mouse
gcaggacacagaaacatggg

SEQ ID NO: 641465 - DNA, 20 bp, mouse
gaccaaggacgcgggagctc

SEQ ID NO: 641466 - DNA, 20 bp, mouse
gggaaccggagctgaccacg

SEQ ID NO: 641467 - DNA, 20 bp, mouse
gacaccggaagagcccgcgg

SEQ ID NO: 641468 - DNA, 20 bp, mouse
gcggggctgcacacgctgaa

SEQ ID NO: 641469 - DNA, 20 bp, mouse
gcgcgggaagagtctgcaga

SEQ ID NO: 641470 - DNA, 20 bp, mouse
gccgaagtcctgctccggtt

SEQ ID NO: 641471 - DNA, 20 bp, mouse
gcgtgtgcagccccggggtc

SEQ ID NO: 641472 - DNA, 20 bp, mouse
ggacgtagcccgcacttccg

SEQ ID NO: 641473 - DNA, 20 bp, mouse
ggacgcgcgccaggaacccc

SEQ ID NO: 641474 - DNA, 20 bp, mouse
gggcgattttgcagcggcgc

SEQ ID NO: 641475 - DNA, 20 bp, mouse
gtccgcgggcgattttgcag

SEQ ID NO: 641476 - DNA, 20 bp, mouse
gtctgcgtgaagttctaggc

SEQ ID NO: 641477 - DNA, 20 bp, mouse
gtgaagttctaggcgggagg

SEQ ID NO: 641478 - DNA, 20 bp, mouse
ggtgtgggcccggaagaggt

SEQ ID NO: 641479 - DNA, 20 bp, mouse
ggaggtggcccgggtcctga

SEQ ID NO: 641480 - DNA, 20 bp, mouse
ggcccgggtcctgatggtgt

SEQ ID NO: 641481 - DNA, 20 bp, mouse
gaggacgcacacagaagctt

SEQ ID NO: 641482 - DNA, 20 bp, mouse
gtggggaccgcgtcccacta

SEQ ID NO: 641483 - DNA, 20 bp, mouse
gcgggggcggggaccccgga

SEQ ID NO: 641484 - DNA, 20 bp, mouse
ggaaggcaggtggtcggccg

SEQ ID NO: 641485 - DNA, 20 bp, mouse
gggcggggaccccggaaggc

SEQ ID NO: 641486 - DNA, 20 bp, mouse
gctagcaagcagatctctcc

SEQ ID NO: 641487 - DNA, 20 bp, mouse
gcctctgggtaaacaactcc

SEQ ID NO: 641488 - DNA, 20 bp, mouse
gcatctcactgtagagagag

SEQ ID NO: 641489 - DNA, 20 bp, mouse
gagtctggccagggatgaag

SEQ ID NO: 641490 - DNA, 20 bp, mouse
ggctgggctactatgacgtc

SEQ ID NO: 641491 - DNA, 20 bp, mouse
gataaaagttaaaaatgtcc

SEQ ID NO: 641492 - DNA, 20 bp, mouse
gttagagcagttatatcctc

SEQ ID NO: 641493 - DNA, 20 bp, mouse
gggtaaacaactccaggtcc

SEQ ID NO: 641494 - DNA, 20 bp, mouse
gggacttggaggcggcctta

SEQ ID NO: 641495 - DNA, 20 bp, mouse
ggttggaagcagcagcctta

SEQ ID NO: 641496 - DNA, 20 bp, mouse
gcacctgccggcggcttctg

SEQ ID NO: 641497 - DNA, 20 bp, mouse
gggacccaggtggacgtagg

SEQ ID NO: 641498 - DNA, 20 bp, mouse
ggggtccccgcacctgccgg

SEQ ID NO: 641499 - DNA, 20 bp, mouse
gcggggacccaggtggacgt

SEQ ID NO: 641500 - DNA, 20 bp, mouse
gagcgaccgggccctgtaga

SEQ ID NO: 641501 - DNA, 20 bp, mouse
gggccaccgccgccgtgacc

SEQ ID NO: 641502 - DNA, 20 bp, mouse
gaggtacagggacctactgg

SEQ ID NO: 641503 - DNA, 20 bp, mouse
gaggaggtacagggacctac

SEQ ID NO: 641504 - DNA, 20 bp, mouse
gctgcggctccgggtcacgg

SEQ ID NO: 641505 - DNA, 20 bp, mouse
gaggagggcctgcagcgacc

SEQ ID NO: 641506 - DNA, 20 bp, mouse
gagctgacagcgttgagtgt

SEQ ID NO: 641507 - DNA, 20 bp, mouse
gcgtgctgagggatctggag

SEQ ID NO: 641508 - DNA, 20 bp, mouse
gcacgtccgggtcgatggga

SEQ ID NO: 641509 - DNA, 20 bp, mouse
gggtagaccgtctgcttcgc

SEQ ID NO: 641510 - DNA, 20 bp, mouse
gtcgatgggagggatggtgg

SEQ ID NO: 641511 - DNA, 20 bp, mouse
ggagtccaccgcgtcgcggt

SEQ ID NO: 641512 - DNA, 20 bp, mouse
ggcgacgcggtggactcctt

SEQ ID NO: 641513 - DNA, 20 bp, mouse
gccagatccctcagcacgtc

SEQ ID NO: 641514 - DNA, 20 bp, mouse
gtcctcgcagcgcgcaagta

SEQ ID NO: 641515 - DNA, 20 bp, mouse
gacccagcccgcgaagcaga

SEQ ID NO: 641516 - DNA, 20 bp, mouse
gataggggaaatggtgtcat

SEQ ID NO: 641517 - DNA, 20 bp, mouse
gactcctacttggtttaatc

SEQ ID NO: 641518 - DNA, 20 bp, mouse
gaggagtcagagacatcctg

SEQ ID NO: 641519 - DNA, 20 bp, mouse
gtggtgactgttgtctgtaa

SEQ ID NO: 641520 - DNA, 20 bp, mouse
ggatgtctctgactcctact

SEQ ID NO: 641521 - DNA, 20 bp, mouse
gacctcccgcacacatgttg

SEQ ID NO: 641522 - DNA, 20 bp, mouse
gcggcctgccagactgtgtg

SEQ ID NO: 641523 - DNA, 20 bp, mouse
gaagagcgggaggtttgcgc

SEQ ID NO: 641524 - DNA, 20 bp, mouse
gagtccatcacaattctgtc

SEQ ID NO: 641525 - DNA, 20 bp, mouse
gggaggtttgcgcaggtgga

SEQ ID NO: 641526 - DNA, 20 bp, mouse
gtctcgcaggaggctgtagg

SEQ ID NO: 641527 - DNA, 20 bp, mouse
gctcggcctgaagctctcgc

SEQ ID NO: 641528 - DNA, 20 bp, mouse
gaggcccgcagcgactgccg

SEQ ID NO: 641529 - DNA, 20 bp, mouse
gggctccgcggcagtcgctg

SEQ ID NO: 641530 - DNA, 20 bp, mouse
gggcctgaagctctcgcagg

SEQ ID NO: 641531 - DNA, 20 bp, mouse
gctgcctccggacccgacag

SEQ ID NO: 641532 - DNA, 20 bp, mouse
gactggctgtgcgcggtgga

SEQ ID NO: 641533 - DNA, 20 bp, mouse
ggctgtaggcggcgctggtg

SEQ ID NO: 641534 - DNA, 20 bp, mouse
gaggaggctgtaggcggcgc

SEQ ID NO: 641535 - DNA, 20 bp, mouse
gcgcccgcaaagtgcgggac

SEQ ID NO: 641536 - DNA, 20 bp, mouse
gaggcccagcccagcacgcg

SEQ ID NO: 641537 - DNA, 20 bp, mouse
gcccagcacgcgtggagcgg

SEQ ID NO: 641538 - DNA, 20 bp, mouse
gagccgggagcaggtggcgc

SEQ ID NO: 641539 - DNA, 20 bp, mouse
ggtggcgctgccaaccgcgc

SEQ ID NO: 641540 - DNA, 20 bp, mouse
gcagcccagcacgcgtggag

SEQ ID NO: 641541 - DNA, 20 bp, mouse
gctcccgtcacgccagaggg

SEQ ID NO: 641542 - DNA, 20 bp, mouse
ggacccctgtcgacacccta

SEQ ID NO: 641543 - DNA, 20 bp, mouse
gttgtcacaaggctcctgcg

SEQ ID NO: 641544 - DNA, 20 bp, mouse
gcggcgcgggggcgggacgt

SEQ ID NO: 641545 - DNA, 20 bp, mouse
ggagccttgtgacaagattg

SEQ ID NO: 641546 - DNA, 20 bp, mouse
ggaagcaataaagtactgta

SEQ ID NO: 641547 - DNA, 20 bp, mouse
gaagtactgtatggcacgga

SEQ ID NO: 641548 - DNA, 20 bp, mouse
gatagtgagcagcgattcat

SEQ ID NO: 641549 - DNA, 20 bp, mouse
gtcccagagtctcaggtatt

SEQ ID NO: 641550 - DNA, 20 bp, mouse
gaatgctcgagatgaagccc

SEQ ID NO: 641551 - DNA, 20 bp, mouse
gcagtactttattgcttcct

SEQ ID NO: 641552 - DNA, 20 bp, mouse
gctgtcggtggctcttcatg

SEQ ID NO: 641553 - DNA, 20 bp, mouse
gaatcgctgctcactatata

SEQ ID NO: 641554 - DNA, 20 bp, mouse
gaactatctcccagagtctc

SEQ ID NO: 641555 - DNA, 20 bp, mouse
gcagccacctgggtttccct

SEQ ID NO: 641556 - DNA, 20 bp, mouse
gtgggggtgtggtctgaact

SEQ ID NO: 641557 - DNA, 20 bp, mouse
gcaagagctacctaatgtgg

SEQ ID NO: 641558 - DNA, 20 bp, mouse
ggaagaaaaatctttagaat

SEQ ID NO: 641559 - DNA, 20 bp, mouse
gcctgtggcactagtgttac

SEQ ID NO: 641560 - DNA, 20 bp, mouse
ggaagactttaaaatcctaa

SEQ ID NO: 641561 - DNA, 20 bp, mouse
gcagaggtttagtccattgt

SEQ ID NO: 641562 - DNA, 20 bp, mouse
ggctacctaatgtgggggtg

SEQ ID NO: 641563 - DNA, 20 bp, mouse
gatggttgtgggctcccatg

SEQ ID NO: 641564 - DNA, 20 bp, mouse
gtattataaagaaaaatatt

SEQ ID NO: 641565 - DNA, 20 bp, mouse
gagtccattgttggcatggt

SEQ ID NO: 641566 - DNA, 20 bp, mouse
ggaaactggagtaaattcac

SEQ ID NO: 641567 - DNA, 20 bp, mouse
gccctggggatattgtacca

SEQ ID NO: 641568 - DNA, 20 bp, mouse
ggccaggagaagtgaaaccc

SEQ ID NO: 641569 - DNA, 20 bp, mouse
ggggagtcaacaacctggtt

SEQ ID NO: 641570 - DNA, 20 bp, mouse
gacgcagggagtcaacaacc

SEQ ID NO: 641571 - DNA, 20 bp, mouse
ggctgtaatcagttcacatg

SEQ ID NO: 641572 - DNA, 20 bp, mouse
gtacgtgcatgtgggacata

SEQ ID NO: 641573 - DNA, 20 bp, mouse
gtgccttataaccttcaaag

SEQ ID NO: 641574 - DNA, 20 bp, mouse
gaccctggtacaatatcccc

SEQ ID NO: 641575 - DNA, 20 bp, mouse
gtggtgaccccaatgaggaa

SEQ ID NO: 641576 - DNA, 20 bp, mouse
gcccgcccaggccgtggcga

SEQ ID NO: 641577 - DNA, 20 bp, mouse
gggtaaacgcacttgggcga

SEQ ID NO: 641578 - DNA, 20 bp, mouse
ggccgcccctagaactattg

SEQ ID NO: 641579 - DNA, 20 bp, mouse
gcgcaaacccgctgccagga

SEQ ID NO: 641580 - DNA, 20 bp, mouse
gggaacgcaaacccgctgcc

SEQ ID NO: 641581 - DNA, 20 bp, mouse
gcgcgccccgcgagcgtctc

SEQ ID NO: 641582 - DNA, 20 bp, mouse
gggtacgaaaggagctcggc

SEQ ID NO: 641583 - DNA, 20 bp, mouse
gtaacaaggactacgatgat

SEQ ID NO: 641584 - DNA, 20 bp, mouse
gcgctgccaggacggaatcc

SEQ ID NO: 641585 - DNA, 20 bp, mouse
gtttacccaggattccgtcc

SEQ ID NO: 641586 - DNA, 20 bp, mouse
gagcccgagggcttcggcct

SEQ ID NO: 641587 - DNA, 20 bp, mouse
gcggctgcggggcgtctccc

SEQ ID NO: 641588 - DNA, 20 bp, mouse
gcgcacggcggggagcccga

SEQ ID NO: 641589 - DNA, 20 bp, mouse
gagcccaggccgaagccctc

SEQ ID NO: 641590 - DNA, 20 bp, mouse
gcaacccagagattgttcgg

SEQ ID NO: 641591 - DNA, 20 bp, mouse
ggcggggagcccgagggctt

SEQ ID NO: 641592 - DNA, 20 bp, mouse
gaaccagccgccgccctctg

SEQ ID NO: 641593 - DNA, 20 bp, mouse
ggggccgccagaaggtaccg

SEQ ID NO: 641594 - DNA, 20 bp, mouse
gctgctgtcaagggagtgag

SEQ ID NO: 641595 - DNA, 20 bp, mouse
gggcccgccgcggaaaggca

SEQ ID NO: 641596 - DNA, 20 bp, mouse
gcacagtgacaggagaagag

SEQ ID NO: 641597 - DNA, 20 bp, mouse
ggaaggctgcacctggatcc

SEQ ID NO: 641598 - DNA, 20 bp, mouse
gaaccaagtcaggcggtggg

SEQ ID NO: 641599 - DNA, 20 bp, mouse
gagaagcctgctccctaagg

SEQ ID NO: 641600 - DNA, 20 bp, mouse
gaaggaaccaagtcaggcgg

SEQ ID NO: 641601 - DNA, 20 bp, mouse
gacggtccaaacacagtgac

SEQ ID NO: 641602 - DNA, 20 bp, mouse
gctgcacctggatccaggct

SEQ ID NO: 641603 - DNA, 20 bp, mouse
gggcaaatgtccatatacac

SEQ ID NO: 641604 - DNA, 20 bp, mouse
gaggctgggacaagtgcttc

SEQ ID NO: 641605 - DNA, 20 bp, mouse
ggcggtgggcggagcgatgc

SEQ ID NO: 641606 - DNA, 20 bp, mouse
ggactcgtccaaaggagggg

SEQ ID NO: 641607 - DNA, 20 bp, mouse
ggggccctaggctcgttaag

SEQ ID NO: 641608 - DNA, 20 bp, mouse
gccgctgcagccacgacatc

SEQ ID NO: 641609 - DNA, 20 bp, mouse
gcccacggcgggtgctggcc

SEQ ID NO: 641610 - DNA, 20 bp, mouse
gggtggccaggcggagtcgg

SEQ ID NO: 641611 - DNA, 20 bp, mouse
gtcgtggctgcagcggcgtc

SEQ ID NO: 641612 - DNA, 20 bp, mouse
gtctcggtggtgggagtgaa

SEQ ID NO: 641613 - DNA, 20 bp, mouse
gcaaacaacgttctcggtgg

SEQ ID NO: 641614 - DNA, 20 bp, mouse
ggtccctctcgtctcgatgg

SEQ ID NO: 641615 - DNA, 20 bp, mouse
gaggctcggctcgacccagc

SEQ ID NO: 641616 - DNA, 20 bp, mouse
ggacaagccactcacggctt

SEQ ID NO: 641617 - DNA, 20 bp, mouse
gagggcagtcagtggagtct

SEQ ID NO: 641618 - DNA, 20 bp, mouse
gcgcaagcccaagccgtgag

SEQ ID NO: 641619 - DNA, 20 bp, mouse
gacgccccacgcctcctcat

SEQ ID NO: 641620 - DNA, 20 bp, mouse
gcgtgcctcccgcggaccaa

SEQ ID NO: 641621 - DNA, 20 bp, mouse
gcttgcgaggcatcgacctg

SEQ ID NO: 641622 - DNA, 20 bp, mouse
ggcctgcagcccctctgcga

SEQ ID NO: 641623 - DNA, 20 bp, mouse
gtctcctacggcctgaagtg

SEQ ID NO: 641624 - DNA, 20 bp, mouse
gccgaaacccgaatctccta

SEQ ID NO: 641625 - DNA, 20 bp, mouse
ggaagccaatgaggaggcgt

SEQ ID NO: 641626 - DNA, 20 bp, mouse
gaggccagggtacctcctgc

SEQ ID NO: 641627 - DNA, 20 bp, mouse
ggttaattcccgaaaggcca

SEQ ID NO: 641628 - DNA, 20 bp, mouse
gtgggcatacacttactata

SEQ ID NO: 641629 - DNA, 20 bp, mouse
gaacttatggtgttcttctc

SEQ ID NO: 641630 - DNA, 20 bp, mouse
gtgctcagttgggttgtatg

SEQ ID NO: 641631 - DNA, 20 bp, mouse
gccttgcagccagtcttccc

SEQ ID NO: 641632 - DNA, 20 bp, mouse
gtatatggttaattcccgaa

SEQ ID NO: 641633 - DNA, 20 bp, mouse
gtagttacaacttacagaga

SEQ ID NO: 641634 - DNA, 20 bp, mouse
gtgatatttaagccagcagg

SEQ ID NO: 641635 - DNA, 20 bp, mouse
gagagaatcaagttgacagt

SEQ ID NO: 641636 - DNA, 20 bp, mouse
gtggtccgcacctacctcgt

SEQ ID NO: 641637 - DNA, 20 bp, mouse
gacctacctcgtgggaccta

SEQ ID NO: 641638 - DNA, 20 bp, mouse
gcccacggaggtatgaaagg

SEQ ID NO: 641639 - DNA, 20 bp, mouse
gaccagagaggggacaagaa

SEQ ID NO: 641640 - DNA, 20 bp, mouse
gggtaggtgcggaccagaga

SEQ ID NO: 641641 - DNA, 20 bp, mouse
gccaagccttaggtcccacg

SEQ ID NO: 641642 - DNA, 20 bp, mouse
gaagcggcacctgggggcga

SEQ ID NO: 641643 - DNA, 20 bp, mouse
gccagagaagcggcacctgg

SEQ ID NO: 641644 - DNA, 20 bp, mouse
gaaactgaggaagacctccg

SEQ ID NO: 641645 - DNA, 20 bp, mouse
ggggcctgattcctgcatct

SEQ ID NO: 641646 - DNA, 20 bp, mouse
gtgaacagataagggtagta

SEQ ID NO: 641647 - DNA, 20 bp, mouse
ggatggggaggtaatctttg

SEQ ID NO: 641648 - DNA, 20 bp, mouse
gcatgtgaccacaaccctac

SEQ ID NO: 641649 - DNA, 20 bp, mouse
gtcagactgtatcacccagt

SEQ ID NO: 641650 - DNA, 20 bp, mouse
gggggaggtaatctttgagg

SEQ ID NO: 641651 - DNA, 20 bp, mouse
gcagataagggtagtaggga

SEQ ID NO: 641652 - DNA, 20 bp, mouse
gacgaggataaaaaatccac

SEQ ID NO: 641653 - DNA, 20 bp, mouse
gagcatactctgaacagata

SEQ ID NO: 641654 - DNA, 20 bp, mouse
gcacatagggctgcattttc

SEQ ID NO: 641655 - DNA, 20 bp, mouse
ggtatcacccagtagggttg

SEQ ID NO: 641656 - DNA, 20 bp, mouse
gcaaaccgatagaggatgaa

SEQ ID NO: 641657 - DNA, 20 bp, mouse
ggggagctagccctgcttcc

SEQ ID NO: 641658 - DNA, 20 bp, mouse
gtatctcaattcaaacattg

SEQ ID NO: 641659 - DNA, 20 bp, mouse
gaactcccttcatcctctat

SEQ ID NO: 641660 - DNA, 20 bp, mouse
gtcttcttgccctggaagca

SEQ ID NO: 641661 - DNA, 20 bp, mouse
gacttggctcacaaagaacc

SEQ ID NO: 641662 - DNA, 20 bp, mouse
gcgagtccccaaaccgatag

SEQ ID NO: 641663 - DNA, 20 bp, mouse
gagggtgcaaatggctggtt

SEQ ID NO: 641664 - DNA, 20 bp, mouse
ggtgtcagggtgcaaatggc

SEQ ID NO: 641665 - DNA, 20 bp, mouse
gtgtttgaattgagatactc

SEQ ID NO: 641666 - DNA, 20 bp, mouse
ggtagcagggagtgagctag

SEQ ID NO: 641667 - DNA, 20 bp, mouse
gtggggtagggacagaagtt

SEQ ID NO: 641668 - DNA, 20 bp, mouse
gggggcagacccagcatagt

SEQ ID NO: 641669 - DNA, 20 bp, mouse
gggtagggacagaagttggg

SEQ ID NO: 641670 - DNA, 20 bp, mouse
gatgccttgaggggaaagat

SEQ ID NO: 641671 - DNA, 20 bp, mouse
gagctcactccctgctacac

SEQ ID NO: 641672 - DNA, 20 bp, mouse
gggagctgtccagtgtagca

SEQ ID NO: 641673 - DNA, 20 bp, mouse
gtggggctctctacggaagt

SEQ ID NO: 641674 - DNA, 20 bp, mouse
ggctctctacggaagtagga

SEQ ID NO: 641675 - DNA, 20 bp, mouse
gtgactgtgagatcagatgg

SEQ ID NO: 641676 - DNA, 20 bp, mouse
ggaacccgaaaggttagcgt

SEQ ID NO: 641677 - DNA, 20 bp, mouse
gtcccgaagcagctacgtcc

SEQ ID NO: 641678 - DNA, 20 bp, mouse
gggtgtgagtcctcacatac

SEQ ID NO: 641679 - DNA, 20 bp, mouse
gactcccacgctaacctttc

SEQ ID NO: 641680 - DNA, 20 bp, mouse
gggacggatttattttcaac

SEQ ID NO: 641681 - DNA, 20 bp, mouse
gcgccgggacgtagctgctt

SEQ ID NO: 641682 - DNA, 20 bp, mouse
gcgtataccctgggacagat

SEQ ID NO: 641683 - DNA, 20 bp, mouse
gccaagcacccctgtatgtg

SEQ ID NO: 641684 - DNA, 20 bp, mouse
gagagggcaccgtataccct

SEQ ID NO: 641685 - DNA, 20 bp, mouse
gaaaaaaaaggcgaatggga

SEQ ID NO: 641686 - DNA, 20 bp, mouse
gcctgctcgtagggagagaa

SEQ ID NO: 641687 - DNA, 20 bp, mouse
gcgactgacaccctgctcgt

SEQ ID NO: 641688 - DNA, 20 bp, mouse
ggcaaggagctggtccgcag

SEQ ID NO: 641689 - DNA, 20 bp, mouse
gcagcggcgagcatgtttgg

SEQ ID NO: 641690 - DNA, 20 bp, mouse
gactcccagcgtgcacaacg

SEQ ID NO: 641691 - DNA, 20 bp, mouse
ggatctgtatgaggctcaaa

SEQ ID NO: 641692 - DNA, 20 bp, mouse
gcacaacgcggacccgtgca

SEQ ID NO: 641693 - DNA, 20 bp, mouse
ggagctggtccgcagaggct

SEQ ID NO: 641694 - DNA, 20 bp, mouse
gggtccgcgttgtgcacgct

SEQ ID NO: 641695 - DNA, 20 bp, mouse
ggcggacccgtgcaaggagc

SEQ ID NO: 641696 - DNA, 20 bp, mouse
gtagctgtggcgtaccgcaa

SEQ ID NO: 641697 - DNA, 20 bp, mouse
gctgacgtctgcgacttcaa

SEQ ID NO: 641698 - DNA, 20 bp, mouse
gtaccgcaagggacccgagg

SEQ ID NO: 641699 - DNA, 20 bp, mouse
gagtcgcagacgtcagtcgg

SEQ ID NO: 641700 - DNA, 20 bp, mouse
gcccgaggggagccgcgtca

SEQ ID NO: 641701 - DNA, 20 bp, mouse
gccgaggaggcgcagaccga

SEQ ID NO: 641702 - DNA, 20 bp, mouse
gggttgcaacatcgccgctg

SEQ ID NO: 641703 - DNA, 20 bp, mouse
ggaggcgcagaccgagggaa

SEQ ID NO: 641704 - DNA, 20 bp, mouse
gtaaatccccgaacccgagt

SEQ ID NO: 641705 - DNA, 20 bp, mouse
ggcgaacagagctgacagcg

SEQ ID NO: 641706 - DNA, 20 bp, mouse
gcctgccaggcgccaatcac

SEQ ID NO: 641707 - DNA, 20 bp, mouse
gactccagggcgttaaccca

SEQ ID NO: 641708 - DNA, 20 bp, mouse
gccgccctgggttaacgccc

SEQ ID NO: 641709 - DNA, 20 bp, mouse
ggcggctgaacgtcaccaca

SEQ ID NO: 641710 - DNA, 20 bp, mouse
gccaggcgccaatcacaggt

SEQ ID NO: 641711 - DNA, 20 bp, mouse
ggaagccccgcccaggccag

SEQ ID NO: 641712 - DNA, 20 bp, mouse
gtagctctggcaagactcca

SEQ ID NO: 641713 - DNA, 20 bp, mouse
gccgcctcgaccaatagcta

SEQ ID NO: 641714 - DNA, 20 bp, mouse
gctgcgcgccaacctgtgat

SEQ ID NO: 641715 - DNA, 20 bp, mouse
ggcaggcggcggtctagctc

SEQ ID NO: 641716 - DNA, 20 bp, mouse
gttcccctgcggattctggc

SEQ ID NO: 641717 - DNA, 20 bp, mouse
gcgctgggggagggaggtct

SEQ ID NO: 641718 - DNA, 20 bp, mouse
ggaaagttgggcatgcgctg

SEQ ID NO: 641719 - DNA, 20 bp, mouse
gaacatgacaaatacctgga

SEQ ID NO: 641720 - DNA, 20 bp, mouse
gcagcctaagcctgccctcc

SEQ ID NO: 641721 - DNA, 20 bp, mouse
gaagcctgccagaatccgca

SEQ ID NO: 641722 - DNA, 20 bp, mouse
gcagcagagtgcattttatc

SEQ ID NO: 641723 - DNA, 20 bp, mouse
gggcttaggctgccctgcaa

SEQ ID NO: 641724 - DNA, 20 bp, mouse
ggtttctggcatttgagcta

SEQ ID NO: 641725 - DNA, 20 bp, mouse
gacagtcctgatttcccctg

SEQ ID NO: 641726 - DNA, 20 bp, mouse
gtaggaagggtctatcctga

SEQ ID NO: 641727 - DNA, 20 bp, mouse
gcctaggaatggagtagcaa

SEQ ID NO: 641728 - DNA, 20 bp, mouse
gttgggaagctaggtgtgtt

SEQ ID NO: 641729 - DNA, 20 bp, mouse
gggtgtgttgggtaaccata

SEQ ID NO: 641730 - DNA, 20 bp, mouse
gaggcctggccttgtgcgtc

SEQ ID NO: 641731 - DNA, 20 bp, mouse
gagatgcactcacggaaggt

SEQ ID NO: 641732 - DNA, 20 bp, mouse
gcagaggccttatggagacc

SEQ ID NO: 641733 - DNA, 20 bp, mouse
gcccaccgtgaccaggctcc

SEQ ID NO: 641734 - DNA, 20 bp, mouse
gtttaagctaaagaagaagt

SEQ ID NO: 641735 - DNA, 20 bp, mouse
gcccagcccccaccgtgacc

SEQ ID NO: 641736 - DNA, 20 bp, mouse
gggccctggaacagcaacgt

SEQ ID NO: 641737 - DNA, 20 bp, mouse
gcgaccgttttccagataat

SEQ ID NO: 641738 - DNA, 20 bp, mouse
ggcactctcaccctattatc

SEQ ID NO: 641739 - DNA, 20 bp, mouse
gatcgctgcaatggcaagac

SEQ ID NO: 641740 - DNA, 20 bp, mouse
gttttattccaatgcgcaca

SEQ ID NO: 641741 - DNA, 20 bp, mouse
gactctttatttgtggggca

SEQ ID NO: 641742 - DNA, 20 bp, mouse
gaaactgtagtttaagcagt

SEQ ID NO: 641743 - DNA, 20 bp, mouse
gcaccctattatctggaaaa

SEQ ID NO: 641744 - DNA, 20 bp, mouse
gacaaagtttctgacatcgc

SEQ ID NO: 641745 - DNA, 20 bp, mouse
gaaactgaggccggggtccc

SEQ ID NO: 641746 - DNA, 20 bp, mouse
ggcggggcgcggcacgcagg

SEQ ID NO: 641747 - DNA, 20 bp, mouse
gggagagtgtacccactcga

SEQ ID NO: 641748 - DNA, 20 bp, mouse
gccggctaaagccctcgagt

SEQ ID NO: 641749 - DNA, 20 bp, mouse
gtggggcacttctgctgcaa

SEQ ID NO: 641750 - DNA, 20 bp, mouse
ggacctaggcatcatcagtc

SEQ ID NO: 641751 - DNA, 20 bp, mouse
ggggcgcggcacgcaggtgg

SEQ ID NO: 641752 - DNA, 20 bp, mouse
gtcctccaagagcacttaat

SEQ ID NO: 641753 - DNA, 20 bp, mouse
ggagggaagaaggcagacta

SEQ ID NO: 641754 - DNA, 20 bp, mouse
gcatctgggcagggatccac

SEQ ID NO: 641755 - DNA, 20 bp, mouse
gccccccgcagggagtgtcc

SEQ ID NO: 641756 - DNA, 20 bp, mouse
ggccgcccaccgcggtgagt

SEQ ID NO: 641757 - DNA, 20 bp, mouse
gtcctcccactcaccgcggt

SEQ ID NO: 641758 - DNA, 20 bp, mouse
gcgccctcacctggtggcca

SEQ ID NO: 641759 - DNA, 20 bp, mouse
ggaaagctgcggacctccga

SEQ ID NO: 641760 - DNA, 20 bp, mouse
gtggccacggcttgtcccgg

SEQ ID NO: 641761 - DNA, 20 bp, mouse
ggcccaccgcggtgagtggg

SEQ ID NO: 641762 - DNA, 20 bp, mouse
gaagccgtggccaccaggtg

SEQ ID NO: 641763 - DNA, 20 bp, mouse
gcgcccgggtccagccccgc

SEQ ID NO: 641764 - DNA, 20 bp, mouse
gcggccgccagagcccgccc

SEQ ID NO: 641765 - DNA, 20 bp, mouse
gccacggcttgtcccggcgg

SEQ ID NO: 641766 - DNA, 20 bp, mouse
gcggacgtctgtaaggggtg

SEQ ID NO: 641767 - DNA, 20 bp, mouse
gcgcgcatgcgtagtagcac

SEQ ID NO: 641768 - DNA, 20 bp, mouse
gtccccccgcaggtagacag

SEQ ID NO: 641769 - DNA, 20 bp, mouse
gtacgcgaaagccctggact

SEQ ID NO: 641770 - DNA, 20 bp, mouse
gcccccggccggggagagcc

SEQ ID NO: 641771 - DNA, 20 bp, mouse
gctggacttggctctcccac

SEQ ID NO: 641772 - DNA, 20 bp, mouse
gcatgcgtagtagcacggga

SEQ ID NO: 641773 - DNA, 20 bp, mouse
gtgcgctggcgcagtctgga

SEQ ID NO: 641774 - DNA, 20 bp, mouse
gaatatgcggacgtctgtaa

SEQ ID NO: 641775 - DNA, 20 bp, mouse
gtgcgcgccgggcatggcgg

SEQ ID NO: 641776 - DNA, 20 bp, mouse
gcatctgtctggagggaaaa

SEQ ID NO: 641777 - DNA, 20 bp, mouse
gggaaaggaaggagtctgaa

SEQ ID NO: 641778 - DNA, 20 bp, mouse
gtggtgactcatgcgaaggg

SEQ ID NO: 641779 - DNA, 20 bp, mouse
gtgggtgggtgggtagtgtc

SEQ ID NO: 641780 - DNA, 20 bp, mouse
gctggagggaaaaaggaagt

SEQ ID NO: 641781 - DNA, 20 bp, mouse
gagaaaatgatgcatctgtc

SEQ ID NO: 641782 - DNA, 20 bp, mouse
gtagtggagccttgcgacaa

SEQ ID NO: 641783 - DNA, 20 bp, mouse
gactcatgcgaagggtgggt

SEQ ID NO: 641784 - DNA, 20 bp, mouse
gaatgatgcatctgtctgga

SEQ ID NO: 641785 - DNA, 20 bp, mouse
gtatctacaggttctagatt

SEQ ID NO: 641786 - DNA, 20 bp, mouse
gttcaccgattaggcaaggg

SEQ ID NO: 641787 - DNA, 20 bp, mouse
gtggctgacaggtgagcttc

SEQ ID NO: 641788 - DNA, 20 bp, mouse
gcacttcaccgattaggcaa

SEQ ID NO: 641789 - DNA, 20 bp, mouse
gttaggcaagggtggctgac

SEQ ID NO: 641790 - DNA, 20 bp, mouse
gggagcgctaacacggggct

SEQ ID NO: 641791 - DNA, 20 bp, mouse
ggaaaagagggtcttgaggt

SEQ ID NO: 641792 - DNA, 20 bp, mouse
gtctgcaatcactgaaccat

SEQ ID NO: 641793 - DNA, 20 bp, mouse
gagaatggtgagtggtgcat

SEQ ID NO: 641794 - DNA, 20 bp, mouse
gatctgaaaagagggtcttg

SEQ ID NO: 641795 - DNA, 20 bp, mouse
ggatgacatcatctgaaaag

SEQ ID NO: 641796 - DNA, 20 bp, mouse
gttcaccgattaggcaaggg

SEQ ID NO: 641797 - DNA, 20 bp, mouse
gtggctgacaggtgagcttc

SEQ ID NO: 641798 - DNA, 20 bp, mouse
gcacttcaccgattaggcaa

SEQ ID NO: 641799 - DNA, 20 bp, mouse
gttaggcaagggtggctgac

SEQ ID NO: 641800 - DNA, 20 bp, mouse
gggagcgctaacacggggct

SEQ ID NO: 641801 - DNA, 20 bp, mouse
ggaaaagagggtcttgaggt

SEQ ID NO: 641802 - DNA, 20 bp, mouse
gagaatggtgagtggtgcat

SEQ ID NO: 641803 - DNA, 20 bp, mouse
gtctgcaatcactgaaccat

SEQ ID NO: 641804 - DNA, 20 bp, mouse
gatctgaaaagagggtcttg

SEQ ID NO: 641805 - DNA, 20 bp, mouse
gccacctccctctctgtgga

SEQ ID NO: 641806 - DNA, 20 bp, mouse
gcgcaggggctctaccggaa

SEQ ID NO: 641807 - DNA, 20 bp, mouse
gtcgcaaggcccgcccgcag

SEQ ID NO: 641808 - DNA, 20 bp, mouse
gggaaggggcgggtctaagg

SEQ ID NO: 641809 - DNA, 20 bp, mouse
ggcgaggcggaagtggaagt

SEQ ID NO: 641810 - DNA, 20 bp, mouse
gaagaggctgcggacggagt

SEQ ID NO: 641811 - DNA, 20 bp, mouse
gccgcccgcaggggctctac

SEQ ID NO: 641812 - DNA, 20 bp, mouse
gaccggaaggggcgggtcta

SEQ ID NO: 641813 - DNA, 20 bp, mouse
gcaagccagaacctttgaag

SEQ ID NO: 641814 - DNA, 20 bp, mouse
gtgacaactggcggtcccag

SEQ ID NO: 641815 - DNA, 20 bp, mouse
gaccgccagttgtcagtccg

SEQ ID NO: 641816 - DNA, 20 bp, mouse
gaaacggggcccgaagggtg

SEQ ID NO: 641817 - DNA, 20 bp, mouse
gaacatcaggcagttatttg

SEQ ID NO: 641818 - DNA, 20 bp, mouse
gcctgatgttgatgaccaaa

SEQ ID NO: 641819 - DNA, 20 bp, mouse
gctatcagagtcttagaaac

SEQ ID NO: 641820 - DNA, 20 bp, mouse
gcttagaaacggggcccgaa

SEQ ID NO: 641821 - DNA, 20 bp, mouse
ggtcctgcatctgtaatttc

SEQ ID NO: 641822 - DNA, 20 bp, mouse
gtcatactctctcttccctt

SEQ ID NO: 641823 - DNA, 20 bp, mouse
gtggtaacacaatatggaca

SEQ ID NO: 641824 - DNA, 20 bp, mouse
gggccagaaattacagatgc

SEQ ID NO: 641825 - DNA, 20 bp, mouse
gaaggtaaaagcagtgaaat

SEQ ID NO: 641826 - DNA, 20 bp, mouse
gtgaaatctgagggcagcaa

SEQ ID NO: 641827 - DNA, 20 bp, mouse
gcactcaagtgagatccagc

SEQ ID NO: 641828 - DNA, 20 bp, mouse
ggatgcctatcatgtaacag

SEQ ID NO: 641829 - DNA, 20 bp, mouse
ggggtggtattttatgtaaa

SEQ ID NO: 641830 - DNA, 20 bp, mouse
gctgattgggtaaaggatgt

SEQ ID NO: 641831 - DNA, 20 bp, mouse
gcagaggtagttaactacat

SEQ ID NO: 641832 - DNA, 20 bp, mouse
ggttaaggctctgcacctgg

SEQ ID NO: 641833 - DNA, 20 bp, mouse
gctgcacctggcggctgatt

SEQ ID NO: 641834 - DNA, 20 bp, mouse
gaaacgttgcctgtccaaac

SEQ ID NO: 641835 - DNA, 20 bp, mouse
gtttttaacgctgctcccgt

SEQ ID NO: 641836 - DNA, 20 bp, mouse
gtctcccggggagaccgccg

SEQ ID NO: 641837 - DNA, 20 bp, mouse
gactccgcggcggtctcccc

SEQ ID NO: 641838 - DNA, 20 bp, mouse
ggaccggcctggactcctgg

SEQ ID NO: 641839 - DNA, 20 bp, mouse
gcctccaggcactgactccg

SEQ ID NO: 641840 - DNA, 20 bp, mouse
ggcggtctccccgggagagg

SEQ ID NO: 641841 - DNA, 20 bp, mouse
ggagcagaagggaggacgtg

SEQ ID NO: 641842 - DNA, 20 bp, mouse
gcatacatggccaattgaaa

SEQ ID NO: 641843 - DNA, 20 bp, mouse
ggcaccgccgggcatgcagg

SEQ ID NO: 641844 - DNA, 20 bp, mouse
ggcgcccctccgtgcataca

SEQ ID NO: 641845 - DNA, 20 bp, mouse
gggccggtccctgatcctcc

SEQ ID NO: 641846 - DNA, 20 bp, mouse
gctagtcaggacaggataag

SEQ ID NO: 641847 - DNA, 20 bp, mouse
gacctggctctagtcaggac

SEQ ID NO: 641848 - DNA, 20 bp, mouse
gcatgggtcagtgacagttc

SEQ ID NO: 641849 - DNA, 20 bp, mouse
gcaaaggaggattcgttctt

SEQ ID NO: 641850 - DNA, 20 bp, mouse
gcgagaggacaatggcaaga

SEQ ID NO: 641851 - DNA, 20 bp, mouse
gtctggcacgtgttcacacc

SEQ ID NO: 641852 - DNA, 20 bp, mouse
gtcctgtcctgactagagcc

SEQ ID NO: 641853 - DNA, 20 bp, mouse
gacttgtcagtggacccata

SEQ ID NO: 641854 - DNA, 20 bp, mouse
ggtactttgtttgcccttcc

SEQ ID NO: 641855 - DNA, 20 bp, mouse
ggcttggcatgggaacagcg

SEQ ID NO: 641856 - DNA, 20 bp, mouse
ggccctttgaccaggtaatt

SEQ ID NO: 641857 - DNA, 20 bp, mouse
gctgcgtggatgcaagagac

SEQ ID NO: 641858 - DNA, 20 bp, mouse
gacctggtcaaagggctgcg

SEQ ID NO: 641859 - DNA, 20 bp, mouse
ggaagcttagttatctaaaa

SEQ ID NO: 641860 - DNA, 20 bp, mouse
gcgaagtgatatactaggga

SEQ ID NO: 641861 - DNA, 20 bp, mouse
gtcaaactccaaaggttcag

SEQ ID NO: 641862 - DNA, 20 bp, mouse
gggttcagtggctgtaggtt

SEQ ID NO: 641863 - DNA, 20 bp, mouse
gatactagggaaggtaatct

SEQ ID NO: 641864 - DNA, 20 bp, mouse
gactgtgtggcacaacaaca

SEQ ID NO: 641865 - DNA, 20 bp, mouse
gccaaaggttcagtggctgt

SEQ ID NO: 641866 - DNA, 20 bp, mouse
gcagccagcactgacaggtg

SEQ ID NO: 641867 - DNA, 20 bp, mouse
ggcctggcacggtggctcca

SEQ ID NO: 641868 - DNA, 20 bp, mouse
ggggcacgcttggaaactgg

SEQ ID NO: 641869 - DNA, 20 bp, mouse
gcacgggcacgcttggaaac

SEQ ID NO: 641870 - DNA, 20 bp, mouse
gggacaccgaggttgccctc

SEQ ID NO: 641871 - DNA, 20 bp, mouse
ggggctggggcaacggtctg

SEQ ID NO: 641872 - DNA, 20 bp, mouse
gctatagaagcgtgaagact

SEQ ID NO: 641873 - DNA, 20 bp, mouse
gtggcggtaaaagagatctc

SEQ ID NO: 641874 - DNA, 20 bp, mouse
gataggccgggctggggcaa

SEQ ID NO: 641875 - DNA, 20 bp, mouse
ggaccagtaggtgccaagct

SEQ ID NO: 641876 - DNA, 20 bp, mouse
gccctgagaacagtcgtgaa

SEQ ID NO: 641877 - DNA, 20 bp, mouse
gccaacggcagccatcacta

SEQ ID NO: 641878 - DNA, 20 bp, mouse
gggcgcggccgccatagtga

SEQ ID NO: 641879 - DNA, 20 bp, mouse
gcgtgaacggcagcgagacc

SEQ ID NO: 641880 - DNA, 20 bp, mouse
gcgagaccaggaaaggatgc

SEQ ID NO: 641881 - DNA, 20 bp, mouse
gcgaccgcctgctcccggcg

SEQ ID NO: 641882 - DNA, 20 bp, mouse
gacggcagcgagaccaggaa

SEQ ID NO: 641883 - DNA, 20 bp, mouse
gggtcgactcgctttcccag

SEQ ID NO: 641884 - DNA, 20 bp, mouse
gtggctctggcgtgcggggg

SEQ ID NO: 641885 - DNA, 20 bp, mouse
ggccgagagtccactggctc

SEQ ID NO: 641886 - DNA, 20 bp, mouse
ggacgcttcgggttctgcat

SEQ ID NO: 641887 - DNA, 20 bp, mouse
ggcagaacccgaagcgtctt

SEQ ID NO: 641888 - DNA, 20 bp, mouse
gggagcaccgaactgtggtg

SEQ ID NO: 641889 - DNA, 20 bp, mouse
gtgcataggaggagcagcga

SEQ ID NO: 641890 - DNA, 20 bp, mouse
ggcgagggagcaccgaactg

SEQ ID NO: 641891 - DNA, 20 bp, mouse
gaattagagagagaagccgt

SEQ ID NO: 641892 - DNA, 20 bp, mouse
gcggtggtccgaagacgctt

SEQ ID NO: 641893 - DNA, 20 bp, mouse
gggtgcggctccgcccccaa

SEQ ID NO: 641894 - DNA, 20 bp, mouse
gggggggaggggaacatcct

SEQ ID NO: 641895 - DNA, 20 bp, mouse
ggcttcgggttctgcatagg

SEQ ID NO: 641896 - DNA, 20 bp, mouse
gggactcagggttcgttctg

SEQ ID NO: 641897 - DNA, 20 bp, mouse
gctgagtccctgggcgaaag

SEQ ID NO: 641898 - DNA, 20 bp, mouse
gtgagtaagcagacgggcaa

SEQ ID NO: 641899 - DNA, 20 bp, mouse
gctctgctccggattgtctg

SEQ ID NO: 641900 - DNA, 20 bp, mouse
gaggggctcagtttcaggtg

SEQ ID NO: 641901 - DNA, 20 bp, mouse
gcctgccggccatctctgga

SEQ ID NO: 641902 - DNA, 20 bp, mouse
gaccccctgcggtgggtaac

SEQ ID NO: 641903 - DNA, 20 bp, mouse
gtgagtgactggcagtcccc

SEQ ID NO: 641904 - DNA, 20 bp, mouse
gagcagacgggcaagggcgt

SEQ ID NO: 641905 - DNA, 20 bp, mouse
gagctgcggctggagactac

SEQ ID NO: 641906 - DNA, 20 bp, mouse
gcctgtcagcgggcattctc

SEQ ID NO: 641907 - DNA, 20 bp, mouse
gtgcggttgggatagttcag

SEQ ID NO: 641908 - DNA, 20 bp, mouse
gcggaaaagcatcgtgctca

SEQ ID NO: 641909 - DNA, 20 bp, mouse
gacaaaagtcttgacacctt

SEQ ID NO: 641910 - DNA, 20 bp, mouse
gtctcactttctcactgtaa

SEQ ID NO: 641911 - DNA, 20 bp, mouse
gtaacttgagtttacctctg

SEQ ID NO: 641912 - DNA, 20 bp, mouse
gtaatttgtgccactgccca

SEQ ID NO: 641913 - DNA, 20 bp, mouse
gaagtgagaaagttacagtt

SEQ ID NO: 641914 - DNA, 20 bp, mouse
gggtaaactcaagttaacac

SEQ ID NO: 641915 - DNA, 20 bp, mouse
gcacaaattacagtgaccta

SEQ ID NO: 641916 - DNA, 20 bp, mouse
gctaacctggagactgggag

SEQ ID NO: 641917 - DNA, 20 bp, mouse
gtggccaagaccaggttctg

SEQ ID NO: 641918 - DNA, 20 bp, mouse
gcggaggccctgcagaggag

SEQ ID NO: 641919 - DNA, 20 bp, mouse
gaagaccaggttctgaggta

SEQ ID NO: 641920 - DNA, 20 bp, mouse
gcctctgcagggcctccgga

SEQ ID NO: 641921 - DNA, 20 bp, mouse
gtacccaaggaggaaatgtt

SEQ ID NO: 641922 - DNA, 20 bp, mouse
gaccaggttctgaggtaggg

SEQ ID NO: 641923 - DNA, 20 bp, mouse
gcggctgcgagcgcgtgtgt

SEQ ID NO: 641924 - DNA, 20 bp, mouse
gaatatgcgagacggaatgt

SEQ ID NO: 641925 - DNA, 20 bp, mouse
ggtctgaagtggccaagacc

SEQ ID NO: 641926 - DNA, 20 bp, mouse
gaccatcgggaatactcact

SEQ ID NO: 641927 - DNA, 20 bp, mouse
gacccagtgagtattcccga

SEQ ID NO: 641928 - DNA, 20 bp, mouse
gggctctggaaggacgccat

SEQ ID NO: 641929 - DNA, 20 bp, mouse
gaatctgactctagctcaga

SEQ ID NO: 641930 - DNA, 20 bp, mouse
gctagctcagagggaccatc

SEQ ID NO: 641931 - DNA, 20 bp, mouse
gtgtcaagagggggacgaaa

SEQ ID NO: 641932 - DNA, 20 bp, mouse
gcgccccgccccctgggctt

SEQ ID NO: 641933 - DNA, 20 bp, mouse
ggcgtccttccagagccctc

SEQ ID NO: 641934 - DNA, 20 bp, mouse
gtatctgttagagatttctt

SEQ ID NO: 641935 - DNA, 20 bp, mouse
gaaacagagcaatatccagg

SEQ ID NO: 641936 - DNA, 20 bp, mouse
gtcttctgaggcaaggttct

SEQ ID NO: 641937 - DNA, 20 bp, mouse
gtgggacctaggacaactgc

SEQ ID NO: 641938 - DNA, 20 bp, mouse
gagaaggggcgaccgattct

SEQ ID NO: 641939 - DNA, 20 bp, mouse
gtaggtcccactctcttctg

SEQ ID NO: 641940 - DNA, 20 bp, mouse
gcccagcttcagcacacgca

SEQ ID NO: 641941 - DNA, 20 bp, mouse
gtctctgtggagatgaggaa

SEQ ID NO: 641942 - DNA, 20 bp, mouse
ggggccgagctggttttaga

SEQ ID NO: 641943 - DNA, 20 bp, mouse
gcaccaaggcagcttatgcc

SEQ ID NO: 641944 - DNA, 20 bp, mouse
gaggagactcctgagctggt

SEQ ID NO: 641945 - DNA, 20 bp, mouse
gtgtgtgtgcatcttacaag

SEQ ID NO: 641946 - DNA, 20 bp, mouse
gcattctggcacagtctcac

SEQ ID NO: 641947 - DNA, 20 bp, mouse
gccaccgcacaacccaccgg

SEQ ID NO: 641948 - DNA, 20 bp, mouse
gactgactgagatgtcctgg

SEQ ID NO: 641949 - DNA, 20 bp, mouse
gtgcctgtgtggccctccgg

SEQ ID NO: 641950 - DNA, 20 bp, mouse
ggagactgactgagatgtcc

SEQ ID NO: 641951 - DNA, 20 bp, mouse
gggcggtcccacacactcgc

SEQ ID NO: 641952 - DNA, 20 bp, mouse
gtgcacacatgtaactgaca

SEQ ID NO: 641953 - DNA, 20 bp, mouse
gaaactgcggagtgccgctt

SEQ ID NO: 641954 - DNA, 20 bp, mouse
gccaactcacacatctgcag

SEQ ID NO: 641955 - DNA, 20 bp, mouse
gggacatgtgagatctgata

SEQ ID NO: 641956 - DNA, 20 bp, mouse
gttgttcagagaactcgtgt

SEQ ID NO: 641957 - DNA, 20 bp, mouse
ggatgctctgggctcctgtc

SEQ ID NO: 641958 - DNA, 20 bp, mouse
gaacgtgctgaggagcagct

SEQ ID NO: 641959 - DNA, 20 bp, mouse
ggatggcctagttactgcca

SEQ ID NO: 641960 - DNA, 20 bp, mouse
gaagacagacagaccttctg

SEQ ID NO: 641961 - DNA, 20 bp, mouse
gacgttcaggaccagatctc

SEQ ID NO: 641962 - DNA, 20 bp, mouse
ggcatcaataagtggctgtg

SEQ ID NO: 641963 - DNA, 20 bp, mouse
gctgctccccgccagagatc

SEQ ID NO: 641964 - DNA, 20 bp, mouse
gtctgggaattccggctaac

SEQ ID NO: 641965 - DNA, 20 bp, mouse
ggcttgccaactctccagac

SEQ ID NO: 641966 - DNA, 20 bp, mouse
gtcccctgacggatctcatt

SEQ ID NO: 641967 - DNA, 20 bp, mouse
gcactcttggtaggaggaaa

SEQ ID NO: 641968 - DNA, 20 bp, mouse
gagccgggtgcctcccctga

SEQ ID NO: 641969 - DNA, 20 bp, mouse
gtgcccaatgagatccgtca

SEQ ID NO: 641970 - DNA, 20 bp, mouse
ggagagcgcaggggcaaggc

SEQ ID NO: 641971 - DNA, 20 bp, mouse
gcaagcgcgggagagcgcag

SEQ ID NO: 641972 - DNA, 20 bp, mouse
gtgtgcgcactcttggtagg

SEQ ID NO: 641973 - DNA, 20 bp, mouse
gtcggcccagaattagtgga

SEQ ID NO: 641974 - DNA, 20 bp, mouse
gatccgtcaggggaggcacc

SEQ ID NO: 641975 - DNA, 20 bp, mouse
gagtgcgcacaacttttcgc

SEQ ID NO: 641976 - DNA, 20 bp, mouse
gccaacgcgaagaaaccaat

SEQ ID NO: 641977 - DNA, 20 bp, mouse
gtaggcgaggagaatatgga

SEQ ID NO: 641978 - DNA, 20 bp, mouse
ggcggggccggctgacagga

SEQ ID NO: 641979 - DNA, 20 bp, mouse
gggtggggagacaaaggtcc

SEQ ID NO: 641980 - DNA, 20 bp, mouse
gcaccaacgcgcgctgtgat

SEQ ID NO: 641981 - DNA, 20 bp, mouse
ggcagcgtcggccagagcca

SEQ ID NO: 641982 - DNA, 20 bp, mouse
ggcgaagaaaccaataggcg

SEQ ID NO: 641983 - DNA, 20 bp, mouse
gctcggaggcaaggcggcgg

SEQ ID NO: 641984 - DNA, 20 bp, mouse
ggacaaaggtcctggtggat

SEQ ID NO: 641985 - DNA, 20 bp, mouse
gcacagcgcgcgttggtggg

SEQ ID NO: 641986 - DNA, 20 bp, mouse
gtgtgcggcgcgggagacaa

SEQ ID NO: 641987 - DNA, 20 bp, mouse
gcggacgcacctaagacctc

SEQ ID NO: 641988 - DNA, 20 bp, mouse
gagaccagtgactgagatcg

SEQ ID NO: 641989 - DNA, 20 bp, mouse
ggccacggacccacgagccc

SEQ ID NO: 641990 - DNA, 20 bp, mouse
gggtctgctggtgtgcggcg

SEQ ID NO: 641991 - DNA, 20 bp, mouse
gcccgcccctagcaacgccc

SEQ ID NO: 641992 - DNA, 20 bp, mouse
gcctggaggctagtgaagag

SEQ ID NO: 641993 - DNA, 20 bp, mouse
gggaggtaagatgcattctg

SEQ ID NO: 641994 - DNA, 20 bp, mouse
gggtcctatctctgcagaaa

SEQ ID NO: 641995 - DNA, 20 bp, mouse
gggtggacatggttcggggt

SEQ ID NO: 641996 - DNA, 20 bp, mouse
gggaccgggaaggcacgtcg

SEQ ID NO: 641997 - DNA, 20 bp, mouse
gctggagcccccacatcttg

SEQ ID NO: 641998 - DNA, 20 bp, mouse
gtgactggactggcaatgac

SEQ ID NO: 641999 - DNA, 20 bp, mouse
gagcccccacatcttgtgga

SEQ ID NO: 642000 - DNA, 20 bp, mouse
gatcccatccacaagatgtg

SEQ ID NO: 642001 - DNA, 20 bp, mouse
gcagccgcgacgtgccttcc

SEQ ID NO: 642002 - DNA, 20 bp, mouse
gaaaagggaactctgatctg

SEQ ID NO: 642003 - DNA, 20 bp, mouse
gctggactggcaatgaccgg

SEQ ID NO: 642004 - DNA, 20 bp, mouse
gcccacctaggcatgcacgt

SEQ ID NO: 642005 - DNA, 20 bp, mouse
gatcttgtggatgggatccc

SEQ ID NO: 642006 - DNA, 20 bp, mouse
ggaagcaggaaggacggaag

SEQ ID NO: 642007 - DNA, 20 bp, mouse
gaagcgccctgctccttcgg

SEQ ID NO: 642008 - DNA, 20 bp, mouse
gctaccgcttccaccgaagc

SEQ ID NO: 642009 - DNA, 20 bp, mouse
gctagtgcgatgtggggaaa

SEQ ID NO: 642010 - DNA, 20 bp, mouse
gaaggggaagccagacagaa

SEQ ID NO: 642011 - DNA, 20 bp, mouse
gcaagctggcgcggggaccg

SEQ ID NO: 642012 - DNA, 20 bp, mouse
ggtaaagtctagtgcgatgt

SEQ ID NO: 642013 - DNA, 20 bp, mouse
gcggcggtgaatcgccaagc

SEQ ID NO: 642014 - DNA, 20 bp, mouse
ggtcagcccggcatccctgg

SEQ ID NO: 642015 - DNA, 20 bp, mouse
gactcacccccagggatgcc

SEQ ID NO: 642016 - DNA, 20 bp, mouse
gcatacctcctgctgatctc

SEQ ID NO: 642017 - DNA, 20 bp, mouse
gtgcagctcctcagcctgat

SEQ ID NO: 642018 - DNA, 20 bp, mouse
gtcctcagcctgatgggcca

SEQ ID NO: 642019 - DNA, 20 bp, mouse
ggctagagacccaatttgaa

SEQ ID NO: 642020 - DNA, 20 bp, mouse
gaagctcgccctggcccatc

SEQ ID NO: 642021 - DNA, 20 bp, mouse
ggctccaaaatccatggctg

SEQ ID NO: 642022 - DNA, 20 bp, mouse
gacaggagccagcagcggca

SEQ ID NO: 642023 - DNA, 20 bp, mouse
gttctcccgagatcagcagg

SEQ ID NO: 642024 - DNA, 20 bp, mouse
gtaactgcatggacgctgcc

SEQ ID NO: 642025 - DNA, 20 bp, mouse
gagtgctctgttccttcaga

SEQ ID NO: 642026 - DNA, 20 bp, mouse
gtgtacgtggacatagtggc

SEQ ID NO: 642027 - DNA, 20 bp, mouse
gaatgagcctgggagggaat

SEQ ID NO: 642028 - DNA, 20 bp, mouse
ggggagggcagcttctaaca

SEQ ID NO: 642029 - DNA, 20 bp, mouse
gacctcctcccattaaggga

SEQ ID NO: 642030 - DNA, 20 bp, mouse
gcctgggagggaatgggagt

SEQ ID NO: 642031 - DNA, 20 bp, mouse
gaggcgacacacaaggaata

SEQ ID NO: 642032 - DNA, 20 bp, mouse
gaggaggtcccagggtacac

SEQ ID NO: 642033 - DNA, 20 bp, mouse
gctgggacctcctcccatta

SEQ ID NO: 642034 - DNA, 20 bp, mouse
gaaaaccttcccttaatggg

SEQ ID NO: 642035 - DNA, 20 bp, mouse
gcctcacagcccaacatccc

SEQ ID NO: 642036 - DNA, 20 bp, mouse
ggcagcgcgcgcctccccga

SEQ ID NO: 642037 - DNA, 20 bp, mouse
gttcccgccacgctgggaaa

SEQ ID NO: 642038 - DNA, 20 bp, mouse
gcgcgcgcctccccgacgga

SEQ ID NO: 642039 - DNA, 20 bp, mouse
gcgcggctcgccgtccgtcg

SEQ ID NO: 642040 - DNA, 20 bp, mouse
gtggccgccatgtttgggaa

SEQ ID NO: 642041 - DNA, 20 bp, mouse
gcagccgcccttctcaaaca

SEQ ID NO: 642042 - DNA, 20 bp, mouse
ggagcgccggaagctgggca

SEQ ID NO: 642043 - DNA, 20 bp, mouse
gcgggcgggcctccgcgcga

SEQ ID NO: 642044 - DNA, 20 bp, mouse
gtcaaacatggcggcgacgg

SEQ ID NO: 642045 - DNA, 20 bp, mouse
gcggtctaacgcctccctcg

SEQ ID NO: 642046 - DNA, 20 bp, mouse
gtgggcacgtcttgaggcta

SEQ ID NO: 642047 - DNA, 20 bp, mouse
gtcctctgaaagacagtagt

SEQ ID NO: 642048 - DNA, 20 bp, mouse
gggctccagctcacagctga

SEQ ID NO: 642049 - DNA, 20 bp, mouse
gctgcagctgttggggactc

SEQ ID NO: 642050 - DNA, 20 bp, mouse
gggagggtaggggcgggctt

SEQ ID NO: 642051 - DNA, 20 bp, mouse
gctggagaagaccgagggtc

SEQ ID NO: 642052 - DNA, 20 bp, mouse
gtgaaggagctcaggttaac

SEQ ID NO: 642053 - DNA, 20 bp, mouse
gcatagctggagaagaccga

SEQ ID NO: 642054 - DNA, 20 bp, mouse
gctcgtggctaccccatagc

SEQ ID NO: 642055 - DNA, 20 bp, mouse
gccaaacttggagacgtgac

SEQ ID NO: 642056 - DNA, 20 bp, mouse
gcaactgctgaagaggaacg

SEQ ID NO: 642057 - DNA, 20 bp, mouse
gtggggacagacacatatgt

SEQ ID NO: 642058 - DNA, 20 bp, mouse
gagggcctcaccctaacact

SEQ ID NO: 642059 - DNA, 20 bp, mouse
ggtgcccgagtgttagggtg

SEQ ID NO: 642060 - DNA, 20 bp, mouse
gtaaagcctcccacgagggg

SEQ ID NO: 642061 - DNA, 20 bp, mouse
gcacacgctggaacacacat

SEQ ID NO: 642062 - DNA, 20 bp, mouse
ggtggcgccaactgctgaag

SEQ ID NO: 642063 - DNA, 20 bp, mouse
gtgaagaggaacggggtgtg

SEQ ID NO: 642064 - DNA, 20 bp, mouse
gtctctagacagacacacgc

SEQ ID NO: 642065 - DNA, 20 bp, mouse
gtttgtgtgcccgagtgtta

SEQ ID NO: 642066 - DNA, 20 bp, mouse
gaaagtgcgggtgataggac

SEQ ID NO: 642067 - DNA, 20 bp, mouse
gaactgtcgcctggggtctg

SEQ ID NO: 642068 - DNA, 20 bp, mouse
gaggggaagagctacggacc

SEQ ID NO: 642069 - DNA, 20 bp, mouse
gtgcagggaccccaccacta

SEQ ID NO: 642070 - DNA, 20 bp, mouse
gactagggagtcggtggcag

SEQ ID NO: 642071 - DNA, 20 bp, mouse
ggtaccggagggaaccctag

SEQ ID NO: 642072 - DNA, 20 bp, mouse
gcggagggaaccctagtggt

SEQ ID NO: 642073 - DNA, 20 bp, mouse
ggacaggaaactgtcgcctg

SEQ ID NO: 642074 - DNA, 20 bp, mouse
ggtagttactagggagtcgg

SEQ ID NO: 642075 - DNA, 20 bp, mouse
gggtggggtccctgcactcc

SEQ ID NO: 642076 - DNA, 20 bp, mouse
gaggcgggcgggtcttactg

SEQ ID NO: 642077 - DNA, 20 bp, mouse
gtactggggctcaggatcac

SEQ ID NO: 642078 - DNA, 20 bp, mouse
gagggccgtcagccatcgtg

SEQ ID NO: 642079 - DNA, 20 bp, mouse
gggaccggggcaccagcagc

SEQ ID NO: 642080 - DNA, 20 bp, mouse
gccacccttccactcgcaga

SEQ ID NO: 642081 - DNA, 20 bp, mouse
gcaggatcacaggtgaaagt

SEQ ID NO: 642082 - DNA, 20 bp, mouse
gcaggagatctaggcacgaa

SEQ ID NO: 642083 - DNA, 20 bp, mouse
gctcctgtgcgaggacactg

SEQ ID NO: 642084 - DNA, 20 bp, mouse
gtgtgctagacaagaccagc

SEQ ID NO: 642085 - DNA, 20 bp, mouse
gagagaaacgccccgaggga

SEQ ID NO: 642086 - DNA, 20 bp, mouse
gcaggcggagagggacccgt

SEQ ID NO: 642087 - DNA, 20 bp, mouse
gtctagacaggactagctgc

SEQ ID NO: 642088 - DNA, 20 bp, mouse
gaataggattgtgactagtg

SEQ ID NO: 642089 - DNA, 20 bp, mouse
ggactagctgcaggcggaga

SEQ ID NO: 642090 - DNA, 20 bp, mouse
gaggaggattgctagctctg

SEQ ID NO: 642091 - DNA, 20 bp, mouse
gtgctagctctggggcagaa

SEQ ID NO: 642092 - DNA, 20 bp, mouse
ggctagtcctgtctagaaat

SEQ ID NO: 642093 - DNA, 20 bp, mouse
gattgtgactagtgaggtgt

SEQ ID NO: 642094 - DNA, 20 bp, mouse
gcccacccccatttctagac

SEQ ID NO: 642095 - DNA, 20 bp, mouse
ggggcggcgctcctgtccgc

SEQ ID NO: 642096 - DNA, 20 bp, mouse
ggctcccagagaatcctctc

SEQ ID NO: 642097 - DNA, 20 bp, mouse
gagcaggcttgacaagtgtg

SEQ ID NO: 642098 - DNA, 20 bp, mouse
gtccccacatatcaacttaa

SEQ ID NO: 642099 - DNA, 20 bp, mouse
gcctgcttggggctctatca

SEQ ID NO: 642100 - DNA, 20 bp, mouse
gtgttggggggaggagctta

SEQ ID NO: 642101 - DNA, 20 bp, mouse
gtctacctgagaggattctc

SEQ ID NO: 642102 - DNA, 20 bp, mouse
gcacttgtcaagcctgcttg

SEQ ID NO: 642103 - DNA, 20 bp, mouse
ggttgtaaaaggttcttcat

SEQ ID NO: 642104 - DNA, 20 bp, mouse
gctccgcagtggtacatcaa

SEQ ID NO: 642105 - DNA, 20 bp, mouse
gaaggagaacggatatccca

SEQ ID NO: 642106 - DNA, 20 bp, mouse
gccaaggtggacaggaatag

SEQ ID NO: 642107 - DNA, 20 bp, mouse
gccccaggggacagtaggcc

SEQ ID NO: 642108 - DNA, 20 bp, mouse
gctactgtcccctggggccc

SEQ ID NO: 642109 - DNA, 20 bp, mouse
gtgaacaaattgtgccaagg

SEQ ID NO: 642110 - DNA, 20 bp, mouse
ggtaggccaggtctgcgcat

SEQ ID NO: 642111 - DNA, 20 bp, mouse
ggtatgaacaaattgtgcca

SEQ ID NO: 642112 - DNA, 20 bp, mouse
gagctgtgcagtggagttaa

SEQ ID NO: 642113 - DNA, 20 bp, mouse
gaaattgtgccaaggtggac

SEQ ID NO: 642114 - DNA, 20 bp, mouse
gtgggaggtactattttcca

SEQ ID NO: 642115 - DNA, 20 bp, mouse
ggggcccaagttccagatgt

SEQ ID NO: 642116 - DNA, 20 bp, mouse
gacagcaagagggttaagaa

SEQ ID NO: 642117 - DNA, 20 bp, mouse
gacacactctcattcaaaag

SEQ ID NO: 642118 - DNA, 20 bp, mouse
gtagtgggtggttgagactg

SEQ ID NO: 642119 - DNA, 20 bp, mouse
gctcaaccacccactagtga

SEQ ID NO: 642120 - DNA, 20 bp, mouse
gttaaccctcttgctgtgtt

SEQ ID NO: 642121 - DNA, 20 bp, mouse
gatggaaagcagaaaagaat

SEQ ID NO: 642122 - DNA, 20 bp, mouse
ggtggctttgccatcactag

SEQ ID NO: 642123 - DNA, 20 bp, mouse
gtcagtggatgcaaacaagc

SEQ ID NO: 642124 - DNA, 20 bp, mouse
gctttgccatcactagtggg

SEQ ID NO: 642125 - DNA, 20 bp, mouse
gagaccacagagaaggcgat

SEQ ID NO: 642126 - DNA, 20 bp, mouse
gaggcaaagcaaggtggcta

SEQ ID NO: 642127 - DNA, 20 bp, mouse
gaacagaggctggaaataac

SEQ ID NO: 642128 - DNA, 20 bp, mouse
ggaacaggtcccaagagtac

SEQ ID NO: 642129 - DNA, 20 bp, mouse
gaataacaggcaaagcaagg

SEQ ID NO: 642130 - DNA, 20 bp, mouse
gggaaataacaggcaaagca

SEQ ID NO: 642131 - DNA, 20 bp, mouse
gtcttgggacctgttcctgc

SEQ ID NO: 642132 - DNA, 20 bp, mouse
gtaacaggcaaaacagaggc

SEQ ID NO: 642133 - DNA, 20 bp, mouse
gcggaagtggatcacagccg

SEQ ID NO: 642134 - DNA, 20 bp, mouse
gccccgactggctatagcct

SEQ ID NO: 642135 - DNA, 20 bp, mouse
ggccgaggctatagccagtc

SEQ ID NO: 642136 - DNA, 20 bp, mouse
gttggcctggatcctaagta

SEQ ID NO: 642137 - DNA, 20 bp, mouse
gttgttgaataaaggacctt

SEQ ID NO: 642138 - DNA, 20 bp, mouse
gtctcagctgtttcaagcta

SEQ ID NO: 642139 - DNA, 20 bp, mouse
gcatgccttacttaggatcc

SEQ ID NO: 642140 - DNA, 20 bp, mouse
ggatgaaacctaatcccatg

SEQ ID NO: 642141 - DNA, 20 bp, mouse
gattcacggtgtattctggt

SEQ ID NO: 642142 - DNA, 20 bp, mouse
gagcaatgctagacacaaat

SEQ ID NO: 642143 - DNA, 20 bp, mouse
ggctgtttcaagctagggat

SEQ ID NO: 642144 - DNA, 20 bp, mouse
gaattaatgttgttgaataa

SEQ ID NO: 642145 - DNA, 20 bp, mouse
gagaatacaccgtgaatctg

SEQ ID NO: 642146 - DNA, 20 bp, mouse
ggaactaagctgcagcacat

SEQ ID NO: 642147 - DNA, 20 bp, mouse
gtgcacaagacatcttaggt

SEQ ID NO: 642148 - DNA, 20 bp, mouse
gtgtgctttaaaaaaccaag

SEQ ID NO: 642149 - DNA, 20 bp, mouse
gtaaagcacagatttactta

SEQ ID NO: 642150 - DNA, 20 bp, mouse
gcaggaagttaatgtaggag

SEQ ID NO: 642151 - DNA, 20 bp, mouse
ggtgctcagaaaacacttcg

SEQ ID NO: 642152 - DNA, 20 bp, mouse
gatggaatattactaccgaa

SEQ ID NO: 642153 - DNA, 20 bp, mouse
ggaatctctcccaagaggag

SEQ ID NO: 642154 - DNA, 20 bp, mouse
gctgtcttcagcacctggga

SEQ ID NO: 642155 - DNA, 20 bp, mouse
ggagctctgcccctcctctt

SEQ ID NO: 642156 - DNA, 20 bp, mouse
gtaggaagggtctgacctga

SEQ ID NO: 642157 - DNA, 20 bp, mouse
ggtggtggaactggccaggg

SEQ ID NO: 642158 - DNA, 20 bp, mouse
gcagtgaatgtggcatgttg

SEQ ID NO: 642159 - DNA, 20 bp, mouse
ggttggggaaactggatgtg

SEQ ID NO: 642160 - DNA, 20 bp, mouse
ggaagtggtggaactggcca

SEQ ID NO: 642161 - DNA, 20 bp, mouse
gactgagaaccatgacccac

SEQ ID NO: 642162 - DNA, 20 bp, mouse
ggggtcatggttctcagtct

SEQ ID NO: 642163 - DNA, 20 bp, mouse
gagtctcacattttagcctg

SEQ ID NO: 642164 - DNA, 20 bp, mouse
gcattttagcctgtgggtca

SEQ ID NO: 642165 - DNA, 20 bp, mouse
gagagctgagaacgcccagg

SEQ ID NO: 642166 - DNA, 20 bp, mouse
gctggggcaaggacaactac

SEQ ID NO: 642167 - DNA, 20 bp, mouse
gcggcggcggaagaccccgt

SEQ ID NO: 642168 - DNA, 20 bp, mouse
gcgcggagactgtggtccgg

SEQ ID NO: 642169 - DNA, 20 bp, mouse
gagcccggacgcggagactg

SEQ ID NO: 642170 - DNA, 20 bp, mouse
ggtcccggcaggtccgggtg

SEQ ID NO: 642171 - DNA, 20 bp, mouse
ggcgacccctcgcggccctg

SEQ ID NO: 642172 - DNA, 20 bp, mouse
gcgaaggtgtattcgctgtt

SEQ ID NO: 642173 - DNA, 20 bp, mouse
gggcgagcgcgcgatcgggg

SEQ ID NO: 642174 - DNA, 20 bp, mouse
gcgcgcgatcggggaggagc

SEQ ID NO: 642175 - DNA, 20 bp, mouse
gggacgcggagactgtggtc

SEQ ID NO: 642176 - DNA, 20 bp, mouse
gaaactggggcgaggaagac

SEQ ID NO: 642177 - DNA, 20 bp, mouse
gtggggcgaggaagactggc

SEQ ID NO: 642178 - DNA, 20 bp, mouse
gcaggacccgtaggcagctg

SEQ ID NO: 642179 - DNA, 20 bp, mouse
ggcccagcaggaagcggctg

SEQ ID NO: 642180 - DNA, 20 bp, mouse
gacaacttcctgtgtctaga

SEQ ID NO: 642181 - DNA, 20 bp, mouse
gcttcctcgccccagtttag

SEQ ID NO: 642182 - DNA, 20 bp, mouse
gcaaatccacatgtagccaa

SEQ ID NO: 642183 - DNA, 20 bp, mouse
gagagagatgagcgctgcta

SEQ ID NO: 642184 - DNA, 20 bp, mouse
gcactgacggttgttgtctt

SEQ ID NO: 642185 - DNA, 20 bp, mouse
gcatgcaccttagtactgtg

SEQ ID NO: 642186 - DNA, 20 bp, mouse
gtggggtggtaccaaaaaga

SEQ ID NO: 642187 - DNA, 20 bp, mouse
gctctggaaaaatccctctg

SEQ ID NO: 642188 - DNA, 20 bp, mouse
gctcacaggcttaacttatc

SEQ ID NO: 642189 - DNA, 20 bp, mouse
gagttcaagccttgcactga

SEQ ID NO: 642190 - DNA, 20 bp, mouse
gtagaagctacattagcaga

SEQ ID NO: 642191 - DNA, 20 bp, mouse
ggacagccaaggtcaggaca

SEQ ID NO: 642192 - DNA, 20 bp, mouse
ggtcaacacagtcatgagtg

SEQ ID NO: 642193 - DNA, 20 bp, mouse
gttcttgagccctcagtgca

SEQ ID NO: 642194 - DNA, 20 bp, mouse
gacggacattgtctccacag

SEQ ID NO: 642195 - DNA, 20 bp, mouse
gactgctcgtgaaagaagat

SEQ ID NO: 642196 - DNA, 20 bp, mouse
gagacccgagagagggaacg

SEQ ID NO: 642197 - DNA, 20 bp, mouse
gaaagctaggacctcgatct

SEQ ID NO: 642198 - DNA, 20 bp, mouse
ggagagagggaacgtggtac

SEQ ID NO: 642199 - DNA, 20 bp, mouse
gtgttcctgtaccgtgactg

SEQ ID NO: 642200 - DNA, 20 bp, mouse
gtttgcagagacccgagaga

SEQ ID NO: 642201 - DNA, 20 bp, mouse
gtaggacctcgatctggggt

SEQ ID NO: 642202 - DNA, 20 bp, mouse
gggaaagctaaatatgatta

SEQ ID NO: 642203 - DNA, 20 bp, mouse
gagtgctaccaccagaggtc

SEQ ID NO: 642204 - DNA, 20 bp, mouse
gttactgcaggaatgggggt

SEQ ID NO: 642205 - DNA, 20 bp, mouse
gactgcacctttagaaatac

SEQ ID NO: 642206 - DNA, 20 bp, mouse
gaaaccgcgaggactggagg

SEQ ID NO: 642207 - DNA, 20 bp, mouse
ggcgccgcctccagtcctcg

SEQ ID NO: 642208 - DNA, 20 bp, mouse
gggggcctctagaaaccgcg

SEQ ID NO: 642209 - DNA, 20 bp, mouse
gcctccttgggcttaagtgg

SEQ ID NO: 642210 - DNA, 20 bp, mouse
gcaccggcttgggacgggaa

SEQ ID NO: 642211 - DNA, 20 bp, mouse
gccacctccacttaagccca

SEQ ID NO: 642212 - DNA, 20 bp, mouse
gagcccaaggaggctgtagc

SEQ ID NO: 642213 - DNA, 20 bp, mouse
ggtagcaggctgttgttgtc

SEQ ID NO: 642214 - DNA, 20 bp, mouse
gggcgcggctacagctgagg

SEQ ID NO: 642215 - DNA, 20 bp, mouse
ggaggcgggcgtggttttcg

SEQ ID NO: 642216 - DNA, 20 bp, mouse
gtagtgcagaggattacctt

SEQ ID NO: 642217 - DNA, 20 bp, mouse
ggctggagtgggtgggtcgg

SEQ ID NO: 642218 - DNA, 20 bp, mouse
gggagggggagaaccttcat

SEQ ID NO: 642219 - DNA, 20 bp, mouse
gtataagggaatgtcagggc

SEQ ID NO: 642220 - DNA, 20 bp, mouse
gggggaggggatatggggta

SEQ ID NO: 642221 - DNA, 20 bp, mouse
gagaaccttcataggagcag

SEQ ID NO: 642222 - DNA, 20 bp, mouse
gtttcctgggaggggaaacc

SEQ ID NO: 642223 - DNA, 20 bp, mouse
gtatggggtaggggtttcct

SEQ ID NO: 642224 - DNA, 20 bp, mouse
gggtaggggtttcctgggag

SEQ ID NO: 642225 - DNA, 20 bp, mouse
ggtcctggggtttttttggt

SEQ ID NO: 642226 - DNA, 20 bp, mouse
gacagcaatactgtgtaaca

SEQ ID NO: 642227 - DNA, 20 bp, mouse
ggaaactgaacccaaatcta

SEQ ID NO: 642228 - DNA, 20 bp, mouse
gccagtacagttgtctacta

SEQ ID NO: 642229 - DNA, 20 bp, mouse
gagccctccaaagctcttac

SEQ ID NO: 642230 - DNA, 20 bp, mouse
gttcctgtaagagctttgga

SEQ ID NO: 642231 - DNA, 20 bp, mouse
gacaccacagccatagattt

SEQ ID NO: 642232 - DNA, 20 bp, mouse
ggaaaaaccaagtactgtgc

SEQ ID NO: 642233 - DNA, 20 bp, mouse
gcaacatgagctgacagaca

SEQ ID NO: 642234 - DNA, 20 bp, mouse
gcctgcggaccagatagcca

SEQ ID NO: 642235 - DNA, 20 bp, mouse
gagaatccctaaaaggttat

SEQ ID NO: 642236 - DNA, 20 bp, mouse
gttgcccacaatatcctctg

SEQ ID NO: 642237 - DNA, 20 bp, mouse
gagacaacgactgtaatacg

SEQ ID NO: 642238 - DNA, 20 bp, mouse
gtgcctgcatgctcatagaa

SEQ ID NO: 642239 - DNA, 20 bp, mouse
ggtaaggaattaaatatgat

SEQ ID NO: 642240 - DNA, 20 bp, mouse
gtagtagccttctgagtcct

SEQ ID NO: 642241 - DNA, 20 bp, mouse
ggggaaagcctttgcctcag

SEQ ID NO: 642242 - DNA, 20 bp, mouse
gtttgcctcagaggatattg

SEQ ID NO: 642243 - DNA, 20 bp, mouse
gtcacatatgattttcaggc

SEQ ID NO: 642244 - DNA, 20 bp, mouse
gcagcatcactcagttgttt

SEQ ID NO: 642245 - DNA, 20 bp, mouse
gaaaaaggtggtgattagta

SEQ ID NO: 642246 - DNA, 20 bp, mouse
gattacagctcaacaggata

SEQ ID NO: 642247 - DNA, 20 bp, mouse
gatggtagagagcgtaactt

SEQ ID NO: 642248 - DNA, 20 bp, mouse
gaactttggcaacagttaga

SEQ ID NO: 642249 - DNA, 20 bp, mouse
ggtaacaaacatgaacacag

SEQ ID NO: 642250 - DNA, 20 bp, mouse
gctcaggaacaaggtcaccc

SEQ ID NO: 642251 - DNA, 20 bp, mouse
gaccttgttcctgagtaaac

SEQ ID NO: 642252 - DNA, 20 bp, mouse
gaaagtttcactggcggtcg

SEQ ID NO: 642253 - DNA, 20 bp, mouse
gatattaaaagtttcactgg

SEQ ID NO: 642254 - DNA, 20 bp, mouse
gtagatctgagtggcaaatt

SEQ ID NO: 642255 - DNA, 20 bp, mouse
gtgcagtaaatgaccatgta

SEQ ID NO: 642256 - DNA, 20 bp, mouse
ggcccccagaggctgggcca

SEQ ID NO: 642257 - DNA, 20 bp, mouse
gcccccgtgacacttccaca

SEQ ID NO: 642258 - DNA, 20 bp, mouse
ggccctgtggaagtgtcacg

SEQ ID NO: 642259 - DNA, 20 bp, mouse
ggtggcacaaaagcccccag

SEQ ID NO: 642260 - DNA, 20 bp, mouse
ggcgtccaagctctgaagtt

SEQ ID NO: 642261 - DNA, 20 bp, mouse
gtggacgcctctccttagtt

SEQ ID NO: 642262 - DNA, 20 bp, mouse
gatgctggtgccattaataa

SEQ ID NO: 642263 - DNA, 20 bp, mouse
ggccagggaggcctatgcca

SEQ ID NO: 642264 - DNA, 20 bp, mouse
gcaagctctgaagtttggta

SEQ ID NO: 642265 - DNA, 20 bp, mouse
gttgggaaaaccaaacatct

SEQ ID NO: 642266 - DNA, 20 bp, mouse
ggaggggccaaggatatcag

SEQ ID NO: 642267 - DNA, 20 bp, mouse
gtgggtcccccctttattcc

SEQ ID NO: 642268 - DNA, 20 bp, mouse
ggcaggagtccaggaataaa

SEQ ID NO: 642269 - DNA, 20 bp, mouse
gtatccttggcccctcagga

SEQ ID NO: 642270 - DNA, 20 bp, mouse
gctcctgcgactggttctaa

SEQ ID NO: 642271 - DNA, 20 bp, mouse
gcaatgctgcccctcctgag

SEQ ID NO: 642272 - DNA, 20 bp, mouse
ggcaccatatagtccatata

SEQ ID NO: 642273 - DNA, 20 bp, mouse
ggaaccagtcgcaggagtcc

SEQ ID NO: 642274 - DNA, 20 bp, mouse
ggaggccacagggggtctct

SEQ ID NO: 642275 - DNA, 20 bp, mouse
gtcaaagtcactcttcagct

SEQ ID NO: 642276 - DNA, 20 bp, mouse
ggcaaagataagcatctcag

SEQ ID NO: 642277 - DNA, 20 bp, mouse
gtagctgctcggctgtgcga

SEQ ID NO: 642278 - DNA, 20 bp, mouse
ggcctggggcccagacgcca

SEQ ID NO: 642279 - DNA, 20 bp, mouse
gccttctgagaagcactgtg

SEQ ID NO: 642280 - DNA, 20 bp, mouse
gaagtgctcacatctgtgtc

SEQ ID NO: 642281 - DNA, 20 bp, mouse
gtcacccaggcagaaagact

SEQ ID NO: 642282 - DNA, 20 bp, mouse
ggctctcactcactgtgaga

SEQ ID NO: 642283 - DNA, 20 bp, mouse
ggtctgtgggagatcagaac

SEQ ID NO: 642284 - DNA, 20 bp, mouse
ggagagctgtgcacgggact

SEQ ID NO: 642285 - DNA, 20 bp, mouse
gtggcctcccgaactcaccc

SEQ ID NO: 642286 - DNA, 20 bp, mouse
gagtgatgaaggtaggatat

SEQ ID NO: 642287 - DNA, 20 bp, mouse
gtataagcacaaggaaggag

SEQ ID NO: 642288 - DNA, 20 bp, mouse
gctagattagacattagctc

SEQ ID NO: 642289 - DNA, 20 bp, mouse
gcatggcttggcattctatt

SEQ ID NO: 642290 - DNA, 20 bp, mouse
gctctggtagctgataaatc

SEQ ID NO: 642291 - DNA, 20 bp, mouse
gtggtagctgataaatctgg

SEQ ID NO: 642292 - DNA, 20 bp, mouse
ggaggtgcagtcacataaaa

SEQ ID NO: 642293 - DNA, 20 bp, mouse
gaggatatgggctttctgca

SEQ ID NO: 642294 - DNA, 20 bp, mouse
ggagtagttctcagaaatgg

SEQ ID NO: 642295 - DNA, 20 bp, mouse
gctgatggacagtcatattc

SEQ ID NO: 642296 - DNA, 20 bp, mouse
ggtgtggagatcatgctata

SEQ ID NO: 642297 - DNA, 20 bp, mouse
gcagcacgtttgtgttctgg

SEQ ID NO: 642298 - DNA, 20 bp, mouse
gagagcaagaaaagcctcaa

SEQ ID NO: 642299 - DNA, 20 bp, mouse
gtcacccttagtccaagcct

SEQ ID NO: 642300 - DNA, 20 bp, mouse
gggcagagatcatagccgtg

SEQ ID NO: 642301 - DNA, 20 bp, mouse
gggtcagcacgtttgtgttc

SEQ ID NO: 642302 - DNA, 20 bp, mouse
ggaaaagtcacctcccagca

SEQ ID NO: 642303 - DNA, 20 bp, mouse
gttgggggtgggagtaaccg

SEQ ID NO: 642304 - DNA, 20 bp, mouse
gggtgacttttcaggcattg

SEQ ID NO: 642305 - DNA, 20 bp, mouse
gcaaaggcaaggttggcctc

SEQ ID NO: 642306 - DNA, 20 bp, mouse
gcccagggaaagccagtgaa

SEQ ID NO: 642307 - DNA, 20 bp, mouse
gccaagcactaacgagtcac

SEQ ID NO: 642308 - DNA, 20 bp, mouse
gtatccgcttctcctgttgg

SEQ ID NO: 642309 - DNA, 20 bp, mouse
gacagggacagataggagat

SEQ ID NO: 642310 - DNA, 20 bp, mouse
gaatgtgtcaaggttctaga

SEQ ID NO: 642311 - DNA, 20 bp, mouse
gacgagtcacagggacagat

SEQ ID NO: 642312 - DNA, 20 bp, mouse
gttgtgctgtagtccaagtc

SEQ ID NO: 642313 - DNA, 20 bp, mouse
gtagtccaagtctggtttta

SEQ ID NO: 642314 - DNA, 20 bp, mouse
gttatcctggttgggaagtt

SEQ ID NO: 642315 - DNA, 20 bp, mouse
gcagtgaaaggaatgtgtca

SEQ ID NO: 642316 - DNA, 20 bp, mouse
ggggctctgcagagcgcccg

SEQ ID NO: 642317 - DNA, 20 bp, mouse
gtggaggagcgcgcggtcgc

SEQ ID NO: 642318 - DNA, 20 bp, mouse
gcctcgcgaggcacagacag

SEQ ID NO: 642319 - DNA, 20 bp, mouse
ggtcgccggctgtcgtgcac

SEQ ID NO: 642320 - DNA, 20 bp, mouse
gcccactcacgggctggcga

SEQ ID NO: 642321 - DNA, 20 bp, mouse
gtctgcagagcgcccggggc

SEQ ID NO: 642322 - DNA, 20 bp, mouse
gagtgggtgcaggcgtatgt

SEQ ID NO: 642323 - DNA, 20 bp, mouse
gcggggcagcaggcctcgcg

SEQ ID NO: 642324 - DNA, 20 bp, mouse
gggactgcgtccccaggcct

SEQ ID NO: 642325 - DNA, 20 bp, mouse
ggaggaccgtgcaccctatg

SEQ ID NO: 642326 - DNA, 20 bp, mouse
gactgcgtagactgatgggg

SEQ ID NO: 642327 - DNA, 20 bp, mouse
ggccccttgttcactgtggt

SEQ ID NO: 642328 - DNA, 20 bp, mouse
ggactcaaagcgcagcgcta

SEQ ID NO: 642329 - DNA, 20 bp, mouse
ggaacaaggggcgatcccag

SEQ ID NO: 642330 - DNA, 20 bp, mouse
gtcccagcggttccgggagt

SEQ ID NO: 642331 - DNA, 20 bp, mouse
ggaaagctgccagaggctag

SEQ ID NO: 642332 - DNA, 20 bp, mouse
ggggcgatcccagcggttcc

SEQ ID NO: 642333 - DNA, 20 bp, mouse
ggcagaccggatctccgcga

SEQ ID NO: 642334 - DNA, 20 bp, mouse
gggatctccgcgaggggcaa

SEQ ID NO: 642335 - DNA, 20 bp, mouse
ggaggaaaggcacaggacgc

SEQ ID NO: 642336 - DNA, 20 bp, mouse
gaatgagcctgaagatgttc

SEQ ID NO: 642337 - DNA, 20 bp, mouse
ggcccagccggaacatcttc

SEQ ID NO: 642338 - DNA, 20 bp, mouse
gtgtcaggatggttgttatt

SEQ ID NO: 642339 - DNA, 20 bp, mouse
gaagcgaagctacccctgtc

SEQ ID NO: 642340 - DNA, 20 bp, mouse
ggtgtgcagcgggagaaacc

SEQ ID NO: 642341 - DNA, 20 bp, mouse
gcaagctgcaggaatttgtc

SEQ ID NO: 642342 - DNA, 20 bp, mouse
ggcgaggctagcctgcagaa

SEQ ID NO: 642343 - DNA, 20 bp, mouse
gtgtgtggtgtaaggtagga

SEQ ID NO: 642344 - DNA, 20 bp, mouse
gagcctgaagatgttccggc

SEQ ID NO: 642345 - DNA, 20 bp, mouse
gttcgcttgctttgtttcca

SEQ ID NO: 642346 - DNA, 20 bp, mouse
gggctctgttgggattctgt

SEQ ID NO: 642347 - DNA, 20 bp, mouse
gtgtcagctgggctgttacc

SEQ ID NO: 642348 - DNA, 20 bp, mouse
gtctgtagggatatgatgca

SEQ ID NO: 642349 - DNA, 20 bp, mouse
gtggaaaccacccgccactc

SEQ ID NO: 642350 - DNA, 20 bp, mouse
gcctaaagaacaagtggccc

SEQ ID NO: 642351 - DNA, 20 bp, mouse
gcaagacacggactgtccct

SEQ ID NO: 642352 - DNA, 20 bp, mouse
ggagtcacctgagtggcggg

SEQ ID NO: 642353 - DNA, 20 bp, mouse
gagaatcccaacagagccca

SEQ ID NO: 642354 - DNA, 20 bp, mouse
ggatatgatgcagggatgct

SEQ ID NO: 642355 - DNA, 20 bp, mouse
gtaggagccctccttctatg

SEQ ID NO: 642356 - DNA, 20 bp, mouse
ggagaagcagcttcggcatc

SEQ ID NO: 642357 - DNA, 20 bp, mouse
gggactggctgtctcccagc

SEQ ID NO: 642358 - DNA, 20 bp, mouse
gtgtctcccagcagggtgag

SEQ ID NO: 642359 - DNA, 20 bp, mouse
gtggagtgtctgcctgggac

SEQ ID NO: 642360 - DNA, 20 bp, mouse
gtcaaggacatcgcacccac

SEQ ID NO: 642361 - DNA, 20 bp, mouse
gtctggcagggacttttagt

SEQ ID NO: 642362 - DNA, 20 bp, mouse
ggaacttcctctcaccctgc

SEQ ID NO: 642363 - DNA, 20 bp, mouse
gagctcgttgtgagatttat

SEQ ID NO: 642364 - DNA, 20 bp, mouse
ggatgtccttgatgcccttg

SEQ ID NO: 642365 - DNA, 20 bp, mouse
ggctggccacaagggcatca

SEQ ID NO: 642366 - DNA, 20 bp, mouse
ggggactcaaattacaaatt

SEQ ID NO: 642367 - DNA, 20 bp, mouse
ggcccaaaatgtgaccaggc

SEQ ID NO: 642368 - DNA, 20 bp, mouse
gagcgcatgctcagaagggg

SEQ ID NO: 642369 - DNA, 20 bp, mouse
ggctctcgggagttcagctg

SEQ ID NO: 642370 - DNA, 20 bp, mouse
gtgggaagggactatcaact

SEQ ID NO: 642371 - DNA, 20 bp, mouse
gtaattagtgaactgtgcag

SEQ ID NO: 642372 - DNA, 20 bp, mouse
gcaccagcttggcctgggaa

SEQ ID NO: 642373 - DNA, 20 bp, mouse
gggcaaattcaattaagttg

SEQ ID NO: 642374 - DNA, 20 bp, mouse
ggggtggtcccatttaccaa

SEQ ID NO: 642375 - DNA, 20 bp, mouse
gtttgggcatttgtgacttt

SEQ ID NO: 642376 - DNA, 20 bp, mouse
gagagctggggtcactgaaa

SEQ ID NO: 642377 - DNA, 20 bp, mouse
gtgacagcaaacagctcctt

SEQ ID NO: 642378 - DNA, 20 bp, mouse
gttgcaggctccatagggtg

SEQ ID NO: 642379 - DNA, 20 bp, mouse
gggagctgatgctaacaagg

SEQ ID NO: 642380 - DNA, 20 bp, mouse
gtggggtcactgaaatggaa

SEQ ID NO: 642381 - DNA, 20 bp, mouse
gtcacaggaggggagatgat

SEQ ID NO: 642382 - DNA, 20 bp, mouse
gagcctgcaaagccattgaa

SEQ ID NO: 642383 - DNA, 20 bp, mouse
gtgggatactcaagaccaca

SEQ ID NO: 642384 - DNA, 20 bp, mouse
gcagacaactttcacttcac

SEQ ID NO: 642385 - DNA, 20 bp, mouse
gagggggtggagcgacacgc

SEQ ID NO: 642386 - DNA, 20 bp, mouse
gagctgtcgcaggacccgca

SEQ ID NO: 642387 - DNA, 20 bp, mouse
ggccagaagcgtgacggacg

SEQ ID NO: 642388 - DNA, 20 bp, mouse
gctggtgggtggtctcgcgt

SEQ ID NO: 642389 - DNA, 20 bp, mouse
ggcgatagtcgctgtaaaca

SEQ ID NO: 642390 - DNA, 20 bp, mouse
gctggccgccagaagcgtga

SEQ ID NO: 642391 - DNA, 20 bp, mouse
gctaaactggagggggtgtt

SEQ ID NO: 642392 - DNA, 20 bp, mouse
ggcgactatcgctgcggcgc

SEQ ID NO: 642393 - DNA, 20 bp, mouse
gccgggggtgtgtacaacag

SEQ ID NO: 642394 - DNA, 20 bp, mouse
ggggcgtgaagctaaactgg

SEQ ID NO: 642395 - DNA, 20 bp, mouse
gcacccccggcgcaccacgt

SEQ ID NO: 642396 - DNA, 20 bp, mouse
gaaccctgaagggtgggcta

SEQ ID NO: 642397 - DNA, 20 bp, mouse
gtggcgcagttcccagacgt

SEQ ID NO: 642398 - DNA, 20 bp, mouse
gccggctcgcgtcctacgtc

SEQ ID NO: 642399 - DNA, 20 bp, mouse
gtgaagggtgggctacggag

SEQ ID NO: 642400 - DNA, 20 bp, mouse
gaatcacaaaccctgaaggg

SEQ ID NO: 642401 - DNA, 20 bp, mouse
ggagaatcacaaaccctgaa

SEQ ID NO: 642402 - DNA, 20 bp, mouse
gttcccgcccggggccgcac

SEQ ID NO: 642403 - DNA, 20 bp, mouse
ggaagcccatgcggtccgaa

SEQ ID NO: 642404 - DNA, 20 bp, mouse
gccggggcacctctggcgct

SEQ ID NO: 642405 - DNA, 20 bp, mouse
gacggtgcaaggggcttgtt

SEQ ID NO: 642406 - DNA, 20 bp, mouse
gggctcttgcagatccctcc

SEQ ID NO: 642407 - DNA, 20 bp, mouse
gcctgtggacgattctactg

SEQ ID NO: 642408 - DNA, 20 bp, mouse
gtagaatcgtccacaggcac

SEQ ID NO: 642409 - DNA, 20 bp, mouse
gctccaggcggggaagagtc

SEQ ID NO: 642410 - DNA, 20 bp, mouse
gcgagaccctcctccgggat

SEQ ID NO: 642411 - DNA, 20 bp, mouse
gcccacgcagcgctagagat

SEQ ID NO: 642412 - DNA, 20 bp, mouse
gtgggccacccacaaggttc

SEQ ID NO: 642413 - DNA, 20 bp, mouse
ggcgcgcgcgtcaccccggt

SEQ ID NO: 642414 - DNA, 20 bp, mouse
gtgcggaagtacaccgaccg

SEQ ID NO: 642415 - DNA, 20 bp, mouse
gaggcacaggtgacgactgc

SEQ ID NO: 642416 - DNA, 20 bp, mouse
gggagtaagtagattcggga

SEQ ID NO: 642417 - DNA, 20 bp, mouse
gttcgggaaggaataatgac

SEQ ID NO: 642418 - DNA, 20 bp, mouse
gcttaggagtaagtagattc

SEQ ID NO: 642419 - DNA, 20 bp, mouse
ggacatcattgatgtagctt

SEQ ID NO: 642420 - DNA, 20 bp, mouse
ggctgtgcgtggtaagctgt

SEQ ID NO: 642421 - DNA, 20 bp, mouse
ggagtacatgctatttatgc

SEQ ID NO: 642422 - DNA, 20 bp, mouse
ggatatgaaaaggtttagga

SEQ ID NO: 642423 - DNA, 20 bp, mouse
gggtaagctgtgggccttcc

SEQ ID NO: 642424 - DNA, 20 bp, mouse
ggatttgttgctggaacaca

SEQ ID NO: 642425 - DNA, 20 bp, mouse
gaacacagggctttacgtgc

SEQ ID NO: 642426 - DNA, 20 bp, mouse
gctagtgaaggcagagcgct

SEQ ID NO: 642427 - DNA, 20 bp, mouse
gccgcctcggggagcagctt

SEQ ID NO: 642428 - DNA, 20 bp, mouse
gacggtgtgcgcccagctcc

SEQ ID NO: 642429 - DNA, 20 bp, mouse
gaagccggagatgagaacta

SEQ ID NO: 642430 - DNA, 20 bp, mouse
gacacctctggctacagctc

SEQ ID NO: 642431 - DNA, 20 bp, mouse
ggtgcttgttggctactcct

SEQ ID NO: 642432 - DNA, 20 bp, mouse
gcaggcagcaacgccggttg

SEQ ID NO: 642433 - DNA, 20 bp, mouse
gtctcatcccagcctagtga

SEQ ID NO: 642434 - DNA, 20 bp, mouse
gactgcgggtgtagctgcca

SEQ ID NO: 642435 - DNA, 20 bp, mouse
ggggagcgagcaccgcctcg

SEQ ID NO: 642436 - DNA, 20 bp, mouse
gacagatagcggccctgata

SEQ ID NO: 642437 - DNA, 20 bp, mouse
gtgaaacctgcaccctatca

SEQ ID NO: 642438 - DNA, 20 bp, mouse
gagcggccctgatagggtgc

SEQ ID NO: 642439 - DNA, 20 bp, mouse
gacttcttcaagacgaaggt

SEQ ID NO: 642440 - DNA, 20 bp, mouse
ggaaccgcagaacctttcag

SEQ ID NO: 642441 - DNA, 20 bp, mouse
ggcacttgtttcagattcca

SEQ ID NO: 642442 - DNA, 20 bp, mouse
gccagacttcttcaagacga

SEQ ID NO: 642443 - DNA, 20 bp, mouse
gctttctgtacagactttta

SEQ ID NO: 642444 - DNA, 20 bp, mouse
gggctttcaaaggaactccc

SEQ ID NO: 642445 - DNA, 20 bp, mouse
gtcactattgttacctgaag

SEQ ID NO: 642446 - DNA, 20 bp, mouse
gaagtggcacctacccctca

SEQ ID NO: 642447 - DNA, 20 bp, mouse
gaggggtaggtgccacttcc

SEQ ID NO: 642448 - DNA, 20 bp, mouse
gtccaggatcatcccggaag

SEQ ID NO: 642449 - DNA, 20 bp, mouse
gaggggtaacgtttccctga

SEQ ID NO: 642450 - DNA, 20 bp, mouse
gctggaaatggtactcaaaa

SEQ ID NO: 642451 - DNA, 20 bp, mouse
gttgctgaaaccaaatctag

SEQ ID NO: 642452 - DNA, 20 bp, mouse
ggaaacgttacccctagatt

SEQ ID NO: 642453 - DNA, 20 bp, mouse
gtccgggatgatcctggaaa

SEQ ID NO: 642454 - DNA, 20 bp, mouse
gtaacgtttccctgaggggt

SEQ ID NO: 642455 - DNA, 20 bp, mouse
gtggaggccagagccctgca

SEQ ID NO: 642456 - DNA, 20 bp, mouse
gcgtgcatttggttcttcca

SEQ ID NO: 642457 - DNA, 20 bp, mouse
gaaggggcaaagttcttgat

SEQ ID NO: 642458 - DNA, 20 bp, mouse
gggaaccgtttcccccttta

SEQ ID NO: 642459 - DNA, 20 bp, mouse
gtggtgttaaacgtgaacag

SEQ ID NO: 642460 - DNA, 20 bp, mouse
gaagcagaagcagggagcga

SEQ ID NO: 642461 - DNA, 20 bp, mouse
gacaccaaacagccttaaag

SEQ ID NO: 642462 - DNA, 20 bp, mouse
gcgaagagctggtaaaacag

SEQ ID NO: 642463 - DNA, 20 bp, mouse
gagcgagcacctgtgcgcgc

SEQ ID NO: 642464 - DNA, 20 bp, mouse
gaatgcacgcgcccgccctc

SEQ ID NO: 642465 - DNA, 20 bp, mouse
ggagttccgaccaccttccg

SEQ ID NO: 642466 - DNA, 20 bp, mouse
gccgcccaaacttgccttca

SEQ ID NO: 642467 - DNA, 20 bp, mouse
gtgctggctgcgctctccca

SEQ ID NO: 642468 - DNA, 20 bp, mouse
gactgtgggcggggccagag

SEQ ID NO: 642469 - DNA, 20 bp, mouse
ggggaccagaccattccgga

SEQ ID NO: 642470 - DNA, 20 bp, mouse
ggagcccgcgggcgccgtct

SEQ ID NO: 642471 - DNA, 20 bp, mouse
gcccgcgggcgccgtctggg

SEQ ID NO: 642472 - DNA, 20 bp, mouse
gcccgcccagacggcgcccg

SEQ ID NO: 642473 - DNA, 20 bp, mouse
gaccccaggtggtgcaagtc

SEQ ID NO: 642474 - DNA, 20 bp, mouse
gcccaaacttgccttcaagg

SEQ ID NO: 642475 - DNA, 20 bp, mouse
gactctggagttgaggatcg

SEQ ID NO: 642476 - DNA, 20 bp, mouse
gttgggcaataaactctcct

SEQ ID NO: 642477 - DNA, 20 bp, mouse
ggcgaaccgtttaaaccttg

SEQ ID NO: 642478 - DNA, 20 bp, mouse
ggatcggaaagccacttcaa

SEQ ID NO: 642479 - DNA, 20 bp, mouse
ggaagcagttaggctgttat

SEQ ID NO: 642480 - DNA, 20 bp, mouse
gtattccggaggaagcagtt

SEQ ID NO: 642481 - DNA, 20 bp, mouse
gtattagtcgctcctcgcgg

SEQ ID NO: 642482 - DNA, 20 bp, mouse
gaaccgtttaaaccttgggg

SEQ ID NO: 642483 - DNA, 20 bp, mouse
gctaatagattatgcattgt

SEQ ID NO: 642484 - DNA, 20 bp, mouse
ggagagggtagtccacccca

SEQ ID NO: 642485 - DNA, 20 bp, mouse
ggggccttagtggtagacat

SEQ ID NO: 642486 - DNA, 20 bp, mouse
ggaccggagtgtagcgggat

SEQ ID NO: 642487 - DNA, 20 bp, mouse
gtggctgtcgagcctcgcaa

SEQ ID NO: 642488 - DNA, 20 bp, mouse
gactggctcccgggtctgag

SEQ ID NO: 642489 - DNA, 20 bp, mouse
gcccggagaccggagtgtag

SEQ ID NO: 642490 - DNA, 20 bp, mouse
gcaacggtgcctacggacgg

SEQ ID NO: 642491 - DNA, 20 bp, mouse
gctgtcgagcctcgcaacgg

SEQ ID NO: 642492 - DNA, 20 bp, mouse
gtctcggggtgcccggagac

SEQ ID NO: 642493 - DNA, 20 bp, mouse
gagtcgccacccggcgtcac

SEQ ID NO: 642494 - DNA, 20 bp, mouse
gccccggcaggggaccgagc

SEQ ID NO: 642495 - DNA, 20 bp, mouse
gcccgctacactccggtctc

SEQ ID NO: 642496 - DNA, 20 bp, mouse
gccacccagaggtgtcacat

SEQ ID NO: 642497 - DNA, 20 bp, mouse
gtaccatctaaggaggcccc

SEQ ID NO: 642498 - DNA, 20 bp, mouse
gtgacacagcaaacggtaaa

SEQ ID NO: 642499 - DNA, 20 bp, mouse
gagaatgctctgtcttgctg

SEQ ID NO: 642500 - DNA, 20 bp, mouse
gtctgcctatgtgacacctc

SEQ ID NO: 642501 - DNA, 20 bp, mouse
gagacagagcattcttcact

SEQ ID NO: 642502 - DNA, 20 bp, mouse
gagcttgccaagcgtttcct

SEQ ID NO: 642503 - DNA, 20 bp, mouse
ggggaatttaccatctaagg

SEQ ID NO: 642504 - DNA, 20 bp, mouse
gaagagtattcagctccgac

SEQ ID NO: 642505 - DNA, 20 bp, mouse
gatatctgagtctataaatg

SEQ ID NO: 642506 - DNA, 20 bp, mouse
gatagccctgattagaagag

SEQ ID NO: 642507 - DNA, 20 bp, mouse
gcccaggccggaagctgggg

SEQ ID NO: 642508 - DNA, 20 bp, mouse
gggagccactcttctaatca

SEQ ID NO: 642509 - DNA, 20 bp, mouse
gttgactcccagttcctccc

SEQ ID NO: 642510 - DNA, 20 bp, mouse
gccttcccaggccggaagct

SEQ ID NO: 642511 - DNA, 20 bp, mouse
gactaagtctttatccaata

SEQ ID NO: 642512 - DNA, 20 bp, mouse
gaagactcttgttctgtccc

SEQ ID NO: 642513 - DNA, 20 bp, mouse
gttctgtcccgggaggaact

SEQ ID NO: 642514 - DNA, 20 bp, mouse
gactcttgttctgtcccggg

SEQ ID NO: 642515 - DNA, 20 bp, mouse
gttagaagagtggctccttc

SEQ ID NO: 642516 - DNA, 20 bp, mouse
gtacccgcttagagactcgg

SEQ ID NO: 642517 - DNA, 20 bp, mouse
gaccggggacctaaagtcta

SEQ ID NO: 642518 - DNA, 20 bp, mouse
ggagtctctaagcgggtaat

SEQ ID NO: 642519 - DNA, 20 bp, mouse
gtcacctccgagtctctaag

SEQ ID NO: 642520 - DNA, 20 bp, mouse
gagtctgtgcagtctagggt

SEQ ID NO: 642521 - DNA, 20 bp, mouse
gcggaagctctgtctctgat

SEQ ID NO: 642522 - DNA, 20 bp, mouse
gcagtctagggtaggagaat

SEQ ID NO: 642523 - DNA, 20 bp, mouse
gggcgccgttaggtgagacc

SEQ ID NO: 642524 - DNA, 20 bp, mouse
gaggctgcagtgagactttg

SEQ ID NO: 642525 - DNA, 20 bp, mouse
gggggactgcaattattaaa

SEQ ID NO: 642526 - DNA, 20 bp, mouse
gaggggggagaggcggaagc

SEQ ID NO: 642527 - DNA, 20 bp, mouse
gtagtacaacagtttggtta

SEQ ID NO: 642528 - DNA, 20 bp, mouse
gcaaactgttgtactagata

SEQ ID NO: 642529 - DNA, 20 bp, mouse
gtattagataagaagaatat

SEQ ID NO: 642530 - DNA, 20 bp, mouse
gggttaaggaagtaacatga

SEQ ID NO: 642531 - DNA, 20 bp, mouse
gcgctggcacagacacggcc

SEQ ID NO: 642532 - DNA, 20 bp, mouse
gactaagtagtagatttctc

SEQ ID NO: 642533 - DNA, 20 bp, mouse
gttgcacgctggcacagaca

SEQ ID NO: 642534 - DNA, 20 bp, mouse
gtctctgaaccccaaacaca

SEQ ID NO: 642535 - DNA, 20 bp, mouse
gtaataactccttgtgtttg

SEQ ID NO: 642536 - DNA, 20 bp, mouse
gccgcccaagggtagagtgc

SEQ ID NO: 642537 - DNA, 20 bp, mouse
ggggcagaaactagggaagt

SEQ ID NO: 642538 - DNA, 20 bp, mouse
gtgcggcggcgctggggcaa

SEQ ID NO: 642539 - DNA, 20 bp, mouse
gtcgcctgcactctaccctt

SEQ ID NO: 642540 - DNA, 20 bp, mouse
gagcctaagccggcgaccgg

SEQ ID NO: 642541 - DNA, 20 bp, mouse
ggccaacggcgcacgacctg

SEQ ID NO: 642542 - DNA, 20 bp, mouse
gaacggcgcacgacctgcgg

SEQ ID NO: 642543 - DNA, 20 bp, mouse
gtaagccggcgaccgggggg

SEQ ID NO: 642544 - DNA, 20 bp, mouse
gggggcacgctgagagctag

SEQ ID NO: 642545 - DNA, 20 bp, mouse
gcggcttaggctctcacttg

SEQ ID NO: 642546 - DNA, 20 bp, mouse
gcggagaggcaggttctcat

SEQ ID NO: 642547 - DNA, 20 bp, mouse
gcggacttttatttaaggca

SEQ ID NO: 642548 - DNA, 20 bp, mouse
ggggcaccagcgcacactgc

SEQ ID NO: 642549 - DNA, 20 bp, mouse
gcctgagaagcaggtgggcg

SEQ ID NO: 642550 - DNA, 20 bp, mouse
gtgccagctactgagggagg

SEQ ID NO: 642551 - DNA, 20 bp, mouse
gctcaggcgctccggagcgc

SEQ ID NO: 642552 - DNA, 20 bp, mouse
gtccggagcgcctgagaagc

SEQ ID NO: 642553 - DNA, 20 bp, mouse
gctcctcctccctcagtagc

SEQ ID NO: 642554 - DNA, 20 bp, mouse
gctcctggaagtccaatcat

SEQ ID NO: 642555 - DNA, 20 bp, mouse
gacttagcagttagaaagga

SEQ ID NO: 642556 - DNA, 20 bp, mouse
gcgtcagcacgcatcagtca

SEQ ID NO: 642557 - DNA, 20 bp, mouse
gctggaggctccctgtccta

SEQ ID NO: 642558 - DNA, 20 bp, mouse
ggtccccgcagcggcaagag

SEQ ID NO: 642559 - DNA, 20 bp, mouse
gggggctgaaccctaggaca

SEQ ID NO: 642560 - DNA, 20 bp, mouse
gcacccaaatcagggccttg

SEQ ID NO: 642561 - DNA, 20 bp, mouse
gcgggtagagcaaggggtgt

SEQ ID NO: 642562 - DNA, 20 bp, mouse
gggagcctccagagcggact

SEQ ID NO: 642563 - DNA, 20 bp, mouse
ggggaccctaaggctcgtcc

SEQ ID NO: 642564 - DNA, 20 bp, mouse
gagccccaaggccctgattt

SEQ ID NO: 642565 - DNA, 20 bp, mouse
gcgcctgcccacccaaatca

SEQ ID NO: 642566 - DNA, 20 bp, mouse
gcaaagggaacgcaaacgtt

SEQ ID NO: 642567 - DNA, 20 bp, mouse
ggggaaaattgcaaagcaaa

SEQ ID NO: 642568 - DNA, 20 bp, mouse
gtccctccttccaaacctgt

SEQ ID NO: 642569 - DNA, 20 bp, mouse
gtcacaagagtgtgttgagt

SEQ ID NO: 642570 - DNA, 20 bp, mouse
ggacctacaggtttggaagg

SEQ ID NO: 642571 - DNA, 20 bp, mouse
gaatgcactgggccaagtcc

SEQ ID NO: 642572 - DNA, 20 bp, mouse
gaatcccacagctatgatgg

SEQ ID NO: 642573 - DNA, 20 bp, mouse
gccaccctctggggttatga

SEQ ID NO: 642574 - DNA, 20 bp, mouse
gggtggaaatctcctgtgaa

SEQ ID NO: 642575 - DNA, 20 bp, mouse
gctcttgtgacctacaggtt

SEQ ID NO: 642576 - DNA, 20 bp, mouse
gttgcccgaagctgactcgt

SEQ ID NO: 642577 - DNA, 20 bp, mouse
ggcagcagctgcaccaaaag

SEQ ID NO: 642578 - DNA, 20 bp, mouse
ggctgcaccaaaagaggtca

SEQ ID NO: 642579 - DNA, 20 bp, mouse
gtagctacgcccctaggagg

SEQ ID NO: 642580 - DNA, 20 bp, mouse
gccgccccacgagtcagctt

SEQ ID NO: 642581 - DNA, 20 bp, mouse
gctgcacacagagttggccg

SEQ ID NO: 642582 - DNA, 20 bp, mouse
gaggggcgtagctagagcga

SEQ ID NO: 642583 - DNA, 20 bp, mouse
ggcggagctctggagagcag

SEQ ID NO: 642584 - DNA, 20 bp, mouse
ggtagctagagcgaagggtg

SEQ ID NO: 642585 - DNA, 20 bp, mouse
gggcttctgggaggagtcta

SEQ ID NO: 642586 - DNA, 20 bp, mouse
ggccccgcctggccaggaaa

SEQ ID NO: 642587 - DNA, 20 bp, mouse
gtggcggcgacagcgacctg

SEQ ID NO: 642588 - DNA, 20 bp, mouse
ggacctggggacgagtcccg

SEQ ID NO: 642589 - DNA, 20 bp, mouse
gcgggcggaaccctgcgccc

SEQ ID NO: 642590 - DNA, 20 bp, mouse
gggccacgggactcgtcccc

SEQ ID NO: 642591 - DNA, 20 bp, mouse
gggagcgagcaaagcggtgg

SEQ ID NO: 642592 - DNA, 20 bp, mouse
gcgcgcgctcgcggggacgc

SEQ ID NO: 642593 - DNA, 20 bp, mouse
gcgggtggcgcgcggtgcgc

SEQ ID NO: 642594 - DNA, 20 bp, mouse
gacgcggacgcggccgggtg

SEQ ID NO: 642595 - DNA, 20 bp, mouse
ggccaaggctgctcacgtca

SEQ ID NO: 642596 - DNA, 20 bp, mouse
gctgcaggcaagtatgggat

SEQ ID NO: 642597 - DNA, 20 bp, mouse
gtgttggggtctttgcggaa

SEQ ID NO: 642598 - DNA, 20 bp, mouse
gggaagaagccagacgagga

SEQ ID NO: 642599 - DNA, 20 bp, mouse
gaaacatggcaacaggatgg

SEQ ID NO: 642600 - DNA, 20 bp, mouse
gtggaggtacatgtcgctgt

SEQ ID NO: 642601 - DNA, 20 bp, mouse
gtgcaggaagaagccagacg

SEQ ID NO: 642602 - DNA, 20 bp, mouse
gtgtaaatcctgaaactcta

SEQ ID NO: 642603 - DNA, 20 bp, mouse
gttgcccagagttacctgag

SEQ ID NO: 642604 - DNA, 20 bp, mouse
ggaagccagacgaggagggt

SEQ ID NO: 642605 - DNA, 20 bp, mouse
gagtatgggatgggtgtggc

SEQ ID NO: 642606 - DNA, 20 bp, mouse
ggagactccgacaggcacgg

SEQ ID NO: 642607 - DNA, 20 bp, mouse
gagaatgcgaactcttcggt

SEQ ID NO: 642608 - DNA, 20 bp, mouse
gcgggagaatgcgaactctt

SEQ ID NO: 642609 - DNA, 20 bp, mouse
gaactcttcggtaggacgat

SEQ ID NO: 642610 - DNA, 20 bp, mouse
ggcggggccccagccttatt

SEQ ID NO: 642611 - DNA, 20 bp, mouse
ggactccccagacactaccg

SEQ ID NO: 642612 - DNA, 20 bp, mouse
ggtagcgaggggcttgtcac

SEQ ID NO: 642613 - DNA, 20 bp, mouse
gcaggcgcagatgcggtcgc

SEQ ID NO: 642614 - DNA, 20 bp, mouse
gagtgtctggggagtccccg

SEQ ID NO: 642615 - DNA, 20 bp, mouse
gcgcccgggtggcgcaggga

SEQ ID NO: 642616 - DNA, 20 bp, mouse
gtggacattagatggttaga

SEQ ID NO: 642617 - DNA, 20 bp, mouse
gaggaccagggaagaccaaa

SEQ ID NO: 642618 - DNA, 20 bp, mouse
gtagggaggggcctcgaacc

SEQ ID NO: 642619 - DNA, 20 bp, mouse
gaacaggtggagcctttagt

SEQ ID NO: 642620 - DNA, 20 bp, mouse
gaagagtacgtgacttaacg

SEQ ID NO: 642621 - DNA, 20 bp, mouse
gagatggatgtcagtgagtt

SEQ ID NO: 642622 - DNA, 20 bp, mouse
gaatacctaccaagtgtaac

SEQ ID NO: 642623 - DNA, 20 bp, mouse
gtcgtggcctcactatcaac

SEQ ID NO: 642624 - DNA, 20 bp, mouse
ggtcaacgctaacagttcag

SEQ ID NO: 642625 - DNA, 20 bp, mouse
gtcttcacttgctgttcttg

SEQ ID NO: 642626 - DNA, 20 bp, mouse
ggaaagcgatggtcgaccgc

SEQ ID NO: 642627 - DNA, 20 bp, mouse
gtgaccgcggtccttacctg

SEQ ID NO: 642628 - DNA, 20 bp, mouse
gcgaccgcaggtaaggaccg

SEQ ID NO: 642629 - DNA, 20 bp, mouse
gggaccaggacagaaagcga

SEQ ID NO: 642630 - DNA, 20 bp, mouse
ggcagccaaccgctcgggga

SEQ ID NO: 642631 - DNA, 20 bp, mouse
gacgcgcggccctccccgag

SEQ ID NO: 642632 - DNA, 20 bp, mouse
gtgactcagtgcgacgcggt

SEQ ID NO: 642633 - DNA, 20 bp, mouse
gcgatggtcgaccgcaggta

SEQ ID NO: 642634 - DNA, 20 bp, mouse
gtgaaggtggcagccagcgc

SEQ ID NO: 642635 - DNA, 20 bp, mouse
ggtctgggaggttcaggttc

SEQ ID NO: 642636 - DNA, 20 bp, mouse
gcaggtgagaagtctcaatt

SEQ ID NO: 642637 - DNA, 20 bp, mouse
ggcaacttccgcagcctcct

SEQ ID NO: 642638 - DNA, 20 bp, mouse
gccaggctgtccgatcccca

SEQ ID NO: 642639 - DNA, 20 bp, mouse
gagttgatgtggttgccttg

SEQ ID NO: 642640 - DNA, 20 bp, mouse
gccggcctggaactgcaaga

SEQ ID NO: 642641 - DNA, 20 bp, mouse
ggttgcagcttgtacatctt

SEQ ID NO: 642642 - DNA, 20 bp, mouse
gtggccggcggctttatttc

SEQ ID NO: 642643 - DNA, 20 bp, mouse
ggcggggaggctccgctccc

SEQ ID NO: 642644 - DNA, 20 bp, mouse
gcaaaacgttggaagaaacc

SEQ ID NO: 642645 - DNA, 20 bp, mouse
gaggccggaaataaagccgc

SEQ ID NO: 642646 - DNA, 20 bp, mouse
gctacccgctcatgagtggc

SEQ ID NO: 642647 - DNA, 20 bp, mouse
gcccgctggggccccagaat

SEQ ID NO: 642648 - DNA, 20 bp, mouse
gggtcaggcaacaatgacgc

SEQ ID NO: 642649 - DNA, 20 bp, mouse
ggcgccagccactcatgagc

SEQ ID NO: 642650 - DNA, 20 bp, mouse
gcactcatgagcgggtagga

SEQ ID NO: 642651 - DNA, 20 bp, mouse
gacagcccaatggagggtag

SEQ ID NO: 642652 - DNA, 20 bp, mouse
gggcataattcactcgtccg

SEQ ID NO: 642653 - DNA, 20 bp, mouse
ggggactcagaattgctatg

SEQ ID NO: 642654 - DNA, 20 bp, mouse
gcaaagcttctgtgcctgac

SEQ ID NO: 642655 - DNA, 20 bp, mouse
gcccgcccctaccctccatt

SEQ ID NO: 642656 - DNA, 20 bp, mouse
gaacagctggaatgaggagt

SEQ ID NO: 642657 - DNA, 20 bp, mouse
gggctctctaagtaaagagg

SEQ ID NO: 642658 - DNA, 20 bp, mouse
gcattccagctgttcagtca

SEQ ID NO: 642659 - DNA, 20 bp, mouse
gcagtcagggaggactcagg

SEQ ID NO: 642660 - DNA, 20 bp, mouse
gaaagggtaggcgtggtaga

SEQ ID NO: 642661 - DNA, 20 bp, mouse
gctcaggaggggaatcagcc

SEQ ID NO: 642662 - DNA, 20 bp, mouse
gggtaggcgtggtagaaggc

SEQ ID NO: 642663 - DNA, 20 bp, mouse
gtcctccctgactgaacagc

SEQ ID NO: 642664 - DNA, 20 bp, mouse
gtctctaagtaaagaggggg

SEQ ID NO: 642665 - DNA, 20 bp, mouse
gtccagctgttcagtcaggg

SEQ ID NO: 642666 - DNA, 20 bp, mouse
ggccgcacgtggcagcaaca

SEQ ID NO: 642667 - DNA, 20 bp, mouse
gcacaagacctcttgggggg

SEQ ID NO: 642668 - DNA, 20 bp, mouse
gtccctgttgctgccacgtg

SEQ ID NO: 642669 - DNA, 20 bp, mouse
gaatgcacaagacctcttgg

SEQ ID NO: 642670 - DNA, 20 bp, mouse
gagaaccaggctgccgcacg

SEQ ID NO: 642671 - DNA, 20 bp, mouse
gtgatgatgtcacaggaccc

SEQ ID NO: 642672 - DNA, 20 bp, mouse
gtaaaaaagtctttgtttgc

SEQ ID NO: 642673 - DNA, 20 bp, mouse
gggcaatgcacaagacctct

SEQ ID NO: 642674 - DNA, 20 bp, mouse
gaaagcatgaattttccact

SEQ ID NO: 642675 - DNA, 20 bp, mouse
gcatcatcagaaagggccgc

SEQ ID NO: 642676 - DNA, 20 bp, mouse
gcccctcgaagcatcccgaa

SEQ ID NO: 642677 - DNA, 20 bp, mouse
gcatccgggagctatggcgt

SEQ ID NO: 642678 - DNA, 20 bp, mouse
gccactgcatccgggagcta

SEQ ID NO: 642679 - DNA, 20 bp, mouse
gccccttcgggatgcttcga

SEQ ID NO: 642680 - DNA, 20 bp, mouse
ggctgcgaaagcccagataa

SEQ ID NO: 642681 - DNA, 20 bp, mouse
ggcagcgccacaagcccctt

SEQ ID NO: 642682 - DNA, 20 bp, mouse
gtaagggagccactgcatcc

SEQ ID NO: 642683 - DNA, 20 bp, mouse
ggcaccgacgccatagctcc

SEQ ID NO: 642684 - DNA, 20 bp, mouse
gatgcagtggctcccttatc

SEQ ID NO: 642685 - DNA, 20 bp, mouse
gagcatcccgaaggggcttg

SEQ ID NO: 642686 - DNA, 20 bp, mouse
gagagcgcagggctaggact

SEQ ID NO: 642687 - DNA, 20 bp, mouse
gaactccaggtcagtctcct

SEQ ID NO: 642688 - DNA, 20 bp, mouse
gaggtgccggggcaccccgc

SEQ ID NO: 642689 - DNA, 20 bp, mouse
gacacccgggatagcgagga

SEQ ID NO: 642690 - DNA, 20 bp, mouse
ggaaagccggctccagggag

SEQ ID NO: 642691 - DNA, 20 bp, mouse
ggtctcctgggccgggtcta

SEQ ID NO: 642692 - DNA, 20 bp, mouse
gtgcaggccagggaccaggg

SEQ ID NO: 642693 - DNA, 20 bp, mouse
gcccgcccgctccctggagc

SEQ ID NO: 642694 - DNA, 20 bp, mouse
gcgctggaaagccggctcca

SEQ ID NO: 642695 - DNA, 20 bp, mouse
gccaggcgcgctgagagcgc

SEQ ID NO: 642696 - DNA, 20 bp, mouse
ggttagcgggtcttcagcag

SEQ ID NO: 642697 - DNA, 20 bp, mouse
gccagatagccacaccctaa

SEQ ID NO: 642698 - DNA, 20 bp, mouse
ggggtctctcgcgtcctctg

SEQ ID NO: 642699 - DNA, 20 bp, mouse
gagagacaacccttagggtg

SEQ ID NO: 642700 - DNA, 20 bp, mouse
ggcaaggcactgctgttagc

SEQ ID NO: 642701 - DNA, 20 bp, mouse
gaattagctggaaatcgcag

SEQ ID NO: 642702 - DNA, 20 bp, mouse
gcaaagctaacgttgtggca

SEQ ID NO: 642703 - DNA, 20 bp, mouse
gaagctgagagacaaccctt

SEQ ID NO: 642704 - DNA, 20 bp, mouse
gagggcacaagattattgaa

SEQ ID NO: 642705 - DNA, 20 bp, mouse
ggggtgtggctatctggtat

SEQ ID NO: 642706 - DNA, 20 bp, mouse
gccactgggcacttgtgggg

SEQ ID NO: 642707 - DNA, 20 bp, mouse
ggggccactgggcacttgtg

SEQ ID NO: 642708 - DNA, 20 bp, mouse
gtggcactaccaagattctc

SEQ ID NO: 642709 - DNA, 20 bp, mouse
ggattctcggggttgaaggg

SEQ ID NO: 642710 - DNA, 20 bp, mouse
gaccttgcctgaggacactc

SEQ ID NO: 642711 - DNA, 20 bp, mouse
gaagtgcccagtggccctat

SEQ ID NO: 642712 - DNA, 20 bp, mouse
gcaagattctcggggttgaa

SEQ ID NO: 642713 - DNA, 20 bp, mouse
gtacaaaactgtagccaata

SEQ ID NO: 642714 - DNA, 20 bp, mouse
gagaaaggagaagcgagtgt

SEQ ID NO: 642715 - DNA, 20 bp, mouse
gtagtgccagtgtgctacga

SEQ ID NO: 642716 - DNA, 20 bp, mouse
ggatattaatgactaatgat

SEQ ID NO: 642717 - DNA, 20 bp, mouse
gatttctgctattttgatgt

SEQ ID NO: 642718 - DNA, 20 bp, mouse
gtgtgtagcagttgcagtct

SEQ ID NO: 642719 - DNA, 20 bp, mouse
gatattacatcagaataaat

SEQ ID NO: 642720 - DNA, 20 bp, mouse
gcagaataaatgggctgaaa

SEQ ID NO: 642721 - DNA, 20 bp, mouse
ggcagacagacaggtagtgt

SEQ ID NO: 642722 - DNA, 20 bp, mouse
gtgaagaatgatagagagct

SEQ ID NO: 642723 - DNA, 20 bp, mouse
gcagtgaggaaacacaatta

SEQ ID NO: 642724 - DNA, 20 bp, mouse
gaagatgataagcaatgttc

SEQ ID NO: 642725 - DNA, 20 bp, mouse
gagttgcagtctaggataca

SEQ ID NO: 642726 - DNA, 20 bp, mouse
gtgaggcctgggattgtgaa

SEQ ID NO: 642727 - DNA, 20 bp, mouse
gtctctgggtttagggattt

SEQ ID NO: 642728 - DNA, 20 bp, mouse
gtggggtgagatgaactgaa

SEQ ID NO: 642729 - DNA, 20 bp, mouse
gccgacattaaggaacgaga

SEQ ID NO: 642730 - DNA, 20 bp, mouse
gtgacctcagattgaggcct

SEQ ID NO: 642731 - DNA, 20 bp, mouse
gccctaaacccagagaacca

SEQ ID NO: 642732 - DNA, 20 bp, mouse
gtcaaactaccctggggcgg

SEQ ID NO: 642733 - DNA, 20 bp, mouse
ggtcggagtttgctaggaga

SEQ ID NO: 642734 - DNA, 20 bp, mouse
gccactctcaaactaccctg

SEQ ID NO: 642735 - DNA, 20 bp, mouse
gtgctaggagatggctcctg

SEQ ID NO: 642736 - DNA, 20 bp, mouse
ggcccctgatgtcacaaata

SEQ ID NO: 642737 - DNA, 20 bp, mouse
gggagtgtgcgtagcaggct

SEQ ID NO: 642738 - DNA, 20 bp, mouse
gtgtgacatcaggggccaaa

SEQ ID NO: 642739 - DNA, 20 bp, mouse
ggagtgcttccaaggcctct

SEQ ID NO: 642740 - DNA, 20 bp, mouse
gtccatatttgtgacatcag

SEQ ID NO: 642741 - DNA, 20 bp, mouse
ggcattatgaagaaaggagc

SEQ ID NO: 642742 - DNA, 20 bp, mouse
gtccaagtttgttggagtca

SEQ ID NO: 642743 - DNA, 20 bp, mouse
gtcactggagtgtgcgtagc

SEQ ID NO: 642744 - DNA, 20 bp, mouse
ggtgaatgcctggttccagg

SEQ ID NO: 642745 - DNA, 20 bp, mouse
gtgcatcatgagtgcttcca

SEQ ID NO: 642746 - DNA, 20 bp, mouse
ggagttccaccacatccagg

SEQ ID NO: 642747 - DNA, 20 bp, mouse
gggtttgtctataatccacc

SEQ ID NO: 642748 - DNA, 20 bp, mouse
gtggatcactgtgagtattc

SEQ ID NO: 642749 - DNA, 20 bp, mouse
gagcaagtctattactttgt

SEQ ID NO: 642750 - DNA, 20 bp, mouse
gtgattattgttataagcca

SEQ ID NO: 642751 - DNA, 20 bp, mouse
gaagacacaggcctctaatc

SEQ ID NO: 642752 - DNA, 20 bp, mouse
gaagcaaaatccaaaaatga

SEQ ID NO: 642753 - DNA, 20 bp, mouse
gataatccacctggatgtgg

SEQ ID NO: 642754 - DNA, 20 bp, mouse
gttgcttcaatcctgattag

SEQ ID NO: 642755 - DNA, 20 bp, mouse
gtattgagcttgaaagacac

SEQ ID NO: 642756 - DNA, 20 bp, mouse
gctgtggccttcagtcaagt

SEQ ID NO: 642757 - DNA, 20 bp, mouse
ggggcaatgctccaaactcc

SEQ ID NO: 642758 - DNA, 20 bp, mouse
gcattgccctacttgactga

SEQ ID NO: 642759 - DNA, 20 bp, mouse
gtcggaacagagacacagtc

SEQ ID NO: 642760 - DNA, 20 bp, mouse
gaaaggagctgctagggttg

SEQ ID NO: 642761 - DNA, 20 bp, mouse
gaaggagtgaagcttcttgt

SEQ ID NO: 642762 - DNA, 20 bp, mouse
gccttaggtgcttggactaa

SEQ ID NO: 642763 - DNA, 20 bp, mouse
gtggtctcagacctagtttc

SEQ ID NO: 642764 - DNA, 20 bp, mouse
gcagcagaataactctgcaa

SEQ ID NO: 642765 - DNA, 20 bp, mouse
gtgcctccttaggcaatgaa

SEQ ID NO: 642766 - DNA, 20 bp, mouse
gcagggaagccctcgggtaa

SEQ ID NO: 642767 - DNA, 20 bp, mouse
gaggaagtgtgtgtcgcaga

SEQ ID NO: 642768 - DNA, 20 bp, mouse
gagagggtggacaacctgac

SEQ ID NO: 642769 - DNA, 20 bp, mouse
gtgtccccacttattctgtg

SEQ ID NO: 642770 - DNA, 20 bp, mouse
ggctccagatgaacagtagc

SEQ ID NO: 642771 - DNA, 20 bp, mouse
ggaaggagatggttcctctg

SEQ ID NO: 642772 - DNA, 20 bp, mouse
ggtggggacaaccactgctg

SEQ ID NO: 642773 - DNA, 20 bp, mouse
gcagatgaacagtagcagga

SEQ ID NO: 642774 - DNA, 20 bp, mouse
gctaccacacagaataagtg

SEQ ID NO: 642775 - DNA, 20 bp, mouse
gcaccccaaacagaataaga

SEQ ID NO: 642776 - DNA, 20 bp, mouse
gcctctcagcataggtcagc

SEQ ID NO: 642777 - DNA, 20 bp, mouse
gaatgggacagtttcctaaa

SEQ ID NO: 642778 - DNA, 20 bp, mouse
gacctaaatcctctcagcat

SEQ ID NO: 642779 - DNA, 20 bp, mouse
gacctatgctgagaggattt

SEQ ID NO: 642780 - DNA, 20 bp, mouse
ggggttacatataggaatat

SEQ ID NO: 642781 - DNA, 20 bp, mouse
gtcctgggttccttatgtag

SEQ ID NO: 642782 - DNA, 20 bp, mouse
gtcctctacataaggaaccc

SEQ ID NO: 642783 - DNA, 20 bp, mouse
gacatataggaatatgggtg

SEQ ID NO: 642784 - DNA, 20 bp, mouse
gttttattggggttacatat

SEQ ID NO: 642785 - DNA, 20 bp, mouse
gcgtgtttctcctctacata

SEQ ID NO: 642786 - DNA, 20 bp, mouse
gtcgggccagatccaccccg

SEQ ID NO: 642787 - DNA, 20 bp, mouse
gtagggagaagcaaaccccg

SEQ ID NO: 642788 - DNA, 20 bp, mouse
gcgggcgcccactctctagg

SEQ ID NO: 642789 - DNA, 20 bp, mouse
gaccgggcaaaagcaagcag

SEQ ID NO: 642790 - DNA, 20 bp, mouse
ggctgcagccacctagagag

SEQ ID NO: 642791 - DNA, 20 bp, mouse
ggcaaaccccggggtggatc

SEQ ID NO: 642792 - DNA, 20 bp, mouse
gggcgcggcaatagcgccga

SEQ ID NO: 642793 - DNA, 20 bp, mouse
gtcagcaggcgcgactctta

SEQ ID NO: 642794 - DNA, 20 bp, mouse
gagtcgcgcctgctgagacc

SEQ ID NO: 642795 - DNA, 20 bp, mouse
gagggtgagcagagtgcacc

SEQ ID NO: 642796 - DNA, 20 bp, mouse
gcgcgcacgcgctttcggga

SEQ ID NO: 642797 - DNA, 20 bp, mouse
gggaacgcgcgagcgggagc

SEQ ID NO: 642798 - DNA, 20 bp, mouse
gctcgagcggggtgggcgga

SEQ ID NO: 642799 - DNA, 20 bp, mouse
gtcgggacggcggctctccc

SEQ ID NO: 642800 - DNA, 20 bp, mouse
gcgcgctcgagcggggtggg

SEQ ID NO: 642801 - DNA, 20 bp, mouse
gaggcccgcttgcccttcgc

SEQ ID NO: 642802 - DNA, 20 bp, mouse
gcccgcttgcccttcgccgg

SEQ ID NO: 642803 - DNA, 20 bp, mouse
gtcccgctcgcgcgttccgg

SEQ ID NO: 642804 - DNA, 20 bp, mouse
gaggctgcagaggggccgcg

SEQ ID NO: 642805 - DNA, 20 bp, mouse
ggcagcgagagcgcaggcgc

SEQ ID NO: 642806 - DNA, 20 bp, mouse
ggcagcagcaggtattgtgt

SEQ ID NO: 642807 - DNA, 20 bp, mouse
gagcctgtcttcacagggcc

SEQ ID NO: 642808 - DNA, 20 bp, mouse
gagaatgaggactcagccat

SEQ ID NO: 642809 - DNA, 20 bp, mouse
gtgaaattcggggatcaact

SEQ ID NO: 642810 - DNA, 20 bp, mouse
ggctacccactgttcctgtg

SEQ ID NO: 642811 - DNA, 20 bp, mouse
gggactcagccatgggagcc

SEQ ID NO: 642812 - DNA, 20 bp, mouse
gagtctgcggtctcagctca

SEQ ID NO: 642813 - DNA, 20 bp, mouse
gatgtcactaacagagtctg

SEQ ID NO: 642814 - DNA, 20 bp, mouse
gggctttctcttcaggtcat

SEQ ID NO: 642815 - DNA, 20 bp, mouse
gcagacacagtgagccacac

SEQ ID NO: 642816 - DNA, 20 bp, mouse
ggcaccgagggctcaccctg

SEQ ID NO: 642817 - DNA, 20 bp, mouse
gtgaccgcgcggcggctctt

SEQ ID NO: 642818 - DNA, 20 bp, mouse
gcgagctgcgagccagggaa

SEQ ID NO: 642819 - DNA, 20 bp, mouse
gagagcggggctcgaatcgg

SEQ ID NO: 642820 - DNA, 20 bp, mouse
gccagagggacctgcaccga

SEQ ID NO: 642821 - DNA, 20 bp, mouse
gcgctcgggaggctaacgtt

SEQ ID NO: 642822 - DNA, 20 bp, mouse
gtccctctgggctttaactt

SEQ ID NO: 642823 - DNA, 20 bp, mouse
ggggctcgaatcggaggagg

SEQ ID NO: 642824 - DNA, 20 bp, mouse
gggaacacgcgcccggacgg

SEQ ID NO: 642825 - DNA, 20 bp, mouse
gccggcctgagtcagcgcgg

SEQ ID NO: 642826 - DNA, 20 bp, mouse
gagccaacctggagtcaaac

SEQ ID NO: 642827 - DNA, 20 bp, mouse
gaaagctcaggtgtggacgg

SEQ ID NO: 642828 - DNA, 20 bp, mouse
gatggtggttgcctaggaaa

SEQ ID NO: 642829 - DNA, 20 bp, mouse
ggagagtgaacataactcgg

SEQ ID NO: 642830 - DNA, 20 bp, mouse
gcaggtgtggacggagggta

SEQ ID NO: 642831 - DNA, 20 bp, mouse
gaggcaaccaccatgacttc

SEQ ID NO: 642832 - DNA, 20 bp, mouse
gcctgactcaagacctccgg

SEQ ID NO: 642833 - DNA, 20 bp, mouse
gtagtggcctgactctgtca

SEQ ID NO: 642834 - DNA, 20 bp, mouse
gcctgctgaagctccggaat

SEQ ID NO: 642835 - DNA, 20 bp, mouse
gttgactccaggttggctag

SEQ ID NO: 642836 - DNA, 20 bp, mouse
gtgaagacgcggggacagaa

SEQ ID NO: 642837 - DNA, 20 bp, mouse
gcggtcgccccctgctgccg

SEQ ID NO: 642838 - DNA, 20 bp, mouse
gcgcccacccgcatccggat

SEQ ID NO: 642839 - DNA, 20 bp, mouse
gccgcgcagcgggaaggttg

SEQ ID NO: 642840 - DNA, 20 bp, mouse
gtccacgccgcggcagcagg

SEQ ID NO: 642841 - DNA, 20 bp, mouse
gcgaccgagggccgcgcagc

SEQ ID NO: 642842 - DNA, 20 bp, mouse
gtgtccgcgggtagaggcgg

SEQ ID NO: 642843 - DNA, 20 bp, mouse
gttcccggctgcacacgggc

SEQ ID NO: 642844 - DNA, 20 bp, mouse
gtcctgcagcgtccacgccg

SEQ ID NO: 642845 - DNA, 20 bp, mouse
gcggcccgcccacccgcatc

SEQ ID NO: 642846 - DNA, 20 bp, mouse
ggctgctgtgtgtaattcaa

SEQ ID NO: 642847 - DNA, 20 bp, mouse
gtctcccttggctctaaaac

SEQ ID NO: 642848 - DNA, 20 bp, mouse
gacacctggtctgacctgaa

SEQ ID NO: 642849 - DNA, 20 bp, mouse
gctcctgcaagagacaggaa

SEQ ID NO: 642850 - DNA, 20 bp, mouse
gaaaaggtcgcaaacctttc

SEQ ID NO: 642851 - DNA, 20 bp, mouse
ggtgtgtaattcaagggaaa

SEQ ID NO: 642852 - DNA, 20 bp, mouse
gatgcgcagtgagtggtctc

SEQ ID NO: 642853 - DNA, 20 bp, mouse
gaaggtatggatctggcagt

SEQ ID NO: 642854 - DNA, 20 bp, mouse
gaaacctttcaggtcagacc

SEQ ID NO: 642855 - DNA, 20 bp, mouse
gcaggaaaggggcgggatac

SEQ ID NO: 642856 - DNA, 20 bp, mouse
gtgggagagcttaacctttg

SEQ ID NO: 642857 - DNA, 20 bp, mouse
gagggagcggtgagatgtca

SEQ ID NO: 642858 - DNA, 20 bp, mouse
gtcagacagttgtgagatac

SEQ ID NO: 642859 - DNA, 20 bp, mouse
gctagagcgacctaggagag

SEQ ID NO: 642860 - DNA, 20 bp, mouse
gatactgggaaattgaacca

SEQ ID NO: 642861 - DNA, 20 bp, mouse
gctctagcccgcatagggag

SEQ ID NO: 642862 - DNA, 20 bp, mouse
gggtcgctctagcccgcata

SEQ ID NO: 642863 - DNA, 20 bp, mouse
gcttccttctaggctgcggg

SEQ ID NO: 642864 - DNA, 20 bp, mouse
gaaagagtgcatggttgcta

SEQ ID NO: 642865 - DNA, 20 bp, mouse
gaaaactggcaatgcttttt

SEQ ID NO: 642866 - DNA, 20 bp, mouse
ggggcccaaagggcagatct

SEQ ID NO: 642867 - DNA, 20 bp, mouse
gtgcaaggcacgcagagtgg

SEQ ID NO: 642868 - DNA, 20 bp, mouse
gagctagaggcgggcccaaa

SEQ ID NO: 642869 - DNA, 20 bp, mouse
ggctagcaatggtctggcaa

SEQ ID NO: 642870 - DNA, 20 bp, mouse
gagccaggctagcaatggtc

SEQ ID NO: 642871 - DNA, 20 bp, mouse
gggaggtggaatcaagctag

SEQ ID NO: 642872 - DNA, 20 bp, mouse
gctgtgcaaggcacgcagag

SEQ ID NO: 642873 - DNA, 20 bp, mouse
gcccaggcctgaaaccacat

SEQ ID NO: 642874 - DNA, 20 bp, mouse
gggggaagacgtatctgtga

SEQ ID NO: 642875 - DNA, 20 bp, mouse
ggggcgcaggaggggctcca

SEQ ID NO: 642876 - DNA, 20 bp, mouse
gttgccttggaaacactctg

SEQ ID NO: 642877 - DNA, 20 bp, mouse
ggcgcctaggccttgcctat

SEQ ID NO: 642878 - DNA, 20 bp, mouse
ggagggctggcctcagaaga

SEQ ID NO: 642879 - DNA, 20 bp, mouse
gtgtgggggcaggaaaagtt

SEQ ID NO: 642880 - DNA, 20 bp, mouse
ggcctcagaagaaggcggaa

SEQ ID NO: 642881 - DNA, 20 bp, mouse
gccacactgaccacatcccc

SEQ ID NO: 642882 - DNA, 20 bp, mouse
gcctgtggggtgggactgac

SEQ ID NO: 642883 - DNA, 20 bp, mouse
gggtctggaccttgcctgtg

SEQ ID NO: 642884 - DNA, 20 bp, mouse
gcgatctgaaaggccctgga

SEQ ID NO: 642885 - DNA, 20 bp, mouse
gcagtcccaccccacaggca

SEQ ID NO: 642886 - DNA, 20 bp, mouse
gcctcccagccccaaagctg

SEQ ID NO: 642887 - DNA, 20 bp, mouse
gagggtgggtgggggcctga

SEQ ID NO: 642888 - DNA, 20 bp, mouse
gtgcttgtgctgaatgaagg

SEQ ID NO: 642889 - DNA, 20 bp, mouse
gtatgccaggacaaggtgtt

SEQ ID NO: 642890 - DNA, 20 bp, mouse
gctggggaacagcaggaaac

SEQ ID NO: 642891 - DNA, 20 bp, mouse
ggggctccaagccacccctc

SEQ ID NO: 642892 - DNA, 20 bp, mouse
gggtggctgcctgacgtcac

SEQ ID NO: 642893 - DNA, 20 bp, mouse
gctgctgttccccagctttg

SEQ ID NO: 642894 - DNA, 20 bp, mouse
gaggttgaagcatagagcaa

SEQ ID NO: 642895 - DNA, 20 bp, mouse
ggggtggcttggagccctgg

SEQ ID NO: 642896 - DNA, 20 bp, mouse
gcgcgcgccgagcgaccggt

SEQ ID NO: 642897 - DNA, 20 bp, mouse
gagcatgccgccctcctcag

SEQ ID NO: 642898 - DNA, 20 bp, mouse
gcggggagaccctccggatg

SEQ ID NO: 642899 - DNA, 20 bp, mouse
gcctgcgcgcgcgcctcatc

SEQ ID NO: 642900 - DNA, 20 bp, mouse
gccgagcgaccggtgggcgc

SEQ ID NO: 642901 - DNA, 20 bp, mouse
gccccctcgcctgctctgat

SEQ ID NO: 642902 - DNA, 20 bp, mouse
gcgagtcttcggccactctc

SEQ ID NO: 642903 - DNA, 20 bp, mouse
ggaggaggcgggagctccgg

SEQ ID NO: 642904 - DNA, 20 bp, mouse
gccggcctcgcccgagtctt

SEQ ID NO: 642905 - DNA, 20 bp, mouse
gaccggtgggcgcgggaggt

SEQ ID NO: 642906 - DNA, 20 bp, mouse
ggacgaactgggactgagag

SEQ ID NO: 642907 - DNA, 20 bp, mouse
ggggaaaagcatcgcgtctc

SEQ ID NO: 642908 - DNA, 20 bp, mouse
ggctgcgccgaaagcaccgg

SEQ ID NO: 642909 - DNA, 20 bp, mouse
gtcagccaagaggacgaact

SEQ ID NO: 642910 - DNA, 20 bp, mouse
gctcccacaaggcactgcgg

SEQ ID NO: 642911 - DNA, 20 bp, mouse
gcgggctgcgccgaaagcac

SEQ ID NO: 642912 - DNA, 20 bp, mouse
gctgacgcacctcagccaag

SEQ ID NO: 642913 - DNA, 20 bp, mouse
gagcggagcagagtcctgcc

SEQ ID NO: 642914 - DNA, 20 bp, mouse
ggtcgcggaagtgacgtgag

SEQ ID NO: 642915 - DNA, 20 bp, mouse
gctctgccatgggacgtcac

SEQ ID NO: 642916 - DNA, 20 bp, mouse
gaggtgacaggtgtgtcgaa

SEQ ID NO: 642917 - DNA, 20 bp, mouse
gcaatgaggagaaaccacgg

SEQ ID NO: 642918 - DNA, 20 bp, mouse
gtgccacaggactacaacca

SEQ ID NO: 642919 - DNA, 20 bp, mouse
gcacttccatgcacagacca

SEQ ID NO: 642920 - DNA, 20 bp, mouse
ggtgcataggtaagtggcta

SEQ ID NO: 642921 - DNA, 20 bp, mouse
gctcataccggcaaccaccg

SEQ ID NO: 642922 - DNA, 20 bp, mouse
gaccccttcaagctccactt

SEQ ID NO: 642923 - DNA, 20 bp, mouse
ggtctggcgaggagcatcca

SEQ ID NO: 642924 - DNA, 20 bp, mouse
ggctcctcgccagaccaaag

SEQ ID NO: 642925 - DNA, 20 bp, mouse
ggcaggaggttgctgtactt

SEQ ID NO: 642926 - DNA, 20 bp, mouse
gtctcagagccacaagtctc

SEQ ID NO: 642927 - DNA, 20 bp, mouse
gacttgtggctctgagattt

SEQ ID NO: 642928 - DNA, 20 bp, mouse
gttggcacttgcaaaccctg

SEQ ID NO: 642929 - DNA, 20 bp, mouse
ggcatggtgtacctatacca

SEQ ID NO: 642930 - DNA, 20 bp, mouse
ggagcagtgctgaaacagcc

SEQ ID NO: 642931 - DNA, 20 bp, mouse
gttaagaggtttccctagcc

SEQ ID NO: 642932 - DNA, 20 bp, mouse
gaaatagtctaatatcccca

SEQ ID NO: 642933 - DNA, 20 bp, mouse
gtggctctgagattttggat

SEQ ID NO: 642934 - DNA, 20 bp, mouse
gtaaccatcaactgccaacc

SEQ ID NO: 642935 - DNA, 20 bp, mouse
gttagctagttttaacacct

SEQ ID NO: 642936 - DNA, 20 bp, mouse
gcctgccgcgggttccctac

SEQ ID NO: 642937 - DNA, 20 bp, mouse
gtggatcgggcgtgccggta

SEQ ID NO: 642938 - DNA, 20 bp, mouse
gcgtgccggtagggaacccg

SEQ ID NO: 642939 - DNA, 20 bp, mouse
ggcggctctgctccccagca

SEQ ID NO: 642940 - DNA, 20 bp, mouse
gccccagcagggcgtgggcc

SEQ ID NO: 642941 - DNA, 20 bp, mouse
gaccctgatctgctcaggaa

SEQ ID NO: 642942 - DNA, 20 bp, mouse
gccccgccgcccaactcccc

SEQ ID NO: 642943 - DNA, 20 bp, mouse
gctgcgcggaggacctcgcc

SEQ ID NO: 642944 - DNA, 20 bp, mouse
gggcccggggagttgggcgg

SEQ ID NO: 642945 - DNA, 20 bp, mouse
gttccacaacagcctattgt

SEQ ID NO: 642946 - DNA, 20 bp, mouse
gtggcaaacagacttgtagg

SEQ ID NO: 642947 - DNA, 20 bp, mouse
gtgtacagaaatcacatagc

SEQ ID NO: 642948 - DNA, 20 bp, mouse
gttgtaggggggggtatgac

SEQ ID NO: 642949 - DNA, 20 bp, mouse
gcatagcagggttataaaat

SEQ ID NO: 642950 - DNA, 20 bp, mouse
gcaaacagacttgtaggggg

SEQ ID NO: 642951 - DNA, 20 bp, mouse
ggtgacctgaagttcagtta

SEQ ID NO: 642952 - DNA, 20 bp, mouse
gaacatagattcctgagccg

SEQ ID NO: 642953 - DNA, 20 bp, mouse
gtgagccgtggcttcataga

SEQ ID NO: 642954 - DNA, 20 bp, mouse
gaagagcctatagttagccc

SEQ ID NO: 642955 - DNA, 20 bp, mouse
gtcacctgttagctgattgt

SEQ ID NO: 642956 - DNA, 20 bp, mouse
gcagtgaagctctgttgtat

SEQ ID NO: 642957 - DNA, 20 bp, mouse
gcaggcagacggtctctctc

SEQ ID NO: 642958 - DNA, 20 bp, mouse
gagagaccgtctgcctgggg

SEQ ID NO: 642959 - DNA, 20 bp, mouse
gtaaatgacgtgtgtctcca

SEQ ID NO: 642960 - DNA, 20 bp, mouse
gttgtatgggctgacgggcg

SEQ ID NO: 642961 - DNA, 20 bp, mouse
gtccagcggcccacaggact

SEQ ID NO: 642962 - DNA, 20 bp, mouse
ggctctcccatggtcctcca

SEQ ID NO: 642963 - DNA, 20 bp, mouse
gtgtggctgcaatgtttaat

SEQ ID NO: 642964 - DNA, 20 bp, mouse
gcctgtgggccgctggagga

SEQ ID NO: 642965 - DNA, 20 bp, mouse
gcagagcttcactgcagctt

SEQ ID NO: 642966 - DNA, 20 bp, mouse
gaaggggcgggcagcgtcca

SEQ ID NO: 642967 - DNA, 20 bp, mouse
gaccctgcgggaagtggtgt

SEQ ID NO: 642968 - DNA, 20 bp, mouse
ggcggtgcgcgtccttcccc

SEQ ID NO: 642969 - DNA, 20 bp, mouse
ggagccggcgcgagaatccc

SEQ ID NO: 642970 - DNA, 20 bp, mouse
gccgggaggtgcaggtcttc

SEQ ID NO: 642971 - DNA, 20 bp, mouse
gcgagaatcccgggaggtgc

SEQ ID NO: 642972 - DNA, 20 bp, mouse
gcctcccgggattctcgcgc

SEQ ID NO: 642973 - DNA, 20 bp, mouse
gggcgggcagcgtccagggg

SEQ ID NO: 642974 - DNA, 20 bp, mouse
gaggacgcgcaccgccccag

SEQ ID NO: 642975 - DNA, 20 bp, mouse
gggaaccagaaggctagggg

SEQ ID NO: 642976 - DNA, 20 bp, mouse
gccgctcccaggaaaactcc

SEQ ID NO: 642977 - DNA, 20 bp, mouse
gatgccctaccgggtctcca

SEQ ID NO: 642978 - DNA, 20 bp, mouse
gccgccccagccacaggtct

SEQ ID NO: 642979 - DNA, 20 bp, mouse
gtgtgcagcgcgtttgtctc

SEQ ID NO: 642980 - DNA, 20 bp, mouse
gcaccaatggctggaggaaa

SEQ ID NO: 642981 - DNA, 20 bp, mouse
gagacgagaaaagaccggtg

SEQ ID NO: 642982 - DNA, 20 bp, mouse
gcgaagcctggagttttcct

SEQ ID NO: 642983 - DNA, 20 bp, mouse
ggcttcgccgccgagcaaac

SEQ ID NO: 642984 - DNA, 20 bp, mouse
gaacgcgctgcacagggttc

SEQ ID NO: 642985 - DNA, 20 bp, mouse
gtgtctctggccggtttgct

SEQ ID NO: 642986 - DNA, 20 bp, mouse
ggggagggaggcagaaccgg

SEQ ID NO: 642987 - DNA, 20 bp, mouse
gcagcaagcgcgcccgacca

SEQ ID NO: 642988 - DNA, 20 bp, mouse
gaggtcttggagagggtccc

SEQ ID NO: 642989 - DNA, 20 bp, mouse
ggccgctgcgccgggaggga

SEQ ID NO: 642990 - DNA, 20 bp, mouse
gcggaattgggccctcgagg

SEQ ID NO: 642991 - DNA, 20 bp, mouse
gtccgacaacagtttgaggg

SEQ ID NO: 642992 - DNA, 20 bp, mouse
gacctccctcaaactgttgt

SEQ ID NO: 642993 - DNA, 20 bp, mouse
gttggagagggtccctggtc

SEQ ID NO: 642994 - DNA, 20 bp, mouse
gaggagcgcggccgctgcgc

SEQ ID NO: 642995 - DNA, 20 bp, mouse
ggcagggaatcgctcatcca

SEQ ID NO: 642996 - DNA, 20 bp, mouse
gtggccattaaacctccctt

SEQ ID NO: 642997 - DNA, 20 bp, mouse
gcagcccgagctgacgcggt

SEQ ID NO: 642998 - DNA, 20 bp, mouse
gagggttagaatgtgcagat

SEQ ID NO: 642999 - DNA, 20 bp, mouse
ggaacccaccgcgtcagctc

SEQ ID NO: 643000 - DNA, 20 bp, mouse
gtagagagctagggagggca

SEQ ID NO: 643001 - DNA, 20 bp, mouse
ggttctccccagagctggat

SEQ ID NO: 643002 - DNA, 20 bp, mouse
gagagaaggcgggaccttcc

SEQ ID NO: 643003 - DNA, 20 bp, mouse
ggactgacaaatccacccca

SEQ ID NO: 643004 - DNA, 20 bp, mouse
gagctggatgggaagacaga

SEQ ID NO: 643005 - DNA, 20 bp, mouse
gcctccctagctctctaaat

SEQ ID NO: 643006 - DNA, 20 bp, mouse
gcggagcccggtgacagttg

SEQ ID NO: 643007 - DNA, 20 bp, mouse
gcaggggcgtcgcgagaagg

SEQ ID NO: 643008 - DNA, 20 bp, mouse
ggaaaagtggccgccgccag

SEQ ID NO: 643009 - DNA, 20 bp, mouse
ggagaaggcggggccccgtg

SEQ ID NO: 643010 - DNA, 20 bp, mouse
gcgccaggggcgtcgcgaga

SEQ ID NO: 643011 - DNA, 20 bp, mouse
gtggcactcggtggggctct

SEQ ID NO: 643012 - DNA, 20 bp, mouse
gctggagcccgtggtgtcgc

SEQ ID NO: 643013 - DNA, 20 bp, mouse
gtcaccgggctccgctgcgt

SEQ ID NO: 643014 - DNA, 20 bp, mouse
ggccgcgcgcacctgcgagt

SEQ ID NO: 643015 - DNA, 20 bp, mouse
ggctccgcctggcactcggt

SEQ ID NO: 643016 - DNA, 20 bp, mouse
ggggcggccgaggcgagctg

SEQ ID NO: 643017 - DNA, 20 bp, mouse
gaggggccggctcgctcaaa

SEQ ID NO: 643018 - DNA, 20 bp, mouse
gtcgctcaaaggggcggccg

SEQ ID NO: 643019 - DNA, 20 bp, mouse
ggaggcaagcggaattaaac

SEQ ID NO: 643020 - DNA, 20 bp, mouse
ggccggctcgctcaaagggg

SEQ ID NO: 643021 - DNA, 20 bp, mouse
gagggggaagcggccaatga

SEQ ID NO: 643022 - DNA, 20 bp, mouse
ggacgccgcgtccttcgcga

SEQ ID NO: 643023 - DNA, 20 bp, mouse
gcgacctcgcagggcgacgg

SEQ ID NO: 643024 - DNA, 20 bp, mouse
ggagcgagccggcccctcat

SEQ ID NO: 643025 - DNA, 20 bp, mouse
gcgtcggttggttgtcaaga

SEQ ID NO: 643026 - DNA, 20 bp, mouse
gcgcccccgtccaacagact

SEQ ID NO: 643027 - DNA, 20 bp, mouse
gggcgagggcgcgactcgtg

SEQ ID NO: 643028 - DNA, 20 bp, mouse
gaggtccgaaggtgaagcaa

SEQ ID NO: 643029 - DNA, 20 bp, mouse
gtgagcgtggcttgagtgga

SEQ ID NO: 643030 - DNA, 20 bp, mouse
gcacacgactcgcacgtgtt

SEQ ID NO: 643031 - DNA, 20 bp, mouse
ggctgtgagcgtggcttgag

SEQ ID NO: 643032 - DNA, 20 bp, mouse
ggagggactgagagtgtctc

SEQ ID NO: 643033 - DNA, 20 bp, mouse
gtgggactggccagagtaga

SEQ ID NO: 643034 - DNA, 20 bp, mouse
gaggcagccctcggataaag

SEQ ID NO: 643035 - DNA, 20 bp, mouse
ggcggggcttgctgtgagcg

SEQ ID NO: 643036 - DNA, 20 bp, mouse
ggcctggaggggcggttcta

SEQ ID NO: 643037 - DNA, 20 bp, mouse
ggcccctcctcaggcctgga

SEQ ID NO: 643038 - DNA, 20 bp, mouse
gggcacagatccgccccttc

SEQ ID NO: 643039 - DNA, 20 bp, mouse
gccagcaagtagcaccaccc

SEQ ID NO: 643040 - DNA, 20 bp, mouse
gcccctccaggcctgaggag

SEQ ID NO: 643041 - DNA, 20 bp, mouse
gttgctgggcagtccctgtg

SEQ ID NO: 643042 - DNA, 20 bp, mouse
gggaggggcggttctaaggc

SEQ ID NO: 643043 - DNA, 20 bp, mouse
gggccttcagtatttttcaa

SEQ ID NO: 643044 - DNA, 20 bp, mouse
gtactcatccaaagaacagg

SEQ ID NO: 643045 - DNA, 20 bp, mouse
gttggatgagtacccctcaa

SEQ ID NO: 643046 - DNA, 20 bp, mouse
gaggaactgaatttgattgg

SEQ ID NO: 643047 - DNA, 20 bp, mouse
gaaaaaaagaggcaaactag

SEQ ID NO: 643048 - DNA, 20 bp, mouse
gactgaatttgattggtggt

SEQ ID NO: 643049 - DNA, 20 bp, mouse
ggttaagctaaaatgtcaac

SEQ ID NO: 643050 - DNA, 20 bp, mouse
gtggaaaacaagaacccaga

SEQ ID NO: 643051 - DNA, 20 bp, mouse
gagaactgtttccaggtgaa

SEQ ID NO: 643052 - DNA, 20 bp, mouse
gaatactctaccctttctcc

SEQ ID NO: 643053 - DNA, 20 bp, mouse
gtggttggtccagaaccttc

SEQ ID NO: 643054 - DNA, 20 bp, mouse
gcatacctagaaatgcctac

SEQ ID NO: 643055 - DNA, 20 bp, mouse
gaatactattgttgtggatt

SEQ ID NO: 643056 - DNA, 20 bp, mouse
ggggtggggaccaacaggga

SEQ ID NO: 643057 - DNA, 20 bp, mouse
gccgccaggcacatttccgg

SEQ ID NO: 643058 - DNA, 20 bp, mouse
gagggaatctccagaactag

SEQ ID NO: 643059 - DNA, 20 bp, mouse
ggaaatgtgcctggcgggta

SEQ ID NO: 643060 - DNA, 20 bp, mouse
ggggtagggtggggaccaac

SEQ ID NO: 643061 - DNA, 20 bp, mouse
ggtgcctggcgggtagggtg

SEQ ID NO: 643062 - DNA, 20 bp, mouse
gggtccccaccctacccgcc

SEQ ID NO: 643063 - DNA, 20 bp, mouse
gaactaggggaaaggtcttt

SEQ ID NO: 643064 - DNA, 20 bp, mouse
gatctccagaactaggggaa

SEQ ID NO: 643065 - DNA, 20 bp, mouse
gtagccaccggaaatgtgcc

SEQ ID NO: 643066 - DNA, 20 bp, mouse
gctgacgggtgcaggaagga

SEQ ID NO: 643067 - DNA, 20 bp, mouse
ggaagctgacgggtgcagga

SEQ ID NO: 643068 - DNA, 20 bp, mouse
gggaggagccagtccggacc

SEQ ID NO: 643069 - DNA, 20 bp, mouse
gagacaagcgggacggcctg

SEQ ID NO: 643070 - DNA, 20 bp, mouse
ggccgtcccgcttgtctctc

SEQ ID NO: 643071 - DNA, 20 bp, mouse
gcccggtacaccatctaact

SEQ ID NO: 643072 - DNA, 20 bp, mouse
ggctctcccgagagacaagc

SEQ ID NO: 643073 - DNA, 20 bp, mouse
gggtcgccgtggaagctgac

SEQ ID NO: 643074 - DNA, 20 bp, mouse
gaccggcgagcccgctctgt

SEQ ID NO: 643075 - DNA, 20 bp, mouse
gctgcacccgtcagcttcca

SEQ ID NO: 643076 - DNA, 20 bp, mouse
ggggttagccacagggtcat

SEQ ID NO: 643077 - DNA, 20 bp, mouse
gggctgcaggggttagccac

SEQ ID NO: 643078 - DNA, 20 bp, mouse
gtggagacaagtgcccgggc

SEQ ID NO: 643079 - DNA, 20 bp, mouse
gtgcccgggcggggctgcag

SEQ ID NO: 643080 - DNA, 20 bp, mouse
gggaacaggtgtgataacat

SEQ ID NO: 643081 - DNA, 20 bp, mouse
gaacccctgcagccccgccc

SEQ ID NO: 643082 - DNA, 20 bp, mouse
gggcatggtcaggccagttc

SEQ ID NO: 643083 - DNA, 20 bp, mouse
ggtcaggccagttctggata

SEQ ID NO: 643084 - DNA, 20 bp, mouse
ggttctggatatgggatttg

SEQ ID NO: 643085 - DNA, 20 bp, mouse
ggcgggaacagagtgtttaa

SEQ ID NO: 643086 - DNA, 20 bp, mouse
ggcaacccgtaaggcggcgg

SEQ ID NO: 643087 - DNA, 20 bp, mouse
gctcacgaagagtaagtgtt

SEQ ID NO: 643088 - DNA, 20 bp, mouse
ggaagagtaagtgtttggat

SEQ ID NO: 643089 - DNA, 20 bp, mouse
gagcttctggacttggggcg

SEQ ID NO: 643090 - DNA, 20 bp, mouse
gccccaagtccagaagctcg

SEQ ID NO: 643091 - DNA, 20 bp, mouse
ggagcagtcccgttaagtgg

SEQ ID NO: 643092 - DNA, 20 bp, mouse
ggggctgccacgtcccatcc

SEQ ID NO: 643093 - DNA, 20 bp, mouse
gttggggcgtggctcgtctc

SEQ ID NO: 643094 - DNA, 20 bp, mouse
gtggaggagcaaggccatgg

SEQ ID NO: 643095 - DNA, 20 bp, mouse
gcatggcggtgagcgaaagg

SEQ ID NO: 643096 - DNA, 20 bp, mouse
gaggccagggaaacttctag

SEQ ID NO: 643097 - DNA, 20 bp, mouse
gaaaactaggaagttggcga

SEQ ID NO: 643098 - DNA, 20 bp, mouse
gtgaccttgggaagtgatgg

SEQ ID NO: 643099 - DNA, 20 bp, mouse
gagggctggccagataaaat

SEQ ID NO: 643100 - DNA, 20 bp, mouse
gaaaccactagaagtttccc

SEQ ID NO: 643101 - DNA, 20 bp, mouse
gccacccccatcacttccca

SEQ ID NO: 643102 - DNA, 20 bp, mouse
gcttccaccctgacctaatt

SEQ ID NO: 643103 - DNA, 20 bp, mouse
ggggtcacctggttacttaa

SEQ ID NO: 643104 - DNA, 20 bp, mouse
gcctgtagatgttccgaatt

SEQ ID NO: 643105 - DNA, 20 bp, mouse
gtaaccaggtgaccccgcta

SEQ ID NO: 643106 - DNA, 20 bp, mouse
ggggtagggaggaacatcat

SEQ ID NO: 643107 - DNA, 20 bp, mouse
gggaacaggcagggattaag

SEQ ID NO: 643108 - DNA, 20 bp, mouse
gttggcttgaggattcctag

SEQ ID NO: 643109 - DNA, 20 bp, mouse
gcctagagggatccagaaat

SEQ ID NO: 643110 - DNA, 20 bp, mouse
gaatcagcagggagaccgga

SEQ ID NO: 643111 - DNA, 20 bp, mouse
ggggctcctccctacccaat

SEQ ID NO: 643112 - DNA, 20 bp, mouse
gtgtgtggctggatgaactc

SEQ ID NO: 643113 - DNA, 20 bp, mouse
gaagactgcatgttggcttg

SEQ ID NO: 643114 - DNA, 20 bp, mouse
gtcagataagagcgagtgtg

SEQ ID NO: 643115 - DNA, 20 bp, mouse
gcacccagctactgtgtggc

SEQ ID NO: 643116 - DNA, 20 bp, mouse
gggctcgcggccaaaggctg

SEQ ID NO: 643117 - DNA, 20 bp, mouse
gggaggaggggcggcgctga

SEQ ID NO: 643118 - DNA, 20 bp, mouse
gcagccgcgagcccaaaagt

SEQ ID NO: 643119 - DNA, 20 bp, mouse
gggtgcgggccgccccgcaa

SEQ ID NO: 643120 - DNA, 20 bp, mouse
gcgtccgggccctcagcctt

SEQ ID NO: 643121 - DNA, 20 bp, mouse
gcgcaagggctcgcggccaa

SEQ ID NO: 643122 - DNA, 20 bp, mouse
ggccgcgagcccttgcgggg

SEQ ID NO: 643123 - DNA, 20 bp, mouse
gctgagtgctcgagctaagg

SEQ ID NO: 643124 - DNA, 20 bp, mouse
gggcctgagtgctcgagcta

SEQ ID NO: 643125 - DNA, 20 bp, mouse
ggatcagcgccggttcggag

SEQ ID NO: 643126 - DNA, 20 bp, mouse
gaggccctgattagctggtg

SEQ ID NO: 643127 - DNA, 20 bp, mouse
gtgcccgcctccattccgat

SEQ ID NO: 643128 - DNA, 20 bp, mouse
gactttgcagtccaggtgta

SEQ ID NO: 643129 - DNA, 20 bp, mouse
gggaacaccaatcggaatgg

SEQ ID NO: 643130 - DNA, 20 bp, mouse
gtcacagcctcagtcgctaa

SEQ ID NO: 643131 - DNA, 20 bp, mouse
gatgctagagacctatatga

SEQ ID NO: 643132 - DNA, 20 bp, mouse
ggaagttcccactaggtgca

SEQ ID NO: 643133 - DNA, 20 bp, mouse
gctcgaggcggaacaccaat

SEQ ID NO: 643134 - DNA, 20 bp, mouse
gcaggcctcaccagctaatc

SEQ ID NO: 643135 - DNA, 20 bp, mouse
gggcggaacaccaatcggaa

SEQ ID NO: 643136 - DNA, 20 bp, mouse
ggttacgcgtagccgatctc

SEQ ID NO: 643137 - DNA, 20 bp, mouse
gtacgcgtaacaaccggaga

SEQ ID NO: 643138 - DNA, 20 bp, mouse
gctctcggatgcaacgtcgt

SEQ ID NO: 643139 - DNA, 20 bp, mouse
ggcctgccgcccgccctctc

SEQ ID NO: 643140 - DNA, 20 bp, mouse
gcgtaacaaccggagagggc

SEQ ID NO: 643141 - DNA, 20 bp, mouse
gcattggctgggaggagtgt

SEQ ID NO: 643142 - DNA, 20 bp, mouse
gagaggtctcgggttagagt

SEQ ID NO: 643143 - DNA, 20 bp, mouse
gaacaaccggagagggcggg

SEQ ID NO: 643144 - DNA, 20 bp, mouse
gaagaagcaccagagggtat

SEQ ID NO: 643145 - DNA, 20 bp, mouse
gatcggctacgcgtaacaac

SEQ ID NO: 643146 - DNA, 20 bp, mouse
gagaagtttacacaattagt

SEQ ID NO: 643147 - DNA, 20 bp, mouse
gtgccccaaagcaattcaaa

SEQ ID NO: 643148 - DNA, 20 bp, mouse
gccaagtgggaaaaggctct

SEQ ID NO: 643149 - DNA, 20 bp, mouse
gtaaacttctctcagactcg

SEQ ID NO: 643150 - DNA, 20 bp, mouse
gccaggcttctcctagcctc

SEQ ID NO: 643151 - DNA, 20 bp, mouse
gaagagtaacacaagtacat

SEQ ID NO: 643152 - DNA, 20 bp, mouse
gctaggatgtggtttcaggc

SEQ ID NO: 643153 - DNA, 20 bp, mouse
gttcagggctctctaggatg

SEQ ID NO: 643154 - DNA, 20 bp, mouse
gcattttcatcgtgggttgt

SEQ ID NO: 643155 - DNA, 20 bp, mouse
ggtgtttgcattttcatcgt

SEQ ID NO: 643156 - DNA, 20 bp, mouse
gcaggaaccaggttacttct

SEQ ID NO: 643157 - DNA, 20 bp, mouse
ggtaagtaacaagtcctcgt

SEQ ID NO: 643158 - DNA, 20 bp, mouse
ggaggcttacaggtcaaatt

SEQ ID NO: 643159 - DNA, 20 bp, mouse
gtcccagctgggatagcccc

SEQ ID NO: 643160 - DNA, 20 bp, mouse
gactgaccaagcggtggatc

SEQ ID NO: 643161 - DNA, 20 bp, mouse
gttccggataatcgaggggt

SEQ ID NO: 643162 - DNA, 20 bp, mouse
ggaagcgcataaggaaataa

SEQ ID NO: 643163 - DNA, 20 bp, mouse
gtctaagtcgtggtggaatc

SEQ ID NO: 643164 - DNA, 20 bp, mouse
gtgacccagccaaggtctcc

SEQ ID NO: 643165 - DNA, 20 bp, mouse
gcggaatgaagagcgaattt

SEQ ID NO: 643166 - DNA, 20 bp, mouse
ggccagcaggggcgggtcaa

SEQ ID NO: 643167 - DNA, 20 bp, mouse
gcaggggcgggtcaagggtt

SEQ ID NO: 643168 - DNA, 20 bp, mouse
ggagaactgcatagcttcag

SEQ ID NO: 643169 - DNA, 20 bp, mouse
ggcttctgctaccaaagcga

SEQ ID NO: 643170 - DNA, 20 bp, mouse
gtcaacaaatatggtcgctg

SEQ ID NO: 643171 - DNA, 20 bp, mouse
ggagcttgagcttgagtccc

SEQ ID NO: 643172 - DNA, 20 bp, mouse
ggccagaggcgggactcggc

SEQ ID NO: 643173 - DNA, 20 bp, mouse
gctctggcattacgtggttc

SEQ ID NO: 643174 - DNA, 20 bp, mouse
gtaatgccagaggcgggact

SEQ ID NO: 643175 - DNA, 20 bp, mouse
ggcattacgtggttccggcc

SEQ ID NO: 643176 - DNA, 20 bp, mouse
ggggccagtcgatgatgtaa

SEQ ID NO: 643177 - DNA, 20 bp, mouse
gcggagcccgcccagccggt

SEQ ID NO: 643178 - DNA, 20 bp, mouse
gccacaatcccgtgctgcga

SEQ ID NO: 643179 - DNA, 20 bp, mouse
ggggcggagacataggctcc

SEQ ID NO: 643180 - DNA, 20 bp, mouse
ggagagagtcgatgtcctat

SEQ ID NO: 643181 - DNA, 20 bp, mouse
gcaggccgtcaggtgatctg

SEQ ID NO: 643182 - DNA, 20 bp, mouse
gagccggtgggcggagacat

SEQ ID NO: 643183 - DNA, 20 bp, mouse
gtctccgcccaccggctggg

SEQ ID NO: 643184 - DNA, 20 bp, mouse
gggcccgcaaaggtcgttcc

SEQ ID NO: 643185 - DNA, 20 bp, mouse
gcgaccgccccggcccgcaa

SEQ ID NO: 643186 - DNA, 20 bp, mouse
ggggaactagaagctaacca

SEQ ID NO: 643187 - DNA, 20 bp, mouse
gaataagtggagccggggaa

SEQ ID NO: 643188 - DNA, 20 bp, mouse
gaactagaagctaaccatgg

SEQ ID NO: 643189 - DNA, 20 bp, mouse
gtccacaccggagctgatcc

SEQ ID NO: 643190 - DNA, 20 bp, mouse
gctggccactcccctgctgt

SEQ ID NO: 643191 - DNA, 20 bp, mouse
gggaagggaaggcaatgtcc

SEQ ID NO: 643192 - DNA, 20 bp, mouse
ggctaaccatggaggagact

SEQ ID NO: 643193 - DNA, 20 bp, mouse
gagcttacatagtttttttt

SEQ ID NO: 643194 - DNA, 20 bp, mouse
gggcagaacaactgcagtga

SEQ ID NO: 643195 - DNA, 20 bp, mouse
gcaactgcagtgaagggggc

SEQ ID NO: 643196 - DNA, 20 bp, mouse
gtgaagcgaagcccgggcca

SEQ ID NO: 643197 - DNA, 20 bp, mouse
gaagcccgggccagggtcgc

SEQ ID NO: 643198 - DNA, 20 bp, mouse
ggccgcccatcctctcctgg

SEQ ID NO: 643199 - DNA, 20 bp, mouse
ggagatgtgaagcgaagccc

SEQ ID NO: 643200 - DNA, 20 bp, mouse
gtccgccaggagaggatggg

SEQ ID NO: 643201 - DNA, 20 bp, mouse
gtggcagcggcacttccgcc

SEQ ID NO: 643202 - DNA, 20 bp, mouse
gcgcctccggccccggcgag

SEQ ID NO: 643203 - DNA, 20 bp, mouse
gagaggatgggcggcccggg

SEQ ID NO: 643204 - DNA, 20 bp, mouse
gcgggccgcccatcctctcc

SEQ ID NO: 643205 - DNA, 20 bp, mouse
gcgaccccgcctcaggtctg

SEQ ID NO: 643206 - DNA, 20 bp, mouse
ggggagcaaaagaggaatgt

SEQ ID NO: 643207 - DNA, 20 bp, mouse
gcaaacacgtacacacatgc

SEQ ID NO: 643208 - DNA, 20 bp, mouse
gaagataaagtcacgaccat

SEQ ID NO: 643209 - DNA, 20 bp, mouse
gatgctcacaaatatcctaa

SEQ ID NO: 643210 - DNA, 20 bp, mouse
gtgttgctgccaggtgccta

SEQ ID NO: 643211 - DNA, 20 bp, mouse
gggaagagatggtgaaatgg

SEQ ID NO: 643212 - DNA, 20 bp, mouse
ggcaaggagggaaatgggag

SEQ ID NO: 643213 - DNA, 20 bp, mouse
gtatgggagggtagaaggat

SEQ ID NO: 643214 - DNA, 20 bp, mouse
gtggaggcaaggagggaaat

SEQ ID NO: 643215 - DNA, 20 bp, mouse
gtggatggggggagtgaata

SEQ ID NO: 643216 - DNA, 20 bp, mouse
ggggccttgacggctcgcct

SEQ ID NO: 643217 - DNA, 20 bp, mouse
gtatccccgcggggccttga

SEQ ID NO: 643218 - DNA, 20 bp, mouse
gcgggaaagtggcgctgcgg

SEQ ID NO: 643219 - DNA, 20 bp, mouse
ggccccgcggggatacccga

SEQ ID NO: 643220 - DNA, 20 bp, mouse
gaccctccgggccggtgcga

SEQ ID NO: 643221 - DNA, 20 bp, mouse
ggcggcccagagagtcaatt

SEQ ID NO: 643222 - DNA, 20 bp, mouse
gccgcccccacccctcgcac

SEQ ID NO: 643223 - DNA, 20 bp, mouse
gccgccgtcgggtatccccg

SEQ ID NO: 643224 - DNA, 20 bp, mouse
gcccacccctcgcaccggcc

SEQ ID NO: 643225 - DNA, 20 bp, mouse
ggccggcggggaccagtccc

SEQ ID NO: 643226 - DNA, 20 bp, mouse
gcatgcagataattcacaag

SEQ ID NO: 643227 - DNA, 20 bp, mouse
gccattgggtgaaacatgaa

SEQ ID NO: 643228 - DNA, 20 bp, mouse
ggataattcacaagaggccc

SEQ ID NO: 643229 - DNA, 20 bp, mouse
gatgtctcattgctttttcc

SEQ ID NO: 643230 - DNA, 20 bp, mouse
gaatgagaattctaatattt

SEQ ID NO: 643231 - DNA, 20 bp, mouse
gagaactgtttgagaatcaa

SEQ ID NO: 643232 - DNA, 20 bp, mouse
gtgggctacgactttgatct

SEQ ID NO: 643233 - DNA, 20 bp, mouse
ggaaggaaaaaatatgtccc

SEQ ID NO: 643234 - DNA, 20 bp, mouse
gatcaaagtcgtagcccaat

SEQ ID NO: 643235 - DNA, 20 bp, mouse
ggcatgaagtaccatgttcc

SEQ ID NO: 643236 - DNA, 20 bp, mouse
gaagcacttgggtaggattt

SEQ ID NO: 643237 - DNA, 20 bp, mouse
gcagactgtgaggggacacg

SEQ ID NO: 643238 - DNA, 20 bp, mouse
gtgctgggaagcacttgggt

SEQ ID NO: 643239 - DNA, 20 bp, mouse
gtgggttgccagactgtgag

SEQ ID NO: 643240 - DNA, 20 bp, mouse
ggggcacataggttaatgag

SEQ ID NO: 643241 - DNA, 20 bp, mouse
gacacggggcattgagaagg

SEQ ID NO: 643242 - DNA, 20 bp, mouse
ggtaccccctcggaagaatg

SEQ ID NO: 643243 - DNA, 20 bp, mouse
ggctctgacagaagaggtgc

SEQ ID NO: 643244 - DNA, 20 bp, mouse
gagctgacatgactctggga

SEQ ID NO: 643245 - DNA, 20 bp, mouse
gggagtaccccattcttccg

SEQ ID NO: 643246 - DNA, 20 bp, mouse
ggcacagagcaacatcagga

SEQ ID NO: 643247 - DNA, 20 bp, mouse
gacccttcatcattattagt

SEQ ID NO: 643248 - DNA, 20 bp, mouse
gagagaaggcattcattggt

SEQ ID NO: 643249 - DNA, 20 bp, mouse
gactgagagaaggcattcat

SEQ ID NO: 643250 - DNA, 20 bp, mouse
gcatcaggatggtaaccttg

SEQ ID NO: 643251 - DNA, 20 bp, mouse
gcaacctccacactgagaga

SEQ ID NO: 643252 - DNA, 20 bp, mouse
gaagacacagagtttgtcag

SEQ ID NO: 643253 - DNA, 20 bp, mouse
ggattattgtcttttcaact

SEQ ID NO: 643254 - DNA, 20 bp, mouse
ggcattcattggtaggaact

SEQ ID NO: 643255 - DNA, 20 bp, mouse
gatgccttctctcagtgtgg

SEQ ID NO: 643256 - DNA, 20 bp, mouse
gcgcccccttgcgtacggag

SEQ ID NO: 643257 - DNA, 20 bp, mouse
ggtgcccgctccgtacgcaa

SEQ ID NO: 643258 - DNA, 20 bp, mouse
gcacgacgctgacacgtccg

SEQ ID NO: 643259 - DNA, 20 bp, mouse
gtacgccacaggtcggtcct

SEQ ID NO: 643260 - DNA, 20 bp, mouse
gggggcgcgccaggaagtcc

SEQ ID NO: 643261 - DNA, 20 bp, mouse
gtggcgcgcccccttgcgta

SEQ ID NO: 643262 - DNA, 20 bp, mouse
gcgctccttacgccacaggt

SEQ ID NO: 643263 - DNA, 20 bp, mouse
ggcggggaaagctcactggt

SEQ ID NO: 643264 - DNA, 20 bp, mouse
gacgtccgaggaccgacctg

SEQ ID NO: 643265 - DNA, 20 bp, mouse
gaggaagaaagttccgagtc

SEQ ID NO: 643266 - DNA, 20 bp, mouse
gcggcggagggttacagaag

SEQ ID NO: 643267 - DNA, 20 bp, mouse
ggccgcgccgcgcctgcaaa

SEQ ID NO: 643268 - DNA, 20 bp, mouse
gaagagggcgtggtctcaag

SEQ ID NO: 643269 - DNA, 20 bp, mouse
gtgtgcaataagtgagggcg

SEQ ID NO: 643270 - DNA, 20 bp, mouse
ggcaggcgaggcactctttt

SEQ ID NO: 643271 - DNA, 20 bp, mouse
gggcgtggcgaaggctgctg

SEQ ID NO: 643272 - DNA, 20 bp, mouse
gaccaggccggatgtcccac

SEQ ID NO: 643273 - DNA, 20 bp, mouse
ggcgcggcctgtgggacatc

SEQ ID NO: 643274 - DNA, 20 bp, mouse
gttaagcacaggacattctg

SEQ ID NO: 643275 - DNA, 20 bp, mouse
ggtcgcgtgtgctcactcac

SEQ ID NO: 643276 - DNA, 20 bp, mouse
gtagggcccagaggcaatta

SEQ ID NO: 643277 - DNA, 20 bp, mouse
gcccaacgggaaggaaagta

SEQ ID NO: 643278 - DNA, 20 bp, mouse
gaacgcctggagtttcccaa

SEQ ID NO: 643279 - DNA, 20 bp, mouse
gttaggtaacacttggtgac

SEQ ID NO: 643280 - DNA, 20 bp, mouse
gacgcaatctcttaaagcac

SEQ ID NO: 643281 - DNA, 20 bp, mouse
gttgaaattctttgtagatt

SEQ ID NO: 643282 - DNA, 20 bp, mouse
gagcagagctttaatctcga

SEQ ID NO: 643283 - DNA, 20 bp, mouse
gaatttggactgaataagtt

SEQ ID NO: 643284 - DNA, 20 bp, mouse
gctggagtttcccaacggga

SEQ ID NO: 643285 - DNA, 20 bp, mouse
ggctttaagagattgcgtcg

SEQ ID NO: 643286 - DNA, 20 bp, mouse
gagaatccaaatgtaagcac

SEQ ID NO: 643287 - DNA, 20 bp, mouse
gttaaagcttagtctactct

SEQ ID NO: 643288 - DNA, 20 bp, mouse
gaaattacatgttaatttag

SEQ ID NO: 643289 - DNA, 20 bp, mouse
gaaatgaaagatagggtgtg

SEQ ID NO: 643290 - DNA, 20 bp, mouse
gtgttgaaattcatcaggtg

SEQ ID NO: 643291 - DNA, 20 bp, mouse
ggttctgcaaatggacagac

SEQ ID NO: 643292 - DNA, 20 bp, mouse
gcagaatgaagaaacactgc

SEQ ID NO: 643293 - DNA, 20 bp, mouse
gaagctttaaaatgaaagat

SEQ ID NO: 643294 - DNA, 20 bp, mouse
ggtcagcataaaatagcttt

SEQ ID NO: 643295 - DNA, 20 bp, mouse
gtattagcatatattttaac

SEQ ID NO: 643296 - DNA, 20 bp, mouse
ggtgtgggcagtaagatcaa

SEQ ID NO: 643297 - DNA, 20 bp, mouse
gaaggggagggtgttgttcc

SEQ ID NO: 643298 - DNA, 20 bp, mouse
ggtgatgccaggattcaaat

SEQ ID NO: 643299 - DNA, 20 bp, mouse
gctggccagggcccatactg

SEQ ID NO: 643300 - DNA, 20 bp, mouse
gtgtcacagatccaagggga

SEQ ID NO: 643301 - DNA, 20 bp, mouse
ggatctgtgacatcttgact

SEQ ID NO: 643302 - DNA, 20 bp, mouse
gaagactagaattagggtgt

SEQ ID NO: 643303 - DNA, 20 bp, mouse
gtgtggcaagactagaatta

SEQ ID NO: 643304 - DNA, 20 bp, mouse
gacagtgcttacaggaagca

SEQ ID NO: 643305 - DNA, 20 bp, mouse
gactactatagatagggcgt

SEQ ID NO: 643306 - DNA, 20 bp, mouse
gcacaggcagcccaagtcac

SEQ ID NO: 643307 - DNA, 20 bp, mouse
ggtgatgcacgataacaaca

SEQ ID NO: 643308 - DNA, 20 bp, mouse
gggacaaagtccatccacag

SEQ ID NO: 643309 - DNA, 20 bp, mouse
gcgccccgccggccggccta

SEQ ID NO: 643310 - DNA, 20 bp, mouse
gtggaagctgatggtatctc

SEQ ID NO: 643311 - DNA, 20 bp, mouse
ggcctatggcagctgaccac

SEQ ID NO: 643312 - DNA, 20 bp, mouse
ggaggggcagtggctgaccc

SEQ ID NO: 643313 - DNA, 20 bp, mouse
gtaaatagacccgggtcagg

SEQ ID NO: 643314 - DNA, 20 bp, mouse
gtgccataggccggccggcg

SEQ ID NO: 643315 - DNA, 20 bp, mouse
gtggagagacgaaaaccgct

SEQ ID NO: 643316 - DNA, 20 bp, mouse
gtggaaaggcggggtcacga

SEQ ID NO: 643317 - DNA, 20 bp, mouse
gccacgcggggccgaccctt

SEQ ID NO: 643318 - DNA, 20 bp, mouse
ggacagtgctatgggaggtg

SEQ ID NO: 643319 - DNA, 20 bp, mouse
ggacgctacggagctacaga

SEQ ID NO: 643320 - DNA, 20 bp, mouse
gcgcggggccgacccttcgg

SEQ ID NO: 643321 - DNA, 20 bp, mouse
gttcggaggcgtggccacaa

SEQ ID NO: 643322 - DNA, 20 bp, mouse
ggaggggacagtgctatggg

SEQ ID NO: 643323 - DNA, 20 bp, mouse
gggtattcaaactggaagaa

SEQ ID NO: 643324 - DNA, 20 bp, mouse
ggtggccacaagggacgcta

SEQ ID NO: 643325 - DNA, 20 bp, mouse
gtcaaactggaagaacggtt

SEQ ID NO: 643326 - DNA, 20 bp, mouse
gccactggaggagcggggaa

SEQ ID NO: 643327 - DNA, 20 bp, mouse
ggcaacgcggcgcgcgcgac

SEQ ID NO: 643328 - DNA, 20 bp, mouse
gcgcgcgcgccgcgttgcta

SEQ ID NO: 643329 - DNA, 20 bp, mouse
gtgggcctgcgccatgacta

SEQ ID NO: 643330 - DNA, 20 bp, mouse
gcgctgggcagccgaggctc

SEQ ID NO: 643331 - DNA, 20 bp, mouse
gccatctaggagcgctccgc

SEQ ID NO: 643332 - DNA, 20 bp, mouse
gggagcgctcctagatggtg

SEQ ID NO: 643333 - DNA, 20 bp, mouse
gcctgcgccatgactaagga

SEQ ID NO: 643334 - DNA, 20 bp, mouse
ggcgcgctccactggaggag

SEQ ID NO: 643335 - DNA, 20 bp, mouse
ggcggggaaggggggtgtga

SEQ ID NO: 643336 - DNA, 20 bp, mouse
gcggccctgagaagcacttc

SEQ ID NO: 643337 - DNA, 20 bp, mouse
gctcgctcccggggcatctt

SEQ ID NO: 643338 - DNA, 20 bp, mouse
ggccaccggaagtgcttctc

SEQ ID NO: 643339 - DNA, 20 bp, mouse
gccttcggacgccgtctcca

SEQ ID NO: 643340 - DNA, 20 bp, mouse
gccttctcaggggccgtctc

SEQ ID NO: 643341 - DNA, 20 bp, mouse
gatagctggtgcacctgaga

SEQ ID NO: 643342 - DNA, 20 bp, mouse
gcaccctgggaagagtagtt

SEQ ID NO: 643343 - DNA, 20 bp, mouse
gcagggactggagatgatag

SEQ ID NO: 643344 - DNA, 20 bp, mouse
gactggagatgatagtggag

SEQ ID NO: 643345 - DNA, 20 bp, mouse
gccggtggcaggtcacttcc

SEQ ID NO: 643346 - DNA, 20 bp, mouse
ggaagagggcggaaagtgaa

SEQ ID NO: 643347 - DNA, 20 bp, mouse
gggagccttgaagtcgtaga

SEQ ID NO: 643348 - DNA, 20 bp, mouse
gggcagtagcgaccccgaag

SEQ ID NO: 643349 - DNA, 20 bp, mouse
gaagcggggcggagaggttg

SEQ ID NO: 643350 - DNA, 20 bp, mouse
gctactgcctcgtgtgacag

SEQ ID NO: 643351 - DNA, 20 bp, mouse
gggcccgtagcgttccaaga

SEQ ID NO: 643352 - DNA, 20 bp, mouse
gaatgaaaacaagggaagcg

SEQ ID NO: 643353 - DNA, 20 bp, mouse
ggacaggaggcgctctcgag

SEQ ID NO: 643354 - DNA, 20 bp, mouse
ggaaaacaagggaagcgggg

SEQ ID NO: 643355 - DNA, 20 bp, mouse
gttgaagtcgtagagggaag

SEQ ID NO: 643356 - DNA, 20 bp, mouse
gacggggagcgcagtgaagg

SEQ ID NO: 643357 - DNA, 20 bp, mouse
gtccgggccaatggcgacag

SEQ ID NO: 643358 - DNA, 20 bp, mouse
ggggctctcccgccacgccc

SEQ ID NO: 643359 - DNA, 20 bp, mouse
gaactaggatgaccaggccg

SEQ ID NO: 643360 - DNA, 20 bp, mouse
gccggagaactactcctccc

SEQ ID NO: 643361 - DNA, 20 bp, mouse
ggtcatgtaaggtggagctt

SEQ ID NO: 643362 - DNA, 20 bp, mouse
ggggccaatggcgacagtgg

SEQ ID NO: 643363 - DNA, 20 bp, mouse
ggtcctccggggtaaggaga

SEQ ID NO: 643364 - DNA, 20 bp, mouse
gctgggggcggagtcatgta

SEQ ID NO: 643365 - DNA, 20 bp, mouse
gggtaaggagagggaccctc

SEQ ID NO: 643366 - DNA, 20 bp, mouse
gtgagggcaggcgtcatcag

SEQ ID NO: 643367 - DNA, 20 bp, mouse
gtctggccctatcctgctga

SEQ ID NO: 643368 - DNA, 20 bp, mouse
gggcgtcatcagtggtactg

SEQ ID NO: 643369 - DNA, 20 bp, mouse
gcaagctatagggagagcat

SEQ ID NO: 643370 - DNA, 20 bp, mouse
gctgcctggggtaacatggg

SEQ ID NO: 643371 - DNA, 20 bp, mouse
gcgcctgccctcagcaggat

SEQ ID NO: 643372 - DNA, 20 bp, mouse
gatactgcctggggtaacat

SEQ ID NO: 643373 - DNA, 20 bp, mouse
gccagcagggcttggcagtc

SEQ ID NO: 643374 - DNA, 20 bp, mouse
ggaccaagaaggaccctcag

SEQ ID NO: 643375 - DNA, 20 bp, mouse
gctctccctatagcttgaga

SEQ ID NO: 643376 - DNA, 20 bp, mouse
gtctggacggggatataaag

SEQ ID NO: 643377 - DNA, 20 bp, mouse
ggtgaccggcataggaaatg

SEQ ID NO: 643378 - DNA, 20 bp, mouse
gggtgagtatgtttctggac

SEQ ID NO: 643379 - DNA, 20 bp, mouse
gtggatggtgagtatgtttc

SEQ ID NO: 643380 - DNA, 20 bp, mouse
gcggaaacgggacggaagtt

SEQ ID NO: 643381 - DNA, 20 bp, mouse
gtataaatgtgcactgagtg

SEQ ID NO: 643382 - DNA, 20 bp, mouse
ggcacacagtagccacagac

SEQ ID NO: 643383 - DNA, 20 bp, mouse
gcaaagcatggttcaggtgt

SEQ ID NO: 643384 - DNA, 20 bp, mouse
gcttgagaccaaaaggactg

SEQ ID NO: 643385 - DNA, 20 bp, mouse
gagactggctcagtcatggt

SEQ ID NO: 643386 - DNA, 20 bp, mouse
gtccctccgttgttgctatg

SEQ ID NO: 643387 - DNA, 20 bp, mouse
gtgcctcatagcaacaacgg

SEQ ID NO: 643388 - DNA, 20 bp, mouse
gcctcggtttttatctgcgt

SEQ ID NO: 643389 - DNA, 20 bp, mouse
gagccgagcagcgctctgag

SEQ ID NO: 643390 - DNA, 20 bp, mouse
gcgggggcagttaacggaac

SEQ ID NO: 643391 - DNA, 20 bp, mouse
gttaaggccgatcgggtcgg

SEQ ID NO: 643392 - DNA, 20 bp, mouse
gcccccgcccccgacccgat

SEQ ID NO: 643393 - DNA, 20 bp, mouse
ggtggatgatacatgcgtat

SEQ ID NO: 643394 - DNA, 20 bp, mouse
ggtaacagcgtccactgcca

SEQ ID NO: 643395 - DNA, 20 bp, mouse
gctgacgatttaccacgggg

SEQ ID NO: 643396 - DNA, 20 bp, mouse
gcaggagccttcccagaaac

SEQ ID NO: 643397 - DNA, 20 bp, mouse
gaacaagccggtttctggga

SEQ ID NO: 643398 - DNA, 20 bp, mouse
gacatggagtgtcacgtgac

SEQ ID NO: 643399 - DNA, 20 bp, mouse
gagctaacaagccggtttct

SEQ ID NO: 643400 - DNA, 20 bp, mouse
gcgcgaatgagctaacaagc

SEQ ID NO: 643401 - DNA, 20 bp, mouse
gacgtgacagggttgactat

SEQ ID NO: 643402 - DNA, 20 bp, mouse
gcattcgcgctccgaatgat

SEQ ID NO: 643403 - DNA, 20 bp, mouse
gggatggtgaggtacggctc

SEQ ID NO: 643404 - DNA, 20 bp, mouse
gtggtggcgatcacagattt

SEQ ID NO: 643405 - DNA, 20 bp, mouse
ggctcaagaaagctaggaca

SEQ ID NO: 643406 - DNA, 20 bp, mouse
gggaagaagtccccttcttg

SEQ ID NO: 643407 - DNA, 20 bp, mouse
ggcgggtggaagacttgggg

SEQ ID NO: 643408 - DNA, 20 bp, mouse
ggggactgaagcaggttctt

SEQ ID NO: 643409 - DNA, 20 bp, mouse
gcctggcgggtggaagactt

SEQ ID NO: 643410 - DNA, 20 bp, mouse
gaacaggtgtgggtgcaatt

SEQ ID NO: 643411 - DNA, 20 bp, mouse
gtacagcggcccctggcggg

SEQ ID NO: 643412 - DNA, 20 bp, mouse
gactgccagaatacagattt

SEQ ID NO: 643413 - DNA, 20 bp, mouse
ggacttcttcccctggcgag

SEQ ID NO: 643414 - DNA, 20 bp, mouse
gcctactctatgcaaagtta

SEQ ID NO: 643415 - DNA, 20 bp, mouse
gaaagtgtttccccaagaag

SEQ ID NO: 643416 - DNA, 20 bp, mouse
gaggccctgtggcataaagg

SEQ ID NO: 643417 - DNA, 20 bp, mouse
gggcggacggagagcgatgt

SEQ ID NO: 643418 - DNA, 20 bp, mouse
gctcttggggccttgtgatt

SEQ ID NO: 643419 - DNA, 20 bp, mouse
gcagaggccctgtggcataa

SEQ ID NO: 643420 - DNA, 20 bp, mouse
gttaccgcgctcggcacgaa

SEQ ID NO: 643421 - DNA, 20 bp, mouse
gctctgctggccaaatcaca

SEQ ID NO: 643422 - DNA, 20 bp, mouse
gaagacgttcttcagctctt

SEQ ID NO: 643423 - DNA, 20 bp, mouse
gtaccccttcgtgccgagcg

SEQ ID NO: 643424 - DNA, 20 bp, mouse
gtactaaaactgccaactgt

SEQ ID NO: 643425 - DNA, 20 bp, mouse
gtggcagttttagtaaattt

SEQ ID NO: 643426 - DNA, 20 bp, mouse
ggtaggaggaagggttgcga

SEQ ID NO: 643427 - DNA, 20 bp, mouse
gaacgctcccggtgtccttc

SEQ ID NO: 643428 - DNA, 20 bp, mouse
ggggcgggccctcccgagat

SEQ ID NO: 643429 - DNA, 20 bp, mouse
gtggactccagaaggacacc

SEQ ID NO: 643430 - DNA, 20 bp, mouse
gcgggccctcccgagattgg

SEQ ID NO: 643431 - DNA, 20 bp, mouse
gtactctctatccagggaaa

SEQ ID NO: 643432 - DNA, 20 bp, mouse
gcactcctccaatctcggga

SEQ ID NO: 643433 - DNA, 20 bp, mouse
gacccgcccaccactcgtcc

SEQ ID NO: 643434 - DNA, 20 bp, mouse
gcctctccttatatggtagg

SEQ ID NO: 643435 - DNA, 20 bp, mouse
gccttatatggtaggaggaa

SEQ ID NO: 643436 - DNA, 20 bp, mouse
ggacgctggagtgacgtcac

SEQ ID NO: 643437 - DNA, 20 bp, mouse
gcgcacggaccaaacccgtt

SEQ ID NO: 643438 - DNA, 20 bp, mouse
ggcgcccgaagatgacgcag

SEQ ID NO: 643439 - DNA, 20 bp, mouse
gcccgttgggccaaacgcgg

SEQ ID NO: 643440 - DNA, 20 bp, mouse
gccgctgaaggtgacgcttc

SEQ ID NO: 643441 - DNA, 20 bp, mouse
gaaacccgttgggccaaacg

SEQ ID NO: 643442 - DNA, 20 bp, mouse
ggcaggggccgatgattccc

SEQ ID NO: 643443 - DNA, 20 bp, mouse
gagagcccgccccccgacgc

SEQ ID NO: 643444 - DNA, 20 bp, mouse
gtgggtgctggagacctaga

SEQ ID NO: 643445 - DNA, 20 bp, mouse
ggacgtcactccagcgtcgg

SEQ ID NO: 643446 - DNA, 20 bp, mouse
gaaccctgaactaaaggtgg

SEQ ID NO: 643447 - DNA, 20 bp, mouse
gcacccccacctttagttca

SEQ ID NO: 643448 - DNA, 20 bp, mouse
gaagccggcagggcggtttg

SEQ ID NO: 643449 - DNA, 20 bp, mouse
gccgccctgccggcttccgt

SEQ ID NO: 643450 - DNA, 20 bp, mouse
gcgcacagacgcctgaaaag

SEQ ID NO: 643451 - DNA, 20 bp, mouse
ggtaggagacgtacaggttg

SEQ ID NO: 643452 - DNA, 20 bp, mouse
gtgcgaagtagctggacgcc

SEQ ID NO: 643453 - DNA, 20 bp, mouse
gttagttcagggttgagcgt

SEQ ID NO: 643454 - DNA, 20 bp, mouse
gaggcccagcctgtaaactc

SEQ ID NO: 643455 - DNA, 20 bp, mouse
gtagctcgctctcctcggaa

SEQ ID NO: 643456 - DNA, 20 bp, mouse
ggcagtaagcccacgagggt

SEQ ID NO: 643457 - DNA, 20 bp, mouse
gctagggtcagagatctttc

SEQ ID NO: 643458 - DNA, 20 bp, mouse
gatgagctaagtaagctcta

SEQ ID NO: 643459 - DNA, 20 bp, mouse
gtgtggcagtaagcccacga

SEQ ID NO: 643460 - DNA, 20 bp, mouse
gtgaacttcagggtagagca

SEQ ID NO: 643461 - DNA, 20 bp, mouse
gcagggcatgacctagtacc

SEQ ID NO: 643462 - DNA, 20 bp, mouse
gacctggcagcaccgctgat

SEQ ID NO: 643463 - DNA, 20 bp, mouse
gcttacttagctcatggcat

SEQ ID NO: 643464 - DNA, 20 bp, mouse
gccgttgattggctgcagga

SEQ ID NO: 643465 - DNA, 20 bp, mouse
gggcagcaccgctgattggt

SEQ ID NO: 643466 - DNA, 20 bp, mouse
gtgaccgcttggagcgagaa

SEQ ID NO: 643467 - DNA, 20 bp, mouse
gcccgcgccgcgcgtccgag

SEQ ID NO: 643468 - DNA, 20 bp, mouse
gggcgcccgaaaccgtggca

SEQ ID NO: 643469 - DNA, 20 bp, mouse
gcgcaaccctgccacggttt

SEQ ID NO: 643470 - DNA, 20 bp, mouse
ggcggctcgcaaccctgcca

SEQ ID NO: 643471 - DNA, 20 bp, mouse
gtccaagcggtcacgtgctc

SEQ ID NO: 643472 - DNA, 20 bp, mouse
gggggcgtcgcgtcaccact

SEQ ID NO: 643473 - DNA, 20 bp, mouse
gcgcgcgtccgaggggcctc

SEQ ID NO: 643474 - DNA, 20 bp, mouse
gcggcgcacgcgcgttcggg

SEQ ID NO: 643475 - DNA, 20 bp, mouse
gctccggcgcacgcgcgttc

SEQ ID NO: 643476 - DNA, 20 bp, mouse
gaatccgagggggcatgagt

SEQ ID NO: 643477 - DNA, 20 bp, mouse
ggcaaagccgcctttgttgg

SEQ ID NO: 643478 - DNA, 20 bp, mouse
gagcccagaaggccggggtc

SEQ ID NO: 643479 - DNA, 20 bp, mouse
gggagaagaagggtcagcgt

SEQ ID NO: 643480 - DNA, 20 bp, mouse
gagccagtgtgtcccgtaca

SEQ ID NO: 643481 - DNA, 20 bp, mouse
ggggctgctgggacgcccaa

SEQ ID NO: 643482 - DNA, 20 bp, mouse
gaagcagcccccaacaaagg

SEQ ID NO: 643483 - DNA, 20 bp, mouse
gtcactctgcctgtctcaca

SEQ ID NO: 643484 - DNA, 20 bp, mouse
gccttctgggctatcagcgt

SEQ ID NO: 643485 - DNA, 20 bp, mouse
ggaagctggtgccgaggcct

SEQ ID NO: 643486 - DNA, 20 bp, mouse
gaaggctggggacacggaga

SEQ ID NO: 643487 - DNA, 20 bp, mouse
gggaggggcacgcagttcgt

SEQ ID NO: 643488 - DNA, 20 bp, mouse
gtgggggggctatgaaataa

SEQ ID NO: 643489 - DNA, 20 bp, mouse
gagaggggtcacggaggtgg

SEQ ID NO: 643490 - DNA, 20 bp, mouse
gcagaggctgggcagcgcga

SEQ ID NO: 643491 - DNA, 20 bp, mouse
ggcagttcgtgggacaatga

SEQ ID NO: 643492 - DNA, 20 bp, mouse
gaagacaggggcgcagaggc

SEQ ID NO: 643493 - DNA, 20 bp, mouse
gggaggttcacgtaggtcgt

SEQ ID NO: 643494 - DNA, 20 bp, mouse
gctgggcagcgcgaaggctg

SEQ ID NO: 643495 - DNA, 20 bp, mouse
gaggagaggggtcacggagg

SEQ ID NO: 643496 - DNA, 20 bp, mouse
ggggcagagtccgacctccg

SEQ ID NO: 643497 - DNA, 20 bp, mouse
gcccgggcgcatcctatcca

SEQ ID NO: 643498 - DNA, 20 bp, mouse
ggggccggagcaagggactt

SEQ ID NO: 643499 - DNA, 20 bp, mouse
gccatggcgggtgctctcat

SEQ ID NO: 643500 - DNA, 20 bp, mouse
gccaccttctggtgcatcag

SEQ ID NO: 643501 - DNA, 20 bp, mouse
ggagtccgacctccgtggat

SEQ ID NO: 643502 - DNA, 20 bp, mouse
ggcccgggggtctccgagga

SEQ ID NO: 643503 - DNA, 20 bp, mouse
gcatgggccaccgcccccgg

SEQ ID NO: 643504 - DNA, 20 bp, mouse
gcggccctcgcggccctcct

SEQ ID NO: 643505 - DNA, 20 bp, mouse
gtgggagcctggtgagtcgc

SEQ ID NO: 643506 - DNA, 20 bp, mouse
gccgccgcagcgggcactgg

SEQ ID NO: 643507 - DNA, 20 bp, mouse
ggggccagggctacagaaag

SEQ ID NO: 643508 - DNA, 20 bp, mouse
ggccgggaatgtggagtccc

SEQ ID NO: 643509 - DNA, 20 bp, mouse
gtgcggcggcgcactgtcgc

SEQ ID NO: 643510 - DNA, 20 bp, mouse
ggactgaactacataaacag

SEQ ID NO: 643511 - DNA, 20 bp, mouse
gtcactcagcagaaagcacg

SEQ ID NO: 643512 - DNA, 20 bp, mouse
ggcgcactgtcgccggttta

SEQ ID NO: 643513 - DNA, 20 bp, mouse
gcatggcccgccccttaaac

SEQ ID NO: 643514 - DNA, 20 bp, mouse
gcagaaagcacgtggagaca

SEQ ID NO: 643515 - DNA, 20 bp, mouse
gctgtcgccggtttaagggg

SEQ ID NO: 643516 - DNA, 20 bp, mouse
gacagcagggactatgtgta

SEQ ID NO: 643517 - DNA, 20 bp, mouse
ggcaggtgacacgttctcta

SEQ ID NO: 643518 - DNA, 20 bp, mouse
gtagacgcgtcataggaatt

SEQ ID NO: 643519 - DNA, 20 bp, mouse
gattaggcgggaccctggaa

SEQ ID NO: 643520 - DNA, 20 bp, mouse
gggaccctggaagggccagt

SEQ ID NO: 643521 - DNA, 20 bp, mouse
gacgcgtcataggaattagg

SEQ ID NO: 643522 - DNA, 20 bp, mouse
gagtcctactggcccttcca

SEQ ID NO: 643523 - DNA, 20 bp, mouse
gtctggagagtaggaggtgt

SEQ ID NO: 643524 - DNA, 20 bp, mouse
ggatgcaggacaagtcctac

SEQ ID NO: 643525 - DNA, 20 bp, mouse
gtaggccagagagtgactcc

SEQ ID NO: 643526 - DNA, 20 bp, mouse
ggtcccctggtgctctgcct

SEQ ID NO: 643527 - DNA, 20 bp, mouse
gctgcacgtgcctttgtgtg

SEQ ID NO: 643528 - DNA, 20 bp, mouse
gcagccgaggcagagcacca

SEQ ID NO: 643529 - DNA, 20 bp, mouse
gccctcccgggacataaaga

SEQ ID NO: 643530 - DNA, 20 bp, mouse
gtagccaattctaacaaagg

SEQ ID NO: 643531 - DNA, 20 bp, mouse
gtgtggggtctggaagataa

SEQ ID NO: 643532 - DNA, 20 bp, mouse
gggccacaggcttctactga

SEQ ID NO: 643533 - DNA, 20 bp, mouse
gctctaagagacttccctcc

SEQ ID NO: 643534 - DNA, 20 bp, mouse
ggtgatgcaagacagattat

SEQ ID NO: 643535 - DNA, 20 bp, mouse
gctgaaggctggtatataag

SEQ ID NO: 643536 - DNA, 20 bp, mouse
gtggcggcgcagatccgatc

SEQ ID NO: 643537 - DNA, 20 bp, mouse
gaagcgatagcagaactcag

SEQ ID NO: 643538 - DNA, 20 bp, mouse
ggtgcacaggggctacactc

SEQ ID NO: 643539 - DNA, 20 bp, mouse
gcgggtgcgcgatgggaacc

SEQ ID NO: 643540 - DNA, 20 bp, mouse
gtcccatcgcgcacccggat

SEQ ID NO: 643541 - DNA, 20 bp, mouse
gtgagccaaactcagtagag

SEQ ID NO: 643542 - DNA, 20 bp, mouse
ggaaccaggcgcgcgctgga

SEQ ID NO: 643543 - DNA, 20 bp, mouse
gatccgatccgggtgcgcga

SEQ ID NO: 643544 - DNA, 20 bp, mouse
gggttggctagagcgttgag

SEQ ID NO: 643545 - DNA, 20 bp, mouse
ggtgtagcccctgtgcactc

SEQ ID NO: 643546 - DNA, 20 bp, mouse
gtgggggaggaacaggggat

SEQ ID NO: 643547 - DNA, 20 bp, mouse
gcacggaagcgggtctggga

SEQ ID NO: 643548 - DNA, 20 bp, mouse
gaagatggaggcacgtgctg

SEQ ID NO: 643549 - DNA, 20 bp, mouse
ggaggaacaggggatgggct

SEQ ID NO: 643550 - DNA, 20 bp, mouse
gacgtgctgggggaggaaca

SEQ ID NO: 643551 - DNA, 20 bp, mouse
gcaacaaaacagaaggatca

SEQ ID NO: 643552 - DNA, 20 bp, mouse
gtggaggcacgtgctggggg

SEQ ID NO: 643553 - DNA, 20 bp, mouse
gcaagtgcggtgagccgttg

SEQ ID NO: 643554 - DNA, 20 bp, mouse
gagggaaagagcacggaagc

SEQ ID NO: 643555 - DNA, 20 bp, mouse
gtgagccgttgaggagagtc

SEQ ID NO: 643556 - DNA, 20 bp, mouse
gctgctctgcgcagtctccc

SEQ ID NO: 643557 - DNA, 20 bp, mouse
gcggggcagaggcccagtag

SEQ ID NO: 643558 - DNA, 20 bp, mouse
gccgcctccgaacttccggt

SEQ ID NO: 643559 - DNA, 20 bp, mouse
gaggccaaccggaagttcgg

SEQ ID NO: 643560 - DNA, 20 bp, mouse
ggcagaggcccagtagcgga

SEQ ID NO: 643561 - DNA, 20 bp, mouse
gaggcagtgcttgggatgtg

SEQ ID NO: 643562 - DNA, 20 bp, mouse
gcggttgatccgggtgttga

SEQ ID NO: 643563 - DNA, 20 bp, mouse
gtaaattgctacattactat

SEQ ID NO: 643564 - DNA, 20 bp, mouse
gggcagctcgcaacaactgt

SEQ ID NO: 643565 - DNA, 20 bp, mouse
ggccaggccaaccggaagtt

SEQ ID NO: 643566 - DNA, 20 bp, mouse
ggagaagcggggttgagcgt

SEQ ID NO: 643567 - DNA, 20 bp, mouse
gcaggcagaaggcagggcgt

SEQ ID NO: 643568 - DNA, 20 bp, mouse
gggggcgttaggatttcttc

SEQ ID NO: 643569 - DNA, 20 bp, mouse
ggcggggccaacagtcgtcg

SEQ ID NO: 643570 - DNA, 20 bp, mouse
gcagggcgtcggggtctctt

SEQ ID NO: 643571 - DNA, 20 bp, mouse
gcggcccaggcaggagggaa

SEQ ID NO: 643572 - DNA, 20 bp, mouse
gccactaggagaatacagtc

SEQ ID NO: 643573 - DNA, 20 bp, mouse
gttgggcggtagagtttcct

SEQ ID NO: 643574 - DNA, 20 bp, mouse
gcgccccaatctcctgtccg

SEQ ID NO: 643575 - DNA, 20 bp, mouse
ggcgaacatctgtgtgccct

SEQ ID NO: 643576 - DNA, 20 bp, mouse
gcgcccgggtagccgccagg

SEQ ID NO: 643577 - DNA, 20 bp, mouse
ggggatcttggtttagatgg

SEQ ID NO: 643578 - DNA, 20 bp, mouse
gtgcacctgcgcacagcact

SEQ ID NO: 643579 - DNA, 20 bp, mouse
gtaaaggcgtctctgcgccc

SEQ ID NO: 643580 - DNA, 20 bp, mouse
gaaggtgcgagccgggatct

SEQ ID NO: 643581 - DNA, 20 bp, mouse
gacctcggaaaggtgcgagc

SEQ ID NO: 643582 - DNA, 20 bp, mouse
gcgcacctttccgaggtcta

SEQ ID NO: 643583 - DNA, 20 bp, mouse
ggcgcagagacgcctttaag

SEQ ID NO: 643584 - DNA, 20 bp, mouse
ggcccgtcgcccccacttaa

SEQ ID NO: 643585 - DNA, 20 bp, mouse
ggaggcctagtgctgtgcgc

SEQ ID NO: 643586 - DNA, 20 bp, mouse
gcctacaagcgcttgcccac

SEQ ID NO: 643587 - DNA, 20 bp, mouse
gcaaacccggggcacctgca

SEQ ID NO: 643588 - DNA, 20 bp, mouse
gtggggtgagcgtgcgtgat

SEQ ID NO: 643589 - DNA, 20 bp, mouse
ggggcaagcgcttgtagggt

SEQ ID NO: 643590 - DNA, 20 bp, mouse
gcggaatgttgaactgggag

SEQ ID NO: 643591 - DNA, 20 bp, mouse
gccggccgggggcaaacccg

SEQ ID NO: 643592 - DNA, 20 bp, mouse
gactgcgcagacgcacgatc

SEQ ID NO: 643593 - DNA, 20 bp, mouse
gaacagtaggcgttagtttg

SEQ ID NO: 643594 - DNA, 20 bp, mouse
ggggcgtgctgcacgatcag

SEQ ID NO: 643595 - DNA, 20 bp, mouse
ggttgcccagctccgacaga

SEQ ID NO: 643596 - DNA, 20 bp, mouse
gacacaagtgcgggcacgga

SEQ ID NO: 643597 - DNA, 20 bp, mouse
gcctccaccggacatcagag

SEQ ID NO: 643598 - DNA, 20 bp, mouse
ggagcccctctgatgtccgg

SEQ ID NO: 643599 - DNA, 20 bp, mouse
gctgcccggtgtcagagcac

SEQ ID NO: 643600 - DNA, 20 bp, mouse
gcctgtaagcccttttgtga

SEQ ID NO: 643601 - DNA, 20 bp, mouse
gtatgcttgaaggggaaacg

SEQ ID NO: 643602 - DNA, 20 bp, mouse
ggtgtccttctggtgattaa

SEQ ID NO: 643603 - DNA, 20 bp, mouse
gttcaggtgccctcctccac

SEQ ID NO: 643604 - DNA, 20 bp, mouse
gggccctaaatacacaagtg

SEQ ID NO: 643605 - DNA, 20 bp, mouse
gatcaccagaaggacacagc

SEQ ID NO: 643606 - DNA, 20 bp, mouse
gcgcccctgaatgcacctga

SEQ ID NO: 643607 - DNA, 20 bp, mouse
gcaaacccatcgagcctcgg

SEQ ID NO: 643608 - DNA, 20 bp, mouse
gtgctcctggagctcgagac

SEQ ID NO: 643609 - DNA, 20 bp, mouse
gtcgccgcgctcacctccgc

SEQ ID NO: 643610 - DNA, 20 bp, mouse
gccctccaccgaggctcgat

SEQ ID NO: 643611 - DNA, 20 bp, mouse
gggaggacgctgcagcaaga

SEQ ID NO: 643612 - DNA, 20 bp, mouse
gcaggtgctcagaacctcct

SEQ ID NO: 643613 - DNA, 20 bp, mouse
gccgccctcaggtgcattca

SEQ ID NO: 643614 - DNA, 20 bp, mouse
ggacctgccgactctagctc

SEQ ID NO: 643615 - DNA, 20 bp, mouse
gcgctcccgtctcgagctcc

SEQ ID NO: 643616 - DNA, 20 bp, mouse
ggggtgaatgaacagacaca

SEQ ID NO: 643617 - DNA, 20 bp, mouse
gtgatctcatcatatctgaa

SEQ ID NO: 643618 - DNA, 20 bp, mouse
gtggcaaactcacactaact

SEQ ID NO: 643619 - DNA, 20 bp, mouse
ggatatgatgagatcaagat

SEQ ID NO: 643620 - DNA, 20 bp, mouse
gtttttccggagttgaaagg

SEQ ID NO: 643621 - DNA, 20 bp, mouse
gcagctgtgtgggattttat

SEQ ID NO: 643622 - DNA, 20 bp, mouse
gtaccgtcagactatctcca

SEQ ID NO: 643623 - DNA, 20 bp, mouse
gtagacgtcagttttcaatt

SEQ ID NO: 643624 - DNA, 20 bp, mouse
gtctcaaccaatcacagaac

SEQ ID NO: 643625 - DNA, 20 bp, mouse
gattcaccccctttcaactc

SEQ ID NO: 643626 - DNA, 20 bp, mouse
gccgagccgggtttcttaaa

SEQ ID NO: 643627 - DNA, 20 bp, mouse
gtaagaaacccggctcggag

SEQ ID NO: 643628 - DNA, 20 bp, mouse
gtcactgggacacgacaaag

SEQ ID NO: 643629 - DNA, 20 bp, mouse
ggattcctgctgcatcagtt

SEQ ID NO: 643630 - DNA, 20 bp, mouse
ggaaacccggctcggagagg

SEQ ID NO: 643631 - DNA, 20 bp, mouse
ggtggtcccgcctcctccaa

SEQ ID NO: 643632 - DNA, 20 bp, mouse
gacagcccgcctctccgagc

SEQ ID NO: 643633 - DNA, 20 bp, mouse
ggcgactttgccattggagg

SEQ ID NO: 643634 - DNA, 20 bp, mouse
ggcaaagtcgcctgagtagc

SEQ ID NO: 643635 - DNA, 20 bp, mouse
gtggctcacactgctgtggt

SEQ ID NO: 643636 - DNA, 20 bp, mouse
ggaaaaatctgtgttgccga

SEQ ID NO: 643637 - DNA, 20 bp, mouse
gcagcagcgaagggtatgtt

SEQ ID NO: 643638 - DNA, 20 bp, mouse
gataattagtcaaatgagta

SEQ ID NO: 643639 - DNA, 20 bp, mouse
gaggatggaagatatgatat

SEQ ID NO: 643640 - DNA, 20 bp, mouse
gagagctcagagccttttaa

SEQ ID NO: 643641 - DNA, 20 bp, mouse
gaagaagaagcagcagcgaa

SEQ ID NO: 643642 - DNA, 20 bp, mouse
ggttggcaattctctgctgt

SEQ ID NO: 643643 - DNA, 20 bp, mouse
ggacttattctgccatgttg

SEQ ID NO: 643644 - DNA, 20 bp, mouse
gttacaaatttggactccct

SEQ ID NO: 643645 - DNA, 20 bp, mouse
gtgcttttggaggaagattg

SEQ ID NO: 643646 - DNA, 20 bp, mouse
ggggcggtgccagttatatt

SEQ ID NO: 643647 - DNA, 20 bp, mouse
gaactggcaccgccctgcgg

SEQ ID NO: 643648 - DNA, 20 bp, mouse
gtggccatgtggctgtataa

SEQ ID NO: 643649 - DNA, 20 bp, mouse
gttaggcatcctgcaagctt

SEQ ID NO: 643650 - DNA, 20 bp, mouse
gcagagagctgtgttatcgg

SEQ ID NO: 643651 - DNA, 20 bp, mouse
gggctgcacagcggtaaaag

SEQ ID NO: 643652 - DNA, 20 bp, mouse
ggcagccagcccccgcaggg

SEQ ID NO: 643653 - DNA, 20 bp, mouse
gtgtgcagccagcccccgca

SEQ ID NO: 643654 - DNA, 20 bp, mouse
gttggtcttgccaaacacca

SEQ ID NO: 643655 - DNA, 20 bp, mouse
gtataactggcaccgccctg

SEQ ID NO: 643656 - DNA, 20 bp, mouse
gttaaagcctagcttcttcc

SEQ ID NO: 643657 - DNA, 20 bp, mouse
gttcctcagcagggatcctg

SEQ ID NO: 643658 - DNA, 20 bp, mouse
gcatgcacgcagtgctactg

SEQ ID NO: 643659 - DNA, 20 bp, mouse
gagaatccactcttctgtta

SEQ ID NO: 643660 - DNA, 20 bp, mouse
ggttaggggtttaatccaaa

SEQ ID NO: 643661 - DNA, 20 bp, mouse
gtcctgtggttgcagatggt

SEQ ID NO: 643662 - DNA, 20 bp, mouse
gggtttaatccaaagggggt

SEQ ID NO: 643663 - DNA, 20 bp, mouse
gttaaacaaaaatagtatac

SEQ ID NO: 643664 - DNA, 20 bp, mouse
gacgtggcaacgaagcaatg

SEQ ID NO: 643665 - DNA, 20 bp, mouse
gtaaaagctgaatctacacg

SEQ ID NO: 643666 - DNA, 20 bp, mouse
ggctggtcgccgcccagggg

SEQ ID NO: 643667 - DNA, 20 bp, mouse
gcccaggggtggaccctacg

SEQ ID NO: 643668 - DNA, 20 bp, mouse
gcagtgaccggcgagagaaa

SEQ ID NO: 643669 - DNA, 20 bp, mouse
gaagagactcaggtcgtaag

SEQ ID NO: 643670 - DNA, 20 bp, mouse
gtccccggcagtgccttgtc

SEQ ID NO: 643671 - DNA, 20 bp, mouse
ggccgcgtagggtccacccc

SEQ ID NO: 643672 - DNA, 20 bp, mouse
ggccgcgccttccgccgcgt

SEQ ID NO: 643673 - DNA, 20 bp, mouse
gtagcggctggtcgccgccc

SEQ ID NO: 643674 - DNA, 20 bp, mouse
ggcccgggcgctggcccgat

SEQ ID NO: 643675 - DNA, 20 bp, mouse
gggcactgccggggagctag

SEQ ID NO: 643676 - DNA, 20 bp, mouse
gagtgcgtggggaccttctg

SEQ ID NO: 643677 - DNA, 20 bp, mouse
gtccccacgcactctgggtt

SEQ ID NO: 643678 - DNA, 20 bp, mouse
gtaccatgaggccccactct

SEQ ID NO: 643679 - DNA, 20 bp, mouse
gaacccaaacccagagtgcg

SEQ ID NO: 643680 - DNA, 20 bp, mouse
ggaaggtccccacgcactct

SEQ ID NO: 643681 - DNA, 20 bp, mouse
gaagagtcgggcctctcacc

SEQ ID NO: 643682 - DNA, 20 bp, mouse
ggcccagttgcccgagagtg

SEQ ID NO: 643683 - DNA, 20 bp, mouse
gcactgagggcctgcaaccc

SEQ ID NO: 643684 - DNA, 20 bp, mouse
ggctggctccagatcactga

SEQ ID NO: 643685 - DNA, 20 bp, mouse
gggcttaaaaaagaagagtc

SEQ ID NO: 643686 - DNA, 20 bp, mouse
gcccaggcacagtggaacag

SEQ ID NO: 643687 - DNA, 20 bp, mouse
ggctggagaaattgcgaaac

SEQ ID NO: 643688 - DNA, 20 bp, mouse
gacctccaggtcaaactcac

SEQ ID NO: 643689 - DNA, 20 bp, mouse
gtctaattgacctttgagag

SEQ ID NO: 643690 - DNA, 20 bp, mouse
gccagccagtgagtttgacc

SEQ ID NO: 643691 - DNA, 20 bp, mouse
gactgtgcctgggctttctg

SEQ ID NO: 643692 - DNA, 20 bp, mouse
gtccaccaagatgtagactt

SEQ ID NO: 643693 - DNA, 20 bp, mouse
ggtctggtttcccctctcaa

SEQ ID NO: 643694 - DNA, 20 bp, mouse
gaagaaaagcccctgcacgg

SEQ ID NO: 643695 - DNA, 20 bp, mouse
gttgactcaagtattattgc

SEQ ID NO: 643696 - DNA, 20 bp, mouse
gtacctggatagtacacagt

SEQ ID NO: 643697 - DNA, 20 bp, mouse
gcgaaacaggagatacttcc

SEQ ID NO: 643698 - DNA, 20 bp, mouse
gatgcccaatcccacccacc

SEQ ID NO: 643699 - DNA, 20 bp, mouse
ggcccggcagccaatcagcc

SEQ ID NO: 643700 - DNA, 20 bp, mouse
gtggctgccgggccttaggg

SEQ ID NO: 643701 - DNA, 20 bp, mouse
gcggcagccaatcagcctgg

SEQ ID NO: 643702 - DNA, 20 bp, mouse
ggatgccagcggccgcccta

SEQ ID NO: 643703 - DNA, 20 bp, mouse
gaaccaactgtgtactatcc

SEQ ID NO: 643704 - DNA, 20 bp, mouse
gcgcccttctcaaaaaaatc

SEQ ID NO: 643705 - DNA, 20 bp, mouse
ggccaatcagcctggtgggt

SEQ ID NO: 643706 - DNA, 20 bp, mouse
gtctccgcggccgcccaccc

SEQ ID NO: 643707 - DNA, 20 bp, mouse
ggccagaggaggcatcgagc

SEQ ID NO: 643708 - DNA, 20 bp, mouse
ggcccgtagcctgccagagg

SEQ ID NO: 643709 - DNA, 20 bp, mouse
gaggcgggtaccgagagagg

SEQ ID NO: 643710 - DNA, 20 bp, mouse
ggtgtggcagtcacttttag

SEQ ID NO: 643711 - DNA, 20 bp, mouse
gcgacacgctggtggcgctg

SEQ ID NO: 643712 - DNA, 20 bp, mouse
gcgagccgaggatgcataag

SEQ ID NO: 643713 - DNA, 20 bp, mouse
gaggcatcgagcaggcttat

SEQ ID NO: 643714 - DNA, 20 bp, mouse
gcggagacgcgcgcccctgg

SEQ ID NO: 643715 - DNA, 20 bp, mouse
gggcgagggcgacacgctgg

SEQ ID NO: 643716 - DNA, 20 bp, mouse
gccaacggtaacatcatata

SEQ ID NO: 643717 - DNA, 20 bp, mouse
gtacaaccagagcctcacat

SEQ ID NO: 643718 - DNA, 20 bp, mouse
gtctgagcagaacacaaggt

SEQ ID NO: 643719 - DNA, 20 bp, mouse
gaaacagcaaactcagaagg

SEQ ID NO: 643720 - DNA, 20 bp, mouse
gaaactcagaaggaggtcct

SEQ ID NO: 643721 - DNA, 20 bp, mouse
ggaacactgtgtgctttaca

SEQ ID NO: 643722 - DNA, 20 bp, mouse
ggagtacttattctactcag

SEQ ID NO: 643723 - DNA, 20 bp, mouse
gaacagcctatgtgaggctc

SEQ ID NO: 643724 - DNA, 20 bp, mouse
gctgtattatggtcagcgtt

SEQ ID NO: 643725 - DNA, 20 bp, mouse
gcttcatcactgattatatc

SEQ ID NO: 643726 - DNA, 20 bp, mouse
ggctagcagctgggacccta

SEQ ID NO: 643727 - DNA, 20 bp, mouse
gcgcccaccagatctatcca

SEQ ID NO: 643728 - DNA, 20 bp, mouse
gcagggttcccattggccaa

SEQ ID NO: 643729 - DNA, 20 bp, mouse
gacccaacatttttgtgcgg

SEQ ID NO: 643730 - DNA, 20 bp, mouse
ggcgcgtgcgtgaagagagt

SEQ ID NO: 643731 - DNA, 20 bp, mouse
gaatagggctgagaaccgac

SEQ ID NO: 643732 - DNA, 20 bp, mouse
ggctgctagcgagtgggaac

SEQ ID NO: 643733 - DNA, 20 bp, mouse
gtgggtcacatgtccaaggc

SEQ ID NO: 643734 - DNA, 20 bp, mouse
gccggcaagcacggcgtacg

SEQ ID NO: 643735 - DNA, 20 bp, mouse
gggtcccagctgctagcgag

SEQ ID NO: 643736 - DNA, 20 bp, mouse
gaaaaagcccgagtcactgg

SEQ ID NO: 643737 - DNA, 20 bp, mouse
gaagaacaatggtagtctga

SEQ ID NO: 643738 - DNA, 20 bp, mouse
gaagaaaaagcccgagtcac

SEQ ID NO: 643739 - DNA, 20 bp, mouse
gtatgtcccaagtgttgctt

SEQ ID NO: 643740 - DNA, 20 bp, mouse
gtcgaatggcagacaagata

SEQ ID NO: 643741 - DNA, 20 bp, mouse
ggaggattgtgggacgccgg

SEQ ID NO: 643742 - DNA, 20 bp, mouse
ggagaaagcaatgaaagccg

SEQ ID NO: 643743 - DNA, 20 bp, mouse
ggtggagcatggcattgagt

SEQ ID NO: 643744 - DNA, 20 bp, mouse
ggccggcggactgagtgccg

SEQ ID NO: 643745 - DNA, 20 bp, mouse
gccccgctcgcgcccgacac

SEQ ID NO: 643746 - DNA, 20 bp, mouse
ggaagtcaggtgcgggtcag

SEQ ID NO: 643747 - DNA, 20 bp, mouse
gtgctcagtggcctgaagtc

SEQ ID NO: 643748 - DNA, 20 bp, mouse
gtggaacaactctagagaaa

SEQ ID NO: 643749 - DNA, 20 bp, mouse
ggtggcctgaagtcaggtgc

SEQ ID NO: 643750 - DNA, 20 bp, mouse
gagggagcatagagattgtc

SEQ ID NO: 643751 - DNA, 20 bp, mouse
gaccacttcctgtgatgcca

SEQ ID NO: 643752 - DNA, 20 bp, mouse
gacgttcattctcacattag

SEQ ID NO: 643753 - DNA, 20 bp, mouse
gctcacattagaggacgtcc

SEQ ID NO: 643754 - DNA, 20 bp, mouse
ggtgagtagcaggatcacat

SEQ ID NO: 643755 - DNA, 20 bp, mouse
ggctcaaggtcagaagcgcc

SEQ ID NO: 643756 - DNA, 20 bp, mouse
ggagcctcaaggaaagtggg

SEQ ID NO: 643757 - DNA, 20 bp, mouse
ggcccctcccactttccttg

SEQ ID NO: 643758 - DNA, 20 bp, mouse
gaagctccgccccatcctcg

SEQ ID NO: 643759 - DNA, 20 bp, mouse
gttcccgcccacttcccctg

SEQ ID NO: 643760 - DNA, 20 bp, mouse
gaaaaggcttccggagaaat

SEQ ID NO: 643761 - DNA, 20 bp, mouse
gaggcggagtcttcaggaaa

SEQ ID NO: 643762 - DNA, 20 bp, mouse
ggtcccgcctacatctcctg

SEQ ID NO: 643763 - DNA, 20 bp, mouse
ggaaagtgggaggggcctcg

SEQ ID NO: 643764 - DNA, 20 bp, mouse
gcggggtaggcggattgagg

SEQ ID NO: 643765 - DNA, 20 bp, mouse
gcctcggggtaggcggattg

SEQ ID NO: 643766 - DNA, 20 bp, mouse
gggggccagcggtacagtta

SEQ ID NO: 643767 - DNA, 20 bp, mouse
ggatgaagcccaggtgtgga

SEQ ID NO: 643768 - DNA, 20 bp, mouse
ggcccagtgcggggttcttc

SEQ ID NO: 643769 - DNA, 20 bp, mouse
gtgagtgggagctgcagacg

SEQ ID NO: 643770 - DNA, 20 bp, mouse
gtgcagctcccactcactgg

SEQ ID NO: 643771 - DNA, 20 bp, mouse
gttaggagccgccagtgagt

SEQ ID NO: 643772 - DNA, 20 bp, mouse
ggcggctcctaaagccgaca

SEQ ID NO: 643773 - DNA, 20 bp, mouse
ggggttcttccgggccgtgt

SEQ ID NO: 643774 - DNA, 20 bp, mouse
gccacgagttgccctggcct

SEQ ID NO: 643775 - DNA, 20 bp, mouse
ggtgtggagggcccagtgcg

SEQ ID NO: 643776 - DNA, 20 bp, mouse
gcattcttgaggtacttccg

SEQ ID NO: 643777 - DNA, 20 bp, mouse
gctagggggcggggattcag

SEQ ID NO: 643778 - DNA, 20 bp, mouse
gtccaagtgcgggagacagg

SEQ ID NO: 643779 - DNA, 20 bp, mouse
ggtgctgcgccacgatgcta

SEQ ID NO: 643780 - DNA, 20 bp, mouse
gaggacgcgctgccaggtca

SEQ ID NO: 643781 - DNA, 20 bp, mouse
gaagtcgctgtccccggggc

SEQ ID NO: 643782 - DNA, 20 bp, mouse
ggagaggaagtcgctgtccc

SEQ ID NO: 643783 - DNA, 20 bp, mouse
ggtggcgcagcaccctgacc

SEQ ID NO: 643784 - DNA, 20 bp, mouse
ggagggtgaacgtaagtacc

SEQ ID NO: 643785 - DNA, 20 bp, mouse
gagtaccaggatctagaaac

SEQ ID NO: 643786 - DNA, 20 bp, mouse
gggcagtggtatgctgtgac

SEQ ID NO: 643787 - DNA, 20 bp, mouse
gacaggctgcaggcaaggtt

SEQ ID NO: 643788 - DNA, 20 bp, mouse
ggggcagaggtcacccccag

SEQ ID NO: 643789 - DNA, 20 bp, mouse
ggggcagtgccctttaatgt

SEQ ID NO: 643790 - DNA, 20 bp, mouse
gccactgcccatgaggccat

SEQ ID NO: 643791 - DNA, 20 bp, mouse
gccctcaggcccacattaaa

SEQ ID NO: 643792 - DNA, 20 bp, mouse
gcatcccaggactgatctgt

SEQ ID NO: 643793 - DNA, 20 bp, mouse
ggtaagcattgacctcagat

SEQ ID NO: 643794 - DNA, 20 bp, mouse
gagggttggaggaagaccca

SEQ ID NO: 643795 - DNA, 20 bp, mouse
gtcactacgcaacatgatca

SEQ ID NO: 643796 - DNA, 20 bp, mouse
gtggtcacactacaggggca

SEQ ID NO: 643797 - DNA, 20 bp, mouse
gcccacatgcagggatgcat

SEQ ID NO: 643798 - DNA, 20 bp, mouse
gactgggaatcaccagatac

SEQ ID NO: 643799 - DNA, 20 bp, mouse
gcagacaaaacaacaatcag

SEQ ID NO: 643800 - DNA, 20 bp, mouse
gggatgcataggttgtgtac

SEQ ID NO: 643801 - DNA, 20 bp, mouse
gcagtcacatgtctgctcac

SEQ ID NO: 643802 - DNA, 20 bp, mouse
ggaagtaaaaccccacatgc

SEQ ID NO: 643803 - DNA, 20 bp, mouse
gctagatttggtcacactac

SEQ ID NO: 643804 - DNA, 20 bp, mouse
gagacattaatgcagttggc

SEQ ID NO: 643805 - DNA, 20 bp, mouse
gtgataagcctcccagtatc

SEQ ID NO: 643806 - DNA, 20 bp, mouse
gagggacagtagagtaagga

SEQ ID NO: 643807 - DNA, 20 bp, mouse
gtaaaagtgctggtacctaa

SEQ ID NO: 643808 - DNA, 20 bp, mouse
gggagtcagaggcggttccg

SEQ ID NO: 643809 - DNA, 20 bp, mouse
gtaaaggataatgtaagaaa

SEQ ID NO: 643810 - DNA, 20 bp, mouse
ggggcggggaggagtgccta

SEQ ID NO: 643811 - DNA, 20 bp, mouse
gtgttgcaatcgctggggac

SEQ ID NO: 643812 - DNA, 20 bp, mouse
ggaggagtgcctatggagca

SEQ ID NO: 643813 - DNA, 20 bp, mouse
gagggagaacttgacccaga

SEQ ID NO: 643814 - DNA, 20 bp, mouse
gctcacgtccatcagcttcg

SEQ ID NO: 643815 - DNA, 20 bp, mouse
gagccccagcagatctgccc

SEQ ID NO: 643816 - DNA, 20 bp, mouse
gaccgcgcgcaggtgaccgg

SEQ ID NO: 643817 - DNA, 20 bp, mouse
gcgcagggggacggccgctg

SEQ ID NO: 643818 - DNA, 20 bp, mouse
ggcgcgcaggtgaccggggg

SEQ ID NO: 643819 - DNA, 20 bp, mouse
gcacgcgacacgcttctccc

SEQ ID NO: 643820 - DNA, 20 bp, mouse
gcacccaagcaccaccctga

SEQ ID NO: 643821 - DNA, 20 bp, mouse
ggtgtcgcgtgagagcgcag

SEQ ID NO: 643822 - DNA, 20 bp, mouse
gcgggccggcgcttggttcc

SEQ ID NO: 643823 - DNA, 20 bp, mouse
gaaggtggcgggggcggtac

SEQ ID NO: 643824 - DNA, 20 bp, mouse
gaccgcccccgccaccttca

SEQ ID NO: 643825 - DNA, 20 bp, mouse
gcgccctgaccccgcctctc

SEQ ID NO: 643826 - DNA, 20 bp, mouse
gtgcccagcccccgtgacta

SEQ ID NO: 643827 - DNA, 20 bp, mouse
ggggctgggcaggcgggtcg

SEQ ID NO: 643828 - DNA, 20 bp, mouse
gggcagcacgagatgcgcgc

SEQ ID NO: 643829 - DNA, 20 bp, mouse
gtcagaaaccggggaaggat

SEQ ID NO: 643830 - DNA, 20 bp, mouse
ggggcatcagaaaccgggga

SEQ ID NO: 643831 - DNA, 20 bp, mouse
gcaccgctggtgcccgggat

SEQ ID NO: 643832 - DNA, 20 bp, mouse
gagcagcctgcaccccatcc

SEQ ID NO: 643833 - DNA, 20 bp, mouse
gcccgtgactaaggcagaga

SEQ ID NO: 643834 - DNA, 20 bp, mouse
gtcagagaatacagcgccac

SEQ ID NO: 643835 - DNA, 20 bp, mouse
gggcgggtcggggtagccgg

SEQ ID NO: 643836 - DNA, 20 bp, mouse
ggtgcccggggaggtgattc

SEQ ID NO: 643837 - DNA, 20 bp, mouse
ggccggcccggcacttttca

SEQ ID NO: 643838 - DNA, 20 bp, mouse
gggaccaggcaggtttgaca

SEQ ID NO: 643839 - DNA, 20 bp, mouse
ggtccagctgcatacagagg

SEQ ID NO: 643840 - DNA, 20 bp, mouse
gtggacttagcaatgcagga

SEQ ID NO: 643841 - DNA, 20 bp, mouse
gggagggacttctcacggag

SEQ ID NO: 643842 - DNA, 20 bp, mouse
gccaaagtatgcagcaagtt

SEQ ID NO: 643843 - DNA, 20 bp, mouse
gcccctgaaaagtgccgggc

SEQ ID NO: 643844 - DNA, 20 bp, mouse
ggtatgcagcaagtttggga

SEQ ID NO: 643845 - DNA, 20 bp, mouse
ggcttggagctgagttctga

SEQ ID NO: 643846 - DNA, 20 bp, mouse
gacccagcgcacgtgcgcat

SEQ ID NO: 643847 - DNA, 20 bp, mouse
gggcgaggcggtgtctgagt

SEQ ID NO: 643848 - DNA, 20 bp, mouse
gagctgctcttgtggggcga

SEQ ID NO: 643849 - DNA, 20 bp, mouse
gagatcagaggggtccccat

SEQ ID NO: 643850 - DNA, 20 bp, mouse
gttaggggaaagatcgggac

SEQ ID NO: 643851 - DNA, 20 bp, mouse
ggggctcacccggatcatct

SEQ ID NO: 643852 - DNA, 20 bp, mouse
ggctcttgtggggcgagggt

SEQ ID NO: 643853 - DNA, 20 bp, mouse
gcccgcccccacctgccgct

SEQ ID NO: 643854 - DNA, 20 bp, mouse
gcacgcactccgggctcacc

SEQ ID NO: 643855 - DNA, 20 bp, mouse
gagggaagagagctagattc

SEQ ID NO: 643856 - DNA, 20 bp, mouse
gtccccgcctcaggcgtctg

SEQ ID NO: 643857 - DNA, 20 bp, mouse
gatccgggcaaggagggtgg

SEQ ID NO: 643858 - DNA, 20 bp, mouse
gggaatggccggagtgatgg

SEQ ID NO: 643859 - DNA, 20 bp, mouse
gggggagggtggtcctgaat

SEQ ID NO: 643860 - DNA, 20 bp, mouse
gcaccccagacgcctgaggc

SEQ ID NO: 643861 - DNA, 20 bp, mouse
gatgatccgggcaaggaggg

SEQ ID NO: 643862 - DNA, 20 bp, mouse
gtcccaggtagggatgatcc

SEQ ID NO: 643863 - DNA, 20 bp, mouse
ggagcagctccggaggagtg

SEQ ID NO: 643864 - DNA, 20 bp, mouse
gtgcccggatcatccctacc

SEQ ID NO: 643865 - DNA, 20 bp, mouse
gagggatgatccgggcaagg

SEQ ID NO: 643866 - DNA, 20 bp, mouse
gcctccccaggggtggtgat

SEQ ID NO: 643867 - DNA, 20 bp, mouse
gggtagggcgagaacggggt

SEQ ID NO: 643868 - DNA, 20 bp, mouse
gcccctggggaggggtaggt

SEQ ID NO: 643869 - DNA, 20 bp, mouse
gaagaggcggagtccgagtt

SEQ ID NO: 643870 - DNA, 20 bp, mouse
gaacgacagcgtctacgcca

SEQ ID NO: 643871 - DNA, 20 bp, mouse
gtccaacggtagggcgagaa

SEQ ID NO: 643872 - DNA, 20 bp, mouse
gccggggaggggcgtcacgg

SEQ ID NO: 643873 - DNA, 20 bp, mouse
ggggtggggcacccctaact

SEQ ID NO: 643874 - DNA, 20 bp, mouse
gggggaggggtccaacggta

SEQ ID NO: 643875 - DNA, 20 bp, mouse
gtggaggcgccttggcggga

SEQ ID NO: 643876 - DNA, 20 bp, mouse
gccacccacaggcgtctcat

SEQ ID NO: 643877 - DNA, 20 bp, mouse
gagcatgctcagtagctcta

SEQ ID NO: 643878 - DNA, 20 bp, mouse
gcggtgagaccctggactcc

SEQ ID NO: 643879 - DNA, 20 bp, mouse
gggcgtctcattggctgcgt

SEQ ID NO: 643880 - DNA, 20 bp, mouse
ggactcgcccccggaggatg

SEQ ID NO: 643881 - DNA, 20 bp, mouse
gcagccaatgagacgcctgt

SEQ ID NO: 643882 - DNA, 20 bp, mouse
ggctcagtagctctaaggga

SEQ ID NO: 643883 - DNA, 20 bp, mouse
gtctggggagagtcgaaaca

SEQ ID NO: 643884 - DNA, 20 bp, mouse
gctgctgagggactcgcccc

SEQ ID NO: 643885 - DNA, 20 bp, mouse
gagagtcgaaacaagggcga

SEQ ID NO: 643886 - DNA, 20 bp, mouse
gcgggcgcggggcgatcgaa

SEQ ID NO: 643887 - DNA, 20 bp, mouse
gcgtgcgcagagcgtccccc

SEQ ID NO: 643888 - DNA, 20 bp, mouse
gcgaaagggtcgttccccgg

SEQ ID NO: 643889 - DNA, 20 bp, mouse
gactcggccggaaacgcggc

SEQ ID NO: 643890 - DNA, 20 bp, mouse
ggggaagccaaagtccacgg

SEQ ID NO: 643891 - DNA, 20 bp, mouse
gcctgcgccacggactccgt

SEQ ID NO: 643892 - DNA, 20 bp, mouse
ggggctgctggagaccggcg

SEQ ID NO: 643893 - DNA, 20 bp, mouse
ggatcgcaaggccgaagcgt

SEQ ID NO: 643894 - DNA, 20 bp, mouse
gggacccccgcggactcggc

SEQ ID NO: 643895 - DNA, 20 bp, mouse
gtgtctgcccgccgcgtttc

SEQ ID NO: 643896 - DNA, 20 bp, mouse
gtggccagagcgtcccctgt

SEQ ID NO: 643897 - DNA, 20 bp, mouse
gacgcgctagatagagaaga

SEQ ID NO: 643898 - DNA, 20 bp, mouse
gtagatagagaagacggctc

SEQ ID NO: 643899 - DNA, 20 bp, mouse
gggccccgccctaggaggaa

SEQ ID NO: 643900 - DNA, 20 bp, mouse
gtctgcccggggaggacacc

SEQ ID NO: 643901 - DNA, 20 bp, mouse
gagccccacaggggacgctc

SEQ ID NO: 643902 - DNA, 20 bp, mouse
gtagcaagaggttatagagc

SEQ ID NO: 643903 - DNA, 20 bp, mouse
gccggcgctgtggccgttcc

SEQ ID NO: 643904 - DNA, 20 bp, mouse
gctctcttgttcttcaggaa

SEQ ID NO: 643905 - DNA, 20 bp, mouse
ggagccagctcacccgatga

SEQ ID NO: 643906 - DNA, 20 bp, mouse
gaatcaggtgtgtaagacag

SEQ ID NO: 643907 - DNA, 20 bp, mouse
gggcctgagaaccggaattg

SEQ ID NO: 643908 - DNA, 20 bp, mouse
gccgccgagactagggagaa

SEQ ID NO: 643909 - DNA, 20 bp, mouse
gactgcggctcgacgattct

SEQ ID NO: 643910 - DNA, 20 bp, mouse
gctggagggagtgatgacgt

SEQ ID NO: 643911 - DNA, 20 bp, mouse
gctaggctccctcagttcat

SEQ ID NO: 643912 - DNA, 20 bp, mouse
gaccggaattgtggcgaatc

SEQ ID NO: 643913 - DNA, 20 bp, mouse
gcctaacgccgccgagacta

SEQ ID NO: 643914 - DNA, 20 bp, mouse
ggtggcgggggcctgagaac

SEQ ID NO: 643915 - DNA, 20 bp, mouse
gcgccacaattccggttctc

SEQ ID NO: 643916 - DNA, 20 bp, mouse
gctgcccactccagtcaagt

SEQ ID NO: 643917 - DNA, 20 bp, mouse
ggcgcagacacgtggggcaa

SEQ ID NO: 643918 - DNA, 20 bp, mouse
gtaggctccgccccgacccg

SEQ ID NO: 643919 - DNA, 20 bp, mouse
gggtcggggcggagcctaca

SEQ ID NO: 643920 - DNA, 20 bp, mouse
gaaggggcgtggcggcattg

SEQ ID NO: 643921 - DNA, 20 bp, mouse
gcgtggcggcattgcggctt

SEQ ID NO: 643922 - DNA, 20 bp, mouse
gcagcagaccctccgcgggt

SEQ ID NO: 643923 - DNA, 20 bp, mouse
gtcacctacttgactggagt

SEQ ID NO: 643924 - DNA, 20 bp, mouse
ggagacgtcacctacttgac

SEQ ID NO: 643925 - DNA, 20 bp, mouse
gagctgcttaggcgttggga

SEQ ID NO: 643926 - DNA, 20 bp, mouse
gccttggcgcgctgccgcga

SEQ ID NO: 643927 - DNA, 20 bp, mouse
gaggtgggctggtctcccaa

SEQ ID NO: 643928 - DNA, 20 bp, mouse
gaacgcgcgatgattctggt

SEQ ID NO: 643929 - DNA, 20 bp, mouse
gctgggaatcgtggtagttc

SEQ ID NO: 643930 - DNA, 20 bp, mouse
gttagggcgggactctcctc

SEQ ID NO: 643931 - DNA, 20 bp, mouse
gctagaacggcgcaacacct

SEQ ID NO: 643932 - DNA, 20 bp, mouse
gtcagaacgcgcgatgattc

SEQ ID NO: 643933 - DNA, 20 bp, mouse
gggaatcgtggtagttccgg

SEQ ID NO: 643934 - DNA, 20 bp, mouse
gcaaaccggcttggtaggac

SEQ ID NO: 643935 - DNA, 20 bp, mouse
ggaggcccgtcctaccaagc

SEQ ID NO: 643936 - DNA, 20 bp, mouse
gcacaggtggtagacgtaga

SEQ ID NO: 643937 - DNA, 20 bp, mouse
gagcacgggaggtgttgcga

SEQ ID NO: 643938 - DNA, 20 bp, mouse
gcgggaaactggaaccgcgc

SEQ ID NO: 643939 - DNA, 20 bp, mouse
gcagagtctgcgtgagtcca

SEQ ID NO: 643940 - DNA, 20 bp, mouse
gaagcgccgcggagtccagc

SEQ ID NO: 643941 - DNA, 20 bp, mouse
ggaacgggacgcaagcgccg

SEQ ID NO: 643942 - DNA, 20 bp, mouse
ggggatgaggggtgcgattt

SEQ ID NO: 643943 - DNA, 20 bp, mouse
gaaccctgcgcatgctcctt

SEQ ID NO: 643944 - DNA, 20 bp, mouse
gcggaagctgccacgcctgc

SEQ ID NO: 643945 - DNA, 20 bp, mouse
gaggggtgcgatttcggggt

SEQ ID NO: 643946 - DNA, 20 bp, mouse
ggcccccactggttcgtcta

SEQ ID NO: 643947 - DNA, 20 bp, mouse
gaggcctctcccaaccgcct

SEQ ID NO: 643948 - DNA, 20 bp, mouse
gggcctgggaagcccacttc

SEQ ID NO: 643949 - DNA, 20 bp, mouse
gaggcctagcagacagcttc

SEQ ID NO: 643950 - DNA, 20 bp, mouse
gcccacttcagggaccctgc

SEQ ID NO: 643951 - DNA, 20 bp, mouse
gtgtccctggggcttctacc

SEQ ID NO: 643952 - DNA, 20 bp, mouse
gggacccgaagctgtctgct

SEQ ID NO: 643953 - DNA, 20 bp, mouse
gaaccctagacgaaccagtg

SEQ ID NO: 643954 - DNA, 20 bp, mouse
gcccgcccctgcccacgatt

SEQ ID NO: 643955 - DNA, 20 bp, mouse
gggggcgccctacaaaccac

SEQ ID NO: 643956 - DNA, 20 bp, mouse
ggcacaggctcctggacgga

SEQ ID NO: 643957 - DNA, 20 bp, mouse
gcagctggacacatgtgggc

SEQ ID NO: 643958 - DNA, 20 bp, mouse
gagagagccccgggtcatgg

SEQ ID NO: 643959 - DNA, 20 bp, mouse
gagcagagagccccgggtca

SEQ ID NO: 643960 - DNA, 20 bp, mouse
ggcggcgcgagctgacgtca

SEQ ID NO: 643961 - DNA, 20 bp, mouse
gcgctctccgccctccgtcc

SEQ ID NO: 643962 - DNA, 20 bp, mouse
gcaggctcctggacggaggg

SEQ ID NO: 643963 - DNA, 20 bp, mouse
ggcgccgccccgcagctcgc

SEQ ID NO: 643964 - DNA, 20 bp, mouse
gtgctgcacaggctcctgga

SEQ ID NO: 643965 - DNA, 20 bp, mouse
gccgggtcatggcggaggca

SEQ ID NO: 643966 - DNA, 20 bp, mouse
ggggccaagccatggggaaa

SEQ ID NO: 643967 - DNA, 20 bp, mouse
gagtctctgtggggcgtggt

SEQ ID NO: 643968 - DNA, 20 bp, mouse
gctggggccccctttgggac

SEQ ID NO: 643969 - DNA, 20 bp, mouse
gaggggcgagtcctggtgca

SEQ ID NO: 643970 - DNA, 20 bp, mouse
gatggggaagatgcaatcag

SEQ ID NO: 643971 - DNA, 20 bp, mouse
gggagggtggggcgcgacat

SEQ ID NO: 643972 - DNA, 20 bp, mouse
ggagtggcgtcttggggtga

SEQ ID NO: 643973 - DNA, 20 bp, mouse
gggaaggggggagtctctgt

SEQ ID NO: 643974 - DNA, 20 bp, mouse
gaggtgcggggccaagccat

SEQ ID NO: 643975 - DNA, 20 bp, mouse
gggcagtggggcggaaggga

SEQ ID NO: 643976 - DNA, 20 bp, mouse
gtcaacccggaggtcaccaa

SEQ ID NO: 643977 - DNA, 20 bp, mouse
gacccggaggtcaccaaggg

SEQ ID NO: 643978 - DNA, 20 bp, mouse
gagagaggcaggtccttgag

SEQ ID NO: 643979 - DNA, 20 bp, mouse
gaggcaggtccttgagcggt

SEQ ID NO: 643980 - DNA, 20 bp, mouse
gccctcccttggtgacctcc

SEQ ID NO: 643981 - DNA, 20 bp, mouse
gcagagttggggcccgaatg

SEQ ID NO: 643982 - DNA, 20 bp, mouse
gccgcgagtagcaaggatgg

SEQ ID NO: 643983 - DNA, 20 bp, mouse
gcaggtctccaagccagtat

SEQ ID NO: 643984 - DNA, 20 bp, mouse
ggcaagagataagcaatgag

SEQ ID NO: 643985 - DNA, 20 bp, mouse
gactccgcgagtagcaagga

SEQ ID NO: 643986 - DNA, 20 bp, mouse
gagagagagcccaacagcag

SEQ ID NO: 643987 - DNA, 20 bp, mouse
gtgtcgagataaggacactc

SEQ ID NO: 643988 - DNA, 20 bp, mouse
ggcacaaacagcactggtca

SEQ ID NO: 643989 - DNA, 20 bp, mouse
ggggctgggtaggatcggac

SEQ ID NO: 643990 - DNA, 20 bp, mouse
gagcaggggaggccacacaa

SEQ ID NO: 643991 - DNA, 20 bp, mouse
gcgtggggaagtgacctcag

SEQ ID NO: 643992 - DNA, 20 bp, mouse
gctcaggtgccccagctcta

SEQ ID NO: 643993 - DNA, 20 bp, mouse
ggtctgaggggaacagtctc

SEQ ID NO: 643994 - DNA, 20 bp, mouse
gttatctcacgaggattcca

SEQ ID NO: 643995 - DNA, 20 bp, mouse
gataaggacactctggctaa

SEQ ID NO: 643996 - DNA, 20 bp, mouse
ggggctgggtaggatcggac

SEQ ID NO: 643997 - DNA, 20 bp, mouse
gttatctcacgaggattcca

SEQ ID NO: 643998 - DNA, 20 bp, mouse
gtccagggcagctttaactg

SEQ ID NO: 643999 - DNA, 20 bp, mouse
gtgtcgagataaggacactc

SEQ ID NO: 644000 - DNA, 20 bp, mouse
gagggcctcacatcaacaga

SEQ ID NO: 644001 - DNA, 20 bp, mouse
gataaggacactctggctaa

SEQ ID NO: 644002 - DNA, 20 bp, mouse
gctccctctggactcagaaa

SEQ ID NO: 644003 - DNA, 20 bp, mouse
gctaaaggtacatcagataa

SEQ ID NO: 644004 - DNA, 20 bp, mouse
gagctccctggagcaaggtt

SEQ ID NO: 644005 - DNA, 20 bp, mouse
gggtgaactgttatctcacg

SEQ ID NO: 644006 - DNA, 20 bp, mouse
gcatgcgcaaaggtgctgtc

SEQ ID NO: 644007 - DNA, 20 bp, mouse
gagtccgcggggagcggggt

SEQ ID NO: 644008 - DNA, 20 bp, mouse
gcatgcgtctccgcgcccgg

SEQ ID NO: 644009 - DNA, 20 bp, mouse
gggcctgggccccttgtcgg

SEQ ID NO: 644010 - DNA, 20 bp, mouse
gtgggccccttgtcggaggt

SEQ ID NO: 644011 - DNA, 20 bp, mouse
gcagacgcgcgcaggtcgcg

SEQ ID NO: 644012 - DNA, 20 bp, mouse
gacgcgcagtccgcggggag

SEQ ID NO: 644013 - DNA, 20 bp, mouse
gactgcgcgtgcgtgacctc

SEQ ID NO: 644014 - DNA, 20 bp, mouse
gcgtctccgcgcccgggggc

SEQ ID NO: 644015 - DNA, 20 bp, mouse
gcagccccacctccgacaag

SEQ ID NO: 644016 - DNA, 20 bp, mouse
gtgcctggcagtggctacga

SEQ ID NO: 644017 - DNA, 20 bp, mouse
gaagggctggggtcgtctag

SEQ ID NO: 644018 - DNA, 20 bp, mouse
gagcgtggagggtcccccgt

SEQ ID NO: 644019 - DNA, 20 bp, mouse
gccagctagtcctacagacc

SEQ ID NO: 644020 - DNA, 20 bp, mouse
ggccctagttggaatagaca

SEQ ID NO: 644021 - DNA, 20 bp, mouse
gcgcgtgcgaagtggaccag

SEQ ID NO: 644022 - DNA, 20 bp, mouse
ggtgtaacgtgcaagggctg

SEQ ID NO: 644023 - DNA, 20 bp, mouse
ggaccagggaagcgctacgt

SEQ ID NO: 644024 - DNA, 20 bp, mouse
ggggcagggctagcgctgta

SEQ ID NO: 644025 - DNA, 20 bp, mouse
gtcgggaactggtctctaag

SEQ ID NO: 644026 - DNA, 20 bp, mouse
ggggcgcgctgcttgtgaag

SEQ ID NO: 644027 - DNA, 20 bp, mouse
gagggcctgcctcagttcgt

SEQ ID NO: 644028 - DNA, 20 bp, mouse
ggccctctgcctacgaactg

SEQ ID NO: 644029 - DNA, 20 bp, mouse
gccaatcagcgcacgagtcc

SEQ ID NO: 644030 - DNA, 20 bp, mouse
gtgtgaagcggagctgccgg

SEQ ID NO: 644031 - DNA, 20 bp, mouse
gcccttctccaagatggctg

SEQ ID NO: 644032 - DNA, 20 bp, mouse
gagggcagggctagtctgaa

SEQ ID NO: 644033 - DNA, 20 bp, mouse
gccgaatggggagggtgcta

SEQ ID NO: 644034 - DNA, 20 bp, mouse
gtaagtggtccgaatgggga

SEQ ID NO: 644035 - DNA, 20 bp, mouse
ggcgccagccacagccatct

SEQ ID NO: 644036 - DNA, 20 bp, mouse
gaagccccagcctctgcaat

SEQ ID NO: 644037 - DNA, 20 bp, mouse
gggtatgagaccaaccaggg

SEQ ID NO: 644038 - DNA, 20 bp, mouse
ggtctcatacccagacaagc

SEQ ID NO: 644039 - DNA, 20 bp, mouse
gaaggtcacacccattgcag

SEQ ID NO: 644040 - DNA, 20 bp, mouse
ggggcggagcaagagcagca

SEQ ID NO: 644041 - DNA, 20 bp, mouse
gaaacttggccacctaccta

SEQ ID NO: 644042 - DNA, 20 bp, mouse
gggcagatgcttcccttgct

SEQ ID NO: 644043 - DNA, 20 bp, mouse
gggtggccaagttttcctct

SEQ ID NO: 644044 - DNA, 20 bp, mouse
gagcatctgccaaagctcat

SEQ ID NO: 644045 - DNA, 20 bp, mouse
gtattctgtgggcctagcaa

SEQ ID NO: 644046 - DNA, 20 bp, mouse
gcatgcgcataggggtgcac

SEQ ID NO: 644047 - DNA, 20 bp, mouse
gggctaccgtagcatgaagg

SEQ ID NO: 644048 - DNA, 20 bp, mouse
gcatgctacggtagcccgta

SEQ ID NO: 644049 - DNA, 20 bp, mouse
gtgttcaggcagcagttgac

SEQ ID NO: 644050 - DNA, 20 bp, mouse
ggggctccgccttcatgcta

SEQ ID NO: 644051 - DNA, 20 bp, mouse
ggccaagagcaggcacattt

SEQ ID NO: 644052 - DNA, 20 bp, mouse
gtgcgcatgcgcaggacact

SEQ ID NO: 644053 - DNA, 20 bp, mouse
gcgcataggggtgcacaggt

SEQ ID NO: 644054 - DNA, 20 bp, mouse
ggtaggggcaagatacatct

SEQ ID NO: 644055 - DNA, 20 bp, mouse
gcacccctatgcgcatgcgc

SEQ ID NO: 644056 - DNA, 20 bp, mouse
ggaaccgggtgactttccac

SEQ ID NO: 644057 - DNA, 20 bp, mouse
gaccagggaagaacgtgggg

SEQ ID NO: 644058 - DNA, 20 bp, mouse
gaccgccccacgttcttccc

SEQ ID NO: 644059 - DNA, 20 bp, mouse
gaggaaagacacgctgtgta

SEQ ID NO: 644060 - DNA, 20 bp, mouse
gggcgggcctcggtgcttta

SEQ ID NO: 644061 - DNA, 20 bp, mouse
ggttaccagggaagaacgtg

SEQ ID NO: 644062 - DNA, 20 bp, mouse
gctgacccgtctggggaatg

SEQ ID NO: 644063 - DNA, 20 bp, mouse
gttaagctctgacccgtctg

SEQ ID NO: 644064 - DNA, 20 bp, mouse
gacgctgtgtaaggatgtca

SEQ ID NO: 644065 - DNA, 20 bp, mouse
gcctgcggaaattgatgaac

SEQ ID NO: 644066 - DNA, 20 bp, mouse
gctgactcagggtgagggat

SEQ ID NO: 644067 - DNA, 20 bp, mouse
gcccatgtgcaccaaaaaca

SEQ ID NO: 644068 - DNA, 20 bp, mouse
ggcagcttgtgaccaagaga

SEQ ID NO: 644069 - DNA, 20 bp, mouse
gatcaaagaacgaagggtta

SEQ ID NO: 644070 - DNA, 20 bp, mouse
gtcacctggccgaactttgg

SEQ ID NO: 644071 - DNA, 20 bp, mouse
gcgttccaggcgccctctct

SEQ ID NO: 644072 - DNA, 20 bp, mouse
gtctgtggagcagatcaatg

SEQ ID NO: 644073 - DNA, 20 bp, mouse
gaaggtgcagacgagcctag

SEQ ID NO: 644074 - DNA, 20 bp, mouse
gttggtcacaagctgccact

SEQ ID NO: 644075 - DNA, 20 bp, mouse
gagaaatggcttgacttaac

SEQ ID NO: 644076 - DNA, 20 bp, mouse
gaggggagctcgacccgaac

SEQ ID NO: 644077 - DNA, 20 bp, mouse
gtgtcgcaatcgctgtacaa

SEQ ID NO: 644078 - DNA, 20 bp, mouse
gagagagccgggccacaaag

SEQ ID NO: 644079 - DNA, 20 bp, mouse
gctccggattggtcgtggtc

SEQ ID NO: 644080 - DNA, 20 bp, mouse
gcgcgcgcgccctcctgctt

SEQ ID NO: 644081 - DNA, 20 bp, mouse
ggaacaaggagtgctaggaa

SEQ ID NO: 644082 - DNA, 20 bp, mouse
ggggccacaaagcgggagcg

SEQ ID NO: 644083 - DNA, 20 bp, mouse
gatcgctgtacaaagggctg

SEQ ID NO: 644084 - DNA, 20 bp, mouse
ggcagagggtgaaagagagc

SEQ ID NO: 644085 - DNA, 20 bp, mouse
gtacagcgattgcgacaagc

SEQ ID NO: 644086 - DNA, 20 bp, mouse
gcggaggcatacctgaccac

SEQ ID NO: 644087 - DNA, 20 bp, mouse
gggatctcaacgacccactc

SEQ ID NO: 644088 - DNA, 20 bp, mouse
gtccgccctggaggacacag

SEQ ID NO: 644089 - DNA, 20 bp, mouse
ggtcaggtatgcctccgccc

SEQ ID NO: 644090 - DNA, 20 bp, mouse
gggctccctgcgagagtttg

SEQ ID NO: 644091 - DNA, 20 bp, mouse
gcctcatccacatcccggag

SEQ ID NO: 644092 - DNA, 20 bp, mouse
gggtctcctcaaactctcgc

SEQ ID NO: 644093 - DNA, 20 bp, mouse
ggggtcgttgagatcccagt

SEQ ID NO: 644094 - DNA, 20 bp, mouse
gggacaccggcaagctcttc

SEQ ID NO: 644095 - DNA, 20 bp, mouse
gcgggatgtggatgaggctg

SEQ ID NO: 644096 - DNA, 20 bp, mouse
ggaggagtgttcagcgcagt

SEQ ID NO: 644097 - DNA, 20 bp, mouse
ggccccgcccgtagtctcct

SEQ ID NO: 644098 - DNA, 20 bp, mouse
gaggcggcggggacggcagt

SEQ ID NO: 644099 - DNA, 20 bp, mouse
gggacggcagtgggagtctc

SEQ ID NO: 644100 - DNA, 20 bp, mouse
ggcagcgcccaggagactac

SEQ ID NO: 644101 - DNA, 20 bp, mouse
ggcgcccaggagactacggg

SEQ ID NO: 644102 - DNA, 20 bp, mouse
ggaccctgccacggggcgag

SEQ ID NO: 644103 - DNA, 20 bp, mouse
gctgacgttctcgccacgag

SEQ ID NO: 644104 - DNA, 20 bp, mouse
gtgttcagcgcagtgggcga

SEQ ID NO: 644105 - DNA, 20 bp, mouse
gacctgaggccgagggacag

SEQ ID NO: 644106 - DNA, 20 bp, mouse
ggctgggagaagtgatgcta

SEQ ID NO: 644107 - DNA, 20 bp, mouse
gaggctcacaaaggcttcta

SEQ ID NO: 644108 - DNA, 20 bp, mouse
ggaagtgatgctagggtgac

SEQ ID NO: 644109 - DNA, 20 bp, mouse
gcccataaggaagaagtcaa

SEQ ID NO: 644110 - DNA, 20 bp, mouse
gtaaaggtaggcaaccaaag

SEQ ID NO: 644111 - DNA, 20 bp, mouse
gcctaaggcactttcctagg

SEQ ID NO: 644112 - DNA, 20 bp, mouse
gggtcctaaggcactttcct

SEQ ID NO: 644113 - DNA, 20 bp, mouse
gaaggtggtagaaacatgtt

SEQ ID NO: 644114 - DNA, 20 bp, mouse
gcatctcctccactaaaggt

SEQ ID NO: 644115 - DNA, 20 bp, mouse
ggccattggggcctacccag

SEQ ID NO: 644116 - DNA, 20 bp, mouse
gaggtggggccatgagaagg

SEQ ID NO: 644117 - DNA, 20 bp, mouse
ggggcggggctcaagatgga

SEQ ID NO: 644118 - DNA, 20 bp, mouse
gaccgcgaagcggattgggt

SEQ ID NO: 644119 - DNA, 20 bp, mouse
gcgggcggggctttatatgg

SEQ ID NO: 644120 - DNA, 20 bp, mouse
gttctgggcggggctcaaga

SEQ ID NO: 644121 - DNA, 20 bp, mouse
ggcggggcctggaataaagg

SEQ ID NO: 644122 - DNA, 20 bp, mouse
ggagcaaagcgaccgcgaag

SEQ ID NO: 644123 - DNA, 20 bp, mouse
gcggtacatgtgctggaggt

SEQ ID NO: 644124 - DNA, 20 bp, mouse
ggattgggtaggttgttgtg

SEQ ID NO: 644125 - DNA, 20 bp, mouse
ggaggagtcggatttctggg

SEQ ID NO: 644126 - DNA, 20 bp, mouse
gcggcaggaggcggggattg

SEQ ID NO: 644127 - DNA, 20 bp, mouse
gagggcgccgaagctgaccc

SEQ ID NO: 644128 - DNA, 20 bp, mouse
gagtcacgtgggccgacctg

SEQ ID NO: 644129 - DNA, 20 bp, mouse
gcgctacggagccgggagac

SEQ ID NO: 644130 - DNA, 20 bp, mouse
gcgaacgcggctgtccatca

SEQ ID NO: 644131 - DNA, 20 bp, mouse
gcagcggagtcgctacgcta

SEQ ID NO: 644132 - DNA, 20 bp, mouse
gtcccccattggctcgaacg

SEQ ID NO: 644133 - DNA, 20 bp, mouse
gcggacccaaggtgcaagtc

SEQ ID NO: 644134 - DNA, 20 bp, mouse
gcggcccacgtgactcatta

SEQ ID NO: 644135 - DNA, 20 bp, mouse
gacggagccgggagacaggt

SEQ ID NO: 644136 - DNA, 20 bp, mouse
gcacacaaagcccgcggcgg

SEQ ID NO: 644137 - DNA, 20 bp, mouse
gggcgggcggggctacccat

SEQ ID NO: 644138 - DNA, 20 bp, mouse
gggcgagcggggcgggtcag

SEQ ID NO: 644139 - DNA, 20 bp, mouse
gccgcagccccggcgaggtg

SEQ ID NO: 644140 - DNA, 20 bp, mouse
gcggcacacaaagcccgcgg

SEQ ID NO: 644141 - DNA, 20 bp, mouse
gaactggaggccggccgaga

SEQ ID NO: 644142 - DNA, 20 bp, mouse
gcggcgcggtaacccggaag

SEQ ID NO: 644143 - DNA, 20 bp, mouse
ggcggggcggcgcgctggag

SEQ ID NO: 644144 - DNA, 20 bp, mouse
gaagtggcagtagcgtgcgg

SEQ ID NO: 644145 - DNA, 20 bp, mouse
gagccccggcgaggtgcgga

SEQ ID NO: 644146 - DNA, 20 bp, mouse
gtagcagaggcggtcgtcag

SEQ ID NO: 644147 - DNA, 20 bp, mouse
gtggaggcggagattcttag

SEQ ID NO: 644148 - DNA, 20 bp, mouse
gtggcggctgggtgatccaa

SEQ ID NO: 644149 - DNA, 20 bp, mouse
gggactgctcctcaaggtgg

SEQ ID NO: 644150 - DNA, 20 bp, mouse
gtggtggcccattggtcagt

SEQ ID NO: 644151 - DNA, 20 bp, mouse
gcgatgaacaaatagagtgg

SEQ ID NO: 644152 - DNA, 20 bp, mouse
ggggtgatccaatggacact

SEQ ID NO: 644153 - DNA, 20 bp, mouse
gtctgctacgcccccaagca

SEQ ID NO: 644154 - DNA, 20 bp, mouse
gtccccgaggggcgggataa

SEQ ID NO: 644155 - DNA, 20 bp, mouse
gtgggcggggccggtagcgg

SEQ ID NO: 644156 - DNA, 20 bp, mouse
gggggtccatggtctccggg

SEQ ID NO: 644157 - DNA, 20 bp, mouse
gcctcagccaacggcggctc

SEQ ID NO: 644158 - DNA, 20 bp, mouse
gggtccagctggcgtctgga

SEQ ID NO: 644159 - DNA, 20 bp, mouse
gctggctctgaagggacact

SEQ ID NO: 644160 - DNA, 20 bp, mouse
gaagggacactgggggtcca

SEQ ID NO: 644161 - DNA, 20 bp, mouse
gaggtagggtgggacggaac

SEQ ID NO: 644162 - DNA, 20 bp, mouse
gacgcctcccgagccgccgt

SEQ ID NO: 644163 - DNA, 20 bp, mouse
ggtctggaaggttctcaggt

SEQ ID NO: 644164 - DNA, 20 bp, mouse
ggctctctcctggctctgaa

SEQ ID NO: 644165 - DNA, 20 bp, mouse
ggggcggtccagctggcgtc

SEQ ID NO: 644166 - DNA, 20 bp, mouse
ggggttctagcgggcaaagt

SEQ ID NO: 644167 - DNA, 20 bp, mouse
gaatccggatcacatccctt

SEQ ID NO: 644168 - DNA, 20 bp, mouse
gcacatggacagcaatcagt

SEQ ID NO: 644169 - DNA, 20 bp, mouse
ggcggggcctgggtcgctag

SEQ ID NO: 644170 - DNA, 20 bp, mouse
ggtcgctagcggggttctag

SEQ ID NO: 644171 - DNA, 20 bp, mouse
gagaaccccgctagcgaccc

SEQ ID NO: 644172 - DNA, 20 bp, mouse
gactacggtcccacaaaagt

SEQ ID NO: 644173 - DNA, 20 bp, mouse
gaagtatcggataacaaagg

SEQ ID NO: 644174 - DNA, 20 bp, mouse
gaaaagtaggctccttaatc

SEQ ID NO: 644175 - DNA, 20 bp, mouse
gggttctggcgtcgagcgga

SEQ ID NO: 644176 - DNA, 20 bp, mouse
gcaaacgcagggcggaaata

SEQ ID NO: 644177 - DNA, 20 bp, mouse
gggggagataggccctgcgc

SEQ ID NO: 644178 - DNA, 20 bp, mouse
gctatagtacacgtctccag

SEQ ID NO: 644179 - DNA, 20 bp, mouse
gccaattggcccgccggtgt

SEQ ID NO: 644180 - DNA, 20 bp, mouse
gtagccacgcccacaccggc

SEQ ID NO: 644181 - DNA, 20 bp, mouse
gtcgtcgccagagcaacaga

SEQ ID NO: 644182 - DNA, 20 bp, mouse
gccggcgggccaattggctc

SEQ ID NO: 644183 - DNA, 20 bp, mouse
ggacgccgacatgacgaaca

SEQ ID NO: 644184 - DNA, 20 bp, mouse
gagagggcgtcaacaaacgc

SEQ ID NO: 644185 - DNA, 20 bp, mouse
ggcgcgagccacatcgtctg

SEQ ID NO: 644186 - DNA, 20 bp, mouse
gggaggcgggggcactggta

SEQ ID NO: 644187 - DNA, 20 bp, mouse
ggcgctgcccgcctgtcgcg

SEQ ID NO: 644188 - DNA, 20 bp, mouse
gcccgcctgtcgcgcggagg

SEQ ID NO: 644189 - DNA, 20 bp, mouse
gagcctaggtagtcatccgt

SEQ ID NO: 644190 - DNA, 20 bp, mouse
ggcccccgcctccgcgcgac

SEQ ID NO: 644191 - DNA, 20 bp, mouse
gaaggtcagcccgacgccgc

SEQ ID NO: 644192 - DNA, 20 bp, mouse
ggcccgctgggacgatccga

SEQ ID NO: 644193 - DNA, 20 bp, mouse
gcgtccagggcagtccacac

SEQ ID NO: 644194 - DNA, 20 bp, mouse
gcatgcgtcgtccgcccgct

SEQ ID NO: 644195 - DNA, 20 bp, mouse
gcccgacgccgcgggagcct

SEQ ID NO: 644196 - DNA, 20 bp, mouse
gcggagaggcgctccgggga

SEQ ID NO: 644197 - DNA, 20 bp, mouse
gcactctcgctctcggcagt

SEQ ID NO: 644198 - DNA, 20 bp, mouse
gtggccaatgggtgctcgtg

SEQ ID NO: 644199 - DNA, 20 bp, mouse
gctgagacgacgcctgatgc

SEQ ID NO: 644200 - DNA, 20 bp, mouse
gtcagcagctggaatttgtt

SEQ ID NO: 644201 - DNA, 20 bp, mouse
gtctccgcacgagcacccat

SEQ ID NO: 644202 - DNA, 20 bp, mouse
gtgcgcaggtgcggggacct

SEQ ID NO: 644203 - DNA, 20 bp, mouse
ggggagggtttttctgtcgg

SEQ ID NO: 644204 - DNA, 20 bp, mouse
gacgacgcctgatgcgggct

SEQ ID NO: 644205 - DNA, 20 bp, mouse
ggcagctggaatttgtttgg

SEQ ID NO: 644206 - DNA, 20 bp, mouse
gctagagcctggaccgagaa

SEQ ID NO: 644207 - DNA, 20 bp, mouse
gcagaccgcgcgctgatcct

SEQ ID NO: 644208 - DNA, 20 bp, mouse
gccccccaaactcttcacag

SEQ ID NO: 644209 - DNA, 20 bp, mouse
gccacccctgtgaagagttt

SEQ ID NO: 644210 - DNA, 20 bp, mouse
ggagaagggcttgcagtcga

SEQ ID NO: 644211 - DNA, 20 bp, mouse
ggggacagcgagtagcttgg

SEQ ID NO: 644212 - DNA, 20 bp, mouse
gtgcaagcccttctcggtcc

SEQ ID NO: 644213 - DNA, 20 bp, mouse
gacgctgggtgggacttaca

SEQ ID NO: 644214 - DNA, 20 bp, mouse
gagcagatgggcaggcatct

SEQ ID NO: 644215 - DNA, 20 bp, mouse
gtagataaccgtccaaccag

SEQ ID NO: 644216 - DNA, 20 bp, mouse
gcattgctatagtggatggg

SEQ ID NO: 644217 - DNA, 20 bp, mouse
gtaggccgcgcatgcgtcta

SEQ ID NO: 644218 - DNA, 20 bp, mouse
gtgtggcggctgtgcgtcct

SEQ ID NO: 644219 - DNA, 20 bp, mouse
ggggaattgtagtttcttcc

SEQ ID NO: 644220 - DNA, 20 bp, mouse
ggggactcccgttgtcatgg

SEQ ID NO: 644221 - DNA, 20 bp, mouse
gccagaaagcattgctatag

SEQ ID NO: 644222 - DNA, 20 bp, mouse
gagggtgggtggttggcgtc

SEQ ID NO: 644223 - DNA, 20 bp, mouse
gaagcattgctatagtggat

SEQ ID NO: 644224 - DNA, 20 bp, mouse
gtccctccgccgggtattgt

SEQ ID NO: 644225 - DNA, 20 bp, mouse
gaggaaagtcagtaagtcaa

SEQ ID NO: 644226 - DNA, 20 bp, mouse
gaggacggtcaccgcggcga

SEQ ID NO: 644227 - DNA, 20 bp, mouse
gaccctacggcgcgcgacga

SEQ ID NO: 644228 - DNA, 20 bp, mouse
gaggcggggcgcgagccgac

SEQ ID NO: 644229 - DNA, 20 bp, mouse
ggccgcggtgaccgtcctcg

SEQ ID NO: 644230 - DNA, 20 bp, mouse
gtacggcgcgcgacgaggga

SEQ ID NO: 644231 - DNA, 20 bp, mouse
ggggctctgggttaaccctt

SEQ ID NO: 644232 - DNA, 20 bp, mouse
gaggactcccagacccagga

SEQ ID NO: 644233 - DNA, 20 bp, mouse
ggccgcgaggacggtcaccg

SEQ ID NO: 644234 - DNA, 20 bp, mouse
ggctaggagacgccggaagt

SEQ ID NO: 644235 - DNA, 20 bp, mouse
gcgcgggtgggaatcttttt

SEQ ID NO: 644236 - DNA, 20 bp, mouse
gaggcagagcggccaatcag

SEQ ID NO: 644237 - DNA, 20 bp, mouse
ggaaaccaaaagcagaggga

SEQ ID NO: 644238 - DNA, 20 bp, mouse
ggagataagtcatactgggg

SEQ ID NO: 644239 - DNA, 20 bp, mouse
ggaggaagctagttgatggg

SEQ ID NO: 644240 - DNA, 20 bp, mouse
gaacctgcctgtaaaggggt

SEQ ID NO: 644241 - DNA, 20 bp, mouse
gtccactcatggaagagggg

SEQ ID NO: 644242 - DNA, 20 bp, mouse
ggaaggggctggcctgctat

SEQ ID NO: 644243 - DNA, 20 bp, mouse
gggagaggaagctagttgat

SEQ ID NO: 644244 - DNA, 20 bp, mouse
ggggatggggtagtagagac

SEQ ID NO: 644245 - DNA, 20 bp, mouse
ggggtaggcatgctcattcc

SEQ ID NO: 644246 - DNA, 20 bp, mouse
gaggcaagctgttgcagcat

SEQ ID NO: 644247 - DNA, 20 bp, mouse
gagctgttgcagcattggag

SEQ ID NO: 644248 - DNA, 20 bp, mouse
gctgctgtgggcttactcac

SEQ ID NO: 644249 - DNA, 20 bp, mouse
gctgtgggcttactcacagg

SEQ ID NO: 644250 - DNA, 20 bp, mouse
gtgggcttactcacaggggg

SEQ ID NO: 644251 - DNA, 20 bp, mouse
gctcccgcctctgtcagtgg

SEQ ID NO: 644252 - DNA, 20 bp, mouse
gcgtcctccactgacagagg

SEQ ID NO: 644253 - DNA, 20 bp, mouse
gtgcctgagtagttctttca

SEQ ID NO: 644254 - DNA, 20 bp, mouse
gcctggaactgcatttaagt

SEQ ID NO: 644255 - DNA, 20 bp, mouse
gatccatgaaagaactactc

SEQ ID NO: 644256 - DNA, 20 bp, mouse
gaggctggaacccgaaggtg

SEQ ID NO: 644257 - DNA, 20 bp, mouse
gttaaaaggtcgtgcggagc

SEQ ID NO: 644258 - DNA, 20 bp, mouse
gtcactggctaactggatgg

SEQ ID NO: 644259 - DNA, 20 bp, mouse
gtgcggagccgggttgtcgc

SEQ ID NO: 644260 - DNA, 20 bp, mouse
gcagtgaggctggaacccga

SEQ ID NO: 644261 - DNA, 20 bp, mouse
ggggaattccggcgtcgctg

SEQ ID NO: 644262 - DNA, 20 bp, mouse
gcgctcactggctaactgga

SEQ ID NO: 644263 - DNA, 20 bp, mouse
gcgaaggtgcggcggcgtgt

SEQ ID NO: 644264 - DNA, 20 bp, mouse
gcgggttgtcgcaggcagtg

SEQ ID NO: 644265 - DNA, 20 bp, mouse
ggagctcaaggtgagagatg

SEQ ID NO: 644266 - DNA, 20 bp, mouse
ggggtcagcgaagctttcga

SEQ ID NO: 644267 - DNA, 20 bp, mouse
gagtgtgtggagccgaacgt

SEQ ID NO: 644268 - DNA, 20 bp, mouse
gtagcagtaaaagcactcga

SEQ ID NO: 644269 - DNA, 20 bp, mouse
ggcccacagtcctccaagtg

SEQ ID NO: 644270 - DNA, 20 bp, mouse
gaaagcttcgctgaccctgt

SEQ ID NO: 644271 - DNA, 20 bp, mouse
gtcgctgaccctgtgggccc

SEQ ID NO: 644272 - DNA, 20 bp, mouse
gtggagccgaacgtgggtga

SEQ ID NO: 644273 - DNA, 20 bp, mouse
gggtggaagccggggcccac

SEQ ID NO: 644274 - DNA, 20 bp, mouse
gggccccggcttccacccag

SEQ ID NO: 644275 - DNA, 20 bp, mouse
gccacctgtcaaatcagaag

SEQ ID NO: 644276 - DNA, 20 bp, mouse
gtggcgagagtgctatgaac

SEQ ID NO: 644277 - DNA, 20 bp, mouse
ggctaggggaactgctactg

SEQ ID NO: 644278 - DNA, 20 bp, mouse
gctgagacaggagttcctat

SEQ ID NO: 644279 - DNA, 20 bp, mouse
gggtgagggaagagatgcta

SEQ ID NO: 644280 - DNA, 20 bp, mouse
gagtcaggagttcctggtga

SEQ ID NO: 644281 - DNA, 20 bp, mouse
gtataaaaacagccatcacc

SEQ ID NO: 644282 - DNA, 20 bp, mouse
ggctatgaacaggtctaact

SEQ ID NO: 644283 - DNA, 20 bp, mouse
gcctgactgcagtctgagac

SEQ ID NO: 644284 - DNA, 20 bp, mouse
ggatctacaaatgcggtcca

SEQ ID NO: 644285 - DNA, 20 bp, mouse
ggcggtccagggaaagactc

SEQ ID NO: 644286 - DNA, 20 bp, mouse
gcgcgggagggtcgcatcct

SEQ ID NO: 644287 - DNA, 20 bp, mouse
gtccgcacgtccaactgcgg

SEQ ID NO: 644288 - DNA, 20 bp, mouse
gtccaactgcggtggcgcgc

SEQ ID NO: 644289 - DNA, 20 bp, mouse
gcaggctgtgtgttccgctc

SEQ ID NO: 644290 - DNA, 20 bp, mouse
gtagtccgcacgtccaactg

SEQ ID NO: 644291 - DNA, 20 bp, mouse
gtgtcaacagggtctaaggg

SEQ ID NO: 644292 - DNA, 20 bp, mouse
ggccaccgcagttggacgtg

SEQ ID NO: 644293 - DNA, 20 bp, mouse
gccaccagtctgcgcctgag

SEQ ID NO: 644294 - DNA, 20 bp, mouse
gcctcccgcggctcgacaag

SEQ ID NO: 644295 - DNA, 20 bp, mouse
gcgggagccccgagctgcgg

SEQ ID NO: 644296 - DNA, 20 bp, mouse
ggaatcccgcgggtcgtctg

SEQ ID NO: 644297 - DNA, 20 bp, mouse
gaggctgcggagcccgaagg

SEQ ID NO: 644298 - DNA, 20 bp, mouse
ggtccgggagggggtatcgg

SEQ ID NO: 644299 - DNA, 20 bp, mouse
gagctcgccatccatgatgt

SEQ ID NO: 644300 - DNA, 20 bp, mouse
ggggtgagcctacataagga

SEQ ID NO: 644301 - DNA, 20 bp, mouse
gtggccgccaggtcagtgaa

SEQ ID NO: 644302 - DNA, 20 bp, mouse
gatcactgggagtacttaga

SEQ ID NO: 644303 - DNA, 20 bp, mouse
ggggggggggcagtccggga

SEQ ID NO: 644304 - DNA, 20 bp, mouse
gaggaaggaaagttatcact

SEQ ID NO: 644305 - DNA, 20 bp, mouse
gggagggggtatcgggggta

SEQ ID NO: 644306 - DNA, 20 bp, mouse
gggtcacatcacagggactg

SEQ ID NO: 644307 - DNA, 20 bp, mouse
gatggcgtgagagaaaagac

SEQ ID NO: 644308 - DNA, 20 bp, mouse
ggacaggtatctccaaccac

SEQ ID NO: 644309 - DNA, 20 bp, mouse
gggttcctgtacacacgcct

SEQ ID NO: 644310 - DNA, 20 bp, mouse
gggttagagcatgacagcag

SEQ ID NO: 644311 - DNA, 20 bp, mouse
ggcaagctgaagaagacagt

SEQ ID NO: 644312 - DNA, 20 bp, mouse
gagctctgaacacctgtggg

SEQ ID NO: 644313 - DNA, 20 bp, mouse
gctctaacctgactttgcta

SEQ ID NO: 644314 - DNA, 20 bp, mouse
gggttggagatacctgtctg

SEQ ID NO: 644315 - DNA, 20 bp, mouse
ggcagacttctgatttgccc

SEQ ID NO: 644316 - DNA, 20 bp, mouse
gagggtgggcgactgaagta

SEQ ID NO: 644317 - DNA, 20 bp, mouse
gcccacccttggtgtgtgtc

SEQ ID NO: 644318 - DNA, 20 bp, mouse
gaagtaaggcgggaccactg

SEQ ID NO: 644319 - DNA, 20 bp, mouse
gcagcccaaccaggggagga

SEQ ID NO: 644320 - DNA, 20 bp, mouse
gtgtaagatcaaggatagat

SEQ ID NO: 644321 - DNA, 20 bp, mouse
ggggtgatttaaggtttggt

SEQ ID NO: 644322 - DNA, 20 bp, mouse
gtgctgcccaagcttgtcta

SEQ ID NO: 644323 - DNA, 20 bp, mouse
gccgcctcccggagaccccg

SEQ ID NO: 644324 - DNA, 20 bp, mouse
ggatctctaagcacgatttc

SEQ ID NO: 644325 - DNA, 20 bp, mouse
gtgggcgactgaagtaaggc

SEQ ID NO: 644326 - DNA, 20 bp, mouse
gtgggaaggagagcctgtga

SEQ ID NO: 644327 - DNA, 20 bp, mouse
gccctctgctgtgatgaaat

SEQ ID NO: 644328 - DNA, 20 bp, mouse
gtctcctccaagtgccagag

SEQ ID NO: 644329 - DNA, 20 bp, mouse
ggggccatggcaccacatct

SEQ ID NO: 644330 - DNA, 20 bp, mouse
gttgccaagatgtggtgcca

SEQ ID NO: 644331 - DNA, 20 bp, mouse
gaacaagccctgaacagtct

SEQ ID NO: 644332 - DNA, 20 bp, mouse
ggattgtcctagactgttca

SEQ ID NO: 644333 - DNA, 20 bp, mouse
ggaaggagagcctgtgacgg

SEQ ID NO: 644334 - DNA, 20 bp, mouse
gaagcagggtgtgagtggga

SEQ ID NO: 644335 - DNA, 20 bp, mouse
gcacagcagagggacatttc

SEQ ID NO: 644336 - DNA, 20 bp, mouse
gctgacgagtaggacgagag

SEQ ID NO: 644337 - DNA, 20 bp, mouse
gctcccgggacacgcctagg

SEQ ID NO: 644338 - DNA, 20 bp, mouse
gaagctggaggcaggtttct

SEQ ID NO: 644339 - DNA, 20 bp, mouse
gaaggggccgcccattctcc

SEQ ID NO: 644340 - DNA, 20 bp, mouse
gctcctcctaggcgtgtccc

SEQ ID NO: 644341 - DNA, 20 bp, mouse
ggggacaaggagaggcgtag

SEQ ID NO: 644342 - DNA, 20 bp, mouse
gcaacgccaaagctggaggc

SEQ ID NO: 644343 - DNA, 20 bp, mouse
gtaggcgtgtcccgggagaa

SEQ ID NO: 644344 - DNA, 20 bp, mouse
gagtaggacgagagaggtga

SEQ ID NO: 644345 - DNA, 20 bp, mouse
gactaagtgctgtctggaaa

SEQ ID NO: 644346 - DNA, 20 bp, mouse
gaggggcgaggccaacagac

SEQ ID NO: 644347 - DNA, 20 bp, mouse
gtaccgggacccaggtcctg

SEQ ID NO: 644348 - DNA, 20 bp, mouse
gtggactgaggagaagggtt

SEQ ID NO: 644349 - DNA, 20 bp, mouse
gcgcgacggaagtattttac

SEQ ID NO: 644350 - DNA, 20 bp, mouse
ggtaccctggtgcctctcgt

SEQ ID NO: 644351 - DNA, 20 bp, mouse
gggcagagacagactgggcg

SEQ ID NO: 644352 - DNA, 20 bp, mouse
gagccgcaggacctgggtcc

SEQ ID NO: 644353 - DNA, 20 bp, mouse
gaatcctgggtgcggagggg

SEQ ID NO: 644354 - DNA, 20 bp, mouse
ggtaaatcctgggtgcggag

SEQ ID NO: 644355 - DNA, 20 bp, mouse
gagagacagactgggcgggg

SEQ ID NO: 644356 - DNA, 20 bp, mouse
gaagtccccagaggctaagt

SEQ ID NO: 644357 - DNA, 20 bp, mouse
gtgggtgcggccttggggag

SEQ ID NO: 644358 - DNA, 20 bp, mouse
gtgggcgtggttaaggttac

SEQ ID NO: 644359 - DNA, 20 bp, mouse
gcccgcctgcgactccgcag

SEQ ID NO: 644360 - DNA, 20 bp, mouse
gagacgggtgggcggggtga

SEQ ID NO: 644361 - DNA, 20 bp, mouse
gtggatgcgagggcggggtt

SEQ ID NO: 644362 - DNA, 20 bp, mouse
ggccttggggagcggccttc

SEQ ID NO: 644363 - DNA, 20 bp, mouse
gagcggccttctggatgcga

SEQ ID NO: 644364 - DNA, 20 bp, mouse
gtgccgcccggaggaccgtc

SEQ ID NO: 644365 - DNA, 20 bp, mouse
gcacgcccacttagcctctg

SEQ ID NO: 644366 - DNA, 20 bp, mouse
gaccgagaatggggtgtagc

SEQ ID NO: 644367 - DNA, 20 bp, mouse
gagaatggggtgtagcgggt

SEQ ID NO: 644368 - DNA, 20 bp, mouse
ggcccggcgtggctgatgat

SEQ ID NO: 644369 - DNA, 20 bp, mouse
gcgggcaagggctatgccaa

SEQ ID NO: 644370 - DNA, 20 bp, mouse
gcatcagccacgccgggcaa

SEQ ID NO: 644371 - DNA, 20 bp, mouse
ggggtatggctgagggggtt

SEQ ID NO: 644372 - DNA, 20 bp, mouse
gtatgccaatggtttccgag

SEQ ID NO: 644373 - DNA, 20 bp, mouse
gcagagacccagaaagccgg

SEQ ID NO: 644374 - DNA, 20 bp, mouse
gcgcccctctcggaaaccat

SEQ ID NO: 644375 - DNA, 20 bp, mouse
gtagcgggtgggtatggctg

SEQ ID NO: 644376 - DNA, 20 bp, mouse
ggggcgggactctggggcaa

SEQ ID NO: 644377 - DNA, 20 bp, mouse
gatactgcgagaggtaggat

SEQ ID NO: 644378 - DNA, 20 bp, mouse
gtgaaaggggatcacaaccc

SEQ ID NO: 644379 - DNA, 20 bp, mouse
gacgtcgcaaggcctgaaag

SEQ ID NO: 644380 - DNA, 20 bp, mouse
gtaagagtgcgcattacgat

SEQ ID NO: 644381 - DNA, 20 bp, mouse
gttaaggggagtctgattga

SEQ ID NO: 644382 - DNA, 20 bp, mouse
ggccccgcccgccaatccta

SEQ ID NO: 644383 - DNA, 20 bp, mouse
gagtggagagaaagcgtctt

SEQ ID NO: 644384 - DNA, 20 bp, mouse
gggcgttgggcgggactctg

SEQ ID NO: 644385 - DNA, 20 bp, mouse
ggtacaaccaattagattaa

SEQ ID NO: 644386 - DNA, 20 bp, mouse
gtacacacttgcaccatcac

SEQ ID NO: 644387 - DNA, 20 bp, mouse
gtggacaaacttaagaagga

SEQ ID NO: 644388 - DNA, 20 bp, mouse
gaaggacgcgggcttgcaca

SEQ ID NO: 644389 - DNA, 20 bp, mouse
ggcaccatcacaggtgtaca

SEQ ID NO: 644390 - DNA, 20 bp, mouse
gtgtgtactgcgcaagttca

SEQ ID NO: 644391 - DNA, 20 bp, mouse
gccattctgcagccaatcag

SEQ ID NO: 644392 - DNA, 20 bp, mouse
gtgcacagggcagagccaat

SEQ ID NO: 644393 - DNA, 20 bp, mouse
gggaagagtcgccctctgat

SEQ ID NO: 644394 - DNA, 20 bp, mouse
gacactgcaaatggagatag

SEQ ID NO: 644395 - DNA, 20 bp, mouse
gtactcaagcatccagctta

SEQ ID NO: 644396 - DNA, 20 bp, mouse
gcacacgtggcccgaagtgg

SEQ ID NO: 644397 - DNA, 20 bp, mouse
gcctctagaagcctgggata

SEQ ID NO: 644398 - DNA, 20 bp, mouse
gtggtcttcccgaggctcgg

SEQ ID NO: 644399 - DNA, 20 bp, mouse
gatggggtgtgcggtcgaag

SEQ ID NO: 644400 - DNA, 20 bp, mouse
ggcctgggatagggcagatg

SEQ ID NO: 644401 - DNA, 20 bp, mouse
ggaggggcgcggggcacacg

SEQ ID NO: 644402 - DNA, 20 bp, mouse
ggggcgaggatggggaagta

SEQ ID NO: 644403 - DNA, 20 bp, mouse
gcccagaaaaagcggaggtg

SEQ ID NO: 644404 - DNA, 20 bp, mouse
gaccccatctgccctatccc

SEQ ID NO: 644405 - DNA, 20 bp, mouse
gggctccgcccacactctta

SEQ ID NO: 644406 - DNA, 20 bp, mouse
ggacgcgcgcggacctaatg

SEQ ID NO: 644407 - DNA, 20 bp, mouse
ggagcggggtcggaggtgaa

SEQ ID NO: 644408 - DNA, 20 bp, mouse
gctgcccggagcggggtcgg

SEQ ID NO: 644409 - DNA, 20 bp, mouse
gcactggcgcccagaccgcg

SEQ ID NO: 644410 - DNA, 20 bp, mouse
gtctgggcgccagtgggagg

SEQ ID NO: 644411 - DNA, 20 bp, mouse
ggatgccgatggtccgagtg

SEQ ID NO: 644412 - DNA, 20 bp, mouse
gggcgggtctgggacgtggt

SEQ ID NO: 644413 - DNA, 20 bp, mouse
gcggacctaatggggctggg

SEQ ID NO: 644414 - DNA, 20 bp, mouse
gtccacctcccggcagagag

SEQ ID NO: 644415 - DNA, 20 bp, mouse
gcgggcccgcgtcagccaat

SEQ ID NO: 644416 - DNA, 20 bp, mouse
ggcccaggagggctgcaccg

SEQ ID NO: 644417 - DNA, 20 bp, mouse
gaataaggggaaggtcactc

SEQ ID NO: 644418 - DNA, 20 bp, mouse
gggcccgtgagtccacagtg

SEQ ID NO: 644419 - DNA, 20 bp, mouse
gggcagcagtgacccaggct

SEQ ID NO: 644420 - DNA, 20 bp, mouse
ggtcataagcaataagggga

SEQ ID NO: 644421 - DNA, 20 bp, mouse
gacacggggtgtgattccag

SEQ ID NO: 644422 - DNA, 20 bp, mouse
gttgctgtcacagggtgttc

SEQ ID NO: 644423 - DNA, 20 bp, mouse
gtccctcactgtggactcac

SEQ ID NO: 644424 - DNA, 20 bp, mouse
gagagctattccacgaacac

SEQ ID NO: 644425 - DNA, 20 bp, mouse
gtctcaaccccgactgggac

SEQ ID NO: 644426 - DNA, 20 bp, mouse
gggcaggctgcgcgcgacgg

SEQ ID NO: 644427 - DNA, 20 bp, mouse
gaggccgagcggcccgcggt

SEQ ID NO: 644428 - DNA, 20 bp, mouse
ggctcggcgtgggccccggt

SEQ ID NO: 644429 - DNA, 20 bp, mouse
ggacaggcgctgctcggcgt

SEQ ID NO: 644430 - DNA, 20 bp, mouse
ggcgctgaagccgaagtcgg

SEQ ID NO: 644431 - DNA, 20 bp, mouse
ggagctcgcgggtcactcgc

SEQ ID NO: 644432 - DNA, 20 bp, mouse
ggcggcgctgaagccgaagt

SEQ ID NO: 644433 - DNA, 20 bp, mouse
gtggcggcgctgccgaccgc

SEQ ID NO: 644434 - DNA, 20 bp, mouse
gcgctgctcggcgtgggccc

SEQ ID NO: 644435 - DNA, 20 bp, mouse
gcgcgggccgctcggcctct

SEQ ID NO: 644436 - DNA, 20 bp, mouse
ggagtctgggactcggagtc

SEQ ID NO: 644437 - DNA, 20 bp, mouse
gactccagctctgacgctga

SEQ ID NO: 644438 - DNA, 20 bp, mouse
gcgccagcggaagacctgtg

SEQ ID NO: 644439 - DNA, 20 bp, mouse
gcatgtgggaggcggagtct

SEQ ID NO: 644440 - DNA, 20 bp, mouse
gtctgggactcggagtctgg

SEQ ID NO: 644441 - DNA, 20 bp, mouse
gctggcgcgtccttagtcta

SEQ ID NO: 644442 - DNA, 20 bp, mouse
gctaagtctggtcccacaac

SEQ ID NO: 644443 - DNA, 20 bp, mouse
gtgctgcaaagccatgtggg

SEQ ID NO: 644444 - DNA, 20 bp, mouse
gtgcccagagtcccggtgat

SEQ ID NO: 644445 - DNA, 20 bp, mouse
gtgttgctgcaaagccatgt

SEQ ID NO: 644446 - DNA, 20 bp, mouse
gggaagcggaggttgtgact

SEQ ID NO: 644447 - DNA, 20 bp, mouse
gcgcacccgccggcgggaag

SEQ ID NO: 644448 - DNA, 20 bp, mouse
gtggcggcgctgccaccggt

SEQ ID NO: 644449 - DNA, 20 bp, mouse
gggccggacgagcccaccgg

SEQ ID NO: 644450 - DNA, 20 bp, mouse
gcgcacgcgcacccgccggc

SEQ ID NO: 644451 - DNA, 20 bp, mouse
gcccactccgagcaggtgac

SEQ ID NO: 644452 - DNA, 20 bp, mouse
gcagacggtcagccaagggg

SEQ ID NO: 644453 - DNA, 20 bp, mouse
gcaaaatccagttgggataa

SEQ ID NO: 644454 - DNA, 20 bp, mouse
gaccggggcccactccgagc

SEQ ID NO: 644455 - DNA, 20 bp, mouse
ggaaagcgcatgcgcgactt

SEQ ID NO: 644456 - DNA, 20 bp, mouse
ggcgccgcccccacgatctc

SEQ ID NO: 644457 - DNA, 20 bp, mouse
gagtagaagacgcgtctcag

SEQ ID NO: 644458 - DNA, 20 bp, mouse
ggcgactggcgtgcccggac

SEQ ID NO: 644459 - DNA, 20 bp, mouse
gcgggctccaataggactac

SEQ ID NO: 644460 - DNA, 20 bp, mouse
gggtgggtaaagccgaatta

SEQ ID NO: 644461 - DNA, 20 bp, mouse
gactgccaggctaatcttct

SEQ ID NO: 644462 - DNA, 20 bp, mouse
gtacagttcccagagatcgt

SEQ ID NO: 644463 - DNA, 20 bp, mouse
gaactcccagagtatcaggg

SEQ ID NO: 644464 - DNA, 20 bp, mouse
gtggtgcgttgaatgaatgg

SEQ ID NO: 644465 - DNA, 20 bp, mouse
ggggcacgccagtcgcctca

SEQ ID NO: 644466 - DNA, 20 bp, mouse
gttgagcgaggctattggac

SEQ ID NO: 644467 - DNA, 20 bp, mouse
gacgccaatcacccgcgtcc

SEQ ID NO: 644468 - DNA, 20 bp, mouse
ggcacttcctgatgacgcaa

SEQ ID NO: 644469 - DNA, 20 bp, mouse
gccgccttgagcgaggctat

SEQ ID NO: 644470 - DNA, 20 bp, mouse
ggcggtgcagggtgagactt

SEQ ID NO: 644471 - DNA, 20 bp, mouse
gatacagcaatgcttggcgt

SEQ ID NO: 644472 - DNA, 20 bp, mouse
gggtgattggcgtcattggg

SEQ ID NO: 644473 - DNA, 20 bp, mouse
gggaagtgcgagctagcttc

SEQ ID NO: 644474 - DNA, 20 bp, mouse
ggcgcagcccttgcgtcatc

SEQ ID NO: 644475 - DNA, 20 bp, mouse
gagctagcttccggttgcag

SEQ ID NO: 644476 - DNA, 20 bp, mouse
gggggtgggacgactctcca

SEQ ID NO: 644477 - DNA, 20 bp, mouse
gccctcccctcccggctgca

SEQ ID NO: 644478 - DNA, 20 bp, mouse
gtcagccctgcagccgggag

SEQ ID NO: 644479 - DNA, 20 bp, mouse
gccgccctgcggcccgcagt

SEQ ID NO: 644480 - DNA, 20 bp, mouse
gggtgccgccagctcgggcg

SEQ ID NO: 644481 - DNA, 20 bp, mouse
gagctggcggcaccgccctg

SEQ ID NO: 644482 - DNA, 20 bp, mouse
ggccggacggcgggacggtg

SEQ ID NO: 644483 - DNA, 20 bp, mouse
ggtaaaggattgtgctgatt

SEQ ID NO: 644484 - DNA, 20 bp, mouse
gctcggggacagccaactgc

SEQ ID NO: 644485 - DNA, 20 bp, mouse
gcatgcacctttcagtgcgg

SEQ ID NO: 644486 - DNA, 20 bp, mouse
gtgagctctcagactgactt

SEQ ID NO: 644487 - DNA, 20 bp, mouse
gggtccaagcagaagacctt

SEQ ID NO: 644488 - DNA, 20 bp, mouse
gggcggggctagatgaggga

SEQ ID NO: 644489 - DNA, 20 bp, mouse
gttagactctaggggtgcgg

SEQ ID NO: 644490 - DNA, 20 bp, mouse
gcaaagtctgcagacctcgg

SEQ ID NO: 644491 - DNA, 20 bp, mouse
ggggcgggccttagactcta

SEQ ID NO: 644492 - DNA, 20 bp, mouse
gtgggaggcggggctagatg

SEQ ID NO: 644493 - DNA, 20 bp, mouse
ggccttagactctaggggtg

SEQ ID NO: 644494 - DNA, 20 bp, mouse
ggggccaagcacagaagttt

SEQ ID NO: 644495 - DNA, 20 bp, mouse
gggtcaaagtctgcagacct

SEQ ID NO: 644496 - DNA, 20 bp, mouse
ggcaggggcaggcctgagac

SEQ ID NO: 644497 - DNA, 20 bp, mouse
gcccgcccctgcagccgtgt

SEQ ID NO: 644498 - DNA, 20 bp, mouse
gtgggtgaggcccggaccct

SEQ ID NO: 644499 - DNA, 20 bp, mouse
gcccaccgggccgcaggggc

SEQ ID NO: 644500 - DNA, 20 bp, mouse
ggagcctgaggcagaattgc

SEQ ID NO: 644501 - DNA, 20 bp, mouse
ggagacaggctcacgaccta

SEQ ID NO: 644502 - DNA, 20 bp, mouse
gcacgcccaccgggccgcag

SEQ ID NO: 644503 - DNA, 20 bp, mouse
gaggcgctgggttcagtttt

SEQ ID NO: 644504 - DNA, 20 bp, mouse
gcacgcccacacggctgcag

SEQ ID NO: 644505 - DNA, 20 bp, mouse
gcaaaatgaaagtttaaaga

SEQ ID NO: 644506 - DNA, 20 bp, mouse
gactcaaaggggtgtgtgag

SEQ ID NO: 644507 - DNA, 20 bp, mouse
gggcgtggggcgggcgggaa

SEQ ID NO: 644508 - DNA, 20 bp, mouse
gcagtgggcggggactcaaa

SEQ ID NO: 644509 - DNA, 20 bp, mouse
gcgagacttgggcaaggcgt

SEQ ID NO: 644510 - DNA, 20 bp, mouse
gacttgggcaaggcgtgggg

SEQ ID NO: 644511 - DNA, 20 bp, mouse
ggcggcgctacggttactca

SEQ ID NO: 644512 - DNA, 20 bp, mouse
gcctcggtgcggttgtcagg

SEQ ID NO: 644513 - DNA, 20 bp, mouse
gagggtcctgcgtgccccgt

SEQ ID NO: 644514 - DNA, 20 bp, mouse
gtgtcaggaggtgagtcacg

SEQ ID NO: 644515 - DNA, 20 bp, mouse
gaggggcggatgctcggagt

SEQ ID NO: 644516 - DNA, 20 bp, mouse
gaaaacggatcgtttgaaga

SEQ ID NO: 644517 - DNA, 20 bp, mouse
gaggttggaggtagactgga

SEQ ID NO: 644518 - DNA, 20 bp, mouse
gcctaggtcaggtagaatac

SEQ ID NO: 644519 - DNA, 20 bp, mouse
gtaaatgactagaaggttgg

SEQ ID NO: 644520 - DNA, 20 bp, mouse
gaagtctgatccactaaaaa

SEQ ID NO: 644521 - DNA, 20 bp, mouse
gccagcggctctatagagtt

SEQ ID NO: 644522 - DNA, 20 bp, mouse
ggtggtgggggcgtggtctt

SEQ ID NO: 644523 - DNA, 20 bp, mouse
ggaagagattagataagaga

SEQ ID NO: 644524 - DNA, 20 bp, mouse
gggcccagacacacaacctt

SEQ ID NO: 644525 - DNA, 20 bp, mouse
gttgggcctcgatgcatggt

SEQ ID NO: 644526 - DNA, 20 bp, mouse
gccccggggccaatctgcgg

SEQ ID NO: 644527 - DNA, 20 bp, mouse
gcacccccggggccaatctg

SEQ ID NO: 644528 - DNA, 20 bp, mouse
ggaggggagggcacacacga

SEQ ID NO: 644529 - DNA, 20 bp, mouse
gcgggcgcgcagggcacgag

SEQ ID NO: 644530 - DNA, 20 bp, mouse
ggcgcgcaggacccgggctg

SEQ ID NO: 644531 - DNA, 20 bp, mouse
gagggcacacacgaggggtg

SEQ ID NO: 644532 - DNA, 20 bp, mouse
gcagtccaggcggccccgga

SEQ ID NO: 644533 - DNA, 20 bp, mouse
gggccaatctgcggggggag

SEQ ID NO: 644534 - DNA, 20 bp, mouse
gcccgcgtctgcattgcggt

SEQ ID NO: 644535 - DNA, 20 bp, mouse
ggtgacacatacataggggc

SEQ ID NO: 644536 - DNA, 20 bp, mouse
gtgacagcaggcagtctctg

SEQ ID NO: 644537 - DNA, 20 bp, mouse
ggaccagtgtcccagatgga

SEQ ID NO: 644538 - DNA, 20 bp, mouse
gggtgaataaattttttgag

SEQ ID NO: 644539 - DNA, 20 bp, mouse
ggaaagaccagtgtcccaga

SEQ ID NO: 644540 - DNA, 20 bp, mouse
gtctctgctgctttctccat

SEQ ID NO: 644541 - DNA, 20 bp, mouse
gctgtctctgctgtaattaa

SEQ ID NO: 644542 - DNA, 20 bp, mouse
gccagatggaaggtgacagc

SEQ ID NO: 644543 - DNA, 20 bp, mouse
ggcaggcagtctctggggga

SEQ ID NO: 644544 - DNA, 20 bp, mouse
gctgggagacaaaaaagcga

SEQ ID NO: 644545 - DNA, 20 bp, mouse
gcttctaggcagctctggga

SEQ ID NO: 644546 - DNA, 20 bp, mouse
ggtgcacaggcgtcgttagg

SEQ ID NO: 644547 - DNA, 20 bp, mouse
gacagccaaccgcggtgcac

SEQ ID NO: 644548 - DNA, 20 bp, mouse
ggacgcctgtgcaccgcggt

SEQ ID NO: 644549 - DNA, 20 bp, mouse
gccactgcgacagccaaccg

SEQ ID NO: 644550 - DNA, 20 bp, mouse
gtaacgacgcctgtgcaccg

SEQ ID NO: 644551 - DNA, 20 bp, mouse
gaccgcccgcgggaggtgca

SEQ ID NO: 644552 - DNA, 20 bp, mouse
gtagacccgagggaggagtg

SEQ ID NO: 644553 - DNA, 20 bp, mouse
gcctgagaaggaaggaagtc

SEQ ID NO: 644554 - DNA, 20 bp, mouse
gctgccggaagcccctcccg

SEQ ID NO: 644555 - DNA, 20 bp, mouse
ggcagacgccctgagaagga

SEQ ID NO: 644556 - DNA, 20 bp, mouse
gccacccgctgtcacctccg

SEQ ID NO: 644557 - DNA, 20 bp, mouse
gggcctcggcggttgggctt

SEQ ID NO: 644558 - DNA, 20 bp, mouse
gcgcaggcgccgtccctgct

SEQ ID NO: 644559 - DNA, 20 bp, mouse
gcggcccagctcccagaccg

SEQ ID NO: 644560 - DNA, 20 bp, mouse
gggagctgggccggcctcgg

SEQ ID NO: 644561 - DNA, 20 bp, mouse
ggccccgcccgctcaaatat

SEQ ID NO: 644562 - DNA, 20 bp, mouse
gcgacggcggcggggagatc

SEQ ID NO: 644563 - DNA, 20 bp, mouse
gaggccgagtggagaacgcg

SEQ ID NO: 644564 - DNA, 20 bp, mouse
gctcacaggggcgcgatgat

SEQ ID NO: 644565 - DNA, 20 bp, mouse
gcccacttcaggcatcacgg

SEQ ID NO: 644566 - DNA, 20 bp, mouse
gtggcccgaggactgagctg

SEQ ID NO: 644567 - DNA, 20 bp, mouse
gggcccgtagccagagggcg

SEQ ID NO: 644568 - DNA, 20 bp, mouse
gacgtcgcaagctctgcggt

SEQ ID NO: 644569 - DNA, 20 bp, mouse
gcacgacgtcgcaagctctg

SEQ ID NO: 644570 - DNA, 20 bp, mouse
gaagctctgcggtggggaag

SEQ ID NO: 644571 - DNA, 20 bp, mouse
gccgccaagcgcagcgatct

SEQ ID NO: 644572 - DNA, 20 bp, mouse
ggaaaactacaggcatctgg

SEQ ID NO: 644573 - DNA, 20 bp, mouse
gtggactgctattggaggag

SEQ ID NO: 644574 - DNA, 20 bp, mouse
gctctgcggtggggaagtgg

SEQ ID NO: 644575 - DNA, 20 bp, mouse
gtcaggcacggcaaagtgaa

SEQ ID NO: 644576 - DNA, 20 bp, mouse
ggcggtgtgcagacggtcta

SEQ ID NO: 644577 - DNA, 20 bp, mouse
gtaacccgacacacctaggt

SEQ ID NO: 644578 - DNA, 20 bp, mouse
gtaggtgtgtcgggttaggg

SEQ ID NO: 644579 - DNA, 20 bp, mouse
gacctccaacccaacatccc

SEQ ID NO: 644580 - DNA, 20 bp, mouse
gggggtgtcgaagagcgatg

SEQ ID NO: 644581 - DNA, 20 bp, mouse
gagactctttggtttggtat

SEQ ID NO: 644582 - DNA, 20 bp, mouse
gacggtctaggggtcatagg

SEQ ID NO: 644583 - DNA, 20 bp, mouse
gcagacggtctaggggtcat

SEQ ID NO: 644584 - DNA, 20 bp, mouse
gtacccaacctaggtgtgtc

SEQ ID NO: 644585 - DNA, 20 bp, mouse
gtggtttggtatggggtaga

SEQ ID NO: 644586 - DNA, 20 bp, mouse
gacagggtgtgcaaggtcta

SEQ ID NO: 644587 - DNA, 20 bp, mouse
gtcagggatggtgaagaaca

SEQ ID NO: 644588 - DNA, 20 bp, mouse
ggaggaggagtggggatcag

SEQ ID NO: 644589 - DNA, 20 bp, mouse
gtgagagcgatcagcgttgg

SEQ ID NO: 644590 - DNA, 20 bp, mouse
ggggcggggcggagccgttg

SEQ ID NO: 644591 - DNA, 20 bp, mouse
gtctaacacccggaaccccc

SEQ ID NO: 644592 - DNA, 20 bp, mouse
gcccaggggccgaggatgga

SEQ ID NO: 644593 - DNA, 20 bp, mouse
ggaaccccaggggccgagga

SEQ ID NO: 644594 - DNA, 20 bp, mouse
ggagtgagagcgatcagcgt

SEQ ID NO: 644595 - DNA, 20 bp, mouse
ggtcccggctgaatcatcag

SEQ ID NO: 644596 - DNA, 20 bp, mouse
gctccctgggacggccacgg

SEQ ID NO: 644597 - DNA, 20 bp, mouse
gggagccgggacgtcccgtg

SEQ ID NO: 644598 - DNA, 20 bp, mouse
ggaggtccccagcaagccga

SEQ ID NO: 644599 - DNA, 20 bp, mouse
ggccccgcccccgagcgtgt

SEQ ID NO: 644600 - DNA, 20 bp, mouse
gggaccgccacgaaccccac

SEQ ID NO: 644601 - DNA, 20 bp, mouse
gcaccgccgtggccgtccca

SEQ ID NO: 644602 - DNA, 20 bp, mouse
gggtgagcctctctccgaga

SEQ ID NO: 644603 - DNA, 20 bp, mouse
gcgaaccccacgggacgtcc

SEQ ID NO: 644604 - DNA, 20 bp, mouse
gccgtgccctcggcttgctg

SEQ ID NO: 644605 - DNA, 20 bp, mouse
gcggctccctgggacggcca

SEQ ID NO: 644606 - DNA, 20 bp, mouse
gaggcgctgcagcccgcctc

SEQ ID NO: 644607 - DNA, 20 bp, mouse
gtcaatcaacccactcccgt

SEQ ID NO: 644608 - DNA, 20 bp, mouse
gcccgcctcgggctgtcgcg

SEQ ID NO: 644609 - DNA, 20 bp, mouse
gggtggaaacccacgggagt

SEQ ID NO: 644610 - DNA, 20 bp, mouse
gccaggcggggctaatttat

SEQ ID NO: 644611 - DNA, 20 bp, mouse
ggggctgcagcgcctcccgg

SEQ ID NO: 644612 - DNA, 20 bp, mouse
gaccgcgcgacagcccgagg

SEQ ID NO: 644613 - DNA, 20 bp, mouse
gataccctaaccagtaagga

SEQ ID NO: 644614 - DNA, 20 bp, mouse
gttccagaggggcagggata

SEQ ID NO: 644615 - DNA, 20 bp, mouse
ggagtcgaggtgcctcggac

SEQ ID NO: 644616 - DNA, 20 bp, mouse
gggcgagggcgggaacgcga

SEQ ID NO: 644617 - DNA, 20 bp, mouse
gaggggcgctgcgacctggg

SEQ ID NO: 644618 - DNA, 20 bp, mouse
ggcgaggggcgctgcgacct

SEQ ID NO: 644619 - DNA, 20 bp, mouse
gcggacacccgggattcctc

SEQ ID NO: 644620 - DNA, 20 bp, mouse
ggggatctgtgcgtgagaac

SEQ ID NO: 644621 - DNA, 20 bp, mouse
ggcaacgggaacacagcccg

SEQ ID NO: 644622 - DNA, 20 bp, mouse
gcgctcgccggaggaatccc

SEQ ID NO: 644623 - DNA, 20 bp, mouse
gccgccctcgcccgcgtcgt

SEQ ID NO: 644624 - DNA, 20 bp, mouse
gcgcacagcatggtctcgaa

SEQ ID NO: 644625 - DNA, 20 bp, mouse
gtgcgtgagaaccgggcaac

SEQ ID NO: 644626 - DNA, 20 bp, mouse
gccgccgcggtgacgtgcac

SEQ ID NO: 644627 - DNA, 20 bp, mouse
gtctcagaggaggggaaaag

SEQ ID NO: 644628 - DNA, 20 bp, mouse
gtgaaggcggtgaagtacta

SEQ ID NO: 644629 - DNA, 20 bp, mouse
gctcggggttaaaccggaga

SEQ ID NO: 644630 - DNA, 20 bp, mouse
gaggggccacctttaggacc

SEQ ID NO: 644631 - DNA, 20 bp, mouse
gcctagcctcggggttaaac

SEQ ID NO: 644632 - DNA, 20 bp, mouse
gctgcaaggcgctccggctg

SEQ ID NO: 644633 - DNA, 20 bp, mouse
ggtatccaggggccaccttt

SEQ ID NO: 644634 - DNA, 20 bp, mouse
gggctggcgtagtccccctc

SEQ ID NO: 644635 - DNA, 20 bp, mouse
gccggtgcttgtttatgttc

SEQ ID NO: 644636 - DNA, 20 bp, mouse
gacacacggtggggcagtga

SEQ ID NO: 644637 - DNA, 20 bp, mouse
gatagggcccccaggggaaa

SEQ ID NO: 644638 - DNA, 20 bp, mouse
ggctgctagagtagagtcgc

SEQ ID NO: 644639 - DNA, 20 bp, mouse
gcgcgggaaacagagagctg

SEQ ID NO: 644640 - DNA, 20 bp, mouse
gcacccggatagggccccca

SEQ ID NO: 644641 - DNA, 20 bp, mouse
gaaagcgctgggaaatgagg

SEQ ID NO: 644642 - DNA, 20 bp, mouse
ggccccaccgtgtgtctaaa

SEQ ID NO: 644643 - DNA, 20 bp, mouse
gaatgagggggcagcaagtt

SEQ ID NO: 644644 - DNA, 20 bp, mouse
gtaaccatttagacacacgg

SEQ ID NO: 644645 - DNA, 20 bp, mouse
gtattttaagtcagagtggg

SEQ ID NO: 644646 - DNA, 20 bp, mouse
ggtaactcagcccagtgtct

SEQ ID NO: 644647 - DNA, 20 bp, mouse
gaaatgagctccgagacact

SEQ ID NO: 644648 - DNA, 20 bp, mouse
gggagcgggagggagtgtct

SEQ ID NO: 644649 - DNA, 20 bp, mouse
gacgctatcggccatccctg

SEQ ID NO: 644650 - DNA, 20 bp, mouse
gacccagaggtagaatggag

SEQ ID NO: 644651 - DNA, 20 bp, mouse
gttaacaccgctacacccag

SEQ ID NO: 644652 - DNA, 20 bp, mouse
ggactaattggccacaggag

SEQ ID NO: 644653 - DNA, 20 bp, mouse
gatggccgatagcgtctctc

SEQ ID NO: 644654 - DNA, 20 bp, mouse
gattggccacaggagcggga

SEQ ID NO: 644655 - DNA, 20 bp, mouse
gaaccaataggagagaccgg

SEQ ID NO: 644656 - DNA, 20 bp, mouse
gaggaagattggtgtttcag

SEQ ID NO: 644657 - DNA, 20 bp, mouse
gtcatgcttaggtaatgccc

SEQ ID NO: 644658 - DNA, 20 bp, mouse
ggcggggagatctcatgctt

SEQ ID NO: 644659 - DNA, 20 bp, mouse
gccccgccatctatttgtaa

SEQ ID NO: 644660 - DNA, 20 bp, mouse
gggcgatctggcgggaacac

SEQ ID NO: 644661 - DNA, 20 bp, mouse
gagtgtgtccgaaaagctag

SEQ ID NO: 644662 - DNA, 20 bp, mouse
gtgccccctggcgatctggc

SEQ ID NO: 644663 - DNA, 20 bp, mouse
gtggagtccgaacttagaaa

SEQ ID NO: 644664 - DNA, 20 bp, mouse
gatgagagaaggaatggagt

SEQ ID NO: 644665 - DNA, 20 bp, mouse
gttcccgccagatcgccagg

SEQ ID NO: 644666 - DNA, 20 bp, mouse
gggcccctgctcttcgaagg

SEQ ID NO: 644667 - DNA, 20 bp, mouse
gcttcagctgaagtgttcac

SEQ ID NO: 644668 - DNA, 20 bp, mouse
gagaactggctcggagtatc

SEQ ID NO: 644669 - DNA, 20 bp, mouse
gactatggaaagtaaccaga

SEQ ID NO: 644670 - DNA, 20 bp, mouse
gtcgaaggaggctagagcca

SEQ ID NO: 644671 - DNA, 20 bp, mouse
ggggtagttggctccaggag

SEQ ID NO: 644672 - DNA, 20 bp, mouse
gccaaggccatctagataat

SEQ ID NO: 644673 - DNA, 20 bp, mouse
gagaaacggggaggtaccat

SEQ ID NO: 644674 - DNA, 20 bp, mouse
gctgctgggtagttggctcc

SEQ ID NO: 644675 - DNA, 20 bp, mouse
gaagtgttcacaggctggga

SEQ ID NO: 644676 - DNA, 20 bp, mouse
ggtactgaggaacagctcac

SEQ ID NO: 644677 - DNA, 20 bp, mouse
ggaggctgcagcagagaatg

SEQ ID NO: 644678 - DNA, 20 bp, mouse
gcggctctagagttgtactg

SEQ ID NO: 644679 - DNA, 20 bp, mouse
gtacaactctagagccggaa

SEQ ID NO: 644680 - DNA, 20 bp, mouse
gcgcaggcgcagaaccgcga

SEQ ID NO: 644681 - DNA, 20 bp, mouse
gacccgggaagagcttgcgc

SEQ ID NO: 644682 - DNA, 20 bp, mouse
ggagagcgatccaggttagg

SEQ ID NO: 644683 - DNA, 20 bp, mouse
gcgcctgcgcaagctcttcc

SEQ ID NO: 644684 - DNA, 20 bp, mouse
gggggcggagtctcaaactt

SEQ ID NO: 644685 - DNA, 20 bp, mouse
ggaaactacggcaacatttt

SEQ ID NO: 644686 - DNA, 20 bp, mouse
ggcagcctggatggagaaat

SEQ ID NO: 644687 - DNA, 20 bp, mouse
gtgggcaaggagagccctgt

SEQ ID NO: 644688 - DNA, 20 bp, mouse
gctagatcgggctctctcag

SEQ ID NO: 644689 - DNA, 20 bp, mouse
ggtccccggcagcgcgaacc

SEQ ID NO: 644690 - DNA, 20 bp, mouse
gaggaggaagcgcggagggg

SEQ ID NO: 644691 - DNA, 20 bp, mouse
gggcgggcggggaatcagcc

SEQ ID NO: 644692 - DNA, 20 bp, mouse
ggtcactcaagagcccggaa

SEQ ID NO: 644693 - DNA, 20 bp, mouse
ggcggcccaaccgtgccctc

SEQ ID NO: 644694 - DNA, 20 bp, mouse
gggagagccctgtggggcca

SEQ ID NO: 644695 - DNA, 20 bp, mouse
ggcggccagagggcacggtt

SEQ ID NO: 644696 - DNA, 20 bp, mouse
ggtgcccaacccaagttcaa

SEQ ID NO: 644697 - DNA, 20 bp, mouse
gcagcctttgaacttgggtt

SEQ ID NO: 644698 - DNA, 20 bp, mouse
ggtatctttaacagctttta

SEQ ID NO: 644699 - DNA, 20 bp, mouse
gaccaatatgaagttaatcc

SEQ ID NO: 644700 - DNA, 20 bp, mouse
ggttaaagatacactggagg

SEQ ID NO: 644701 - DNA, 20 bp, mouse
gtatgaagttaatcctggag

SEQ ID NO: 644702 - DNA, 20 bp, mouse
gtaaaatgttagcaaagcta

SEQ ID NO: 644703 - DNA, 20 bp, mouse
gctcatcagcctttgaactt

SEQ ID NO: 644704 - DNA, 20 bp, mouse
ggaaatcatgggacacatat

SEQ ID NO: 644705 - DNA, 20 bp, mouse
ggattttactataacagaaa

SEQ ID NO: 644706 - DNA, 20 bp, mouse
ggcccctgatgtcacaaata

SEQ ID NO: 644707 - DNA, 20 bp, mouse
gggagtgtgcgtagcaggct

SEQ ID NO: 644708 - DNA, 20 bp, mouse
gtgtgacatcaggggccaaa

SEQ ID NO: 644709 - DNA, 20 bp, mouse
ggagtgcttccaaggcctct

SEQ ID NO: 644710 - DNA, 20 bp, mouse
gtccatatttgtgacatcag

SEQ ID NO: 644711 - DNA, 20 bp, mouse
ggcattatgaagaaaggagc

SEQ ID NO: 644712 - DNA, 20 bp, mouse
gtccaagtttgttggagtca

SEQ ID NO: 644713 - DNA, 20 bp, mouse
gtcactggagtgtgcgtagc

SEQ ID NO: 644714 - DNA, 20 bp, mouse
ggtgaatgcctggttccagg

SEQ ID NO: 644715 - DNA, 20 bp, mouse
gtgcatcatgagtgcttcca

SEQ ID NO: 644716 - DNA, 20 bp, mouse
gctggcagatgtgcacggta

SEQ ID NO: 644717 - DNA, 20 bp, mouse
gcagctgcctaaggcagcct

SEQ ID NO: 644718 - DNA, 20 bp, mouse
ggtaatactgtggtgataag

SEQ ID NO: 644719 - DNA, 20 bp, mouse
gagaggaaaaacctgctggg

SEQ ID NO: 644720 - DNA, 20 bp, mouse
gaggctaccctggtgcaata

SEQ ID NO: 644721 - DNA, 20 bp, mouse
gtccctggctgggcactcct

SEQ ID NO: 644722 - DNA, 20 bp, mouse
ggtggctccctattgcacca

SEQ ID NO: 644723 - DNA, 20 bp, mouse
ggtgcccagccagggagagg

SEQ ID NO: 644724 - DNA, 20 bp, mouse
gagggcaccgaggctgcctt

SEQ ID NO: 644725 - DNA, 20 bp, mouse
gtgtgcacggtagggcaccg

SEQ ID NO: 644726 - DNA, 20 bp, mouse
ggacaccagccccatttcag

SEQ ID NO: 644727 - DNA, 20 bp, mouse
gtgtttgagcccctgaaatg

SEQ ID NO: 644728 - DNA, 20 bp, mouse
gagcccgggcaatggttgtc

SEQ ID NO: 644729 - DNA, 20 bp, mouse
ggcccagacaaccattgccc

SEQ ID NO: 644730 - DNA, 20 bp, mouse
gtcaagcgaaagaaagccga

SEQ ID NO: 644731 - DNA, 20 bp, mouse
gtgaagtgtgacaaggtgac

SEQ ID NO: 644732 - DNA, 20 bp, mouse
gtgtcacacttcagcagcag

SEQ ID NO: 644733 - DNA, 20 bp, mouse
gtcttgcaagcctagagccc

SEQ ID NO: 644734 - DNA, 20 bp, mouse
gataagtgcttttattccat

SEQ ID NO: 644735 - DNA, 20 bp, mouse
ggtatgtgattgttggtatc

SEQ ID NO: 644736 - DNA, 20 bp, mouse
gtgccccgggagcggtgggt

SEQ ID NO: 644737 - DNA, 20 bp, mouse
ggacccatcctgatcgtgcg

SEQ ID NO: 644738 - DNA, 20 bp, mouse
gcagccccgcacgatcagga

SEQ ID NO: 644739 - DNA, 20 bp, mouse
gactgggcagggagcgggac

SEQ ID NO: 644740 - DNA, 20 bp, mouse
gcgcctgccccgggagcggt

SEQ ID NO: 644741 - DNA, 20 bp, mouse
gggtgggaatccggagaagt

SEQ ID NO: 644742 - DNA, 20 bp, mouse
gagggagcgggacgggccag

SEQ ID NO: 644743 - DNA, 20 bp, mouse
gcagtcccacccaccgctcc

SEQ ID NO: 644744 - DNA, 20 bp, mouse
gactgccctcacactaatag

SEQ ID NO: 644745 - DNA, 20 bp, mouse
gccggccgaccccgacgtga

SEQ ID NO: 644746 - DNA, 20 bp, mouse
ggtctcggggcttgaaggga

SEQ ID NO: 644747 - DNA, 20 bp, mouse
gccccgccgctgcgggtctg

SEQ ID NO: 644748 - DNA, 20 bp, mouse
gcccgctccccggggtctcg

SEQ ID NO: 644749 - DNA, 20 bp, mouse
gacccgcagacccgcagcgg

SEQ ID NO: 644750 - DNA, 20 bp, mouse
gaggggaggtggcagcccgg

SEQ ID NO: 644751 - DNA, 20 bp, mouse
gtgcgggtctgcgggtctgt

SEQ ID NO: 644752 - DNA, 20 bp, mouse
gagactgtcgcctgcgtgaa

SEQ ID NO: 644753 - DNA, 20 bp, mouse
gagctcaagcccaccctcgg

SEQ ID NO: 644754 - DNA, 20 bp, mouse
gtgtctgggctcccgctccc

SEQ ID NO: 644755 - DNA, 20 bp, mouse
gcggggtctcggggcttgaa

SEQ ID NO: 644756 - DNA, 20 bp, mouse
ggtaatagaggggtagacta

SEQ ID NO: 644757 - DNA, 20 bp, mouse
ggggccagccgctaggtaga

SEQ ID NO: 644758 - DNA, 20 bp, mouse
gatgggtatgccagattcga

SEQ ID NO: 644759 - DNA, 20 bp, mouse
gtccgccaacgcccttcgaa

SEQ ID NO: 644760 - DNA, 20 bp, mouse
gggaaacgaccgaacagctc

SEQ ID NO: 644761 - DNA, 20 bp, mouse
ggcggctggcccctcccatc

SEQ ID NO: 644762 - DNA, 20 bp, mouse
gcctgaaagccagatgggag

SEQ ID NO: 644763 - DNA, 20 bp, mouse
gcggtccgttcgaagggcgt

SEQ ID NO: 644764 - DNA, 20 bp, mouse
ggaacagctccggagaaacc

SEQ ID NO: 644765 - DNA, 20 bp, mouse
gaggggtagactatggcagt

SEQ ID NO: 644766 - DNA, 20 bp, mouse
gagggggcctagacagacaa

SEQ ID NO: 644767 - DNA, 20 bp, mouse
gagagtgcagaagatcagct

SEQ ID NO: 644768 - DNA, 20 bp, mouse
gaagagcagtccaataaccc

SEQ ID NO: 644769 - DNA, 20 bp, mouse
gcagtggggaatcccactga

SEQ ID NO: 644770 - DNA, 20 bp, mouse
gcggatgggaggacttacca

SEQ ID NO: 644771 - DNA, 20 bp, mouse
gggtgggagtcattagagct

SEQ ID NO: 644772 - DNA, 20 bp, mouse
ggctcactgctgggacatag

SEQ ID NO: 644773 - DNA, 20 bp, mouse
ggggcactccttcctggggt

SEQ ID NO: 644774 - DNA, 20 bp, mouse
gtggggaagtcgctcttccc

SEQ ID NO: 644775 - DNA, 20 bp, mouse
gcagagtgagcaggagtctc

SEQ ID NO: 644776 - DNA, 20 bp, mouse
gcatgcctgcgcgctgtggt

SEQ ID NO: 644777 - DNA, 20 bp, mouse
gcaggcatgcaggcttgtac

SEQ ID NO: 644778 - DNA, 20 bp, mouse
gcctgcacaaacacattctt

SEQ ID NO: 644779 - DNA, 20 bp, mouse
gccctcctgtaaccctctct

SEQ ID NO: 644780 - DNA, 20 bp, mouse
gctctcccaccacagcgcgc

SEQ ID NO: 644781 - DNA, 20 bp, mouse
gacctagagagggttacagg

SEQ ID NO: 644782 - DNA, 20 bp, mouse
gacaacctagagagggttac

SEQ ID NO: 644783 - DNA, 20 bp, mouse
gaggaactcccggtgctcat

SEQ ID NO: 644784 - DNA, 20 bp, mouse
gtgcaaaggctagatcctat

SEQ ID NO: 644785 - DNA, 20 bp, mouse
gaacttctgaacttcgatgt

SEQ ID NO: 644786 - DNA, 20 bp, mouse
gacacagacgtgaggtaaat

SEQ ID NO: 644787 - DNA, 20 bp, mouse
gtaaggatcacacagacgtg

SEQ ID NO: 644788 - DNA, 20 bp, mouse
gattgagtctggtgtctaat

SEQ ID NO: 644789 - DNA, 20 bp, mouse
gagactcaatggcagttatg

SEQ ID NO: 644790 - DNA, 20 bp, mouse
gaaggctaattattcaccca

SEQ ID NO: 644791 - DNA, 20 bp, mouse
gctcagtgtgacctcatcac

SEQ ID NO: 644792 - DNA, 20 bp, mouse
gtgagatgtaagttttgagc

SEQ ID NO: 644793 - DNA, 20 bp, mouse
ggatgtgatggagcaacccg

SEQ ID NO: 644794 - DNA, 20 bp, mouse
gatcctggctgtcaaccgtc

SEQ ID NO: 644795 - DNA, 20 bp, mouse
gatgctaaaatctttaccat

SEQ ID NO: 644796 - DNA, 20 bp, mouse
gcgccctcaggcctgacctg

SEQ ID NO: 644797 - DNA, 20 bp, mouse
gcgtgggcggggcctaggat

SEQ ID NO: 644798 - DNA, 20 bp, mouse
gccacagcccccagcctcgt

SEQ ID NO: 644799 - DNA, 20 bp, mouse
ggccaccacagcagcgaatg

SEQ ID NO: 644800 - DNA, 20 bp, mouse
gtagcctgtgagctgatggg

SEQ ID NO: 644801 - DNA, 20 bp, mouse
gaacgcgtgtgcccaatcgc

SEQ ID NO: 644802 - DNA, 20 bp, mouse
gcacggccccgcccacgtcc

SEQ ID NO: 644803 - DNA, 20 bp, mouse
gaccacagcagcgaatgggg

SEQ ID NO: 644804 - DNA, 20 bp, mouse
gcctcagctacccaacccgg

SEQ ID NO: 644805 - DNA, 20 bp, mouse
gtctaggaggagaacctacg

SEQ ID NO: 644806 - DNA, 20 bp, mouse
gcctcctgacgggtacctga

SEQ ID NO: 644807 - DNA, 20 bp, mouse
ggaggcctggccagcccagt

SEQ ID NO: 644808 - DNA, 20 bp, mouse
gtacctgaaggtagacataa

SEQ ID NO: 644809 - DNA, 20 bp, mouse
gaggtagctcagtcggcaga

SEQ ID NO: 644810 - DNA, 20 bp, mouse
ggctttgggccagcattctt

SEQ ID NO: 644811 - DNA, 20 bp, mouse
gtggggcagtgcaccatgtc

SEQ ID NO: 644812 - DNA, 20 bp, mouse
gctaccttcaggtacccgtc

SEQ ID NO: 644813 - DNA, 20 bp, mouse
gagaatgtactcaactccag

SEQ ID NO: 644814 - DNA, 20 bp, mouse
gggaccgactgagtccagtc

SEQ ID NO: 644815 - DNA, 20 bp, mouse
gtgtttgcccacttggcttt

SEQ ID NO: 644816 - DNA, 20 bp, mouse
gccaaatccgggtttccgga

SEQ ID NO: 644817 - DNA, 20 bp, mouse
gagagcgcgcgaccttcatc

SEQ ID NO: 644818 - DNA, 20 bp, mouse
ggggtgaaccccaaagcggg

SEQ ID NO: 644819 - DNA, 20 bp, mouse
gggaaacccggatttggggc

SEQ ID NO: 644820 - DNA, 20 bp, mouse
gcccgctaggaagtcgccta

SEQ ID NO: 644821 - DNA, 20 bp, mouse
gtgtccgcccgccccaaatc

SEQ ID NO: 644822 - DNA, 20 bp, mouse
gcaggcgcggcgcgatgccg

SEQ ID NO: 644823 - DNA, 20 bp, mouse
ggacagaaacgctctgccaa

SEQ ID NO: 644824 - DNA, 20 bp, mouse
gccgcgcctgcgcagaaggt

SEQ ID NO: 644825 - DNA, 20 bp, mouse
gaaacgctctgccaaaggcg

SEQ ID NO: 644826 - DNA, 20 bp, mouse
gcaaccaagtcacagacttc

SEQ ID NO: 644827 - DNA, 20 bp, mouse
gacacctgaagtctgtgact

SEQ ID NO: 644828 - DNA, 20 bp, mouse
gtacaagattactgccacag

SEQ ID NO: 644829 - DNA, 20 bp, mouse
gcccctttccatctctgcag

SEQ ID NO: 644830 - DNA, 20 bp, mouse
gtctctgcagtggtgtggac

SEQ ID NO: 644831 - DNA, 20 bp, mouse
gcaactgagctgctccagaa

SEQ ID NO: 644832 - DNA, 20 bp, mouse
gttccatctctgcagtggtg

SEQ ID NO: 644833 - DNA, 20 bp, mouse
gtggcagtaatcttgtaagc

SEQ ID NO: 644834 - DNA, 20 bp, mouse
gacggacatcttacagtttt

SEQ ID NO: 644835 - DNA, 20 bp, mouse
gtaagtattaaagtccattc

SEQ ID NO: 644836 - DNA, 20 bp, mouse
gtctcctgcccaatttggaa

SEQ ID NO: 644837 - DNA, 20 bp, mouse
gcaggagaggtgtactcttt

SEQ ID NO: 644838 - DNA, 20 bp, mouse
gactccattccaaattgggc

SEQ ID NO: 644839 - DNA, 20 bp, mouse
gaatcactccattccaaatt

SEQ ID NO: 644840 - DNA, 20 bp, mouse
ggtgatgtaactaggggcac

SEQ ID NO: 644841 - DNA, 20 bp, mouse
gatggtggtgatgtaactag

SEQ ID NO: 644842 - DNA, 20 bp, mouse
gacacctctcctgcccaatt

SEQ ID NO: 644843 - DNA, 20 bp, mouse
gggagtgattagataataat

SEQ ID NO: 644844 - DNA, 20 bp, mouse
gaataggtaatctattatgg

SEQ ID NO: 644845 - DNA, 20 bp, mouse
gaataataggtaatctatta

SEQ ID NO: 644846 - DNA, 20 bp, mouse
gggcagatgggcggagtcta

SEQ ID NO: 644847 - DNA, 20 bp, mouse
gtccgcccatctgccaagat

SEQ ID NO: 644848 - DNA, 20 bp, mouse
ggggccggaaccagctgctg

SEQ ID NO: 644849 - DNA, 20 bp, mouse
gtgaaggcagaccataccga

SEQ ID NO: 644850 - DNA, 20 bp, mouse
gtccgggtgcgccctccctt

SEQ ID NO: 644851 - DNA, 20 bp, mouse
gcccatctgccaagatcgga

SEQ ID NO: 644852 - DNA, 20 bp, mouse
gatcgcttgcagcttctaga

SEQ ID NO: 644853 - DNA, 20 bp, mouse
gctgggccttggggcggaat

SEQ ID NO: 644854 - DNA, 20 bp, mouse
gtcggaaggttccgaaggga

SEQ ID NO: 644855 - DNA, 20 bp, mouse
ggggcctaggaggtacagag

SEQ ID NO: 644856 - DNA, 20 bp, mouse
gggaggaggccccaccctcg

SEQ ID NO: 644857 - DNA, 20 bp, mouse
ggcagatagcacagtgggcg

SEQ ID NO: 644858 - DNA, 20 bp, mouse
gcccaagggcaaaggtgaca

SEQ ID NO: 644859 - DNA, 20 bp, mouse
ggtgggcggggcttacatga

SEQ ID NO: 644860 - DNA, 20 bp, mouse
gcgtggaaagcaaagatgcg

SEQ ID NO: 644861 - DNA, 20 bp, mouse
gagagacgagtcaaccgcga

SEQ ID NO: 644862 - DNA, 20 bp, mouse
gggcttacatgacggaaacc

SEQ ID NO: 644863 - DNA, 20 bp, mouse
gctccagcttccacacccaa

SEQ ID NO: 644864 - DNA, 20 bp, mouse
gaagagtgcagatagcacag

SEQ ID NO: 644865 - DNA, 20 bp, mouse
gtgcccttgggtgtggaagc

SEQ ID NO: 644866 - DNA, 20 bp, mouse
gcaggccaagtgtgtctctt

SEQ ID NO: 644867 - DNA, 20 bp, mouse
gccactcgctgcagtcccat

SEQ ID NO: 644868 - DNA, 20 bp, mouse
gtgccggctaagaaggaacc

SEQ ID NO: 644869 - DNA, 20 bp, mouse
gggcctggttccttcttagc

SEQ ID NO: 644870 - DNA, 20 bp, mouse
gaaccctctgaatttcaacg

SEQ ID NO: 644871 - DNA, 20 bp, mouse
gcttaggaggtgtctgtctg

SEQ ID NO: 644872 - DNA, 20 bp, mouse
gctgtctgaggccaaccaat

SEQ ID NO: 644873 - DNA, 20 bp, mouse
gggttcccaagagacacact

SEQ ID NO: 644874 - DNA, 20 bp, mouse
gaagtctcacaactcttagg

SEQ ID NO: 644875 - DNA, 20 bp, mouse
gctggagtagttagtagttg

SEQ ID NO: 644876 - DNA, 20 bp, mouse
ggtcagctcagagaggtcag

SEQ ID NO: 644877 - DNA, 20 bp, mouse
gactatggatcctgcatatt

SEQ ID NO: 644878 - DNA, 20 bp, mouse
gcctgcatatttgggaagag

SEQ ID NO: 644879 - DNA, 20 bp, mouse
gtggcgtcacctagaaggtg

SEQ ID NO: 644880 - DNA, 20 bp, mouse
gcatacagcctcagatcaag

SEQ ID NO: 644881 - DNA, 20 bp, mouse
gcacaggtgtcagctcagag

SEQ ID NO: 644882 - DNA, 20 bp, mouse
gatgtcatggaaccctatcc

SEQ ID NO: 644883 - DNA, 20 bp, mouse
gatcaggccttctaatataa

SEQ ID NO: 644884 - DNA, 20 bp, mouse
gaatgtcttcggtttctatc

SEQ ID NO: 644885 - DNA, 20 bp, mouse
gacaatctgatcttgatatg

SEQ ID NO: 644886 - DNA, 20 bp, mouse
ggactccctggcaagagaat

SEQ ID NO: 644887 - DNA, 20 bp, mouse
gcgtccacaagagggcaggc

SEQ ID NO: 644888 - DNA, 20 bp, mouse
gtccggtggtgccagtaggt

SEQ ID NO: 644889 - DNA, 20 bp, mouse
gctccctagcacctgccaac

SEQ ID NO: 644890 - DNA, 20 bp, mouse
ggcccagttggcaggtgcta

SEQ ID NO: 644891 - DNA, 20 bp, mouse
gactctatgtctctagactc

SEQ ID NO: 644892 - DNA, 20 bp, mouse
ggggcaggctggagtgtagc

SEQ ID NO: 644893 - DNA, 20 bp, mouse
gagctcccattctcttgcca

SEQ ID NO: 644894 - DNA, 20 bp, mouse
gagagtccggtggtgccagt

SEQ ID NO: 644895 - DNA, 20 bp, mouse
ggggcctgttgcccacctac

SEQ ID NO: 644896 - DNA, 20 bp, mouse
gccctcctcgcgacagtccc

SEQ ID NO: 644897 - DNA, 20 bp, mouse
ggggccccaggggatcggga

SEQ ID NO: 644898 - DNA, 20 bp, mouse
gcagtccccggctgactcgt

SEQ ID NO: 644899 - DNA, 20 bp, mouse
gcgcccgctgccaggtgctt

SEQ ID NO: 644900 - DNA, 20 bp, mouse
gggcccgcccccgctccaaa

SEQ ID NO: 644901 - DNA, 20 bp, mouse
gtcagccggggactgtcgcg

SEQ ID NO: 644902 - DNA, 20 bp, mouse
ggactgtcgcgaggagggcg

SEQ ID NO: 644903 - DNA, 20 bp, mouse
ggcttaggaggtgagaggtc

SEQ ID NO: 644904 - DNA, 20 bp, mouse
ggggcgggccccaggggatc

SEQ ID NO: 644905 - DNA, 20 bp, mouse
gcctagctccaaaacgcatg

SEQ ID NO: 644906 - DNA, 20 bp, mouse
gcgcggacggggaccagaga

SEQ ID NO: 644907 - DNA, 20 bp, mouse
gcgaacgccggaacctgcgc

SEQ ID NO: 644908 - DNA, 20 bp, mouse
gggccagcgaggcgcagatg

SEQ ID NO: 644909 - DNA, 20 bp, mouse
gctggggcgctaaagagtga

SEQ ID NO: 644910 - DNA, 20 bp, mouse
gcgcgtccgcgtcaaccttc

SEQ ID NO: 644911 - DNA, 20 bp, mouse
gggacgctggggaccatcgt

SEQ ID NO: 644912 - DNA, 20 bp, mouse
gcccgaagcagcacaggcgg

SEQ ID NO: 644913 - DNA, 20 bp, mouse
gtcggcgcccgaagcagcac

SEQ ID NO: 644914 - DNA, 20 bp, mouse
ggggcggtcttcttgccgga

SEQ ID NO: 644915 - DNA, 20 bp, mouse
ggcgcccgaagcagcacagg

SEQ ID NO: 644916 - DNA, 20 bp, mouse
gtggcgactggaggtttcat

SEQ ID NO: 644917 - DNA, 20 bp, mouse
gggtccagcccacttttcat

SEQ ID NO: 644918 - DNA, 20 bp, mouse
gaacgagtgtctattactct

SEQ ID NO: 644919 - DNA, 20 bp, mouse
ggcacctgaaaaacagtgct

SEQ ID NO: 644920 - DNA, 20 bp, mouse
gtaccccatgaaaagtgggc

SEQ ID NO: 644921 - DNA, 20 bp, mouse
ggacactcgttactaatctt

SEQ ID NO: 644922 - DNA, 20 bp, mouse
ggatctcttaactttctctg

SEQ ID NO: 644923 - DNA, 20 bp, mouse
gtgctaggttccggatataa

SEQ ID NO: 644924 - DNA, 20 bp, mouse
ggaaaaacagtgctaggttc

SEQ ID NO: 644925 - DNA, 20 bp, mouse
ggcaggcagctggccactag

SEQ ID NO: 644926 - DNA, 20 bp, mouse
gagacagtggaccaacactg

SEQ ID NO: 644927 - DNA, 20 bp, mouse
gcagtcacctggtccaatca

SEQ ID NO: 644928 - DNA, 20 bp, mouse
gttctcttggggaacctctc

SEQ ID NO: 644929 - DNA, 20 bp, mouse
ggggaaagttgaacattgga

SEQ ID NO: 644930 - DNA, 20 bp, mouse
gacagcagaaagcagaattc

SEQ ID NO: 644931 - DNA, 20 bp, mouse
gttatctagggacttcttat

SEQ ID NO: 644932 - DNA, 20 bp, mouse
gagaaagcagaattccggag

SEQ ID NO: 644933 - DNA, 20 bp, mouse
ggaggtagattatctgagta

SEQ ID NO: 644934 - DNA, 20 bp, mouse
gtaggactcaacacagacag

SEQ ID NO: 644935 - DNA, 20 bp, mouse
gaattctttgagcttatcta

SEQ ID NO: 644936 - DNA, 20 bp, mouse
ggtggtgttgtgaaagtgat

SEQ ID NO: 644937 - DNA, 20 bp, mouse
gggccaaaggtcatgcttcg

SEQ ID NO: 644938 - DNA, 20 bp, mouse
gcactttcacaacaccacgt

SEQ ID NO: 644939 - DNA, 20 bp, mouse
gctgggagctgtagcatcca

SEQ ID NO: 644940 - DNA, 20 bp, mouse
ggcttctcgccactcccacg

SEQ ID NO: 644941 - DNA, 20 bp, mouse
ggcaaagtacgatccttccg

SEQ ID NO: 644942 - DNA, 20 bp, mouse
ggggccacacaaaaggacac

SEQ ID NO: 644943 - DNA, 20 bp, mouse
gcagcttacaaaaacttccc

SEQ ID NO: 644944 - DNA, 20 bp, mouse
gcatgatctgtcagcaattt

SEQ ID NO: 644945 - DNA, 20 bp, mouse
gacaaaaggacacgggagaa

SEQ ID NO: 644946 - DNA, 20 bp, mouse
ggctcaaagccaagtttctc

SEQ ID NO: 644947 - DNA, 20 bp, mouse
gagagtaaaactattggtcg

SEQ ID NO: 644948 - DNA, 20 bp, mouse
gtcaagcggagctagagctc

SEQ ID NO: 644949 - DNA, 20 bp, mouse
gacccaatgggcagtgacaa

SEQ ID NO: 644950 - DNA, 20 bp, mouse
gggacaaggactgagttgca

SEQ ID NO: 644951 - DNA, 20 bp, mouse
gctgaaatctgtaaaccgaa

SEQ ID NO: 644952 - DNA, 20 bp, mouse
gctggaaaggaagcgagatc

SEQ ID NO: 644953 - DNA, 20 bp, mouse
gccggaatgcatgaggagtc

SEQ ID NO: 644954 - DNA, 20 bp, mouse
gcaagggcagtgacctgatc

SEQ ID NO: 644955 - DNA, 20 bp, mouse
gttactcatgcaatctggaa

SEQ ID NO: 644956 - DNA, 20 bp, mouse
gctcacgtggtgttgaggat

SEQ ID NO: 644957 - DNA, 20 bp, mouse
gacaggaggatcattgtgtt

SEQ ID NO: 644958 - DNA, 20 bp, mouse
gaagtccgggaagtctacgt

SEQ ID NO: 644959 - DNA, 20 bp, mouse
gccctccaacgtagacttcc

SEQ ID NO: 644960 - DNA, 20 bp, mouse
gtatgacaggagattgaata

SEQ ID NO: 644961 - DNA, 20 bp, mouse
gtccgggaagtctacgttgg

SEQ ID NO: 644962 - DNA, 20 bp, mouse
gacgtggtgttgaggatagg

SEQ ID NO: 644963 - DNA, 20 bp, mouse
gacagaggattctgctcacg

SEQ ID NO: 644964 - DNA, 20 bp, mouse
gtactactgaatccacgcaa

SEQ ID NO: 644965 - DNA, 20 bp, mouse
gggctacaactattctgcag

SEQ ID NO: 644966 - DNA, 20 bp, mouse
gagtgaaggggcctcctcaa

SEQ ID NO: 644967 - DNA, 20 bp, mouse
gtgaaagcagcaggaagtcg

SEQ ID NO: 644968 - DNA, 20 bp, mouse
gggagataggggtttaataa

SEQ ID NO: 644969 - DNA, 20 bp, mouse
gaaaggcccgcccctctgca

SEQ ID NO: 644970 - DNA, 20 bp, mouse
gacagcttccggccaatatc

SEQ ID NO: 644971 - DNA, 20 bp, mouse
ggtcggtcggccctgcagag

SEQ ID NO: 644972 - DNA, 20 bp, mouse
ggagtgctgggacagacaag

SEQ ID NO: 644973 - DNA, 20 bp, mouse
gggtctgccaagtgaggcag

SEQ ID NO: 644974 - DNA, 20 bp, mouse
ggagggagctggtgctgcac

SEQ ID NO: 644975 - DNA, 20 bp, mouse
gtcctcaagggaatctagct

SEQ ID NO: 644976 - DNA, 20 bp, mouse
gcaggggccggaaatcccaa

SEQ ID NO: 644977 - DNA, 20 bp, mouse
gtgattgggtgaatcagcga

SEQ ID NO: 644978 - DNA, 20 bp, mouse
ggcgagacgcagattgtgat

SEQ ID NO: 644979 - DNA, 20 bp, mouse
gcttgggaggagcccagaac

SEQ ID NO: 644980 - DNA, 20 bp, mouse
gtgcttgtcaatttcagagt

SEQ ID NO: 644981 - DNA, 20 bp, mouse
gcttccggaaggtcgctcca

SEQ ID NO: 644982 - DNA, 20 bp, mouse
gaccggtaacagcaacctag

SEQ ID NO: 644983 - DNA, 20 bp, mouse
ggggtgaatcagcgaggggg

SEQ ID NO: 644984 - DNA, 20 bp, mouse
gttggacatccgcgtgtgat

SEQ ID NO: 644985 - DNA, 20 bp, mouse
gggcccctggagcgaccttc

SEQ ID NO: 644986 - DNA, 20 bp, mouse
ggggacttctgcgtagagaa

SEQ ID NO: 644987 - DNA, 20 bp, mouse
gcccactcaatcagctaggt

SEQ ID NO: 644988 - DNA, 20 bp, mouse
gtcaatcagctaggtggggt

SEQ ID NO: 644989 - DNA, 20 bp, mouse
ggcgggtcctgctatttgat

SEQ ID NO: 644990 - DNA, 20 bp, mouse
gggctgcgctgcccggggta

SEQ ID NO: 644991 - DNA, 20 bp, mouse
gcagaagtcccgccccctgg

SEQ ID NO: 644992 - DNA, 20 bp, mouse
ggagggcctcactgcaggaa

SEQ ID NO: 644993 - DNA, 20 bp, mouse
ggtagggctgtgccgccagg

SEQ ID NO: 644994 - DNA, 20 bp, mouse
gacttctgcgtagagaatgg

SEQ ID NO: 644995 - DNA, 20 bp, mouse
gatagggagggcctcactgc

SEQ ID NO: 644996 - DNA, 20 bp, mouse
gccgccactcctcacgtgac

SEQ ID NO: 644997 - DNA, 20 bp, mouse
gaccgcagtggcactggaaa

SEQ ID NO: 644998 - DNA, 20 bp, mouse
gccaaggaaagcaaggtaaa

SEQ ID NO: 644999 - DNA, 20 bp, mouse
gcccgagcggctcctcgcca

SEQ ID NO: 645000 - DNA, 20 bp, mouse
gcagccggtcacgtgaggag

SEQ ID NO: 645001 - DNA, 20 bp, mouse
gagaagggaatgggtgtcaa

SEQ ID NO: 645002 - DNA, 20 bp, mouse
gaacctggagacgtgaggtc

SEQ ID NO: 645003 - DNA, 20 bp, mouse
gcggcgggcggtaccagcgt

SEQ ID NO: 645004 - DNA, 20 bp, mouse
ggattgcagccggtcacgtg

SEQ ID NO: 645005 - DNA, 20 bp, mouse
gtccgctcatagggcctggt

SEQ ID NO: 645006 - DNA, 20 bp, mouse
gacactggcaggaaacagca

SEQ ID NO: 645007 - DNA, 20 bp, mouse
gactcagcttccaggcttaa

SEQ ID NO: 645008 - DNA, 20 bp, mouse
gcacaggacacacccctcag

SEQ ID NO: 645009 - DNA, 20 bp, mouse
gagggcctcatgcaatactc

SEQ ID NO: 645010 - DNA, 20 bp, mouse
ggtttcctgccagtgtcgtt

SEQ ID NO: 645011 - DNA, 20 bp, mouse
gaccctttgcccaacgacac

SEQ ID NO: 645012 - DNA, 20 bp, mouse
gaggggtgtgtcctgtgtcc

SEQ ID NO: 645013 - DNA, 20 bp, mouse
gtggacccgtcctgccacca

SEQ ID NO: 645014 - DNA, 20 bp, mouse
gtgccagtgtcgttgggcaa

SEQ ID NO: 645015 - DNA, 20 bp, mouse
gaaagggtgtatattgtatc

SEQ ID NO: 645016 - DNA, 20 bp, mouse
gtaacccgggagaaggcaac

SEQ ID NO: 645017 - DNA, 20 bp, mouse
gcggcagcaaccccagtcaa

SEQ ID NO: 645018 - DNA, 20 bp, mouse
gcaagggagggatgatgtcc

SEQ ID NO: 645019 - DNA, 20 bp, mouse
gcgtttccctggcgacgggg

SEQ ID NO: 645020 - DNA, 20 bp, mouse
gtccgcgtttccctggcgac

SEQ ID NO: 645021 - DNA, 20 bp, mouse
gagcccgaagcatctaaccc

SEQ ID NO: 645022 - DNA, 20 bp, mouse
ggagggatgatgtccgggat

SEQ ID NO: 645023 - DNA, 20 bp, mouse
gtcagctcaaatgcggttcc

SEQ ID NO: 645024 - DNA, 20 bp, mouse
gggctcagaatgatgacgca

SEQ ID NO: 645025 - DNA, 20 bp, mouse
gcagcaaccccagtcaaggg

SEQ ID NO: 645026 - DNA, 20 bp, mouse
gaaggtcgggagaacagtgg

SEQ ID NO: 645027 - DNA, 20 bp, mouse
gaaagagggaggagatgtgt

SEQ ID NO: 645028 - DNA, 20 bp, mouse
gaccacagcaataatggggt

SEQ ID NO: 645029 - DNA, 20 bp, mouse
gagcagttcctggtaaggtc

SEQ ID NO: 645030 - DNA, 20 bp, mouse
gggtaaggtcgggagaacag

SEQ ID NO: 645031 - DNA, 20 bp, mouse
gtaaagagcagttcctggta

SEQ ID NO: 645032 - DNA, 20 bp, mouse
ggggaaacatgcaaaatggc

SEQ ID NO: 645033 - DNA, 20 bp, mouse
gagtggaatgataagtagga

SEQ ID NO: 645034 - DNA, 20 bp, mouse
ggatgtgtgggtgagctggg

SEQ ID NO: 645035 - DNA, 20 bp, mouse
ggtgctgatctgatgtctct

SEQ ID NO: 645036 - DNA, 20 bp, mouse
gtgcccaggtcgcacgtcta

SEQ ID NO: 645037 - DNA, 20 bp, mouse
ggggccagaagtcgcctaga

SEQ ID NO: 645038 - DNA, 20 bp, mouse
gtcgcacgtctaaggagtga

SEQ ID NO: 645039 - DNA, 20 bp, mouse
gtgagggcggggtgaacgcg

SEQ ID NO: 645040 - DNA, 20 bp, mouse
gcgtctaaggagtgagggcg

SEQ ID NO: 645041 - DNA, 20 bp, mouse
gggtggcacggtgttgagca

SEQ ID NO: 645042 - DNA, 20 bp, mouse
ggccgcgtacgaacgtgggg

SEQ ID NO: 645043 - DNA, 20 bp, mouse
gccaatgaactcaaggatag

SEQ ID NO: 645044 - DNA, 20 bp, mouse
ggtgttgagcagggaggatt

SEQ ID NO: 645045 - DNA, 20 bp, mouse
gtggggtcggtggtccaaag

SEQ ID NO: 645046 - DNA, 20 bp, mouse
gggcggtgatgaacgagggt

SEQ ID NO: 645047 - DNA, 20 bp, mouse
ggattggcggtgatgaacga

SEQ ID NO: 645048 - DNA, 20 bp, mouse
gcaaaactggggcaaggtgt

SEQ ID NO: 645049 - DNA, 20 bp, mouse
gaatggagaaggtttgcgat

SEQ ID NO: 645050 - DNA, 20 bp, mouse
ggtgggagaaggcggaattt

SEQ ID NO: 645051 - DNA, 20 bp, mouse
gctggtgcaaaactggggca

SEQ ID NO: 645052 - DNA, 20 bp, mouse
gacccaaagaaagatggcga

SEQ ID NO: 645053 - DNA, 20 bp, mouse
ggcgaccttccgggcagaaa

SEQ ID NO: 645054 - DNA, 20 bp, mouse
ggaccgggaatgagaaagtc

SEQ ID NO: 645055 - DNA, 20 bp, mouse
gcttgccctggttggggtct

SEQ ID NO: 645056 - DNA, 20 bp, mouse
gagaccctggctgactgtgc

SEQ ID NO: 645057 - DNA, 20 bp, mouse
gacacattaccatcagaccc

SEQ ID NO: 645058 - DNA, 20 bp, mouse
gctcacatgacccaagggga

SEQ ID NO: 645059 - DNA, 20 bp, mouse
ggtccagaagccctcccctt

SEQ ID NO: 645060 - DNA, 20 bp, mouse
ggacccaaggggagggcttc

SEQ ID NO: 645061 - DNA, 20 bp, mouse
gtctgatggtaatgtgtact

SEQ ID NO: 645062 - DNA, 20 bp, mouse
gagggcttctggacaatcct

SEQ ID NO: 645063 - DNA, 20 bp, mouse
gtcacggctcagtctggcct

SEQ ID NO: 645064 - DNA, 20 bp, mouse
gtgcagtgaacagtcaaact

SEQ ID NO: 645065 - DNA, 20 bp, mouse
gccagtgctcacatgaccca

SEQ ID NO: 645066 - DNA, 20 bp, mouse
gacctggcgcctcgcctcca

SEQ ID NO: 645067 - DNA, 20 bp, mouse
ggaggcgaggcgccaggtaa

SEQ ID NO: 645068 - DNA, 20 bp, mouse
gtgagcaccccaaaagtcga

SEQ ID NO: 645069 - DNA, 20 bp, mouse
gtcccctgcgcggccaccag

SEQ ID NO: 645070 - DNA, 20 bp, mouse
gaggcgccaggtaatggctg

SEQ ID NO: 645071 - DNA, 20 bp, mouse
ggtggcaggtcagcggtgga

SEQ ID NO: 645072 - DNA, 20 bp, mouse
gcgggtctcccttaactcct

SEQ ID NO: 645073 - DNA, 20 bp, mouse
ggggctggacctcccctgcg

SEQ ID NO: 645074 - DNA, 20 bp, mouse
gcaccccaaaagtcgaaggc

SEQ ID NO: 645075 - DNA, 20 bp, mouse
gttcagagtcccaggagtta

SEQ ID NO: 645076 - DNA, 20 bp, mouse
ggggactgggagtggaacgt

SEQ ID NO: 645077 - DNA, 20 bp, mouse
gactgggagtggaacgtggg

SEQ ID NO: 645078 - DNA, 20 bp, mouse
gggaccttaagcatggcggg

SEQ ID NO: 645079 - DNA, 20 bp, mouse
gtgcgcggccgaggtcccca

SEQ ID NO: 645080 - DNA, 20 bp, mouse
ggcggccgaggtccccaggg

SEQ ID NO: 645081 - DNA, 20 bp, mouse
gccgacggaactgccctccc

SEQ ID NO: 645082 - DNA, 20 bp, mouse
gggaggtcaggagattgcgt

SEQ ID NO: 645083 - DNA, 20 bp, mouse
gagtggaacgtgggaggcgt

SEQ ID NO: 645084 - DNA, 20 bp, mouse
gcggccccccgccatgctta

SEQ ID NO: 645085 - DNA, 20 bp, mouse
gcccgccagtcttcaattta

SEQ ID NO: 645086 - DNA, 20 bp, mouse
gcctgcggggcggagctcca

SEQ ID NO: 645087 - DNA, 20 bp, mouse
gggtcccgcacggccgcctg

SEQ ID NO: 645088 - DNA, 20 bp, mouse
ggcagcctgctggtcccgca

SEQ ID NO: 645089 - DNA, 20 bp, mouse
gcgggccttggaggcacaca

SEQ ID NO: 645090 - DNA, 20 bp, mouse
gggcgcgaccggagcctgtc

SEQ ID NO: 645091 - DNA, 20 bp, mouse
gggacccggcggtcccggta

SEQ ID NO: 645092 - DNA, 20 bp, mouse
gcggtcgcgccgtccgggtc

SEQ ID NO: 645093 - DNA, 20 bp, mouse
ggcggccgtgcgggaccagc

SEQ ID NO: 645094 - DNA, 20 bp, mouse
ggcccggcccgacgcgctca

SEQ ID NO: 645095 - DNA, 20 bp, mouse
gccctcccgggtcctaagtc

SEQ ID NO: 645096 - DNA, 20 bp, mouse
gcctccttgcaatcctaata

SEQ ID NO: 645097 - DNA, 20 bp, mouse
gaggcgtaactcaagacctc

SEQ ID NO: 645098 - DNA, 20 bp, mouse
gctctggctcctaattgaag

SEQ ID NO: 645099 - DNA, 20 bp, mouse
ggtagtgggcatgtatcgac

SEQ ID NO: 645100 - DNA, 20 bp, mouse
gtcttgagttacgcctgctc

SEQ ID NO: 645101 - DNA, 20 bp, mouse
gtggctcctaattgaagtgg

SEQ ID NO: 645102 - DNA, 20 bp, mouse
gagccacattcttccctatt

SEQ ID NO: 645103 - DNA, 20 bp, mouse
gttagcatgcaaataatgcc

SEQ ID NO: 645104 - DNA, 20 bp, mouse
gaagaaactcacagacgacc

SEQ ID NO: 645105 - DNA, 20 bp, mouse
gttaggattgcaaggagggt

SEQ ID NO: 645106 - DNA, 20 bp, mouse
gtaacccccaggcctctcca

SEQ ID NO: 645107 - DNA, 20 bp, mouse
gaaagcggagaggtagttac

SEQ ID NO: 645108 - DNA, 20 bp, mouse
gaggaaatggcaaagcggag

SEQ ID NO: 645109 - DNA, 20 bp, mouse
gcccccaggagatgcccatt

SEQ ID NO: 645110 - DNA, 20 bp, mouse
ggaggcctgggggttaggca

SEQ ID NO: 645111 - DNA, 20 bp, mouse
ggagccatggagaggcctgg

SEQ ID NO: 645112 - DNA, 20 bp, mouse
ggccaaatgggcatctcctg

SEQ ID NO: 645113 - DNA, 20 bp, mouse
gcatctatactgtgctaaca

SEQ ID NO: 645114 - DNA, 20 bp, mouse
gcaccccctgcctaaccccc

SEQ ID NO: 645115 - DNA, 20 bp, mouse
gtagatgctggtggccaaat

SEQ ID NO: 645116 - DNA, 20 bp, mouse
gaggtcaggagaatctactc

SEQ ID NO: 645117 - DNA, 20 bp, mouse
gagaatctactcgggaagtt

SEQ ID NO: 645118 - DNA, 20 bp, mouse
gtgagtacctcaccaccctg

SEQ ID NO: 645119 - DNA, 20 bp, mouse
gaaggctggccaaggatgaa

SEQ ID NO: 645120 - DNA, 20 bp, mouse
gacctcaccaccctgaggtc

SEQ ID NO: 645121 - DNA, 20 bp, mouse
gggtcttccgacagaggaga

SEQ ID NO: 645122 - DNA, 20 bp, mouse
gcataaagggagacttcaga

SEQ ID NO: 645123 - DNA, 20 bp, mouse
ggctggccaaggatgaatgg

SEQ ID NO: 645124 - DNA, 20 bp, mouse
gcctgcctggcctaactgct

SEQ ID NO: 645125 - DNA, 20 bp, mouse
gaatggaggtcttccgacag

SEQ ID NO: 645126 - DNA, 20 bp, mouse
ggggccatgtcaggagccac

SEQ ID NO: 645127 - DNA, 20 bp, mouse
gcagacccggggttacagct

SEQ ID NO: 645128 - DNA, 20 bp, mouse
gtacacacctcctgggtcta

SEQ ID NO: 645129 - DNA, 20 bp, mouse
gcagggaggggtaggaacta

SEQ ID NO: 645130 - DNA, 20 bp, mouse
gagtcggtcttcaacagcgt

SEQ ID NO: 645131 - DNA, 20 bp, mouse
ggaagtagcgcgcagacccg

SEQ ID NO: 645132 - DNA, 20 bp, mouse
ggttacagctaggagaaatt

SEQ ID NO: 645133 - DNA, 20 bp, mouse
gggtctaggggttaagtggc

SEQ ID NO: 645134 - DNA, 20 bp, mouse
gaagtggtaccgagcaatag

SEQ ID NO: 645135 - DNA, 20 bp, mouse
gcgtcacagaaggtgagggc

SEQ ID NO: 645136 - DNA, 20 bp, mouse
gtgcctgaacaggatgtaag

SEQ ID NO: 645137 - DNA, 20 bp, mouse
ggtgtagaatagtgtgttag

SEQ ID NO: 645138 - DNA, 20 bp, mouse
gagggccagcctgcctgaac

SEQ ID NO: 645139 - DNA, 20 bp, mouse
gtcactagtggcattgccat

SEQ ID NO: 645140 - DNA, 20 bp, mouse
ggagggtcaacagtgaagtg

SEQ ID NO: 645141 - DNA, 20 bp, mouse
gagaaaatgctcttcactag

SEQ ID NO: 645142 - DNA, 20 bp, mouse
ggggcagaaggtactacagt

SEQ ID NO: 645143 - DNA, 20 bp, mouse
gtaaaagaacatgtgtgttc

SEQ ID NO: 645144 - DNA, 20 bp, mouse
gtagtcaaagttggggtcat

SEQ ID NO: 645145 - DNA, 20 bp, mouse
gactgagtgtttcatggctc

SEQ ID NO: 645146 - DNA, 20 bp, mouse
ggggccctccgggtcacttc

SEQ ID NO: 645147 - DNA, 20 bp, mouse
ggtgcctgaagtgacccgga

SEQ ID NO: 645148 - DNA, 20 bp, mouse
gtgaatgcagcggaaaaacc

SEQ ID NO: 645149 - DNA, 20 bp, mouse
gagaggaaatggggccctcc

SEQ ID NO: 645150 - DNA, 20 bp, mouse
gagtgagaggctggccttga

SEQ ID NO: 645151 - DNA, 20 bp, mouse
ggcagcggggggcgggcatg

SEQ ID NO: 645152 - DNA, 20 bp, mouse
gtgcggtctcccacagtgag

SEQ ID NO: 645153 - DNA, 20 bp, mouse
gctcctcatcttgaatgcag

SEQ ID NO: 645154 - DNA, 20 bp, mouse
gtgagcttctgaaaacagag

SEQ ID NO: 645155 - DNA, 20 bp, mouse
ggcccattggctagaccttc

SEQ ID NO: 645156 - DNA, 20 bp, mouse
gacggccagtgatgtcataa

SEQ ID NO: 645157 - DNA, 20 bp, mouse
gaggagaaaagtactccctg

SEQ ID NO: 645158 - DNA, 20 bp, mouse
ggagtaagtacactggtgag

SEQ ID NO: 645159 - DNA, 20 bp, mouse
ggaatgaatgagggaatgat

SEQ ID NO: 645160 - DNA, 20 bp, mouse
gacaccccttatgacatcac

SEQ ID NO: 645161 - DNA, 20 bp, mouse
gctcctgaggctgggtgcag

SEQ ID NO: 645162 - DNA, 20 bp, mouse
gagggccattcaagaaccta

SEQ ID NO: 645163 - DNA, 20 bp, mouse
gggctgggtgcaggggagga

SEQ ID NO: 645164 - DNA, 20 bp, mouse
ggcctgtcaaaccaacactg

SEQ ID NO: 645165 - DNA, 20 bp, mouse
gcagtgctcaacactggagc

SEQ ID NO: 645166 - DNA, 20 bp, mouse
gtcgctctgcctatggggtg

SEQ ID NO: 645167 - DNA, 20 bp, mouse
ggtgctgcagagccggtctt

SEQ ID NO: 645168 - DNA, 20 bp, mouse
gaggccgggaagtggcgact

SEQ ID NO: 645169 - DNA, 20 bp, mouse
gcttcgagggcgggcttgaa

SEQ ID NO: 645170 - DNA, 20 bp, mouse
gaagggcgggacttcgaggg

SEQ ID NO: 645171 - DNA, 20 bp, mouse
gggaagtggcgactcggtcc

SEQ ID NO: 645172 - DNA, 20 bp, mouse
gctcccggggctcccaagac

SEQ ID NO: 645173 - DNA, 20 bp, mouse
gggctgcagttcccacgcaa

SEQ ID NO: 645174 - DNA, 20 bp, mouse
gcctatggggtgaggaggac

SEQ ID NO: 645175 - DNA, 20 bp, mouse
gtggtcccacgtgcccagta

SEQ ID NO: 645176 - DNA, 20 bp, mouse
gcgcaagtcttgagagggac

SEQ ID NO: 645177 - DNA, 20 bp, mouse
gctgctcgcaagtcttgaga

SEQ ID NO: 645178 - DNA, 20 bp, mouse
gagatctggtaacagatgtc

SEQ ID NO: 645179 - DNA, 20 bp, mouse
gccgggacgtattagatcga

SEQ ID NO: 645180 - DNA, 20 bp, mouse
gcaagccagcaatgtagcta

SEQ ID NO: 645181 - DNA, 20 bp, mouse
ggagcaggaacgttcgttcc

SEQ ID NO: 645182 - DNA, 20 bp, mouse
ggacaatggatccagagatc

SEQ ID NO: 645183 - DNA, 20 bp, mouse
ggcgcctgagaaatgcgttc

SEQ ID NO: 645184 - DNA, 20 bp, mouse
gttcccggaacgcatttctc

SEQ ID NO: 645185 - DNA, 20 bp, mouse
gttacccttagctacattgc

SEQ ID NO: 645186 - DNA, 20 bp, mouse
gagtgggcgcgctaagagat

SEQ ID NO: 645187 - DNA, 20 bp, mouse
gtcgacctgtgcgacaggag

SEQ ID NO: 645188 - DNA, 20 bp, mouse
ggggcgggacctgagaggag

SEQ ID NO: 645189 - DNA, 20 bp, mouse
gcgcgctaagagatggggcg

SEQ ID NO: 645190 - DNA, 20 bp, mouse
ggggacctgagaggagcggt

SEQ ID NO: 645191 - DNA, 20 bp, mouse
gacctgtgcgacaggagggg

SEQ ID NO: 645192 - DNA, 20 bp, mouse
gcagacccgcggtgcctctc

SEQ ID NO: 645193 - DNA, 20 bp, mouse
gcacacccaccgctcctctc

SEQ ID NO: 645194 - DNA, 20 bp, mouse
ggatcagcccagatagggcg

SEQ ID NO: 645195 - DNA, 20 bp, mouse
ggaggagcggtgggtgtgat

SEQ ID NO: 645196 - DNA, 20 bp, mouse
ggggcggggcgaggttacta

SEQ ID NO: 645197 - DNA, 20 bp, mouse
gcccgactggggccctcgca

SEQ ID NO: 645198 - DNA, 20 bp, mouse
gggcggggattgagcccttg

SEQ ID NO: 645199 - DNA, 20 bp, mouse
gggaagacctgaggcgtcca

SEQ ID NO: 645200 - DNA, 20 bp, mouse
ggttactatgggtcattctg

SEQ ID NO: 645201 - DNA, 20 bp, mouse
gcgacggctggacccgactg

SEQ ID NO: 645202 - DNA, 20 bp, mouse
gccccaggccggcatttgat

SEQ ID NO: 645203 - DNA, 20 bp, mouse
gccaccgcccgcgggccaat

SEQ ID NO: 645204 - DNA, 20 bp, mouse
gggcctggggagcgcggtgc

SEQ ID NO: 645205 - DNA, 20 bp, mouse
gggattgagcccttggggag

SEQ ID NO: 645206 - DNA, 20 bp, mouse
gcggaggcgggcgtgtgggt

SEQ ID NO: 645207 - DNA, 20 bp, mouse
gaaaaaggcggagcccgatc

SEQ ID NO: 645208 - DNA, 20 bp, mouse
gcgcccgcctccgctcacta

SEQ ID NO: 645209 - DNA, 20 bp, mouse
gcagctgctgcaaaggagga

SEQ ID NO: 645210 - DNA, 20 bp, mouse
gagggcgtgggccagttctg

SEQ ID NO: 645211 - DNA, 20 bp, mouse
gttgcccagcactgcgggag

SEQ ID NO: 645212 - DNA, 20 bp, mouse
gcaacccggacagccagcgg

SEQ ID NO: 645213 - DNA, 20 bp, mouse
ggaggagggctgcttccgaa

SEQ ID NO: 645214 - DNA, 20 bp, mouse
ggtggctgcgggctcaaggg

SEQ ID NO: 645215 - DNA, 20 bp, mouse
gaggccgcctgcgattcggc

SEQ ID NO: 645216 - DNA, 20 bp, mouse
gaggtctggggactggcgaa

SEQ ID NO: 645217 - DNA, 20 bp, mouse
gagctggtgtgtctgcggaa

SEQ ID NO: 645218 - DNA, 20 bp, mouse
gataatgctgaggtgtaaga

SEQ ID NO: 645219 - DNA, 20 bp, mouse
gtgggagaccagaacctcaa

SEQ ID NO: 645220 - DNA, 20 bp, mouse
ggagagccattcagttgaag

SEQ ID NO: 645221 - DNA, 20 bp, mouse
ggggagccacttcaactgaa

SEQ ID NO: 645222 - DNA, 20 bp, mouse
gtagagggacctccgccctt

SEQ ID NO: 645223 - DNA, 20 bp, mouse
gaacttggcggggtgagagc

SEQ ID NO: 645224 - DNA, 20 bp, mouse
gtttgaatcagggaggtctg

SEQ ID NO: 645225 - DNA, 20 bp, mouse
gtctcaccccgccaagttta

SEQ ID NO: 645226 - DNA, 20 bp, mouse
gtaaagacaacatgtggtca

SEQ ID NO: 645227 - DNA, 20 bp, mouse
gtggcaggctggcagagtaa

SEQ ID NO: 645228 - DNA, 20 bp, mouse
gggcagaagggcatgggttg

SEQ ID NO: 645229 - DNA, 20 bp, mouse
gcatgggttgaggccctggc

SEQ ID NO: 645230 - DNA, 20 bp, mouse
gccagactaaagacaacatg

SEQ ID NO: 645231 - DNA, 20 bp, mouse
gtctgcacatggggcggtac

SEQ ID NO: 645232 - DNA, 20 bp, mouse
gtggttgcttggctttgagc

SEQ ID NO: 645233 - DNA, 20 bp, mouse
gttgtctttagtctgggagg

SEQ ID NO: 645234 - DNA, 20 bp, mouse
gcatggggcggtactggctc

SEQ ID NO: 645235 - DNA, 20 bp, mouse
gccgccccatgtgcagatga

SEQ ID NO: 645236 - DNA, 20 bp, mouse
ggcagcgcgccgggactcct

SEQ ID NO: 645237 - DNA, 20 bp, mouse
gtggaggtagggtcgttcat

SEQ ID NO: 645238 - DNA, 20 bp, mouse
gcgctgcggggctgggagtc

SEQ ID NO: 645239 - DNA, 20 bp, mouse
ggccgagcccgactggggga

SEQ ID NO: 645240 - DNA, 20 bp, mouse
gccgccccgcaacgttctgg

SEQ ID NO: 645241 - DNA, 20 bp, mouse
gcgaactgccgagcccgact

SEQ ID NO: 645242 - DNA, 20 bp, mouse
gtcccagccccgcagcgcgc

SEQ ID NO: 645243 - DNA, 20 bp, mouse
gcgcccgccccgcaacgttc

SEQ ID NO: 645244 - DNA, 20 bp, mouse
gggtggaggcacggtgaggt

SEQ ID NO: 645245 - DNA, 20 bp, mouse
ggcgcagcgcgcgctcctca

SEQ ID NO: 645246 - DNA, 20 bp, mouse
gcagcagggacagtcatcta

SEQ ID NO: 645247 - DNA, 20 bp, mouse
gccaccttgagtagcccatg

SEQ ID NO: 645248 - DNA, 20 bp, mouse
gaaaggtatacactgggaaa

SEQ ID NO: 645249 - DNA, 20 bp, mouse
ggagtgacaacttcaggaat

SEQ ID NO: 645250 - DNA, 20 bp, mouse
gcttgagtagcccatgagga

SEQ ID NO: 645251 - DNA, 20 bp, mouse
gcaaaagaaaggtatacact

SEQ ID NO: 645252 - DNA, 20 bp, mouse
gcaggaagagacaggtattg

SEQ ID NO: 645253 - DNA, 20 bp, mouse
gacagtgcagacttccagca

SEQ ID NO: 645254 - DNA, 20 bp, mouse
gtggagtgaggggctcaccc

SEQ ID NO: 645255 - DNA, 20 bp, mouse
gaaactagatgactcttaag

SEQ ID NO: 645256 - DNA, 20 bp, mouse
ggaactgctccttagcccaa

SEQ ID NO: 645257 - DNA, 20 bp, mouse
gaacctctcattgatccctt

SEQ ID NO: 645258 - DNA, 20 bp, mouse
gtcaactgacactcctccac

SEQ ID NO: 645259 - DNA, 20 bp, mouse
gaagcctgagtagcctccga

SEQ ID NO: 645260 - DNA, 20 bp, mouse
gtgagtgtcacaaacagagc

SEQ ID NO: 645261 - DNA, 20 bp, mouse
gtcattgatcccttgggcta

SEQ ID NO: 645262 - DNA, 20 bp, mouse
gccaagtggagacatcaaat

SEQ ID NO: 645263 - DNA, 20 bp, mouse
gaaggttttgccctgaccag

SEQ ID NO: 645264 - DNA, 20 bp, mouse
gggctactcaggcttgatta

SEQ ID NO: 645265 - DNA, 20 bp, mouse
ggagccctcggaggctactc

SEQ ID NO: 645266 - DNA, 20 bp, mouse
ggaaaagcaaccggaatccg

SEQ ID NO: 645267 - DNA, 20 bp, mouse
gacctctgaagggctgagtg

SEQ ID NO: 645268 - DNA, 20 bp, mouse
gaaggccgagcggtgaggtc

SEQ ID NO: 645269 - DNA, 20 bp, mouse
gcactgcctccacctctgaa

SEQ ID NO: 645270 - DNA, 20 bp, mouse
gtggccgtgggaagagttac

SEQ ID NO: 645271 - DNA, 20 bp, mouse
gtgcttttactaggagggaa

SEQ ID NO: 645272 - DNA, 20 bp, mouse
gagctcaaggatctctaggc

SEQ ID NO: 645273 - DNA, 20 bp, mouse
gcgggagctcaaggatctct

SEQ ID NO: 645274 - DNA, 20 bp, mouse
ggcaggaaggccgagcggtg

SEQ ID NO: 645275 - DNA, 20 bp, mouse
gtgcgtgtgcttttactagg

SEQ ID NO: 645276 - DNA, 20 bp, mouse
gagcaggtttagtttttctt

SEQ ID NO: 645277 - DNA, 20 bp, mouse
gggcactgagtcaggggagg

SEQ ID NO: 645278 - DNA, 20 bp, mouse
gctagctatgtcaatgtcct

SEQ ID NO: 645279 - DNA, 20 bp, mouse
ggggaggatcataatccctt

SEQ ID NO: 645280 - DNA, 20 bp, mouse
gacgcctataaggcacatct

SEQ ID NO: 645281 - DNA, 20 bp, mouse
gtggacaacctgaggttaaa

SEQ ID NO: 645282 - DNA, 20 bp, mouse
gttctttggcactgagtcag

SEQ ID NO: 645283 - DNA, 20 bp, mouse
gaaagggacagacgcctata

SEQ ID NO: 645284 - DNA, 20 bp, mouse
gtataacgcccatctcagag

SEQ ID NO: 645285 - DNA, 20 bp, mouse
ggagctctgataaaattctt

SEQ ID NO: 645286 - DNA, 20 bp, mouse
gtgaaggaatagcttggcaa

SEQ ID NO: 645287 - DNA, 20 bp, mouse
gcctgggcaaagggtattgg

SEQ ID NO: 645288 - DNA, 20 bp, mouse
ggtgaaaaacagataggatc

SEQ ID NO: 645289 - DNA, 20 bp, mouse
gggcctggagtcagcctgtt

SEQ ID NO: 645290 - DNA, 20 bp, mouse
gtagtgtgccagtccctaac

SEQ ID NO: 645291 - DNA, 20 bp, mouse
gtgaccctgaaggaatagct

SEQ ID NO: 645292 - DNA, 20 bp, mouse
gtacactaatggcatcccaa

SEQ ID NO: 645293 - DNA, 20 bp, mouse
ggggtattgggggtgcagaa

SEQ ID NO: 645294 - DNA, 20 bp, mouse
ggtgcctgcaagataaacct

SEQ ID NO: 645295 - DNA, 20 bp, mouse
gcactagtacacgtgctccc

SEQ ID NO: 645296 - DNA, 20 bp, mouse
gaaactgaagccgagagcgc

SEQ ID NO: 645297 - DNA, 20 bp, mouse
gcgagagcgcgggctagccc

SEQ ID NO: 645298 - DNA, 20 bp, mouse
gcgcgggctagccccggact

SEQ ID NO: 645299 - DNA, 20 bp, mouse
gtgtccaggagggaagaggt

SEQ ID NO: 645300 - DNA, 20 bp, mouse
gggctgatgagcaaccctgg

SEQ ID NO: 645301 - DNA, 20 bp, mouse
ggcctgtgtcccaggtccgg

SEQ ID NO: 645302 - DNA, 20 bp, mouse
gcggggccgtggagactctt

SEQ ID NO: 645303 - DNA, 20 bp, mouse
gccgggaggtgggtagaact

SEQ ID NO: 645304 - DNA, 20 bp, mouse
gttgttgtgcgcccagtccg

SEQ ID NO: 645305 - DNA, 20 bp, mouse
ggctgcctgtgtcccaggtc

SEQ ID NO: 645306 - DNA, 20 bp, mouse
ggggtagggccgtgcgtgaa

SEQ ID NO: 645307 - DNA, 20 bp, mouse
gcgctgaagacaaggggtaa

SEQ ID NO: 645308 - DNA, 20 bp, mouse
ggggcggggccagaggtgac

SEQ ID NO: 645309 - DNA, 20 bp, mouse
gaggcgggcccgtggagtga

SEQ ID NO: 645310 - DNA, 20 bp, mouse
gaaagcagaaggaatggtca

SEQ ID NO: 645311 - DNA, 20 bp, mouse
gcggagctgtcttgccggaa

SEQ ID NO: 645312 - DNA, 20 bp, mouse
gcaaaaaccgctgaagacaa

SEQ ID NO: 645313 - DNA, 20 bp, mouse
gcggctggatgtgacacgag

SEQ ID NO: 645314 - DNA, 20 bp, mouse
gagggccgtgcgtgaagggg

SEQ ID NO: 645315 - DNA, 20 bp, mouse
ggtgccggggcggggaaaac

SEQ ID NO: 645316 - DNA, 20 bp, mouse
gagaaagcaacaggctggaa

SEQ ID NO: 645317 - DNA, 20 bp, mouse
gaggctggaacggaggcctg

SEQ ID NO: 645318 - DNA, 20 bp, mouse
gagcccctagccccgaagtt

SEQ ID NO: 645319 - DNA, 20 bp, mouse
ggagtcagcaagaaagcaac

SEQ ID NO: 645320 - DNA, 20 bp, mouse
gggaggcggggctaatcaag

SEQ ID NO: 645321 - DNA, 20 bp, mouse
gagtggccaggagtttatag

SEQ ID NO: 645322 - DNA, 20 bp, mouse
gcgtgtaagagttgaattta

SEQ ID NO: 645323 - DNA, 20 bp, mouse
gaaaagcccaaagggcccaa

SEQ ID NO: 645324 - DNA, 20 bp, mouse
gttacccagcagggttgggg

SEQ ID NO: 645325 - DNA, 20 bp, mouse
gacgcctagaaaaagcccaa

SEQ ID NO: 645326 - DNA, 20 bp, mouse
gggctccaaggctcacggaa

SEQ ID NO: 645327 - DNA, 20 bp, mouse
ggcactagagtcccttcctt

SEQ ID NO: 645328 - DNA, 20 bp, mouse
gctcctgcactgaccaaaga

SEQ ID NO: 645329 - DNA, 20 bp, mouse
gggccagtcctctccttctt

SEQ ID NO: 645330 - DNA, 20 bp, mouse
ggcactgaccaaagaaggag

SEQ ID NO: 645331 - DNA, 20 bp, mouse
gtggcccaggtagctaggac

SEQ ID NO: 645332 - DNA, 20 bp, mouse
ggaccaaagaaggagaggac

SEQ ID NO: 645333 - DNA, 20 bp, mouse
gtggggatactctccatata

SEQ ID NO: 645334 - DNA, 20 bp, mouse
gcaggctgagaaccagccga

SEQ ID NO: 645335 - DNA, 20 bp, mouse
gagccttggagccagttggg

SEQ ID NO: 645336 - DNA, 20 bp, mouse
gtgtttcgggagcagaacag

SEQ ID NO: 645337 - DNA, 20 bp, mouse
gaatgcagtggaagagaccc

SEQ ID NO: 645338 - DNA, 20 bp, mouse
gcactctaacacaaccatat

SEQ ID NO: 645339 - DNA, 20 bp, mouse
gcaaaactctctaatctggg

SEQ ID NO: 645340 - DNA, 20 bp, mouse
gcatttgagcagttgttctg

SEQ ID NO: 645341 - DNA, 20 bp, mouse
gtctgggtggccagaggcct

SEQ ID NO: 645342 - DNA, 20 bp, mouse
gtgaggacttggataaggaa

SEQ ID NO: 645343 - DNA, 20 bp, mouse
gagcacaaaactctctaatc

SEQ ID NO: 645344 - DNA, 20 bp, mouse
gccaaacaaggagcaaagac

SEQ ID NO: 645345 - DNA, 20 bp, mouse
ggctcaaatgcccagacact

SEQ ID NO: 645346 - DNA, 20 bp, mouse
ggtaaccgagacattgaatg

SEQ ID NO: 645347 - DNA, 20 bp, mouse
gaaccaccccaggaccctct

SEQ ID NO: 645348 - DNA, 20 bp, mouse
gttactaggcctgcattctg

SEQ ID NO: 645349 - DNA, 20 bp, mouse
gctgcactgtgcggcgaggc

SEQ ID NO: 645350 - DNA, 20 bp, mouse
gcggaacggcgggcgctgat

SEQ ID NO: 645351 - DNA, 20 bp, mouse
gtccgtaggcccagatgtac

SEQ ID NO: 645352 - DNA, 20 bp, mouse
gcggccactcgagccataaa

SEQ ID NO: 645353 - DNA, 20 bp, mouse
gtggatatcgagcacttaag

SEQ ID NO: 645354 - DNA, 20 bp, mouse
gccacacccagagggtcctg

SEQ ID NO: 645355 - DNA, 20 bp, mouse
gaggctattcctgtacatct

SEQ ID NO: 645356 - DNA, 20 bp, mouse
gggcgcgcgcccaagctcag

SEQ ID NO: 645357 - DNA, 20 bp, mouse
gccgcccgtcggcgcagtgt

SEQ ID NO: 645358 - DNA, 20 bp, mouse
ggcttgcgcccgtttgggga

SEQ ID NO: 645359 - DNA, 20 bp, mouse
gcggagcttgcgcccgtttg

SEQ ID NO: 645360 - DNA, 20 bp, mouse
gcccgtcggcgcagtgtagg

SEQ ID NO: 645361 - DNA, 20 bp, mouse
gcggggccgttgtccggaag

SEQ ID NO: 645362 - DNA, 20 bp, mouse
gaaggcaaacgctggcccgg

SEQ ID NO: 645363 - DNA, 20 bp, mouse
gggcggggtcacagtggcac

SEQ ID NO: 645364 - DNA, 20 bp, mouse
ggcccaagctcaggggacaa

SEQ ID NO: 645365 - DNA, 20 bp, mouse
gtagctgcgcgtgcgtattg

SEQ ID NO: 645366 - DNA, 20 bp, mouse
gagacccggaagcagtgtgt

SEQ ID NO: 645367 - DNA, 20 bp, mouse
gaccaagtggctaaatctca

SEQ ID NO: 645368 - DNA, 20 bp, mouse
gagaaatgctgggaactggt

SEQ ID NO: 645369 - DNA, 20 bp, mouse
gctgggcggggctacctttg

SEQ ID NO: 645370 - DNA, 20 bp, mouse
gtctttcataaagagaaaac

SEQ ID NO: 645371 - DNA, 20 bp, mouse
ggaactggtggggtaggaca

SEQ ID NO: 645372 - DNA, 20 bp, mouse
ggtcagagtgcgcgcttaag

SEQ ID NO: 645373 - DNA, 20 bp, mouse
gagccccgcccagaaatgct

SEQ ID NO: 645374 - DNA, 20 bp, mouse
gagttcccagcatttctggg

SEQ ID NO: 645375 - DNA, 20 bp, mouse
ggatttctatgtgatgcaga

SEQ ID NO: 645376 - DNA, 20 bp, mouse
ggggtagaggatcagccagg

SEQ ID NO: 645377 - DNA, 20 bp, mouse
ggtgctaaggcgaccaaata

SEQ ID NO: 645378 - DNA, 20 bp, mouse
gaccatgtaaggaaggggag

SEQ ID NO: 645379 - DNA, 20 bp, mouse
gctgcccttggctccaagaa

SEQ ID NO: 645380 - DNA, 20 bp, mouse
gccaatgcgccccttggggt

SEQ ID NO: 645381 - DNA, 20 bp, mouse
gggcaggccagcaaggggtg

SEQ ID NO: 645382 - DNA, 20 bp, mouse
gaggccattcttggagccaa

SEQ ID NO: 645383 - DNA, 20 bp, mouse
gctcccagaccatgtaagga

SEQ ID NO: 645384 - DNA, 20 bp, mouse
ggccatatagggagctaggg

SEQ ID NO: 645385 - DNA, 20 bp, mouse
ggcggtcctagatggtgcta

SEQ ID NO: 645386 - DNA, 20 bp, mouse
gaggcccggttcttgctcgc

SEQ ID NO: 645387 - DNA, 20 bp, mouse
gcgggccgcgccccgatctg

SEQ ID NO: 645388 - DNA, 20 bp, mouse
gagcaagaaccgggcctccc

SEQ ID NO: 645389 - DNA, 20 bp, mouse
gcgcccgccagggacacgtg

SEQ ID NO: 645390 - DNA, 20 bp, mouse
gacccccgcgagcaagaacc

SEQ ID NO: 645391 - DNA, 20 bp, mouse
ggcgcgggcggggccgttgg

SEQ ID NO: 645392 - DNA, 20 bp, mouse
ggggccccacgtgtccctgg

SEQ ID NO: 645393 - DNA, 20 bp, mouse
gcggggtcgcgagcgcgcgg

SEQ ID NO: 645394 - DNA, 20 bp, mouse
ggactgccgcgtagcaggga

SEQ ID NO: 645395 - DNA, 20 bp, mouse
gacgcggcagtcccggggca

SEQ ID NO: 645396 - DNA, 20 bp, mouse
gcggggcgtggatggagggt

SEQ ID NO: 645397 - DNA, 20 bp, mouse
gaaaaggccagctgacggtg

SEQ ID NO: 645398 - DNA, 20 bp, mouse
gcctttcggggcgtggatgg

SEQ ID NO: 645399 - DNA, 20 bp, mouse
gcagcctttcggggcgtgga

SEQ ID NO: 645400 - DNA, 20 bp, mouse
gtcactctggacagcttata

SEQ ID NO: 645401 - DNA, 20 bp, mouse
gcctaaaaggaacaaatcca

SEQ ID NO: 645402 - DNA, 20 bp, mouse
ggcctgacagggctgtgctc

SEQ ID NO: 645403 - DNA, 20 bp, mouse
ggccctgtcaggcctcactc

SEQ ID NO: 645404 - DNA, 20 bp, mouse
ggtccagagtgaggcctgac

SEQ ID NO: 645405 - DNA, 20 bp, mouse
gtgtatgcagaaggattcag

SEQ ID NO: 645406 - DNA, 20 bp, mouse
gcccatgcggctgtcacaca

SEQ ID NO: 645407 - DNA, 20 bp, mouse
ggtgggaaggaacttagatt

SEQ ID NO: 645408 - DNA, 20 bp, mouse
gctgccattagcccacgcaa

SEQ ID NO: 645409 - DNA, 20 bp, mouse
ggtgacagccgcatggggtc

SEQ ID NO: 645410 - DNA, 20 bp, mouse
gggtcagaccagaccccatg

SEQ ID NO: 645411 - DNA, 20 bp, mouse
gctaatggcagcagccattt

SEQ ID NO: 645412 - DNA, 20 bp, mouse
gaagagacttggacttgctt

SEQ ID NO: 645413 - DNA, 20 bp, mouse
gctcctccacccccttgcgt

SEQ ID NO: 645414 - DNA, 20 bp, mouse
gacccccttgcgtgggctaa

SEQ ID NO: 645415 - DNA, 20 bp, mouse
gacagacagatccttaacat

SEQ ID NO: 645416 - DNA, 20 bp, mouse
gagggccaaggtaaggtcaa

SEQ ID NO: 645417 - DNA, 20 bp, mouse
gagacactgccctcactgag

SEQ ID NO: 645418 - DNA, 20 bp, mouse
gtctggggtagagtggtcac

SEQ ID NO: 645419 - DNA, 20 bp, mouse
gcagaccagcccctcagtga

SEQ ID NO: 645420 - DNA, 20 bp, mouse
gcccaccccctgaagacagg

SEQ ID NO: 645421 - DNA, 20 bp, mouse
gaagcccagggccagtatct

SEQ ID NO: 645422 - DNA, 20 bp, mouse
gggccccaccccctgaagac

SEQ ID NO: 645423 - DNA, 20 bp, mouse
ggggactttaggacttctgt

SEQ ID NO: 645424 - DNA, 20 bp, mouse
gcttccctgaggactttagg

SEQ ID NO: 645425 - DNA, 20 bp, mouse
gggaagcctcctgtcttcag

SEQ ID NO: 645426 - DNA, 20 bp, mouse
gccaatggaaggcatccgta

SEQ ID NO: 645427 - DNA, 20 bp, mouse
ggaaggcatccgtaggggca

SEQ ID NO: 645428 - DNA, 20 bp, mouse
gaagccggaccctttgtcat

SEQ ID NO: 645429 - DNA, 20 bp, mouse
gcatccgtaggggcagggag

SEQ ID NO: 645430 - DNA, 20 bp, mouse
ggggactggccgaagactac

SEQ ID NO: 645431 - DNA, 20 bp, mouse
ggaagctcggtccaccctac

SEQ ID NO: 645432 - DNA, 20 bp, mouse
gcgcgcgcgaatagagtagg

SEQ ID NO: 645433 - DNA, 20 bp, mouse
gaaggtgttggggtacgggc

SEQ ID NO: 645434 - DNA, 20 bp, mouse
gtgcggggccggcgttctca

SEQ ID NO: 645435 - DNA, 20 bp, mouse
gtgttggggtacgggcagga

SEQ ID NO: 645436 - DNA, 20 bp, mouse
gcaacctcggaatgaagaag

SEQ ID NO: 645437 - DNA, 20 bp, mouse
gtaaagcagcggcccccagc

SEQ ID NO: 645438 - DNA, 20 bp, mouse
gcggcggccaatcagaacac

SEQ ID NO: 645439 - DNA, 20 bp, mouse
gcagccgcttcttcattccg

SEQ ID NO: 645440 - DNA, 20 bp, mouse
gcgagacaataacccggctg

SEQ ID NO: 645441 - DNA, 20 bp, mouse
gggtccaattgcaaagacta

SEQ ID NO: 645442 - DNA, 20 bp, mouse
gggacagctcccgggatccc

SEQ ID NO: 645443 - DNA, 20 bp, mouse
gacagggcaacggatggaat

SEQ ID NO: 645444 - DNA, 20 bp, mouse
gtcattccgaggttgggagg

SEQ ID NO: 645445 - DNA, 20 bp, mouse
gccccaacggcgcggccgat

SEQ ID NO: 645446 - DNA, 20 bp, mouse
gcaggaagggggggtgtcga

SEQ ID NO: 645447 - DNA, 20 bp, mouse
gttactacaaaactgggggt

SEQ ID NO: 645448 - DNA, 20 bp, mouse
gatctggtctacattctagt

SEQ ID NO: 645449 - DNA, 20 bp, mouse
ggaagggggggtgtcgaggg

SEQ ID NO: 645450 - DNA, 20 bp, mouse
gtagaatgtagaccagataa

SEQ ID NO: 645451 - DNA, 20 bp, mouse
gaatgtagaccagataaggg

SEQ ID NO: 645452 - DNA, 20 bp, mouse
gcgctcagttaataattgtt

SEQ ID NO: 645453 - DNA, 20 bp, mouse
gacagaaccccacccttatc

SEQ ID NO: 645454 - DNA, 20 bp, mouse
gggccaggctgacgtggcgt

SEQ ID NO: 645455 - DNA, 20 bp, mouse
ggacactggagactagagtt

SEQ ID NO: 645456 - DNA, 20 bp, mouse
gaaccgaggcccggtgtgtt

SEQ ID NO: 645457 - DNA, 20 bp, mouse
ggaacggaaagaaagaaccg

SEQ ID NO: 645458 - DNA, 20 bp, mouse
gacactcattggtgacttaa

SEQ ID NO: 645459 - DNA, 20 bp, mouse
gggctcaaatatcaatgcca

SEQ ID NO: 645460 - DNA, 20 bp, mouse
ggaatgatcactgaatggtc

SEQ ID NO: 645461 - DNA, 20 bp, mouse
ggaaagaaagaaccgaggcc

SEQ ID NO: 645462 - DNA, 20 bp, mouse
gacaacccaagtggttgcca

SEQ ID NO: 645463 - DNA, 20 bp, mouse
gaacggtttgctccaggaca

SEQ ID NO: 645464 - DNA, 20 bp, mouse
gatcactgaatggtcaggca

SEQ ID NO: 645465 - DNA, 20 bp, mouse
gtcttgccctccacactcat

SEQ ID NO: 645466 - DNA, 20 bp, mouse
gtagacttgggtagaatctc

SEQ ID NO: 645467 - DNA, 20 bp, mouse
gatctgcccaagctagactt

SEQ ID NO: 645468 - DNA, 20 bp, mouse
ggggtaacatgatacctaaa

SEQ ID NO: 645469 - DNA, 20 bp, mouse
gatgagttgaggtcaggcag

SEQ ID NO: 645470 - DNA, 20 bp, mouse
gtcaaaggctctcatactaa

SEQ ID NO: 645471 - DNA, 20 bp, mouse
gtgacaaatcttgatgtcaa

SEQ ID NO: 645472 - DNA, 20 bp, mouse
ggggttggccagaaaaagac

SEQ ID NO: 645473 - DNA, 20 bp, mouse
gtccctgcattgtgaagcaa

SEQ ID NO: 645474 - DNA, 20 bp, mouse
gctcttgtataaaccttacc

SEQ ID NO: 645475 - DNA, 20 bp, mouse
gggtcttagctctgcctcta

SEQ ID NO: 645476 - DNA, 20 bp, mouse
gggactgggcggccccctcc

SEQ ID NO: 645477 - DNA, 20 bp, mouse
gtgcacagagacccgcctga

SEQ ID NO: 645478 - DNA, 20 bp, mouse
gggagcccgaggagtcgctg

SEQ ID NO: 645479 - DNA, 20 bp, mouse
gccaatggagaacctcggga

SEQ ID NO: 645480 - DNA, 20 bp, mouse
gtgcatataggtggactggg

SEQ ID NO: 645481 - DNA, 20 bp, mouse
gccccccagcgcctctcatt

SEQ ID NO: 645482 - DNA, 20 bp, mouse
ggcgtccccaggctccactc

SEQ ID NO: 645483 - DNA, 20 bp, mouse
gaggcgctggggggaagttt

SEQ ID NO: 645484 - DNA, 20 bp, mouse
gacgccaccgcccactccct

SEQ ID NO: 645485 - DNA, 20 bp, mouse
gtctgcgaacagagccgcgg

SEQ ID NO: 645486 - DNA, 20 bp, mouse
gggtgcccctaggtcatccc

SEQ ID NO: 645487 - DNA, 20 bp, mouse
gggcttccagggatgaccta

SEQ ID NO: 645488 - DNA, 20 bp, mouse
ggggttggaagcttagaact

SEQ ID NO: 645489 - DNA, 20 bp, mouse
gtccccgtctccaacacgtg

SEQ ID NO: 645490 - DNA, 20 bp, mouse
gacctcggacagcaacccag

SEQ ID NO: 645491 - DNA, 20 bp, mouse
gagcaacccagaggaaagta

SEQ ID NO: 645492 - DNA, 20 bp, mouse
gctggaagccagcagagagc

SEQ ID NO: 645493 - DNA, 20 bp, mouse
gtcctctgggttgctgtccg

SEQ ID NO: 645494 - DNA, 20 bp, mouse
gcgtctccaacacgtgtggt

SEQ ID NO: 645495 - DNA, 20 bp, mouse
ggaagcttagaactagggag

SEQ ID NO: 645496 - DNA, 20 bp, mouse
ggtgctggagtcaaagattg

SEQ ID NO: 645497 - DNA, 20 bp, mouse
gaaagattgcggaatcgcgg

SEQ ID NO: 645498 - DNA, 20 bp, mouse
gaataccggggcggctgtag

SEQ ID NO: 645499 - DNA, 20 bp, mouse
ggatgaggaaacaaagtcca

SEQ ID NO: 645500 - DNA, 20 bp, mouse
gcggaatcgcgggggatgct

SEQ ID NO: 645501 - DNA, 20 bp, mouse
gtaaatatggggtacgtggg

SEQ ID NO: 645502 - DNA, 20 bp, mouse
gttagtacgaacccgatctg

SEQ ID NO: 645503 - DNA, 20 bp, mouse
ggcggctgtagaggagtgta

SEQ ID NO: 645504 - DNA, 20 bp, mouse
gccggtccagcccccagatc

SEQ ID NO: 645505 - DNA, 20 bp, mouse
gcgtgggtggggccagatag

SEQ ID NO: 645506 - DNA, 20 bp, mouse
gccggcgcagaacgcacctc

SEQ ID NO: 645507 - DNA, 20 bp, mouse
gccggctgcccgcccagcgt

SEQ ID NO: 645508 - DNA, 20 bp, mouse
gcgcgcgcgcgcacctgagg

SEQ ID NO: 645509 - DNA, 20 bp, mouse
ggttcccgctagaagcgcct

SEQ ID NO: 645510 - DNA, 20 bp, mouse
gcctgggctcccacgctggg

SEQ ID NO: 645511 - DNA, 20 bp, mouse
gcgcgcacctgaggaggccc

SEQ ID NO: 645512 - DNA, 20 bp, mouse
gcgcgcgcgtcaccccgtgt

SEQ ID NO: 645513 - DNA, 20 bp, mouse
ggcgcctgggctcccacgct

SEQ ID NO: 645514 - DNA, 20 bp, mouse
gggagcccaggcgcttctag

SEQ ID NO: 645515 - DNA, 20 bp, mouse
gctgaaagcagctgaagcgg

SEQ ID NO: 645516 - DNA, 20 bp, mouse
ggagaggcctgacgtcgcgg

SEQ ID NO: 645517 - DNA, 20 bp, mouse
gggcgcgccggacaccttag

SEQ ID NO: 645518 - DNA, 20 bp, mouse
ggccggacaccttagagggg

SEQ ID NO: 645519 - DNA, 20 bp, mouse
gtccgcccctctaaggtgtc

SEQ ID NO: 645520 - DNA, 20 bp, mouse
gccgaggcggtcaggcgcgc

SEQ ID NO: 645521 - DNA, 20 bp, mouse
gaaggagaggcctgacgtcg

SEQ ID NO: 645522 - DNA, 20 bp, mouse
gtaaacgaccaacacagaac

SEQ ID NO: 645523 - DNA, 20 bp, mouse
ggagtctgctcagaagagat

SEQ ID NO: 645524 - DNA, 20 bp, mouse
gcgcggaggccgaggcggtc

SEQ ID NO: 645525 - DNA, 20 bp, mouse
gcctgacgtcgcggaggccg

SEQ ID NO: 645526 - DNA, 20 bp, mouse
gtcccagcccgatcggattt

SEQ ID NO: 645527 - DNA, 20 bp, mouse
gcctccgaggcgaggtcggg

SEQ ID NO: 645528 - DNA, 20 bp, mouse
gcaatctcctaaatccgatc

SEQ ID NO: 645529 - DNA, 20 bp, mouse
ggtactggaaaccccttcga

SEQ ID NO: 645530 - DNA, 20 bp, mouse
gcgccggtactgggcatcca

SEQ ID NO: 645531 - DNA, 20 bp, mouse
gctcctaaatccgatcgggc

SEQ ID NO: 645532 - DNA, 20 bp, mouse
gatccgatcgggctgggacc

SEQ ID NO: 645533 - DNA, 20 bp, mouse
gcagtctagtcgccggtact

SEQ ID NO: 645534 - DNA, 20 bp, mouse
gaaccgggtcccagcccgat

SEQ ID NO: 645535 - DNA, 20 bp, mouse
gctccctggatgcccagtac

SEQ ID NO: 645536 - DNA, 20 bp, mouse
gcggccgtaagatgatgtca

SEQ ID NO: 645537 - DNA, 20 bp, mouse
ggggaggggcctcttggagc

SEQ ID NO: 645538 - DNA, 20 bp, mouse
gtgacggccggcgccgggga

SEQ ID NO: 645539 - DNA, 20 bp, mouse
gcgggctgcaggaggaccgg

SEQ ID NO: 645540 - DNA, 20 bp, mouse
gcggcgccggggagggttgc

SEQ ID NO: 645541 - DNA, 20 bp, mouse
gcgcgtaggcagcgcactgg

SEQ ID NO: 645542 - DNA, 20 bp, mouse
gtaggcagcgcactggggga

SEQ ID NO: 645543 - DNA, 20 bp, mouse
gtggttagcgatgatgtcgt

SEQ ID NO: 645544 - DNA, 20 bp, mouse
gagccaggcgttgccaaggt

SEQ ID NO: 645545 - DNA, 20 bp, mouse
gtcatggctgggttcttaaa

SEQ ID NO: 645546 - DNA, 20 bp, mouse
gcgcttggctggtggggcgg

SEQ ID NO: 645547 - DNA, 20 bp, mouse
gcccggcagccgttccaaga

SEQ ID NO: 645548 - DNA, 20 bp, mouse
gcagccccggaagcagaacg

SEQ ID NO: 645549 - DNA, 20 bp, mouse
ggaagcagaacgaggcgaga

SEQ ID NO: 645550 - DNA, 20 bp, mouse
gtcgcctcgttctgcttccg

SEQ ID NO: 645551 - DNA, 20 bp, mouse
gcggggactggcagccgaga

SEQ ID NO: 645552 - DNA, 20 bp, mouse
ggcgggacggcagtggagaa

SEQ ID NO: 645553 - DNA, 20 bp, mouse
ggctctgaccaagttgtctc

SEQ ID NO: 645554 - DNA, 20 bp, mouse
ggccgggccggctgtacagg

SEQ ID NO: 645555 - DNA, 20 bp, mouse
gcaccagccaagcgcagccc

SEQ ID NO: 645556 - DNA, 20 bp, mouse
gccgcggaaaggcagtgcga

SEQ ID NO: 645557 - DNA, 20 bp, mouse
gaggaggccgcggcagggta

SEQ ID NO: 645558 - DNA, 20 bp, mouse
gggaagaagttgtagggtgg

SEQ ID NO: 645559 - DNA, 20 bp, mouse
gcgctcctcccacccggaac

SEQ ID NO: 645560 - DNA, 20 bp, mouse
gcgtgctcgctcctcccacc

SEQ ID NO: 645561 - DNA, 20 bp, mouse
gccggaagtgggagcgatcg

SEQ ID NO: 645562 - DNA, 20 bp, mouse
gagcggctacgcatgcgcag

SEQ ID NO: 645563 - DNA, 20 bp, mouse
gggcgcgcagctgtgggtcg

SEQ ID NO: 645564 - DNA, 20 bp, mouse
gagaagttgtagggtggggg

SEQ ID NO: 645565 - DNA, 20 bp, mouse
gcggtggcagcccagaagtc

SEQ ID NO: 645566 - DNA, 20 bp, mouse
ggggctgccagcactaagga

SEQ ID NO: 645567 - DNA, 20 bp, mouse
gcactgcaggatagatgcat

SEQ ID NO: 645568 - DNA, 20 bp, mouse
ggagcgtgcgcgtccccgat

SEQ ID NO: 645569 - DNA, 20 bp, mouse
gcgccgggctgccagcacta

SEQ ID NO: 645570 - DNA, 20 bp, mouse
gtgggctcccggcagctcct

SEQ ID NO: 645571 - DNA, 20 bp, mouse
gactaaggatggctgacaag

SEQ ID NO: 645572 - DNA, 20 bp, mouse
gaggatggctgacaagaggg

SEQ ID NO: 645573 - DNA, 20 bp, mouse
gggcaccaggaatctgaatt

SEQ ID NO: 645574 - DNA, 20 bp, mouse
ggcagcgccgctccccaccc

SEQ ID NO: 645575 - DNA, 20 bp, mouse
ggatgcataggctaaaacgc

SEQ ID NO: 645576 - DNA, 20 bp, mouse
gcaagggagagtaaggggac

SEQ ID NO: 645577 - DNA, 20 bp, mouse
ggctctaactaagggaccaa

SEQ ID NO: 645578 - DNA, 20 bp, mouse
gaacacggtcacaaaactaa

SEQ ID NO: 645579 - DNA, 20 bp, mouse
gcaaaggctccacccacact

SEQ ID NO: 645580 - DNA, 20 bp, mouse
gtccatccctggaacctatt

SEQ ID NO: 645581 - DNA, 20 bp, mouse
gccgcccccagctccgaaca

SEQ ID NO: 645582 - DNA, 20 bp, mouse
gacgccccttgctctaacta

SEQ ID NO: 645583 - DNA, 20 bp, mouse
gcccccagctccgaacatgg

SEQ ID NO: 645584 - DNA, 20 bp, mouse
gggtcccttagttagagcaa

SEQ ID NO: 645585 - DNA, 20 bp, mouse
ggaaggagattagcttaaca

SEQ ID NO: 645586 - DNA, 20 bp, mouse
gtggccgtggcgtaaacttc

SEQ ID NO: 645587 - DNA, 20 bp, mouse
gtacgccagaagtcgagcag

SEQ ID NO: 645588 - DNA, 20 bp, mouse
gcaaatgcatcgattttcgg

SEQ ID NO: 645589 - DNA, 20 bp, mouse
ggcacacgcagcccaccaaa

SEQ ID NO: 645590 - DNA, 20 bp, mouse
gtacttagcagtttctacta

SEQ ID NO: 645591 - DNA, 20 bp, mouse
gtaaccggaagtttacgcca

SEQ ID NO: 645592 - DNA, 20 bp, mouse
gaacaagcagggggattcgt

SEQ ID NO: 645593 - DNA, 20 bp, mouse
ggacgagtgccaagaaatga

SEQ ID NO: 645594 - DNA, 20 bp, mouse
gtgctccgctgctcgacttc

SEQ ID NO: 645595 - DNA, 20 bp, mouse
gactccgttgtcagggtaac

SEQ ID NO: 645596 - DNA, 20 bp, mouse
gggaacgtggagggcatgac

SEQ ID NO: 645597 - DNA, 20 bp, mouse
ggtcgcccctagagaattct

SEQ ID NO: 645598 - DNA, 20 bp, mouse
gtggctgcccacagtcaaaa

SEQ ID NO: 645599 - DNA, 20 bp, mouse
ggatgtagctcattggtaat

SEQ ID NO: 645600 - DNA, 20 bp, mouse
ggtggagggcatgacagggt

SEQ ID NO: 645601 - DNA, 20 bp, mouse
gggacgccgcgcctgcgcaa

SEQ ID NO: 645602 - DNA, 20 bp, mouse
ggagaattctgggaacgtgg

SEQ ID NO: 645603 - DNA, 20 bp, mouse
gtcccaaagaacccaatcag

SEQ ID NO: 645604 - DNA, 20 bp, mouse
gctagagaattctgggaacg

SEQ ID NO: 645605 - DNA, 20 bp, mouse
ggaacatgctcactattcaa

SEQ ID NO: 645606 - DNA, 20 bp, mouse
ggaccctcatttgagatcat

SEQ ID NO: 645607 - DNA, 20 bp, mouse
gccagaggtaagatggtttg

SEQ ID NO: 645608 - DNA, 20 bp, mouse
gcggcagcgggtagagaaaa

SEQ ID NO: 645609 - DNA, 20 bp, mouse
gacttacaagctgtgatgtg

SEQ ID NO: 645610 - DNA, 20 bp, mouse
gtgagccaacactattcatt

SEQ ID NO: 645611 - DNA, 20 bp, mouse
gttctccaaatgaatagtgt

SEQ ID NO: 645612 - DNA, 20 bp, mouse
ggcctgacccacacggcagc

SEQ ID NO: 645613 - DNA, 20 bp, mouse
gagcctatgatctcaaatga

SEQ ID NO: 645614 - DNA, 20 bp, mouse
gctatgtcataatgtagcca

SEQ ID NO: 645615 - DNA, 20 bp, mouse
ggggggcccagggggaaagt

SEQ ID NO: 645616 - DNA, 20 bp, mouse
gcctaggggcctcacctcag

SEQ ID NO: 645617 - DNA, 20 bp, mouse
gaggtactgcccttgaacca

SEQ ID NO: 645618 - DNA, 20 bp, mouse
gggcttatcaacatcaccca

SEQ ID NO: 645619 - DNA, 20 bp, mouse
gaggtctcatttaagaatgg

SEQ ID NO: 645620 - DNA, 20 bp, mouse
gggtgatgttgataagccta

SEQ ID NO: 645621 - DNA, 20 bp, mouse
gcagaggtctcatttaagaa

SEQ ID NO: 645622 - DNA, 20 bp, mouse
gaaatgagacctctgaggtg

SEQ ID NO: 645623 - DNA, 20 bp, mouse
gaggacaattgttacttcac

SEQ ID NO: 645624 - DNA, 20 bp, mouse
gcagtgtcctctcaagggtg

SEQ ID NO: 645625 - DNA, 20 bp, mouse
gaactgctatacaagggctg

SEQ ID NO: 645626 - DNA, 20 bp, mouse
gggcccgcatgacatgagtg

SEQ ID NO: 645627 - DNA, 20 bp, mouse
gagggcgagtgggaagctgg

SEQ ID NO: 645628 - DNA, 20 bp, mouse
ggctgtgcggtgacaggtgt

SEQ ID NO: 645629 - DNA, 20 bp, mouse
gtcctgcgaccgctttccat

SEQ ID NO: 645630 - DNA, 20 bp, mouse
gtggttaacagtagtgttcc

SEQ ID NO: 645631 - DNA, 20 bp, mouse
gtgagcatcaccgctgctcc

SEQ ID NO: 645632 - DNA, 20 bp, mouse
ggcacctcactcatgtcatg

SEQ ID NO: 645633 - DNA, 20 bp, mouse
gctcttaagtccttgcactg

SEQ ID NO: 645634 - DNA, 20 bp, mouse
ggtagtgttccagggcgagt

SEQ ID NO: 645635 - DNA, 20 bp, mouse
gagaggacccggccatctgc

SEQ ID NO: 645636 - DNA, 20 bp, mouse
gtcctcccggcgcggatcca

SEQ ID NO: 645637 - DNA, 20 bp, mouse
gtaggcgggcggaatccctg

SEQ ID NO: 645638 - DNA, 20 bp, mouse
gcggatccagggagccggga

SEQ ID NO: 645639 - DNA, 20 bp, mouse
gcgggcggaatccctggggc

SEQ ID NO: 645640 - DNA, 20 bp, mouse
gcggctccctggatccgcgc

SEQ ID NO: 645641 - DNA, 20 bp, mouse
ggggcggcccgaagggtcgg

SEQ ID NO: 645642 - DNA, 20 bp, mouse
gacagcccgggcggcccgaa

SEQ ID NO: 645643 - DNA, 20 bp, mouse
gtccctggatccgcgccggg

SEQ ID NO: 645644 - DNA, 20 bp, mouse
gccgaagggtcgggggtcgg

SEQ ID NO: 645645 - DNA, 20 bp, mouse
ggcaacacatcatttcctcc

SEQ ID NO: 645646 - DNA, 20 bp, mouse
gccaacctcgcgcacccgtg

SEQ ID NO: 645647 - DNA, 20 bp, mouse
gtgcgcccgccttaaagggg

SEQ ID NO: 645648 - DNA, 20 bp, mouse
ggggagggtccctgttaaag

SEQ ID NO: 645649 - DNA, 20 bp, mouse
gcgcgcgcgcccccgaaggg

SEQ ID NO: 645650 - DNA, 20 bp, mouse
gagggtccctgttaaagggg

SEQ ID NO: 645651 - DNA, 20 bp, mouse
gcgccggcgcggccactccg

SEQ ID NO: 645652 - DNA, 20 bp, mouse
gcgccggcacgtgagctccc

SEQ ID NO: 645653 - DNA, 20 bp, mouse
gcgcacccggccccgccctt

SEQ ID NO: 645654 - DNA, 20 bp, mouse
gcgccgcgcgcgcccccgaa

SEQ ID NO: 645655 - DNA, 20 bp, mouse
ggaggagggagactgtcggt

SEQ ID NO: 645656 - DNA, 20 bp, mouse
ggccccgcgggctgcctcga

SEQ ID NO: 645657 - DNA, 20 bp, mouse
ggggcggggcaggagaccga

SEQ ID NO: 645658 - DNA, 20 bp, mouse
ggggaggtgacacctcttgt

SEQ ID NO: 645659 - DNA, 20 bp, mouse
gcgcccctgccgcgcctcca

SEQ ID NO: 645660 - DNA, 20 bp, mouse
ggagaccgagggcggagggg

SEQ ID NO: 645661 - DNA, 20 bp, mouse
ggctgccagccaccctcccg

SEQ ID NO: 645662 - DNA, 20 bp, mouse
gtcctgccccgccctcggga

SEQ ID NO: 645663 - DNA, 20 bp, mouse
gaatgtggagagatctagaa

SEQ ID NO: 645664 - DNA, 20 bp, mouse
ggcaggagaccgagggcgga

SEQ ID NO: 645665 - DNA, 20 bp, mouse
gtgccgcgcctccacgggta

SEQ ID NO: 645666 - DNA, 20 bp, mouse
gcgagcgcgaggagattgtc

SEQ ID NO: 645667 - DNA, 20 bp, mouse
gcggcctcggcgtcccccag

SEQ ID NO: 645668 - DNA, 20 bp, mouse
gcgcgaggagattgtccggg

SEQ ID NO: 645669 - DNA, 20 bp, mouse
gacgcccggtgtgcccagtg

SEQ ID NO: 645670 - DNA, 20 bp, mouse
ggccctgcgggtgcccgccg

SEQ ID NO: 645671 - DNA, 20 bp, mouse
gcgtcccgtctgctcggtct

SEQ ID NO: 645672 - DNA, 20 bp, mouse
gcagcctcgcgagcgcgctc

SEQ ID NO: 645673 - DNA, 20 bp, mouse
ggcgcagcgcgcgtgccggg

SEQ ID NO: 645674 - DNA, 20 bp, mouse
gggaggggcggggccggatc

SEQ ID NO: 645675 - DNA, 20 bp, mouse
gcccgggcgggcaccgcact

SEQ ID NO: 645676 - DNA, 20 bp, mouse
gtggtccgcgccccccttgg

SEQ ID NO: 645677 - DNA, 20 bp, mouse
ggggctccatagcacggggc

SEQ ID NO: 645678 - DNA, 20 bp, mouse
gctctccgagctggtgggat

SEQ ID NO: 645679 - DNA, 20 bp, mouse
ggcgcgctctccgagctggt

SEQ ID NO: 645680 - DNA, 20 bp, mouse
gagcgtgcatcccgtagcgt

SEQ ID NO: 645681 - DNA, 20 bp, mouse
gcccgcctagccctagagtc

SEQ ID NO: 645682 - DNA, 20 bp, mouse
gaaagcaccagccaagttgt

SEQ ID NO: 645683 - DNA, 20 bp, mouse
gccagagggcgcgggctggg

SEQ ID NO: 645684 - DNA, 20 bp, mouse
gagcgtgggctccatagcac

SEQ ID NO: 645685 - DNA, 20 bp, mouse
gcggggcgcgctctccgagc

SEQ ID NO: 645686 - DNA, 20 bp, mouse
ggcgtcctgggtaggaacgt

SEQ ID NO: 645687 - DNA, 20 bp, mouse
gctggccacccctgacctga

SEQ ID NO: 645688 - DNA, 20 bp, mouse
ggggctggggtggtcgcact

SEQ ID NO: 645689 - DNA, 20 bp, mouse
gcagcagggctcggctctag

SEQ ID NO: 645690 - DNA, 20 bp, mouse
ggggaggcgtactgggcaat

SEQ ID NO: 645691 - DNA, 20 bp, mouse
gctccctgccacgaagggac

SEQ ID NO: 645692 - DNA, 20 bp, mouse
gggtcccgtgcgtcctgggt

SEQ ID NO: 645693 - DNA, 20 bp, mouse
gcaggggtggccagaataga

SEQ ID NO: 645694 - DNA, 20 bp, mouse
gggagtgagcacaggtaagt

SEQ ID NO: 645695 - DNA, 20 bp, mouse
gagcccctccctgccacgaa

SEQ ID NO: 645696 - DNA, 20 bp, mouse
gtcagagaggaggacccagt

SEQ ID NO: 645697 - DNA, 20 bp, mouse
gccaaggcggggtgtcggga

SEQ ID NO: 645698 - DNA, 20 bp, mouse
gtccctgccaggttctgcgt

SEQ ID NO: 645699 - DNA, 20 bp, mouse
gtggcctgggcggagtggag

SEQ ID NO: 645700 - DNA, 20 bp, mouse
gctggcagggacaacggcgc

SEQ ID NO: 645701 - DNA, 20 bp, mouse
gtggggggcgggaccatcct

SEQ ID NO: 645702 - DNA, 20 bp, mouse
gggacccagtgggtggatcc

SEQ ID NO: 645703 - DNA, 20 bp, mouse
gggcggagaccgaagactat

SEQ ID NO: 645704 - DNA, 20 bp, mouse
ggggaggagggtccccctgg

SEQ ID NO: 645705 - DNA, 20 bp, mouse
gcccttgcagcctccggata

SEQ ID NO: 645706 - DNA, 20 bp, mouse
gggtggggccctgcgaactt

SEQ ID NO: 645707 - DNA, 20 bp, mouse
ggggcggagcttaggggata

SEQ ID NO: 645708 - DNA, 20 bp, mouse
gccattaagctgatgggagt

SEQ ID NO: 645709 - DNA, 20 bp, mouse
gtaaaactgtcccttttccg

SEQ ID NO: 645710 - DNA, 20 bp, mouse
gccaagcagccaaagttcgc

SEQ ID NO: 645711 - DNA, 20 bp, mouse
gttaatgggtccaggtctct

SEQ ID NO: 645712 - DNA, 20 bp, mouse
gccactgcttggtcctttaa

SEQ ID NO: 645713 - DNA, 20 bp, mouse
gctggacccattaagctgat

SEQ ID NO: 645714 - DNA, 20 bp, mouse
gtcctctttcccccggaaaa

SEQ ID NO: 645715 - DNA, 20 bp, mouse
gcggtggcccccaaagtaca

SEQ ID NO: 645716 - DNA, 20 bp, mouse
gacaagaggggtacacttag

SEQ ID NO: 645717 - DNA, 20 bp, mouse
gcgcccaagggtggggcttc

SEQ ID NO: 645718 - DNA, 20 bp, mouse
gcacggggaaatgacaagag

SEQ ID NO: 645719 - DNA, 20 bp, mouse
gcagccctaggcacccagta

SEQ ID NO: 645720 - DNA, 20 bp, mouse
gcaagaacccgcccaagggt

SEQ ID NO: 645721 - DNA, 20 bp, mouse
gagtggcagaagtgtggtac

SEQ ID NO: 645722 - DNA, 20 bp, mouse
gtgttcaagaacccgcccaa

SEQ ID NO: 645723 - DNA, 20 bp, mouse
ggcggttaacacggctcggg

SEQ ID NO: 645724 - DNA, 20 bp, mouse
gtgtcctgaagccccaccct

SEQ ID NO: 645725 - DNA, 20 bp, mouse
gaagccgagctctaaacttc

SEQ ID NO: 645726 - DNA, 20 bp, mouse
ggagagggagcaccctgcta

SEQ ID NO: 645727 - DNA, 20 bp, mouse
ggtcctggggaacgcagaga

SEQ ID NO: 645728 - DNA, 20 bp, mouse
gtgggtcatgcgtaagaaga

SEQ ID NO: 645729 - DNA, 20 bp, mouse
gccaggggaggaagacttat

SEQ ID NO: 645730 - DNA, 20 bp, mouse
gacccagcgcgctcttgtct

SEQ ID NO: 645731 - DNA, 20 bp, mouse
ggaggaagacttatgggctc

SEQ ID NO: 645732 - DNA, 20 bp, mouse
gtcggtgggtagatattagt

SEQ ID NO: 645733 - DNA, 20 bp, mouse
ggagcgggtaaagtctaagt

SEQ ID NO: 645734 - DNA, 20 bp, mouse
gtcgccctcactgtgtacaa

SEQ ID NO: 645735 - DNA, 20 bp, mouse
gcggaggtcgggcatgtgag

SEQ ID NO: 645736 - DNA, 20 bp, mouse
ggtactgaaggggcccggaa

SEQ ID NO: 645737 - DNA, 20 bp, mouse
gagccagcagggaaggtctg

SEQ ID NO: 645738 - DNA, 20 bp, mouse
gggaagcctcggtactgaag

SEQ ID NO: 645739 - DNA, 20 bp, mouse
gtacaccctaggaagctccc

SEQ ID NO: 645740 - DNA, 20 bp, mouse
ggggccgtggctccggaagg

SEQ ID NO: 645741 - DNA, 20 bp, mouse
gctcacctgggagcttccta

SEQ ID NO: 645742 - DNA, 20 bp, mouse
gtccctgctggctacaccct

SEQ ID NO: 645743 - DNA, 20 bp, mouse
gggaaggcggggtctctctg

SEQ ID NO: 645744 - DNA, 20 bp, mouse
gtgtgggcgtagcgtgggcg

SEQ ID NO: 645745 - DNA, 20 bp, mouse
gtcctagggtgtagccagca

SEQ ID NO: 645746 - DNA, 20 bp, mouse
ggggcctgggtcacggtgaa

SEQ ID NO: 645747 - DNA, 20 bp, mouse
gtgaatggggcgcaggttcc

SEQ ID NO: 645748 - DNA, 20 bp, mouse
gccccgcgccctatgcgcgt

SEQ ID NO: 645749 - DNA, 20 bp, mouse
gtgacaaggccggaagaacg

SEQ ID NO: 645750 - DNA, 20 bp, mouse
gagcccacgcgcatagggcg

SEQ ID NO: 645751 - DNA, 20 bp, mouse
gcgtgggctgcgtgtgtagc

SEQ ID NO: 645752 - DNA, 20 bp, mouse
gcccctctcacctcctcatg

SEQ ID NO: 645753 - DNA, 20 bp, mouse
gtcagcaaggaccttcgctc

SEQ ID NO: 645754 - DNA, 20 bp, mouse
gggacagagaggctgaacct

SEQ ID NO: 645755 - DNA, 20 bp, mouse
gggacgaggggcgcccacgg

SEQ ID NO: 645756 - DNA, 20 bp, mouse
gcgagggcaggtctagtggg

SEQ ID NO: 645757 - DNA, 20 bp, mouse
gcctgggagcggaaagctga

SEQ ID NO: 645758 - DNA, 20 bp, mouse
gggaatctaggttagagctg

SEQ ID NO: 645759 - DNA, 20 bp, mouse
gtgccctcgcgcggtacagt

SEQ ID NO: 645760 - DNA, 20 bp, mouse
ggcgcggtacagttggcggg

SEQ ID NO: 645761 - DNA, 20 bp, mouse
gcgcgcgagggcaggtctag

SEQ ID NO: 645762 - DNA, 20 bp, mouse
ggtgctcaggcgtggacgcg

SEQ ID NO: 645763 - DNA, 20 bp, mouse
gctcgcgcggtacagttggc

SEQ ID NO: 645764 - DNA, 20 bp, mouse
gtaaggatgggctgtggtct

SEQ ID NO: 645765 - DNA, 20 bp, mouse
gacccccgttcaggtaagga

SEQ ID NO: 645766 - DNA, 20 bp, mouse
ggggaagtccacctcccaga

SEQ ID NO: 645767 - DNA, 20 bp, mouse
gggagcctgagcccaaggac

SEQ ID NO: 645768 - DNA, 20 bp, mouse
ggcccgagctgccgtctggg

SEQ ID NO: 645769 - DNA, 20 bp, mouse
gcgcgcgcacgtaatagccg

SEQ ID NO: 645770 - DNA, 20 bp, mouse
gacctcccagacggcagctc

SEQ ID NO: 645771 - DNA, 20 bp, mouse
gtgagcccaaggacaggatc

SEQ ID NO: 645772 - DNA, 20 bp, mouse
gctggcccgagctgccgtct

SEQ ID NO: 645773 - DNA, 20 bp, mouse
gctcaaggcggagaggatcg

SEQ ID NO: 645774 - DNA, 20 bp, mouse
gtgggcggcccaggcaatga

SEQ ID NO: 645775 - DNA, 20 bp, mouse
gaatagccgcggtggataag

SEQ ID NO: 645776 - DNA, 20 bp, mouse
ggagaccaggcgaagagcga

SEQ ID NO: 645777 - DNA, 20 bp, mouse
ggagggccgcggctcaggga

SEQ ID NO: 645778 - DNA, 20 bp, mouse
gcacgtggcgagaaaggagg

SEQ ID NO: 645779 - DNA, 20 bp, mouse
gcagggaaggggctgagacc

SEQ ID NO: 645780 - DNA, 20 bp, mouse
gcacgcatgcgcattatccc

SEQ ID NO: 645781 - DNA, 20 bp, mouse
gtggcgagaaaggaggcgga

SEQ ID NO: 645782 - DNA, 20 bp, mouse
ggcggcctcgcgagtgtatt

SEQ ID NO: 645783 - DNA, 20 bp, mouse
gcgtcacgtggcgagaaagg

SEQ ID NO: 645784 - DNA, 20 bp, mouse
gaagagcgagggcagggaag

SEQ ID NO: 645785 - DNA, 20 bp, mouse
gcgtgccgaggcgagcgccc

SEQ ID NO: 645786 - DNA, 20 bp, mouse
gctggccgcggccatcccgg

SEQ ID NO: 645787 - DNA, 20 bp, mouse
gcgccccgccgggatggccg

SEQ ID NO: 645788 - DNA, 20 bp, mouse
ggcggcggggccgggttaag

SEQ ID NO: 645789 - DNA, 20 bp, mouse
gccaagggagtgccctgaag

SEQ ID NO: 645790 - DNA, 20 bp, mouse
gtgcggaggggtcgcaggat

SEQ ID NO: 645791 - DNA, 20 bp, mouse
gcccaggccaccactgcggt

SEQ ID NO: 645792 - DNA, 20 bp, mouse
gcgagcggcgcggggaggga

SEQ ID NO: 645793 - DNA, 20 bp, mouse
gggtaggacaaaaggggcac

SEQ ID NO: 645794 - DNA, 20 bp, mouse
gcggcaaagcacgtgagctt

SEQ ID NO: 645795 - DNA, 20 bp, mouse
gcgccgggctcagtgcgctc

SEQ ID NO: 645796 - DNA, 20 bp, mouse
ggggaccagcgatctgaggg

SEQ ID NO: 645797 - DNA, 20 bp, mouse
gggcctgtgcaatggatccg

SEQ ID NO: 645798 - DNA, 20 bp, mouse
gtgagggcgggcctgtgcaa

SEQ ID NO: 645799 - DNA, 20 bp, mouse
gccccggcgccaactcggac

SEQ ID NO: 645800 - DNA, 20 bp, mouse
ggctcgcacaaggggtctga

SEQ ID NO: 645801 - DNA, 20 bp, mouse
ggggacgcgaggaacaggtc

SEQ ID NO: 645802 - DNA, 20 bp, mouse
gccggggtccccgacagcct

SEQ ID NO: 645803 - DNA, 20 bp, mouse
gaggacccgcgggacgccgc

SEQ ID NO: 645804 - DNA, 20 bp, mouse
gggtcctagagaccgctccg

SEQ ID NO: 645805 - DNA, 20 bp, mouse
gtgggtcctatccactcccg

SEQ ID NO: 645806 - DNA, 20 bp, mouse
gaagccgggctacagacggg

SEQ ID NO: 645807 - DNA, 20 bp, mouse
gctgcctcccgtctgtagcc

SEQ ID NO: 645808 - DNA, 20 bp, mouse
gcctgcggctggtgcttcgc

SEQ ID NO: 645809 - DNA, 20 bp, mouse
gctacagacgggaggcagga

SEQ ID NO: 645810 - DNA, 20 bp, mouse
gagggaaggcgcgagtcttg

SEQ ID NO: 645811 - DNA, 20 bp, mouse
ggctgtgtatggcgattgaa

SEQ ID NO: 645812 - DNA, 20 bp, mouse
gcccggtagctgccggaaag

SEQ ID NO: 645813 - DNA, 20 bp, mouse
gacgaagccgggctacagac

SEQ ID NO: 645814 - DNA, 20 bp, mouse
gcggcttcgtggagattgtg

SEQ ID NO: 645815 - DNA, 20 bp, mouse
gcttccggctcacccaatcc

SEQ ID NO: 645816 - DNA, 20 bp, mouse
gtgaccgcggggaacgaagg

SEQ ID NO: 645817 - DNA, 20 bp, mouse
ggggtgccgtagagcattgt

SEQ ID NO: 645818 - DNA, 20 bp, mouse
gcggcccacagccggaagaa

SEQ ID NO: 645819 - DNA, 20 bp, mouse
gtgggccgcggggtggtctc

SEQ ID NO: 645820 - DNA, 20 bp, mouse
gtgccgtagagcattgtggg

SEQ ID NO: 645821 - DNA, 20 bp, mouse
gctctacggcacccttcttc

SEQ ID NO: 645822 - DNA, 20 bp, mouse
gcggcagaacgccatcttct

SEQ ID NO: 645823 - DNA, 20 bp, mouse
gagcgccgcctgcacttccg

SEQ ID NO: 645824 - DNA, 20 bp, mouse
gcgcgtggggcggatctcca

SEQ ID NO: 645825 - DNA, 20 bp, mouse
gagagagagagggtcgagtc

SEQ ID NO: 645826 - DNA, 20 bp, mouse
gcaagcgatgcctgctgcga

SEQ ID NO: 645827 - DNA, 20 bp, mouse
ggccaccaggggctcgccag

SEQ ID NO: 645828 - DNA, 20 bp, mouse
gagaagctggtgttggttct

SEQ ID NO: 645829 - DNA, 20 bp, mouse
gtggcagccgtggggcacgt

SEQ ID NO: 645830 - DNA, 20 bp, mouse
gggtcacgctgggaatcaat

SEQ ID NO: 645831 - DNA, 20 bp, mouse
gtggcacaggccctcgcagc

SEQ ID NO: 645832 - DNA, 20 bp, mouse
ggaggctcaggggctccacc

SEQ ID NO: 645833 - DNA, 20 bp, mouse
gcgtgggagagccgccacca

SEQ ID NO: 645834 - DNA, 20 bp, mouse
gaggggctcgccagaggctc

SEQ ID NO: 645835 - DNA, 20 bp, mouse
ggcctctggcgagcccctgg

SEQ ID NO: 645836 - DNA, 20 bp, mouse
gtcaggtgaaggacacccag

SEQ ID NO: 645837 - DNA, 20 bp, mouse
ggaggcgccacgcggaggag

SEQ ID NO: 645838 - DNA, 20 bp, mouse
ggtgaaggacacccagggga

SEQ ID NO: 645839 - DNA, 20 bp, mouse
gtggctggagggacagcagt

SEQ ID NO: 645840 - DNA, 20 bp, mouse
gagtcagcgatgctcccggg

SEQ ID NO: 645841 - DNA, 20 bp, mouse
gctgcctggaatgggaggag

SEQ ID NO: 645842 - DNA, 20 bp, mouse
ggggctctgcctggaatggg

SEQ ID NO: 645843 - DNA, 20 bp, mouse
gggagcgagggaagcccccc

SEQ ID NO: 645844 - DNA, 20 bp, mouse
gggcggagcgtctgggatgt

SEQ ID NO: 645845 - DNA, 20 bp, mouse
ggcctgggagattacaggac

SEQ ID NO: 645846 - DNA, 20 bp, mouse
gtacaccagtgaaaggaatc

SEQ ID NO: 645847 - DNA, 20 bp, mouse
ggggaggggacaaagttctc

SEQ ID NO: 645848 - DNA, 20 bp, mouse
gactgcctgattcctttcac

SEQ ID NO: 645849 - DNA, 20 bp, mouse
gttggtagacacaaggatac

SEQ ID NO: 645850 - DNA, 20 bp, mouse
gttacagtggtcatgctgga

SEQ ID NO: 645851 - DNA, 20 bp, mouse
ggtgtgtgtacaccagtgaa

SEQ ID NO: 645852 - DNA, 20 bp, mouse
gactgtaagaatgaggaatg

SEQ ID NO: 645853 - DNA, 20 bp, mouse
gcacacttgctgactgcagt

SEQ ID NO: 645854 - DNA, 20 bp, mouse
gaaactaaagcttcggactt

SEQ ID NO: 645855 - DNA, 20 bp, mouse
gtaaagcttcggacttgggt

SEQ ID NO: 645856 - DNA, 20 bp, mouse
gtacagagcaagggtcttgg

SEQ ID NO: 645857 - DNA, 20 bp, mouse
gatggagcacagaggagcta

SEQ ID NO: 645858 - DNA, 20 bp, mouse
gtgagctctgagaagtgtga

SEQ ID NO: 645859 - DNA, 20 bp, mouse
ggagctaggggcgcggcctg

SEQ ID NO: 645860 - DNA, 20 bp, mouse
gcagagctcaaaacctgccc

SEQ ID NO: 645861 - DNA, 20 bp, mouse
ggctcctgtctacagagcaa

SEQ ID NO: 645862 - DNA, 20 bp, mouse
gacagagtatgcccacctag

SEQ ID NO: 645863 - DNA, 20 bp, mouse
ggtgctccatcatacagctc

SEQ ID NO: 645864 - DNA, 20 bp, mouse
gccttgatttggaacatttg

SEQ ID NO: 645865 - DNA, 20 bp, mouse
gacaggagcgttctaaccca

SEQ ID NO: 645866 - DNA, 20 bp, mouse
gcccccaactgccctgtaga

SEQ ID NO: 645867 - DNA, 20 bp, mouse
gaaaaagccgagtagcagaa

SEQ ID NO: 645868 - DNA, 20 bp, mouse
gccccggggcggggtccagg

SEQ ID NO: 645869 - DNA, 20 bp, mouse
ggaaatctgagaccaaagaa

SEQ ID NO: 645870 - DNA, 20 bp, mouse
gagggccaactgccattccc

SEQ ID NO: 645871 - DNA, 20 bp, mouse
ggaggaagcaaaactcactc

SEQ ID NO: 645872 - DNA, 20 bp, mouse
ggggaagcgtttgtgctgct

SEQ ID NO: 645873 - DNA, 20 bp, mouse
gcagttgggggcgcgaggtg

SEQ ID NO: 645874 - DNA, 20 bp, mouse
gcaactgccattccccgggg

SEQ ID NO: 645875 - DNA, 20 bp, mouse
gaatcaagcaggaggtttga

SEQ ID NO: 645876 - DNA, 20 bp, mouse
gggtggagatattacaagta

SEQ ID NO: 645877 - DNA, 20 bp, mouse
gggatcagctgaggccatgt

SEQ ID NO: 645878 - DNA, 20 bp, mouse
gaggttttacaaggatggta

SEQ ID NO: 645879 - DNA, 20 bp, mouse
gacattctttttctcttata

SEQ ID NO: 645880 - DNA, 20 bp, mouse
gctaaaagaaatagtatagt

SEQ ID NO: 645881 - DNA, 20 bp, mouse
gaaaagtcatgttgcctaca

SEQ ID NO: 645882 - DNA, 20 bp, mouse
gcttccaaaatgtagagaga

SEQ ID NO: 645883 - DNA, 20 bp, mouse
gtttccatctctctacattt

SEQ ID NO: 645884 - DNA, 20 bp, mouse
gaaatctgattactatactg

SEQ ID NO: 645885 - DNA, 20 bp, mouse
gtctgataatagtgaattta

SEQ ID NO: 645886 - DNA, 20 bp, mouse
gcctagcaagcccaatgctc

SEQ ID NO: 645887 - DNA, 20 bp, mouse
gagatccaacccagagcatt

SEQ ID NO: 645888 - DNA, 20 bp, mouse
gtagctgtgaagtagacaaa

SEQ ID NO: 645889 - DNA, 20 bp, mouse
gaagaagagagtctagagtt

SEQ ID NO: 645890 - DNA, 20 bp, mouse
gctaacttatggttatctcg

SEQ ID NO: 645891 - DNA, 20 bp, mouse
gttctgaaacaaagctgtat

SEQ ID NO: 645892 - DNA, 20 bp, mouse
gttagtaactaattctggga

SEQ ID NO: 645893 - DNA, 20 bp, mouse
gggtgtgtaatctataagag

SEQ ID NO: 645894 - DNA, 20 bp, mouse
gtgtaagagattcttattca

SEQ ID NO: 645895 - DNA, 20 bp, mouse
gactatttagtaactaattc

SEQ ID NO: 645896 - DNA, 20 bp, mouse
gctggtggccagcacagcgg

SEQ ID NO: 645897 - DNA, 20 bp, mouse
gtggggcaagtgcaccacca

SEQ ID NO: 645898 - DNA, 20 bp, mouse
gcgggtgcgcagggccctgg

SEQ ID NO: 645899 - DNA, 20 bp, mouse
gcggccgggtgcggcgcgtg

SEQ ID NO: 645900 - DNA, 20 bp, mouse
gcacagctagctggtctcta

SEQ ID NO: 645901 - DNA, 20 bp, mouse
ggggaaagagccgggtgcgc

SEQ ID NO: 645902 - DNA, 20 bp, mouse
gctactctggtgcgcgcggc

SEQ ID NO: 645903 - DNA, 20 bp, mouse
gggtgtgcagtctacttctt

SEQ ID NO: 645904 - DNA, 20 bp, mouse
gtggctcttcgcagaacttg

SEQ ID NO: 645905 - DNA, 20 bp, mouse
ggaagtagactgcacaccaa

SEQ ID NO: 645906 - DNA, 20 bp, mouse
ggctgcgcatgctcgactgt

SEQ ID NO: 645907 - DNA, 20 bp, mouse
gcgggcgcgctcccggaggg

SEQ ID NO: 645908 - DNA, 20 bp, mouse
gcgcgcccgaacggggtttc

SEQ ID NO: 645909 - DNA, 20 bp, mouse
ggtactgcaccccaccctcc

SEQ ID NO: 645910 - DNA, 20 bp, mouse
gcgcacccgaaaccccgttc

SEQ ID NO: 645911 - DNA, 20 bp, mouse
gctcgactgtgggagccctg

SEQ ID NO: 645912 - DNA, 20 bp, mouse
gcggcgcgggcgcgagactc

SEQ ID NO: 645913 - DNA, 20 bp, mouse
gcctccaaagaccagaggta

SEQ ID NO: 645914 - DNA, 20 bp, mouse
gtgcgcagcgcggcccatgc

SEQ ID NO: 645915 - DNA, 20 bp, mouse
gctccgggagcgcgcccgaa

SEQ ID NO: 645916 - DNA, 20 bp, mouse
gggtgagtagaaataagatt

SEQ ID NO: 645917 - DNA, 20 bp, mouse
ggataccaaactatgtgtga

SEQ ID NO: 645918 - DNA, 20 bp, mouse
gtggtggagacacagtggga

SEQ ID NO: 645919 - DNA, 20 bp, mouse
gcaaggttctatagtctaag

SEQ ID NO: 645920 - DNA, 20 bp, mouse
gtgagatggtggagacacag

SEQ ID NO: 645921 - DNA, 20 bp, mouse
gagtgggaaggccaactaca

SEQ ID NO: 645922 - DNA, 20 bp, mouse
gtctatagtctaagaggctc

SEQ ID NO: 645923 - DNA, 20 bp, mouse
gagcacaataaatatggata

SEQ ID NO: 645924 - DNA, 20 bp, mouse
gcacgatatggctaaatgtt

SEQ ID NO: 645925 - DNA, 20 bp, mouse
gaaataagatttggttgaga

SEQ ID NO: 645926 - DNA, 20 bp, mouse
gagacaacatgacttcaaaa

SEQ ID NO: 645927 - DNA, 20 bp, mouse
gcttctaaagtatagagaga

SEQ ID NO: 645928 - DNA, 20 bp, mouse
ggattcaatagaaagctaag

SEQ ID NO: 645929 - DNA, 20 bp, mouse
gatgttttacaaggatggtg

SEQ ID NO: 645930 - DNA, 20 bp, mouse
gggttgagatagtaaaagca

SEQ ID NO: 645931 - DNA, 20 bp, mouse
gaatctgattattcatactg

SEQ ID NO: 645932 - DNA, 20 bp, mouse
gcctataagagaaaagaatg

SEQ ID NO: 645933 - DNA, 20 bp, mouse
gggatggtgtggatcagctg

SEQ ID NO: 645934 - DNA, 20 bp, mouse
gtattggactatgttttaca

SEQ ID NO: 645935 - DNA, 20 bp, mouse
gtgaagtcatgttgtctaca

SEQ ID NO: 645936 - DNA, 20 bp, mouse
gcgctgcgctctggtgtctc

SEQ ID NO: 645937 - DNA, 20 bp, mouse
gcaccagagcgcagcgtata

SEQ ID NO: 645938 - DNA, 20 bp, mouse
ggagggctgagaaccagcat

SEQ ID NO: 645939 - DNA, 20 bp, mouse
gctccttatacgctgcgctc

SEQ ID NO: 645940 - DNA, 20 bp, mouse
gtatgggatgaatttggaag

SEQ ID NO: 645941 - DNA, 20 bp, mouse
gctcaaagcacttaacatta

SEQ ID NO: 645942 - DNA, 20 bp, mouse
gctagtatatgggatgaatt

SEQ ID NO: 645943 - DNA, 20 bp, mouse
ggctattcaagctagtatat

SEQ ID NO: 645944 - DNA, 20 bp, mouse
ggtgtgaatttctttggcag

SEQ ID NO: 645945 - DNA, 20 bp, mouse
gaagaaattcacacctatgc

SEQ ID NO: 645946 - DNA, 20 bp, mouse
gcaccagagcatagtgtata

SEQ ID NO: 645947 - DNA, 20 bp, mouse
gctccttatacactatgctc

SEQ ID NO: 645948 - DNA, 20 bp, mouse
gtgccaggttctgtgaaagg

SEQ ID NO: 645949 - DNA, 20 bp, mouse
gaggtgttcaatgtctctgg

SEQ ID NO: 645950 - DNA, 20 bp, mouse
gaagctatagttgtatgaca

SEQ ID NO: 645951 - DNA, 20 bp, mouse
gcactatgctctggtgtgtc

SEQ ID NO: 645952 - DNA, 20 bp, mouse
gtttattctggaagcaaata

SEQ ID NO: 645953 - DNA, 20 bp, mouse
gattattatcatctttattc

SEQ ID NO: 645954 - DNA, 20 bp, mouse
gcatggttttacagtatatg

SEQ ID NO: 645955 - DNA, 20 bp, mouse
gacaatgcatctacatatgc

SEQ ID NO: 645956 - DNA, 20 bp, mouse
ggcatggcaggcggaagtcc

SEQ ID NO: 645957 - DNA, 20 bp, mouse
gggaagtcctggctgcctct

SEQ ID NO: 645958 - DNA, 20 bp, mouse
gcgaaggtgttgcacaactg

SEQ ID NO: 645959 - DNA, 20 bp, mouse
gagctcaagaggtcacaagg

SEQ ID NO: 645960 - DNA, 20 bp, mouse
gtggttctgccgcaatggca

SEQ ID NO: 645961 - DNA, 20 bp, mouse
ggccgcaatggcatggcagg

SEQ ID NO: 645962 - DNA, 20 bp, mouse
gctaatagaggaaattttag

SEQ ID NO: 645963 - DNA, 20 bp, mouse
gagctgtggttctgccgcaa

SEQ ID NO: 645964 - DNA, 20 bp, mouse
gtatagctcaagaggtcaca

SEQ ID NO: 645965 - DNA, 20 bp, mouse
gaaacaatagctcctaatag

SEQ ID NO: 645966 - DNA, 20 bp, mouse
gggtatggggaactatgtta

SEQ ID NO: 645967 - DNA, 20 bp, mouse
ggctaaaggtgtcagggtat

SEQ ID NO: 645968 - DNA, 20 bp, mouse
gaagttggctaaaggtgtca

SEQ ID NO: 645969 - DNA, 20 bp, mouse
gtcatgacaaagttggctaa

SEQ ID NO: 645970 - DNA, 20 bp, mouse
ggtttctcaagtaaggtctg

SEQ ID NO: 645971 - DNA, 20 bp, mouse
gtactatagtattaaagttt

SEQ ID NO: 645972 - DNA, 20 bp, mouse
gttgtgctgttcaatgacat

SEQ ID NO: 645973 - DNA, 20 bp, mouse
gaaagaatgtttctcaagta

SEQ ID NO: 645974 - DNA, 20 bp, mouse
gttaaatcgttagtgcaaat

SEQ ID NO: 645975 - DNA, 20 bp, mouse
gacagcacaatattcttcaa

SEQ ID NO: 645976 - DNA, 20 bp, mouse
gaacaggaaggcccacggtg

SEQ ID NO: 645977 - DNA, 20 bp, mouse
gggactaggtagctggtgac

SEQ ID NO: 645978 - DNA, 20 bp, mouse
ggggaaaaggttgagtcatc

SEQ ID NO: 645979 - DNA, 20 bp, mouse
gttttccctgcagacgtcag

SEQ ID NO: 645980 - DNA, 20 bp, mouse
gagagtccagcgttcatgtg

SEQ ID NO: 645981 - DNA, 20 bp, mouse
ggctgtggcaccctcaccgt

SEQ ID NO: 645982 - DNA, 20 bp, mouse
gccgaagagctcaggcgcag

SEQ ID NO: 645983 - DNA, 20 bp, mouse
ggcatcctctgacgtctgca

SEQ ID NO: 645984 - DNA, 20 bp, mouse
gcagaacaggaagtacgaac

SEQ ID NO: 645985 - DNA, 20 bp, mouse
gagaactgggactaggtagc

SEQ ID NO: 645986 - DNA, 20 bp, mouse
gtgaatatgtgggatgcgga

SEQ ID NO: 645987 - DNA, 20 bp, mouse
gacagcgtgttctgaatatg

SEQ ID NO: 645988 - DNA, 20 bp, mouse
gagctcgcgcttaagaatag

SEQ ID NO: 645989 - DNA, 20 bp, mouse
gtaagaatagagggagaccg

SEQ ID NO: 645990 - DNA, 20 bp, mouse
ggttctgaatatgtgggatg

SEQ ID NO: 645991 - DNA, 20 bp, mouse
gcgcgagcttaattcactgc

SEQ ID NO: 645992 - DNA, 20 bp, mouse
gtatgtgggatgcggagggg

SEQ ID NO: 645993 - DNA, 20 bp, mouse
gtaattcactgccgggttag

SEQ ID NO: 645994 - DNA, 20 bp, mouse
gacttatggagcctgtctac

SEQ ID NO: 645995 - DNA, 20 bp, mouse
gcctctgccactcagagttc

SEQ ID NO: 645996 - DNA, 20 bp, mouse
gcgcatgcgcagtactggag

SEQ ID NO: 645997 - DNA, 20 bp, mouse
gagtactggagaggctgcga

SEQ ID NO: 645998 - DNA, 20 bp, mouse
gaaacccgcatgcgcagtac

SEQ ID NO: 645999 - DNA, 20 bp, mouse
gccaccgtgggccacgtcct

SEQ ID NO: 646000 - DNA, 20 bp, mouse
gagaggctgcgagggcgctc

SEQ ID NO: 646001 - DNA, 20 bp, mouse
gaggaagcctggcggtccat

SEQ ID NO: 646002 - DNA, 20 bp, mouse
ggggctgtggggcacgtgcc

SEQ ID NO: 646003 - DNA, 20 bp, mouse
gacgtgccaggggccaccgt

SEQ ID NO: 646004 - DNA, 20 bp, mouse
gtgtggaaatgtagacccca

SEQ ID NO: 646005 - DNA, 20 bp, mouse
gttagggcgctccaaggacg

SEQ ID NO: 646006 - DNA, 20 bp, mouse
gacgccagggagggtcatcc

SEQ ID NO: 646007 - DNA, 20 bp, mouse
gctaccctggcccgcaaaac

SEQ ID NO: 646008 - DNA, 20 bp, mouse
gtcccttggccagcgtggat

SEQ ID NO: 646009 - DNA, 20 bp, mouse
gaaaacaggagtccgcgctg

SEQ ID NO: 646010 - DNA, 20 bp, mouse
gcgctggccaagggaggcga

SEQ ID NO: 646011 - DNA, 20 bp, mouse
ggttgcagataacgccaggg

SEQ ID NO: 646012 - DNA, 20 bp, mouse
ggaggcgagggcggaaagtc

SEQ ID NO: 646013 - DNA, 20 bp, mouse
gcgccacctcacaggagcgc

SEQ ID NO: 646014 - DNA, 20 bp, mouse
gaggcggccccctctagccg

SEQ ID NO: 646015 - DNA, 20 bp, mouse
gggttcttagagaacctctc

SEQ ID NO: 646016 - DNA, 20 bp, mouse
ggtggtgtggggaccatctc

SEQ ID NO: 646017 - DNA, 20 bp, mouse
gggaagatggatgtcattgg

SEQ ID NO: 646018 - DNA, 20 bp, mouse
ggtagcctgagcttaggagg

SEQ ID NO: 646019 - DNA, 20 bp, mouse
gaagaaacagcacatcttga

SEQ ID NO: 646020 - DNA, 20 bp, mouse
ggatggaagatggatgtcat

SEQ ID NO: 646021 - DNA, 20 bp, mouse
ggggaaagggtgcctgcaga

SEQ ID NO: 646022 - DNA, 20 bp, mouse
ggtggctccagcacccgaga

SEQ ID NO: 646023 - DNA, 20 bp, mouse
ggaagtagcctgagcttagg

SEQ ID NO: 646024 - DNA, 20 bp, mouse
gggctgtgtggctaacctca

SEQ ID NO: 646025 - DNA, 20 bp, mouse
gcgctgaagacgcgcgggaa

SEQ ID NO: 646026 - DNA, 20 bp, mouse
gtggacgatggcacagcttg

SEQ ID NO: 646027 - DNA, 20 bp, mouse
gacagcggagcagtggacga

SEQ ID NO: 646028 - DNA, 20 bp, mouse
gatagaggacagcggagcag

SEQ ID NO: 646029 - DNA, 20 bp, mouse
gataacctccacctgagcaa

SEQ ID NO: 646030 - DNA, 20 bp, mouse
gaactacataggatgtgaca

SEQ ID NO: 646031 - DNA, 20 bp, mouse
ggaagcccttgctcaggtgg

SEQ ID NO: 646032 - DNA, 20 bp, mouse
gaagatgtgtacatagtgaa

SEQ ID NO: 646033 - DNA, 20 bp, mouse
gaaagtagctctaactacat

SEQ ID NO: 646034 - DNA, 20 bp, mouse
gaaagtctatgcaatatgca

SEQ ID NO: 646035 - DNA, 20 bp, mouse
gcattttggtagtactatag

SEQ ID NO: 646036 - DNA, 20 bp, mouse
gaataagcatcagcattaga

SEQ ID NO: 646037 - DNA, 20 bp, mouse
gcttaccaaatgtagagaaa

SEQ ID NO: 646038 - DNA, 20 bp, mouse
gatttccatttctctacatt

SEQ ID NO: 646039 - DNA, 20 bp, mouse
ggattcaatagaaagctaac

SEQ ID NO: 646040 - DNA, 20 bp, mouse
gtgaagttaatttactttga

SEQ ID NO: 646041 - DNA, 20 bp, mouse
gggttgagatagtaaaagca

SEQ ID NO: 646042 - DNA, 20 bp, mouse
gaatctgattactcatactg

SEQ ID NO: 646043 - DNA, 20 bp, mouse
gggactatgttttacaagaa

SEQ ID NO: 646044 - DNA, 20 bp, mouse
gcctataagagaaaagaatg

SEQ ID NO: 646045 - DNA, 20 bp, mouse
gttaaaagaaataacatagt

SEQ ID NO: 646046 - DNA, 20 bp, mouse
gacctatggcagaagcccga

SEQ ID NO: 646047 - DNA, 20 bp, mouse
gggatgagcatagcattgtt

SEQ ID NO: 646048 - DNA, 20 bp, mouse
ggtttttggatgtaattaaa

SEQ ID NO: 646049 - DNA, 20 bp, mouse
gcagggatctggagaaccta

SEQ ID NO: 646050 - DNA, 20 bp, mouse
gcactttttgcttttccctc

SEQ ID NO: 646051 - DNA, 20 bp, mouse
gatccaagcattgtgtgctc

SEQ ID NO: 646052 - DNA, 20 bp, mouse
ggtaaatcttatattatata

SEQ ID NO: 646053 - DNA, 20 bp, mouse
gatagtttatagaagtaact

SEQ ID NO: 646054 - DNA, 20 bp, mouse
gctgactgtgaaaatttaag

SEQ ID NO: 646055 - DNA, 20 bp, mouse
gcattgtgtgctcagggatc

SEQ ID NO: 646056 - DNA, 20 bp, mouse
gctgctaactgtaaaaagga

SEQ ID NO: 646057 - DNA, 20 bp, mouse
gcatcctgctaactgtaaaa

SEQ ID NO: 646058 - DNA, 20 bp, mouse
gttacagttagcaggatggt

SEQ ID NO: 646059 - DNA, 20 bp, mouse
gtccctagcgacaaccctgc

SEQ ID NO: 646060 - DNA, 20 bp, mouse
gacagtacgccgaagtatcc

SEQ ID NO: 646061 - DNA, 20 bp, mouse
gaaggaaggtggatgcctgc

SEQ ID NO: 646062 - DNA, 20 bp, mouse
gtctgggccctgaacctgca

SEQ ID NO: 646063 - DNA, 20 bp, mouse
gcgggcgttgtgtccagtaa

SEQ ID NO: 646064 - DNA, 20 bp, mouse
gggcccagagcttccgttac

SEQ ID NO: 646065 - DNA, 20 bp, mouse
ggcctgaagagtaaacctgc

SEQ ID NO: 646066 - DNA, 20 bp, mouse
gtgggtgttgctcgaaagtt

SEQ ID NO: 646067 - DNA, 20 bp, mouse
gctttcgagcaacacccaaa

SEQ ID NO: 646068 - DNA, 20 bp, mouse
gagtctgaatgtgttagctg

SEQ ID NO: 646069 - DNA, 20 bp, mouse
gagcaaggagtgtctctgac

SEQ ID NO: 646070 - DNA, 20 bp, mouse
gaggttaaatattgtcaaaa

SEQ ID NO: 646071 - DNA, 20 bp, mouse
gaacagtcactgggtgtggc

SEQ ID NO: 646072 - DNA, 20 bp, mouse
gaatgtgttagctgaggttg

SEQ ID NO: 646073 - DNA, 20 bp, mouse
gtggttcccagtgtgactct

SEQ ID NO: 646074 - DNA, 20 bp, mouse
gctcaggctcccaacctaag

SEQ ID NO: 646075 - DNA, 20 bp, mouse
gaggtaacagtcactgggtg

SEQ ID NO: 646076 - DNA, 20 bp, mouse
gtgggtgttgctcgaaagtt

SEQ ID NO: 646077 - DNA, 20 bp, mouse
gctttcgagcaacacccaaa

SEQ ID NO: 646078 - DNA, 20 bp, mouse
gagtctgaatgtgttagctg

SEQ ID NO: 646079 - DNA, 20 bp, mouse
gagcaaggagtgtctctgac

SEQ ID NO: 646080 - DNA, 20 bp, mouse
gaggttaaatattgtcaaaa

SEQ ID NO: 646081 - DNA, 20 bp, mouse
gaacagtcactgggtgtggc

SEQ ID NO: 646082 - DNA, 20 bp, mouse
gaatgtgttagctgaggttg

SEQ ID NO: 646083 - DNA, 20 bp, mouse
gtggttcccagtgtgactct

SEQ ID NO: 646084 - DNA, 20 bp, mouse
gctcaggctcccaacctaag

SEQ ID NO: 646085 - DNA, 20 bp, mouse
gaggtaacagtcactgggtg

SEQ ID NO: 646086 - DNA, 20 bp, mouse
gacaacagtggagctagtgg

SEQ ID NO: 646087 - DNA, 20 bp, mouse
gacagtggagctagtggggg

SEQ ID NO: 646088 - DNA, 20 bp, mouse
ggcttgaggctaaaacacag

SEQ ID NO: 646089 - DNA, 20 bp, mouse
gaggacaacagtggagctag

SEQ ID NO: 646090 - DNA, 20 bp, mouse
gaagtctacgacatatactt

SEQ ID NO: 646091 - DNA, 20 bp, mouse
ggtgggggtggaaatgaacc

SEQ ID NO: 646092 - DNA, 20 bp, mouse
gtactaattaaggacaacag

SEQ ID NO: 646093 - DNA, 20 bp, mouse
gacagagtagaatctgtgcc

SEQ ID NO: 646094 - DNA, 20 bp, mouse
gggaaaaagaggagatgcat

SEQ ID NO: 646095 - DNA, 20 bp, mouse
gacagatagagagatgtcca

SEQ ID NO: 646096 - DNA, 20 bp, mouse
ggggcagtctggagttacag

SEQ ID NO: 646097 - DNA, 20 bp, mouse
gcccctccgaagtaacttct

SEQ ID NO: 646098 - DNA, 20 bp, mouse
gtacctagaagttacttcgg

SEQ ID NO: 646099 - DNA, 20 bp, mouse
gacaagctcccagtcctggt

SEQ ID NO: 646100 - DNA, 20 bp, mouse
gcaactgggtgttggtatag

SEQ ID NO: 646101 - DNA, 20 bp, mouse
ggggcccaggaccaacttgt

SEQ ID NO: 646102 - DNA, 20 bp, mouse
gaggctggttgctgccaact

SEQ ID NO: 646103 - DNA, 20 bp, mouse
gcgccccgcggtccagtgat

SEQ ID NO: 646104 - DNA, 20 bp, mouse
gcctcccatggcagagcttt

SEQ ID NO: 646105 - DNA, 20 bp, mouse
ggtcctggtggggagattgt

SEQ ID NO: 646106 - DNA, 20 bp, mouse
ggcggccagaggctgacgta

SEQ ID NO: 646107 - DNA, 20 bp, mouse
ggggttgcaaggatgaccga

SEQ ID NO: 646108 - DNA, 20 bp, mouse
gtggccgcgggatcgggaaa

SEQ ID NO: 646109 - DNA, 20 bp, mouse
gctggcggggcgctcgccct

SEQ ID NO: 646110 - DNA, 20 bp, mouse
gcgggcgcgaactggagcgg

SEQ ID NO: 646111 - DNA, 20 bp, mouse
gccgcgcgcgtgctcgccga

SEQ ID NO: 646112 - DNA, 20 bp, mouse
ggaaaggggcggggtttttg

SEQ ID NO: 646113 - DNA, 20 bp, mouse
ggctgcacggagcggaggga

SEQ ID NO: 646114 - DNA, 20 bp, mouse
gggagcgtcgagctgcgcac

SEQ ID NO: 646115 - DNA, 20 bp, mouse
gcgcccctccgcccgctcag

SEQ ID NO: 646116 - DNA, 20 bp, mouse
gctgtggggaggctcattaa

SEQ ID NO: 646117 - DNA, 20 bp, mouse
gtaaacattggtctcaaagg

SEQ ID NO: 646118 - DNA, 20 bp, mouse
ggatgcacagatgtaaacat

SEQ ID NO: 646119 - DNA, 20 bp, mouse
gcgggatggaactcaacata

SEQ ID NO: 646120 - DNA, 20 bp, mouse
gtcaaaggaggaacagtctc

SEQ ID NO: 646121 - DNA, 20 bp, mouse
gccgattggaatgtgaactc

SEQ ID NO: 646122 - DNA, 20 bp, mouse
gtgttgagttccatcccgat

SEQ ID NO: 646123 - DNA, 20 bp, mouse
ggttcacattccaatcggga

SEQ ID NO: 646124 - DNA, 20 bp, mouse
gtttcagtgctgcagctcat

SEQ ID NO: 646125 - DNA, 20 bp, mouse
ggctagtccgcaacacaatt

SEQ ID NO: 646126 - DNA, 20 bp, mouse
ggcccagccggggcacagga

SEQ ID NO: 646127 - DNA, 20 bp, mouse
ggcgcctcggggcctgaagg

SEQ ID NO: 646128 - DNA, 20 bp, mouse
gcgccacagctcgtcactct

SEQ ID NO: 646129 - DNA, 20 bp, mouse
ggcccactttggggcagaag

SEQ ID NO: 646130 - DNA, 20 bp, mouse
gtggcgtgaggccagggcgg

SEQ ID NO: 646131 - DNA, 20 bp, mouse
gaaaagctggggtaaagaga

SEQ ID NO: 646132 - DNA, 20 bp, mouse
ggggcggtgtcgcagtgttg

SEQ ID NO: 646133 - DNA, 20 bp, mouse
gtctgcgcctcggggcctga

SEQ ID NO: 646134 - DNA, 20 bp, mouse
gacaggaagcagggtggtcc

SEQ ID NO: 646135 - DNA, 20 bp, mouse
gaaaccgagctctgcgcctc

SEQ ID NO: 646136 - DNA, 20 bp, mouse
gtcgcgaagggcgcccgtgt

SEQ ID NO: 646137 - DNA, 20 bp, mouse
ggctccggggtccttggctt

SEQ ID NO: 646138 - DNA, 20 bp, mouse
gtcgcgaggcggggtaatcc

SEQ ID NO: 646139 - DNA, 20 bp, mouse
gggacccaagccaaggaccc

SEQ ID NO: 646140 - DNA, 20 bp, mouse
gaggagtggacgcacacagt

SEQ ID NO: 646141 - DNA, 20 bp, mouse
ggccgcccagggcctcaggc

SEQ ID NO: 646142 - DNA, 20 bp, mouse
gagtggacgcacacagtagg

SEQ ID NO: 646143 - DNA, 20 bp, mouse
gtcaggctggacccaagcca

SEQ ID NO: 646144 - DNA, 20 bp, mouse
gcgggcgcccttcgcgaggc

SEQ ID NO: 646145 - DNA, 20 bp, mouse
gtcagcatctccacccacac

SEQ ID NO: 646146 - DNA, 20 bp, mouse
gtgggcatgcgggccaaata

SEQ ID NO: 646147 - DNA, 20 bp, mouse
gcccaggctctgagcccgga

SEQ ID NO: 646148 - DNA, 20 bp, mouse
gaggggagaccctagacagc

SEQ ID NO: 646149 - DNA, 20 bp, mouse
gagcagaggggtggggatct

SEQ ID NO: 646150 - DNA, 20 bp, mouse
gaggctctgagcccggaggg

SEQ ID NO: 646151 - DNA, 20 bp, mouse
gctagagtaagagccgtcag

SEQ ID NO: 646152 - DNA, 20 bp, mouse
gcttcctggccagctgtcta

SEQ ID NO: 646153 - DNA, 20 bp, mouse
gggactgggtcagagccaag

SEQ ID NO: 646154 - DNA, 20 bp, mouse
gacagaatagggtacattca

SEQ ID NO: 646155 - DNA, 20 bp, mouse
gtcatcctgtgtaaaggaga

SEQ ID NO: 646156 - DNA, 20 bp, mouse
ggtgcaccctcctcctggga

SEQ ID NO: 646157 - DNA, 20 bp, mouse
gcaccccctgggtcctatta

SEQ ID NO: 646158 - DNA, 20 bp, mouse
gccagggcagggttatgggg

SEQ ID NO: 646159 - DNA, 20 bp, mouse
gtatgcgagcccacaccccc

SEQ ID NO: 646160 - DNA, 20 bp, mouse
gcctcccagggcagggttat

SEQ ID NO: 646161 - DNA, 20 bp, mouse
gtgctagaccagaccctccc

SEQ ID NO: 646162 - DNA, 20 bp, mouse
gcaagccctaataggaccca

SEQ ID NO: 646163 - DNA, 20 bp, mouse
ggacaaaagcaagccctaat

SEQ ID NO: 646164 - DNA, 20 bp, mouse
gattccaaaagagcagtctc

SEQ ID NO: 646165 - DNA, 20 bp, mouse
ggcacagttggaacttttcc

SEQ ID NO: 646166 - DNA, 20 bp, mouse
gcaggggctcccggcgtacg

SEQ ID NO: 646167 - DNA, 20 bp, mouse
ggaaagctctggcgtctgaa

SEQ ID NO: 646168 - DNA, 20 bp, mouse
gacgccgggagcccctgcgc

SEQ ID NO: 646169 - DNA, 20 bp, mouse
gaacggggaggagcggctat

SEQ ID NO: 646170 - DNA, 20 bp, mouse
ggggcgggcctggcgagcta

SEQ ID NO: 646171 - DNA, 20 bp, mouse
gtaaggcatgcggcccggat

SEQ ID NO: 646172 - DNA, 20 bp, mouse
gacagagcctgcaaacgggg

SEQ ID NO: 646173 - DNA, 20 bp, mouse
gccacgcggagcccgcgcag

SEQ ID NO: 646174 - DNA, 20 bp, mouse
gcgagctaaggcatgcggcc

SEQ ID NO: 646175 - DNA, 20 bp, mouse
gcctggcgagctaaggcatg

SEQ ID NO: 646176 - DNA, 20 bp, mouse
gaggctgggaggggagttag

SEQ ID NO: 646177 - DNA, 20 bp, mouse
gatgccgaggcaggaggcgt

SEQ ID NO: 646178 - DNA, 20 bp, mouse
gccaggcagcgagctctggg

SEQ ID NO: 646179 - DNA, 20 bp, mouse
gtgagcaagagccacttggc

SEQ ID NO: 646180 - DNA, 20 bp, mouse
gtggggtctgggttcaagaa

SEQ ID NO: 646181 - DNA, 20 bp, mouse
gagggagtggcgttatgccg

SEQ ID NO: 646182 - DNA, 20 bp, mouse
ggagaagtgacgcgaggtgg

SEQ ID NO: 646183 - DNA, 20 bp, mouse
gaagagccacttggcgggga

SEQ ID NO: 646184 - DNA, 20 bp, mouse
gtgctcagggaggaacaggt

SEQ ID NO: 646185 - DNA, 20 bp, mouse
ggcgggaccgagttctccag

SEQ ID NO: 646186 - DNA, 20 bp, mouse
gaggagatgaagcagactca

SEQ ID NO: 646187 - DNA, 20 bp, mouse
gcagactcatggtaagtact

SEQ ID NO: 646188 - DNA, 20 bp, mouse
ggcaggactagggagggcaa

SEQ ID NO: 646189 - DNA, 20 bp, mouse
gagggtctgtaaccagggga

SEQ ID NO: 646190 - DNA, 20 bp, mouse
gatagaggagggagtaaagc

SEQ ID NO: 646191 - DNA, 20 bp, mouse
gcaaccaagggacagcaggg

SEQ ID NO: 646192 - DNA, 20 bp, mouse
gctaccccaagttctcatgt

SEQ ID NO: 646193 - DNA, 20 bp, mouse
ggccaccgctgcagctctgt

SEQ ID NO: 646194 - DNA, 20 bp, mouse
gctggggcacgtgaagaaaa

SEQ ID NO: 646195 - DNA, 20 bp, mouse
gaagcacccgcagcaaccaa

SEQ ID NO: 646196 - DNA, 20 bp, mouse
gaatacggacagggaaggcg

SEQ ID NO: 646197 - DNA, 20 bp, mouse
gtccctgtccgtattggtta

SEQ ID NO: 646198 - DNA, 20 bp, mouse
ggaaaccaacgtgcgtagtt

SEQ ID NO: 646199 - DNA, 20 bp, mouse
gggccctaaccaatacggac

SEQ ID NO: 646200 - DNA, 20 bp, mouse
gacaacctaactacgcacgt

SEQ ID NO: 646201 - DNA, 20 bp, mouse
gcgaccggccctaaccaata

SEQ ID NO: 646202 - DNA, 20 bp, mouse
gtggtttctaggcagtaggt

SEQ ID NO: 646203 - DNA, 20 bp, mouse
ggaccaggctggtgtcctcc

SEQ ID NO: 646204 - DNA, 20 bp, mouse
gtacgcacgttggtttcgac

SEQ ID NO: 646205 - DNA, 20 bp, mouse
gggtaggctgtgacaccagg

SEQ ID NO: 646206 - DNA, 20 bp, mouse
ggaggccgggtgggagtcaa

SEQ ID NO: 646207 - DNA, 20 bp, mouse
gaggcctgggctccgaggga

SEQ ID NO: 646208 - DNA, 20 bp, mouse
gccgggtgggagtcaagggg

SEQ ID NO: 646209 - DNA, 20 bp, mouse
ggctccgagggagggaacag

SEQ ID NO: 646210 - DNA, 20 bp, mouse
gcgagctcctgtgcagtaaa

SEQ ID NO: 646211 - DNA, 20 bp, mouse
gcggacacaccgccaggaga

SEQ ID NO: 646212 - DNA, 20 bp, mouse
gcgcctgagctaggatccca

SEQ ID NO: 646213 - DNA, 20 bp, mouse
gcctgtgcagtaaagggcgt

SEQ ID NO: 646214 - DNA, 20 bp, mouse
gacgaacccggggaaacctc

SEQ ID NO: 646215 - DNA, 20 bp, mouse
gacacaccgccaggagaggg

SEQ ID NO: 646216 - DNA, 20 bp, mouse
gcgggtgcgggcggcgaatc

SEQ ID NO: 646217 - DNA, 20 bp, mouse
ggtcccacggggctccagcc

SEQ ID NO: 646218 - DNA, 20 bp, mouse
gtccagctccccagcgaatt

SEQ ID NO: 646219 - DNA, 20 bp, mouse
gactgcgggtctgtcccacg

SEQ ID NO: 646220 - DNA, 20 bp, mouse
gagggcggcctccggaccag

SEQ ID NO: 646221 - DNA, 20 bp, mouse
gcgcccgccacgctccgcgc

SEQ ID NO: 646222 - DNA, 20 bp, mouse
gggcccggctggagccccgt

SEQ ID NO: 646223 - DNA, 20 bp, mouse
ggactcatcacctaattcgc

SEQ ID NO: 646224 - DNA, 20 bp, mouse
gagctggagcgcagagagcc

SEQ ID NO: 646225 - DNA, 20 bp, mouse
gcgcgcctcctggctcttgg

SEQ ID NO: 646226 - DNA, 20 bp, mouse
gaggaggcgaaggcaagcga

SEQ ID NO: 646227 - DNA, 20 bp, mouse
gcggccgcgccaagaagcgc

SEQ ID NO: 646228 - DNA, 20 bp, mouse
gcgaaggcaagcgaggggga

SEQ ID NO: 646229 - DNA, 20 bp, mouse
gagaagcgccgggtcaccgc

SEQ ID NO: 646230 - DNA, 20 bp, mouse
gcgagtcgggaagcgaggag

SEQ ID NO: 646231 - DNA, 20 bp, mouse
gaggcgaggcgcgcaggaga

SEQ ID NO: 646232 - DNA, 20 bp, mouse
gcagagacaccccgaggcgg

SEQ ID NO: 646233 - DNA, 20 bp, mouse
ggggtcccaagtcacctcga

SEQ ID NO: 646234 - DNA, 20 bp, mouse
gcgagctagctagcgggcga

SEQ ID NO: 646235 - DNA, 20 bp, mouse
ggcagagaagcgctggaagc

SEQ ID NO: 646236 - DNA, 20 bp, mouse
gggaaccgagccagagtagc

SEQ ID NO: 646237 - DNA, 20 bp, mouse
ggcgcgcaccgggacctccc

SEQ ID NO: 646238 - DNA, 20 bp, mouse
ggacctggtcgaccaatcag

SEQ ID NO: 646239 - DNA, 20 bp, mouse
ggggacgcggagctgcagcc

SEQ ID NO: 646240 - DNA, 20 bp, mouse
gtggtcgaccaatcagcggg

SEQ ID NO: 646241 - DNA, 20 bp, mouse
gtgtcaacgtgcgtggggtc

SEQ ID NO: 646242 - DNA, 20 bp, mouse
gcccgcgcgccccgctactc

SEQ ID NO: 646243 - DNA, 20 bp, mouse
gaacgtgcgtggggtctggc

SEQ ID NO: 646244 - DNA, 20 bp, mouse
gtggtcgaccaggtcctggg

SEQ ID NO: 646245 - DNA, 20 bp, mouse
ggggcccgccccccaggacc

SEQ ID NO: 646246 - DNA, 20 bp, mouse
ggggccgtccggaggaggga

SEQ ID NO: 646247 - DNA, 20 bp, mouse
gggcccgcgccccccggcgt

SEQ ID NO: 646248 - DNA, 20 bp, mouse
ggacccgccgggcgctaaaa

SEQ ID NO: 646249 - DNA, 20 bp, mouse
gttagcgcccggcgggtcgc

SEQ ID NO: 646250 - DNA, 20 bp, mouse
gcggccgcctaggaggaggg

SEQ ID NO: 646251 - DNA, 20 bp, mouse
gcgcgggccccgggtgacgt

SEQ ID NO: 646252 - DNA, 20 bp, mouse
gagaactcgcaccgtcccag

SEQ ID NO: 646253 - DNA, 20 bp, mouse
gcgcgcgcccacgtcacccg

SEQ ID NO: 646254 - DNA, 20 bp, mouse
gaccccctccctcctccgga

SEQ ID NO: 646255 - DNA, 20 bp, mouse
gtcccagcccgactggagga

SEQ ID NO: 646256 - DNA, 20 bp, mouse
gtcactgggactctgaagga

SEQ ID NO: 646257 - DNA, 20 bp, mouse
gaagggacttgcccagggga

SEQ ID NO: 646258 - DNA, 20 bp, mouse
gtgcttcccaaagaccttag

SEQ ID NO: 646259 - DNA, 20 bp, mouse
gcacacacagagggcggttc

SEQ ID NO: 646260 - DNA, 20 bp, mouse
gcagagccccaggggaggtc

SEQ ID NO: 646261 - DNA, 20 bp, mouse
ggtcccagtgaccaagcttc

SEQ ID NO: 646262 - DNA, 20 bp, mouse
gaccgccctctgtgtgtgag

SEQ ID NO: 646263 - DNA, 20 bp, mouse
gtagcaagcagatgcattta

SEQ ID NO: 646264 - DNA, 20 bp, mouse
gagggctgatggtgggattt

SEQ ID NO: 646265 - DNA, 20 bp, mouse
gtagaccaggctggatagga

SEQ ID NO: 646266 - DNA, 20 bp, mouse
gtccgcgcctaatctgatgg

SEQ ID NO: 646267 - DNA, 20 bp, mouse
gggcgcggaccgggaagggt

SEQ ID NO: 646268 - DNA, 20 bp, mouse
ggggccagaacctagcaagg

SEQ ID NO: 646269 - DNA, 20 bp, mouse
gcggtccgcgcctaatctga

SEQ ID NO: 646270 - DNA, 20 bp, mouse
ggggacaaaggagggagtaa

SEQ ID NO: 646271 - DNA, 20 bp, mouse
gcgcctaatctgatggggga

SEQ ID NO: 646272 - DNA, 20 bp, mouse
gaacctagcaaggtggaagg

SEQ ID NO: 646273 - DNA, 20 bp, mouse
gaaggggccagaacctagca

SEQ ID NO: 646274 - DNA, 20 bp, mouse
ggatcgaggaaaggcagacc

SEQ ID NO: 646275 - DNA, 20 bp, mouse
ggattaggcgcggaccggga

SEQ ID NO: 646276 - DNA, 20 bp, mouse
ggggttgcaaagcacttctc

SEQ ID NO: 646277 - DNA, 20 bp, mouse
gaagcaaagcacaagttgtt

SEQ ID NO: 646278 - DNA, 20 bp, mouse
gagaatatctaagcgttttt

SEQ ID NO: 646279 - DNA, 20 bp, mouse
gggtgtggctttgcaagggg

SEQ ID NO: 646280 - DNA, 20 bp, mouse
gcaaacaatagagattgcac

SEQ ID NO: 646281 - DNA, 20 bp, mouse
gagactatagggttttattc

SEQ ID NO: 646282 - DNA, 20 bp, mouse
gattctggctgcagaataac

SEQ ID NO: 646283 - DNA, 20 bp, mouse
gtggctttgcaagggggggc

SEQ ID NO: 646284 - DNA, 20 bp, mouse
gcagaatttgaagatgaaaa

SEQ ID NO: 646285 - DNA, 20 bp, mouse
ggctggtgtggctttgcaag

SEQ ID NO: 646286 - DNA, 20 bp, mouse
ggggcggggcgagaccggtg

SEQ ID NO: 646287 - DNA, 20 bp, mouse
gtgggcgcgcaccaccgcca

SEQ ID NO: 646288 - DNA, 20 bp, mouse
gaagaggtggcccgcccgca

SEQ ID NO: 646289 - DNA, 20 bp, mouse
ggctacagacgtccccctgg

SEQ ID NO: 646290 - DNA, 20 bp, mouse
gtccggagcctgagttggta

SEQ ID NO: 646291 - DNA, 20 bp, mouse
gccccctcagccagctgccg

SEQ ID NO: 646292 - DNA, 20 bp, mouse
gggcggtccggagcctgagt

SEQ ID NO: 646293 - DNA, 20 bp, mouse
ggcccgcccgcagggcgctg

SEQ ID NO: 646294 - DNA, 20 bp, mouse
gagatctcggaggatacaga

SEQ ID NO: 646295 - DNA, 20 bp, mouse
ggggggggggtagatctcgg

SEQ ID NO: 646296 - DNA, 20 bp, mouse
gcctgaaggcgagtcctaga

SEQ ID NO: 646297 - DNA, 20 bp, mouse
ggggctcactgactcctgat

SEQ ID NO: 646298 - DNA, 20 bp, mouse
gactacttaactatcgggag

SEQ ID NO: 646299 - DNA, 20 bp, mouse
gtgtctctgaggccagagca

SEQ ID NO: 646300 - DNA, 20 bp, mouse
gtgtgcaagagccaggtgct

SEQ ID NO: 646301 - DNA, 20 bp, mouse
gggggactgtccagcattac

SEQ ID NO: 646302 - DNA, 20 bp, mouse
gtgtccagcattacaggaat

SEQ ID NO: 646303 - DNA, 20 bp, mouse
gttcacgtagtcacgtaaaa

SEQ ID NO: 646304 - DNA, 20 bp, mouse
gtggaatcacgctgtccatt

SEQ ID NO: 646305 - DNA, 20 bp, mouse
gaacctggcagtgttaaaag

SEQ ID NO: 646306 - DNA, 20 bp, mouse
gcagctggaggggcctaaag

SEQ ID NO: 646307 - DNA, 20 bp, mouse
ggcagtgccggagcaatcgg

SEQ ID NO: 646308 - DNA, 20 bp, mouse
gaccctaggtgcacgcctcc

SEQ ID NO: 646309 - DNA, 20 bp, mouse
gaggcccctccagctgccgg

SEQ ID NO: 646310 - DNA, 20 bp, mouse
gggaggggacaggatctaca

SEQ ID NO: 646311 - DNA, 20 bp, mouse
gggcctaaagcggtgagtcc

SEQ ID NO: 646312 - DNA, 20 bp, mouse
gaggaaaggggaatcggagt

SEQ ID NO: 646313 - DNA, 20 bp, mouse
gtccgcctccggcagctgga

SEQ ID NO: 646314 - DNA, 20 bp, mouse
gcggtgagtcctggcacccg

SEQ ID NO: 646315 - DNA, 20 bp, mouse
gaaaggggaatcggagtggg

SEQ ID NO: 646316 - DNA, 20 bp, mouse
gaggagagatagatgtgcac

SEQ ID NO: 646317 - DNA, 20 bp, mouse
gactgaaaggcaggggagca

SEQ ID NO: 646318 - DNA, 20 bp, mouse
gaataacaaagcggttgggg

SEQ ID NO: 646319 - DNA, 20 bp, mouse
gtgattagcaggagtctgat

SEQ ID NO: 646320 - DNA, 20 bp, mouse
ggcacattcagtcccgacta

SEQ ID NO: 646321 - DNA, 20 bp, mouse
gctgaataacaaagcggttg

SEQ ID NO: 646322 - DNA, 20 bp, mouse
ggacatgctgaataacaaag

SEQ ID NO: 646323 - DNA, 20 bp, mouse
gaatggaatctctctagagc

SEQ ID NO: 646324 - DNA, 20 bp, mouse
ggtctcacagagcactaacc

SEQ ID NO: 646325 - DNA, 20 bp, mouse
gctcgctcaggaaatgtgag

SEQ ID NO: 646326 - DNA, 20 bp, mouse
gcagcctggccatactccag

SEQ ID NO: 646327 - DNA, 20 bp, mouse
gacctaggcaagccagtctc

SEQ ID NO: 646328 - DNA, 20 bp, mouse
gttaacccgctctgctcctc

SEQ ID NO: 646329 - DNA, 20 bp, mouse
gtgtggcagcagcagccagc

SEQ ID NO: 646330 - DNA, 20 bp, mouse
gcctccctccacatgacctc

SEQ ID NO: 646331 - DNA, 20 bp, mouse
gtgggcgggggagcagcggt

SEQ ID NO: 646332 - DNA, 20 bp, mouse
gtgggctgagagcccctcct

SEQ ID NO: 646333 - DNA, 20 bp, mouse
gtatagctgtcaggcagacg

SEQ ID NO: 646334 - DNA, 20 bp, mouse
gttagatgggtgggtcaagg

SEQ ID NO: 646335 - DNA, 20 bp, mouse
gggagggaggttggcagtgg

SEQ ID NO: 646336 - DNA, 20 bp, mouse
ggctccgagccgcctggctg

SEQ ID NO: 646337 - DNA, 20 bp, mouse
gtcccagcgcccctgggtta

SEQ ID NO: 646338 - DNA, 20 bp, mouse
gtggcatcctcgcactggtc

SEQ ID NO: 646339 - DNA, 20 bp, mouse
gcaagtgcgcgccgcgtcta

SEQ ID NO: 646340 - DNA, 20 bp, mouse
gggtccccggggtctggcgg

SEQ ID NO: 646341 - DNA, 20 bp, mouse
gagcaggagtgggtagactc

SEQ ID NO: 646342 - DNA, 20 bp, mouse
gggtgatggtcaagctccta

SEQ ID NO: 646343 - DNA, 20 bp, mouse
gtggctggcccgtggcgcag

SEQ ID NO: 646344 - DNA, 20 bp, mouse
ggagggtggcatcctcgcac

SEQ ID NO: 646345 - DNA, 20 bp, mouse
gtgggaacgcggggacaagc

SEQ ID NO: 646346 - DNA, 20 bp, mouse
gagaccccaccaactctggc

SEQ ID NO: 646347 - DNA, 20 bp, mouse
gaggacaggctccaaccaaa

SEQ ID NO: 646348 - DNA, 20 bp, mouse
gtagctgtacggggcacccg

SEQ ID NO: 646349 - DNA, 20 bp, mouse
ggggaaccgtgtccacagcg

SEQ ID NO: 646350 - DNA, 20 bp, mouse
gaggagcctgccagagttgg

SEQ ID NO: 646351 - DNA, 20 bp, mouse
gaaaaggagcctgccagagt

SEQ ID NO: 646352 - DNA, 20 bp, mouse
gtgtacggggcacccggggt

SEQ ID NO: 646353 - DNA, 20 bp, mouse
gggctagcccaggttcttcg

SEQ ID NO: 646354 - DNA, 20 bp, mouse
gaaagcggaggcgatggcat

SEQ ID NO: 646355 - DNA, 20 bp, mouse
gggactcaaccacccacccc

SEQ ID NO: 646356 - DNA, 20 bp, mouse
gcccaggctggggtcaccga

SEQ ID NO: 646357 - DNA, 20 bp, mouse
ggggcccggacctgcggcag

SEQ ID NO: 646358 - DNA, 20 bp, mouse
gggccaagggcgccctcgtg

SEQ ID NO: 646359 - DNA, 20 bp, mouse
gctgcgctgtcagacacagt

SEQ ID NO: 646360 - DNA, 20 bp, mouse
ggggaagtgcagctgcgggg

SEQ ID NO: 646361 - DNA, 20 bp, mouse
gtgggcgcgcctaggaggcc

SEQ ID NO: 646362 - DNA, 20 bp, mouse
gtcaccgagggcgcaggcca

SEQ ID NO: 646363 - DNA, 20 bp, mouse
gcaggagagggcgcacgcgt

SEQ ID NO: 646364 - DNA, 20 bp, mouse
gagggcgcacgcgttgggcc

SEQ ID NO: 646365 - DNA, 20 bp, mouse
gcgcgttgggcccggacctg

SEQ ID NO: 646366 - DNA, 20 bp, mouse
gaacccgcgctgcggaagga

SEQ ID NO: 646367 - DNA, 20 bp, mouse
gagggagcgggccagagatc

SEQ ID NO: 646368 - DNA, 20 bp, mouse
gacctcagcttcaacccaac

SEQ ID NO: 646369 - DNA, 20 bp, mouse
gtcgcagggaacccgcgctg

SEQ ID NO: 646370 - DNA, 20 bp, mouse
gcagacacccggctctggga

SEQ ID NO: 646371 - DNA, 20 bp, mouse
gtagacttggacacgtgtga

SEQ ID NO: 646372 - DNA, 20 bp, mouse
gagcgggccagagatcagga

SEQ ID NO: 646373 - DNA, 20 bp, mouse
ggcctcaacgggtccacctg

SEQ ID NO: 646374 - DNA, 20 bp, mouse
gtcaacgggtccacctgggg

SEQ ID NO: 646375 - DNA, 20 bp, mouse
gggcacgcttgcgtgttggg

SEQ ID NO: 646376 - DNA, 20 bp, mouse
ggggcggggcatattatcca

SEQ ID NO: 646377 - DNA, 20 bp, mouse
gggccccgcctccaggtctt

SEQ ID NO: 646378 - DNA, 20 bp, mouse
gagccaggctagattagatc

SEQ ID NO: 646379 - DNA, 20 bp, mouse
gccaagctccaccgcctaag

SEQ ID NO: 646380 - DNA, 20 bp, mouse
gtgtccctccccttaggcgg

SEQ ID NO: 646381 - DNA, 20 bp, mouse
ggctccaccgcctaagggga

SEQ ID NO: 646382 - DNA, 20 bp, mouse
ggggcctgctgtcccgtggg

SEQ ID NO: 646383 - DNA, 20 bp, mouse
gctccgaagacctggaggcg

SEQ ID NO: 646384 - DNA, 20 bp, mouse
gtaaaccatggtctctagcc

SEQ ID NO: 646385 - DNA, 20 bp, mouse
ggtcggcgaccgaactgtcc

SEQ ID NO: 646386 - DNA, 20 bp, mouse
ggacctggggagtagaatca

SEQ ID NO: 646387 - DNA, 20 bp, mouse
gtcagtctttctaccatctg

SEQ ID NO: 646388 - DNA, 20 bp, mouse
ggaccggaaggccacagaac

SEQ ID NO: 646389 - DNA, 20 bp, mouse
ggatactgcagtttttctca

SEQ ID NO: 646390 - DNA, 20 bp, mouse
gcaggggctcaaacaaaaga

SEQ ID NO: 646391 - DNA, 20 bp, mouse
gcggtccacttgaaaaagaa

SEQ ID NO: 646392 - DNA, 20 bp, mouse
gggccttgattctactcccc

SEQ ID NO: 646393 - DNA, 20 bp, mouse
ggtggtgggaactagatact

SEQ ID NO: 646394 - DNA, 20 bp, mouse
gcaaaaatgtcctcctcaga

SEQ ID NO: 646395 - DNA, 20 bp, mouse
gctggaaaatgagggttttg

SEQ ID NO: 646396 - DNA, 20 bp, mouse
ggagtggtgaggaaggcggt

SEQ ID NO: 646397 - DNA, 20 bp, mouse
gagtgccctgctagtggagg

SEQ ID NO: 646398 - DNA, 20 bp, mouse
gtacggcggcccagccctta

SEQ ID NO: 646399 - DNA, 20 bp, mouse
gagcatcctgcccaccataa

SEQ ID NO: 646400 - DNA, 20 bp, mouse
ggcggcccagcccttatggt

SEQ ID NO: 646401 - DNA, 20 bp, mouse
gaggcggtgggcgtggacta

SEQ ID NO: 646402 - DNA, 20 bp, mouse
ggggcggggaagccttttca

SEQ ID NO: 646403 - DNA, 20 bp, mouse
gtatagtgccctgctagtgg

SEQ ID NO: 646404 - DNA, 20 bp, mouse
gcaactgttgggccaagagg

SEQ ID NO: 646405 - DNA, 20 bp, mouse
gcactccacctccactagca

SEQ ID NO: 646406 - DNA, 20 bp, mouse
ggcggcggcgggaactgcga

SEQ ID NO: 646407 - DNA, 20 bp, mouse
gtcgctagggagactcgaag

SEQ ID NO: 646408 - DNA, 20 bp, mouse
ggcaccgagaagatcgacgg

SEQ ID NO: 646409 - DNA, 20 bp, mouse
gcctgcccggagccgacgtc

SEQ ID NO: 646410 - DNA, 20 bp, mouse
gcgcgagcgagtccggacgt

SEQ ID NO: 646411 - DNA, 20 bp, mouse
gagggagactcgaagcggaa

SEQ ID NO: 646412 - DNA, 20 bp, mouse
gcgggaactgcgagggttag

SEQ ID NO: 646413 - DNA, 20 bp, mouse
ggcctcggatgggacctaag

SEQ ID NO: 646414 - DNA, 20 bp, mouse
gcgagtccggacgtcggctc

SEQ ID NO: 646415 - DNA, 20 bp, mouse
gaacaggtcgtgcgtcgcta

SEQ ID NO: 646416 - DNA, 20 bp, mouse
gcggctccatccaaccgaat

SEQ ID NO: 646417 - DNA, 20 bp, mouse
gtgcaggagggtgactacct

SEQ ID NO: 646418 - DNA, 20 bp, mouse
gacaccgaactggttttact

SEQ ID NO: 646419 - DNA, 20 bp, mouse
gctaccagaggcggtagagc

SEQ ID NO: 646420 - DNA, 20 bp, mouse
ggcaccagctctaccgcctc

SEQ ID NO: 646421 - DNA, 20 bp, mouse
gagccgcccaggagaaagga

SEQ ID NO: 646422 - DNA, 20 bp, mouse
gcagcggggcagtttgcagg

SEQ ID NO: 646423 - DNA, 20 bp, mouse
gtactgggagaagtccagcg

SEQ ID NO: 646424 - DNA, 20 bp, mouse
gaaccagttcggtgtgattg

SEQ ID NO: 646425 - DNA, 20 bp, mouse
ggacgagctccctgcatgat

SEQ ID NO: 646426 - DNA, 20 bp, mouse
gagtttctcacctcagtcat

SEQ ID NO: 646427 - DNA, 20 bp, mouse
gtgaccggagcggccctcta

SEQ ID NO: 646428 - DNA, 20 bp, mouse
gctgtgggaacggtgcaaag

SEQ ID NO: 646429 - DNA, 20 bp, mouse
gtgggaacggtgcaaagggg

SEQ ID NO: 646430 - DNA, 20 bp, mouse
gacgccctagagggccgctc

SEQ ID NO: 646431 - DNA, 20 bp, mouse
ggggcagagcttgaccggag

SEQ ID NO: 646432 - DNA, 20 bp, mouse
ggcagctagaaaagggtatt

SEQ ID NO: 646433 - DNA, 20 bp, mouse
gaagtcggtctttgctgcgg

SEQ ID NO: 646434 - DNA, 20 bp, mouse
ggatgagatgcgagctaagt

SEQ ID NO: 646435 - DNA, 20 bp, mouse
ggctaagtcggtctttgctg

SEQ ID NO: 646436 - DNA, 20 bp, mouse
ggtcccggatcagtaagcgg

SEQ ID NO: 646437 - DNA, 20 bp, mouse
ggatcagtaagcggcggctg

SEQ ID NO: 646438 - DNA, 20 bp, mouse
gttgtggcttaagcggagga

SEQ ID NO: 646439 - DNA, 20 bp, mouse
gaagggggcgtggactagag

SEQ ID NO: 646440 - DNA, 20 bp, mouse
gctgctcagagaaacgtctg

SEQ ID NO: 646441 - DNA, 20 bp, mouse
gacctccgaggactgtgccc

SEQ ID NO: 646442 - DNA, 20 bp, mouse
ggcagaggttgtggcttaag

SEQ ID NO: 646443 - DNA, 20 bp, mouse
ggtgggttgcctaggggaga

SEQ ID NO: 646444 - DNA, 20 bp, mouse
gaggcaacccacacaacacg

SEQ ID NO: 646445 - DNA, 20 bp, mouse
gtggacctccggcagcagcg

SEQ ID NO: 646446 - DNA, 20 bp, mouse
ggtctcaaagtgtcacaaag

SEQ ID NO: 646447 - DNA, 20 bp, mouse
ggaggcagaaggagactcta

SEQ ID NO: 646448 - DNA, 20 bp, mouse
gggactttacagaagtatga

SEQ ID NO: 646449 - DNA, 20 bp, mouse
gtcagcagagagaagacttg

SEQ ID NO: 646450 - DNA, 20 bp, mouse
gaaaccccctagactcagca

SEQ ID NO: 646451 - DNA, 20 bp, mouse
gcacgggagcgtagttccat

SEQ ID NO: 646452 - DNA, 20 bp, mouse
gtgcagcgagtagaatactg

SEQ ID NO: 646453 - DNA, 20 bp, mouse
gacaaggccttgctgagtct

SEQ ID NO: 646454 - DNA, 20 bp, mouse
gtcccttaaggccgtgcgcg

SEQ ID NO: 646455 - DNA, 20 bp, mouse
gagagaagacttgaggcaga

SEQ ID NO: 646456 - DNA, 20 bp, mouse
gacgcaggacgcaggatctg

SEQ ID NO: 646457 - DNA, 20 bp, mouse
gcgggcgcaaggcggggcgt

SEQ ID NO: 646458 - DNA, 20 bp, mouse
gcctgcctgctccgtagcca

SEQ ID NO: 646459 - DNA, 20 bp, mouse
ggcccccgcgaaggaggacg

SEQ ID NO: 646460 - DNA, 20 bp, mouse
gtgtccctggctgaagtcga

SEQ ID NO: 646461 - DNA, 20 bp, mouse
gttccccgcgtggacctccg

SEQ ID NO: 646462 - DNA, 20 bp, mouse
gcaccggggcggggctaggg

SEQ ID NO: 646463 - DNA, 20 bp, mouse
gcacccggttgccctggcta

SEQ ID NO: 646464 - DNA, 20 bp, mouse
gactcgctggggagacctat

SEQ ID NO: 646465 - DNA, 20 bp, mouse
gtggcggcacccggttgccc

SEQ ID NO: 646466 - DNA, 20 bp, mouse
gacaaggaaaggttttcctc

SEQ ID NO: 646467 - DNA, 20 bp, mouse
gagctgtggcctctagtcta

SEQ ID NO: 646468 - DNA, 20 bp, mouse
gccggcaggcctcgcggcac

SEQ ID NO: 646469 - DNA, 20 bp, mouse
gagcctgagctcaaacgtcg

SEQ ID NO: 646470 - DNA, 20 bp, mouse
gacgtggagagcggtgggtc

SEQ ID NO: 646471 - DNA, 20 bp, mouse
ggcgcagcttccctaccctc

SEQ ID NO: 646472 - DNA, 20 bp, mouse
gcacaatctggcagcgggat

SEQ ID NO: 646473 - DNA, 20 bp, mouse
gccgcccagacgaagctggg

SEQ ID NO: 646474 - DNA, 20 bp, mouse
gtcccgcacaatctggcagc

SEQ ID NO: 646475 - DNA, 20 bp, mouse
gtacagaagccggtgccgcg

SEQ ID NO: 646476 - DNA, 20 bp, mouse
gtgaagaggaaaggcagacg

SEQ ID NO: 646477 - DNA, 20 bp, mouse
gacgaggctgtgaagaggaa

SEQ ID NO: 646478 - DNA, 20 bp, mouse
gaaaggcagacgcggaaaag

SEQ ID NO: 646479 - DNA, 20 bp, mouse
gcctttaaggagcatgtcgt

SEQ ID NO: 646480 - DNA, 20 bp, mouse
gaactagggcaaaagcgcct

SEQ ID NO: 646481 - DNA, 20 bp, mouse
gaagctacgaggctgtgaag

SEQ ID NO: 646482 - DNA, 20 bp, mouse
gggggccacggcgcgaacta

SEQ ID NO: 646483 - DNA, 20 bp, mouse
gtcgcgccgtggccccttta

SEQ ID NO: 646484 - DNA, 20 bp, mouse
gacaggaactcgatgtgccc

SEQ ID NO: 646485 - DNA, 20 bp, mouse
gcggaagctgggagcagcgc

SEQ ID NO: 646486 - DNA, 20 bp, mouse
ggcgcagctcacagccaata

SEQ ID NO: 646487 - DNA, 20 bp, mouse
gttcaagggcggcctctcat

SEQ ID NO: 646488 - DNA, 20 bp, mouse
gtagggaccgcggccttcaa

SEQ ID NO: 646489 - DNA, 20 bp, mouse
gggaccgcggccttcaaggg

SEQ ID NO: 646490 - DNA, 20 bp, mouse
gaggccgcccttgaaggccg

SEQ ID NO: 646491 - DNA, 20 bp, mouse
gtacccaggcgaccctcacg

SEQ ID NO: 646492 - DNA, 20 bp, mouse
gcggggcagctaacaaacag

SEQ ID NO: 646493 - DNA, 20 bp, mouse
gtcacagccaatagggactg

SEQ ID NO: 646494 - DNA, 20 bp, mouse
gtcacctggcagccacgtga

SEQ ID NO: 646495 - DNA, 20 bp, mouse
gtggctgtgagctgcgcacg

SEQ ID NO: 646496 - DNA, 20 bp, mouse
gccactacctcctttctcac

SEQ ID NO: 646497 - DNA, 20 bp, mouse
ggccgtgtgcaaaattagac

SEQ ID NO: 646498 - DNA, 20 bp, mouse
gtggcaaagagaatgactca

SEQ ID NO: 646499 - DNA, 20 bp, mouse
ggagaatgactcagggtccg

SEQ ID NO: 646500 - DNA, 20 bp, mouse
ggtgggaggggcagccttta

SEQ ID NO: 646501 - DNA, 20 bp, mouse
gccagttcttgactgttaac

SEQ ID NO: 646502 - DNA, 20 bp, mouse
gtgatgggaatgggcgtgaa

SEQ ID NO: 646503 - DNA, 20 bp, mouse
gggggcagcctttaaggaca

SEQ ID NO: 646504 - DNA, 20 bp, mouse
ggagaaaggaggtagtggcg

SEQ ID NO: 646505 - DNA, 20 bp, mouse
gaaggaggagcattccaagt

SEQ ID NO: 646506 - DNA, 20 bp, mouse
ggtggcaaggggtggaacct

SEQ ID NO: 646507 - DNA, 20 bp, mouse
gcgctgaggaggcgtggcaa

SEQ ID NO: 646508 - DNA, 20 bp, mouse
gacctaggctaaggctctgt

SEQ ID NO: 646509 - DNA, 20 bp, mouse
ggcaaaaactcaccccgctg

SEQ ID NO: 646510 - DNA, 20 bp, mouse
gtcaccccgctgaggaggcg

SEQ ID NO: 646511 - DNA, 20 bp, mouse
gaaaactcaccccgctgagg

SEQ ID NO: 646512 - DNA, 20 bp, mouse
ggtgggtcttctgtgttagt

SEQ ID NO: 646513 - DNA, 20 bp, mouse
gcgagctgctgtgctaccat

SEQ ID NO: 646514 - DNA, 20 bp, mouse
gcgtgcatccgtggtggcag

SEQ ID NO: 646515 - DNA, 20 bp, mouse
gagtggtcaagaatcgtccc

SEQ ID NO: 646516 - DNA, 20 bp, mouse
gtgtgtgtatctgtacacag

SEQ ID NO: 646517 - DNA, 20 bp, mouse
gctgccttgaatataccagt

SEQ ID NO: 646518 - DNA, 20 bp, mouse
ggaccctcactggtgatcac

SEQ ID NO: 646519 - DNA, 20 bp, mouse
gccacccactggtatattca

SEQ ID NO: 646520 - DNA, 20 bp, mouse
gaacacctctagaccctcac

SEQ ID NO: 646521 - DNA, 20 bp, mouse
gtgtggttgagccacatccc

SEQ ID NO: 646522 - DNA, 20 bp, mouse
gtgcctgtgatcaccagtga

SEQ ID NO: 646523 - DNA, 20 bp, mouse
gaatataccagtgggtggcc

SEQ ID NO: 646524 - DNA, 20 bp, mouse
gggggtactaggattaaagt

SEQ ID NO: 646525 - DNA, 20 bp, mouse
gatcaccagtgagggtctag

SEQ ID NO: 646526 - DNA, 20 bp, mouse
gatgccccgggcgacctcaa

SEQ ID NO: 646527 - DNA, 20 bp, mouse
gcgcccggggcatagcctca

SEQ ID NO: 646528 - DNA, 20 bp, mouse
gtgaccgcctcggcgtgcag

SEQ ID NO: 646529 - DNA, 20 bp, mouse
gggcgtgcagcggccccttg

SEQ ID NO: 646530 - DNA, 20 bp, mouse
gtggcccttccactctaccc

SEQ ID NO: 646531 - DNA, 20 bp, mouse
gcggtcacgtcacgttttgg

SEQ ID NO: 646532 - DNA, 20 bp, mouse
gaaacgtgacgtgaccgcct

SEQ ID NO: 646533 - DNA, 20 bp, mouse
gtgggtaaaagggctaccct

SEQ ID NO: 646534 - DNA, 20 bp, mouse
gtcccatgaggctatgcccc

SEQ ID NO: 646535 - DNA, 20 bp, mouse
gtctagagtgaaataggagt

SEQ ID NO: 646536 - DNA, 20 bp, mouse
gccccggcagtggtcctctg

SEQ ID NO: 646537 - DNA, 20 bp, mouse
gccccaagagccccgatcct

SEQ ID NO: 646538 - DNA, 20 bp, mouse
gcccgcccgcgccccggcag

SEQ ID NO: 646539 - DNA, 20 bp, mouse
gggatcccgggcgctgagtt

SEQ ID NO: 646540 - DNA, 20 bp, mouse
ggactctgtccgcccaggat

SEQ ID NO: 646541 - DNA, 20 bp, mouse
gaggaccactgccggggcgc

SEQ ID NO: 646542 - DNA, 20 bp, mouse
gcttgggcgtgcgggatccc

SEQ ID NO: 646543 - DNA, 20 bp, mouse
gaaccgaggctcaaagagtc

SEQ ID NO: 646544 - DNA, 20 bp, mouse
gcaaggtcacgtggcccctt

SEQ ID NO: 646545 - DNA, 20 bp, mouse
gcgaagactcatagaggggt

SEQ ID NO: 646546 - DNA, 20 bp, mouse
gcactggctgtgcttctgat

SEQ ID NO: 646547 - DNA, 20 bp, mouse
gactggcttggctcaatctc

SEQ ID NO: 646548 - DNA, 20 bp, mouse
gtctactgctcttggaagac

SEQ ID NO: 646549 - DNA, 20 bp, mouse
gaaagagatgtgtaaacgat

SEQ ID NO: 646550 - DNA, 20 bp, mouse
gaatctcaggttctcatgtc

SEQ ID NO: 646551 - DNA, 20 bp, mouse
ggcagtagaccactcagtgt

SEQ ID NO: 646552 - DNA, 20 bp, mouse
gctgagtggtctactgctct

SEQ ID NO: 646553 - DNA, 20 bp, mouse
ggtggagggtgactgaaatt

SEQ ID NO: 646554 - DNA, 20 bp, mouse
gagtgactacactggacagg

SEQ ID NO: 646555 - DNA, 20 bp, mouse
gtcagaccaaagttgatcag

SEQ ID NO: 646556 - DNA, 20 bp, mouse
gggtgcgctgcgcgcggggt

SEQ ID NO: 646557 - DNA, 20 bp, mouse
gtggggcgaggcgggccgag

SEQ ID NO: 646558 - DNA, 20 bp, mouse
gtggctcccgccctcgcgag

SEQ ID NO: 646559 - DNA, 20 bp, mouse
ggagcccagcctggccgtcg

SEQ ID NO: 646560 - DNA, 20 bp, mouse
gcgcaccggcctccgcgcag

SEQ ID NO: 646561 - DNA, 20 bp, mouse
gaggctggagggcaaggact

SEQ ID NO: 646562 - DNA, 20 bp, mouse
ggcgcccgggagctgccctg

SEQ ID NO: 646563 - DNA, 20 bp, mouse
gcagcctgcgacaggctgga

SEQ ID NO: 646564 - DNA, 20 bp, mouse
gccgccctcgcgagcggtgg

SEQ ID NO: 646565 - DNA, 20 bp, mouse
gggggggcggtggtgggcgc

SEQ ID NO: 646566 - DNA, 20 bp, mouse
gtgggcggagacactgagat

SEQ ID NO: 646567 - DNA, 20 bp, mouse
gcgtggaaacgccgaattgg

SEQ ID NO: 646568 - DNA, 20 bp, mouse
ggggcttgatctctcttcga

SEQ ID NO: 646569 - DNA, 20 bp, mouse
gagcccagacgtcaagcgtg

SEQ ID NO: 646570 - DNA, 20 bp, mouse
gttcagggaagatacgtccc

SEQ ID NO: 646571 - DNA, 20 bp, mouse
gcctccacccggcgcccagg

SEQ ID NO: 646572 - DNA, 20 bp, mouse
gtggcaagagggagacaccg

SEQ ID NO: 646573 - DNA, 20 bp, mouse
gcgcccaggaggcggcgaca

SEQ ID NO: 646574 - DNA, 20 bp, mouse
gtggcagatagaaaggaacg

SEQ ID NO: 646575 - DNA, 20 bp, mouse
gtcgccgggcgctggcaaga

SEQ ID NO: 646576 - DNA, 20 bp, mouse
gacgatgtcgatgagcaggt

SEQ ID NO: 646577 - DNA, 20 bp, mouse
gtcgatgagcaggtgggccg

SEQ ID NO: 646578 - DNA, 20 bp, mouse
gaaggggctgggctgtatcg

SEQ ID NO: 646579 - DNA, 20 bp, mouse
gtcaggctccagaacgggaa

SEQ ID NO: 646580 - DNA, 20 bp, mouse
ggggagaaacacgaggtaac

SEQ ID NO: 646581 - DNA, 20 bp, mouse
gaacacgaggtaacggggta

SEQ ID NO: 646582 - DNA, 20 bp, mouse
ggggctgtatcgcggggaag

SEQ ID NO: 646583 - DNA, 20 bp, mouse
ggggagtcaggctccagaac

SEQ ID NO: 646584 - DNA, 20 bp, mouse
ggggccgtgggagaaacacg

SEQ ID NO: 646585 - DNA, 20 bp, mouse
gcggggtaaggggacgacaa

SEQ ID NO: 646586 - DNA, 20 bp, mouse
ggggtgccggggccaggacg

SEQ ID NO: 646587 - DNA, 20 bp, mouse
gcggctccaggcaccaggga

SEQ ID NO: 646588 - DNA, 20 bp, mouse
gctcgggcctcggctcacag

SEQ ID NO: 646589 - DNA, 20 bp, mouse
gggaccacggcatccagcga

SEQ ID NO: 646590 - DNA, 20 bp, mouse
gcccggcttgagtatgttcg

SEQ ID NO: 646591 - DNA, 20 bp, mouse
gggcggcgagcgggcgagaa

SEQ ID NO: 646592 - DNA, 20 bp, mouse
ggccgcccgcgtcctggccc

SEQ ID NO: 646593 - DNA, 20 bp, mouse
gcagcaccgtagctgaagtt

SEQ ID NO: 646594 - DNA, 20 bp, mouse
gggagcgtggcccccgcgaa

SEQ ID NO: 646595 - DNA, 20 bp, mouse
gaggggagcgggggtccctg

SEQ ID NO: 646596 - DNA, 20 bp, mouse
gcctctgggaatagagatct

SEQ ID NO: 646597 - DNA, 20 bp, mouse
gtggtggcgagataagaacg

SEQ ID NO: 646598 - DNA, 20 bp, mouse
gggcgagataagaacgggga

SEQ ID NO: 646599 - DNA, 20 bp, mouse
ggaaggggcagacgctatca

SEQ ID NO: 646600 - DNA, 20 bp, mouse
gggctcatactcacagagga

SEQ ID NO: 646601 - DNA, 20 bp, mouse
gagccagaaacaggtcctct

SEQ ID NO: 646602 - DNA, 20 bp, mouse
gatctcgccaccactaccac

SEQ ID NO: 646603 - DNA, 20 bp, mouse
gttcccagaggacctgtttc

SEQ ID NO: 646604 - DNA, 20 bp, mouse
ggagccctgtgagtccttta

SEQ ID NO: 646605 - DNA, 20 bp, mouse
gggagtcagagtgttcttga

SEQ ID NO: 646606 - DNA, 20 bp, mouse
gggcagctcccccactcctg

SEQ ID NO: 646607 - DNA, 20 bp, mouse
gggcttgcagtctggaattg

SEQ ID NO: 646608 - DNA, 20 bp, mouse
gggttgaagccgttgtcttg

SEQ ID NO: 646609 - DNA, 20 bp, mouse
gcagactgcaagccagccac

SEQ ID NO: 646610 - DNA, 20 bp, mouse
ggggctagctagctaaggct

SEQ ID NO: 646611 - DNA, 20 bp, mouse
gcgggactcgggtaagagta

SEQ ID NO: 646612 - DNA, 20 bp, mouse
gctcagttctcgctgtggtg

SEQ ID NO: 646613 - DNA, 20 bp, mouse
ggtgagggaaggggcctctc

SEQ ID NO: 646614 - DNA, 20 bp, mouse
gctctgctcagttctcgctg

SEQ ID NO: 646615 - DNA, 20 bp, mouse
gacttcctgctcggcaacag

SEQ ID NO: 646616 - DNA, 20 bp, mouse
gccggtgggtcgagcgagcg

SEQ ID NO: 646617 - DNA, 20 bp, mouse
gctcgctcgacccaccggtg

SEQ ID NO: 646618 - DNA, 20 bp, mouse
gcccccggaacccaggatgg

SEQ ID NO: 646619 - DNA, 20 bp, mouse
gggacgccccaggtcttgaa

SEQ ID NO: 646620 - DNA, 20 bp, mouse
ggcgcccgctggttcctccg

SEQ ID NO: 646621 - DNA, 20 bp, mouse
gaggtcttgaagggccgcac

SEQ ID NO: 646622 - DNA, 20 bp, mouse
gggtgcagagccaggatcgt

SEQ ID NO: 646623 - DNA, 20 bp, mouse
gtcttgaagggccgcaccgg

SEQ ID NO: 646624 - DNA, 20 bp, mouse
ggaggcacccagatctgcac

SEQ ID NO: 646625 - DNA, 20 bp, mouse
ggagcctggcagctctgcgg

SEQ ID NO: 646626 - DNA, 20 bp, mouse
gaggcctcggaagaaggcgg

SEQ ID NO: 646627 - DNA, 20 bp, mouse
gcagccaaggcctcggaaga

SEQ ID NO: 646628 - DNA, 20 bp, mouse
gcggagcagcccagggcgga

SEQ ID NO: 646629 - DNA, 20 bp, mouse
gagcctgggccgcctgctgt

SEQ ID NO: 646630 - DNA, 20 bp, mouse
ggggcgccgccctccgccct

SEQ ID NO: 646631 - DNA, 20 bp, mouse
gggtgcgcgtgtcccggacc

SEQ ID NO: 646632 - DNA, 20 bp, mouse
gccgggcgcgcgctcctagg

SEQ ID NO: 646633 - DNA, 20 bp, mouse
gggcccgcgcacgtcaccgc

SEQ ID NO: 646634 - DNA, 20 bp, mouse
gcgcgctgcggcagaggaga

SEQ ID NO: 646635 - DNA, 20 bp, mouse
ggaggcctggtgcccacagc

SEQ ID NO: 646636 - DNA, 20 bp, mouse
gactccggatcttatcatcc

SEQ ID NO: 646637 - DNA, 20 bp, mouse
gtgcggaagtcgggagtcgg

SEQ ID NO: 646638 - DNA, 20 bp, mouse
gtcagcatcctagtccctca

SEQ ID NO: 646639 - DNA, 20 bp, mouse
ggcctctgtgggagactatc

SEQ ID NO: 646640 - DNA, 20 bp, mouse
gttctctgctctgaggtctc

SEQ ID NO: 646641 - DNA, 20 bp, mouse
gtaccggatcattacgtgac

SEQ ID NO: 646642 - DNA, 20 bp, mouse
gccccagtcacgtaatgatc

SEQ ID NO: 646643 - DNA, 20 bp, mouse
gtcagagttgtcattggtgg

SEQ ID NO: 646644 - DNA, 20 bp, mouse
gtatcagaagcggatgactc

SEQ ID NO: 646645 - DNA, 20 bp, mouse
gaagaggaaaagtcagtggg

SEQ ID NO: 646646 - DNA, 20 bp, mouse
gtaggccgggggcagagatg

SEQ ID NO: 646647 - DNA, 20 bp, mouse
gccgccccccgggctctcat

SEQ ID NO: 646648 - DNA, 20 bp, mouse
gcgacagaactgggaaaggg

SEQ ID NO: 646649 - DNA, 20 bp, mouse
gctgcgacagaactgggaaa

SEQ ID NO: 646650 - DNA, 20 bp, mouse
gcctccccggcagacctcgc

SEQ ID NO: 646651 - DNA, 20 bp, mouse
gctgagttgtgccttcctca

SEQ ID NO: 646652 - DNA, 20 bp, mouse
gcaggccaatgagagcccgg

SEQ ID NO: 646653 - DNA, 20 bp, mouse
gtgccacctgagcaagtccc

SEQ ID NO: 646654 - DNA, 20 bp, mouse
gcggcctaaccccgcccccc

SEQ ID NO: 646655 - DNA, 20 bp, mouse
ggggagagggctttctctag

SEQ ID NO: 646656 - DNA, 20 bp, mouse
gccctgggaggcggagagaa

SEQ ID NO: 646657 - DNA, 20 bp, mouse
ggccgcacccagcttggcgg

SEQ ID NO: 646658 - DNA, 20 bp, mouse
ggtagggcgttcagaccaat

SEQ ID NO: 646659 - DNA, 20 bp, mouse
gcggagagaagggtagactc

SEQ ID NO: 646660 - DNA, 20 bp, mouse
gcaacaatgcacagccccat

SEQ ID NO: 646661 - DNA, 20 bp, mouse
gaaggggcaggcccggagaa

SEQ ID NO: 646662 - DNA, 20 bp, mouse
gagagagtagtgctggacgg

SEQ ID NO: 646663 - DNA, 20 bp, mouse
gaacagagagtagtgctgga

SEQ ID NO: 646664 - DNA, 20 bp, mouse
gcagcactactctctgttat

SEQ ID NO: 646665 - DNA, 20 bp, mouse
ggctgaaggcggtgtcacag

SEQ ID NO: 646666 - DNA, 20 bp, mouse
gggaagaatgaagaatcatg

SEQ ID NO: 646667 - DNA, 20 bp, mouse
gtactcaggtgcatgcaagg

SEQ ID NO: 646668 - DNA, 20 bp, mouse
gcagataaaggcaggatcgt

SEQ ID NO: 646669 - DNA, 20 bp, mouse
gctgctgttacccagaatag

SEQ ID NO: 646670 - DNA, 20 bp, mouse
gcacctgagtactgatttct

SEQ ID NO: 646671 - DNA, 20 bp, mouse
gtattacgtgagatggaaca

SEQ ID NO: 646672 - DNA, 20 bp, mouse
ggctcaggacctcacacccg

SEQ ID NO: 646673 - DNA, 20 bp, mouse
gtctctagaagagcactctc

SEQ ID NO: 646674 - DNA, 20 bp, mouse
ggaagagcttccggccagca

SEQ ID NO: 646675 - DNA, 20 bp, mouse
gtaactgcccacccctattc

SEQ ID NO: 646676 - DNA, 20 bp, mouse
gtgaagctggggtactagaa

SEQ ID NO: 646677 - DNA, 20 bp, mouse
gtaccacaggccacgcctca

SEQ ID NO: 646678 - DNA, 20 bp, mouse
ggaagggtcaagcctgtaga

SEQ ID NO: 646679 - DNA, 20 bp, mouse
ggggtcaagcctgtagaggg

SEQ ID NO: 646680 - DNA, 20 bp, mouse
gaggcgtggcctgtggtagg

SEQ ID NO: 646681 - DNA, 20 bp, mouse
gaggcggggccaaggcgttc

SEQ ID NO: 646682 - DNA, 20 bp, mouse
gcccacaggcctgaacgcct

SEQ ID NO: 646683 - DNA, 20 bp, mouse
gggcggaatcaagagccctg

SEQ ID NO: 646684 - DNA, 20 bp, mouse
gcccgtactgggcggagtga

SEQ ID NO: 646685 - DNA, 20 bp, mouse
gaggcggggctagagctctc

SEQ ID NO: 646686 - DNA, 20 bp, mouse
gaggcgctggcttagaagag

SEQ ID NO: 646687 - DNA, 20 bp, mouse
ggtacagctgtgggaggtca

SEQ ID NO: 646688 - DNA, 20 bp, mouse
ggggaggggagaggaagatc

SEQ ID NO: 646689 - DNA, 20 bp, mouse
gtgatgaagcaacagtggag

SEQ ID NO: 646690 - DNA, 20 bp, mouse
gagcaaaacagtacagctgt

SEQ ID NO: 646691 - DNA, 20 bp, mouse
gcatcagatgtaaagggcgg

SEQ ID NO: 646692 - DNA, 20 bp, mouse
gcacggttgccgtgaggcgc

SEQ ID NO: 646693 - DNA, 20 bp, mouse
ggttgcttcatcagatgtaa

SEQ ID NO: 646694 - DNA, 20 bp, mouse
gatgtaaagggcgggggggt

SEQ ID NO: 646695 - DNA, 20 bp, mouse
ggtcaaggttaaaattaact

SEQ ID NO: 646696 - DNA, 20 bp, mouse
gcaaccggaaggctcctccc

SEQ ID NO: 646697 - DNA, 20 bp, mouse
gtggcctgggaggagccttc

SEQ ID NO: 646698 - DNA, 20 bp, mouse
gtgggaaggagctgtgatgc

SEQ ID NO: 646699 - DNA, 20 bp, mouse
gcagctttagagttggtgtc

SEQ ID NO: 646700 - DNA, 20 bp, mouse
gtcggctaagagaacactcg

SEQ ID NO: 646701 - DNA, 20 bp, mouse
ggcgagttctgacaaccgga

SEQ ID NO: 646702 - DNA, 20 bp, mouse
gggcagcgagttctgacaac

SEQ ID NO: 646703 - DNA, 20 bp, mouse
gttaaaaaaacgctggacag

SEQ ID NO: 646704 - DNA, 20 bp, mouse
gatgaaggaactgctatgtt

SEQ ID NO: 646705 - DNA, 20 bp, mouse
gtcctggcaacagcagacgc

SEQ ID NO: 646706 - DNA, 20 bp, mouse
gagtggacggagatctcgac

SEQ ID NO: 646707 - DNA, 20 bp, mouse
ggctctggacgagtgctgtt

SEQ ID NO: 646708 - DNA, 20 bp, mouse
gtatcaagaaaatcgtgctc

SEQ ID NO: 646709 - DNA, 20 bp, mouse
gctgaagggtgtgtcgtaaa

SEQ ID NO: 646710 - DNA, 20 bp, mouse
gaaagggccagatcacgtgt

SEQ ID NO: 646711 - DNA, 20 bp, mouse
gctgaaacttccagtccatg

SEQ ID NO: 646712 - DNA, 20 bp, mouse
ggactgagtgcagctgagaa

SEQ ID NO: 646713 - DNA, 20 bp, mouse
gctccatactacacacccca

SEQ ID NO: 646714 - DNA, 20 bp, mouse
ggtccatggggtgtgtagta

SEQ ID NO: 646715 - DNA, 20 bp, mouse
gtgagagcctgtggagagta

SEQ ID NO: 646716 - DNA, 20 bp, mouse
gagggtgtaaaacaggagaa

SEQ ID NO: 646717 - DNA, 20 bp, mouse
gaaaaaatctggtggcagct

SEQ ID NO: 646718 - DNA, 20 bp, mouse
gcatgcaggaatacatggaa

SEQ ID NO: 646719 - DNA, 20 bp, mouse
ggagggacattccagaatga

SEQ ID NO: 646720 - DNA, 20 bp, mouse
gaaggtcatctccatcattc

SEQ ID NO: 646721 - DNA, 20 bp, mouse
gagaaccatgcaggaataca

SEQ ID NO: 646722 - DNA, 20 bp, mouse
gttgatgggaaagcacaaat

SEQ ID NO: 646723 - DNA, 20 bp, mouse
gcaaaattaaactatttgat

SEQ ID NO: 646724 - DNA, 20 bp, mouse
gctgggagtgatgagtttgt

SEQ ID NO: 646725 - DNA, 20 bp, mouse
gtgtaaaacaggagaatggg

SEQ ID NO: 646726 - DNA, 20 bp, mouse
gggcgggcctaataccggaa

SEQ ID NO: 646727 - DNA, 20 bp, mouse
gggaggaggtggctgtgcgt

SEQ ID NO: 646728 - DNA, 20 bp, mouse
ggggcctaataccggaaggg

SEQ ID NO: 646729 - DNA, 20 bp, mouse
ggccccgcccttccggtatt

SEQ ID NO: 646730 - DNA, 20 bp, mouse
ggtaggcggggcgtacgtga

SEQ ID NO: 646731 - DNA, 20 bp, mouse
gagcgcagtagccgaaactc

SEQ ID NO: 646732 - DNA, 20 bp, mouse
gtacgccccgcctacatcga

SEQ ID NO: 646733 - DNA, 20 bp, mouse
gtgggaggcgggcctaatac

SEQ ID NO: 646734 - DNA, 20 bp, mouse
ggcggggcgtacgtgagggc

SEQ ID NO: 646735 - DNA, 20 bp, mouse
ggggcgtacgtgagggcggg

SEQ ID NO: 646736 - DNA, 20 bp, mouse
gggtggcagctgagagtgat

SEQ ID NO: 646737 - DNA, 20 bp, mouse
gagggtgtaaaacaagaatg

SEQ ID NO: 646738 - DNA, 20 bp, mouse
ggaactaagtgggggataca

SEQ ID NO: 646739 - DNA, 20 bp, mouse
gctaagtgggggatacaggg

SEQ ID NO: 646740 - DNA, 20 bp, mouse
gaaggtcatttcagttgttc

SEQ ID NO: 646741 - DNA, 20 bp, mouse
gcaaaattaaactattcatt

SEQ ID NO: 646742 - DNA, 20 bp, mouse
gaatttccttgcacatttgt

SEQ ID NO: 646743 - DNA, 20 bp, mouse
gtcaacaaacagaactaagt

SEQ ID NO: 646744 - DNA, 20 bp, mouse
gactctcagctgccaccaag

SEQ ID NO: 646745 - DNA, 20 bp, mouse
gaaaacaagaatggggacag

SEQ ID NO: 646746 - DNA, 20 bp, mouse
gtaccagaagggcaagtgga

SEQ ID NO: 646747 - DNA, 20 bp, mouse
gtatgaggggacagaagacc

SEQ ID NO: 646748 - DNA, 20 bp, mouse
gaggaatgaaagatcagcta

SEQ ID NO: 646749 - DNA, 20 bp, mouse
ggagtgacagccatggtatg

SEQ ID NO: 646750 - DNA, 20 bp, mouse
ggggcagagtcagcctgaag

SEQ ID NO: 646751 - DNA, 20 bp, mouse
gagaggaggcggaggcaatg

SEQ ID NO: 646752 - DNA, 20 bp, mouse
ggatcagctaaggacaataa

SEQ ID NO: 646753 - DNA, 20 bp, mouse
gtggggctaagagacactgc

SEQ ID NO: 646754 - DNA, 20 bp, mouse
gcagctaaggacaataaagg

SEQ ID NO: 646755 - DNA, 20 bp, mouse
ggcccttccagaaaccctgt

SEQ ID NO: 646756 - DNA, 20 bp, mouse
gtctactgcctctaccctaa

SEQ ID NO: 646757 - DNA, 20 bp, mouse
gctcacagaagttgccctta

SEQ ID NO: 646758 - DNA, 20 bp, mouse
gttatggggaaagtcatgac

SEQ ID NO: 646759 - DNA, 20 bp, mouse
gccaaaccctgtgtgaggaa

SEQ ID NO: 646760 - DNA, 20 bp, mouse
gagaagcattctcgacattc

SEQ ID NO: 646761 - DNA, 20 bp, mouse
ggaagttgcccttagggtag

SEQ ID NO: 646762 - DNA, 20 bp, mouse
gaaaaccccagacattatca

SEQ ID NO: 646763 - DNA, 20 bp, mouse
gacaaccctgataatgtctg

SEQ ID NO: 646764 - DNA, 20 bp, mouse
gttctcgacattccggaaga

SEQ ID NO: 646765 - DNA, 20 bp, mouse
gttgtgccaaaccctgtgtg

SEQ ID NO: 646766 - DNA, 20 bp, mouse
gcaccctcctgcaagtcaag

SEQ ID NO: 646767 - DNA, 20 bp, mouse
ggggtggagcttcttgggtt

SEQ ID NO: 646768 - DNA, 20 bp, mouse
gcaccacttgacttgcagga

SEQ ID NO: 646769 - DNA, 20 bp, mouse
gagaacagcttgcacgtaga

SEQ ID NO: 646770 - DNA, 20 bp, mouse
gttgggttgggaaaattcta

SEQ ID NO: 646771 - DNA, 20 bp, mouse
gataatcaagtctactatga

SEQ ID NO: 646772 - DNA, 20 bp, mouse
gacgtgcaagctgttctgtc

SEQ ID NO: 646773 - DNA, 20 bp, mouse
gcaatgcactctgtatcaat

SEQ ID NO: 646774 - DNA, 20 bp, mouse
gctctaaaataaaatgggta

SEQ ID NO: 646775 - DNA, 20 bp, mouse
gaagctatatcgagtgcaaa

SEQ ID NO: 646776 - DNA, 20 bp, mouse
gaaactctgaaatgtctcaa

SEQ ID NO: 646777 - DNA, 20 bp, mouse
ggaccggattggctgttagt

SEQ ID NO: 646778 - DNA, 20 bp, mouse
gcagtcttagctcatttctc

SEQ ID NO: 646779 - DNA, 20 bp, mouse
gaatgagctaagactgggtc

SEQ ID NO: 646780 - DNA, 20 bp, mouse
gagtccagcagcgaccggat

SEQ ID NO: 646781 - DNA, 20 bp, mouse
ggtggagtaggcggcgaaca

SEQ ID NO: 646782 - DNA, 20 bp, mouse
ggtcgctgctggactccagg

SEQ ID NO: 646783 - DNA, 20 bp, mouse
ggaggcagaagttttcctcc

SEQ ID NO: 646784 - DNA, 20 bp, mouse
ggatacttagaactataaac

SEQ ID NO: 646785 - DNA, 20 bp, mouse
gtcaggtgaccttgcattgg

SEQ ID NO: 646786 - DNA, 20 bp, mouse
gcggtggtgggcggggtgta

SEQ ID NO: 646787 - DNA, 20 bp, mouse
ggtagggcggagttgtcggg

SEQ ID NO: 646788 - DNA, 20 bp, mouse
gagacacataactgccgagg

SEQ ID NO: 646789 - DNA, 20 bp, mouse
gaccccgcccaccaccgttg

SEQ ID NO: 646790 - DNA, 20 bp, mouse
gatgccaccaccttctccag

SEQ ID NO: 646791 - DNA, 20 bp, mouse
gataactgccgaggaggctg

SEQ ID NO: 646792 - DNA, 20 bp, mouse
gggtagacacataactgccg

SEQ ID NO: 646793 - DNA, 20 bp, mouse
gcgggagggcgtgaccgctc

SEQ ID NO: 646794 - DNA, 20 bp, mouse
ggggtgtagggcggagttgt

SEQ ID NO: 646795 - DNA, 20 bp, mouse
gagccccaacggtggtgggc

SEQ ID NO: 646796 - DNA, 20 bp, mouse
gcagccctggctatccttct

SEQ ID NO: 646797 - DNA, 20 bp, mouse
gcatgagcccagtgactcct

SEQ ID NO: 646798 - DNA, 20 bp, mouse
gggctggctgaaagacactc

SEQ ID NO: 646799 - DNA, 20 bp, mouse
gcagagagagcctacagggg

SEQ ID NO: 646800 - DNA, 20 bp, mouse
gagtacgaaagtgccttata

SEQ ID NO: 646801 - DNA, 20 bp, mouse
gcgtactcatggttacactg

SEQ ID NO: 646802 - DNA, 20 bp, mouse
gaggaagtcacagtgtcctc

SEQ ID NO: 646803 - DNA, 20 bp, mouse
gcagacttgcactgttgtga

SEQ ID NO: 646804 - DNA, 20 bp, mouse
gtctttcataagaaggtcaa

SEQ ID NO: 646805 - DNA, 20 bp, mouse
gctatccttcttggaagctt

SEQ ID NO: 646806 - DNA, 20 bp, mouse
gacccaagctggattaaacc

SEQ ID NO: 646807 - DNA, 20 bp, mouse
ggagcaaggggcccactcat

SEQ ID NO: 646808 - DNA, 20 bp, mouse
gctctaccagagcaagagat

SEQ ID NO: 646809 - DNA, 20 bp, mouse
gaaggccaatagccaatgag

SEQ ID NO: 646810 - DNA, 20 bp, mouse
ggggcccactcattggctat

SEQ ID NO: 646811 - DNA, 20 bp, mouse
gtggccaggtctcattagtc

SEQ ID NO: 646812 - DNA, 20 bp, mouse
ggcttgacagaagctctact

SEQ ID NO: 646813 - DNA, 20 bp, mouse
ggattaaaccaggttcccta

SEQ ID NO: 646814 - DNA, 20 bp, mouse
ggcagaccccagcttaccat

SEQ ID NO: 646815 - DNA, 20 bp, mouse
gatggccaaagcctggaaac

SEQ ID NO: 646816 - DNA, 20 bp, mouse
gccagcgattggtcagatca

SEQ ID NO: 646817 - DNA, 20 bp, mouse
gtcccagcttggccctacac

SEQ ID NO: 646818 - DNA, 20 bp, mouse
gaaaagcgaggccgtggggt

SEQ ID NO: 646819 - DNA, 20 bp, mouse
gccctacacgcgcccgtcgt

SEQ ID NO: 646820 - DNA, 20 bp, mouse
gcgggcgcgtgtaggggagt

SEQ ID NO: 646821 - DNA, 20 bp, mouse
gggaatgcctggatcggagc

SEQ ID NO: 646822 - DNA, 20 bp, mouse
gcccacccccgggacactta

SEQ ID NO: 646823 - DNA, 20 bp, mouse
ggggcagggcgctgaggatc

SEQ ID NO: 646824 - DNA, 20 bp, mouse
gcctgcgcgtgccaatcatc

SEQ ID NO: 646825 - DNA, 20 bp, mouse
gcgccctgcccgcgccggaa

SEQ ID NO: 646826 - DNA, 20 bp, mouse
ggaacggcctaggacggcta

SEQ ID NO: 646827 - DNA, 20 bp, mouse
gctattgagccaggggacga

SEQ ID NO: 646828 - DNA, 20 bp, mouse
gagggcgtgctgaaaacact

SEQ ID NO: 646829 - DNA, 20 bp, mouse
ggaggcaggtgctacgtgaa

SEQ ID NO: 646830 - DNA, 20 bp, mouse
ggggaaagtaataacgaagt

SEQ ID NO: 646831 - DNA, 20 bp, mouse
gttgtagccccaatagggaa

SEQ ID NO: 646832 - DNA, 20 bp, mouse
ggttacttgtagccccaata

SEQ ID NO: 646833 - DNA, 20 bp, mouse
gctacgtgaacggcctagga

SEQ ID NO: 646834 - DNA, 20 bp, mouse
gtggaaacccttccctattg

SEQ ID NO: 646835 - DNA, 20 bp, mouse
gacactcccaacagtgggcg

SEQ ID NO: 646836 - DNA, 20 bp, mouse
gcagccgcgctggcctaaac

SEQ ID NO: 646837 - DNA, 20 bp, mouse
ggcttccaaagcctcccgag

SEQ ID NO: 646838 - DNA, 20 bp, mouse
gaagctgggtgagcgttccg

SEQ ID NO: 646839 - DNA, 20 bp, mouse
gtggaagcgtgatgcatctt

SEQ ID NO: 646840 - DNA, 20 bp, mouse
gaaaccggaagcctcccctc

SEQ ID NO: 646841 - DNA, 20 bp, mouse
ggacgcgcatcgcacgaggc

SEQ ID NO: 646842 - DNA, 20 bp, mouse
gcctcccgaggggaggcttc

SEQ ID NO: 646843 - DNA, 20 bp, mouse
ggcacggggtgtggtcttac

SEQ ID NO: 646844 - DNA, 20 bp, mouse
gtccaaagcctcccgagggg

SEQ ID NO: 646845 - DNA, 20 bp, mouse
ggcctcccctcgggaggctt

SEQ ID NO: 646846 - DNA, 20 bp, mouse
gcgctgtagcgccgccccca

SEQ ID NO: 646847 - DNA, 20 bp, mouse
gccccgcgggcagcgagcct

SEQ ID NO: 646848 - DNA, 20 bp, mouse
gggctcgctggggctcggtc

SEQ ID NO: 646849 - DNA, 20 bp, mouse
gcccgcgcgcggggtgtgta

SEQ ID NO: 646850 - DNA, 20 bp, mouse
gccgggagggcaaggggagg

SEQ ID NO: 646851 - DNA, 20 bp, mouse
ggggccgggagggcaagggg

SEQ ID NO: 646852 - DNA, 20 bp, mouse
gccggccccccagggcaata

SEQ ID NO: 646853 - DNA, 20 bp, mouse
gcggcgctacagcggaccga

SEQ ID NO: 646854 - DNA, 20 bp, mouse
gcgctacagcggaccgacgg

SEQ ID NO: 646855 - DNA, 20 bp, mouse
ggctgcccgcggggctcgct

SEQ ID NO: 646856 - DNA, 20 bp, mouse
gtactcaggggctgaaggaa

SEQ ID NO: 646857 - DNA, 20 bp, mouse
gcggaacggcgttcagtgag

SEQ ID NO: 646858 - DNA, 20 bp, mouse
gcccaaacggagttaggctg

SEQ ID NO: 646859 - DNA, 20 bp, mouse
ggcggggcttagtggaaagg

SEQ ID NO: 646860 - DNA, 20 bp, mouse
gacctcgattactacggtaa

SEQ ID NO: 646861 - DNA, 20 bp, mouse
ggctctacgcgcttccctac

SEQ ID NO: 646862 - DNA, 20 bp, mouse
gaggggctgaaggaacgggg

SEQ ID NO: 646863 - DNA, 20 bp, mouse
gcgcgtagagccaatggtta

SEQ ID NO: 646864 - DNA, 20 bp, mouse
ggactctagtccataaccat

SEQ ID NO: 646865 - DNA, 20 bp, mouse
gagggaccccaaacggagtt

SEQ ID NO: 646866 - DNA, 20 bp, mouse
gaggggtaagaggtcccctg

SEQ ID NO: 646867 - DNA, 20 bp, mouse
gtgccctgcagcttgcctgt

SEQ ID NO: 646868 - DNA, 20 bp, mouse
gggaaccagaacaactcggg

SEQ ID NO: 646869 - DNA, 20 bp, mouse
gtatggggggtaggggtaag

SEQ ID NO: 646870 - DNA, 20 bp, mouse
gaggggaaccagaacaactc

SEQ ID NO: 646871 - DNA, 20 bp, mouse
ggaagcaagcacgctggaga

SEQ ID NO: 646872 - DNA, 20 bp, mouse
gccagtctaatctctcagag

SEQ ID NO: 646873 - DNA, 20 bp, mouse
ggcagcttgcctgtgggtat

SEQ ID NO: 646874 - DNA, 20 bp, mouse
gaagctcagatcagcactct

SEQ ID NO: 646875 - DNA, 20 bp, mouse
ggcgctcaggggcggacggt

SEQ ID NO: 646876 - DNA, 20 bp, mouse
gtcaaggggcccatccttgc

SEQ ID NO: 646877 - DNA, 20 bp, mouse
ggagcgtcctccacccgggt

SEQ ID NO: 646878 - DNA, 20 bp, mouse
gccacaggaggtcacttcaa

SEQ ID NO: 646879 - DNA, 20 bp, mouse
gcagaaggtaccaggagtga

SEQ ID NO: 646880 - DNA, 20 bp, mouse
gagctgaccagaaaccccgt

SEQ ID NO: 646881 - DNA, 20 bp, mouse
ggggcggagcgtcctccacc

SEQ ID NO: 646882 - DNA, 20 bp, mouse
gggcccagacgctgatgggg

SEQ ID NO: 646883 - DNA, 20 bp, mouse
gaaggtagggagttgtgctc

SEQ ID NO: 646884 - DNA, 20 bp, mouse
ggggctactgccctcactcc

SEQ ID NO: 646885 - DNA, 20 bp, mouse
gaaagcagtagagccacagg

SEQ ID NO: 646886 - DNA, 20 bp, mouse
ggggaagggacttccgtttc

SEQ ID NO: 646887 - DNA, 20 bp, mouse
gccggggaagccgtcacgat

SEQ ID NO: 646888 - DNA, 20 bp, mouse
gggacccggagcggacgctc

SEQ ID NO: 646889 - DNA, 20 bp, mouse
gaaggcagctacgtcctccg

SEQ ID NO: 646890 - DNA, 20 bp, mouse
gccccgggccgcgctgtcgc

SEQ ID NO: 646891 - DNA, 20 bp, mouse
ggacgtcccagtgtggtccc

SEQ ID NO: 646892 - DNA, 20 bp, mouse
gcggcggcggtgctcgtggt

SEQ ID NO: 646893 - DNA, 20 bp, mouse
ggtaccaaatctcggagcat

SEQ ID NO: 646894 - DNA, 20 bp, mouse
gcgtcacgattggcttgaaa

SEQ ID NO: 646895 - DNA, 20 bp, mouse
gacgaatgggtttttatccg

SEQ ID NO: 646896 - DNA, 20 bp, mouse
ggaccgaagagctctccctt

SEQ ID NO: 646897 - DNA, 20 bp, mouse
gctcggcgacccccccccaa

SEQ ID NO: 646898 - DNA, 20 bp, mouse
ggggggggggtcgccgagta

SEQ ID NO: 646899 - DNA, 20 bp, mouse
ggcagtgcggccattatcca

SEQ ID NO: 646900 - DNA, 20 bp, mouse
ggggagagctcttcggtcct

SEQ ID NO: 646901 - DNA, 20 bp, mouse
gagctctcgcgagaacgtgg

SEQ ID NO: 646902 - DNA, 20 bp, mouse
gtcgccgagtagggggtcca

SEQ ID NO: 646903 - DNA, 20 bp, mouse
ggccccccccagcctctcct

SEQ ID NO: 646904 - DNA, 20 bp, mouse
gcggcgctgcggtcagagga

SEQ ID NO: 646905 - DNA, 20 bp, mouse
ggcgcctcctagtggggcaa

SEQ ID NO: 646906 - DNA, 20 bp, mouse
gcaggcctcgaggctgtgga

SEQ ID NO: 646907 - DNA, 20 bp, mouse
ggggcccgggaaaagagccc

SEQ ID NO: 646908 - DNA, 20 bp, mouse
gcgaaggctctagacccagg

SEQ ID NO: 646909 - DNA, 20 bp, mouse
gctagacccagggggtccag

SEQ ID NO: 646910 - DNA, 20 bp, mouse
gctggagcccccaggcctcg

SEQ ID NO: 646911 - DNA, 20 bp, mouse
ggtgtgcctggggaccccct

SEQ ID NO: 646912 - DNA, 20 bp, mouse
gtcgagagcttgcccagagg

SEQ ID NO: 646913 - DNA, 20 bp, mouse
gaatgggtgtagagtgtgcc

SEQ ID NO: 646914 - DNA, 20 bp, mouse
gctctcgagagcttgcccag

SEQ ID NO: 646915 - DNA, 20 bp, mouse
gaccccctgggctcttttcc

SEQ ID NO: 646916 - DNA, 20 bp, mouse
gcgcgcccggctgtagtcgt

SEQ ID NO: 646917 - DNA, 20 bp, mouse
gcggctgtagtcgttggtgt

SEQ ID NO: 646918 - DNA, 20 bp, mouse
gaacgcgtcctgcggagcag

SEQ ID NO: 646919 - DNA, 20 bp, mouse
ggggcctgctgggtcactcg

SEQ ID NO: 646920 - DNA, 20 bp, mouse
gtacccgcactcacgctccg

SEQ ID NO: 646921 - DNA, 20 bp, mouse
gcctagggagcaagggtcaa

SEQ ID NO: 646922 - DNA, 20 bp, mouse
ggggccccggagcgtgagtg

SEQ ID NO: 646923 - DNA, 20 bp, mouse
gcccgcgccagcgcctgtct

SEQ ID NO: 646924 - DNA, 20 bp, mouse
gcacgctccggggcccagac

SEQ ID NO: 646925 - DNA, 20 bp, mouse
gttggtgtgggccgcgtgaa

SEQ ID NO: 646926 - DNA, 20 bp, mouse
gcaccagcggcgtcccaggt

SEQ ID NO: 646927 - DNA, 20 bp, mouse
gggtggacccgccaggtcct

SEQ ID NO: 646928 - DNA, 20 bp, mouse
gcgtgcgcgcacgcggggaa

SEQ ID NO: 646929 - DNA, 20 bp, mouse
ggatggcaggcgtgattctg

SEQ ID NO: 646930 - DNA, 20 bp, mouse
gaggagacggagggcgacga

SEQ ID NO: 646931 - DNA, 20 bp, mouse
ggggtaggggaggagacgga

SEQ ID NO: 646932 - DNA, 20 bp, mouse
gactaagcccaggacctggc

SEQ ID NO: 646933 - DNA, 20 bp, mouse
gaaaacgtgagcgtctcgaa

SEQ ID NO: 646934 - DNA, 20 bp, mouse
gacgcctgccatccagtccc

SEQ ID NO: 646935 - DNA, 20 bp, mouse
gagcggcgtcccaggtgggt

SEQ ID NO: 646936 - DNA, 20 bp, mouse
gaaccaggggaaactgtctc

SEQ ID NO: 646937 - DNA, 20 bp, mouse
ggcgccccacccctctccgg

SEQ ID NO: 646938 - DNA, 20 bp, mouse
gtggaagggcgaggtggtga

SEQ ID NO: 646939 - DNA, 20 bp, mouse
gcccagccccggcctagggt

SEQ ID NO: 646940 - DNA, 20 bp, mouse
gggagtggcgctggaggagg

SEQ ID NO: 646941 - DNA, 20 bp, mouse
gacctgaagcgcccacgttg

SEQ ID NO: 646942 - DNA, 20 bp, mouse
gcacacccgaccctaggccg

SEQ ID NO: 646943 - DNA, 20 bp, mouse
gaggaggcggtcaggacgcg

SEQ ID NO: 646944 - DNA, 20 bp, mouse
gtggggcgccaaggcttcat

SEQ ID NO: 646945 - DNA, 20 bp, mouse
gggagccaccggagaggggt

SEQ ID NO: 646946 - DNA, 20 bp, mouse
gcctgagctcggggaaggat

SEQ ID NO: 646947 - DNA, 20 bp, mouse
gtcccgcccgagggaaattc

SEQ ID NO: 646948 - DNA, 20 bp, mouse
ggggaagtggtgaagcttcg

SEQ ID NO: 646949 - DNA, 20 bp, mouse
ggccccgccagggtgctcgc

SEQ ID NO: 646950 - DNA, 20 bp, mouse
gcagctggagcaaggaccct

SEQ ID NO: 646951 - DNA, 20 bp, mouse
ggggttcccgaatttccctc

SEQ ID NO: 646952 - DNA, 20 bp, mouse
ggcgggagagggacacattc

SEQ ID NO: 646953 - DNA, 20 bp, mouse
gaagcccgggcccggacctg

SEQ ID NO: 646954 - DNA, 20 bp, mouse
gcggagaatgcagcactgag

SEQ ID NO: 646955 - DNA, 20 bp, mouse
ggcagcggagaccacgggat

SEQ ID NO: 646956 - DNA, 20 bp, mouse
gtagcagcccgcatcaccgg

SEQ ID NO: 646957 - DNA, 20 bp, mouse
gcggtgctacatggactttt

SEQ ID NO: 646958 - DNA, 20 bp, mouse
gacatagcagcccgcatcac

SEQ ID NO: 646959 - DNA, 20 bp, mouse
gaaggaagacatgtctgatt

SEQ ID NO: 646960 - DNA, 20 bp, mouse
gaggcatcctccggtgatgc

SEQ ID NO: 646961 - DNA, 20 bp, mouse
gttaaaaactggcataataa

SEQ ID NO: 646962 - DNA, 20 bp, mouse
gtttgctgtaagaggcttca

SEQ ID NO: 646963 - DNA, 20 bp, mouse
ggaggcttcacggtgctaca

SEQ ID NO: 646964 - DNA, 20 bp, mouse
gtaggccttttgtgatgact

SEQ ID NO: 646965 - DNA, 20 bp, mouse
gtcacagagcaggcttttaa

SEQ ID NO: 646966 - DNA, 20 bp, mouse
gctggaggcgggacgacgac

SEQ ID NO: 646967 - DNA, 20 bp, mouse
gacgacagggctggcgttgg

SEQ ID NO: 646968 - DNA, 20 bp, mouse
gccagttatgggtggagcta

SEQ ID NO: 646969 - DNA, 20 bp, mouse
gacaggctcttcctcccgat

SEQ ID NO: 646970 - DNA, 20 bp, mouse
gcacgcgcccagctgggagg

SEQ ID NO: 646971 - DNA, 20 bp, mouse
ggggaagacgtgtacggatt

SEQ ID NO: 646972 - DNA, 20 bp, mouse
gttatgggtggagctatggg

SEQ ID NO: 646973 - DNA, 20 bp, mouse
gaatatcgggaagacgtgta

SEQ ID NO: 646974 - DNA, 20 bp, mouse
gccgatgggcggagctacga

SEQ ID NO: 646975 - DNA, 20 bp, mouse
gaggaggcgcgagccgagaa

SEQ ID NO: 646976 - DNA, 20 bp, mouse
gaagccttgcgcatcagctc

SEQ ID NO: 646977 - DNA, 20 bp, mouse
gccaccgcccagagcggctt

SEQ ID NO: 646978 - DNA, 20 bp, mouse
gggccggacaccactccact

SEQ ID NO: 646979 - DNA, 20 bp, mouse
gaaggaggaaggggcggtgc

SEQ ID NO: 646980 - DNA, 20 bp, mouse
ggcgctgcgtgtgggccgag

SEQ ID NO: 646981 - DNA, 20 bp, mouse
ggagcccaagccgctctggg

SEQ ID NO: 646982 - DNA, 20 bp, mouse
ggtcctccgcactggacgga

SEQ ID NO: 646983 - DNA, 20 bp, mouse
gaaccacggctgaacggact

SEQ ID NO: 646984 - DNA, 20 bp, mouse
ggttcccgagctgatgcgca

SEQ ID NO: 646985 - DNA, 20 bp, mouse
ggctctgggcggtgggtacc

SEQ ID NO: 646986 - DNA, 20 bp, mouse
gacagagtagcacagctcac

SEQ ID NO: 646987 - DNA, 20 bp, mouse
ggagctggctgggtgtacac

SEQ ID NO: 646988 - DNA, 20 bp, mouse
ggagcagatggtcaaggaac

SEQ ID NO: 646989 - DNA, 20 bp, mouse
gcaccacgtgggagctgttt

SEQ ID NO: 646990 - DNA, 20 bp, mouse
ggagcagtatgttctcattg

SEQ ID NO: 646991 - DNA, 20 bp, mouse
gggtggcaccaatgagataa

SEQ ID NO: 646992 - DNA, 20 bp, mouse
ggtcccaaacagctcccacg

SEQ ID NO: 646993 - DNA, 20 bp, mouse
ggatggtcaaggaaccggga

SEQ ID NO: 646994 - DNA, 20 bp, mouse
gcacgctggctctccagcaa

SEQ ID NO: 646995 - DNA, 20 bp, mouse
gggagctgtttgggacacgc

SEQ ID NO: 646996 - DNA, 20 bp, mouse
gaagcgtgcgagtacttatg

SEQ ID NO: 646997 - DNA, 20 bp, mouse
ggcgctgtggggtaggacgt

SEQ ID NO: 646998 - DNA, 20 bp, mouse
gaccccacagcgccactcaa

SEQ ID NO: 646999 - DNA, 20 bp, mouse
ggagactccgggccacaagg

SEQ ID NO: 647000 - DNA, 20 bp, mouse
gggcagcagtggctttgagt

SEQ ID NO: 647001 - DNA, 20 bp, mouse
ggtaaatggcaccacaaatg

SEQ ID NO: 647002 - DNA, 20 bp, mouse
ggagactcccagccgttgag

SEQ ID NO: 647003 - DNA, 20 bp, mouse
gaggacgtaggctgagactc

SEQ ID NO: 647004 - DNA, 20 bp, mouse
gggtcctccgcgggatttta

SEQ ID NO: 647005 - DNA, 20 bp, mouse
ggctccctaaaatcccgcgg

SEQ ID NO: 647006 - DNA, 20 bp, mouse
gcctgagcccatggccgcga

SEQ ID NO: 647007 - DNA, 20 bp, mouse
ggggccggtccggagcccaa

SEQ ID NO: 647008 - DNA, 20 bp, mouse
gggtggcggcccagcgctga

SEQ ID NO: 647009 - DNA, 20 bp, mouse
gagcccaagggcggtcaagc

SEQ ID NO: 647010 - DNA, 20 bp, mouse
gtgtacgcgccgcagtggtg

SEQ ID NO: 647011 - DNA, 20 bp, mouse
ggcggagaggccgagaccgg

SEQ ID NO: 647012 - DNA, 20 bp, mouse
gccggtccggagcccaaggg

SEQ ID NO: 647013 - DNA, 20 bp, mouse
gaggtggcccaaaggaggcg

SEQ ID NO: 647014 - DNA, 20 bp, mouse
gcgccacatccctgagccca

SEQ ID NO: 647015 - DNA, 20 bp, mouse
ggctcagggatgtggcggag

SEQ ID NO: 647016 - DNA, 20 bp, mouse
ggggaagtagagatcgaaat

SEQ ID NO: 647017 - DNA, 20 bp, mouse
gcgaaatgggacagagaaac

SEQ ID NO: 647018 - DNA, 20 bp, mouse
ggatcagtatcaagcgtgga

SEQ ID NO: 647019 - DNA, 20 bp, mouse
gagggatgagggtaaaaaag

SEQ ID NO: 647020 - DNA, 20 bp, mouse
gtatcaagcgtggagggatg

SEQ ID NO: 647021 - DNA, 20 bp, mouse
gcgcacatttcgtaaaattc

SEQ ID NO: 647022 - DNA, 20 bp, mouse
gctgggtttcccctatcaat

SEQ ID NO: 647023 - DNA, 20 bp, mouse
gcgcctggcaatggtggtag

SEQ ID NO: 647024 - DNA, 20 bp, mouse
gaaaagaggaaggggtaaac

SEQ ID NO: 647025 - DNA, 20 bp, mouse
ggggttgacgtagtacaggc

SEQ ID NO: 647026 - DNA, 20 bp, mouse
gacgccagcgccagcctagt

SEQ ID NO: 647027 - DNA, 20 bp, mouse
gcctctgcggggatggggcg

SEQ ID NO: 647028 - DNA, 20 bp, mouse
gccccctggggtgtatgaac

SEQ ID NO: 647029 - DNA, 20 bp, mouse
gcgctccctctgcggggatg

SEQ ID NO: 647030 - DNA, 20 bp, mouse
gtaggctggcgctggcgtcg

SEQ ID NO: 647031 - DNA, 20 bp, mouse
gacatcaggcggggaagccc

SEQ ID NO: 647032 - DNA, 20 bp, mouse
gcccgcagagggagcggtgc

SEQ ID NO: 647033 - DNA, 20 bp, mouse
gaatcccagcgggccccctg

SEQ ID NO: 647034 - DNA, 20 bp, mouse
gactgcacggcggtgacatc

SEQ ID NO: 647035 - DNA, 20 bp, mouse
gcggcactagggggcaatgc

SEQ ID NO: 647036 - DNA, 20 bp, mouse
gagcgctggggcaaaagccg

SEQ ID NO: 647037 - DNA, 20 bp, mouse
gcggctgcgggggtcctcgc

SEQ ID NO: 647038 - DNA, 20 bp, mouse
ggaggataaggggacagcta

SEQ ID NO: 647039 - DNA, 20 bp, mouse
gtgaccgcaagtccagagag

SEQ ID NO: 647040 - DNA, 20 bp, mouse
gccggcgcgagccagcgaag

SEQ ID NO: 647041 - DNA, 20 bp, mouse
gagaggacggtcgtgagcac

SEQ ID NO: 647042 - DNA, 20 bp, mouse
gaggggctccgcgcgtccag

SEQ ID NO: 647043 - DNA, 20 bp, mouse
gggggcaaaagccggggtgc

SEQ ID NO: 647044 - DNA, 20 bp, mouse
gacgcgcggagccccttcgc

SEQ ID NO: 647045 - DNA, 20 bp, mouse
gagcaagagcccaggatctg

SEQ ID NO: 647046 - DNA, 20 bp, mouse
gcccagaggcagcgctctcc

SEQ ID NO: 647047 - DNA, 20 bp, mouse
gcctcgcgcctcccctcctt

SEQ ID NO: 647048 - DNA, 20 bp, mouse
ggggccagctagtagccgaa

SEQ ID NO: 647049 - DNA, 20 bp, mouse
gctagagcccgcacccgagt

SEQ ID NO: 647050 - DNA, 20 bp, mouse
gccggcgtcagcccccacgt

SEQ ID NO: 647051 - DNA, 20 bp, mouse
gggtgcgggctctagaccta

SEQ ID NO: 647052 - DNA, 20 bp, mouse
ggctctcccgggtccgactc

SEQ ID NO: 647053 - DNA, 20 bp, mouse
ggcgggctctagacctaagg

SEQ ID NO: 647054 - DNA, 20 bp, mouse
gcccgcacccgagtcggacc

SEQ ID NO: 647055 - DNA, 20 bp, mouse
ggcaacgccggcttcatcct

SEQ ID NO: 647056 - DNA, 20 bp, mouse
gcggccgagtctagagagca

SEQ ID NO: 647057 - DNA, 20 bp, mouse
gcgggcgatccgaccagggt

SEQ ID NO: 647058 - DNA, 20 bp, mouse
gagccagcaccgcgggagga

SEQ ID NO: 647059 - DNA, 20 bp, mouse
gagtaaaagatgtgcgtcgc

SEQ ID NO: 647060 - DNA, 20 bp, mouse
gagcacgcaccgattctctt

SEQ ID NO: 647061 - DNA, 20 bp, mouse
gggggcgggcgatccgacca

SEQ ID NO: 647062 - DNA, 20 bp, mouse
ggagaaagatgttggggccc

SEQ ID NO: 647063 - DNA, 20 bp, mouse
ggcagggagtctggggtcgt

SEQ ID NO: 647064 - DNA, 20 bp, mouse
gctggggtcgtcggcgttct

SEQ ID NO: 647065 - DNA, 20 bp, mouse
ggcgatccgaccagggtggg

SEQ ID NO: 647066 - DNA, 20 bp, mouse
ggaactgaggctgactgagg

SEQ ID NO: 647067 - DNA, 20 bp, mouse
gcgcgcacaccggctcgtaa

SEQ ID NO: 647068 - DNA, 20 bp, mouse
gacaccggctcgtaaggggc

SEQ ID NO: 647069 - DNA, 20 bp, mouse
gcgcctgtaaccgagtgagg

SEQ ID NO: 647070 - DNA, 20 bp, mouse
gggcgagggcgccccctcca

SEQ ID NO: 647071 - DNA, 20 bp, mouse
gagcgctgagaggtactcag

SEQ ID NO: 647072 - DNA, 20 bp, mouse
gcagggcgcgcactcggcga

SEQ ID NO: 647073 - DNA, 20 bp, mouse
ggcactctccaatcaggccg

SEQ ID NO: 647074 - DNA, 20 bp, mouse
gctcgtaaggggctggctcg

SEQ ID NO: 647075 - DNA, 20 bp, mouse
gcagacctggggctgcctgg

SEQ ID NO: 647076 - DNA, 20 bp, mouse
ggtgggggcaccattgtcgg

SEQ ID NO: 647077 - DNA, 20 bp, mouse
ggaaaggctccaaagattgc

SEQ ID NO: 647078 - DNA, 20 bp, mouse
gccttggcggcgattggctg

SEQ ID NO: 647079 - DNA, 20 bp, mouse
gcgcgctcgctgcagcccgt

SEQ ID NO: 647080 - DNA, 20 bp, mouse
ggtagtccgcccgcaatctt

SEQ ID NO: 647081 - DNA, 20 bp, mouse
gttcaatcgcgggtaggagg

SEQ ID NO: 647082 - DNA, 20 bp, mouse
gggcgccgcagactagactc

SEQ ID NO: 647083 - DNA, 20 bp, mouse
gagcgcgccctttcctgctc

SEQ ID NO: 647084 - DNA, 20 bp, mouse
gtagaggcgagggaactacg

SEQ ID NO: 647085 - DNA, 20 bp, mouse
gaggcggcggggcgccgcag

SEQ ID NO: 647086 - DNA, 20 bp, mouse
ggggcccagcggctccccgg

SEQ ID NO: 647087 - DNA, 20 bp, mouse
ggagccgctgggccccgccc

SEQ ID NO: 647088 - DNA, 20 bp, mouse
gcggaggggcgaggcaccaa

SEQ ID NO: 647089 - DNA, 20 bp, mouse
gcaccagagagagaaatcta

SEQ ID NO: 647090 - DNA, 20 bp, mouse
gcctagcccgcctcctcctg

SEQ ID NO: 647091 - DNA, 20 bp, mouse
gccgggctaaccccaggagg

SEQ ID NO: 647092 - DNA, 20 bp, mouse
gtagcccgggcggggcccag

SEQ ID NO: 647093 - DNA, 20 bp, mouse
ggcggggcccagcggctccc

SEQ ID NO: 647094 - DNA, 20 bp, mouse
gccccgcccgggctaacccc

SEQ ID NO: 647095 - DNA, 20 bp, mouse
gggtagctggaagggagcgg

SEQ ID NO: 647096 - DNA, 20 bp, mouse
ggctgagggagtgtcaagac

SEQ ID NO: 647097 - DNA, 20 bp, mouse
gcaactagggtgtacatggg

SEQ ID NO: 647098 - DNA, 20 bp, mouse
ggaagaggggctatcttgga

SEQ ID NO: 647099 - DNA, 20 bp, mouse
gtccaggaaaccggtgctga

SEQ ID NO: 647100 - DNA, 20 bp, mouse
gcggcaactagggtgtacat

SEQ ID NO: 647101 - DNA, 20 bp, mouse
gcacaagagaggcctctggt

SEQ ID NO: 647102 - DNA, 20 bp, mouse
ggtacaccctagttgccggg

SEQ ID NO: 647103 - DNA, 20 bp, mouse
gccactcctcccggcaacta

SEQ ID NO: 647104 - DNA, 20 bp, mouse
gcgtccaatagtcacaagag

SEQ ID NO: 647105 - DNA, 20 bp, mouse
gtccctcagcaccggtttcc

SEQ ID NO: 647106 - DNA, 20 bp, mouse
ggcccggctcggcccctcgg

SEQ ID NO: 647107 - DNA, 20 bp, mouse
gcccgccgggactgcagtcg

SEQ ID NO: 647108 - DNA, 20 bp, mouse
gccactagggccaagaccgt

SEQ ID NO: 647109 - DNA, 20 bp, mouse
gccctagaggctgcaccgct

SEQ ID NO: 647110 - DNA, 20 bp, mouse
gcccggtcctcgctcgtcgc

SEQ ID NO: 647111 - DNA, 20 bp, mouse
gccgctcgggtccgagacac

SEQ ID NO: 647112 - DNA, 20 bp, mouse
gaggactgagacccgtgtct

SEQ ID NO: 647113 - DNA, 20 bp, mouse
ggccccgactgcagtcccgg

SEQ ID NO: 647114 - DNA, 20 bp, mouse
gtagactgcacgctccacta

SEQ ID NO: 647115 - DNA, 20 bp, mouse
gcggcccctcggcggctcgc

SEQ ID NO: 647116 - DNA, 20 bp, mouse
ggaagtccctggtgcctgag

SEQ ID NO: 647117 - DNA, 20 bp, mouse
gactgagtggacactccagg

SEQ ID NO: 647118 - DNA, 20 bp, mouse
gaggtctagggtggggctaa

SEQ ID NO: 647119 - DNA, 20 bp, mouse
gactgtgcttagagagctaa

SEQ ID NO: 647120 - DNA, 20 bp, mouse
gaggctgggtcaggagcgcg

SEQ ID NO: 647121 - DNA, 20 bp, mouse
gctggagaggacgcttcaag

SEQ ID NO: 647122 - DNA, 20 bp, mouse
ggcgcgccgtggccccgtcg

SEQ ID NO: 647123 - DNA, 20 bp, mouse
gctagggtggggctaatggc

SEQ ID NO: 647124 - DNA, 20 bp, mouse
gcgtggccgcggacggttgg

SEQ ID NO: 647125 - DNA, 20 bp, mouse
gctggagcagcgctgtccca

SEQ ID NO: 647126 - DNA, 20 bp, mouse
gaggtcgagaccagggtgat

SEQ ID NO: 647127 - DNA, 20 bp, mouse
gcgcgccggcggcctgtttc

SEQ ID NO: 647128 - DNA, 20 bp, mouse
ggcgggccggatgcgatgga

SEQ ID NO: 647129 - DNA, 20 bp, mouse
gtccgccggaaacaggccgc

SEQ ID NO: 647130 - DNA, 20 bp, mouse
gatgcgatggacggtgacca

SEQ ID NO: 647131 - DNA, 20 bp, mouse
gatccggcccgcctccgcgc

SEQ ID NO: 647132 - DNA, 20 bp, mouse
ggttcccagcgctgccgcca

SEQ ID NO: 647133 - DNA, 20 bp, mouse
ggagcggcggtggcccctgg

SEQ ID NO: 647134 - DNA, 20 bp, mouse
gagcacgttggtgtacggtc

SEQ ID NO: 647135 - DNA, 20 bp, mouse
gccacgagcacgttggtgta

SEQ ID NO: 647136 - DNA, 20 bp, mouse
ggaaaagcgttgaccctcag

SEQ ID NO: 647137 - DNA, 20 bp, mouse
gactgaggaggcacagcgtg

SEQ ID NO: 647138 - DNA, 20 bp, mouse
gccggcctggaaggcgaaga

SEQ ID NO: 647139 - DNA, 20 bp, mouse
gcccgccccgtgtgtaacgc

SEQ ID NO: 647140 - DNA, 20 bp, mouse
gagggtcaacgcttttctct

SEQ ID NO: 647141 - DNA, 20 bp, mouse
ggtactccaagtgtccacta

SEQ ID NO: 647142 - DNA, 20 bp, mouse
gtgtgtaacgccggcctgga

SEQ ID NO: 647143 - DNA, 20 bp, mouse
gagcagggccaaaagcggaa

SEQ ID NO: 647144 - DNA, 20 bp, mouse
gcgccaggaaggcgccctag

SEQ ID NO: 647145 - DNA, 20 bp, mouse
gcccgtgtgtaacgccggcc

SEQ ID NO: 647146 - DNA, 20 bp, mouse
ggcgcctgcgggccgcgcag

SEQ ID NO: 647147 - DNA, 20 bp, mouse
gcaaactcgcggtagggaag

SEQ ID NO: 647148 - DNA, 20 bp, mouse
gctcaactgccgccacccca

SEQ ID NO: 647149 - DNA, 20 bp, mouse
ggcgggccgcgcagaggctt

SEQ ID NO: 647150 - DNA, 20 bp, mouse
gaactgccgccaccccaggg

SEQ ID NO: 647151 - DNA, 20 bp, mouse
ggcgcgccaagccggggatg

SEQ ID NO: 647152 - DNA, 20 bp, mouse
gtgaaaggccagaggctggt

SEQ ID NO: 647153 - DNA, 20 bp, mouse
ggctctcgcgcggttctccc

SEQ ID NO: 647154 - DNA, 20 bp, mouse
ggcaggccgaagcctctgcg

SEQ ID NO: 647155 - DNA, 20 bp, mouse
gtgtggcctccgccctgggg

SEQ ID NO: 647156 - DNA, 20 bp, mouse
gctagcaggccagtgggcag

SEQ ID NO: 647157 - DNA, 20 bp, mouse
gagacgccccgacacgactt

SEQ ID NO: 647158 - DNA, 20 bp, mouse
gagtccgggtcgtgcagcac

SEQ ID NO: 647159 - DNA, 20 bp, mouse
gagcgacagcggcagggaca

SEQ ID NO: 647160 - DNA, 20 bp, mouse
gagtgggcaggggtagagtc

SEQ ID NO: 647161 - DNA, 20 bp, mouse
gcactggcctgctaggacta

SEQ ID NO: 647162 - DNA, 20 bp, mouse
gtggcacctctcacgtccta

SEQ ID NO: 647163 - DNA, 20 bp, mouse
gtgcagatggcgcgcactta

SEQ ID NO: 647164 - DNA, 20 bp, mouse
gtgcttgcccaagtcgtgtc

SEQ ID NO: 647165 - DNA, 20 bp, mouse
ggaacaccctaggacgtgag

SEQ ID NO: 647166 - DNA, 20 bp, mouse
ggaaaggcaaagcaagagat

SEQ ID NO: 647167 - DNA, 20 bp, mouse
gagttcccaccagcccctga

SEQ ID NO: 647168 - DNA, 20 bp, mouse
gcctcgggccaggacagaga

SEQ ID NO: 647169 - DNA, 20 bp, mouse
ggcctccctcaggggctggt

SEQ ID NO: 647170 - DNA, 20 bp, mouse
gggtgggagtggatgatcaa

SEQ ID NO: 647171 - DNA, 20 bp, mouse
ggggccaggacagagagggt

SEQ ID NO: 647172 - DNA, 20 bp, mouse
ggaccttgccggggttcctt

SEQ ID NO: 647173 - DNA, 20 bp, mouse
gggcccgaggccaagcaggg

SEQ ID NO: 647174 - DNA, 20 bp, mouse
gacctggcttgaccttgccg

SEQ ID NO: 647175 - DNA, 20 bp, mouse
gttgccggggttccttggga

SEQ ID NO: 647176 - DNA, 20 bp, mouse
gcacccagaccctctaaact

SEQ ID NO: 647177 - DNA, 20 bp, mouse
gctgacgctgctattagtct

SEQ ID NO: 647178 - DNA, 20 bp, mouse
gcgtcagcgcccagtttaga

SEQ ID NO: 647179 - DNA, 20 bp, mouse
ggagcccagggagattgcta

SEQ ID NO: 647180 - DNA, 20 bp, mouse
gaggagccggccttggaccg

SEQ ID NO: 647181 - DNA, 20 bp, mouse
gccccgcagcccccggtcca

SEQ ID NO: 647182 - DNA, 20 bp, mouse
gagggagtgtgcggagtcta

SEQ ID NO: 647183 - DNA, 20 bp, mouse
gctcccctagcaatctccct

SEQ ID NO: 647184 - DNA, 20 bp, mouse
ggcagcccccggtccaaggc

SEQ ID NO: 647185 - DNA, 20 bp, mouse
gggggcttcgggtttccgga

SEQ ID NO: 647186 - DNA, 20 bp, mouse
ggcccggagcgggaaggcgt

SEQ ID NO: 647187 - DNA, 20 bp, mouse
gagccctcgaaacccgaagt

SEQ ID NO: 647188 - DNA, 20 bp, mouse
gggaaggcccaaagaaactc

SEQ ID NO: 647189 - DNA, 20 bp, mouse
gcaaagaaactctggagggg

SEQ ID NO: 647190 - DNA, 20 bp, mouse
gcaccgacttcgggtttcga

SEQ ID NO: 647191 - DNA, 20 bp, mouse
gcggaacgcgcgcactcacg

SEQ ID NO: 647192 - DNA, 20 bp, mouse
ggggccctcctcccgctctg

SEQ ID NO: 647193 - DNA, 20 bp, mouse
gcgtaagtggagcaagtgtc

SEQ ID NO: 647194 - DNA, 20 bp, mouse
gggagcgggaaggcgtggga

SEQ ID NO: 647195 - DNA, 20 bp, mouse
gcccgcgcggggacacgcgc

SEQ ID NO: 647196 - DNA, 20 bp, mouse
gtggggctaccgaaggaaga

SEQ ID NO: 647197 - DNA, 20 bp, mouse
gtaagtgtgccaactggaag

SEQ ID NO: 647198 - DNA, 20 bp, mouse
gtgtgccaactggaaggggt

SEQ ID NO: 647199 - DNA, 20 bp, mouse
ggaaggggtggggctaccga

SEQ ID NO: 647200 - DNA, 20 bp, mouse
gctaccgaaggaagagggcg

SEQ ID NO: 647201 - DNA, 20 bp, mouse
gccagttggcacacttactg

SEQ ID NO: 647202 - DNA, 20 bp, mouse
gagcacatcccgatctgcct

SEQ ID NO: 647203 - DNA, 20 bp, mouse
gtaggcgtcgggtcagaaac

SEQ ID NO: 647204 - DNA, 20 bp, mouse
gcgtggcctgcgccgggata

SEQ ID NO: 647205 - DNA, 20 bp, mouse
gtaaaaccgaatggaacgtc

SEQ ID NO: 647206 - DNA, 20 bp, mouse
gcgcgcggggccaaggtcac

SEQ ID NO: 647207 - DNA, 20 bp, mouse
gggcccggaaccccagctgg

SEQ ID NO: 647208 - DNA, 20 bp, mouse
gcggggccaaggtcacgggt

SEQ ID NO: 647209 - DNA, 20 bp, mouse
gactcgcagcctggacaccc

SEQ ID NO: 647210 - DNA, 20 bp, mouse
ggccgcgcccggcactgcgc

SEQ ID NO: 647211 - DNA, 20 bp, mouse
ggggagggttggcacggctg

SEQ ID NO: 647212 - DNA, 20 bp, mouse
ggctgcgagtctgtggcctt

SEQ ID NO: 647213 - DNA, 20 bp, mouse
gggcccccatcctacctctg

SEQ ID NO: 647214 - DNA, 20 bp, mouse
gcacggcccggaaccccagc

SEQ ID NO: 647215 - DNA, 20 bp, mouse
gacacctgtcccacagaggt

SEQ ID NO: 647216 - DNA, 20 bp, mouse
gcggggccgtgggtccgagc

SEQ ID NO: 647217 - DNA, 20 bp, mouse
gagccaatggttagggagtt

SEQ ID NO: 647218 - DNA, 20 bp, mouse
gagcgcagagtcccgggtgc

SEQ ID NO: 647219 - DNA, 20 bp, mouse
gcagatcagcgcagagtccc

SEQ ID NO: 647220 - DNA, 20 bp, mouse
gcgcccaactccctaaccat

SEQ ID NO: 647221 - DNA, 20 bp, mouse
gtccctaaccattggctaga

SEQ ID NO: 647222 - DNA, 20 bp, mouse
gaacaaagagaggctgggcg

SEQ ID NO: 647223 - DNA, 20 bp, mouse
ggttagggagttgggcggag

SEQ ID NO: 647224 - DNA, 20 bp, mouse
ggggtgccggctcggaccca

SEQ ID NO: 647225 - DNA, 20 bp, mouse
gacaccgccggtgcgagctg

SEQ ID NO: 647226 - DNA, 20 bp, mouse
gggaaagcagggagtggcgt

SEQ ID NO: 647227 - DNA, 20 bp, mouse
gcggaccgggacactcgcag

SEQ ID NO: 647228 - DNA, 20 bp, mouse
ggcactgaaccgaagcgtgt

SEQ ID NO: 647229 - DNA, 20 bp, mouse
gcgagtgtcccggtccgcac

SEQ ID NO: 647230 - DNA, 20 bp, mouse
gttccccccgccctcctgct

SEQ ID NO: 647231 - DNA, 20 bp, mouse
gcccccacaggggtgtaaag

SEQ ID NO: 647232 - DNA, 20 bp, mouse
gccgaagcgtgtgggccgtg

SEQ ID NO: 647233 - DNA, 20 bp, mouse
gtagcccagcaggagggcgg

SEQ ID NO: 647234 - DNA, 20 bp, mouse
ggcgttggccagtgcggacc

SEQ ID NO: 647235 - DNA, 20 bp, mouse
gcttcggttcagtgcccccg

SEQ ID NO: 647236 - DNA, 20 bp, mouse
ggggtggagtcaggatcgga

SEQ ID NO: 647237 - DNA, 20 bp, mouse
ggggaacagcgagctcccgt

SEQ ID NO: 647238 - DNA, 20 bp, mouse
ggggacggggagcccagtgc

SEQ ID NO: 647239 - DNA, 20 bp, mouse
gcgccctcgggccaacttgg

SEQ ID NO: 647240 - DNA, 20 bp, mouse
gaaagcccggggaagactcc

SEQ ID NO: 647241 - DNA, 20 bp, mouse
ggggcggctcgggtggagtc

SEQ ID NO: 647242 - DNA, 20 bp, mouse
ggcggggtccagggcggctc

SEQ ID NO: 647243 - DNA, 20 bp, mouse
gagactgagggccagcgggg

SEQ ID NO: 647244 - DNA, 20 bp, mouse
gccaggagggcccaggatgt

SEQ ID NO: 647245 - DNA, 20 bp, mouse
ggcgcggcggccactccggg

SEQ ID NO: 647246 - DNA, 20 bp, mouse
gcgagctcgggcacctcgag

SEQ ID NO: 647247 - DNA, 20 bp, mouse
ggccgccccggggcactgtc

SEQ ID NO: 647248 - DNA, 20 bp, mouse
gcgggcgagccgcacctccc

SEQ ID NO: 647249 - DNA, 20 bp, mouse
gtcgggtcaccagagaccaa

SEQ ID NO: 647250 - DNA, 20 bp, mouse
ggccgccgctgcccccaatt

SEQ ID NO: 647251 - DNA, 20 bp, mouse
gcagttcgcccgcacttcgg

SEQ ID NO: 647252 - DNA, 20 bp, mouse
gggggggtcccggcgagctc

SEQ ID NO: 647253 - DNA, 20 bp, mouse
gacccgacagtgccccgggg

SEQ ID NO: 647254 - DNA, 20 bp, mouse
gcacatcgcccccgaagtgc

SEQ ID NO: 647255 - DNA, 20 bp, mouse
ggtgacccgacagtgccccg

SEQ ID NO: 647256 - DNA, 20 bp, mouse
gggtcctgggacccagacag

SEQ ID NO: 647257 - DNA, 20 bp, mouse
gctagcccaggacccagagg

SEQ ID NO: 647258 - DNA, 20 bp, mouse
gtcgcggcttcgagctgtcc

SEQ ID NO: 647259 - DNA, 20 bp, mouse
gacagctcgaagccgcgaca

SEQ ID NO: 647260 - DNA, 20 bp, mouse
gccccgtgatgcagcccaga

SEQ ID NO: 647261 - DNA, 20 bp, mouse
gtgggtcccaggacctcctc

SEQ ID NO: 647262 - DNA, 20 bp, mouse
gagctgattttgacaggggg

SEQ ID NO: 647263 - DNA, 20 bp, mouse
gcccatcagctgattttgac

SEQ ID NO: 647264 - DNA, 20 bp, mouse
ggcgtccccagcatccctct

SEQ ID NO: 647265 - DNA, 20 bp, mouse
gcctcaccccaacctaccac

SEQ ID NO: 647266 - DNA, 20 bp, mouse
gctggggcgggtaggagcag

SEQ ID NO: 647267 - DNA, 20 bp, mouse
gtcatggtggccaggggcaa

SEQ ID NO: 647268 - DNA, 20 bp, mouse
gttgagatacacagtcatgg

SEQ ID NO: 647269 - DNA, 20 bp, mouse
ggtgtggaggcgacggacta

SEQ ID NO: 647270 - DNA, 20 bp, mouse
gagtctgccctggggcgggt

SEQ ID NO: 647271 - DNA, 20 bp, mouse
gagtgtgcaggtgttgatag

SEQ ID NO: 647272 - DNA, 20 bp, mouse
gactcccacctaaccctaaa

SEQ ID NO: 647273 - DNA, 20 bp, mouse
gagtacctggtaagagtata

SEQ ID NO: 647274 - DNA, 20 bp, mouse
gtgtgaaagtgtggaggcga

SEQ ID NO: 647275 - DNA, 20 bp, mouse
gcatacagaggaggaaaaaa

SEQ ID NO: 647276 - DNA, 20 bp, mouse
gcaaccctcggggccactga

SEQ ID NO: 647277 - DNA, 20 bp, mouse
gggaccccgagcagccgcac

SEQ ID NO: 647278 - DNA, 20 bp, mouse
gcgcctcccggaggagaaag

SEQ ID NO: 647279 - DNA, 20 bp, mouse
gcccgcgcacacgcgcctcc

SEQ ID NO: 647280 - DNA, 20 bp, mouse
gcagccgcacggggagagcg

SEQ ID NO: 647281 - DNA, 20 bp, mouse
ggctccccgctctccccgtg

SEQ ID NO: 647282 - DNA, 20 bp, mouse
gcggcagtccggcccgagaa

SEQ ID NO: 647283 - DNA, 20 bp, mouse
ggggcgagggcgagaggcag

SEQ ID NO: 647284 - DNA, 20 bp, mouse
ggacgtcccccgcaaccctc

SEQ ID NO: 647285 - DNA, 20 bp, mouse
gggaggggcgcgggtgagga

SEQ ID NO: 647286 - DNA, 20 bp, mouse
gccgggccgggttctgtccc

SEQ ID NO: 647287 - DNA, 20 bp, mouse
ggtcggcggggctgacgcgc

SEQ ID NO: 647288 - DNA, 20 bp, mouse
ggccgcggcccatgtgacca

SEQ ID NO: 647289 - DNA, 20 bp, mouse
ggggactgggactgacgcag

SEQ ID NO: 647290 - DNA, 20 bp, mouse
ggacgcgcgggctgacgtgc

SEQ ID NO: 647291 - DNA, 20 bp, mouse
ggctgcgtgtgacttactgt

SEQ ID NO: 647292 - DNA, 20 bp, mouse
gggagcggggatgcgaagcg

SEQ ID NO: 647293 - DNA, 20 bp, mouse
gcgcaccagcgtcagacccg

SEQ ID NO: 647294 - DNA, 20 bp, mouse
ggcgaagcgcgggtcgcagc

SEQ ID NO: 647295 - DNA, 20 bp, mouse
ggggactgacgcagtggccg

SEQ ID NO: 647296 - DNA, 20 bp, mouse
ggcagcgcgaagcgacactc

SEQ ID NO: 647297 - DNA, 20 bp, mouse
gtgcgcacgcgcgcccccga

SEQ ID NO: 647298 - DNA, 20 bp, mouse
ggctgcctgacagctgatgg

SEQ ID NO: 647299 - DNA, 20 bp, mouse
ggcgcagctggccgccgcat

SEQ ID NO: 647300 - DNA, 20 bp, mouse
ggttcgcggccgtgctcctt

SEQ ID NO: 647301 - DNA, 20 bp, mouse
gtcggctcggacctctcttt

SEQ ID NO: 647302 - DNA, 20 bp, mouse
gctaaaggcccttggtgtct

SEQ ID NO: 647303 - DNA, 20 bp, mouse
ggtgggtcctcggggtaacg

SEQ ID NO: 647304 - DNA, 20 bp, mouse
gcctgacagctgatggcgga

SEQ ID NO: 647305 - DNA, 20 bp, mouse
gggcggcgcgaggtcagggc

SEQ ID NO: 647306 - DNA, 20 bp, mouse
gacgccctcgggtccggaga

SEQ ID NO: 647307 - DNA, 20 bp, mouse
gagggggagggacgcgtaac

SEQ ID NO: 647308 - DNA, 20 bp, mouse
gtccccctctccggacccga

SEQ ID NO: 647309 - DNA, 20 bp, mouse
gccggccacgccctcgggtc

SEQ ID NO: 647310 - DNA, 20 bp, mouse
ggagggacgcgtaaccgggc

SEQ ID NO: 647311 - DNA, 20 bp, mouse
gggctggaggcgggagcaaa

SEQ ID NO: 647312 - DNA, 20 bp, mouse
gggaaagtggggcggagtga

SEQ ID NO: 647313 - DNA, 20 bp, mouse
gctgaaggagggaccgaaga

SEQ ID NO: 647314 - DNA, 20 bp, mouse
gaggaggagtggcggggtta

SEQ ID NO: 647315 - DNA, 20 bp, mouse
gaggcggccggccacgccct

SEQ ID NO: 647316 - DNA, 20 bp, mouse
gaggattattcttaccctgt

SEQ ID NO: 647317 - DNA, 20 bp, mouse
gaaaaaccaaaccagcccac

SEQ ID NO: 647318 - DNA, 20 bp, mouse
gttggactgagctacctctc

SEQ ID NO: 647319 - DNA, 20 bp, mouse
gtatgccttaggtctctcag

SEQ ID NO: 647320 - DNA, 20 bp, mouse
gaaaaaaaaatctgctgaat

SEQ ID NO: 647321 - DNA, 20 bp, mouse
gaggctggcctgagagtcac

SEQ ID NO: 647322 - DNA, 20 bp, mouse
gattatgctgtgtttcactg

SEQ ID NO: 647323 - DNA, 20 bp, mouse
gcttaccctgtgggctggtt

SEQ ID NO: 647324 - DNA, 20 bp, mouse
gcaggccactgagagaccta

SEQ ID NO: 647325 - DNA, 20 bp, mouse
gggtcctggtgcaaatttct

SEQ ID NO: 647326 - DNA, 20 bp, mouse
gggcgccagggtgcggaagg

SEQ ID NO: 647327 - DNA, 20 bp, mouse
ggagctcgcaggaggcgcca

SEQ ID NO: 647328 - DNA, 20 bp, mouse
gcgcaggaggcgccagggtg

SEQ ID NO: 647329 - DNA, 20 bp, mouse
ggggaggaaaagctcacccc

SEQ ID NO: 647330 - DNA, 20 bp, mouse
gccccaagaagagacatcct

SEQ ID NO: 647331 - DNA, 20 bp, mouse
gcggccggacccgcccccgt

SEQ ID NO: 647332 - DNA, 20 bp, mouse
gaaagccaaagggctctgaa

SEQ ID NO: 647333 - DNA, 20 bp, mouse
gcaagaagagacatcctagg

SEQ ID NO: 647334 - DNA, 20 bp, mouse
ggccagggtgcggaaggggg

SEQ ID NO: 647335 - DNA, 20 bp, mouse
gcagtaggacatatttccca

SEQ ID NO: 647336 - DNA, 20 bp, mouse
gcaggtgcggggtctggagt

SEQ ID NO: 647337 - DNA, 20 bp, mouse
gggctggtgcggggtgtaca

SEQ ID NO: 647338 - DNA, 20 bp, mouse
gggactctcggtgctaacta

SEQ ID NO: 647339 - DNA, 20 bp, mouse
gtggtgcggggtgtacaagg

SEQ ID NO: 647340 - DNA, 20 bp, mouse
gtcgggggcagattcaggtg

SEQ ID NO: 647341 - DNA, 20 bp, mouse
gtgcccgcgaactcaaaagg

SEQ ID NO: 647342 - DNA, 20 bp, mouse
gtcgggtggtggctggtgcg

SEQ ID NO: 647343 - DNA, 20 bp, mouse
gaatgggccttcggggcggt

SEQ ID NO: 647344 - DNA, 20 bp, mouse
gaatgaatgggccttcgggg

SEQ ID NO: 647345 - DNA, 20 bp, mouse
ggggaggcccaccgccccga

SEQ ID NO: 647346 - DNA, 20 bp, mouse
ggacaaagaccacttcagag

SEQ ID NO: 647347 - DNA, 20 bp, mouse
gccaataattaacagagcag

SEQ ID NO: 647348 - DNA, 20 bp, mouse
gggtctttgtccttgaacat

SEQ ID NO: 647349 - DNA, 20 bp, mouse
gcacttgtatcctatgttca

SEQ ID NO: 647350 - DNA, 20 bp, mouse
gtaacaggcatcccttaaac

SEQ ID NO: 647351 - DNA, 20 bp, mouse
gctgaaggttactagttaac

SEQ ID NO: 647352 - DNA, 20 bp, mouse
gtctatttgaacagtttaga

SEQ ID NO: 647353 - DNA, 20 bp, mouse
ggaatgggagctggctcatc

SEQ ID NO: 647354 - DNA, 20 bp, mouse
gttgttcagtgcctagcata

SEQ ID NO: 647355 - DNA, 20 bp, mouse
gataaaatatacttgaccga

SEQ ID NO: 647356 - DNA, 20 bp, mouse
gtgcgcccggaagtgacgta

SEQ ID NO: 647357 - DNA, 20 bp, mouse
gtcagagggtcgggagggga

SEQ ID NO: 647358 - DNA, 20 bp, mouse
gctgcctcagagggtcggga

SEQ ID NO: 647359 - DNA, 20 bp, mouse
gagcgctgcctcagagggtc

SEQ ID NO: 647360 - DNA, 20 bp, mouse
ggccgggcgctggtgggtgc

SEQ ID NO: 647361 - DNA, 20 bp, mouse
gcaggtggctaggtcggggc

SEQ ID NO: 647362 - DNA, 20 bp, mouse
ggaagagggcggagggtagt

SEQ ID NO: 647363 - DNA, 20 bp, mouse
gcgggcgcaggtggctaggt

SEQ ID NO: 647364 - DNA, 20 bp, mouse
gcgtcacttccgggcgcagg

SEQ ID NO: 647365 - DNA, 20 bp, mouse
gatgggagagtgtgtggagt

SEQ ID NO: 647366 - DNA, 20 bp, mouse
gagacaacgaggccttctat

SEQ ID NO: 647367 - DNA, 20 bp, mouse
gcagccggccagcgcgagaa

SEQ ID NO: 647368 - DNA, 20 bp, mouse
ggcgagagttgaggaagttg

SEQ ID NO: 647369 - DNA, 20 bp, mouse
gctgcctgagtctgagctgg

SEQ ID NO: 647370 - DNA, 20 bp, mouse
gccttctattggcccagtga

SEQ ID NO: 647371 - DNA, 20 bp, mouse
gagttggggatgagactaaa

SEQ ID NO: 647372 - DNA, 20 bp, mouse
gttcaagcatcgtgcgacta

SEQ ID NO: 647373 - DNA, 20 bp, mouse
gcaactctcgcgagacaacg

SEQ ID NO: 647374 - DNA, 20 bp, mouse
gaaaaacctgtggtgaagaa

SEQ ID NO: 647375 - DNA, 20 bp, mouse
ggacgtcctacaaaaacctg

SEQ ID NO: 647376 - DNA, 20 bp, mouse
ggggtctggcgcaattcccc

SEQ ID NO: 647377 - DNA, 20 bp, mouse
gcccgccccgcgctgcctct

SEQ ID NO: 647378 - DNA, 20 bp, mouse
ggccgccgctgcgtcctcgg

SEQ ID NO: 647379 - DNA, 20 bp, mouse
ggcgccgcggtcttcccgga

SEQ ID NO: 647380 - DNA, 20 bp, mouse
ggcggcgcttcccagcgcgc

SEQ ID NO: 647381 - DNA, 20 bp, mouse
gtcccagcgcgccggatccc

SEQ ID NO: 647382 - DNA, 20 bp, mouse
ggggctggcacggggcagta

SEQ ID NO: 647383 - DNA, 20 bp, mouse
ggcgctcggagcggtctccg

SEQ ID NO: 647384 - DNA, 20 bp, mouse
gcgcactgggcgggccccgc

SEQ ID NO: 647385 - DNA, 20 bp, mouse
gtccccgtacagaggcgcgg

SEQ ID NO: 647386 - DNA, 20 bp, mouse
gaggggaggggcgtggatcc

SEQ ID NO: 647387 - DNA, 20 bp, mouse
gagggagctgggtgatgaga

SEQ ID NO: 647388 - DNA, 20 bp, mouse
gcgctcccctcacattgagg

SEQ ID NO: 647389 - DNA, 20 bp, mouse
gctagggcggtacaaaatcc

SEQ ID NO: 647390 - DNA, 20 bp, mouse
gcatggtgtgagaaatgagg

SEQ ID NO: 647391 - DNA, 20 bp, mouse
gaatcatggtgtgagaaatg

SEQ ID NO: 647392 - DNA, 20 bp, mouse
ggcctcctcctcaatgtgag

SEQ ID NO: 647393 - DNA, 20 bp, mouse
gggggctaggtagttggtgg

SEQ ID NO: 647394 - DNA, 20 bp, mouse
gggaggagataggaacccac

SEQ ID NO: 647395 - DNA, 20 bp, mouse
gtccctcccaaaacctggac

SEQ ID NO: 647396 - DNA, 20 bp, mouse
gcggccagcacgcggttctt

SEQ ID NO: 647397 - DNA, 20 bp, mouse
gcggccccacccacccgcgt

SEQ ID NO: 647398 - DNA, 20 bp, mouse
gagcacgcggttcttggggg

SEQ ID NO: 647399 - DNA, 20 bp, mouse
ggggcgcagggcgacgctgg

SEQ ID NO: 647400 - DNA, 20 bp, mouse
gaaggcgcttgcgagagagg

SEQ ID NO: 647401 - DNA, 20 bp, mouse
gtgggtggggccgcgcgtcg

SEQ ID NO: 647402 - DNA, 20 bp, mouse
gaaccctggcaagatcccta

SEQ ID NO: 647403 - DNA, 20 bp, mouse
ggctaaggcgcttgcgagag

SEQ ID NO: 647404 - DNA, 20 bp, mouse
gcggaagggcctacgcgggt

SEQ ID NO: 647405 - DNA, 20 bp, mouse
gcgggggcgcagggcgacgc

SEQ ID NO: 647406 - DNA, 20 bp, mouse
gtgcctggcaccagctatca

SEQ ID NO: 647407 - DNA, 20 bp, mouse
gctgagtgagattagagact

SEQ ID NO: 647408 - DNA, 20 bp, mouse
gactgggtgagcatgccacc

SEQ ID NO: 647409 - DNA, 20 bp, mouse
gaatgacagagaaaaaccag

SEQ ID NO: 647410 - DNA, 20 bp, mouse
gggcacctgggaagataaca

SEQ ID NO: 647411 - DNA, 20 bp, mouse
gagtaatatagaggacagac

SEQ ID NO: 647412 - DNA, 20 bp, mouse
gcaggcactcacattccagg

SEQ ID NO: 647413 - DNA, 20 bp, mouse
gcagtgctttcagtttttcc

SEQ ID NO: 647414 - DNA, 20 bp, mouse
ggcaccagagaccggcacct

SEQ ID NO: 647415 - DNA, 20 bp, mouse
gctggcaccagctatcaagg

SEQ ID NO: 647416 - DNA, 20 bp, mouse
gcagcgcggtgtcaccccgc

SEQ ID NO: 647417 - DNA, 20 bp, mouse
ggggtcggaagcgagagccc

SEQ ID NO: 647418 - DNA, 20 bp, mouse
gcggcctggggaccagctgc

SEQ ID NO: 647419 - DNA, 20 bp, mouse
gtggggaccagctgcgggga

SEQ ID NO: 647420 - DNA, 20 bp, mouse
gggagccagaagcggaagga

SEQ ID NO: 647421 - DNA, 20 bp, mouse
gagcgccctgcctcggagtg

SEQ ID NO: 647422 - DNA, 20 bp, mouse
gacagagcagaagtttccac

SEQ ID NO: 647423 - DNA, 20 bp, mouse
ggctcgcagcttacagatga

SEQ ID NO: 647424 - DNA, 20 bp, mouse
gctgcagcgtccacccggcc

SEQ ID NO: 647425 - DNA, 20 bp, mouse
gaaggggtagccaggcagcg

SEQ ID NO: 647426 - DNA, 20 bp, mouse
ggcgggagacattgatgcta

SEQ ID NO: 647427 - DNA, 20 bp, mouse
gaaggtggtgaggtttttgg

SEQ ID NO: 647428 - DNA, 20 bp, mouse
gcctcctgcaatgctcaaac

SEQ ID NO: 647429 - DNA, 20 bp, mouse
gccggcaggggtgggacgac

SEQ ID NO: 647430 - DNA, 20 bp, mouse
gcgggtcccgccccgagaga

SEQ ID NO: 647431 - DNA, 20 bp, mouse
gacgaccggcggacttgaag

SEQ ID NO: 647432 - DNA, 20 bp, mouse
gcagcggtcgctgagagagc

SEQ ID NO: 647433 - DNA, 20 bp, mouse
gattgatgctaggggatgat

SEQ ID NO: 647434 - DNA, 20 bp, mouse
gtgaagaggcccagggaacg

SEQ ID NO: 647435 - DNA, 20 bp, mouse
gcctgccgggagaatacttt

SEQ ID NO: 647436 - DNA, 20 bp, mouse
ggaaaccggcggcccctgag

SEQ ID NO: 647437 - DNA, 20 bp, mouse
gccccaggttactgtggctt

SEQ ID NO: 647438 - DNA, 20 bp, mouse
gctcccagccggccgctcag

SEQ ID NO: 647439 - DNA, 20 bp, mouse
ggccgcgcagcgtcttcctg

SEQ ID NO: 647440 - DNA, 20 bp, mouse
gtgaaggcggtatgctcgtg

SEQ ID NO: 647441 - DNA, 20 bp, mouse
ggattggcacctggagagtg

SEQ ID NO: 647442 - DNA, 20 bp, mouse
ggcggtatgctcgtgcgggg

SEQ ID NO: 647443 - DNA, 20 bp, mouse
gcacccaagccacagtaacc

SEQ ID NO: 647444 - DNA, 20 bp, mouse
gggcccctgagcggccggct

SEQ ID NO: 647445 - DNA, 20 bp, mouse
gtgcaaggatgacactttat

SEQ ID NO: 647446 - DNA, 20 bp, mouse
gagtgagccgcacacggcgg

SEQ ID NO: 647447 - DNA, 20 bp, mouse
gccccaaacggccccctcac

SEQ ID NO: 647448 - DNA, 20 bp, mouse
ggcggggtggcattcgacgg

SEQ ID NO: 647449 - DNA, 20 bp, mouse
gaaccctgcgtggcgaccaa

SEQ ID NO: 647450 - DNA, 20 bp, mouse
gcgttggcaggtacctgtga

SEQ ID NO: 647451 - DNA, 20 bp, mouse
ggcccgcggaagcccccaaa

SEQ ID NO: 647452 - DNA, 20 bp, mouse
gcgcgggccaccgccgtgtg

SEQ ID NO: 647453 - DNA, 20 bp, mouse
ggagcctgatggtgtgtaaa

SEQ ID NO: 647454 - DNA, 20 bp, mouse
ggcagtgcgctttactgggc

SEQ ID NO: 647455 - DNA, 20 bp, mouse
gtcgctagcgggagagggag

SEQ ID NO: 647456 - DNA, 20 bp, mouse
gatggaactcggtgggttga

SEQ ID NO: 647457 - DNA, 20 bp, mouse
gagggagaggtagtgcccag

SEQ ID NO: 647458 - DNA, 20 bp, mouse
gactcatgatggaactcggt

SEQ ID NO: 647459 - DNA, 20 bp, mouse
gggtgtagagccctacccca

SEQ ID NO: 647460 - DNA, 20 bp, mouse
gagggtgcaagccccaccta

SEQ ID NO: 647461 - DNA, 20 bp, mouse
gagcaatctcacccgacctg

SEQ ID NO: 647462 - DNA, 20 bp, mouse
gtctgggacaagagtccttc

SEQ ID NO: 647463 - DNA, 20 bp, mouse
gtgggtacatctttgtactg

SEQ ID NO: 647464 - DNA, 20 bp, mouse
gctgccagtgtcctcaggtc

SEQ ID NO: 647465 - DNA, 20 bp, mouse
gcggtgggttgaaggaagtg

SEQ ID NO: 647466 - DNA, 20 bp, mouse
gtggccgcagtgactcctcc

SEQ ID NO: 647467 - DNA, 20 bp, mouse
ggccacgctgcggcaagggt

SEQ ID NO: 647468 - DNA, 20 bp, mouse
gtggccgggaggagtcactg

SEQ ID NO: 647469 - DNA, 20 bp, mouse
gtacaggcacccagcggata

SEQ ID NO: 647470 - DNA, 20 bp, mouse
gagtcactgcggccacgctg

SEQ ID NO: 647471 - DNA, 20 bp, mouse
ggggagcggcaagaggagac

SEQ ID NO: 647472 - DNA, 20 bp, mouse
gccgagaccggagtccgcga

SEQ ID NO: 647473 - DNA, 20 bp, mouse
gactaggctagattctgtaa

SEQ ID NO: 647474 - DNA, 20 bp, mouse
gtgcggcaagggtcggagct

SEQ ID NO: 647475 - DNA, 20 bp, mouse
ggcaagggtcggagctgggc

SEQ ID NO: 647476 - DNA, 20 bp, mouse
gagaaggccgggtggcagtg

SEQ ID NO: 647477 - DNA, 20 bp, mouse
gcagtggggcgtggttctga

SEQ ID NO: 647478 - DNA, 20 bp, mouse
ggaaaagacagaaggccggg

SEQ ID NO: 647479 - DNA, 20 bp, mouse
gaaccaatggaaaagacaga

SEQ ID NO: 647480 - DNA, 20 bp, mouse
gtccccgccccctctcgcca

SEQ ID NO: 647481 - DNA, 20 bp, mouse
gtaggagtccgtggcgagag

SEQ ID NO: 647482 - DNA, 20 bp, mouse
gaaggcagcgagcggttaaa

SEQ ID NO: 647483 - DNA, 20 bp, mouse
gggcacgcattgtacttgca

SEQ ID NO: 647484 - DNA, 20 bp, mouse
gtctctcgcggtcgtggtcg

SEQ ID NO: 647485 - DNA, 20 bp, mouse
gcgagacggcctccggttgc

SEQ ID NO: 647486 - DNA, 20 bp, mouse
ggtacacggggctaggagct

SEQ ID NO: 647487 - DNA, 20 bp, mouse
gctaggagctgggtacaaat

SEQ ID NO: 647488 - DNA, 20 bp, mouse
gaagcgacggaaagctagaa

SEQ ID NO: 647489 - DNA, 20 bp, mouse
gcgcgctggtacacggggct

SEQ ID NO: 647490 - DNA, 20 bp, mouse
gtagaagggtctgatcgcgc

SEQ ID NO: 647491 - DNA, 20 bp, mouse
gaaaacacaggccgttgttt

SEQ ID NO: 647492 - DNA, 20 bp, mouse
gtttccccattcaaaatcga

SEQ ID NO: 647493 - DNA, 20 bp, mouse
gagaaccctcgattttgaat

SEQ ID NO: 647494 - DNA, 20 bp, mouse
gctgatcgcgctggtacacg

SEQ ID NO: 647495 - DNA, 20 bp, mouse
gactcctacactacaataca

SEQ ID NO: 647496 - DNA, 20 bp, mouse
gcctcccgtgacctagggat

SEQ ID NO: 647497 - DNA, 20 bp, mouse
gcgagccctcccgtgaccta

SEQ ID NO: 647498 - DNA, 20 bp, mouse
ggacagggcgggagatgagg

SEQ ID NO: 647499 - DNA, 20 bp, mouse
gggagagcccacaggggtgt

SEQ ID NO: 647500 - DNA, 20 bp, mouse
gtcgctgggctgaagatgaa

SEQ ID NO: 647501 - DNA, 20 bp, mouse
gggctcgcgctgctccgcgt

SEQ ID NO: 647502 - DNA, 20 bp, mouse
ggagcccatccctaggtcac

SEQ ID NO: 647503 - DNA, 20 bp, mouse
gatgcacggaagagcagggt

SEQ ID NO: 647504 - DNA, 20 bp, mouse
gacgactggctggcgacaga

SEQ ID NO: 647505 - DNA, 20 bp, mouse
gaacaagtaatgtgagagaa

SEQ ID NO: 647506 - DNA, 20 bp, mouse
gagggcagggcggccgtgaa

SEQ ID NO: 647507 - DNA, 20 bp, mouse
ggtccggggcccagcggagt

SEQ ID NO: 647508 - DNA, 20 bp, mouse
gggccccggactagcctggg

SEQ ID NO: 647509 - DNA, 20 bp, mouse
gatggctcccggaagtgggc

SEQ ID NO: 647510 - DNA, 20 bp, mouse
gtacgagcgggatagacgtg

SEQ ID NO: 647511 - DNA, 20 bp, mouse
gaggctagtccggggcccag

SEQ ID NO: 647512 - DNA, 20 bp, mouse
gggaacgccggacgcagcgg

SEQ ID NO: 647513 - DNA, 20 bp, mouse
gcgccccccaggctagtccg

SEQ ID NO: 647514 - DNA, 20 bp, mouse
gaggggacagtgacaggcca

SEQ ID NO: 647515 - DNA, 20 bp, mouse
gcggcggcccggggagggca

SEQ ID NO: 647516 - DNA, 20 bp, mouse
gtgaatggggagcctcgact

SEQ ID NO: 647517 - DNA, 20 bp, mouse
gggacacactgggatcaaag

SEQ ID NO: 647518 - DNA, 20 bp, mouse
ggaacgctgcaactgagggc

SEQ ID NO: 647519 - DNA, 20 bp, mouse
gaggggctgaagtccagatc

SEQ ID NO: 647520 - DNA, 20 bp, mouse
gccccccaacacctggcctt

SEQ ID NO: 647521 - DNA, 20 bp, mouse
gttggctcattgaccatcca

SEQ ID NO: 647522 - DNA, 20 bp, mouse
gtggtcaatgagccaagtcg

SEQ ID NO: 647523 - DNA, 20 bp, mouse
gctcagttgcagcgttcaaa

SEQ ID NO: 647524 - DNA, 20 bp, mouse
gtccttgcaatgacaaacct

SEQ ID NO: 647525 - DNA, 20 bp, mouse
gtcaaagggcagggacacac

SEQ ID NO: 647526 - DNA, 20 bp, mouse
gttccccaggaagaggaagt

SEQ ID NO: 647527 - DNA, 20 bp, mouse
gagtcccaataaggacaaaa

SEQ ID NO: 647528 - DNA, 20 bp, mouse
gtggaagattccccaggaag

SEQ ID NO: 647529 - DNA, 20 bp, mouse
ggtgcctttgaaaatgaaag

SEQ ID NO: 647530 - DNA, 20 bp, mouse
gaatcctatctgagaagcaa

SEQ ID NO: 647531 - DNA, 20 bp, mouse
gaccaggctcgactgcagag

SEQ ID NO: 647532 - DNA, 20 bp, mouse
gaatccctgaacagtttctt

SEQ ID NO: 647533 - DNA, 20 bp, mouse
gagtagaaagaaatgcatag

SEQ ID NO: 647534 - DNA, 20 bp, mouse
ggaacactagcagcaagagt

SEQ ID NO: 647535 - DNA, 20 bp, mouse
ggttcagtggaagattcccc

SEQ ID NO: 647536 - DNA, 20 bp, mouse
gcagtggcgtaagaggggag

SEQ ID NO: 647537 - DNA, 20 bp, mouse
gccaggctgcagccggggaa

SEQ ID NO: 647538 - DNA, 20 bp, mouse
gaccgtgcagcggcctctgg

SEQ ID NO: 647539 - DNA, 20 bp, mouse
gccgcgcagtggcgtaagag

SEQ ID NO: 647540 - DNA, 20 bp, mouse
gcaggctgcacggctacgag

SEQ ID NO: 647541 - DNA, 20 bp, mouse
ggggcgctcgacggcaacaa

SEQ ID NO: 647542 - DNA, 20 bp, mouse
ggggcgcggggaccgtgcag

SEQ ID NO: 647543 - DNA, 20 bp, mouse
ggccctcccgccaggctgca

SEQ ID NO: 647544 - DNA, 20 bp, mouse
ggccgtgcagcctggcggga

SEQ ID NO: 647545 - DNA, 20 bp, mouse
gccactggagccctcccgcc

SEQ ID NO: 647546 - DNA, 20 bp, mouse
gggggcgagagggacgacga

SEQ ID NO: 647547 - DNA, 20 bp, mouse
gcgagagggacgacgaggga

SEQ ID NO: 647548 - DNA, 20 bp, mouse
ggggggggggggactcgctg

SEQ ID NO: 647549 - DNA, 20 bp, mouse
gcgcgccggcgggatggggg

SEQ ID NO: 647550 - DNA, 20 bp, mouse
ggtgccctgggtcgcttctg

SEQ ID NO: 647551 - DNA, 20 bp, mouse
ggcgtgcttgccctgaatga

SEQ ID NO: 647552 - DNA, 20 bp, mouse
gttctggggtccctcattca

SEQ ID NO: 647553 - DNA, 20 bp, mouse
gggaccccagaagcgaccca

SEQ ID NO: 647554 - DNA, 20 bp, mouse
gaggctctgccactcggcgc

SEQ ID NO: 647555 - DNA, 20 bp, mouse
gcggcgcgcgccggcgggat

SEQ ID NO: 647556 - DNA, 20 bp, mouse
ggcgggagcaacaaggtctg

SEQ ID NO: 647557 - DNA, 20 bp, mouse
gtgcccgcggagcttacctg

SEQ ID NO: 647558 - DNA, 20 bp, mouse
gccgacccggagggagagcg

SEQ ID NO: 647559 - DNA, 20 bp, mouse
gaggtctggggatctgtggg

SEQ ID NO: 647560 - DNA, 20 bp, mouse
gaacaaggtctggggatctg

SEQ ID NO: 647561 - DNA, 20 bp, mouse
ggggagagcggggcgggatc

SEQ ID NO: 647562 - DNA, 20 bp, mouse
ggtcaggcacagcgggtgca

SEQ ID NO: 647563 - DNA, 20 bp, mouse
gtgacgcgagcgggcttccg

SEQ ID NO: 647564 - DNA, 20 bp, mouse
gaggctggcacggggaaagc

SEQ ID NO: 647565 - DNA, 20 bp, mouse
gcagggcgaccgcccatccg

SEQ ID NO: 647566 - DNA, 20 bp, mouse
gagtctcaggacgaagtgga

SEQ ID NO: 647567 - DNA, 20 bp, mouse
ggctccgccggtccccattc

SEQ ID NO: 647568 - DNA, 20 bp, mouse
gagcgggcccgctggtggaa

SEQ ID NO: 647569 - DNA, 20 bp, mouse
ggtcccgcacgccgctccgc

SEQ ID NO: 647570 - DNA, 20 bp, mouse
gaggttgccagaatggggac

SEQ ID NO: 647571 - DNA, 20 bp, mouse
gtggaatccagctctttcga

SEQ ID NO: 647572 - DNA, 20 bp, mouse
gtggaggaaggttgccagaa

SEQ ID NO: 647573 - DNA, 20 bp, mouse
ggggcccgctggtggaaggg

SEQ ID NO: 647574 - DNA, 20 bp, mouse
gcgcctgcggtcccgggtcc

SEQ ID NO: 647575 - DNA, 20 bp, mouse
gttgccagaatggggaccgg

SEQ ID NO: 647576 - DNA, 20 bp, mouse
gagcgccactgagctccctg

SEQ ID NO: 647577 - DNA, 20 bp, mouse
gaggcccggcaggcatgggg

SEQ ID NO: 647578 - DNA, 20 bp, mouse
ggagaggcccggcaggcatg

SEQ ID NO: 647579 - DNA, 20 bp, mouse
gcccgccccagggagctcag

SEQ ID NO: 647580 - DNA, 20 bp, mouse
gtgcctgccgggcctctcgc

SEQ ID NO: 647581 - DNA, 20 bp, mouse
gcgagcgatgaggctgaccg

SEQ ID NO: 647582 - DNA, 20 bp, mouse
gaagtcagcaggcgctggga

SEQ ID NO: 647583 - DNA, 20 bp, mouse
ggcgagggagccggggtcac

SEQ ID NO: 647584 - DNA, 20 bp, mouse
gcgtgcgagcgaagctagac

SEQ ID NO: 647585 - DNA, 20 bp, mouse
gaccggtggcccgagcgatg

SEQ ID NO: 647586 - DNA, 20 bp, mouse
gggagagggtgacacccgaa

SEQ ID NO: 647587 - DNA, 20 bp, mouse
gccacccggcagctcagaga

SEQ ID NO: 647588 - DNA, 20 bp, mouse
gtggcaccgcagctccctaa

SEQ ID NO: 647589 - DNA, 20 bp, mouse
ggggagccgcgggacgagtg

SEQ ID NO: 647590 - DNA, 20 bp, mouse
ggtgacacccgaagggccga

SEQ ID NO: 647591 - DNA, 20 bp, mouse
gcggcagggccaggcccgga

SEQ ID NO: 647592 - DNA, 20 bp, mouse
gagccccggtgcaggggcgt

SEQ ID NO: 647593 - DNA, 20 bp, mouse
gccccgccgcgtcctggacg

SEQ ID NO: 647594 - DNA, 20 bp, mouse
gggaggcggggtccgcgtcc

SEQ ID NO: 647595 - DNA, 20 bp, mouse
ggcccggaggggcgggaaca

SEQ ID NO: 647596 - DNA, 20 bp, mouse
ggggcccaggaacaccccag

SEQ ID NO: 647597 - DNA, 20 bp, mouse
ggtcctccggagtcccactg

SEQ ID NO: 647598 - DNA, 20 bp, mouse
gtcggccaacggacagcaag

SEQ ID NO: 647599 - DNA, 20 bp, mouse
gtgggaaggggtctaggctg

SEQ ID NO: 647600 - DNA, 20 bp, mouse
ggggtctaggaacatcccgc

SEQ ID NO: 647601 - DNA, 20 bp, mouse
ggccaacggacagcaagcgg

SEQ ID NO: 647602 - DNA, 20 bp, mouse
ggcaacccaggaggactcca

SEQ ID NO: 647603 - DNA, 20 bp, mouse
ggaacaccccagtgggactc

SEQ ID NO: 647604 - DNA, 20 bp, mouse
gaggaccgcaggcagctgaa

SEQ ID NO: 647605 - DNA, 20 bp, mouse
gcaccccagtgggactccgg

SEQ ID NO: 647606 - DNA, 20 bp, mouse
ggacttagcagctactggga

SEQ ID NO: 647607 - DNA, 20 bp, mouse
gcccatctggctccaacagg

SEQ ID NO: 647608 - DNA, 20 bp, mouse
ggggaaaaaaaggtggtcct

SEQ ID NO: 647609 - DNA, 20 bp, mouse
gtaaaaggaagtgacatggg

SEQ ID NO: 647610 - DNA, 20 bp, mouse
gggggtggacccttcgggaa

SEQ ID NO: 647611 - DNA, 20 bp, mouse
gagggtgactcatgttacac

SEQ ID NO: 647612 - DNA, 20 bp, mouse
gccgaagggtccaccccttt

SEQ ID NO: 647613 - DNA, 20 bp, mouse
gttggagccagatggggatt

SEQ ID NO: 647614 - DNA, 20 bp, mouse
gttacactcattggaaggag

SEQ ID NO: 647615 - DNA, 20 bp, mouse
gagcgagactccacccaaag

SEQ ID NO: 647616 - DNA, 20 bp, mouse
gcgactgcgaatgctggctg

SEQ ID NO: 647617 - DNA, 20 bp, mouse
gcaccacctcacttcttccc

SEQ ID NO: 647618 - DNA, 20 bp, mouse
gcgactaagtcgtggagcac

SEQ ID NO: 647619 - DNA, 20 bp, mouse
gcatgctcgactgcgaatgc

SEQ ID NO: 647620 - DNA, 20 bp, mouse
gaggaggcgccttattaccc

SEQ ID NO: 647621 - DNA, 20 bp, mouse
gatgcgtcgtgacgaggcca

SEQ ID NO: 647622 - DNA, 20 bp, mouse
ggcgtgagccgactaagtcg

SEQ ID NO: 647623 - DNA, 20 bp, mouse
gcctccccgctgacaagcac

SEQ ID NO: 647624 - DNA, 20 bp, mouse
gtcgagcatgcgtcgtgacg

SEQ ID NO: 647625 - DNA, 20 bp, mouse
gctaagtcgtggagcacagg

SEQ ID NO: 647626 - DNA, 20 bp, mouse
gcgcttgcgcggtctcccgg

SEQ ID NO: 647627 - DNA, 20 bp, mouse
gtgcgaggagcgagcatcgc

SEQ ID NO: 647628 - DNA, 20 bp, mouse
gcccggggagagggagaacc

SEQ ID NO: 647629 - DNA, 20 bp, mouse
gctcccggaggaccccaggg

SEQ ID NO: 647630 - DNA, 20 bp, mouse
gagaccgcgcaagcgcggtt

SEQ ID NO: 647631 - DNA, 20 bp, mouse
gacacagctcagacaggccc

SEQ ID NO: 647632 - DNA, 20 bp, mouse
ggagtggggtccacgtccag

SEQ ID NO: 647633 - DNA, 20 bp, mouse
gactcgggggcggggattga

SEQ ID NO: 647634 - DNA, 20 bp, mouse
gcccagggtgggcggggctc

SEQ ID NO: 647635 - DNA, 20 bp, mouse
gagctcagacaggccccggt

SEQ ID NO: 647636 - DNA, 20 bp, mouse
gcggcagcgaggatccccgc

SEQ ID NO: 647637 - DNA, 20 bp, mouse
ggccacccaacagggagctc

SEQ ID NO: 647638 - DNA, 20 bp, mouse
gccccccgcactcccagcaa

SEQ ID NO: 647639 - DNA, 20 bp, mouse
gcagcgatcggggacgtcag

SEQ ID NO: 647640 - DNA, 20 bp, mouse
ggtgactcaccgaggccctc

SEQ ID NO: 647641 - DNA, 20 bp, mouse
ggttccctgcacctcggcgt

SEQ ID NO: 647642 - DNA, 20 bp, mouse
gacgtcagcggtccgttctg

SEQ ID NO: 647643 - DNA, 20 bp, mouse
gaggaaatcaggcccggggt

SEQ ID NO: 647644 - DNA, 20 bp, mouse
gcagcagcgcccgggagacg

SEQ ID NO: 647645 - DNA, 20 bp, mouse
gtcccaggaggtcgtgttgc

SEQ ID NO: 647646 - DNA, 20 bp, mouse
gcccgcgcgaccattcgctg

SEQ ID NO: 647647 - DNA, 20 bp, mouse
gcggattggcccaaaggggc

SEQ ID NO: 647648 - DNA, 20 bp, mouse
gcagagcaggtgagttccag

SEQ ID NO: 647649 - DNA, 20 bp, mouse
gctgcaggtacgccaggacg

SEQ ID NO: 647650 - DNA, 20 bp, mouse
gggagcccggattggcccaa

SEQ ID NO: 647651 - DNA, 20 bp, mouse
ggggcggggcgaagctgctg

SEQ ID NO: 647652 - DNA, 20 bp, mouse
gcccctgccgccagtcgccg

SEQ ID NO: 647653 - DNA, 20 bp, mouse
ggcgcccggaggctattttc

SEQ ID NO: 647654 - DNA, 20 bp, mouse
ggcctcgccacgcctcgtcc

SEQ ID NO: 647655 - DNA, 20 bp, mouse
ggggccaatccgggctccgc

SEQ ID NO: 647656 - DNA, 20 bp, mouse
gccagagaagacaattgctt

SEQ ID NO: 647657 - DNA, 20 bp, mouse
ggaagacaattgcttgggag

SEQ ID NO: 647658 - DNA, 20 bp, mouse
gccactaatcctgtttccac

SEQ ID NO: 647659 - DNA, 20 bp, mouse
gcagctgtataactgtaaga

SEQ ID NO: 647660 - DNA, 20 bp, mouse
gtgggcagtatgccaagtcc

SEQ ID NO: 647661 - DNA, 20 bp, mouse
gtgtgattggatagaagttg

SEQ ID NO: 647662 - DNA, 20 bp, mouse
gaaatgcaatctgcccaaga

SEQ ID NO: 647663 - DNA, 20 bp, mouse
gaacaacagttaaaaaacgc

SEQ ID NO: 647664 - DNA, 20 bp, mouse
gttaaatgaagacgtttgat

SEQ ID NO: 647665 - DNA, 20 bp, mouse
ggttagcagcctgtggaaac

SEQ ID NO: 647666 - DNA, 20 bp, mouse
gggaatgaaaccaagttctt

SEQ ID NO: 647667 - DNA, 20 bp, mouse
gggggaaaagtcaggggcaa

SEQ ID NO: 647668 - DNA, 20 bp, mouse
gcggaacaatggcctacaca

SEQ ID NO: 647669 - DNA, 20 bp, mouse
ggtaggccattgttccgaat

SEQ ID NO: 647670 - DNA, 20 bp, mouse
ggtgatcttaatttagagcg

SEQ ID NO: 647671 - DNA, 20 bp, mouse
gatacagagctaaagagatc

SEQ ID NO: 647672 - DNA, 20 bp, mouse
gagcgctcttgttgctatgc

SEQ ID NO: 647673 - DNA, 20 bp, mouse
gtcagggtgactcaggttgc

SEQ ID NO: 647674 - DNA, 20 bp, mouse
ggaactcccattcggaacaa

SEQ ID NO: 647675 - DNA, 20 bp, mouse
ggaatgtagaaaccgtgtgt

SEQ ID NO: 647676 - DNA, 20 bp, mouse
ggacggggcggggacggcgt

SEQ ID NO: 647677 - DNA, 20 bp, mouse
gggcgggcgccgcagtctcc

SEQ ID NO: 647678 - DNA, 20 bp, mouse
gcgcgcgggtcgcagggagc

SEQ ID NO: 647679 - DNA, 20 bp, mouse
ggagggagggcggacggcgt

SEQ ID NO: 647680 - DNA, 20 bp, mouse
gcagccctagcgtcaggctg

SEQ ID NO: 647681 - DNA, 20 bp, mouse
ggcccgccgagctggggcgg

SEQ ID NO: 647682 - DNA, 20 bp, mouse
ggggctcgcccggtctgcac

SEQ ID NO: 647683 - DNA, 20 bp, mouse
gaggacagttcaggcggacg

SEQ ID NO: 647684 - DNA, 20 bp, mouse
gacgtgctgggaattccaag

SEQ ID NO: 647685 - DNA, 20 bp, mouse
gtgcgcgcagccctagcgtc

SEQ ID NO: 647686 - DNA, 20 bp, mouse
gacaaaggaggatgtctctg

SEQ ID NO: 647687 - DNA, 20 bp, mouse
ggagctggaaactggaggac

SEQ ID NO: 647688 - DNA, 20 bp, mouse
gaaaaggggccgagcagctt

SEQ ID NO: 647689 - DNA, 20 bp, mouse
gcgggtagaggtagaagcct

SEQ ID NO: 647690 - DNA, 20 bp, mouse
ggagggaagccgaggggcgg

SEQ ID NO: 647691 - DNA, 20 bp, mouse
gaggcaggaggcagccaagt

SEQ ID NO: 647692 - DNA, 20 bp, mouse
ggtagaagcctggggaaggt

SEQ ID NO: 647693 - DNA, 20 bp, mouse
ggggttaagtgttgtcacag

SEQ ID NO: 647694 - DNA, 20 bp, mouse
ggatgcaaagtggacaaaag

SEQ ID NO: 647695 - DNA, 20 bp, mouse
ggccgagcagcttcgggtag

SEQ ID NO: 647696 - DNA, 20 bp, mouse
gagctgatgaggccaggcgt

SEQ ID NO: 647697 - DNA, 20 bp, mouse
gtgggtgtaacaggacccat

SEQ ID NO: 647698 - DNA, 20 bp, mouse
gtcatcagcttgacagagta

SEQ ID NO: 647699 - DNA, 20 bp, mouse
gagtaaggactgcacatttg

SEQ ID NO: 647700 - DNA, 20 bp, mouse
gtgtatgtgcagcaagtgca

SEQ ID NO: 647701 - DNA, 20 bp, mouse
gctagaaagcccaccaaaca

SEQ ID NO: 647702 - DNA, 20 bp, mouse
gcagtacccacgaaggtcag

SEQ ID NO: 647703 - DNA, 20 bp, mouse
gctgacaacacagggcggaa

SEQ ID NO: 647704 - DNA, 20 bp, mouse
ggcacatttgtgggtgtaac

SEQ ID NO: 647705 - DNA, 20 bp, mouse
gaagcccaccaaacaggggc

SEQ ID NO: 647706 - DNA, 20 bp, mouse
ggcccagaggaacatcaccc

SEQ ID NO: 647707 - DNA, 20 bp, mouse
gggccagggtgatgttcctc

SEQ ID NO: 647708 - DNA, 20 bp, mouse
gcctctgtacagagtagccc

SEQ ID NO: 647709 - DNA, 20 bp, mouse
ggcttgaccaagatggatca

SEQ ID NO: 647710 - DNA, 20 bp, mouse
gtgaggctcatctgccagta

SEQ ID NO: 647711 - DNA, 20 bp, mouse
gtggagatggatctattcct

SEQ ID NO: 647712 - DNA, 20 bp, mouse
gccaagatggatcagggcca

SEQ ID NO: 647713 - DNA, 20 bp, mouse
gaatcctgtgactgtggtcc

SEQ ID NO: 647714 - DNA, 20 bp, mouse
gctgggggaggacccagatc

SEQ ID NO: 647715 - DNA, 20 bp, mouse
gggtctgcatggctggcttc

SEQ ID NO: 647716 - DNA, 20 bp, mouse
ggggaagggcgggacgtcgg

SEQ ID NO: 647717 - DNA, 20 bp, mouse
gcgcgtgcgcaaggtcgggt

SEQ ID NO: 647718 - DNA, 20 bp, mouse
gcgggggcggcacgcctgga

SEQ ID NO: 647719 - DNA, 20 bp, mouse
gtgggggaagggcgcttcca

SEQ ID NO: 647720 - DNA, 20 bp, mouse
gaggtcgggtgggtaccaag

SEQ ID NO: 647721 - DNA, 20 bp, mouse
gcggcgccccgcccaactca

SEQ ID NO: 647722 - DNA, 20 bp, mouse
ggaagggcgcttccagggaa

SEQ ID NO: 647723 - DNA, 20 bp, mouse
gcacaggaacccaaaggtaa

SEQ ID NO: 647724 - DNA, 20 bp, mouse
gggcagggtggggcggagta

SEQ ID NO: 647725 - DNA, 20 bp, mouse
gggtgcgcgcccttaccttt

SEQ ID NO: 647726 - DNA, 20 bp, mouse
gtggacagagggtctcgggg

SEQ ID NO: 647727 - DNA, 20 bp, mouse
gactccgtcagaaactggag

SEQ ID NO: 647728 - DNA, 20 bp, mouse
ggggaggagtgcaaagcctt

SEQ ID NO: 647729 - DNA, 20 bp, mouse
ggggttggacagagggtctc

SEQ ID NO: 647730 - DNA, 20 bp, mouse
gggaagggcacatcggtgac

SEQ ID NO: 647731 - DNA, 20 bp, mouse
gcctccatcttcaacacttc

SEQ ID NO: 647732 - DNA, 20 bp, mouse
gggaagactccgtcagaaac

SEQ ID NO: 647733 - DNA, 20 bp, mouse
gcagcctgaagtgttgaaga

SEQ ID NO: 647734 - DNA, 20 bp, mouse
gaactggagagggagagggt

SEQ ID NO: 647735 - DNA, 20 bp, mouse
gacatcggtgactggcagca

SEQ ID NO: 647736 - DNA, 20 bp, mouse
ggggaaggcaagcccagact

SEQ ID NO: 647737 - DNA, 20 bp, mouse
gtcaggagggtctttaaggc

SEQ ID NO: 647738 - DNA, 20 bp, mouse
gaggtgacactgaagtacat

SEQ ID NO: 647739 - DNA, 20 bp, mouse
gaaggcggggcgagaaggga

SEQ ID NO: 647740 - DNA, 20 bp, mouse
gacagattctgactaaggca

SEQ ID NO: 647741 - DNA, 20 bp, mouse
gtgtcaagggaggggtcagg

SEQ ID NO: 647742 - DNA, 20 bp, mouse
gccttgacagattctgacta

SEQ ID NO: 647743 - DNA, 20 bp, mouse
gctttaaggcggggcgagaa

SEQ ID NO: 647744 - DNA, 20 bp, mouse
gaagtgagcctgtatcaagt

SEQ ID NO: 647745 - DNA, 20 bp, mouse
gagtgtcacctacttgatac

SEQ ID NO: 647746 - DNA, 20 bp, mouse
gttccagagggcttttcttc

SEQ ID NO: 647747 - DNA, 20 bp, mouse
gacagagcgaatatataaga

SEQ ID NO: 647748 - DNA, 20 bp, mouse
ggctactagaatcaactctc

SEQ ID NO: 647749 - DNA, 20 bp, mouse
gccagaattctgtaggttga

SEQ ID NO: 647750 - DNA, 20 bp, mouse
ggcagggcaaccaaccaaaa

SEQ ID NO: 647751 - DNA, 20 bp, mouse
gctaaagtaagttaaggact

SEQ ID NO: 647752 - DNA, 20 bp, mouse
gtagaaggttggggataaga

SEQ ID NO: 647753 - DNA, 20 bp, mouse
ggtcagctccagaattctgt

SEQ ID NO: 647754 - DNA, 20 bp, mouse
gccctgctgctagaaggttg

SEQ ID NO: 647755 - DNA, 20 bp, mouse
ggacaaggtagaaaacgatt

SEQ ID NO: 647756 - DNA, 20 bp, mouse
gggaactggcgcaacgcgac

SEQ ID NO: 647757 - DNA, 20 bp, mouse
gctgcagcctaggggctcaa

SEQ ID NO: 647758 - DNA, 20 bp, mouse
gcctaagtgggatcgaggtg

SEQ ID NO: 647759 - DNA, 20 bp, mouse
gggctgcctaagtgggatcg

SEQ ID NO: 647760 - DNA, 20 bp, mouse
gacctcctggcttgaagcac

SEQ ID NO: 647761 - DNA, 20 bp, mouse
gggcgggaggccaactcgcg

SEQ ID NO: 647762 - DNA, 20 bp, mouse
gtgcagaaatcccgacctcc

SEQ ID NO: 647763 - DNA, 20 bp, mouse
gcaggagctggtagaggcct

SEQ ID NO: 647764 - DNA, 20 bp, mouse
ggcagccggttgctaggaga

SEQ ID NO: 647765 - DNA, 20 bp, mouse
gcgggcagaaactgcgggtg

SEQ ID NO: 647766 - DNA, 20 bp, mouse
gtgggctgtgaggggaccca

SEQ ID NO: 647767 - DNA, 20 bp, mouse
gagggtggacaggacagtgg

SEQ ID NO: 647768 - DNA, 20 bp, mouse
gcaagcgcccacctgagcac

SEQ ID NO: 647769 - DNA, 20 bp, mouse
ggtcagagagcaagtgcccg

SEQ ID NO: 647770 - DNA, 20 bp, mouse
ggaggtgtgagctttccaca

SEQ ID NO: 647771 - DNA, 20 bp, mouse
gcatactgctgttctttgac

SEQ ID NO: 647772 - DNA, 20 bp, mouse
gcccctggctgggctgtgag

SEQ ID NO: 647773 - DNA, 20 bp, mouse
gcaaggagctactggtgact

SEQ ID NO: 647774 - DNA, 20 bp, mouse
gggtaacggagaagttgaat

SEQ ID NO: 647775 - DNA, 20 bp, mouse
gaatgtttgtccttctgtca

SEQ ID NO: 647776 - DNA, 20 bp, mouse
gaggacatgcgggattgaga

SEQ ID NO: 647777 - DNA, 20 bp, mouse
ggcagcaaaggacgttagga

SEQ ID NO: 647778 - DNA, 20 bp, mouse
gaggcggggtggctttagaa

SEQ ID NO: 647779 - DNA, 20 bp, mouse
ggcagactgctgactataaa

SEQ ID NO: 647780 - DNA, 20 bp, mouse
gaagggcagcaaaggacgtt

SEQ ID NO: 647781 - DNA, 20 bp, mouse
gcccagagcctgactttatt

SEQ ID NO: 647782 - DNA, 20 bp, mouse
gcggggtagaatggagcagg

SEQ ID NO: 647783 - DNA, 20 bp, mouse
gagagaggggaaggacatgc

SEQ ID NO: 647784 - DNA, 20 bp, mouse
gccccggggtagaatggagc

SEQ ID NO: 647785 - DNA, 20 bp, mouse
gaaaggagcttgggagtatt

SEQ ID NO: 647786 - DNA, 20 bp, mouse
ggggctcggacttctcgcga

SEQ ID NO: 647787 - DNA, 20 bp, mouse
gcctactaggcctttcgcaa

SEQ ID NO: 647788 - DNA, 20 bp, mouse
ggtgcgctgggcgtagtgta

SEQ ID NO: 647789 - DNA, 20 bp, mouse
gctggccacgatccttccct

SEQ ID NO: 647790 - DNA, 20 bp, mouse
gaaagactacaagtcccata

SEQ ID NO: 647791 - DNA, 20 bp, mouse
gccagcgcacaaagccctat

SEQ ID NO: 647792 - DNA, 20 bp, mouse
gcccgcggagtcggcgccag

SEQ ID NO: 647793 - DNA, 20 bp, mouse
gtcgcctatctgctcctagg

SEQ ID NO: 647794 - DNA, 20 bp, mouse
gcagggtctctccgcctcct

SEQ ID NO: 647795 - DNA, 20 bp, mouse
gtgcgatcggatccccgccc

SEQ ID NO: 647796 - DNA, 20 bp, mouse
gggacccctggcactcgact

SEQ ID NO: 647797 - DNA, 20 bp, mouse
gtcgagtgccaggggtccaa

SEQ ID NO: 647798 - DNA, 20 bp, mouse
gtaggagggagcgtggagag

SEQ ID NO: 647799 - DNA, 20 bp, mouse
gccctggcactcgactagga

SEQ ID NO: 647800 - DNA, 20 bp, mouse
ggggggctgaaacttagggg

SEQ ID NO: 647801 - DNA, 20 bp, mouse
gtccctcctagtcgagtgcc

SEQ ID NO: 647802 - DNA, 20 bp, mouse
ggttgagcggagcgggagca

SEQ ID NO: 647803 - DNA, 20 bp, mouse
gccgctcaacgcctcgagct

SEQ ID NO: 647804 - DNA, 20 bp, mouse
gattcactggctggacggat

SEQ ID NO: 647805 - DNA, 20 bp, mouse
gtgcctgtgaatccccactc

SEQ ID NO: 647806 - DNA, 20 bp, mouse
ggccccgcgccgagctgctt

SEQ ID NO: 647807 - DNA, 20 bp, mouse
gcacgcaaagtaagggtaga

SEQ ID NO: 647808 - DNA, 20 bp, mouse
gtggcagccccaaggagagg

SEQ ID NO: 647809 - DNA, 20 bp, mouse
gaaaggaggggcgattcctg

SEQ ID NO: 647810 - DNA, 20 bp, mouse
ggggctgccagtacttgacg

SEQ ID NO: 647811 - DNA, 20 bp, mouse
gggaaagaggcggggacaaa

SEQ ID NO: 647812 - DNA, 20 bp, mouse
gggagcctgccggacagcga

SEQ ID NO: 647813 - DNA, 20 bp, mouse
gtactggcagccccaaggag

SEQ ID NO: 647814 - DNA, 20 bp, mouse
gcctcggtgatgaacgtccc

SEQ ID NO: 647815 - DNA, 20 bp, mouse
ggcaaagtaagggtagaggg

SEQ ID NO: 647816 - DNA, 20 bp, mouse
ggggagcggaggcgatggag

SEQ ID NO: 647817 - DNA, 20 bp, mouse
gaggcgagcgcagtgcaagt

SEQ ID NO: 647818 - DNA, 20 bp, mouse
ggggtggggcgaggctcgag

SEQ ID NO: 647819 - DNA, 20 bp, mouse
gctcgcgcgtgagtcagaca

SEQ ID NO: 647820 - DNA, 20 bp, mouse
gcgcgtgagtcagacagggg

SEQ ID NO: 647821 - DNA, 20 bp, mouse
gggggtgggagcggaggcga

SEQ ID NO: 647822 - DNA, 20 bp, mouse
ggaggctcgagaggccgggc

SEQ ID NO: 647823 - DNA, 20 bp, mouse
gaagcgcactacaggttctg

SEQ ID NO: 647824 - DNA, 20 bp, mouse
ggggcgaggctcgagaggcc

SEQ ID NO: 647825 - DNA, 20 bp, mouse
gcacgcgactagaagaccgt

SEQ ID NO: 647826 - DNA, 20 bp, mouse
ggggcgagggcgagagacgg

SEQ ID NO: 647827 - DNA, 20 bp, mouse
ggccactccggctgctccga

SEQ ID NO: 647828 - DNA, 20 bp, mouse
gctcgcagaggcaacggcgg

SEQ ID NO: 647829 - DNA, 20 bp, mouse
gcgcgcggagcggccgaaca

SEQ ID NO: 647830 - DNA, 20 bp, mouse
ggactgctgatcctcctcaa

SEQ ID NO: 647831 - DNA, 20 bp, mouse
ggggacttgtagtccctgtt

SEQ ID NO: 647832 - DNA, 20 bp, mouse
gtcccccctggggttccgga

SEQ ID NO: 647833 - DNA, 20 bp, mouse
gcccggagcggaccctatgc

SEQ ID NO: 647834 - DNA, 20 bp, mouse
ggccagggatactccggcat

SEQ ID NO: 647835 - DNA, 20 bp, mouse
gatggtgagcagcgaaggta

SEQ ID NO: 647836 - DNA, 20 bp, mouse
gcggaagcgcgccgggtaga

SEQ ID NO: 647837 - DNA, 20 bp, mouse
ggcagccggaagcgagtccc

SEQ ID NO: 647838 - DNA, 20 bp, mouse
gagagggcgtggccgtggtc

SEQ ID NO: 647839 - DNA, 20 bp, mouse
ggcggcgcgcctccgcactg

SEQ ID NO: 647840 - DNA, 20 bp, mouse
gtgcacccgggactcgcttc

SEQ ID NO: 647841 - DNA, 20 bp, mouse
gcgcgcttccgggatctggc

SEQ ID NO: 647842 - DNA, 20 bp, mouse
gcacggccacgccctctacc

SEQ ID NO: 647843 - DNA, 20 bp, mouse
gaggcccgggttgtgtggga

SEQ ID NO: 647844 - DNA, 20 bp, mouse
gggagatcccggccggacca

SEQ ID NO: 647845 - DNA, 20 bp, mouse
ggactcgcttccggctgcag

SEQ ID NO: 647846 - DNA, 20 bp, mouse
ggccgggcggggcccgaata

SEQ ID NO: 647847 - DNA, 20 bp, mouse
gcgggacaggagcaatagat

SEQ ID NO: 647848 - DNA, 20 bp, mouse
gaagccaccctggaatgggc

SEQ ID NO: 647849 - DNA, 20 bp, mouse
gggagcaatagatgggatag

SEQ ID NO: 647850 - DNA, 20 bp, mouse
ggcggggcccgaatagggca

SEQ ID NO: 647851 - DNA, 20 bp, mouse
gccttcaccggcccattcca

SEQ ID NO: 647852 - DNA, 20 bp, mouse
ggaggcggctcttgtaactc

SEQ ID NO: 647853 - DNA, 20 bp, mouse
gagggggctcagggacgagg

SEQ ID NO: 647854 - DNA, 20 bp, mouse
gaggggcacagattcacagt

SEQ ID NO: 647855 - DNA, 20 bp, mouse
ggggtctgcccggagctgtg

SEQ ID NO: 647856 - DNA, 20 bp, mouse
gcaaggctgcagcaaccaat

SEQ ID NO: 647857 - DNA, 20 bp, mouse
gctacggggcggggccgtca

SEQ ID NO: 647858 - DNA, 20 bp, mouse
gcgtgctgaccactccgcaa

SEQ ID NO: 647859 - DNA, 20 bp, mouse
ggggaggaccacaggggcct

SEQ ID NO: 647860 - DNA, 20 bp, mouse
ggccgctcgcgtcgcccttg

SEQ ID NO: 647861 - DNA, 20 bp, mouse
gaggggactgcgggagtcta

SEQ ID NO: 647862 - DNA, 20 bp, mouse
gtccgcaagggcgacgcgag

SEQ ID NO: 647863 - DNA, 20 bp, mouse
gccaatgggctgaatgagac

SEQ ID NO: 647864 - DNA, 20 bp, mouse
ggcgacgcgagcggcgctgc

SEQ ID NO: 647865 - DNA, 20 bp, mouse
gcagggcggggccggagcca

SEQ ID NO: 647866 - DNA, 20 bp, mouse
gtagccgcgcccggtcccga

SEQ ID NO: 647867 - DNA, 20 bp, mouse
ggaggggccgcagtgctcta

SEQ ID NO: 647868 - DNA, 20 bp, mouse
gccctcctgggaaccgtgag

SEQ ID NO: 647869 - DNA, 20 bp, mouse
gaggctggaaaacaggtact

SEQ ID NO: 647870 - DNA, 20 bp, mouse
gtcggactgcaagaagtgtt

SEQ ID NO: 647871 - DNA, 20 bp, mouse
gcacgtgctgcgaagagggt

SEQ ID NO: 647872 - DNA, 20 bp, mouse
gaactggtggacggactcgg

SEQ ID NO: 647873 - DNA, 20 bp, mouse
gtggggcaccgagcgtcaaa

SEQ ID NO: 647874 - DNA, 20 bp, mouse
gcggaggagcgggctcgcgg

SEQ ID NO: 647875 - DNA, 20 bp, mouse
gtcagcccggagcgacccgg

SEQ ID NO: 647876 - DNA, 20 bp, mouse
ggggtctgagtgcctggata

SEQ ID NO: 647877 - DNA, 20 bp, mouse
gaaagggcgcgtggcaggca

SEQ ID NO: 647878 - DNA, 20 bp, mouse
ggggaccctaaatattgaaa

SEQ ID NO: 647879 - DNA, 20 bp, mouse
gcccgaagcggcagacgcaa

SEQ ID NO: 647880 - DNA, 20 bp, mouse
gaagcggtgacaccctatcc

SEQ ID NO: 647881 - DNA, 20 bp, mouse
gcggctcgcgtgctggggtg

SEQ ID NO: 647882 - DNA, 20 bp, mouse
gtattgaaagggcgcgtggc

SEQ ID NO: 647883 - DNA, 20 bp, mouse
gcgggtacccgaagagcaag

SEQ ID NO: 647884 - DNA, 20 bp, mouse
gacgcgccctttcaatattt

SEQ ID NO: 647885 - DNA, 20 bp, mouse
ggtccccgggtctgagtgcc

SEQ ID NO: 647886 - DNA, 20 bp, mouse
ggtggggattaggatcttga

SEQ ID NO: 647887 - DNA, 20 bp, mouse
gaccttccgcagttatcgga

SEQ ID NO: 647888 - DNA, 20 bp, mouse
ggaagtacccggtaagagcg

SEQ ID NO: 647889 - DNA, 20 bp, mouse
gacggctcggcgagctggaa

SEQ ID NO: 647890 - DNA, 20 bp, mouse
gccagaagttacggaaccta

SEQ ID NO: 647891 - DNA, 20 bp, mouse
ggaggaggagccggaagtta

SEQ ID NO: 647892 - DNA, 20 bp, mouse
ggaaggaacgccagaagtta

SEQ ID NO: 647893 - DNA, 20 bp, mouse
ggagctggaacggaagtacc

SEQ ID NO: 647894 - DNA, 20 bp, mouse
gggagccggaagttaaggct

SEQ ID NO: 647895 - DNA, 20 bp, mouse
gccctcccagccttaacttc

SEQ ID NO: 647896 - DNA, 20 bp, mouse
gagaggcggggcgaagtcgg

SEQ ID NO: 647897 - DNA, 20 bp, mouse
ggggcagagtcgatgtgggg

SEQ ID NO: 647898 - DNA, 20 bp, mouse
gtggggtggagctggctgcg

SEQ ID NO: 647899 - DNA, 20 bp, mouse
gcagaggtgtggcatattgg

SEQ ID NO: 647900 - DNA, 20 bp, mouse
gggcatagggcggggtctta

SEQ ID NO: 647901 - DNA, 20 bp, mouse
ggcttggggcagagtcgatg

SEQ ID NO: 647902 - DNA, 20 bp, mouse
gcgaaccaggggttacaaag

SEQ ID NO: 647903 - DNA, 20 bp, mouse
ggggtcttagggcagagagg

SEQ ID NO: 647904 - DNA, 20 bp, mouse
gtctgggcgccgccctctgc

SEQ ID NO: 647905 - DNA, 20 bp, mouse
gtgggggagaagcctgcaga

SEQ ID NO: 647906 - DNA, 20 bp, mouse
gcccacagcagcattgactt

SEQ ID NO: 647907 - DNA, 20 bp, mouse
ggactttggcagatctgttg

SEQ ID NO: 647908 - DNA, 20 bp, mouse
gcgcagctgcagtggcggtg

SEQ ID NO: 647909 - DNA, 20 bp, mouse
gaggaattgcgtaaaggcgt

SEQ ID NO: 647910 - DNA, 20 bp, mouse
gcgccgaaggaattgcgtaa

SEQ ID NO: 647911 - DNA, 20 bp, mouse
gtggtgataacagcagagag

SEQ ID NO: 647912 - DNA, 20 bp, mouse
gaggaggcaaacagctacac

SEQ ID NO: 647913 - DNA, 20 bp, mouse
gccaaagtctgcctggaaca

SEQ ID NO: 647914 - DNA, 20 bp, mouse
gctggaaaagcaaataagtt

SEQ ID NO: 647915 - DNA, 20 bp, mouse
ggccaaagtcaatgctgctg

SEQ ID NO: 647916 - DNA, 20 bp, mouse
ggggtccagtaaagatgggc

SEQ ID NO: 647917 - DNA, 20 bp, mouse
gttactggacccaacccagg

SEQ ID NO: 647918 - DNA, 20 bp, mouse
gggtagtgatgctgtcgtgg

SEQ ID NO: 647919 - DNA, 20 bp, mouse
gcacacggattaaatgattg

SEQ ID NO: 647920 - DNA, 20 bp, mouse
ggtaaagatgggcggggctg

SEQ ID NO: 647921 - DNA, 20 bp, mouse
gggttgggtccagtaaagat

SEQ ID NO: 647922 - DNA, 20 bp, mouse
gaccacaggtaacaaagatc

SEQ ID NO: 647923 - DNA, 20 bp, mouse
ggcagatgttggatacctgg

SEQ ID NO: 647924 - DNA, 20 bp, mouse
ggtcccaggtatcacaccta

SEQ ID NO: 647925 - DNA, 20 bp, mouse
gtttagaggaacagcctcga

SEQ ID NO: 647926 - DNA, 20 bp, mouse
gtaagcttgtcaggaagcga

SEQ ID NO: 647927 - DNA, 20 bp, mouse
gcggacgctgggcgaggact

SEQ ID NO: 647928 - DNA, 20 bp, mouse
gcccctggatggtagtcagt

SEQ ID NO: 647929 - DNA, 20 bp, mouse
gggggacctcagagtccgta

SEQ ID NO: 647930 - DNA, 20 bp, mouse
gaccccacgacccgcctcca

SEQ ID NO: 647931 - DNA, 20 bp, mouse
gtcccactgactaccatcca

SEQ ID NO: 647932 - DNA, 20 bp, mouse
gggtccccggtaagcttgtc

SEQ ID NO: 647933 - DNA, 20 bp, mouse
gcttcctgacaagcttaccg

SEQ ID NO: 647934 - DNA, 20 bp, mouse
gagcaggaagagtggcctta

SEQ ID NO: 647935 - DNA, 20 bp, mouse
gggcgaggactcggccgatc

SEQ ID NO: 647936 - DNA, 20 bp, mouse
gaggcagaacgggttgagag

SEQ ID NO: 647937 - DNA, 20 bp, mouse
gtggagctaggtgtgttaca

SEQ ID NO: 647938 - DNA, 20 bp, mouse
gagctcccggaggtgtggaa

SEQ ID NO: 647939 - DNA, 20 bp, mouse
gtgctgaaaaattactttgg

SEQ ID NO: 647940 - DNA, 20 bp, mouse
ggatgcctgggagttagcaa

SEQ ID NO: 647941 - DNA, 20 bp, mouse
ggtacagtctgcttctttgg

SEQ ID NO: 647942 - DNA, 20 bp, mouse
gggaaaggcaccaggatctg

SEQ ID NO: 647943 - DNA, 20 bp, mouse
gggaccgagcgtgataccct

SEQ ID NO: 647944 - DNA, 20 bp, mouse
gagcaagggaatgagtggaa

SEQ ID NO: 647945 - DNA, 20 bp, mouse
gacttcaattctcaagagcc

SEQ ID NO: 647946 - DNA, 20 bp, mouse
ggacgcggaaaatgcaagat

SEQ ID NO: 647947 - DNA, 20 bp, mouse
gccgggcaaaggtgacagtg

SEQ ID NO: 647948 - DNA, 20 bp, mouse
gaggaggcgggccgccggag

SEQ ID NO: 647949 - DNA, 20 bp, mouse
gtgcgcgcggcagcggggag

SEQ ID NO: 647950 - DNA, 20 bp, mouse
gtccgcgtcctccagcagag

SEQ ID NO: 647951 - DNA, 20 bp, mouse
ggtgtggcgacgggacccag

SEQ ID NO: 647952 - DNA, 20 bp, mouse
gtaagcgtccggctaaacag

SEQ ID NO: 647953 - DNA, 20 bp, mouse
gtggcgacgggacccagggg

SEQ ID NO: 647954 - DNA, 20 bp, mouse
gcaggggcggagggacctcg

SEQ ID NO: 647955 - DNA, 20 bp, mouse
gggacacgagtcctctaggg

SEQ ID NO: 647956 - DNA, 20 bp, mouse
gccacccgctgcctccgggc

SEQ ID NO: 647957 - DNA, 20 bp, mouse
gtgtgggaccaattgcagtg

SEQ ID NO: 647958 - DNA, 20 bp, mouse
ggggaaacttgcaaatgcgg

SEQ ID NO: 647959 - DNA, 20 bp, mouse
gctacagggccgctaactct

SEQ ID NO: 647960 - DNA, 20 bp, mouse
gagccgctgtgtaggtaatg

SEQ ID NO: 647961 - DNA, 20 bp, mouse
gggtcggcgcatgcgtccgg

SEQ ID NO: 647962 - DNA, 20 bp, mouse
gtgcgccgacctcctcgctg

SEQ ID NO: 647963 - DNA, 20 bp, mouse
gaaccggcccactagagcca

SEQ ID NO: 647964 - DNA, 20 bp, mouse
ggtccccattacctacacag

SEQ ID NO: 647965 - DNA, 20 bp, mouse
gcacgcgcgctgcaaagccc

SEQ ID NO: 647966 - DNA, 20 bp, mouse
gggagtgtccaagtagggag

SEQ ID NO: 647967 - DNA, 20 bp, mouse
gcgctgggagtgtccaagta

SEQ ID NO: 647968 - DNA, 20 bp, mouse
ggcgacccggagacagtgat

SEQ ID NO: 647969 - DNA, 20 bp, mouse
gaaactaaggcgcaggatct

SEQ ID NO: 647970 - DNA, 20 bp, mouse
ggcaggctgagaggctagct

SEQ ID NO: 647971 - DNA, 20 bp, mouse
gctgcgccttagttttgcca

SEQ ID NO: 647972 - DNA, 20 bp, mouse
ggaaacccctggcaaaacta

SEQ ID NO: 647973 - DNA, 20 bp, mouse
ggtagggagcggctggtagg

SEQ ID NO: 647974 - DNA, 20 bp, mouse
gtgtccaagtagggagcggc

SEQ ID NO: 647975 - DNA, 20 bp, mouse
gagctaggctgcatcagcgc

SEQ ID NO: 647976 - DNA, 20 bp, mouse
gaacccgggcaggtgggcta

SEQ ID NO: 647977 - DNA, 20 bp, mouse
gccgggcaggtgggctaagg

SEQ ID NO: 647978 - DNA, 20 bp, mouse
gggcgctgcggctacactgc

SEQ ID NO: 647979 - DNA, 20 bp, mouse
gtgcctgtgaagtctgaagg

SEQ ID NO: 647980 - DNA, 20 bp, mouse
ggccagtttgctctacttat

SEQ ID NO: 647981 - DNA, 20 bp, mouse
ggggctgcggccggcctgca

SEQ ID NO: 647982 - DNA, 20 bp, mouse
gcaggtgggctaagggggcg

SEQ ID NO: 647983 - DNA, 20 bp, mouse
ggactcaaacccgggcaggt

SEQ ID NO: 647984 - DNA, 20 bp, mouse
ggcctccctgactcaaaccc

SEQ ID NO: 647985 - DNA, 20 bp, mouse
ggcccataagtagagcaaac

SEQ ID NO: 647986 - DNA, 20 bp, mouse
ggggaaggacctgaccgaac

SEQ ID NO: 647987 - DNA, 20 bp, mouse
gcggccgggcgccccctagg

SEQ ID NO: 647988 - DNA, 20 bp, mouse
gccaggccgccagctcgcgt

SEQ ID NO: 647989 - DNA, 20 bp, mouse
gtcggcgccgccactgtccc

SEQ ID NO: 647990 - DNA, 20 bp, mouse
gccccgcccgcgcaggtctc

SEQ ID NO: 647991 - DNA, 20 bp, mouse
gcggtcaggtccttcccgtc

SEQ ID NO: 647992 - DNA, 20 bp, mouse
gggacctcgcggaccgccta

SEQ ID NO: 647993 - DNA, 20 bp, mouse
gggcggcctggtgtcatctc

SEQ ID NO: 647994 - DNA, 20 bp, mouse
gcccaccttggaggccgggg

SEQ ID NO: 647995 - DNA, 20 bp, mouse
ggggcaaccacggttccaga

SEQ ID NO: 647996 - DNA, 20 bp, mouse
gtgcctgtagaggttctaat

SEQ ID NO: 647997 - DNA, 20 bp, mouse
ggggcccgcctcgccagcgt

SEQ ID NO: 647998 - DNA, 20 bp, mouse
gtgctccagcatcaatgtag

SEQ ID NO: 647999 - DNA, 20 bp, mouse
gacgcccgcccgcagtccgg

SEQ ID NO: 648000 - DNA, 20 bp, mouse
ggaggcgggccccaggcagg

SEQ ID NO: 648001 - DNA, 20 bp, mouse
gctggagcgattccctggtg

SEQ ID NO: 648002 - DNA, 20 bp, mouse
gtgactgttcggcgtcgcag

SEQ ID NO: 648003 - DNA, 20 bp, mouse
ggaggaatgcagcagctctt

SEQ ID NO: 648004 - DNA, 20 bp, mouse
ggccccaggcaggaggctga

SEQ ID NO: 648005 - DNA, 20 bp, mouse
gtggcagcggtggtggcatc

SEQ ID NO: 648006 - DNA, 20 bp, mouse
gagctctggggcgctgtgtt

SEQ ID NO: 648007 - DNA, 20 bp, mouse
gtgcccgtccgcacccttgc

SEQ ID NO: 648008 - DNA, 20 bp, mouse
ggcggccctgaggaatccag

SEQ ID NO: 648009 - DNA, 20 bp, mouse
ggtggtcccagccatccctc

SEQ ID NO: 648010 - DNA, 20 bp, mouse
gaccctgcaagggtgcggac

SEQ ID NO: 648011 - DNA, 20 bp, mouse
gctgctgtgagaaaggactc

SEQ ID NO: 648012 - DNA, 20 bp, mouse
ggctctgccgaagccatcgg

SEQ ID NO: 648013 - DNA, 20 bp, mouse
gccagcccctggattcctca

SEQ ID NO: 648014 - DNA, 20 bp, mouse
ggtgggcagcgcctgtgact

SEQ ID NO: 648015 - DNA, 20 bp, mouse
gtgcggacgggcacctgggg

SEQ ID NO: 648016 - DNA, 20 bp, mouse
gtgagcgaagttgagagaca

SEQ ID NO: 648017 - DNA, 20 bp, mouse
ggacaaggtacatctctcac

SEQ ID NO: 648018 - DNA, 20 bp, mouse
gcagcagagaggcagtcctg

SEQ ID NO: 648019 - DNA, 20 bp, mouse
gagaaagagggcggggctct

SEQ ID NO: 648020 - DNA, 20 bp, mouse
gtgaaagagggtgacatata

SEQ ID NO: 648021 - DNA, 20 bp, mouse
gtgtgtggagaccaaggatg

SEQ ID NO: 648022 - DNA, 20 bp, mouse
gaataaggactctgaacctc

SEQ ID NO: 648023 - DNA, 20 bp, mouse
gagctctaaaagagcttcgt

SEQ ID NO: 648024 - DNA, 20 bp, mouse
ggacccaggtcaaaagcagt

SEQ ID NO: 648025 - DNA, 20 bp, mouse
ggctctcggttccagcagag

SEQ ID NO: 648026 - DNA, 20 bp, mouse
gtggtaacctaggaattctt

SEQ ID NO: 648027 - DNA, 20 bp, mouse
gtatgcaagatgatcaaaaa

SEQ ID NO: 648028 - DNA, 20 bp, mouse
gaaagggcatgtggtaacct

SEQ ID NO: 648029 - DNA, 20 bp, mouse
gcaaaaaaggatactttcaa

SEQ ID NO: 648030 - DNA, 20 bp, mouse
gacaaggtaagtggttaaca

SEQ ID NO: 648031 - DNA, 20 bp, mouse
ggatactttcaaagggcatg

SEQ ID NO: 648032 - DNA, 20 bp, mouse
gtctacactttgcaggggtc

SEQ ID NO: 648033 - DNA, 20 bp, mouse
gggcacagtgtgtatacttc

SEQ ID NO: 648034 - DNA, 20 bp, mouse
gttaccagttcattcacttg

SEQ ID NO: 648035 - DNA, 20 bp, mouse
gtctatgcaagtctacattc

SEQ ID NO: 648036 - DNA, 20 bp, mouse
gcgccgagacgcaaccccgg

SEQ ID NO: 648037 - DNA, 20 bp, mouse
gtccccggctcagaacccga

SEQ ID NO: 648038 - DNA, 20 bp, mouse
gagcagtggccgacccgagg

SEQ ID NO: 648039 - DNA, 20 bp, mouse
ggggaagaccccaaaacttc

SEQ ID NO: 648040 - DNA, 20 bp, mouse
ggaggtgcgcgctcaccctc

SEQ ID NO: 648041 - DNA, 20 bp, mouse
ggatgtgacgtcatgagcag

SEQ ID NO: 648042 - DNA, 20 bp, mouse
gccccgccgccgcctcgggt

SEQ ID NO: 648043 - DNA, 20 bp, mouse
gtgggagctcagtgtggtac

SEQ ID NO: 648044 - DNA, 20 bp, mouse
ggcagcggacggccgatgag

SEQ ID NO: 648045 - DNA, 20 bp, mouse
gtctgagccggggacccggg

SEQ ID NO: 648046 - DNA, 20 bp, mouse
gctcccgcggtgactgtgac

SEQ ID NO: 648047 - DNA, 20 bp, mouse
gcgtctcctggaacacccat

SEQ ID NO: 648048 - DNA, 20 bp, mouse
gtcgctagcccgcccggaag

SEQ ID NO: 648049 - DNA, 20 bp, mouse
gagttggcgctgccgctctc

SEQ ID NO: 648050 - DNA, 20 bp, mouse
gcatccatggagcaaaccga

SEQ ID NO: 648051 - DNA, 20 bp, mouse
gggcagcgccaactctcccg

SEQ ID NO: 648052 - DNA, 20 bp, mouse
gccgcggtgactgtgactgg

SEQ ID NO: 648053 - DNA, 20 bp, mouse
gccagctcacctcacgcctt

SEQ ID NO: 648054 - DNA, 20 bp, mouse
ggagctggacttgtggtctc

SEQ ID NO: 648055 - DNA, 20 bp, mouse
gacagtcaccgcgggagagt

SEQ ID NO: 648056 - DNA, 20 bp, mouse
gtaagcacaactggcagggg

SEQ ID NO: 648057 - DNA, 20 bp, mouse
gagggcatctacaacttaaa

SEQ ID NO: 648058 - DNA, 20 bp, mouse
gcccgcccctaagcaggctc

SEQ ID NO: 648059 - DNA, 20 bp, mouse
ggcaggggagggacaaccaa

SEQ ID NO: 648060 - DNA, 20 bp, mouse
ggtgcttagttggctttata

SEQ ID NO: 648061 - DNA, 20 bp, mouse
gcaaaggcccgcccctaagc

SEQ ID NO: 648062 - DNA, 20 bp, mouse
gggagcctgagcctgcttag

SEQ ID NO: 648063 - DNA, 20 bp, mouse
gaaagccaactaagcacaac

SEQ ID NO: 648064 - DNA, 20 bp, mouse
gcaagcgccattttgactga

SEQ ID NO: 648065 - DNA, 20 bp, mouse
gaggcccaaagggaatacac

SEQ ID NO: 648066 - DNA, 20 bp, mouse
gctgaggaatgtggacggtg

SEQ ID NO: 648067 - DNA, 20 bp, mouse
gcatctgctgagagatcctg

SEQ ID NO: 648068 - DNA, 20 bp, mouse
gacccaggggattccccgac

SEQ ID NO: 648069 - DNA, 20 bp, mouse
gtccctgtcggggaatcccc

SEQ ID NO: 648070 - DNA, 20 bp, mouse
gccctctggtgggattatct

SEQ ID NO: 648071 - DNA, 20 bp, mouse
gctggctgatacctgggaag

SEQ ID NO: 648072 - DNA, 20 bp, mouse
gacagctggggccatccgag

SEQ ID NO: 648073 - DNA, 20 bp, mouse
gcagcagctgacatcaccca

SEQ ID NO: 648074 - DNA, 20 bp, mouse
gggcagaaggaaggtagtct

SEQ ID NO: 648075 - DNA, 20 bp, mouse
gtgctgtcctcccctctggt

SEQ ID NO: 648076 - DNA, 20 bp, mouse
gctgcctggcctcgggatag

SEQ ID NO: 648077 - DNA, 20 bp, mouse
ggcctcgggatagaggaagc

SEQ ID NO: 648078 - DNA, 20 bp, mouse
gctgccctgcctttgggttc

SEQ ID NO: 648079 - DNA, 20 bp, mouse
gctacagaggatctgtttat

SEQ ID NO: 648080 - DNA, 20 bp, mouse
gctctccagtctccctacag

SEQ ID NO: 648081 - DNA, 20 bp, mouse
ggaccaggcaactaactgaa

SEQ ID NO: 648082 - DNA, 20 bp, mouse
gccgggactggcgggaaaga

SEQ ID NO: 648083 - DNA, 20 bp, mouse
ggctgtagagctcactgacc

SEQ ID NO: 648084 - DNA, 20 bp, mouse
gtagagactgccctgccttt

SEQ ID NO: 648085 - DNA, 20 bp, mouse
gtaagctcaagcaaggttca

SEQ ID NO: 648086 - DNA, 20 bp, mouse
gggagctggactggcgacct

SEQ ID NO: 648087 - DNA, 20 bp, mouse
gtcggagcccccaacccggc

SEQ ID NO: 648088 - DNA, 20 bp, mouse
gaacgcagagggctgatttg

SEQ ID NO: 648089 - DNA, 20 bp, mouse
gcgcggccagggatggggaa

SEQ ID NO: 648090 - DNA, 20 bp, mouse
gcccggacgcggccagggat

SEQ ID NO: 648091 - DNA, 20 bp, mouse
gcgccagtccagctccagcg

SEQ ID NO: 648092 - DNA, 20 bp, mouse
gagcccccaacccggccggt

SEQ ID NO: 648093 - DNA, 20 bp, mouse
gccgccggatggtgttgcca

SEQ ID NO: 648094 - DNA, 20 bp, mouse
ggctccgactccaggttgag

SEQ ID NO: 648095 - DNA, 20 bp, mouse
ggctctgcggagggcgcggt

SEQ ID NO: 648096 - DNA, 20 bp, mouse
gacaggacgtaaaaggtcaa

SEQ ID NO: 648097 - DNA, 20 bp, mouse
ggctgcagacaggacgtaaa
